United States Patent 7,655,785 (BIOINFORMATICALLY DETECTABLE GROUP OF NOVEL REGULATORY OLIGONUCLEOTIDES AND USES THEREOF) - sequence listing, part 40

SEQ ID NO: 1648956 - RNA, 16 nt, Homo sapiens
uguucauucugugacc

SEQ ID NO: 1648957 - RNA, 22 nt, Homo sapiens
uguucauucuuguucaaaaaga

SEQ ID NO: 1648958 - RNA, 16 nt, Homo sapiens
uguuccccaucaucug

SEQ ID NO: 1648959 - RNA, 15 nt, Homo sapiens
uguucccuauuuugc

SEQ ID NO: 1648960 - RNA, 19 nt, Homo sapiens
uguucuauuucagugccaa

SEQ ID NO: 1648961 - RNA, 13 nt, Homo sapiens
uguucugggacac

SEQ ID NO: 1648962 - RNA, 17 nt, Homo sapiens
uguuggaaaaugugcaa

SEQ ID NO: 1648963 - RNA, 12 nt, Homo sapiens
uguuggugacaa

SEQ ID NO: 1648964 - RNA, 13 nt, Homo sapiens
uguuguuccaaau

SEQ ID NO: 1648965 - RNA, 16 nt, Homo sapiens
uguuuaagcaucacau

SEQ ID NO: 1648966 - RNA, 19 nt, Homo sapiens
uguuugguaguuuugccaa

SEQ ID NO: 1648967 - RNA, 17 nt, Homo sapiens
uguuuuccccaguugua

SEQ ID NO: 1648968 - RNA, 12 nt, Homo sapiens
uuaaaaacucac

SEQ ID NO: 1648969 - RNA, 20 nt, Homo sapiens
uuaaaacaacacucacauuu

SEQ ID NO: 1648970 - RNA, 16 nt, Homo sapiens
uuaaaauagccauaaa

SEQ ID NO: 1648971 - RNA, 11 nt, Homo sapiens
uuaaaauaucu

SEQ ID NO: 1648972 - RNA, 20 nt, Homo sapiens
uuaaaauaugcucuaaacau

SEQ ID NO: 1648973 - RNA, 23 nt, Homo sapiens
uuaaaauauuuuuaugugcaaua

SEQ ID NO: 1648974 - RNA, 18 nt, Homo sapiens
uuaaaauuguaagcuccu

SEQ ID NO: 1648975 - RNA, 17 nt, Homo sapiens
uuaaacaaauguaugau

SEQ ID NO: 1648976 - RNA, 21 nt, Homo sapiens
uuaaacucagggagcauuuau

SEQ ID NO: 1648977 - RNA, 14 nt, Homo sapiens
uuaaacuuacuuag

SEQ ID NO: 1648978 - RNA, 17 nt, Homo sapiens
uuaaagaguaaagcagc

SEQ ID NO: 1648979 - RNA, 14 nt, Homo sapiens
uuaaauaaauggaa

SEQ ID NO: 1648980 - RNA, 12 nt, Homo sapiens
uuaaauaguaaa

SEQ ID NO: 1648981 - RNA, 21 nt, Homo sapiens
uuaaaucaacgaguacuucaa

SEQ ID NO: 1648982 - RNA, 18 nt, Homo sapiens
uuaaauggcauaccaaaa

SEQ ID NO: 1648983 - RNA, 21 nt, Homo sapiens
uuaaauguagaaagugaucca

SEQ ID NO: 1648984 - RNA, 22 nt, Homo sapiens
uuaaauguagaaagugauccau

SEQ ID NO: 1648985 - RNA, 12 nt, Homo sapiens
uuaacacucauu

SEQ ID NO: 1648986 - RNA, 15 nt, Homo sapiens
uuaacaguguucuca

SEQ ID NO: 1648987 - RNA, 14 nt, Homo sapiens
uuaacccucacugg

SEQ ID NO: 1648988 - RNA, 15 nt, Homo sapiens
uuaacgcaaauauua

SEQ ID NO: 1648989 - RNA, 20 nt, Homo sapiens
uuaagaauguucuuauguug

SEQ ID NO: 1648990 - RNA, 19 nt, Homo sapiens
uuaagacuaaaaguugcau

SEQ ID NO: 1648991 - RNA, 21 nt, Homo sapiens
uuaagauuguaaaaauaauca

SEQ ID NO: 1648992 - RNA, 20 nt, Homo sapiens
uuaagccuuauaaaccaauc

SEQ ID NO: 1648993 - RNA, 20 nt, Homo sapiens
uuaagcucugagcugucaac

SEQ ID NO: 1648994 - RNA, 16 nt, Homo sapiens
uuaagcuuucagcuca

SEQ ID NO: 1648995 - RNA, 21 nt, Homo sapiens
uuaaggaaacucuuaucucag

SEQ ID NO: 1648996 - RNA, 19 nt, Homo sapiens
uuaaguugauggugaugaa

SEQ ID NO: 1648997 - RNA, 15 nt, Homo sapiens
uuaaguuuaccaaau

SEQ ID NO: 1648998 - RNA, 21 nt, Homo sapiens
uuaauccuguaccaaaucuga

SEQ ID NO: 1648999 - RNA, 18 nt, Homo sapiens
uuaaugaagaaaguggaa

SEQ ID NO: 1649000 - RNA, 19 nt, Homo sapiens
uuaaugaucagcuauauac

SEQ ID NO: 1649001 - RNA, 23 nt, Homo sapiens
uuaauggguuucccuugcccuuu

SEQ ID NO: 1649002 - RNA, 18 nt, Homo sapiens
uuaauuacccuacuuuca

SEQ ID NO: 1649003 - RNA, 23 nt, Homo sapiens
uuacaaacauggaaaacagagua

SEQ ID NO: 1649004 - RNA, 15 nt, Homo sapiens
uuacagaaaauaugg

SEQ ID NO: 1649005 - RNA, 13 nt, Homo sapiens
uuacagacaugaa

SEQ ID NO: 1649006 - RNA, 17 nt, Homo sapiens
uuacagacaugaacugc

SEQ ID NO: 1649007 - RNA, 18 nt, Homo sapiens
uuacagagaaaagacaua

SEQ ID NO: 1649008 - RNA, 16 nt, Homo sapiens
uuacauuuuguauauu

SEQ ID NO: 1649009 - RNA, 22 nt, Homo sapiens
uuaccugaaauaaaauucauua

SEQ ID NO: 1649010 - RNA, 22 nt, Homo sapiens
uuaccuucauggugcuguugcc

SEQ ID NO: 1649011 - RNA, 18 nt, Homo sapiens
uuacguaguaaaagucau

SEQ ID NO: 1649012 - RNA, 12 nt, Homo sapiens
uuacgugcaaua

SEQ ID NO: 1649013 - RNA, 13 nt, Homo sapiens
uuacuaaugaugc

SEQ ID NO: 1649014 - RNA, 23 nt, Homo sapiens
uuacuaguacagguuuugcccug

SEQ ID NO: 1649015 - RNA, 21 nt, Homo sapiens
uuacuauuuauugcugaauga

SEQ ID NO: 1649016 - RNA, 13 nt, Homo sapiens
uuacugagacaau

SEQ ID NO: 1649017 - RNA, 22 nt, Homo sapiens
uuacugugucaggaaacauauu

SEQ ID NO: 1649018 - RNA, 19 nt, Homo sapiens
uuacuuuaccacccccaca

SEQ ID NO: 1649019 - RNA, 16 nt, Homo sapiens
uuacuuuguguucacc

SEQ ID NO: 1649020 - RNA, 15 nt, Homo sapiens
uuagacagucccugc

SEQ ID NO: 1649021 - RNA, 21 nt, Homo sapiens
uuagacuuaauagaaacauug

SEQ ID NO: 1649022 - RNA, 16 nt, Homo sapiens
uuagaguaaugaaaug

SEQ ID NO: 1649023 - RNA, 17 nt, Homo sapiens
uuagaguaaugaaaugg

SEQ ID NO: 1649024 - RNA, 17 nt, Homo sapiens
uuagagugucuuuccac

SEQ ID NO: 1649025 - RNA, 12 nt, Homo sapiens
uuagcagugucu

SEQ ID NO: 1649026 - RNA, 14 nt, Homo sapiens
uuagccccucucuu

SEQ ID NO: 1649027 - RNA, 20 nt, Homo sapiens
uuaggagagagaaaauaauu

SEQ ID NO: 1649028 - RNA, 18 nt, Homo sapiens
uuaggaguaccauaauuc

SEQ ID NO: 1649029 - RNA, 14 nt, Homo sapiens
uuaggugauccacu

SEQ ID NO: 1649030 - RNA, 14 nt, Homo sapiens
uuaguaaacugugc

SEQ ID NO: 1649031 - RNA, 16 nt, Homo sapiens
uuaguauuuuaauccu

SEQ ID NO: 1649032 - RNA, 15 nt, Homo sapiens
uuagugauggagcuu

SEQ ID NO: 1649033 - RNA, 18 nt, Homo sapiens
uuaguuuuaaaaagggaa

SEQ ID NO: 1649034 - RNA, 17 nt, Homo sapiens
uuauaaaagaugcauua

SEQ ID NO: 1649035 - RNA, 15 nt, Homo sapiens
uuauaacccagugag

SEQ ID NO: 1649036 - RNA, 13 nt, Homo sapiens
uuauaacuguaaa

SEQ ID NO: 1649037 - RNA, 13 nt, Homo sapiens
uuauaaugggaua

SEQ ID NO: 1649038 - RNA, 18 nt, Homo sapiens
uuauagccgaaaugaucu

SEQ ID NO: 1649039 - RNA, 13 nt, Homo sapiens
uuauaugcuauuu

SEQ ID NO: 1649040 - RNA, 12 nt, Homo sapiens
uuauauuacuug

SEQ ID NO: 1649041 - RNA, 21 nt, Homo sapiens
uuauauuacuugccuaucuga

SEQ ID NO: 1649042 - RNA, 22 nt, Homo sapiens
uuauauugauaacagcacugac

SEQ ID NO: 1649043 - RNA, 15 nt, Homo sapiens
uuaucacuuuggggu

SEQ ID NO: 1649044 - RNA, 24 nt, Homo sapiens
uuaucuaauuugugccucacugga

SEQ ID NO: 1649045 - RNA, 20 nt, Homo sapiens
uuaucugcuaugcuauugaa

SEQ ID NO: 1649046 - RNA, 21 nt, Homo sapiens
uuaugaaaaauaagucacuua

SEQ ID NO: 1649047 - RNA, 13 nt, Homo sapiens
uuaugacuguugu

SEQ ID NO: 1649048 - RNA, 15 nt, Homo sapiens
uuaugcaucugcuac

SEQ ID NO: 1649049 - RNA, 23 nt, Homo sapiens
uuauggaguucuucuucuccuag

SEQ ID NO: 1649050 - RNA, 16 nt, Homo sapiens
uuaugucucagaccac

SEQ ID NO: 1649051 - RNA, 11 nt, Homo sapiens
uuaugugcaau

SEQ ID NO: 1649052 - RNA, 20 nt, Homo sapiens
uuauuaaaaccagucucaga

SEQ ID NO: 1649053 - RNA, 19 nt, Homo sapiens
uuauuagagugucuuucca

SEQ ID NO: 1649054 - RNA, 18 nt, Homo sapiens
uuauuauagaauugcaca

SEQ ID NO: 1649055 - RNA, 11 nt, Homo sapiens
uuauucacuuu

SEQ ID NO: 1649056 - RNA, 14 nt, Homo sapiens
uugcaauggcagcc

SEQ ID NO: 1649057 - RNA, 18 nt, Homo sapiens
uugcacugaggauauuca

SEQ ID NO: 1649058 - RNA, 14 nt, Homo sapiens
uugcaucagcaaca

SEQ ID NO: 1649059 - RNA, 18 nt, Homo sapiens
uugcaugaccacauagaa

SEQ ID NO: 1649060 - RNA, 13 nt, Homo sapiens
uugcaugaggcua

SEQ ID NO: 1649061 - RNA, 23 nt, Homo sapiens
uugcauugaauuuagucauuauu

SEQ ID NO: 1649062 - RNA, 23 nt, Homo sapiens
uugccaagcucaggaccaggcaa

SEQ ID NO: 1649063 - RNA, 15 nt, Homo sapiens
uugccaaguucucca

SEQ ID NO: 1649064 - RNA, 15 nt, Homo sapiens
uugccccaugagaca

SEQ ID NO: 1649065 - RNA, 21 nt, Homo sapiens
uugccucugaagccuauguau

SEQ ID NO: 1649066 - RNA, 17 nt, Homo sapiens
uugccugggacggcuga

SEQ ID NO: 1649067 - RNA, 20 nt, Homo sapiens
uugcuacagggcucacagaa

SEQ ID NO: 1649068 - RNA, 11 nt, Homo sapiens
uugcucccuau

SEQ ID NO: 1649069 - RNA, 15 nt, Homo sapiens
uugcuucaaugauua

SEQ ID NO: 1649070 - RNA, 15 nt, Homo sapiens
uuggaaaaugugcaa

SEQ ID NO: 1649071 - RNA, 21 nt, Homo sapiens
uuggacaacuagccucaucuc

SEQ ID NO: 1649072 - RNA, 19 nt, Homo sapiens
uuggacagaagcagcucuu

SEQ ID NO: 1649073 - RNA, 21 nt, Homo sapiens
uuggcgggggcuuggcugugc

SEQ ID NO: 1649074 - RNA, 17 nt, Homo sapiens
uuggcucacacugagaa

SEQ ID NO: 1649075 - RNA, 15 nt, Homo sapiens
uugggaacugcaaua

SEQ ID NO: 1649076 - RNA, 16 nt, Homo sapiens
uugggcuggugucacc

SEQ ID NO: 1649077 - RNA, 15 nt, Homo sapiens
uugggcugugccugg

SEQ ID NO: 1649078 - RNA, 20 nt, Homo sapiens
uuggggaugagaaagguuga

SEQ ID NO: 1649079 - RNA, 11 nt, Homo sapiens
uuggggguccu

SEQ ID NO: 1649080 - RNA, 23 nt, Homo sapiens
uuggggguccuccuccagggaca

SEQ ID NO: 1649081 - RNA, 21 nt, Homo sapiens
uugguacuagauacugaaugu

SEQ ID NO: 1649082 - RNA, 17 nt, Homo sapiens
uuguaaauagcucaggu

SEQ ID NO: 1649083 - RNA, 20 nt, Homo sapiens
uuguacaggcuggucucaaa

SEQ ID NO: 1649084 - RNA, 20 nt, Homo sapiens
uuguaguuuuggcuaguccu

SEQ ID NO: 1649085 - RNA, 22 nt, Homo sapiens
uuguauccucugaccuacauac

SEQ ID NO: 1649086 - RNA, 15 nt, Homo sapiens
uuguaugagguuuga

SEQ ID NO: 1649087 - RNA, 13 nt, Homo sapiens
uuguauuucccca

SEQ ID NO: 1649088 - RNA, 22 nt, Homo sapiens
uugucaaaaagcaacugaucau

SEQ ID NO: 1649089 - RNA, 21 nt, Homo sapiens
uugucagauucacacaugcca

SEQ ID NO: 1649090 - RNA, 17 nt, Homo sapiens
uugucuuuacuccauga

SEQ ID NO: 1649091 - RNA, 22 nt, Homo sapiens
uugugaacccuagcugugucag

SEQ ID NO: 1649092 - RNA, 20 nt, Homo sapiens
uuguguuuuguuuuguauca

SEQ ID NO: 1649093 - RNA, 19 nt, Homo sapiens
uuguucacaucccauguag

SEQ ID NO: 1649094 - RNA, 14 nt, Homo sapiens
uuguucauugcuag

SEQ ID NO: 1649095 - RNA, 15 nt, Homo sapiens
uuguuguaauugcau

SEQ ID NO: 1649096 - RNA, 14 nt, Homo sapiens
uuuaaaaaugcacc

SEQ ID NO: 1649097 - RNA, 17 nt, Homo sapiens
uuuaaagaaagcaacuu

SEQ ID NO: 1649098 - RNA, 19 nt, Homo sapiens
uuuaaagagaguuugccac

SEQ ID NO: 1649099 - RNA, 13 nt, Homo sapiens
uuuaaaggacaaa

SEQ ID NO: 1649100 - RNA, 14 nt, Homo sapiens
uuuaaauaaaugga

SEQ ID NO: 1649101 - RNA, 22 nt, Homo sapiens
uuuaaaucaacgaguacuucaa

SEQ ID NO: 1649102 - RNA, 17 nt, Homo sapiens
uuuaaaugaaagugaga

SEQ ID NO: 1649103 - RNA, 14 nt, Homo sapiens
uuuaacagcucucu

SEQ ID NO: 1649104 - RNA, 20 nt, Homo sapiens
uuuaagaucacgccacugga

SEQ ID NO: 1649105 - RNA, 18 nt, Homo sapiens
uuuaagcaucacauuaaa

SEQ ID NO: 1649106 - RNA, 14 nt, Homo sapiens
uuuaaucacauucg

SEQ ID NO: 1649107 - RNA, 23 nt, Homo sapiens
uuuaauccuguaccaaaucugac

SEQ ID NO: 1649108 - RNA, 19 nt, Homo sapiens
uuuacaagggcauaaagua

SEQ ID NO: 1649109 - RNA, 12 nt, Homo sapiens
uuuacaccaguu

SEQ ID NO: 1649110 - RNA, 23 nt, Homo sapiens
uuuacuuuugcucccuaccugac

SEQ ID NO: 1649111 - RNA, 20 nt, Homo sapiens
uuuagaaccaccaacaagca

SEQ ID NO: 1649112 - RNA, 18 nt, Homo sapiens
uuuagacccugcauuuau

SEQ ID NO: 1649113 - RNA, 21 nt, Homo sapiens
uuuagcauaguaccucugcua

SEQ ID NO: 1649114 - RNA, 22 nt, Homo sapiens
uuuagcauaguaccucugcuau

SEQ ID NO: 1649115 - RNA, 15 nt, Homo sapiens
uuuaggauuacuuag

SEQ ID NO: 1649116 - RNA, 12 nt, Homo sapiens
uuuaguccugua

SEQ ID NO: 1649117 - RNA, 18 nt, Homo sapiens
uuuaguuuuauacuauau

SEQ ID NO: 1649118 - RNA, 23 nt, Homo sapiens
uuuauaaagggagauaacaaucu

SEQ ID NO: 1649119 - RNA, 16 nt, Homo sapiens
uuuauaaauggacaaa

SEQ ID NO: 1649120 - RNA, 22 nt, Homo sapiens
uuuauagaugggcaacuggcug

SEQ ID NO: 1649121 - RNA, 16 nt, Homo sapiens
uuuaucauuaccauua

SEQ ID NO: 1649122 - RNA, 18 nt, Homo sapiens
uuuaucugcuaugcuauu

SEQ ID NO: 1649123 - RNA, 19 nt, Homo sapiens
uuuaucuuugauucuccuu

SEQ ID NO: 1649124 - RNA, 13 nt, Homo sapiens
uuuaugugcaaua

SEQ ID NO: 1649125 - RNA, 18 nt, Homo sapiens
uuuauugaagggucuguu

SEQ ID NO: 1649126 - RNA, 14 nt, Homo sapiens
uuuauugcaugaga

SEQ ID NO: 1649127 - RNA, 14 nt, Homo sapiens
uuuauugcuuguug

SEQ ID NO: 1649128 - RNA, 19 nt, Homo sapiens
uuucaacagaaauauucua

SEQ ID NO: 1649129 - RNA, 11 nt, Homo sapiens
uuucaccacau

SEQ ID NO: 1649130 - RNA, 17 nt, Homo sapiens
uuucaccacaugugcac

SEQ ID NO: 1649131 - RNA, 15 nt, Homo sapiens
uuucaccauguuggc

SEQ ID NO: 1649132 - RNA, 13 nt, Homo sapiens
uuucaccauuuga

SEQ ID NO: 1649133 - RNA, 14 nt, Homo sapiens
uuucacucacaucu

SEQ ID NO: 1649134 - RNA, 17 nt, Homo sapiens
uuucacuugcacaucau

SEQ ID NO: 1649135 - RNA, 17 nt, Homo sapiens
uuucagaaaauucccau

SEQ ID NO: 1649136 - RNA, 20 nt, Homo sapiens
uuucauaagaauucuguuga

SEQ ID NO: 1649137 - RNA, 20 nt, Homo sapiens
uuucaugcuuccagguaaaa

SEQ ID NO: 1649138 - RNA, 23 nt, Homo sapiens
uuucccaucacuguauccauucu

SEQ ID NO: 1649139 - RNA, 13 nt, Homo sapiens
uuuccugugacac

SEQ ID NO: 1649140 - RNA, 21 nt, Homo sapiens
uuuccuuguccccacacuccu

SEQ ID NO: 1649141 - RNA, 18 nt, Homo sapiens
uuuccuuugguccuucaa

SEQ ID NO: 1649142 - RNA, 16 nt, Homo sapiens
uuucuaaaacugccuu

SEQ ID NO: 1649143 - RNA, 20 nt, Homo sapiens
uuucuagauaccacuuaaca

SEQ ID NO: 1649144 - RNA, 12 nt, Homo sapiens
uuucuucuacug

SEQ ID NO: 1649145 - RNA, 12 nt, Homo sapiens
uuucuuugaacu

SEQ ID NO: 1649146 - RNA, 16 nt, Homo sapiens
uuugaagagugugagg

SEQ ID NO: 1649147 - RNA, 19 nt, Homo sapiens
uuugaauacaggcauagag

SEQ ID NO: 1649148 - RNA, 22 nt, Homo sapiens
uuugaaugguuuucuaauaucu

SEQ ID NO: 1649149 - RNA, 14 nt, Homo sapiens
uuugaggguguaua

SEQ ID NO: 1649150 - RNA, 17 nt, Homo sapiens
uuugauuaaagacucca

SEQ ID NO: 1649151 - RNA, 18 nt, Homo sapiens
uuugccagugggaacucc

SEQ ID NO: 1649152 - RNA, 12 nt, Homo sapiens
uuugcuguagaa

SEQ ID NO: 1649153 - RNA, 14 nt, Homo sapiens
uuuggaauauucca

SEQ ID NO: 1649154 - RNA, 17 nt, Homo sapiens
uuuggaauauuguccau

SEQ ID NO: 1649155 - RNA, 12 nt, Homo sapiens
uuuggagucaga

SEQ ID NO: 1649156 - RNA, 13 nt, Homo sapiens
uuuggcaacagaa

SEQ ID NO: 1649157 - RNA, 19 nt, Homo sapiens
uuuggcaagcucuaucacc

SEQ ID NO: 1649158 - RNA, 14 nt, Homo sapiens
uuuggcuuugcaaa

SEQ ID NO: 1649159 - RNA, 16 nt, Homo sapiens
uuuguaauauggaaug

SEQ ID NO: 1649160 - RNA, 16 nt, Homo sapiens
uuuguaucauuaugaa

SEQ ID NO: 1649161 - RNA, 20 nt, Homo sapiens
uuuguaucauuaugaaguca

SEQ ID NO: 1649162 - RNA, 15 nt, Homo sapiens
uuuguaugcuaaaug

SEQ ID NO: 1649163 - RNA, 15 nt, Homo sapiens
uuuguauuuauuaau

SEQ ID NO: 1649164 - RNA, 12 nt, Homo sapiens
uuuguauuuccc

SEQ ID NO: 1649165 - RNA, 13 nt, Homo sapiens
uuugucaaaaagc

SEQ ID NO: 1649166 - RNA, 18 nt, Homo sapiens
cuccccuggggacagcaa

SEQ ID NO: 1649167 - RNA, 19 nt, Homo sapiens
cucccgaguagcugagauu

SEQ ID NO: 1649168 - RNA, 19 nt, Homo sapiens
cucccugaaguaagcaaag

SEQ ID NO: 1649169 - RNA, 19 nt, Homo sapiens
cuccgcuuucuacccagcg

SEQ ID NO: 1649170 - RNA, 15 nt, Homo sapiens
cuccuccguggcaca

SEQ ID NO: 1649171 - RNA, 13 nt, Homo sapiens
cuccucugugacu

SEQ ID NO: 1649172 - RNA, 14 nt, Homo sapiens
cuccugaagccaca

SEQ ID NO: 1649173 - RNA, 15 nt, Homo sapiens
cuccugaagccacag

SEQ ID NO: 1649174 - RNA, 22 nt, Homo sapiens
cuccugaguagcugggacuaca

SEQ ID NO: 1649175 - RNA, 18 nt, Homo sapiens
cuccugggcccaagugau

SEQ ID NO: 1649176 - RNA, 18 nt, Homo sapiens
cuccugggcuaagugauc

SEQ ID NO: 1649177 - RNA, 21 nt, Homo sapiens
cuccuguggccacagcagcuu

SEQ ID NO: 1649178 - RNA, 22 nt, Homo sapiens
cuccuucacagcuaagaugcca

SEQ ID NO: 1649179 - RNA, 20 nt, Homo sapiens
cuccuucaccuuugucccca

SEQ ID NO: 1649180 - RNA, 18 nt, Homo sapiens
cuccuuccagcacugacu

SEQ ID NO: 1649181 - RNA, 23 nt, Homo sapiens
cuccuuccuggagcccagaggag

SEQ ID NO: 1649182 - RNA, 18 nt, Homo sapiens
cucgccuucaucucccaa

SEQ ID NO: 1649183 - RNA, 17 nt, Homo sapiens
cucgggauuaguacaca

SEQ ID NO: 1649184 - RNA, 23 nt, Homo sapiens
cucuaauuuuggauaauauucau

SEQ ID NO: 1649185 - RNA, 22 nt, Homo sapiens
cucuagguacgaugacaguguu

SEQ ID NO: 1649186 - RNA, 23 nt, Homo sapiens
cucuagucccuguguucugcaca

SEQ ID NO: 1649187 - RNA, 12 nt, Homo sapiens
cucuaucugcaa

SEQ ID NO: 1649188 - RNA, 13 nt, Homo sapiens
cucuaucugcaau

SEQ ID NO: 1649189 - RNA, 18 nt, Homo sapiens
cucucaggagaucuggcu

SEQ ID NO: 1649190 - RNA, 17 nt, Homo sapiens
cucucaggcugucccaa

SEQ ID NO: 1649191 - RNA, 17 nt, Homo sapiens
cucucaggugaccaaaa

SEQ ID NO: 1649192 - RNA, 19 nt, Homo sapiens
cucucauauaagacaaaua

SEQ ID NO: 1649193 - RNA, 11 nt, Homo sapiens
cucucaucucu

SEQ ID NO: 1649194 - RNA, 18 nt, Homo sapiens
cucucgcacacacaguga

SEQ ID NO: 1649195 - RNA, 17 nt, Homo sapiens
cucucuuauaauuccag

SEQ ID NO: 1649196 - RNA, 19 nt, Homo sapiens
cucucuuuaaaaugcaaaa

SEQ ID NO: 1649197 - RNA, 16 nt, Homo sapiens
cucugagcuguuaucu

SEQ ID NO: 1649198 - RNA, 21 nt, Homo sapiens
cucugagguuuccgaaaucag

SEQ ID NO: 1649199 - RNA, 14 nt, Homo sapiens
cucuggaugccuga

SEQ ID NO: 1649200 - RNA, 21 nt, Homo sapiens
cucugggagcucaagugaucc

SEQ ID NO: 1649201 - RNA, 14 nt, Homo sapiens
cucugguccauaga

SEQ ID NO: 1649202 - RNA, 14 nt, Homo sapiens
cucugugucaggug

SEQ ID NO: 1649203 - RNA, 13 nt, Homo sapiens
cucuuauaauucc

SEQ ID NO: 1649204 - RNA, 14 nt, Homo sapiens
cucuuauaauucca

SEQ ID NO: 1649205 - RNA, 21 nt, Homo sapiens
cucuucccauaccacccaaug

SEQ ID NO: 1649206 - RNA, 23 nt, Homo sapiens
cucuuccccucucagagcuacuu

SEQ ID NO: 1649207 - RNA, 15 nt, Homo sapiens
cucuuuuucuagucu

SEQ ID NO: 1649208 - RNA, 17 nt, Homo sapiens
ccuuucauuuacugugg

SEQ ID NO: 1649209 - RNA, 18 nt, Homo sapiens
ccuuucauuuacuguggc

SEQ ID NO: 1649210 - RNA, 19 nt, Homo sapiens
ccuuuccugcgccccagac

SEQ ID NO: 1649211 - RNA, 15 nt, Homo sapiens
ccuuucucuucucug

SEQ ID NO: 1649212 - RNA, 18 nt, Homo sapiens
ccuuucuucagacacuga

SEQ ID NO: 1649213 - RNA, 15 nt, Homo sapiens
ccuuugagacaguuu

SEQ ID NO: 1649214 - RNA, 18 nt, Homo sapiens
ccuuuggaugcacuuuau

SEQ ID NO: 1649215 - RNA, 19 nt, Homo sapiens
ccuuuggaugcacuuuaua

SEQ ID NO: 1649216 - RNA, 18 nt, Homo sapiens
cgaaauaacaauguuaag

SEQ ID NO: 1649217 - RNA, 20 nt, Homo sapiens
cgaaauaacaauguuaagga

SEQ ID NO: 1649218 - RNA, 14 nt, Homo sapiens
cgaacaauucauau

SEQ ID NO: 1649219 - RNA, 16 nt, Homo sapiens
cgaacuccugaccuua

SEQ ID NO: 1649220 - RNA, 21 nt, Homo sapiens
cgagcaugccuggauggggcu

SEQ ID NO: 1649221 - RNA, 19 nt, Homo sapiens
cgagccaaguuaagaaugu

SEQ ID NO: 1649222 - RNA, 17 nt, Homo sapiens
cgaggcggaucuuugga

SEQ ID NO: 1649223 - RNA, 14 nt, Homo sapiens
cgaguacucuugaa

SEQ ID NO: 1649224 - RNA, 19 nt, Homo sapiens
cgaguacucuugaacacaa

SEQ ID NO: 1649225 - RNA, 10 nt, Homo sapiens
cgaguacuuc

SEQ ID NO: 1649226 - RNA, 14 nt, Homo sapiens
cgaucccaucuuga

SEQ ID NO: 1649227 - RNA, 16 nt, Homo sapiens
cgccacuggacugucu

SEQ ID NO: 1649228 - RNA, 21 nt, Homo sapiens
cgcccagucuggaaugcagug

SEQ ID NO: 1649229 - RNA, 14 nt, Homo sapiens
cgcccaucagugcc

SEQ ID NO: 1649230 - RNA, 17 nt, Homo sapiens
cgcccaucagugccagc

SEQ ID NO: 1649231 - RNA, 18 nt, Homo sapiens
cgccuuaugagaacaugg

SEQ ID NO: 1649232 - RNA, 20 nt, Homo sapiens
cgcggcaggcuucucagucu

SEQ ID NO: 1649233 - RNA, 17 nt, Homo sapiens
cgcugaauaugaggcau

SEQ ID NO: 1649234 - RNA, 22 nt, Homo sapiens
cgcugagcgaggagaugcuccu

SEQ ID NO: 1649235 - RNA, 22 nt, Homo sapiens
cgcugggauccgggaucaaagu

SEQ ID NO: 1649236 - RNA, 15 nt, Homo sapiens
cggagaacaaaugug

SEQ ID NO: 1649237 - RNA, 23 nt, Homo sapiens
cggagacggagucccaccuuggc

SEQ ID NO: 1649238 - RNA, 14 nt, Homo sapiens
cggaucuuuggaca

SEQ ID NO: 1649239 - RNA, 21 nt, Homo sapiens
cggccagcccucccagcagug

SEQ ID NO: 1649240 - RNA, 21 nt, Homo sapiens
cggccccugcugguucagggu

SEQ ID NO: 1649241 - RNA, 17 nt, Homo sapiens
cgggaagaaggggacaa

SEQ ID NO: 1649242 - RNA, 14 nt, Homo sapiens
cgggaccccgagcc

SEQ ID NO: 1649243 - RNA, 19 nt, Homo sapiens
cgggcacucagaagacacu

SEQ ID NO: 1649244 - RNA, 14 nt, Homo sapiens
cggguggaucacaa

SEQ ID NO: 1649245 - RNA, 21 nt, Homo sapiens
cgguaagcacuuaaugaauga

SEQ ID NO: 1649246 - RNA, 15 nt, Homo sapiens
cgguggucacuggaa

SEQ ID NO: 1649247 - RNA, 15 nt, Homo sapiens
cgguucgcauuauca

SEQ ID NO: 1649248 - RNA, 16 nt, Homo sapiens
cguaugugaaacacac

SEQ ID NO: 1649249 - RNA, 21 nt, Homo sapiens
cguccaucacuggcucucuaa

SEQ ID NO: 1649250 - RNA, 21 nt, Homo sapiens
cgugaagggauuuuagucaca

SEQ ID NO: 1649251 - RNA, 14 nt, Homo sapiens
cgugacaacacaaa

SEQ ID NO: 1649252 - RNA, 9 nt, Homo sapiens
cgugcaaua

SEQ ID NO: 1649253 - RNA, 20 nt, Homo sapiens
cguggaauugugcugaguug

SEQ ID NO: 1649254 - RNA, 13 nt, Homo sapiens
cgugggaucugcc

SEQ ID NO: 1649255 - RNA, 15 nt, Homo sapiens
cguggguucugucau

SEQ ID NO: 1649256 - RNA, 19 nt, Homo sapiens
cgugguaggacuguagaaa

SEQ ID NO: 1649257 - RNA, 17 nt, Homo sapiens
cguguacuacaauuuaa

SEQ ID NO: 1649258 - RNA, 19 nt, Homo sapiens
cguguguuuuucuauuaaa

SEQ ID NO: 1649259 - RNA, 22 nt, Homo sapiens
cguuguuuugguuguacuuugg

SEQ ID NO: 1649260 - RNA, 23 nt, Homo sapiens
cuaaaacagaaaaaaaaauggaa

SEQ ID NO: 1649261 - RNA, 22 nt, Homo sapiens
cuaaaauaagggcagagucaca

SEQ ID NO: 1649262 - RNA, 22 nt, Homo sapiens
cuaaaauuguaucaaaugugac

SEQ ID NO: 1649263 - RNA, 15 nt, Homo sapiens
cuaaacccucuguga

SEQ ID NO: 1649264 - RNA, 15 nt, Homo sapiens
cuaaagcaauaugca

SEQ ID NO: 1649265 - RNA, 19 nt, Homo sapiens
cuaaagguuguauugcaua

SEQ ID NO: 1649266 - RNA, 17 nt, Homo sapiens
cuaaaucaauucuauua

SEQ ID NO: 1649267 - RNA, 22 nt, Homo sapiens
cuaaauggugcugcagauuuga

SEQ ID NO: 1649268 - RNA, 23 nt, Homo sapiens
cuaaauuauuuacugcaaaaaga

SEQ ID NO: 1649269 - RNA, 20 nt, Homo sapiens
cuaacaggagaaugcacagu

SEQ ID NO: 1649270 - RNA, 15 nt, Homo sapiens
cuaacaggccaaaga

SEQ ID NO: 1649271 - RNA, 17 nt, Homo sapiens
cuaaccaccuaccuuac

SEQ ID NO: 1649272 - RNA, 21 nt, Homo sapiens
cuaaccucugagucaccaucu

SEQ ID NO: 1649273 - RNA, 18 nt, Homo sapiens
cuaacuagagcagcccug

SEQ ID NO: 1649274 - RNA, 17 nt, Homo sapiens
cuaacuagcauuguaaa

SEQ ID NO: 1649275 - RNA, 12 nt, Homo sapiens
cuaacuccaugu

SEQ ID NO: 1649276 - RNA, 17 nt, Homo sapiens
cuaacuuaucaucacac

SEQ ID NO: 1649277 - RNA, 19 nt, Homo sapiens
cuaagaacaccugcauucu

SEQ ID NO: 1649278 - RNA, 15 nt, Homo sapiens
cuaagacugauguca

SEQ ID NO: 1649279 - RNA, 22 nt, Homo sapiens
cuaagaucuaaaaugauacugu

SEQ ID NO: 1649280 - RNA, 15 nt, Homo sapiens
cuaagcagaccacug

SEQ ID NO: 1649281 - RNA, 17 nt, Homo sapiens
cuaagggaggcacuucc

SEQ ID NO: 1649282 - RNA, 17 nt, Homo sapiens
cuaaguguaccagagaa

SEQ ID NO: 1649283 - RNA, 13 nt, Homo sapiens
cuaaucauaacau

SEQ ID NO: 1649284 - RNA, 21 nt, Homo sapiens
cuaauccucuuuuucuagucu

SEQ ID NO: 1649285 - RNA, 11 nt, Homo sapiens
cuaaugcauua

SEQ ID NO: 1649286 - RNA, 12 nt, Homo sapiens
cuaaugggacac

SEQ ID NO: 1649287 - RNA, 12 nt, Homo sapiens
cuaauuaauucu

SEQ ID NO: 1649288 - RNA, 22 nt, Homo sapiens
cuaauuagaaaucaacuugugg

SEQ ID NO: 1649289 - RNA, 20 nt, Homo sapiens
cuaauuagaucaauuacuua

SEQ ID NO: 1649290 - RNA, 17 nt, Homo sapiens
cuaauugagaccacagg

SEQ ID NO: 1649291 - RNA, 21 nt, Homo sapiens
cuaauuuuccauaagcuauuu

SEQ ID NO: 1649292 - RNA, 13 nt, Homo sapiens
cuacacaacaugu

SEQ ID NO: 1649293 - RNA, 19 nt, Homo sapiens
cuacacucaccugcacuaa

SEQ ID NO: 1649294 - RNA, 22 nt, Homo sapiens
cuacagagcuucccugacucau

SEQ ID NO: 1649295 - RNA, 19 nt, Homo sapiens
cuacagggcucacagaauu

SEQ ID NO: 1649296 - RNA, 17 nt, Homo sapiens
cuacaguuuuaacugug

SEQ ID NO: 1649297 - RNA, 22 nt, Homo sapiens
cuaccacugucuucuucagggu

SEQ ID NO: 1649298 - RNA, 21 nt, Homo sapiens
cuaccccucccagcugacagu

SEQ ID NO: 1649299 - RNA, 12 nt, Homo sapiens
cuaccucuccag

SEQ ID NO: 1649300 - RNA, 19 nt, Homo sapiens
cuagaaccaagaagggcua

SEQ ID NO: 1649301 - RNA, 19 nt, Homo sapiens
cuagaaccuggaagggcua

SEQ ID NO: 1649302 - RNA, 23 nt, Homo sapiens
cuagcauuguaaaauuauuucau

SEQ ID NO: 1649303 - RNA, 20 nt, Homo sapiens
cuagcugugucagaaucucc

SEQ ID NO: 1649304 - RNA, 18 nt, Homo sapiens
cuagcuuauuuugaggcu

SEQ ID NO: 1649305 - RNA, 14 nt, Homo sapiens
cuagggaucccuca

SEQ ID NO: 1649306 - RNA, 16 nt, Homo sapiens
cuagggccaagcccag

SEQ ID NO: 1649307 - RNA, 12 nt, Homo sapiens
cuaguauacauu

SEQ ID NO: 1649308 - RNA, 22 nt, Homo sapiens
cuagucccuguguucugcacau

SEQ ID NO: 1649309 - RNA, 18 nt, Homo sapiens
cuagucuucccuuaccuc

SEQ ID NO: 1649310 - RNA, 16 nt, Homo sapiens
cuaguggucuuuguaa

SEQ ID NO: 1649311 - RNA, 17 nt, Homo sapiens
cuaguuauuuucugaaa

SEQ ID NO: 1649312 - RNA, 20 nt, Homo sapiens
cuaguuuuuuugaaauccaa

SEQ ID NO: 1649313 - RNA, 20 nt, Homo sapiens
cuauaacuauguugauaaaa

SEQ ID NO: 1649314 - RNA, 19 nt, Homo sapiens
cuauauaaaaaacauaaua

SEQ ID NO: 1649315 - RNA, 19 nt, Homo sapiens
cuauauauuuuaugaucuu

SEQ ID NO: 1649316 - RNA, 13 nt, Homo sapiens
cuaucgugucaac

SEQ ID NO: 1649317 - RNA, 16 nt, Homo sapiens
gcuucauuuccugugu

SEQ ID NO: 1649318 - RNA, 15 nt, Homo sapiens
gcuucccugacucau

SEQ ID NO: 1649319 - RNA, 21 nt, Homo sapiens
gcuucuaugaaagacucaaaa

SEQ ID NO: 1649320 - RNA, 16 nt, Homo sapiens
gcuucugccacuuccc

SEQ ID NO: 1649321 - RNA, 18 nt, Homo sapiens
gcuucuuaaucuuuucac

SEQ ID NO: 1649322 - RNA, 23 nt, Homo sapiens
gcuuggaaacuggaugaggucau

SEQ ID NO: 1649323 - RNA, 18 nt, Homo sapiens
gcuuggcugugcccucag

SEQ ID NO: 1649324 - RNA, 17 nt, Homo sapiens
gcuuguuucuuguuauu

SEQ ID NO: 1649325 - RNA, 16 nt, Homo sapiens
gcuuucuacccagcga

SEQ ID NO: 1649326 - RNA, 12 nt, Homo sapiens
gcuuucuucuac

SEQ ID NO: 1649327 - RNA, 15 nt, Homo sapiens
gcuuuggcaacagaa

SEQ ID NO: 1649328 - RNA, 16 nt, Homo sapiens
gcuuuguuuaagcauc

SEQ ID NO: 1649329 - RNA, 12 nt, Homo sapiens
gcuuuugaacug

SEQ ID NO: 1649330 - RNA, 18 nt, Homo sapiens
ggaaaaaauaacaaugaa

SEQ ID NO: 1649331 - RNA, 17 nt, Homo sapiens
ggaaaacagaguauuuc

SEQ ID NO: 1649332 - RNA, 20 nt, Homo sapiens
ggaaacagcuaaugggacac

SEQ ID NO: 1649333 - RNA, 22 nt, Homo sapiens
ggaaaggcaaaugcccaaggga

SEQ ID NO: 1649334 - RNA, 22 nt, Homo sapiens
ggaacauguacuguuacugugu

SEQ ID NO: 1649335 - RNA, 14 nt, Homo sapiens
ggaacucaguguga

SEQ ID NO: 1649336 - RNA, 13 nt, Homo sapiens
ggaacugcaauaa

SEQ ID NO: 1649337 - RNA, 19 nt, Homo sapiens
ggaacuuuuauuacugggg

SEQ ID NO: 1649338 - RNA, 24 nt, Homo sapiens
ggaagagugguuaagacuacugaa

SEQ ID NO: 1649339 - RNA, 17 nt, Homo sapiens
ggaagcagcucaaggga

SEQ ID NO: 1649340 - RNA, 23 nt, Homo sapiens
ggaagcuucuaaauggugcugca

SEQ ID NO: 1649341 - RNA, 14 nt, Homo sapiens
ggaaggagcugccu

SEQ ID NO: 1649342 - RNA, 17 nt, Homo sapiens
ggaagggggcugggaca

SEQ ID NO: 1649343 - RNA, 16 nt, Homo sapiens
ggaagucccucagagg

SEQ ID NO: 1649344 - RNA, 15 nt, Homo sapiens
ggaagucugugucua

SEQ ID NO: 1649345 - RNA, 14 nt, Homo sapiens
ggaauaauccagaa

SEQ ID NO: 1649346 - RNA, 22 nt, Homo sapiens
ggaauaauccuaaacauaugaa

SEQ ID NO: 1649347 - RNA, 23 nt, Homo sapiens
ggaauauguuagagaauuuccuu

SEQ ID NO: 1649348 - RNA, 18 nt, Homo sapiens
ggaaucacuggcuguuaa

SEQ ID NO: 1649349 - RNA, 17 nt, Homo sapiens
ggaaucuaccaacuguu

SEQ ID NO: 1649350 - RNA, 12 nt, Homo sapiens
ggaaugccugag

SEQ ID NO: 1649351 - RNA, 19 nt, Homo sapiens
ggacaagacccucucaggc

SEQ ID NO: 1649352 - RNA, 23 nt, Homo sapiens
ggacaaggaugaucuaggaagac

SEQ ID NO: 1649353 - RNA, 18 nt, Homo sapiens
ggacacuaauacaccagg

SEQ ID NO: 1649354 - RNA, 20 nt, Homo sapiens
ggacacuugcucaugcccug

SEQ ID NO: 1649355 - RNA, 16 nt, Homo sapiens
ggacagcaacuaucag

SEQ ID NO: 1649356 - RNA, 21 nt, Homo sapiens
ggacauugccuuuucuagccc

SEQ ID NO: 1649357 - RNA, 20 nt, Homo sapiens
ggaccacgugagaucauuca

SEQ ID NO: 1649358 - RNA, 20 nt, Homo sapiens
ggaccagaaaccugggagag

SEQ ID NO: 1649359 - RNA, 23 nt, Homo sapiens
ggacucaaugcacugacauuguu

SEQ ID NO: 1649360 - RNA, 15 nt, Homo sapiens
ggacuuucuugcaag

SEQ ID NO: 1649361 - RNA, 20 nt, Homo sapiens
ggacuuuuccucucaugucu

SEQ ID NO: 1649362 - RNA, 19 nt, Homo sapiens
ggagacucaggacugcuga

SEQ ID NO: 1649363 - RNA, 20 nt, Homo sapiens
ggagacucaggacugcugaa

SEQ ID NO: 1649364 - RNA, 16 nt, Homo sapiens
ggagagcuggagccug

SEQ ID NO: 1649365 - RNA, 15 nt, Homo sapiens
ggagaggguacacaa

SEQ ID NO: 1649366 - RNA, 23 nt, Homo sapiens
ggagcaaaggcugagaacacugu

SEQ ID NO: 1649367 - RNA, 21 nt, Homo sapiens
ggagccggacacuucucagga

SEQ ID NO: 1649368 - RNA, 14 nt, Homo sapiens
ggagccugcaacau

SEQ ID NO: 1649369 - RNA, 16 nt, Homo sapiens
ggagcuggcccucucc

SEQ ID NO: 1649370 - RNA, 16 nt, Homo sapiens
ggagcuguaaaccaga

SEQ ID NO: 1649371 - RNA, 22 nt, Homo sapiens
ggaggaaaagacuaacaggaga

SEQ ID NO: 1649372 - RNA, 20 nt, Homo sapiens
ggaggacaagacccucucag

SEQ ID NO: 1649373 - RNA, 23 nt, Homo sapiens
ggaggagaaaagugacagauccu

SEQ ID NO: 1649374 - RNA, 15 nt, Homo sapiens
ggaggcaacgccaga

SEQ ID NO: 1649375 - RNA, 13 nt, Homo sapiens
ggaggcuucugau

SEQ ID NO: 1649376 - RNA, 14 nt, Homo sapiens
ggaguacaccccaa

SEQ ID NO: 1649377 - RNA, 18 nt, Homo sapiens
ggaguacaccccaacagc

SEQ ID NO: 1649378 - RNA, 14 nt, Homo sapiens
ggaguacaggugaa

SEQ ID NO: 1649379 - RNA, 15 nt, Homo sapiens
ggagucggagccacu

SEQ ID NO: 1649380 - RNA, 23 nt, Homo sapiens
ggagugguggcucaugccuguaa

SEQ ID NO: 1649381 - RNA, 15 nt, Homo sapiens
ggauacuauuuaauu

SEQ ID NO: 1649382 - RNA, 19 nt, Homo sapiens
ggauaggcaggaacauaca

SEQ ID NO: 1649383 - RNA, 23 nt, Homo sapiens
ggauauguguaaauguuaugacu

SEQ ID NO: 1649384 - RNA, 17 nt, Homo sapiens
ggauauugggucucagc

SEQ ID NO: 1649385 - RNA, 17 nt, Homo sapiens
ggauauuuuuuacuuua

SEQ ID NO: 1649386 - RNA, 13 nt, Homo sapiens
ggaucuuuggaca

SEQ ID NO: 1649387 - RNA, 16 nt, Homo sapiens
ggauggugggguacca

SEQ ID NO: 1649388 - RNA, 16 nt, Homo sapiens
ggauguucugggacac

SEQ ID NO: 1649389 - RNA, 21 nt, Homo sapiens
ggauucuggccuagucccuuc

SEQ ID NO: 1649390 - RNA, 19 nt, Homo sapiens
ggauuuccagccagggcug

SEQ ID NO: 1649391 - RNA, 14 nt, Homo sapiens
ggauuuuucuuuaa

SEQ ID NO: 1649392 - RNA, 23 nt, Homo sapiens
ggcaacuugggaacuagacuccc

SEQ ID NO: 1649393 - RNA, 15 nt, Homo sapiens
ggcacacacugugua

SEQ ID NO: 1649394 - RNA, 20 nt, Homo sapiens
ggcacagcauggagucacag

SEQ ID NO: 1649395 - RNA, 15 nt, Homo sapiens
ggcacauuccuugcc

SEQ ID NO: 1649396 - RNA, 19 nt, Homo sapiens
ggcacccggccccugcugg

SEQ ID NO: 1649397 - RNA, 19 nt, Homo sapiens
ggcacgaucucaacucacu

SEQ ID NO: 1649398 - RNA, 16 nt, Homo sapiens
ggcacugccaugcagg

SEQ ID NO: 1649399 - RNA, 17 nt, Homo sapiens
ggcacuugaugugaugu

SEQ ID NO: 1649400 - RNA, 19 nt, Homo sapiens
ggcagcggggcaagcaaaa

SEQ ID NO: 1649401 - RNA, 23 nt, Homo sapiens
ggcaggcuucucagucucugucc

SEQ ID NO: 1649402 - RNA, 21 nt, Homo sapiens
ggcagugguguggagaagcca

SEQ ID NO: 1649403 - RNA, 17 nt, Homo sapiens
ggcaguuuuucuguauu

SEQ ID NO: 1649404 - RNA, 17 nt, Homo sapiens
ggcaucuaauucuuauu

SEQ ID NO: 1649405 - RNA, 17 nt, Homo sapiens
ggccaggcuggucucaa

SEQ ID NO: 1649406 - RNA, 13 nt, Homo sapiens
ggccaucuuccag

SEQ ID NO: 1649407 - RNA, 22 nt, Homo sapiens
ggcccagagggccugcaaggga

SEQ ID NO: 1649408 - RNA, 22 nt, Homo sapiens
ggcccauggaggagacaggaag

SEQ ID NO: 1649409 - RNA, 21 nt, Homo sapiens
ggccccagcccuacucugugu

SEQ ID NO: 1649410 - RNA, 14 nt, Homo sapiens
ggcccugccaugcu

SEQ ID NO: 1649411 - RNA, 20 nt, Homo sapiens
ggcccugccaugcucuccaa

SEQ ID NO: 1649412 - RNA, 23 nt, Homo sapiens
ggcccuucccacaggacauuucu

SEQ ID NO: 1649413 - RNA, 16 nt, Homo sapiens
ggccuccugugugugc

SEQ ID NO: 1649414 - RNA, 17 nt, Homo sapiens
ggccugccuucucaggg

SEQ ID NO: 1649415 - RNA, 21 nt, Homo sapiens
ggccuuggcaggcugcuggaa

SEQ ID NO: 1649416 - RNA, 18 nt, Homo sapiens
ggcgcaaagggcaugggu

SEQ ID NO: 1649417 - RNA, 16 nt, Homo sapiens
ggcgccagcagcucca

SEQ ID NO: 1649418 - RNA, 23 nt, Homo sapiens
ggcggaucuuuggacagaagcag

SEQ ID NO: 1649419 - RNA, 20 nt, Homo sapiens
ggcuaaauugaaaccuggaa

SEQ ID NO: 1649420 - RNA, 23 nt, Homo sapiens
ggcuaauuuaacaagaacuuuaa

SEQ ID NO: 1649421 - RNA, 15 nt, Homo sapiens
ggcuacacagggaug

SEQ ID NO: 1649422 - RNA, 12 nt, Homo sapiens
ggcuauacaugg

SEQ ID NO: 1649423 - RNA, 18 nt, Homo sapiens
ggcuauauuucugggaug

SEQ ID NO: 1649424 - RNA, 15 nt, Homo sapiens
ggcucaacuagggag

SEQ ID NO: 1649425 - RNA, 22 nt, Homo sapiens
ggcucagccaggugcugugaca

SEQ ID NO: 1649426 - RNA, 14 nt, Homo sapiens
gccccauuuaccca

SEQ ID NO: 1649427 - RNA, 20 nt, Homo sapiens
gcccccugcaggaaggagcu

SEQ ID NO: 1649428 - RNA, 17 nt, Homo sapiens
gccccugauccugugaa

SEQ ID NO: 1649429 - RNA, 17 nt, Homo sapiens
gcccgaucuccacuguu

SEQ ID NO: 1649430 - RNA, 15 nt, Homo sapiens
gcccuacucugugua

SEQ ID NO: 1649431 - RNA, 19 nt, Homo sapiens
gcccucagauuccgcacca

SEQ ID NO: 1649432 - RNA, 19 nt, Homo sapiens
gcccugccugcugcaucuu

SEQ ID NO: 1649433 - RNA, 19 nt, Homo sapiens
gcccuggcaccuguggcca

SEQ ID NO: 1649434 - RNA, 19 nt, Homo sapiens
gccuacaggagugagcacu

SEQ ID NO: 1649435 - RNA, 12 nt, Homo sapiens
gccuaucugacu

SEQ ID NO: 1649436 - RNA, 14 nt, Homo sapiens
gccuaugugcaugc

SEQ ID NO: 1649437 - RNA, 13 nt, Homo sapiens
gccucaaguucca

SEQ ID NO: 1649438 - RNA, 17 nt, Homo sapiens
gccucaaguuccagugc

SEQ ID NO: 1649439 - RNA, 18 nt, Homo sapiens
gccucacuggacuugucc

SEQ ID NO: 1649440 - RNA, 15 nt, Homo sapiens
gccucauuacuuuac

SEQ ID NO: 1649441 - RNA, 14 nt, Homo sapiens
gccucccacaguga

SEQ ID NO: 1649442 - RNA, 15 nt, Homo sapiens
gccucccacagugac

SEQ ID NO: 1649443 - RNA, 23 nt, Homo sapiens
gccuccuggguucacaccauucu

SEQ ID NO: 1649444 - RNA, 22 nt, Homo sapiens
gccucucuuuguuuuucuuuug

SEQ ID NO: 1649445 - RNA, 14 nt, Homo sapiens
gccucuguggcacu

SEQ ID NO: 1649446 - RNA, 18 nt, Homo sapiens
gccucugugucacuggcu

SEQ ID NO: 1649447 - RNA, 15 nt, Homo sapiens
gccucuuuuccccau

SEQ ID NO: 1649448 - RNA, 20 nt, Homo sapiens
gccugacaacagccugagaa

SEQ ID NO: 1649449 - RNA, 21 nt, Homo sapiens
gccugagguuugccagcauuu

SEQ ID NO: 1649450 - RNA, 22 nt, Homo sapiens
gccugaucagcgccgcaccagc

SEQ ID NO: 1649451 - RNA, 14 nt, Homo sapiens
gccugccuucucag

SEQ ID NO: 1649452 - RNA, 14 nt, Homo sapiens
gccuggacacagag

SEQ ID NO: 1649453 - RNA, 17 nt, Homo sapiens
gccuggccccucagggu

SEQ ID NO: 1649454 - RNA, 23 nt, Homo sapiens
gccuggcuccaaacccucgaggc

SEQ ID NO: 1649455 - RNA, 12 nt, Homo sapiens
gccugugugcga

SEQ ID NO: 1649456 - RNA, 23 nt, Homo sapiens
gccuuccacuuggcuacacaggg

SEQ ID NO: 1649457 - RNA, 18 nt, Homo sapiens
gccuucccaggaguacac

SEQ ID NO: 1649458 - RNA, 14 nt, Homo sapiens
gccuucugaccugg

SEQ ID NO: 1649459 - RNA, 18 nt, Homo sapiens
gccuuuuauaaaccucua

SEQ ID NO: 1649460 - RNA, 14 nt, Homo sapiens
gccuuuuguguuuu

SEQ ID NO: 1649461 - RNA, 23 nt, Homo sapiens
gcgccaaauaaugucucugugag

SEQ ID NO: 1649462 - RNA, 17 nt, Homo sapiens
gcggauccaagcaaaug

SEQ ID NO: 1649463 - RNA, 16 nt, Homo sapiens
gcggcauuaaagccau

SEQ ID NO: 1649464 - RNA, 21 nt, Homo sapiens
gcggggacucgguaagcacuu

SEQ ID NO: 1649465 - RNA, 11 nt, Homo sapiens
gcgggggcuug

SEQ ID NO: 1649466 - RNA, 12 nt, Homo sapiens
gcgucacuguga

SEQ ID NO: 1649467 - RNA, 15 nt, Homo sapiens
gcgugguagugcaag

SEQ ID NO: 1649468 - RNA, 13 nt, Homo sapiens
gcuaacacacagc

SEQ ID NO: 1649469 - RNA, 12 nt, Homo sapiens
gcuaagacugau

SEQ ID NO: 1649470 - RNA, 14 nt, Homo sapiens
gcuacaaaugcauu

SEQ ID NO: 1649471 - RNA, 13 nt, Homo sapiens
gcuagaaccugga

SEQ ID NO: 1649472 - RNA, 14 nt, Homo sapiens
gcuaggaacacucc

SEQ ID NO: 1649473 - RNA, 12 nt, Homo sapiens
gcuagugcugua

SEQ ID NO: 1649474 - RNA, 12 nt, Homo sapiens
gcuaguguuucc

SEQ ID NO: 1649475 - RNA, 17 nt, Homo sapiens
gcuauaacuauguugau

SEQ ID NO: 1649476 - RNA, 14 nt, Homo sapiens
gcuauagucuggca

SEQ ID NO: 1649477 - RNA, 17 nt, Homo sapiens
gcuauugucaccagggc

SEQ ID NO: 1649478 - RNA, 19 nt, Homo sapiens
gcuauuuauuaaguauuuu

SEQ ID NO: 1649479 - RNA, 22 nt, Homo sapiens
gcucacacugagaauguaagaa

SEQ ID NO: 1649480 - RNA, 13 nt, Homo sapiens
gcucacaucugaa

SEQ ID NO: 1649481 - RNA, 22 nt, Homo sapiens
gcucacuggucaaaaccuacac

SEQ ID NO: 1649482 - RNA, 22 nt, Homo sapiens
gcucacuguucuauucaucuca

SEQ ID NO: 1649483 - RNA, 17 nt, Homo sapiens
gcucacuuggugauaug

SEQ ID NO: 1649484 - RNA, 21 nt, Homo sapiens
gcucagccaggugcugugaca

SEQ ID NO: 1649485 - RNA, 18 nt, Homo sapiens
uucugacgcagccugaga

SEQ ID NO: 1649486 - RNA, 21 nt, Homo sapiens
uucugagcaucugcaguacag

SEQ ID NO: 1649487 - RNA, 19 nt, Homo sapiens
uucugaguagagcuuguaa

SEQ ID NO: 1649488 - RNA, 17 nt, Homo sapiens
uucugauacguguauga

SEQ ID NO: 1649489 - RNA, 18 nt, Homo sapiens
uucugauguuacugagau

SEQ ID NO: 1649490 - RNA, 13 nt, Homo sapiens
uucugcacuugcg

SEQ ID NO: 1649491 - RNA, 14 nt, Homo sapiens
uucugccacuuccc

SEQ ID NO: 1649492 - RNA, 14 nt, Homo sapiens
uucugcucuaagaa

SEQ ID NO: 1649493 - RNA, 20 nt, Homo sapiens
uucuggauuucauacuguaa

SEQ ID NO: 1649494 - RNA, 17 nt, Homo sapiens
uucuguugcugccucau

SEQ ID NO: 1649495 - RNA, 21 nt, Homo sapiens
uucuuaaacaaauguaugauu

SEQ ID NO: 1649496 - RNA, 18 nt, Homo sapiens
uucuuaauuuguaacuuu

SEQ ID NO: 1649497 - RNA, 14 nt, Homo sapiens
uucuuccagauaau

SEQ ID NO: 1649498 - RNA, 13 nt, Homo sapiens
uucuuuucugacu

SEQ ID NO: 1649499 - RNA, 22 nt, Homo sapiens
uucuuuuuuuuuuuugagacag

SEQ ID NO: 1649500 - RNA, 13 nt, Homo sapiens
uugaaaaauugcc

SEQ ID NO: 1649501 - RNA, 20 nt, Homo sapiens
uugaaaagaagcaaggaaau

SEQ ID NO: 1649502 - RNA, 13 nt, Homo sapiens
uugaaaucuauga

SEQ ID NO: 1649503 - RNA, 19 nt, Homo sapiens
uugaaucccuuaaacucag

SEQ ID NO: 1649504 - RNA, 23 nt, Homo sapiens
uugacagggucucacucugucac

SEQ ID NO: 1649505 - RNA, 20 nt, Homo sapiens
uugacuauuauagaauggaa

SEQ ID NO: 1649506 - RNA, 18 nt, Homo sapiens
uugacuuuagggacucaa

SEQ ID NO: 1649507 - RNA, 13 nt, Homo sapiens
uugagacagaguu

SEQ ID NO: 1649508 - RNA, 13 nt, Homo sapiens
uugauacuguugc

SEQ ID NO: 1649509 - RNA, 16 nt, Homo sapiens
uugauaguauugugca

SEQ ID NO: 1649510 - RNA, 16 nt, Homo sapiens
uugaucaaccaaaaac

SEQ ID NO: 1649511 - RNA, 14 nt, Homo sapiens
uugauggugaugaa

SEQ ID NO: 1649512 - RNA, 17 nt, Homo sapiens
uugauucaaagcacugu

SEQ ID NO: 1649513 - RNA, 20 nt, Homo sapiens
uugauugcguggaauugugc

SEQ ID NO: 1649514 - RNA, 14 nt, Homo sapiens
uugcaaccucgcug

SEQ ID NO: 1649515 - RNA, 20 nt, Homo sapiens
uugcacaaguucagugagaa

SEQ ID NO: 1649516 - RNA, 12 nt, Homo sapiens
uugcacauucua

SEQ ID NO: 1649517 - RNA, 20 nt, Homo sapiens
uugcagcuuauauucaucca

SEQ ID NO: 1649518 - RNA, 15 nt, Homo sapiens
uugcaggacccugau

SEQ ID NO: 1649519 - RNA, 18 nt, Homo sapiens
uugcaucauaguuugcuu

SEQ ID NO: 1649520 - RNA, 13 nt, Homo sapiens
uugccacauuuag

SEQ ID NO: 1649521 - RNA, 13 nt, Homo sapiens
uugcccuuuccau

SEQ ID NO: 1649522 - RNA, 13 nt, Homo sapiens
uugccuaccauuu

SEQ ID NO: 1649523 - RNA, 23 nt, Homo sapiens
uugccugcacaaacucaccaucu

SEQ ID NO: 1649524 - RNA, 23 nt, Homo sapiens
uugcgcaaacuuuaacagguuuu

SEQ ID NO: 1649525 - RNA, 23 nt, Homo sapiens
uugcguuucuuacugccuucuuu

SEQ ID NO: 1649526 - RNA, 15 nt, Homo sapiens
uugcuggcugugaaa

SEQ ID NO: 1649527 - RNA, 20 nt, Homo sapiens
uugcuuucuucuccugugau

SEQ ID NO: 1649528 - RNA, 14 nt, Homo sapiens
uugcuuugggagac

SEQ ID NO: 1649529 - RNA, 16 nt, Homo sapiens
uuggaaagaguucaag

SEQ ID NO: 1649530 - RNA, 19 nt, Homo sapiens
uuggaaauugagucugaag

SEQ ID NO: 1649531 - RNA, 20 nt, Homo sapiens
uuggaacuggaggcagggaa

SEQ ID NO: 1649532 - RNA, 19 nt, Homo sapiens
uuggaagugugugaucugu

SEQ ID NO: 1649533 - RNA, 15 nt, Homo sapiens
uuggaauauuccacu

SEQ ID NO: 1649534 - RNA, 17 nt, Homo sapiens
uuggacagaagcagcuc

SEQ ID NO: 1649535 - RNA, 23 nt, Homo sapiens
uuggaggagcaaaggcugagaac

SEQ ID NO: 1649536 - RNA, 17 nt, Homo sapiens
uuggagggaucauuuuc

SEQ ID NO: 1649537 - RNA, 16 nt, Homo sapiens
uuggauucucugagaa

SEQ ID NO: 1649538 - RNA, 15 nt, Homo sapiens
uuggccagugugaca

SEQ ID NO: 1649539 - RNA, 16 nt, Homo sapiens
uuggccaucucuggau

SEQ ID NO: 1649540 - RNA, 18 nt, Homo sapiens
uuggcuuguuuggagcau

SEQ ID NO: 1649541 - RNA, 15 nt, Homo sapiens
uuggcuuugcaaaau

SEQ ID NO: 1649542 - RNA, 16 nt, Homo sapiens
uugggauauucugaaa

SEQ ID NO: 1649543 - RNA, 19 nt, Homo sapiens
uuagaguaaugaaauggag

SEQ ID NO: 1649544 - RNA, 20 nt, Homo sapiens
uuagauuuuguauucagggg

SEQ ID NO: 1649545 - RNA, 22 nt, Homo sapiens
uuaggaaauuuaagacuagaua

SEQ ID NO: 1649546 - RNA, 20 nt, Homo sapiens
uuaggccuggcacagugucu

SEQ ID NO: 1649547 - RNA, 16 nt, Homo sapiens
uuaguauuuauucacu

SEQ ID NO: 1649548 - RNA, 18 nt, Homo sapiens
uuaguuuuuaaaauaucu

SEQ ID NO: 1649549 - RNA, 15 nt, Homo sapiens
uuauaaaagaugcau

SEQ ID NO: 1649550 - RNA, 16 nt, Homo sapiens
uuauaaaccaaucuua

SEQ ID NO: 1649551 - RNA, 14 nt, Homo sapiens
uuauaaacugagag

SEQ ID NO: 1649552 - RNA, 13 nt, Homo sapiens
uuauaacaguguu

SEQ ID NO: 1649553 - RNA, 21 nt, Homo sapiens
uuauaacccagugaguucagc

SEQ ID NO: 1649554 - RNA, 12 nt, Homo sapiens
uuauaaucuuuu

SEQ ID NO: 1649555 - RNA, 13 nt, Homo sapiens
uuauacacuguaa

SEQ ID NO: 1649556 - RNA, 21 nt, Homo sapiens
uuauacuucucuauuaucuca

SEQ ID NO: 1649557 - RNA, 21 nt, Homo sapiens
uuauaggcaccuaccaccacg

SEQ ID NO: 1649558 - RNA, 13 nt, Homo sapiens
uuauauucaucca

SEQ ID NO: 1649559 - RNA, 20 nt, Homo sapiens
uuauauugauaacagcacug

SEQ ID NO: 1649560 - RNA, 23 nt, Homo sapiens
uuauauugauaacagcacugacu

SEQ ID NO: 1649561 - RNA, 23 nt, Homo sapiens
uuauauuuccaagaaauauuccu

SEQ ID NO: 1649562 - RNA, 14 nt, Homo sapiens
uuauauuuggccca

SEQ ID NO: 1649563 - RNA, 22 nt, Homo sapiens
uuauauuuggcccaaacucauc

SEQ ID NO: 1649564 - RNA, 18 nt, Homo sapiens
uuaucaccgugggcuccc

SEQ ID NO: 1649565 - RNA, 13 nt, Homo sapiens
uuaucuauggcac

SEQ ID NO: 1649566 - RNA, 18 nt, Homo sapiens
uuaucucacuugugccaa

SEQ ID NO: 1649567 - RNA, 13 nt, Homo sapiens
uuaucuucacuuu

SEQ ID NO: 1649568 - RNA, 16 nt, Homo sapiens
uuaugacuccuugaua

SEQ ID NO: 1649569 - RNA, 13 nt, Homo sapiens
uuaugcggcauuu

SEQ ID NO: 1649570 - RNA, 17 nt, Homo sapiens
uuaugcuaccuacugau

SEQ ID NO: 1649571 - RNA, 21 nt, Homo sapiens
uuauuaaauguagaaagugau

SEQ ID NO: 1649572 - RNA, 20 nt, Homo sapiens
uuauuauguccauuauucaa

SEQ ID NO: 1649573 - RNA, 13 nt, Homo sapiens
uuauugacuaaca

SEQ ID NO: 1649574 - RNA, 16 nt, Homo sapiens
uuauugauguuuucau

SEQ ID NO: 1649575 - RNA, 22 nt, Homo sapiens
uuauugcaugagaagccauaca

SEQ ID NO: 1649576 - RNA, 23 nt, Homo sapiens
uuauuuaccugaaauaaaauuca

SEQ ID NO: 1649577 - RNA, 17 nt, Homo sapiens
uuauuuagcaccaggga

SEQ ID NO: 1649578 - RNA, 14 nt, Homo sapiens
uucaaaaacuaaaa

SEQ ID NO: 1649579 - RNA, 15 nt, Homo sapiens
uucaaaaacuaaaau

SEQ ID NO: 1649580 - RNA, 22 nt, Homo sapiens
uucaaaauugcuucuucuucaa

SEQ ID NO: 1649581 - RNA, 15 nt, Homo sapiens
uucaacagagacuga

SEQ ID NO: 1649582 - RNA, 14 nt, Homo sapiens
uucaaguacuguaa

SEQ ID NO: 1649583 - RNA, 15 nt, Homo sapiens
uucaaguacuguaac

SEQ ID NO: 1649584 - RNA, 19 nt, Homo sapiens
uucaaguacuguaacugug

SEQ ID NO: 1649585 - RNA, 19 nt, Homo sapiens
uucaauaaaguugagcaaa

SEQ ID NO: 1649586 - RNA, 14 nt, Homo sapiens
uucaauacuuacau

SEQ ID NO: 1649587 - RNA, 15 nt, Homo sapiens
uucaauacuuacaua

SEQ ID NO: 1649588 - RNA, 20 nt, Homo sapiens
uucaauacuuacauaucuga

SEQ ID NO: 1649589 - RNA, 16 nt, Homo sapiens
uucaaucuggauucau

SEQ ID NO: 1649590 - RNA, 22 nt, Homo sapiens
uucaauucucauuugucacaca

SEQ ID NO: 1649591 - RNA, 22 nt, Homo sapiens
uucacaccuagcgucaguauuu

SEQ ID NO: 1649592 - RNA, 12 nt, Homo sapiens
uucacaguguga

SEQ ID NO: 1649593 - RNA, 16 nt, Homo sapiens
uucaccuguguacuga

SEQ ID NO: 1649594 - RNA, 15 nt, Homo sapiens
uucacucugcucuca

SEQ ID NO: 1649595 - RNA, 22 nt, Homo sapiens
uucacuggucucuaaguguaaa

SEQ ID NO: 1649596 - RNA, 23 nt, Homo sapiens
uucacuuuuggcaaugacucaaa

SEQ ID NO: 1649597 - RNA, 19 nt, Homo sapiens
uucagaaaauucccaugag

SEQ ID NO: 1649598 - RNA, 17 nt, Homo sapiens
uucagagugacuacaca

SEQ ID NO: 1649599 - RNA, 16 nt, Homo sapiens
uucagcuacuuuccau

SEQ ID NO: 1649600 - RNA, 14 nt, Homo sapiens
uucaguggcagcug

SEQ ID NO: 1649601 - RNA, 13 nt, Homo sapiens
uucaguguucuga

SEQ ID NO: 1649602 - RNA, 15 nt, Homo sapiens
uucaguuuucaggag

SEQ ID NO: 1649603 - RNA, 17 nt, Homo sapiens
ugucauguaacacgaca

SEQ ID NO: 1649604 - RNA, 18 nt, Homo sapiens
ugucauguaacacgacau

SEQ ID NO: 1649605 - RNA, 17 nt, Homo sapiens
uguccaggcacugagau

SEQ ID NO: 1649606 - RNA, 17 nt, Homo sapiens
uguccuccucugugaaa

SEQ ID NO: 1649607 - RNA, 23 nt, Homo sapiens
ugucgguuugcuuugauuucccu

SEQ ID NO: 1649608 - RNA, 18 nt, Homo sapiens
ugucuacguuaccaggca

SEQ ID NO: 1649609 - RNA, 18 nt, Homo sapiens
ugucucagaccacuauuc

SEQ ID NO: 1649610 - RNA, 18 nt, Homo sapiens
ugucuccuuaacacugag

SEQ ID NO: 1649611 - RNA, 17 nt, Homo sapiens
ugucucuauccaucaga

SEQ ID NO: 1649612 - RNA, 12 nt, Homo sapiens
ugucucugugag

SEQ ID NO: 1649613 - RNA, 23 nt, Homo sapiens
ugucuuacagagaaaagacauaa

SEQ ID NO: 1649614 - RNA, 14 nt, Homo sapiens
ugugaacguguaug

SEQ ID NO: 1649615 - RNA, 21 nt, Homo sapiens
ugugaagaaaaagaccugcau

SEQ ID NO: 1649616 - RNA, 18 nt, Homo sapiens
ugugaaguuuaauugacu

SEQ ID NO: 1649617 - RNA, 16 nt, Homo sapiens
ugugacaaugguuuca

SEQ ID NO: 1649618 - RNA, 18 nt, Homo sapiens
ugugaggcccucagggca

SEQ ID NO: 1649619 - RNA, 20 nt, Homo sapiens
ugugaugacugguuguucaa

SEQ ID NO: 1649620 - RNA, 17 nt, Homo sapiens
ugugauucacaguguga

SEQ ID NO: 1649621 - RNA, 14 nt, Homo sapiens
ugugcaaacagugu

SEQ ID NO: 1649622 - RNA, 19 nt, Homo sapiens
ugugccuuaggaaaagcau

SEQ ID NO: 1649623 - RNA, 12 nt, Homo sapiens
ugugcucaggga

SEQ ID NO: 1649624 - RNA, 13 nt, Homo sapiens
ugugcucagggaa

SEQ ID NO: 1649625 - RNA, 22 nt, Homo sapiens
ugugcugaguugguguugacau

SEQ ID NO: 1649626 - RNA, 18 nt, Homo sapiens
uguggaggagcucaggac

SEQ ID NO: 1649627 - RNA, 13 nt, Homo sapiens
uguggcuucuuaa

SEQ ID NO: 1649628 - RNA, 15 nt, Homo sapiens
ugugggcuccaugua

SEQ ID NO: 1649629 - RNA, 22 nt, Homo sapiens
ugugguuaaugccauggacaga

SEQ ID NO: 1649630 - RNA, 20 nt, Homo sapiens
uguguacugaguauugauaa

SEQ ID NO: 1649631 - RNA, 14 nt, Homo sapiens
ugugucaaaacugg

SEQ ID NO: 1649632 - RNA, 18 nt, Homo sapiens
ugugucaggaaacauauu

SEQ ID NO: 1649633 - RNA, 17 nt, Homo sapiens
ugugucagggaacauau

SEQ ID NO: 1649634 - RNA, 19 nt, Homo sapiens
ugugucagggaacauauuu

SEQ ID NO: 1649635 - RNA, 22 nt, Homo sapiens
ugugucuaucugcuuuugccua

SEQ ID NO: 1649636 - RNA, 22 nt, Homo sapiens
ugugugaacguguauguaccua

SEQ ID NO: 1649637 - RNA, 17 nt, Homo sapiens
ugugugaauuuuucuaa

SEQ ID NO: 1649638 - RNA, 19 nt, Homo sapiens
uguguggucaacauuucuc

SEQ ID NO: 1649639 - RNA, 17 nt, Homo sapiens
uguguguucaccuucaa

SEQ ID NO: 1649640 - RNA, 15 nt, Homo sapiens
uguguguugauacug

SEQ ID NO: 1649641 - RNA, 15 nt, Homo sapiens
uguuaaggaaacucu

SEQ ID NO: 1649642 - RNA, 20 nt, Homo sapiens
uguuacacaugacacucuuc

SEQ ID NO: 1649643 - RNA, 15 nt, Homo sapiens
uguuacuaucuacaa

SEQ ID NO: 1649644 - RNA, 14 nt, Homo sapiens
uguuauaacuucau

SEQ ID NO: 1649645 - RNA, 15 nt, Homo sapiens
uguuaucuucacuuu

SEQ ID NO: 1649646 - RNA, 17 nt, Homo sapiens
uguuaugaggagcugca

SEQ ID NO: 1649647 - RNA, 20 nt, Homo sapiens
uguuauuauaaaaguacuag

SEQ ID NO: 1649648 - RNA, 19 nt, Homo sapiens
uguuauuuacacuggucua

SEQ ID NO: 1649649 - RNA, 18 nt, Homo sapiens
uguucaagagcacacuug

SEQ ID NO: 1649650 - RNA, 15 nt, Homo sapiens
uguucacuuccaaga

SEQ ID NO: 1649651 - RNA, 11 nt, Homo sapiens
uguuccagagc

SEQ ID NO: 1649652 - RNA, 13 nt, Homo sapiens
uguuccauugaau

SEQ ID NO: 1649653 - RNA, 18 nt, Homo sapiens
uguuccccuuccacugag

SEQ ID NO: 1649654 - RNA, 23 nt, Homo sapiens
uguucccuauuuugccaguggga

SEQ ID NO: 1649655 - RNA, 16 nt, Homo sapiens
uguucugggacacagu

SEQ ID NO: 1649656 - RNA, 16 nt, Homo sapiens
uguucugucccuugcc

SEQ ID NO: 1649657 - RNA, 13 nt, Homo sapiens
uguugacaugugc

SEQ ID NO: 1649658 - RNA, 18 nt, Homo sapiens
uguuggaaaaugugcaau

SEQ ID NO: 1649659 - RNA, 20 nt, Homo sapiens
uguuggccaaagccaaagcu

SEQ ID NO: 1649660 - RNA, 15 nt, Homo sapiens
uguuggccaguguga

SEQ ID NO: 1649661 - RNA, 20 nt, Homo sapiens
uguuucaauugcaucuccca

SEQ ID NO: 1649662 - RNA, 22 nt, Homo sapiens
uguuucccaucacuguauccau

SEQ ID NO: 1649663 - RNA, 18 nt, Homo sapiens
uguuucugaucugaugca

SEQ ID NO: 1649664 - RNA, 18 nt, Homo sapiens
uguuuggaauauuccacu

SEQ ID NO: 1649665 - RNA, 20 nt, Homo sapiens
uguuuggaauauuccacuau

SEQ ID NO: 1649666 - RNA, 21 nt, Homo sapiens
ucauuuacuguggcuucuuaa

SEQ ID NO: 1649667 - RNA, 22 nt, Homo sapiens
ucauuuacuuuuaaacuuugau

SEQ ID NO: 1649668 - RNA, 23 nt, Homo sapiens
ucauuucaggagcagccucagaa

SEQ ID NO: 1649669 - RNA, 22 nt, Homo sapiens
ucauuuggguuaauauggcucu

SEQ ID NO: 1649670 - RNA, 23 nt, Homo sapiens
uccaaaaagaggagaugacuaca

SEQ ID NO: 1649671 - RNA, 21 nt, Homo sapiens
uccaaauaaaaauaacaucau

SEQ ID NO: 1649672 - RNA, 23 nt, Homo sapiens
uccaaauuuaaccauaaaucaau

SEQ ID NO: 1649673 - RNA, 21 nt, Homo sapiens
uccaaggaaaccacagcugcu

SEQ ID NO: 1649674 - RNA, 13 nt, Homo sapiens
uccaaucauacaa

SEQ ID NO: 1649675 - RNA, 11 nt, Homo sapiens
uccaaugcaca

SEQ ID NO: 1649676 - RNA, 18 nt, Homo sapiens
uccaaugcacaguugcca

SEQ ID NO: 1649677 - RNA, 12 nt, Homo sapiens
uccacaacacac

SEQ ID NO: 1649678 - RNA, 22 nt, Homo sapiens
uccacaccugcggcccaaucca

SEQ ID NO: 1649679 - RNA, 18 nt, Homo sapiens
uccacagaacuagccuua

SEQ ID NO: 1649680 - RNA, 17 nt, Homo sapiens
uccacagugacuccacu

SEQ ID NO: 1649681 - RNA, 13 nt, Homo sapiens
uccacaguggaac

SEQ ID NO: 1649682 - RNA, 11 nt, Homo sapiens
uccacccacag

SEQ ID NO: 1649683 - RNA, 15 nt, Homo sapiens
uccaccugccaggga

SEQ ID NO: 1649684 - RNA, 18 nt, Homo sapiens
uccacgcggccaccucac

SEQ ID NO: 1649685 - RNA, 18 nt, Homo sapiens
uccacguguaugcaagug

SEQ ID NO: 1649686 - RNA, 15 nt, Homo sapiens
uccacucccaggcag

SEQ ID NO: 1649687 - RNA, 15 nt, Homo sapiens
uccacugugccaugu

SEQ ID NO: 1649688 - RNA, 22 nt, Homo sapiens
uccacuuguucauucugugacc

SEQ ID NO: 1649689 - RNA, 18 nt, Homo sapiens
uccagagacugggacuaa

SEQ ID NO: 1649690 - RNA, 14 nt, Homo sapiens
uccagagcugcuuc

SEQ ID NO: 1649691 - RNA, 19 nt, Homo sapiens
uccagcaaacaaaauggac

SEQ ID NO: 1649692 - RNA, 22 nt, Homo sapiens
uccagcuggccgggagccugau

SEQ ID NO: 1649693 - RNA, 19 nt, Homo sapiens
uccagggcuggacugaggc

SEQ ID NO: 1649694 - RNA, 20 nt, Homo sapiens
uccaggggugggacacccug

SEQ ID NO: 1649695 - RNA, 18 nt, Homo sapiens
uccaggguccacaggaag

SEQ ID NO: 1649696 - RNA, 17 nt, Homo sapiens
uccaguaguuagcuuuc

SEQ ID NO: 1649697 - RNA, 14 nt, Homo sapiens
uccagugcugcaug

SEQ ID NO: 1649698 - RNA, 16 nt, Homo sapiens
uccaugauguuuucca

SEQ ID NO: 1649699 - RNA, 15 nt, Homo sapiens
uccauguguaucugg

SEQ ID NO: 1649700 - RNA, 14 nt, Homo sapiens
ucccacagcacuaa

SEQ ID NO: 1649701 - RNA, 14 nt, Homo sapiens
ucccaccucagccu

SEQ ID NO: 1649702 - RNA, 21 nt, Homo sapiens
ucccagauuggcucacacuga

SEQ ID NO: 1649703 - RNA, 14 nt, Homo sapiens
ucccaggaguacac

SEQ ID NO: 1649704 - RNA, 23 nt, Homo sapiens
ucccaggaguacaccccaacagc

SEQ ID NO: 1649705 - RNA, 20 nt, Homo sapiens
ucccaggcuggagugcagug

SEQ ID NO: 1649706 - RNA, 15 nt, Homo sapiens
ucccaucugugaaag

SEQ ID NO: 1649707 - RNA, 13 nt, Homo sapiens
uccccaagccugg

SEQ ID NO: 1649708 - RNA, 14 nt, Homo sapiens
uccccagacuucau

SEQ ID NO: 1649709 - RNA, 12 nt, Homo sapiens
ucccccacugau

SEQ ID NO: 1649710 - RNA, 22 nt, Homo sapiens
ucccuaucuuugccacccucau

SEQ ID NO: 1649711 - RNA, 13 nt, Homo sapiens
ucccucauccuca

SEQ ID NO: 1649712 - RNA, 20 nt, Homo sapiens
ucccugauaacaaccuggag

SEQ ID NO: 1649713 - RNA, 13 nt, Homo sapiens
ucccuuggacauu

SEQ ID NO: 1649714 - RNA, 22 nt, Homo sapiens
ucccuuuucuuuaaguuuuauu

SEQ ID NO: 1649715 - RNA, 13 nt, Homo sapiens
uccgcacaccucu

SEQ ID NO: 1649716 - RNA, 13 nt, Homo sapiens
uccgccugccuca

SEQ ID NO: 1649717 - RNA, 14 nt, Homo sapiens
uccggggugcaaug

SEQ ID NO: 1649718 - RNA, 19 nt, Homo sapiens
uccuaaccuuccuguaaac

SEQ ID NO: 1649719 - RNA, 15 nt, Homo sapiens
uccuaagccauaaaa

SEQ ID NO: 1649720 - RNA, 22 nt, Homo sapiens
uccuaagccaugggagacacug

SEQ ID NO: 1649721 - RNA, 18 nt, Homo sapiens
uccuaauuccacagcugc

SEQ ID NO: 1649722 - RNA, 23 nt, Homo sapiens
uccuaauuccacagcugcucaau

SEQ ID NO: 1649723 - RNA, 22 nt, Homo sapiens
ucaaagaaauuuccacucaggu

SEQ ID NO: 1649724 - RNA, 21 nt, Homo sapiens
ucaaagcacuguuucucucac

SEQ ID NO: 1649725 - RNA, 22 nt, Homo sapiens
ucaaaguuuugaaaagcuauua

SEQ ID NO: 1649726 - RNA, 18 nt, Homo sapiens
ucaaaugugacauuauau

SEQ ID NO: 1649727 - RNA, 12 nt, Homo sapiens
ucaaauguucuc

SEQ ID NO: 1649728 - RNA, 18 nt, Homo sapiens
ucaaauguucuccaguca

SEQ ID NO: 1649729 - RNA, 19 nt, Homo sapiens
ucaacagaaauauucuaca

SEQ ID NO: 1649730 - RNA, 19 nt, Homo sapiens
ucaacauuccugccccaga

SEQ ID NO: 1649731 - RNA, 21 nt, Homo sapiens
ucaaccccaaauuuuuacgua

SEQ ID NO: 1649732 - RNA, 13 nt, Homo sapiens
ucaagcagguuuc

SEQ ID NO: 1649733 - RNA, 18 nt, Homo sapiens
ucaaggaauaaugggcuu

SEQ ID NO: 1649734 - RNA, 12 nt, Homo sapiens
ucaaggcacugc

SEQ ID NO: 1649735 - RNA, 18 nt, Homo sapiens
ucaaguacuguaacugug

SEQ ID NO: 1649736 - RNA, 19 nt, Homo sapiens
ucaaguacuguaacugugu

SEQ ID NO: 1649737 - RNA, 11 nt, Homo sapiens
ucaaguuccag

SEQ ID NO: 1649738 - RNA, 16 nt, Homo sapiens
ucaaguuggcuucuaa

SEQ ID NO: 1649739 - RNA, 20 nt, Homo sapiens
ucaaguuggcuucuaaucaa

SEQ ID NO: 1649740 - RNA, 16 nt, Homo sapiens
ucaauacuuacauauc

SEQ ID NO: 1649741 - RNA, 19 nt, Homo sapiens
ucaauacuuacauaucuga

SEQ ID NO: 1649742 - RNA, 18 nt, Homo sapiens
ucaaucucugauucuguc

SEQ ID NO: 1649743 - RNA, 17 nt, Homo sapiens
ucaaucuggauucauau

SEQ ID NO: 1649744 - RNA, 14 nt, Homo sapiens
ucaaugaaauggau

SEQ ID NO: 1649745 - RNA, 22 nt, Homo sapiens
ucaaugcuauaacuauguugau

SEQ ID NO: 1649746 - RNA, 14 nt, Homo sapiens
ucaauucugucuca

SEQ ID NO: 1649747 - RNA, 13 nt, Homo sapiens
ucaauuugcugaa

SEQ ID NO: 1649748 - RNA, 19 nt, Homo sapiens
ucacacaugccacuaugag

SEQ ID NO: 1649749 - RNA, 18 nt, Homo sapiens
ucacacgggggcagcuga

SEQ ID NO: 1649750 - RNA, 19 nt, Homo sapiens
ucacacgguuugaagccug

SEQ ID NO: 1649751 - RNA, 23 nt, Homo sapiens
ucacacugggacuugcaaaaagg

SEQ ID NO: 1649752 - RNA, 21 nt, Homo sapiens
ucacagagauaauucuagcuu

SEQ ID NO: 1649753 - RNA, 23 nt, Homo sapiens
ucacagaugcuguguaacagaac

SEQ ID NO: 1649754 - RNA, 16 nt, Homo sapiens
ucacagaugugugauu

SEQ ID NO: 1649755 - RNA, 19 nt, Homo sapiens
ucacagcuaagaugccaug

SEQ ID NO: 1649756 - RNA, 19 nt, Homo sapiens
ucacaguaaugcaagcaaa

SEQ ID NO: 1649757 - RNA, 15 nt, Homo sapiens
ucacaguuucuucca

SEQ ID NO: 1649758 - RNA, 20 nt, Homo sapiens
ucacaucaugcuguuuuauc

SEQ ID NO: 1649759 - RNA, 17 nt, Homo sapiens
ucacaugucaguaccuu

SEQ ID NO: 1649760 - RNA, 20 nt, Homo sapiens
ucaccauuuggcaaugccau

SEQ ID NO: 1649761 - RNA, 23 nt, Homo sapiens
ucaccauuuggcaaugccaucau

SEQ ID NO: 1649762 - RNA, 14 nt, Homo sapiens
ucacccaaugcaua

SEQ ID NO: 1649763 - RNA, 19 nt, Homo sapiens
ucacccaggcuggagugca

SEQ ID NO: 1649764 - RNA, 16 nt, Homo sapiens
ucaccgaggacaugaa

SEQ ID NO: 1649765 - RNA, 17 nt, Homo sapiens
ucaccgaggacaugaaa

SEQ ID NO: 1649766 - RNA, 12 nt, Homo sapiens
ucaccucaauau

SEQ ID NO: 1649767 - RNA, 21 nt, Homo sapiens
ucacgauugucaucaggagaa

SEQ ID NO: 1649768 - RNA, 15 nt, Homo sapiens
ucacuacuacaucug

SEQ ID NO: 1649769 - RNA, 13 nt, Homo sapiens
ucacuauggugcc

SEQ ID NO: 1649770 - RNA, 18 nt, Homo sapiens
ucacucaaucucugauuc

SEQ ID NO: 1649771 - RNA, 15 nt, Homo sapiens
ucacugaacuuugcu

SEQ ID NO: 1649772 - RNA, 22 nt, Homo sapiens
ucacugcugcaaauacuguaua

SEQ ID NO: 1649773 - RNA, 15 nt, Homo sapiens
ucacuggcuguuaau

SEQ ID NO: 1649774 - RNA, 20 nt, Homo sapiens
ucacuggcuguuaaucuuuc

SEQ ID NO: 1649775 - RNA, 21 nt, Homo sapiens
ucacugggccuccaaccaugu

SEQ ID NO: 1649776 - RNA, 24 nt, Homo sapiens
ucacugugcuuauuuuguuucaau

SEQ ID NO: 1649777 - RNA, 12 nt, Homo sapiens
ucacuugcacau

SEQ ID NO: 1649778 - RNA, 20 nt, Homo sapiens
ucacuugcuggcugugaaac

SEQ ID NO: 1649779 - RNA, 16 nt, Homo sapiens
uagagguacuuuccac

SEQ ID NO: 1649780 - RNA, 15 nt, Homo sapiens
uagauaccacuuaac

SEQ ID NO: 1649781 - RNA, 14 nt, Homo sapiens
uagaugaaugucag

SEQ ID NO: 1649782 - RNA, 18 nt, Homo sapiens
uagauguggccuuugaau

SEQ ID NO: 1649783 - RNA, 14 nt, Homo sapiens
uagauuaggauuaa

SEQ ID NO: 1649784 - RNA, 18 nt, Homo sapiens
uagauuucucauuugcca

SEQ ID NO: 1649785 - RNA, 21 nt, Homo sapiens
uagcaacuuguguuacaaaaa

SEQ ID NO: 1649786 - RNA, 16 nt, Homo sapiens
uagcacagacccugcc

SEQ ID NO: 1649787 - RNA, 22 nt, Homo sapiens
uagcagaugcuggucauguguu

SEQ ID NO: 1649788 - RNA, 18 nt, Homo sapiens
uagcagcacagcugccaa

SEQ ID NO: 1649789 - RNA, 13 nt, Homo sapiens
uagcaugaugaaa

SEQ ID NO: 1649790 - RNA, 23 nt, Homo sapiens
uagccaguugaauuuauggaauc

SEQ ID NO: 1649791 - RNA, 16 nt, Homo sapiens
uagccgaaaugaucuu

SEQ ID NO: 1649792 - RNA, 14 nt, Homo sapiens
uagcgucaguauuu

SEQ ID NO: 1649793 - RNA, 17 nt, Homo sapiens
uagcuacaucaguuuga

SEQ ID NO: 1649794 - RNA, 17 nt, Homo sapiens
uagcugggacuacaggc

SEQ ID NO: 1649795 - RNA, 23 nt, Homo sapiens
uaggguacucaucugacuugaac

SEQ ID NO: 1649796 - RNA, 12 nt, Homo sapiens
uaguaacaugug

SEQ ID NO: 1649797 - RNA, 22 nt, Homo sapiens
uagucacagagauaauucuagc

SEQ ID NO: 1649798 - RNA, 19 nt, Homo sapiens
uaguccagugguccaacua

SEQ ID NO: 1649799 - RNA, 18 nt, Homo sapiens
uagugaucacagcagcuu

SEQ ID NO: 1649800 - RNA, 15 nt, Homo sapiens
uagugccaccacagc

SEQ ID NO: 1649801 - RNA, 16 nt, Homo sapiens
uaguggaagcuucuaa

SEQ ID NO: 1649802 - RNA, 13 nt, Homo sapiens
uaguuaaguuaag

SEQ ID NO: 1649803 - RNA, 15 nt, Homo sapiens
uaguucucagcucuu

SEQ ID NO: 1649804 - RNA, 13 nt, Homo sapiens
uauaaaaguacua

SEQ ID NO: 1649805 - RNA, 19 nt, Homo sapiens
uauaaaauuuacugucuaa

SEQ ID NO: 1649806 - RNA, 19 nt, Homo sapiens
uauaaagauuaacacucau

SEQ ID NO: 1649807 - RNA, 17 nt, Homo sapiens
uauaaauauccugcuca

SEQ ID NO: 1649808 - RNA, 22 nt, Homo sapiens
uauaaauauccugcucacaucu

SEQ ID NO: 1649809 - RNA, 11 nt, Homo sapiens
uauaacagugu

SEQ ID NO: 1649810 - RNA, 13 nt, Homo sapiens
uauaacaguguuu

SEQ ID NO: 1649811 - RNA, 19 nt, Homo sapiens
uauaaugggauauaguuua

SEQ ID NO: 1649812 - RNA, 10 nt, Homo sapiens
uauacauuug

SEQ ID NO: 1649813 - RNA, 13 nt, Homo sapiens
uauaccuuacugc

SEQ ID NO: 1649814 - RNA, 14 nt, Homo sapiens
uauagauuugaccu

SEQ ID NO: 1649815 - RNA, 16 nt, Homo sapiens
uauagcugcuuggauu

SEQ ID NO: 1649816 - RNA, 18 nt, Homo sapiens
uauaggucauacaaucca

SEQ ID NO: 1649817 - RNA, 17 nt, Homo sapiens
uauaguuaauaaucuau

SEQ ID NO: 1649818 - RNA, 18 nt, Homo sapiens
uauauauuuuugugcaca

SEQ ID NO: 1649819 - RNA, 21 nt, Homo sapiens
uauauccgccuggcauuucac

SEQ ID NO: 1649820 - RNA, 22 nt, Homo sapiens
uauauccgccuggcauuucaca

SEQ ID NO: 1649821 - RNA, 16 nt, Homo sapiens
uauaugcuaagucuua

SEQ ID NO: 1649822 - RNA, 21 nt, Homo sapiens
uauauuacuugccuaucugac

SEQ ID NO: 1649823 - RNA, 19 nt, Homo sapiens
uauauuuuuugaacuuugu

SEQ ID NO: 1649824 - RNA, 17 nt, Homo sapiens
uaucaccgugggcuccc

SEQ ID NO: 1649825 - RNA, 15 nt, Homo sapiens
uaucaccuuccaaac

SEQ ID NO: 1649826 - RNA, 14 nt, Homo sapiens
uaucaggugcugcc

SEQ ID NO: 1649827 - RNA, 20 nt, Homo sapiens
uauccucugaccuacauacg

SEQ ID NO: 1649828 - RNA, 19 nt, Homo sapiens
uauccuguuuuuaaaccau

SEQ ID NO: 1649829 - RNA, 21 nt, Homo sapiens
uaucgaaauaacaauguuaag

SEQ ID NO: 1649830 - RNA, 23 nt, Homo sapiens
uaucuaauauguaacaagccacc

SEQ ID NO: 1649831 - RNA, 19 nt, Homo sapiens
uaucuaauuugugccucac

SEQ ID NO: 1649832 - RNA, 21 nt, Homo sapiens
uaucuauggcacccaugcacc

SEQ ID NO: 1649833 - RNA, 16 nt, Homo sapiens
uaucuauguagaauau

SEQ ID NO: 1649834 - RNA, 16 nt, Homo sapiens
guaacauuaguuuuaa

SEQ ID NO: 1649835 - RNA, 23 nt, Homo sapiens
guaacuguuuagaugaaugucag

SEQ ID NO: 1649836 - RNA, 18 nt, Homo sapiens
guaagcaaagacuuuccu

SEQ ID NO: 1649837 - RNA, 16 nt, Homo sapiens
guaaguuaucuuugaa

SEQ ID NO: 1649838 - RNA, 20 nt, Homo sapiens
guaaucccagcuacuuggga

SEQ ID NO: 1649839 - RNA, 17 nt, Homo sapiens
guaauucucaggccauc

SEQ ID NO: 1649840 - RNA, 13 nt, Homo sapiens
guaauugcauuau

SEQ ID NO: 1649841 - RNA, 18 nt, Homo sapiens
guacagguuuugcccuga

SEQ ID NO: 1649842 - RNA, 16 nt, Homo sapiens
guaccaaaucugacau

SEQ ID NO: 1649843 - RNA, 18 nt, Homo sapiens
guaccugcccccaaucca

SEQ ID NO: 1649844 - RNA, 13 nt, Homo sapiens
guaccugugcacg

SEQ ID NO: 1649845 - RNA, 15 nt, Homo sapiens
guacgaugacagugu

SEQ ID NO: 1649846 - RNA, 21 nt, Homo sapiens
guacuggggugggaucuugga

SEQ ID NO: 1649847 - RNA, 21 nt, Homo sapiens
guacuuuuuguuccagagcug

SEQ ID NO: 1649848 - RNA, 19 nt, Homo sapiens
guagaaaagggaacugaac

SEQ ID NO: 1649849 - RNA, 20 nt, Homo sapiens
guagaaagugauccauacuu

SEQ ID NO: 1649850 - RNA, 22 nt, Homo sapiens
guagcaguaucucauugcuguu

SEQ ID NO: 1649851 - RNA, 20 nt, Homo sapiens
guagguuggaagcuagcucc

SEQ ID NO: 1649852 - RNA, 22 nt, Homo sapiens
guauaagugguguguguaugcg

SEQ ID NO: 1649853 - RNA, 12 nt, Homo sapiens
guauaauggggc

SEQ ID NO: 1649854 - RNA, 17 nt, Homo sapiens
guauaugagacuuucaa

SEQ ID NO: 1649855 - RNA, 15 nt, Homo sapiens
guaucaggacccaga

SEQ ID NO: 1649856 - RNA, 19 nt, Homo sapiens
guaugauccuaaugaaugc

SEQ ID NO: 1649857 - RNA, 15 nt, Homo sapiens
guauguuugggagac

SEQ ID NO: 1649858 - RNA, 20 nt, Homo sapiens
guauuaacuuuauacacuug

SEQ ID NO: 1649859 - RNA, 15 nt, Homo sapiens
guauuaaguuguuaa

SEQ ID NO: 1649860 - RNA, 15 nt, Homo sapiens
guauuagccagucau

SEQ ID NO: 1649861 - RNA, 12 nt, Homo sapiens
guauuagucaca

SEQ ID NO: 1649862 - RNA, 13 nt, Homo sapiens
guauugugcauag

SEQ ID NO: 1649863 - RNA, 19 nt, Homo sapiens
gucaccucaauauuuacua

SEQ ID NO: 1649864 - RNA, 18 nt, Homo sapiens
gucacuauaggucauaca

SEQ ID NO: 1649865 - RNA, 13 nt, Homo sapiens
gucacuucaccau

SEQ ID NO: 1649866 - RNA, 20 nt, Homo sapiens
gucacuucgugggaucugcc

SEQ ID NO: 1649867 - RNA, 20 nt, Homo sapiens
gucacuugcuggcugugaaa

SEQ ID NO: 1649868 - RNA, 17 nt, Homo sapiens
gucagcaacagagcaaa

SEQ ID NO: 1649869 - RNA, 21 nt, Homo sapiens
gucaguaacuuacccuuaggg

SEQ ID NO: 1649870 - RNA, 23 nt, Homo sapiens
gucaucaggagaaaaagccucca

SEQ ID NO: 1649871 - RNA, 21 nt, Homo sapiens
gucaugcauaaauaugcagug

SEQ ID NO: 1649872 - RNA, 19 nt, Homo sapiens
guccaaggaaaccacagcu

SEQ ID NO: 1649873 - RNA, 19 nt, Homo sapiens
guccaaguggcugugacau

SEQ ID NO: 1649874 - RNA, 17 nt, Homo sapiens
guccacaggaagugaag

SEQ ID NO: 1649875 - RNA, 14 nt, Homo sapiens
guccacaguggaac

SEQ ID NO: 1649876 - RNA, 14 nt, Homo sapiens
guccaccaccaccu

SEQ ID NO: 1649877 - RNA, 24 nt, Homo sapiens
guccacgagcuguuuacuagggau

SEQ ID NO: 1649878 - RNA, 17 nt, Homo sapiens
guccauuguccaauccu

SEQ ID NO: 1649879 - RNA, 16 nt, Homo sapiens
gucccagccacagugu

SEQ ID NO: 1649880 - RNA, 13 nt, Homo sapiens
gucccccuuccau

SEQ ID NO: 1649881 - RNA, 19 nt, Homo sapiens
guccccuucucucaucucu

SEQ ID NO: 1649882 - RNA, 23 nt, Homo sapiens
guccucuggguaggaaucagcaa

SEQ ID NO: 1649883 - RNA, 12 nt, Homo sapiens
guccugcccuug

SEQ ID NO: 1649884 - RNA, 20 nt, Homo sapiens
guccuuagccccaucugcca

SEQ ID NO: 1649885 - RNA, 21 nt, Homo sapiens
gucgcuggguccucugcagug

SEQ ID NO: 1649886 - RNA, 14 nt, Homo sapiens
gucgugagugucuc

SEQ ID NO: 1649887 - RNA, 15 nt, Homo sapiens
aauguucacuuuuga

SEQ ID NO: 1649888 - RNA, 20 nt, Homo sapiens
aauguucuauuuaacaacug

SEQ ID NO: 1649889 - RNA, 17 nt, Homo sapiens
aauguucuccagucauu

SEQ ID NO: 1649890 - RNA, 21 nt, Homo sapiens
aauguucuccagucauuaugu

SEQ ID NO: 1649891 - RNA, 15 nt, Homo sapiens
aauguuuaaacauuu

SEQ ID NO: 1649892 - RNA, 19 nt, Homo sapiens
aauuaaaauccucaaucca

SEQ ID NO: 1649893 - RNA, 12 nt, Homo sapiens
aauuaacacugc

SEQ ID NO: 1649894 - RNA, 15 nt, Homo sapiens
aauuaacugcuccaa

SEQ ID NO: 1649895 - RNA, 21 nt, Homo sapiens
aauuaauuugugaauuugcaa

SEQ ID NO: 1649896 - RNA, 11 nt, Homo sapiens
aauuaccaugc

SEQ ID NO: 1649897 - RNA, 16 nt, Homo sapiens
aauuagaaauaucuuc

SEQ ID NO: 1649898 - RNA, 13 nt, Homo sapiens
aauuagaccuagg

SEQ ID NO: 1649899 - RNA, 11 nt, Homo sapiens
aauuagcucac

SEQ ID NO: 1649900 - RNA, 18 nt, Homo sapiens
aauucaacauauaccuua

SEQ ID NO: 1649901 - RNA, 21 nt, Homo sapiens
aauucccuucaucuggaacca

SEQ ID NO: 1649902 - RNA, 19 nt, Homo sapiens
aauucuauuacgugcaaua

SEQ ID NO: 1649903 - RNA, 17 nt, Homo sapiens
aauucucauuugucaca

SEQ ID NO: 1649904 - RNA, 16 nt, Homo sapiens
aauucuccugccucag

SEQ ID NO: 1649905 - RNA, 19 nt, Homo sapiens
aauucugauguuacugaga

SEQ ID NO: 1649906 - RNA, 15 nt, Homo sapiens
aauugagaccacagg

SEQ ID NO: 1649907 - RNA, 14 nt, Homo sapiens
aauuggaaucuuca

SEQ ID NO: 1649908 - RNA, 15 nt, Homo sapiens
aauuggccaucuuaa

SEQ ID NO: 1649909 - RNA, 19 nt, Homo sapiens
aauuguauuacaaauccaa

SEQ ID NO: 1649910 - RNA, 15 nt, Homo sapiens
aauuguuuggggaug

SEQ ID NO: 1649911 - RNA, 14 nt, Homo sapiens
aauuuaaaaauccu

SEQ ID NO: 1649912 - RNA, 13 nt, Homo sapiens
aauuuaaccauaa

SEQ ID NO: 1649913 - RNA, 15 nt, Homo sapiens
aauuuagucccuuaa

SEQ ID NO: 1649914 - RNA, 14 nt, Homo sapiens
aauuucauuuuccu

SEQ ID NO: 1649915 - RNA, 18 nt, Homo sapiens
aauuuccuuacucuugau

SEQ ID NO: 1649916 - RNA, 14 nt, Homo sapiens
aauuucuacuuuga

SEQ ID NO: 1649917 - RNA, 18 nt, Homo sapiens
aauuucucuacugucuca

SEQ ID NO: 1649918 - RNA, 23 nt, Homo sapiens
aauuucugugucuaaauuucuuc

SEQ ID NO: 1649919 - RNA, 23 nt, Homo sapiens
aauuugcaacaguaaucagaguu

SEQ ID NO: 1649920 - RNA, 14 nt, Homo sapiens
aauuuggagucuga

SEQ ID NO: 1649921 - RNA, 21 nt, Homo sapiens
aauuugguuuguuaauucuua

SEQ ID NO: 1649922 - RNA, 15 nt, Homo sapiens
aauuuuccugugaca

SEQ ID NO: 1649923 - RNA, 13 nt, Homo sapiens
aauuuucuuccaa

SEQ ID NO: 1649924 - RNA, 16 nt, Homo sapiens
aauuuugucuuuauga

SEQ ID NO: 1649925 - RNA, 16 nt, Homo sapiens
aauuuuucaguguuga

SEQ ID NO: 1649926 - RNA, 14 nt, Homo sapiens
acaaaaauuugcca

SEQ ID NO: 1649927 - RNA, 16 nt, Homo sapiens
acaaaacugccaaaaa

SEQ ID NO: 1649928 - RNA, 22 nt, Homo sapiens
acaaaaggcuuuggcaacagaa

SEQ ID NO: 1649929 - RNA, 16 nt, Homo sapiens
acaaaauauauuuugu

SEQ ID NO: 1649930 - RNA, 12 nt, Homo sapiens
acaaacagugaa

SEQ ID NO: 1649931 - RNA, 12 nt, Homo sapiens
acaaacaugugg

SEQ ID NO: 1649932 - RNA, 14 nt, Homo sapiens
acaaacaugugguu

SEQ ID NO: 1649933 - RNA, 13 nt, Homo sapiens
acaaaccaaccau

SEQ ID NO: 1649934 - RNA, 18 nt, Homo sapiens
acaaaggagauaaaucua

SEQ ID NO: 1649935 - RNA, 22 nt, Homo sapiens
acaaauaaucaaaacccaacau

SEQ ID NO: 1649936 - RNA, 15 nt, Homo sapiens
acaaauacuauccaa

SEQ ID NO: 1649937 - RNA, 16 nt, Homo sapiens
acaacaaacacuguga

SEQ ID NO: 1649938 - RNA, 17 nt, Homo sapiens
acaagacccucucaggc

SEQ ID NO: 1649939 - RNA, 15 nt, Homo sapiens
acaagagggacaagu

SEQ ID NO: 1649940 - RNA, 22 nt, Homo sapiens
acaagagugagacuccaccuca

SEQ ID NO: 1649941 - RNA, 18 nt, Homo sapiens
acaagcacuaaacaaaga

SEQ ID NO: 1649942 - RNA, 19 nt, Homo sapiens
acaauaacgauaaaagaca

SEQ ID NO: 1649943 - RNA, 19 nt, Homo sapiens
acaaucaucaucauucuca

SEQ ID NO: 1649944 - RNA, 19 nt, Homo sapiens
acaaugacuuguacucuga

SEQ ID NO: 1649945 - RNA, 15 nt, Homo sapiens
acaauggagugugua

SEQ ID NO: 1649946 - RNA, 18 nt, Homo sapiens
acaauguacaagguaugu

SEQ ID NO: 1649947 - RNA, 12 nt, Homo sapiens
acaauguugcac

SEQ ID NO: 1649948 - RNA, 12 nt, Homo sapiens
acacaacaugua

SEQ ID NO: 1649949 - RNA, 14 nt, Homo sapiens
acacacacauacag

SEQ ID NO: 1649950 - RNA, 13 nt, Homo sapiens
acacacagugauu

SEQ ID NO: 1649951 - RNA, 19 nt, Homo sapiens
acacaccccaacaugccug

SEQ ID NO: 1649952 - RNA, 18 nt, Homo sapiens
acacacugagacuugaau

SEQ ID NO: 1649953 - RNA, 17 nt, Homo sapiens
acacagaggggagucac

SEQ ID NO: 1649954 - RNA, 18 nt, Homo sapiens
acacagauuugagcucag

SEQ ID NO: 1649955 - RNA, 14 nt, Homo sapiens
acacagcucccaua

SEQ ID NO: 1649956 - RNA, 20 nt, Homo sapiens
acacagcugaugaacugugg

SEQ ID NO: 1649957 - RNA, 17 nt, Homo sapiens
acacaguauuacuucug

SEQ ID NO: 1649958 - RNA, 11 nt, Homo sapiens
acacagugauu

SEQ ID NO: 1649959 - RNA, 17 nt, Homo sapiens
acacaugacacucuucu

SEQ ID NO: 1649960 - RNA, 11 nt, Homo sapiens
acacauuccau

SEQ ID NO: 1649961 - RNA, 19 nt, Homo sapiens
acaccagagcagaugcaga

SEQ ID NO: 1649962 - RNA, 16 nt, Homo sapiens
acaccagguagaacac

SEQ ID NO: 1649963 - RNA, 22 nt, Homo sapiens
acacccccaccccuugcucuca

SEQ ID NO: 1649964 - RNA, 14 nt, Homo sapiens
acaccguucauuca

SEQ ID NO: 1649965 - RNA, 19 nt, Homo sapiens
acaccuccaaugcugccug

SEQ ID NO: 1649966 - RNA, 13 nt, Homo sapiens
acacgaagaccau

SEQ ID NO: 1649967 - RNA, 23 nt, Homo sapiens
acacuaacgauuuguuaaugaua

SEQ ID NO: 1649968 - RNA, 17 nt, Homo sapiens
acacuaauacaccaggu

SEQ ID NO: 1649969 - RNA, 19 nt, Homo sapiens
acacucccuucccaugacc

SEQ ID NO: 1649970 - RNA, 15 nt, Homo sapiens
acacugaaaaggaaa

SEQ ID NO: 1649971 - RNA, 22 nt, Homo sapiens
acacugaucugcuagugcugua

SEQ ID NO: 1649972 - RNA, 22 nt, Homo sapiens
acacugcacagaagacagcagc

SEQ ID NO: 1649973 - RNA, 21 nt, Homo sapiens
accauaagugacaccaauaaa

SEQ ID NO: 1649974 - RNA, 15 nt, Homo sapiens
accauagcuacauca

SEQ ID NO: 1649975 - RNA, 14 nt, Homo sapiens
accaucaagccacc

SEQ ID NO: 1649976 - RNA, 23 nt, Homo sapiens
accaucugugcacgcaguggccu

SEQ ID NO: 1649977 - RNA, 20 nt, Homo sapiens
accaugcagugccccuagcu

SEQ ID NO: 1649978 - RNA, 24 nt, Homo sapiens
accaugccucuccaacaucuucaa

SEQ ID NO: 1649979 - RNA, 14 nt, Homo sapiens
accaugcuucacaa

SEQ ID NO: 1649980 - RNA, 18 nt, Homo sapiens
accauuagcauuugucaa

SEQ ID NO: 1649981 - RNA, 21 nt, Homo sapiens
accauuucuagagagucuccu

SEQ ID NO: 1649982 - RNA, 16 nt, Homo sapiens
accauuuguauccacu

SEQ ID NO: 1649983 - RNA, 21 nt, Homo sapiens
accauuuugggguacccacug

SEQ ID NO: 1649984 - RNA, 21 nt, Homo sapiens
accauuuuguuauugacuaac

SEQ ID NO: 1649985 - RNA, 17 nt, Homo sapiens
acccaacucuguacaaa

SEQ ID NO: 1649986 - RNA, 16 nt, Homo sapiens
acccaccaucaugucu

SEQ ID NO: 1649987 - RNA, 12 nt, Homo sapiens
acccaccucagc

SEQ ID NO: 1649988 - RNA, 18 nt, Homo sapiens
acccacuucugcacuugc

SEQ ID NO: 1649989 - RNA, 22 nt, Homo sapiens
acccagaugggggaaagcacag

SEQ ID NO: 1649990 - RNA, 21 nt, Homo sapiens
acccaggucuugacaccagcu

SEQ ID NO: 1649991 - RNA, 23 nt, Homo sapiens
acccauugucuuuacuccaugaa

SEQ ID NO: 1649992 - RNA, 15 nt, Homo sapiens
accccaacagcaccc

SEQ ID NO: 1649993 - RNA, 18 nt, Homo sapiens
accccaacagcacccucu

SEQ ID NO: 1649994 - RNA, 22 nt, Homo sapiens
accccaacagcacccucuccag

SEQ ID NO: 1649995 - RNA, 20 nt, Homo sapiens
accccucaucaggaguucca

SEQ ID NO: 1649996 - RNA, 23 nt, Homo sapiens
accccuccucccuuuuuccuugu

SEQ ID NO: 1649997 - RNA, 20 nt, Homo sapiens
accccugaccccucauagcc

SEQ ID NO: 1649998 - RNA, 12 nt, Homo sapiens
aagucacacagu

SEQ ID NO: 1649999 - RNA, 22 nt, Homo sapiens
aagucuuccauagagacuuugu

SEQ ID NO: 1650000 - RNA, 14 nt, Homo sapiens
aagucuugcauuga

SEQ ID NO: 1650001 - RNA, 15 nt, Homo sapiens
aagugacuucacaga

SEQ ID NO: 1650002 - RNA, 20 nt, Homo sapiens
aagugagcuccuaagccaug

SEQ ID NO: 1650003 - RNA, 23 nt, Homo sapiens
aagugcugggauuacagguguga

SEQ ID NO: 1650004 - RNA, 23 nt, Homo sapiens
aaguggcucugggguccucacau

SEQ ID NO: 1650005 - RNA, 22 nt, Homo sapiens
aaguggggaccccaccccucau

SEQ ID NO: 1650006 - RNA, 13 nt, Homo sapiens
aagugugcaaaau

SEQ ID NO: 1650007 - RNA, 19 nt, Homo sapiens
aaguguuugaaagcuuuau

SEQ ID NO: 1650008 - RNA, 22 nt, Homo sapiens
aaguuagggaauggcacagccc

SEQ ID NO: 1650009 - RNA, 17 nt, Homo sapiens
aaguuccacuugguuca

SEQ ID NO: 1650010 - RNA, 19 nt, Homo sapiens
aaguuccacuugguucagg

SEQ ID NO: 1650011 - RNA, 19 nt, Homo sapiens
aaguugacaggcagugcca

SEQ ID NO: 1650012 - RNA, 14 nt, Homo sapiens
aaguuggcuucuaa

SEQ ID NO: 1650013 - RNA, 17 nt, Homo sapiens
aauaaaaccaagccucu

SEQ ID NO: 1650014 - RNA, 14 nt, Homo sapiens
aauaaauacuuaag

SEQ ID NO: 1650015 - RNA, 17 nt, Homo sapiens
aauaaaucacacauuca

SEQ ID NO: 1650016 - RNA, 13 nt, Homo sapiens
aauaaaugaacug

SEQ ID NO: 1650017 - RNA, 11 nt, Homo sapiens
aauaaauggaa

SEQ ID NO: 1650018 - RNA, 16 nt, Homo sapiens
aauaacaauaaaagac

SEQ ID NO: 1650019 - RNA, 16 nt, Homo sapiens
aauaacgauaaaagac

SEQ ID NO: 1650020 - RNA, 15 nt, Homo sapiens
aauaauaauaccucc

SEQ ID NO: 1650021 - RNA, 13 nt, Homo sapiens
aauaauccagaaa

SEQ ID NO: 1650022 - RNA, 23 nt, Homo sapiens
aauaauccucaguuuuugugaaa

SEQ ID NO: 1650023 - RNA, 21 nt, Homo sapiens
aauaauuuuccugugacacuu

SEQ ID NO: 1650024 - RNA, 20 nt, Homo sapiens
aauacagucuuccauuugca

SEQ ID NO: 1650025 - RNA, 23 nt, Homo sapiens
aauacuaccucacuacuacaucu

SEQ ID NO: 1650026 - RNA, 22 nt, Homo sapiens
aauacucagggaaagcauuuaa

SEQ ID NO: 1650027 - RNA, 14 nt, Homo sapiens
aauacucucugaaa

SEQ ID NO: 1650028 - RNA, 11 nt, Homo sapiens
aauacugagcc

SEQ ID NO: 1650029 - RNA, 14 nt, Homo sapiens
aauacugcagcuug

SEQ ID NO: 1650030 - RNA, 21 nt, Homo sapiens
aauacuggacucaggaacuuu

SEQ ID NO: 1650031 - RNA, 16 nt, Homo sapiens
aauacuggucucaggc

SEQ ID NO: 1650032 - RNA, 14 nt, Homo sapiens
aauagaacagagaa

SEQ ID NO: 1650033 - RNA, 14 nt, Homo sapiens
aauagcagcacagc

SEQ ID NO: 1650034 - RNA, 19 nt, Homo sapiens
aauaguuccugaacauugc

SEQ ID NO: 1650035 - RNA, 14 nt, Homo sapiens
aauauaaacacuau

SEQ ID NO: 1650036 - RNA, 20 nt, Homo sapiens
aauauaaauuuaucauuuag

SEQ ID NO: 1650037 - RNA, 22 nt, Homo sapiens
aauauaguugucuuucuuugcu

SEQ ID NO: 1650038 - RNA, 14 nt, Homo sapiens
aauauauauuuuag

SEQ ID NO: 1650039 - RNA, 15 nt, Homo sapiens
aauaucaugcuccau

SEQ ID NO: 1650040 - RNA, 23 nt, Homo sapiens
aauaucccuuggacauuuuaugu

SEQ ID NO: 1650041 - RNA, 22 nt, Homo sapiens
aauaucuaccccauuuggugaa

SEQ ID NO: 1650042 - RNA, 19 nt, Homo sapiens
aauaucuuuaaaugaugua

SEQ ID NO: 1650043 - RNA, 19 nt, Homo sapiens
aauaucuuuauugcaugag

SEQ ID NO: 1650044 - RNA, 19 nt, Homo sapiens
aauaugcaccaaaucaucu

SEQ ID NO: 1650045 - RNA, 23 nt, Homo sapiens
aauauuaaaaucacugucaauau

SEQ ID NO: 1650046 - RNA, 22 nt, Homo sapiens
aauauuccagagacugggacua

SEQ ID NO: 1650047 - RNA, 14 nt, Homo sapiens
aauauucuacacau

SEQ ID NO: 1650048 - RNA, 22 nt, Homo sapiens
aauauuuguugagauuuugcag

SEQ ID NO: 1650049 - RNA, 19 nt, Homo sapiens
aauauuuuguuuugugcag

SEQ ID NO: 1650050 - RNA, 17 nt, Homo sapiens
aauauuuuuaugugcaa

SEQ ID NO: 1650051 - RNA, 20 nt, Homo sapiens
aaucaaaacccaacaugacu

SEQ ID NO: 1650052 - RNA, 13 nt, Homo sapiens
aaucaaagcagau

SEQ ID NO: 1650053 - RNA, 22 nt, Homo sapiens
aaucaaguuggcuucuaaucaa

SEQ ID NO: 1650054 - RNA, 18 nt, Homo sapiens
aaucagcaagaagauccu

SEQ ID NO: 1650055 - RNA, 22 nt, Homo sapiens
aaucaguguguuacuaucuaca

SEQ ID NO: 1650056 - RNA, 16 nt, Homo sapiens
aaucauacaaauacua

SEQ ID NO: 1650057 - RNA, 15 nt, Homo sapiens
aaucaucucucauca

SEQ ID NO: 1650058 - RNA, 14 nt, Homo sapiens
aauccacaucuuua

SEQ ID NO: 1650059 - RNA, 18 nt, Homo sapiens
aauccacaucuuuacuca

SEQ ID NO: 1650060 - RNA, 12 nt, Homo sapiens
aauccaugaacc

SEQ ID NO: 1650061 - RNA, 16 nt, Homo sapiens
aaucccaacauuucuc

SEQ ID NO: 1650062 - RNA, 17 nt, Homo sapiens
aaucucaauucuucccu

SEQ ID NO: 1650063 - RNA, 15 nt, Homo sapiens
aaucuccagucucau

SEQ ID NO: 1650064 - RNA, 15 nt, Homo sapiens
aaucuccugacuuca

SEQ ID NO: 1650065 - RNA, 14 nt, Homo sapiens
aaucuucaccucag

SEQ ID NO: 1650066 - RNA, 15 nt, Homo sapiens
aaucuucaccucaga

SEQ ID NO: 1650067 - RNA, 17 nt, Homo sapiens
aaucuucagaccuagaa

SEQ ID NO: 1650068 - RNA, 11 nt, Homo sapiens
aaucuuuccag

SEQ ID NO: 1650069 - RNA, 17 nt, Homo sapiens
aaucuuuccaguuagaa

SEQ ID NO: 1650070 - RNA, 15 nt, Homo sapiens
aaucuuuuacauuga

SEQ ID NO: 1650071 - RNA, 15 nt, Homo sapiens
aaugaaaugaguuuu

SEQ ID NO: 1650072 - RNA, 14 nt, Homo sapiens
aaugaaccccaguc

SEQ ID NO: 1650073 - RNA, 18 nt, Homo sapiens
aaugaaccccagucagcc

SEQ ID NO: 1650074 - RNA, 16 nt, Homo sapiens
aaugaaccgcugaaua

SEQ ID NO: 1650075 - RNA, 17 nt, Homo sapiens
aaugaaccgcugaauau

SEQ ID NO: 1650076 - RNA, 14 nt, Homo sapiens
aaugacucaaaguc

SEQ ID NO: 1650077 - RNA, 21 nt, Homo sapiens
aaugaugucguuugaaucaca

SEQ ID NO: 1650078 - RNA, 15 nt, Homo sapiens
aaugauuucacagug

SEQ ID NO: 1650079 - RNA, 15 nt, Homo sapiens
aaugcacaguugcca

SEQ ID NO: 1650080 - RNA, 14 nt, Homo sapiens
aaugcaccacuuuu

SEQ ID NO: 1650081 - RNA, 17 nt, Homo sapiens
aaugcagcauguugccc

SEQ ID NO: 1650082 - RNA, 19 nt, Homo sapiens
aaugcauuucuaaagccau

SEQ ID NO: 1650083 - RNA, 20 nt, Homo sapiens
aaugcccuuacacuuacugu

SEQ ID NO: 1650084 - RNA, 12 nt, Homo sapiens
aaugccuaccuu

SEQ ID NO: 1650085 - RNA, 22 nt, Homo sapiens
aauuaugcaucugcuacugugu

SEQ ID NO: 1650086 - RNA, 18 nt, Homo sapiens
aauucagggagugggcua

SEQ ID NO: 1650087 - RNA, 17 nt, Homo sapiens
aauucaucucucuuuaa

SEQ ID NO: 1650088 - RNA, 12 nt, Homo sapiens
aauucaugaaca

SEQ ID NO: 1650089 - RNA, 23 nt, Homo sapiens
aauuccaguggaacagucuuccc

SEQ ID NO: 1650090 - RNA, 15 nt, Homo sapiens
aauucccuucaucug

SEQ ID NO: 1650091 - RNA, 21 nt, Homo sapiens
aauucuauuacgugcaauacu

SEQ ID NO: 1650092 - RNA, 18 nt, Homo sapiens
aauucucauuugucacac

SEQ ID NO: 1650093 - RNA, 20 nt, Homo sapiens
aauucucauuugucacacac

SEQ ID NO: 1650094 - RNA, 18 nt, Homo sapiens
aauucuuacaaacaugug

SEQ ID NO: 1650095 - RNA, 13 nt, Homo sapiens
aauucuugccaaa

SEQ ID NO: 1650096 - RNA, 15 nt, Homo sapiens
aauugaaagaacuua

SEQ ID NO: 1650097 - RNA, 22 nt, Homo sapiens
aauugauuuugaaccugaugaa

SEQ ID NO: 1650098 - RNA, 13 nt, Homo sapiens
aauuggucauucc

SEQ ID NO: 1650099 - RNA, 22 nt, Homo sapiens
aauuggucauuccuaaugcauu

SEQ ID NO: 1650100 - RNA, 14 nt, Homo sapiens
aauugguucuucuc

SEQ ID NO: 1650101 - RNA, 18 nt, Homo sapiens
aauuguaucaaaugugac

SEQ ID NO: 1650102 - RNA, 12 nt, Homo sapiens
aauuuacuuugu

SEQ ID NO: 1650103 - RNA, 14 nt, Homo sapiens
aauuucagucaauu

SEQ ID NO: 1650104 - RNA, 17 nt, Homo sapiens
aauuucauuuuuuaugu

SEQ ID NO: 1650105 - RNA, 13 nt, Homo sapiens
aauuuccaugugu

SEQ ID NO: 1650106 - RNA, 20 nt, Homo sapiens
aauuuggagucugacugugc

SEQ ID NO: 1650107 - RNA, 14 nt, Homo sapiens
aauuuguauuuccc

SEQ ID NO: 1650108 - RNA, 15 nt, Homo sapiens
aauuuucccacugca

SEQ ID NO: 1650109 - RNA, 20 nt, Homo sapiens
acaaaauaaccaauccugga

SEQ ID NO: 1650110 - RNA, 21 nt, Homo sapiens
acaaaaugacauuuugccaaa

SEQ ID NO: 1650111 - RNA, 17 nt, Homo sapiens
acaaacaccuuauuugu

SEQ ID NO: 1650112 - RNA, 14 nt, Homo sapiens
acaaaccauuuugu

SEQ ID NO: 1650113 - RNA, 13 nt, Homo sapiens
acaaacucaccau

SEQ ID NO: 1650114 - RNA, 18 nt, Homo sapiens
acaaacuucuuucacuca

SEQ ID NO: 1650115 - RNA, 15 nt, Homo sapiens
acaaaggaggacaag

SEQ ID NO: 1650116 - RNA, 18 nt, Homo sapiens
acaaaugggaaaaccaga

SEQ ID NO: 1650117 - RNA, 21 nt, Homo sapiens
acaaaugugauaauauauugc

SEQ ID NO: 1650118 - RNA, 23 nt, Homo sapiens
acaaauuugggagggugagacac

SEQ ID NO: 1650119 - RNA, 15 nt, Homo sapiens
acaacaaacacugug

SEQ ID NO: 1650120 - RNA, 12 nt, Homo sapiens
acaacagccuga

SEQ ID NO: 1650121 - RNA, 13 nt, Homo sapiens
acaacaugguguc

SEQ ID NO: 1650122 - RNA, 17 nt, Homo sapiens
acaacauguauguggau

SEQ ID NO: 1650123 - RNA, 18 nt, Homo sapiens
acaagugauaauacagau

SEQ ID NO: 1650124 - RNA, 15 nt, Homo sapiens
acaauaaaacauuaa

SEQ ID NO: 1650125 - RNA, 13 nt, Homo sapiens
acaauaaaagaca

SEQ ID NO: 1650126 - RNA, 22 nt, Homo sapiens
acaauaagccacgaggugcagu

SEQ ID NO: 1650127 - RNA, 23 nt, Homo sapiens
acaauaguaauucucaggccauc

SEQ ID NO: 1650128 - RNA, 12 nt, Homo sapiens
acacaaggucau

SEQ ID NO: 1650129 - RNA, 15 nt, Homo sapiens
acacaaguuccugau

SEQ ID NO: 1650130 - RNA, 12 nt, Homo sapiens
acacacagcucu

SEQ ID NO: 1650131 - RNA, 12 nt, Homo sapiens
acacacagugau

SEQ ID NO: 1650132 - RNA, 14 nt, Homo sapiens
acacagcauuguau

SEQ ID NO: 1650133 - RNA, 21 nt, Homo sapiens
acacagcucuucuccaggcug

SEQ ID NO: 1650134 - RNA, 19 nt, Homo sapiens
acacagugaccauacuaau

SEQ ID NO: 1650135 - RNA, 20 nt, Homo sapiens
acacagugccuguaaaucuc

SEQ ID NO: 1650136 - RNA, 10 nt, Homo sapiens
acacauucca

SEQ ID NO: 1650137 - RNA, 21 nt, Homo sapiens
acacauugccccaugagacag

SEQ ID NO: 1650138 - RNA, 22 nt, Homo sapiens
acacauuuacacuagaggccag

SEQ ID NO: 1650139 - RNA, 22 nt, Homo sapiens
acaccagcuguucugucccuug

SEQ ID NO: 1650140 - RNA, 19 nt, Homo sapiens
acaccauucuccugccuca

SEQ ID NO: 1650141 - RNA, 14 nt, Homo sapiens
acaccauuuuggca

SEQ ID NO: 1650142 - RNA, 23 nt, Homo sapiens
acaccauuuuggcaagcucuauc

SEQ ID NO: 1650143 - RNA, 19 nt, Homo sapiens
acaccuagcgucaguauuu

SEQ ID NO: 1650144 - RNA, 23 nt, Homo sapiens
acacgggggcagcugauacaaau

SEQ ID NO: 1650145 - RNA, 19 nt, Homo sapiens
acacuaaauccccucacua

SEQ ID NO: 1650146 - RNA, 22 nt, Homo sapiens
acacuaacgaaauaucaaaguc

SEQ ID NO: 1650147 - RNA, 21 nt, Homo sapiens
acacugggacuugcaaaaagg

SEQ ID NO: 1650148 - RNA, 21 nt, Homo sapiens
acacugggcuucuagaaccag

SEQ ID NO: 1650149 - RNA, 12 nt, Homo sapiens
acacugugaugu

SEQ ID NO: 1650150 - RNA, 20 nt, Homo sapiens
acacuuggaguuugcauucu

SEQ ID NO: 1650151 - RNA, 17 nt, Homo sapiens
acagaaaacaauuguuc

SEQ ID NO: 1650152 - RNA, 20 nt, Homo sapiens
acagaacacacugagacuug

SEQ ID NO: 1650153 - RNA, 21 nt, Homo sapiens
acagaaggaaaaaaacaugaa

SEQ ID NO: 1650154 - RNA, 17 nt, Homo sapiens
acagacuaugucaccca

SEQ ID NO: 1650155 - RNA, 24 nt, Homo sapiens
acagacuaugucacccaaugcaua

SEQ ID NO: 1650156 - RNA, 20 nt, Homo sapiens
acagaggggagucaccagcc

SEQ ID NO: 1650157 - RNA, 14 nt, Homo sapiens
acagcaaacaggug

SEQ ID NO: 1650158 - RNA, 16 nt, Homo sapiens
acagcacccuauauac

SEQ ID NO: 1650159 - RNA, 22 nt, Homo sapiens
acagcaucgugaucacugagcc

SEQ ID NO: 1650160 - RNA, 22 nt, Homo sapiens
acagcauggagucacagccacu

SEQ ID NO: 1650161 - RNA, 16 nt, Homo sapiens
acagcuccuucugucc

SEQ ID NO: 1650162 - RNA, 23 nt, Homo sapiens
acagcucgggcccucugugagau

SEQ ID NO: 1650163 - RNA, 13 nt, Homo sapiens
acagcugaugaac

SEQ ID NO: 1650164 - RNA, 17 nt, Homo sapiens
acagcugcucaauaaag

SEQ ID NO: 1650165 - RNA, 20 nt, Homo sapiens
acagcuggguggcacugcca

SEQ ID NO: 1650166 - RNA, 14 nt, Homo sapiens
acagcugugcucug

SEQ ID NO: 1650167 - RNA, 14 nt, Homo sapiens
acaggcaaauuccu

SEQ ID NO: 1650168 - RNA, 23 nt, Homo sapiens
acaggcaaugcuggcuguuggcu

SEQ ID NO: 1650169 - RNA, 17 nt, Homo sapiens
acaggccugagauuuca

SEQ ID NO: 1650170 - RNA, 15 nt, Homo sapiens
acaggcgugagccac

SEQ ID NO: 1650171 - RNA, 18 nt, Homo sapiens
acaggcuggugcuaacau

SEQ ID NO: 1650172 - RNA, 15 nt, Homo sapiens
acagggaggugaccc

SEQ ID NO: 1650173 - RNA, 22 nt, Homo sapiens
acagggugcuccuugucaauac

SEQ ID NO: 1650174 - RNA, 15 nt, Homo sapiens
acaggucuucucucc

SEQ ID NO: 1650175 - RNA, 18 nt, Homo sapiens
acagguuauaacaguguu

SEQ ID NO: 1650176 - RNA, 21 nt, Homo sapiens
acagguuuucuucuaaucaua

SEQ ID NO: 1650177 - RNA, 14 nt, Homo sapiens
acaguaaaauccac

SEQ ID NO: 1650178 - RNA, 19 nt, Homo sapiens
acaguaaauggcuuaucca

SEQ ID NO: 1650179 - RNA, 11 nt, Homo sapiens
acagugacauu

SEQ ID NO: 1650180 - RNA, 22 nt, Homo sapiens
acagugacauuuauuuuucuca

SEQ ID NO: 1650181 - RNA, 20 nt, Homo sapiens
acagugacuccacucugagu

SEQ ID NO: 1650182 - RNA, 21 nt, Homo sapiens
acagugagucgaggacaggga

SEQ ID NO: 1650183 - RNA, 14 nt, Homo sapiens
acagugcuguguac

SEQ ID NO: 1650184 - RNA, 12 nt, Homo sapiens
acaguguucuca

SEQ ID NO: 1650185 - RNA, 15 nt, Homo sapiens
acaguguuucuggcu

SEQ ID NO: 1650186 - RNA, 22 nt, Homo sapiens
acaguucaauucucauuuguca

SEQ ID NO: 1650187 - RNA, 14 nt, Homo sapiens
acaguuuuaacugu

SEQ ID NO: 1650188 - RNA, 17 nt, Homo sapiens
acaguuuuaacugugga

SEQ ID NO: 1650189 - RNA, 19 nt, Homo sapiens
acauaaaaccugagcagca

SEQ ID NO: 1650190 - RNA, 13 nt, Homo sapiens
acauacagacaca

SEQ ID NO: 1650191 - RNA, 15 nt, Homo sapiens
acauaucauuuguga

SEQ ID NO: 1650192 - RNA, 15 nt, Homo sapiens
acauaucugacuucu

SEQ ID NO: 1650193 - RNA, 15 nt, Homo sapiens
acauaucuuguuaga

SEQ ID NO: 1650194 - RNA, 23 nt, Homo sapiens
acauaugauaaaaaaguguccua

SEQ ID NO: 1650195 - RNA, 14 nt, Homo sapiens
cauuugucaacaaa

SEQ ID NO: 1650196 - RNA, 21 nt, Homo sapiens
cauuuuaggcaaauguuuaaa

SEQ ID NO: 1650197 - RNA, 17 nt, Homo sapiens
cauuuucugccacccaa

SEQ ID NO: 1650198 - RNA, 23 nt, Homo sapiens
cauuuuuaaaggacaaacaguga

SEQ ID NO: 1650199 - RNA, 12 nt, Homo sapiens
ccaaaacacaga

SEQ ID NO: 1650200 - RNA, 20 nt, Homo sapiens
ccaaaagcccauucauucca

SEQ ID NO: 1650201 - RNA, 15 nt, Homo sapiens
ccaaaauaaugcacc

SEQ ID NO: 1650202 - RNA, 17 nt, Homo sapiens
ccaaacagaacuaugga

SEQ ID NO: 1650203 - RNA, 19 nt, Homo sapiens
ccaaacugauccaguauaa

SEQ ID NO: 1650204 - RNA, 19 nt, Homo sapiens
ccaaagaaaauuauaguuu

SEQ ID NO: 1650205 - RNA, 21 nt, Homo sapiens
ccaaagaaaauuauaguuuaa

SEQ ID NO: 1650206 - RNA, 16 nt, Homo sapiens
ccaaaguccaggacac

SEQ ID NO: 1650207 - RNA, 15 nt, Homo sapiens
ccaaagugcugcgau

SEQ ID NO: 1650208 - RNA, 14 nt, Homo sapiens
ccaaagugguauag

SEQ ID NO: 1650209 - RNA, 16 nt, Homo sapiens
ccaaauuauuguccaa

SEQ ID NO: 1650210 - RNA, 14 nt, Homo sapiens
ccaacagcacccuc

SEQ ID NO: 1650211 - RNA, 13 nt, Homo sapiens
ccaacauggugaa

SEQ ID NO: 1650212 - RNA, 23 nt, Homo sapiens
ccaacauggugaaacuccaucuc

SEQ ID NO: 1650213 - RNA, 17 nt, Homo sapiens
ccaacauuguucauucu

SEQ ID NO: 1650214 - RNA, 20 nt, Homo sapiens
ccaaccccccagcacugagg

SEQ ID NO: 1650215 - RNA, 16 nt, Homo sapiens
ccaaccugaagacacc

SEQ ID NO: 1650216 - RNA, 14 nt, Homo sapiens
ccaaguuuacucaa

SEQ ID NO: 1650217 - RNA, 10 nt, Homo sapiens
ccaauacugc

SEQ ID NO: 1650218 - RNA, 22 nt, Homo sapiens
ccaaucauacaaauacuaucca

SEQ ID NO: 1650219 - RNA, 12 nt, Homo sapiens
ccaaugaaauga

SEQ ID NO: 1650220 - RNA, 19 nt, Homo sapiens
ccaaugagaucauugugaa

SEQ ID NO: 1650221 - RNA, 20 nt, Homo sapiens
ccaaugagaucauugugaag

SEQ ID NO: 1650222 - RNA, 12 nt, Homo sapiens
ccaauucaucuu

SEQ ID NO: 1650223 - RNA, 21 nt, Homo sapiens
ccacaaaugggaaaaccagac

SEQ ID NO: 1650224 - RNA, 14 nt, Homo sapiens
ccacaagaccaucu

SEQ ID NO: 1650225 - RNA, 21 nt, Homo sapiens
ccacaccugcggcccaaucca

SEQ ID NO: 1650226 - RNA, 19 nt, Homo sapiens
ccacagaccugcucuggac

SEQ ID NO: 1650227 - RNA, 19 nt, Homo sapiens
ccacagcgcuggccgggac

SEQ ID NO: 1650228 - RNA, 22 nt, Homo sapiens
ccacagcuuuuacguaguaaaa

SEQ ID NO: 1650229 - RNA, 23 nt, Homo sapiens
ccacauccuccacguucugcuca

SEQ ID NO: 1650230 - RNA, 22 nt, Homo sapiens
ccacauuagccuuugcacugua

SEQ ID NO: 1650231 - RNA, 20 nt, Homo sapiens
ccacccuccuuucaccacau

SEQ ID NO: 1650232 - RNA, 21 nt, Homo sapiens
ccaccuccuuccagcacugac

SEQ ID NO: 1650233 - RNA, 15 nt, Homo sapiens
ccaccugcucacugg

SEQ ID NO: 1650234 - RNA, 11 nt, Homo sapiens
ccacucagguc

SEQ ID NO: 1650235 - RNA, 16 nt, Homo sapiens
ccacuccucugacuca

SEQ ID NO: 1650236 - RNA, 14 nt, Homo sapiens
ccacugccaaagaa

SEQ ID NO: 1650237 - RNA, 21 nt, Homo sapiens
ccacugccaaagaacuuggaa

SEQ ID NO: 1650238 - RNA, 16 nt, Homo sapiens
ccacuggacucaccuc

SEQ ID NO: 1650239 - RNA, 18 nt, Homo sapiens
ccacugguccugcugcug

SEQ ID NO: 1650240 - RNA, 23 nt, Homo sapiens
ccacuguuaagccauguguucca

SEQ ID NO: 1650241 - RNA, 19 nt, Homo sapiens
ccacuuccccuccuacccc

SEQ ID NO: 1650242 - RNA, 20 nt, Homo sapiens
ccacuuucagaauguugaag

SEQ ID NO: 1650243 - RNA, 21 nt, Homo sapiens
ccacuuuuaacagaacagaca

SEQ ID NO: 1650244 - RNA, 13 nt, Homo sapiens
ccagaaccuggag

SEQ ID NO: 1650245 - RNA, 16 nt, Homo sapiens
ccagacacauguccaa

SEQ ID NO: 1650246 - RNA, 13 nt, Homo sapiens
ccagacuucauag

SEQ ID NO: 1650247 - RNA, 20 nt, Homo sapiens
ccagagaggguggugaccuc

SEQ ID NO: 1650248 - RNA, 15 nt, Homo sapiens
ccagagggcacucug

SEQ ID NO: 1650249 - RNA, 22 nt, Homo sapiens
ccagaggggccugccaccugga

SEQ ID NO: 1650250 - RNA, 18 nt, Homo sapiens
ccagaugugagggcacca

SEQ ID NO: 1650251 - RNA, 14 nt, Homo sapiens
ccagcacagacuca

SEQ ID NO: 1650252 - RNA, 23 nt, Homo sapiens
ccagcaccggccccauuuaccca

SEQ ID NO: 1650253 - RNA, 14 nt, Homo sapiens
ccagcacugaggaa

SEQ ID NO: 1650254 - RNA, 10 nt, Homo sapiens
ccagcacuuu

SEQ ID NO: 1650255 - RNA, 18 nt, Homo sapiens
ccagcauauauaguauuu

SEQ ID NO: 1650256 - RNA, 16 nt, Homo sapiens
ccagccagggcugcua

SEQ ID NO: 1650257 - RNA, 23 nt, Homo sapiens
ccagccugacaacagccugagaa

SEQ ID NO: 1650258 - RNA, 22 nt, Homo sapiens
ccagccugcuaauuccccagau

SEQ ID NO: 1650259 - RNA, 15 nt, Homo sapiens
ccagcuccucaucca

SEQ ID NO: 1650260 - RNA, 19 nt, Homo sapiens
ccaggaagaccccagcaca

SEQ ID NO: 1650261 - RNA, 15 nt, Homo sapiens
ccaggacacccagug

SEQ ID NO: 1650262 - RNA, 15 nt, Homo sapiens
ccaggagcagccaca

SEQ ID NO: 1650263 - RNA, 13 nt, Homo sapiens
ccaggcaggcuaa

SEQ ID NO: 1650264 - RNA, 15 nt, Homo sapiens
ccaggccaucuucca

SEQ ID NO: 1650265 - RNA, 19 nt, Homo sapiens
ccaggcuggagugcaaugg

SEQ ID NO: 1650266 - RNA, 20 nt, Homo sapiens
ccaggcuggagugcaauggc

SEQ ID NO: 1650267 - RNA, 17 nt, Homo sapiens
ccaggcuggagugcagu

SEQ ID NO: 1650268 - RNA, 13 nt, Homo sapiens
ccaggggagaccc

SEQ ID NO: 1650269 - RNA, 18 nt, Homo sapiens
ccaggguucaguccucaa

SEQ ID NO: 1650270 - RNA, 12 nt, Homo sapiens
ccaggugcugcu

SEQ ID NO: 1650271 - RNA, 17 nt, Homo sapiens
ccaggugcugugacacc

SEQ ID NO: 1650272 - RNA, 15 nt, Homo sapiens
ccagguuacauucua

SEQ ID NO: 1650273 - RNA, 15 nt, Homo sapiens
ccaguaaacagagga

SEQ ID NO: 1650274 - RNA, 21 nt, Homo sapiens
ccauaaaggggagggacucau

SEQ ID NO: 1650275 - RNA, 19 nt, Homo sapiens
ccauaccacccaaugcuga

SEQ ID NO: 1650276 - RNA, 15 nt, Homo sapiens
ccauagagacuuugu

SEQ ID NO: 1650277 - RNA, 22 nt, Homo sapiens
ccauaggaggccaacccaaaau

SEQ ID NO: 1650278 - RNA, 22 nt, Homo sapiens
ccauaggcccagugagaugcau

SEQ ID NO: 1650279 - RNA, 19 nt, Homo sapiens
ccauauucccacagcacua

SEQ ID NO: 1650280 - RNA, 22 nt, Homo sapiens
ccaucacuggcucucuaauucc

SEQ ID NO: 1650281 - RNA, 23 nt, Homo sapiens
ccaucagugcucccucacauguc

SEQ ID NO: 1650282 - RNA, 17 nt, Homo sapiens
ccauccggucaccagaa

SEQ ID NO: 1650283 - RNA, 17 nt, Homo sapiens
ccauccucaaacacugc

SEQ ID NO: 1650284 - RNA, 15 nt, Homo sapiens
ccaugaaaaugcaac

SEQ ID NO: 1650285 - RNA, 17 nt, Homo sapiens
ccaugaaaaugcaacaa

SEQ ID NO: 1650286 - RNA, 22 nt, Homo sapiens
ccaugggauuuuaucuguggau

SEQ ID NO: 1650287 - RNA, 20 nt, Homo sapiens
ccaugggggcucagccaggu

SEQ ID NO: 1650288 - RNA, 22 nt, Homo sapiens
ccauguagaagcugcaucuugu

SEQ ID NO: 1650289 - RNA, 15 nt, Homo sapiens
ccauuagaagauauu

SEQ ID NO: 1650290 - RNA, 19 nt, Homo sapiens
ccauuguaaaucugaagaa

SEQ ID NO: 1650291 - RNA, 11 nt, Homo sapiens
cccaagggaaa

SEQ ID NO: 1650292 - RNA, 22 nt, Homo sapiens
cccaagggccuggccugagcug

SEQ ID NO: 1650293 - RNA, 19 nt, Homo sapiens
cccacacuccuacaccuaa

SEQ ID NO: 1650294 - RNA, 15 nt, Homo sapiens
cccaccaucaugucu

SEQ ID NO: 1650295 - RNA, 21 nt, Homo sapiens
cccacccuccuuucaccacau

SEQ ID NO: 1650296 - RNA, 19 nt, Homo sapiens
cccacguccugucagugcc

SEQ ID NO: 1650297 - RNA, 14 nt, Homo sapiens
cccacucauuccuu

SEQ ID NO: 1650298 - RNA, 15 nt, Homo sapiens
cccacuucugccaua

SEQ ID NO: 1650299 - RNA, 20 nt, Homo sapiens
cccagagaggguggugaccu

SEQ ID NO: 1650300 - RNA, 23 nt, Homo sapiens
cccagagguaacagaacagcuuc

SEQ ID NO: 1650301 - RNA, 18 nt, Homo sapiens
cccagaguccucuaugaa

SEQ ID NO: 1650302 - RNA, 22 nt, Homo sapiens
cccagauuggcucacacugaga

SEQ ID NO: 1650303 - RNA, 15 nt, Homo sapiens
cccagcacagacuca

SEQ ID NO: 1650304 - RNA, 17 nt, Homo sapiens
cucugagacacacccca

SEQ ID NO: 1650305 - RNA, 15 nt, Homo sapiens
cucugcuccaccuug

SEQ ID NO: 1650306 - RNA, 19 nt, Homo sapiens
cucuggccuccaaguccac

SEQ ID NO: 1650307 - RNA, 14 nt, Homo sapiens
cucugggguccuca

SEQ ID NO: 1650308 - RNA, 17 nt, Homo sapiens
cucugucgugagugucu

SEQ ID NO: 1650309 - RNA, 14 nt, Homo sapiens
cucugugaccaaug

SEQ ID NO: 1650310 - RNA, 18 nt, Homo sapiens
cucuuaagcuaagacuga

SEQ ID NO: 1650311 - RNA, 12 nt, Homo sapiens
cucuuaucucag

SEQ ID NO: 1650312 - RNA, 21 nt, Homo sapiens
cucuuaucucagucaugcaua

SEQ ID NO: 1650313 - RNA, 22 nt, Homo sapiens
cucuucuucuuucuacaguauu

SEQ ID NO: 1650314 - RNA, 18 nt, Homo sapiens
cucuuuaaaaugcaaaau

SEQ ID NO: 1650315 - RNA, 15 nt, Homo sapiens
cucuuuaaugucaca

SEQ ID NO: 1650316 - RNA, 17 nt, Homo sapiens
cucuuuucaaaacauuu

SEQ ID NO: 1650317 - RNA, 19 nt, Homo sapiens
cugaaaacacugugcacau

SEQ ID NO: 1650318 - RNA, 16 nt, Homo sapiens
cugaacgcuucugcuu

SEQ ID NO: 1650319 - RNA, 14 nt, Homo sapiens
cugaagaaaguuau

SEQ ID NO: 1650320 - RNA, 16 nt, Homo sapiens
cugaagccaaagccaa

SEQ ID NO: 1650321 - RNA, 16 nt, Homo sapiens
cugaaguaagcaaaga

SEQ ID NO: 1650322 - RNA, 16 nt, Homo sapiens
cugaaucugcuaccaa

SEQ ID NO: 1650323 - RNA, 20 nt, Homo sapiens
cugaaugaagccuucugacc

SEQ ID NO: 1650324 - RNA, 21 nt, Homo sapiens
cugaaugaagccuucugaccu

SEQ ID NO: 1650325 - RNA, 18 nt, Homo sapiens
cugaauuaucuauuucau

SEQ ID NO: 1650326 - RNA, 23 nt, Homo sapiens
cugaauuuggagucugacugugc

SEQ ID NO: 1650327 - RNA, 19 nt, Homo sapiens
cugacaacagccugagaaa

SEQ ID NO: 1650328 - RNA, 14 nt, Homo sapiens
cugacagcacuccu

SEQ ID NO: 1650329 - RNA, 15 nt, Homo sapiens
cugaccaauauugua

SEQ ID NO: 1650330 - RNA, 20 nt, Homo sapiens
cugaccaauauuguacaguu

SEQ ID NO: 1650331 - RNA, 13 nt, Homo sapiens
cugacccacugcu

SEQ ID NO: 1650332 - RNA, 14 nt, Homo sapiens
cugacccauguuca

SEQ ID NO: 1650333 - RNA, 17 nt, Homo sapiens
cugaccucgugauccac

SEQ ID NO: 1650334 - RNA, 17 nt, Homo sapiens
cugacgcagccugagaa

SEQ ID NO: 1650335 - RNA, 11 nt, Homo sapiens
cugacugcuag

SEQ ID NO: 1650336 - RNA, 15 nt, Homo sapiens
cugacugugcccaag

SEQ ID NO: 1650337 - RNA, 20 nt, Homo sapiens
cugacuuaagugugcaaaau

SEQ ID NO: 1650338 - RNA, 16 nt, Homo sapiens
cugacuucauacaucc

SEQ ID NO: 1650339 - RNA, 17 nt, Homo sapiens
cugacuuuucugaccca

SEQ ID NO: 1650340 - RNA, 14 nt, Homo sapiens
cugagaaugaccug

SEQ ID NO: 1650341 - RNA, 16 nt, Homo sapiens
cugagcagaauacugg

SEQ ID NO: 1650342 - RNA, 22 nt, Homo sapiens
cugagcagugaaugauucagug

SEQ ID NO: 1650343 - RNA, 19 nt, Homo sapiens
cugaggagccugcaacaug

SEQ ID NO: 1650344 - RNA, 22 nt, Homo sapiens
cugaggcccgaucuccacuguu

SEQ ID NO: 1650345 - RNA, 23 nt, Homo sapiens
cugaguagcuggaacuacaagga

SEQ ID NO: 1650346 - RNA, 18 nt, Homo sapiens
cugaguaguugggauuac

SEQ ID NO: 1650347 - RNA, 20 nt, Homo sapiens
cugauaaccacuccuaauau

SEQ ID NO: 1650348 - RNA, 18 nt, Homo sapiens
cugauacuuugacagugu

SEQ ID NO: 1650349 - RNA, 16 nt, Homo sapiens
cugauaggacccauau

SEQ ID NO: 1650350 - RNA, 17 nt, Homo sapiens
cugauagggauacaugc

SEQ ID NO: 1650351 - RNA, 21 nt, Homo sapiens
cugauagggauacaugcucuu

SEQ ID NO: 1650352 - RNA, 17 nt, Homo sapiens
cugauagguagcauuuu

SEQ ID NO: 1650353 - RNA, 13 nt, Homo sapiens
cugaucugaugca

SEQ ID NO: 1650354 - RNA, 16 nt, Homo sapiens
cugaugaacuguggug

SEQ ID NO: 1650355 - RNA, 13 nt, Homo sapiens
cugauguuuauaa

SEQ ID NO: 1650356 - RNA, 16 nt, Homo sapiens
cugcaaaaacagaggu

SEQ ID NO: 1650357 - RNA, 21 nt, Homo sapiens
cugcacacuguccuauuauau

SEQ ID NO: 1650358 - RNA, 13 nt, Homo sapiens
cugcagauuugau

SEQ ID NO: 1650359 - RNA, 20 nt, Homo sapiens
cugcagccucagagacauca

SEQ ID NO: 1650360 - RNA, 19 nt, Homo sapiens
cugcagccugccccuguga

SEQ ID NO: 1650361 - RNA, 18 nt, Homo sapiens
cugcaguguggcaagcaa

SEQ ID NO: 1650362 - RNA, 18 nt, Homo sapiens
cugcaugcgagugcucau

SEQ ID NO: 1650363 - RNA, 16 nt, Homo sapiens
cugcauguaaaaucuu

SEQ ID NO: 1650364 - RNA, 17 nt, Homo sapiens
cugcccgaaaagcauuu

SEQ ID NO: 1650365 - RNA, 14 nt, Homo sapiens
cugcccuccaagac

SEQ ID NO: 1650366 - RNA, 17 nt, Homo sapiens
cugccugaagucacaca

SEQ ID NO: 1650367 - RNA, 17 nt, Homo sapiens
cugcggggccugaggca

SEQ ID NO: 1650368 - RNA, 17 nt, Homo sapiens
cugcgugguugaugauc

SEQ ID NO: 1650369 - RNA, 19 nt, Homo sapiens
cugcucaauaaaguacaag

SEQ ID NO: 1650370 - RNA, 23 nt, Homo sapiens
cugcucuuugauucaaagcacug

SEQ ID NO: 1650371 - RNA, 21 nt, Homo sapiens
cugcuggaaggcagcuugugg

SEQ ID NO: 1650372 - RNA, 19 nt, Homo sapiens
cugcugggggugaggacac

SEQ ID NO: 1650373 - RNA, 14 nt, Homo sapiens
cuggaacagauuca

SEQ ID NO: 1650374 - RNA, 20 nt, Homo sapiens
cuggaacagauucacacugu

SEQ ID NO: 1650375 - RNA, 19 nt, Homo sapiens
cuggaauggaauuggacau

SEQ ID NO: 1650376 - RNA, 13 nt, Homo sapiens
cuggacucucagu

SEQ ID NO: 1650377 - RNA, 20 nt, Homo sapiens
cuggagggagaacccaaaga

SEQ ID NO: 1650378 - RNA, 16 nt, Homo sapiens
cuggagggguguugua

SEQ ID NO: 1650379 - RNA, 17 nt, Homo sapiens
cuggagucaugccaagc

SEQ ID NO: 1650380 - RNA, 15 nt, Homo sapiens
cuggaugcagccuca

SEQ ID NO: 1650381 - RNA, 14 nt, Homo sapiens
cuggcaaacaugug

SEQ ID NO: 1650382 - RNA, 13 nt, Homo sapiens
cuggcacugcugg

SEQ ID NO: 1650383 - RNA, 19 nt, Homo sapiens
cuggcagagagcacaguga

SEQ ID NO: 1650384 - RNA, 22 nt, Homo sapiens
cuggcagagagcacagugauca

SEQ ID NO: 1650385 - RNA, 19 nt, Homo sapiens
cuggccagaugcaccagcc

SEQ ID NO: 1650386 - RNA, 20 nt, Homo sapiens
cuggcgugcaguggugcgau

SEQ ID NO: 1650387 - RNA, 18 nt, Homo sapiens
cuggcuuuguucuuguca

SEQ ID NO: 1650388 - RNA, 15 nt, Homo sapiens
cugggaagugacuua

SEQ ID NO: 1650389 - RNA, 23 nt, Homo sapiens
cugggagugguggcucaugccug

SEQ ID NO: 1650390 - RNA, 18 nt, Homo sapiens
cugggauuacaagcguga

SEQ ID NO: 1650391 - RNA, 22 nt, Homo sapiens
cugggauuacagacaugaacug

SEQ ID NO: 1650392 - RNA, 15 nt, Homo sapiens
cugggauuacaggug

SEQ ID NO: 1650393 - RNA, 20 nt, Homo sapiens
cugggauuacaggugugaac

SEQ ID NO: 1650394 - RNA, 21 nt, Homo sapiens
cugggauuacaggugugagcc

SEQ ID NO: 1650395 - RNA, 14 nt, Homo sapiens
cugggcacagucag

SEQ ID NO: 1650396 - RNA, 13 nt, Homo sapiens
cugggguccucac

SEQ ID NO: 1650397 - RNA, 12 nt, Homo sapiens
cuggguggacau

SEQ ID NO: 1650398 - RNA, 20 nt, Homo sapiens
cuggguuggcgcacccuccc

SEQ ID NO: 1650399 - RNA, 22 nt, Homo sapiens
cuggguuuuguauucucugagc

SEQ ID NO: 1650400 - RNA, 15 nt, Homo sapiens
cugguaacauagguu

SEQ ID NO: 1650401 - RNA, 19 nt, Homo sapiens
cugguauuaacuuuauaca

SEQ ID NO: 1650402 - RNA, 19 nt, Homo sapiens
cugguauuuuaucuuugau

SEQ ID NO: 1650403 - RNA, 18 nt, Homo sapiens
cuggucaaaaccuacaca

SEQ ID NO: 1650404 - RNA, 17 nt, Homo sapiens
cugguggggcugccagg

SEQ ID NO: 1650405 - RNA, 14 nt, Homo sapiens
cugguucugaugau

SEQ ID NO: 1650406 - RNA, 16 nt, Homo sapiens
cuguaaaacagguuau

SEQ ID NO: 1650407 - RNA, 14 nt, Homo sapiens
cuguaaaugaacac

SEQ ID NO: 1650408 - RNA, 14 nt, Homo sapiens
cuguaaccucuuca

SEQ ID NO: 1650409 - RNA, 18 nt, Homo sapiens
cuguaccugugcacguug

SEQ ID NO: 1650410 - RNA, 22 nt, Homo sapiens
cuguagaaaagggaacugaaca

SEQ ID NO: 1650411 - RNA, 17 nt, Homo sapiens
cuguauauagcucuaca

SEQ ID NO: 1650412 - RNA, 15 nt, Homo sapiens
cuguauggaaacacu

SEQ ID NO: 1650413 - RNA, 17 nt, Homo sapiens
cuguauuagucacagag

SEQ ID NO: 1650414 - RNA, 22 nt, Homo sapiens
gagggaaacugugaaugcuucu

SEQ ID NO: 1650415 - RNA, 17 nt, Homo sapiens
gagguuugccagcauuu

SEQ ID NO: 1650416 - RNA, 17 nt, Homo sapiens
gaguacaccccaacagc

SEQ ID NO: 1650417 - RNA, 17 nt, Homo sapiens
gagucucacuguugccc

SEQ ID NO: 1650418 - RNA, 12 nt, Homo sapiens
gagucucugaac

SEQ ID NO: 1650419 - RNA, 17 nt, Homo sapiens
gagucucugaacauccu

SEQ ID NO: 1650420 - RNA, 15 nt, Homo sapiens
gagucuugugugcau

SEQ ID NO: 1650421 - RNA, 13 nt, Homo sapiens
gagugagacucca

SEQ ID NO: 1650422 - RNA, 20 nt, Homo sapiens
gagugagacuccaccucaaa

SEQ ID NO: 1650423 - RNA, 19 nt, Homo sapiens
gagugagacucugucucaa

SEQ ID NO: 1650424 - RNA, 13 nt, Homo sapiens
gagugagcugguu

SEQ ID NO: 1650425 - RNA, 20 nt, Homo sapiens
gagugggggugggggguccc

SEQ ID NO: 1650426 - RNA, 14 nt, Homo sapiens
gaguucuuugcaag

SEQ ID NO: 1650427 - RNA, 15 nt, Homo sapiens
gaguuugcauucuua

SEQ ID NO: 1650428 - RNA, 11 nt, Homo sapiens
gaguuugccac

SEQ ID NO: 1650429 - RNA, 21 nt, Homo sapiens
gaguuugggaacugcaauaac

SEQ ID NO: 1650430 - RNA, 16 nt, Homo sapiens
gauaaaagacagugaa

SEQ ID NO: 1650431 - RNA, 16 nt, Homo sapiens
gauaauacagauuugu

SEQ ID NO: 1650432 - RNA, 11 nt, Homo sapiens
gauaauauuca

SEQ ID NO: 1650433 - RNA, 18 nt, Homo sapiens
gauaccacuuaacagguu

SEQ ID NO: 1650434 - RNA, 14 nt, Homo sapiens
gauacugcugccaa

SEQ ID NO: 1650435 - RNA, 11 nt, Homo sapiens
gauacuuugac

SEQ ID NO: 1650436 - RNA, 18 nt, Homo sapiens
gauagguauaaguggugu

SEQ ID NO: 1650437 - RNA, 15 nt, Homo sapiens
gauauagaacagugc

SEQ ID NO: 1650438 - RNA, 17 nt, Homo sapiens
gauauauuuaagccuua

SEQ ID NO: 1650439 - RNA, 19 nt, Homo sapiens
gauauccucugcuuaaaaa

SEQ ID NO: 1650440 - RNA, 13 nt, Homo sapiens
gauaucuaugacu

SEQ ID NO: 1650441 - RNA, 18 nt, Homo sapiens
gauaucuaugacuguguu

SEQ ID NO: 1650442 - RNA, 13 nt, Homo sapiens
gaucacaccacug

SEQ ID NO: 1650443 - RNA, 19 nt, Homo sapiens
gaucacaccacuguacucc

SEQ ID NO: 1650444 - RNA, 17 nt, Homo sapiens
gaucacgccacugcacu

SEQ ID NO: 1650445 - RNA, 13 nt, Homo sapiens
gaucauugugaag

SEQ ID NO: 1650446 - RNA, 14 nt, Homo sapiens
gauccaagcugguc

SEQ ID NO: 1650447 - RNA, 14 nt, Homo sapiens
gaucccgugugcca

SEQ ID NO: 1650448 - RNA, 21 nt, Homo sapiens
gauccgucuuuggccuccucc

SEQ ID NO: 1650449 - RNA, 16 nt, Homo sapiens
gauccuaaaacaaaag

SEQ ID NO: 1650450 - RNA, 22 nt, Homo sapiens
gauccuaaaacaaaagcucauc

SEQ ID NO: 1650451 - RNA, 17 nt, Homo sapiens
gauccuaguuccaccau

SEQ ID NO: 1650452 - RNA, 12 nt, Homo sapiens
gauccuccaggu

SEQ ID NO: 1650453 - RNA, 18 nt, Homo sapiens
gaucuaggaagacuuugg

SEQ ID NO: 1650454 - RNA, 16 nt, Homo sapiens
gaucugcuagugcugu

SEQ ID NO: 1650455 - RNA, 15 nt, Homo sapiens
gaucuuuggacagaa

SEQ ID NO: 1650456 - RNA, 17 nt, Homo sapiens
gaugaacuguggugcca

SEQ ID NO: 1650457 - RNA, 16 nt, Homo sapiens
gaugacaacuggaaua

SEQ ID NO: 1650458 - RNA, 16 nt, Homo sapiens
gaugaggguucaucau

SEQ ID NO: 1650459 - RNA, 15 nt, Homo sapiens
gaugaguacccaaaa

SEQ ID NO: 1650460 - RNA, 23 nt, Homo sapiens
gaugauucuuccagauaaugucc

SEQ ID NO: 1650461 - RNA, 22 nt, Homo sapiens
gaugcauagccuggacacagag

SEQ ID NO: 1650462 - RNA, 15 nt, Homo sapiens
gaugcuaccaugccu

SEQ ID NO: 1650463 - RNA, 15 nt, Homo sapiens
gaugggaccugauga

SEQ ID NO: 1650464 - RNA, 18 nt, Homo sapiens
gauggugacauugaaacu

SEQ ID NO: 1650465 - RNA, 20 nt, Homo sapiens
gaugguuucaauaaaccuaa

SEQ ID NO: 1650466 - RNA, 14 nt, Homo sapiens
gauguccucaccac

SEQ ID NO: 1650467 - RNA, 20 nt, Homo sapiens
gaugugccuggguggacaug

SEQ ID NO: 1650468 - RNA, 19 nt, Homo sapiens
gaugugggucccucucuug

SEQ ID NO: 1650469 - RNA, 22 nt, Homo sapiens
gaugugggucccucucuugacc

SEQ ID NO: 1650470 - RNA, 15 nt, Homo sapiens
gauguuucugucaca

SEQ ID NO: 1650471 - RNA, 19 nt, Homo sapiens
gauuacaggugugagccac

SEQ ID NO: 1650472 - RNA, 21 nt, Homo sapiens
gauuacaggugugagccacca

SEQ ID NO: 1650473 - RNA, 13 nt, Homo sapiens
gauuauucagugu

SEQ ID NO: 1650474 - RNA, 14 nt, Homo sapiens
gauucaguguuaaa

SEQ ID NO: 1650475 - RNA, 13 nt, Homo sapiens
gauucuauguuaa

SEQ ID NO: 1650476 - RNA, 14 nt, Homo sapiens
gauucucaugccuc

SEQ ID NO: 1650477 - RNA, 23 nt, Homo sapiens
gauugccucugaagccuauguau

SEQ ID NO: 1650478 - RNA, 16 nt, Homo sapiens
gauuggagauagggaa

SEQ ID NO: 1650479 - RNA, 19 nt, Homo sapiens
gauuggccggcuaguguuu

SEQ ID NO: 1650480 - RNA, 19 nt, Homo sapiens
gauugugggauacuauuua

SEQ ID NO: 1650481 - RNA, 21 nt, Homo sapiens
gauuucaggucaacucugaag

SEQ ID NO: 1650482 - RNA, 14 nt, Homo sapiens
gauuuccacaguga

SEQ ID NO: 1650483 - RNA, 17 nt, Homo sapiens
gauuugggcucuuggaa

SEQ ID NO: 1650484 - RNA, 18 nt, Homo sapiens
gauuuuacacaccaccag

SEQ ID NO: 1650485 - RNA, 22 nt, Homo sapiens
gcaaaauguuucaaguacugua

SEQ ID NO: 1650486 - RNA, 16 nt, Homo sapiens
gcaaagacuuuccucu

SEQ ID NO: 1650487 - RNA, 13 nt, Homo sapiens
gcaaagcccagcu

SEQ ID NO: 1650488 - RNA, 23 nt, Homo sapiens
gcaaaggcugagaacacugugaa

SEQ ID NO: 1650489 - RNA, 23 nt, Homo sapiens
gcaaaggcugggaccacgugaga

SEQ ID NO: 1650490 - RNA, 21 nt, Homo sapiens
gcaacaugccagccacuguga

SEQ ID NO: 1650491 - RNA, 14 nt, Homo sapiens
gcaagaaacacugg

SEQ ID NO: 1650492 - RNA, 22 nt, Homo sapiens
gcaagugugcuggccucucuga

SEQ ID NO: 1650493 - RNA, 16 nt, Homo sapiens
gcaauaaaauguauuu

SEQ ID NO: 1650494 - RNA, 14 nt, Homo sapiens
gcaauuaacucugg

SEQ ID NO: 1650495 - RNA, 17 nt, Homo sapiens
gcaauuagacaagaacu

SEQ ID NO: 1650496 - RNA, 22 nt, Homo sapiens
gcaauucuaacuuuuuugcuau

SEQ ID NO: 1650497 - RNA, 22 nt, Homo sapiens
gcacaaaccaauuaaacccagu

SEQ ID NO: 1650498 - RNA, 13 nt, Homo sapiens
gcacacacaguga

SEQ ID NO: 1650499 - RNA, 15 nt, Homo sapiens
gcacacacagugauu

SEQ ID NO: 1650500 - RNA, 21 nt, Homo sapiens
gcacacacuguguacaguaaa

SEQ ID NO: 1650501 - RNA, 16 nt, Homo sapiens
gcaccaauaaagccuu

SEQ ID NO: 1650502 - RNA, 12 nt, Homo sapiens
gcaccacuuuuu

SEQ ID NO: 1650503 - RNA, 22 nt, Homo sapiens
gcacuaccauagcuacaucagu

SEQ ID NO: 1650504 - RNA, 15 nt, Homo sapiens
gcacugcauguuccu

SEQ ID NO: 1650505 - RNA, 21 nt, Homo sapiens
gcacugccugauggaccuguc

SEQ ID NO: 1650506 - RNA, 22 nt, Homo sapiens
gcagagcagagaccaucccuga

SEQ ID NO: 1650507 - RNA, 16 nt, Homo sapiens
gcagaugagguugcua

SEQ ID NO: 1650508 - RNA, 17 nt, Homo sapiens
gcagcauggauucugca

SEQ ID NO: 1650509 - RNA, 15 nt, Homo sapiens
gcagccaagggauga

SEQ ID NO: 1650510 - RNA, 14 nt, Homo sapiens
gcagcuaaaaccua

SEQ ID NO: 1650511 - RNA, 18 nt, Homo sapiens
gcagcugcuggcugugac

SEQ ID NO: 1650512 - RNA, 19 nt, Homo sapiens
gcagcugcuggcugugaca

SEQ ID NO: 1650513 - RNA, 23 nt, Homo sapiens
gcagcuggcagagagcacaguga

SEQ ID NO: 1650514 - RNA, 20 nt, Homo sapiens
gcagcuuagacuaaggccau

SEQ ID NO: 1650515 - RNA, 22 nt, Homo sapiens
gcaggaaggagcugccuggacc

SEQ ID NO: 1650516 - RNA, 17 nt, Homo sapiens
gcaggccugccuucuca

SEQ ID NO: 1650517 - RNA, 20 nt, Homo sapiens
gcaggccugccuucucaggg

SEQ ID NO: 1650518 - RNA, 14 nt, Homo sapiens
gcaggcuacacuga

SEQ ID NO: 1650519 - RNA, 16 nt, Homo sapiens
gcaggcuacacugaca

SEQ ID NO: 1650520 - RNA, 17 nt, Homo sapiens
gcagugccccuagcuua

SEQ ID NO: 1650521 - RNA, 17 nt, Homo sapiens
gcaguggcaccaccaug

SEQ ID NO: 1650522 - RNA, 19 nt, Homo sapiens
gcagugggucccacuuccc

SEQ ID NO: 1650523 - RNA, 10 nt, Homo sapiens
gcaguuauug

SEQ ID NO: 1650524 - RNA, 20 nt, Homo sapiens
guagagacaggguuuugcca

SEQ ID NO: 1650525 - RNA, 21 nt, Homo sapiens
guagccucgauguccuccucu

SEQ ID NO: 1650526 - RNA, 13 nt, Homo sapiens
guagccucucuuu

SEQ ID NO: 1650527 - RNA, 17 nt, Homo sapiens
guagcugggacuacagg

SEQ ID NO: 1650528 - RNA, 12 nt, Homo sapiens
guagcugggauu

SEQ ID NO: 1650529 - RNA, 16 nt, Homo sapiens
guagcugggauuacag

SEQ ID NO: 1650530 - RNA, 15 nt, Homo sapiens
guagugccacuguug

SEQ ID NO: 1650531 - RNA, 19 nt, Homo sapiens
guaguuucugcauuucaag

SEQ ID NO: 1650532 - RNA, 12 nt, Homo sapiens
guauaaggugag

SEQ ID NO: 1650533 - RNA, 17 nt, Homo sapiens
guauaucuucuacaugc

SEQ ID NO: 1650534 - RNA, 13 nt, Homo sapiens
guauccauucuac

SEQ ID NO: 1650535 - RNA, 21 nt, Homo sapiens
guauccucugaccuacauacg

SEQ ID NO: 1650536 - RNA, 17 nt, Homo sapiens
guaugaucacggcucac

SEQ ID NO: 1650537 - RNA, 15 nt, Homo sapiens
guauggaaacacuga

SEQ ID NO: 1650538 - RNA, 18 nt, Homo sapiens
guauucaaacaauuugaa

SEQ ID NO: 1650539 - RNA, 17 nt, Homo sapiens
guauucauauguuuaug

SEQ ID NO: 1650540 - RNA, 16 nt, Homo sapiens
gucaaauuuacauuua

SEQ ID NO: 1650541 - RNA, 12 nt, Homo sapiens
gucaacauuucu

SEQ ID NO: 1650542 - RNA, 22 nt, Homo sapiens
gucaacccaauaguuguugauu

SEQ ID NO: 1650543 - RNA, 16 nt, Homo sapiens
gucaacuuucauuuga

SEQ ID NO: 1650544 - RNA, 13 nt, Homo sapiens
gucaaggacaaaa

SEQ ID NO: 1650545 - RNA, 23 nt, Homo sapiens
gucaauucugauguuacugagau

SEQ ID NO: 1650546 - RNA, 18 nt, Homo sapiens
gucacacacuuuggcuau

SEQ ID NO: 1650547 - RNA, 20 nt, Homo sapiens
gucacagaucacagugucuu

SEQ ID NO: 1650548 - RNA, 18 nt, Homo sapiens
gucacagccacuugggau

SEQ ID NO: 1650549 - RNA, 15 nt, Homo sapiens
gucacuccacgcagc

SEQ ID NO: 1650550 - RNA, 15 nt, Homo sapiens
gucacucuggcagcu

SEQ ID NO: 1650551 - RNA, 14 nt, Homo sapiens
gucauaacuagaac

SEQ ID NO: 1650552 - RNA, 14 nt, Homo sapiens
gucauacaauccau

SEQ ID NO: 1650553 - RNA, 16 nt, Homo sapiens
guccacaacacacaga

SEQ ID NO: 1650554 - RNA, 21 nt, Homo sapiens
guccacaacacacagauuuga

SEQ ID NO: 1650555 - RNA, 23 nt, Homo sapiens
guccagguaaaugguaugaucaa

SEQ ID NO: 1650556 - RNA, 18 nt, Homo sapiens
gucccagccacaguguua

SEQ ID NO: 1650557 - RNA, 13 nt, Homo sapiens
guccuauguauau

SEQ ID NO: 1650558 - RNA, 19 nt, Homo sapiens
guccucacauggcguccug

SEQ ID NO: 1650559 - RNA, 12 nt, Homo sapiens
guccuccuccag

SEQ ID NO: 1650560 - RNA, 17 nt, Homo sapiens
guccuccuccagggaca

SEQ ID NO: 1650561 - RNA, 16 nt, Homo sapiens
guccugacagcacucc

SEQ ID NO: 1650562 - RNA, 12 nt, Homo sapiens
guccugcugcug

SEQ ID NO: 1650563 - RNA, 13 nt, Homo sapiens
guccugucagugc

SEQ ID NO: 1650564 - RNA, 14 nt, Homo sapiens
guccuugaugcuca

SEQ ID NO: 1650565 - RNA, 16 nt, Homo sapiens
gucgucuuaacucacc

SEQ ID NO: 1650566 - RNA, 12 nt, Homo sapiens
gucuaaaaccuu

SEQ ID NO: 1650567 - RNA, 15 nt, Homo sapiens
gucuaagaacucuuu

SEQ ID NO: 1650568 - RNA, 19 nt, Homo sapiens
gucuaccaacauuguucau

SEQ ID NO: 1650569 - RNA, 18 nt, Homo sapiens
gucuaugggacucaaugc

SEQ ID NO: 1650570 - RNA, 17 nt, Homo sapiens
gucucaaucuccugacu

SEQ ID NO: 1650571 - RNA, 17 nt, Homo sapiens
gucucagaccacuauuc

SEQ ID NO: 1650572 - RNA, 16 nt, Homo sapiens
gucugggcacagucag

SEQ ID NO: 1650573 - RNA, 13 nt, Homo sapiens
gucugguuuauuu

SEQ ID NO: 1650574 - RNA, 13 nt, Homo sapiens
gucuguuugcauu

SEQ ID NO: 1650575 - RNA, 16 nt, Homo sapiens
gucuguuuuaauuuaa

SEQ ID NO: 1650576 - RNA, 13 nt, Homo sapiens
gucuucuucaggg

SEQ ID NO: 1650577 - RNA, 13 nt, Homo sapiens
gucuuugcugcag

SEQ ID NO: 1650578 - RNA, 20 nt, Homo sapiens
gugaaaaugugugugugcuu

SEQ ID NO: 1650579 - RNA, 20 nt, Homo sapiens
gugaaacugggaugauaaua

SEQ ID NO: 1650580 - RNA, 20 nt, Homo sapiens
gugaaagcaucacuugggau

SEQ ID NO: 1650581 - RNA, 23 nt, Homo sapiens
gugaagucgucuuaacucaccau

SEQ ID NO: 1650582 - RNA, 23 nt, Homo sapiens
gugaauaaaccaucaucuugcca

SEQ ID NO: 1650583 - RNA, 17 nt, Homo sapiens
gugacauuuccaugcau

SEQ ID NO: 1650584 - RNA, 21 nt, Homo sapiens
gugaccucugccugaagucac

SEQ ID NO: 1650585 - RNA, 18 nt, Homo sapiens
gugagaagggcucagaga

SEQ ID NO: 1650586 - RNA, 12 nt, Homo sapiens
gugagacccagc

SEQ ID NO: 1650587 - RNA, 16 nt, Homo sapiens
gugagcaaagggcuca

SEQ ID NO: 1650588 - RNA, 22 nt, Homo sapiens
gugagcagacugcaaaucugcc

SEQ ID NO: 1650589 - RNA, 13 nt, Homo sapiens
gugauauguuggu

SEQ ID NO: 1650590 - RNA, 15 nt, Homo sapiens
gugaucaucuuugcu

SEQ ID NO: 1650591 - RNA, 20 nt, Homo sapiens
gugccacaaauaaaauggau

SEQ ID NO: 1650592 - RNA, 19 nt, Homo sapiens
gugccaugggggcaacagc

SEQ ID NO: 1650593 - RNA, 19 nt, Homo sapiens
gugcccugcaucccucucc

SEQ ID NO: 1650594 - RNA, 13 nt, Homo sapiens
gugcuaacauaaa

SEQ ID NO: 1650595 - RNA, 17 nt, Homo sapiens
gugcucugaucauccac

SEQ ID NO: 1650596 - RNA, 11 nt, Homo sapiens
gugcugggauu

SEQ ID NO: 1650597 - RNA, 15 nt, Homo sapiens
gugcugggauuacag

SEQ ID NO: 1650598 - RNA, 18 nt, Homo sapiens
gugcugggauuacaggug

SEQ ID NO: 1650599 - RNA, 19 nt, Homo sapiens
gugcugggauuacaggugu

SEQ ID NO: 1650600 - RNA, 15 nt, Homo sapiens
guggcacugccaugc

SEQ ID NO: 1650601 - RNA, 19 nt, Homo sapiens
gugggccuucagggaguga

SEQ ID NO: 1650602 - RNA, 14 nt, Homo sapiens
guggggacagggau

SEQ ID NO: 1650603 - RNA, 16 nt, Homo sapiens
gugggucccacuuccc

SEQ ID NO: 1650604 - RNA, 13 nt, Homo sapiens
guggucacuggaa

SEQ ID NO: 1650605 - RNA, 12 nt, Homo sapiens
guggugccacau

SEQ ID NO: 1650606 - RNA, 16 nt, Homo sapiens
guggugcgagugcgug

SEQ ID NO: 1650607 - RNA, 14 nt, Homo sapiens
gugguguguguaug

SEQ ID NO: 1650608 - RNA, 17 nt, Homo sapiens
gugguucagcuacuuuc

SEQ ID NO: 1650609 - RNA, 19 nt, Homo sapiens
gugguugaagagcaaugug

SEQ ID NO: 1650610 - RNA, 18 nt, Homo sapiens
guguauauuuaagguaua

SEQ ID NO: 1650611 - RNA, 19 nt, Homo sapiens
guguaugguucugugccaa

SEQ ID NO: 1650612 - RNA, 23 nt, Homo sapiens
guguauuuaaccuugaaggguuc

SEQ ID NO: 1650613 - RNA, 15 nt, Homo sapiens
gugucaaccccaaau

SEQ ID NO: 1650614 - RNA, 18 nt, Homo sapiens
gugucaacuuucauuuga

SEQ ID NO: 1650615 - RNA, 15 nt, Homo sapiens
gugucaugauucacc

SEQ ID NO: 1650616 - RNA, 15 nt, Homo sapiens
gugugaacguguaug

SEQ ID NO: 1650617 - RNA, 19 nt, Homo sapiens
gugugcauugcugugaauu

SEQ ID NO: 1650618 - RNA, 15 nt, Homo sapiens
gugugcgucacugug

SEQ ID NO: 1650619 - RNA, 19 nt, Homo sapiens
guguggcaagcaagagcuc

SEQ ID NO: 1650620 - RNA, 22 nt, Homo sapiens
gugugguucagcuacuuuccau

SEQ ID NO: 1650621 - RNA, 14 nt, Homo sapiens
gugugugucucuga

SEQ ID NO: 1650622 - RNA, 15 nt, Homo sapiens
gugugugugcuuaug

SEQ ID NO: 1650623 - RNA, 17 nt, Homo sapiens
guguguugauacuguug

SEQ ID NO: 1650624 - RNA, 9 nt, Homo sapiens
guguuaaau

SEQ ID NO: 1650625 - RNA, 20 nt, Homo sapiens
guguuaugcggucuagggaa

SEQ ID NO: 1650626 - RNA, 20 nt, Homo sapiens
guguuggaaaaugugcaaua

SEQ ID NO: 1650627 - RNA, 15 nt, Homo sapiens
guguuggcaguguuu

SEQ ID NO: 1650628 - RNA, 13 nt, Homo sapiens
guguuuagcuauu

SEQ ID NO: 1650629 - RNA, 17 nt, Homo sapiens
guuaacacuguaauauc

SEQ ID NO: 1650630 - RNA, 21 nt, Homo sapiens
guuaccugaaaacacugugca

SEQ ID NO: 1650631 - RNA, 13 nt, Homo sapiens
guuacuaguacag

SEQ ID NO: 1650632 - RNA, 21 nt, Homo sapiens
guuacugagauguuuuaccau

SEQ ID NO: 1650633 - RNA, 12 nt, Homo sapiens
guuacuguguca

SEQ ID NO: 1650634 - RNA, 18 nt, Homo sapiens
guuagcuaaaggaucuua

SEQ ID NO: 1650635 - RNA, 20 nt, Homo sapiens
uuguauuuaaaugaaaguga

SEQ ID NO: 1650636 - RNA, 22 nt, Homo sapiens
uugucaacaaagucacccacuu

SEQ ID NO: 1650637 - RNA, 16 nt, Homo sapiens
uugucuuuacuccaug

SEQ ID NO: 1650638 - RNA, 23 nt, Homo sapiens
uugugaacccuagcugugucaga

SEQ ID NO: 1650639 - RNA, 21 nt, Homo sapiens
uugugaaguugcccaccaaaa

SEQ ID NO: 1650640 - RNA, 12 nt, Homo sapiens
uugugauugccu

SEQ ID NO: 1650641 - RNA, 15 nt, Homo sapiens
uugugccucacugga

SEQ ID NO: 1650642 - RNA, 17 nt, Homo sapiens
uugugccucacuggacu

SEQ ID NO: 1650643 - RNA, 19 nt, Homo sapiens
uugugggcuuggaccacga

SEQ ID NO: 1650644 - RNA, 22 nt, Homo sapiens
uuguuaauaacuaauaacugga

SEQ ID NO: 1650645 - RNA, 14 nt, Homo sapiens
uuguuaugucuaga

SEQ ID NO: 1650646 - RNA, 13 nt, Homo sapiens
uuguucauucuug

SEQ ID NO: 1650647 - RNA, 10 nt, Homo sapiens
uuguucugua

SEQ ID NO: 1650648 - RNA, 13 nt, Homo sapiens
uuguucuguauau

SEQ ID NO: 1650649 - RNA, 20 nt, Homo sapiens
uuguucuuuggaaauacaca

SEQ ID NO: 1650650 - RNA, 17 nt, Homo sapiens
uuguuggccaaagccaa

SEQ ID NO: 1650651 - RNA, 16 nt, Homo sapiens
uuguuuauuguaaaac

SEQ ID NO: 1650652 - RNA, 15 nt, Homo sapiens
uuuaaaauaugcucu

SEQ ID NO: 1650653 - RNA, 14 nt, Homo sapiens
uuuaaacaguuuag

SEQ ID NO: 1650654 - RNA, 14 nt, Homo sapiens
uuuaaacauaggaa

SEQ ID NO: 1650655 - RNA, 21 nt, Homo sapiens
uuuaaacauuuuuaucuauca

SEQ ID NO: 1650656 - RNA, 17 nt, Homo sapiens
uuuaaagcuugcucaca

SEQ ID NO: 1650657 - RNA, 17 nt, Homo sapiens
uuuaaaguauucuccau

SEQ ID NO: 1650658 - RNA, 23 nt, Homo sapiens
uuuaaauacagucuuccauuugc

SEQ ID NO: 1650659 - RNA, 18 nt, Homo sapiens
uuuaaauauaugcuaagu

SEQ ID NO: 1650660 - RNA, 12 nt, Homo sapiens
uuuaaaucugag

SEQ ID NO: 1650661 - RNA, 16 nt, Homo sapiens
uuuaagauaccuugau

SEQ ID NO: 1650662 - RNA, 17 nt, Homo sapiens
uuuaagauuuuucucaa

SEQ ID NO: 1650663 - RNA, 17 nt, Homo sapiens
uuuaagcucugagcugu

SEQ ID NO: 1650664 - RNA, 21 nt, Homo sapiens
uuuaaguauugcagucuaaaa

SEQ ID NO: 1650665 - RNA, 15 nt, Homo sapiens
uuuaauagcgucaua

SEQ ID NO: 1650666 - RNA, 18 nt, Homo sapiens
uuuaauuagaaauaucuu

SEQ ID NO: 1650667 - RNA, 15 nt, Homo sapiens
uuuaauuucuaugaa

SEQ ID NO: 1650668 - RNA, 11 nt, Homo sapiens
uuuacaguguu

SEQ ID NO: 1650669 - RNA, 21 nt, Homo sapiens
uuuacugaugaaacagccucu

SEQ ID NO: 1650670 - RNA, 13 nt, Homo sapiens
uuuacuuccucag

SEQ ID NO: 1650671 - RNA, 16 nt, Homo sapiens
uuuagaaucagugugu

SEQ ID NO: 1650672 - RNA, 21 nt, Homo sapiens
uuuagacucaaagaauauaau

SEQ ID NO: 1650673 - RNA, 16 nt, Homo sapiens
uuuagugaucacagca

SEQ ID NO: 1650674 - RNA, 15 nt, Homo sapiens
uuuauaaacugagag

SEQ ID NO: 1650675 - RNA, 23 nt, Homo sapiens
uuuauagagcagaacccuagucu

SEQ ID NO: 1650676 - RNA, 20 nt, Homo sapiens
uuuauagucgaacaauucau

SEQ ID NO: 1650677 - RNA, 13 nt, Homo sapiens
uuuauaugcuauu

SEQ ID NO: 1650678 - RNA, 15 nt, Homo sapiens
uuuauguauugugcu

SEQ ID NO: 1650679 - RNA, 22 nt, Homo sapiens
uuuaugucucagaccacuauuc

SEQ ID NO: 1650680 - RNA, 19 nt, Homo sapiens
uuuauuauauuuuucccua

SEQ ID NO: 1650681 - RNA, 13 nt, Homo sapiens
uuuauuccaaaau

SEQ ID NO: 1650682 - RNA, 15 nt, Homo sapiens
uuuauucuuccucaa

SEQ ID NO: 1650683 - RNA, 15 nt, Homo sapiens
uuuauugcugaauga

SEQ ID NO: 1650684 - RNA, 21 nt, Homo sapiens
uuuauuguaaaacagcuaaau

SEQ ID NO: 1650685 - RNA, 19 nt, Homo sapiens
uuuauuuuuguagagccag

SEQ ID NO: 1650686 - RNA, 16 nt, Homo sapiens
uuucaaaaccuuuuga

SEQ ID NO: 1650687 - RNA, 18 nt, Homo sapiens
uuucaaauuggagcuuca

SEQ ID NO: 1650688 - RNA, 15 nt, Homo sapiens
uuucaauaaaccuaa

SEQ ID NO: 1650689 - RNA, 17 nt, Homo sapiens
uuucaauaaaccuaaua

SEQ ID NO: 1650690 - RNA, 20 nt, Homo sapiens
uuucaauaucuuuauugcau

SEQ ID NO: 1650691 - RNA, 14 nt, Homo sapiens
uuucaccuucauau

SEQ ID NO: 1650692 - RNA, 11 nt, Homo sapiens
uuucagaacac

SEQ ID NO: 1650693 - RNA, 16 nt, Homo sapiens
uuucaggccacauggc

SEQ ID NO: 1650694 - RNA, 19 nt, Homo sapiens
uuucagguuccaaucagaa

SEQ ID NO: 1650695 - RNA, 19 nt, Homo sapiens
uuucagugaaagcaucacu

SEQ ID NO: 1650696 - RNA, 22 nt, Homo sapiens
uuucaucugcucuccuuccugg

SEQ ID NO: 1650697 - RNA, 17 nt, Homo sapiens
uuuccaaaggccaugga

SEQ ID NO: 1650698 - RNA, 10 nt, Homo sapiens
uuuccaugau

SEQ ID NO: 1650699 - RNA, 22 nt, Homo sapiens
uuuccaugcacccucauacaca

SEQ ID NO: 1650700 - RNA, 13 nt, Homo sapiens
uuucccaucacug

SEQ ID NO: 1650701 - RNA, 21 nt, Homo sapiens
uuucccugggagcuguucucu

SEQ ID NO: 1650702 - RNA, 15 nt, Homo sapiens
uuuccgaaaucagaa

SEQ ID NO: 1650703 - RNA, 15 nt, Homo sapiens
uuucuccucuccauc

SEQ ID NO: 1650704 - RNA, 17 nt, Homo sapiens
uuucucuagggagaaaa

SEQ ID NO: 1650705 - RNA, 16 nt, Homo sapiens
uuucugaucugaugca

SEQ ID NO: 1650706 - RNA, 13 nt, Homo sapiens
uuucugcauuuca

SEQ ID NO: 1650707 - RNA, 18 nt, Homo sapiens
uuucuggaggucucugaa

SEQ ID NO: 1650708 - RNA, 16 nt, Homo sapiens
uuucuuccauucccau

SEQ ID NO: 1650709 - RNA, 22 nt, Homo sapiens
uuucuugaacauacuugguuuc

SEQ ID NO: 1650710 - RNA, 13 nt, Homo sapiens
uuucuugcaugag

SEQ ID NO: 1650711 - RNA, 18 nt, Homo sapiens
uuucuuuuuuauacucaa

SEQ ID NO: 1650712 - RNA, 14 nt, Homo sapiens
uuugaaaucuauga

SEQ ID NO: 1650713 - RNA, 15 nt, Homo sapiens
uuugaaaucuaugaa

SEQ ID NO: 1650714 - RNA, 18 nt, Homo sapiens
uuugaccuguggugcaaa

SEQ ID NO: 1650715 - RNA, 20 nt, Homo sapiens
uuugacugugcuagcuaaaa

SEQ ID NO: 1650716 - RNA, 15 nt, Homo sapiens
uuugaggguguauau

SEQ ID NO: 1650717 - RNA, 19 nt, Homo sapiens
uuugaugaggcccuccaca

SEQ ID NO: 1650718 - RNA, 14 nt, Homo sapiens
uuugauucagacag

SEQ ID NO: 1650719 - RNA, 20 nt, Homo sapiens
uuugcaagggaaaagucucu

SEQ ID NO: 1650720 - RNA, 22 nt, Homo sapiens
uuugcagcuuucucuaguucaa

SEQ ID NO: 1650721 - RNA, 23 nt, Homo sapiens
uuugccauauuuucaccauuuga

SEQ ID NO: 1650722 - RNA, 15 nt, Homo sapiens
uuugcugacuuuaaa

SEQ ID NO: 1650723 - RNA, 16 nt, Homo sapiens
uuugcugcuguggaaa

SEQ ID NO: 1650724 - RNA, 11 nt, Homo sapiens
uuugcuguaga

SEQ ID NO: 1650725 - RNA, 17 nt, Homo sapiens
uuugcuguuaacuguua

SEQ ID NO: 1650726 - RNA, 22 nt, Homo sapiens
uuuggaaaucacacgucuggcu

SEQ ID NO: 1650727 - RNA, 19 nt, Homo sapiens
uuuggaaauugagucugaa

SEQ ID NO: 1650728 - RNA, 15 nt, Homo sapiens
uuuggauuacuuaaa

SEQ ID NO: 1650729 - RNA, 13 nt, Homo sapiens
uuuguaacuuuag

SEQ ID NO: 1650730 - RNA, 20 nt, Homo sapiens
uuuguauccucugaccuaca

SEQ ID NO: 1650731 - RNA, 12 nt, Homo sapiens
uuugucuuuaug

SEQ ID NO: 1650732 - RNA, 14 nt, Homo sapiens
uuugugauucccuc

SEQ ID NO: 1650733 - RNA, 13 nt, Homo sapiens
uuuguucuguaua

SEQ ID NO: 1650734 - RNA, 16 nt, Homo sapiens
uuuguugagucucuga

SEQ ID NO: 1650735 - RNA, 14 nt, Homo sapiens
uuuguuucaaucuc

SEQ ID NO: 1650736 - RNA, 13 nt, Homo sapiens
uuuuaaacauucu

SEQ ID NO: 1650737 - RNA, 21 nt, Homo sapiens
uuuuaauaacuuaucuauaaa

SEQ ID NO: 1650738 - RNA, 13 nt, Homo sapiens
uuuuagacagagu

SEQ ID NO: 1650739 - RNA, 20 nt, Homo sapiens
uuuuagucuaauugaauccc

SEQ ID NO: 1650740 - RNA, 23 nt, Homo sapiens
uuuuauuuuuagacagagucuca

SEQ ID NO: 1650741 - RNA, 23 nt, Homo sapiens
uuuucaauguuagccacagugua

SEQ ID NO: 1650742 - RNA, 19 nt, Homo sapiens
uuuuccagcuccucaucca

SEQ ID NO: 1650743 - RNA, 21 nt, Homo sapiens
uuuucuaaacaagaaccauuu

SEQ ID NO: 1650744 - RNA, 21 nt, Homo sapiens
uuuucuaagaaagaaauugua

SEQ ID NO: 1650745 - RNA, 18 nt, Homo sapiens
cacuggucuaauguuugu

SEQ ID NO: 1650746 - RNA, 16 nt, Homo sapiens
cacugugggcuuuuau

SEQ ID NO: 1650747 - RNA, 14 nt, Homo sapiens
cacuguuaagccau

SEQ ID NO: 1650748 - RNA, 14 nt, Homo sapiens
cacuguugcccagg

SEQ ID NO: 1650749 - RNA, 12 nt, Homo sapiens
cacuuaccuuau

SEQ ID NO: 1650750 - RNA, 15 nt, Homo sapiens
cacuuauaaauaucc

SEQ ID NO: 1650751 - RNA, 16 nt, Homo sapiens
cacuuauugacuauua

SEQ ID NO: 1650752 - RNA, 16 nt, Homo sapiens
cacuuccaagagccuu

SEQ ID NO: 1650753 - RNA, 13 nt, Homo sapiens
cacuucucaggaa

SEQ ID NO: 1650754 - RNA, 19 nt, Homo sapiens
cacuucugagaacucaucc

SEQ ID NO: 1650755 - RNA, 12 nt, Homo sapiens
cacuucuuccau

SEQ ID NO: 1650756 - RNA, 21 nt, Homo sapiens
cacuugaugugauguggcagg

SEQ ID NO: 1650757 - RNA, 21 nt, Homo sapiens
cacuugcagacucuacagagg

SEQ ID NO: 1650758 - RNA, 15 nt, Homo sapiens
cacuuggcaucagcu

SEQ ID NO: 1650759 - RNA, 19 nt, Homo sapiens
cacuuggugauauguccua

SEQ ID NO: 1650760 - RNA, 22 nt, Homo sapiens
cacuuggugauauguccuauau

SEQ ID NO: 1650761 - RNA, 17 nt, Homo sapiens
cacuuguucauucugug

SEQ ID NO: 1650762 - RNA, 19 nt, Homo sapiens
cacuuguucauucugugac

SEQ ID NO: 1650763 - RNA, 18 nt, Homo sapiens
cacuuuaaagcaauugca

SEQ ID NO: 1650764 - RNA, 21 nt, Homo sapiens
cacuuuuaacagaacagacag

SEQ ID NO: 1650765 - RNA, 23 nt, Homo sapiens
cagaaggaaaaaaacaugaauuu

SEQ ID NO: 1650766 - RNA, 17 nt, Homo sapiens
cagaaucaaaugcaauu

SEQ ID NO: 1650767 - RNA, 15 nt, Homo sapiens
cagaaucagaucuga

SEQ ID NO: 1650768 - RNA, 12 nt, Homo sapiens
cagaauguugaa

SEQ ID NO: 1650769 - RNA, 20 nt, Homo sapiens
cagaauuuuaugcggcauuu

SEQ ID NO: 1650770 - RNA, 18 nt, Homo sapiens
cagacuccacacucagua

SEQ ID NO: 1650771 - RNA, 18 nt, Homo sapiens
cagacuccuagacucacu

SEQ ID NO: 1650772 - RNA, 20 nt, Homo sapiens
cagacuucauagaauacuca

SEQ ID NO: 1650773 - RNA, 14 nt, Homo sapiens
cagacuucucaaua

SEQ ID NO: 1650774 - RNA, 16 nt, Homo sapiens
cagagaaaagacauaa

SEQ ID NO: 1650775 - RNA, 17 nt, Homo sapiens
cagagacacuguugaua

SEQ ID NO: 1650776 - RNA, 15 nt, Homo sapiens
cagagaccaucccug

SEQ ID NO: 1650777 - RNA, 13 nt, Homo sapiens
cagagacugggac

SEQ ID NO: 1650778 - RNA, 21 nt, Homo sapiens
cagagauaauucuagcuuuga

SEQ ID NO: 1650779 - RNA, 15 nt, Homo sapiens
cagagcagaugcaga

SEQ ID NO: 1650780 - RNA, 15 nt, Homo sapiens
cagagccucaaauga

SEQ ID NO: 1650781 - RNA, 15 nt, Homo sapiens
cagagcucucugagg

SEQ ID NO: 1650782 - RNA, 22 nt, Homo sapiens
cagagcuuggacuggaugcaug

SEQ ID NO: 1650783 - RNA, 17 nt, Homo sapiens
cagaguccucuaugaac

SEQ ID NO: 1650784 - RNA, 12 nt, Homo sapiens
cagagucucacu

SEQ ID NO: 1650785 - RNA, 18 nt, Homo sapiens
cagagucucacuguugcc

SEQ ID NO: 1650786 - RNA, 22 nt, Homo sapiens
cagaguggaguugaaacugcua

SEQ ID NO: 1650787 - RNA, 17 nt, Homo sapiens
cagauaauguccuugcu

SEQ ID NO: 1650788 - RNA, 19 nt, Homo sapiens
cagauauauuuaagccuua

SEQ ID NO: 1650789 - RNA, 15 nt, Homo sapiens
cagaucacagugucu

SEQ ID NO: 1650790 - RNA, 19 nt, Homo sapiens
cagaucuaccccuuacuua

SEQ ID NO: 1650791 - RNA, 14 nt, Homo sapiens
cagaugcaccagcc

SEQ ID NO: 1650792 - RNA, 21 nt, Homo sapiens
cagaugcccacguaugugaaa

SEQ ID NO: 1650793 - RNA, 22 nt, Homo sapiens
cagaugggagugcccccaacag

SEQ ID NO: 1650794 - RNA, 20 nt, Homo sapiens
cagaugugagggcaccacca

SEQ ID NO: 1650795 - RNA, 19 nt, Homo sapiens
cagauugcaacaggcuggg

SEQ ID NO: 1650796 - RNA, 20 nt, Homo sapiens
cagauuggcucacacugaga

SEQ ID NO: 1650797 - RNA, 19 nt, Homo sapiens
cagauuuuaacagcucucu

SEQ ID NO: 1650798 - RNA, 22 nt, Homo sapiens
cagcaaacaggugcuaauuugu

SEQ ID NO: 1650799 - RNA, 20 nt, Homo sapiens
cagcacagaacacacugaga

SEQ ID NO: 1650800 - RNA, 13 nt, Homo sapiens
cagcacuuugcaa

SEQ ID NO: 1650801 - RNA, 18 nt, Homo sapiens
cagcaucgugaucacuga

SEQ ID NO: 1650802 - RNA, 21 nt, Homo sapiens
cagcaucgugaucacugagcc

SEQ ID NO: 1650803 - RNA, 13 nt, Homo sapiens
cagcauguugccc

SEQ ID NO: 1650804 - RNA, 12 nt, Homo sapiens
cagcauucucag

SEQ ID NO: 1650805 - RNA, 19 nt, Homo sapiens
cagccaggugcugugacac

SEQ ID NO: 1650806 - RNA, 13 nt, Homo sapiens
cagccaucccagc

SEQ ID NO: 1650807 - RNA, 16 nt, Homo sapiens
cagccccagugcccac

SEQ ID NO: 1650808 - RNA, 12 nt, Homo sapiens
cagcccuggugg

SEQ ID NO: 1650809 - RNA, 18 nt, Homo sapiens
cagccucccaaaguucug

SEQ ID NO: 1650810 - RNA, 20 nt, Homo sapiens
cagccucccgaauagcuggg

SEQ ID NO: 1650811 - RNA, 22 nt, Homo sapiens
cagccuccuuauauuuggccca

SEQ ID NO: 1650812 - RNA, 22 nt, Homo sapiens
cagccugacaacagccugagaa

SEQ ID NO: 1650813 - RNA, 14 nt, Homo sapiens
cagcgugaagggau

SEQ ID NO: 1650814 - RNA, 13 nt, Homo sapiens
cagcuaaaaccua

SEQ ID NO: 1650815 - RNA, 12 nt, Homo sapiens
cagcuaacacac

SEQ ID NO: 1650816 - RNA, 16 nt, Homo sapiens
cagcuaagaugccaug

SEQ ID NO: 1650817 - RNA, 12 nt, Homo sapiens
cagcucaucucu

SEQ ID NO: 1650818 - RNA, 17 nt, Homo sapiens
cagcuccccagaguccu

SEQ ID NO: 1650819 - RNA, 18 nt, Homo sapiens
cagcucucaguugcagcc

SEQ ID NO: 1650820 - RNA, 14 nt, Homo sapiens
cagcugacacaucu

SEQ ID NO: 1650821 - RNA, 18 nt, Homo sapiens
cagcugcuggcugugaca

SEQ ID NO: 1650822 - RNA, 19 nt, Homo sapiens
cagcugcuggcugugacaa

SEQ ID NO: 1650823 - RNA, 18 nt, Homo sapiens
cagcuggaaguggcucug

SEQ ID NO: 1650824 - RNA, 22 nt, Homo sapiens
cagcuggccgggagccugauca

SEQ ID NO: 1650825 - RNA, 13 nt, Homo sapiens
cagcuguuuaugc

SEQ ID NO: 1650826 - RNA, 17 nt, Homo sapiens
cagcuuauauucaucca

SEQ ID NO: 1650827 - RNA, 21 nt, Homo sapiens
cagcuugaaaccuucacuuag

SEQ ID NO: 1650828 - RNA, 23 nt, Homo sapiens
caggaaaaagaacuuccccauac

SEQ ID NO: 1650829 - RNA, 13 nt, Homo sapiens
caggaacauacag

SEQ ID NO: 1650830 - RNA, 20 nt, Homo sapiens
caggaagaccccagcacaga

SEQ ID NO: 1650831 - RNA, 13 nt, Homo sapiens
caggaagcucagg

SEQ ID NO: 1650832 - RNA, 15 nt, Homo sapiens
caggacuuccaucug

SEQ ID NO: 1650833 - RNA, 17 nt, Homo sapiens
caggagacaaaagagca

SEQ ID NO: 1650834 - RNA, 20 nt, Homo sapiens
caggagccggacacuucuca

SEQ ID NO: 1650835 - RNA, 23 nt, Homo sapiens
caggagccggacacuucucagga

SEQ ID NO: 1650836 - RNA, 19 nt, Homo sapiens
caggaguacaccccaacag

SEQ ID NO: 1650837 - RNA, 15 nt, Homo sapiens
caggaucauggugua

SEQ ID NO: 1650838 - RNA, 12 nt, Homo sapiens
caggauccaaua

SEQ ID NO: 1650839 - RNA, 14 nt, Homo sapiens
caggaugauuuugg

SEQ ID NO: 1650840 - RNA, 22 nt, Homo sapiens
caggauuauuuugauuauauac

SEQ ID NO: 1650841 - RNA, 19 nt, Homo sapiens
caggauucccccaacacac

SEQ ID NO: 1650842 - RNA, 16 nt, Homo sapiens
caggauuggggaccug

SEQ ID NO: 1650843 - RNA, 17 nt, Homo sapiens
caggcaaagcaagugau

SEQ ID NO: 1650844 - RNA, 18 nt, Homo sapiens
caggcaacgcacaaaaca

SEQ ID NO: 1650845 - RNA, 23 nt, Homo sapiens
caggcaaugugacuuugcaucag

SEQ ID NO: 1650846 - RNA, 18 nt, Homo sapiens
ccaucagaaacacccuca

SEQ ID NO: 1650847 - RNA, 20 nt, Homo sapiens
ccaucagcaaauauuauucu

SEQ ID NO: 1650848 - RNA, 20 nt, Homo sapiens
ccauccaaagaauuaugcau

SEQ ID NO: 1650849 - RNA, 16 nt, Homo sapiens
ccauccuugagucaaa

SEQ ID NO: 1650850 - RNA, 15 nt, Homo sapiens
ccugagguuugccag

SEQ ID NO: 1650851 - RNA, 20 nt, Homo sapiens
ccugagguuugccagcauuu

SEQ ID NO: 1650852 - RNA, 20 nt, Homo sapiens
ccugauaggacccauauucc

SEQ ID NO: 1650853 - RNA, 15 nt, Homo sapiens
ccugccaggcacacu

SEQ ID NO: 1650854 - RNA, 16 nt, Homo sapiens
ccugccuaaggaagcu

SEQ ID NO: 1650855 - RNA, 23 nt, Homo sapiens
ccugccuccacccacaguggaga

SEQ ID NO: 1650856 - RNA, 17 nt, Homo sapiens
ccugccucuuuucccca

SEQ ID NO: 1650857 - RNA, 13 nt, Homo sapiens
ccugccuucucag

SEQ ID NO: 1650858 - RNA, 23 nt, Homo sapiens
ccugcuuauacuuuucucaauau

SEQ ID NO: 1650859 - RNA, 19 nt, Homo sapiens
ccuggaccccugcauugga

SEQ ID NO: 1650860 - RNA, 16 nt, Homo sapiens
ccuggccaaagggaua

SEQ ID NO: 1650861 - RNA, 16 nt, Homo sapiens
ccuggcccaucagugu

SEQ ID NO: 1650862 - RNA, 18 nt, Homo sapiens
ccugggagccagggugag

SEQ ID NO: 1650863 - RNA, 17 nt, Homo sapiens
ccugggguaccaagaga

SEQ ID NO: 1650864 - RNA, 12 nt, Homo sapiens
ccugggugacaa

SEQ ID NO: 1650865 - RNA, 18 nt, Homo sapiens
ccugguaccuagcaaagc

SEQ ID NO: 1650866 - RNA, 13 nt, Homo sapiens
ccugguuccacau

SEQ ID NO: 1650867 - RNA, 12 nt, Homo sapiens
ccugguucucau

SEQ ID NO: 1650868 - RNA, 15 nt, Homo sapiens
ccugguucugaugau

SEQ ID NO: 1650869 - RNA, 14 nt, Homo sapiens
ccugguuuccugcc

SEQ ID NO: 1650870 - RNA, 20 nt, Homo sapiens
ccuguaaagucugaguaaga

SEQ ID NO: 1650871 - RNA, 18 nt, Homo sapiens
ccuguaaucccagcacuu

SEQ ID NO: 1650872 - RNA, 17 nt, Homo sapiens
ccuguacuguauggaaa

SEQ ID NO: 1650873 - RNA, 14 nt, Homo sapiens
ccugugauguccca

SEQ ID NO: 1650874 - RNA, 16 nt, Homo sapiens
ccuguucugugacugu

SEQ ID NO: 1650875 - RNA, 22 nt, Homo sapiens
ccuuacucauuaauucaaugaa

SEQ ID NO: 1650876 - RNA, 15 nt, Homo sapiens
ccuuagaaguggaag

SEQ ID NO: 1650877 - RNA, 14 nt, Homo sapiens
ccuuagacaguccc

SEQ ID NO: 1650878 - RNA, 22 nt, Homo sapiens
ccuucaugaucaucacaaucau

SEQ ID NO: 1650879 - RNA, 17 nt, Homo sapiens
ccuuccaggggugggac

SEQ ID NO: 1650880 - RNA, 13 nt, Homo sapiens
ccuucccaugacc

SEQ ID NO: 1650881 - RNA, 17 nt, Homo sapiens
ccuucccaugacccagg

SEQ ID NO: 1650882 - RNA, 14 nt, Homo sapiens
ccuucucucaucuc

SEQ ID NO: 1650883 - RNA, 20 nt, Homo sapiens
ccuucugacgcagccugaga

SEQ ID NO: 1650884 - RNA, 21 nt, Homo sapiens
ccuucugacgcagccugagaa

SEQ ID NO: 1650885 - RNA, 19 nt, Homo sapiens
ccuucugccaguucccucc

SEQ ID NO: 1650886 - RNA, 14 nt, Homo sapiens
ccuucugccuuugu

SEQ ID NO: 1650887 - RNA, 18 nt, Homo sapiens
ccuucuuuuuguucuuca

SEQ ID NO: 1650888 - RNA, 13 nt, Homo sapiens
ccuugaaggguuc

SEQ ID NO: 1650889 - RNA, 20 nt, Homo sapiens
ccuugacaaacuucuuucac

SEQ ID NO: 1650890 - RNA, 13 nt, Homo sapiens
ccuugagucaaaa

SEQ ID NO: 1650891 - RNA, 14 nt, Homo sapiens
ccuugaugcucaua

SEQ ID NO: 1650892 - RNA, 23 nt, Homo sapiens
ccuugauuaguguaguguuaaag

SEQ ID NO: 1650893 - RNA, 23 nt, Homo sapiens
ccuuggggcaugacccagugaag

SEQ ID NO: 1650894 - RNA, 14 nt, Homo sapiens
ccuuguccccauga

SEQ ID NO: 1650895 - RNA, 21 nt, Homo sapiens
ccuugugaggguugcuucaau

SEQ ID NO: 1650896 - RNA, 17 nt, Homo sapiens
ccuuguuguucuuuaac

SEQ ID NO: 1650897 - RNA, 23 nt, Homo sapiens
ccuuguuguucuuuaacccucac

SEQ ID NO: 1650898 - RNA, 17 nt, Homo sapiens
ccuuuaaaaaugcacca

SEQ ID NO: 1650899 - RNA, 15 nt, Homo sapiens
ccuuuagugaucaca

SEQ ID NO: 1650900 - RNA, 20 nt, Homo sapiens
ccuuucaccacaugugcaca

SEQ ID NO: 1650901 - RNA, 18 nt, Homo sapiens
ccuuuccugcgccccaga

SEQ ID NO: 1650902 - RNA, 17 nt, Homo sapiens
ccuuuuauuucuuaaac

SEQ ID NO: 1650903 - RNA, 16 nt, Homo sapiens
cgaacaauucauauau

SEQ ID NO: 1650904 - RNA, 13 nt, Homo sapiens
cgaacuccugacc

SEQ ID NO: 1650905 - RNA, 20 nt, Homo sapiens
cgaauguaauuggaaucuuc

SEQ ID NO: 1650906 - RNA, 13 nt, Homo sapiens
cgaccagacaccu

SEQ ID NO: 1650907 - RNA, 20 nt, Homo sapiens
cgagaucgugccauugcacu

SEQ ID NO: 1650908 - RNA, 22 nt, Homo sapiens
cgagcauaagaaauaaaaucua

SEQ ID NO: 1650909 - RNA, 17 nt, Homo sapiens
cgagccuggcuccaaac

SEQ ID NO: 1650910 - RNA, 18 nt, Homo sapiens
cgagcgcuaccucuccag

SEQ ID NO: 1650911 - RNA, 16 nt, Homo sapiens
cgagugcucauuucag

SEQ ID NO: 1650912 - RNA, 20 nt, Homo sapiens
cgaucucaacucacugcaag

SEQ ID NO: 1650913 - RNA, 18 nt, Homo sapiens
cgaucuggguucacugca

SEQ ID NO: 1650914 - RNA, 13 nt, Homo sapiens
cgaugacaguguu

SEQ ID NO: 1650915 - RNA, 17 nt, Homo sapiens
cgcaccaauaaagccuu

SEQ ID NO: 1650916 - RNA, 18 nt, Homo sapiens
cgcaccaauaaagccuuc

SEQ ID NO: 1650917 - RNA, 19 nt, Homo sapiens
cgccagauucuuuccugag

SEQ ID NO: 1650918 - RNA, 11 nt, Homo sapiens
cgcgcacacac

SEQ ID NO: 1650919 - RNA, 11 nt, Homo sapiens
cgcgugcacac

SEQ ID NO: 1650920 - RNA, 12 nt, Homo sapiens
cgcuaguggagg

SEQ ID NO: 1650921 - RNA, 18 nt, Homo sapiens
cgcuggguccucugcagu

SEQ ID NO: 1650922 - RNA, 14 nt, Homo sapiens
cgcuuaagcuuuca

SEQ ID NO: 1650923 - RNA, 13 nt, Homo sapiens
cggacacuucuca

SEQ ID NO: 1650924 - RNA, 19 nt, Homo sapiens
cggacauggucuguccuga

SEQ ID NO: 1650925 - RNA, 17 nt, Homo sapiens
cggagaacaaaugugaa

SEQ ID NO: 1650926 - RNA, 13 nt, Homo sapiens
cggaguuccagca

SEQ ID NO: 1650927 - RNA, 11 nt, Homo sapiens
cggaugacagc

SEQ ID NO: 1650928 - RNA, 22 nt, Homo sapiens
cgggaggauguucugggacaca

SEQ ID NO: 1650929 - RNA, 13 nt, Homo sapiens
cgggcgcugccag

SEQ ID NO: 1650930 - RNA, 15 nt, Homo sapiens
cggggcucuucucau

SEQ ID NO: 1650931 - RNA, 20 nt, Homo sapiens
cgggguuucaccauguuggc

SEQ ID NO: 1650932 - RNA, 12 nt, Homo sapiens
cgguaagcacuu

SEQ ID NO: 1650933 - RNA, 21 nt, Homo sapiens
cggugagcuacaaaugcauuu

SEQ ID NO: 1650934 - RNA, 20 nt, Homo sapiens
cguaugagauccuuuagucc

SEQ ID NO: 1650935 - RNA, 13 nt, Homo sapiens
cguccuacuguau

SEQ ID NO: 1650936 - RNA, 21 nt, Homo sapiens
cgucuacucauuccccggggc

SEQ ID NO: 1650937 - RNA, 19 nt, Homo sapiens
cgucuuucacaguuucuuc

SEQ ID NO: 1650938 - RNA, 18 nt, Homo sapiens
cgugaccugccaggcaca

SEQ ID NO: 1650939 - RNA, 16 nt, Homo sapiens
cgugugucuguguuga

SEQ ID NO: 1650940 - RNA, 14 nt, Homo sapiens
cguugagcaucuau

SEQ ID NO: 1650941 - RNA, 21 nt, Homo sapiens
cguuguucccacugaaaugga

SEQ ID NO: 1650942 - RNA, 23 nt, Homo sapiens
cuaaaauaagggcagagucacac

SEQ ID NO: 1650943 - RNA, 21 nt, Homo sapiens
cuaaaauauuuucuacaucuu

SEQ ID NO: 1650944 - RNA, 22 nt, Homo sapiens
cuaaaaugauacuguguucccu

SEQ ID NO: 1650945 - RNA, 14 nt, Homo sapiens
cuaaaauguucuaa

SEQ ID NO: 1650946 - RNA, 18 nt, Homo sapiens
cuaaacuccaggauuuau

SEQ ID NO: 1650947 - RNA, 22 nt, Homo sapiens
cuaaagaagguuucagaaagaa

SEQ ID NO: 1650948 - RNA, 12 nt, Homo sapiens
cuaaauccauua

SEQ ID NO: 1650949 - RNA, 19 nt, Homo sapiens
cuaaauuguuguaauugca

SEQ ID NO: 1650950 - RNA, 14 nt, Homo sapiens
cuaacaaagaccau

SEQ ID NO: 1650951 - RNA, 13 nt, Homo sapiens
cuaacaauuguga

SEQ ID NO: 1650952 - RNA, 17 nt, Homo sapiens
cuaacaggagaaugcac

SEQ ID NO: 1650953 - RNA, 14 nt, Homo sapiens
cuaacccccaaaua

SEQ ID NO: 1650954 - RNA, 17 nt, Homo sapiens
cuaagaacaccugcauu

SEQ ID NO: 1650955 - RNA, 17 nt, Homo sapiens
cuaagcagaccacugau

SEQ ID NO: 1650956 - RNA, 17 nt, Homo sapiens
cuaagcuucacuguaaa

SEQ ID NO: 1650957 - RNA, 17 nt, Homo sapiens
cuaaggaagcuaaaagc

SEQ ID NO: 1650958 - RNA, 21 nt, Homo sapiens
cuaaggagcugauacuuugac

SEQ ID NO: 1650959 - RNA, 22 nt, Homo sapiens
cuaagucuuauauauuguagau

SEQ ID NO: 1650960 - RNA, 17 nt, Homo sapiens
gccugagguuugccagc

SEQ ID NO: 1650961 - RNA, 19 nt, Homo sapiens
gccugaguuuagggucaag

SEQ ID NO: 1650962 - RNA, 21 nt, Homo sapiens
gccugaguuuagggucaagga

SEQ ID NO: 1650963 - RNA, 22 nt, Homo sapiens
gccugccuucucagggacuucu

SEQ ID NO: 1650964 - RNA, 15 nt, Homo sapiens
gccuggcuccaaacc

SEQ ID NO: 1650965 - RNA, 15 nt, Homo sapiens
gccugggaucccuca

SEQ ID NO: 1650966 - RNA, 15 nt, Homo sapiens
gccuuaaccaugagg

SEQ ID NO: 1650967 - RNA, 21 nt, Homo sapiens
gccuuaggaaaagcauuugcu

SEQ ID NO: 1650968 - RNA, 16 nt, Homo sapiens
gccuuauaaaccaauc

SEQ ID NO: 1650969 - RNA, 13 nt, Homo sapiens
gccuucaaacucc

SEQ ID NO: 1650970 - RNA, 13 nt, Homo sapiens
gccuucucaggga

SEQ ID NO: 1650971 - RNA, 16 nt, Homo sapiens
gccuucuuuaugggaa

SEQ ID NO: 1650972 - RNA, 16 nt, Homo sapiens
gcgagugcucauuuca

SEQ ID NO: 1650973 - RNA, 16 nt, Homo sapiens
gcgauuacaggcauga

SEQ ID NO: 1650974 - RNA, 12 nt, Homo sapiens
gcgugacaauaa

SEQ ID NO: 1650975 - RNA, 16 nt, Homo sapiens
gcgugagccacugcac

SEQ ID NO: 1650976 - RNA, 19 nt, Homo sapiens
gcguguguagaguuaagaa

SEQ ID NO: 1650977 - RNA, 19 nt, Homo sapiens
gcuaacacacagcucccau

SEQ ID NO: 1650978 - RNA, 14 nt, Homo sapiens
gcuaauugagacca

SEQ ID NO: 1650979 - RNA, 23 nt, Homo sapiens
gcaaggaaacuauguaacaugua

SEQ ID NO: 1650980 - RNA, 18 nt, Homo sapiens
gcaaucagcuaccauuca

SEQ ID NO: 1650981 - RNA, 20 nt, Homo sapiens
gcaaucagcuaccauucaaa

SEQ ID NO: 1650982 - RNA, 22 nt, Homo sapiens
gcaauguguggcugaagacuuu

SEQ ID NO: 1650983 - RNA, 19 nt, Homo sapiens
gcacacacuguguacagua

SEQ ID NO: 1650984 - RNA, 15 nt, Homo sapiens
gcacagaagacagca

SEQ ID NO: 1650985 - RNA, 18 nt, Homo sapiens
gcacagacccugcccugu

SEQ ID NO: 1650986 - RNA, 19 nt, Homo sapiens
gcacagacccugcccugug

SEQ ID NO: 1650987 - RNA, 13 nt, Homo sapiens
gcacagcugccaa

SEQ ID NO: 1650988 - RNA, 18 nt, Homo sapiens
gcacaguugccacauuua

SEQ ID NO: 1650989 - RNA, 19 nt, Homo sapiens
gcaccaaaucaucucucau

SEQ ID NO: 1650990 - RNA, 15 nt, Homo sapiens
gcaccaauaaagccu

SEQ ID NO: 1650991 - RNA, 12 nt, Homo sapiens
gcaccaccaaga

SEQ ID NO: 1650992 - RNA, 15 nt, Homo sapiens
gcacccucuccagau

SEQ ID NO: 1650993 - RNA, 18 nt, Homo sapiens
gcaccgcuucucagccac

SEQ ID NO: 1650994 - RNA, 13 nt, Homo sapiens
gcaccuaccacca

SEQ ID NO: 1650995 - RNA, 21 nt, Homo sapiens
gcaccuagaauuggcugaacu

SEQ ID NO: 1650996 - RNA, 20 nt, Homo sapiens
gagccgagaucgugccauug

SEQ ID NO: 1650997 - RNA, 14 nt, Homo sapiens
gagccuuccagggg

SEQ ID NO: 1650998 - RNA, 17 nt, Homo sapiens
gagcgcuaccucuccag

SEQ ID NO: 1650999 - RNA, 13 nt, Homo sapiens
gagcgcuccugcc

SEQ ID NO: 1651000 - RNA, 13 nt, Homo sapiens
gagcuagaaccug

SEQ ID NO: 1651001 - RNA, 18 nt, Homo sapiens
gagcuagaaccuggagag

SEQ ID NO: 1651002 - RNA, 17 nt, Homo sapiens
gagcuggaccugccugc

SEQ ID NO: 1651003 - RNA, 11 nt, Homo sapiens
gagcugggaug

SEQ ID NO: 1651004 - RNA, 21 nt, Homo sapiens
gagcuucccugacucauucug

SEQ ID NO: 1651005 - RNA, 20 nt, Homo sapiens
gagcuuguaauaaauacugc

SEQ ID NO: 1651006 - RNA, 15 nt, Homo sapiens
gaggacuucugcauc

SEQ ID NO: 1651007 - RNA, 17 nt, Homo sapiens
gaggacuuuucuuugug

SEQ ID NO: 1651008 - RNA, 19 nt, Homo sapiens
gaggagggucggugccuuc

SEQ ID NO: 1651009 - RNA, 14 nt, Homo sapiens
gaggauaugggugg

SEQ ID NO: 1651010 - RNA, 15 nt, Homo sapiens
gaggcaaagaacaau

SEQ ID NO: 1651011 - RNA, 19 nt, Homo sapiens
gaagggcuagaaccuggag

SEQ ID NO: 1651012 - RNA, 23 nt, Homo sapiens
gaagggcuuggacucaagcaaga

SEQ ID NO: 1651013 - RNA, 15 nt, Homo sapiens
gaaggggacaauggc

SEQ ID NO: 1651014 - RNA, 19 nt, Homo sapiens
gaaguaagcaaagacuuuc

SEQ ID NO: 1651015 - RNA, 21 nt, Homo sapiens
gaaguaagcaaagacuuuccu

SEQ ID NO: 1651016 - RNA, 14 nt, Homo sapiens
gaaguauguauauu

SEQ ID NO: 1651017 - RNA, 14 nt, Homo sapiens
gaagucacacagua

SEQ ID NO: 1651018 - RNA, 15 nt, Homo sapiens
gaagucaugcguuua

SEQ ID NO: 1651019 - RNA, 14 nt, Homo sapiens
gaauaauccagaaa

SEQ ID NO: 1651020 - RNA, 19 nt, Homo sapiens
gaauacaaacaccuggacu

SEQ ID NO: 1651021 - RNA, 20 nt, Homo sapiens
gaaucagauuuuaacagcuc

SEQ ID NO: 1651022 - RNA, 15 nt, Homo sapiens
gaaucaguguguuac

SEQ ID NO: 1651023 - RNA, 13 nt, Homo sapiens
caaggacacagau

SEQ ID NO: 1651024 - RNA, 22 nt, Homo sapiens
caaggagacacaacaacuccua

SEQ ID NO: 1651025 - RNA, 16 nt, Homo sapiens
caaggaggccacguga

SEQ ID NO: 1651026 - RNA, 16 nt, Homo sapiens
caaggcacugccugau

SEQ ID NO: 1651027 - RNA, 17 nt, Homo sapiens
caaggccucccacagug

SEQ ID NO: 1651028 - RNA, 19 nt, Homo sapiens
caaggcggguggaucacaa

SEQ ID NO: 1651029 - RNA, 21 nt, Homo sapiens
caagggaugggaccugaugac

SEQ ID NO: 1651030 - RNA, 15 nt, Homo sapiens
caagucauucucacc

SEQ ID NO: 1651031 - RNA, 20 nt, Homo sapiens
caagucuuuacagaaucaaa

SEQ ID NO: 1651032 - RNA, 20 nt, Homo sapiens
caagugauucucaugccuca

SEQ ID NO: 1651033 - RNA, 23 nt, Homo sapiens
caaguggguccaaguggcuguga

SEQ ID NO: 1651034 - RNA, 16 nt, Homo sapiens
caaguuccagugcaga

SEQ ID NO: 1651035 - RNA, 21 nt, Homo sapiens
caauaaaagaauaguugccaa

SEQ ID NO: 1651036 - RNA, 15 nt, Homo sapiens
caauaaaccuaauaa

SEQ ID NO: 1651037 - RNA, 15 nt, Homo sapiens
caauaaagccuucaa

SEQ ID NO: 1651038 - RNA, 19 nt, Homo sapiens
caauaaagccuucaaacuc

SEQ ID NO: 1651039 - RNA, 22 nt, Homo sapiens
caauaagccacgaggugcagua

SEQ ID NO: 1651040 - RNA, 12 nt, Homo sapiens
caauacccaaau

SEQ ID NO: 1651041 - RNA, 20 nt, Homo sapiens
caauacuuacauaucugacu

SEQ ID NO: 1651042 - RNA, 14 nt, Homo sapiens
caauagaaauccaa

SEQ ID NO: 1651043 - RNA, 23 nt, Homo sapiens
caauauuguaauccuagcacuuu

SEQ ID NO: 1651044 - RNA, 23 nt, Homo sapiens
caaucaguagccagcaucugccu

SEQ ID NO: 1651045 - RNA, 19 nt, Homo sapiens
caaucaucaucauucucau

SEQ ID NO: 1651046 - RNA, 13 nt, Homo sapiens
caauccuauguuu

SEQ ID NO: 1651047 - RNA, 12 nt, Homo sapiens
caaugaaaugga

SEQ ID NO: 1651048 - RNA, 16 nt, Homo sapiens
caauggguaucuaaua

SEQ ID NO: 1651049 - RNA, 22 nt, Homo sapiens
caaugguuugugucaaaacugg

SEQ ID NO: 1651050 - RNA, 14 nt, Homo sapiens
caauguuagccaca

SEQ ID NO: 1651051 - RNA, 17 nt, Homo sapiens
caauguuauuaccuaua

SEQ ID NO: 1651052 - RNA, 14 nt, Homo sapiens
caauuaacucugga

SEQ ID NO: 1651053 - RNA, 20 nt, Homo sapiens
caauuagacaagaacuugga

SEQ ID NO: 1651054 - RNA, 20 nt, Homo sapiens
caauucuauuacgugcaaua

SEQ ID NO: 1651055 - RNA, 13 nt, Homo sapiens
caauucuccugcc

SEQ ID NO: 1651056 - RNA, 17 nt, Homo sapiens
caauuuuaaaucugaga

SEQ ID NO: 1651057 - RNA, 23 nt, Homo sapiens
caauuuucuuuuuuauacucaau

SEQ ID NO: 1651058 - RNA, 12 nt, Homo sapiens
cacaaaacagaa

SEQ ID NO: 1651059 - RNA, 15 nt, Homo sapiens
cacaaaacagccuuu

SEQ ID NO: 1651060 - RNA, 15 nt, Homo sapiens
cacaaaacauccuga

SEQ ID NO: 1651061 - RNA, 14 nt, Homo sapiens
cacaacccaaaagg

SEQ ID NO: 1651062 - RNA, 16 nt, Homo sapiens
cacaacucuuuguuca

SEQ ID NO: 1651063 - RNA, 12 nt, Homo sapiens
cacaauguugca

SEQ ID NO: 1651064 - RNA, 12 nt, Homo sapiens
cacacacaguga

SEQ ID NO: 1651065 - RNA, 12 nt, Homo sapiens
cacacacugugu

SEQ ID NO: 1651066 - RNA, 12 nt, Homo sapiens
cacacauacaga

SEQ ID NO: 1651067 - RNA, 19 nt, Homo sapiens
cacacaugccacuaugagc

SEQ ID NO: 1651068 - RNA, 18 nt, Homo sapiens
cacacugagacuugaauc

SEQ ID NO: 1651069 - RNA, 20 nt, Homo sapiens
cacacugagacuugaaucaa

SEQ ID NO: 1651070 - RNA, 12 nt, Homo sapiens
cacacuuugcca

SEQ ID NO: 1651071 - RNA, 17 nt, Homo sapiens
cacagaagguccuggug

SEQ ID NO: 1651072 - RNA, 19 nt, Homo sapiens
cacagaauucauucacuca

SEQ ID NO: 1651073 - RNA, 21 nt, Homo sapiens
cacagagauaauucuagcuuu

SEQ ID NO: 1651074 - RNA, 16 nt, Homo sapiens
cacagauuugagcuca

SEQ ID NO: 1651075 - RNA, 15 nt, Homo sapiens
cacagcacuaauuca

SEQ ID NO: 1651076 - RNA, 13 nt, Homo sapiens
cacagcauuguau

SEQ ID NO: 1651077 - RNA, 17 nt, Homo sapiens
cacagccuccccugcca

SEQ ID NO: 1651078 - RNA, 20 nt, Homo sapiens
cacagcugcuggagacuccu

SEQ ID NO: 1651079 - RNA, 20 nt, Homo sapiens
cacagcuguuuccucacguc

SEQ ID NO: 1651080 - RNA, 14 nt, Homo sapiens
cacaggcccggcuc

SEQ ID NO: 1651081 - RNA, 19 nt, Homo sapiens
cacaggccugagauuucau

SEQ ID NO: 1651082 - RNA, 16 nt, Homo sapiens
cacagggauguacaag

SEQ ID NO: 1651083 - RNA, 23 nt, Homo sapiens
cacaguauuacuucugcuacaua

SEQ ID NO: 1651084 - RNA, 22 nt, Homo sapiens
cacagugagucgaggacaggga

SEQ ID NO: 1651085 - RNA, 22 nt, Homo sapiens
cacaguucccuuuauuucacau

SEQ ID NO: 1651086 - RNA, 14 nt, Homo sapiens
cacaguuccuugca

SEQ ID NO: 1651087 - RNA, 15 nt, Homo sapiens
cacaguuucuuccau

SEQ ID NO: 1651088 - RNA, 19 nt, Homo sapiens
cacaugcacgugugugcac

SEQ ID NO: 1651089 - RNA, 17 nt, Homo sapiens
cacaugccaagcacugu

SEQ ID NO: 1651090 - RNA, 14 nt, Homo sapiens
cacaugugcacaug

SEQ ID NO: 1651091 - RNA, 17 nt, Homo sapiens
cacaugugcacaugcac

SEQ ID NO: 1651092 - RNA, 18 nt, Homo sapiens
caccaaaucaucucucau

SEQ ID NO: 1651093 - RNA, 15 nt, Homo sapiens
caccaccugcucacu

SEQ ID NO: 1651094 - RNA, 16 nt, Homo sapiens
caccauaaaaaggaau

SEQ ID NO: 1651095 - RNA, 23 nt, Homo sapiens
caccaugcucggcuuuugcauua

SEQ ID NO: 1651096 - RNA, 23 nt, Homo sapiens
caccauucuuucuuggugcauuc

SEQ ID NO: 1651097 - RNA, 16 nt, Homo sapiens
caccauuuguauccac

SEQ ID NO: 1651098 - RNA, 22 nt, Homo sapiens
cacccagaugggggaaagcaca

SEQ ID NO: 1651099 - RNA, 20 nt, Homo sapiens
cacccaggcuggagugcagu

SEQ ID NO: 1651100 - RNA, 21 nt, Homo sapiens
cacccucccucccugaucccg

SEQ ID NO: 1651101 - RNA, 17 nt, Homo sapiens
caccgccauggcuucca

SEQ ID NO: 1651102 - RNA, 17 nt, Homo sapiens
caccuagcgucaguauu

SEQ ID NO: 1651103 - RNA, 13 nt, Homo sapiens
caccuagucugua

SEQ ID NO: 1651104 - RNA, 20 nt, Homo sapiens
caccuaguggcuguccagug

SEQ ID NO: 1651105 - RNA, 16 nt, Homo sapiens
caccucagaguggagu

SEQ ID NO: 1651106 - RNA, 14 nt, Homo sapiens
caccucaugucauu

SEQ ID NO: 1651107 - RNA, 19 nt, Homo sapiens
caccuccuucucugucuca

SEQ ID NO: 1651108 - RNA, 16 nt, Homo sapiens
caccugcccugcugag

SEQ ID NO: 1651109 - RNA, 15 nt, Homo sapiens
caccuggggcugcug

SEQ ID NO: 1651110 - RNA, 12 nt, Homo sapiens
caccuguggcca

SEQ ID NO: 1651111 - RNA, 16 nt, Homo sapiens
caccuucaaaauguuc

SEQ ID NO: 1651112 - RNA, 23 nt, Homo sapiens
caccuugcggggauaaagagaga

SEQ ID NO: 1651113 - RNA, 13 nt, Homo sapiens
cacgaacugaaau

SEQ ID NO: 1651114 - RNA, 14 nt, Homo sapiens
cacgaggugcagua

SEQ ID NO: 1651115 - RNA, 15 nt, Homo sapiens
cacgcagcuggcaga

SEQ ID NO: 1651116 - RNA, 16 nt, Homo sapiens
cacgcuggagugcagu

SEQ ID NO: 1651117 - RNA, 17 nt, Homo sapiens
cacgguggucacuggaa

SEQ ID NO: 1651118 - RNA, 16 nt, Homo sapiens
cacuaacaaacucuga

SEQ ID NO: 1651119 - RNA, 18 nt, Homo sapiens
cacuaauggggcggugag

SEQ ID NO: 1651120 - RNA, 14 nt, Homo sapiens
cacuaauucugcau

SEQ ID NO: 1651121 - RNA, 20 nt, Homo sapiens
cacuaccauagcuacaucag

SEQ ID NO: 1651122 - RNA, 16 nt, Homo sapiens
cacuacucaguuauua

SEQ ID NO: 1651123 - RNA, 14 nt, Homo sapiens
cacuagacccacug

SEQ ID NO: 1651124 - RNA, 21 nt, Homo sapiens
cacuagacccacuggacucac

SEQ ID NO: 1651125 - RNA, 19 nt, Homo sapiens
cacuauucuuaacuauuca

SEQ ID NO: 1651126 - RNA, 14 nt, Homo sapiens
cacuccccucaaaa

SEQ ID NO: 1651127 - RNA, 16 nt, Homo sapiens
cacucugcucucagga

SEQ ID NO: 1651128 - RNA, 17 nt, Homo sapiens
cacucuggcagcucaga

SEQ ID NO: 1651129 - RNA, 11 nt, Homo sapiens
cacucugucac

SEQ ID NO: 1651130 - RNA, 18 nt, Homo sapiens
cacucugucacccaggcu

SEQ ID NO: 1651131 - RNA, 21 nt, Homo sapiens
cacucuucugaauugacugua

SEQ ID NO: 1651132 - RNA, 13 nt, Homo sapiens
cacugaaauggac

SEQ ID NO: 1651133 - RNA, 17 nt, Homo sapiens
augucguuugaaucaca

SEQ ID NO: 1651134 - RNA, 19 nt, Homo sapiens
augucguuugaaucacagu

SEQ ID NO: 1651135 - RNA, 15 nt, Homo sapiens
augucucagaccacu

SEQ ID NO: 1651136 - RNA, 17 nt, Homo sapiens
augucucagaccacuau

SEQ ID NO: 1651137 - RNA, 16 nt, Homo sapiens
augucucugagcauua

SEQ ID NO: 1651138 - RNA, 17 nt, Homo sapiens
augucucugagcauuag

SEQ ID NO: 1651139 - RNA, 19 nt, Homo sapiens
augugacauuauaugcacu

SEQ ID NO: 1651140 - RNA, 16 nt, Homo sapiens
auguggauacagucau

SEQ ID NO: 1651141 - RNA, 15 nt, Homo sapiens
augugggucuaccaa

SEQ ID NO: 1651142 - RNA, 24 nt, Homo sapiens
augugguuaaugccauggacagaa

SEQ ID NO: 1651143 - RNA, 20 nt, Homo sapiens
augugucccagccacagugu

SEQ ID NO: 1651144 - RNA, 16 nt, Homo sapiens
augugugauucacagu

SEQ ID NO: 1651145 - RNA, 14 nt, Homo sapiens
auguguguugauac

SEQ ID NO: 1651146 - RNA, 16 nt, Homo sapiens
auguguguugauacug

SEQ ID NO: 1651147 - RNA, 16 nt, Homo sapiens
auguguuuuuuuacau

SEQ ID NO: 1651148 - RNA, 18 nt, Homo sapiens
auguuagccacaguguau

SEQ ID NO: 1651149 - RNA, 22 nt, Homo sapiens
auguuaguauuuuaauccugua

SEQ ID NO: 1651150 - RNA, 14 nt, Homo sapiens
auguucuaauacuu

SEQ ID NO: 1651151 - RNA, 14 nt, Homo sapiens
auguucugggacac

SEQ ID NO: 1651152 - RNA, 21 nt, Homo sapiens
auguugaagggaaguucagca

SEQ ID NO: 1651153 - RNA, 14 nt, Homo sapiens
auguugcccaggca

SEQ ID NO: 1651154 - RNA, 14 nt, Homo sapiens
auguugcccagugu

SEQ ID NO: 1651155 - RNA, 18 nt, Homo sapiens
auguuggcugggaacuca

SEQ ID NO: 1651156 - RNA, 16 nt, Homo sapiens
auguuguagcagugau

SEQ ID NO: 1651157 - RNA, 18 nt, Homo sapiens
auguuuauaaacugagag

SEQ ID NO: 1651158 - RNA, 20 nt, Homo sapiens
auguuuaucaccuuuauuga

SEQ ID NO: 1651159 - RNA, 22 nt, Homo sapiens
auguuugccgcuuaagcuuuca

SEQ ID NO: 1651160 - RNA, 14 nt, Homo sapiens
auuaaaauggauuu

SEQ ID NO: 1651161 - RNA, 20 nt, Homo sapiens
auuaaagugaauuguugaca

SEQ ID NO: 1651162 - RNA, 11 nt, Homo sapiens
auuaacuuuau

SEQ ID NO: 1651163 - RNA, 21 nt, Homo sapiens
auuaacuuuuuaaaacacaac

SEQ ID NO: 1651164 - RNA, 22 nt, Homo sapiens
auuaagugacuguucaagagca

SEQ ID NO: 1651165 - RNA, 15 nt, Homo sapiens
auuaauagcauucga

SEQ ID NO: 1651166 - RNA, 20 nt, Homo sapiens
auuaauauggggaugcagca

SEQ ID NO: 1651167 - RNA, 18 nt, Homo sapiens
auuaaucaaggcauaaaa

SEQ ID NO: 1651168 - RNA, 23 nt, Homo sapiens
auuaaucuuuuauauugauaaca

SEQ ID NO: 1651169 - RNA, 21 nt, Homo sapiens
auuaauuauauuucuacagag

SEQ ID NO: 1651170 - RNA, 11 nt, Homo sapiens
auuacagacau

SEQ ID NO: 1651171 - RNA, 17 nt, Homo sapiens
auuacagacaugaacug

SEQ ID NO: 1651172 - RNA, 22 nt, Homo sapiens
auuaccuugugcuaauccucuu

SEQ ID NO: 1651173 - RNA, 13 nt, Homo sapiens
auuacgugcaaua

SEQ ID NO: 1651174 - RNA, 19 nt, Homo sapiens
auuacgugcaauacuucaa

SEQ ID NO: 1651175 - RNA, 19 nt, Homo sapiens
auuagccuaugugcaugca

SEQ ID NO: 1651176 - RNA, 16 nt, Homo sapiens
auuaggaaucauucug

SEQ ID NO: 1651177 - RNA, 20 nt, Homo sapiens
auuaggaaucauucuguaaa

SEQ ID NO: 1651178 - RNA, 17 nt, Homo sapiens
auuauaaacaaccuaga

SEQ ID NO: 1651179 - RNA, 13 nt, Homo sapiens
auuauaaucaaaa

SEQ ID NO: 1651180 - RNA, 17 nt, Homo sapiens
auuaucuauacauaaaa

SEQ ID NO: 1651181 - RNA, 13 nt, Homo sapiens
auuauuacuguuu

SEQ ID NO: 1651182 - RNA, 15 nt, Homo sapiens
auuauuuaauaacau

SEQ ID NO: 1651183 - RNA, 23 nt, Homo sapiens
auucaaaagcacuuugugcugug

SEQ ID NO: 1651184 - RNA, 20 nt, Homo sapiens
auucacccccaaacagugac

SEQ ID NO: 1651185 - RNA, 20 nt, Homo sapiens
auucaccucucucacugacu

SEQ ID NO: 1651186 - RNA, 16 nt, Homo sapiens
auucacucauacaucu

SEQ ID NO: 1651187 - RNA, 13 nt, Homo sapiens
auucagaacuuua

SEQ ID NO: 1651188 - RNA, 18 nt, Homo sapiens
auucaugaacacaauaca

SEQ ID NO: 1651189 - RNA, 11 nt, Homo sapiens
auucauuccau

SEQ ID NO: 1651190 - RNA, 12 nt, Homo sapiens
auucauuccauu

SEQ ID NO: 1651191 - RNA, 21 nt, Homo sapiens
auuccaugccgcagacaugaa

SEQ ID NO: 1651192 - RNA, 16 nt, Homo sapiens
auucccacagcacuaa

SEQ ID NO: 1651193 - RNA, 23 nt, Homo sapiens
auucccggagggaaacugugaau

SEQ ID NO: 1651194 - RNA, 18 nt, Homo sapiens
auucccuuuucuuuaagu

SEQ ID NO: 1651195 - RNA, 21 nt, Homo sapiens
auuccuaagacugcugcugaa

SEQ ID NO: 1651196 - RNA, 19 nt, Homo sapiens
auuccuguuagccaggugg

SEQ ID NO: 1651197 - RNA, 18 nt, Homo sapiens
auuccuucucgugcacug

SEQ ID NO: 1651198 - RNA, 18 nt, Homo sapiens
auucuauuacgugcaaua

SEQ ID NO: 1651199 - RNA, 15 nt, Homo sapiens
auucucaugccucag

SEQ ID NO: 1651200 - RNA, 16 nt, Homo sapiens
auucucauuugucaca

SEQ ID NO: 1651201 - RNA, 19 nt, Homo sapiens
auucucugucucauccauc

SEQ ID NO: 1651202 - RNA, 18 nt, Homo sapiens
auucugcucuuugauuca

SEQ ID NO: 1651203 - RNA, 16 nt, Homo sapiens
auucugucaaugucuu

SEQ ID NO: 1651204 - RNA, 16 nt, Homo sapiens
auucuguucuacuuga

SEQ ID NO: 1651205 - RNA, 19 nt, Homo sapiens
auucuuccucaaagcauuu

SEQ ID NO: 1651206 - RNA, 23 nt, Homo sapiens
auugaauuauuuuguuacugucu

SEQ ID NO: 1651207 - RNA, 18 nt, Homo sapiens
auugacuauagugugagc

SEQ ID NO: 1651208 - RNA, 16 nt, Homo sapiens
auugaguuuucagugg

SEQ ID NO: 1651209 - RNA, 16 nt, Homo sapiens
auugauaacagcacug

SEQ ID NO: 1651210 - RNA, 19 nt, Homo sapiens
auugccuuuagugaucaca

SEQ ID NO: 1651211 - RNA, 20 nt, Homo sapiens
auugcuccauuuucuuguca

SEQ ID NO: 1651212 - RNA, 19 nt, Homo sapiens
auugcugugaauuagcuca

SEQ ID NO: 1651213 - RNA, 19 nt, Homo sapiens
auugcuugcacaaaccaau

SEQ ID NO: 1651214 - RNA, 14 nt, Homo sapiens
auuggaagagcaca

SEQ ID NO: 1651215 - RNA, 19 nt, Homo sapiens
auuggaaucuucaccucag

SEQ ID NO: 1651216 - RNA, 20 nt, Homo sapiens
auuggccggcuaguguuucc

SEQ ID NO: 1651217 - RNA, 15 nt, Homo sapiens
auuguaaauacugga

SEQ ID NO: 1651218 - RNA, 17 nt, Homo sapiens
auuguaaauacuggacu

SEQ ID NO: 1651219 - RNA, 21 nt, Homo sapiens
auuguaauccuagcacuuugg

SEQ ID NO: 1651220 - RNA, 13 nt, Homo sapiens
auuguaugguggg

SEQ ID NO: 1651221 - RNA, 17 nt, Homo sapiens
auuguguuccugaagaa

SEQ ID NO: 1651222 - RNA, 16 nt, Homo sapiens
auuguuguaauugcau

SEQ ID NO: 1651223 - RNA, 20 nt, Homo sapiens
auuguuguaauugcauuaua

SEQ ID NO: 1651224 - RNA, 14 nt, Homo sapiens
auuguuuugucucc

SEQ ID NO: 1651225 - RNA, 15 nt, Homo sapiens
auuuaaaagacaaac

SEQ ID NO: 1651226 - RNA, 18 nt, Homo sapiens
auuuaaagggugauguac

SEQ ID NO: 1651227 - RNA, 17 nt, Homo sapiens
auuuaagagacagucac

SEQ ID NO: 1651228 - RNA, 13 nt, Homo sapiens
auuuaauacuaau

SEQ ID NO: 1651229 - RNA, 17 nt, Homo sapiens
auuuacuguggcuucuu

SEQ ID NO: 1651230 - RNA, 15 nt, Homo sapiens
auuuauggaaucuac

SEQ ID NO: 1651231 - RNA, 17 nt, Homo sapiens
auuuauugaaaugauuu

SEQ ID NO: 1651232 - RNA, 13 nt, Homo sapiens
auuucacagugug

SEQ ID NO: 1651233 - RNA, 22 nt, Homo sapiens
auuuccaagaaauauuccuuaa

SEQ ID NO: 1651234 - RNA, 18 nt, Homo sapiens
auuuccccuuaucuuucu

SEQ ID NO: 1651235 - RNA, 17 nt, Homo sapiens
auuuccucugagcuguu

SEQ ID NO: 1651236 - RNA, 16 nt, Homo sapiens
auuucuagagagucuc

SEQ ID NO: 1651237 - RNA, 20 nt, Homo sapiens
auuucuauguaugugccaau

SEQ ID NO: 1651238 - RNA, 18 nt, Homo sapiens
auuucucuucaguguguu

SEQ ID NO: 1651239 - RNA, 22 nt, Homo sapiens
auuucugaggagccugcaacau

SEQ ID NO: 1651240 - RNA, 14 nt, Homo sapiens
auuucuguucuucc

SEQ ID NO: 1651241 - RNA, 16 nt, Homo sapiens
auuucuuagagauuaa

SEQ ID NO: 1651242 - RNA, 21 nt, Homo sapiens
auuucuucaagugaguggcau

SEQ ID NO: 1651243 - RNA, 12 nt, Homo sapiens
aauuauaacuua

SEQ ID NO: 1651244 - RNA, 22 nt, Homo sapiens
aauuauaaucaaaaucaaugca

SEQ ID NO: 1651245 - RNA, 18 nt, Homo sapiens
aauuaugugaaaugcuua

SEQ ID NO: 1651246 - RNA, 16 nt, Homo sapiens
aauuauugauguuuuc

SEQ ID NO: 1651247 - RNA, 16 nt, Homo sapiens
aauuauuucacuuuag

SEQ ID NO: 1651248 - RNA, 22 nt, Homo sapiens
aauuauuugcauaacaauuccu

SEQ ID NO: 1651249 - RNA, 17 nt, Homo sapiens
aauucaaugaaauggau

SEQ ID NO: 1651250 - RNA, 17 nt, Homo sapiens
aauucaguuauuugcac

SEQ ID NO: 1651251 - RNA, 20 nt, Homo sapiens
aauucaugaacacaauacau

SEQ ID NO: 1651252 - RNA, 20 nt, Homo sapiens
aauuccacuuguucauucug

SEQ ID NO: 1651253 - RNA, 14 nt, Homo sapiens
aauugaaagaacuu

SEQ ID NO: 1651254 - RNA, 15 nt, Homo sapiens
aauugcuucuucuuc

SEQ ID NO: 1651255 - RNA, 22 nt, Homo sapiens
aauugcuucuucuucaagauuu

SEQ ID NO: 1651256 - RNA, 23 nt, Homo sapiens
aauugugaagucgucuuaacuca

SEQ ID NO: 1651257 - RNA, 17 nt, Homo sapiens
aauuuaaaauaugcucu

SEQ ID NO: 1651258 - RNA, 15 nt, Homo sapiens
aauuuaauuaccuua

SEQ ID NO: 1651259 - RNA, 21 nt, Homo sapiens
aauuuacuuuuuaaacagugu

SEQ ID NO: 1651260 - RNA, 22 nt, Homo sapiens
aauuuacuuuuuaaacaguguu

SEQ ID NO: 1651261 - RNA, 18 nt, Homo sapiens
aauuuauggaaucuacca

SEQ ID NO: 1651262 - RNA, 15 nt, Homo sapiens
aauuucauugaacua

SEQ ID NO: 1651263 - RNA, 18 nt, Homo sapiens
aauuucgguuauagcuua

SEQ ID NO: 1651264 - RNA, 22 nt, Homo sapiens
aauuugacugguucaccugugu

SEQ ID NO: 1651265 - RNA, 18 nt, Homo sapiens
aauuugcaacaguaauca

SEQ ID NO: 1651266 - RNA, 19 nt, Homo sapiens
aauuuguaacuuuguugca

SEQ ID NO: 1651267 - RNA, 13 nt, Homo sapiens
aauuuguauuucc

SEQ ID NO: 1651268 - RNA, 16 nt, Homo sapiens
aauuugugauggaauc

SEQ ID NO: 1651269 - RNA, 21 nt, Homo sapiens
aauuuuccucauuuugaauua

SEQ ID NO: 1651270 - RNA, 23 nt, Homo sapiens
aauuuugucagauucacacaugc

SEQ ID NO: 1651271 - RNA, 19 nt, Homo sapiens
aauuuuuuaaauaaaugga

SEQ ID NO: 1651272 - RNA, 20 nt, Homo sapiens
aauuuuuuaaauaaauggaa

SEQ ID NO: 1651273 - RNA, 13 nt, Homo sapiens
acaaaacugccaa

SEQ ID NO: 1651274 - RNA, 14 nt, Homo sapiens
acaaaaugauggca

SEQ ID NO: 1651275 - RNA, 16 nt, Homo sapiens
acaaaccucuaaccca

SEQ ID NO: 1651276 - RNA, 21 nt, Homo sapiens
acaaacucaccaucugugcac

SEQ ID NO: 1651277 - RNA, 13 nt, Homo sapiens
acaaagaccauga

SEQ ID NO: 1651278 - RNA, 20 nt, Homo sapiens
acaaagcggggagaggguac

SEQ ID NO: 1651279 - RNA, 16 nt, Homo sapiens
acaaauacuauccaaa

SEQ ID NO: 1651280 - RNA, 17 nt, Homo sapiens
acaacaaacacugugau

SEQ ID NO: 1651281 - RNA, 16 nt, Homo sapiens
acaacagccugagaaa

SEQ ID NO: 1651282 - RNA, 20 nt, Homo sapiens
acaacauguauguggauaca

SEQ ID NO: 1651283 - RNA, 12 nt, Homo sapiens
acaacucuuugu

SEQ ID NO: 1651284 - RNA, 20 nt, Homo sapiens
acaagaacuuuaaauugugu

SEQ ID NO: 1651285 - RNA, 13 nt, Homo sapiens
acaagacacagug

SEQ ID NO: 1651286 - RNA, 15 nt, Homo sapiens
acaagacacagugac

SEQ ID NO: 1651287 - RNA, 20 nt, Homo sapiens
acaagcaauuagacaagaac

SEQ ID NO: 1651288 - RNA, 20 nt, Homo sapiens
acaagcgugagccacugcac

SEQ ID NO: 1651289 - RNA, 16 nt, Homo sapiens
acaaggcgaucccauc

SEQ ID NO: 1651290 - RNA, 16 nt, Homo sapiens
acaagugauaauacag

SEQ ID NO: 1651291 - RNA, 23 nt, Homo sapiens
acaauaagccacgaggugcagua

SEQ ID NO: 1651292 - RNA, 15 nt, Homo sapiens
acaauagaaaccugu

SEQ ID NO: 1651293 - RNA, 15 nt, Homo sapiens
acaaucuguauauaa

SEQ ID NO: 1651294 - RNA, 23 nt, Homo sapiens
acaauggaccggagagugggggu

SEQ ID NO: 1651295 - RNA, 18 nt, Homo sapiens
acaauggcagaacaggug

SEQ ID NO: 1651296 - RNA, 19 nt, Homo sapiens
acaauggguaucuaauaaa

SEQ ID NO: 1651297 - RNA, 15 nt, Homo sapiens
acaauuaaagcaaaa

SEQ ID NO: 1651298 - RNA, 14 nt, Homo sapiens
acacaacauguaug

SEQ ID NO: 1651299 - RNA, 21 nt, Homo sapiens
acacagaggggagucaccagc

SEQ ID NO: 1651300 - RNA, 18 nt, Homo sapiens
acacagaugaaacacaaa

SEQ ID NO: 1651301 - RNA, 20 nt, Homo sapiens
acacagcucuucuccaggcu

SEQ ID NO: 1651302 - RNA, 14 nt, Homo sapiens
acacagcuguuucc

SEQ ID NO: 1651303 - RNA, 15 nt, Homo sapiens
acacaggaugaaggc

SEQ ID NO: 1651304 - RNA, 16 nt, Homo sapiens
acacaguucaauucuc

SEQ ID NO: 1651305 - RNA, 13 nt, Homo sapiens
acacauacagagc

SEQ ID NO: 1651306 - RNA, 18 nt, Homo sapiens
acacauguauccuuucac

SEQ ID NO: 1651307 - RNA, 18 nt, Homo sapiens
acacauuccaucuuacau

SEQ ID NO: 1651308 - RNA, 17 nt, Homo sapiens
acaccacuguacuccag

SEQ ID NO: 1651309 - RNA, 22 nt, Homo sapiens
acaccagagcagaugcagagag

SEQ ID NO: 1651310 - RNA, 17 nt, Homo sapiens
acaccauuuuccugccu

SEQ ID NO: 1651311 - RNA, 19 nt, Homo sapiens
acaccauuuuccugccuca

SEQ ID NO: 1651312 - RNA, 16 nt, Homo sapiens
acaccauuuuggcaag

SEQ ID NO: 1651313 - RNA, 21 nt, Homo sapiens
acaccauuuuggcaagcucua

SEQ ID NO: 1651314 - RNA, 12 nt, Homo sapiens
acaccugacuaa

SEQ ID NO: 1651315 - RNA, 19 nt, Homo sapiens
acaccuuauuaaugaucag

SEQ ID NO: 1651316 - RNA, 15 nt, Homo sapiens
acaccuugacagggc

SEQ ID NO: 1651317 - RNA, 19 nt, Homo sapiens
acaccuugacagggcacac

SEQ ID NO: 1651318 - RNA, 21 nt, Homo sapiens
accuggaccccugcauuggaa

SEQ ID NO: 1651319 - RNA, 23 nt, Homo sapiens
accuggagggcuggaaucuggag

SEQ ID NO: 1651320 - RNA, 21 nt, Homo sapiens
accuggaggggcuagaaccua

SEQ ID NO: 1651321 - RNA, 22 nt, Homo sapiens
accuggguuccagcaauucucc

SEQ ID NO: 1651322 - RNA, 15 nt, Homo sapiens
accuguggugcaaaa

SEQ ID NO: 1651323 - RNA, 21 nt, Homo sapiens
accuuacuuucccauuguaac

SEQ ID NO: 1651324 - RNA, 22 nt, Homo sapiens
accuuauuaaugaucagcuaua

SEQ ID NO: 1651325 - RNA, 14 nt, Homo sapiens
accuucaacuucca

SEQ ID NO: 1651326 - RNA, 23 nt, Homo sapiens
accuuugacacugacagaugugu

SEQ ID NO: 1651327 - RNA, 17 nt, Homo sapiens
acgacugucuccauggc

SEQ ID NO: 1651328 - RNA, 17 nt, Homo sapiens
acgagauacagaauuuu

SEQ ID NO: 1651329 - RNA, 16 nt, Homo sapiens
acgauugacaccaaaa

SEQ ID NO: 1651330 - RNA, 18 nt, Homo sapiens
acgcacacacacauacag

SEQ ID NO: 1651331 - RNA, 13 nt, Homo sapiens
acgcagacuccac

SEQ ID NO: 1651332 - RNA, 13 nt, Homo sapiens
acgcagccugaga

SEQ ID NO: 1651333 - RNA, 21 nt, Homo sapiens
acgccacugcacuauagccua

SEQ ID NO: 1651334 - RNA, 14 nt, Homo sapiens
acggcucacugcag

SEQ ID NO: 1651335 - RNA, 15 nt, Homo sapiens
acggggcucuucuca

SEQ ID NO: 1651336 - RNA, 20 nt, Homo sapiens
acguauggaaugcuucuuaa

SEQ ID NO: 1651337 - RNA, 18 nt, Homo sapiens
acgugaccucugcaagac

SEQ ID NO: 1651338 - RNA, 20 nt, Homo sapiens
acgugagaucauucacucau

SEQ ID NO: 1651339 - RNA, 22 nt, Homo sapiens
acuaaaauuguaucaaauguga

SEQ ID NO: 1651340 - RNA, 16 nt, Homo sapiens
acuaacaggccaaaga

SEQ ID NO: 1651341 - RNA, 19 nt, Homo sapiens
acuaagggcgcuuguccca

SEQ ID NO: 1651342 - RNA, 17 nt, Homo sapiens
acuaaugcucaaccuaa

SEQ ID NO: 1651343 - RNA, 23 nt, Homo sapiens
acuaaugcucaaccuaaccaccu

SEQ ID NO: 1651344 - RNA, 19 nt, Homo sapiens
acuaauuuuccauaagcua

SEQ ID NO: 1651345 - RNA, 18 nt, Homo sapiens
acuacaauuuaaagcaaa

SEQ ID NO: 1651346 - RNA, 15 nt, Homo sapiens
acuagggaucccuca

SEQ ID NO: 1651347 - RNA, 18 nt, Homo sapiens
acuauguugcccaggcag

SEQ ID NO: 1651348 - RNA, 18 nt, Homo sapiens
acuauuucaauacuuaca

SEQ ID NO: 1651349 - RNA, 16 nt, Homo sapiens
aacccauugucuuuac

SEQ ID NO: 1651350 - RNA, 22 nt, Homo sapiens
aaccccuuuucaguuugaacuc

SEQ ID NO: 1651351 - RNA, 16 nt, Homo sapiens
aacccucacugggacu

SEQ ID NO: 1651352 - RNA, 12 nt, Homo sapiens
aaccugaacuuu

SEQ ID NO: 1651353 - RNA, 14 nt, Homo sapiens
aaccugaugcaguc

SEQ ID NO: 1651354 - RNA, 21 nt, Homo sapiens
aaccuggagagcuagaaccua

SEQ ID NO: 1651355 - RNA, 21 nt, Homo sapiens
aaccuggagggcuagaaccua

SEQ ID NO: 1651356 - RNA, 17 nt, Homo sapiens
aaccuuaaacuuucaau

SEQ ID NO: 1651357 - RNA, 22 nt, Homo sapiens
aaccuugcugggguuggagguu

SEQ ID NO: 1651358 - RNA, 23 nt, Homo sapiens
aaccuuuuuuaagauuuuucuca

SEQ ID NO: 1651359 - RNA, 21 nt, Homo sapiens
aacgcacacaguaucuaguca

SEQ ID NO: 1651360 - RNA, 20 nt, Homo sapiens
aacgcuucugcuuaaucuga

SEQ ID NO: 1651361 - RNA, 16 nt, Homo sapiens
aacgugcucaugggcu

SEQ ID NO: 1651362 - RNA, 19 nt, Homo sapiens
aacguggcaggacuuccau

SEQ ID NO: 1651363 - RNA, 13 nt, Homo sapiens
aacuaaaauguuc

SEQ ID NO: 1651364 - RNA, 15 nt, Homo sapiens
aacuaaaauguucua

SEQ ID NO: 1651365 - RNA, 16 nt, Homo sapiens
aacuaauacaauacau

SEQ ID NO: 1651366 - RNA, 17 nt, Homo sapiens
aacuauuguauaauggg

SEQ ID NO: 1651367 - RNA, 14 nt, Homo sapiens
aacuauugugcuca

SEQ ID NO: 1651368 - RNA, 15 nt, Homo sapiens
aacucaagcuucuuc

SEQ ID NO: 1651369 - RNA, 20 nt, Homo sapiens
aacucaagcuucuucacuca

SEQ ID NO: 1651370 - RNA, 21 nt, Homo sapiens
aacucaaggaaaucuguguca

SEQ ID NO: 1651371 - RNA, 19 nt, Homo sapiens
aacucaauauuuuccauga

SEQ ID NO: 1651372 - RNA, 12 nt, Homo sapiens
aacucaguguga

SEQ ID NO: 1651373 - RNA, 19 nt, Homo sapiens
aacucagugugacuccuca

SEQ ID NO: 1651374 - RNA, 18 nt, Homo sapiens
aacuccaucauucaucca

SEQ ID NO: 1651375 - RNA, 15 nt, Homo sapiens
aacuccugaccuuag

SEQ ID NO: 1651376 - RNA, 19 nt, Homo sapiens
aacucuggauuuugaauua

SEQ ID NO: 1651377 - RNA, 18 nt, Homo sapiens
aacucuuugccuaacuaa

SEQ ID NO: 1651378 - RNA, 13 nt, Homo sapiens
aacugcagcguca

SEQ ID NO: 1651379 - RNA, 19 nt, Homo sapiens
aacuggguacuuguggaca

SEQ ID NO: 1651380 - RNA, 22 nt, Homo sapiens
aacuuggaaauagugauuucca

SEQ ID NO: 1651381 - RNA, 22 nt, Homo sapiens
aacuuucauuuuuuuccaggcu

SEQ ID NO: 1651382 - RNA, 17 nt, Homo sapiens
aagaaacagagugcuaa

SEQ ID NO: 1651383 - RNA, 14 nt, Homo sapiens
aagaaauauuccuu

SEQ ID NO: 1651384 - RNA, 13 nt, Homo sapiens
aagaaaucuuucc

SEQ ID NO: 1651385 - RNA, 12 nt, Homo sapiens
aagaacaccauc

SEQ ID NO: 1651386 - RNA, 20 nt, Homo sapiens
aagaagaauuggccaucuua

SEQ ID NO: 1651387 - RNA, 15 nt, Homo sapiens
aagaaguuuuguucc

SEQ ID NO: 1651388 - RNA, 13 nt, Homo sapiens
aagaaucuguuuc

SEQ ID NO: 1651389 - RNA, 16 nt, Homo sapiens
aagaaugacuaugcaa

SEQ ID NO: 1651390 - RNA, 17 nt, Homo sapiens
aagaaugaguaauguga

SEQ ID NO: 1651391 - RNA, 12 nt, Homo sapiens
aagaauuacaua

SEQ ID NO: 1651392 - RNA, 16 nt, Homo sapiens
aagaauuacauaugaa

SEQ ID NO: 1651393 - RNA, 16 nt, Homo sapiens
aagaauuaugcaucug

SEQ ID NO: 1651394 - RNA, 21 nt, Homo sapiens
aagaauuuuuauauccacuaa

SEQ ID NO: 1651395 - RNA, 13 nt, Homo sapiens
aagacacagugac

SEQ ID NO: 1651396 - RNA, 21 nt, Homo sapiens
aagacauaaacccaguugcca

SEQ ID NO: 1651397 - RNA, 16 nt, Homo sapiens
aagaccccagcacaga

SEQ ID NO: 1651398 - RNA, 20 nt, Homo sapiens
aagacccuuguggucccacc

SEQ ID NO: 1651399 - RNA, 23 nt, Homo sapiens
aagacgugauuuugcuguagaag

SEQ ID NO: 1651400 - RNA, 17 nt, Homo sapiens
aagacuauauuguacac

SEQ ID NO: 1651401 - RNA, 13 nt, Homo sapiens
aagagcaaugugu

SEQ ID NO: 1651402 - RNA, 15 nt, Homo sapiens
aagagcucuugugaa

SEQ ID NO: 1651403 - RNA, 16 nt, Homo sapiens
aagagcuuaacagugu

SEQ ID NO: 1651404 - RNA, 20 nt, Homo sapiens
aagagggagggagggcucca

SEQ ID NO: 1651405 - RNA, 16 nt, Homo sapiens
aagagggucugaggaa

SEQ ID NO: 1651406 - RNA, 20 nt, Homo sapiens
aagagugagacuccaccuca

SEQ ID NO: 1651407 - RNA, 19 nt, Homo sapiens
aagaucacgccacuggacu

SEQ ID NO: 1651408 - RNA, 19 nt, Homo sapiens
aagaucuaaaaugauacug

SEQ ID NO: 1651409 - RNA, 22 nt, Homo sapiens
aagaugaaugagcaaaaccaaa

SEQ ID NO: 1651410 - RNA, 20 nt, Homo sapiens
aagauggcacuuauaaccaa

SEQ ID NO: 1651411 - RNA, 20 nt, Homo sapiens
aagauggguggaucacuuga

SEQ ID NO: 1651412 - RNA, 22 nt, Homo sapiens
aagauuaacacucauuuccaau

SEQ ID NO: 1651413 - RNA, 18 nt, Homo sapiens
aagauuuuugaaaauccu

SEQ ID NO: 1651414 - RNA, 21 nt, Homo sapiens
aagcaaagacuaugaggaaua

SEQ ID NO: 1651415 - RNA, 17 nt, Homo sapiens
aagcaacugaucauauu

SEQ ID NO: 1651416 - RNA, 19 nt, Homo sapiens
aagcaacuuuacugagaca

SEQ ID NO: 1651417 - RNA, 22 nt, Homo sapiens
aagcaacuuuacugagacaaug

SEQ ID NO: 1651418 - RNA, 18 nt, Homo sapiens
aagcaaugguugaugaua

SEQ ID NO: 1651419 - RNA, 20 nt, Homo sapiens
aagcacaggugggcuuccca

SEQ ID NO: 1651420 - RNA, 12 nt, Homo sapiens
aagcacuuugug

SEQ ID NO: 1651421 - RNA, 16 nt, Homo sapiens
aagcacuuugugcugu

SEQ ID NO: 1651422 - RNA, 15 nt, Homo sapiens
aagcaguuaguuccu

SEQ ID NO: 1651423 - RNA, 16 nt, Homo sapiens
aagcauggcccugcug

SEQ ID NO: 1651424 - RNA, 19 nt, Homo sapiens
aagcauucacaacuuguuu

SEQ ID NO: 1651425 - RNA, 19 nt, Homo sapiens
aagccaauaacacacagcu

SEQ ID NO: 1651426 - RNA, 20 nt, Homo sapiens
aagccucugugucacuggcu

SEQ ID NO: 1651427 - RNA, 12 nt, Homo sapiens
aagccuguccau

SEQ ID NO: 1651428 - RNA, 19 nt, Homo sapiens
aagcgagacuccaucucaa

SEQ ID NO: 1651429 - RNA, 17 nt, Homo sapiens
aagcggcuguuuacugc

SEQ ID NO: 1651430 - RNA, 18 nt, Homo sapiens
aagcgugagccacugcac

SEQ ID NO: 1651431 - RNA, 14 nt, Homo sapiens
aagcuaaaagcaug

SEQ ID NO: 1651432 - RNA, 19 nt, Homo sapiens
aagcuccugccucuuugug

SEQ ID NO: 1651433 - RNA, 15 nt, Homo sapiens
aagcucuaucugcaa

SEQ ID NO: 1651434 - RNA, 23 nt, Homo sapiens
aagcucugcuccucuccccagca

SEQ ID NO: 1651435 - RNA, 20 nt, Homo sapiens
aagcuuuuuuugaaucauca

SEQ ID NO: 1651436 - RNA, 20 nt, Homo sapiens
aaggauaaugaauacuuuau

SEQ ID NO: 1651437 - RNA, 21 nt, Homo sapiens
aaggaucuuaggcaugacugu

SEQ ID NO: 1651438 - RNA, 23 nt, Homo sapiens
aaggaugaucuaggaagacuuug

SEQ ID NO: 1651439 - RNA, 18 nt, Homo sapiens
aaggccucccacagugac

SEQ ID NO: 1651440 - RNA, 20 nt, Homo sapiens
aaggcguggagcugccugau

SEQ ID NO: 1651441 - RNA, 14 nt, Homo sapiens
aaggcuaagcuuca

SEQ ID NO: 1651442 - RNA, 18 nt, Homo sapiens
aaggcugagaacacugug

SEQ ID NO: 1651443 - RNA, 14 nt, Homo sapiens
aagggcagcauaua

SEQ ID NO: 1651444 - RNA, 18 nt, Homo sapiens
aaggguucaccaggucag

SEQ ID NO: 1651445 - RNA, 22 nt, Homo sapiens
aaggguucaccaggucagggag

SEQ ID NO: 1651446 - RNA, 22 nt, Homo sapiens
aaggucggaccagcuuuuccca

SEQ ID NO: 1651447 - RNA, 22 nt, Homo sapiens
aaguacaagagcuuaacagugu

SEQ ID NO: 1651448 - RNA, 23 nt, Homo sapiens
aaguacaagagcuuaacagugug

SEQ ID NO: 1651449 - RNA, 17 nt, Homo sapiens
aaguacuguaacugugu

SEQ ID NO: 1651450 - RNA, 18 nt, Homo sapiens
aaguagcaacccugugau

SEQ ID NO: 1651451 - RNA, 16 nt, Homo sapiens
aaguauucuccauccu

SEQ ID NO: 1651452 - RNA, 14 nt, Homo sapiens
aagucaaccugccu

SEQ ID NO: 1651453 - RNA, 13 nt, Homo sapiens
aagucagcaacag

SEQ ID NO: 1651454 - RNA, 11 nt, Homo sapiens
aagucauucuc

SEQ ID NO: 1651455 - RNA, 16 nt, Homo sapiens
aaguccacaguggaac

SEQ ID NO: 1651456 - RNA, 18 nt, Homo sapiens
aaguccaggacacccagu

SEQ ID NO: 1651457 - RNA, 14 nt, Homo sapiens
aagucuaaaaccuu

SEQ ID NO: 1651458 - RNA, 13 nt, Homo sapiens
uucagaaagaagu

SEQ ID NO: 1651459 - RNA, 18 nt, Homo sapiens
uucagcagagaaguuuuc

SEQ ID NO: 1651460 - RNA, 20 nt, Homo sapiens
uucagcucagcuaaugaagu

SEQ ID NO: 1651461 - RNA, 18 nt, Homo sapiens
uucaggcaacgcacaaaa

SEQ ID NO: 1651462 - RNA, 16 nt, Homo sapiens
uucagugcuucgcaga

SEQ ID NO: 1651463 - RNA, 19 nt, Homo sapiens
uucaguguguugacuucua

SEQ ID NO: 1651464 - RNA, 20 nt, Homo sapiens
uucaguucuuacacauucca

SEQ ID NO: 1651465 - RNA, 21 nt, Homo sapiens
uucaugcuggccugugugaua

SEQ ID NO: 1651466 - RNA, 22 nt, Homo sapiens
uucauuaauuacccuacuuuca

SEQ ID NO: 1651467 - RNA, 21 nt, Homo sapiens
uucauucaggcaacgcacaaa

SEQ ID NO: 1651468 - RNA, 22 nt, Homo sapiens
uucauucucccuuucacuaaaa

SEQ ID NO: 1651469 - RNA, 19 nt, Homo sapiens
uucauucuuuuugaaaugu

SEQ ID NO: 1651470 - RNA, 16 nt, Homo sapiens
uuccaaauguguauaa

SEQ ID NO: 1651471 - RNA, 16 nt, Homo sapiens
uuccacagcugcucaa

SEQ ID NO: 1651472 - RNA, 22 nt, Homo sapiens
uuccacuuguucauucugugac

SEQ ID NO: 1651473 - RNA, 17 nt, Homo sapiens
uuccagugcagagaucc

SEQ ID NO: 1651474 - RNA, 14 nt, Homo sapiens
uuccauaagcuauu

SEQ ID NO: 1651475 - RNA, 15 nt, Homo sapiens
uuccauggacuuugu

SEQ ID NO: 1651476 - RNA, 16 nt, Homo sapiens
uucccacaggacauuu

SEQ ID NO: 1651477 - RNA, 17 nt, Homo sapiens
uucccacaggacauuuc

SEQ ID NO: 1651478 - RNA, 19 nt, Homo sapiens
uucccauuguaacaauaaa

SEQ ID NO: 1651479 - RNA, 19 nt, Homo sapiens
uucccauuuacaggucuuc

SEQ ID NO: 1651480 - RNA, 18 nt, Homo sapiens
uucccuaaaaucagggaa

SEQ ID NO: 1651481 - RNA, 16 nt, Homo sapiens
uucccuggcguccucu

SEQ ID NO: 1651482 - RNA, 15 nt, Homo sapiens
uuccucacuuugaag

SEQ ID NO: 1651483 - RNA, 14 nt, Homo sapiens
uuccugacugcuag

SEQ ID NO: 1651484 - RNA, 22 nt, Homo sapiens
uuccugauagagguauggaaag

SEQ ID NO: 1651485 - RNA, 16 nt, Homo sapiens
uuccuguguucucuua

SEQ ID NO: 1651486 - RNA, 15 nt, Homo sapiens
uuccuucaccaccuc

SEQ ID NO: 1651487 - RNA, 17 nt, Homo sapiens
uuccuuucauuuacugu

SEQ ID NO: 1651488 - RNA, 18 nt, Homo sapiens
uucguugaaacgauuuca

SEQ ID NO: 1651489 - RNA, 19 nt, Homo sapiens
uucuaaauaaggugugaaa

SEQ ID NO: 1651490 - RNA, 14 nt, Homo sapiens
uucuacccaggugc

SEQ ID NO: 1651491 - RNA, 12 nt, Homo sapiens
uucuauuuaaca

SEQ ID NO: 1651492 - RNA, 23 nt, Homo sapiens
uucuauuuaaugcuuccagggau

SEQ ID NO: 1651493 - RNA, 24 nt, Homo sapiens
uucuccaagcaggacauggacaag

SEQ ID NO: 1651494 - RNA, 17 nt, Homo sapiens
uucuccaccugccaggg

SEQ ID NO: 1651495 - RNA, 13 nt, Homo sapiens
uucuccugccuca

SEQ ID NO: 1651496 - RNA, 14 nt, Homo sapiens
uucucugaaggaca

SEQ ID NO: 1651497 - RNA, 17 nt, Homo sapiens
uucugaaaagcaccauu

SEQ ID NO: 1651498 - RNA, 21 nt, Homo sapiens
uucugacuuaagugugcaaaa

SEQ ID NO: 1651499 - RNA, 12 nt, Homo sapiens
uucugagcauuu

SEQ ID NO: 1651500 - RNA, 16 nt, Homo sapiens
uucugauacguguaug

SEQ ID NO: 1651501 - RNA, 13 nt, Homo sapiens
uucugcucacaua

SEQ ID NO: 1651502 - RNA, 20 nt, Homo sapiens
uucuggaauggaauuggaca

SEQ ID NO: 1651503 - RNA, 13 nt, Homo sapiens
uucugggacacag

SEQ ID NO: 1651504 - RNA, 16 nt, Homo sapiens
uucugggacacaguuc

SEQ ID NO: 1651505 - RNA, 17 nt, Homo sapiens
uucugggcugggaacca

SEQ ID NO: 1651506 - RNA, 14 nt, Homo sapiens
uucuggggcuucag

SEQ ID NO: 1651507 - RNA, 18 nt, Homo sapiens
uucugguuuguaaggugg

SEQ ID NO: 1651508 - RNA, 15 nt, Homo sapiens
uucuguacucaaaug

SEQ ID NO: 1651509 - RNA, 22 nt, Homo sapiens
uucugugcagauaaacagaaau

SEQ ID NO: 1651510 - RNA, 21 nt, Homo sapiens
uugggagcaccgccugugaaa

SEQ ID NO: 1651511 - RNA, 23 nt, Homo sapiens
uugggagggugguucaacaaaga

SEQ ID NO: 1651512 - RNA, 21 nt, Homo sapiens
uugggauauucugaaacuuga

SEQ ID NO: 1651513 - RNA, 17 nt, Homo sapiens
uugguauuacacaguca

SEQ ID NO: 1651514 - RNA, 20 nt, Homo sapiens
uuggucuuacuuugugcaaa

SEQ ID NO: 1651515 - RNA, 11 nt, Homo sapiens
uuggugacaau

SEQ ID NO: 1651516 - RNA, 17 nt, Homo sapiens
uuguaaaauuauuucau

SEQ ID NO: 1651517 - RNA, 16 nt, Homo sapiens
uuguaagaguguagaa

SEQ ID NO: 1651518 - RNA, 14 nt, Homo sapiens
uuguaauaaauacu

SEQ ID NO: 1651519 - RNA, 23 nt, Homo sapiens
uuguaauaaauacugcagcuuga

SEQ ID NO: 1651520 - RNA, 14 nt, Homo sapiens
uuguaauagugcca

SEQ ID NO: 1651521 - RNA, 16 nt, Homo sapiens
uuguacacgaagacca

SEQ ID NO: 1651522 - RNA, 21 nt, Homo sapiens
uuguagagccagggucucacu

SEQ ID NO: 1651523 - RNA, 15 nt, Homo sapiens
uuguagcagugauuc

SEQ ID NO: 1651524 - RNA, 14 nt, Homo sapiens
uuguauaaggugag

SEQ ID NO: 1651525 - RNA, 20 nt, Homo sapiens
uuguaucaaaugugacauua

SEQ ID NO: 1651526 - RNA, 14 nt, Homo sapiens
uugucacaugaaac

SEQ ID NO: 1651527 - RNA, 20 nt, Homo sapiens
uugucaccucaauauuuacu

SEQ ID NO: 1651528 - RNA, 13 nt, Homo sapiens
uugucuacacucu

SEQ ID NO: 1651529 - RNA, 23 nt, Homo sapiens
uuguguaugauuuugaugcacaa

SEQ ID NO: 1651530 - RNA, 19 nt, Homo sapiens
uuguuauuuacacuggucu

SEQ ID NO: 1651531 - RNA, 15 nt, Homo sapiens
uuguucagaugcuuc

SEQ ID NO: 1651532 - RNA, 12 nt, Homo sapiens
uuguuccaaaug

SEQ ID NO: 1651533 - RNA, 11 nt, Homo sapiens
uuguugacaaa

SEQ ID NO: 1651534 - RNA, 21 nt, Homo sapiens
uuguugaugcucacauaugau

SEQ ID NO: 1651535 - RNA, 19 nt, Homo sapiens
uuguuguuuauaaagggag

SEQ ID NO: 1651536 - RNA, 23 nt, Homo sapiens
uuuaaagaaaaugugucugcaac

SEQ ID NO: 1651537 - RNA, 15 nt, Homo sapiens
uuuaaauaaauggaa

SEQ ID NO: 1651538 - RNA, 18 nt, Homo sapiens
uuuaaaugaaagugagac

SEQ ID NO: 1651539 - RNA, 15 nt, Homo sapiens
uuuaacguuucucau

SEQ ID NO: 1651540 - RNA, 11 nt, Homo sapiens
uuuaagccagg

SEQ ID NO: 1651541 - RNA, 21 nt, Homo sapiens
uuuaagcuaucuauaccuuac

SEQ ID NO: 1651542 - RNA, 19 nt, Homo sapiens
uuuaagcucugagcuguca

SEQ ID NO: 1651543 - RNA, 12 nt, Homo sapiens
uuuaaggcagca

SEQ ID NO: 1651544 - RNA, 23 nt, Homo sapiens
uuuaaggcagcaacaagaaaaga

SEQ ID NO: 1651545 - RNA, 16 nt, Homo sapiens
uuuaaggggagcucuu

SEQ ID NO: 1651546 - RNA, 18 nt, Homo sapiens
uuuaagucaacacuauau

SEQ ID NO: 1651547 - RNA, 18 nt, Homo sapiens
uuuaagugcguguguaga

SEQ ID NO: 1651548 - RNA, 16 nt, Homo sapiens
uuuaauuugauaguau

SEQ ID NO: 1651549 - RNA, 23 nt, Homo sapiens
uuuacagaaucaaaugcaauuuu

SEQ ID NO: 1651550 - RNA, 21 nt, Homo sapiens
uuuaccugaaauaaaauucau

SEQ ID NO: 1651551 - RNA, 11 nt, Homo sapiens
uuuacuuuguu

SEQ ID NO: 1651552 - RNA, 21 nt, Homo sapiens
uuuagaccuguguuacuaaaa

SEQ ID NO: 1651553 - RNA, 15 nt, Homo sapiens
uuuagaugaauguca

SEQ ID NO: 1651554 - RNA, 23 nt, Homo sapiens
uuuagcauaguaccucugcuauu

SEQ ID NO: 1651555 - RNA, 19 nt, Homo sapiens
uuuaguccacccaauggcu

SEQ ID NO: 1651556 - RNA, 17 nt, Homo sapiens
uuuaguccuguacugua

SEQ ID NO: 1651557 - RNA, 18 nt, Homo sapiens
uuuaguucucagcucuuc

SEQ ID NO: 1651558 - RNA, 16 nt, Homo sapiens
uuuauaaaaguguuca

SEQ ID NO: 1651559 - RNA, 14 nt, Homo sapiens
uuuauagauuugac

SEQ ID NO: 1651560 - RNA, 23 nt, Homo sapiens
uuuauauguagauuagugaucua

SEQ ID NO: 1651561 - RNA, 14 nt, Homo sapiens
uuuauauuaauuuc

SEQ ID NO: 1651562 - RNA, 16 nt, Homo sapiens
uuuauauuugugugag

SEQ ID NO: 1651563 - RNA, 16 nt, Homo sapiens
ugggacacccugugau

SEQ ID NO: 1651564 - RNA, 14 nt, Homo sapiens
ugggacauugccuu

SEQ ID NO: 1651565 - RNA, 21 nt, Homo sapiens
ugggaccacgugagaucauuc

SEQ ID NO: 1651566 - RNA, 17 nt, Homo sapiens
ugggaccugaugaccug

SEQ ID NO: 1651567 - RNA, 21 nt, Homo sapiens
ugggacucauucacauuucaa

SEQ ID NO: 1651568 - RNA, 14 nt, Homo sapiens
ugggagacacugau

SEQ ID NO: 1651569 - RNA, 20 nt, Homo sapiens
ugggaugcgggcauuuugaa

SEQ ID NO: 1651570 - RNA, 17 nt, Homo sapiens
ugggauuacaggcuccu

SEQ ID NO: 1651571 - RNA, 17 nt, Homo sapiens
ugggcaacuauucauga

SEQ ID NO: 1651572 - RNA, 21 nt, Homo sapiens
ugggcagagcagagaccaucc

SEQ ID NO: 1651573 - RNA, 13 nt, Homo sapiens
ugggcagagccca

SEQ ID NO: 1651574 - RNA, 16 nt, Homo sapiens
ugggcagcucaucucu

SEQ ID NO: 1651575 - RNA, 19 nt, Homo sapiens
ugggcccccaaauggaaau

SEQ ID NO: 1651576 - RNA, 13 nt, Homo sapiens
ugggccuccucac

SEQ ID NO: 1651577 - RNA, 16 nt, Homo sapiens
uggggagaaaguacuu

SEQ ID NO: 1651578 - RNA, 20 nt, Homo sapiens
uggggcagcuugaggguugg

SEQ ID NO: 1651579 - RNA, 15 nt, Homo sapiens
ugggggaaagcacag

SEQ ID NO: 1651580 - RNA, 16 nt, Homo sapiens
ugggggaaauggugcc

SEQ ID NO: 1651581 - RNA, 23 nt, Homo sapiens
ugggggaagaccuggcaaggaca

SEQ ID NO: 1651582 - RNA, 21 nt, Homo sapiens
ugggguacccacugcucuggu

SEQ ID NO: 1651583 - RNA, 13 nt, Homo sapiens
uggguaaaugccu

SEQ ID NO: 1651584 - RNA, 23 nt, Homo sapiens
ugggucagaguuccgacugccau

SEQ ID NO: 1651585 - RNA, 22 nt, Homo sapiens
ugggucaggaggaaaagacuaa

SEQ ID NO: 1651586 - RNA, 21 nt, Homo sapiens
ugggucccagauuggcucaca

SEQ ID NO: 1651587 - RNA, 18 nt, Homo sapiens
ugguaaaauacauauaaa

SEQ ID NO: 1651588 - RNA, 21 nt, Homo sapiens
ugguauaaacguccuacugua

SEQ ID NO: 1651589 - RNA, 22 nt, Homo sapiens
ugguauaaacguccuacuguau

SEQ ID NO: 1651590 - RNA, 12 nt, Homo sapiens
ugguaugaucac

SEQ ID NO: 1651591 - RNA, 20 nt, Homo sapiens
ugguccauagagagcaagac

SEQ ID NO: 1651592 - RNA, 18 nt, Homo sapiens
uggucccccuuccaugga

SEQ ID NO: 1651593 - RNA, 13 nt, Homo sapiens
uggucuccucuca

SEQ ID NO: 1651594 - RNA, 18 nt, Homo sapiens
uggucuguuugcauuuga

SEQ ID NO: 1651595 - RNA, 22 nt, Homo sapiens
uggucuuuguaagaguguagaa

SEQ ID NO: 1651596 - RNA, 15 nt, Homo sapiens
uggugcuaauaugac

SEQ ID NO: 1651597 - RNA, 12 nt, Homo sapiens
ugguggcagcuc

SEQ ID NO: 1651598 - RNA, 19 nt, Homo sapiens
uggugggggugcagaugag

SEQ ID NO: 1651599 - RNA, 17 nt, Homo sapiens
ugguuacuaguacaggu

SEQ ID NO: 1651600 - RNA, 20 nt, Homo sapiens
ugguuaucuaauauguaaca

SEQ ID NO: 1651601 - RNA, 16 nt, Homo sapiens
ugguucaccuguguac

SEQ ID NO: 1651602 - RNA, 14 nt, Homo sapiens
ugguuuacuguguu

SEQ ID NO: 1651603 - RNA, 17 nt, Homo sapiens
ugguuuuuguugagucu

SEQ ID NO: 1651604 - RNA, 16 nt, Homo sapiens
uguaaacuuccaaguc

SEQ ID NO: 1651605 - RNA, 19 nt, Homo sapiens
uguaaagauguuuauuuca

SEQ ID NO: 1651606 - RNA, 21 nt, Homo sapiens
uguaaagcaggugcccaggaa

SEQ ID NO: 1651607 - RNA, 18 nt, Homo sapiens
uguaagguggucacuguu

SEQ ID NO: 1651608 - RNA, 17 nt, Homo sapiens
uguaaguuucaggugac

SEQ ID NO: 1651609 - RNA, 19 nt, Homo sapiens
uguaaucccagcuacuugg

SEQ ID NO: 1651610 - RNA, 18 nt, Homo sapiens
uguaauggacuaugcaca

SEQ ID NO: 1651611 - RNA, 19 nt, Homo sapiens
uguaauggacuaugcacac

SEQ ID NO: 1651612 - RNA, 14 nt, Homo sapiens
ggaagggccaccac

SEQ ID NO: 1651613 - RNA, 14 nt, Homo sapiens
ggaagucacuucac

SEQ ID NO: 1651614 - RNA, 16 nt, Homo sapiens
ggaaguccucugggua

SEQ ID NO: 1651615 - RNA, 17 nt, Homo sapiens
ggaagugugugaucugu

SEQ ID NO: 1651616 - RNA, 21 nt, Homo sapiens
ggaaguuuuguggaggagcuc

SEQ ID NO: 1651617 - RNA, 22 nt, Homo sapiens
ggaauauuugcaagacauagaa

SEQ ID NO: 1651618 - RNA, 16 nt, Homo sapiens
ggaaucuucaccucag

SEQ ID NO: 1651619 - RNA, 20 nt, Homo sapiens
ggacacauugccccaugaga

SEQ ID NO: 1651620 - RNA, 13 nt, Homo sapiens
ggacaccacccag

SEQ ID NO: 1651621 - RNA, 18 nt, Homo sapiens
ggacacuugcucaugccc

SEQ ID NO: 1651622 - RNA, 15 nt, Homo sapiens
ggacagggaggugac

SEQ ID NO: 1651623 - RNA, 15 nt, Homo sapiens
ggacaugaaacucca

SEQ ID NO: 1651624 - RNA, 19 nt, Homo sapiens
ggacauggccccugugagu

SEQ ID NO: 1651625 - RNA, 20 nt, Homo sapiens
ggacauugccuuuucuagcc

SEQ ID NO: 1651626 - RNA, 18 nt, Homo sapiens
ggacauugcggacagcca

SEQ ID NO: 1651627 - RNA, 16 nt, Homo sapiens
ggaccccaccccucau

SEQ ID NO: 1651628 - RNA, 21 nt, Homo sapiens
ggaccccaccccucaucagga

SEQ ID NO: 1651629 - RNA, 19 nt, Homo sapiens
ggaccccugagcuugcaga

SEQ ID NO: 1651630 - RNA, 12 nt, Homo sapiens
ggaccugaugac

SEQ ID NO: 1651631 - RNA, 19 nt, Homo sapiens
ggacuaaguguaccagaga

SEQ ID NO: 1651632 - RNA, 20 nt, Homo sapiens
ggacuaaguguaccagagaa

SEQ ID NO: 1651633 - RNA, 17 nt, Homo sapiens
ggacuacaggcacccac

SEQ ID NO: 1651634 - RNA, 22 nt, Homo sapiens
auaaagugcacaccuuuauuca

SEQ ID NO: 1651635 - RNA, 14 nt, Homo sapiens
auaaauaugcagug

SEQ ID NO: 1651636 - RNA, 17 nt, Homo sapiens
auaaaucuaguauacau

SEQ ID NO: 1651637 - RNA, 22 nt, Homo sapiens
auaacauuuacuuuugcucccu

SEQ ID NO: 1651638 - RNA, 14 nt, Homo sapiens
auaaccacuccuaa

SEQ ID NO: 1651639 - RNA, 11 nt, Homo sapiens
auaaccauagc

SEQ ID NO: 1651640 - RNA, 23 nt, Homo sapiens
auaaccguuuccuuucauuuacu

SEQ ID NO: 1651641 - RNA, 22 nt, Homo sapiens
auaacuaggcguggacuuacua

SEQ ID NO: 1651642 - RNA, 16 nt, Homo sapiens
auaagauauuguacau

SEQ ID NO: 1651643 - RNA, 17 nt, Homo sapiens
auaagcaaagacuauga

SEQ ID NO: 1651644 - RNA, 12 nt, Homo sapiens
auaauaaaucac

SEQ ID NO: 1651645 - RNA, 21 nt, Homo sapiens
auaauaaugccuaccuuguga

SEQ ID NO: 1651646 - RNA, 22 nt, Homo sapiens
auaaucaaaacccaacaugacu

SEQ ID NO: 1651647 - RNA, 16 nt, Homo sapiens
auaaucuaugaugaag

SEQ ID NO: 1651648 - RNA, 18 nt, Homo sapiens
auaaucugaggaagggag

SEQ ID NO: 1651649 - RNA, 11 nt, Homo sapiens
auaaugcacca

SEQ ID NO: 1651650 - RNA, 16 nt, Homo sapiens
auaaugcaccacuuuu

SEQ ID NO: 1651651 - RNA, 21 nt, Homo sapiens
auacaagugauaauacagauu

SEQ ID NO: 1651652 - RNA, 22 nt, Homo sapiens
auacacacacacgcgugcacac

SEQ ID NO: 1651653 - RNA, 15 nt, Homo sapiens
auacacagugcugac

SEQ ID NO: 1651654 - RNA, 13 nt, Homo sapiens
auacagugauaug

SEQ ID NO: 1651655 - RNA, 12 nt, Homo sapiens
auacagugucuu

SEQ ID NO: 1651656 - RNA, 14 nt, Homo sapiens
auacaugcauauaa

SEQ ID NO: 1651657 - RNA, 17 nt, Homo sapiens
auacauuguacuuauac

SEQ ID NO: 1651658 - RNA, 22 nt, Homo sapiens
auaccaaccugaagacaccguu

SEQ ID NO: 1651659 - RNA, 14 nt, Homo sapiens
auaccccauuugau

SEQ ID NO: 1651660 - RNA, 13 nt, Homo sapiens
auacggugggggu

SEQ ID NO: 1651661 - RNA, 21 nt, Homo sapiens
auacuauuuaauuauuucacu

SEQ ID NO: 1651662 - RNA, 15 nt, Homo sapiens
auacuauuuauauac

SEQ ID NO: 1651663 - RNA, 15 nt, Homo sapiens
auacugcccaaggau

SEQ ID NO: 1651664 - RNA, 22 nt, Homo sapiens
auacugugugcuaaaacaagca

SEQ ID NO: 1651665 - RNA, 12 nt, Homo sapiens
auacuguugcac

SEQ ID NO: 1651666 - RNA, 13 nt, Homo sapiens
auagaacagagaa

SEQ ID NO: 1651667 - RNA, 17 nt, Homo sapiens
auagaauacucagggaa

SEQ ID NO: 1651668 - RNA, 18 nt, Homo sapiens
auagcaugguuccaauuu

SEQ ID NO: 1651669 - RNA, 20 nt, Homo sapiens
auagcugugugaacguguau

SEQ ID NO: 1651670 - RNA, 23 nt, Homo sapiens
auaggaaauauuuuaauguuucu

SEQ ID NO: 1651671 - RNA, 15 nt, Homo sapiens
auaggagaggaugag

SEQ ID NO: 1651672 - RNA, 18 nt, Homo sapiens
auaggaggccaacccaaa

SEQ ID NO: 1651673 - RNA, 18 nt, Homo sapiens
auaggcaggaacauacag

SEQ ID NO: 1651674 - RNA, 14 nt, Homo sapiens
auaggcccagugag

SEQ ID NO: 1651675 - RNA, 17 nt, Homo sapiens
auaggcccagugagaug

SEQ ID NO: 1651676 - RNA, 17 nt, Homo sapiens
auaguggggucagggcu

SEQ ID NO: 1651677 - RNA, 16 nt, Homo sapiens
auaguguuggaaaaug

SEQ ID NO: 1651678 - RNA, 23 nt, Homo sapiens
auaguguuggaaaaugugcaaua

SEQ ID NO: 1651679 - RNA, 14 nt, Homo sapiens
auauagaacagugc

SEQ ID NO: 1651680 - RNA, 16 nt, Homo sapiens
auauauuaaauuugaa

SEQ ID NO: 1651681 - RNA, 17 nt, Homo sapiens
auauauuuauaaggaaa

SEQ ID NO: 1651682 - RNA, 16 nt, Homo sapiens
auaucauuugugaaga

SEQ ID NO: 1651683 - RNA, 13 nt, Homo sapiens
auauccugcucac

SEQ ID NO: 1651684 - RNA, 12 nt, Homo sapiens
auaucucccuuu

SEQ ID NO: 1651685 - RNA, 16 nt, Homo sapiens
auaucuucuacaugca

SEQ ID NO: 1651686 - RNA, 15 nt, Homo sapiens
auaucuuuauugcau

SEQ ID NO: 1651687 - RNA, 13 nt, Homo sapiens
auaugaagacaua

SEQ ID NO: 1651688 - RNA, 17 nt, Homo sapiens
auaugacaauaagccac

SEQ ID NO: 1651689 - RNA, 15 nt, Homo sapiens
auaugagacuuucaa

SEQ ID NO: 1651690 - RNA, 20 nt, Homo sapiens
auaugcaccaaaucaucucu

SEQ ID NO: 1651691 - RNA, 14 nt, Homo sapiens
auaugcagugauau

SEQ ID NO: 1651692 - RNA, 15 nt, Homo sapiens
auauguuaaauguau

SEQ ID NO: 1651693 - RNA, 20 nt, Homo sapiens
auauguuuggaauauuccac

SEQ ID NO: 1651694 - RNA, 21 nt, Homo sapiens
auauguuuuaagaggcagggu

SEQ ID NO: 1651695 - RNA, 20 nt, Homo sapiens
auauuacuugccuaucugac

SEQ ID NO: 1651696 - RNA, 22 nt, Homo sapiens
auauucacuuucauuuuugaca

SEQ ID NO: 1651697 - RNA, 15 nt, Homo sapiens
auauugaccauguga

SEQ ID NO: 1651698 - RNA, 12 nt, Homo sapiens
auauugaugaaa

SEQ ID NO: 1651699 - RNA, 20 nt, Homo sapiens
auauugcagcuuauauucau

SEQ ID NO: 1651700 - RNA, 22 nt, Homo sapiens
auauugugaacccuagcugugu

SEQ ID NO: 1651701 - RNA, 22 nt, Homo sapiens
auauuuccaagaaauauuccuu

SEQ ID NO: 1651702 - RNA, 16 nt, Homo sapiens
auauuugguuuggcca

SEQ ID NO: 1651703 - RNA, 18 nt, Homo sapiens
auauuuuguuaccuuuua

SEQ ID NO: 1651704 - RNA, 19 nt, Homo sapiens
auauuuuuaugugcaauaa

SEQ ID NO: 1651705 - RNA, 15 nt, Homo sapiens
aucaaaaucaaugca

SEQ ID NO: 1651706 - RNA, 22 nt, Homo sapiens
aucaaauggaagacacauugaa

SEQ ID NO: 1651707 - RNA, 13 nt, Homo sapiens
aucaacagcauuu

SEQ ID NO: 1651708 - RNA, 12 nt, Homo sapiens
aucaaccaaaaa

SEQ ID NO: 1651709 - RNA, 16 nt, Homo sapiens
aucaacgaguacuuca

SEQ ID NO: 1651710 - RNA, 14 nt, Homo sapiens
aucaagcagccaag

SEQ ID NO: 1651711 - RNA, 23 nt, Homo sapiens
aucaauucuauuacgugcaauac

SEQ ID NO: 1651712 - RNA, 13 nt, Homo sapiens
aucacacaacuca

SEQ ID NO: 1651713 - RNA, 23 nt, Homo sapiens
aucacacgucuggcuucacagau

SEQ ID NO: 1651714 - RNA, 14 nt, Homo sapiens
aucacaucaugcug

SEQ ID NO: 1651715 - RNA, 17 nt, Homo sapiens
aucaccuccaccauacu

SEQ ID NO: 1651716 - RNA, 15 nt, Homo sapiens
aucacuggcucucua

SEQ ID NO: 1651717 - RNA, 19 nt, Homo sapiens
aucacugguauuaacuuua

SEQ ID NO: 1651718 - RNA, 13 nt, Homo sapiens
aucacugucaaua

SEQ ID NO: 1651719 - RNA, 14 nt, Homo sapiens
aucacugucaauau

SEQ ID NO: 1651720 - RNA, 16 nt, Homo sapiens
aucacuuuucucugag

SEQ ID NO: 1651721 - RNA, 18 nt, Homo sapiens
aucagcgccgcaccagcc

SEQ ID NO: 1651722 - RNA, 15 nt, Homo sapiens
aucaggacccagagg

SEQ ID NO: 1651723 - RNA, 21 nt, Homo sapiens
aucaguuagagcugacacaaa

SEQ ID NO: 1651724 - RNA, 19 nt, Homo sapiens
aucauacaaauacuaucca

SEQ ID NO: 1651725 - RNA, 14 nt, Homo sapiens
agggaggcacuucc

SEQ ID NO: 1651726 - RNA, 17 nt, Homo sapiens
agggagugggcuaagca

SEQ ID NO: 1651727 - RNA, 20 nt, Homo sapiens
agggauggugcccuguucuc

SEQ ID NO: 1651728 - RNA, 14 nt, Homo sapiens
agggcacacacugu

SEQ ID NO: 1651729 - RNA, 15 nt, Homo sapiens
agggcacacacugug

SEQ ID NO: 1651730 - RNA, 12 nt, Homo sapiens
agggcagcagaa

SEQ ID NO: 1651731 - RNA, 18 nt, Homo sapiens
agggcagccagggagagc

SEQ ID NO: 1651732 - RNA, 15 nt, Homo sapiens
agggcgcuuguccca

SEQ ID NO: 1651733 - RNA, 20 nt, Homo sapiens
agggcuacaaaggaggacaa

SEQ ID NO: 1651734 - RNA, 23 nt, Homo sapiens
agggcuagaaccuguagagcuag

SEQ ID NO: 1651735 - RNA, 18 nt, Homo sapiens
agggcucacagaauucau

SEQ ID NO: 1651736 - RNA, 18 nt, Homo sapiens
aggggaaugggaagcagc

SEQ ID NO: 1651737 - RNA, 14 nt, Homo sapiens
aggggacaacaaua

SEQ ID NO: 1651738 - RNA, 16 nt, Homo sapiens
aggggcccgcuugccu

SEQ ID NO: 1651739 - RNA, 23 nt, Homo sapiens
aggggcuguugaauuucccacau

SEQ ID NO: 1651740 - RNA, 13 nt, Homo sapiens
agggguaguggga

SEQ ID NO: 1651741 - RNA, 22 nt, Homo sapiens
aggguacacaauggguaucuaa

SEQ ID NO: 1651742 - RNA, 12 nt, Homo sapiens
agggucaaggac

SEQ ID NO: 1651743 - RNA, 18 nt, Homo sapiens
agggugggccuucaggga

SEQ ID NO: 1651744 - RNA, 18 nt, Homo sapiens
agguaaaggaugaggguu

SEQ ID NO: 1651745 - RNA, 14 nt, Homo sapiens
agguacccaugaau

SEQ ID NO: 1651746 - RNA, 17 nt, Homo sapiens
agguacgaugacagugu

SEQ ID NO: 1651747 - RNA, 22 nt, Homo sapiens
agguacugucaugggcuaggca

SEQ ID NO: 1651748 - RNA, 23 nt, Homo sapiens
aggucggaccagcuuuucccaaa

SEQ ID NO: 1651749 - RNA, 21 nt, Homo sapiens
aggucucgcugaugcugggcu

SEQ ID NO: 1651750 - RNA, 13 nt, Homo sapiens
aggucuucuccaa

SEQ ID NO: 1651751 - RNA, 15 nt, Homo sapiens
aggucuucucuccaa

SEQ ID NO: 1651752 - RNA, 13 nt, Homo sapiens
aggugacagagug

SEQ ID NO: 1651753 - RNA, 16 nt, Homo sapiens
aggugauccacccacc

SEQ ID NO: 1651754 - RNA, 16 nt, Homo sapiens
aggugccaacaguguu

SEQ ID NO: 1651755 - RNA, 22 nt, Homo sapiens
aggugcccaggaaccucagggc

SEQ ID NO: 1651756 - RNA, 19 nt, Homo sapiens
aggugugaggacuucugca

SEQ ID NO: 1651757 - RNA, 13 nt, Homo sapiens
agguuagaaccua

SEQ ID NO: 1651758 - RNA, 18 nt, Homo sapiens
agguuaucgaaauaacaa

SEQ ID NO: 1651759 - RNA, 22 nt, Homo sapiens
agguuuuuggucugacccacug

SEQ ID NO: 1651760 - RNA, 22 nt, Homo sapiens
aguaaccuggguaaaugcagcg

SEQ ID NO: 1651761 - RNA, 21 nt, Homo sapiens
aguaauuauuuucuuccuuuc

SEQ ID NO: 1651762 - RNA, 18 nt, Homo sapiens
aguacaccccaacagcac

SEQ ID NO: 1651763 - RNA, 22 nt, Homo sapiens
aguacuguaacugugucaugau

SEQ ID NO: 1651764 - RNA, 15 nt, Homo sapiens
aguagacaagcaauu

SEQ ID NO: 1651765 - RNA, 15 nt, Homo sapiens
aguaggaagacuuug

SEQ ID NO: 1651766 - RNA, 16 nt, Homo sapiens
aguagggguugaagaa

SEQ ID NO: 1651767 - RNA, 23 nt, Homo sapiens
aguaguugggauuaccaguagau

SEQ ID NO: 1651768 - RNA, 16 nt, Homo sapiens
agucaauuugcugaaa

SEQ ID NO: 1651769 - RNA, 20 nt, Homo sapiens
agucacuuauaauuaugcua

SEQ ID NO: 1651770 - RNA, 18 nt, Homo sapiens
agucacuucaccaucaac

SEQ ID NO: 1651771 - RNA, 20 nt, Homo sapiens
agucaugcaaaggcugggac

SEQ ID NO: 1651772 - RNA, 16 nt, Homo sapiens
agucauuaaagacagg

SEQ ID NO: 1651773 - RNA, 22 nt, Homo sapiens
agucauuguuucccaucacugu

SEQ ID NO: 1651774 - RNA, 23 nt, Homo sapiens
agucauuuuuguuucuaccuccc

SEQ ID NO: 1651775 - RNA, 18 nt, Homo sapiens
agucccaccuuggcugca

SEQ ID NO: 1651776 - RNA, 14 nt, Homo sapiens
aguccuguacugua

SEQ ID NO: 1651777 - RNA, 17 nt, Homo sapiens
agucggagccacugguc

SEQ ID NO: 1651778 - RNA, 14 nt, Homo sapiens
agucugacugugcc

SEQ ID NO: 1651779 - RNA, 13 nt, Homo sapiens
agucuggcucugu

SEQ ID NO: 1651780 - RNA, 15 nt, Homo sapiens
agucuguccuggaac

SEQ ID NO: 1651781 - RNA, 13 nt, Homo sapiens
agucuucccauuu

SEQ ID NO: 1651782 - RNA, 16 nt, Homo sapiens
agucuuguauuaaguu

SEQ ID NO: 1651783 - RNA, 12 nt, Homo sapiens
agugaaggauuu

SEQ ID NO: 1651784 - RNA, 14 nt, Homo sapiens
agugaaggauuuau

SEQ ID NO: 1651785 - RNA, 11 nt, Homo sapiens
agugacagagg

SEQ ID NO: 1651786 - RNA, 12 nt, Homo sapiens
agugacagaucc

SEQ ID NO: 1651787 - RNA, 16 nt, Homo sapiens
agugagaugcauucuu

SEQ ID NO: 1651788 - RNA, 17 nt, Homo sapiens
agugagccgagaucaca

SEQ ID NO: 1651789 - RNA, 17 nt, Homo sapiens
agugagcuccuaagcca

SEQ ID NO: 1651790 - RNA, 14 nt, Homo sapiens
agugagugaucacu

SEQ ID NO: 1651791 - RNA, 19 nt, Homo sapiens
agugauccucccaccucag

SEQ ID NO: 1651792 - RNA, 19 nt, Homo sapiens
agugauccuuccaccucag

SEQ ID NO: 1651793 - RNA, 12 nt, Homo sapiens
agugauggagcu

SEQ ID NO: 1651794 - RNA, 18 nt, Homo sapiens
agugcaauggcacaaucu

SEQ ID NO: 1651795 - RNA, 20 nt, Homo sapiens
agugcacaacauuacaggga

SEQ ID NO: 1651796 - RNA, 18 nt, Homo sapiens
agugcacuaauucugcau

SEQ ID NO: 1651797 - RNA, 16 nt, Homo sapiens
agugcccccaacagca

SEQ ID NO: 1651798 - RNA, 17 nt, Homo sapiens
agugccuauugauacuu

SEQ ID NO: 1651799 - RNA, 20 nt, Homo sapiens
agugccuggccaaagggaua

SEQ ID NO: 1651800 - RNA, 13 nt, Homo sapiens
agugcgguuuacu

SEQ ID NO: 1651801 - RNA, 12 nt, Homo sapiens
aguggagccaug

SEQ ID NO: 1651802 - RNA, 19 nt, Homo sapiens
aguggcaccaccauggcuc

SEQ ID NO: 1651803 - RNA, 20 nt, Homo sapiens
aguggcguaaucucggcuca

SEQ ID NO: 1651804 - RNA, 13 nt, Homo sapiens
agugggcauguau

SEQ ID NO: 1651805 - RNA, 14 nt, Homo sapiens
aguggggucagggc

SEQ ID NO: 1651806 - RNA, 19 nt, Homo sapiens
agugguugggcugugccug

SEQ ID NO: 1651807 - RNA, 22 nt, Homo sapiens
aguguuaggccuggcacagugu

SEQ ID NO: 1651808 - RNA, 23 nt, Homo sapiens
aguguuccccuuccacugagggc

SEQ ID NO: 1651809 - RNA, 20 nt, Homo sapiens
aguuaaauguaucacauuga

SEQ ID NO: 1651810 - RNA, 21 nt, Homo sapiens
aguuaauaaucuaugaugaag

SEQ ID NO: 1651811 - RNA, 16 nt, Homo sapiens
aguuaauccacaucuu

SEQ ID NO: 1651812 - RNA, 23 nt, Homo sapiens
aguuacugguaucugucacugac

SEQ ID NO: 1651813 - RNA, 15 nt, Homo sapiens
aguuauaucagugaa

SEQ ID NO: 1651814 - RNA, 17 nt, Homo sapiens
aguucaagugucuguau

SEQ ID NO: 1651815 - RNA, 20 nt, Homo sapiens
aguucuaugagggcuaauau

SEQ ID NO: 1651816 - RNA, 22 nt, Homo sapiens
aguucucagcucuucugacuua

SEQ ID NO: 1651817 - RNA, 22 nt, Homo sapiens
aguucuccacuagcuauggugu

SEQ ID NO: 1651818 - RNA, 22 nt, Homo sapiens
aguugacuugacagaacacugu

SEQ ID NO: 1651819 - RNA, 14 nt, Homo sapiens
aguugccagucacc

SEQ ID NO: 1651820 - RNA, 22 nt, Homo sapiens
aguugccaucugcgugacaaua

SEQ ID NO: 1651821 - RNA, 21 nt, Homo sapiens
aguugcccaccaaaacacaga

SEQ ID NO: 1651822 - RNA, 21 nt, Homo sapiens
aguugccuuuauuugcuguua

SEQ ID NO: 1651823 - RNA, 17 nt, Homo sapiens
aguugcucacaugucuu

SEQ ID NO: 1651824 - RNA, 11 nt, Homo sapiens
aguugcuguau

SEQ ID NO: 1651825 - RNA, 19 nt, Homo sapiens
aguuuguugugaggauuaa

SEQ ID NO: 1651826 - RNA, 18 nt, Homo sapiens
aguuuucaacuucaguac

SEQ ID NO: 1651827 - RNA, 13 nt, Homo sapiens
aguuuugccaagg

SEQ ID NO: 1651828 - RNA, 22 nt, Homo sapiens
auaaaagaaauaaaccaaagga

SEQ ID NO: 1651829 - RNA, 18 nt, Homo sapiens
auaaaaguguucauuguu

SEQ ID NO: 1651830 - RNA, 20 nt, Homo sapiens
auaaaaucuaauuaauucuu

SEQ ID NO: 1651831 - RNA, 16 nt, Homo sapiens
auaaaccaaaggaaaa

SEQ ID NO: 1651832 - RNA, 14 nt, Homo sapiens
auaaacccaguugc

SEQ ID NO: 1651833 - RNA, 12 nt, Homo sapiens
auaaacugagag

SEQ ID NO: 1651834 - RNA, 23 nt, Homo sapiens
auaaacugagaggucacaaagaa

SEQ ID NO: 1651835 - RNA, 16 nt, Homo sapiens
agcccauucauuccau

SEQ ID NO: 1651836 - RNA, 14 nt, Homo sapiens
agccccauccucug

SEQ ID NO: 1651837 - RNA, 13 nt, Homo sapiens
agccccucagaca

SEQ ID NO: 1651838 - RNA, 22 nt, Homo sapiens
agccccucucuuauaauuccag

SEQ ID NO: 1651839 - RNA, 15 nt, Homo sapiens
agcccuacucugugu

SEQ ID NO: 1651840 - RNA, 15 nt, Homo sapiens
agcccucacccuggg

SEQ ID NO: 1651841 - RNA, 21 nt, Homo sapiens
agccgagaucacgccacugca

SEQ ID NO: 1651842 - RNA, 19 nt, Homo sapiens
agccgagaucgugccauug

SEQ ID NO: 1651843 - RNA, 14 nt, Homo sapiens
agccggacacuucu

SEQ ID NO: 1651844 - RNA, 18 nt, Homo sapiens
agccuaggugacagagug

SEQ ID NO: 1651845 - RNA, 23 nt, Homo sapiens
agccuauguaugccauggaggca

SEQ ID NO: 1651846 - RNA, 14 nt, Homo sapiens
agccucaaauuuga

SEQ ID NO: 1651847 - RNA, 19 nt, Homo sapiens
agccucccgaguagcugag

SEQ ID NO: 1651848 - RNA, 22 nt, Homo sapiens
agccugaacgcuucugcuuaau

SEQ ID NO: 1651849 - RNA, 22 nt, Homo sapiens
agccugacaacagccugagaaa

SEQ ID NO: 1651850 - RNA, 14 nt, Homo sapiens
agccuggaacauca

SEQ ID NO: 1651851 - RNA, 17 nt, Homo sapiens
agccuggaacaucauca

SEQ ID NO: 1651852 - RNA, 12 nt, Homo sapiens
agccuggcccag

SEQ ID NO: 1651853 - RNA, 18 nt, Homo sapiens
agccuggcuccaaacccu

SEQ ID NO: 1651854 - RNA, 17 nt, Homo sapiens
agccugggggcuccuca

SEQ ID NO: 1651855 - RNA, 18 nt, Homo sapiens
agccugucaagaggcaaa

SEQ ID NO: 1651856 - RNA, 15 nt, Homo sapiens
agcgauuaauaacag

SEQ ID NO: 1651857 - RNA, 15 nt, Homo sapiens
agcgcgcacacgcac

SEQ ID NO: 1651858 - RNA, 16 nt, Homo sapiens
agcgugagccacugca

SEQ ID NO: 1651859 - RNA, 21 nt, Homo sapiens
agcgugcgucugugugugccu

SEQ ID NO: 1651860 - RNA, 15 nt, Homo sapiens
agcuaacacacagcu

SEQ ID NO: 1651861 - RNA, 17 nt, Homo sapiens
agcuaauugagaccaca

SEQ ID NO: 1651862 - RNA, 22 nt, Homo sapiens
agcuacuguuuauuauuuuauu

SEQ ID NO: 1651863 - RNA, 18 nt, Homo sapiens
agcuaggccuggccagau

SEQ ID NO: 1651864 - RNA, 22 nt, Homo sapiens
agcuaggccuggccagaugcac

SEQ ID NO: 1651865 - RNA, 16 nt, Homo sapiens
agcuaucuauaccuua

SEQ ID NO: 1651866 - RNA, 16 nt, Homo sapiens
agcuauuagccaggau

SEQ ID NO: 1651867 - RNA, 14 nt, Homo sapiens
agcucacuguucua

SEQ ID NO: 1651868 - RNA, 13 nt, Homo sapiens
agcucaucucagc

SEQ ID NO: 1651869 - RNA, 18 nt, Homo sapiens
agcuccacuuucagugaa

SEQ ID NO: 1651870 - RNA, 14 nt, Homo sapiens
agcucccaagggau

SEQ ID NO: 1651871 - RNA, 21 nt, Homo sapiens
agcucccaagggauggugccc

SEQ ID NO: 1651872 - RNA, 21 nt, Homo sapiens
agcucugguguaguuucugca

SEQ ID NO: 1651873 - RNA, 23 nt, Homo sapiens
agcucuugugaauauuguggcuc

SEQ ID NO: 1651874 - RNA, 14 nt, Homo sapiens
agcugauacuuuga

SEQ ID NO: 1651875 - RNA, 17 nt, Homo sapiens
agcugcuggcugugaca

SEQ ID NO: 1651876 - RNA, 20 nt, Homo sapiens
agcugcuggcugugacaaug

SEQ ID NO: 1651877 - RNA, 20 nt, Homo sapiens
agcuggcaccuuaguugcau

SEQ ID NO: 1651878 - RNA, 14 nt, Homo sapiens
agcugggauuacag

SEQ ID NO: 1651879 - RNA, 22 nt, Homo sapiens
agcuggguuggaaaacaguauu

SEQ ID NO: 1651880 - RNA, 20 nt, Homo sapiens
agcugguggauggugacuuu

SEQ ID NO: 1651881 - RNA, 16 nt, Homo sapiens
agcuggugguaucuga

SEQ ID NO: 1651882 - RNA, 18 nt, Homo sapiens
agcugugugaacguguau

SEQ ID NO: 1651883 - RNA, 12 nt, Homo sapiens
agcuguucucug

SEQ ID NO: 1651884 - RNA, 23 nt, Homo sapiens
agcuuaccagggucuuugcagau

SEQ ID NO: 1651885 - RNA, 14 nt, Homo sapiens
agcuucacaguacc

SEQ ID NO: 1651886 - RNA, 20 nt, Homo sapiens
agcuugaguuuuuaguggaa

SEQ ID NO: 1651887 - RNA, 13 nt, Homo sapiens
agcuugaugccag

SEQ ID NO: 1651888 - RNA, 17 nt, Homo sapiens
agcuuguaaauagcuca

SEQ ID NO: 1651889 - RNA, 16 nt, Homo sapiens
agcuuucaaaagcaag

SEQ ID NO: 1651890 - RNA, 14 nt, Homo sapiens
agcuuucagacucc

SEQ ID NO: 1651891 - RNA, 17 nt, Homo sapiens
aggaaaaucugcacugu

SEQ ID NO: 1651892 - RNA, 15 nt, Homo sapiens
aggaaaccacagcug

SEQ ID NO: 1651893 - RNA, 20 nt, Homo sapiens
aggaaauauucuguaaucuu

SEQ ID NO: 1651894 - RNA, 14 nt, Homo sapiens
aggaagacuuugga

SEQ ID NO: 1651895 - RNA, 19 nt, Homo sapiens
aggaagagccaggugcugc

SEQ ID NO: 1651896 - RNA, 12 nt, Homo sapiens
aggaagcucagg

SEQ ID NO: 1651897 - RNA, 14 nt, Homo sapiens
aggaagggccacca

SEQ ID NO: 1651898 - RNA, 17 nt, Homo sapiens
aggaauuaaguuaggga

SEQ ID NO: 1651899 - RNA, 17 nt, Homo sapiens
aggacaaaaaaccucag

SEQ ID NO: 1651900 - RNA, 17 nt, Homo sapiens
aggacaaacagugaauu

SEQ ID NO: 1651901 - RNA, 14 nt, Homo sapiens
aggacacagaugaa

SEQ ID NO: 1651902 - RNA, 13 nt, Homo sapiens
aggacauggacaa

SEQ ID NO: 1651903 - RNA, 14 nt, Homo sapiens
aggaccaagggcag

SEQ ID NO: 1651904 - RNA, 11 nt, Homo sapiens
aggacugagau

SEQ ID NO: 1651905 - RNA, 14 nt, Homo sapiens
aggacuuccaucug

SEQ ID NO: 1651906 - RNA, 15 nt, Homo sapiens
aggagacccacaggu

SEQ ID NO: 1651907 - RNA, 19 nt, Homo sapiens
aggagaucuggcugugagg

SEQ ID NO: 1651908 - RNA, 20 nt, Homo sapiens
aggagccaaacauccuacaa

SEQ ID NO: 1651909 - RNA, 17 nt, Homo sapiens
aggagcugccuggaccc

SEQ ID NO: 1651910 - RNA, 17 nt, Homo sapiens
aggagggcaguggugga

SEQ ID NO: 1651911 - RNA, 21 nt, Homo sapiens
aggagguucucacuguuguga

SEQ ID NO: 1651912 - RNA, 20 nt, Homo sapiens
aggaguacaccccaacagca

SEQ ID NO: 1651913 - RNA, 21 nt, Homo sapiens
aggaguacaccccaacagcac

SEQ ID NO: 1651914 - RNA, 15 nt, Homo sapiens
aggaguacaggugaa

SEQ ID NO: 1651915 - RNA, 19 nt, Homo sapiens
aggaugaaggcaaugccau

SEQ ID NO: 1651916 - RNA, 23 nt, Homo sapiens
aggaugagagcccagagguaaca

SEQ ID NO: 1651917 - RNA, 14 nt, Homo sapiens
aggauugcuacugu

SEQ ID NO: 1651918 - RNA, 19 nt, Homo sapiens
aggauuugggcucuuggaa

SEQ ID NO: 1651919 - RNA, 15 nt, Homo sapiens
aggauuuugauccaa

SEQ ID NO: 1651920 - RNA, 14 nt, Homo sapiens
aggcaagccaugga

SEQ ID NO: 1651921 - RNA, 15 nt, Homo sapiens
aggcagcagugugag

SEQ ID NO: 1651922 - RNA, 17 nt, Homo sapiens
aggcagcugacacaucu

SEQ ID NO: 1651923 - RNA, 19 nt, Homo sapiens
aggcaggcuuuuccuccaa

SEQ ID NO: 1651924 - RNA, 14 nt, Homo sapiens
aggcagggucucac

SEQ ID NO: 1651925 - RNA, 13 nt, Homo sapiens
aggcaugaaauga

SEQ ID NO: 1651926 - RNA, 16 nt, Homo sapiens
aggcaugaaguuuccu

SEQ ID NO: 1651927 - RNA, 15 nt, Homo sapiens
aggcaugacuguaga

SEQ ID NO: 1651928 - RNA, 20 nt, Homo sapiens
aggccagagggagugacaga

SEQ ID NO: 1651929 - RNA, 11 nt, Homo sapiens
aggccaggacu

SEQ ID NO: 1651930 - RNA, 20 nt, Homo sapiens
aggccgagucuguccuggaa

SEQ ID NO: 1651931 - RNA, 23 nt, Homo sapiens
aggccugagauuucaucugcucu

SEQ ID NO: 1651932 - RNA, 18 nt, Homo sapiens
aggccuggccagaugcac

SEQ ID NO: 1651933 - RNA, 20 nt, Homo sapiens
aggccuggccagaugcacca

SEQ ID NO: 1651934 - RNA, 17 nt, Homo sapiens
aggcucguugacuggcu

SEQ ID NO: 1651935 - RNA, 16 nt, Homo sapiens
aggcugagaacacugu

SEQ ID NO: 1651936 - RNA, 17 nt, Homo sapiens
aggcugagaacacugug

SEQ ID NO: 1651937 - RNA, 15 nt, Homo sapiens
aggcugauaccuuug

SEQ ID NO: 1651938 - RNA, 22 nt, Homo sapiens
aggcugccuccuuuaaacugca

SEQ ID NO: 1651939 - RNA, 21 nt, Homo sapiens
aggcugcucuugaacuccuga

SEQ ID NO: 1651940 - RNA, 20 nt, Homo sapiens
aggcuggagugcaauggcac

SEQ ID NO: 1651941 - RNA, 20 nt, Homo sapiens
aggcuuuuaccauuagcaua

SEQ ID NO: 1651942 - RNA, 17 nt, Homo sapiens
agggaaaacauuccauc

SEQ ID NO: 1651943 - RNA, 19 nt, Homo sapiens
agggaaaggauggggacca

SEQ ID NO: 1651944 - RNA, 20 nt, Homo sapiens
agggacccugggugggagca

SEQ ID NO: 1651945 - RNA, 14 nt, Homo sapiens
agaccacuauucuu

SEQ ID NO: 1651946 - RNA, 23 nt, Homo sapiens
agaccacuauucuuaacuauuca

SEQ ID NO: 1651947 - RNA, 21 nt, Homo sapiens
agaccaucuacauacacagug

SEQ ID NO: 1651948 - RNA, 13 nt, Homo sapiens
agaccaucuuugc

SEQ ID NO: 1651949 - RNA, 12 nt, Homo sapiens
agacccggcugc

SEQ ID NO: 1651950 - RNA, 16 nt, Homo sapiens
agaccucugugcacuu

SEQ ID NO: 1651951 - RNA, 15 nt, Homo sapiens
agaccugcucuggac

SEQ ID NO: 1651952 - RNA, 19 nt, Homo sapiens
agacgugauuuugcuguag

SEQ ID NO: 1651953 - RNA, 21 nt, Homo sapiens
agacgugauuuugcuguagaa

SEQ ID NO: 1651954 - RNA, 19 nt, Homo sapiens
agacuaugcaaaaguacaa

SEQ ID NO: 1651955 - RNA, 22 nt, Homo sapiens
agacucacuuguucucacuguc

SEQ ID NO: 1651956 - RNA, 19 nt, Homo sapiens
agacugcugcugaauuuau

SEQ ID NO: 1651957 - RNA, 15 nt, Homo sapiens
agacuggaagcacag

SEQ ID NO: 1651958 - RNA, 17 nt, Homo sapiens
agacuggaagcacagcu

SEQ ID NO: 1651959 - RNA, 16 nt, Homo sapiens
agacugggcugaggga

SEQ ID NO: 1651960 - RNA, 21 nt, Homo sapiens
agacuuaauagaaacauugaa

SEQ ID NO: 1651961 - RNA, 11 nt, Homo sapiens
agacuuucaag

SEQ ID NO: 1651962 - RNA, 20 nt, Homo sapiens
agacuuugacucuccagaaa

SEQ ID NO: 1651963 - RNA, 21 nt, Homo sapiens
agacuuuuguuaugaggagcu

SEQ ID NO: 1651964 - RNA, 16 nt, Homo sapiens
agagaaaguacuucuc

SEQ ID NO: 1651965 - RNA, 12 nt, Homo sapiens
agagaauggaca

SEQ ID NO: 1651966 - RNA, 21 nt, Homo sapiens
agagacagcucuucuacuacc

SEQ ID NO: 1651967 - RNA, 15 nt, Homo sapiens
agagacuccuugaga

SEQ ID NO: 1651968 - RNA, 14 nt, Homo sapiens
agagagcacaguga

SEQ ID NO: 1651969 - RNA, 20 nt, Homo sapiens
agagauguguguugauacug

SEQ ID NO: 1651970 - RNA, 22 nt, Homo sapiens
agagcacacuuggcccaagugg

SEQ ID NO: 1651971 - RNA, 15 nt, Homo sapiens
agagcagaugcagag

SEQ ID NO: 1651972 - RNA, 19 nt, Homo sapiens
agagcaggcguucagcuca

SEQ ID NO: 1651973 - RNA, 13 nt, Homo sapiens
agagccagggucu

SEQ ID NO: 1651974 - RNA, 14 nt, Homo sapiens
agagcucugaccca

SEQ ID NO: 1651975 - RNA, 17 nt, Homo sapiens
agagcucugacccacag

SEQ ID NO: 1651976 - RNA, 21 nt, Homo sapiens
agaggccggucccuuccuugg

SEQ ID NO: 1651977 - RNA, 18 nt, Homo sapiens
agagggcacacacugugu

SEQ ID NO: 1651978 - RNA, 14 nt, Homo sapiens
agagggcaggcaug

SEQ ID NO: 1651979 - RNA, 13 nt, Homo sapiens
agaguacacccca

SEQ ID NO: 1651980 - RNA, 20 nt, Homo sapiens
agaguacaccccaacagcac

SEQ ID NO: 1651981 - RNA, 15 nt, Homo sapiens
agaguauggagcuca

SEQ ID NO: 1651982 - RNA, 23 nt, Homo sapiens
agagucuccuuacucauuaauuc

SEQ ID NO: 1651983 - RNA, 16 nt, Homo sapiens
agagugaaggauuuau

SEQ ID NO: 1651984 - RNA, 18 nt, Homo sapiens
agaguggcauuggcagca

SEQ ID NO: 1651985 - RNA, 19 nt, Homo sapiens
agauaaucuuuuacauuga

SEQ ID NO: 1651986 - RNA, 23 nt, Homo sapiens
agauacugaggaaugucuuucag

SEQ ID NO: 1651987 - RNA, 19 nt, Homo sapiens
agauauauuaagugacugu

SEQ ID NO: 1651988 - RNA, 17 nt, Homo sapiens
agauaucuaugacugug

SEQ ID NO: 1651989 - RNA, 13 nt, Homo sapiens
agaucacaccacu

SEQ ID NO: 1651990 - RNA, 18 nt, Homo sapiens
agaucacaccacuguacu

SEQ ID NO: 1651991 - RNA, 12 nt, Homo sapiens
agaucacgccac

SEQ ID NO: 1651992 - RNA, 17 nt, Homo sapiens
agaucacgccacugcac

SEQ ID NO: 1651993 - RNA, 20 nt, Homo sapiens
agauccaaaugcugugcaaa

SEQ ID NO: 1651994 - RNA, 20 nt, Homo sapiens
agauccccaagccuggcaag

SEQ ID NO: 1651995 - RNA, 13 nt, Homo sapiens
agauccuacccca

SEQ ID NO: 1651996 - RNA, 22 nt, Homo sapiens
agauccuaccccaauuccuugu

SEQ ID NO: 1651997 - RNA, 13 nt, Homo sapiens
agauccuccauuu

SEQ ID NO: 1651998 - RNA, 19 nt, Homo sapiens
agauccuuuaguccaccca

SEQ ID NO: 1651999 - RNA, 12 nt, Homo sapiens
agaucuaccccu

SEQ ID NO: 1652000 - RNA, 21 nt, Homo sapiens
agaugaccuacagugcugugu

SEQ ID NO: 1652001 - RNA, 20 nt, Homo sapiens
agaugcauuaucuaugauau

SEQ ID NO: 1652002 - RNA, 22 nt, Homo sapiens
agaugggggaaagcacaggugg

SEQ ID NO: 1652003 - RNA, 19 nt, Homo sapiens
agauguccuugaugcucau

SEQ ID NO: 1652004 - RNA, 16 nt, Homo sapiens
agaugugagggcacca

SEQ ID NO: 1652005 - RNA, 17 nt, Homo sapiens
agauguuauuaugcuaa

SEQ ID NO: 1652006 - RNA, 12 nt, Homo sapiens
agauguuuauuu

SEQ ID NO: 1652007 - RNA, 19 nt, Homo sapiens
agauuaacacucauuucca

SEQ ID NO: 1652008 - RNA, 16 nt, Homo sapiens
agauuccgcaccaaua

SEQ ID NO: 1652009 - RNA, 17 nt, Homo sapiens
agauuccgcaccaauaa

SEQ ID NO: 1652010 - RNA, 21 nt, Homo sapiens
agauuuauggaaaauacucug

SEQ ID NO: 1652011 - RNA, 17 nt, Homo sapiens
agauuucagauuuguga

SEQ ID NO: 1652012 - RNA, 16 nt, Homo sapiens
agauuugauauuugca

SEQ ID NO: 1652013 - RNA, 18 nt, Homo sapiens
agauuuggagaugucucu

SEQ ID NO: 1652014 - RNA, 18 nt, Homo sapiens
agauuuuguauucagggg

SEQ ID NO: 1652015 - RNA, 22 nt, Homo sapiens
agcaaaaccaaauauuccagag

SEQ ID NO: 1652016 - RNA, 17 nt, Homo sapiens
agcaaagcuccugccuc

SEQ ID NO: 1652017 - RNA, 16 nt, Homo sapiens
agcaaaggcugagaac

SEQ ID NO: 1652018 - RNA, 16 nt, Homo sapiens
agcaacuuguguuaca

SEQ ID NO: 1652019 - RNA, 17 nt, Homo sapiens
agcaauucuccugccuc

SEQ ID NO: 1652020 - RNA, 12 nt, Homo sapiens
agcacagacuca

SEQ ID NO: 1652021 - RNA, 17 nt, Homo sapiens
agcacagguuagggcau

SEQ ID NO: 1652022 - RNA, 12 nt, Homo sapiens
agcacagugauc

SEQ ID NO: 1652023 - RNA, 13 nt, Homo sapiens
agcaccaagcuca

SEQ ID NO: 1652024 - RNA, 19 nt, Homo sapiens
agcaccuacaguguacagu

SEQ ID NO: 1652025 - RNA, 21 nt, Homo sapiens
agcaccuuagacagucccugc

SEQ ID NO: 1652026 - RNA, 10 nt, Homo sapiens
agcacugagg

SEQ ID NO: 1652027 - RNA, 16 nt, Homo sapiens
agcagaaaauacagcu

SEQ ID NO: 1652028 - RNA, 21 nt, Homo sapiens
agcagaaaauacagcuggauu

SEQ ID NO: 1652029 - RNA, 14 nt, Homo sapiens
agcagaauacuggu

SEQ ID NO: 1652030 - RNA, 22 nt, Homo sapiens
agcagaugcuggucauguguuu

SEQ ID NO: 1652031 - RNA, 18 nt, Homo sapiens
agcagauuaccucuugcc

SEQ ID NO: 1652032 - RNA, 11 nt, Homo sapiens
agcagcacagc

SEQ ID NO: 1652033 - RNA, 16 nt, Homo sapiens
agcagcccuuuuuaca

SEQ ID NO: 1652034 - RNA, 12 nt, Homo sapiens
agcagcuuugua

SEQ ID NO: 1652035 - RNA, 15 nt, Homo sapiens
agcaggacauggaca

SEQ ID NO: 1652036 - RNA, 17 nt, Homo sapiens
agcaggcuugugcuuua

SEQ ID NO: 1652037 - RNA, 21 nt, Homo sapiens
agcauacgguaugauauugca

SEQ ID NO: 1652038 - RNA, 21 nt, Homo sapiens
agcaucacuugggauuaauau

SEQ ID NO: 1652039 - RNA, 15 nt, Homo sapiens
agcaucuauuuuacc

SEQ ID NO: 1652040 - RNA, 19 nt, Homo sapiens
agcaucuccagcauucuca

SEQ ID NO: 1652041 - RNA, 16 nt, Homo sapiens
agcaugucgucaaagc

SEQ ID NO: 1652042 - RNA, 18 nt, Homo sapiens
agcauuaugauguggguc

SEQ ID NO: 1652043 - RNA, 23 nt, Homo sapiens
agcauuccuucuuugauaauguu

SEQ ID NO: 1652044 - RNA, 17 nt, Homo sapiens
agcauuuagacccugca

SEQ ID NO: 1652045 - RNA, 23 nt, Homo sapiens
agcauuugggcagacccugagca

SEQ ID NO: 1652046 - RNA, 20 nt, Homo sapiens
agccaaauuuaaaacuguug

SEQ ID NO: 1652047 - RNA, 15 nt, Homo sapiens
agccaaguuaagaau

SEQ ID NO: 1652048 - RNA, 19 nt, Homo sapiens
agccacaaacccugccucu

SEQ ID NO: 1652049 - RNA, 21 nt, Homo sapiens
agccacaggccugagauuuca

SEQ ID NO: 1652050 - RNA, 15 nt, Homo sapiens
agccaccaagaggga

SEQ ID NO: 1652051 - RNA, 12 nt, Homo sapiens
agccaggugcug

SEQ ID NO: 1652052 - RNA, 16 nt, Homo sapiens
agccaggugcugugac

SEQ ID NO: 1652053 - RNA, 16 nt, Homo sapiens
agcccaccuuggcuca

SEQ ID NO: 1652054 - RNA, 14 nt, Homo sapiens
agcccaggagcucc

SEQ ID NO: 1652055 - RNA, 19 nt, Homo sapiens
ucacacgggggcagcugau

SEQ ID NO: 1652056 - RNA, 20 nt, Homo sapiens
ucacagcacccuauauacac

SEQ ID NO: 1652057 - RNA, 18 nt, Homo sapiens
ucacagcuaacaauugug

SEQ ID NO: 1652058 - RNA, 20 nt, Homo sapiens
ucacagcuaagaugccaugu

SEQ ID NO: 1652059 - RNA, 15 nt, Homo sapiens
ucacaucugaaucuc

SEQ ID NO: 1652060 - RNA, 13 nt, Homo sapiens
ucacaucuuggca

SEQ ID NO: 1652061 - RNA, 18 nt, Homo sapiens
ucacaugaacuuguaaag

SEQ ID NO: 1652062 - RNA, 14 nt, Homo sapiens
ucacauguucuaau

SEQ ID NO: 1652063 - RNA, 19 nt, Homo sapiens
ucacauuuauucugcucac

SEQ ID NO: 1652064 - RNA, 19 nt, Homo sapiens
ucacauuuucucagugugc

SEQ ID NO: 1652065 - RNA, 15 nt, Homo sapiens
ucaccaagcccaguu

SEQ ID NO: 1652066 - RNA, 16 nt, Homo sapiens
ucaccacaugugcaca

SEQ ID NO: 1652067 - RNA, 16 nt, Homo sapiens
ucaccaggucagggag

SEQ ID NO: 1652068 - RNA, 15 nt, Homo sapiens
ucaccaucaacauuc

SEQ ID NO: 1652069 - RNA, 14 nt, Homo sapiens
ucaccaucugugca

SEQ ID NO: 1652070 - RNA, 18 nt, Homo sapiens
ucaccccugguucucauc

SEQ ID NO: 1652071 - RNA, 18 nt, Homo sapiens
ucaccucaauauuuacua

SEQ ID NO: 1652072 - RNA, 22 nt, Homo sapiens
ucaccucaauauuuacuauuuc

SEQ ID NO: 1652073 - RNA, 17 nt, Homo sapiens
ucaccugcccugcugag

SEQ ID NO: 1652074 - RNA, 15 nt, Homo sapiens
ucacgguacagaggc

SEQ ID NO: 1652075 - RNA, 17 nt, Homo sapiens
ucacuauggugccaaug

SEQ ID NO: 1652076 - RNA, 17 nt, Homo sapiens
ucacucacauuuucuca

SEQ ID NO: 1652077 - RNA, 12 nt, Homo sapiens
ucacucugucac

SEQ ID NO: 1652078 - RNA, 20 nt, Homo sapiens
ucacugcugcaaauacugua

SEQ ID NO: 1652079 - RNA, 19 nt, Homo sapiens
ucacugguauuaacuuuau

SEQ ID NO: 1652080 - RNA, 22 nt, Homo sapiens
ucacuggucaaaaccuacacag

SEQ ID NO: 1652081 - RNA, 12 nt, Homo sapiens
ucacuguaaaau

SEQ ID NO: 1652082 - RNA, 18 nt, Homo sapiens
ucacuguauccauucuac

SEQ ID NO: 1652083 - RNA, 20 nt, Homo sapiens
ucacuguccaccaccaccug

SEQ ID NO: 1652084 - RNA, 15 nt, Homo sapiens
ucacuucaccaucaa

SEQ ID NO: 1652085 - RNA, 23 nt, Homo sapiens
ucacuuccguuuaccuucauggu

SEQ ID NO: 1652086 - RNA, 13 nt, Homo sapiens
ucacuucuuccau

SEQ ID NO: 1652087 - RNA, 19 nt, Homo sapiens
ucacuugugccaacacuca

SEQ ID NO: 1652088 - RNA, 18 nt, Homo sapiens
ucacuuguucucacuguc

SEQ ID NO: 1652089 - RNA, 16 nt, Homo sapiens
ucagaaacacccucac

SEQ ID NO: 1652090 - RNA, 14 nt, Homo sapiens
ucagaacaaaguga

SEQ ID NO: 1652091 - RNA, 13 nt, Homo sapiens
ucagaagugauuu

SEQ ID NO: 1652092 - RNA, 19 nt, Homo sapiens
ucagagagggcaggcauga

SEQ ID NO: 1652093 - RNA, 14 nt, Homo sapiens
ucccuguaaccucu

SEQ ID NO: 1652094 - RNA, 22 nt, Homo sapiens
ucccuucuuuuuguucuucauc

SEQ ID NO: 1652095 - RNA, 13 nt, Homo sapiens
ucccuugcccuuu

SEQ ID NO: 1652096 - RNA, 19 nt, Homo sapiens
ucccuuugacgccauccca

SEQ ID NO: 1652097 - RNA, 13 nt, Homo sapiens
ucccuuuuucaca

SEQ ID NO: 1652098 - RNA, 14 nt, Homo sapiens
uccgccugccucag

SEQ ID NO: 1652099 - RNA, 13 nt, Homo sapiens
uccgggaucaaag

SEQ ID NO: 1652100 - RNA, 21 nt, Homo sapiens
uccguuuaccuucauggugcu

SEQ ID NO: 1652101 - RNA, 19 nt, Homo sapiens
uccuaaaacaaaagcucau

SEQ ID NO: 1652102 - RNA, 17 nt, Homo sapiens
uccuaauuccacagcug

SEQ ID NO: 1652103 - RNA, 18 nt, Homo sapiens
uccuacaagacacaguga

SEQ ID NO: 1652104 - RNA, 18 nt, Homo sapiens
uccuacucugugucaggu

SEQ ID NO: 1652105 - RNA, 17 nt, Homo sapiens
uccuagcugugugaaua

SEQ ID NO: 1652106 - RNA, 15 nt, Homo sapiens
uccucaaagcauuug

SEQ ID NO: 1652107 - RNA, 18 nt, Homo sapiens
uccuccagaauggagcug

SEQ ID NO: 1652108 - RNA, 17 nt, Homo sapiens
uccuccagggacagcaa

SEQ ID NO: 1652109 - RNA, 22 nt, Homo sapiens
uccuccucugugaaacugggau

SEQ ID NO: 1652110 - RNA, 20 nt, Homo sapiens
uccucgaggcccuagcauuu

SEQ ID NO: 1652111 - RNA, 18 nt, Homo sapiens
uccucugcaguguggcaa

SEQ ID NO: 1652112 - RNA, 22 nt, Homo sapiens
uccucuggguaggaaucagcaa

SEQ ID NO: 1652113 - RNA, 12 nt, Homo sapiens
uccucugugaaa

SEQ ID NO: 1652114 - RNA, 19 nt, Homo sapiens
uccucugugaaacugggau

SEQ ID NO: 1652115 - RNA, 16 nt, Homo sapiens
uccucugugaccaaug

SEQ ID NO: 1652116 - RNA, 17 nt, Homo sapiens
uccugaguagcugggau

SEQ ID NO: 1652117 - RNA, 20 nt, Homo sapiens
uccugccucagccuccugag

SEQ ID NO: 1652118 - RNA, 16 nt, Homo sapiens
uccugcuccacagugu

SEQ ID NO: 1652119 - RNA, 16 nt, Homo sapiens
uccuggccucaaguga

SEQ ID NO: 1652120 - RNA, 16 nt, Homo sapiens
uccugggagugagcug

SEQ ID NO: 1652121 - RNA, 18 nt, Homo sapiens
uccugggcccaagugauc

SEQ ID NO: 1652122 - RNA, 18 nt, Homo sapiens
uccuggggaacauagaac

SEQ ID NO: 1652123 - RNA, 23 nt, Homo sapiens
uccuggggaacauagaacucaug

SEQ ID NO: 1652124 - RNA, 22 nt, Homo sapiens
uccugucauuuuuuuucucuag

SEQ ID NO: 1652125 - RNA, 22 nt, Homo sapiens
uccugugugugcgccuacagga

SEQ ID NO: 1652126 - RNA, 14 nt, Homo sapiens
uccuuaucaaagga

SEQ ID NO: 1652127 - RNA, 15 nt, Homo sapiens
uccuuggaaauugga

SEQ ID NO: 1652128 - RNA, 18 nt, Homo sapiens
uccuuguuguucuuuaac

SEQ ID NO: 1652129 - RNA, 17 nt, Homo sapiens
uccuuuagcgcccaguu

SEQ ID NO: 1652130 - RNA, 14 nt, Homo sapiens
uccuuucaccacau

SEQ ID NO: 1652131 - RNA, 22 nt, Homo sapiens
uccuuucagaaaauucccauga

SEQ ID NO: 1652132 - RNA, 21 nt, Homo sapiens
uccuuugcgcaaacuuuaaca

SEQ ID NO: 1652133 - RNA, 12 nt, Homo sapiens
ucgaguguuuca

SEQ ID NO: 1652134 - RNA, 15 nt, Homo sapiens
ucgcacacacaguga

SEQ ID NO: 1652135 - RNA, 15 nt, Homo sapiens
ucgcugucaucucag

SEQ ID NO: 1652136 - RNA, 14 nt, Homo sapiens
ucggccucccaaag

SEQ ID NO: 1652137 - RNA, 21 nt, Homo sapiens
ucggcgccagcagcuccaaaa

SEQ ID NO: 1652138 - RNA, 17 nt, Homo sapiens
ucggcucuggccuccaa

SEQ ID NO: 1652139 - RNA, 12 nt, Homo sapiens
ucggugugcacc

SEQ ID NO: 1652140 - RNA, 15 nt, Homo sapiens
ucguuugaaucacag

SEQ ID NO: 1652141 - RNA, 16 nt, Homo sapiens
ucuaaagagcaucuga

SEQ ID NO: 1652142 - RNA, 21 nt, Homo sapiens
ucuaaagcaguuuauuauaau

SEQ ID NO: 1652143 - RNA, 18 nt, Homo sapiens
ucuaaauugaucauucau

SEQ ID NO: 1652144 - RNA, 20 nt, Homo sapiens
ucuaagagaacaaugugcua

SEQ ID NO: 1652145 - RNA, 21 nt, Homo sapiens
ucuaagauuaauagcauucga

SEQ ID NO: 1652146 - RNA, 14 nt, Homo sapiens
ucuaagucuuucca

SEQ ID NO: 1652147 - RNA, 15 nt, Homo sapiens
ucuaaugacauucaa

SEQ ID NO: 1652148 - RNA, 14 nt, Homo sapiens
ucuaauggcuuuau

SEQ ID NO: 1652149 - RNA, 13 nt, Homo sapiens
ucuacccaggugc

SEQ ID NO: 1652150 - RNA, 16 nt, Homo sapiens
ucuacguaucugcuac

SEQ ID NO: 1652151 - RNA, 21 nt, Homo sapiens
ucuacguauggcuccacaccu

SEQ ID NO: 1652152 - RNA, 20 nt, Homo sapiens
ucuacugcccugagccugaa

SEQ ID NO: 1652153 - RNA, 17 nt, Homo sapiens
ucuacuguacacaaucu

SEQ ID NO: 1652154 - RNA, 20 nt, Homo sapiens
ucuagaaccaggcaacuugg

SEQ ID NO: 1652155 - RNA, 12 nt, Homo sapiens
ucuaggaacucc

SEQ ID NO: 1652156 - RNA, 22 nt, Homo sapiens
ucuagggcuaguagaacuggau

SEQ ID NO: 1652157 - RNA, 19 nt, Homo sapiens
ucuagucaggggaaaagac

SEQ ID NO: 1652158 - RNA, 17 nt, Homo sapiens
ucuauaccuuacugcaa

SEQ ID NO: 1652159 - RNA, 14 nt, Homo sapiens
ucuaugaacuugca

SEQ ID NO: 1652160 - RNA, 15 nt, Homo sapiens
ucuaugaacuugcaa

SEQ ID NO: 1652161 - RNA, 23 nt, Homo sapiens
ucuaugaccucgcccuccacaaa

SEQ ID NO: 1652162 - RNA, 18 nt, Homo sapiens
cuggguggcacugccaug

SEQ ID NO: 1652163 - RNA, 15 nt, Homo sapiens
cuggugggcagagag

SEQ ID NO: 1652164 - RNA, 20 nt, Homo sapiens
cugguucucaucuuucuuga

SEQ ID NO: 1652165 - RNA, 21 nt, Homo sapiens
cuguaacgauugacaccaaaa

SEQ ID NO: 1652166 - RNA, 21 nt, Homo sapiens
cuguaauauuguaaauacugg

SEQ ID NO: 1652167 - RNA, 17 nt, Homo sapiens
cuguaaucccagcacuu

SEQ ID NO: 1652168 - RNA, 16 nt, Homo sapiens
cuguaccugugcacgu

SEQ ID NO: 1652169 - RNA, 16 nt, Homo sapiens
cuguauuaagccacuu

SEQ ID NO: 1652170 - RNA, 12 nt, Homo sapiens
uacaugcaauuu

SEQ ID NO: 1652171 - RNA, 20 nt, Homo sapiens
uacauuguacuuauacaccu

SEQ ID NO: 1652172 - RNA, 22 nt, Homo sapiens
uaccaaaaauaucccuuuuuca

SEQ ID NO: 1652173 - RNA, 17 nt, Homo sapiens
uaccaaaucugacauau

SEQ ID NO: 1652174 - RNA, 22 nt, Homo sapiens
uaccaaggggaauuacugaaaa

SEQ ID NO: 1652175 - RNA, 13 nt, Homo sapiens
uaccacuuaacag

SEQ ID NO: 1652176 - RNA, 22 nt, Homo sapiens
uaccacuucgccuucuugccag

SEQ ID NO: 1652177 - RNA, 16 nt, Homo sapiens
uaccauauguuuauca

SEQ ID NO: 1652178 - RNA, 14 nt, Homo sapiens
uaccaugccucucc

SEQ ID NO: 1652179 - RNA, 12 nt, Homo sapiens
uaccaugcugaa

SEQ ID NO: 1652180 - RNA, 23 nt, Homo sapiens
uaccuaggauauguuaaauguau

SEQ ID NO: 1652181 - RNA, 22 nt, Homo sapiens
uaccucugcuauuugcuguuau

SEQ ID NO: 1652182 - RNA, 14 nt, Homo sapiens
uaccugacacuccc

SEQ ID NO: 1652183 - RNA, 14 nt, Homo sapiens
uaccugcacacugu

SEQ ID NO: 1652184 - RNA, 14 nt, Homo sapiens
uaccuuacugcaau

SEQ ID NO: 1652185 - RNA, 21 nt, Homo sapiens
uaccuugguucccccacugau

SEQ ID NO: 1652186 - RNA, 19 nt, Homo sapiens
uacuaaaaaguauaaaaua

SEQ ID NO: 1652187 - RNA, 18 nt, Homo sapiens
uacuaauuuccaugugua

SEQ ID NO: 1652188 - RNA, 19 nt, Homo sapiens
uacuacaguccucccaucu

SEQ ID NO: 1652189 - RNA, 12 nt, Homo sapiens
uacuaguacagg

SEQ ID NO: 1652190 - RNA, 15 nt, Homo sapiens
uacuaucaugucaaa

SEQ ID NO: 1652191 - RNA, 12 nt, Homo sapiens
uacuauccaaau

SEQ ID NO: 1652192 - RNA, 23 nt, Homo sapiens
uacucccaucugugaaaggaaag

SEQ ID NO: 1652193 - RNA, 19 nt, Homo sapiens
uacugaggaaugucuuuca

SEQ ID NO: 1652194 - RNA, 19 nt, Homo sapiens
uacugauaaccacuccuaa

SEQ ID NO: 1652195 - RNA, 14 nt, Homo sapiens
uacuggcaauuugu

SEQ ID NO: 1652196 - RNA, 21 nt, Homo sapiens
uacugggguuuuucuaagaaa

SEQ ID NO: 1652197 - RNA, 16 nt, Homo sapiens
uacuguguucccucau

SEQ ID NO: 1652198 - RNA, 19 nt, Homo sapiens
uacuguuacugugucagga

SEQ ID NO: 1652199 - RNA, 15 nt, Homo sapiens
uacuuacauaucuga

SEQ ID NO: 1652200 - RNA, 16 nt, Homo sapiens
uacuuacauaucugac

SEQ ID NO: 1652201 - RNA, 18 nt, Homo sapiens
uacuuacauaucugacuu

SEQ ID NO: 1652202 - RNA, 18 nt, Homo sapiens
uacuugccuaucugacuu

SEQ ID NO: 1652203 - RNA, 13 nt, Homo sapiens
uacuuguucugua

SEQ ID NO: 1652204 - RNA, 16 nt, Homo sapiens
uagaaaagggaacuga

SEQ ID NO: 1652205 - RNA, 19 nt, Homo sapiens
uagaacagugcuugccaca

SEQ ID NO: 1652206 - RNA, 21 nt, Homo sapiens
uagaagccacuauuacuggga

SEQ ID NO: 1652207 - RNA, 20 nt, Homo sapiens
uagaauaauacuagucuuau

SEQ ID NO: 1652208 - RNA, 20 nt, Homo sapiens
uagaauaaucuugcucacag

SEQ ID NO: 1652209 - RNA, 16 nt, Homo sapiens
uagaauacucagggaa

SEQ ID NO: 1652210 - RNA, 21 nt, Homo sapiens
uagaauacucagggaaagcau

SEQ ID NO: 1652211 - RNA, 21 nt, Homo sapiens
uagaauauauuuccuuauuca

SEQ ID NO: 1652212 - RNA, 18 nt, Homo sapiens
uagaauuauaacuguaaa

SEQ ID NO: 1652213 - RNA, 16 nt, Homo sapiens
uagacagagucucacu

SEQ ID NO: 1652214 - RNA, 15 nt, Homo sapiens
uagacauucuuuauc

SEQ ID NO: 1652215 - RNA, 21 nt, Homo sapiens
uagacccugcauuuauagcau

SEQ ID NO: 1652216 - RNA, 19 nt, Homo sapiens
uagagacaggguuucacca

SEQ ID NO: 1652217 - RNA, 17 nt, Homo sapiens
uagagacuuugugaaaa

SEQ ID NO: 1652218 - RNA, 18 nt, Homo sapiens
uagagccagggucucacu

SEQ ID NO: 1652219 - RNA, 18 nt, Homo sapiens
uagaggcaaagaacaauu

SEQ ID NO: 1652220 - RNA, 20 nt, Homo sapiens
uagauaaucucuccauuccc

SEQ ID NO: 1652221 - RNA, 19 nt, Homo sapiens
uagaugaagaagcuagaaa

SEQ ID NO: 1652222 - RNA, 18 nt, Homo sapiens
uagauuaacggagugucu

SEQ ID NO: 1652223 - RNA, 14 nt, Homo sapiens
uagcaacccuguga

SEQ ID NO: 1652224 - RNA, 13 nt, Homo sapiens
uagcauacgguau

SEQ ID NO: 1652225 - RNA, 20 nt, Homo sapiens
uagcaugaauccuacauaca

SEQ ID NO: 1652226 - RNA, 14 nt, Homo sapiens
uagccccucucuua

SEQ ID NO: 1652227 - RNA, 12 nt, Homo sapiens
uagccucucuuu

SEQ ID NO: 1652228 - RNA, 17 nt, Homo sapiens
uagccuuagaagucaca

SEQ ID NO: 1652229 - RNA, 18 nt, Homo sapiens
uagcugggacuacaggug

SEQ ID NO: 1652230 - RNA, 14 nt, Homo sapiens
uagcuguagguuuu

SEQ ID NO: 1652231 - RNA, 16 nt, Homo sapiens
uaggaacacuccuuca

SEQ ID NO: 1652232 - RNA, 13 nt, Homo sapiens
uaggaaguaggaa

SEQ ID NO: 1652233 - RNA, 18 nt, Homo sapiens
uaggauuaaaauggauuu

SEQ ID NO: 1652234 - RNA, 14 nt, Homo sapiens
uaggcaccuaccac

SEQ ID NO: 1652235 - RNA, 20 nt, Homo sapiens
uaggcaccuaccaccacgcc

SEQ ID NO: 1652236 - RNA, 17 nt, Homo sapiens
uaggccuggcacagugu

SEQ ID NO: 1652237 - RNA, 20 nt, Homo sapiens
uaggcgcuggggcucagcuu

SEQ ID NO: 1652238 - RNA, 17 nt, Homo sapiens
uagggaaaacauuccau

SEQ ID NO: 1652239 - RNA, 21 nt, Homo sapiens
uagguauguagcaguaucuca

SEQ ID NO: 1652240 - RNA, 20 nt, Homo sapiens
uaggugacagagugagacuc

SEQ ID NO: 1652241 - RNA, 20 nt, Homo sapiens
uaguacagguuuugcccuga

SEQ ID NO: 1652242 - RNA, 20 nt, Homo sapiens
uagucaagugcguccacgag

SEQ ID NO: 1652243 - RNA, 15 nt, Homo sapiens
uaguccuguacugua

SEQ ID NO: 1652244 - RNA, 17 nt, Homo sapiens
uagucgaacaauucaua

SEQ ID NO: 1652245 - RNA, 14 nt, Homo sapiens
uagugauggagcuu

SEQ ID NO: 1652246 - RNA, 17 nt, Homo sapiens
uagugccaccacagcuu

SEQ ID NO: 1652247 - RNA, 18 nt, Homo sapiens
cuccugugucuugcaaug

SEQ ID NO: 1652248 - RNA, 15 nt, Homo sapiens
cuccuuaccacugug

SEQ ID NO: 1652249 - RNA, 16 nt, Homo sapiens
cucgaggcggaucuuu

SEQ ID NO: 1652250 - RNA, 17 nt, Homo sapiens
cucgcacacacagugau

SEQ ID NO: 1652251 - RNA, 14 nt, Homo sapiens
cucuaaguguaaaa

SEQ ID NO: 1652252 - RNA, 21 nt, Homo sapiens
uaguggugacugugggcucca

SEQ ID NO: 1652253 - RNA, 16 nt, Homo sapiens
uaguuaaaagccuuuc

SEQ ID NO: 1652254 - RNA, 11 nt, Homo sapiens
uaguuagcuuu

SEQ ID NO: 1652255 - RNA, 12 nt, Homo sapiens
uaguugcuguau

SEQ ID NO: 1652256 - RNA, 17 nt, Homo sapiens
uaguuuggauuacuuaa

SEQ ID NO: 1652257 - RNA, 16 nt, Homo sapiens
uauaaaagacugacca

SEQ ID NO: 1652258 - RNA, 23 nt, Homo sapiens
uauaaaauaguaugaaaauggaa

SEQ ID NO: 1652259 - RNA, 16 nt, Homo sapiens
uauaacuauguugaua

SEQ ID NO: 1652260 - RNA, 18 nt, Homo sapiens
uauaacuauguugauaaa

SEQ ID NO: 1652261 - RNA, 16 nt, Homo sapiens
uauaauugaguuuuca

SEQ ID NO: 1652262 - RNA, 20 nt, Homo sapiens
uauacuucucuauuaucuca

SEQ ID NO: 1652263 - RNA, 16 nt, Homo sapiens
uauagaaaugcugguu

SEQ ID NO: 1652264 - RNA, 22 nt, Homo sapiens
uauagaacagugcuugccacag

SEQ ID NO: 1652265 - RNA, 14 nt, Homo sapiens
uauagcuacuaauu

SEQ ID NO: 1652266 - RNA, 14 nt, Homo sapiens
uauagcugugugaa

SEQ ID NO: 1652267 - RNA, 19 nt, Homo sapiens
uauaggcaccuaccaccac

SEQ ID NO: 1652268 - RNA, 18 nt, Homo sapiens
uauauaaaugugauugca

SEQ ID NO: 1652269 - RNA, 21 nt, Homo sapiens
uauauaaaugugauugcagcu

SEQ ID NO: 1652270 - RNA, 16 nt, Homo sapiens
uauauaacaacaaacu

SEQ ID NO: 1652271 - RNA, 19 nt, Homo sapiens
uauauacuuguuguuuaau

SEQ ID NO: 1652272 - RNA, 23 nt, Homo sapiens
uauauagcucuacacaacaugua

SEQ ID NO: 1652273 - RNA, 21 nt, Homo sapiens
uauauauuuuugugcacauuu

SEQ ID NO: 1652274 - RNA, 21 nt, Homo sapiens
uauauccuugacaccuuacuu

SEQ ID NO: 1652275 - RNA, 14 nt, Homo sapiens
uauaucuucuacau

SEQ ID NO: 1652276 - RNA, 12 nt, Homo sapiens
uauauguagauu

SEQ ID NO: 1652277 - RNA, 16 nt, Homo sapiens
uauauguauaugcaau

SEQ ID NO: 1652278 - RNA, 16 nt, Homo sapiens
uauauucauccaugcc

SEQ ID NO: 1652279 - RNA, 21 nt, Homo sapiens
uauauugauaacagcacugac

SEQ ID NO: 1652280 - RNA, 23 nt, Homo sapiens
uauauugugaacccuagcugugu

SEQ ID NO: 1652281 - RNA, 22 nt, Homo sapiens
uaucaaaauagucuaaggccau

SEQ ID NO: 1652282 - RNA, 20 nt, Homo sapiens
uaucacagcuuucaaaagca

SEQ ID NO: 1652283 - RNA, 22 nt, Homo sapiens
uaucauaucucucuuuacuucc

SEQ ID NO: 1652284 - RNA, 19 nt, Homo sapiens
uaucuaauaaauacuuaag

SEQ ID NO: 1652285 - RNA, 12 nt, Homo sapiens
uaucuaugacug

SEQ ID NO: 1652286 - RNA, 22 nt, Homo sapiens
guuauauuacuugccuaucuga

SEQ ID NO: 1652287 - RNA, 17 nt, Homo sapiens
guuaugcggucuaggga

SEQ ID NO: 1652288 - RNA, 14 nt, Homo sapiens
guucauucugugac

SEQ ID NO: 1652289 - RNA, 14 nt, Homo sapiens
guuccgacugccau

SEQ ID NO: 1652290 - RNA, 15 nt, Homo sapiens
guucuacccaggugc

SEQ ID NO: 1652291 - RNA, 21 nt, Homo sapiens
guucuggacggcccagcagcu

SEQ ID NO: 1652292 - RNA, 14 nt, Homo sapiens
guucuuacacauuc

SEQ ID NO: 1652293 - RNA, 19 nt, Homo sapiens
guucuuacacauuccaucu

SEQ ID NO: 1652294 - RNA, 14 nt, Homo sapiens
guugaaacugcuau

SEQ ID NO: 1652295 - RNA, 16 nt, Homo sapiens
guugaauuucccacau

SEQ ID NO: 1652296 - RNA, 23 nt, Homo sapiens
guugaauuucccacauacccucc

SEQ ID NO: 1652297 - RNA, 17 nt, Homo sapiens
guugcacggcugcugag

SEQ ID NO: 1652298 - RNA, 14 nt, Homo sapiens
guugccacauuuag

SEQ ID NO: 1652299 - RNA, 14 nt, Homo sapiens
guugcccagugugu

SEQ ID NO: 1652300 - RNA, 22 nt, Homo sapiens
guuggcgggggcuuggcugugc

SEQ ID NO: 1652301 - RNA, 18 nt, Homo sapiens
guuggcugggaacucacc

SEQ ID NO: 1652302 - RNA, 12 nt, Homo sapiens
guuggcuucuaa

SEQ ID NO: 1652303 - RNA, 16 nt, Homo sapiens
guuguuaaaaauguca

SEQ ID NO: 1652304 - RNA, 21 nt, Homo sapiens
guuuaauucuguuaacugaag

SEQ ID NO: 1652305 - RNA, 22 nt, Homo sapiens
guuuacaacaaacacugugaug

SEQ ID NO: 1652306 - RNA, 20 nt, Homo sapiens
guuucaaguacuguaacugu

SEQ ID NO: 1652307 - RNA, 15 nt, Homo sapiens
guuucacuugcacau

SEQ ID NO: 1652308 - RNA, 16 nt, Homo sapiens
guuuccuuucauuuac

SEQ ID NO: 1652309 - RNA, 13 nt, Homo sapiens
guuucuccaagca

SEQ ID NO: 1652310 - RNA, 23 nt, Homo sapiens
guuucuggauuucauacuguaac

SEQ ID NO: 1652311 - RNA, 21 nt, Homo sapiens
guuucuuccagcagaacagag

SEQ ID NO: 1652312 - RNA, 17 nt, Homo sapiens
guuugaaucacaguaua

SEQ ID NO: 1652313 - RNA, 21 nt, Homo sapiens
guuugcuuuguuuaagcauca

SEQ ID NO: 1652314 - RNA, 15 nt, Homo sapiens
guuuggccuauucca

SEQ ID NO: 1652315 - RNA, 18 nt, Homo sapiens
guuugguaguuuugccaa

SEQ ID NO: 1652316 - RNA, 19 nt, Homo sapiens
guuuguuauuuacacuggu

SEQ ID NO: 1652317 - RNA, 21 nt, Homo sapiens
guuuuacaguguuucuggcuu

SEQ ID NO: 1652318 - RNA, 18 nt, Homo sapiens
guuuuauauuuuauaugu

SEQ ID NO: 1652319 - RNA, 11 nt, Homo sapiens
guuuucuuaua

SEQ ID NO: 1652320 - RNA, 18 nt, Homo sapiens
guuuucuugaacauacuu

SEQ ID NO: 1652321 - RNA, 15 nt, Homo sapiens
guuuuguauucucug

SEQ ID NO: 1652322 - RNA, 16 nt, Homo sapiens
guuuuuaaaacccagu

SEQ ID NO: 1652323 - RNA, 17 nt, Homo sapiens
guuuuucuuuucauuua

SEQ ID NO: 1652324 - RNA, 15 nt, Homo sapiens
guuuuuggagggguu

SEQ ID NO: 1652325 - RNA, 22 nt, Homo sapiens
guuuuuguauuuauuaauuuga

SEQ ID NO: 1652326 - RNA, 14 nt, Homo sapiens
uaaaaaagagacau

SEQ ID NO: 1652327 - RNA, 17 nt, Homo sapiens
uaaaaagauagacuuca

SEQ ID NO: 1652328 - RNA, 17 nt, Homo sapiens
uaaaaauuguuuuugga

SEQ ID NO: 1652329 - RNA, 23 nt, Homo sapiens
uaaaaauuuuuacaaaacugcca

SEQ ID NO: 1652330 - RNA, 23 nt, Homo sapiens
uaaaagaugcauuaucuaugaua

SEQ ID NO: 1652331 - RNA, 16 nt, Homo sapiens
uaaaagcaucacauga

SEQ ID NO: 1652332 - RNA, 14 nt, Homo sapiens
uaaaauacauauaa

SEQ ID NO: 1652333 - RNA, 14 nt, Homo sapiens
uaaaauagccauaa

SEQ ID NO: 1652334 - RNA, 20 nt, Homo sapiens
uaaaauauuuuuaugugcaa

SEQ ID NO: 1652335 - RNA, 21 nt, Homo sapiens
uaaaauauuuuuaugugcaau

SEQ ID NO: 1652336 - RNA, 21 nt, Homo sapiens
uaaaaucauaaauauaaucua

SEQ ID NO: 1652337 - RNA, 16 nt, Homo sapiens
uaaaauccaguauuau

SEQ ID NO: 1652338 - RNA, 18 nt, Homo sapiens
uaaaauguuggugcaauu

SEQ ID NO: 1652339 - RNA, 19 nt, Homo sapiens
uaaaauguuggugcaauua

SEQ ID NO: 1652340 - RNA, 16 nt, Homo sapiens
uaaaauuuuggauuaa

SEQ ID NO: 1652341 - RNA, 17 nt, Homo sapiens
uaaacaaaggaauuaug

SEQ ID NO: 1652342 - RNA, 18 nt, Homo sapiens
uaaacaaauguaugauua

SEQ ID NO: 1652343 - RNA, 18 nt, Homo sapiens
uaaacccaguugccaucu

SEQ ID NO: 1652344 - RNA, 18 nt, Homo sapiens
uaaaccuaauaaucugaa

SEQ ID NO: 1652345 - RNA, 23 nt, Homo sapiens
uaaacugguauuuuaucuuugau

SEQ ID NO: 1652346 - RNA, 22 nt, Homo sapiens
uaaagacuuguauagcaugaaa

SEQ ID NO: 1652347 - RNA, 16 nt, Homo sapiens
uaaagauuaacacuca

SEQ ID NO: 1652348 - RNA, 12 nt, Homo sapiens
uaaagccuucaa

SEQ ID NO: 1652349 - RNA, 17 nt, Homo sapiens
uaaaguaaauacaugca

SEQ ID NO: 1652350 - RNA, 15 nt, Homo sapiens
uaaauaaauggaaua

SEQ ID NO: 1652351 - RNA, 16 nt, Homo sapiens
uaaauaugcagugaua

SEQ ID NO: 1652352 - RNA, 18 nt, Homo sapiens
uaaauggcauaccaaaau

SEQ ID NO: 1652353 - RNA, 22 nt, Homo sapiens
uaaaugucucuuuaaugucaca

SEQ ID NO: 1652354 - RNA, 15 nt, Homo sapiens
uaaauugauuuguua

SEQ ID NO: 1652355 - RNA, 21 nt, Homo sapiens
uaaauuguuguaauugcauua

SEQ ID NO: 1652356 - RNA, 13 nt, Homo sapiens
uaaauuucuuccu

SEQ ID NO: 1652357 - RNA, 20 nt, Homo sapiens
uaaauuuguaaguuucaggu

SEQ ID NO: 1652358 - RNA, 15 nt, Homo sapiens
uaacaauaaaagaca

SEQ ID NO: 1652359 - RNA, 15 nt, Homo sapiens
uaacaauugugaagu

SEQ ID NO: 1652360 - RNA, 12 nt, Homo sapiens
uaacacacagcu

SEQ ID NO: 1652361 - RNA, 15 nt, Homo sapiens
uaacacucauuucca

SEQ ID NO: 1652362 - RNA, 20 nt, Homo sapiens
uaacacucauuuccaaucau

SEQ ID NO: 1652363 - RNA, 19 nt, Homo sapiens
uaacagaacagcuucaggu

SEQ ID NO: 1652364 - RNA, 15 nt, Homo sapiens
uaacauggugugcuu

SEQ ID NO: 1652365 - RNA, 20 nt, Homo sapiens
uaacauuuacuuuugcuccc

SEQ ID NO: 1652366 - RNA, 19 nt, Homo sapiens
uaacccccaaauacucuga

SEQ ID NO: 1652367 - RNA, 13 nt, Homo sapiens
uaaccuauuucca

SEQ ID NO: 1652368 - RNA, 15 nt, Homo sapiens
uaacgauaaaagaca

SEQ ID NO: 1652369 - RNA, 20 nt, Homo sapiens
uaacgauaaaagacagugaa

SEQ ID NO: 1652370 - RNA, 11 nt, Homo sapiens
uaacuauucaa

SEQ ID NO: 1652371 - RNA, 17 nt, Homo sapiens
uaacuccaugucucuga

SEQ ID NO: 1652372 - RNA, 20 nt, Homo sapiens
uaacuguuaacuaugacaga

SEQ ID NO: 1652373 - RNA, 23 nt, Homo sapiens
uaacuguuaacuaugacagauau

SEQ ID NO: 1652374 - RNA, 19 nt, Homo sapiens
uaacuuuuuaaaacacaac

SEQ ID NO: 1652375 - RNA, 20 nt, Homo sapiens
uaagaaauauauuugauaaa

SEQ ID NO: 1652376 - RNA, 18 nt, Homo sapiens
uaagacuaaaaguugcau

SEQ ID NO: 1652377 - RNA, 12 nt, Homo sapiens
uaagacugaugu

SEQ ID NO: 1652378 - RNA, 13 nt, Homo sapiens
uaagaugccaugu

SEQ ID NO: 1652379 - RNA, 16 nt, Homo sapiens
uaagaugccaugugca

SEQ ID NO: 1652380 - RNA, 14 nt, Homo sapiens
uaagaugucuugaa

SEQ ID NO: 1652381 - RNA, 18 nt, Homo sapiens
uaagauuguaaaaauaau

SEQ ID NO: 1652382 - RNA, 21 nt, Homo sapiens
uaagauuuuugaaaauccuga

SEQ ID NO: 1652383 - RNA, 15 nt, Homo sapiens
uaagcaaagacuuuc

SEQ ID NO: 1652384 - RNA, 16 nt, Homo sapiens
uaagcaucacauuaaa

SEQ ID NO: 1652385 - RNA, 22 nt, Homo sapiens
uaaggaaacacuucuauuuaau

SEQ ID NO: 1652386 - RNA, 15 nt, Homo sapiens
uaaggaauaccuguc

SEQ ID NO: 1652387 - RNA, 23 nt, Homo sapiens
uaaguagcaacccugugauacua

SEQ ID NO: 1652388 - RNA, 14 nt, Homo sapiens
uaagugcaugacau

SEQ ID NO: 1652389 - RNA, 19 nt, Homo sapiens
uaaguuagggaauggcaca

SEQ ID NO: 1652390 - RNA, 12 nt, Homo sapiens
uaauaacuaaua

SEQ ID NO: 1652391 - RNA, 12 nt, Homo sapiens
uaauaacuuauc

SEQ ID NO: 1652392 - RNA, 18 nt, Homo sapiens
uaauaaucuaugaugaag

SEQ ID NO: 1652393 - RNA, 21 nt, Homo sapiens
uaauauauuuuuugaacuuug

SEQ ID NO: 1652394 - RNA, 19 nt, Homo sapiens
uaauaugauuauuaaucag

SEQ ID NO: 1652395 - RNA, 18 nt, Homo sapiens
uaaucccagcacuuggag

SEQ ID NO: 1652396 - RNA, 12 nt, Homo sapiens
gcagccaaggga

SEQ ID NO: 1652397 - RNA, 17 nt, Homo sapiens
gcagccuccucugugac

SEQ ID NO: 1652398 - RNA, 18 nt, Homo sapiens
gcagccugagaaugaccu

SEQ ID NO: 1652399 - RNA, 19 nt, Homo sapiens
gcagccugagaaugaccug

SEQ ID NO: 1652400 - RNA, 22 nt, Homo sapiens
gcagcgauuaauaacaggcaaa

SEQ ID NO: 1652401 - RNA, 23 nt, Homo sapiens
gcagcggggcaagcaaaaacaau

SEQ ID NO: 1652402 - RNA, 21 nt, Homo sapiens
gcagcugacuuuucugaccca

SEQ ID NO: 1652403 - RNA, 15 nt, Homo sapiens
gcaggcuagaaccug

SEQ ID NO: 1652404 - RNA, 17 nt, Homo sapiens
gcaggcuucucagucuc

SEQ ID NO: 1652405 - RNA, 15 nt, Homo sapiens
gcagggaaacagcua

SEQ ID NO: 1652406 - RNA, 16 nt, Homo sapiens
gcagggaacaugggga

SEQ ID NO: 1652407 - RNA, 23 nt, Homo sapiens
gcauaaagucagggguucccuuu

SEQ ID NO: 1652408 - RNA, 18 nt, Homo sapiens
gcauagaguucagacuuu

SEQ ID NO: 1652409 - RNA, 19 nt, Homo sapiens
gcauagaguucagacuuuu

SEQ ID NO: 1652410 - RNA, 17 nt, Homo sapiens
gcaucgguucgcauuau

SEQ ID NO: 1652411 - RNA, 21 nt, Homo sapiens
gcaucugggcaggaugacuuu

SEQ ID NO: 1652412 - RNA, 21 nt, Homo sapiens
gcaucuuuucuguugccccau

SEQ ID NO: 1652413 - RNA, 16 nt, Homo sapiens
gcaugaccacauagaa

SEQ ID NO: 1652414 - RNA, 11 nt, Homo sapiens
gcaugaugaaa

SEQ ID NO: 1652415 - RNA, 15 nt, Homo sapiens
gcauuguugaugcuc

SEQ ID NO: 1652416 - RNA, 15 nt, Homo sapiens
gcauuuaauguagcc

SEQ ID NO: 1652417 - RNA, 14 nt, Homo sapiens
gcauuuaggagaua

SEQ ID NO: 1652418 - RNA, 19 nt, Homo sapiens
gcauuugucaacaaaguca

SEQ ID NO: 1652419 - RNA, 17 nt, Homo sapiens
gcauuuucaagcaguua

SEQ ID NO: 1652420 - RNA, 17 nt, Homo sapiens
gcauuuuccagcacuuu

SEQ ID NO: 1652421 - RNA, 13 nt, Homo sapiens
gccaaaagccuuu

SEQ ID NO: 1652422 - RNA, 21 nt, Homo sapiens
gccaaaauaaugcaccacuuu

SEQ ID NO: 1652423 - RNA, 15 nt, Homo sapiens
gccaauccacuccuu

SEQ ID NO: 1652424 - RNA, 13 nt, Homo sapiens
gccacagcagcuu

SEQ ID NO: 1652425 - RNA, 13 nt, Homo sapiens
gccaccucacccu

SEQ ID NO: 1652426 - RNA, 16 nt, Homo sapiens
gccacgaggugcagua

SEQ ID NO: 1652427 - RNA, 21 nt, Homo sapiens
gccaggcccggccaaaauaau

SEQ ID NO: 1652428 - RNA, 14 nt, Homo sapiens
gccagggucucacu

SEQ ID NO: 1652429 - RNA, 14 nt, Homo sapiens
gccaggugcuguga

SEQ ID NO: 1652430 - RNA, 15 nt, Homo sapiens
gccaggugcugugac

SEQ ID NO: 1652431 - RNA, 23 nt, Homo sapiens
gccaguacucgggacagacuaag

SEQ ID NO: 1652432 - RNA, 13 nt, Homo sapiens
gccauaugaauaa

SEQ ID NO: 1652433 - RNA, 22 nt, Homo sapiens
gccauaugaaugucaguaguuu

SEQ ID NO: 1652434 - RNA, 14 nt, Homo sapiens
gcccaccuccuucc

SEQ ID NO: 1652435 - RNA, 16 nt, Homo sapiens
gcccacuagacccacu

SEQ ID NO: 1652436 - RNA, 21 nt, Homo sapiens
gcccagcagcuccuguggcca

SEQ ID NO: 1652437 - RNA, 20 nt, Homo sapiens
gcccaggcuggagugcaaug

SEQ ID NO: 1652438 - RNA, 19 nt, Homo sapiens
gcccaggcuggagugcagu

SEQ ID NO: 1652439 - RNA, 20 nt, Homo sapiens
gcccaggcuggagugcagug

SEQ ID NO: 1652440 - RNA, 16 nt, Homo sapiens
gcccagggcugcaaug

SEQ ID NO: 1652441 - RNA, 15 nt, Homo sapiens
gccccaaauuccugu

SEQ ID NO: 1652442 - RNA, 16 nt, Homo sapiens
gccccaggcauugcca

SEQ ID NO: 1652443 - RNA, 19 nt, Homo sapiens
gccccaggcauugccaagg

SEQ ID NO: 1652444 - RNA, 21 nt, Homo sapiens
gccccaucaggacucuuguga

SEQ ID NO: 1652445 - RNA, 14 nt, Homo sapiens
gccccaugagacag

SEQ ID NO: 1652446 - RNA, 16 nt, Homo sapiens
ugauuuuauaugcuau

SEQ ID NO: 1652447 - RNA, 22 nt, Homo sapiens
ugcaaaaggacucucaggacca

SEQ ID NO: 1652448 - RNA, 14 nt, Homo sapiens
ugcaaauacuguau

SEQ ID NO: 1652449 - RNA, 13 nt, Homo sapiens
ugcaacaacaugu

SEQ ID NO: 1652450 - RNA, 12 nt, Homo sapiens
ugcaagacauag

SEQ ID NO: 1652451 - RNA, 17 nt, Homo sapiens
ugcaagcaacaagcuau

SEQ ID NO: 1652452 - RNA, 19 nt, Homo sapiens
ugcaagcaagaaacacugg

SEQ ID NO: 1652453 - RNA, 18 nt, Homo sapiens
ugcacaaacucaccaucu

SEQ ID NO: 1652454 - RNA, 13 nt, Homo sapiens
ugcacacuuugcc

SEQ ID NO: 1652455 - RNA, 19 nt, Homo sapiens
ugcacaguugccacauuua

SEQ ID NO: 1652456 - RNA, 20 nt, Homo sapiens
ugcacaguugccacauuuag

SEQ ID NO: 1652457 - RNA, 20 nt, Homo sapiens
ugcaccaaaucaucucucau

SEQ ID NO: 1652458 - RNA, 22 nt, Homo sapiens
ugcaccuucugacgcagccuga

SEQ ID NO: 1652459 - RNA, 14 nt, Homo sapiens
ugcacuaacagagu

SEQ ID NO: 1652460 - RNA, 13 nt, Homo sapiens
ugcagagagccau

SEQ ID NO: 1652461 - RNA, 21 nt, Homo sapiens
ugcagaggaggagaaaaguga

SEQ ID NO: 1652462 - RNA, 23 nt, Homo sapiens
ugcagauaaacagaaaugcucug

SEQ ID NO: 1652463 - RNA, 19 nt, Homo sapiens
ugcagccucagagacauca

SEQ ID NO: 1652464 - RNA, 15 nt, Homo sapiens
ugcagcuuauauuca

SEQ ID NO: 1652465 - RNA, 19 nt, Homo sapiens
ugcagcuuauauucaucca

SEQ ID NO: 1652466 - RNA, 17 nt, Homo sapiens
ugcaggaaggagcugcc

SEQ ID NO: 1652467 - RNA, 16 nt, Homo sapiens
ugcaggcaucacagcu

SEQ ID NO: 1652468 - RNA, 20 nt, Homo sapiens
ugcauaaaauguuaaguuga

SEQ ID NO: 1652469 - RNA, 21 nt, Homo sapiens
ugcauaaauaugcagugauau

SEQ ID NO: 1652470 - RNA, 22 nt, Homo sapiens
ugcauaauguuucuggauuuca

SEQ ID NO: 1652471 - RNA, 13 nt, Homo sapiens
ugcauauauacau

SEQ ID NO: 1652472 - RNA, 20 nt, Homo sapiens
ugcauauccaacaugugcuc

SEQ ID NO: 1652473 - RNA, 22 nt, Homo sapiens
ugcaugaccacauagaacaugu

SEQ ID NO: 1652474 - RNA, 17 nt, Homo sapiens
ugcauuaucuaugauau

SEQ ID NO: 1652475 - RNA, 14 nt, Homo sapiens
ugcauuugcacuau

SEQ ID NO: 1652476 - RNA, 14 nt, Homo sapiens
ugccaaagaacuug

SEQ ID NO: 1652477 - RNA, 12 nt, Homo sapiens
ugccaauggaac

SEQ ID NO: 1652478 - RNA, 18 nt, Homo sapiens
ugccacaacgcccggcua

SEQ ID NO: 1652479 - RNA, 23 nt, Homo sapiens
ugccacagccuccccugccaggg

SEQ ID NO: 1652480 - RNA, 18 nt, Homo sapiens
ugccacccucaugcugug

SEQ ID NO: 1652481 - RNA, 14 nt, Homo sapiens
ugccaccuggaccc

SEQ ID NO: 1652482 - RNA, 14 nt, Homo sapiens
ugccagacaucacc

SEQ ID NO: 1652483 - RNA, 19 nt, Homo sapiens
ugccauccucaaacacugc

SEQ ID NO: 1652484 - RNA, 19 nt, Homo sapiens
ugccaucuuggacuuguca

SEQ ID NO: 1652485 - RNA, 21 nt, Homo sapiens
ugcccaaggauagguauuuua

SEQ ID NO: 1652486 - RNA, 12 nt, Homo sapiens
ugcccaccuccu

SEQ ID NO: 1652487 - RNA, 22 nt, Homo sapiens
ugcccacguaugugaaacacac

SEQ ID NO: 1652488 - RNA, 17 nt, Homo sapiens
ugcccaugggcacugcu

SEQ ID NO: 1652489 - RNA, 12 nt, Homo sapiens
ugccccaugaga

SEQ ID NO: 1652490 - RNA, 21 nt, Homo sapiens
ugccccaugagacagucccag

SEQ ID NO: 1652491 - RNA, 16 nt, Homo sapiens
ugcccuccuaucccca

SEQ ID NO: 1652492 - RNA, 16 nt, Homo sapiens
ugcccuggcaccugug

SEQ ID NO: 1652493 - RNA, 19 nt, Homo sapiens
ugcccuguaccugugcacg

SEQ ID NO: 1652494 - RNA, 23 nt, Homo sapiens
ugcccuucucuuaucugccaugu

SEQ ID NO: 1652495 - RNA, 18 nt, Homo sapiens
ugccuaucuucuuucaca

SEQ ID NO: 1652496 - RNA, 18 nt, Homo sapiens
ugccucugacacacagcu

SEQ ID NO: 1652497 - RNA, 16 nt, Homo sapiens
ugccugguggcagcug

SEQ ID NO: 1652498 - RNA, 16 nt, Homo sapiens
ugccuuuagugaucac

SEQ ID NO: 1652499 - RNA, 18 nt, Homo sapiens
ugccuuucugguggcuuu

SEQ ID NO: 1652500 - RNA, 20 nt, Homo sapiens
ugccuuucugguggcuuuuu

SEQ ID NO: 1652501 - RNA, 19 nt, Homo sapiens
ugcgagagauguguguuga

SEQ ID NO: 1652502 - RNA, 21 nt, Homo sapiens
ugcgaucuggguucacugcaa

SEQ ID NO: 1652503 - RNA, 20 nt, Homo sapiens
ugcggaaugaaccacaucuu

SEQ ID NO: 1652504 - RNA, 15 nt, Homo sapiens
ugcuaacccccaaau

SEQ ID NO: 1652505 - RNA, 23 nt, Homo sapiens
ugcuaauauauguauaugcaaua

SEQ ID NO: 1652506 - RNA, 22 nt, Homo sapiens
ugcuaauccucuuuuucuaguc

SEQ ID NO: 1652507 - RNA, 22 nt, Homo sapiens
ucuaauuccacuuguucauucu

SEQ ID NO: 1652508 - RNA, 13 nt, Homo sapiens
ucuacacauaucu

SEQ ID NO: 1652509 - RNA, 14 nt, Homo sapiens
ucuacagaggccau

SEQ ID NO: 1652510 - RNA, 18 nt, Homo sapiens
ucuacguaucugcuacuu

SEQ ID NO: 1652511 - RNA, 19 nt, Homo sapiens
ucuacugaaaauacaaaaa

SEQ ID NO: 1652512 - RNA, 20 nt, Homo sapiens
ucuacugucucaguuuacau

SEQ ID NO: 1652513 - RNA, 13 nt, Homo sapiens
ucuagauaccacu

SEQ ID NO: 1652514 - RNA, 14 nt, Homo sapiens
ucuagcaguaaaag

SEQ ID NO: 1652515 - RNA, 23 nt, Homo sapiens
ucuaucaccaaggagccaaacau

SEQ ID NO: 1652516 - RNA, 12 nt, Homo sapiens
ucuaucugcaau

SEQ ID NO: 1652517 - RNA, 18 nt, Homo sapiens
ucuaucugcuuuugccua

SEQ ID NO: 1652518 - RNA, 17 nt, Homo sapiens
ucuaugaaauaucaugc

SEQ ID NO: 1652519 - RNA, 12 nt, Homo sapiens
ucuaugacugug

SEQ ID NO: 1652520 - RNA, 18 nt, Homo sapiens
ucuauggcacccaugcac

SEQ ID NO: 1652521 - RNA, 18 nt, Homo sapiens
ucuaugggacucaaugca

SEQ ID NO: 1652522 - RNA, 23 nt, Homo sapiens
ucuaugggacucaaugcacugac

SEQ ID NO: 1652523 - RNA, 11 nt, Homo sapiens
ucuauguuaau

SEQ ID NO: 1652524 - RNA, 13 nt, Homo sapiens
ucuauuaucucaa

SEQ ID NO: 1652525 - RNA, 23 nt, Homo sapiens
ucuauuuaacaacugggucaugu

SEQ ID NO: 1652526 - RNA, 16 nt, Homo sapiens
ucucaaacuacuggca

SEQ ID NO: 1652527 - RNA, 15 nt, Homo sapiens
ucucaauucuucccu

SEQ ID NO: 1652528 - RNA, 16 nt, Homo sapiens
ucucacuguugcccag

SEQ ID NO: 1652529 - RNA, 12 nt, Homo sapiens
ucucacuguugu

SEQ ID NO: 1652530 - RNA, 19 nt, Homo sapiens
ucucagcucuucugacuua

SEQ ID NO: 1652531 - RNA, 20 nt, Homo sapiens
ucucaggaccaaagcuuuca

SEQ ID NO: 1652532 - RNA, 13 nt, Homo sapiens
ucucauccaucau

SEQ ID NO: 1652533 - RNA, 13 nt, Homo sapiens
ucucauuaaaauc

SEQ ID NO: 1652534 - RNA, 21 nt, Homo sapiens
ucuccaaccccccagcacuga

SEQ ID NO: 1652535 - RNA, 17 nt, Homo sapiens
ucuccaccugccaggga

SEQ ID NO: 1652536 - RNA, 16 nt, Homo sapiens
ucuccagaaagcucau

SEQ ID NO: 1652537 - RNA, 22 nt, Homo sapiens
ucuccagcauucucagccacaa

SEQ ID NO: 1652538 - RNA, 22 nt, Homo sapiens
ucuccaucccugaaauuucuca

SEQ ID NO: 1652539 - RNA, 21 nt, Homo sapiens
ucucccagccagguucugacu

SEQ ID NO: 1652540 - RNA, 22 nt, Homo sapiens
ucuccugugaugucccaguuuc

SEQ ID NO: 1652541 - RNA, 14 nt, Homo sapiens
ucuccuuacucauu

SEQ ID NO: 1652542 - RNA, 15 nt, Homo sapiens
ucucuaaugcuugau

SEQ ID NO: 1652543 - RNA, 14 nt, Homo sapiens
ucucugagcaguga

SEQ ID NO: 1652544 - RNA, 17 nt, Homo sapiens
ucucugaggacacuaac

SEQ ID NO: 1652545 - RNA, 15 nt, Homo sapiens
ucucuguguguuugu

SEQ ID NO: 1652546 - RNA, 23 nt, Homo sapiens
ucucuuuuuagagaaauuugcca

SEQ ID NO: 1652547 - RNA, 18 nt, Homo sapiens
ucugaaaauuaacacugc

SEQ ID NO: 1652548 - RNA, 22 nt, Homo sapiens
ucugaaagucaugcacauaccu

SEQ ID NO: 1652549 - RNA, 14 nt, Homo sapiens
ucugacacacagcu

SEQ ID NO: 1652550 - RNA, 16 nt, Homo sapiens
ucugacgcagccugag

SEQ ID NO: 1652551 - RNA, 20 nt, Homo sapiens
ucugacuuaagugugcaaaa

SEQ ID NO: 1652552 - RNA, 19 nt, Homo sapiens
ucugagcagugaaugauuc

SEQ ID NO: 1652553 - RNA, 13 nt, Homo sapiens
ucugauacgugua

SEQ ID NO: 1652554 - RNA, 22 nt, Homo sapiens
ucugaucauccacugugccaug

SEQ ID NO: 1652555 - RNA, 16 nt, Homo sapiens
ucugaucugaugcaag

SEQ ID NO: 1652556 - RNA, 13 nt, Homo sapiens
ucugaugcaagca

SEQ ID NO: 1652557 - RNA, 13 nt, Homo sapiens
ucugcacacagca

SEQ ID NO: 1652558 - RNA, 22 nt, Homo sapiens
ucugcagccuccucugugacuc

SEQ ID NO: 1652559 - RNA, 21 nt, Homo sapiens
ucugccaguucccucccucaa

SEQ ID NO: 1652560 - RNA, 19 nt, Homo sapiens
ucugccucugacacacagc

SEQ ID NO: 1652561 - RNA, 16 nt, Homo sapiens
ucugccugaagucaca

SEQ ID NO: 1652562 - RNA, 17 nt, Homo sapiens
ucugccugaagucacac

SEQ ID NO: 1652563 - RNA, 22 nt, Homo sapiens
ucugccugauaggacccauauu

SEQ ID NO: 1652564 - RNA, 13 nt, Homo sapiens
ucugcuacugugu

SEQ ID NO: 1652565 - RNA, 21 nt, Homo sapiens
gaaaaugcuguauuagucaca

SEQ ID NO: 1652566 - RNA, 10 nt, Homo sapiens
gaaaauggaa

SEQ ID NO: 1652567 - RNA, 14 nt, Homo sapiens
gaaaaugugcaaua

SEQ ID NO: 1652568 - RNA, 15 nt, Homo sapiens
gaaaaugugcaauau

SEQ ID NO: 1652569 - RNA, 14 nt, Homo sapiens
gaaaauuaacacug

SEQ ID NO: 1652570 - RNA, 14 nt, Homo sapiens
gaaaauuauuugca

SEQ ID NO: 1652571 - RNA, 22 nt, Homo sapiens
gaaacaacaauuucuacuuuga

SEQ ID NO: 1652572 - RNA, 23 nt, Homo sapiens
gaaacaacaauuucuacuuugaa

SEQ ID NO: 1652573 - RNA, 14 nt, Homo sapiens
gaaacagcugccac

SEQ ID NO: 1652574 - RNA, 13 nt, Homo sapiens
gaaaccacagcug

SEQ ID NO: 1652575 - RNA, 19 nt, Homo sapiens
gaaacuccaucucuacuga

SEQ ID NO: 1652576 - RNA, 14 nt, Homo sapiens
gaaagaagugggga

SEQ ID NO: 1652577 - RNA, 20 nt, Homo sapiens
gaaagaauagaacacaguuu

SEQ ID NO: 1652578 - RNA, 18 nt, Homo sapiens
gaaagacagagcugggau

SEQ ID NO: 1652579 - RNA, 17 nt, Homo sapiens
gaaagaggaagcuuucu

SEQ ID NO: 1652580 - RNA, 22 nt, Homo sapiens
gaaaggcaaaugcccaagggaa

SEQ ID NO: 1652581 - RNA, 18 nt, Homo sapiens
gaaaguuuuguucuguau

SEQ ID NO: 1652582 - RNA, 21 nt, Homo sapiens
gaaaguuuuguucuguauauu

SEQ ID NO: 1652583 - RNA, 18 nt, Homo sapiens
gaaauaaaagcuuugcaa

SEQ ID NO: 1652584 - RNA, 17 nt, Homo sapiens
gaaauaucaugcuccau

SEQ ID NO: 1652585 - RNA, 14 nt, Homo sapiens
gaaaucaacuugug

SEQ ID NO: 1652586 - RNA, 19 nt, Homo sapiens
gaaaucuaugaaauaucau

SEQ ID NO: 1652587 - RNA, 15 nt, Homo sapiens
gaaaugaaugugcaa

SEQ ID NO: 1652588 - RNA, 22 nt, Homo sapiens
gaacacaaguuccugauaacuu

SEQ ID NO: 1652589 - RNA, 20 nt, Homo sapiens
gaacaucaauuccaguggaa

SEQ ID NO: 1652590 - RNA, 18 nt, Homo sapiens
gaaccaggcaacuuggga

SEQ ID NO: 1652591 - RNA, 16 nt, Homo sapiens
gaaccuggagggcuag

SEQ ID NO: 1652592 - RNA, 15 nt, Homo sapiens
gaaccuugcuaucaa

SEQ ID NO: 1652593 - RNA, 20 nt, Homo sapiens
gaacguuuuuccuguucuua

SEQ ID NO: 1652594 - RNA, 16 nt, Homo sapiens
gaacuagaaccuggag

SEQ ID NO: 1652595 - RNA, 13 nt, Homo sapiens
gaacucaguguga

SEQ ID NO: 1652596 - RNA, 19 nt, Homo sapiens
gaacuccugaccucaggua

SEQ ID NO: 1652597 - RNA, 14 nt, Homo sapiens
gaacuccugaccuu

SEQ ID NO: 1652598 - RNA, 16 nt, Homo sapiens
gaacugaacauuccag

SEQ ID NO: 1652599 - RNA, 19 nt, Homo sapiens
gaacuguggugccacauga

SEQ ID NO: 1652600 - RNA, 20 nt, Homo sapiens
gaagaacggggcucuucuca

SEQ ID NO: 1652601 - RNA, 21 nt, Homo sapiens
gaagaccccagcacagacuca

SEQ ID NO: 1652602 - RNA, 14 nt, Homo sapiens
gaagagaauauucc

SEQ ID NO: 1652603 - RNA, 23 nt, Homo sapiens
gaagagacucuguuugcuugugu

SEQ ID NO: 1652604 - RNA, 20 nt, Homo sapiens
gaagauauaacuauugccca

SEQ ID NO: 1652605 - RNA, 15 nt, Homo sapiens
gaagauucuauguua

SEQ ID NO: 1652606 - RNA, 18 nt, Homo sapiens
gaagcaggcuacacugac

SEQ ID NO: 1652607 - RNA, 18 nt, Homo sapiens
gaagcauuccuucuuuga

SEQ ID NO: 1652608 - RNA, 15 nt, Homo sapiens
gaagcauuuacuuug

SEQ ID NO: 1652609 - RNA, 17 nt, Homo sapiens
gaagcauuuacuuugug

SEQ ID NO: 1652610 - RNA, 15 nt, Homo sapiens
gaagcuuucaguauu

SEQ ID NO: 1652611 - RNA, 17 nt, Homo sapiens
gaaggauccaucuuugu

SEQ ID NO: 1652612 - RNA, 22 nt, Homo sapiens
gaaggguucaccaggucaggga

SEQ ID NO: 1652613 - RNA, 19 nt, Homo sapiens
gaagucacacaguauuacu

SEQ ID NO: 1652614 - RNA, 16 nt, Homo sapiens
gaagucuuccauagag

SEQ ID NO: 1652615 - RNA, 15 nt, Homo sapiens
gaagucuucuauuua

SEQ ID NO: 1652616 - RNA, 18 nt, Homo sapiens
gaagugaaaaggcugccu

SEQ ID NO: 1652617 - RNA, 20 nt, Homo sapiens
gaagugacuguuguaccaug

SEQ ID NO: 1652618 - RNA, 16 nt, Homo sapiens
gaagugugugaucugu

SEQ ID NO: 1652619 - RNA, 22 nt, Homo sapiens
gaaguugcccaccaaaacacag

SEQ ID NO: 1652620 - RNA, 17 nt, Homo sapiens
gaaguuuaaagaugccu

SEQ ID NO: 1652621 - RNA, 13 nt, Homo sapiens
gaauaauccagaa

SEQ ID NO: 1652622 - RNA, 19 nt, Homo sapiens
gaauauacuaaauuaacuu

SEQ ID NO: 1652623 - RNA, 16 nt, Homo sapiens
gaauauauuuccuuau

SEQ ID NO: 1652624 - RNA, 11 nt, Homo sapiens
gaauauuccac

SEQ ID NO: 1652625 - RNA, 16 nt, Homo sapiens
gaaucagauuuuaaca

SEQ ID NO: 1652626 - RNA, 11 nt, Homo sapiens
gaaucauucug

SEQ ID NO: 1652627 - RNA, 13 nt, Homo sapiens
gaaucauucugua

SEQ ID NO: 1652628 - RNA, 16 nt, Homo sapiens
gaaucccuuaaacuca

SEQ ID NO: 1652629 - RNA, 14 nt, Homo sapiens
gaauccuacauaca

SEQ ID NO: 1652630 - RNA, 19 nt, Homo sapiens
gaaucuagcuuauuuugag

SEQ ID NO: 1652631 - RNA, 17 nt, Homo sapiens
gaaugagcaaaaccaaa

SEQ ID NO: 1652632 - RNA, 19 nt, Homo sapiens
gaaugagcaaaaccaaaua

SEQ ID NO: 1652633 - RNA, 16 nt, Homo sapiens
gaaugcagugguauga

SEQ ID NO: 1652634 - RNA, 15 nt, Homo sapiens
gaauggaauuggaca

SEQ ID NO: 1652635 - RNA, 17 nt, Homo sapiens
gaauggagcuggcccuc

SEQ ID NO: 1652636 - RNA, 20 nt, Homo sapiens
gaauggcucacuauggugcc

SEQ ID NO: 1652637 - RNA, 16 nt, Homo sapiens
gaaugggcagcucauc

SEQ ID NO: 1652638 - RNA, 12 nt, Homo sapiens
gaauuagcucac

SEQ ID NO: 1652639 - RNA, 18 nt, Homo sapiens
gaauuagcucacuuggug

SEQ ID NO: 1652640 - RNA, 15 nt, Homo sapiens
gaauuauucagugaa

SEQ ID NO: 1652641 - RNA, 19 nt, Homo sapiens
gaauuuauggaaucuacca

SEQ ID NO: 1652642 - RNA, 18 nt, Homo sapiens
gaauuucauaugacauuc

SEQ ID NO: 1652643 - RNA, 21 nt, Homo sapiens
gaauuuuauuuuuugggaaaa

SEQ ID NO: 1652644 - RNA, 14 nt, Homo sapiens
gaauuuucuuccaa

SEQ ID NO: 1652645 - RNA, 18 nt, Homo sapiens
gaauuuuugcacauucua

SEQ ID NO: 1652646 - RNA, 22 nt, Homo sapiens
gacaaauauuccuuugcauauu

SEQ ID NO: 1652647 - RNA, 18 nt, Homo sapiens
gacaaggaaaaaauaaca

SEQ ID NO: 1652648 - RNA, 15 nt, Homo sapiens
gacaaggaaaggcaa

SEQ ID NO: 1652649 - RNA, 13 nt, Homo sapiens
gacacaaaccugc

SEQ ID NO: 1652650 - RNA, 15 nt, Homo sapiens
gacacaaaccugccu

SEQ ID NO: 1652651 - RNA, 19 nt, Homo sapiens
gacacaauguugcacugaa

SEQ ID NO: 1652652 - RNA, 14 nt, Homo sapiens
gacacauugcccca

SEQ ID NO: 1652653 - RNA, 14 nt, Homo sapiens
gacaccaaaaugaa

SEQ ID NO: 1652654 - RNA, 17 nt, Homo sapiens
gacacugccacucuccc

SEQ ID NO: 1652655 - RNA, 13 nt, Homo sapiens
gacagaacacugu

SEQ ID NO: 1652656 - RNA, 12 nt, Homo sapiens
gacagaccuuca

SEQ ID NO: 1652657 - RNA, 19 nt, Homo sapiens
gacagagcagaacuuucac

SEQ ID NO: 1652658 - RNA, 16 nt, Homo sapiens
gacagagcuggugaua

SEQ ID NO: 1652659 - RNA, 14 nt, Homo sapiens
gacaggaccaggga

SEQ ID NO: 1652660 - RNA, 15 nt, Homo sapiens
gacaggcuggugcua

SEQ ID NO: 1652661 - RNA, 19 nt, Homo sapiens
gacauuaaaaauguuagua

SEQ ID NO: 1652662 - RNA, 21 nt, Homo sapiens
gacauuuauuuuucucaugaa

SEQ ID NO: 1652663 - RNA, 13 nt, Homo sapiens
gaccacgagcccu

SEQ ID NO: 1652664 - RNA, 19 nt, Homo sapiens
gaccaggcaaagcaaguga

SEQ ID NO: 1652665 - RNA, 15 nt, Homo sapiens
gaccaggcaauguga

SEQ ID NO: 1652666 - RNA, 19 nt, Homo sapiens
gaccagggauuuccaugau

SEQ ID NO: 1652667 - RNA, 20 nt, Homo sapiens
gaccaguuuaaccugaugca

SEQ ID NO: 1652668 - RNA, 17 nt, Homo sapiens
gaccaucuuugccaaca

SEQ ID NO: 1652669 - RNA, 15 nt, Homo sapiens
gaccauuagcauuug

SEQ ID NO: 1652670 - RNA, 11 nt, Homo sapiens
gacccauuccu

SEQ ID NO: 1652671 - RNA, 19 nt, Homo sapiens
gaccccagaggauugcugc

SEQ ID NO: 1652672 - RNA, 14 nt, Homo sapiens
gaccccgagccugg

SEQ ID NO: 1652673 - RNA, 15 nt, Homo sapiens
gaccuacagugcugu

SEQ ID NO: 1652674 - RNA, 11 nt, Homo sapiens
gaccucaggug

SEQ ID NO: 1652675 - RNA, 19 nt, Homo sapiens
gaccugccaggcacacuga

SEQ ID NO: 1652676 - RNA, 16 nt, Homo sapiens
aaaccaaauauuccag

SEQ ID NO: 1652677 - RNA, 14 nt, Homo sapiens
aaaccaaaucacug

SEQ ID NO: 1652678 - RNA, 18 nt, Homo sapiens
aaaccacuuuuugcagcu

SEQ ID NO: 1652679 - RNA, 22 nt, Homo sapiens
aaaccccuuuucaguuugaacu

SEQ ID NO: 1652680 - RNA, 13 nt, Homo sapiens
aaacccucuguga

SEQ ID NO: 1652681 - RNA, 22 nt, Homo sapiens
aaacccugccucuuuuccccau

SEQ ID NO: 1652682 - RNA, 14 nt, Homo sapiens
aaaccuacacagcu

SEQ ID NO: 1652683 - RNA, 23 nt, Homo sapiens
aaaccuacacagcuguuuccuca

SEQ ID NO: 1652684 - RNA, 14 nt, Homo sapiens
aaaccuauguuugc

SEQ ID NO: 1652685 - RNA, 16 nt, Homo sapiens
aaaccucuaacccagg

SEQ ID NO: 1652686 - RNA, 16 nt, Homo sapiens
aaacguccuacuguau

SEQ ID NO: 1652687 - RNA, 13 nt, Homo sapiens
aaacuaaaacaga

SEQ ID NO: 1652688 - RNA, 22 nt, Homo sapiens
aaacucaagcuucuucacucac

SEQ ID NO: 1652689 - RNA, 23 nt, Homo sapiens
aaacucaugacugagucuggcaa

SEQ ID NO: 1652690 - RNA, 18 nt, Homo sapiens
aaacucuccucugcugcu

SEQ ID NO: 1652691 - RNA, 21 nt, Homo sapiens
aaacugguuuaggauuacuua

SEQ ID NO: 1652692 - RNA, 16 nt, Homo sapiens
aaacuucuuucacuca

SEQ ID NO: 1652693 - RNA, 14 nt, Homo sapiens
aaagaacuuggaaa

SEQ ID NO: 1652694 - RNA, 13 nt, Homo sapiens
aaagaagcaagga

SEQ ID NO: 1652695 - RNA, 14 nt, Homo sapiens
acagaggcagagau

SEQ ID NO: 1652696 - RNA, 18 nt, Homo sapiens
acagagucucgcuauugu

SEQ ID NO: 1652697 - RNA, 18 nt, Homo sapiens
acagcacccucuccagau

SEQ ID NO: 1652698 - RNA, 19 nt, Homo sapiens
acagcgcuggccgggaccc

SEQ ID NO: 1652699 - RNA, 19 nt, Homo sapiens
acagcuaacacacagcucc

SEQ ID NO: 1652700 - RNA, 18 nt, Homo sapiens
acagcucuucuccaggcu

SEQ ID NO: 1652701 - RNA, 22 nt, Homo sapiens
acagcuuauggcaucucauuga

SEQ ID NO: 1652702 - RNA, 21 nt, Homo sapiens
acagcuuucaaaagcaagaac

SEQ ID NO: 1652703 - RNA, 15 nt, Homo sapiens
acaggagacaaaaga

SEQ ID NO: 1652704 - RNA, 20 nt, Homo sapiens
acaggaugaaggcaaugcca

SEQ ID NO: 1652705 - RNA, 14 nt, Homo sapiens
acaggccugagauu

SEQ ID NO: 1652706 - RNA, 22 nt, Homo sapiens
acaggcuggucucaaacuccua

SEQ ID NO: 1652707 - RNA, 12 nt, Homo sapiens
acagggucucac

SEQ ID NO: 1652708 - RNA, 14 nt, Homo sapiens
acagggucucacuc

SEQ ID NO: 1652709 - RNA, 20 nt, Homo sapiens
acagggucucacucugucac

SEQ ID NO: 1652710 - RNA, 22 nt, Homo sapiens
acaggguuuugccauguuggcc

SEQ ID NO: 1652711 - RNA, 15 nt, Homo sapiens
acaggugugagccac

SEQ ID NO: 1652712 - RNA, 15 nt, Homo sapiens
acaggugugagucac

SEQ ID NO: 1652713 - RNA, 17 nt, Homo sapiens
acaguauacgcuccauc

SEQ ID NO: 1652714 - RNA, 15 nt, Homo sapiens
acaguccucccaucu

SEQ ID NO: 1652715 - RNA, 22 nt, Homo sapiens
acagucuuguauuaaguuguua

SEQ ID NO: 1652716 - RNA, 18 nt, Homo sapiens
acagugaauuuaagcaug

SEQ ID NO: 1652717 - RNA, 14 nt, Homo sapiens
acaguguaagcuua

SEQ ID NO: 1652718 - RNA, 15 nt, Homo sapiens
acagugucugggcug

SEQ ID NO: 1652719 - RNA, 20 nt, Homo sapiens
acaguguuauguaguauugu

SEQ ID NO: 1652720 - RNA, 14 nt, Homo sapiens
acaguuucuuccau

SEQ ID NO: 1652721 - RNA, 18 nt, Homo sapiens
acaguuuuaacuguggau

SEQ ID NO: 1652722 - RNA, 13 nt, Homo sapiens
acauaaacccagu

SEQ ID NO: 1652723 - RNA, 15 nt, Homo sapiens
acauaaauguucacu

SEQ ID NO: 1652724 - RNA, 20 nt, Homo sapiens
acauaacguuuuuccuuuaa

SEQ ID NO: 1652725 - RNA, 19 nt, Homo sapiens
acauaagcaaagacuauga

SEQ ID NO: 1652726 - RNA, 21 nt, Homo sapiens
acauaccuaugggauuuuaca

SEQ ID NO: 1652727 - RNA, 15 nt, Homo sapiens
acauacgucuuucac

SEQ ID NO: 1652728 - RNA, 12 nt, Homo sapiens
acauacucccau

SEQ ID NO: 1652729 - RNA, 20 nt, Homo sapiens
acauagaaaguucauggaac

SEQ ID NO: 1652730 - RNA, 18 nt, Homo sapiens
acauauaaagauuaacac

SEQ ID NO: 1652731 - RNA, 21 nt, Homo sapiens
acauauggacgaggauggguu

SEQ ID NO: 1652732 - RNA, 15 nt, Homo sapiens
acauauugagcacuu

SEQ ID NO: 1652733 - RNA, 20 nt, Homo sapiens
acaucaucaaggcacugccu

SEQ ID NO: 1652734 - RNA, 15 nt, Homo sapiens
acaucccauguagaa

SEQ ID NO: 1652735 - RNA, 15 nt, Homo sapiens
acaucugugucuugu

SEQ ID NO: 1652736 - RNA, 17 nt, Homo sapiens
acaucuuuacucaggca

SEQ ID NO: 1652737 - RNA, 19 nt, Homo sapiens
acaucuuuuucacugacuu

SEQ ID NO: 1652738 - RNA, 15 nt, Homo sapiens
acaugaaaacauuga

SEQ ID NO: 1652739 - RNA, 16 nt, Homo sapiens
acaugaaaacauugau

SEQ ID NO: 1652740 - RNA, 11 nt, Homo sapiens
acaugacuguu

SEQ ID NO: 1652741 - RNA, 16 nt, Homo sapiens
acaugccaagcacugu

SEQ ID NO: 1652742 - RNA, 14 nt, Homo sapiens
acaugccacuauga

SEQ ID NO: 1652743 - RNA, 16 nt, Homo sapiens
acauguauccuuucac

SEQ ID NO: 1652744 - RNA, 19 nt, Homo sapiens
acaugugucccagccacag

SEQ ID NO: 1652745 - RNA, 23 nt, Homo sapiens
acauguuaggaagguacugucau

SEQ ID NO: 1652746 - RNA, 16 nt, Homo sapiens
acauuaaacucccuuu

SEQ ID NO: 1652747 - RNA, 15 nt, Homo sapiens
acauuccaucuuaca

SEQ ID NO: 1652748 - RNA, 16 nt, Homo sapiens
acauuccaucuuacau

SEQ ID NO: 1652749 - RNA, 19 nt, Homo sapiens
acauuguguccugcuuaua

SEQ ID NO: 1652750 - RNA, 15 nt, Homo sapiens
acauuuaagagacag

SEQ ID NO: 1652751 - RNA, 22 nt, Homo sapiens
acauuuuguuuauguuacuuaa

SEQ ID NO: 1652752 - RNA, 20 nt, Homo sapiens
accaaaaaaauaaagcauua

SEQ ID NO: 1652753 - RNA, 13 nt, Homo sapiens
accaaaucacuga

SEQ ID NO: 1652754 - RNA, 18 nt, Homo sapiens
accaacauuguucauucu

SEQ ID NO: 1652755 - RNA, 14 nt, Homo sapiens
accaagccucugga

SEQ ID NO: 1652756 - RNA, 17 nt, Homo sapiens
accaauaaagccuucaa

SEQ ID NO: 1652757 - RNA, 13 nt, Homo sapiens
accaaugucuuga

SEQ ID NO: 1652758 - RNA, 11 nt, Homo sapiens
accacaggcuu

SEQ ID NO: 1652759 - RNA, 17 nt, Homo sapiens
accacaggcuuguuacc

SEQ ID NO: 1652760 - RNA, 18 nt, Homo sapiens
accacauagaacaugugu

SEQ ID NO: 1652761 - RNA, 18 nt, Homo sapiens
accacaugugcacaugca

SEQ ID NO: 1652762 - RNA, 16 nt, Homo sapiens
accacccagagcaccc

SEQ ID NO: 1652763 - RNA, 21 nt, Homo sapiens
accacgugagaucauucacuc

SEQ ID NO: 1652764 - RNA, 20 nt, Homo sapiens
accacuauucuuaacuauuc

SEQ ID NO: 1652765 - RNA, 21 nt, Homo sapiens
accacuauucuuaacuauuca

SEQ ID NO: 1652766 - RNA, 22 nt, Homo sapiens
accagagaagggcuuggacuca

SEQ ID NO: 1652767 - RNA, 23 nt, Homo sapiens
accagagaagggcuuggacucaa

SEQ ID NO: 1652768 - RNA, 21 nt, Homo sapiens
accagcagagcaccuuagaca

SEQ ID NO: 1652769 - RNA, 22 nt, Homo sapiens
accagguaaugugggucuacca

SEQ ID NO: 1652770 - RNA, 13 nt, Homo sapiens
accaggucaggga

SEQ ID NO: 1652771 - RNA, 13 nt, Homo sapiens
accaggucuccuc

SEQ ID NO: 1652772 - RNA, 15 nt, Homo sapiens
accaugccucuccaa

SEQ ID NO: 1652773 - RNA, 13 nt, Homo sapiens
acccaacaugacu

SEQ ID NO: 1652774 - RNA, 10 nt, Homo sapiens
acccaagggc

SEQ ID NO: 1652775 - RNA, 21 nt, Homo sapiens
acccacugcuuuuggucugug

SEQ ID NO: 1652776 - RNA, 16 nt, Homo sapiens
acccagccucuaggga

SEQ ID NO: 1652777 - RNA, 21 nt, Homo sapiens
acccaggauucccccaacaca

SEQ ID NO: 1652778 - RNA, 20 nt, Homo sapiens
acccaggcuggagugcagug

SEQ ID NO: 1652779 - RNA, 16 nt, Homo sapiens
acccaggguggggaca

SEQ ID NO: 1652780 - RNA, 13 nt, Homo sapiens
accccaacagcac

SEQ ID NO: 1652781 - RNA, 21 nt, Homo sapiens
accccaagcaaaucccaacau

SEQ ID NO: 1652782 - RNA, 21 nt, Homo sapiens
accccacccacuucugcacuu

SEQ ID NO: 1652783 - RNA, 14 nt, Homo sapiens
accccaucugccca

SEQ ID NO: 1652784 - RNA, 12 nt, Homo sapiens
accccauuugau

SEQ ID NO: 1652785 - RNA, 20 nt, Homo sapiens
acccccacagaccugcucug

SEQ ID NO: 1652786 - RNA, 22 nt, Homo sapiens
acccccuccccccaaucccuca

SEQ ID NO: 1652787 - RNA, 17 nt, Homo sapiens
acccuacuuucauuccu

SEQ ID NO: 1652788 - RNA, 20 nt, Homo sapiens
acccucccucccugaucccg

SEQ ID NO: 1652789 - RNA, 22 nt, Homo sapiens
acccuccuggggcucucagugu

SEQ ID NO: 1652790 - RNA, 22 nt, Homo sapiens
acccuccuuucaccacaugugc

SEQ ID NO: 1652791 - RNA, 20 nt, Homo sapiens
acccugagcagaauacuggu

SEQ ID NO: 1652792 - RNA, 17 nt, Homo sapiens
acccugcucuccgacca

SEQ ID NO: 1652793 - RNA, 21 nt, Homo sapiens
acccuguggagaaauucguug

SEQ ID NO: 1652794 - RNA, 18 nt, Homo sapiens
acccuuccacguguaugc

SEQ ID NO: 1652795 - RNA, 17 nt, Homo sapiens
acccuucuuuucugacu

SEQ ID NO: 1652796 - RNA, 21 nt, Homo sapiens
acccuuggaaagaaauguaga

SEQ ID NO: 1652797 - RNA, 18 nt, Homo sapiens
accgcuucucagccacaa

SEQ ID NO: 1652798 - RNA, 19 nt, Homo sapiens
accguagggccugacuccu

SEQ ID NO: 1652799 - RNA, 19 nt, Homo sapiens
accuaaacccucugugaaa

SEQ ID NO: 1652800 - RNA, 21 nt, Homo sapiens
accuacacagcuguuuccuca

SEQ ID NO: 1652801 - RNA, 23 nt, Homo sapiens
accuacacagcuguuuccucacg

SEQ ID NO: 1652802 - RNA, 20 nt, Homo sapiens
accuagaguuuggacuucca

SEQ ID NO: 1652803 - RNA, 21 nt, Homo sapiens
accuagccuuagaagucacac

SEQ ID NO: 1652804 - RNA, 15 nt, Homo sapiens
aggaaggcucuucuc

SEQ ID NO: 1652805 - RNA, 20 nt, Homo sapiens
aggaaggcucuucuccccag

SEQ ID NO: 1652806 - RNA, 13 nt, Homo sapiens
aggaaucauucug

SEQ ID NO: 1652807 - RNA, 15 nt, Homo sapiens
aggaaucauucugua

SEQ ID NO: 1652808 - RNA, 21 nt, Homo sapiens
aggaauuuauaacaaauaugg

SEQ ID NO: 1652809 - RNA, 20 nt, Homo sapiens
aggacaaacagugaauuuaa

SEQ ID NO: 1652810 - RNA, 20 nt, Homo sapiens
aggacauugcggacagccac

SEQ ID NO: 1652811 - RNA, 17 nt, Homo sapiens
aggacuagaaccuggag

SEQ ID NO: 1652812 - RNA, 14 nt, Homo sapiens
aggacugggccacu

SEQ ID NO: 1652813 - RNA, 16 nt, Homo sapiens
aggacugguaaaauac

SEQ ID NO: 1652814 - RNA, 13 nt, Homo sapiens
aggacuguagaaa

SEQ ID NO: 1652815 - RNA, 14 nt, Homo sapiens
aggagaagugggga

SEQ ID NO: 1652816 - RNA, 16 nt, Homo sapiens
aggagacacaacaacu

SEQ ID NO: 1652817 - RNA, 18 nt, Homo sapiens
aggagacccacagguaug

SEQ ID NO: 1652818 - RNA, 18 nt, Homo sapiens
aggagcagugcaggcaca

SEQ ID NO: 1652819 - RNA, 12 nt, Homo sapiens
aggagccaaaca

SEQ ID NO: 1652820 - RNA, 18 nt, Homo sapiens
aggagcugauacuuugac

SEQ ID NO: 1652821 - RNA, 20 nt, Homo sapiens
aggaggcagagguugcagug

SEQ ID NO: 1652822 - RNA, 14 nt, Homo sapiens
aggaggccacguga

SEQ ID NO: 1652823 - RNA, 19 nt, Homo sapiens
aggagggucggugccuuca

SEQ ID NO: 1652824 - RNA, 14 nt, Homo sapiens
aggaguacagguga

SEQ ID NO: 1652825 - RNA, 20 nt, Homo sapiens
aggauauugggucucagccc

SEQ ID NO: 1652826 - RNA, 15 nt, Homo sapiens
aggauccaucuuugu

SEQ ID NO: 1652827 - RNA, 23 nt, Homo sapiens
aggauuauuuugauuauauacuu

SEQ ID NO: 1652828 - RNA, 14 nt, Homo sapiens
aggcacagcacagg

SEQ ID NO: 1652829 - RNA, 23 nt, Homo sapiens
aggcagaauccuacaacuuccac

SEQ ID NO: 1652830 - RNA, 16 nt, Homo sapiens
aggcaggggaauguau

SEQ ID NO: 1652831 - RNA, 20 nt, Homo sapiens
aggcagggucucacucuguc

SEQ ID NO: 1652832 - RNA, 19 nt, Homo sapiens
aggcaucgcaauguaagac

SEQ ID NO: 1652833 - RNA, 20 nt, Homo sapiens
aggcaugagccaccgcgccu

SEQ ID NO: 1652834 - RNA, 19 nt, Homo sapiens
aggcauggcuggugccuga

SEQ ID NO: 1652835 - RNA, 21 nt, Homo sapiens
aggccagagggagugacagag

SEQ ID NO: 1652836 - RNA, 14 nt, Homo sapiens
aggccaucuuccag

SEQ ID NO: 1652837 - RNA, 23 nt, Homo sapiens
aggccccucuccuccguggcaca

SEQ ID NO: 1652838 - RNA, 16 nt, Homo sapiens
aggccugcgugugucu

SEQ ID NO: 1652839 - RNA, 16 nt, Homo sapiens
aggccugugauuauuc

SEQ ID NO: 1652840 - RNA, 20 nt, Homo sapiens
aggcgugagccaccgugccu

SEQ ID NO: 1652841 - RNA, 19 nt, Homo sapiens
aggcguggagcugccugau

SEQ ID NO: 1652842 - RNA, 20 nt, Homo sapiens
aggcgugguggcgggugccu

SEQ ID NO: 1652843 - RNA, 20 nt, Homo sapiens
aggcuggagugcaguggcac

SEQ ID NO: 1652844 - RNA, 20 nt, Homo sapiens
aggcugggagagccuuccag

SEQ ID NO: 1652845 - RNA, 18 nt, Homo sapiens
aggcuucuccgcccauuc

SEQ ID NO: 1652846 - RNA, 17 nt, Homo sapiens
agggaaagcuuccuccu

SEQ ID NO: 1652847 - RNA, 12 nt, Homo sapiens
agggaacauauu

SEQ ID NO: 1652848 - RNA, 23 nt, Homo sapiens
agggaagaacuauugugcucaga

SEQ ID NO: 1652849 - RNA, 15 nt, Homo sapiens
agggaaggggacaag

SEQ ID NO: 1652850 - RNA, 20 nt, Homo sapiens
agggaauggcacagcccaaa

SEQ ID NO: 1652851 - RNA, 15 nt, Homo sapiens
agggaauuucuucaa

SEQ ID NO: 1652852 - RNA, 13 nt, Homo sapiens
agggagggggaag

SEQ ID NO: 1652853 - RNA, 19 nt, Homo sapiens
agggauuuuagucacacgu

SEQ ID NO: 1652854 - RNA, 17 nt, Homo sapiens
agggcagggauacaaag

SEQ ID NO: 1652855 - RNA, 14 nt, Homo sapiens
agggccuggaagac

SEQ ID NO: 1652856 - RNA, 14 nt, Homo sapiens
agggcuagaaccua

SEQ ID NO: 1652857 - RNA, 17 nt, Homo sapiens
agggcuagaaccuggag

SEQ ID NO: 1652858 - RNA, 23 nt, Homo sapiens
agggcuggaaucuggagagcuag

SEQ ID NO: 1652859 - RNA, 16 nt, Homo sapiens
agggcuuccuaaaaau

SEQ ID NO: 1652860 - RNA, 19 nt, Homo sapiens
aggggagucaccagccaga

SEQ ID NO: 1652861 - RNA, 20 nt, Homo sapiens
aggggcaggcacagcacagg

SEQ ID NO: 1652862 - RNA, 13 nt, Homo sapiens
aggggugggacac

SEQ ID NO: 1652863 - RNA, 20 nt, Homo sapiens
aggguaucaggugcugccau

SEQ ID NO: 1652864 - RNA, 12 nt, Homo sapiens
agggugagacac

SEQ ID NO: 1652865 - RNA, 21 nt, Homo sapiens
aggguucaccaggucagggag

SEQ ID NO: 1652866 - RNA, 22 nt, Homo sapiens
aggguucaccaggucagggaga

SEQ ID NO: 1652867 - RNA, 19 nt, Homo sapiens
aggguugggcuggugucac

SEQ ID NO: 1652868 - RNA, 19 nt, Homo sapiens
agguaaaagcaucacauga

SEQ ID NO: 1652869 - RNA, 18 nt, Homo sapiens
agguaaggaauaccuguc

SEQ ID NO: 1652870 - RNA, 16 nt, Homo sapiens
agguccuggugguauu

SEQ ID NO: 1652871 - RNA, 21 nt, Homo sapiens
aggucuuuuacauacagugau

SEQ ID NO: 1652872 - RNA, 21 nt, Homo sapiens
aggugacaugugaaaccuuuu

SEQ ID NO: 1652873 - RNA, 18 nt, Homo sapiens
aggugagaucacacugaa

SEQ ID NO: 1652874 - RNA, 18 nt, Homo sapiens
agguggaacaagcacaga

SEQ ID NO: 1652875 - RNA, 12 nt, Homo sapiens
agguuagggcau

SEQ ID NO: 1652876 - RNA, 22 nt, Homo sapiens
agguucuucagaagucacacau

SEQ ID NO: 1652877 - RNA, 22 nt, Homo sapiens
agguuguagacguuguguaaug

SEQ ID NO: 1652878 - RNA, 15 nt, Homo sapiens
agguuugccagcauu

SEQ ID NO: 1652879 - RNA, 16 nt, Homo sapiens
agguuuuuggucugac

SEQ ID NO: 1652880 - RNA, 12 nt, Homo sapiens
aguaaacugugc

SEQ ID NO: 1652881 - RNA, 17 nt, Homo sapiens
aguaagcaaagacuuuc

SEQ ID NO: 1652882 - RNA, 17 nt, Homo sapiens
aguaauuauuuucuucc

SEQ ID NO: 1652883 - RNA, 23 nt, Homo sapiens
aguacaccccaacagcacccucu

SEQ ID NO: 1652884 - RNA, 14 nt, Homo sapiens
aguagagacagggu

SEQ ID NO: 1652885 - RNA, 16 nt, Homo sapiens
aguagagacaggguuu

SEQ ID NO: 1652886 - RNA, 21 nt, Homo sapiens
aguagcaacccugugauacua

SEQ ID NO: 1652887 - RNA, 22 nt, Homo sapiens
aguaguaaauuuugugaugaau

SEQ ID NO: 1652888 - RNA, 12 nt, Homo sapiens
aguauugugcau

SEQ ID NO: 1652889 - RNA, 23 nt, Homo sapiens
agucaaggacugguaaaauacau

SEQ ID NO: 1652890 - RNA, 22 nt, Homo sapiens
agucaauccaagagucugauga

SEQ ID NO: 1652891 - RNA, 20 nt, Homo sapiens
agucacuggucuguuugcau

SEQ ID NO: 1652892 - RNA, 19 nt, Homo sapiens
agucacuucaccaucaaca

SEQ ID NO: 1652893 - RNA, 19 nt, Homo sapiens
agucagcaacagagcaaaa

SEQ ID NO: 1652894 - RNA, 13 nt, Homo sapiens
agucaugccaagc

SEQ ID NO: 1652895 - RNA, 20 nt, Homo sapiens
agucaugcguuuaaucacau

SEQ ID NO: 1652896 - RNA, 18 nt, Homo sapiens
agucauuugaggaucuca

SEQ ID NO: 1652897 - RNA, 19 nt, Homo sapiens
agucauuugaggaucucac

SEQ ID NO: 1652898 - RNA, 14 nt, Homo sapiens
aguccauauuucaa

SEQ ID NO: 1652899 - RNA, 23 nt, Homo sapiens
agucgaggacagggaggugaccc

SEQ ID NO: 1652900 - RNA, 11 nt, Homo sapiens
agucuauggcc

SEQ ID NO: 1652901 - RNA, 16 nt, Homo sapiens
agucucacuguugccc

SEQ ID NO: 1652902 - RNA, 16 nt, Homo sapiens
agucuccccuauguaa

SEQ ID NO: 1652903 - RNA, 18 nt, Homo sapiens
agucucucucugccaugg

SEQ ID NO: 1652904 - RNA, 16 nt, Homo sapiens
agucugcuucauuucc

SEQ ID NO: 1652905 - RNA, 18 nt, Homo sapiens
agucugcuucauuuccuc

SEQ ID NO: 1652906 - RNA, 21 nt, Homo sapiens
agucuggcaaacaugugcaac

SEQ ID NO: 1652907 - RNA, 13 nt, Homo sapiens
agucuucuauuua

SEQ ID NO: 1652908 - RNA, 20 nt, Homo sapiens
agugaaagcaucacuuggga

SEQ ID NO: 1652909 - RNA, 16 nt, Homo sapiens
agugagccgagaucac

SEQ ID NO: 1652910 - RNA, 22 nt, Homo sapiens
agugauccuccugccucagucu

SEQ ID NO: 1652911 - RNA, 17 nt, Homo sapiens
agugauucucaugccuc

SEQ ID NO: 1652912 - RNA, 12 nt, Homo sapiens
agugauuuccac

SEQ ID NO: 1652913 - RNA, 21 nt, Homo sapiens
auucccacagcacuaauucaa

SEQ ID NO: 1652914 - RNA, 18 nt, Homo sapiens
auucccauuuccugucau

SEQ ID NO: 1652915 - RNA, 14 nt, Homo sapiens
auuccgcaccaaua

SEQ ID NO: 1652916 - RNA, 17 nt, Homo sapiens
auuccuacuugcaguac

SEQ ID NO: 1652917 - RNA, 15 nt, Homo sapiens
auuccuuugcauauu

SEQ ID NO: 1652918 - RNA, 13 nt, Homo sapiens
auucuaaacagau

SEQ ID NO: 1652919 - RNA, 18 nt, Homo sapiens
auucuaauugucagugau

SEQ ID NO: 1652920 - RNA, 13 nt, Homo sapiens
auucuacacacag

SEQ ID NO: 1652921 - RNA, 14 nt, Homo sapiens
auucuacacauauc

SEQ ID NO: 1652922 - RNA, 17 nt, Homo sapiens
auucuacguaucugcua

SEQ ID NO: 1652923 - RNA, 19 nt, Homo sapiens
auucuauuacgugcaauac

SEQ ID NO: 1652924 - RNA, 13 nt, Homo sapiens
auucucaccuaaa

SEQ ID NO: 1652925 - RNA, 18 nt, Homo sapiens
auucucaggccaucauca

SEQ ID NO: 1652926 - RNA, 22 nt, Homo sapiens
auucucaggccaucaucagugg

SEQ ID NO: 1652927 - RNA, 17 nt, Homo sapiens
auucucauuugucacac

SEQ ID NO: 1652928 - RNA, 17 nt, Homo sapiens
auucucccuuucacuaa

SEQ ID NO: 1652929 - RNA, 18 nt, Homo sapiens
auucucugagcugugcag

SEQ ID NO: 1652930 - RNA, 22 nt, Homo sapiens
auucuuccucaaagcauuugca

SEQ ID NO: 1652931 - RNA, 12 nt, Homo sapiens
auucuucuguac

SEQ ID NO: 1652932 - RNA, 22 nt, Homo sapiens
auucuuugaauuucccagucuc

SEQ ID NO: 1652933 - RNA, 16 nt, Homo sapiens
auugaaaugauuucac

SEQ ID NO: 1652934 - RNA, 18 nt, Homo sapiens
auugaaguuuuggcaauu

SEQ ID NO: 1652935 - RNA, 23 nt, Homo sapiens
auugaauuacggaaaaugccugu

SEQ ID NO: 1652936 - RNA, 17 nt, Homo sapiens
auugaauuauuuuguua

SEQ ID NO: 1652937 - RNA, 17 nt, Homo sapiens
auugaggaaauauuaau

SEQ ID NO: 1652938 - RNA, 18 nt, Homo sapiens
auugauuucaacagaauc

SEQ ID NO: 1652939 - RNA, 18 nt, Homo sapiens
auugcaauagaaauccaa

SEQ ID NO: 1652940 - RNA, 15 nt, Homo sapiens
auugcagacugugua

SEQ ID NO: 1652941 - RNA, 22 nt, Homo sapiens
auugcauaauagauaaaaaccu

SEQ ID NO: 1652942 - RNA, 20 nt, Homo sapiens
auugccuuuagugaucacag

SEQ ID NO: 1652943 - RNA, 17 nt, Homo sapiens
auuggcucacacugaga

SEQ ID NO: 1652944 - RNA, 16 nt, Homo sapiens
auugguguuuuaucuc

SEQ ID NO: 1652945 - RNA, 20 nt, Homo sapiens
auuguaguccuguaauggaa

SEQ ID NO: 1652946 - RNA, 16 nt, Homo sapiens
auuguaucuguuuaga

SEQ ID NO: 1652947 - RNA, 15 nt, Homo sapiens
auuguguuaaaucag

SEQ ID NO: 1652948 - RNA, 20 nt, Homo sapiens
auuguuauauuacuugccua

SEQ ID NO: 1652949 - RNA, 17 nt, Homo sapiens
auuguucugggugauuu

SEQ ID NO: 1652950 - RNA, 13 nt, Homo sapiens
auuuaaagcacau

SEQ ID NO: 1652951 - RNA, 14 nt, Homo sapiens
auuuaaaguauucu

SEQ ID NO: 1652952 - RNA, 13 nt, Homo sapiens
auuuaagccuuau

SEQ ID NO: 1652953 - RNA, 12 nt, Homo sapiens
auuuaauaacau

SEQ ID NO: 1652954 - RNA, 17 nt, Homo sapiens
auuuaaugcuuccaggg

SEQ ID NO: 1652955 - RNA, 21 nt, Homo sapiens
auuuacccaacucuguacaaa

SEQ ID NO: 1652956 - RNA, 12 nt, Homo sapiens
auuuacuguggc

SEQ ID NO: 1652957 - RNA, 18 nt, Homo sapiens
auuuagagucaauuugcu

SEQ ID NO: 1652958 - RNA, 15 nt, Homo sapiens
auuuaguucucagcu

SEQ ID NO: 1652959 - RNA, 14 nt, Homo sapiens
auuuauagcuguag

SEQ ID NO: 1652960 - RNA, 21 nt, Homo sapiens
auuuauauacaagugauaaua

SEQ ID NO: 1652961 - RNA, 20 nt, Homo sapiens
auuuaugauuucaacaugga

SEQ ID NO: 1652962 - RNA, 21 nt, Homo sapiens
auuuauugaaaugauuucaca

SEQ ID NO: 1652963 - RNA, 17 nt, Homo sapiens
auuucagugcugcugaa

SEQ ID NO: 1652964 - RNA, 23 nt, Homo sapiens
auuuccacuaagaacaccugcau

SEQ ID NO: 1652965 - RNA, 17 nt, Homo sapiens
auuuccagccagggcug

SEQ ID NO: 1652966 - RNA, 18 nt, Homo sapiens
auuuccccaaagacuuau

SEQ ID NO: 1652967 - RNA, 14 nt, Homo sapiens
auuuccccaaugac

SEQ ID NO: 1652968 - RNA, 16 nt, Homo sapiens
auuucgagcauaagaa

SEQ ID NO: 1652969 - RNA, 19 nt, Homo sapiens
auuucuccuccaugggaga

SEQ ID NO: 1652970 - RNA, 14 nt, Homo sapiens
auuucuucacucaa

SEQ ID NO: 1652971 - RNA, 19 nt, Homo sapiens
auuucuucacucaaucucu

SEQ ID NO: 1652972 - RNA, 21 nt, Homo sapiens
auuugauacauuuuuguacua

SEQ ID NO: 1652973 - RNA, 15 nt, Homo sapiens
auuugcaagacauag

SEQ ID NO: 1652974 - RNA, 17 nt, Homo sapiens
auuugcaauauggauuu

SEQ ID NO: 1652975 - RNA, 23 nt, Homo sapiens
auuugcauugaggaaauauuaau

SEQ ID NO: 1652976 - RNA, 17 nt, Homo sapiens
auuugccaauuuacuuu

SEQ ID NO: 1652977 - RNA, 18 nt, Homo sapiens
auuuggaaaauaaaucaa

SEQ ID NO: 1652978 - RNA, 20 nt, Homo sapiens
auuuggagaugucucugugu

SEQ ID NO: 1652979 - RNA, 16 nt, Homo sapiens
auuuggcaaugccauc

SEQ ID NO: 1652980 - RNA, 15 nt, Homo sapiens
auuugggcagacccu

SEQ ID NO: 1652981 - RNA, 17 nt, Homo sapiens
auuugguuaugauggaa

SEQ ID NO: 1652982 - RNA, 17 nt, Homo sapiens
auuugguuuguuaauuc

SEQ ID NO: 1652983 - RNA, 14 nt, Homo sapiens
auuuguaacuuuag

SEQ ID NO: 1652984 - RNA, 17 nt, Homo sapiens
auuugucaacaaaguca

SEQ ID NO: 1652985 - RNA, 19 nt, Homo sapiens
auuuguuaaaaagacuguu

SEQ ID NO: 1652986 - RNA, 21 nt, Homo sapiens
auuuuaaugaagaaaguggaa

SEQ ID NO: 1652987 - RNA, 13 nt, Homo sapiens
auuuuagaaucag

SEQ ID NO: 1652988 - RNA, 19 nt, Homo sapiens
auuuuagaaucaguguguu

SEQ ID NO: 1652989 - RNA, 17 nt, Homo sapiens
auuuuauaccaaagcca

SEQ ID NO: 1652990 - RNA, 18 nt, Homo sapiens
auuuuauaccaaagccaa

SEQ ID NO: 1652991 - RNA, 14 nt, Homo sapiens
auuuuauagcuacu

SEQ ID NO: 1652992 - RNA, 18 nt, Homo sapiens
auuuuccaaugcacaguu

SEQ ID NO: 1652993 - RNA, 12 nt, Homo sapiens
auuuucuuccaa

SEQ ID NO: 1652994 - RNA, 15 nt, Homo sapiens
auuuugauccaagcu

SEQ ID NO: 1652995 - RNA, 17 nt, Homo sapiens
auuuugcacugaggaua

SEQ ID NO: 1652996 - RNA, 19 nt, Homo sapiens
auuuugccacugccuuuca

SEQ ID NO: 1652997 - RNA, 17 nt, Homo sapiens
auuuuggcaagcucuau

SEQ ID NO: 1652998 - RNA, 20 nt, Homo sapiens
auuuugggguacccacugcu

SEQ ID NO: 1652999 - RNA, 20 nt, Homo sapiens
auuuuguguucaguacaauu

SEQ ID NO: 1653000 - RNA, 19 nt, Homo sapiens
auuuuguuauugacuaaca

SEQ ID NO: 1653001 - RNA, 15 nt, Homo sapiens
auuuuuaugugcaau

SEQ ID NO: 1653002 - RNA, 16 nt, Homo sapiens
auuuuuaugugcaaua

SEQ ID NO: 1653003 - RNA, 21 nt, Homo sapiens
auuuuugaaaauccugaauaa

SEQ ID NO: 1653004 - RNA, 13 nt, Homo sapiens
auuuuugaauaca

SEQ ID NO: 1653005 - RNA, 19 nt, Homo sapiens
auuuuuguagagccagggu

SEQ ID NO: 1653006 - RNA, 13 nt, Homo sapiens
auuuuugugcaca

SEQ ID NO: 1653007 - RNA, 16 nt, Homo sapiens
auuuuuuggugcuaau

SEQ ID NO: 1653008 - RNA, 15 nt, Homo sapiens
auuuuuuugagacag

SEQ ID NO: 1653009 - RNA, 18 nt, Homo sapiens
auuuuuuugagacagagu

SEQ ID NO: 1653010 - RNA, 23 nt, Homo sapiens
caaaaagauuuuagcuacaucua

SEQ ID NO: 1653011 - RNA, 15 nt, Homo sapiens
caaaaauaguuaaaa

SEQ ID NO: 1653012 - RNA, 17 nt, Homo sapiens
caaaacagaaaaugaag

SEQ ID NO: 1653013 - RNA, 21 nt, Homo sapiens
caaaacauauuuuacaucuga

SEQ ID NO: 1653014 - RNA, 17 nt, Homo sapiens
caaaacauuuuacuuua

SEQ ID NO: 1653015 - RNA, 13 nt, Homo sapiens
caaaaccaaauau

SEQ ID NO: 1653016 - RNA, 19 nt, Homo sapiens
caaaaccaaauauuccaga

SEQ ID NO: 1653017 - RNA, 17 nt, Homo sapiens
caaaacugaaaaucaau

SEQ ID NO: 1653018 - RNA, 19 nt, Homo sapiens
caaaagcccauucauucca

SEQ ID NO: 1653019 - RNA, 21 nt, Homo sapiens
caaaagcccauucauuccauu

SEQ ID NO: 1653020 - RNA, 16 nt, Homo sapiens
caaaagcucauccauu

SEQ ID NO: 1653021 - RNA, 15 nt, Homo sapiens
caaaaggacucucag

SEQ ID NO: 1653022 - RNA, 15 nt, Homo sapiens
caaaagggcuuccua

SEQ ID NO: 1653023 - RNA, 22 nt, Homo sapiens
caucaggaguuccagugcugca

SEQ ID NO: 1653024 - RNA, 17 nt, Homo sapiens
caucaucaguggagcca

SEQ ID NO: 1653025 - RNA, 19 nt, Homo sapiens
caucaucuccugccuuccu

SEQ ID NO: 1653026 - RNA, 14 nt, Homo sapiens
caucaugucuggcu

SEQ ID NO: 1653027 - RNA, 16 nt, Homo sapiens
cauccagguucagcuu

SEQ ID NO: 1653028 - RNA, 24 nt, Homo sapiens
cauccauguuccgagaagaacaga

SEQ ID NO: 1653029 - RNA, 15 nt, Homo sapiens
cauccccuagaaauc

SEQ ID NO: 1653030 - RNA, 18 nt, Homo sapiens
caucccgucgacguagaa

SEQ ID NO: 1653031 - RNA, 20 nt, Homo sapiens
cauccuacaagacacaguga

SEQ ID NO: 1653032 - RNA, 16 nt, Homo sapiens
cauccucaaacacugc

SEQ ID NO: 1653033 - RNA, 22 nt, Homo sapiens
caucuaaccucaucuucuucac

SEQ ID NO: 1653034 - RNA, 15 nt, Homo sapiens
caucucuacugaaaa

SEQ ID NO: 1653035 - RNA, 17 nt, Homo sapiens
caucucuggaugccuga

SEQ ID NO: 1653036 - RNA, 15 nt, Homo sapiens
caucugcgugacaau

SEQ ID NO: 1653037 - RNA, 13 nt, Homo sapiens
caucuuccaggug

SEQ ID NO: 1653038 - RNA, 18 nt, Homo sapiens
caucuugaucaaccaaaa

SEQ ID NO: 1653039 - RNA, 21 nt, Homo sapiens
caugaacuuguaaaggaauuu

SEQ ID NO: 1653040 - RNA, 23 nt, Homo sapiens
caugacccuuguggcacagaugc

SEQ ID NO: 1653041 - RNA, 15 nt, Homo sapiens
caugagacuauguaa

SEQ ID NO: 1653042 - RNA, 18 nt, Homo sapiens
caugcacccucauacaca

SEQ ID NO: 1653043 - RNA, 17 nt, Homo sapiens
caugcaggucuccauga

SEQ ID NO: 1653044 - RNA, 18 nt, Homo sapiens
caugccaagcacugugcu

SEQ ID NO: 1653045 - RNA, 15 nt, Homo sapiens
caugcccugccaagc

SEQ ID NO: 1653046 - RNA, 17 nt, Homo sapiens
caugccgcagacaugaa

SEQ ID NO: 1653047 - RNA, 22 nt, Homo sapiens
caugccuguaaucccagcacuu

SEQ ID NO: 1653048 - RNA, 19 nt, Homo sapiens
cauggacaaggaugaucua

SEQ ID NO: 1653049 - RNA, 17 nt, Homo sapiens
cauggagucacagccac

SEQ ID NO: 1653050 - RNA, 14 nt, Homo sapiens
cauggaguguuuga

SEQ ID NO: 1653051 - RNA, 21 nt, Homo sapiens
cauggcagaaggcaaacccau

SEQ ID NO: 1653052 - RNA, 23 nt, Homo sapiens
cauggcgaaaccccucucuacua

SEQ ID NO: 1653053 - RNA, 19 nt, Homo sapiens
cauggcuuuggcuuugcaa

SEQ ID NO: 1653054 - RNA, 17 nt, Homo sapiens
cauguaaacugugcacc

SEQ ID NO: 1653055 - RNA, 14 nt, Homo sapiens
cauguaauggacua

SEQ ID NO: 1653056 - RNA, 18 nt, Homo sapiens
cauguacuguuacugugu

SEQ ID NO: 1653057 - RNA, 16 nt, Homo sapiens
caugucuuugcugcag

SEQ ID NO: 1653058 - RNA, 19 nt, Homo sapiens
caugucuuuucuugcauga

SEQ ID NO: 1653059 - RNA, 14 nt, Homo sapiens
caugugcacaugca

SEQ ID NO: 1653060 - RNA, 14 nt, Homo sapiens
caugugcacuugaa

SEQ ID NO: 1653061 - RNA, 16 nt, Homo sapiens
cauguuagucaaggac

SEQ ID NO: 1653062 - RNA, 21 nt, Homo sapiens
cauguuggccaggcugcucuu

SEQ ID NO: 1653063 - RNA, 22 nt, Homo sapiens
cauguuuuccagcuccucaucc

SEQ ID NO: 1653064 - RNA, 22 nt, Homo sapiens
cauuaaagaugaccuacagugc

SEQ ID NO: 1653065 - RNA, 12 nt, Homo sapiens
cauuaaagccau

SEQ ID NO: 1653066 - RNA, 21 nt, Homo sapiens
cauuaaaggaaacguggcagg

SEQ ID NO: 1653067 - RNA, 14 nt, Homo sapiens
cauuaaucuaagaa

SEQ ID NO: 1653068 - RNA, 16 nt, Homo sapiens
cauuaccuugugcuaa

SEQ ID NO: 1653069 - RNA, 18 nt, Homo sapiens
cauuagcaguugcucaca

SEQ ID NO: 1653070 - RNA, 16 nt, Homo sapiens
cauuauuauuacuuuu

SEQ ID NO: 1653071 - RNA, 22 nt, Homo sapiens
cauuauucaagaaagauaucua

SEQ ID NO: 1653072 - RNA, 19 nt, Homo sapiens
cauucaggcaacgcacaaa

SEQ ID NO: 1653073 - RNA, 9 nt, Homo sapiens
cauucaguc

SEQ ID NO: 1653074 - RNA, 19 nt, Homo sapiens
cauucauuccauucuggaa

SEQ ID NO: 1653075 - RNA, 22 nt, Homo sapiens
cauuccauccuugagucaaaaa

SEQ ID NO: 1653076 - RNA, 21 nt, Homo sapiens
cauucugcucuuugauucaaa

SEQ ID NO: 1653077 - RNA, 11 nt, Homo sapiens
cauucugugac

SEQ ID NO: 1653078 - RNA, 15 nt, Homo sapiens
cauucuuuugccaau

SEQ ID NO: 1653079 - RNA, 20 nt, Homo sapiens
cauuguauuaacgcaaauau

SEQ ID NO: 1653080 - RNA, 19 nt, Homo sapiens
cauuguuucguaacacagc

SEQ ID NO: 1653081 - RNA, 14 nt, Homo sapiens
cauuuacccaacuc

SEQ ID NO: 1653082 - RNA, 12 nt, Homo sapiens
cauuuacugugg

SEQ ID NO: 1653083 - RNA, 13 nt, Homo sapiens
cauuuacuguggc

SEQ ID NO: 1653084 - RNA, 22 nt, Homo sapiens
cauuuaugucucagaccacuau

SEQ ID NO: 1653085 - RNA, 18 nt, Homo sapiens
cauuucacaaaacagccu

SEQ ID NO: 1653086 - RNA, 21 nt, Homo sapiens
cauuucacagugcccaagagu

SEQ ID NO: 1653087 - RNA, 22 nt, Homo sapiens
cauuucuauuucuccuccaugg

SEQ ID NO: 1653088 - RNA, 14 nt, Homo sapiens
cauuuucugccuau

SEQ ID NO: 1653089 - RNA, 14 nt, Homo sapiens
cauuuugaauguga

SEQ ID NO: 1653090 - RNA, 19 nt, Homo sapiens
cauuuugaaugugaucauc

SEQ ID NO: 1653091 - RNA, 20 nt, Homo sapiens
cauuuugacacaauguugca

SEQ ID NO: 1653092 - RNA, 14 nt, Homo sapiens
cauuuugguuuaaa

SEQ ID NO: 1653093 - RNA, 19 nt, Homo sapiens
ccaaaaaaauaaagcauua

SEQ ID NO: 1653094 - RNA, 11 nt, Homo sapiens
ccaaaacacag

SEQ ID NO: 1653095 - RNA, 14 nt, Homo sapiens
ccaaaacaguuaau

SEQ ID NO: 1653096 - RNA, 20 nt, Homo sapiens
ccaaaacuggaccaccagag

SEQ ID NO: 1653097 - RNA, 22 nt, Homo sapiens
ccaaaagcccauucauuccauu

SEQ ID NO: 1653098 - RNA, 19 nt, Homo sapiens
ccaaagcccaaagugguau

SEQ ID NO: 1653099 - RNA, 15 nt, Homo sapiens
ccaaauagcagcaca

SEQ ID NO: 1653100 - RNA, 15 nt, Homo sapiens
ccaaaucaucucuca

SEQ ID NO: 1653101 - RNA, 18 nt, Homo sapiens
ccaaaucugacauauuau

SEQ ID NO: 1653102 - RNA, 14 nt, Homo sapiens
ccaaauuacgugua

SEQ ID NO: 1653103 - RNA, 10 nt, Homo sapiens
ccaacagcac

SEQ ID NO: 1653104 - RNA, 12 nt, Homo sapiens
ccaacagcaccc

SEQ ID NO: 1653105 - RNA, 21 nt, Homo sapiens
ccaacagcacccucuccagau

SEQ ID NO: 1653106 - RNA, 18 nt, Homo sapiens
ccaacaugugcucaggga

SEQ ID NO: 1653107 - RNA, 23 nt, Homo sapiens
ccaaccauguucccuucuucuua

SEQ ID NO: 1653108 - RNA, 18 nt, Homo sapiens
ccaaccuggggggcagug

SEQ ID NO: 1653109 - RNA, 18 nt, Homo sapiens
ccaacgucugugccauuu

SEQ ID NO: 1653110 - RNA, 12 nt, Homo sapiens
ccaacugaccac

SEQ ID NO: 1653111 - RNA, 21 nt, Homo sapiens
ccaacuucuucagagcugaca

SEQ ID NO: 1653112 - RNA, 18 nt, Homo sapiens
ccaagaaugagaagaaug

SEQ ID NO: 1653113 - RNA, 22 nt, Homo sapiens
ccaagcaggaaaugaaaauguc

SEQ ID NO: 1653114 - RNA, 12 nt, Homo sapiens
ccaagcucugcu

SEQ ID NO: 1653115 - RNA, 20 nt, Homo sapiens
ccaaggcuauauuucuggga

SEQ ID NO: 1653116 - RNA, 20 nt, Homo sapiens
ccaaggggaauuacugaaaa

SEQ ID NO: 1653117 - RNA, 21 nt, Homo sapiens
ccaagucauuugaggaucuca

SEQ ID NO: 1653118 - RNA, 13 nt, Homo sapiens
ccaauaaagccuu

SEQ ID NO: 1653119 - RNA, 22 nt, Homo sapiens
ccaauaaagccuucaaacuccc

SEQ ID NO: 1653120 - RNA, 14 nt, Homo sapiens
ccaauauuguaauc

SEQ ID NO: 1653121 - RNA, 13 nt, Homo sapiens
ccaaucaaaauca

SEQ ID NO: 1653122 - RNA, 20 nt, Homo sapiens
ccaauucuuugaauuuccca

SEQ ID NO: 1653123 - RNA, 23 nt, Homo sapiens
ccacaccugcggcccaauccaag

SEQ ID NO: 1653124 - RNA, 21 nt, Homo sapiens
ccacagcuuauggcaucucau

SEQ ID NO: 1653125 - RNA, 20 nt, Homo sapiens
ccacagugacuccacucuga

SEQ ID NO: 1653126 - RNA, 15 nt, Homo sapiens
ccacaugccaagcac

SEQ ID NO: 1653127 - RNA, 17 nt, Homo sapiens
ccacauuccugaugcuu

SEQ ID NO: 1653128 - RNA, 17 nt, Homo sapiens
ccaccacgcccggcuaa

SEQ ID NO: 1653129 - RNA, 23 nt, Homo sapiens
ccaccaggagggaguggcagcua

SEQ ID NO: 1653130 - RNA, 15 nt, Homo sapiens
ccacccucaugcugu

SEQ ID NO: 1653131 - RNA, 18 nt, Homo sapiens
ccacccucccacugccaa

SEQ ID NO: 1653132 - RNA, 19 nt, Homo sapiens
ccaccuaccuuacagugag

SEQ ID NO: 1653133 - RNA, 19 nt, Homo sapiens
ggcccaaacucaucuugau

SEQ ID NO: 1653134 - RNA, 22 nt, Homo sapiens
ggccccagcccuacucugugua

SEQ ID NO: 1653135 - RNA, 17 nt, Homo sapiens
ggccccauuuacccaac

SEQ ID NO: 1653136 - RNA, 14 nt, Homo sapiens
ggccccucaggguc

SEQ ID NO: 1653137 - RNA, 22 nt, Homo sapiens
ggccccucuccuccguggcaca

SEQ ID NO: 1653138 - RNA, 23 nt, Homo sapiens
ggccccucuccuccguggcacau

SEQ ID NO: 1653139 - RNA, 20 nt, Homo sapiens
ggcccggccaaaauaaugca

SEQ ID NO: 1653140 - RNA, 17 nt, Homo sapiens
ggccucccacagugacu

SEQ ID NO: 1653141 - RNA, 20 nt, Homo sapiens
ggccucggacuuagcuggga

SEQ ID NO: 1653142 - RNA, 15 nt, Homo sapiens
ggccugagauuucau

SEQ ID NO: 1653143 - RNA, 18 nt, Homo sapiens
ggccugccuucucaggga

SEQ ID NO: 1653144 - RNA, 19 nt, Homo sapiens
ggccugcgugugucugugu

SEQ ID NO: 1653145 - RNA, 14 nt, Homo sapiens
ggccugugugauac

SEQ ID NO: 1653146 - RNA, 16 nt, Homo sapiens
ggcgagucugcuuucu

SEQ ID NO: 1653147 - RNA, 12 nt, Homo sapiens
ggcgcaaagggc

SEQ ID NO: 1653148 - RNA, 22 nt, Homo sapiens
ggcggaucuuuggacagaagca

SEQ ID NO: 1653149 - RNA, 14 nt, Homo sapiens
ggcuacacagggau

SEQ ID NO: 1653150 - RNA, 23 nt, Homo sapiens
ggcucagccaggugcugugacac

SEQ ID NO: 1653151 - RNA, 19 nt, Homo sapiens
ggcucagcggggacagcuc

SEQ ID NO: 1653152 - RNA, 17 nt, Homo sapiens
ggcucucccagccaggu

SEQ ID NO: 1653153 - RNA, 15 nt, Homo sapiens
ggcucuucucauuuc

SEQ ID NO: 1653154 - RNA, 16 nt, Homo sapiens
ggcugagaacacugug

SEQ ID NO: 1653155 - RNA, 20 nt, Homo sapiens
ggcuggagugcaauggcaca

SEQ ID NO: 1653156 - RNA, 15 nt, Homo sapiens
ggcuggagugcagug

SEQ ID NO: 1653157 - RNA, 19 nt, Homo sapiens
ggcugggaacucaccuggg

SEQ ID NO: 1653158 - RNA, 14 nt, Homo sapiens
ggcuucucagucuc

SEQ ID NO: 1653159 - RNA, 13 nt, Homo sapiens
ggcuugcugccaa

SEQ ID NO: 1653160 - RNA, 14 nt, Homo sapiens
ggcuuugcaaaaua

SEQ ID NO: 1653161 - RNA, 14 nt, Homo sapiens
ggcuuuuauugcca

SEQ ID NO: 1653162 - RNA, 14 nt, Homo sapiens
ggcuuuuccaaaag

SEQ ID NO: 1653163 - RNA, 19 nt, Homo sapiens
ggcuuuuccaaaagcaaac

SEQ ID NO: 1653164 - RNA, 13 nt, Homo sapiens
gggaaagcauuua

SEQ ID NO: 1653165 - RNA, 19 nt, Homo sapiens
gggacagacuaagggcgcu

SEQ ID NO: 1653166 - RNA, 20 nt, Homo sapiens
gggacagagcagaacuuuca

SEQ ID NO: 1653167 - RNA, 14 nt, Homo sapiens
gggaccacaaggaa

SEQ ID NO: 1653168 - RNA, 16 nt, Homo sapiens
gggaccugaugaccug

SEQ ID NO: 1653169 - RNA, 19 nt, Homo sapiens
gggacgcaggccccucucc

SEQ ID NO: 1653170 - RNA, 15 nt, Homo sapiens
gggagagccuuccag

SEQ ID NO: 1653171 - RNA, 16 nt, Homo sapiens
gggagccagggugaga

SEQ ID NO: 1653172 - RNA, 12 nt, Homo sapiens
gggagggugaga

SEQ ID NO: 1653173 - RNA, 20 nt, Homo sapiens
gggagugcccccaacagcac

SEQ ID NO: 1653174 - RNA, 13 nt, Homo sapiens
gggauagaggaua

SEQ ID NO: 1653175 - RNA, 12 nt, Homo sapiens
gggaugagcaug

SEQ ID NO: 1653176 - RNA, 19 nt, Homo sapiens
gggaugggaccugaugacc

SEQ ID NO: 1653177 - RNA, 17 nt, Homo sapiens
gggauguuucugucaca

SEQ ID NO: 1653178 - RNA, 11 nt, Homo sapiens
gggcagggaua

SEQ ID NO: 1653179 - RNA, 22 nt, Homo sapiens
gggccaguuggucccccuucca

SEQ ID NO: 1653180 - RNA, 22 nt, Homo sapiens
gggccuggccugagcugggaug

SEQ ID NO: 1653181 - RNA, 19 nt, Homo sapiens
gggccuguuacacaugaca

SEQ ID NO: 1653182 - RNA, 21 nt, Homo sapiens
gggcucccuucccaccucucu

SEQ ID NO: 1653183 - RNA, 14 nt, Homo sapiens
ggggaaauggugcc

SEQ ID NO: 1653184 - RNA, 12 nt, Homo sapiens
ggggacagggau

SEQ ID NO: 1653185 - RNA, 17 nt, Homo sapiens
ggggcuuuuacaccagu

SEQ ID NO: 1653186 - RNA, 22 nt, Homo sapiens
gggggcuggguaagagcacagg

SEQ ID NO: 1653187 - RNA, 20 nt, Homo sapiens
gggggcuuggcugugcccuc

SEQ ID NO: 1653188 - RNA, 20 nt, Homo sapiens
gggguuucacuguggucuca

SEQ ID NO: 1653189 - RNA, 22 nt, Homo sapiens
ggguauauuucuggguucucaa

SEQ ID NO: 1653190 - RNA, 12 nt, Homo sapiens
ggguccaagugg

SEQ ID NO: 1653191 - RNA, 22 nt, Homo sapiens
ggguccaggccuggccaugugg

SEQ ID NO: 1653192 - RNA, 20 nt, Homo sapiens
gggucucacuauguugccca

SEQ ID NO: 1653193 - RNA, 22 nt, Homo sapiens
gggugagagucuggguccaggc

SEQ ID NO: 1653194 - RNA, 19 nt, Homo sapiens
ggguucaagugauucucau

SEQ ID NO: 1653195 - RNA, 21 nt, Homo sapiens
ggguucaagugauucucaugc

SEQ ID NO: 1653196 - RNA, 13 nt, Homo sapiens
gguaguuuugcca

SEQ ID NO: 1653197 - RNA, 13 nt, Homo sapiens
gguaucaggugcu

SEQ ID NO: 1653198 - RNA, 14 nt, Homo sapiens
gguaugauauugca

SEQ ID NO: 1653199 - RNA, 13 nt, Homo sapiens
ggucaaggacaaa

SEQ ID NO: 1653200 - RNA, 17 nt, Homo sapiens
gguccgaagucuuccau

SEQ ID NO: 1653201 - RNA, 14 nt, Homo sapiens
gguccucugcagug

SEQ ID NO: 1653202 - RNA, 13 nt, Homo sapiens
ggucguucuuauc

SEQ ID NO: 1653203 - RNA, 17 nt, Homo sapiens
ggucuagggaaugagac

SEQ ID NO: 1653204 - RNA, 15 nt, Homo sapiens
ggucuugacaccagc

SEQ ID NO: 1653205 - RNA, 18 nt, Homo sapiens
ggugagagucugggucca

SEQ ID NO: 1653206 - RNA, 17 nt, Homo sapiens
ggugcaugaagguuucu

SEQ ID NO: 1653207 - RNA, 22 nt, Homo sapiens
gguggccucuccuuguggccug

SEQ ID NO: 1653208 - RNA, 20 nt, Homo sapiens
ggugggagugggcccaaugc

SEQ ID NO: 1653209 - RNA, 14 nt, Homo sapiens
gguggugucuccaa

SEQ ID NO: 1653210 - RNA, 19 nt, Homo sapiens
gguguagguugaaauucau

SEQ ID NO: 1653211 - RNA, 19 nt, Homo sapiens
ggugucuggauucccagga

SEQ ID NO: 1653212 - RNA, 13 nt, Homo sapiens
gguguugacaugu

SEQ ID NO: 1653213 - RNA, 19 nt, Homo sapiens
gguuagggaaaacauucca

SEQ ID NO: 1653214 - RNA, 16 nt, Homo sapiens
gguucacaccauucuc

SEQ ID NO: 1653215 - RNA, 12 nt, Homo sapiens
gguucugaugau

SEQ ID NO: 1653216 - RNA, 16 nt, Homo sapiens
gguugcuucaaugauu

SEQ ID NO: 1653217 - RNA, 16 nt, Homo sapiens
gguuuaggauuacuua

SEQ ID NO: 1653218 - RNA, 19 nt, Homo sapiens
gguuuucuguguuuagcua

SEQ ID NO: 1653219 - RNA, 13 nt, Homo sapiens
guaaaauacauau

SEQ ID NO: 1653220 - RNA, 16 nt, Homo sapiens
guaaacaggauuauua

SEQ ID NO: 1653221 - RNA, 23 nt, Homo sapiens
guaaacucuggaugauucuucca

SEQ ID NO: 1653222 - RNA, 21 nt, Homo sapiens
guaaacuuccaagucauucuc

SEQ ID NO: 1653223 - RNA, 18 nt, Homo sapiens
guaaagaguuaguuugag

SEQ ID NO: 1653224 - RNA, 18 nt, Homo sapiens
guaaagggcgcaaagggc

SEQ ID NO: 1653225 - RNA, 16 nt, Homo sapiens
guaaauacaugcauau

SEQ ID NO: 1653226 - RNA, 16 nt, Homo sapiens
guaacgauugacacca

SEQ ID NO: 1653227 - RNA, 17 nt, Homo sapiens
guaacucuuucugagga

SEQ ID NO: 1653228 - RNA, 15 nt, Homo sapiens
guaaggaauaccugu

SEQ ID NO: 1653229 - RNA, 20 nt, Homo sapiens
guaaguagcaacccugugau

SEQ ID NO: 1653230 - RNA, 13 nt, Homo sapiens
guaauagugccaa

SEQ ID NO: 1653231 - RNA, 15 nt, Homo sapiens
guaaucccagcacuu

SEQ ID NO: 1653232 - RNA, 19 nt, Homo sapiens
guaaucccagcacuuggag

SEQ ID NO: 1653233 - RNA, 15 nt, Homo sapiens
guaaucucggcucac

SEQ ID NO: 1653234 - RNA, 22 nt, Homo sapiens
guaaugauguaggggccaagca

SEQ ID NO: 1653235 - RNA, 17 nt, Homo sapiens
guaauuauuuucuuccu

SEQ ID NO: 1653236 - RNA, 14 nt, Homo sapiens
guaauucaguuauu

SEQ ID NO: 1653237 - RNA, 13 nt, Homo sapiens
guaauucucaggc

SEQ ID NO: 1653238 - RNA, 22 nt, Homo sapiens
guacaagguauguacaguucau

SEQ ID NO: 1653239 - RNA, 17 nt, Homo sapiens
guacauguuaaacuuac

SEQ ID NO: 1653240 - RNA, 20 nt, Homo sapiens
guacauugggcacauaucuc

SEQ ID NO: 1653241 - RNA, 21 nt, Homo sapiens
guaccuucaaacuagggccaa

SEQ ID NO: 1653242 - RNA, 21 nt, Homo sapiens
guacuaauacagacuauguca

SEQ ID NO: 1653243 - RNA, 22 nt, Homo sapiens
uagcacugcacacucaguucug

SEQ ID NO: 1653244 - RNA, 14 nt, Homo sapiens
uagcagcacagcug

SEQ ID NO: 1653245 - RNA, 18 nt, Homo sapiens
uagcagggaaacagcuaa

SEQ ID NO: 1653246 - RNA, 18 nt, Homo sapiens
uagcauacgguaugauau

SEQ ID NO: 1653247 - RNA, 20 nt, Homo sapiens
uagcauaguaccucugcuau

SEQ ID NO: 1653248 - RNA, 21 nt, Homo sapiens
uagcauaguaccucugcuauu

SEQ ID NO: 1653249 - RNA, 18 nt, Homo sapiens
uagcauuugucaacaaag

SEQ ID NO: 1653250 - RNA, 19 nt, Homo sapiens
uagccuuguguucugagua

SEQ ID NO: 1653251 - RNA, 19 nt, Homo sapiens
uagcggggaggggguuauc

SEQ ID NO: 1653252 - RNA, 20 nt, Homo sapiens
uagcuggaacuacaaggaag

SEQ ID NO: 1653253 - RNA, 15 nt, Homo sapiens
uagcugggacuacag

SEQ ID NO: 1653254 - RNA, 17 nt, Homo sapiens
uagcugggacuacaggu

SEQ ID NO: 1653255 - RNA, 15 nt, Homo sapiens
uagcugugucagaau

SEQ ID NO: 1653256 - RNA, 19 nt, Homo sapiens
uagcugugugaacguguau

SEQ ID NO: 1653257 - RNA, 15 nt, Homo sapiens
uagcuuggaaacugg

SEQ ID NO: 1653258 - RNA, 15 nt, Homo sapiens
uaggaagacuuugga

SEQ ID NO: 1653259 - RNA, 17 nt, Homo sapiens
uaggaaucauucuguaa

SEQ ID NO: 1653260 - RNA, 15 nt, Homo sapiens
uaggcaggacaugcu

SEQ ID NO: 1653261 - RNA, 19 nt, Homo sapiens
uaggcgcuggggcucagcu

SEQ ID NO: 1653262 - RNA, 17 nt, Homo sapiens
uaggguguguguucacc

SEQ ID NO: 1653263 - RNA, 16 nt, Homo sapiens
uaggugauccacucgc

SEQ ID NO: 1653264 - RNA, 13 nt, Homo sapiens
uaguaaacugugc

SEQ ID NO: 1653265 - RNA, 13 nt, Homo sapiens
uaguaauucucag

SEQ ID NO: 1653266 - RNA, 12 nt, Homo sapiens
uaguacacacuu

SEQ ID NO: 1653267 - RNA, 16 nt, Homo sapiens
uaguaccucugcuauu

SEQ ID NO: 1653268 - RNA, 19 nt, Homo sapiens
uaguagauguggccuuuga

SEQ ID NO: 1653269 - RNA, 13 nt, Homo sapiens
uaguauacauugu

SEQ ID NO: 1653270 - RNA, 15 nt, Homo sapiens
uaguauacauugucu

SEQ ID NO: 1653271 - RNA, 17 nt, Homo sapiens
uagugaaucacguaaag

SEQ ID NO: 1653272 - RNA, 22 nt, Homo sapiens
uagugaaucacguaaagcuaga

SEQ ID NO: 1653273 - RNA, 23 nt, Homo sapiens
uagugauuuccacagugacucca

SEQ ID NO: 1653274 - RNA, 16 nt, Homo sapiens
uaguggggucagggcu

SEQ ID NO: 1653275 - RNA, 13 nt, Homo sapiens
uaguggucuuugu

SEQ ID NO: 1653276 - RNA, 14 nt, Homo sapiens
uaguggugacugug

SEQ ID NO: 1653277 - RNA, 19 nt, Homo sapiens
uaguguuggaaaaugugca

SEQ ID NO: 1653278 - RNA, 22 nt, Homo sapiens
uaguguuggaaaaugugcaaua

SEQ ID NO: 1653279 - RNA, 13 nt, Homo sapiens
uaguuagcuuucu

SEQ ID NO: 1653280 - RNA, 19 nt, Homo sapiens
uaguucaaucuggauucau

SEQ ID NO: 1653281 - RNA, 15 nt, Homo sapiens
uauaaaccaaucuua

SEQ ID NO: 1653282 - RNA, 23 nt, Homo sapiens
uauaaacuauaaccucuccuuca

SEQ ID NO: 1653283 - RNA, 21 nt, Homo sapiens
uauaagaagcuuucaguauua

SEQ ID NO: 1653284 - RNA, 13 nt, Homo sapiens
uauaagagauuca

SEQ ID NO: 1653285 - RNA, 19 nt, Homo sapiens
uauaaucaaaaucaaugca

SEQ ID NO: 1653286 - RNA, 15 nt, Homo sapiens
uauacaagugauaau

SEQ ID NO: 1653287 - RNA, 16 nt, Homo sapiens
uauacauugucucuaa

SEQ ID NO: 1653288 - RNA, 17 nt, Homo sapiens
uauagaauggaacucaa

SEQ ID NO: 1653289 - RNA, 17 nt, Homo sapiens
uauagcuacuaauuuua

SEQ ID NO: 1653290 - RNA, 13 nt, Homo sapiens
uauagguguuugc

SEQ ID NO: 1653291 - RNA, 21 nt, Homo sapiens
uauagugucuugggaauuuuc

SEQ ID NO: 1653292 - RNA, 22 nt, Homo sapiens
uauauagcucuacacaacaugu

SEQ ID NO: 1653293 - RNA, 20 nt, Homo sapiens
uauauauuuuugugcacauu

SEQ ID NO: 1653294 - RNA, 16 nt, Homo sapiens
uauaugagacuuucaa

SEQ ID NO: 1653295 - RNA, 14 nt, Homo sapiens
uauauuacuugccu

SEQ ID NO: 1653296 - RNA, 12 nt, Homo sapiens
uauauucacuuu

SEQ ID NO: 1653297 - RNA, 15 nt, Homo sapiens
uauauuugugugagg

SEQ ID NO: 1653298 - RNA, 23 nt, Homo sapiens
uaucaaaaagguuucugcacauu

SEQ ID NO: 1653299 - RNA, 14 nt, Homo sapiens
uaucaaaauugcaa

SEQ ID NO: 1653300 - RNA, 23 nt, Homo sapiens
uaucacuaaaaauuuuuacaaaa

SEQ ID NO: 1653301 - RNA, 21 nt, Homo sapiens
uauccaacaugugcucaggga

SEQ ID NO: 1653302 - RNA, 21 nt, Homo sapiens
uaucuacccagucauguacug

SEQ ID NO: 1653303 - RNA, 15 nt, Homo sapiens
uaucuccucuugggc

SEQ ID NO: 1653304 - RNA, 14 nt, Homo sapiens
uaucugcuacuuug

SEQ ID NO: 1653305 - RNA, 11 nt, Homo sapiens
uaucugcuaug

SEQ ID NO: 1653306 - RNA, 14 nt, Homo sapiens
uaucuucacuuuua

SEQ ID NO: 1653307 - RNA, 15 nt, Homo sapiens
uaucuucuccaggau

SEQ ID NO: 1653308 - RNA, 23 nt, Homo sapiens
uaucuuugagcgcccacuagacc

SEQ ID NO: 1653309 - RNA, 13 nt, Homo sapiens
uaucuuugauucu

SEQ ID NO: 1653310 - RNA, 18 nt, Homo sapiens
uaugaucaauaaaggaca

SEQ ID NO: 1653311 - RNA, 16 nt, Homo sapiens
uaugcggucuagggaa

SEQ ID NO: 1653312 - RNA, 21 nt, Homo sapiens
uaugcuauuuauuaaguauuu

SEQ ID NO: 1653313 - RNA, 14 nt, Homo sapiens
uaugcucuaaacau

SEQ ID NO: 1653314 - RNA, 19 nt, Homo sapiens
uaugcuguaaccaaauuau

SEQ ID NO: 1653315 - RNA, 23 nt, Homo sapiens
uauggauucagaauauacuaaau

SEQ ID NO: 1653316 - RNA, 18 nt, Homo sapiens
uauggcacccaugcaccu

SEQ ID NO: 1653317 - RNA, 19 nt, Homo sapiens
uauggcagugucuuuccac

SEQ ID NO: 1653318 - RNA, 22 nt, Homo sapiens
uauggcaucucauugaggacaa

SEQ ID NO: 1653319 - RNA, 18 nt, Homo sapiens
uauggugucauaggcucu

SEQ ID NO: 1653320 - RNA, 20 nt, Homo sapiens
uaugucacccaaugcauauc

SEQ ID NO: 1653321 - RNA, 10 nt, Homo sapiens
uaugugcaau

SEQ ID NO: 1653322 - RNA, 20 nt, Homo sapiens
uauguuagagaauuuccuua

SEQ ID NO: 1653323 - RNA, 12 nt, Homo sapiens
uauguugcccag

SEQ ID NO: 1653324 - RNA, 18 nt, Homo sapiens
uauguuuggaauauucca

SEQ ID NO: 1653325 - RNA, 21 nt, Homo sapiens
uauuaauuuuccaaugcacag

SEQ ID NO: 1653326 - RNA, 18 nt, Homo sapiens
uauuacaaauccaaugaa

SEQ ID NO: 1653327 - RNA, 14 nt, Homo sapiens
uauuacgugcaaua

SEQ ID NO: 1653328 - RNA, 20 nt, Homo sapiens
uauuacugggacugugcuca

SEQ ID NO: 1653329 - RNA, 14 nt, Homo sapiens
uauuagaauuucau

SEQ ID NO: 1653330 - RNA, 20 nt, Homo sapiens
uauuauuccagaucugcagu

SEQ ID NO: 1653331 - RNA, 18 nt, Homo sapiens
uauucaagaaagauaucu

SEQ ID NO: 1653332 - RNA, 19 nt, Homo sapiens
uauucaagaaagauaucua

SEQ ID NO: 1653333 - RNA, 20 nt, Homo sapiens
uauucaccuuuucuucaaaa

SEQ ID NO: 1653334 - RNA, 14 nt, Homo sapiens
uauucaucagggag

SEQ ID NO: 1653335 - RNA, 14 nt, Homo sapiens
uauucccagccuug

SEQ ID NO: 1653336 - RNA, 17 nt, Homo sapiens
uauucuccauccuccca

SEQ ID NO: 1653337 - RNA, 22 nt, Homo sapiens
uauucuguuggccagugugaca

SEQ ID NO: 1653338 - RNA, 17 nt, Homo sapiens
uauugcugaaugacuac

SEQ ID NO: 1653339 - RNA, 21 nt, Homo sapiens
uauuggacaguaaaauccaca

SEQ ID NO: 1653340 - RNA, 23 nt, Homo sapiens
uauuguacauugggcacauaucu

SEQ ID NO: 1653341 - RNA, 23 nt, Homo sapiens
uauuuaagccuuauaaaccaauc

SEQ ID NO: 1653342 - RNA, 20 nt, Homo sapiens
uauuucaauacuuacauauc

SEQ ID NO: 1653343 - RNA, 18 nt, Homo sapiens
uauuuccuauacgugugu

SEQ ID NO: 1653344 - RNA, 18 nt, Homo sapiens
uauuucuguauuuggcua

SEQ ID NO: 1653345 - RNA, 14 nt, Homo sapiens
uauuugaugcuaca

SEQ ID NO: 1653346 - RNA, 14 nt, Homo sapiens
uauuugcauaacaa

SEQ ID NO: 1653347 - RNA, 22 nt, Homo sapiens
uauuugugaugacaacuggaau

SEQ ID NO: 1653348 - RNA, 15 nt, Homo sapiens
uauuuguuugugcau

SEQ ID NO: 1653349 - RNA, 20 nt, Homo sapiens
uauuuugugaagacugggaa

SEQ ID NO: 1653350 - RNA, 16 nt, Homo sapiens
uauuuuuagacagagu

SEQ ID NO: 1653351 - RNA, 14 nt, Homo sapiens
uauuuuuaugugca

SEQ ID NO: 1653352 - RNA, 14 nt, Homo sapiens
uauuuuugugcaca

SEQ ID NO: 1653353 - RNA, 21 nt, Homo sapiens
ugacaggcagcagagacuugg

SEQ ID NO: 1653354 - RNA, 16 nt, Homo sapiens
ugacaggcagugccau

SEQ ID NO: 1653355 - RNA, 17 nt, Homo sapiens
ugacauuauaugcacua

SEQ ID NO: 1653356 - RNA, 14 nt, Homo sapiens
ugacauuguuggcc

SEQ ID NO: 1653357 - RNA, 19 nt, Homo sapiens
ugaccaauauuguacaguu

SEQ ID NO: 1653358 - RNA, 22 nt, Homo sapiens
ugaccacauagaacaugugucu

SEQ ID NO: 1653359 - RNA, 17 nt, Homo sapiens
ugaccaguuuaaccuga

SEQ ID NO: 1653360 - RNA, 21 nt, Homo sapiens
ugaccaguuuaaccugaugca

SEQ ID NO: 1653361 - RNA, 12 nt, Homo sapiens
ugaccaugugau

SEQ ID NO: 1653362 - RNA, 20 nt, Homo sapiens
ugaccauucuuuugccaaug

SEQ ID NO: 1653363 - RNA, 14 nt, Homo sapiens
ugaccccuuuucag

SEQ ID NO: 1653364 - RNA, 18 nt, Homo sapiens
ugacccuguaaaauggag

SEQ ID NO: 1653365 - RNA, 23 nt, Homo sapiens
ugaccuaaauuauuuacugcaaa

SEQ ID NO: 1653366 - RNA, 14 nt, Homo sapiens
ugaccucaggugau

SEQ ID NO: 1653367 - RNA, 16 nt, Homo sapiens
ugacgcagccugagaa

SEQ ID NO: 1653368 - RNA, 22 nt, Homo sapiens
ugacuauuauauuuccaagaaa

SEQ ID NO: 1653369 - RNA, 22 nt, Homo sapiens
ugacucaagacuuccagagccu

SEQ ID NO: 1653370 - RNA, 15 nt, Homo sapiens
ugacuccucaggguu

SEQ ID NO: 1653371 - RNA, 15 nt, Homo sapiens
ugacuccuucugcca

SEQ ID NO: 1653372 - RNA, 14 nt, Homo sapiens
ugacucuccagaaa

SEQ ID NO: 1653373 - RNA, 20 nt, Homo sapiens
ugacucuccagaaagcucau

SEQ ID NO: 1653374 - RNA, 22 nt, Homo sapiens
ugacugcuaguuuauauagaaa

SEQ ID NO: 1653375 - RNA, 19 nt, Homo sapiens
ugacuugacagaacacugu

SEQ ID NO: 1653376 - RNA, 16 nt, Homo sapiens
ugacuuguacucugaa

SEQ ID NO: 1653377 - RNA, 21 nt, Homo sapiens
ugacuuuucugacccauguuc

SEQ ID NO: 1653378 - RNA, 18 nt, Homo sapiens
ugacuuuugaagaacaaa

SEQ ID NO: 1653379 - RNA, 13 nt, Homo sapiens
ugagaacacugug

SEQ ID NO: 1653380 - RNA, 15 nt, Homo sapiens
ugagaacacugugaa

SEQ ID NO: 1653381 - RNA, 14 nt, Homo sapiens
ugagaagggcucag

SEQ ID NO: 1653382 - RNA, 16 nt, Homo sapiens
ugagacacugcacaga

SEQ ID NO: 1653383 - RNA, 20 nt, Homo sapiens
ugagacaguuucuuagcuuu

SEQ ID NO: 1653384 - RNA, 13 nt, Homo sapiens
ugagacuaugcaa

SEQ ID NO: 1653385 - RNA, 16 nt, Homo sapiens
ugagacuccaccucaa

SEQ ID NO: 1653386 - RNA, 14 nt, Homo sapiens
ugagacuugaauca

SEQ ID NO: 1653387 - RNA, 20 nt, Homo sapiens
ugagagcccuucaugcauuu

SEQ ID NO: 1653388 - RNA, 19 nt, Homo sapiens
ugagagcucuaguauuucc

SEQ ID NO: 1653389 - RNA, 23 nt, Homo sapiens
ugagaggagagagacuccagcug

SEQ ID NO: 1653390 - RNA, 19 nt, Homo sapiens
ugagcagacugcaaaucug

SEQ ID NO: 1653391 - RNA, 17 nt, Homo sapiens
ugagcagcaacuguguc

SEQ ID NO: 1653392 - RNA, 15 nt, Homo sapiens
ugagcaucccaggau

SEQ ID NO: 1653393 - RNA, 14 nt, Homo sapiens
ugagccaucauuuc

SEQ ID NO: 1653394 - RNA, 13 nt, Homo sapiens
ugagcuguuaucu

SEQ ID NO: 1653395 - RNA, 21 nt, Homo sapiens
ugaggaauuucuguucuucca

SEQ ID NO: 1653396 - RNA, 23 nt, Homo sapiens
ugaggacacauugccccaugaga

SEQ ID NO: 1653397 - RNA, 15 nt, Homo sapiens
ugaggcugggcuccc

SEQ ID NO: 1653398 - RNA, 17 nt, Homo sapiens
ugagggcaccaccaaga

SEQ ID NO: 1653399 - RNA, 13 nt, Homo sapiens
ugaguacccaaaa

SEQ ID NO: 1653400 - RNA, 16 nt, Homo sapiens
ugaguacuacaguccu

SEQ ID NO: 1653401 - RNA, 18 nt, Homo sapiens
ugaguagagcuuguaaua

SEQ ID NO: 1653402 - RNA, 14 nt, Homo sapiens
ugagucugugccac

SEQ ID NO: 1653403 - RNA, 17 nt, Homo sapiens
ugaguugcaccauucuu

SEQ ID NO: 1653404 - RNA, 15 nt, Homo sapiens
ugaguuuguacaguc

SEQ ID NO: 1653405 - RNA, 13 nt, Homo sapiens
ugaguuuuuagug

SEQ ID NO: 1653406 - RNA, 14 nt, Homo sapiens
ugauaaacuuugaa

SEQ ID NO: 1653407 - RNA, 17 nt, Homo sapiens
ugauaacuuuaagauca

SEQ ID NO: 1653408 - RNA, 19 nt, Homo sapiens
ugauacauuuuuguacuaa

SEQ ID NO: 1653409 - RNA, 12 nt, Homo sapiens
ugauacguguau

SEQ ID NO: 1653410 - RNA, 12 nt, Homo sapiens
ugauagugcuuc

SEQ ID NO: 1653411 - RNA, 18 nt, Homo sapiens
ugauauugaccaugugau

SEQ ID NO: 1653412 - RNA, 15 nt, Homo sapiens
ugaucacugagccau

SEQ ID NO: 1653413 - RNA, 20 nt, Homo sapiens
ugaucagcgccgcaccagcc

SEQ ID NO: 1653414 - RNA, 17 nt, Homo sapiens
ugauccacccaccucag

SEQ ID NO: 1653415 - RNA, 12 nt, Homo sapiens
ugauccugugaa

SEQ ID NO: 1653416 - RNA, 17 nt, Homo sapiens
ugauccuuccaccucag

SEQ ID NO: 1653417 - RNA, 14 nt, Homo sapiens
ugaucuuugcagac

SEQ ID NO: 1653418 - RNA, 16 nt, Homo sapiens
ugaugcuaccaugccu

SEQ ID NO: 1653419 - RNA, 13 nt, Homo sapiens
ugauucacagugu

SEQ ID NO: 1653420 - RNA, 15 nt, Homo sapiens
ugauucacaguguga

SEQ ID NO: 1653421 - RNA, 16 nt, Homo sapiens
ugauucagacagcugc

SEQ ID NO: 1653422 - RNA, 17 nt, Homo sapiens
ugauucucaugccucag

SEQ ID NO: 1653423 - RNA, 20 nt, Homo sapiens
ugauugugggauacuauuua

SEQ ID NO: 1653424 - RNA, 21 nt, Homo sapiens
ugauuugcugggcaguuuuuc

SEQ ID NO: 1653425 - RNA, 19 nt, Homo sapiens
ugauuuuauaugcuauuua

SEQ ID NO: 1653426 - RNA, 16 nt, Homo sapiens
ugcaaaaguacaaggg

SEQ ID NO: 1653427 - RNA, 20 nt, Homo sapiens
ugcaaaguauaaaauuauau

SEQ ID NO: 1653428 - RNA, 17 nt, Homo sapiens
ugcaaagucaugcaaag

SEQ ID NO: 1653429 - RNA, 14 nt, Homo sapiens
ugcaacaacaugua

SEQ ID NO: 1653430 - RNA, 23 nt, Homo sapiens
ugcaacaugccagccacugugau

SEQ ID NO: 1653431 - RNA, 18 nt, Homo sapiens
ugcaacuugugaacucca

SEQ ID NO: 1653432 - RNA, 21 nt, Homo sapiens
ugcaagacauagaauaguguu

SEQ ID NO: 1653433 - RNA, 13 nt, Homo sapiens
ugcacacaccaga

SEQ ID NO: 1653434 - RNA, 22 nt, Homo sapiens
ugcacacagcacgggggccaag

SEQ ID NO: 1653435 - RNA, 14 nt, Homo sapiens
ugcacacucaguuc

SEQ ID NO: 1653436 - RNA, 17 nt, Homo sapiens
ugcacaugcacgugugu

SEQ ID NO: 1653437 - RNA, 16 nt, Homo sapiens
ugcaccaagcaggaaa

SEQ ID NO: 1653438 - RNA, 20 nt, Homo sapiens
ugcaccacuuuuaacagaac

SEQ ID NO: 1653439 - RNA, 16 nt, Homo sapiens
ugcacccccuccugcu

SEQ ID NO: 1653440 - RNA, 21 nt, Homo sapiens
ugcaccuucugacgcagccug

SEQ ID NO: 1653441 - RNA, 23 nt, Homo sapiens
ugcacucugugcccaugggcacu

SEQ ID NO: 1653442 - RNA, 24 nt, Homo sapiens
ugcacuuuguucuggcucuuccag

SEQ ID NO: 1653443 - RNA, 20 nt, Homo sapiens
ugcagacucuacagaggcca

SEQ ID NO: 1653444 - RNA, 23 nt, Homo sapiens
ugcagccucacaguccuuaccag

SEQ ID NO: 1653445 - RNA, 19 nt, Homo sapiens
ugcagccuccucugugacu

SEQ ID NO: 1653446 - RNA, 19 nt, Homo sapiens
ugcagccugccccugugau

SEQ ID NO: 1653447 - RNA, 17 nt, Homo sapiens
ugcaggcaucacagcua

SEQ ID NO: 1653448 - RNA, 17 nt, Homo sapiens
ugcagugccccuagcuu

SEQ ID NO: 1653449 - RNA, 21 nt, Homo sapiens
ugcauaaacaauccaaaugca

SEQ ID NO: 1653450 - RNA, 19 nt, Homo sapiens
ugcauagagccacguaugu

SEQ ID NO: 1653451 - RNA, 16 nt, Homo sapiens
ugcaugcagcaucuaa

SEQ ID NO: 1653452 - RNA, 16 nt, Homo sapiens
ugcauggaguguuuga

SEQ ID NO: 1653453 - RNA, 19 nt, Homo sapiens
ugcauguaauggacuaugc

SEQ ID NO: 1653454 - RNA, 22 nt, Homo sapiens
ugcauguuuuccagcuccucau

SEQ ID NO: 1653455 - RNA, 12 nt, Homo sapiens
ugcauuaucuau

SEQ ID NO: 1653456 - RNA, 13 nt, Homo sapiens
ugcauucuucccu

SEQ ID NO: 1653457 - RNA, 13 nt, Homo sapiens
ugcauuuauagca

SEQ ID NO: 1653458 - RNA, 17 nt, Homo sapiens
ugccaagcucaggacca

SEQ ID NO: 1653459 - RNA, 23 nt, Homo sapiens
ugccaagucauuugaggaucuca

SEQ ID NO: 1653460 - RNA, 21 nt, Homo sapiens
ugccagcauuuagacccugca

SEQ ID NO: 1653461 - RNA, 16 nt, Homo sapiens
ugccaggcacacugag

SEQ ID NO: 1653462 - RNA, 15 nt, Homo sapiens
ugccaguaggcucaa

SEQ ID NO: 1653463 - RNA, 13 nt, Homo sapiens
uuauucagaauuu

SEQ ID NO: 1653464 - RNA, 21 nt, Homo sapiens
uuauuccaaaauaacaaaaua

SEQ ID NO: 1653465 - RNA, 16 nt, Homo sapiens
uuauuggauauuugau

SEQ ID NO: 1653466 - RNA, 22 nt, Homo sapiens
uuauuugugaugacaacuggaa

SEQ ID NO: 1653467 - RNA, 15 nt, Homo sapiens
uuauuuuaucugcua

SEQ ID NO: 1653468 - RNA, 17 nt, Homo sapiens
uuauuuuuuuacuuccu

SEQ ID NO: 1653469 - RNA, 19 nt, Homo sapiens
uucaaaauguucuauuuaa

SEQ ID NO: 1653470 - RNA, 12 nt, Homo sapiens
uucaaaauugcu

SEQ ID NO: 1653471 - RNA, 22 nt, Homo sapiens
uucaaagcacuguuucucucac

SEQ ID NO: 1653472 - RNA, 15 nt, Homo sapiens
uucaaauguucucca

SEQ ID NO: 1653473 - RNA, 21 nt, Homo sapiens
uucaagaaagauaucuaugac

SEQ ID NO: 1653474 - RNA, 22 nt, Homo sapiens
uucaagaaagauaucuaugacu

SEQ ID NO: 1653475 - RNA, 23 nt, Homo sapiens
uucaauaaaagaauaguugccaa

SEQ ID NO: 1653476 - RNA, 13 nt, Homo sapiens
uucaauacccaaa

SEQ ID NO: 1653477 - RNA, 16 nt, Homo sapiens
uucacagaugugugau

SEQ ID NO: 1653478 - RNA, 17 nt, Homo sapiens
uucacagaugugugauu

SEQ ID NO: 1653479 - RNA, 23 nt, Homo sapiens
uucacggaaagugccugcaaaaa

SEQ ID NO: 1653480 - RNA, 12 nt, Homo sapiens
uucacuacauua

SEQ ID NO: 1653481 - RNA, 16 nt, Homo sapiens
uucacucaacaaacau

SEQ ID NO: 1653482 - RNA, 12 nt, Homo sapiens
uucacucccacc

SEQ ID NO: 1653483 - RNA, 18 nt, Homo sapiens
uucacuccccuaucccau

SEQ ID NO: 1653484 - RNA, 15 nt, Homo sapiens
uucacuguggucuca

SEQ ID NO: 1653485 - RNA, 16 nt, Homo sapiens
uucacuuauugacuau

SEQ ID NO: 1653486 - RNA, 11 nt, Homo sapiens
uucacuuuaaa

SEQ ID NO: 1653487 - RNA, 15 nt, Homo sapiens
uucacuuuugacaaa

SEQ ID NO: 1653488 - RNA, 21 nt, Homo sapiens
uucagagacuccugcaggcag

SEQ ID NO: 1653489 - RNA, 14 nt, Homo sapiens
uucagccaggagau

SEQ ID NO: 1653490 - RNA, 23 nt, Homo sapiens
uucagcgcugucaggauugcgag

SEQ ID NO: 1653491 - RNA, 20 nt, Homo sapiens
uucagcuccagcucaccagc

SEQ ID NO: 1653492 - RNA, 19 nt, Homo sapiens
uucaggaagauaaaaauca

SEQ ID NO: 1653493 - RNA, 15 nt, Homo sapiens
uucagugagaaucug

SEQ ID NO: 1653494 - RNA, 17 nt, Homo sapiens
uucagugagaaucugcu

SEQ ID NO: 1653495 - RNA, 16 nt, Homo sapiens
uucaguucuuacacau

SEQ ID NO: 1653496 - RNA, 12 nt, Homo sapiens
uucauacuguaa

SEQ ID NO: 1653497 - RNA, 18 nt, Homo sapiens
uucauccaggacugagau

SEQ ID NO: 1653498 - RNA, 14 nt, Homo sapiens
uucaucucccaaag

SEQ ID NO: 1653499 - RNA, 15 nt, Homo sapiens
uucaugaguauucau

SEQ ID NO: 1653500 - RNA, 19 nt, Homo sapiens
uucauucacucaacaaaca

SEQ ID NO: 1653501 - RNA, 10 nt, Homo sapiens
uucauuccau

SEQ ID NO: 1653502 - RNA, 15 nt, Homo sapiens
uucauuuacuguggc

SEQ ID NO: 1653503 - RNA, 13 nt, Homo sapiens
uuccaaaggccau

SEQ ID NO: 1653504 - RNA, 19 nt, Homo sapiens
uuccaaucauacaaauacu

SEQ ID NO: 1653505 - RNA, 19 nt, Homo sapiens
uuccaaugcacaguugcca

SEQ ID NO: 1653506 - RNA, 23 nt, Homo sapiens
uuccacuaagaacaccugcauuc

SEQ ID NO: 1653507 - RNA, 18 nt, Homo sapiens
uuccacucaaauguccug

SEQ ID NO: 1653508 - RNA, 14 nt, Homo sapiens
uuccagugaggcuc

SEQ ID NO: 1653509 - RNA, 18 nt, Homo sapiens
uuccagugcugcaugcga

SEQ ID NO: 1653510 - RNA, 16 nt, Homo sapiens
uuccaugaaaaugcaa

SEQ ID NO: 1653511 - RNA, 20 nt, Homo sapiens
uuccaugccgcagacaugaa

SEQ ID NO: 1653512 - RNA, 13 nt, Homo sapiens
uuccauucuggaa

SEQ ID NO: 1653513 - RNA, 20 nt, Homo sapiens
uucccacucugaagauccca

SEQ ID NO: 1653514 - RNA, 16 nt, Homo sapiens
uuccccuuccacugag

SEQ ID NO: 1653515 - RNA, 20 nt, Homo sapiens
uucccuauuuugccaguggg

SEQ ID NO: 1653516 - RNA, 13 nt, Homo sapiens
uuccgcaccaaua

SEQ ID NO: 1653517 - RNA, 15 nt, Homo sapiens
uuccuauuucuggaa

SEQ ID NO: 1653518 - RNA, 16 nt, Homo sapiens
uuccucaaagcauuug

SEQ ID NO: 1653519 - RNA, 22 nt, Homo sapiens
uuccucucaugucuuugcugca

SEQ ID NO: 1653520 - RNA, 20 nt, Homo sapiens
uuccugcagguaaacaguuc

SEQ ID NO: 1653521 - RNA, 15 nt, Homo sapiens
uuccugcgccccaga

SEQ ID NO: 1653522 - RNA, 21 nt, Homo sapiens
uucgccaccuggguuccagca

SEQ ID NO: 1653523 - RNA, 21 nt, Homo sapiens
uucuaaagacuuguauagcau

SEQ ID NO: 1653524 - RNA, 13 nt, Homo sapiens
uucuaaucaaagc

SEQ ID NO: 1653525 - RNA, 15 nt, Homo sapiens
uucucaaaguuaaaa

SEQ ID NO: 1653526 - RNA, 15 nt, Homo sapiens
uucucaaaguuuuga

SEQ ID NO: 1653527 - RNA, 17 nt, Homo sapiens
uucucagccacaaccaa

SEQ ID NO: 1653528 - RNA, 20 nt, Homo sapiens
uucucauuucuguagccuga

SEQ ID NO: 1653529 - RNA, 15 nt, Homo sapiens
uucucauuugucaca

SEQ ID NO: 1653530 - RNA, 13 nt, Homo sapiens
uucuccuccaugg

SEQ ID NO: 1653531 - RNA, 14 nt, Homo sapiens
uucuccuucagccc

SEQ ID NO: 1653532 - RNA, 23 nt, Homo sapiens
uucucuaguucaaguucaccaga

SEQ ID NO: 1653533 - RNA, 13 nt, Homo sapiens
uucucucaucucu

SEQ ID NO: 1653534 - RNA, 19 nt, Homo sapiens
uucugacgcagccugagaa

SEQ ID NO: 1653535 - RNA, 16 nt, Homo sapiens
uucugaucugaugcaa

SEQ ID NO: 1653536 - RNA, 23 nt, Homo sapiens
uucugccuaucuucuuucacaua

SEQ ID NO: 1653537 - RNA, 19 nt, Homo sapiens
uucugccuugaaauaccug

SEQ ID NO: 1653538 - RNA, 16 nt, Homo sapiens
uucuguaaaacagguu

SEQ ID NO: 1653539 - RNA, 13 nt, Homo sapiens
uucuuaacuauuc

SEQ ID NO: 1653540 - RNA, 17 nt, Homo sapiens
uucuuaaucuuuucaca

SEQ ID NO: 1653541 - RNA, 13 nt, Homo sapiens
uucuuacaaacau

SEQ ID NO: 1653542 - RNA, 16 nt, Homo sapiens
uucuuacuaaaaagua

SEQ ID NO: 1653543 - RNA, 21 nt, Homo sapiens
uucuuagagauuaaaccaauu

SEQ ID NO: 1653544 - RNA, 17 nt, Homo sapiens
uucuuagucacaaaaua

SEQ ID NO: 1653545 - RNA, 17 nt, Homo sapiens
uucuucacucaaucucu

SEQ ID NO: 1653546 - RNA, 19 nt, Homo sapiens
uucuucaggguccugagau

SEQ ID NO: 1653547 - RNA, 17 nt, Homo sapiens
uucuuccagcagaacag

SEQ ID NO: 1653548 - RNA, 13 nt, Homo sapiens
uucuucguguaua

SEQ ID NO: 1653549 - RNA, 14 nt, Homo sapiens
uucuucuucuccua

SEQ ID NO: 1653550 - RNA, 15 nt, Homo sapiens
uucuuguaaggcaua

SEQ ID NO: 1653551 - RNA, 19 nt, Homo sapiens
uucuuguggcaagagcagc

SEQ ID NO: 1653552 - RNA, 20 nt, Homo sapiens
uucuuuaacccucacuggga

SEQ ID NO: 1653553 - RNA, 22 nt, Homo sapiens
uucuuuaacccucacugggacu

SEQ ID NO: 1653554 - RNA, 12 nt, Homo sapiens
uucuuuccugag

SEQ ID NO: 1653555 - RNA, 20 nt, Homo sapiens
uugaaaaaaaacaguggauc

SEQ ID NO: 1653556 - RNA, 22 nt, Homo sapiens
uugaaaaacuaaaacagaaaaa

SEQ ID NO: 1653557 - RNA, 14 nt, Homo sapiens
uugaaaagcuauua

SEQ ID NO: 1653558 - RNA, 14 nt, Homo sapiens
uugaaaccuuugac

SEQ ID NO: 1653559 - RNA, 15 nt, Homo sapiens
uugaaagaaauggug

SEQ ID NO: 1653560 - RNA, 14 nt, Homo sapiens
uugaacuccugacc

SEQ ID NO: 1653561 - RNA, 13 nt, Homo sapiens
uugaagauucuau

SEQ ID NO: 1653562 - RNA, 14 nt, Homo sapiens
uugaauaagaucca

SEQ ID NO: 1653563 - RNA, 16 nt, Homo sapiens
uugaauauaaacacua

SEQ ID NO: 1653564 - RNA, 21 nt, Homo sapiens
uugaauugugucccccauaaa

SEQ ID NO: 1653565 - RNA, 16 nt, Homo sapiens
uugaauuuauggaauc

SEQ ID NO: 1653566 - RNA, 17 nt, Homo sapiens
uugacaaauguaaacau

SEQ ID NO: 1653567 - RNA, 16 nt, Homo sapiens
uugacagaacacuguc

SEQ ID NO: 1653568 - RNA, 18 nt, Homo sapiens
uugaccugaacucugcaa

SEQ ID NO: 1653569 - RNA, 17 nt, Homo sapiens
uugacuugacagaacac

SEQ ID NO: 1653570 - RNA, 11 nt, Homo sapiens
uugagacagaa

SEQ ID NO: 1653571 - RNA, 18 nt, Homo sapiens
uugaugccaguaggcuca

SEQ ID NO: 1653572 - RNA, 15 nt, Homo sapiens
uugauucauauugca

SEQ ID NO: 1653573 - RNA, 22 nt, Homo sapiens
uugauuuuuuaauuucuaugaa

SEQ ID NO: 1653574 - RNA, 19 nt, Homo sapiens
aaagaaaaugugucugcaa

SEQ ID NO: 1653575 - RNA, 18 nt, Homo sapiens
aaagaaauuguauuauca

SEQ ID NO: 1653576 - RNA, 22 nt, Homo sapiens
aaagaccuuuuccaugcacccu

SEQ ID NO: 1653577 - RNA, 14 nt, Homo sapiens
aaagacucaaaaag

SEQ ID NO: 1653578 - RNA, 19 nt, Homo sapiens
aaagaugaccuacagugcu

SEQ ID NO: 1653579 - RNA, 16 nt, Homo sapiens
aaagauuuuagcuaca

SEQ ID NO: 1653580 - RNA, 18 nt, Homo sapiens
aaagcaacagacuucuca

SEQ ID NO: 1653581 - RNA, 19 nt, Homo sapiens
aaagcagacuuuugugaac

SEQ ID NO: 1653582 - RNA, 19 nt, Homo sapiens
aaagccuccaguccaagga

SEQ ID NO: 1653583 - RNA, 17 nt, Homo sapiens
aaagccuucaaacuccc

SEQ ID NO: 1653584 - RNA, 21 nt, Homo sapiens
aaagcugugucucuguauaua

SEQ ID NO: 1653585 - RNA, 22 nt, Homo sapiens
aaagcuugcucacaucuuggca

SEQ ID NO: 1653586 - RNA, 20 nt, Homo sapiens
aaaggaggacaagacccucu

SEQ ID NO: 1653587 - RNA, 16 nt, Homo sapiens
aaagguuagauuuugu

SEQ ID NO: 1653588 - RNA, 17 nt, Homo sapiens
aaagucuaaaaccuuaa

SEQ ID NO: 1653589 - RNA, 23 nt, Homo sapiens
aaagucuagcacaguuccuugca

SEQ ID NO: 1653590 - RNA, 23 nt, Homo sapiens
aaagucugaguaagaaacuucau

SEQ ID NO: 1653591 - RNA, 17 nt, Homo sapiens
aaagugaauuguugaca

SEQ ID NO: 1653592 - RNA, 14 nt, Homo sapiens
aaaguguguauuua

SEQ ID NO: 1653593 - RNA, 15 nt, Homo sapiens
aaaguguguauuuaa

SEQ ID NO: 1653594 - RNA, 20 nt, Homo sapiens
aaaguguuugaaagcuuuau

SEQ ID NO: 1653595 - RNA, 13 nt, Homo sapiens
aaaguugccuuua

SEQ ID NO: 1653596 - RNA, 23 nt, Homo sapiens
aaaguuuccguggguucugucau

SEQ ID NO: 1653597 - RNA, 14 nt, Homo sapiens
aaauaaauggaaua

SEQ ID NO: 1653598 - RNA, 14 nt, Homo sapiens
aaauaaucaguuac

SEQ ID NO: 1653599 - RNA, 17 nt, Homo sapiens
aaauaaucuacuguaca

SEQ ID NO: 1653600 - RNA, 15 nt, Homo sapiens
aaauacaauauuuaa

SEQ ID NO: 1653601 - RNA, 22 nt, Homo sapiens
aaauacaguuugucacaugaaa

SEQ ID NO: 1653602 - RNA, 20 nt, Homo sapiens
aaauagcaacuuguguuaca

SEQ ID NO: 1653603 - RNA, 15 nt, Homo sapiens
aaauauauaugauau

SEQ ID NO: 1653604 - RNA, 14 nt, Homo sapiens
aaauauauuugaua

SEQ ID NO: 1653605 - RNA, 12 nt, Homo sapiens
aaauauucuaca

SEQ ID NO: 1653606 - RNA, 20 nt, Homo sapiens
aaauauuuuuaugugcaaua

SEQ ID NO: 1653607 - RNA, 23 nt, Homo sapiens
aaaucacacaugcuuuucuuccu

SEQ ID NO: 1653608 - RNA, 13 nt, Homo sapiens
aaaucacugucaa

SEQ ID NO: 1653609 - RNA, 14 nt, Homo sapiens
aaauccaguauuau

SEQ ID NO: 1653610 - RNA, 16 nt, Homo sapiens
aaaucccaacauuucu

SEQ ID NO: 1653611 - RNA, 12 nt, Homo sapiens
aaaucuaugaaa

SEQ ID NO: 1653612 - RNA, 23 nt, Homo sapiens
aaaucugacauauuaugccugaa

SEQ ID NO: 1653613 - RNA, 21 nt, Homo sapiens
aaaucuuuuccaggaaaaaga

SEQ ID NO: 1653614 - RNA, 14 nt, Homo sapiens
aaaugaacugcaua

SEQ ID NO: 1653615 - RNA, 11 nt, Homo sapiens
aaaugcaaaau

SEQ ID NO: 1653616 - RNA, 13 nt, Homo sapiens
aaaugcaccacuu

SEQ ID NO: 1653617 - RNA, 14 nt, Homo sapiens
aaaugcaccacuuu

SEQ ID NO: 1653618 - RNA, 15 nt, Homo sapiens
aaaugcguauuugca

SEQ ID NO: 1653619 - RNA, 14 nt, Homo sapiens
aaauggcuuaucca

SEQ ID NO: 1653620 - RNA, 18 nt, Homo sapiens
aaaugggaaaaccagacu

SEQ ID NO: 1653621 - RNA, 14 nt, Homo sapiens
aaaugucacaguaa

SEQ ID NO: 1653622 - RNA, 13 nt, Homo sapiens
aaaugugaugaau

SEQ ID NO: 1653623 - RNA, 12 nt, Homo sapiens
aaaugugcaaua

SEQ ID NO: 1653624 - RNA, 14 nt, Homo sapiens
aaaugugucugcaa

SEQ ID NO: 1653625 - RNA, 17 nt, Homo sapiens
aaauguucuauuuaaca

SEQ ID NO: 1653626 - RNA, 14 nt, Homo sapiens
aaauguuggugcaa

SEQ ID NO: 1653627 - RNA, 14 nt, Homo sapiens
aaauuaccugugga

SEQ ID NO: 1653628 - RNA, 21 nt, Homo sapiens
aaauucauuaguuguuaguga

SEQ ID NO: 1653629 - RNA, 16 nt, Homo sapiens
aaauucguuguuccca

SEQ ID NO: 1653630 - RNA, 15 nt, Homo sapiens
aaauuggauacugcu

SEQ ID NO: 1653631 - RNA, 15 nt, Homo sapiens
aaauuguauuaucaa

SEQ ID NO: 1653632 - RNA, 24 nt, Homo sapiens
aaauuuaagugcguguguagaguu

SEQ ID NO: 1653633 - RNA, 21 nt, Homo sapiens
aaauuuacugucuaagauuaa

SEQ ID NO: 1653634 - RNA, 15 nt, Homo sapiens
aaauuucagcagcug

SEQ ID NO: 1653635 - RNA, 14 nt, Homo sapiens
aaauuuguuugaca

SEQ ID NO: 1653636 - RNA, 21 nt, Homo sapiens
aaauuuuuacaaaacugccaa

SEQ ID NO: 1653637 - RNA, 20 nt, Homo sapiens
aacaaaaauuaaaauccuca

SEQ ID NO: 1653638 - RNA, 12 nt, Homo sapiens
aacaaaauggac

SEQ ID NO: 1653639 - RNA, 13 nt, Homo sapiens
aacaaaauggacu

SEQ ID NO: 1653640 - RNA, 16 nt, Homo sapiens
aacaaauguauuucaa

SEQ ID NO: 1653641 - RNA, 21 nt, Homo sapiens
aacaaccagcaucccuugacc

SEQ ID NO: 1653642 - RNA, 16 nt, Homo sapiens
aacaagcaagcuccca

SEQ ID NO: 1653643 - RNA, 11 nt, Homo sapiens
aacaagcuauu

SEQ ID NO: 1653644 - RNA, 14 nt, Homo sapiens
aacaauaacacugc

SEQ ID NO: 1653645 - RNA, 16 nt, Homo sapiens
aacaauggaaugagaa

SEQ ID NO: 1653646 - RNA, 20 nt, Homo sapiens
aacacacagauuugagcuca

SEQ ID NO: 1653647 - RNA, 21 nt, Homo sapiens
aacacacaggugcaacagacu

SEQ ID NO: 1653648 - RNA, 18 nt, Homo sapiens
aacacaucacucauuuua

SEQ ID NO: 1653649 - RNA, 16 nt, Homo sapiens
aacaccaaacucuuaa

SEQ ID NO: 1653650 - RNA, 15 nt, Homo sapiens
aacacucauuuccaa

SEQ ID NO: 1653651 - RNA, 19 nt, Homo sapiens
aacacugcaggcaucacag

SEQ ID NO: 1653652 - RNA, 22 nt, Homo sapiens
aacagaaaaauaagacccugug

SEQ ID NO: 1653653 - RNA, 17 nt, Homo sapiens
aacagaaagaaccuugc

SEQ ID NO: 1653654 - RNA, 17 nt, Homo sapiens
aacagaaauuaaucuua

SEQ ID NO: 1653655 - RNA, 23 nt, Homo sapiens
aacagacagaugaggacagagcu

SEQ ID NO: 1653656 - RNA, 12 nt, Homo sapiens
aacagacuugaa

SEQ ID NO: 1653657 - RNA, 14 nt, Homo sapiens
aacagagacugaau

SEQ ID NO: 1653658 - RNA, 13 nt, Homo sapiens
aacagauaauccc

SEQ ID NO: 1653659 - RNA, 17 nt, Homo sapiens
aacagcacccucuccag

SEQ ID NO: 1653660 - RNA, 22 nt, Homo sapiens
aacagcacccucuccagaugag

SEQ ID NO: 1653661 - RNA, 17 nt, Homo sapiens
aacagcauugaaccaag

SEQ ID NO: 1653662 - RNA, 17 nt, Homo sapiens
aacaggagaaugcacag

SEQ ID NO: 1653663 - RNA, 18 nt, Homo sapiens
aacagguguuggugacaa

SEQ ID NO: 1653664 - RNA, 18 nt, Homo sapiens
aacagguuauaacagugu

SEQ ID NO: 1653665 - RNA, 15 nt, Homo sapiens
aacaguguguuggcg

SEQ ID NO: 1653666 - RNA, 13 nt, Homo sapiens
aacaugaauuuca

SEQ ID NO: 1653667 - RNA, 17 nt, Homo sapiens
aacaugcagcucugcag

SEQ ID NO: 1653668 - RNA, 21 nt, Homo sapiens
aacaugugguuaaugccaugg

SEQ ID NO: 1653669 - RNA, 19 nt, Homo sapiens
aacauuaccuuacugugga

SEQ ID NO: 1653670 - RNA, 15 nt, Homo sapiens
aacauugcaauagaa

SEQ ID NO: 1653671 - RNA, 21 nt, Homo sapiens
aacauuuacuuuugcucccua

SEQ ID NO: 1653672 - RNA, 20 nt, Homo sapiens
aacauuucucuucagugugu

SEQ ID NO: 1653673 - RNA, 15 nt, Homo sapiens
aaccaacccauguau

SEQ ID NO: 1653674 - RNA, 16 nt, Homo sapiens
aaccacauugaagaau

SEQ ID NO: 1653675 - RNA, 14 nt, Homo sapiens
aaccacuaaugcuu

SEQ ID NO: 1653676 - RNA, 15 nt, Homo sapiens
aaccaugcccaagaa

SEQ ID NO: 1653677 - RNA, 18 nt, Homo sapiens
aaccauggcacuugaugu

SEQ ID NO: 1653678 - RNA, 17 nt, Homo sapiens
aacccaacaugacuguu

SEQ ID NO: 1653679 - RNA, 14 nt, Homo sapiens
aacccucacuggga

SEQ ID NO: 1653680 - RNA, 21 nt, Homo sapiens
aacccucacugggacuuugua

SEQ ID NO: 1653681 - RNA, 12 nt, Homo sapiens
aacccugugaua

SEQ ID NO: 1653682 - RNA, 18 nt, Homo sapiens
aacccugugauacuauua

SEQ ID NO: 1653683 - RNA, 15 nt, Homo sapiens
aaccuaauaaucuga

SEQ ID NO: 1653684 - RNA, 23 nt, Homo sapiens
aaccuacaguuuuaacuguggau

SEQ ID NO: 1653685 - RNA, 23 nt, Homo sapiens
acaucacuguccaccaccaccug

SEQ ID NO: 1653686 - RNA, 20 nt, Homo sapiens
acauccuccagauaguguag

SEQ ID NO: 1653687 - RNA, 14 nt, Homo sapiens
acauccugacuuca

SEQ ID NO: 1653688 - RNA, 19 nt, Homo sapiens
acaucuugcucugcugaca

SEQ ID NO: 1653689 - RNA, 14 nt, Homo sapiens
acauggcguccugc

SEQ ID NO: 1653690 - RNA, 15 nt, Homo sapiens
acauggcguccugcc

SEQ ID NO: 1653691 - RNA, 21 nt, Homo sapiens
acauggcuaaagaagguuuca

SEQ ID NO: 1653692 - RNA, 17 nt, Homo sapiens
acauggucuguccugac

SEQ ID NO: 1653693 - RNA, 20 nt, Homo sapiens
acauguauccuuucacacau

SEQ ID NO: 1653694 - RNA, 13 nt, Homo sapiens
acaugugcacaug

SEQ ID NO: 1653695 - RNA, 18 nt, Homo sapiens
acauuaccuuacugugga

SEQ ID NO: 1653696 - RNA, 14 nt, Homo sapiens
acauuaucuuggau

SEQ ID NO: 1653697 - RNA, 19 nt, Homo sapiens
acauuguacuuauacaccu

SEQ ID NO: 1653698 - RNA, 16 nt, Homo sapiens
acauuuauuuuucuca

SEQ ID NO: 1653699 - RNA, 22 nt, Homo sapiens
acauuuauuuuucucaugaauc

SEQ ID NO: 1653700 - RNA, 22 nt, Homo sapiens
acauuugaaaucuaugaaauau

SEQ ID NO: 1653701 - RNA, 21 nt, Homo sapiens
acauuuugccaaaauuauuaa

SEQ ID NO: 1653702 - RNA, 17 nt, Homo sapiens
accaaaucaucucucau

SEQ ID NO: 1653703 - RNA, 17 nt, Homo sapiens
accaaaucugacauauu

SEQ ID NO: 1653704 - RNA, 18 nt, Homo sapiens
accaaaucugacauauua

SEQ ID NO: 1653705 - RNA, 18 nt, Homo sapiens
accaacauacucccaucu

SEQ ID NO: 1653706 - RNA, 15 nt, Homo sapiens
accaacccauguaua

SEQ ID NO: 1653707 - RNA, 23 nt, Homo sapiens
accaagaagggcuagaaccugga

SEQ ID NO: 1653708 - RNA, 19 nt, Homo sapiens
accaagggcagaggggugc

SEQ ID NO: 1653709 - RNA, 20 nt, Homo sapiens
accaauauuguacaguuuuu

SEQ ID NO: 1653710 - RNA, 16 nt, Homo sapiens
accaccaccugcucac

SEQ ID NO: 1653711 - RNA, 17 nt, Homo sapiens
accaccuaccuuacagu

SEQ ID NO: 1653712 - RNA, 17 nt, Homo sapiens
accacugauaaaaccau

SEQ ID NO: 1653713 - RNA, 11 nt, Homo sapiens
accacuuugaa

SEQ ID NO: 1653714 - RNA, 18 nt, Homo sapiens
accacuuuuaacagaaca

SEQ ID NO: 1653715 - RNA, 22 nt, Homo sapiens
accacuuuuaacagaacagaca

SEQ ID NO: 1653716 - RNA, 14 nt, Homo sapiens
accagaagugaaaa

SEQ ID NO: 1653717 - RNA, 19 nt, Homo sapiens
accaguuuaaccugaugca

SEQ ID NO: 1653718 - RNA, 22 nt, Homo sapiens
accaguuuaaccugaugcaguc

SEQ ID NO: 1653719 - RNA, 20 nt, Homo sapiens
accauaaaaaggaauccacu

SEQ ID NO: 1653720 - RNA, 23 nt, Homo sapiens
accauaaucccugucuucuuucc

SEQ ID NO: 1653721 - RNA, 12 nt, Homo sapiens
accaucccugaa

SEQ ID NO: 1653722 - RNA, 14 nt, Homo sapiens
accauccuacauaa

SEQ ID NO: 1653723 - RNA, 20 nt, Homo sapiens
accaugcauuuaaaguauuc

SEQ ID NO: 1653724 - RNA, 12 nt, Homo sapiens
accauuagcaua

SEQ ID NO: 1653725 - RNA, 14 nt, Homo sapiens
acccaaaagcucag

SEQ ID NO: 1653726 - RNA, 13 nt, Homo sapiens
acccaacucugua

SEQ ID NO: 1653727 - RNA, 14 nt, Homo sapiens
acccaauuguuuca

SEQ ID NO: 1653728 - RNA, 19 nt, Homo sapiens
acccaggcuggagugcagu

SEQ ID NO: 1653729 - RNA, 12 nt, Homo sapiens
accccaacagca

SEQ ID NO: 1653730 - RNA, 16 nt, Homo sapiens
acccccacaccuggaa

SEQ ID NO: 1653731 - RNA, 20 nt, Homo sapiens
accccgagccuggcuccaaa

SEQ ID NO: 1653732 - RNA, 13 nt, Homo sapiens
accccuaacaaag

SEQ ID NO: 1653733 - RNA, 22 nt, Homo sapiens
accccucccagcugacaguccu

SEQ ID NO: 1653734 - RNA, 16 nt, Homo sapiens
accccugguucucauc

SEQ ID NO: 1653735 - RNA, 22 nt, Homo sapiens
acccggcaggcuagaaccuggc

SEQ ID NO: 1653736 - RNA, 18 nt, Homo sapiens
acccuacuuucauuccuc

SEQ ID NO: 1653737 - RNA, 12 nt, Homo sapiens
acccucaugcug

SEQ ID NO: 1653738 - RNA, 14 nt, Homo sapiens
acccucaugcugug

SEQ ID NO: 1653739 - RNA, 16 nt, Homo sapiens
acccucccacugccaa

SEQ ID NO: 1653740 - RNA, 24 nt, Homo sapiens
acccuggaaacuaccagugggcau

SEQ ID NO: 1653741 - RNA, 19 nt, Homo sapiens
acccuuggccuuuacagaa

SEQ ID NO: 1653742 - RNA, 19 nt, Homo sapiens
accgcaggauuugggcucu

SEQ ID NO: 1653743 - RNA, 13 nt, Homo sapiens
accgcugaauaug

SEQ ID NO: 1653744 - RNA, 23 nt, Homo sapiens
accgcugauucucagggucucug

SEQ ID NO: 1653745 - RNA, 21 nt, Homo sapiens
accgggcacucagaagacacu

SEQ ID NO: 1653746 - RNA, 15 nt, Homo sapiens
accgugccuggccac

SEQ ID NO: 1653747 - RNA, 21 nt, Homo sapiens
accguuuccuuucauuuacug

SEQ ID NO: 1653748 - RNA, 18 nt, Homo sapiens
accuaaacccucugugaa

SEQ ID NO: 1653749 - RNA, 17 nt, Homo sapiens
accuaacgagaaauaga

SEQ ID NO: 1653750 - RNA, 15 nt, Homo sapiens
accuacagugcugug

SEQ ID NO: 1653751 - RNA, 16 nt, Homo sapiens
accuaggccucagcug

SEQ ID NO: 1653752 - RNA, 19 nt, Homo sapiens
accucaaaggcucucacua

SEQ ID NO: 1653753 - RNA, 14 nt, Homo sapiens
accucaauauuuac

SEQ ID NO: 1653754 - RNA, 21 nt, Homo sapiens
accucagaguauggagcucag

SEQ ID NO: 1653755 - RNA, 18 nt, Homo sapiens
accuccuucucugucuca

SEQ ID NO: 1653756 - RNA, 17 nt, Homo sapiens
accucgcuggacucuca

SEQ ID NO: 1653757 - RNA, 19 nt, Homo sapiens
accucuaacaucagaacau

SEQ ID NO: 1653758 - RNA, 20 nt, Homo sapiens
accucuagacugguucauuc

SEQ ID NO: 1653759 - RNA, 22 nt, Homo sapiens
accucuccuucaugacagccuc

SEQ ID NO: 1653760 - RNA, 16 nt, Homo sapiens
accucugggagcucaa

SEQ ID NO: 1653761 - RNA, 19 nt, Homo sapiens
accugaaaacacugugcac

SEQ ID NO: 1653762 - RNA, 16 nt, Homo sapiens
accugaacucugcaac

SEQ ID NO: 1653763 - RNA, 19 nt, Homo sapiens
accugagcagcaacugugu

SEQ ID NO: 1653764 - RNA, 13 nt, Homo sapiens
accugaugcaguc

SEQ ID NO: 1653765 - RNA, 19 nt, Homo sapiens
accugccaggcacacugag

SEQ ID NO: 1653766 - RNA, 18 nt, Homo sapiens
accuggaauuguggggca

SEQ ID NO: 1653767 - RNA, 21 nt, Homo sapiens
accugggaggacucucuuagu

SEQ ID NO: 1653768 - RNA, 15 nt, Homo sapiens
accugggcaaagccu

SEQ ID NO: 1653769 - RNA, 23 nt, Homo sapiens
accuguggccaguacucgggaca

SEQ ID NO: 1653770 - RNA, 20 nt, Homo sapiens
accuuaguugcaugaccaca

SEQ ID NO: 1653771 - RNA, 15 nt, Homo sapiens
accuuaucaauugca

SEQ ID NO: 1653772 - RNA, 22 nt, Homo sapiens
accuucaaaauguucuauuuaa

SEQ ID NO: 1653773 - RNA, 21 nt, Homo sapiens
accuucuaggaagcuccaguu

SEQ ID NO: 1653774 - RNA, 17 nt, Homo sapiens
accuuuggaugcacuuu

SEQ ID NO: 1653775 - RNA, 17 nt, Homo sapiens
accuuuuuuaagauuuu

SEQ ID NO: 1653776 - RNA, 22 nt, Homo sapiens
acgcagacuccacacucaguag

SEQ ID NO: 1653777 - RNA, 15 nt, Homo sapiens
acgcagccugagaau

SEQ ID NO: 1653778 - RNA, 17 nt, Homo sapiens
acgcauggaaaaguuuc

SEQ ID NO: 1653779 - RNA, 11 nt, Homo sapiens
acgccacugca

SEQ ID NO: 1653780 - RNA, 20 nt, Homo sapiens
acgccagauucuuuccugag

SEQ ID NO: 1653781 - RNA, 20 nt, Homo sapiens
acgcgugcacacaccagagc

SEQ ID NO: 1653782 - RNA, 14 nt, Homo sapiens
acggacauggucug

SEQ ID NO: 1653783 - RNA, 22 nt, Homo sapiens
acggcagcugcuggcugugaca

SEQ ID NO: 1653784 - RNA, 23 nt, Homo sapiens
acgugauguggagggcacauucc

SEQ ID NO: 1653785 - RNA, 18 nt, Homo sapiens
acgugauuuugcuguaga

SEQ ID NO: 1653786 - RNA, 15 nt, Homo sapiens
acguugagcaucuau

SEQ ID NO: 1653787 - RNA, 23 nt, Homo sapiens
acguuguuuugguuguacuuugg

SEQ ID NO: 1653788 - RNA, 20 nt, Homo sapiens
acguuucucauuaaaaucca

SEQ ID NO: 1653789 - RNA, 16 nt, Homo sapiens
acuaaaaaaaagauga

SEQ ID NO: 1653790 - RNA, 12 nt, Homo sapiens
acuaaaaauacu

SEQ ID NO: 1653791 - RNA, 17 nt, Homo sapiens
acuaaaacacacaggug

SEQ ID NO: 1653792 - RNA, 18 nt, Homo sapiens
acuaaaaguugcauuuua

SEQ ID NO: 1653793 - RNA, 14 nt, Homo sapiens
acuaaaauguucua

SEQ ID NO: 1653794 - RNA, 24 nt, Homo sapiens
caguaaguagcaacccugugauac

SEQ ID NO: 1653795 - RNA, 20 nt, Homo sapiens
caguagggaugaguacccaa

SEQ ID NO: 1653796 - RNA, 17 nt, Homo sapiens
caguaguggugacugug

SEQ ID NO: 1653797 - RNA, 16 nt, Homo sapiens
caguaguuagcuuucu

SEQ ID NO: 1653798 - RNA, 17 nt, Homo sapiens
cagucuuccauuugcaa

SEQ ID NO: 1653799 - RNA, 22 nt, Homo sapiens
cagucuuccauuugcaagggaa

SEQ ID NO: 1653800 - RNA, 21 nt, Homo sapiens
cagugaaugauucaguguuaa

SEQ ID NO: 1653801 - RNA, 18 nt, Homo sapiens
cagugcaaauacucuggu

SEQ ID NO: 1653802 - RNA, 18 nt, Homo sapiens
cagugccauuuguuaaaa

SEQ ID NO: 1653803 - RNA, 18 nt, Homo sapiens
caguggaacagucuuccc

SEQ ID NO: 1653804 - RNA, 21 nt, Homo sapiens
caguggcacgaucucaacuca

SEQ ID NO: 1653805 - RNA, 15 nt, Homo sapiens
caguguccaaagcag

SEQ ID NO: 1653806 - RNA, 12 nt, Homo sapiens
cagugugacaag

SEQ ID NO: 1653807 - RNA, 15 nt, Homo sapiens
cagugugacuccuca

SEQ ID NO: 1653808 - RNA, 19 nt, Homo sapiens
caguguguuucugaucuga

SEQ ID NO: 1653809 - RNA, 20 nt, Homo sapiens
caguguuaaaugugaugaau

SEQ ID NO: 1653810 - RNA, 17 nt, Homo sapiens
caguucugcucuaagaa

SEQ ID NO: 1653811 - RNA, 20 nt, Homo sapiens
caguugccacauuuaguccu

SEQ ID NO: 1653812 - RNA, 19 nt, Homo sapiens
caguuucccacucugaaga

SEQ ID NO: 1653813 - RNA, 22 nt, Homo sapiens
caguuucccacucugaagaucc

SEQ ID NO: 1653814 - RNA, 19 nt, Homo sapiens
caguuucuaucauucugcu

SEQ ID NO: 1653815 - RNA, 21 nt, Homo sapiens
caguuugauuguuguuuauaa

SEQ ID NO: 1653816 - RNA, 18 nt, Homo sapiens
cauaaaaaggaauccacu

SEQ ID NO: 1653817 - RNA, 19 nt, Homo sapiens
cauaaccgcugauucucag

SEQ ID NO: 1653818 - RNA, 15 nt, Homo sapiens
cauaagaauucuguu

SEQ ID NO: 1653819 - RNA, 15 nt, Homo sapiens
cauaauuuaaaaaua

SEQ ID NO: 1653820 - RNA, 15 nt, Homo sapiens
cauacacagaaacca

SEQ ID NO: 1653821 - RNA, 11 nt, Homo sapiens
cauacagugau

SEQ ID NO: 1653822 - RNA, 19 nt, Homo sapiens
cauaccacccaaugcugau

SEQ ID NO: 1653823 - RNA, 19 nt, Homo sapiens
cauacgucuuucacaguuu

SEQ ID NO: 1653824 - RNA, 13 nt, Homo sapiens
cauagagacuuug

SEQ ID NO: 1653825 - RNA, 19 nt, Homo sapiens
cauagauguuaugcaaaaa

SEQ ID NO: 1653826 - RNA, 16 nt, Homo sapiens
cauagguuuaauaauu

SEQ ID NO: 1653827 - RNA, 11 nt, Homo sapiens
cauaucugacu

SEQ ID NO: 1653828 - RNA, 16 nt, Homo sapiens
cauaugagagcucuag

SEQ ID NO: 1653829 - RNA, 21 nt, Homo sapiens
cauauucaggaagcucagggc

SEQ ID NO: 1653830 - RNA, 13 nt, Homo sapiens
cauauuuugccac

SEQ ID NO: 1653831 - RNA, 17 nt, Homo sapiens
caucaccuccaccauac

SEQ ID NO: 1653832 - RNA, 22 nt, Homo sapiens
caucacuggcucucuaauucca

SEQ ID NO: 1653833 - RNA, 17 nt, Homo sapiens
caucaucuccugccuuc

SEQ ID NO: 1653834 - RNA, 22 nt, Homo sapiens
caucauuguauuaacgcaaaua

SEQ ID NO: 1653835 - RNA, 16 nt, Homo sapiens
cauccaauucuuugaa

SEQ ID NO: 1653836 - RNA, 22 nt, Homo sapiens
cauccaauucuuugaauuuccc

SEQ ID NO: 1653837 - RNA, 16 nt, Homo sapiens
cauccaucaucaugug

SEQ ID NO: 1653838 - RNA, 19 nt, Homo sapiens
cauccccuagaaauccugg

SEQ ID NO: 1653839 - RNA, 15 nt, Homo sapiens
caucccuaaugcugc

SEQ ID NO: 1653840 - RNA, 21 nt, Homo sapiens
cauccuggcccaucaguguac

SEQ ID NO: 1653841 - RNA, 20 nt, Homo sapiens
caucuaaauugaucauucau

SEQ ID NO: 1653842 - RNA, 9 nt, Homo sapiens
caucucuag

SEQ ID NO: 1653843 - RNA, 14 nt, Homo sapiens
caucucucuuuaau

SEQ ID NO: 1653844 - RNA, 18 nt, Homo sapiens
caucuggaaccaucagaa

SEQ ID NO: 1653845 - RNA, 19 nt, Homo sapiens
caucuuaagagaugccuca

SEQ ID NO: 1653846 - RNA, 17 nt, Homo sapiens
caucuugaucaaccaaa

SEQ ID NO: 1653847 - RNA, 22 nt, Homo sapiens
caucuuuucuguugccccaucc

SEQ ID NO: 1653848 - RNA, 15 nt, Homo sapiens
caugaccacauagaa

SEQ ID NO: 1653849 - RNA, 18 nt, Homo sapiens
caugaucaucacaaucau

SEQ ID NO: 1653850 - RNA, 19 nt, Homo sapiens
caugcauaaauaugcagug

SEQ ID NO: 1653851 - RNA, 14 nt, Homo sapiens
caugccaagcacug

SEQ ID NO: 1653852 - RNA, 14 nt, Homo sapiens
caugccaagcauuu

SEQ ID NO: 1653853 - RNA, 17 nt, Homo sapiens
caugccacuaugagcuu

SEQ ID NO: 1653854 - RNA, 17 nt, Homo sapiens
caugcccuguaccugug

SEQ ID NO: 1653855 - RNA, 15 nt, Homo sapiens
caugccugcaccugc

SEQ ID NO: 1653856 - RNA, 19 nt, Homo sapiens
caugcucuuagaaaauuca

SEQ ID NO: 1653857 - RNA, 20 nt, Homo sapiens
caugcugaagccaaagccaa

SEQ ID NO: 1653858 - RNA, 22 nt, Homo sapiens
caugcugugugacucaaaccaa

SEQ ID NO: 1653859 - RNA, 23 nt, Homo sapiens
cauggaaauucccuucaucugga

SEQ ID NO: 1653860 - RNA, 14 nt, Homo sapiens
cauggccaccacca

SEQ ID NO: 1653861 - RNA, 15 nt, Homo sapiens
cauggcucucugcag

SEQ ID NO: 1653862 - RNA, 16 nt, Homo sapiens
cauggcuggugccuga

SEQ ID NO: 1653863 - RNA, 19 nt, Homo sapiens
caugggagacacugaugua

SEQ ID NO: 1653864 - RNA, 17 nt, Homo sapiens
caugguggguccauggg

SEQ ID NO: 1653865 - RNA, 13 nt, Homo sapiens
cauguaauggacu

SEQ ID NO: 1653866 - RNA, 22 nt, Homo sapiens
cauguauguggauacagucauu

SEQ ID NO: 1653867 - RNA, 20 nt, Homo sapiens
cauguauuagccagucauug

SEQ ID NO: 1653868 - RNA, 14 nt, Homo sapiens
cauguccaagaagc

SEQ ID NO: 1653869 - RNA, 22 nt, Homo sapiens
cauguggcccuccaguguauga

SEQ ID NO: 1653870 - RNA, 21 nt, Homo sapiens
cauguuguacauuagaccucu

SEQ ID NO: 1653871 - RNA, 14 nt, Homo sapiens
cauguuuucacuua

SEQ ID NO: 1653872 - RNA, 19 nt, Homo sapiens
cauguuuuuaaagggcuau

SEQ ID NO: 1653873 - RNA, 20 nt, Homo sapiens
cauuaaaaauguuaguauuu

SEQ ID NO: 1653874 - RNA, 20 nt, Homo sapiens
cauuacagggaaugccugag

SEQ ID NO: 1653875 - RNA, 23 nt, Homo sapiens
cauuagagcaggcguucagcuca

SEQ ID NO: 1653876 - RNA, 23 nt, Homo sapiens
cauuagcauaauuuuguguugua

SEQ ID NO: 1653877 - RNA, 16 nt, Homo sapiens
cauuagugauuccauc

SEQ ID NO: 1653878 - RNA, 23 nt, Homo sapiens
cauuaguuguuagugauggagcu

SEQ ID NO: 1653879 - RNA, 20 nt, Homo sapiens
cauuauaugcacuagcaaua

SEQ ID NO: 1653880 - RNA, 16 nt, Homo sapiens
cauuauuugauaacau

SEQ ID NO: 1653881 - RNA, 12 nt, Homo sapiens
cauucacucaua

SEQ ID NO: 1653882 - RNA, 20 nt, Homo sapiens
cauucacucauacaucuggc

SEQ ID NO: 1653883 - RNA, 12 nt, Homo sapiens
cauucauuccau

SEQ ID NO: 1653884 - RNA, 16 nt, Homo sapiens
cauucauugacuucag

SEQ ID NO: 1653885 - RNA, 21 nt, Homo sapiens
cauucccguggaacguuuuuc

SEQ ID NO: 1653886 - RNA, 17 nt, Homo sapiens
cauucugccugcccagg

SEQ ID NO: 1653887 - RNA, 21 nt, Homo sapiens
cauucuguaaagucuagcaca

SEQ ID NO: 1653888 - RNA, 17 nt, Homo sapiens
cauugaaacuacacuaa

SEQ ID NO: 1653889 - RNA, 15 nt, Homo sapiens
cauugccccaugaga

SEQ ID NO: 1653890 - RNA, 13 nt, Homo sapiens
cauugcuuucuaa

SEQ ID NO: 1653891 - RNA, 23 nt, Homo sapiens
cauuggcuauuuaaaacuuguaa

SEQ ID NO: 1653892 - RNA, 17 nt, Homo sapiens
cauugggcacauaucuc

SEQ ID NO: 1653893 - RNA, 16 nt, Homo sapiens
cauuguuucccaucac

SEQ ID NO: 1653894 - RNA, 18 nt, Homo sapiens
cauuguuucccaucacug

SEQ ID NO: 1653895 - RNA, 18 nt, Homo sapiens
cauuuacuguggcuucuu

SEQ ID NO: 1653896 - RNA, 12 nt, Homo sapiens
cauuuccaugca

SEQ ID NO: 1653897 - RNA, 15 nt, Homo sapiens
cauuuccaugcauaa

SEQ ID NO: 1653898 - RNA, 17 nt, Homo sapiens
cauuuccaugcauaaau

SEQ ID NO: 1653899 - RNA, 16 nt, Homo sapiens
cauuucucauguugaa

SEQ ID NO: 1653900 - RNA, 23 nt, Homo sapiens
cauuugaaaucuaugaaauauca

SEQ ID NO: 1653901 - RNA, 14 nt, Homo sapiens
cauuugcaauaugg

SEQ ID NO: 1653902 - RNA, 13 nt, Homo sapiens
cauuugcacuauu

SEQ ID NO: 1653903 - RNA, 22 nt, Homo sapiens
ccugcaaaaacagagguggaua

SEQ ID NO: 1653904 - RNA, 21 nt, Homo sapiens
ccugcaaccugauugugucuc

SEQ ID NO: 1653905 - RNA, 21 nt, Homo sapiens
ccugcaguuauuaacacuaac

SEQ ID NO: 1653906 - RNA, 18 nt, Homo sapiens
ccugccaggcacacugag

SEQ ID NO: 1653907 - RNA, 23 nt, Homo sapiens
ccugcccccugcaggaaggagcu

SEQ ID NO: 1653908 - RNA, 16 nt, Homo sapiens
ccugcggugcuaucuc

SEQ ID NO: 1653909 - RNA, 22 nt, Homo sapiens
ccugcucacaucugaaucuccu

SEQ ID NO: 1653910 - RNA, 15 nt, Homo sapiens
ccugcuccacagugu

SEQ ID NO: 1653911 - RNA, 14 nt, Homo sapiens
ccugcucuggauuu

SEQ ID NO: 1653912 - RNA, 17 nt, Homo sapiens
ccugcuucaauacccaa

SEQ ID NO: 1653913 - RNA, 21 nt, Homo sapiens
ccuggaaccaggcuugccugg

SEQ ID NO: 1653914 - RNA, 13 nt, Homo sapiens
ccuggaagacaga

SEQ ID NO: 1653915 - RNA, 19 nt, Homo sapiens
ccuggauuccucacuuuga

SEQ ID NO: 1653916 - RNA, 13 nt, Homo sapiens
ccuggcacagugu

SEQ ID NO: 1653917 - RNA, 16 nt, Homo sapiens
ccuggccccucagggu

SEQ ID NO: 1653918 - RNA, 17 nt, Homo sapiens
ccugggaggcagaugga

SEQ ID NO: 1653919 - RNA, 19 nt, Homo sapiens
ccuggggagucugggcaca

SEQ ID NO: 1653920 - RNA, 12 nt, Homo sapiens
ccuggugcccua

SEQ ID NO: 1653921 - RNA, 21 nt, Homo sapiens
ccuguaaaagauacugaggaa

SEQ ID NO: 1653922 - RNA, 19 nt, Homo sapiens
ccugucaagaggcaaagga

SEQ ID NO: 1653923 - RNA, 19 nt, Homo sapiens
ccugugaguacuacagucc

SEQ ID NO: 1653924 - RNA, 20 nt, Homo sapiens
ccugugaguacuacaguccu

SEQ ID NO: 1653925 - RNA, 12 nt, Homo sapiens
ccuguggugcaa

SEQ ID NO: 1653926 - RNA, 14 nt, Homo sapiens
ccuguggugcaaaa

SEQ ID NO: 1653927 - RNA, 22 nt, Homo sapiens
ccugugugauacaagagucagc

SEQ ID NO: 1653928 - RNA, 17 nt, Homo sapiens
ccuguguugugcuggga

SEQ ID NO: 1653929 - RNA, 18 nt, Homo sapiens
ccuguucugcuuuccucu

SEQ ID NO: 1653930 - RNA, 17 nt, Homo sapiens
ccuuaaacuuucaauau

SEQ ID NO: 1653931 - RNA, 12 nt, Homo sapiens
ccuuaacacuga

SEQ ID NO: 1653932 - RNA, 22 nt, Homo sapiens
ccuuacauuugaaaucuaugaa

SEQ ID NO: 1653933 - RNA, 19 nt, Homo sapiens
ccuuaucuuucuaaaacug

SEQ ID NO: 1653934 - RNA, 17 nt, Homo sapiens
ccuucaugaucaucaca

SEQ ID NO: 1653935 - RNA, 15 nt, Homo sapiens
ccuucccaugaccca

SEQ ID NO: 1653936 - RNA, 12 nt, Homo sapiens
ccuucucaggga

SEQ ID NO: 1653937 - RNA, 16 nt, Homo sapiens
ccuugcuccagccuga

SEQ ID NO: 1653938 - RNA, 23 nt, Homo sapiens
ccuuggagcuguaaaccagagag

SEQ ID NO: 1653939 - RNA, 19 nt, Homo sapiens
ccuugguucccccacugau

SEQ ID NO: 1653940 - RNA, 18 nt, Homo sapiens
ccuugucaauacugagcc

SEQ ID NO: 1653941 - RNA, 21 nt, Homo sapiens
ccuuuaaaaauaugcaccaaa

SEQ ID NO: 1653942 - RNA, 16 nt, Homo sapiens
ccuuucaccacaugug

SEQ ID NO: 1653943 - RNA, 14 nt, Homo sapiens
ccuuucauuuacug

SEQ ID NO: 1653944 - RNA, 12 nt, Homo sapiens
ccuuugccuugg

SEQ ID NO: 1653945 - RNA, 21 nt, Homo sapiens
ccuuuggggugaacuaccuug

SEQ ID NO: 1653946 - RNA, 20 nt, Homo sapiens
ccuuuuugucaccucaauau

SEQ ID NO: 1653947 - RNA, 21 nt, Homo sapiens
cgaaagacgugauucaauuca

SEQ ID NO: 1653948 - RNA, 12 nt, Homo sapiens
cgaaaugagcuc

SEQ ID NO: 1653949 - RNA, 21 nt, Homo sapiens
cgaacaauucauauauuugaa

SEQ ID NO: 1653950 - RNA, 17 nt, Homo sapiens
cgaaccuacaguuuuaa

SEQ ID NO: 1653951 - RNA, 21 nt, Homo sapiens
cgagaucgugccauugcacuc

SEQ ID NO: 1653952 - RNA, 13 nt, Homo sapiens
cgauguccuccuc

SEQ ID NO: 1653953 - RNA, 18 nt, Homo sapiens
cgauuaauaacaggcaaa

SEQ ID NO: 1653954 - RNA, 17 nt, Homo sapiens
cgcaaacuuuaacaggu

SEQ ID NO: 1653955 - RNA, 10 nt, Homo sapiens
cgcaaagggc

SEQ ID NO: 1653956 - RNA, 19 nt, Homo sapiens
cgcacaauaguaaccuggg

SEQ ID NO: 1653957 - RNA, 18 nt, Homo sapiens
cgcacacacagugauucc

SEQ ID NO: 1653958 - RNA, 23 nt, Homo sapiens
cgccagauucuuuccugaggcug

SEQ ID NO: 1653959 - RNA, 19 nt, Homo sapiens
cgcccaggcuggagugcag

SEQ ID NO: 1653960 - RNA, 20 nt, Homo sapiens
cgcccaggcuggagugcagu

SEQ ID NO: 1653961 - RNA, 20 nt, Homo sapiens
cgcuacccgggaagggggcu

SEQ ID NO: 1653962 - RNA, 16 nt, Homo sapiens
cgcuaccucuccagcc

SEQ ID NO: 1653963 - RNA, 20 nt, Homo sapiens
cggaaugaaccacaucuugc

SEQ ID NO: 1653964 - RNA, 14 nt, Homo sapiens
cggacacuucucag

SEQ ID NO: 1653965 - RNA, 19 nt, Homo sapiens
cggaucuuuggacagaagc

SEQ ID NO: 1653966 - RNA, 15 nt, Homo sapiens
cggcauuaaagccau

SEQ ID NO: 1653967 - RNA, 24 nt, Homo sapiens
cggccuguaacauaucuguaaaua

SEQ ID NO: 1653968 - RNA, 16 nt, Homo sapiens
cgggaagaaggggaca

SEQ ID NO: 1653969 - RNA, 14 nt, Homo sapiens
cgggauuaguacac

SEQ ID NO: 1653970 - RNA, 16 nt, Homo sapiens
cgguauaacacaucua

SEQ ID NO: 1653971 - RNA, 18 nt, Homo sapiens
cgguuugaagccuggaac

SEQ ID NO: 1653972 - RNA, 15 nt, Homo sapiens
cguauggaaugcuuc

SEQ ID NO: 1653973 - RNA, 22 nt, Homo sapiens
cgugaagggauuuuagucacac

SEQ ID NO: 1653974 - RNA, 15 nt, Homo sapiens
cgugacaacacaaau

SEQ ID NO: 1653975 - RNA, 23 nt, Homo sapiens
cgugaccugccaggcacacugag

SEQ ID NO: 1653976 - RNA, 13 nt, Homo sapiens
cgugauggucuga

SEQ ID NO: 1653977 - RNA, 16 nt, Homo sapiens
cgugauuuugcuguag

SEQ ID NO: 1653978 - RNA, 14 nt, Homo sapiens
cguggagcugccug

SEQ ID NO: 1653979 - RNA, 17 nt, Homo sapiens
cguguaauauucucuga

SEQ ID NO: 1653980 - RNA, 21 nt, Homo sapiens
cgugugccaccaggagggagu

SEQ ID NO: 1653981 - RNA, 15 nt, Homo sapiens
cguguguagaguuaa

SEQ ID NO: 1653982 - RNA, 23 nt, Homo sapiens
cguuuccuuucauuuacuguggc

SEQ ID NO: 1653983 - RNA, 17 nt, Homo sapiens
cuaaaacaaaagcucau

SEQ ID NO: 1653984 - RNA, 14 nt, Homo sapiens
cuaaaguaguuuaa

SEQ ID NO: 1653985 - RNA, 21 nt, Homo sapiens
cuaaaugaaaaucgugacaac

SEQ ID NO: 1653986 - RNA, 21 nt, Homo sapiens
cuaaaugaguaaacccagcug

SEQ ID NO: 1653987 - RNA, 17 nt, Homo sapiens
cuaacuugucuuuggac

SEQ ID NO: 1653988 - RNA, 16 nt, Homo sapiens
cuaagagaacaaugug

SEQ ID NO: 1653989 - RNA, 23 nt, Homo sapiens
cuaagagggagggagggcuccag

SEQ ID NO: 1653990 - RNA, 16 nt, Homo sapiens
cuaagcuucacuguaa

SEQ ID NO: 1653991 - RNA, 20 nt, Homo sapiens
cuaagggcgcuugucccauc

SEQ ID NO: 1653992 - RNA, 14 nt, Homo sapiens
cuaaggugugcucu

SEQ ID NO: 1653993 - RNA, 17 nt, Homo sapiens
cuaauagagagauuagu

SEQ ID NO: 1653994 - RNA, 18 nt, Homo sapiens
cuaaugacauucaauaaa

SEQ ID NO: 1653995 - RNA, 22 nt, Homo sapiens
cuaauguuugugagaagcuucu

SEQ ID NO: 1653996 - RNA, 22 nt, Homo sapiens
cuaauuccacagcugcucaaua

SEQ ID NO: 1653997 - RNA, 17 nt, Homo sapiens
cuaauuccacuuguuca

SEQ ID NO: 1653998 - RNA, 16 nt, Homo sapiens
cuacacuccagccugg

SEQ ID NO: 1653999 - RNA, 15 nt, Homo sapiens
cuacacugacacugg

SEQ ID NO: 1654000 - RNA, 14 nt, Homo sapiens
cuacagaggccaug

SEQ ID NO: 1654001 - RNA, 14 nt, Homo sapiens
cuaccaaaacaguu

SEQ ID NO: 1654002 - RNA, 21 nt, Homo sapiens
cuaccaacgaaagacgugauu

SEQ ID NO: 1654003 - RNA, 21 nt, Homo sapiens
cuaccacaugccaagcacugu

SEQ ID NO: 1654004 - RNA, 22 nt, Homo sapiens
cuaccuugguucccccacugau

SEQ ID NO: 1654005 - RNA, 11 nt, Homo sapiens
cuaccuuguga

SEQ ID NO: 1654006 - RNA, 15 nt, Homo sapiens
cuacguaucugcuac

SEQ ID NO: 1654007 - RNA, 13 nt, Homo sapiens
cuacucauucccc

SEQ ID NO: 1654008 - RNA, 22 nt, Homo sapiens
cuacugugucagggaacauauu

SEQ ID NO: 1654009 - RNA, 17 nt, Homo sapiens
cuagaaaacaggcaaau

SEQ ID NO: 1654010 - RNA, 13 nt, Homo sapiens
cuagaaccuggag

SEQ ID NO: 1654011 - RNA, 18 nt, Homo sapiens
cuagaaccuggagagcua

SEQ ID NO: 1654012 - RNA, 21 nt, Homo sapiens
cuuuauaaauguaccagagag

SEQ ID NO: 1654013 - RNA, 23 nt, Homo sapiens
cuuuauaccccauuugauuucga

SEQ ID NO: 1654014 - RNA, 20 nt, Homo sapiens
cuuucagcucagcuaaugaa

SEQ ID NO: 1654015 - RNA, 17 nt, Homo sapiens
cuuucauuuacuguggc

SEQ ID NO: 1654016 - RNA, 22 nt, Homo sapiens
cuuuccuuguuccccaucaucu

SEQ ID NO: 1654017 - RNA, 18 nt, Homo sapiens
cuuucugacucuaaaaua

SEQ ID NO: 1654018 - RNA, 23 nt, Homo sapiens
cuuucugaggagcuguuacugaa

SEQ ID NO: 1654019 - RNA, 20 nt, Homo sapiens
cuuucuugaaaagaagcaag

SEQ ID NO: 1654020 - RNA, 22 nt, Homo sapiens
cuuugaauauguaguaucuaua

SEQ ID NO: 1654021 - RNA, 13 nt, Homo sapiens
cuuugacaguguu

SEQ ID NO: 1654022 - RNA, 16 nt, Homo sapiens
cuuugagugacugggu

SEQ ID NO: 1654023 - RNA, 18 nt, Homo sapiens
cuuugauuuuauaugcua

SEQ ID NO: 1654024 - RNA, 15 nt, Homo sapiens
cuuuggaaaucacac

SEQ ID NO: 1654025 - RNA, 19 nt, Homo sapiens
cuuuggacagaagcagcuc

SEQ ID NO: 1654026 - RNA, 16 nt, Homo sapiens
cuuuggagaucaagga

SEQ ID NO: 1654027 - RNA, 17 nt, Homo sapiens
cuuuggagaucaaggag

SEQ ID NO: 1654028 - RNA, 17 nt, Homo sapiens
cuuuggcuuugcaaaau

SEQ ID NO: 1654029 - RNA, 23 nt, Homo sapiens
cuuuggugaacauugcaauagaa

SEQ ID NO: 1654030 - RNA, 13 nt, Homo sapiens
cuuuguacacgaa

SEQ ID NO: 1654031 - RNA, 20 nt, Homo sapiens
cuuuguugcauuuuggcaac

SEQ ID NO: 1654032 - RNA, 22 nt, Homo sapiens
cuuuuaaagaauuucuuuauaa

SEQ ID NO: 1654033 - RNA, 14 nt, Homo sapiens
cuuuuaacagaaca

SEQ ID NO: 1654034 - RNA, 15 nt, Homo sapiens
cuuuuaacauaauau

SEQ ID NO: 1654035 - RNA, 23 nt, Homo sapiens
cuuuuaagccagguuacauucua

SEQ ID NO: 1654036 - RNA, 18 nt, Homo sapiens
cuuuuagagucagacucc

SEQ ID NO: 1654037 - RNA, 15 nt, Homo sapiens
cuuuuauugccauga

SEQ ID NO: 1654038 - RNA, 12 nt, Homo sapiens
cuuuucaguuug

SEQ ID NO: 1654039 - RNA, 18 nt, Homo sapiens
cuuuucauaaccuagccu

SEQ ID NO: 1654040 - RNA, 18 nt, Homo sapiens
cuuuugugguccuguaaa

SEQ ID NO: 1654041 - RNA, 18 nt, Homo sapiens
cuuuuuuuuaaguuacac

SEQ ID NO: 1654042 - RNA, 23 nt, Homo sapiens
gaaaaauagcaacuuguguuaca

SEQ ID NO: 1654043 - RNA, 12 nt, Homo sapiens
gaaaacacuguu

SEQ ID NO: 1654044 - RNA, 17 nt, Homo sapiens
gaaaacaggcacugccc

SEQ ID NO: 1654045 - RNA, 20 nt, Homo sapiens
gaaaaguuucccagucuuca

SEQ ID NO: 1654046 - RNA, 16 nt, Homo sapiens
gaaaauacagcuggau

SEQ ID NO: 1654047 - RNA, 15 nt, Homo sapiens
gaaaauauauaucua

SEQ ID NO: 1654048 - RNA, 19 nt, Homo sapiens
gaaaaucugcacugugggc

SEQ ID NO: 1654049 - RNA, 17 nt, Homo sapiens
gaaaaugaaaugcauau

SEQ ID NO: 1654050 - RNA, 12 nt, Homo sapiens
gaaaaugugcaa

SEQ ID NO: 1654051 - RNA, 21 nt, Homo sapiens
gaaaauuauggcauauauuaa

SEQ ID NO: 1654052 - RNA, 13 nt, Homo sapiens
gaaacaacucuuu

SEQ ID NO: 1654053 - RNA, 18 nt, Homo sapiens
gaaacacugggcuucuag

SEQ ID NO: 1654054 - RNA, 15 nt, Homo sapiens
gaaaccuuugacacu

SEQ ID NO: 1654055 - RNA, 19 nt, Homo sapiens
gaaacuggaugaggucaua

SEQ ID NO: 1654056 - RNA, 17 nt, Homo sapiens
gaaacuucggggcugca

SEQ ID NO: 1654057 - RNA, 15 nt, Homo sapiens
gaaagaaaaugaauu

SEQ ID NO: 1654058 - RNA, 20 nt, Homo sapiens
gaaagacuuucucugccccu

SEQ ID NO: 1654059 - RNA, 21 nt, Homo sapiens
gaaagcaacuuuacugagaca

SEQ ID NO: 1654060 - RNA, 18 nt, Homo sapiens
gaaagcaucacuugggau

SEQ ID NO: 1654061 - RNA, 23 nt, Homo sapiens
gaaagguuaauucucuagggcua

SEQ ID NO: 1654062 - RNA, 22 nt, Homo sapiens
gaaaguguguauuuaacucugu

SEQ ID NO: 1654063 - RNA, 15 nt, Homo sapiens
gaaaguucauggaac

SEQ ID NO: 1654064 - RNA, 14 nt, Homo sapiens
gaaaguuuuggaaa

SEQ ID NO: 1654065 - RNA, 22 nt, Homo sapiens
gaaauaaaaucuaauuaauucu

SEQ ID NO: 1654066 - RNA, 14 nt, Homo sapiens
gaaauaaacuuugg

SEQ ID NO: 1654067 - RNA, 23 nt, Homo sapiens
gaaauacacuguuaucuucacuu

SEQ ID NO: 1654068 - RNA, 14 nt, Homo sapiens
gaaauauuccuuaa

SEQ ID NO: 1654069 - RNA, 13 nt, Homo sapiens
gaaaucuaugaaa

SEQ ID NO: 1654070 - RNA, 14 nt, Homo sapiens
gaaaugauuucaca

SEQ ID NO: 1654071 - RNA, 14 nt, Homo sapiens
gaaauuaauuugug

SEQ ID NO: 1654072 - RNA, 17 nt, Homo sapiens
gaaauuuaagacuagau

SEQ ID NO: 1654073 - RNA, 23 nt, Homo sapiens
gaaauuugccaauuuacuuuguu

SEQ ID NO: 1654074 - RNA, 15 nt, Homo sapiens
gaacaaaugugaagg

SEQ ID NO: 1654075 - RNA, 14 nt, Homo sapiens
gaacacaaggucau

SEQ ID NO: 1654076 - RNA, 16 nt, Homo sapiens
gaacaccugcauucuu

SEQ ID NO: 1654077 - RNA, 16 nt, Homo sapiens
gaacauaucauuugug

SEQ ID NO: 1654078 - RNA, 22 nt, Homo sapiens
gaacauaucauuugugaagaau

SEQ ID NO: 1654079 - RNA, 16 nt, Homo sapiens
gaacaucaucaaggca

SEQ ID NO: 1654080 - RNA, 16 nt, Homo sapiens
gaaccgaacauaucau

SEQ ID NO: 1654081 - RNA, 20 nt, Homo sapiens
gaaccuccuuucucuucucu

SEQ ID NO: 1654082 - RNA, 22 nt, Homo sapiens
gaacgcuucugcuuaaucugag

SEQ ID NO: 1654083 - RNA, 13 nt, Homo sapiens
gaacuagacuccc

SEQ ID NO: 1654084 - RNA, 15 nt, Homo sapiens
gaacugaacauucca

SEQ ID NO: 1654085 - RNA, 22 nt, Homo sapiens
gaacugccaggcccggccaaaa

SEQ ID NO: 1654086 - RNA, 19 nt, Homo sapiens
gaacuggaggcagggaaca

SEQ ID NO: 1654087 - RNA, 19 nt, Homo sapiens
gaagaaauuccaggaaaau

SEQ ID NO: 1654088 - RNA, 14 nt, Homo sapiens
gaagaagagaggca

SEQ ID NO: 1654089 - RNA, 20 nt, Homo sapiens
gaagaauuggccaucuuaaa

SEQ ID NO: 1654090 - RNA, 11 nt, Homo sapiens
gaagacauaaa

SEQ ID NO: 1654091 - RNA, 17 nt, Homo sapiens
gaagacuauauuguaca

SEQ ID NO: 1654092 - RNA, 14 nt, Homo sapiens
gaagagcuuggaaa

SEQ ID NO: 1654093 - RNA, 20 nt, Homo sapiens
gaagauccuaaaacaaaagc

SEQ ID NO: 1654094 - RNA, 17 nt, Homo sapiens
gaagauucuauguuaau

SEQ ID NO: 1654095 - RNA, 17 nt, Homo sapiens
gaagccuauguaugcca

SEQ ID NO: 1654096 - RNA, 13 nt, Homo sapiens
gaagccuucugac

SEQ ID NO: 1654097 - RNA, 18 nt, Homo sapiens
gaagcuguuguacauuua

SEQ ID NO: 1654098 - RNA, 12 nt, Homo sapiens
gaaggagggaga

SEQ ID NO: 1654099 - RNA, 14 nt, Homo sapiens
gaaggauccaucuu

SEQ ID NO: 1654100 - RNA, 16 nt, Homo sapiens
gaaggggaaacacagc

SEQ ID NO: 1654101 - RNA, 12 nt, Homo sapiens
gaagucuuccau

SEQ ID NO: 1654102 - RNA, 23 nt, Homo sapiens
gaaguggggaccccaccccucau

SEQ ID NO: 1654103 - RNA, 21 nt, Homo sapiens
gaaguugacaggcagugccau

SEQ ID NO: 1654104 - RNA, 16 nt, Homo sapiens
gaaguuuaauugacuu

SEQ ID NO: 1654105 - RNA, 14 nt, Homo sapiens
gaaguuuguuguga

SEQ ID NO: 1654106 - RNA, 21 nt, Homo sapiens
gaauaaaccaucaucuugcca

SEQ ID NO: 1654107 - RNA, 22 nt, Homo sapiens
gaauaacauggugugcuucuua

SEQ ID NO: 1654108 - RNA, 23 nt, Homo sapiens
gaauaguguuggaaaaugugcaa

SEQ ID NO: 1654109 - RNA, 17 nt, Homo sapiens
gaauauuccacuauuug

SEQ ID NO: 1654110 - RNA, 16 nt, Homo sapiens
gaaucaaaugcaauuu

SEQ ID NO: 1654111 - RNA, 16 nt, Homo sapiens
gaaucauucuguaaag

SEQ ID NO: 1654112 - RNA, 16 nt, Homo sapiens
gaauccagacccggcu

SEQ ID NO: 1654113 - RNA, 14 nt, Homo sapiens
gaaucuagcuuauu

SEQ ID NO: 1654114 - RNA, 15 nt, Homo sapiens
gaaucuucaccucag

SEQ ID NO: 1654115 - RNA, 23 nt, Homo sapiens
gaaucuucaccucagaguggagu

SEQ ID NO: 1654116 - RNA, 17 nt, Homo sapiens
gaaugagaagaaugacu

SEQ ID NO: 1654117 - RNA, 23 nt, Homo sapiens
gaauggcucacuauggugccaau

SEQ ID NO: 1654118 - RNA, 16 nt, Homo sapiens
gaauuagcucacuugg

SEQ ID NO: 1654119 - RNA, 15 nt, Homo sapiens
gaauuuaaaaucaua

SEQ ID NO: 1654120 - RNA, 18 nt, Homo sapiens
gaauuuauaacccaguga

SEQ ID NO: 1654121 - RNA, 12 nt, Homo sapiens
gaauuuccuuac

SEQ ID NO: 1654122 - RNA, 18 nt, Homo sapiens
gcugggcuucaguggcag

SEQ ID NO: 1654123 - RNA, 18 nt, Homo sapiens
gcugggggugaggacaca

SEQ ID NO: 1654124 - RNA, 18 nt, Homo sapiens
gcuggguccucugcagug

SEQ ID NO: 1654125 - RNA, 13 nt, Homo sapiens
gcuggucuccccc

SEQ ID NO: 1654126 - RNA, 16 nt, Homo sapiens
gcugugaauuagcuca

SEQ ID NO: 1654127 - RNA, 18 nt, Homo sapiens
gcuguucucugucgugag

SEQ ID NO: 1654128 - RNA, 14 nt, Homo sapiens
gcuguuuacugcuu

SEQ ID NO: 1654129 - RNA, 14 nt, Homo sapiens
gcuguuuccucacg

SEQ ID NO: 1654130 - RNA, 14 nt, Homo sapiens
gcuuaaaaacucac

SEQ ID NO: 1654131 - RNA, 14 nt, Homo sapiens
gcuucacuguauaa

SEQ ID NO: 1654132 - RNA, 18 nt, Homo sapiens
gcuucaguggcagcugcu

SEQ ID NO: 1654133 - RNA, 22 nt, Homo sapiens
gcuucuccaggguccacaggaa

SEQ ID NO: 1654134 - RNA, 19 nt, Homo sapiens
gcuucugauacguguauga

SEQ ID NO: 1654135 - RNA, 18 nt, Homo sapiens
gcuucugcuuaaucugag

SEQ ID NO: 1654136 - RNA, 18 nt, Homo sapiens
gcuucuguugcugccuca

SEQ ID NO: 1654137 - RNA, 22 nt, Homo sapiens
gcuucuuaaucuuuucacaaau

SEQ ID NO: 1654138 - RNA, 16 nt, Homo sapiens
gcuucuucuucaagau

SEQ ID NO: 1654139 - RNA, 14 nt, Homo sapiens
gcuuuaacuauauc

SEQ ID NO: 1654140 - RNA, 19 nt, Homo sapiens
gcuuuauaccccauuugau

SEQ ID NO: 1654141 - RNA, 13 nt, Homo sapiens
gcuuucaguauua

SEQ ID NO: 1654142 - RNA, 21 nt, Homo sapiens
gcuuucucuggacacugccac

SEQ ID NO: 1654143 - RNA, 16 nt, Homo sapiens
gcuuuuaccugugcac

SEQ ID NO: 1654144 - RNA, 13 nt, Homo sapiens
gcuuuucuuccua

SEQ ID NO: 1654145 - RNA, 15 nt, Homo sapiens
ggaaaaaaacaugaa

SEQ ID NO: 1654146 - RNA, 20 nt, Homo sapiens
ggaaaagcugcugacagugu

SEQ ID NO: 1654147 - RNA, 22 nt, Homo sapiens
ggaaaaugugcaauaugugaug

SEQ ID NO: 1654148 - RNA, 14 nt, Homo sapiens
ggaaacacagcuga

SEQ ID NO: 1654149 - RNA, 20 nt, Homo sapiens
ggaaacauauuuaagaaaua

SEQ ID NO: 1654150 - RNA, 14 nt, Homo sapiens
ggaaaccacagcug

SEQ ID NO: 1654151 - RNA, 17 nt, Homo sapiens
ggaaacuggaugagguc

SEQ ID NO: 1654152 - RNA, 20 nt, Homo sapiens
ggaaacuggaugaggucaua

SEQ ID NO: 1654153 - RNA, 16 nt, Homo sapiens
ggaaaggcuccaggag

SEQ ID NO: 1654154 - RNA, 23 nt, Homo sapiens
ggaacauguacuguuacuguguc

SEQ ID NO: 1654155 - RNA, 18 nt, Homo sapiens
ggaacuggaggcagggaa

SEQ ID NO: 1654156 - RNA, 22 nt, Homo sapiens
ggaagaccccagcacagacuca

SEQ ID NO: 1654157 - RNA, 17 nt, Homo sapiens
ggaagagggugauugcu

SEQ ID NO: 1654158 - RNA, 21 nt, Homo sapiens
ggaagcuccgcuuucuaccca

SEQ ID NO: 1654159 - RNA, 11 nt, Homo sapiens
ggaagugcuuc

SEQ ID NO: 1654160 - RNA, 20 nt, Homo sapiens
ggaauauuugcaagacauag

SEQ ID NO: 1654161 - RNA, 17 nt, Homo sapiens
ggaauccagacccggcu

SEQ ID NO: 1654162 - RNA, 15 nt, Homo sapiens
ggaaucuucaccuca

SEQ ID NO: 1654163 - RNA, 19 nt, Homo sapiens
ggaauuucuguucuuccau

SEQ ID NO: 1654164 - RNA, 15 nt, Homo sapiens
ggaauuuucuuccaa

SEQ ID NO: 1654165 - RNA, 20 nt, Homo sapiens
ggacaaggaugaucuaggaa

SEQ ID NO: 1654166 - RNA, 16 nt, Homo sapiens
ggacaccauccaggaa

SEQ ID NO: 1654167 - RNA, 16 nt, Homo sapiens
ggacacuucucaggaa

SEQ ID NO: 1654168 - RNA, 13 nt, Homo sapiens
ggacagaagcagc

SEQ ID NO: 1654169 - RNA, 15 nt, Homo sapiens
ggacagaagcagcuc

SEQ ID NO: 1654170 - RNA, 21 nt, Homo sapiens
ggacagaccuucaacuuccaa

SEQ ID NO: 1654171 - RNA, 15 nt, Homo sapiens
ggacaggcauguucu

SEQ ID NO: 1654172 - RNA, 19 nt, Homo sapiens
ggaccaaaccuagccccuu

SEQ ID NO: 1654173 - RNA, 16 nt, Homo sapiens
ggaccaccuagucugu

SEQ ID NO: 1654174 - RNA, 13 nt, Homo sapiens
ggacuacaggcac

SEQ ID NO: 1654175 - RNA, 18 nt, Homo sapiens
ggacucaagcaagauuuc

SEQ ID NO: 1654176 - RNA, 22 nt, Homo sapiens
ggacucaaugcacugacauugu

SEQ ID NO: 1654177 - RNA, 22 nt, Homo sapiens
ggacucugcagccucagagaca

SEQ ID NO: 1654178 - RNA, 18 nt, Homo sapiens
ggacuuagcugggagaaa

SEQ ID NO: 1654179 - RNA, 19 nt, Homo sapiens
ggacuuccaucugugccau

SEQ ID NO: 1654180 - RNA, 12 nt, Homo sapiens
ggagacacugau

SEQ ID NO: 1654181 - RNA, 11 nt, Homo sapiens
ggagacucagg

SEQ ID NO: 1654182 - RNA, 21 nt, Homo sapiens
ggagagagcagcuucugccac

SEQ ID NO: 1654183 - RNA, 16 nt, Homo sapiens
ggagccaauccacucc

SEQ ID NO: 1654184 - RNA, 18 nt, Homo sapiens
ggagccccugcucuggug

SEQ ID NO: 1654185 - RNA, 19 nt, Homo sapiens
ggagccugggggcuccuca

SEQ ID NO: 1654186 - RNA, 12 nt, Homo sapiens
ggagcucagaga

SEQ ID NO: 1654187 - RNA, 19 nt, Homo sapiens
ggagcugccuguucagcuc

SEQ ID NO: 1654188 - RNA, 12 nt, Homo sapiens
ggaggagcagug

SEQ ID NO: 1654189 - RNA, 23 nt, Homo sapiens
ggaggaggccguaugaagacaga

SEQ ID NO: 1654190 - RNA, 22 nt, Homo sapiens
ggaggauacugaggcacacaga

SEQ ID NO: 1654191 - RNA, 12 nt, Homo sapiens
ggaggauguucu

SEQ ID NO: 1654192 - RNA, 21 nt, Homo sapiens
ggaggccauucugagccacac

SEQ ID NO: 1654193 - RNA, 22 nt, Homo sapiens
ggagggcuccagacacaugucc

SEQ ID NO: 1654194 - RNA, 20 nt, Homo sapiens
ggagggugguucaacaaaga

SEQ ID NO: 1654195 - RNA, 14 nt, Homo sapiens
ggagucaugccaag

SEQ ID NO: 1654196 - RNA, 15 nt, Homo sapiens
ggagucccagagcug

SEQ ID NO: 1654197 - RNA, 17 nt, Homo sapiens
ggagugacgcaucucca

SEQ ID NO: 1654198 - RNA, 14 nt, Homo sapiens
ggaguugaaacugc

SEQ ID NO: 1654199 - RNA, 17 nt, Homo sapiens
ggaguugaaacugcuau

SEQ ID NO: 1654200 - RNA, 14 nt, Homo sapiens
ggaguuugcauucu

SEQ ID NO: 1654201 - RNA, 14 nt, Homo sapiens
ggauauugaugaaa

SEQ ID NO: 1654202 - RNA, 15 nt, Homo sapiens
ggaucccucucugga

SEQ ID NO: 1654203 - RNA, 17 nt, Homo sapiens
ggaucgcaagagccaug

SEQ ID NO: 1654204 - RNA, 13 nt, Homo sapiens
ggaugaggucaua

SEQ ID NO: 1654205 - RNA, 22 nt, Homo sapiens
ggaugcauagccuggacacaga

SEQ ID NO: 1654206 - RNA, 17 nt, Homo sapiens
ggaugguggagggccac

SEQ ID NO: 1654207 - RNA, 22 nt, Homo sapiens
ggauuaaugucaauucuugcca

SEQ ID NO: 1654208 - RNA, 14 nt, Homo sapiens
ggauuaguacacac

SEQ ID NO: 1654209 - RNA, 14 nt, Homo sapiens
ggauucccaggaug

SEQ ID NO: 1654210 - RNA, 21 nt, Homo sapiens
ggauugcuacuguccuaccca

SEQ ID NO: 1654211 - RNA, 13 nt, Homo sapiens
ggauuggggaccu

SEQ ID NO: 1654212 - RNA, 17 nt, Homo sapiens
ggauuuauaaagcaaau

SEQ ID NO: 1654213 - RNA, 24 nt, Homo sapiens
ggcaaagaaaaugaaaugcauauu

SEQ ID NO: 1654214 - RNA, 15 nt, Homo sapiens
ggcaacaauuuaccu

SEQ ID NO: 1654215 - RNA, 19 nt, Homo sapiens
ggcaagcucuaucaccaag

SEQ ID NO: 1654216 - RNA, 14 nt, Homo sapiens
ggcacaaucucggc

SEQ ID NO: 1654217 - RNA, 15 nt, Homo sapiens
ggcacaccgggcacu

SEQ ID NO: 1654218 - RNA, 17 nt, Homo sapiens
ggcacacugagccagca

SEQ ID NO: 1654219 - RNA, 15 nt, Homo sapiens
ggcaccaccauggcu

SEQ ID NO: 1654220 - RNA, 13 nt, Homo sapiens
ggcacugccugau

SEQ ID NO: 1654221 - RNA, 14 nt, Homo sapiens
ggcagcucaucucu

SEQ ID NO: 1654222 - RNA, 19 nt, Homo sapiens
ggcagcugcuggcugugac

SEQ ID NO: 1654223 - RNA, 20 nt, Homo sapiens
ggcagcugcuggcugugaca

SEQ ID NO: 1654224 - RNA, 13 nt, Homo sapiens
ggcaggcuucuca

SEQ ID NO: 1654225 - RNA, 24 nt, Homo sapiens
ggcauagaugcaggugagcccaug

SEQ ID NO: 1654226 - RNA, 14 nt, Homo sapiens
ggcaugacccagug

SEQ ID NO: 1654227 - RNA, 12 nt, Homo sapiens
ggcauuggccau

SEQ ID NO: 1654228 - RNA, 21 nt, Homo sapiens
ggcauuuucuucucacauuua

SEQ ID NO: 1654229 - RNA, 21 nt, Homo sapiens
ggccaaagagucuccaguuua

SEQ ID NO: 1654230 - RNA, 18 nt, Homo sapiens
ggccagagggagugacag

SEQ ID NO: 1654231 - RNA, 17 nt, Homo sapiens
ggccagaugcacauccc

SEQ ID NO: 1654232 - RNA, 13 nt, Homo sapiens
uguuuuaucauua

SEQ ID NO: 1654233 - RNA, 20 nt, Homo sapiens
uguuuuaucauuaccauuaa

SEQ ID NO: 1654234 - RNA, 19 nt, Homo sapiens
uguuuuuuuucagcacaug

SEQ ID NO: 1654235 - RNA, 18 nt, Homo sapiens
uuaaaaacacuacuuuug

SEQ ID NO: 1654236 - RNA, 19 nt, Homo sapiens
uuaaaauaucuuuugaccu

SEQ ID NO: 1654237 - RNA, 10 nt, Homo sapiens
uuaaacuggu

SEQ ID NO: 1654238 - RNA, 21 nt, Homo sapiens
uuaaagacaggagacaaaaga

SEQ ID NO: 1654239 - RNA, 11 nt, Homo sapiens
uuaaagcaaaa

SEQ ID NO: 1654240 - RNA, 16 nt, Homo sapiens
uuaaaucacacaugcu

SEQ ID NO: 1654241 - RNA, 15 nt, Homo sapiens
uuaaaugaaagugag

SEQ ID NO: 1654242 - RNA, 14 nt, Homo sapiens
uuaaaugaacauca

SEQ ID NO: 1654243 - RNA, 17 nt, Homo sapiens
uuaacacucauuuccaa

SEQ ID NO: 1654244 - RNA, 15 nt, Homo sapiens
uuaacagaacagaca

SEQ ID NO: 1654245 - RNA, 21 nt, Homo sapiens
uuaacagcgugucaacuuuca

SEQ ID NO: 1654246 - RNA, 22 nt, Homo sapiens
uuaacagcgugucaacuuucau

SEQ ID NO: 1654247 - RNA, 19 nt, Homo sapiens
uuaacccuauuuuaccuag

SEQ ID NO: 1654248 - RNA, 15 nt, Homo sapiens
uuaacuaugacagau

SEQ ID NO: 1654249 - RNA, 10 nt, Homo sapiens
uuaacuauug

SEQ ID NO: 1654250 - RNA, 12 nt, Homo sapiens
uuaagacuaaaa

SEQ ID NO: 1654251 - RNA, 15 nt, Homo sapiens
uuaagcaucacauua

SEQ ID NO: 1654252 - RNA, 22 nt, Homo sapiens
uuaaguuacacauuuuucagau

SEQ ID NO: 1654253 - RNA, 14 nt, Homo sapiens
uuaauaguauaucu

SEQ ID NO: 1654254 - RNA, 17 nt, Homo sapiens
uuaaucuuuucacaaau

SEQ ID NO: 1654255 - RNA, 15 nt, Homo sapiens
uuaauuauauuucua

SEQ ID NO: 1654256 - RNA, 18 nt, Homo sapiens
uuaauuugugaauuugca

SEQ ID NO: 1654257 - RNA, 13 nt, Homo sapiens
uuacaacaaacac

SEQ ID NO: 1654258 - RNA, 13 nt, Homo sapiens
uuacacauuccau

SEQ ID NO: 1654259 - RNA, 20 nt, Homo sapiens
uuacagcuggguggcacugc

SEQ ID NO: 1654260 - RNA, 16 nt, Homo sapiens
uuacagggaaugccug

SEQ ID NO: 1654261 - RNA, 21 nt, Homo sapiens
uuacaggugugagccaccacg

SEQ ID NO: 1654262 - RNA, 22 nt, Homo sapiens
uuacaucugaacaaaaugccuu

SEQ ID NO: 1654263 - RNA, 15 nt, Homo sapiens
uuaccuaccacaugc

SEQ ID NO: 1654264 - RNA, 16 nt, Homo sapiens
uuaccuugugcuaauc

SEQ ID NO: 1654265 - RNA, 16 nt, Homo sapiens
uuacuaucaugucaaa

SEQ ID NO: 1654266 - RNA, 17 nt, Homo sapiens
uuacuaucaugucaaac

SEQ ID NO: 1654267 - RNA, 22 nt, Homo sapiens
uuacuauuuauugcugaaugac

SEQ ID NO: 1654268 - RNA, 17 nt, Homo sapiens
uuacugauucauacauu

SEQ ID NO: 1654269 - RNA, 13 nt, Homo sapiens
uuacuguggcuuc

SEQ ID NO: 1654270 - RNA, 21 nt, Homo sapiens
uuacuguuugucuucucccca

SEQ ID NO: 1654271 - RNA, 15 nt, Homo sapiens
uuacuuaaaggaaua

SEQ ID NO: 1654272 - RNA, 16 nt, Homo sapiens
uuacuugccuaucuga

SEQ ID NO: 1654273 - RNA, 17 nt, Homo sapiens
uuagaccuguguuacua

SEQ ID NO: 1654274 - RNA, 20 nt, Homo sapiens
uuagaggaucccucucugga

SEQ ID NO: 1654275 - RNA, 15 nt, Homo sapiens
uuagaugaaugucag

SEQ ID NO: 1654276 - RNA, 12 nt, Homo sapiens
uuagcaaugcug

SEQ ID NO: 1654277 - RNA, 17 nt, Homo sapiens
uuagggaaaacauucca

SEQ ID NO: 1654278 - RNA, 15 nt, Homo sapiens
uuagucgagccaagu

SEQ ID NO: 1654279 - RNA, 24 nt, Homo sapiens
uuauaaaagaugcauuaucuauga

SEQ ID NO: 1654280 - RNA, 15 nt, Homo sapiens
uuauaaagcagauua

SEQ ID NO: 1654281 - RNA, 20 nt, Homo sapiens
uuauaaaggauaaagaagga

SEQ ID NO: 1654282 - RNA, 23 nt, Homo sapiens
uuauaaagggagauaacaaucug

SEQ ID NO: 1654283 - RNA, 22 nt, Homo sapiens
uuauaggcaccuaccaccacgc

SEQ ID NO: 1654284 - RNA, 16 nt, Homo sapiens
uuauauacaagugaua

SEQ ID NO: 1654285 - RNA, 14 nt, Homo sapiens
uuauauucauucuu

SEQ ID NO: 1654286 - RNA, 17 nt, Homo sapiens
uuaucgaaauaacaaug

SEQ ID NO: 1654287 - RNA, 23 nt, Homo sapiens
uuaucugucccagguuaucuggg

SEQ ID NO: 1654288 - RNA, 13 nt, Homo sapiens
uuauguacucuac

SEQ ID NO: 1654289 - RNA, 18 nt, Homo sapiens
uuaugucuagaaaguaag

SEQ ID NO: 1654290 - RNA, 12 nt, Homo sapiens
uuaugugcaaua

SEQ ID NO: 1654291 - RNA, 18 nt, Homo sapiens
uuauuaaaaccagucuca

SEQ ID NO: 1654292 - RNA, 15 nt, Homo sapiens
uuauuacucuauaca

SEQ ID NO: 1654293 - RNA, 15 nt, Homo sapiens
uuauuuaauaacauu

SEQ ID NO: 1654294 - RNA, 16 nt, Homo sapiens
uuauuuauuuauucau

SEQ ID NO: 1654295 - RNA, 20 nt, Homo sapiens
uucaagugaguggcaugugg

SEQ ID NO: 1654296 - RNA, 21 nt, Homo sapiens
uucaagugauucucaugccuc

SEQ ID NO: 1654297 - RNA, 23 nt, Homo sapiens
uucaauaaaccuaauaaucugaa

SEQ ID NO: 1654298 - RNA, 16 nt, Homo sapiens
uucaaucuguguaaga

SEQ ID NO: 1654299 - RNA, 13 nt, Homo sapiens
uucaaugaaaugg

SEQ ID NO: 1654300 - RNA, 14 nt, Homo sapiens
uucaaugaaaugga

SEQ ID NO: 1654301 - RNA, 18 nt, Homo sapiens
uucacaaaacagccuuug

SEQ ID NO: 1654302 - RNA, 15 nt, Homo sapiens
uucacaccuagcguc

SEQ ID NO: 1654303 - RNA, 17 nt, Homo sapiens
uucaccacaugugcaca

SEQ ID NO: 1654304 - RNA, 18 nt, Homo sapiens
uucaccacaugugcacau

SEQ ID NO: 1654305 - RNA, 15 nt, Homo sapiens
uucacucauacaucu

SEQ ID NO: 1654306 - RNA, 21 nt, Homo sapiens
uucagaaucacuucugagaac

SEQ ID NO: 1654307 - RNA, 13 nt, Homo sapiens
uucagaaucucuc

SEQ ID NO: 1654308 - RNA, 18 nt, Homo sapiens
uucagagcugacacagga

SEQ ID NO: 1654309 - RNA, 23 nt, Homo sapiens
uucagauauaaaagacugaccaa

SEQ ID NO: 1654310 - RNA, 19 nt, Homo sapiens
uucaggcucugagacacac

SEQ ID NO: 1654311 - RNA, 14 nt, Homo sapiens
uucagugacuuaau

SEQ ID NO: 1654312 - RNA, 15 nt, Homo sapiens
uucagugcugcugaa

SEQ ID NO: 1654313 - RNA, 17 nt, Homo sapiens
uucaguuauuugcacaa

SEQ ID NO: 1654314 - RNA, 21 nt, Homo sapiens
uucaguucuuacacauuccau

SEQ ID NO: 1654315 - RNA, 18 nt, Homo sapiens
uucauacauuaucucacu

SEQ ID NO: 1654316 - RNA, 16 nt, Homo sapiens
uucauacccuguuacc

SEQ ID NO: 1654317 - RNA, 18 nt, Homo sapiens
uucauauauuuguaugau

SEQ ID NO: 1654318 - RNA, 20 nt, Homo sapiens
uucauauauuuguaugaucc

SEQ ID NO: 1654319 - RNA, 16 nt, Homo sapiens
uucaucugcucuccuu

SEQ ID NO: 1654320 - RNA, 18 nt, Homo sapiens
uucaucugcucuccuucc

SEQ ID NO: 1654321 - RNA, 20 nt, Homo sapiens
uucaugguccgccugccuca

SEQ ID NO: 1654322 - RNA, 14 nt, Homo sapiens
uucauuuacugugg

SEQ ID NO: 1654323 - RNA, 22 nt, Homo sapiens
uucauuuacuguggcuucuuaa

SEQ ID NO: 1654324 - RNA, 22 nt, Homo sapiens
uucauuuccucugagcuguuau

SEQ ID NO: 1654325 - RNA, 19 nt, Homo sapiens
uuccaaauuggauacugcu

SEQ ID NO: 1654326 - RNA, 23 nt, Homo sapiens
uuccacacccccaccccuugcuc

SEQ ID NO: 1654327 - RNA, 10 nt, Homo sapiens
uuccacugag

SEQ ID NO: 1654328 - RNA, 14 nt, Homo sapiens
uuccagagcucuga

SEQ ID NO: 1654329 - RNA, 18 nt, Homo sapiens
uuccagagcucugaccca

SEQ ID NO: 1654330 - RNA, 16 nt, Homo sapiens
uuccagcacuuugcaa

SEQ ID NO: 1654331 - RNA, 19 nt, Homo sapiens
uuccaggaaaaucugcacu

SEQ ID NO: 1654332 - RNA, 14 nt, Homo sapiens
uuccaggcugguuc

SEQ ID NO: 1654333 - RNA, 12 nt, Homo sapiens
uuccagguaaaa

SEQ ID NO: 1654334 - RNA, 18 nt, Homo sapiens
uuccaguaguuagcuuuc

SEQ ID NO: 1654335 - RNA, 16 nt, Homo sapiens
uuccaucugugccaua

SEQ ID NO: 1654336 - RNA, 15 nt, Homo sapiens
uuccaucuuacauua

SEQ ID NO: 1654337 - RNA, 22 nt, Homo sapiens
uucccaaaagcccauucauucc

SEQ ID NO: 1654338 - RNA, 15 nt, Homo sapiens
uucccacagugccua

SEQ ID NO: 1654339 - RNA, 21 nt, Homo sapiens
uucccacugaaauggacugac

SEQ ID NO: 1654340 - RNA, 15 nt, Homo sapiens
uucccaggaguacac

SEQ ID NO: 1654341 - RNA, 21 nt, Homo sapiens
uucccauaccacccaaugcug

SEQ ID NO: 1654342 - RNA, 11 nt, Homo sapiens
aaaaauuauca

SEQ ID NO: 1654343 - RNA, 13 nt, Homo sapiens
aaaacaauggaau

SEQ ID NO: 1654344 - RNA, 19 nt, Homo sapiens
aaaacaccuuguacuuuau

SEQ ID NO: 1654345 - RNA, 13 nt, Homo sapiens
aaaacacugugca

SEQ ID NO: 1654346 - RNA, 15 nt, Homo sapiens
aaaacacugugcaca

SEQ ID NO: 1654347 - RNA, 15 nt, Homo sapiens
aaaacaggcaaauuc

SEQ ID NO: 1654348 - RNA, 17 nt, Homo sapiens
aaaacauccugacuuca

SEQ ID NO: 1654349 - RNA, 23 nt, Homo sapiens
aaaacuuggaauucucucaccuc

SEQ ID NO: 1654350 - RNA, 20 nt, Homo sapiens
aaaagcaggcuucuaugaaa

SEQ ID NO: 1654351 - RNA, 17 nt, Homo sapiens
aaaagcccauucauucc

SEQ ID NO: 1654352 - RNA, 18 nt, Homo sapiens
aaaagcccauucauucca

SEQ ID NO: 1654353 - RNA, 18 nt, Homo sapiens
aaaaggaaggcucuucuc

SEQ ID NO: 1654354 - RNA, 20 nt, Homo sapiens
aaaaggcuaagcuucacugu

SEQ ID NO: 1654355 - RNA, 16 nt, Homo sapiens
aaaagggaacugaaca

SEQ ID NO: 1654356 - RNA, 13 nt, Homo sapiens
aaaauaaugcacc

SEQ ID NO: 1654357 - RNA, 18 nt, Homo sapiens
aaaauaaugcaccacuuu

SEQ ID NO: 1654358 - RNA, 12 nt, Homo sapiens
aaaauaauucua

SEQ ID NO: 1654359 - RNA, 21 nt, Homo sapiens
aaaauacaauuaaagcaaaau

SEQ ID NO: 1654360 - RNA, 13 nt, Homo sapiens
aaaauacauauaa

SEQ ID NO: 1654361 - RNA, 13 nt, Homo sapiens
aaaauacucugac

SEQ ID NO: 1654362 - RNA, 22 nt, Homo sapiens
aaaauagggaaguaacaguaac

SEQ ID NO: 1654363 - RNA, 18 nt, Homo sapiens
aaaauaguuauucaguua

SEQ ID NO: 1654364 - RNA, 14 nt, Homo sapiens
aaaaucaauauuuc

SEQ ID NO: 1654365 - RNA, 17 nt, Homo sapiens
aaaaugcaccacuuuuu

SEQ ID NO: 1654366 - RNA, 14 nt, Homo sapiens
aaaaugucaucuca

SEQ ID NO: 1654367 - RNA, 17 nt, Homo sapiens
aaaauuaauaugauuau

SEQ ID NO: 1654368 - RNA, 21 nt, Homo sapiens
aaaauuauuacuaaugaugcu

SEQ ID NO: 1654369 - RNA, 13 nt, Homo sapiens
aaaauugcucccu

SEQ ID NO: 1654370 - RNA, 14 nt, Homo sapiens
aaacaaaagcucau

SEQ ID NO: 1654371 - RNA, 18 nt, Homo sapiens
aaacagcugccaccauca

SEQ ID NO: 1654372 - RNA, 17 nt, Homo sapiens
aaacauaccaacauguu

SEQ ID NO: 1654373 - RNA, 16 nt, Homo sapiens
aaacaugaaaacauug

SEQ ID NO: 1654374 - RNA, 18 nt, Homo sapiens
aaacaugaaaacauugau

SEQ ID NO: 1654375 - RNA, 20 nt, Homo sapiens
aaacaugugguuaaugccau

SEQ ID NO: 1654376 - RNA, 15 nt, Homo sapiens
aaacauguucacuua

SEQ ID NO: 1654377 - RNA, 11 nt, Homo sapiens
aaacauuccau

SEQ ID NO: 1654378 - RNA, 16 nt, Homo sapiens
aaacauuccauccuug

SEQ ID NO: 1654379 - RNA, 18 nt, Homo sapiens
aaacauuuuuaucuauca

SEQ ID NO: 1654380 - RNA, 20 nt, Homo sapiens
aaaccaaccauuucuagaga

SEQ ID NO: 1654381 - RNA, 14 nt, Homo sapiens
aaaccaggacauua

SEQ ID NO: 1654382 - RNA, 15 nt, Homo sapiens
aaacccucugugaaa

SEQ ID NO: 1654383 - RNA, 20 nt, Homo sapiens
aaacguggcaggacuuccau

SEQ ID NO: 1654384 - RNA, 17 nt, Homo sapiens
aaacuaaggaacccugg

SEQ ID NO: 1654385 - RNA, 23 nt, Homo sapiens
aaacuaugauaaauuaugauaau

SEQ ID NO: 1654386 - RNA, 17 nt, Homo sapiens
aaacuauguaacaugua

SEQ ID NO: 1654387 - RNA, 18 nt, Homo sapiens
aaacuauguaacauguag

SEQ ID NO: 1654388 - RNA, 21 nt, Homo sapiens
aaacucaagcuucuucacuca

SEQ ID NO: 1654389 - RNA, 13 nt, Homo sapiens
aaacucaccaucu

SEQ ID NO: 1654390 - RNA, 21 nt, Homo sapiens
aaacugccuuucugguggcuu

SEQ ID NO: 1654391 - RNA, 21 nt, Homo sapiens
aaacugucgguuugcuuugau

SEQ ID NO: 1654392 - RNA, 13 nt, Homo sapiens
aaacuucuuucac

SEQ ID NO: 1654393 - RNA, 14 nt, Homo sapiens
aaacuucuuucacu

SEQ ID NO: 1654394 - RNA, 19 nt, Homo sapiens
aaagaaauaaaccaaagga

SEQ ID NO: 1654395 - RNA, 15 nt, Homo sapiens
aaagaacuagcauaa

SEQ ID NO: 1654396 - RNA, 13 nt, Homo sapiens
aaagaagguuuca

SEQ ID NO: 1654397 - RNA, 17 nt, Homo sapiens
aaagacuaugaggaaua

SEQ ID NO: 1654398 - RNA, 15 nt, Homo sapiens
aaagacucaaaaagc

SEQ ID NO: 1654399 - RNA, 17 nt, Homo sapiens
aaagacucaaaaagcug

SEQ ID NO: 1654400 - RNA, 14 nt, Homo sapiens
aaagacugcauuua

SEQ ID NO: 1654401 - RNA, 19 nt, Homo sapiens
aaagacuuuccucuuaguc

SEQ ID NO: 1654402 - RNA, 22 nt, Homo sapiens
aaagagccucacaguuacguga

SEQ ID NO: 1654403 - RNA, 12 nt, Homo sapiens
aaagauaucuau

SEQ ID NO: 1654404 - RNA, 16 nt, Homo sapiens
aaagaugaaaaguaua

SEQ ID NO: 1654405 - RNA, 13 nt, Homo sapiens
aaagcacaggugg

SEQ ID NO: 1654406 - RNA, 21 nt, Homo sapiens
aaagcacuuacaccaguuuga

SEQ ID NO: 1654407 - RNA, 23 nt, Homo sapiens
aaagcaggccuuugcagauauga

SEQ ID NO: 1654408 - RNA, 17 nt, Homo sapiens
aaagcggggagagggua

SEQ ID NO: 1654409 - RNA, 23 nt, Homo sapiens
aaagcuaagugaauuuuugcaca

SEQ ID NO: 1654410 - RNA, 13 nt, Homo sapiens
aaagcucaucuca

SEQ ID NO: 1654411 - RNA, 13 nt, Homo sapiens
aaagcugcugaca

SEQ ID NO: 1654412 - RNA, 22 nt, Homo sapiens
aaaggaauccacucccaggcag

SEQ ID NO: 1654413 - RNA, 21 nt, Homo sapiens
aaaggauaaugaauacuuuau

SEQ ID NO: 1654414 - RNA, 19 nt, Homo sapiens
aaagggcagcccuccuuac

SEQ ID NO: 1654415 - RNA, 15 nt, Homo sapiens
aaagggcaugggucg

SEQ ID NO: 1654416 - RNA, 16 nt, Homo sapiens
aaaguauaaaauagua

SEQ ID NO: 1654417 - RNA, 16 nt, Homo sapiens
aaaguggaaguaugua

SEQ ID NO: 1654418 - RNA, 16 nt, Homo sapiens
aaaguguucauuguuu

SEQ ID NO: 1654419 - RNA, 20 nt, Homo sapiens
aaauaaagguuagauaaguc

SEQ ID NO: 1654420 - RNA, 23 nt, Homo sapiens
aaauacacuguuaucuucacuuu

SEQ ID NO: 1654421 - RNA, 15 nt, Homo sapiens
aaauacagucuucca

SEQ ID NO: 1654422 - RNA, 21 nt, Homo sapiens
aaauacagucuuccauuugca

SEQ ID NO: 1654423 - RNA, 16 nt, Homo sapiens
aaauacuggacucagg

SEQ ID NO: 1654424 - RNA, 16 nt, Homo sapiens
aaauaguuuggauuac

SEQ ID NO: 1654425 - RNA, 18 nt, Homo sapiens
aaauauaaucuaauacac

SEQ ID NO: 1654426 - RNA, 21 nt, Homo sapiens
aaauaucaaagucauuaaaga

SEQ ID NO: 1654427 - RNA, 18 nt, Homo sapiens
aaauaugcaccaaaucau

SEQ ID NO: 1654428 - RNA, 19 nt, Homo sapiens
aaauauguuuggaauauuc

SEQ ID NO: 1654429 - RNA, 22 nt, Homo sapiens
aaauauguuuggaauauuccac

SEQ ID NO: 1654430 - RNA, 18 nt, Homo sapiens
aaauauuuucuacaucuu

SEQ ID NO: 1654431 - RNA, 20 nt, Homo sapiens
aaauauuuugcggcauuaaa

SEQ ID NO: 1654432 - RNA, 18 nt, Homo sapiens
aaauauuuuuaugugcaa

SEQ ID NO: 1654433 - RNA, 14 nt, Homo sapiens
aaaucaaacuguag

SEQ ID NO: 1654434 - RNA, 21 nt, Homo sapiens
aaaucaaguuggcuucuaauc

SEQ ID NO: 1654435 - RNA, 13 nt, Homo sapiens
aaaucaucucuca

SEQ ID NO: 1654436 - RNA, 20 nt, Homo sapiens
aaaucaucucucaucacuuu

SEQ ID NO: 1654437 - RNA, 17 nt, Homo sapiens
aaaucuaguauacauug

SEQ ID NO: 1654438 - RNA, 20 nt, Homo sapiens
aaaugaggagguacauugaa

SEQ ID NO: 1654439 - RNA, 17 nt, Homo sapiens
aaaugcaacaacaugua

SEQ ID NO: 1654440 - RNA, 23 nt, Homo sapiens
aaaugcugguuuuucaguuuuca

SEQ ID NO: 1654441 - RNA, 20 nt, Homo sapiens
aaaugcuguauuagucacag

SEQ ID NO: 1654442 - RNA, 19 nt, Homo sapiens
aaauggaagacacauugaa

SEQ ID NO: 1654443 - RNA, 20 nt, Homo sapiens
aaauggaggaucucuaaaga

SEQ ID NO: 1654444 - RNA, 19 nt, Homo sapiens
aaauggggauauguuaacu

SEQ ID NO: 1654445 - RNA, 23 nt, Homo sapiens
aaauggggauauguuaacuauug

SEQ ID NO: 1654446 - RNA, 15 nt, Homo sapiens
aaauggguuuauuca

SEQ ID NO: 1654447 - RNA, 22 nt, Homo sapiens
aaaugguccaggagaaggccaa

SEQ ID NO: 1654448 - RNA, 13 nt, Homo sapiens
aaaugucaucuca

SEQ ID NO: 1654449 - RNA, 15 nt, Homo sapiens
aaaugucuugcuuga

SEQ ID NO: 1654450 - RNA, 23 nt, Homo sapiens
aaauguuuguuauuuacacuggu

SEQ ID NO: 1654451 - RNA, 20 nt, Homo sapiens
aaauuaccauaaaaugucag

SEQ ID NO: 1654452 - RNA, 19 nt, Homo sapiens
aaauuauuacuaaugaugc

SEQ ID NO: 1654453 - RNA, 21 nt, Homo sapiens
aaauuauuacuaaugaugcuu

SEQ ID NO: 1654454 - RNA, 22 nt, Homo sapiens
aaauucuuaacuuuuaacauaa

SEQ ID NO: 1654455 - RNA, 23 nt, Homo sapiens
aaauucuuaacuuuuaacauaau

SEQ ID NO: 1654456 - RNA, 20 nt, Homo sapiens
aaauuguaucaaaugugaca

SEQ ID NO: 1654457 - RNA, 22 nt, Homo sapiens
aaauuguaucaaaugugacauu

SEQ ID NO: 1654458 - RNA, 14 nt, Homo sapiens
aaauuguauuauca

SEQ ID NO: 1654459 - RNA, 14 nt, Homo sapiens
aaauugugggucua

SEQ ID NO: 1654460 - RNA, 18 nt, Homo sapiens
aaauuuaaaacuguugga

SEQ ID NO: 1654461 - RNA, 19 nt, Homo sapiens
aaauuucucuacugucuca

SEQ ID NO: 1654462 - RNA, 13 nt, Homo sapiens
aaauuuguaaguu

SEQ ID NO: 1654463 - RNA, 16 nt, Homo sapiens
aaauuuuuguuuauaa

SEQ ID NO: 1654464 - RNA, 15 nt, Homo sapiens
aacaaauguauuuca

SEQ ID NO: 1654465 - RNA, 22 nt, Homo sapiens
aacaacuccuagggccacugaa

SEQ ID NO: 1654466 - RNA, 14 nt, Homo sapiens
aacaagaacuuuaa

SEQ ID NO: 1654467 - RNA, 17 nt, Homo sapiens
aacaauccaaaugcauu

SEQ ID NO: 1654468 - RNA, 23 nt, Homo sapiens
aacacaauacauguuuucacuua

SEQ ID NO: 1654469 - RNA, 21 nt, Homo sapiens
aacacacccaucaucugacau

SEQ ID NO: 1654470 - RNA, 19 nt, Homo sapiens
aacacacugagacuugaau

SEQ ID NO: 1654471 - RNA, 14 nt, Homo sapiens
aacacagcugauga

SEQ ID NO: 1654472 - RNA, 19 nt, Homo sapiens
aacacccucacacugggac

SEQ ID NO: 1654473 - RNA, 13 nt, Homo sapiens
aacacgacaugcu

SEQ ID NO: 1654474 - RNA, 22 nt, Homo sapiens
aacacuauauauuuuaugaucu

SEQ ID NO: 1654475 - RNA, 19 nt, Homo sapiens
aacacucauuuccaaucau

SEQ ID NO: 1654476 - RNA, 14 nt, Homo sapiens
aacagaaaacaauu

SEQ ID NO: 1654477 - RNA, 13 nt, Homo sapiens
aacagaacagaca

SEQ ID NO: 1654478 - RNA, 22 nt, Homo sapiens
aacagauaaucccuguauuuca

SEQ ID NO: 1654479 - RNA, 14 nt, Homo sapiens
aacagcacugacua

SEQ ID NO: 1654480 - RNA, 17 nt, Homo sapiens
aacaguuuuagaauaca

SEQ ID NO: 1654481 - RNA, 22 nt, Homo sapiens
aacauaauaaaucacacauuca

SEQ ID NO: 1654482 - RNA, 23 nt, Homo sapiens
aacauaauaaaucacacauucag

SEQ ID NO: 1654483 - RNA, 16 nt, Homo sapiens
aacauauuuaaggaac

SEQ ID NO: 1654484 - RNA, 18 nt, Homo sapiens
aacauauuuuacaucuga

SEQ ID NO: 1654485 - RNA, 22 nt, Homo sapiens
aacauccuacaagacacaguga

SEQ ID NO: 1654486 - RNA, 19 nt, Homo sapiens
aacaugccagccacuguga

SEQ ID NO: 1654487 - RNA, 13 nt, Homo sapiens
aacaugugcucag

SEQ ID NO: 1654488 - RNA, 14 nt, Homo sapiens
aacaugugcucagg

SEQ ID NO: 1654489 - RNA, 19 nt, Homo sapiens
aaccaaauauuccagagac

SEQ ID NO: 1654490 - RNA, 20 nt, Homo sapiens
aaccaccuaccuuacaguga

SEQ ID NO: 1654491 - RNA, 19 nt, Homo sapiens
aaccagcaucccuugacca

SEQ ID NO: 1654492 - RNA, 16 nt, Homo sapiens
aaccaucaucuugcca

SEQ ID NO: 1654493 - RNA, 16 nt, Homo sapiens
aacccaggagcaucca

SEQ ID NO: 1654494 - RNA, 22 nt, Homo sapiens
aacccagugaguucagccuuua

SEQ ID NO: 1654495 - RNA, 12 nt, Homo sapiens
acucaaaccaaa

SEQ ID NO: 1654496 - RNA, 21 nt, Homo sapiens
acucaaucucugauucuguca

SEQ ID NO: 1654497 - RNA, 12 nt, Homo sapiens
acucaccucccc

SEQ ID NO: 1654498 - RNA, 16 nt, Homo sapiens
acucaccugcacuaac

SEQ ID NO: 1654499 - RNA, 15 nt, Homo sapiens
acucaucauuuccau

SEQ ID NO: 1654500 - RNA, 19 nt, Homo sapiens
acucaucuugaucaaccaa

SEQ ID NO: 1654501 - RNA, 21 nt, Homo sapiens
acucaugacugagucuggcaa

SEQ ID NO: 1654502 - RNA, 15 nt, Homo sapiens
acuccagcugugaag

SEQ ID NO: 1654503 - RNA, 20 nt, Homo sapiens
acuccgagagcaugcuuaau

SEQ ID NO: 1654504 - RNA, 14 nt, Homo sapiens
acuccuaaaucaag

SEQ ID NO: 1654505 - RNA, 23 nt, Homo sapiens
acucuauaaauaaaaccugacag

SEQ ID NO: 1654506 - RNA, 18 nt, Homo sapiens
acucuccccauuggcacc

SEQ ID NO: 1654507 - RNA, 20 nt, Homo sapiens
acucucgcacacacagugau

SEQ ID NO: 1654508 - RNA, 16 nt, Homo sapiens
acucugucacccaggc

SEQ ID NO: 1654509 - RNA, 12 nt, Homo sapiens
acucugugucag

SEQ ID NO: 1654510 - RNA, 14 nt, Homo sapiens
acucugugugugua

SEQ ID NO: 1654511 - RNA, 21 nt, Homo sapiens
acucuuucugaggagcuguua

SEQ ID NO: 1654512 - RNA, 13 nt, Homo sapiens
acugaauacuuga

SEQ ID NO: 1654513 - RNA, 19 nt, Homo sapiens
acugaauuagggugggcuc

SEQ ID NO: 1654514 - RNA, 16 nt, Homo sapiens
acugaauuuugucuuu

SEQ ID NO: 1654515 - RNA, 13 nt, Homo sapiens
acugacacuggua

SEQ ID NO: 1654516 - RNA, 21 nt, Homo sapiens
acugagcaucuccagcauucu

SEQ ID NO: 1654517 - RNA, 19 nt, Homo sapiens
acugaugggcaacccccag

SEQ ID NO: 1654518 - RNA, 21 nt, Homo sapiens
acugauuuuguaaaguugccu

SEQ ID NO: 1654519 - RNA, 19 nt, Homo sapiens
acugcaaaucugccugaua

SEQ ID NO: 1654520 - RNA, 23 nt, Homo sapiens
acugcaaccuucgccaccugggu

SEQ ID NO: 1654521 - RNA, 21 nt, Homo sapiens
acugcaacuugugaacuccau

SEQ ID NO: 1654522 - RNA, 17 nt, Homo sapiens
acugccaucauuuacuu

SEQ ID NO: 1654523 - RNA, 14 nt, Homo sapiens
acugcuugaggaaa

SEQ ID NO: 1654524 - RNA, 17 nt, Homo sapiens
acugcuuuucauuagca

SEQ ID NO: 1654525 - RNA, 15 nt, Homo sapiens
acuggaagcacagcu

SEQ ID NO: 1654526 - RNA, 15 nt, Homo sapiens
acuggacucaccucc

SEQ ID NO: 1654527 - RNA, 17 nt, Homo sapiens
acuggacugucuaugaa

SEQ ID NO: 1654528 - RNA, 20 nt, Homo sapiens
acuggcuguuaaucuuucaa

SEQ ID NO: 1654529 - RNA, 16 nt, Homo sapiens
acugguauuaacuuua

SEQ ID NO: 1654530 - RNA, 19 nt, Homo sapiens
acugguauuuuaucuuuga

SEQ ID NO: 1654531 - RNA, 16 nt, Homo sapiens
acugguccugcugcug

SEQ ID NO: 1654532 - RNA, 21 nt, Homo sapiens
acuguaauaucuuuaaaugau

SEQ ID NO: 1654533 - RNA, 12 nt, Homo sapiens
acuguccugcuc

SEQ ID NO: 1654534 - RNA, 20 nt, Homo sapiens
acuguccugcuccacagugu

SEQ ID NO: 1654535 - RNA, 18 nt, Homo sapiens
acugugaaugcuucugau

SEQ ID NO: 1654536 - RNA, 15 nt, Homo sapiens
acuguggcuucuuaa

SEQ ID NO: 1654537 - RNA, 24 nt, Homo sapiens
acuguggcuucuuaaucuuuucac

SEQ ID NO: 1654538 - RNA, 21 nt, Homo sapiens
acugugucagggaacauauuu

SEQ ID NO: 1654539 - RNA, 17 nt, Homo sapiens
acuguuaacuaugacag

SEQ ID NO: 1654540 - RNA, 12 nt, Homo sapiens
acuguugcacgu

SEQ ID NO: 1654541 - RNA, 18 nt, Homo sapiens
acuguugcuuugggagac

SEQ ID NO: 1654542 - RNA, 13 nt, Homo sapiens
acuucauacaucc

SEQ ID NO: 1654543 - RNA, 17 nt, Homo sapiens
acuuccaagucauucuc

SEQ ID NO: 1654544 - RNA, 13 nt, Homo sapiens
acuuccacuccaa

SEQ ID NO: 1654545 - RNA, 21 nt, Homo sapiens
acuugaaagaaauggugaaug

SEQ ID NO: 1654546 - RNA, 19 nt, Homo sapiens
acuugaaugcuaguuauac

SEQ ID NO: 1654547 - RNA, 17 nt, Homo sapiens
acuugacagaacacugu

SEQ ID NO: 1654548 - RNA, 18 nt, Homo sapiens
acuuggaauucucucacc

SEQ ID NO: 1654549 - RNA, 20 nt, Homo sapiens
acuuggcuacacagggaugu

SEQ ID NO: 1654550 - RNA, 13 nt, Homo sapiens
acuugggaacuag

SEQ ID NO: 1654551 - RNA, 18 nt, Homo sapiens
acuugugccaacacucaa

SEQ ID NO: 1654552 - RNA, 18 nt, Homo sapiens
acuuguggacacagcucu

SEQ ID NO: 1654553 - RNA, 20 nt, Homo sapiens
acuuugauuuuauaugcuau

SEQ ID NO: 1654554 - RNA, 16 nt, Homo sapiens
acuuuuaaacuuugau

SEQ ID NO: 1654555 - RNA, 15 nt, Homo sapiens
acuuuucucaauauu

SEQ ID NO: 1654556 - RNA, 15 nt, Homo sapiens
agaaaaacaaauuca

SEQ ID NO: 1654557 - RNA, 15 nt, Homo sapiens
agaaaacaauaugag

SEQ ID NO: 1654558 - RNA, 20 nt, Homo sapiens
agaaaauaacgauaaaagac

SEQ ID NO: 1654559 - RNA, 21 nt, Homo sapiens
agaaaauaacgauaaaagaca

SEQ ID NO: 1654560 - RNA, 19 nt, Homo sapiens
agaaaaugaaaugcauauu

SEQ ID NO: 1654561 - RNA, 17 nt, Homo sapiens
agaaaaugaauuugacu

SEQ ID NO: 1654562 - RNA, 14 nt, Homo sapiens
agaaacacccucac

SEQ ID NO: 1654563 - RNA, 24 nt, Homo sapiens
agaaacccuuccacguguaugcaa

SEQ ID NO: 1654564 - RNA, 13 nt, Homo sapiens
agaaaguuaugaa

SEQ ID NO: 1654565 - RNA, 20 nt, Homo sapiens
agaaauaaaaucuaauuaau

SEQ ID NO: 1654566 - RNA, 15 nt, Homo sapiens
agaaauaaacuuugg

SEQ ID NO: 1654567 - RNA, 10 nt, Homo sapiens
agaaauaucu

SEQ ID NO: 1654568 - RNA, 16 nt, Homo sapiens
agaaauccuccaauca

SEQ ID NO: 1654569 - RNA, 13 nt, Homo sapiens
agaaauccuggga

SEQ ID NO: 1654570 - RNA, 14 nt, Homo sapiens
agaaaucuuuccag

SEQ ID NO: 1654571 - RNA, 22 nt, Homo sapiens
agaaauuuagagucaauuugcu

SEQ ID NO: 1654572 - RNA, 16 nt, Homo sapiens
agaacaaaaggcuuug

SEQ ID NO: 1654573 - RNA, 16 nt, Homo sapiens
agaacacaaggucauu

SEQ ID NO: 1654574 - RNA, 16 nt, Homo sapiens
agaacaccugcauucu

SEQ ID NO: 1654575 - RNA, 17 nt, Homo sapiens
agaacacggcagcugcu

SEQ ID NO: 1654576 - RNA, 19 nt, Homo sapiens
agaacagguguuggugaca

SEQ ID NO: 1654577 - RNA, 11 nt, Homo sapiens
aagucuuccau

SEQ ID NO: 1654578 - RNA, 19 nt, Homo sapiens
aagugauccucccaccuca

SEQ ID NO: 1654579 - RNA, 19 nt, Homo sapiens
aagugauccuuccaccuca

SEQ ID NO: 1654580 - RNA, 14 nt, Homo sapiens
aagugccugcaaaa

SEQ ID NO: 1654581 - RNA, 20 nt, Homo sapiens
aagugcugggauuacagaca

SEQ ID NO: 1654582 - RNA, 14 nt, Homo sapiens
aaguggcugugaca

SEQ ID NO: 1654583 - RNA, 12 nt, Homo sapiens
aagugugcaaaa

SEQ ID NO: 1654584 - RNA, 21 nt, Homo sapiens
aagugugcuggccucucugac

SEQ ID NO: 1654585 - RNA, 20 nt, Homo sapiens
aaguucaggcucugagacac

SEQ ID NO: 1654586 - RNA, 23 nt, Homo sapiens
aaguugauauagaacagugcuug

SEQ ID NO: 1654587 - RNA, 17 nt, Homo sapiens
aaguugcauagguuuaa

SEQ ID NO: 1654588 - RNA, 22 nt, Homo sapiens
aaguugcccaccaaaacacaga

SEQ ID NO: 1654589 - RNA, 14 nt, Homo sapiens
aaguuuaugguugu

SEQ ID NO: 1654590 - RNA, 22 nt, Homo sapiens
aaguuugugaaugugacuacuu

SEQ ID NO: 1654591 - RNA, 22 nt, Homo sapiens
aauaaaacaccuuguacuuuau

SEQ ID NO: 1654592 - RNA, 17 nt, Homo sapiens
aauaaaaggucggacca

SEQ ID NO: 1654593 - RNA, 13 nt, Homo sapiens
aauaaaauaauuc

SEQ ID NO: 1654594 - RNA, 16 nt, Homo sapiens
aauaaaaucuaauuaa

SEQ ID NO: 1654595 - RNA, 20 nt, Homo sapiens
aauaaaccaucaucuugcca

SEQ ID NO: 1654596 - RNA, 13 nt, Homo sapiens
aauaaauaagaau

SEQ ID NO: 1654597 - RNA, 13 nt, Homo sapiens
aauaaccaauccu

SEQ ID NO: 1654598 - RNA, 23 nt, Homo sapiens
aauaaccuuauucuauacuuucu

SEQ ID NO: 1654599 - RNA, 11 nt, Homo sapiens
aauaacuaaua

SEQ ID NO: 1654600 - RNA, 23 nt, Homo sapiens
aauaagcaggcgugaccugccag

SEQ ID NO: 1654601 - RNA, 19 nt, Homo sapiens
aauaagggcagagucacac

SEQ ID NO: 1654602 - RNA, 20 nt, Homo sapiens
aauaauccagaaaaacugug

SEQ ID NO: 1654603 - RNA, 17 nt, Homo sapiens
aauaaucuaugaugaag

SEQ ID NO: 1654604 - RNA, 16 nt, Homo sapiens
aauaaugucucuguga

SEQ ID NO: 1654605 - RNA, 18 nt, Homo sapiens
aauacaaacaccuggacu

SEQ ID NO: 1654606 - RNA, 14 nt, Homo sapiens
aauacacuguuauc

SEQ ID NO: 1654607 - RNA, 21 nt, Homo sapiens
aauacagucuuccauuugcaa

SEQ ID NO: 1654608 - RNA, 15 nt, Homo sapiens
aauacauguuuucac

SEQ ID NO: 1654609 - RNA, 23 nt, Homo sapiens
aauacuaacugcugauuuugaca

SEQ ID NO: 1654610 - RNA, 17 nt, Homo sapiens
aauacuaccucacuacu

SEQ ID NO: 1654611 - RNA, 13 nt, Homo sapiens
aauacugagccau

SEQ ID NO: 1654612 - RNA, 15 nt, Homo sapiens
aauagaaacauugaa

SEQ ID NO: 1654613 - RNA, 13 nt, Homo sapiens
aauagaacacagu

SEQ ID NO: 1654614 - RNA, 22 nt, Homo sapiens
aauagauuuuagcaugaugaaa

SEQ ID NO: 1654615 - RNA, 13 nt, Homo sapiens
aauagccauaaag

SEQ ID NO: 1654616 - RNA, 23 nt, Homo sapiens
aauagcugggacuacagguguga

SEQ ID NO: 1654617 - RNA, 16 nt, Homo sapiens
aauagggaaguaacag

SEQ ID NO: 1654618 - RNA, 19 nt, Homo sapiens
aauagggaaguaacaguaa

SEQ ID NO: 1654619 - RNA, 14 nt, Homo sapiens
aauagugauuucca

SEQ ID NO: 1654620 - RNA, 11 nt, Homo sapiens
aauagugccaa

SEQ ID NO: 1654621 - RNA, 22 nt, Homo sapiens
aauaguguuggaaaaugugcaa

SEQ ID NO: 1654622 - RNA, 19 nt, Homo sapiens
aauauacauuuguugguaa

SEQ ID NO: 1654623 - RNA, 12 nt, Homo sapiens
aauauauuugau

SEQ ID NO: 1654624 - RNA, 14 nt, Homo sapiens
aauaucaaagucau

SEQ ID NO: 1654625 - RNA, 15 nt, Homo sapiens
aauaucuuaucuucc

SEQ ID NO: 1654626 - RNA, 14 nt, Homo sapiens
aauaugcagugaua

SEQ ID NO: 1654627 - RNA, 19 nt, Homo sapiens
aauauggaaugggcucagu

SEQ ID NO: 1654628 - RNA, 12 nt, Homo sapiens
aauauggcucuu

SEQ ID NO: 1654629 - RNA, 17 nt, Homo sapiens
aauauuguaaauacugg

SEQ ID NO: 1654630 - RNA, 17 nt, Homo sapiens
aauauuugcaagacaua

SEQ ID NO: 1654631 - RNA, 19 nt, Homo sapiens
aauauuuuuaugugcaaua

SEQ ID NO: 1654632 - RNA, 13 nt, Homo sapiens
aaucaacuugugg

SEQ ID NO: 1654633 - RNA, 24 nt, Homo sapiens
aaucaaggcauaaaauacaauuaa

SEQ ID NO: 1654634 - RNA, 18 nt, Homo sapiens
aaucaagucagcaacaga

SEQ ID NO: 1654635 - RNA, 15 nt, Homo sapiens
aaucaaugcuauaac

SEQ ID NO: 1654636 - RNA, 23 nt, Homo sapiens
aaucacacaugcuuuucuuccua

SEQ ID NO: 1654637 - RNA, 12 nt, Homo sapiens
aaucacaguaua

SEQ ID NO: 1654638 - RNA, 18 nt, Homo sapiens
aaucacuucugagaacuc

SEQ ID NO: 1654639 - RNA, 20 nt, Homo sapiens
aaucauacaaauacuaucca

SEQ ID NO: 1654640 - RNA, 21 nt, Homo sapiens
aaucauacaaauacuauccaa

SEQ ID NO: 1654641 - RNA, 20 nt, Homo sapiens
aauccaugaaccaagaccau

SEQ ID NO: 1654642 - RNA, 14 nt, Homo sapiens
aauccuagcacuuu

SEQ ID NO: 1654643 - RNA, 15 nt, Homo sapiens
aauccugaagagcau

SEQ ID NO: 1654644 - RNA, 15 nt, Homo sapiens
aaucuaauacacuuu

SEQ ID NO: 1654645 - RNA, 17 nt, Homo sapiens
aaucuaguauacauugu

SEQ ID NO: 1654646 - RNA, 14 nt, Homo sapiens
aaucucggcucacu

SEQ ID NO: 1654647 - RNA, 16 nt, Homo sapiens
aaucucuccauucccg

SEQ ID NO: 1654648 - RNA, 18 nt, Homo sapiens
aaucugagaaucacauuu

SEQ ID NO: 1654649 - RNA, 17 nt, Homo sapiens
aaucuguaaaugaacac

SEQ ID NO: 1654650 - RNA, 15 nt, Homo sapiens
aaucuuuuauauuga

SEQ ID NO: 1654651 - RNA, 15 nt, Homo sapiens
acacuaauacaccag

SEQ ID NO: 1654652 - RNA, 15 nt, Homo sapiens
acacucacauuuauu

SEQ ID NO: 1654653 - RNA, 18 nt, Homo sapiens
acacucauuuccaaucau

SEQ ID NO: 1654654 - RNA, 22 nt, Homo sapiens
acacugagacuugaaucaaguc

SEQ ID NO: 1654655 - RNA, 15 nt, Homo sapiens
acacugucuugaaga

SEQ ID NO: 1654656 - RNA, 14 nt, Homo sapiens
acacuucuauuuaa

SEQ ID NO: 1654657 - RNA, 13 nt, Homo sapiens
acacuucucagga

SEQ ID NO: 1654658 - RNA, 21 nt, Homo sapiens
acacuuguugauuaauggaaa

SEQ ID NO: 1654659 - RNA, 13 nt, Homo sapiens
acagaacuaugga

SEQ ID NO: 1654660 - RNA, 22 nt, Homo sapiens
acagaagacagcagcaagugug

SEQ ID NO: 1654661 - RNA, 22 nt, Homo sapiens
acagaauuuuaugcggcauuuu

SEQ ID NO: 1654662 - RNA, 14 nt, Homo sapiens
acagacaugaacug

SEQ ID NO: 1654663 - RNA, 16 nt, Homo sapiens
acagaccugcucugga

SEQ ID NO: 1654664 - RNA, 16 nt, Homo sapiens
acagagaaaagacaua

SEQ ID NO: 1654665 - RNA, 20 nt, Homo sapiens
acagagauaauucuagcuuu

SEQ ID NO: 1654666 - RNA, 15 nt, Homo sapiens
acagagcagaacuuu

SEQ ID NO: 1654667 - RNA, 18 nt, Homo sapiens
acagagcuucccugacuc

SEQ ID NO: 1654668 - RNA, 21 nt, Homo sapiens
acagagucucgcuauugucac

SEQ ID NO: 1654669 - RNA, 23 nt, Homo sapiens
acagagugcuaauuuaguucuca

SEQ ID NO: 1654670 - RNA, 22 nt, Homo sapiens
acagaugugugauucacagugu

SEQ ID NO: 1654671 - RNA, 15 nt, Homo sapiens
acagauucacacugu

SEQ ID NO: 1654672 - RNA, 22 nt, Homo sapiens
acagcacccuauauacacuugg

SEQ ID NO: 1654673 - RNA, 15 nt, Homo sapiens
acagcacuaauucaa

SEQ ID NO: 1654674 - RNA, 15 nt, Homo sapiens
acagccuccaaguca

SEQ ID NO: 1654675 - RNA, 18 nt, Homo sapiens
acagcuaagaugccaugu

SEQ ID NO: 1654676 - RNA, 14 nt, Homo sapiens
acagcucuucucca

SEQ ID NO: 1654677 - RNA, 13 nt, Homo sapiens
acagcucuuguuu

SEQ ID NO: 1654678 - RNA, 14 nt, Homo sapiens
acagcuggugcuua

SEQ ID NO: 1654679 - RNA, 18 nt, Homo sapiens
acagcuuauggcaucuca

SEQ ID NO: 1654680 - RNA, 17 nt, Homo sapiens
acaggcaaauuccugac

SEQ ID NO: 1654681 - RNA, 14 nt, Homo sapiens
acagggugcuccuu

SEQ ID NO: 1654682 - RNA, 20 nt, Homo sapiens
acaggugcaacagacuugaa

SEQ ID NO: 1654683 - RNA, 13 nt, Homo sapiens
acaggugugaacc

SEQ ID NO: 1654684 - RNA, 23 nt, Homo sapiens
acaguaaauggcuuauccagcug

SEQ ID NO: 1654685 - RNA, 12 nt, Homo sapiens
uuuuaaaguaau

SEQ ID NO: 1654686 - RNA, 12 nt, Homo sapiens
uuuuaagccagg

SEQ ID NO: 1654687 - RNA, 18 nt, Homo sapiens
uuuuaauuagaaauaucu

SEQ ID NO: 1654688 - RNA, 18 nt, Homo sapiens
uuuuaguagacaguagga

SEQ ID NO: 1654689 - RNA, 19 nt, Homo sapiens
uuuuaguugcucaaagagc

SEQ ID NO: 1654690 - RNA, 18 nt, Homo sapiens
uuuuauaccaaagccaau

SEQ ID NO: 1654691 - RNA, 12 nt, Homo sapiens
uuuuauuaucaa

SEQ ID NO: 1654692 - RNA, 13 nt, Homo sapiens
uuuucccaccacc

SEQ ID NO: 1654693 - RNA, 15 nt, Homo sapiens
uuuucucugcauuua

SEQ ID NO: 1654694 - RNA, 13 nt, Homo sapiens
uuuugaaauccaa

SEQ ID NO: 1654695 - RNA, 20 nt, Homo sapiens
uuuugaagauucuauguuaa

SEQ ID NO: 1654696 - RNA, 13 nt, Homo sapiens
uuuugagacagaa

SEQ ID NO: 1654697 - RNA, 13 nt, Homo sapiens
uuuuguaaacagc

SEQ ID NO: 1654698 - RNA, 13 nt, Homo sapiens
uuuugucaccuca

SEQ ID NO: 1654699 - RNA, 19 nt, Homo sapiens
uuuugucuaugggacucaa

SEQ ID NO: 1654700 - RNA, 23 nt, Homo sapiens
uuuuuauaaaaaauggugccuga

SEQ ID NO: 1654701 - RNA, 16 nt, Homo sapiens
uuuuuauacacuguaa

SEQ ID NO: 1654702 - RNA, 16 nt, Homo sapiens
uuuuugagauggaauc

SEQ ID NO: 1654703 - RNA, 15 nt, Homo sapiens
uuuuuguacuuugcu

SEQ ID NO: 1654704 - RNA, 12 nt, Homo sapiens
uuuuuuaaucua

SEQ ID NO: 1654705 - RNA, 15 nt, Homo sapiens
uguuauuuacacugg

SEQ ID NO: 1654706 - RNA, 22 nt, Homo sapiens
uguuauuuguuuuuauuauuac

SEQ ID NO: 1654707 - RNA, 18 nt, Homo sapiens
uguucacuuauugacuau

SEQ ID NO: 1654708 - RNA, 13 nt, Homo sapiens
uguucagaugcuu

SEQ ID NO: 1654709 - RNA, 13 nt, Homo sapiens
uguucuauuuaac

SEQ ID NO: 1654710 - RNA, 16 nt, Homo sapiens
uguucucugaggacac

SEQ ID NO: 1654711 - RNA, 16 nt, Homo sapiens
uguucugcacacagca

SEQ ID NO: 1654712 - RNA, 23 nt, Homo sapiens
uguucuuuaacccucacugggac

SEQ ID NO: 1654713 - RNA, 13 nt, Homo sapiens
uguugaacaauag

SEQ ID NO: 1654714 - RNA, 14 nt, Homo sapiens
uguugacaugugcu

SEQ ID NO: 1654715 - RNA, 15 nt, Homo sapiens
uguugacuucuaucc

SEQ ID NO: 1654716 - RNA, 14 nt, Homo sapiens
uguugagccuaaua

SEQ ID NO: 1654717 - RNA, 15 nt, Homo sapiens
uguugagccuaauau

SEQ ID NO: 1654718 - RNA, 21 nt, Homo sapiens
uguugaguuuuuagagcucuu

SEQ ID NO: 1654719 - RNA, 14 nt, Homo sapiens
uguugcacgugugu

SEQ ID NO: 1654720 - RNA, 14 nt, Homo sapiens
uguugcugccucau

SEQ ID NO: 1654721 - RNA, 15 nt, Homo sapiens
uguuggcaguguuug

SEQ ID NO: 1654722 - RNA, 14 nt, Homo sapiens
uguuguaauugcau

SEQ ID NO: 1654723 - RNA, 16 nt, Homo sapiens
uguuguagcagugauu

SEQ ID NO: 1654724 - RNA, 15 nt, Homo sapiens
uguugucauguguau

SEQ ID NO: 1654725 - RNA, 13 nt, Homo sapiens
uguuuagcuauuu

SEQ ID NO: 1654726 - RNA, 23 nt, Homo sapiens
uguuuauuucaggcauuggauau

SEQ ID NO: 1654727 - RNA, 15 nt, Homo sapiens
uguuucauuaaucaa

SEQ ID NO: 1654728 - RNA, 15 nt, Homo sapiens
uguuucugaaaggga

SEQ ID NO: 1654729 - RNA, 14 nt, Homo sapiens
uguuucugaucuga

SEQ ID NO: 1654730 - RNA, 15 nt, Homo sapiens
uguuugaaagcuuua

SEQ ID NO: 1654731 - RNA, 16 nt, Homo sapiens
uguuuggaauauucca

SEQ ID NO: 1654732 - RNA, 15 nt, Homo sapiens
uuaaaaaaucuguug

SEQ ID NO: 1654733 - RNA, 19 nt, Homo sapiens
uuaaaaauuaaauucucuc

SEQ ID NO: 1654734 - RNA, 22 nt, Homo sapiens
uuaaaacaacacucacauuuau

SEQ ID NO: 1654735 - RNA, 17 nt, Homo sapiens
uuaaaacauugguuaua

SEQ ID NO: 1654736 - RNA, 18 nt, Homo sapiens
uuaaaaucugucacguag

SEQ ID NO: 1654737 - RNA, 18 nt, Homo sapiens
uuaaaccuuaagauacua

SEQ ID NO: 1654738 - RNA, 12 nt, Homo sapiens
uuaaacuuucaa

SEQ ID NO: 1654739 - RNA, 15 nt, Homo sapiens
uuaaagugaaucuca

SEQ ID NO: 1654740 - RNA, 15 nt, Homo sapiens
uuaaauaaauggaau

SEQ ID NO: 1654741 - RNA, 17 nt, Homo sapiens
uuaaauacagucuucca

SEQ ID NO: 1654742 - RNA, 19 nt, Homo sapiens
uuaaauguagaaagugauc

SEQ ID NO: 1654743 - RNA, 17 nt, Homo sapiens
uuaaauugaauucuacu

SEQ ID NO: 1654744 - RNA, 11 nt, Homo sapiens
uuaacaguguu

SEQ ID NO: 1654745 - RNA, 15 nt, Homo sapiens
uuaaccugaugcagu

SEQ ID NO: 1654746 - RNA, 16 nt, Homo sapiens
uuaacuaugacagaua

SEQ ID NO: 1654747 - RNA, 14 nt, Homo sapiens
uuaagacuacugaa

SEQ ID NO: 1654748 - RNA, 21 nt, Homo sapiens
uuaagauuuuuuauuugaaaa

SEQ ID NO: 1654749 - RNA, 18 nt, Homo sapiens
uuaagccuuauaaaccaa

SEQ ID NO: 1654750 - RNA, 23 nt, Homo sapiens
uuaaguuacaauuacaucucuaa

SEQ ID NO: 1654751 - RNA, 16 nt, Homo sapiens
uuaaguugauggugau

SEQ ID NO: 1654752 - RNA, 17 nt, Homo sapiens
uuaaguugauggugaug

SEQ ID NO: 1654753 - RNA, 16 nt, Homo sapiens
uuaauaguauaucuaa

SEQ ID NO: 1654754 - RNA, 20 nt, Homo sapiens
uuaauauaagaagcuuucag

SEQ ID NO: 1654755 - RNA, 18 nt, Homo sapiens
uuaauccuguaccaaauc

SEQ ID NO: 1654756 - RNA, 21 nt, Homo sapiens
uucuuaaucuuuucacaaaua

SEQ ID NO: 1654757 - RNA, 14 nt, Homo sapiens
uucuuaggccacau

SEQ ID NO: 1654758 - RNA, 15 nt, Homo sapiens
uucuuaguggaagac

SEQ ID NO: 1654759 - RNA, 20 nt, Homo sapiens
uucuuaguggaagacaauac

SEQ ID NO: 1654760 - RNA, 17 nt, Homo sapiens
uucuuauguugcccagu

SEQ ID NO: 1654761 - RNA, 14 nt, Homo sapiens
uucuuauucacuuu

SEQ ID NO: 1654762 - RNA, 12 nt, Homo sapiens
uucuucaacucc

SEQ ID NO: 1654763 - RNA, 21 nt, Homo sapiens
uucuuccucaaagcauuugca

SEQ ID NO: 1654764 - RNA, 23 nt, Homo sapiens
uucuucuacugcccugagccuga

SEQ ID NO: 1654765 - RNA, 16 nt, Homo sapiens
uucuucuuagcaccac

SEQ ID NO: 1654766 - RNA, 19 nt, Homo sapiens
uucuuuucuaaaugccaau

SEQ ID NO: 1654767 - RNA, 15 nt, Homo sapiens
uugaaaccuuugaca

SEQ ID NO: 1654768 - RNA, 14 nt, Homo sapiens
uugaacacaaguuc

SEQ ID NO: 1654769 - RNA, 16 nt, Homo sapiens
uugaauuaagaagaaa

SEQ ID NO: 1654770 - RNA, 18 nt, Homo sapiens
uugacaaacuucuuucac

SEQ ID NO: 1654771 - RNA, 22 nt, Homo sapiens
uugacaaacuucuuucacucac

SEQ ID NO: 1654772 - RNA, 15 nt, Homo sapiens
uugacagaacacugu

SEQ ID NO: 1654773 - RNA, 22 nt, Homo sapiens
uugacguaagcucuaucugcaa

SEQ ID NO: 1654774 - RNA, 16 nt, Homo sapiens
uugagucucugaacau

SEQ ID NO: 1654775 - RNA, 16 nt, Homo sapiens
uugaugcuacaggauu

SEQ ID NO: 1654776 - RNA, 16 nt, Homo sapiens
uugauucauauugcau

SEQ ID NO: 1654777 - RNA, 17 nt, Homo sapiens
uugauuuuauaugcuau

SEQ ID NO: 1654778 - RNA, 22 nt, Homo sapiens
uugcaaccucgcuggacucuca

SEQ ID NO: 1654779 - RNA, 15 nt, Homo sapiens
uugcaagacauagaa

SEQ ID NO: 1654780 - RNA, 13 nt, Homo sapiens
uugcaaggcauuu

SEQ ID NO: 1654781 - RNA, 21 nt, Homo sapiens
uugcagcuuauauucauccau

SEQ ID NO: 1654782 - RNA, 21 nt, Homo sapiens
uugcaucagcaacaaccagca

SEQ ID NO: 1654783 - RNA, 14 nt, Homo sapiens
uugcauccuaacuc

SEQ ID NO: 1654784 - RNA, 16 nt, Homo sapiens
uugccacuacccccuc

SEQ ID NO: 1654785 - RNA, 13 nt, Homo sapiens
uugcccagugugu

SEQ ID NO: 1654786 - RNA, 16 nt, Homo sapiens
uugcccuuuccauauu

SEQ ID NO: 1654787 - RNA, 13 nt, Homo sapiens
uugccuaucugac

SEQ ID NO: 1654788 - RNA, 23 nt, Homo sapiens
uugcgagagauguguguugauac

SEQ ID NO: 1654789 - RNA, 17 nt, Homo sapiens
uugcggggauaaagaga

SEQ ID NO: 1654790 - RNA, 12 nt, Homo sapiens
uugcuccauuuu

SEQ ID NO: 1654791 - RNA, 18 nt, Homo sapiens
uugcugaaugucauuauu

SEQ ID NO: 1654792 - RNA, 24 nt, Homo sapiens
uugcugggguuggagguuucacuu

SEQ ID NO: 1654793 - RNA, 16 nt, Homo sapiens
uugcuuuacaaaccaa

SEQ ID NO: 1654794 - RNA, 13 nt, Homo sapiens
uugcuuugcccag

SEQ ID NO: 1654795 - RNA, 20 nt, Homo sapiens
uugcuuugggggcuuuacaa

SEQ ID NO: 1654796 - RNA, 17 nt, Homo sapiens
uuggaaaauaaaucaau

SEQ ID NO: 1654797 - RNA, 17 nt, Homo sapiens
uuggaaaaugugcaaua

SEQ ID NO: 1654798 - RNA, 12 nt, Homo sapiens
uuggaaaucaca

SEQ ID NO: 1654799 - RNA, 15 nt, Homo sapiens
uuggaagaaauaucc

SEQ ID NO: 1654800 - RNA, 13 nt, Homo sapiens
uuggaauucucuc

SEQ ID NO: 1654801 - RNA, 21 nt, Homo sapiens
uuggacucaagcaagauuuca

SEQ ID NO: 1654802 - RNA, 17 nt, Homo sapiens
uuggagggugucccaaa

SEQ ID NO: 1654803 - RNA, 16 nt, Homo sapiens
uuggagucagacagau

SEQ ID NO: 1654804 - RNA, 20 nt, Homo sapiens
uuggagucugacugugccca

SEQ ID NO: 1654805 - RNA, 19 nt, Homo sapiens
uuggauacgacaacuugca

SEQ ID NO: 1654806 - RNA, 15 nt, Homo sapiens
uuggauuguccccga

SEQ ID NO: 1654807 - RNA, 13 nt, Homo sapiens
uuggcaacagaaa

SEQ ID NO: 1654808 - RNA, 20 nt, Homo sapiens
uuggcaccgcuucucagcca

SEQ ID NO: 1654809 - RNA, 15 nt, Homo sapiens
uuggccaucucugga

SEQ ID NO: 1654810 - RNA, 21 nt, Homo sapiens
uuggccuauuccauucuggau

SEQ ID NO: 1654811 - RNA, 16 nt, Homo sapiens
uuggcuacacagggau

SEQ ID NO: 1654812 - RNA, 20 nt, Homo sapiens
uuggcugagagaguggcauu

SEQ ID NO: 1654813 - RNA, 22 nt, Homo sapiens
uuggcugugcccucagauuccg

SEQ ID NO: 1654814 - RNA, 13 nt, Homo sapiens
guuuaaagucuca

SEQ ID NO: 1654815 - RNA, 22 nt, Homo sapiens
guuuaaagucucaguuucuugc

SEQ ID NO: 1654816 - RNA, 17 nt, Homo sapiens
guuuagaugaaugucag

SEQ ID NO: 1654817 - RNA, 15 nt, Homo sapiens
guuucccacucugaa

SEQ ID NO: 1654818 - RNA, 18 nt, Homo sapiens
guuuccuuucauuuacug

SEQ ID NO: 1654819 - RNA, 13 nt, Homo sapiens
guuucucccccau

SEQ ID NO: 1654820 - RNA, 20 nt, Homo sapiens
guuucugaucugaugcaagc

SEQ ID NO: 1654821 - RNA, 23 nt, Homo sapiens
guuucuuucuaguggucuuugua

SEQ ID NO: 1654822 - RNA, 15 nt, Homo sapiens
guuugagaccagccu

SEQ ID NO: 1654823 - RNA, 17 nt, Homo sapiens
guuugguaguuuugcca

SEQ ID NO: 1654824 - RNA, 13 nt, Homo sapiens
guuugucuucucc

SEQ ID NO: 1654825 - RNA, 19 nt, Homo sapiens
guuugugucaaaacugguu

SEQ ID NO: 1654826 - RNA, 20 nt, Homo sapiens
guuuuaaaaagggaaaguuu

SEQ ID NO: 1654827 - RNA, 20 nt, Homo sapiens
guuuuaaagcuugcucacau

SEQ ID NO: 1654828 - RNA, 22 nt, Homo sapiens
guuuuaagaggcagggucucac

SEQ ID NO: 1654829 - RNA, 17 nt, Homo sapiens
guuuucaucaagacugg

SEQ ID NO: 1654830 - RNA, 21 nt, Homo sapiens
guuuucuuuuucagauuuaug

SEQ ID NO: 1654831 - RNA, 19 nt, Homo sapiens
guuuuguggaggagcucag

SEQ ID NO: 1654832 - RNA, 23 nt, Homo sapiens
guuuuugugaaaagcuccauuuu

SEQ ID NO: 1654833 - RNA, 16 nt, Homo sapiens
uaaaacaaaagcucau

SEQ ID NO: 1654834 - RNA, 19 nt, Homo sapiens
uaaaacaagcacuaaacaa

SEQ ID NO: 1654835 - RNA, 19 nt, Homo sapiens
uaaaacugccuuucuggug

SEQ ID NO: 1654836 - RNA, 23 nt, Homo sapiens
uaaaacugccuuucugguggcuu

SEQ ID NO: 1654837 - RNA, 15 nt, Homo sapiens
uaaaagaauuacaua

SEQ ID NO: 1654838 - RNA, 13 nt, Homo sapiens
uaaaagacaguga

SEQ ID NO: 1654839 - RNA, 19 nt, Homo sapiens
uaaaagcaggcuucuauga

SEQ ID NO: 1654840 - RNA, 23 nt, Homo sapiens
uaaaaguacauguuaaacuuacu

SEQ ID NO: 1654841 - RNA, 15 nt, Homo sapiens
uaaaauaguaugaaa

SEQ ID NO: 1654842 - RNA, 18 nt, Homo sapiens
uaaaauaucuuuugaccu

SEQ ID NO: 1654843 - RNA, 23 nt, Homo sapiens
uaaaauauuuuagauguuauuau

SEQ ID NO: 1654844 - RNA, 23 nt, Homo sapiens
ucugagcagugaaugauucagug

SEQ ID NO: 1654845 - RNA, 13 nt, Homo sapiens
ucugagcauuuaa

SEQ ID NO: 1654846 - RNA, 13 nt, Homo sapiens
ucugagcugugca

SEQ ID NO: 1654847 - RNA, 21 nt, Homo sapiens
ucugaggcuucuggggcuuca

SEQ ID NO: 1654848 - RNA, 14 nt, Homo sapiens
ucugauacguguau

SEQ ID NO: 1654849 - RNA, 20 nt, Homo sapiens
ucugcgugucaccugugcuu

SEQ ID NO: 1654850 - RNA, 18 nt, Homo sapiens
ucugcugacagacacagg

SEQ ID NO: 1654851 - RNA, 22 nt, Homo sapiens
ucugcugucuuuauaaugggau

SEQ ID NO: 1654852 - RNA, 20 nt, Homo sapiens
ucugcuuaaucugagaauca

SEQ ID NO: 1654853 - RNA, 20 nt, Homo sapiens
ucuggauuucauacuguaac

SEQ ID NO: 1654854 - RNA, 11 nt, Homo sapiens
ucuggcagcuc

SEQ ID NO: 1654855 - RNA, 19 nt, Homo sapiens
ucuggccguugauguuggc

SEQ ID NO: 1654856 - RNA, 14 nt, Homo sapiens
ucugggccagguug

SEQ ID NO: 1654857 - RNA, 18 nt, Homo sapiens
ucugguaucugcauguaa

SEQ ID NO: 1654858 - RNA, 12 nt, Homo sapiens
ucuguaaucuuc

SEQ ID NO: 1654859 - RNA, 15 nt, Homo sapiens
ucugucaaugucuug

SEQ ID NO: 1654860 - RNA, 21 nt, Homo sapiens
ucugucccagguuaucugggc

SEQ ID NO: 1654861 - RNA, 17 nt, Homo sapiens
ucuguccccuucucuca

SEQ ID NO: 1654862 - RNA, 17 nt, Homo sapiens
ucuguucugcacacagc

SEQ ID NO: 1654863 - RNA, 21 nt, Homo sapiens
ucuuaaacuaaaugugcaaua

SEQ ID NO: 1654864 - RNA, 22 nt, Homo sapiens
ucuuaaacuaaaugugcaauag

SEQ ID NO: 1654865 - RNA, 14 nt, Homo sapiens
ucuuaacuauucaa

SEQ ID NO: 1654866 - RNA, 23 nt, Homo sapiens
ucuuaagacgugauuuugcugua

SEQ ID NO: 1654867 - RNA, 19 nt, Homo sapiens
ucuuacagucagcacagaa

SEQ ID NO: 1654868 - RNA, 15 nt, Homo sapiens
ucuuacauuagugau

SEQ ID NO: 1654869 - RNA, 11 nt, Homo sapiens
ucuuacuuugu

SEQ ID NO: 1654870 - RNA, 23 nt, Homo sapiens
ucuuagcuccccuccaaccuggg

SEQ ID NO: 1654871 - RNA, 16 nt, Homo sapiens
ucuuaguggaagacaa

SEQ ID NO: 1654872 - RNA, 14 nt, Homo sapiens
ucuuauaauuccag

SEQ ID NO: 1654873 - RNA, 13 nt, Homo sapiens
ucuucaagauuua

SEQ ID NO: 1654874 - RNA, 13 nt, Homo sapiens
ucuucacucacag

SEQ ID NO: 1654875 - RNA, 21 nt, Homo sapiens
ucuucauaauuucuucacuca

SEQ ID NO: 1654876 - RNA, 17 nt, Homo sapiens
ucuuccauuugcaaggg

SEQ ID NO: 1654877 - RNA, 15 nt, Homo sapiens
ucuucccuuaccuca

SEQ ID NO: 1654878 - RNA, 16 nt, Homo sapiens
ucuucccuuaccucaa

SEQ ID NO: 1654879 - RNA, 17 nt, Homo sapiens
ucuuccuguucugugac

SEQ ID NO: 1654880 - RNA, 22 nt, Homo sapiens
ucuucguguauagcugugugaa

SEQ ID NO: 1654881 - RNA, 19 nt, Homo sapiens
ucuucuacaugcaauuuag

SEQ ID NO: 1654882 - RNA, 23 nt, Homo sapiens
ucuucuccaggcuguaucccaug

SEQ ID NO: 1654883 - RNA, 18 nt, Homo sapiens
ucuucugaauugacugua

SEQ ID NO: 1654884 - RNA, 19 nt, Homo sapiens
ucuucuuucuacaguauua

SEQ ID NO: 1654885 - RNA, 21 nt, Homo sapiens
ucuugaauuguaggugacuau

SEQ ID NO: 1654886 - RNA, 21 nt, Homo sapiens
ucuugcaagcaacaagcuauu

SEQ ID NO: 1654887 - RNA, 15 nt, Homo sapiens
ucuuggagaauauca

SEQ ID NO: 1654888 - RNA, 15 nt, Homo sapiens
ucuuguauugcucca

SEQ ID NO: 1654889 - RNA, 19 nt, Homo sapiens
ucuuuaacccucacuggga

SEQ ID NO: 1654890 - RNA, 13 nt, Homo sapiens
ucuuuacucaggc

SEQ ID NO: 1654891 - RNA, 14 nt, Homo sapiens
ucuuuacuccauga

SEQ ID NO: 1654892 - RNA, 16 nt, Homo sapiens
ucuuuauaaugggaua

SEQ ID NO: 1654893 - RNA, 20 nt, Homo sapiens
ucuuugcagacaggcaagca

SEQ ID NO: 1654894 - RNA, 12 nt, Homo sapiens
ucuuugccaagu

SEQ ID NO: 1654895 - RNA, 21 nt, Homo sapiens
ucuuugcugcagaacugaaga

SEQ ID NO: 1654896 - RNA, 13 nt, Homo sapiens
ucuuuggacagaa

SEQ ID NO: 1654897 - RNA, 21 nt, Homo sapiens
ucuuuggaccacuccccucaa

SEQ ID NO: 1654898 - RNA, 14 nt, Homo sapiens
ucuuuggacccuga

SEQ ID NO: 1654899 - RNA, 21 nt, Homo sapiens
ucuuuguauauuuacaugcuu

SEQ ID NO: 1654900 - RNA, 14 nt, Homo sapiens
ucuuugucuuuauu

SEQ ID NO: 1654901 - RNA, 18 nt, Homo sapiens
ucuuuguucaaauguacu

SEQ ID NO: 1654902 - RNA, 18 nt, Homo sapiens
ucuuuuauauugauaaca

SEQ ID NO: 1654903 - RNA, 13 nt, Homo sapiens
ucuuuucacaaau

SEQ ID NO: 1654904 - RNA, 15 nt, Homo sapiens
ucuuuucacaaauaa

SEQ ID NO: 1654905 - RNA, 19 nt, Homo sapiens
ucuuuucuugcaugaggcu

SEQ ID NO: 1654906 - RNA, 13 nt, Homo sapiens
ugaaaaaaagcuu

SEQ ID NO: 1654907 - RNA, 16 nt, Homo sapiens
ugaaaacacugugcac

SEQ ID NO: 1654908 - RNA, 17 nt, Homo sapiens
ugaaaacacugugcaca

SEQ ID NO: 1654909 - RNA, 15 nt, Homo sapiens
ugaaaaccugcauuu

SEQ ID NO: 1654910 - RNA, 22 nt, Homo sapiens
ugaaaagagaggauauguucac

SEQ ID NO: 1654911 - RNA, 12 nt, Homo sapiens
gugauuccauca

SEQ ID NO: 1654912 - RNA, 20 nt, Homo sapiens
gugcacaacauuacagggaa

SEQ ID NO: 1654913 - RNA, 18 nt, Homo sapiens
gugcacguacacacacau

SEQ ID NO: 1654914 - RNA, 17 nt, Homo sapiens
gugcaugcagcaucuaa

SEQ ID NO: 1654915 - RNA, 20 nt, Homo sapiens
gugccauacuuguucuguau

SEQ ID NO: 1654916 - RNA, 20 nt, Homo sapiens
gugcccaaguggguccaagu

SEQ ID NO: 1654917 - RNA, 17 nt, Homo sapiens
gugcccccugaaacagc

SEQ ID NO: 1654918 - RNA, 21 nt, Homo sapiens
gugcuaauuuguuuuggauau

SEQ ID NO: 1654919 - RNA, 18 nt, Homo sapiens
gugcuggccucucugaca

SEQ ID NO: 1654920 - RNA, 22 nt, Homo sapiens
gugcuucuuaaaauagccauaa

SEQ ID NO: 1654921 - RNA, 21 nt, Homo sapiens
gugcuuuauaccccauuugau

SEQ ID NO: 1654922 - RNA, 15 nt, Homo sapiens
guggaacaagcacag

SEQ ID NO: 1654923 - RNA, 15 nt, Homo sapiens
guggaauugugcuga

SEQ ID NO: 1654924 - RNA, 15 nt, Homo sapiens
guggagaaggugaca

SEQ ID NO: 1654925 - RNA, 20 nt, Homo sapiens
guggagccaauccacuccuu

SEQ ID NO: 1654926 - RNA, 22 nt, Homo sapiens
guggcagaauggggugcaugaa

SEQ ID NO: 1654927 - RNA, 20 nt, Homo sapiens
guggcagcggggcaagcaaa

SEQ ID NO: 1654928 - RNA, 21 nt, Homo sapiens
guggcagcugcuuuugucuau

SEQ ID NO: 1654929 - RNA, 20 nt, Homo sapiens
guggcauguggguugugaua

SEQ ID NO: 1654930 - RNA, 15 nt, Homo sapiens
guggccuaccuugug

SEQ ID NO: 1654931 - RNA, 22 nt, Homo sapiens
guggcuucuuaaucuuuucaca

SEQ ID NO: 1654932 - RNA, 20 nt, Homo sapiens
gugggcucccugacugggag

SEQ ID NO: 1654933 - RNA, 19 nt, Homo sapiens
guggggaccccaccccuca

SEQ ID NO: 1654934 - RNA, 12 nt, Homo sapiens
gugggggguccc

SEQ ID NO: 1654935 - RNA, 22 nt, Homo sapiens
guggugucgcgccuucuccccc

SEQ ID NO: 1654936 - RNA, 11 nt, Homo sapiens
gugguucucaa

SEQ ID NO: 1654937 - RNA, 20 nt, Homo sapiens
gugguugcauccuaacucca

SEQ ID NO: 1654938 - RNA, 11 nt, Homo sapiens
guguacauuuu

SEQ ID NO: 1654939 - RNA, 13 nt, Homo sapiens
guguaccagagaa

SEQ ID NO: 1654940 - RNA, 11 nt, Homo sapiens
gugucugcaac

SEQ ID NO: 1654941 - RNA, 20 nt, Homo sapiens
guguugauacuguugcacgu

SEQ ID NO: 1654942 - RNA, 23 nt, Homo sapiens
guguugauacuguugcacgugug

SEQ ID NO: 1654943 - RNA, 13 nt, Homo sapiens
guguugcauaaac

SEQ ID NO: 1654944 - RNA, 23 nt, Homo sapiens
guguuuccuggcacugcuuccag

SEQ ID NO: 1654945 - RNA, 23 nt, Homo sapiens
guuaaaagcaaaaagauguauau

SEQ ID NO: 1654946 - RNA, 14 nt, Homo sapiens
guuaauauggcucu

SEQ ID NO: 1654947 - RNA, 15 nt, Homo sapiens
guuaauccacaucuu

SEQ ID NO: 1654948 - RNA, 11 nt, Homo sapiens
guuaaugccau

SEQ ID NO: 1654949 - RNA, 22 nt, Homo sapiens
guuaccugaaaacacugugcac

SEQ ID NO: 1654950 - RNA, 18 nt, Homo sapiens
guuacugaauauuaaaaa

SEQ ID NO: 1654951 - RNA, 15 nt, Homo sapiens
guuacugauguucaa

SEQ ID NO: 1654952 - RNA, 20 nt, Homo sapiens
guuagauuuuguauucaggg

SEQ ID NO: 1654953 - RNA, 15 nt, Homo sapiens
guuaggguguguguu

SEQ ID NO: 1654954 - RNA, 14 nt, Homo sapiens
guuaguuccuucau

SEQ ID NO: 1654955 - RNA, 19 nt, Homo sapiens
guuauacuuauuuguauau

SEQ ID NO: 1654956 - RNA, 19 nt, Homo sapiens
guuaucugucccagguuau

SEQ ID NO: 1654957 - RNA, 11 nt, Homo sapiens
guuaugacucc

SEQ ID NO: 1654958 - RNA, 17 nt, Homo sapiens
guuauuuuaucugcuau

SEQ ID NO: 1654959 - RNA, 18 nt, Homo sapiens
guucaagagcacacuugg

SEQ ID NO: 1654960 - RNA, 21 nt, Homo sapiens
guucaaucuggauucauauuu

SEQ ID NO: 1654961 - RNA, 23 nt, Homo sapiens
guucaauucucauuugucacaca

SEQ ID NO: 1654962 - RNA, 13 nt, Homo sapiens
guucaccagguca

SEQ ID NO: 1654963 - RNA, 22 nt, Homo sapiens
guucaccuucaaaauguucuau

SEQ ID NO: 1654964 - RNA, 22 nt, Homo sapiens
guucacguuguucacaucccau

SEQ ID NO: 1654965 - RNA, 21 nt, Homo sapiens
guucagaaucacuucugagaa

SEQ ID NO: 1654966 - RNA, 14 nt, Homo sapiens
guucagaugcuucu

SEQ ID NO: 1654967 - RNA, 14 nt, Homo sapiens
guucagcucacugu

SEQ ID NO: 1654968 - RNA, 17 nt, Homo sapiens
guuccacuugguucagg

SEQ ID NO: 1654969 - RNA, 21 nt, Homo sapiens
guuccagcaaacaaaauggac

SEQ ID NO: 1654970 - RNA, 14 nt, Homo sapiens
guucccccacugau

SEQ ID NO: 1654971 - RNA, 20 nt, Homo sapiens
guucuauuuaacaacugggu

SEQ ID NO: 1654972 - RNA, 19 nt, Homo sapiens
guucucaauucugucucau

SEQ ID NO: 1654973 - RNA, 22 nt, Homo sapiens
guucugauauuggacaguaaaa

SEQ ID NO: 1654974 - RNA, 14 nt, Homo sapiens
guucugcacacagc

SEQ ID NO: 1654975 - RNA, 22 nt, Homo sapiens
guucugcuuuccucuuccugaa

SEQ ID NO: 1654976 - RNA, 19 nt, Homo sapiens
guucuggcucuuccaggcu

SEQ ID NO: 1654977 - RNA, 22 nt, Homo sapiens
guucuuuaacccucacugggac

SEQ ID NO: 1654978 - RNA, 22 nt, Homo sapiens
guugauggaaauacacuguuau

SEQ ID NO: 1654979 - RNA, 19 nt, Homo sapiens
guugauucauauugcauca

SEQ ID NO: 1654980 - RNA, 20 nt, Homo sapiens
guugauucauauugcaucau

SEQ ID NO: 1654981 - RNA, 19 nt, Homo sapiens
guugcaauagaacagagaa

SEQ ID NO: 1654982 - RNA, 21 nt, Homo sapiens
guugcacguguguuuuucuau

SEQ ID NO: 1654983 - RNA, 21 nt, Homo sapiens
guugcagugagccgagaucac

SEQ ID NO: 1654984 - RNA, 15 nt, Homo sapiens
guugcaucaacaaag

SEQ ID NO: 1654985 - RNA, 20 nt, Homo sapiens
guugcccaccaaaacacaga

SEQ ID NO: 1654986 - RNA, 16 nt, Homo sapiens
guuggaaaaugugcaa

SEQ ID NO: 1654987 - RNA, 18 nt, Homo sapiens
guuggaaaaugugcaaua

SEQ ID NO: 1654988 - RNA, 22 nt, Homo sapiens
guuggagguuucacuugcacau

SEQ ID NO: 1654989 - RNA, 16 nt, Homo sapiens
guugggcugugccugg

SEQ ID NO: 1654990 - RNA, 16 nt, Homo sapiens
guuggucccccuucca

SEQ ID NO: 1654991 - RNA, 10 nt, Homo sapiens
guuggugcaa

SEQ ID NO: 1654992 - RNA, 19 nt, Homo sapiens
gcuacacugacacugguau

SEQ ID NO: 1654993 - RNA, 15 nt, Homo sapiens
gcuaccuacugauaa

SEQ ID NO: 1654994 - RNA, 23 nt, Homo sapiens
gcuacugugucagggaacauauu

SEQ ID NO: 1654995 - RNA, 13 nt, Homo sapiens
gcuacuucuuauu

SEQ ID NO: 1654996 - RNA, 23 nt, Homo sapiens
gcuaucccuuuccaaaggccaug

SEQ ID NO: 1654997 - RNA, 16 nt, Homo sapiens
gcucaaagagccucac

SEQ ID NO: 1654998 - RNA, 18 nt, Homo sapiens
gcucacauaucugucauu

SEQ ID NO: 1654999 - RNA, 22 nt, Homo sapiens
gcucacugaaaagacuauugug

SEQ ID NO: 1655000 - RNA, 14 nt, Homo sapiens
gcucacugcagccu

SEQ ID NO: 1655001 - RNA, 18 nt, Homo sapiens
gcucacuguucuauucau

SEQ ID NO: 1655002 - RNA, 16 nt, Homo sapiens
gcucaggaccaggcaa

SEQ ID NO: 1655003 - RNA, 13 nt, Homo sapiens
gcuccaaacccuc

SEQ ID NO: 1655004 - RNA, 12 nt, Homo sapiens
gcuccacagugu

SEQ ID NO: 1655005 - RNA, 21 nt, Homo sapiens
gcuccaccuugugacccaggg

SEQ ID NO: 1655006 - RNA, 17 nt, Homo sapiens
gcuccagccugacaaca

SEQ ID NO: 1655007 - RNA, 20 nt, Homo sapiens
gcuccagccugacaacagcc

SEQ ID NO: 1655008 - RNA, 21 nt, Homo sapiens
gcuccaucgcugucaucucag

SEQ ID NO: 1655009 - RNA, 14 nt, Homo sapiens
gcucccacagaaca

SEQ ID NO: 1655010 - RNA, 13 nt, Homo sapiens
gcucccucugugu

SEQ ID NO: 1655011 - RNA, 18 nt, Homo sapiens
gcucccucuguguuagaa

SEQ ID NO: 1655012 - RNA, 19 nt, Homo sapiens
gcucccugguucugaugau

SEQ ID NO: 1655013 - RNA, 12 nt, Homo sapiens
gcuccucaucca

SEQ ID NO: 1655014 - RNA, 15 nt, Homo sapiens
gcuccuucuguccua

SEQ ID NO: 1655015 - RNA, 14 nt, Homo sapiens
gcuccuugucaaua

SEQ ID NO: 1655016 - RNA, 15 nt, Homo sapiens
gcuccuugucaauac

SEQ ID NO: 1655017 - RNA, 16 nt, Homo sapiens
gcucgcuuugagugac

SEQ ID NO: 1655018 - RNA, 18 nt, Homo sapiens
gcucuaagaagcugcaau

SEQ ID NO: 1655019 - RNA, 15 nt, Homo sapiens
gcucucuaauuccac

SEQ ID NO: 1655020 - RNA, 18 nt, Homo sapiens
gcucugaucauccacugu

SEQ ID NO: 1655021 - RNA, 13 nt, Homo sapiens
gcucugcaccuuc

SEQ ID NO: 1655022 - RNA, 17 nt, Homo sapiens
gcucugugggcugcacu

SEQ ID NO: 1655023 - RNA, 15 nt, Homo sapiens
gcugaacucaugaga

SEQ ID NO: 1655024 - RNA, 23 nt, Homo sapiens
gcugaaguguuuuugugcagcug

SEQ ID NO: 1655025 - RNA, 21 nt, Homo sapiens
gcugacuuuucugacccaugu

SEQ ID NO: 1655026 - RNA, 18 nt, Homo sapiens
gcugaguuccggggugca

SEQ ID NO: 1655027 - RNA, 21 nt, Homo sapiens
gcugaguuccggggugcaaug

SEQ ID NO: 1655028 - RNA, 13 nt, Homo sapiens
gcugauguccuca

SEQ ID NO: 1655029 - RNA, 22 nt, Homo sapiens
gcugauguuuauaaacugagag

SEQ ID NO: 1655030 - RNA, 14 nt, Homo sapiens
gcugcaugcgagug

SEQ ID NO: 1655031 - RNA, 21 nt, Homo sapiens
gcuggaacagauucacacugu

SEQ ID NO: 1655032 - RNA, 19 nt, Homo sapiens
gcuggagccuggugcccua

SEQ ID NO: 1655033 - RNA, 20 nt, Homo sapiens
gcuggagccuggugcccuaa

SEQ ID NO: 1655034 - RNA, 21 nt, Homo sapiens
gcuggagggagaacccaaaga

SEQ ID NO: 1655035 - RNA, 14 nt, Homo sapiens
gcuggagugcagug

SEQ ID NO: 1655036 - RNA, 21 nt, Homo sapiens
gcuggcaccuuaguugcauga

SEQ ID NO: 1655037 - RNA, 23 nt, Homo sapiens
gcuggcaccuuaguugcaugacc

SEQ ID NO: 1655038 - RNA, 17 nt, Homo sapiens
gcuggccucucugacau

SEQ ID NO: 1655039 - RNA, 14 nt, Homo sapiens
gcuggccuguguga

SEQ ID NO: 1655040 - RNA, 21 nt, Homo sapiens
gcuggcgucaugcaaagucau

SEQ ID NO: 1655041 - RNA, 21 nt, Homo sapiens
gcuggcuggggccuaucagug

SEQ ID NO: 1655042 - RNA, 13 nt, Homo sapiens
gcuggcugugaaa

SEQ ID NO: 1655043 - RNA, 17 nt, Homo sapiens
gcugggagagccuucca

SEQ ID NO: 1655044 - RNA, 13 nt, Homo sapiens
gcugggauuacag

SEQ ID NO: 1655045 - RNA, 19 nt, Homo sapiens
gcugggcaguuuuucugua

SEQ ID NO: 1655046 - RNA, 19 nt, Homo sapiens
gcuggguggcccauccccc

SEQ ID NO: 1655047 - RNA, 13 nt, Homo sapiens
gcugucaggauug

SEQ ID NO: 1655048 - RNA, 22 nt, Homo sapiens
gcuguccagugcccauuccuca

SEQ ID NO: 1655049 - RNA, 21 nt, Homo sapiens
gcuguggcauuguugaugcuc

SEQ ID NO: 1655050 - RNA, 18 nt, Homo sapiens
gcuguuaacuguuaacua

SEQ ID NO: 1655051 - RNA, 20 nt, Homo sapiens
gcuguuauuuuaucugcuau

SEQ ID NO: 1655052 - RNA, 19 nt, Homo sapiens
gcuguuuuuauauauguga

SEQ ID NO: 1655053 - RNA, 18 nt, Homo sapiens
gcuuaaaacaacacucac

SEQ ID NO: 1655054 - RNA, 14 nt, Homo sapiens
gcuuagaacaaagg

SEQ ID NO: 1655055 - RNA, 19 nt, Homo sapiens
gcuuauggcaucucauuga

SEQ ID NO: 1655056 - RNA, 22 nt, Homo sapiens
gcuucauuuccucugagcuguu

SEQ ID NO: 1655057 - RNA, 13 nt, Homo sapiens
gcuucucagccac

SEQ ID NO: 1655058 - RNA, 19 nt, Homo sapiens
gcuucuccgcccauucuga

SEQ ID NO: 1655059 - RNA, 17 nt, Homo sapiens
gcuucugccacuuccca

SEQ ID NO: 1655060 - RNA, 19 nt, Homo sapiens
gcuucuuaaaauagccaua

SEQ ID NO: 1655061 - RNA, 12 nt, Homo sapiens
gcuucuucuuca

SEQ ID NO: 1655062 - RNA, 21 nt, Homo sapiens
gcuucuucuucaagauuuaug

SEQ ID NO: 1655063 - RNA, 23 nt, Homo sapiens
gcuugauugcguggaauugugcu

SEQ ID NO: 1655064 - RNA, 13 nt, Homo sapiens
gcuuggcugugcc

SEQ ID NO: 1655065 - RNA, 23 nt, Homo sapiens
gcuuguaauaaauacugcagcuu

SEQ ID NO: 1655066 - RNA, 21 nt, Homo sapiens
gcuuucauguaaacugugcac

SEQ ID NO: 1655067 - RNA, 14 nt, Homo sapiens
gcuuuccucuguga

SEQ ID NO: 1655068 - RNA, 23 nt, Homo sapiens
gcuuucugucuccuuaacacuga

SEQ ID NO: 1655069 - RNA, 21 nt, Homo sapiens
gcuuugggauaauguuuauaa

SEQ ID NO: 1655070 - RNA, 18 nt, Homo sapiens
gcuuugggggcuuuacaa

SEQ ID NO: 1655071 - RNA, 14 nt, Homo sapiens
gcuuuggucuaucu

SEQ ID NO: 1655072 - RNA, 19 nt, Homo sapiens
gcuuuugcauuaaucuaag

SEQ ID NO: 1655073 - RNA, 22 nt, Homo sapiens
ggaaaaaauaacaaugaaaguu

SEQ ID NO: 1655074 - RNA, 15 nt, Homo sapiens
ggaaaacaagcauuc

SEQ ID NO: 1655075 - RNA, 13 nt, Homo sapiens
ggaaaacaguauu

SEQ ID NO: 1655076 - RNA, 19 nt, Homo sapiens
ggaaacuggaugaggucau

SEQ ID NO: 1655077 - RNA, 16 nt, Homo sapiens
ggaaaguuuuguucug

SEQ ID NO: 1655078 - RNA, 14 nt, Homo sapiens
ggaaauacacuguu

SEQ ID NO: 1655079 - RNA, 20 nt, Homo sapiens
ggaaauauuuuaauguuucu

SEQ ID NO: 1655080 - RNA, 20 nt, Homo sapiens
ggaacagauucacacugucu

SEQ ID NO: 1655081 - RNA, 18 nt, Homo sapiens
ggaacuaagaaagcccuu

SEQ ID NO: 1655082 - RNA, 17 nt, Homo sapiens
gcaccuuaguugcauga

SEQ ID NO: 1655083 - RNA, 13 nt, Homo sapiens
gcaccuucugacg

SEQ ID NO: 1655084 - RNA, 16 nt, Homo sapiens
gcacgggggccaagga

SEQ ID NO: 1655085 - RNA, 21 nt, Homo sapiens
gcacugacauuguuggccaaa

SEQ ID NO: 1655086 - RNA, 19 nt, Homo sapiens
gcacugaggaagaacgggg

SEQ ID NO: 1655087 - RNA, 22 nt, Homo sapiens
gcacugcugggggugaggacac

SEQ ID NO: 1655088 - RNA, 13 nt, Homo sapiens
gcacugugcucag

SEQ ID NO: 1655089 - RNA, 22 nt, Homo sapiens
gcacuuuguucuggcucuucca

SEQ ID NO: 1655090 - RNA, 23 nt, Homo sapiens
gcagaacugaagagacuaggcgc

SEQ ID NO: 1655091 - RNA, 13 nt, Homo sapiens
gcagaccacugau

SEQ ID NO: 1655092 - RNA, 14 nt, Homo sapiens
gcagaccacugaua

SEQ ID NO: 1655093 - RNA, 21 nt, Homo sapiens
gcagacucuacagaggccaug

SEQ ID NO: 1655094 - RNA, 21 nt, Homo sapiens
gcagacugcaaaucugccuga

SEQ ID NO: 1655095 - RNA, 17 nt, Homo sapiens
gcagagagcacagugau

SEQ ID NO: 1655096 - RNA, 18 nt, Homo sapiens
gcagagagcacagugauc

SEQ ID NO: 1655097 - RNA, 22 nt, Homo sapiens
gcagagagccauuuugugaaug

SEQ ID NO: 1655098 - RNA, 20 nt, Homo sapiens
gcagagguccacaacacaca

SEQ ID NO: 1655099 - RNA, 18 nt, Homo sapiens
gcagcaagugugcuggcc

SEQ ID NO: 1655100 - RNA, 20 nt, Homo sapiens
gcagccucacaguccuuacc

SEQ ID NO: 1655101 - RNA, 18 nt, Homo sapiens
gcagcuccaaaacuggac

SEQ ID NO: 1655102 - RNA, 15 nt, Homo sapiens
gcagcuucugccacu

SEQ ID NO: 1655103 - RNA, 19 nt, Homo sapiens
gcaggaacauacagacaca

SEQ ID NO: 1655104 - RNA, 22 nt, Homo sapiens
gcaggauuugggcucuuggaau

SEQ ID NO: 1655105 - RNA, 20 nt, Homo sapiens
gcagguggggagacugggcu

SEQ ID NO: 1655106 - RNA, 21 nt, Homo sapiens
gcagugagccgagaucgugcc

SEQ ID NO: 1655107 - RNA, 13 nt, Homo sapiens
gcaguggaacuaa

SEQ ID NO: 1655108 - RNA, 23 nt, Homo sapiens
gcauaaaguaaauacaugcauau

SEQ ID NO: 1655109 - RNA, 16 nt, Homo sapiens
gcauaaauaugcagug

SEQ ID NO: 1655110 - RNA, 20 nt, Homo sapiens
gcauaaauaugcagugauau

SEQ ID NO: 1655111 - RNA, 22 nt, Homo sapiens
gcauaauuuuguguuguacaau

SEQ ID NO: 1655112 - RNA, 23 nt, Homo sapiens
gcauacgguaugauauugcagcu

SEQ ID NO: 1655113 - RNA, 19 nt, Homo sapiens
gcauacugccuuguuuaau

SEQ ID NO: 1655114 - RNA, 18 nt, Homo sapiens
gcauauaaaaacaucagu

SEQ ID NO: 1655115 - RNA, 15 nt, Homo sapiens
gcauauauacauaua

SEQ ID NO: 1655116 - RNA, 14 nt, Homo sapiens
gcaucacagcuaac

SEQ ID NO: 1655117 - RNA, 16 nt, Homo sapiens
gcaucuauuuuaccau

SEQ ID NO: 1655118 - RNA, 23 nt, Homo sapiens
gcaucuccagcauucucagccac

SEQ ID NO: 1655119 - RNA, 20 nt, Homo sapiens
gcaucugggcaggaugacuu

SEQ ID NO: 1655120 - RNA, 17 nt, Homo sapiens
gcaugaagguuucugaa

SEQ ID NO: 1655121 - RNA, 16 nt, Homo sapiens
gcauucagccaggaga

SEQ ID NO: 1655122 - RNA, 22 nt, Homo sapiens
gcauucucagccacaaccaaaa

SEQ ID NO: 1655123 - RNA, 16 nt, Homo sapiens
gccaaaauaaugcacc

SEQ ID NO: 1655124 - RNA, 22 nt, Homo sapiens
gccaaagccaauaacacacagc

SEQ ID NO: 1655125 - RNA, 18 nt, Homo sapiens
gccaagaaguugcucuga

SEQ ID NO: 1655126 - RNA, 20 nt, Homo sapiens
gccaagcucaggaccaggca

SEQ ID NO: 1655127 - RNA, 23 nt, Homo sapiens
gccaagucauuugaggaucucac

SEQ ID NO: 1655128 - RNA, 21 nt, Homo sapiens
gccacagcuggugguaucuga

SEQ ID NO: 1655129 - RNA, 20 nt, Homo sapiens
gccacaggccugagauuuca

SEQ ID NO: 1655130 - RNA, 11 nt, Homo sapiens
gccacauggga

SEQ ID NO: 1655131 - RNA, 19 nt, Homo sapiens
gccaccaacauacucccau

SEQ ID NO: 1655132 - RNA, 11 nt, Homo sapiens
gccacccagca

SEQ ID NO: 1655133 - RNA, 18 nt, Homo sapiens
gccacccucccacugcca

SEQ ID NO: 1655134 - RNA, 12 nt, Homo sapiens
gccaccuggacc

SEQ ID NO: 1655135 - RNA, 14 nt, Homo sapiens
gccacuaugagcuu

SEQ ID NO: 1655136 - RNA, 21 nt, Homo sapiens
gccacugccuuucagaaguga

SEQ ID NO: 1655137 - RNA, 16 nt, Homo sapiens
gccacuguuaagccau

SEQ ID NO: 1655138 - RNA, 22 nt, Homo sapiens
gccagccccgccacgcuugugu

SEQ ID NO: 1655139 - RNA, 20 nt, Homo sapiens
gccagcccucccagcagugg

SEQ ID NO: 1655140 - RNA, 23 nt, Homo sapiens
gccaggccagagggagugacaga

SEQ ID NO: 1655141 - RNA, 13 nt, Homo sapiens
gccaggugcugcu

SEQ ID NO: 1655142 - RNA, 22 nt, Homo sapiens
gccaguaaacagaggaguacag

SEQ ID NO: 1655143 - RNA, 18 nt, Homo sapiens
gccaguucccucccucaa

SEQ ID NO: 1655144 - RNA, 22 nt, Homo sapiens
gccauauucuguuggccagugu

SEQ ID NO: 1655145 - RNA, 18 nt, Homo sapiens
gccauugcacuccagccu

SEQ ID NO: 1655146 - RNA, 23 nt, Homo sapiens
gcccaagugauccuuccaccuca

SEQ ID NO: 1655147 - RNA, 14 nt, Homo sapiens
gcccaaugcacuuu

SEQ ID NO: 1655148 - RNA, 16 nt, Homo sapiens
gcccacuucugccaua

SEQ ID NO: 1655149 - RNA, 21 nt, Homo sapiens
gcccaggaccccauggcagug

SEQ ID NO: 1655150 - RNA, 17 nt, Homo sapiens
gcccaggcaggucuuga

SEQ ID NO: 1655151 - RNA, 19 nt, Homo sapiens
gcccaggcuggagugcaau

SEQ ID NO: 1655152 - RNA, 18 nt, Homo sapiens
gcccaguuggguggaugc

SEQ ID NO: 1655153 - RNA, 16 nt, Homo sapiens
gcccaugggcacugcu

SEQ ID NO: 1655154 - RNA, 18 nt, Homo sapiens
gccccaugagacaguccc

SEQ ID NO: 1655155 - RNA, 15 nt, Homo sapiens
gccccauuuacccaa

SEQ ID NO: 1655156 - RNA, 22 nt, Homo sapiens
gccccucuccuccguggcacau

SEQ ID NO: 1655157 - RNA, 13 nt, Homo sapiens
gcccgaaaagcau

SEQ ID NO: 1655158 - RNA, 17 nt, Homo sapiens
gcccggaguggacugau

SEQ ID NO: 1655159 - RNA, 16 nt, Homo sapiens
gcccucauccauuuau

SEQ ID NO: 1655160 - RNA, 15 nt, Homo sapiens
gcccucccagcagug

SEQ ID NO: 1655161 - RNA, 15 nt, Homo sapiens
gcccuggcaccugug

SEQ ID NO: 1655162 - RNA, 21 nt, Homo sapiens
gcccuucccacaggacauuuc

SEQ ID NO: 1655163 - RNA, 18 nt, Homo sapiens
gcccuuguccccaugaaa

SEQ ID NO: 1655164 - RNA, 14 nt, Homo sapiens
gccuaggugacaga

SEQ ID NO: 1655165 - RNA, 14 nt, Homo sapiens
gccucaaguuccag

SEQ ID NO: 1655166 - RNA, 13 nt, Homo sapiens
gccucacaguccu

SEQ ID NO: 1655167 - RNA, 16 nt, Homo sapiens
gccucacuucuuccau

SEQ ID NO: 1655168 - RNA, 16 nt, Homo sapiens
gccucagccuccugag

SEQ ID NO: 1655169 - RNA, 13 nt, Homo sapiens
gccucagugccac

SEQ ID NO: 1655170 - RNA, 16 nt, Homo sapiens
gccucccacagugacu

SEQ ID NO: 1655171 - RNA, 20 nt, Homo sapiens
gccucuuuuccccaugaacu

SEQ ID NO: 1655172 - RNA, 14 nt, Homo sapiens
gccugagaaauccc

SEQ ID NO: 1655173 - RNA, 17 nt, Homo sapiens
gccugagaaugaccugc

SEQ ID NO: 1655174 - RNA, 20 nt, Homo sapiens
gaggcagagguugcagugag

SEQ ID NO: 1655175 - RNA, 22 nt, Homo sapiens
gaggcugggcucccuucccacc

SEQ ID NO: 1655176 - RNA, 14 nt, Homo sapiens
gagggagugacaga

SEQ ID NO: 1655177 - RNA, 15 nt, Homo sapiens
gagggcacacacugu

SEQ ID NO: 1655178 - RNA, 16 nt, Homo sapiens
gagggcagucgauaga

SEQ ID NO: 1655179 - RNA, 15 nt, Homo sapiens
gagggcuacaaagga

SEQ ID NO: 1655180 - RNA, 13 nt, Homo sapiens
gaggggugcucau

SEQ ID NO: 1655181 - RNA, 10 nt, Homo sapiens
gaggguacac

SEQ ID NO: 1655182 - RNA, 15 nt, Homo sapiens
gagguacaaccuguu

SEQ ID NO: 1655183 - RNA, 19 nt, Homo sapiens
gagguccacaacacacaga

SEQ ID NO: 1655184 - RNA, 18 nt, Homo sapiens
gaguacaccccaacagca

SEQ ID NO: 1655185 - RNA, 19 nt, Homo sapiens
gaguacucuugaacacaag

SEQ ID NO: 1655186 - RNA, 16 nt, Homo sapiens
gaguccuccuguccag

SEQ ID NO: 1655187 - RNA, 22 nt, Homo sapiens
gagucucccacugcaacuugug

SEQ ID NO: 1655188 - RNA, 19 nt, Homo sapiens
gagucucgcuauugucacc

SEQ ID NO: 1655189 - RNA, 16 nt, Homo sapiens
gagucuggguccaggc

SEQ ID NO: 1655190 - RNA, 20 nt, Homo sapiens
gagugccuggccaaagggau

SEQ ID NO: 1655191 - RNA, 24 nt, Homo sapiens
gagugcuaugaagacaggaucuag

SEQ ID NO: 1655192 - RNA, 19 nt, Homo sapiens
gagugggcccaaugcacuu

SEQ ID NO: 1655193 - RNA, 23 nt, Homo sapiens
gagugggcccaaugcacuuuguu

SEQ ID NO: 1655194 - RNA, 23 nt, Homo sapiens
gagugucuuuccacggagccacu

SEQ ID NO: 1655195 - RNA, 21 nt, Homo sapiens
gaguguuccccuuccacugag

SEQ ID NO: 1655196 - RNA, 22 nt, Homo sapiens
gaguguuccccuuccacugagg

SEQ ID NO: 1655197 - RNA, 16 nt, Homo sapiens
gaguuaguuugaguua

SEQ ID NO: 1655198 - RNA, 16 nt, Homo sapiens
gaguuccgacugccau

SEQ ID NO: 1655199 - RNA, 23 nt, Homo sapiens
gaguuuuuaguggaagcuucuaa

SEQ ID NO: 1655200 - RNA, 12 nt, Homo sapiens
gauaaaagacag

SEQ ID NO: 1655201 - RNA, 19 nt, Homo sapiens
gauaaaucuaguauacauu

SEQ ID NO: 1655202 - RNA, 22 nt, Homo sapiens
gauaagaccaccaccucagagu

SEQ ID NO: 1655203 - RNA, 18 nt, Homo sapiens
gauaauauuguggugcca

SEQ ID NO: 1655204 - RNA, 18 nt, Homo sapiens
gauaaucucuccauuccc

SEQ ID NO: 1655205 - RNA, 18 nt, Homo sapiens
gauaauguccuugcuuua

SEQ ID NO: 1655206 - RNA, 22 nt, Homo sapiens
gauacaaauugcagacugugua

SEQ ID NO: 1655207 - RNA, 19 nt, Homo sapiens
gauacugaggcacacagag

SEQ ID NO: 1655208 - RNA, 23 nt, Homo sapiens
gauacuguguucccucauaugca

SEQ ID NO: 1655209 - RNA, 19 nt, Homo sapiens
gauacuguugcacgugugu

SEQ ID NO: 1655210 - RNA, 16 nt, Homo sapiens
gauacuuugacagugu

SEQ ID NO: 1655211 - RNA, 20 nt, Homo sapiens
gauagguauaaguggugugu

SEQ ID NO: 1655212 - RNA, 17 nt, Homo sapiens
gauauuuccacuaagaa

SEQ ID NO: 1655213 - RNA, 17 nt, Homo sapiens
gauauuuuuuacuuuag

SEQ ID NO: 1655214 - RNA, 13 nt, Homo sapiens
gaucaauuacuua

SEQ ID NO: 1655215 - RNA, 17 nt, Homo sapiens
gaucacgccacuggacu

SEQ ID NO: 1655216 - RNA, 18 nt, Homo sapiens
gaucauccacugugccau

SEQ ID NO: 1655217 - RNA, 23 nt, Homo sapiens
gauccaaguuuacucaacccucu

SEQ ID NO: 1655218 - RNA, 16 nt, Homo sapiens
gauccacccaccucag

SEQ ID NO: 1655219 - RNA, 16 nt, Homo sapiens
gaucccgugugccacc

SEQ ID NO: 1655220 - RNA, 14 nt, Homo sapiens
gauccuccaggugc

SEQ ID NO: 1655221 - RNA, 16 nt, Homo sapiens
gauccucccaccucag

SEQ ID NO: 1655222 - RNA, 16 nt, Homo sapiens
gauccuuccaccucag

SEQ ID NO: 1655223 - RNA, 22 nt, Homo sapiens
gaucucugcuuuggaaaucaca

SEQ ID NO: 1655224 - RNA, 13 nt, Homo sapiens
gaucuggcuguga

SEQ ID NO: 1655225 - RNA, 16 nt, Homo sapiens
gaucuuuggacagaag

SEQ ID NO: 1655226 - RNA, 16 nt, Homo sapiens
gaugaacuguggugcc

SEQ ID NO: 1655227 - RNA, 14 nt, Homo sapiens
gaugacaacuggaa

SEQ ID NO: 1655228 - RNA, 18 nt, Homo sapiens
gaugaccuacagugcugu

SEQ ID NO: 1655229 - RNA, 13 nt, Homo sapiens
gaugagaguacac

SEQ ID NO: 1655230 - RNA, 21 nt, Homo sapiens
gaugagaguacaccccaacag

SEQ ID NO: 1655231 - RNA, 21 nt, Homo sapiens
gaugaggucauagcagugcuu

SEQ ID NO: 1655232 - RNA, 14 nt, Homo sapiens
gaugaguacccaaa

SEQ ID NO: 1655233 - RNA, 13 nt, Homo sapiens
gaugauucuucca

SEQ ID NO: 1655234 - RNA, 21 nt, Homo sapiens
gaugggggaaagcacaggugg

SEQ ID NO: 1655235 - RNA, 23 nt, Homo sapiens
gauggugacuuuugaagaacaaa

SEQ ID NO: 1655236 - RNA, 17 nt, Homo sapiens
gauggugcccuguucuc

SEQ ID NO: 1655237 - RNA, 16 nt, Homo sapiens
gaugucaacugaccua

SEQ ID NO: 1655238 - RNA, 18 nt, Homo sapiens
gauguccuccucugugaa

SEQ ID NO: 1655239 - RNA, 19 nt, Homo sapiens
gauguccuccucugugaaa

SEQ ID NO: 1655240 - RNA, 14 nt, Homo sapiens
gauguguguugaua

SEQ ID NO: 1655241 - RNA, 15 nt, Homo sapiens
gauguucugggacac

SEQ ID NO: 1655242 - RNA, 15 nt, Homo sapiens
gauguuucauaagaa

SEQ ID NO: 1655243 - RNA, 18 nt, Homo sapiens
gauuaacacucauuucca

SEQ ID NO: 1655244 - RNA, 19 nt, Homo sapiens
gauuacaggcaugagccac

SEQ ID NO: 1655245 - RNA, 15 nt, Homo sapiens
gauuacaggcgugag

SEQ ID NO: 1655246 - RNA, 21 nt, Homo sapiens
gauuacaggcgugagccaccg

SEQ ID NO: 1655247 - RNA, 18 nt, Homo sapiens
gauuacaggugugaacca

SEQ ID NO: 1655248 - RNA, 15 nt, Homo sapiens
gauuacaggugugag

SEQ ID NO: 1655249 - RNA, 13 nt, Homo sapiens
gauucacacuguc

SEQ ID NO: 1655250 - RNA, 18 nt, Homo sapiens
gauucauauugcaucaua

SEQ ID NO: 1655251 - RNA, 17 nt, Homo sapiens
gauucuuucccaauuca

SEQ ID NO: 1655252 - RNA, 22 nt, Homo sapiens
gauugaguuuucuucugugauu

SEQ ID NO: 1655253 - RNA, 17 nt, Homo sapiens
gauugguaagaugucuu

SEQ ID NO: 1655254 - RNA, 16 nt, Homo sapiens
gauuugauuaaugaau

SEQ ID NO: 1655255 - RNA, 11 nt, Homo sapiens
gauuuuccucc

SEQ ID NO: 1655256 - RNA, 19 nt, Homo sapiens
gauuuuguauucagggguu

SEQ ID NO: 1655257 - RNA, 21 nt, Homo sapiens
gauuuuucucaaaguuuugaa

SEQ ID NO: 1655258 - RNA, 12 nt, Homo sapiens
gcaaaaccaaau

SEQ ID NO: 1655259 - RNA, 13 nt, Homo sapiens
gcaaaaccaaaua

SEQ ID NO: 1655260 - RNA, 23 nt, Homo sapiens
gcaaaaccaaauauuccagagac

SEQ ID NO: 1655261 - RNA, 18 nt, Homo sapiens
gcaaaauacaugacauuu

SEQ ID NO: 1655262 - RNA, 19 nt, Homo sapiens
gcaaaauacaugacauuua

SEQ ID NO: 1655263 - RNA, 15 nt, Homo sapiens
gcaaacaugugcaac

SEQ ID NO: 1655264 - RNA, 18 nt, Homo sapiens
gcaaacuuuccugggcaa

SEQ ID NO: 1655265 - RNA, 13 nt, Homo sapiens
gcaacaagcuauu

SEQ ID NO: 1655266 - RNA, 14 nt, Homo sapiens
gcaacagagcaaaa

SEQ ID NO: 1655267 - RNA, 20 nt, Homo sapiens
gcaacaugccagccacugug

SEQ ID NO: 1655268 - RNA, 14 nt, Homo sapiens
gcaacuagggcuag

SEQ ID NO: 1655269 - RNA, 12 nt, Homo sapiens
gaaucucucuuc

SEQ ID NO: 1655270 - RNA, 20 nt, Homo sapiens
gaaucucuuuuugcuuucga

SEQ ID NO: 1655271 - RNA, 14 nt, Homo sapiens
gaaugagaagaaug

SEQ ID NO: 1655272 - RNA, 19 nt, Homo sapiens
gaaugaggaacaaucacaa

SEQ ID NO: 1655273 - RNA, 15 nt, Homo sapiens
gaauguaaugguggc

SEQ ID NO: 1655274 - RNA, 15 nt, Homo sapiens
gaauguaauuggaau

SEQ ID NO: 1655275 - RNA, 15 nt, Homo sapiens
gaauguaugugcaca

SEQ ID NO: 1655276 - RNA, 14 nt, Homo sapiens
gaauguuugccucu

SEQ ID NO: 1655277 - RNA, 23 nt, Homo sapiens
gaauuaaguuagggaauggcaca

SEQ ID NO: 1655278 - RNA, 19 nt, Homo sapiens
gaauuacggaaaaugccug

SEQ ID NO: 1655279 - RNA, 14 nt, Homo sapiens
gaauuaugcaucug

SEQ ID NO: 1655280 - RNA, 23 nt, Homo sapiens
gaauuaugcaucugcuacugugu

SEQ ID NO: 1655281 - RNA, 13 nt, Homo sapiens
gaauuaugugcac

SEQ ID NO: 1655282 - RNA, 21 nt, Homo sapiens
gaauuaugugcacuaccauag

SEQ ID NO: 1655283 - RNA, 24 nt, Homo sapiens
gaauuauucagugaauuuguccau

SEQ ID NO: 1655284 - RNA, 19 nt, Homo sapiens
gaauuguaggugacuauua

SEQ ID NO: 1655285 - RNA, 13 nt, Homo sapiens
gaauuucccacau

SEQ ID NO: 1655286 - RNA, 16 nt, Homo sapiens
gaauuugcaacaguaa

SEQ ID NO: 1655287 - RNA, 21 nt, Homo sapiens
gaauuuuuauauccacuaaaa

SEQ ID NO: 1655288 - RNA, 12 nt, Homo sapiens
gacaaacaguga

SEQ ID NO: 1655289 - RNA, 19 nt, Homo sapiens
gacaaaccucuaacccagg

SEQ ID NO: 1655290 - RNA, 20 nt, Homo sapiens
gacaauggcuuacuccagga

SEQ ID NO: 1655291 - RNA, 15 nt, Homo sapiens
gacacauugccccau

SEQ ID NO: 1655292 - RNA, 19 nt, Homo sapiens
gacacauugccccaugaga

SEQ ID NO: 1655293 - RNA, 21 nt, Homo sapiens
gacaccagagcagaugcagag

SEQ ID NO: 1655294 - RNA, 17 nt, Homo sapiens
gacaccuuacuuuccca

SEQ ID NO: 1655295 - RNA, 20 nt, Homo sapiens
gacacugccacucuccccau

SEQ ID NO: 1655296 - RNA, 14 nt, Homo sapiens
gacacuucucagga

SEQ ID NO: 1655297 - RNA, 17 nt, Homo sapiens
gacagagaccuccugcc

SEQ ID NO: 1655298 - RNA, 22 nt, Homo sapiens
gacagccacggccaggccagag

SEQ ID NO: 1655299 - RNA, 23 nt, Homo sapiens
gacaggcacagaugaaugggagu

SEQ ID NO: 1655300 - RNA, 15 nt, Homo sapiens
gacaggcagugccau

SEQ ID NO: 1655301 - RNA, 19 nt, Homo sapiens
gacaggguuucaccauguu

SEQ ID NO: 1655302 - RNA, 16 nt, Homo sapiens
gacauaaauguucacu

SEQ ID NO: 1655303 - RNA, 19 nt, Homo sapiens
gacauaagcaaagacuaug

SEQ ID NO: 1655304 - RNA, 16 nt, Homo sapiens
gacauauuaugccuga

SEQ ID NO: 1655305 - RNA, 22 nt, Homo sapiens
gacaucagcccuuggggguccu

SEQ ID NO: 1655306 - RNA, 13 nt, Homo sapiens
gacauucaugccu

SEQ ID NO: 1655307 - RNA, 22 nt, Homo sapiens
gaccaauaaccaugcccaagaa

SEQ ID NO: 1655308 - RNA, 19 nt, Homo sapiens
gaccaaugucuugaugcau

SEQ ID NO: 1655309 - RNA, 14 nt, Homo sapiens
gaccacuccccuca

SEQ ID NO: 1655310 - RNA, 18 nt, Homo sapiens
gaccacuccccucaaaac

SEQ ID NO: 1655311 - RNA, 15 nt, Homo sapiens
gaccagccuggccca

SEQ ID NO: 1655312 - RNA, 20 nt, Homo sapiens
gaccaggcaaagcaagugau

SEQ ID NO: 1655313 - RNA, 16 nt, Homo sapiens
gaccaggcaaugugac

SEQ ID NO: 1655314 - RNA, 18 nt, Homo sapiens
gaccagggauuuccauga

SEQ ID NO: 1655315 - RNA, 13 nt, Homo sapiens
gaccaucccugaa

SEQ ID NO: 1655316 - RNA, 19 nt, Homo sapiens
gaccaugaggagaugcugg

SEQ ID NO: 1655317 - RNA, 15 nt, Homo sapiens
gacccacuggacuca

SEQ ID NO: 1655318 - RNA, 13 nt, Homo sapiens
gacccucucaggc

SEQ ID NO: 1655319 - RNA, 20 nt, Homo sapiens
gacccugagcagaauacugg

SEQ ID NO: 1655320 - RNA, 17 nt, Homo sapiens
gacccuguaaaauggag

SEQ ID NO: 1655321 - RNA, 22 nt, Homo sapiens
gaccucaggugauccacccacc

SEQ ID NO: 1655322 - RNA, 13 nt, Homo sapiens
gaccugaacucug

SEQ ID NO: 1655323 - RNA, 17 nt, Homo sapiens
gaccugaugaccuggga

SEQ ID NO: 1655324 - RNA, 22 nt, Homo sapiens
gaccugcccuggccccagcccu

SEQ ID NO: 1655325 - RNA, 17 nt, Homo sapiens
gaccuggugcugccucu

SEQ ID NO: 1655326 - RNA, 19 nt, Homo sapiens
gacggaggccuacucuucc

SEQ ID NO: 1655327 - RNA, 18 nt, Homo sapiens
gacgugauuuugcuguag

SEQ ID NO: 1655328 - RNA, 19 nt, Homo sapiens
gacgugauuuugcuguaga

SEQ ID NO: 1655329 - RNA, 14 nt, Homo sapiens
gacuagaaccugga

SEQ ID NO: 1655330 - RNA, 19 nt, Homo sapiens
gacuaugaggaauauuugc

SEQ ID NO: 1655331 - RNA, 13 nt, Homo sapiens
gacuaugcaaaag

SEQ ID NO: 1655332 - RNA, 22 nt, Homo sapiens
gacucaaaaauagggaaguaac

SEQ ID NO: 1655333 - RNA, 12 nt, Homo sapiens
gacucaaugcac

SEQ ID NO: 1655334 - RNA, 15 nt, Homo sapiens
gacucaucauuucca

SEQ ID NO: 1655335 - RNA, 16 nt, Homo sapiens
gacuccaccucaaaaa

SEQ ID NO: 1655336 - RNA, 19 nt, Homo sapiens
gacucuccagaaagcucau

SEQ ID NO: 1655337 - RNA, 23 nt, Homo sapiens
gacucuccagaaagcucaucuca

SEQ ID NO: 1655338 - RNA, 11 nt, Homo sapiens
gacugccacag

SEQ ID NO: 1655339 - RNA, 20 nt, Homo sapiens
gacuguguuuaauaguauau

SEQ ID NO: 1655340 - RNA, 22 nt, Homo sapiens
gacuguucaagagcacacuugg

SEQ ID NO: 1655341 - RNA, 21 nt, Homo sapiens
gacuuaacgugcucaugggcu

SEQ ID NO: 1655342 - RNA, 14 nt, Homo sapiens
gacuuagcugggag

SEQ ID NO: 1655343 - RNA, 18 nt, Homo sapiens
gacuucauacaucccuca

SEQ ID NO: 1655344 - RNA, 21 nt, Homo sapiens
gacuucugcaucuuacaguca

SEQ ID NO: 1655345 - RNA, 14 nt, Homo sapiens
gacuugcaaaaagg

SEQ ID NO: 1655346 - RNA, 13 nt, Homo sapiens
gacuuucuugcaa

SEQ ID NO: 1655347 - RNA, 20 nt, Homo sapiens
gacuuuuuuuaaauaguaaa

SEQ ID NO: 1655348 - RNA, 16 nt, Homo sapiens
gagaacaaugugcuau

SEQ ID NO: 1655349 - RNA, 18 nt, Homo sapiens
gagaagaaugacuaugca

SEQ ID NO: 1655350 - RNA, 16 nt, Homo sapiens
gagaagccugugcccu

SEQ ID NO: 1655351 - RNA, 18 nt, Homo sapiens
gagaaugguguuccauug

SEQ ID NO: 1655352 - RNA, 12 nt, Homo sapiens
gagacagucacc

SEQ ID NO: 1655353 - RNA, 19 nt, Homo sapiens
gagacaugagcauggcuga

SEQ ID NO: 1655354 - RNA, 15 nt, Homo sapiens
gagaccaucccugaa

SEQ ID NO: 1655355 - RNA, 17 nt, Homo sapiens
gagaccucagauguguu

SEQ ID NO: 1655356 - RNA, 21 nt, Homo sapiens
gagagcacagugaucaccagc

SEQ ID NO: 1655357 - RNA, 23 nt, Homo sapiens
gagagcagcuucugccacuuccc

SEQ ID NO: 1655358 - RNA, 23 nt, Homo sapiens
gagagcugggcuuuccucuguga

SEQ ID NO: 1655359 - RNA, 21 nt, Homo sapiens
gagaggacaaaauaaagugug

SEQ ID NO: 1655360 - RNA, 21 nt, Homo sapiens
gagaucacgccacugcacuau

SEQ ID NO: 1655361 - RNA, 16 nt, Homo sapiens
gagaugucucugugug

SEQ ID NO: 1655362 - RNA, 17 nt, Homo sapiens
gagauuaccuccugaga

SEQ ID NO: 1655363 - RNA, 16 nt, Homo sapiens
gagcaccgccugugaa

SEQ ID NO: 1655364 - RNA, 18 nt, Homo sapiens
gagccacugcaccgggcc

SEQ ID NO: 1655365 - RNA, 13 nt, Homo sapiens
gagcccaggagcu

SEQ ID NO: 1655366 - RNA, 18 nt, Homo sapiens
ccaucugugcacgcagug

SEQ ID NO: 1655367 - RNA, 19 nt, Homo sapiens
ccaugaaccaagaccauug

SEQ ID NO: 1655368 - RNA, 15 nt, Homo sapiens
ccaugacccaggcug

SEQ ID NO: 1655369 - RNA, 17 nt, Homo sapiens
ccaugaggagaugcugg

SEQ ID NO: 1655370 - RNA, 10 nt, Homo sapiens
ccauggacuu

SEQ ID NO: 1655371 - RNA, 15 nt, Homo sapiens
ccauguagaagcugc

SEQ ID NO: 1655372 - RNA, 17 nt, Homo sapiens
ccauguuggccaggcug

SEQ ID NO: 1655373 - RNA, 13 nt, Homo sapiens
ccauucauuccau

SEQ ID NO: 1655374 - RNA, 19 nt, Homo sapiens
ccauuugcguuccaugaug

SEQ ID NO: 1655375 - RNA, 17 nt, Homo sapiens
cccaaaagcccauucau

SEQ ID NO: 1655376 - RNA, 17 nt, Homo sapiens
cccaaauagcagcacag

SEQ ID NO: 1655377 - RNA, 10 nt, Homo sapiens
cccaacagca

SEQ ID NO: 1655378 - RNA, 22 nt, Homo sapiens
cccaacagcacccucuccagau

SEQ ID NO: 1655379 - RNA, 16 nt, Homo sapiens
cccaauucacaucuaa

SEQ ID NO: 1655380 - RNA, 15 nt, Homo sapiens
cccacagcacuaauu

SEQ ID NO: 1655381 - RNA, 19 nt, Homo sapiens
cccacgcuggagugcagug

SEQ ID NO: 1655382 - RNA, 21 nt, Homo sapiens
cccacguaugugaaacacaca

SEQ ID NO: 1655383 - RNA, 15 nt, Homo sapiens
cccacuucugcacuu

SEQ ID NO: 1655384 - RNA, 19 nt, Homo sapiens
cccagagguaacagaacag

SEQ ID NO: 1655385 - RNA, 21 nt, Homo sapiens
cccagaucggaucuguugcaa

SEQ ID NO: 1655386 - RNA, 11 nt, Homo sapiens
cccagcacugc

SEQ ID NO: 1655387 - RNA, 11 nt, Homo sapiens
cccagcauuuu

SEQ ID NO: 1655388 - RNA, 20 nt, Homo sapiens
cccagcccacuucugccaua

SEQ ID NO: 1655389 - RNA, 18 nt, Homo sapiens
cccagccccaaggggugg

SEQ ID NO: 1655390 - RNA, 16 nt, Homo sapiens
cccagcccuacucugu

SEQ ID NO: 1655391 - RNA, 21 nt, Homo sapiens
cccagcuaauugagaccacag

SEQ ID NO: 1655392 - RNA, 12 nt, Homo sapiens
cccaggaguaca

SEQ ID NO: 1655393 - RNA, 16 nt, Homo sapiens
cccaggcaugcaaugc

SEQ ID NO: 1655394 - RNA, 19 nt, Homo sapiens
cccaggcuggagugcaaug

SEQ ID NO: 1655395 - RNA, 19 nt, Homo sapiens
cccaggcuggagugcagug

SEQ ID NO: 1655396 - RNA, 19 nt, Homo sapiens
cccaggcuggcgugcagug

SEQ ID NO: 1655397 - RNA, 15 nt, Homo sapiens
cccaggcugggcaag

SEQ ID NO: 1655398 - RNA, 20 nt, Homo sapiens
cccaggucuugacaccagcu

SEQ ID NO: 1655399 - RNA, 21 nt, Homo sapiens
cccaguguguuucugaucuga

SEQ ID NO: 1655400 - RNA, 19 nt, Homo sapiens
cccaguuucccacucugaa

SEQ ID NO: 1655401 - RNA, 13 nt, Homo sapiens
cccaucagugcca

SEQ ID NO: 1655402 - RNA, 18 nt, Homo sapiens
cccaugcagacaugagug

SEQ ID NO: 1655403 - RNA, 14 nt, Homo sapiens
cccauucauuccau

SEQ ID NO: 1655404 - RNA, 21 nt, Homo sapiens
cccauucucccucucaaggca

SEQ ID NO: 1655405 - RNA, 20 nt, Homo sapiens
ccccaucugccacguguauu

SEQ ID NO: 1655406 - RNA, 13 nt, Homo sapiens
ccccaugaacucu

SEQ ID NO: 1655407 - RNA, 15 nt, Homo sapiens
ccccauuccugggaa

SEQ ID NO: 1655408 - RNA, 13 nt, Homo sapiens
ccccauuggcacc

SEQ ID NO: 1655409 - RNA, 20 nt, Homo sapiens
cccccaguggacaccaauga

SEQ ID NO: 1655410 - RNA, 21 nt, Homo sapiens
ccccucccagcugacaguccu

SEQ ID NO: 1655411 - RNA, 18 nt, Homo sapiens
ccccugagcuugcagaga

SEQ ID NO: 1655412 - RNA, 18 nt, Homo sapiens
cccuaagcagaccacuga

SEQ ID NO: 1655413 - RNA, 20 nt, Homo sapiens
cccuacaaaaccacuggaaa

SEQ ID NO: 1655414 - RNA, 17 nt, Homo sapiens
cccuagcuuagagccuc

SEQ ID NO: 1655415 - RNA, 13 nt, Homo sapiens
cccucagauuccg

SEQ ID NO: 1655416 - RNA, 15 nt, Homo sapiens
cccuccaguguauga

SEQ ID NO: 1655417 - RNA, 12 nt, Homo sapiens
cccuccaugucu

SEQ ID NO: 1655418 - RNA, 22 nt, Homo sapiens
cccucccacugccaaagaacuu

SEQ ID NO: 1655419 - RNA, 14 nt, Homo sapiens
cccuccuuaucaaa

SEQ ID NO: 1655420 - RNA, 12 nt, Homo sapiens
cccucugugaaa

SEQ ID NO: 1655421 - RNA, 19 nt, Homo sapiens
cccucugugaaauuuguaa

SEQ ID NO: 1655422 - RNA, 18 nt, Homo sapiens
cccucuugccccaacccc

SEQ ID NO: 1655423 - RNA, 12 nt, Homo sapiens
cccugcauuuau

SEQ ID NO: 1655424 - RNA, 13 nt, Homo sapiens
cccugcgggucac

SEQ ID NO: 1655425 - RNA, 20 nt, Homo sapiens
cccuggccucccccacuuuc

SEQ ID NO: 1655426 - RNA, 20 nt, Homo sapiens
cccuggcugaaggacuguga

SEQ ID NO: 1655427 - RNA, 23 nt, Homo sapiens
cccugguuuguuuuccccaguug

SEQ ID NO: 1655428 - RNA, 24 nt, Homo sapiens
cccugugaguuuguacagucuugc

SEQ ID NO: 1655429 - RNA, 15 nt, Homo sapiens
cccuuuccaaaggcc

SEQ ID NO: 1655430 - RNA, 22 nt, Homo sapiens
cccuuuuuuggcugcugaaggc

SEQ ID NO: 1655431 - RNA, 13 nt, Homo sapiens
ccgaaaucagaag

SEQ ID NO: 1655432 - RNA, 13 nt, Homo sapiens
ccgaggacaugaa

SEQ ID NO: 1655433 - RNA, 19 nt, Homo sapiens
ccgcaaaagacaagucuuu

SEQ ID NO: 1655434 - RNA, 15 nt, Homo sapiens
ccggacacuucucag

SEQ ID NO: 1655435 - RNA, 18 nt, Homo sapiens
ccggcacugcauguuccu

SEQ ID NO: 1655436 - RNA, 16 nt, Homo sapiens
ccggcauggacaaugg

SEQ ID NO: 1655437 - RNA, 23 nt, Homo sapiens
ccggccaaaauaaugcaccacuu

SEQ ID NO: 1655438 - RNA, 21 nt, Homo sapiens
ccggucaccagaagugaaaag

SEQ ID NO: 1655439 - RNA, 19 nt, Homo sapiens
ccggucuaaagugagcucu

SEQ ID NO: 1655440 - RNA, 15 nt, Homo sapiens
ccuaaacauaugaau

SEQ ID NO: 1655441 - RNA, 17 nt, Homo sapiens
ccuaaacauaugaauua

SEQ ID NO: 1655442 - RNA, 18 nt, Homo sapiens
ccuaaacccucugugaaa

SEQ ID NO: 1655443 - RNA, 20 nt, Homo sapiens
ccuacacgagauacagaauu

SEQ ID NO: 1655444 - RNA, 14 nt, Homo sapiens
ccuacucuguguaa

SEQ ID NO: 1655445 - RNA, 14 nt, Homo sapiens
ccuacucuguguca

SEQ ID NO: 1655446 - RNA, 16 nt, Homo sapiens
ccuaugcagaggucca

SEQ ID NO: 1655447 - RNA, 14 nt, Homo sapiens
ccuauguaugccau

SEQ ID NO: 1655448 - RNA, 12 nt, Homo sapiens
ccuauuugccau

SEQ ID NO: 1655449 - RNA, 15 nt, Homo sapiens
ccucaaggggccauc

SEQ ID NO: 1655450 - RNA, 12 nt, Homo sapiens
ccucaaguucca

SEQ ID NO: 1655451 - RNA, 14 nt, Homo sapiens
ccucacguccauca

SEQ ID NO: 1655452 - RNA, 19 nt, Homo sapiens
ccucacguccaucacuggc

SEQ ID NO: 1655453 - RNA, 14 nt, Homo sapiens
ccucacuucuucca

SEQ ID NO: 1655454 - RNA, 14 nt, Homo sapiens
ccucagaguggagu

SEQ ID NO: 1655455 - RNA, 14 nt, Homo sapiens
ccucagccuccuga

SEQ ID NO: 1655456 - RNA, 13 nt, Homo sapiens
ccucaggugaucc

SEQ ID NO: 1655457 - RNA, 14 nt, Homo sapiens
ccucauacacagaa

SEQ ID NO: 1655458 - RNA, 18 nt, Homo sapiens
ccuccacucccacuuccc

SEQ ID NO: 1655459 - RNA, 21 nt, Homo sapiens
ccuccagggcuggacugaggc

SEQ ID NO: 1655460 - RNA, 14 nt, Homo sapiens
ccuccguggcacau

SEQ ID NO: 1655461 - RNA, 18 nt, Homo sapiens
ccuccugaagccacagca

SEQ ID NO: 1655462 - RNA, 16 nt, Homo sapiens
ccuccugggcccucuc

SEQ ID NO: 1655463 - RNA, 18 nt, Homo sapiens
ccuccuuuccuauuuccc

SEQ ID NO: 1655464 - RNA, 15 nt, Homo sapiens
ccucgcuggacucuc

SEQ ID NO: 1655465 - RNA, 15 nt, Homo sapiens
ccucuccuccguggc

SEQ ID NO: 1655466 - RNA, 13 nt, Homo sapiens
ccucugugaaauu

SEQ ID NO: 1655467 - RNA, 17 nt, Homo sapiens
ccucugugaaauuugua

SEQ ID NO: 1655468 - RNA, 14 nt, Homo sapiens
ccucuguguuagaa

SEQ ID NO: 1655469 - RNA, 24 nt, Homo sapiens
ccucuuugugugcgucacugugaa

SEQ ID NO: 1655470 - RNA, 16 nt, Homo sapiens
ccucuuuuucuagucu

SEQ ID NO: 1655471 - RNA, 20 nt, Homo sapiens
ccucuuuuucuagucuucau

SEQ ID NO: 1655472 - RNA, 19 nt, Homo sapiens
ccugaauuaucuauuucau

SEQ ID NO: 1655473 - RNA, 15 nt, Homo sapiens
ccugacuaacuuuuu

SEQ ID NO: 1655474 - RNA, 16 nt, Homo sapiens
ccugagauuucaucug

SEQ ID NO: 1655475 - RNA, 17 nt, Homo sapiens
ccugagcagaauacugg

SEQ ID NO: 1655476 - RNA, 19 nt, Homo sapiens
ccugagcagaauacugguc

SEQ ID NO: 1655477 - RNA, 17 nt, Homo sapiens
auccuacauaauaccca

SEQ ID NO: 1655478 - RNA, 13 nt, Homo sapiens
auccuacuucucc

SEQ ID NO: 1655479 - RNA, 13 nt, Homo sapiens
auccuacuucucu

SEQ ID NO: 1655480 - RNA, 21 nt, Homo sapiens
auccuaugguuucuccaucca

SEQ ID NO: 1655481 - RNA, 21 nt, Homo sapiens
auccuccaugggggcucagcc

SEQ ID NO: 1655482 - RNA, 16 nt, Homo sapiens
auccugacuucagugu

SEQ ID NO: 1655483 - RNA, 20 nt, Homo sapiens
auccuguaccaaaucugaca

SEQ ID NO: 1655484 - RNA, 16 nt, Homo sapiens
aucuaaaaugauacug

SEQ ID NO: 1655485 - RNA, 18 nt, Homo sapiens
aucuaaauuuaauuaccu

SEQ ID NO: 1655486 - RNA, 17 nt, Homo sapiens
aucuacccagucaugua

SEQ ID NO: 1655487 - RNA, 21 nt, Homo sapiens
aucuagcuuauuuugaggcuu

SEQ ID NO: 1655488 - RNA, 16 nt, Homo sapiens
aucuaggaagacuuug

SEQ ID NO: 1655489 - RNA, 20 nt, Homo sapiens
aucuauuaaaauugccauuu

SEQ ID NO: 1655490 - RNA, 13 nt, Homo sapiens
aucuccaguaucc

SEQ ID NO: 1655491 - RNA, 15 nt, Homo sapiens
aucuccauucucuca

SEQ ID NO: 1655492 - RNA, 13 nt, Homo sapiens
aucuccugaccuc

SEQ ID NO: 1655493 - RNA, 19 nt, Homo sapiens
aucucugucccacuuggca

SEQ ID NO: 1655494 - RNA, 14 nt, Homo sapiens
aucucuugugcuuu

SEQ ID NO: 1655495 - RNA, 14 nt, Homo sapiens
aucugacauaguua

SEQ ID NO: 1655496 - RNA, 14 nt, Homo sapiens
aucugcuacugugu

SEQ ID NO: 1655497 - RNA, 14 nt, Homo sapiens
aucuggaaccauca

SEQ ID NO: 1655498 - RNA, 21 nt, Homo sapiens
aucugugggucuccauccucc

SEQ ID NO: 1655499 - RNA, 14 nt, Homo sapiens
aucuucacuuuuau

SEQ ID NO: 1655500 - RNA, 20 nt, Homo sapiens
aucuugcuucugcuucucau

SEQ ID NO: 1655501 - RNA, 19 nt, Homo sapiens
aucuuguuagauuuuuaac

SEQ ID NO: 1655502 - RNA, 11 nt, Homo sapiens
aucuuuggaca

SEQ ID NO: 1655503 - RNA, 12 nt, Homo sapiens
aucuuuggacag

SEQ ID NO: 1655504 - RNA, 14 nt, Homo sapiens
aucuuuggacagaa

SEQ ID NO: 1655505 - RNA, 22 nt, Homo sapiens
aucuuugucuuuauuagauuuu

SEQ ID NO: 1655506 - RNA, 17 nt, Homo sapiens
aucuuuuaagcuaucua

SEQ ID NO: 1655507 - RNA, 22 nt, Homo sapiens
augaaaugaggucagagccugc

SEQ ID NO: 1655508 - RNA, 22 nt, Homo sapiens
augaacauaaucuaccaacgaa

SEQ ID NO: 1655509 - RNA, 19 nt, Homo sapiens
augaacuguggugccacau

SEQ ID NO: 1655510 - RNA, 16 nt, Homo sapiens
augaagacagaggcag

SEQ ID NO: 1655511 - RNA, 21 nt, Homo sapiens
augaagguuucugaaaauuaa

SEQ ID NO: 1655512 - RNA, 15 nt, Homo sapiens
augaauuugacuggu

SEQ ID NO: 1655513 - RNA, 18 nt, Homo sapiens
augaauuugacugguuca

SEQ ID NO: 1655514 - RNA, 19 nt, Homo sapiens
augacauauccuuauaaga

SEQ ID NO: 1655515 - RNA, 14 nt, Homo sapiens
augaccuacagugc

SEQ ID NO: 1655516 - RNA, 20 nt, Homo sapiens
augaccuacagugcugugua

SEQ ID NO: 1655517 - RNA, 17 nt, Homo sapiens
augacugagucuggcaa

SEQ ID NO: 1655518 - RNA, 21 nt, Homo sapiens
augacugagucuggcaaacau

SEQ ID NO: 1655519 - RNA, 22 nt, Homo sapiens
augagaauuugagugcucugau

SEQ ID NO: 1655520 - RNA, 15 nt, Homo sapiens
augagcccuagaaga

SEQ ID NO: 1655521 - RNA, 23 nt, Homo sapiens
augagguacaaccuguucugcuu

SEQ ID NO: 1655522 - RNA, 14 nt, Homo sapiens
augauacuucccac

SEQ ID NO: 1655523 - RNA, 14 nt, Homo sapiens
augauagcuacugu

SEQ ID NO: 1655524 - RNA, 14 nt, Homo sapiens
augaucacggcuca

SEQ ID NO: 1655525 - RNA, 22 nt, Homo sapiens
augaucaucacaaucaucauca

SEQ ID NO: 1655526 - RNA, 18 nt, Homo sapiens
augauccuaaugaaugca

SEQ ID NO: 1655527 - RNA, 16 nt, Homo sapiens
augauggcagugguuu

SEQ ID NO: 1655528 - RNA, 17 nt, Homo sapiens
augauguaggggccaag

SEQ ID NO: 1655529 - RNA, 22 nt, Homo sapiens
augauuuuuguguauccaguau

SEQ ID NO: 1655530 - RNA, 17 nt, Homo sapiens
augcaacaacauguaua

SEQ ID NO: 1655531 - RNA, 22 nt, Homo sapiens
augcaaccuuuggaugcacuuu

SEQ ID NO: 1655532 - RNA, 16 nt, Homo sapiens
augcacaguugccaca

SEQ ID NO: 1655533 - RNA, 16 nt, Homo sapiens
augcagaggaauauua

SEQ ID NO: 1655534 - RNA, 13 nt, Homo sapiens
augcagcaucuaa

SEQ ID NO: 1655535 - RNA, 16 nt, Homo sapiens
augcagcaucuaagua

SEQ ID NO: 1655536 - RNA, 18 nt, Homo sapiens
augcagccccaucuccuc

SEQ ID NO: 1655537 - RNA, 18 nt, Homo sapiens
augcagugguaugaucac

SEQ ID NO: 1655538 - RNA, 21 nt, Homo sapiens
augcauaaauaugcagugaua

SEQ ID NO: 1655539 - RNA, 16 nt, Homo sapiens
augcauaaaugcgauc

SEQ ID NO: 1655540 - RNA, 23 nt, Homo sapiens
augcauauccaacaugugcucag

SEQ ID NO: 1655541 - RNA, 14 nt, Homo sapiens
augcauggaaaaug

SEQ ID NO: 1655542 - RNA, 16 nt, Homo sapiens
augcauuugcacuauu

SEQ ID NO: 1655543 - RNA, 18 nt, Homo sapiens
augccaagcacugugcuc

SEQ ID NO: 1655544 - RNA, 21 nt, Homo sapiens
augccccgucccccucuggcu

SEQ ID NO: 1655545 - RNA, 16 nt, Homo sapiens
augcguuuaaucacau

SEQ ID NO: 1655546 - RNA, 23 nt, Homo sapiens
augcuaacccccaaauacucuga

SEQ ID NO: 1655547 - RNA, 20 nt, Homo sapiens
augcuaccaugccucuccaa

SEQ ID NO: 1655548 - RNA, 14 nt, Homo sapiens
augcuauuuauuaa

SEQ ID NO: 1655549 - RNA, 16 nt, Homo sapiens
augcuuagagggguga

SEQ ID NO: 1655550 - RNA, 12 nt, Homo sapiens
auggaagcaucu

SEQ ID NO: 1655551 - RNA, 18 nt, Homo sapiens
auggaagccaacacauca

SEQ ID NO: 1655552 - RNA, 13 nt, Homo sapiens
auggaaucagauu

SEQ ID NO: 1655553 - RNA, 14 nt, Homo sapiens
auggacaccaucca

SEQ ID NO: 1655554 - RNA, 20 nt, Homo sapiens
auggagucucccacugcaac

SEQ ID NO: 1655555 - RNA, 22 nt, Homo sapiens
auggaugccgugggaguacaaa

SEQ ID NO: 1655556 - RNA, 20 nt, Homo sapiens
auggauuuuucuuuaacugc

SEQ ID NO: 1655557 - RNA, 17 nt, Homo sapiens
auggcacccaugcaccu

SEQ ID NO: 1655558 - RNA, 17 nt, Homo sapiens
auggcccugcaaaagga

SEQ ID NO: 1655559 - RNA, 23 nt, Homo sapiens
auggcuuuggcuuugcaaaauaa

SEQ ID NO: 1655560 - RNA, 23 nt, Homo sapiens
auggcuuuuuuugccuaccauuu

SEQ ID NO: 1655561 - RNA, 20 nt, Homo sapiens
augggaccugaugaccuggg

SEQ ID NO: 1655562 - RNA, 19 nt, Homo sapiens
augggcagagcccaaggga

SEQ ID NO: 1655563 - RNA, 20 nt, Homo sapiens
auggguuagggaaaacauuc

SEQ ID NO: 1655564 - RNA, 22 nt, Homo sapiens
auggguuagggaaaacauucca

SEQ ID NO: 1655565 - RNA, 14 nt, Homo sapiens
auggugaugaaaug

SEQ ID NO: 1655566 - RNA, 23 nt, Homo sapiens
augguggagggccacaugggagg

SEQ ID NO: 1655567 - RNA, 17 nt, Homo sapiens
augguggccuggggcuu

SEQ ID NO: 1655568 - RNA, 20 nt, Homo sapiens
auggugugugucucugacaa

SEQ ID NO: 1655569 - RNA, 13 nt, Homo sapiens
augguuuguguca

SEQ ID NO: 1655570 - RNA, 14 nt, Homo sapiens
auguaaacugugca

SEQ ID NO: 1655571 - RNA, 13 nt, Homo sapiens
auguaaauacugu

SEQ ID NO: 1655572 - RNA, 23 nt, Homo sapiens
auguaacauguaggaaguaggaa

SEQ ID NO: 1655573 - RNA, 17 nt, Homo sapiens
auguaauggacuaugca

SEQ ID NO: 1655574 - RNA, 23 nt, Homo sapiens
auguaauuggaaucuucaccuca

SEQ ID NO: 1655575 - RNA, 19 nt, Homo sapiens
auguacuggagaguggcaa

SEQ ID NO: 1655576 - RNA, 17 nt, Homo sapiens
auguacuguuacugugu

SEQ ID NO: 1655577 - RNA, 19 nt, Homo sapiens
auguacuguuacuguguca

SEQ ID NO: 1655578 - RNA, 22 nt, Homo sapiens
auguaggggccaagcagugccc

SEQ ID NO: 1655579 - RNA, 22 nt, Homo sapiens
auguauaaauuaauacagagua

SEQ ID NO: 1655580 - RNA, 15 nt, Homo sapiens
auguauccuuucaca

SEQ ID NO: 1655581 - RNA, 23 nt, Homo sapiens
auguauugcagugcggcucacau

SEQ ID NO: 1655582 - RNA, 17 nt, Homo sapiens
auguccuccucugugaa

SEQ ID NO: 1655583 - RNA, 21 nt, Homo sapiens
auguccuccucugugaaacug

SEQ ID NO: 1655584 - RNA, 23 nt, Homo sapiens
auguccuugcuuuacaaaccaac

SEQ ID NO: 1655585 - RNA, 19 nt, Homo sapiens
augucgcuggguccucugc

SEQ ID NO: 1655586 - RNA, 19 nt, Homo sapiens
cauuaaaguuaaacuguau

SEQ ID NO: 1655587 - RNA, 12 nt, Homo sapiens
cauuacagggaa

SEQ ID NO: 1655588 - RNA, 14 nt, Homo sapiens
cauuauaugcacua

SEQ ID NO: 1655589 - RNA, 16 nt, Homo sapiens
cauuauuuaauuugua

SEQ ID NO: 1655590 - RNA, 18 nt, Homo sapiens
cauucaacagagacugaa

SEQ ID NO: 1655591 - RNA, 21 nt, Homo sapiens
cauuccugggacuaugcugua

SEQ ID NO: 1655592 - RNA, 12 nt, Homo sapiens
cauucucugucu

SEQ ID NO: 1655593 - RNA, 16 nt, Homo sapiens
cauucugcucuuugau

SEQ ID NO: 1655594 - RNA, 20 nt, Homo sapiens
cauucuuuuugaaaugucaa

SEQ ID NO: 1655595 - RNA, 22 nt, Homo sapiens
cauugaagaauguuagaguaau

SEQ ID NO: 1655596 - RNA, 19 nt, Homo sapiens
cauugcaauagaaauccaa

SEQ ID NO: 1655597 - RNA, 18 nt, Homo sapiens
cauuguaaaucugaagaa

SEQ ID NO: 1655598 - RNA, 15 nt, Homo sapiens
cauuguacuuauaca

SEQ ID NO: 1655599 - RNA, 19 nt, Homo sapiens
cauuguauuaacgcaaaua

SEQ ID NO: 1655600 - RNA, 19 nt, Homo sapiens
cauuguucagaugcuucuu

SEQ ID NO: 1655601 - RNA, 14 nt, Homo sapiens
cauuuaauauggau

SEQ ID NO: 1655602 - RNA, 21 nt, Homo sapiens
cauuuacaggucuucucucca

SEQ ID NO: 1655603 - RNA, 11 nt, Homo sapiens
cauuuacugug

SEQ ID NO: 1655604 - RNA, 20 nt, Homo sapiens
cauuuacuguggcuucuuaa

SEQ ID NO: 1655605 - RNA, 15 nt, Homo sapiens
cauuuaguccuguac

SEQ ID NO: 1655606 - RNA, 13 nt, Homo sapiens
cauuuauagcaua

SEQ ID NO: 1655607 - RNA, 19 nt, Homo sapiens
cauuuauuugugaugacaa

SEQ ID NO: 1655608 - RNA, 13 nt, Homo sapiens
cauuucaccaugu

SEQ ID NO: 1655609 - RNA, 15 nt, Homo sapiens
cauuugaggaucuca

SEQ ID NO: 1655610 - RNA, 22 nt, Homo sapiens
cauuugucaacaaagucaccca

SEQ ID NO: 1655611 - RNA, 12 nt, Homo sapiens
cauuuugccaaa

SEQ ID NO: 1655612 - RNA, 21 nt, Homo sapiens
cauuuuuaguagagacagggu

SEQ ID NO: 1655613 - RNA, 13 nt, Homo sapiens
ccaaaaacauguu

SEQ ID NO: 1655614 - RNA, 16 nt, Homo sapiens
ccaaaaauuacuuugg

SEQ ID NO: 1655615 - RNA, 19 nt, Homo sapiens
ccaaaacuggaccaccaga

SEQ ID NO: 1655616 - RNA, 21 nt, Homo sapiens
ccaaaauaaugcaccacuuuu

SEQ ID NO: 1655617 - RNA, 15 nt, Homo sapiens
ccaaacauccuacaa

SEQ ID NO: 1655618 - RNA, 23 nt, Homo sapiens
ccaaacuauuuucugaagugacu

SEQ ID NO: 1655619 - RNA, 20 nt, Homo sapiens
ccaaagacuuaucagaugcu

SEQ ID NO: 1655620 - RNA, 20 nt, Homo sapiens
ccaaagccaauaacacacag

SEQ ID NO: 1655621 - RNA, 22 nt, Homo sapiens
ccaaagccaauaacacacagcu

SEQ ID NO: 1655622 - RNA, 17 nt, Homo sapiens
ccaaagcuuucauguaa

SEQ ID NO: 1655623 - RNA, 17 nt, Homo sapiens
ccaaaucugacauauua

SEQ ID NO: 1655624 - RNA, 22 nt, Homo sapiens
ccaaaugaucuggugguuauuu

SEQ ID NO: 1655625 - RNA, 22 nt, Homo sapiens
ccaaaugcugugcaaacagugu

SEQ ID NO: 1655626 - RNA, 20 nt, Homo sapiens
ccaaauuacguguacuacaa

SEQ ID NO: 1655627 - RNA, 22 nt, Homo sapiens
ccaaauuggauacugcugccaa

SEQ ID NO: 1655628 - RNA, 16 nt, Homo sapiens
ccaacagcacccucuc

SEQ ID NO: 1655629 - RNA, 17 nt, Homo sapiens
ccaacaugguccuagca

SEQ ID NO: 1655630 - RNA, 13 nt, Homo sapiens
ccaacuauaauua

SEQ ID NO: 1655631 - RNA, 18 nt, Homo sapiens
ccaagagucugaugauuu

SEQ ID NO: 1655632 - RNA, 20 nt, Homo sapiens
ccaagcccaauacagccauu

SEQ ID NO: 1655633 - RNA, 19 nt, Homo sapiens
ccaagccuggcaagggaau

SEQ ID NO: 1655634 - RNA, 23 nt, Homo sapiens
ccaaggccucauccuggggagga

SEQ ID NO: 1655635 - RNA, 22 nt, Homo sapiens
ccaaggucacuuccguuuaccu

SEQ ID NO: 1655636 - RNA, 17 nt, Homo sapiens
ccaagugagaaggagau

SEQ ID NO: 1655637 - RNA, 22 nt, Homo sapiens
ccaagugauccuuccaccucag

SEQ ID NO: 1655638 - RNA, 15 nt, Homo sapiens
ccaaucauacaaaua

SEQ ID NO: 1655639 - RNA, 17 nt, Homo sapiens
ccaauccuggacaugaa

SEQ ID NO: 1655640 - RNA, 20 nt, Homo sapiens
ccaaugaguuggccuuuaaa

SEQ ID NO: 1655641 - RNA, 22 nt, Homo sapiens
ccaaugcacaguugccacauuu

SEQ ID NO: 1655642 - RNA, 12 nt, Homo sapiens
ccaauuguuuca

SEQ ID NO: 1655643 - RNA, 22 nt, Homo sapiens
ccaauuuaaagaaaacuguuaa

SEQ ID NO: 1655644 - RNA, 14 nt, Homo sapiens
ccaauuuacuuugu

SEQ ID NO: 1655645 - RNA, 11 nt, Homo sapiens
ccacagccauc

SEQ ID NO: 1655646 - RNA, 14 nt, Homo sapiens
ccacaggacauuuc

SEQ ID NO: 1655647 - RNA, 19 nt, Homo sapiens
ccacaggccugagauuuca

SEQ ID NO: 1655648 - RNA, 21 nt, Homo sapiens
ccacaggccugagauuucauc

SEQ ID NO: 1655649 - RNA, 21 nt, Homo sapiens
ccacaucuugcucugcugaca

SEQ ID NO: 1655650 - RNA, 14 nt, Homo sapiens
ccacaugugcacau

SEQ ID NO: 1655651 - RNA, 15 nt, Homo sapiens
ccaccaccugcucac

SEQ ID NO: 1655652 - RNA, 20 nt, Homo sapiens
ccacccaaugcugauguccu

SEQ ID NO: 1655653 - RNA, 14 nt, Homo sapiens
ccaccgcaugcccc

SEQ ID NO: 1655654 - RNA, 18 nt, Homo sapiens
ccaccucucucacuccuu

SEQ ID NO: 1655655 - RNA, 17 nt, Homo sapiens
ccaccuuggcucaaguc

SEQ ID NO: 1655656 - RNA, 14 nt, Homo sapiens
ccacgaggugcagu

SEQ ID NO: 1655657 - RNA, 15 nt, Homo sapiens
ccacgaggugcagua

SEQ ID NO: 1655658 - RNA, 15 nt, Homo sapiens
ccacggccaggccag

SEQ ID NO: 1655659 - RNA, 20 nt, Homo sapiens
ccacguaugugaaacacaca

SEQ ID NO: 1655660 - RNA, 18 nt, Homo sapiens
ccacguccugucagugcc

SEQ ID NO: 1655661 - RNA, 13 nt, Homo sapiens
ccacuccuaauau

SEQ ID NO: 1655662 - RNA, 14 nt, Homo sapiens
ccacugaaauggac

SEQ ID NO: 1655663 - RNA, 12 nt, Homo sapiens
ccacugccugag

SEQ ID NO: 1655664 - RNA, 20 nt, Homo sapiens
ccacuguggaagucccucag

SEQ ID NO: 1655665 - RNA, 12 nt, Homo sapiens
ccacuucugcca

SEQ ID NO: 1655666 - RNA, 13 nt, Homo sapiens
ccagacccggcug

SEQ ID NO: 1655667 - RNA, 19 nt, Homo sapiens
ccagagaggguggugaccu

SEQ ID NO: 1655668 - RNA, 12 nt, Homo sapiens
ccagauugcaac

SEQ ID NO: 1655669 - RNA, 21 nt, Homo sapiens
ccagauuggcucacacugaga

SEQ ID NO: 1655670 - RNA, 19 nt, Homo sapiens
ccagcaucccuugaccagg

SEQ ID NO: 1655671 - RNA, 13 nt, Homo sapiens
ccagcauucucag

SEQ ID NO: 1655672 - RNA, 15 nt, Homo sapiens
ccagcucugguccau

SEQ ID NO: 1655673 - RNA, 12 nt, Homo sapiens
ccaggaccaguc

SEQ ID NO: 1655674 - RNA, 16 nt, Homo sapiens
ccaggaguacacccca

SEQ ID NO: 1655675 - RNA, 20 nt, Homo sapiens
ccaggaucaugguguaauaa

SEQ ID NO: 1655676 - RNA, 18 nt, Homo sapiens
ccaggcaacuugggaacu

SEQ ID NO: 1655677 - RNA, 14 nt, Homo sapiens
ccaggccaggacuc

SEQ ID NO: 1655678 - RNA, 16 nt, Homo sapiens
ccaggcuggagugcaa

SEQ ID NO: 1655679 - RNA, 17 nt, Homo sapiens
ccaggcuggagugcaau

SEQ ID NO: 1655680 - RNA, 15 nt, Homo sapiens
ccagggcugcaaugc

SEQ ID NO: 1655681 - RNA, 16 nt, Homo sapiens
ccaggguccacaggaa

SEQ ID NO: 1655682 - RNA, 15 nt, Homo sapiens
ccaggugcugcucag

SEQ ID NO: 1655683 - RNA, 15 nt, Homo sapiens
ccaggugcugugaca

SEQ ID NO: 1655684 - RNA, 18 nt, Homo sapiens
ccaguauaagacuacuga

SEQ ID NO: 1655685 - RNA, 20 nt, Homo sapiens
ccagugaggcucugcccuug

SEQ ID NO: 1655686 - RNA, 17 nt, Homo sapiens
ccaguggaacagucuuc

SEQ ID NO: 1655687 - RNA, 13 nt, Homo sapiens
ccaguggcugcug

SEQ ID NO: 1655688 - RNA, 19 nt, Homo sapiens
ccaguuguaauagugccaa

SEQ ID NO: 1655689 - RNA, 15 nt, Homo sapiens
ccauagcuacaucag

SEQ ID NO: 1655690 - RNA, 23 nt, Homo sapiens
ccauaugaaaaggcuaagcuuca

SEQ ID NO: 1655691 - RNA, 13 nt, Homo sapiens
ccaucaagccacc

SEQ ID NO: 1655692 - RNA, 19 nt, Homo sapiens
ugagaggagagagacucca

SEQ ID NO: 1655693 - RNA, 18 nt, Homo sapiens
ugagaggggaacagacug

SEQ ID NO: 1655694 - RNA, 22 nt, Homo sapiens
ugagauucuucguguauagcug

SEQ ID NO: 1655695 - RNA, 16 nt, Homo sapiens
ugagcagcaacugugu

SEQ ID NO: 1655696 - RNA, 19 nt, Homo sapiens
ugaggaacaaucacaaaag

SEQ ID NO: 1655697 - RNA, 19 nt, Homo sapiens
ugaggcccuccacaccugc

SEQ ID NO: 1655698 - RNA, 18 nt, Homo sapiens
ugagucaaaaaaucucaa

SEQ ID NO: 1655699 - RNA, 20 nt, Homo sapiens
ugagucaccaagcccaguua

SEQ ID NO: 1655700 - RNA, 14 nt, Homo sapiens
ugagugaucacugg

SEQ ID NO: 1655701 - RNA, 14 nt, Homo sapiens
ugauaacagcacug

SEQ ID NO: 1655702 - RNA, 21 nt, Homo sapiens
ugauaagagggcacacacugu

SEQ ID NO: 1655703 - RNA, 20 nt, Homo sapiens
ugauacaaauugcagacugu

SEQ ID NO: 1655704 - RNA, 22 nt, Homo sapiens
ugauacaaauugcagacugugu

SEQ ID NO: 1655705 - RNA, 11 nt, Homo sapiens
ugauacugugu

SEQ ID NO: 1655706 - RNA, 12 nt, Homo sapiens
ugauacuguugc

SEQ ID NO: 1655707 - RNA, 12 nt, Homo sapiens
ugauacuuugac

SEQ ID NO: 1655708 - RNA, 16 nt, Homo sapiens
ugauagcuaagugagu

SEQ ID NO: 1655709 - RNA, 19 nt, Homo sapiens
ugauauggcagaagacacc

SEQ ID NO: 1655710 - RNA, 18 nt, Homo sapiens
ugaucacggcucacugca

SEQ ID NO: 1655711 - RNA, 16 nt, Homo sapiens
ugaucccgugugccac

SEQ ID NO: 1655712 - RNA, 18 nt, Homo sapiens
ugauccuaaugaaugcau

SEQ ID NO: 1655713 - RNA, 20 nt, Homo sapiens
ugauccuaaugaaugcauaa

SEQ ID NO: 1655714 - RNA, 18 nt, Homo sapiens
ugaugaaugaggaacaau

SEQ ID NO: 1655715 - RNA, 13 nt, Homo sapiens
ugaugauacuucc

SEQ ID NO: 1655716 - RNA, 21 nt, Homo sapiens
ugaugcugggauuuacacuug

SEQ ID NO: 1655717 - RNA, 23 nt, Homo sapiens
ugaugcugggauuuacacuugag

SEQ ID NO: 1655718 - RNA, 19 nt, Homo sapiens
ugauggguuaguggaugga

SEQ ID NO: 1655719 - RNA, 21 nt, Homo sapiens
ugauggguuaguggauggaag

SEQ ID NO: 1655720 - RNA, 15 nt, Homo sapiens
ugauguuacugagau

SEQ ID NO: 1655721 - RNA, 17 nt, Homo sapiens
ugauguuggcugggaac

SEQ ID NO: 1655722 - RNA, 17 nt, Homo sapiens
ugauucauuuucugccu

SEQ ID NO: 1655723 - RNA, 22 nt, Homo sapiens
ugauucuccugccucagccucc

SEQ ID NO: 1655724 - RNA, 22 nt, Homo sapiens
ugauucuuccagauaauguccu

SEQ ID NO: 1655725 - RNA, 15 nt, Homo sapiens
ugauuuagguagccu

SEQ ID NO: 1655726 - RNA, 15 nt, Homo sapiens
ugauuucacagugug

SEQ ID NO: 1655727 - RNA, 16 nt, Homo sapiens
ugcaaaaggacucuca

SEQ ID NO: 1655728 - RNA, 20 nt, Homo sapiens
ugcaaaagggcuuccuaaaa

SEQ ID NO: 1655729 - RNA, 17 nt, Homo sapiens
ugcaaagcccagcuuga

SEQ ID NO: 1655730 - RNA, 18 nt, Homo sapiens
ugcaaagcccagcuugaa

SEQ ID NO: 1655731 - RNA, 17 nt, Homo sapiens
ugcaaaguguauuagga

SEQ ID NO: 1655732 - RNA, 14 nt, Homo sapiens
ugcaaccuucgcca

SEQ ID NO: 1655733 - RNA, 17 nt, Homo sapiens
ugcaauagaacagagaa

SEQ ID NO: 1655734 - RNA, 19 nt, Homo sapiens
ugcaaucagcuaccauuca

SEQ ID NO: 1655735 - RNA, 15 nt, Homo sapiens
ugcacaaaccaauua

SEQ ID NO: 1655736 - RNA, 21 nt, Homo sapiens
ugcacacagcacgggggccaa

SEQ ID NO: 1655737 - RNA, 15 nt, Homo sapiens
ugcacagaagacagc

SEQ ID NO: 1655738 - RNA, 13 nt, Homo sapiens
ugcaccacuuuua

SEQ ID NO: 1655739 - RNA, 14 nt, Homo sapiens
ugcaccuucugacg

SEQ ID NO: 1655740 - RNA, 14 nt, Homo sapiens
ugcacguauuuuaa

SEQ ID NO: 1655741 - RNA, 23 nt, Homo sapiens
ugcacuccagccugggugacaaa

SEQ ID NO: 1655742 - RNA, 14 nt, Homo sapiens
ugcacuguccugcu

SEQ ID NO: 1655743 - RNA, 15 nt, Homo sapiens
ugcacuguccugcuc

SEQ ID NO: 1655744 - RNA, 23 nt, Homo sapiens
ugcacuguccugcuccacagugu

SEQ ID NO: 1655745 - RNA, 21 nt, Homo sapiens
ugcacuguucccccugugcag

SEQ ID NO: 1655746 - RNA, 12 nt, Homo sapiens
ugcagacaugag

SEQ ID NO: 1655747 - RNA, 23 nt, Homo sapiens
ugcagagauccuacuucucugag

SEQ ID NO: 1655748 - RNA, 21 nt, Homo sapiens
ugcagauuagcuaggggacag

SEQ ID NO: 1655749 - RNA, 14 nt, Homo sapiens
ugcagauuugauau

SEQ ID NO: 1655750 - RNA, 20 nt, Homo sapiens
ugcaggacccugaucuuuug

SEQ ID NO: 1655751 - RNA, 17 nt, Homo sapiens
ugcagguuugaccagga

SEQ ID NO: 1655752 - RNA, 17 nt, Homo sapiens
ugcaguggcacgaucuc

SEQ ID NO: 1655753 - RNA, 23 nt, Homo sapiens
ugcagugguaugaucacggcuca

SEQ ID NO: 1655754 - RNA, 18 nt, Homo sapiens
ugcauaagugcaugacau

SEQ ID NO: 1655755 - RNA, 20 nt, Homo sapiens
ugcauaagugcaugacauau

SEQ ID NO: 1655756 - RNA, 11 nt, Homo sapiens
acacuguaaug

SEQ ID NO: 1655757 - RNA, 22 nt, Homo sapiens
acacugugcugagucugaaggc

SEQ ID NO: 1655758 - RNA, 16 nt, Homo sapiens
acacuguuaucuucac

SEQ ID NO: 1655759 - RNA, 17 nt, Homo sapiens
acacuuggaguuugcau

SEQ ID NO: 1655760 - RNA, 18 nt, Homo sapiens
acagaaaauauggugcug

SEQ ID NO: 1655761 - RNA, 16 nt, Homo sapiens
acagaacacacugaga

SEQ ID NO: 1655762 - RNA, 21 nt, Homo sapiens
acagaacacugucuugaagac

SEQ ID NO: 1655763 - RNA, 23 nt, Homo sapiens
acagaagacagcagcaagugugc

SEQ ID NO: 1655764 - RNA, 12 nt, Homo sapiens
acagaagguccu

SEQ ID NO: 1655765 - RNA, 16 nt, Homo sapiens
acagacuggaagcaca

SEQ ID NO: 1655766 - RNA, 17 nt, Homo sapiens
acagagcagaacuuuca

SEQ ID NO: 1655767 - RNA, 18 nt, Homo sapiens
acagagcagaacuuucac

SEQ ID NO: 1655768 - RNA, 16 nt, Homo sapiens
acagagcuucccugac

SEQ ID NO: 1655769 - RNA, 20 nt, Homo sapiens
acagagugagacucugucuc

SEQ ID NO: 1655770 - RNA, 13 nt, Homo sapiens
acagagugcuaau

SEQ ID NO: 1655771 - RNA, 18 nt, Homo sapiens
acagauccccaagccugg

SEQ ID NO: 1655772 - RNA, 22 nt, Homo sapiens
acagauuugagcucagcccugg

SEQ ID NO: 1655773 - RNA, 15 nt, Homo sapiens
acagauuuguaacau

SEQ ID NO: 1655774 - RNA, 16 nt, Homo sapiens
acagcacccucuccag

SEQ ID NO: 1655775 - RNA, 19 nt, Homo sapiens
acagcacccucuccagaug

SEQ ID NO: 1655776 - RNA, 19 nt, Homo sapiens
acagcacgggggccaagga

SEQ ID NO: 1655777 - RNA, 11 nt, Homo sapiens
acagcacuccu

SEQ ID NO: 1655778 - RNA, 14 nt, Homo sapiens
acagccacuuggga

SEQ ID NO: 1655779 - RNA, 14 nt, Homo sapiens
acagccugagaaau

SEQ ID NO: 1655780 - RNA, 20 nt, Homo sapiens
acagcucgggcccucuguga

SEQ ID NO: 1655781 - RNA, 15 nt, Homo sapiens
accccugguucucau

SEQ ID NO: 1655782 - RNA, 21 nt, Homo sapiens
accccuugcucucaacccagg

SEQ ID NO: 1655783 - RNA, 22 nt, Homo sapiens
accccuugcucucaacccagga

SEQ ID NO: 1655784 - RNA, 16 nt, Homo sapiens
acccuaaaucuugacu

SEQ ID NO: 1655785 - RNA, 11 nt, Homo sapiens
acccucccacu

SEQ ID NO: 1655786 - RNA, 20 nt, Homo sapiens
acccucucaggcugucccaa

SEQ ID NO: 1655787 - RNA, 13 nt, Homo sapiens
acccucugugaaa

SEQ ID NO: 1655788 - RNA, 19 nt, Homo sapiens
acccugagcagaauacugg

SEQ ID NO: 1655789 - RNA, 16 nt, Homo sapiens
acccuguaaaauggag

SEQ ID NO: 1655790 - RNA, 16 nt, Homo sapiens
acccuucuccuuagaa

SEQ ID NO: 1655791 - RNA, 12 nt, Homo sapiens
acccuucugccu

SEQ ID NO: 1655792 - RNA, 14 nt, Homo sapiens
accgaggacaugaa

SEQ ID NO: 1655793 - RNA, 23 nt, Homo sapiens
accguucauucaggcaacgcaca

SEQ ID NO: 1655794 - RNA, 23 nt, Homo sapiens
accguuuccuuucauuuacugug

SEQ ID NO: 1655795 - RNA, 21 nt, Homo sapiens
accuaccacaugccaagcacu

SEQ ID NO: 1655796 - RNA, 12 nt, Homo sapiens
accuacuccugg

SEQ ID NO: 1655797 - RNA, 23 nt, Homo sapiens
accuagaagggcuagaaccugga

SEQ ID NO: 1655798 - RNA, 20 nt, Homo sapiens
accuagaauuggcugaacuc

SEQ ID NO: 1655799 - RNA, 20 nt, Homo sapiens
accuagcaaagcuccugccu

SEQ ID NO: 1655800 - RNA, 17 nt, Homo sapiens
accuagcgucaguauuu

SEQ ID NO: 1655801 - RNA, 22 nt, Homo sapiens
accucagggcuguguguacuaa

SEQ ID NO: 1655802 - RNA, 18 nt, Homo sapiens
accucagucucccagcua

SEQ ID NO: 1655803 - RNA, 14 nt, Homo sapiens
accucccaccauaa

SEQ ID NO: 1655804 - RNA, 12 nt, Homo sapiens
accuccuuccag

SEQ ID NO: 1655805 - RNA, 20 nt, Homo sapiens
accucgugauccaccugccu

SEQ ID NO: 1655806 - RNA, 15 nt, Homo sapiens
accucugcaagacaa

SEQ ID NO: 1655807 - RNA, 22 nt, Homo sapiens
accugaaauaaaauucauuagu

SEQ ID NO: 1655808 - RNA, 13 nt, Homo sapiens
accugaagacacc

SEQ ID NO: 1655809 - RNA, 11 nt, Homo sapiens
accugacaaug

SEQ ID NO: 1655810 - RNA, 13 nt, Homo sapiens
accugaugaccug

SEQ ID NO: 1655811 - RNA, 12 nt, Homo sapiens
accugauggaga

SEQ ID NO: 1655812 - RNA, 22 nt, Homo sapiens
accuggagggaaugaaccugga

SEQ ID NO: 1655813 - RNA, 21 nt, Homo sapiens
accuggagggcuagaaccuag

SEQ ID NO: 1655814 - RNA, 22 nt, Homo sapiens
accuggagggcuagaaccugga

SEQ ID NO: 1655815 - RNA, 18 nt, Homo sapiens
accuggccucugcacucc

SEQ ID NO: 1655816 - RNA, 18 nt, Homo sapiens
accuggguaaaugcagcg

SEQ ID NO: 1655817 - RNA, 16 nt, Homo sapiens
accugucccccugaca

SEQ ID NO: 1655818 - RNA, 19 nt, Homo sapiens
accuguggccaaguucuua

SEQ ID NO: 1655819 - RNA, 15 nt, Homo sapiens
accuuaaacuuucaa

SEQ ID NO: 1655820 - RNA, 18 nt, Homo sapiens
accuuauuggauauuuga

SEQ ID NO: 1655821 - RNA, 19 nt, Homo sapiens
accuuauuggauauuugau

SEQ ID NO: 1655822 - RNA, 18 nt, Homo sapiens
accuucaaaauguucuau

SEQ ID NO: 1655823 - RNA, 19 nt, Homo sapiens
accuucugacgcagccuga

SEQ ID NO: 1655824 - RNA, 23 nt, Homo sapiens
accuucugacgcagccugagaau

SEQ ID NO: 1655825 - RNA, 12 nt, Homo sapiens
accuugugagag

SEQ ID NO: 1655826 - RNA, 16 nt, Homo sapiens
accuuugaaauauuaa

SEQ ID NO: 1655827 - RNA, 19 nt, Homo sapiens
accuuuggaugcacuuuau

SEQ ID NO: 1655828 - RNA, 13 nt, Homo sapiens
acgaggugcagua

SEQ ID NO: 1655829 - RNA, 17 nt, Homo sapiens
acgauaaaagacaguga

SEQ ID NO: 1655830 - RNA, 14 nt, Homo sapiens
acgaugacaguguu

SEQ ID NO: 1655831 - RNA, 15 nt, Homo sapiens
acgcggccaccucac

SEQ ID NO: 1655832 - RNA, 12 nt, Homo sapiens
acgcgugcacac

SEQ ID NO: 1655833 - RNA, 16 nt, Homo sapiens
acgcucugcaccuucu

SEQ ID NO: 1655834 - RNA, 22 nt, Homo sapiens
acggagccacuccucugacuca

SEQ ID NO: 1655835 - RNA, 20 nt, Homo sapiens
acggggcucuucucauuuca

SEQ ID NO: 1655836 - RNA, 15 nt, Homo sapiens
acgggggcagcugau

SEQ ID NO: 1655837 - RNA, 16 nt, Homo sapiens
acgguggucacuggaa

SEQ ID NO: 1655838 - RNA, 15 nt, Homo sapiens
acguaucugcuacuu

SEQ ID NO: 1655839 - RNA, 14 nt, Homo sapiens
acguauggcuccac

SEQ ID NO: 1655840 - RNA, 20 nt, Homo sapiens
acguccacgcggccaccuca

SEQ ID NO: 1655841 - RNA, 14 nt, Homo sapiens
acgucugacaggca

SEQ ID NO: 1655842 - RNA, 10 nt, Homo sapiens
acgugcaaua

SEQ ID NO: 1655843 - RNA, 21 nt, Homo sapiens
acguggucuuucuuacaagga

SEQ ID NO: 1655844 - RNA, 15 nt, Homo sapiens
acguguaaacaggau

SEQ ID NO: 1655845 - RNA, 20 nt, Homo sapiens
acgugugugcacguacacac

SEQ ID NO: 1655846 - RNA, 16 nt, Homo sapiens
acguuuauagccgaaa

SEQ ID NO: 1655847 - RNA, 20 nt, Homo sapiens
acuaacaggagaaugcacag

SEQ ID NO: 1655848 - RNA, 22 nt, Homo sapiens
acuaaggugugcucugaucauc

SEQ ID NO: 1655849 - RNA, 16 nt, Homo sapiens
acuaaugaugcuuuua

SEQ ID NO: 1655850 - RNA, 21 nt, Homo sapiens
acuaauuuuccauaagcuauu

SEQ ID NO: 1655851 - RNA, 20 nt, Homo sapiens
acuaccagugggcauguauu

SEQ ID NO: 1655852 - RNA, 15 nt, Homo sapiens
acuacuggcaauuug

SEQ ID NO: 1655853 - RNA, 11 nt, Homo sapiens
acuagggccaa

SEQ ID NO: 1655854 - RNA, 19 nt, Homo sapiens
acuauuaccaccaccugcu

SEQ ID NO: 1655855 - RNA, 12 nt, Homo sapiens
acuauuacuggg

SEQ ID NO: 1655856 - RNA, 16 nt, Homo sapiens
acuauugcuugcacaa

SEQ ID NO: 1655857 - RNA, 14 nt, Homo sapiens
acuauuugcagagg

SEQ ID NO: 1655858 - RNA, 13 nt, Homo sapiens
acucaaucucuga

SEQ ID NO: 1655859 - RNA, 15 nt, Homo sapiens
acucaccugcacuaa

SEQ ID NO: 1655860 - RNA, 21 nt, Homo sapiens
acucagccuggcugauuauca

SEQ ID NO: 1655861 - RNA, 21 nt, Homo sapiens
acucauagauguuaugcaaaa

SEQ ID NO: 1655862 - RNA, 22 nt, Homo sapiens
acucauucuucuguacgucuga

SEQ ID NO: 1655863 - RNA, 21 nt, Homo sapiens
acucauuuccaaucauacaaa

SEQ ID NO: 1655864 - RNA, 17 nt, Homo sapiens
agggaauaauccagaaa

SEQ ID NO: 1655865 - RNA, 16 nt, Homo sapiens
agggacgccugggggu

SEQ ID NO: 1655866 - RNA, 14 nt, Homo sapiens
agggagcuggaaaa

SEQ ID NO: 1655867 - RNA, 19 nt, Homo sapiens
agggagggcuccagacaca

SEQ ID NO: 1655868 - RNA, 14 nt, Homo sapiens
agggagugagugca

SEQ ID NO: 1655869 - RNA, 20 nt, Homo sapiens
agggaugaaagagaaggugg

SEQ ID NO: 1655870 - RNA, 23 nt, Homo sapiens
agggcuagaaccuggagagcuag

SEQ ID NO: 1655871 - RNA, 21 nt, Homo sapiens
aggggauagagagagaccacu

SEQ ID NO: 1655872 - RNA, 22 nt, Homo sapiens
aggggcaggcccugcacugucc

SEQ ID NO: 1655873 - RNA, 18 nt, Homo sapiens
aggggccauccuguccca

SEQ ID NO: 1655874 - RNA, 21 nt, Homo sapiens
aggggcuggcccagggcugca

SEQ ID NO: 1655875 - RNA, 18 nt, Homo sapiens
aggggucuggacaugugg

SEQ ID NO: 1655876 - RNA, 16 nt, Homo sapiens
agggugcuccuuguca

SEQ ID NO: 1655877 - RNA, 14 nt, Homo sapiens
aggguguguguuca

SEQ ID NO: 1655878 - RNA, 15 nt, Homo sapiens
aggguguguguucac

SEQ ID NO: 1655879 - RNA, 16 nt, Homo sapiens
aggguugcuucaauga

SEQ ID NO: 1655880 - RNA, 17 nt, Homo sapiens
aggguugcuucaaugau

SEQ ID NO: 1655881 - RNA, 14 nt, Homo sapiens
agguaaaagcauca

SEQ ID NO: 1655882 - RNA, 22 nt, Homo sapiens
aggucagagccugcaguuauua

SEQ ID NO: 1655883 - RNA, 20 nt, Homo sapiens
agguccacaacacacagauu

SEQ ID NO: 1655884 - RNA, 13 nt, Homo sapiens
aggucuccuccac

SEQ ID NO: 1655885 - RNA, 20 nt, Homo sapiens
aggucugguuuauuucccag

SEQ ID NO: 1655886 - RNA, 20 nt, Homo sapiens
aggugauccacccaccucag

SEQ ID NO: 1655887 - RNA, 13 nt, Homo sapiens
aggugcugugaca

SEQ ID NO: 1655888 - RNA, 20 nt, Homo sapiens
aggugggcgggcagcacagc

SEQ ID NO: 1655889 - RNA, 14 nt, Homo sapiens
agguggggcagcuu

SEQ ID NO: 1655890 - RNA, 15 nt, Homo sapiens
agguggggucacucu

SEQ ID NO: 1655891 - RNA, 20 nt, Homo sapiens
aggugguauguuugggagac

SEQ ID NO: 1655892 - RNA, 14 nt, Homo sapiens
agguuaucgaaaua

SEQ ID NO: 1655893 - RNA, 15 nt, Homo sapiens
aguaaguaucuggag

SEQ ID NO: 1655894 - RNA, 19 nt, Homo sapiens
acugcugcaaauacuguau

SEQ ID NO: 1655895 - RNA, 15 nt, Homo sapiens
acugcuuuuggucug

SEQ ID NO: 1655896 - RNA, 22 nt, Homo sapiens
acuggagaggcuagaaccaaga

SEQ ID NO: 1655897 - RNA, 15 nt, Homo sapiens
acuggaugaggucau

SEQ ID NO: 1655898 - RNA, 23 nt, Homo sapiens
acuggaugcauguuuuccagcuc

SEQ ID NO: 1655899 - RNA, 18 nt, Homo sapiens
acuggcucucuaauucca

SEQ ID NO: 1655900 - RNA, 17 nt, Homo sapiens
acugggaagugacuuag

SEQ ID NO: 1655901 - RNA, 13 nt, Homo sapiens
acugggacuugca

SEQ ID NO: 1655902 - RNA, 15 nt, Homo sapiens
acugggucaugugca

SEQ ID NO: 1655903 - RNA, 22 nt, Homo sapiens
acuguauauucaggacuugaaa

SEQ ID NO: 1655904 - RNA, 19 nt, Homo sapiens
acuguauggaaacacugau

SEQ ID NO: 1655905 - RNA, 18 nt, Homo sapiens
acuguaugugggaauuua

SEQ ID NO: 1655906 - RNA, 18 nt, Homo sapiens
acuguccaccaccaccug

SEQ ID NO: 1655907 - RNA, 20 nt, Homo sapiens
acuguccuauuauauucauu

SEQ ID NO: 1655908 - RNA, 17 nt, Homo sapiens
acugucuaagauuaaua

SEQ ID NO: 1655909 - RNA, 23 nt, Homo sapiens
acuguggcuucuuaaucuuuuca

SEQ ID NO: 1655910 - RNA, 15 nt, Homo sapiens
acuguguucccucau

SEQ ID NO: 1655911 - RNA, 16 nt, Homo sapiens
acuguuaacuaugaca

SEQ ID NO: 1655912 - RNA, 17 nt, Homo sapiens
acuguuacugugucagg

SEQ ID NO: 1655913 - RNA, 18 nt, Homo sapiens
acuguucccccugugcag

SEQ ID NO: 1655914 - RNA, 18 nt, Homo sapiens
acuguucuauucaucuca

SEQ ID NO: 1655915 - RNA, 20 nt, Homo sapiens
acuguuuagaugaaugucag

SEQ ID NO: 1655916 - RNA, 15 nt, Homo sapiens
acuuacauaucugac

SEQ ID NO: 1655917 - RNA, 12 nt, Homo sapiens
acuuagcaacuu

SEQ ID NO: 1655918 - RNA, 18 nt, Homo sapiens
acuuauaaauauccugcu

SEQ ID NO: 1655919 - RNA, 21 nt, Homo sapiens
acuuauaaauauccugcucac

SEQ ID NO: 1655920 - RNA, 17 nt, Homo sapiens
acuuaucagaugcucau

SEQ ID NO: 1655921 - RNA, 14 nt, Homo sapiens
acuuaucaucacac

SEQ ID NO: 1655922 - RNA, 18 nt, Homo sapiens
acuuaucaucacacaacu

SEQ ID NO: 1655923 - RNA, 14 nt, Homo sapiens
acuuauuuauauaa

SEQ ID NO: 1655924 - RNA, 19 nt, Homo sapiens
acuucaagaucugaauuug

SEQ ID NO: 1655925 - RNA, 18 nt, Homo sapiens
acuuccaucugugccaua

SEQ ID NO: 1655926 - RNA, 12 nt, Homo sapiens
acuucuaggauu

SEQ ID NO: 1655927 - RNA, 18 nt, Homo sapiens
acuucucuauuaucucaa

SEQ ID NO: 1655928 - RNA, 22 nt, Homo sapiens
acuucucugagucagcugaccc

SEQ ID NO: 1655929 - RNA, 20 nt, Homo sapiens
acuucugcaucuuacaguca

SEQ ID NO: 1655930 - RNA, 11 nt, Homo sapiens
acuucuuccau

SEQ ID NO: 1655931 - RNA, 15 nt, Homo sapiens
acuugccuaucugac

SEQ ID NO: 1655932 - RNA, 15 nt, Homo sapiens
acuugggacauugcc

SEQ ID NO: 1655933 - RNA, 15 nt, Homo sapiens
acuugggccauagcu

SEQ ID NO: 1655934 - RNA, 20 nt, Homo sapiens
acuugguuuccuauuucccc

SEQ ID NO: 1655935 - RNA, 14 nt, Homo sapiens
acuuguggacacag

SEQ ID NO: 1655936 - RNA, 18 nt, Homo sapiens
acuuguucauucugugac

SEQ ID NO: 1655937 - RNA, 20 nt, Homo sapiens
acuuguuuggccuauuccau

SEQ ID NO: 1655938 - RNA, 13 nt, Homo sapiens
acuuucauuugaa

SEQ ID NO: 1655939 - RNA, 23 nt, Homo sapiens
acuuucuugaaaagaagcaagga

SEQ ID NO: 1655940 - RNA, 12 nt, Homo sapiens
acuuugugaaaa

SEQ ID NO: 1655941 - RNA, 14 nt, Homo sapiens
acuuuguguucacc

SEQ ID NO: 1655942 - RNA, 19 nt, Homo sapiens
agaaaacaggcaaauuccu

SEQ ID NO: 1655943 - RNA, 15 nt, Homo sapiens
agaaaacuguuaaua

SEQ ID NO: 1655944 - RNA, 18 nt, Homo sapiens
agaaaauggguuuauuca

SEQ ID NO: 1655945 - RNA, 17 nt, Homo sapiens
agaaacaaagauguuau

SEQ ID NO: 1655946 - RNA, 10 nt, Homo sapiens
agaaacagcu

SEQ ID NO: 1655947 - RNA, 17 nt, Homo sapiens
agaaacuucggggcugc

SEQ ID NO: 1655948 - RNA, 18 nt, Homo sapiens
agaaacuucugcuuuuaa

SEQ ID NO: 1655949 - RNA, 17 nt, Homo sapiens
agaaagcucaucucagc

SEQ ID NO: 1655950 - RNA, 12 nt, Homo sapiens
agaaaggcauga

SEQ ID NO: 1655951 - RNA, 14 nt, Homo sapiens
agaaaguacuucuc

SEQ ID NO: 1655952 - RNA, 14 nt, Homo sapiens
agaaaguacuucuu

SEQ ID NO: 1655953 - RNA, 14 nt, Homo sapiens
agaaauagaauuau

SEQ ID NO: 1655954 - RNA, 11 nt, Homo sapiens
agaaaugaugg

SEQ ID NO: 1655955 - RNA, 19 nt, Homo sapiens
agaaauuugccaauuuacu

SEQ ID NO: 1655956 - RNA, 21 nt, Homo sapiens
agaacagguguuggugacaau

SEQ ID NO: 1655957 - RNA, 23 nt, Homo sapiens
agaaccauuugcaauauggauuu

SEQ ID NO: 1655958 - RNA, 13 nt, Homo sapiens
agaaccuagaagg

SEQ ID NO: 1655959 - RNA, 12 nt, Homo sapiens
agaacucugaau

SEQ ID NO: 1655960 - RNA, 16 nt, Homo sapiens
agaacugagcaucucc

SEQ ID NO: 1655961 - RNA, 22 nt, Homo sapiens
agaacugggcaacuauucauga

SEQ ID NO: 1655962 - RNA, 17 nt, Homo sapiens
agaacuguugguuauuu

SEQ ID NO: 1655963 - RNA, 22 nt, Homo sapiens
agaacuuaagucucgaauguaa

SEQ ID NO: 1655964 - RNA, 16 nt, Homo sapiens
agaagaaugacuaugc

SEQ ID NO: 1655965 - RNA, 18 nt, Homo sapiens
agaagaauuggccaucuu

SEQ ID NO: 1655966 - RNA, 18 nt, Homo sapiens
agaagacaccagagcaga

SEQ ID NO: 1655967 - RNA, 22 nt, Homo sapiens
agaagacagcagcaagugugcu

SEQ ID NO: 1655968 - RNA, 19 nt, Homo sapiens
agaagacuauauuguacac

SEQ ID NO: 1655969 - RNA, 23 nt, Homo sapiens
agaagcugauggggcaaacucaa

SEQ ID NO: 1655970 - RNA, 20 nt, Homo sapiens
agaagcuguuguacauuuau

SEQ ID NO: 1655971 - RNA, 20 nt, Homo sapiens
agaagguggguuuucaucaa

SEQ ID NO: 1655972 - RNA, 12 nt, Homo sapiens
agaagugaaaag

SEQ ID NO: 1655973 - RNA, 14 nt, Homo sapiens
agaagugauuuagu

SEQ ID NO: 1655974 - RNA, 23 nt, Homo sapiens
agaaguggggaccccaccccuca

SEQ ID NO: 1655975 - RNA, 14 nt, Homo sapiens
agaaguuaauccac

SEQ ID NO: 1655976 - RNA, 14 nt, Homo sapiens
agacuccaccucaa

SEQ ID NO: 1655977 - RNA, 16 nt, Homo sapiens
agacucccaagcugga

SEQ ID NO: 1655978 - RNA, 17 nt, Homo sapiens
agacucccaagcuggac

SEQ ID NO: 1655979 - RNA, 20 nt, Homo sapiens
agacuccuagacucacuugu

SEQ ID NO: 1655980 - RNA, 20 nt, Homo sapiens
agacucuacagaggccaugg

SEQ ID NO: 1655981 - RNA, 14 nt, Homo sapiens
agacucugucucaa

SEQ ID NO: 1655982 - RNA, 23 nt, Homo sapiens
agacuuuuccaacccucaucacc

SEQ ID NO: 1655983 - RNA, 15 nt, Homo sapiens
agagaaaagacauaa

SEQ ID NO: 1655984 - RNA, 12 nt, Homo sapiens
agagaaccauga

SEQ ID NO: 1655985 - RNA, 13 nt, Homo sapiens
agagaauuuccuu

SEQ ID NO: 1655986 - RNA, 21 nt, Homo sapiens
agagacgggguuucaccaugu

SEQ ID NO: 1655987 - RNA, 13 nt, Homo sapiens
agagcacagugau

SEQ ID NO: 1655988 - RNA, 15 nt, Homo sapiens
agagcccaggagcuc

SEQ ID NO: 1655989 - RNA, 22 nt, Homo sapiens
agagcccuucaugcauuugcac

SEQ ID NO: 1655990 - RNA, 23 nt, Homo sapiens
agagcccuucaugcauuugcacu

SEQ ID NO: 1655991 - RNA, 23 nt, Homo sapiens
agagcugggauguuucugucaca

SEQ ID NO: 1655992 - RNA, 22 nt, Homo sapiens
agagcuucuguugcugccucau

SEQ ID NO: 1655993 - RNA, 14 nt, Homo sapiens
agagcuugaugcca

SEQ ID NO: 1655994 - RNA, 23 nt, Homo sapiens
agagcuuguaauaaauacugcag

SEQ ID NO: 1655995 - RNA, 22 nt, Homo sapiens
agaggccuuggggcaugaccca

SEQ ID NO: 1655996 - RNA, 12 nt, Homo sapiens
agaggggacgca

SEQ ID NO: 1655997 - RNA, 19 nt, Homo sapiens
agagguuuagacagcagua

SEQ ID NO: 1655998 - RNA, 15 nt, Homo sapiens
agagugagacuccac

SEQ ID NO: 1655999 - RNA, 22 nt, Homo sapiens
agagugguuaagacuacugaag

SEQ ID NO: 1656000 - RNA, 13 nt, Homo sapiens
agauaaagaccuu

SEQ ID NO: 1656001 - RNA, 23 nt, Homo sapiens
agauaaaucuaguauacauuguc

SEQ ID NO: 1656002 - RNA, 19 nt, Homo sapiens
agauaauguccuugcuuua

SEQ ID NO: 1656003 - RNA, 18 nt, Homo sapiens
agauacccaauuguuuca

SEQ ID NO: 1656004 - RNA, 15 nt, Homo sapiens
agauagagaccaucu

SEQ ID NO: 1656005 - RNA, 20 nt, Homo sapiens
agauagauaggucagugcaa

SEQ ID NO: 1656006 - RNA, 12 nt, Homo sapiens
agaucacagugu

SEQ ID NO: 1656007 - RNA, 13 nt, Homo sapiens
agaucacugugcu

SEQ ID NO: 1656008 - RNA, 21 nt, Homo sapiens
agaucuaaaaugauacugugu

SEQ ID NO: 1656009 - RNA, 19 nt, Homo sapiens
agaucugcagucacuucgu

SEQ ID NO: 1656010 - RNA, 14 nt, Homo sapiens
agaugaaugggagu

SEQ ID NO: 1656011 - RNA, 24 nt, Homo sapiens
agaugaccuacagugcuguguacc

SEQ ID NO: 1656012 - RNA, 17 nt, Homo sapiens
agaugcaggugagccca

SEQ ID NO: 1656013 - RNA, 10 nt, Homo sapiens
agaugcauua

SEQ ID NO: 1656014 - RNA, 19 nt, Homo sapiens
agaugcuuuaagugcacaa

SEQ ID NO: 1656015 - RNA, 14 nt, Homo sapiens
agaugucucugugu

SEQ ID NO: 1656016 - RNA, 17 nt, Homo sapiens
agauguguguugauacu

SEQ ID NO: 1656017 - RNA, 18 nt, Homo sapiens
agauuagcuaggggacag

SEQ ID NO: 1656018 - RNA, 17 nt, Homo sapiens
agauuaguaaauaugug

SEQ ID NO: 1656019 - RNA, 18 nt, Homo sapiens
agauuauauggacuuucu

SEQ ID NO: 1656020 - RNA, 23 nt, Homo sapiens
agauuauauggacuuucuugcaa

SEQ ID NO: 1656021 - RNA, 14 nt, Homo sapiens
agauucacacuguc

SEQ ID NO: 1656022 - RNA, 19 nt, Homo sapiens
agauuggcucacacugaga

SEQ ID NO: 1656023 - RNA, 20 nt, Homo sapiens
agauuggcucacacugagaa

SEQ ID NO: 1656024 - RNA, 12 nt, Homo sapiens
agauuguguucc

SEQ ID NO: 1656025 - RNA, 13 nt, Homo sapiens
agauuucaucugc

SEQ ID NO: 1656026 - RNA, 13 nt, Homo sapiens
agcaaaaccaaau

SEQ ID NO: 1656027 - RNA, 13 nt, Homo sapiens
agcaaagggcuca

SEQ ID NO: 1656028 - RNA, 14 nt, Homo sapiens
agcaacaagcuauu

SEQ ID NO: 1656029 - RNA, 19 nt, Homo sapiens
agcaauucuccugccucag

SEQ ID NO: 1656030 - RNA, 18 nt, Homo sapiens
agcacccuauauacacuu

SEQ ID NO: 1656031 - RNA, 14 nt, Homo sapiens
agcacccucuccag

SEQ ID NO: 1656032 - RNA, 18 nt, Homo sapiens
agcaccuuagacaguccc

SEQ ID NO: 1656033 - RNA, 18 nt, Homo sapiens
agcacgggggccaaggau

SEQ ID NO: 1656034 - RNA, 22 nt, Homo sapiens
agcacucucgcacacacaguga

SEQ ID NO: 1656035 - RNA, 15 nt, Homo sapiens
agcacugaggaagaa

SEQ ID NO: 1656036 - RNA, 21 nt, Homo sapiens
agcagaugcuggucauguguu

SEQ ID NO: 1656037 - RNA, 17 nt, Homo sapiens
agcagcacagcugccaa

SEQ ID NO: 1656038 - RNA, 21 nt, Homo sapiens
agcagccucagaacaaaguga

SEQ ID NO: 1656039 - RNA, 22 nt, Homo sapiens
agcagcuaaaaccuacucacuu

SEQ ID NO: 1656040 - RNA, 14 nt, Homo sapiens
agcagcuccaaaac

SEQ ID NO: 1656041 - RNA, 16 nt, Homo sapiens
agcaguagacaagcaa

SEQ ID NO: 1656042 - RNA, 20 nt, Homo sapiens
agcagugaaugauucagugu

SEQ ID NO: 1656043 - RNA, 20 nt, Homo sapiens
agcaguuaguuccuucauga

SEQ ID NO: 1656044 - RNA, 21 nt, Homo sapiens
agcaugucgucaaagcugaaa

SEQ ID NO: 1656045 - RNA, 21 nt, Homo sapiens
agcauuguaaaauuauuucau

SEQ ID NO: 1656046 - RNA, 11 nt, Homo sapiens
agccaagggau

SEQ ID NO: 1656047 - RNA, 17 nt, Homo sapiens
agccaauaaaugaacug

SEQ ID NO: 1656048 - RNA, 12 nt, Homo sapiens
agccacacugaa

SEQ ID NO: 1656049 - RNA, 15 nt, Homo sapiens
agccagguucugacu

SEQ ID NO: 1656050 - RNA, 17 nt, Homo sapiens
agccauaugaaugucag

SEQ ID NO: 1656051 - RNA, 14 nt, Homo sapiens
agcccccacccggu

SEQ ID NO: 1656052 - RNA, 21 nt, Homo sapiens
agccccucucuuauaauucca

SEQ ID NO: 1656053 - RNA, 20 nt, Homo sapiens
agccccuggaugcagccuca

SEQ ID NO: 1656054 - RNA, 16 nt, Homo sapiens
agcccuacucugugua

SEQ ID NO: 1656055 - RNA, 17 nt, Homo sapiens
agcccuccuuaucaaag

SEQ ID NO: 1656056 - RNA, 20 nt, Homo sapiens
agcccuggagucaugccaag

SEQ ID NO: 1656057 - RNA, 16 nt, Homo sapiens
agcccuggcugaagga

SEQ ID NO: 1656058 - RNA, 18 nt, Homo sapiens
agcccuuaggaagaauuu

SEQ ID NO: 1656059 - RNA, 20 nt, Homo sapiens
agcccuucaugcauuugcac

SEQ ID NO: 1656060 - RNA, 18 nt, Homo sapiens
agccgagaucacaccacu

SEQ ID NO: 1656061 - RNA, 20 nt, Homo sapiens
agccgagaucacaccacugu

SEQ ID NO: 1656062 - RNA, 14 nt, Homo sapiens
agccucaaguucca

SEQ ID NO: 1656063 - RNA, 14 nt, Homo sapiens
agccucacaguccu

SEQ ID NO: 1656064 - RNA, 14 nt, Homo sapiens
agccucagcucuca

SEQ ID NO: 1656065 - RNA, 17 nt, Homo sapiens
agccugagaaugaccug

SEQ ID NO: 1656066 - RNA, 23 nt, Homo sapiens
agccugcaguuauuaacacuaac

SEQ ID NO: 1656067 - RNA, 14 nt, Homo sapiens
agccuggcuccaaa

SEQ ID NO: 1656068 - RNA, 20 nt, Homo sapiens
agccuggcuccaaacccucg

SEQ ID NO: 1656069 - RNA, 18 nt, Homo sapiens
agccugggggcuccucac

SEQ ID NO: 1656070 - RNA, 19 nt, Homo sapiens
agccugugcccugauccaa

SEQ ID NO: 1656071 - RNA, 14 nt, Homo sapiens
agccuuagaaguca

SEQ ID NO: 1656072 - RNA, 20 nt, Homo sapiens
agccuuauaaaccaaucuua

SEQ ID NO: 1656073 - RNA, 16 nt, Homo sapiens
agccuucugaccuggg

SEQ ID NO: 1656074 - RNA, 12 nt, Homo sapiens
agccuuugcacu

SEQ ID NO: 1656075 - RNA, 19 nt, Homo sapiens
agcgaggaggcuccagagg

SEQ ID NO: 1656076 - RNA, 19 nt, Homo sapiens
agcggcuguuuacugcuuu

SEQ ID NO: 1656077 - RNA, 14 nt, Homo sapiens
agcgugaguggugg

SEQ ID NO: 1656078 - RNA, 15 nt, Homo sapiens
agcgugaguggugga

SEQ ID NO: 1656079 - RNA, 15 nt, Homo sapiens
agcuaagacugaugu

SEQ ID NO: 1656080 - RNA, 16 nt, Homo sapiens
agcuaagacugauguc

SEQ ID NO: 1656081 - RNA, 17 nt, Homo sapiens
agcuacaucaguuugau

SEQ ID NO: 1656082 - RNA, 13 nt, Homo sapiens
agcuacuucuuau

SEQ ID NO: 1656083 - RNA, 11 nt, Homo sapiens
agcuacuuucc

SEQ ID NO: 1656084 - RNA, 15 nt, Homo sapiens
agcuagaaccuggag

SEQ ID NO: 1656085 - RNA, 22 nt, Homo sapiens
agcuaguuuuuuugaaauccaa

SEQ ID NO: 1656086 - RNA, 16 nt, Homo sapiens
cugaaaauauaaccag

SEQ ID NO: 1656087 - RNA, 13 nt, Homo sapiens
cugaaaaucaaua

SEQ ID NO: 1656088 - RNA, 17 nt, Homo sapiens
cugaaaauuaacacugc

SEQ ID NO: 1656089 - RNA, 16 nt, Homo sapiens
cugaaacagcugccac

SEQ ID NO: 1656090 - RNA, 17 nt, Homo sapiens
cugaaauaaaauucauu

SEQ ID NO: 1656091 - RNA, 21 nt, Homo sapiens
cugaacauugcacugauauca

SEQ ID NO: 1656092 - RNA, 23 nt, Homo sapiens
cugaacgcuucugcuuaaucuga

SEQ ID NO: 1656093 - RNA, 17 nt, Homo sapiens
cugaagaaaguuauucu

SEQ ID NO: 1656094 - RNA, 14 nt, Homo sapiens
cugaaggacuguga

SEQ ID NO: 1656095 - RNA, 15 nt, Homo sapiens
cugaaggacugugac

SEQ ID NO: 1656096 - RNA, 23 nt, Homo sapiens
cugaauauuaagaaacaauuuaa

SEQ ID NO: 1656097 - RNA, 17 nt, Homo sapiens
cugacaacagccugaga

SEQ ID NO: 1656098 - RNA, 18 nt, Homo sapiens
cugacacacagcucuguc

SEQ ID NO: 1656099 - RNA, 15 nt, Homo sapiens
cugacagcacuccuc

SEQ ID NO: 1656100 - RNA, 18 nt, Homo sapiens
cugacauauuaugccuga

SEQ ID NO: 1656101 - RNA, 14 nt, Homo sapiens
cugaccuacauacg

SEQ ID NO: 1656102 - RNA, 19 nt, Homo sapiens
cugaccuuaggugauccac

SEQ ID NO: 1656103 - RNA, 19 nt, Homo sapiens
cugacuucuaggauuuauu

SEQ ID NO: 1656104 - RNA, 12 nt, Homo sapiens
cugagacuugaa

SEQ ID NO: 1656105 - RNA, 20 nt, Homo sapiens
cugagacuugaaucaaguca

SEQ ID NO: 1656106 - RNA, 21 nt, Homo sapiens
cugagcagcauggauucugca

SEQ ID NO: 1656107 - RNA, 20 nt, Homo sapiens
cugagcaucuccagcauucu

SEQ ID NO: 1656108 - RNA, 20 nt, Homo sapiens
cugagcauuagauuucucau

SEQ ID NO: 1656109 - RNA, 14 nt, Homo sapiens
cugagccucagucu

SEQ ID NO: 1656110 - RNA, 13 nt, Homo sapiens
cugagcugugcag

SEQ ID NO: 1656111 - RNA, 22 nt, Homo sapiens
cugaggagccugcaacaugcca

SEQ ID NO: 1656112 - RNA, 21 nt, Homo sapiens
cugaggagcuguuacugaaua

SEQ ID NO: 1656113 - RNA, 20 nt, Homo sapiens
cugaguagcugggauuacag

SEQ ID NO: 1656114 - RNA, 15 nt, Homo sapiens
cugaguauugauaaa

SEQ ID NO: 1656115 - RNA, 22 nt, Homo sapiens
cugaguauugauaaacuuugaa

SEQ ID NO: 1656116 - RNA, 20 nt, Homo sapiens
cugagugccuggccaaaggg

SEQ ID NO: 1656117 - RNA, 15 nt, Homo sapiens
cugauacguguauga

SEQ ID NO: 1656118 - RNA, 16 nt, Homo sapiens
cugaucccgugugcca

SEQ ID NO: 1656119 - RNA, 21 nt, Homo sapiens
cugauguccuaccacuuugaa

SEQ ID NO: 1656120 - RNA, 19 nt, Homo sapiens
cugauucccaagcucugcu

SEQ ID NO: 1656121 - RNA, 14 nt, Homo sapiens
cugcaaauacugua

SEQ ID NO: 1656122 - RNA, 20 nt, Homo sapiens
cugcaacuugugaacuccau

SEQ ID NO: 1656123 - RNA, 17 nt, Homo sapiens
cugcacacucaguucug

SEQ ID NO: 1656124 - RNA, 12 nt, Homo sapiens
cugcacacuguc

SEQ ID NO: 1656125 - RNA, 14 nt, Homo sapiens
cugcacuugcagac

SEQ ID NO: 1656126 - RNA, 15 nt, Homo sapiens
cugcagccucaggau

SEQ ID NO: 1656127 - RNA, 23 nt, Homo sapiens
cugcaucuuuucuguugccccau

SEQ ID NO: 1656128 - RNA, 22 nt, Homo sapiens
cugccaaaaauauaauucuuag

SEQ ID NO: 1656129 - RNA, 11 nt, Homo sapiens
cugccaccacc

SEQ ID NO: 1656130 - RNA, 12 nt, Homo sapiens
cugccacuuccc

SEQ ID NO: 1656131 - RNA, 19 nt, Homo sapiens
cugccauauucuguuggcc

SEQ ID NO: 1656132 - RNA, 22 nt, Homo sapiens
cugccccuccucucugcccuaa

SEQ ID NO: 1656133 - RNA, 18 nt, Homo sapiens
cugcccugguggcccucu

SEQ ID NO: 1656134 - RNA, 17 nt, Homo sapiens
cugccucagccucccaa

SEQ ID NO: 1656135 - RNA, 15 nt, Homo sapiens
cugccucugacacac

SEQ ID NO: 1656136 - RNA, 18 nt, Homo sapiens
cugccucuguuugacaaa

SEQ ID NO: 1656137 - RNA, 19 nt, Homo sapiens
cugccucuuuuccccauga

SEQ ID NO: 1656138 - RNA, 21 nt, Homo sapiens
cugccuucaccuccucuuuca

SEQ ID NO: 1656139 - RNA, 16 nt, Homo sapiens
cugccuucucagggac

SEQ ID NO: 1656140 - RNA, 13 nt, Homo sapiens
cugccuucuuuau

SEQ ID NO: 1656141 - RNA, 14 nt, Homo sapiens
cugcuaccaaaaca

SEQ ID NO: 1656142 - RNA, 12 nt, Homo sapiens
cugcuacugugu

SEQ ID NO: 1656143 - RNA, 18 nt, Homo sapiens
cugcucagcagaggauau

SEQ ID NO: 1656144 - RNA, 12 nt, Homo sapiens
cugcucucagga

SEQ ID NO: 1656145 - RNA, 20 nt, Homo sapiens
cugcucuugaacuccugacc

SEQ ID NO: 1656146 - RNA, 11 nt, Homo sapiens
cugcuguggaa

SEQ ID NO: 1656147 - RNA, 23 nt, Homo sapiens
cuggaacagauucacacugucug

SEQ ID NO: 1656148 - RNA, 15 nt, Homo sapiens
cuggaacaucaucaa

SEQ ID NO: 1656149 - RNA, 17 nt, Homo sapiens
cuggaaugauuucagcu

SEQ ID NO: 1656150 - RNA, 16 nt, Homo sapiens
cuggacaccacccaga

SEQ ID NO: 1656151 - RNA, 14 nt, Homo sapiens
cuggaggagcccag

SEQ ID NO: 1656152 - RNA, 19 nt, Homo sapiens
cuggagggagaacccaaag

SEQ ID NO: 1656153 - RNA, 22 nt, Homo sapiens
cuggaugcagccucacaguccu

SEQ ID NO: 1656154 - RNA, 17 nt, Homo sapiens
cuggauuucauacugua

SEQ ID NO: 1656155 - RNA, 20 nt, Homo sapiens
cuggcacugcuuccagugag

SEQ ID NO: 1656156 - RNA, 19 nt, Homo sapiens
cuggcaguggaacuaagaa

SEQ ID NO: 1656157 - RNA, 23 nt, Homo sapiens
cuggccauguggcccuccagugu

SEQ ID NO: 1656158 - RNA, 16 nt, Homo sapiens
cuggcccagggcugca

SEQ ID NO: 1656159 - RNA, 21 nt, Homo sapiens
cuggccccucagggucccugg

SEQ ID NO: 1656160 - RNA, 13 nt, Homo sapiens
cuggccgggaccc

SEQ ID NO: 1656161 - RNA, 18 nt, Homo sapiens
cuggcucucuaauuccac

SEQ ID NO: 1656162 - RNA, 16 nt, Homo sapiens
cuggcuggugccugag

SEQ ID NO: 1656163 - RNA, 17 nt, Homo sapiens
cugggacuacaggugug

SEQ ID NO: 1656164 - RNA, 19 nt, Homo sapiens
cugggacugugcucagaga

SEQ ID NO: 1656165 - RNA, 22 nt, Homo sapiens
cugggacuuuguaaacuuccaa

SEQ ID NO: 1656166 - RNA, 19 nt, Homo sapiens
cugggagcucaagugaucc

SEQ ID NO: 1656167 - RNA, 17 nt, Homo sapiens
cugggcauagaugcagg

SEQ ID NO: 1656168 - RNA, 16 nt, Homo sapiens
cuggggcucucagugu

SEQ ID NO: 1656169 - RNA, 14 nt, Homo sapiens
cuggguccucugca

SEQ ID NO: 1656170 - RNA, 21 nt, Homo sapiens
cuggguuaggguguguguuca

SEQ ID NO: 1656171 - RNA, 16 nt, Homo sapiens
cuggguucacaccauu

SEQ ID NO: 1656172 - RNA, 13 nt, Homo sapiens
cuggguuccagca

SEQ ID NO: 1656173 - RNA, 16 nt, Homo sapiens
cugguaucugcaugua

SEQ ID NO: 1656174 - RNA, 23 nt, Homo sapiens
cugguauuaacuuuauacacuug

SEQ ID NO: 1656175 - RNA, 21 nt, Homo sapiens
cugguauuccugccuccauau

SEQ ID NO: 1656176 - RNA, 15 nt, Homo sapiens
cuguaaaccagagag

SEQ ID NO: 1656177 - RNA, 21 nt, Homo sapiens
cuguaaagauguuuauuucag

SEQ ID NO: 1656178 - RNA, 21 nt, Homo sapiens
cuguaaaugaagggucauuuc

SEQ ID NO: 1656179 - RNA, 20 nt, Homo sapiens
cuguaacuuccaaauaaaua

SEQ ID NO: 1656180 - RNA, 22 nt, Homo sapiens
cuguaauauuguaaauacugga

SEQ ID NO: 1656181 - RNA, 18 nt, Homo sapiens
cuguaaucccagcauuuu

SEQ ID NO: 1656182 - RNA, 14 nt, Homo sapiens
cuguaaucccagcu

SEQ ID NO: 1656183 - RNA, 17 nt, Homo sapiens
cuguaugucucguggua

SEQ ID NO: 1656184 - RNA, 19 nt, Homo sapiens
cugucuaagauuaauagca

SEQ ID NO: 1656185 - RNA, 13 nt, Homo sapiens
cugugacuccccu

SEQ ID NO: 1656186 - RNA, 23 nt, Homo sapiens
cugugauucgguggagacuauca

SEQ ID NO: 1656187 - RNA, 14 nt, Homo sapiens
cugugcacgcagug

SEQ ID NO: 1656188 - RNA, 22 nt, Homo sapiens
cuguggccacagcagcuuugua

SEQ ID NO: 1656189 - RNA, 23 nt, Homo sapiens
cuguggcuucuuaaucuuuucac

SEQ ID NO: 1656190 - RNA, 13 nt, Homo sapiens
cuguggugcaaaa

SEQ ID NO: 1656191 - RNA, 19 nt, Homo sapiens
cugugucaguggaugcugc

SEQ ID NO: 1656192 - RNA, 14 nt, Homo sapiens
cuguguucugcaca

SEQ ID NO: 1656193 - RNA, 12 nt, Homo sapiens
cuguuacugugu

SEQ ID NO: 1656194 - RNA, 18 nt, Homo sapiens
cuguuaucuucacuuuua

SEQ ID NO: 1656195 - RNA, 17 nt, Homo sapiens
cuaucugacuucauaca

SEQ ID NO: 1656196 - RNA, 15 nt, Homo sapiens
cuaugacuguguuua

SEQ ID NO: 1656197 - RNA, 15 nt, Homo sapiens
cuaugauaugcuaau

SEQ ID NO: 1656198 - RNA, 16 nt, Homo sapiens
cuaugauaugcuaaua

SEQ ID NO: 1656199 - RNA, 20 nt, Homo sapiens
cuauggcacccaugcaccuu

SEQ ID NO: 1656200 - RNA, 11 nt, Homo sapiens
cuaugggacuc

SEQ ID NO: 1656201 - RNA, 15 nt, Homo sapiens
cuauuacgugcaaua

SEQ ID NO: 1656202 - RNA, 15 nt, Homo sapiens
cuauuuaugugaucc

SEQ ID NO: 1656203 - RNA, 21 nt, Homo sapiens
cuauuuauuuauuuauucauu

SEQ ID NO: 1656204 - RNA, 12 nt, Homo sapiens
cuauuugccaug

SEQ ID NO: 1656205 - RNA, 18 nt, Homo sapiens
cuauuuucugaagugacu

SEQ ID NO: 1656206 - RNA, 22 nt, Homo sapiens
cuauuuuuauuuguuugugcau

SEQ ID NO: 1656207 - RNA, 15 nt, Homo sapiens
cucaaaaauagggaa

SEQ ID NO: 1656208 - RNA, 18 nt, Homo sapiens
cucaaaccaaaucacuga

SEQ ID NO: 1656209 - RNA, 22 nt, Homo sapiens
cucaaacucuugaccucaggug

SEQ ID NO: 1656210 - RNA, 17 nt, Homo sapiens
cucaaagaaauuuccac

SEQ ID NO: 1656211 - RNA, 18 nt, Homo sapiens
cucaaagaaauuuccacu

SEQ ID NO: 1656212 - RNA, 17 nt, Homo sapiens
cucaaauucaaugauuc

SEQ ID NO: 1656213 - RNA, 22 nt, Homo sapiens
cucaaccuccugggcuaaguga

SEQ ID NO: 1656214 - RNA, 16 nt, Homo sapiens
cucaacucacugcaag

SEQ ID NO: 1656215 - RNA, 20 nt, Homo sapiens
cucaaggccucccacaguga

SEQ ID NO: 1656216 - RNA, 16 nt, Homo sapiens
cucaauccauguucua

SEQ ID NO: 1656217 - RNA, 13 nt, Homo sapiens
cucaaucuccuga

SEQ ID NO: 1656218 - RNA, 20 nt, Homo sapiens
cucacacugggacuugcaaa

SEQ ID NO: 1656219 - RNA, 18 nt, Homo sapiens
cucacagcacccuauaua

SEQ ID NO: 1656220 - RNA, 15 nt, Homo sapiens
cucacauaucuguca

SEQ ID NO: 1656221 - RNA, 19 nt, Homo sapiens
cucacauuuauucugcuca

SEQ ID NO: 1656222 - RNA, 22 nt, Homo sapiens
cucacugcugcaaauacuguau

SEQ ID NO: 1656223 - RNA, 21 nt, Homo sapiens
cucacugggccuccaaccaug

SEQ ID NO: 1656224 - RNA, 23 nt, Homo sapiens
cucacuggucaaaaccuacacag

SEQ ID NO: 1656225 - RNA, 23 nt, Homo sapiens
cucacuuguucucacugucuguu

SEQ ID NO: 1656226 - RNA, 22 nt, Homo sapiens
cucagaagacacugaugggcaa

SEQ ID NO: 1656227 - RNA, 15 nt, Homo sapiens
cucagagacaucagc

SEQ ID NO: 1656228 - RNA, 19 nt, Homo sapiens
cucagagagggcaggcaug

SEQ ID NO: 1656229 - RNA, 21 nt, Homo sapiens
cucagcuaaugaaguguuuag

SEQ ID NO: 1656230 - RNA, 12 nt, Homo sapiens
cucaggaccagg

SEQ ID NO: 1656231 - RNA, 13 nt, Homo sapiens
cucaggagaucug

SEQ ID NO: 1656232 - RNA, 22 nt, Homo sapiens
cucagucucccagcuaauugag

SEQ ID NO: 1656233 - RNA, 13 nt, Homo sapiens
cucauaguauggu

SEQ ID NO: 1656234 - RNA, 15 nt, Homo sapiens
cucauauaagacaaa

SEQ ID NO: 1656235 - RNA, 17 nt, Homo sapiens
cucaucaggaguuccag

SEQ ID NO: 1656236 - RNA, 23 nt, Homo sapiens
cucauccagggcucugaccaguu

SEQ ID NO: 1656237 - RNA, 16 nt, Homo sapiens
cucaucucuuagcucc

SEQ ID NO: 1656238 - RNA, 20 nt, Homo sapiens
cucaugcccugccaagcagc

SEQ ID NO: 1656239 - RNA, 15 nt, Homo sapiens
cucaugccuguaauc

SEQ ID NO: 1656240 - RNA, 21 nt, Homo sapiens
cucauggugcauauaaauaua

SEQ ID NO: 1656241 - RNA, 19 nt, Homo sapiens
cucaugucuuugcugcaga

SEQ ID NO: 1656242 - RNA, 13 nt, Homo sapiens
cucauuacuuuac

SEQ ID NO: 1656243 - RNA, 18 nt, Homo sapiens
cucauucccuccccagaa

SEQ ID NO: 1656244 - RNA, 13 nt, Homo sapiens
cucauuugucaca

SEQ ID NO: 1656245 - RNA, 13 nt, Homo sapiens
cuccaaacccucg

SEQ ID NO: 1656246 - RNA, 20 nt, Homo sapiens
cuccacaaaugggaaaacca

SEQ ID NO: 1656247 - RNA, 20 nt, Homo sapiens
cuccacaccuccaaugcugc

SEQ ID NO: 1656248 - RNA, 14 nt, Homo sapiens
cuccacacucagua

SEQ ID NO: 1656249 - RNA, 17 nt, Homo sapiens
cuccacccacaguggag

SEQ ID NO: 1656250 - RNA, 22 nt, Homo sapiens
cuccagaugagaguacacccca

SEQ ID NO: 1656251 - RNA, 17 nt, Homo sapiens
cuccagccucagcucuc

SEQ ID NO: 1656252 - RNA, 22 nt, Homo sapiens
cuccagcucaccagccccagug

SEQ ID NO: 1656253 - RNA, 15 nt, Homo sapiens
cuccaggaugucaac

SEQ ID NO: 1656254 - RNA, 16 nt, Homo sapiens
cuccaucucuacugaa

SEQ ID NO: 1656255 - RNA, 16 nt, Homo sapiens
cuccauguacuggcaa

SEQ ID NO: 1656256 - RNA, 13 nt, Homo sapiens
cucccaagggaug

SEQ ID NO: 1656257 - RNA, 12 nt, Homo sapiens
cucccacagaac

SEQ ID NO: 1656258 - RNA, 17 nt, Homo sapiens
cucccagcugacagucc

SEQ ID NO: 1656259 - RNA, 18 nt, Homo sapiens
cuccccccaaucccucaa

SEQ ID NO: 1656260 - RNA, 14 nt, Homo sapiens
cuccccuccaaaga

SEQ ID NO: 1656261 - RNA, 18 nt, Homo sapiens
cuccccucgcccaucagu

SEQ ID NO: 1656262 - RNA, 15 nt, Homo sapiens
cccugaaauuucuca

SEQ ID NO: 1656263 - RNA, 22 nt, Homo sapiens
cccugaaguaagcaaagacuuu

SEQ ID NO: 1656264 - RNA, 12 nt, Homo sapiens
cccugcaaagcc

SEQ ID NO: 1656265 - RNA, 21 nt, Homo sapiens
cccugccaugcucuccaaacc

SEQ ID NO: 1656266 - RNA, 21 nt, Homo sapiens
cccugccgggacccugcucac

SEQ ID NO: 1656267 - RNA, 13 nt, Homo sapiens
cccugcucccaca

SEQ ID NO: 1656268 - RNA, 20 nt, Homo sapiens
cccugcuucaauacccaaau

SEQ ID NO: 1656269 - RNA, 18 nt, Homo sapiens
cccuggaaggacauccau

SEQ ID NO: 1656270 - RNA, 18 nt, Homo sapiens
cccuggcaccuguggcca

SEQ ID NO: 1656271 - RNA, 22 nt, Homo sapiens
cccugggcaaaugaauggcuca

SEQ ID NO: 1656272 - RNA, 20 nt, Homo sapiens
cccuggggagucugggcaca

SEQ ID NO: 1656273 - RNA, 16 nt, Homo sapiens
cccugguucugaugau

SEQ ID NO: 1656274 - RNA, 14 nt, Homo sapiens
cccuuccuuucuau

SEQ ID NO: 1656275 - RNA, 14 nt, Homo sapiens
cccuucugaaugaa

SEQ ID NO: 1656276 - RNA, 15 nt, Homo sapiens
cccuuggacauuuua

SEQ ID NO: 1656277 - RNA, 22 nt, Homo sapiens
cccuuguggcacagaugcccac

SEQ ID NO: 1656278 - RNA, 14 nt, Homo sapiens
ccgaagucuuccau

SEQ ID NO: 1656279 - RNA, 17 nt, Homo sapiens
ccgaauagcugggacua

SEQ ID NO: 1656280 - RNA, 18 nt, Homo sapiens
ccgacugccaucuuggac

SEQ ID NO: 1656281 - RNA, 20 nt, Homo sapiens
ccgcaggccugccuucucag

SEQ ID NO: 1656282 - RNA, 21 nt, Homo sapiens
ccggguucaagugauucucau

SEQ ID NO: 1656283 - RNA, 15 nt, Homo sapiens
ccgugggaguacaaa

SEQ ID NO: 1656284 - RNA, 18 nt, Homo sapiens
ccuaaaacaaaagcucau

SEQ ID NO: 1656285 - RNA, 16 nt, Homo sapiens
ccuaagacugcugcug

SEQ ID NO: 1656286 - RNA, 22 nt, Homo sapiens
ccuaagcggcuguuuacugcuu

SEQ ID NO: 1656287 - RNA, 19 nt, Homo sapiens
ccuacugcuuccucugaau

SEQ ID NO: 1656288 - RNA, 16 nt, Homo sapiens
ccuacuuucauaauaa

SEQ ID NO: 1656289 - RNA, 22 nt, Homo sapiens
ccuagcuuagagccucccucaa

SEQ ID NO: 1656290 - RNA, 17 nt, Homo sapiens
ccuaggauaucuucucc

SEQ ID NO: 1656291 - RNA, 20 nt, Homo sapiens
ccuagucuuuuaaacaguuu

SEQ ID NO: 1656292 - RNA, 16 nt, Homo sapiens
ccuaguuccaccauca

SEQ ID NO: 1656293 - RNA, 11 nt, Homo sapiens
ccuaucugacu

SEQ ID NO: 1656294 - RNA, 15 nt, Homo sapiens
ccuaugcagaggucc

SEQ ID NO: 1656295 - RNA, 23 nt, Homo sapiens
ccuauguauaucuucuacaugca

SEQ ID NO: 1656296 - RNA, 23 nt, Homo sapiens
ccuauguuuuuguucaaagccag

SEQ ID NO: 1656297 - RNA, 16 nt, Homo sapiens
ccucaaagcauuugca

SEQ ID NO: 1656298 - RNA, 21 nt, Homo sapiens
ccucagauuccgcaccaauaa

SEQ ID NO: 1656299 - RNA, 20 nt, Homo sapiens
ccucauuaccuugugcuaau

SEQ ID NO: 1656300 - RNA, 21 nt, Homo sapiens
ccuccaaguccacaguggaac

SEQ ID NO: 1656301 - RNA, 16 nt, Homo sapiens
ccuccaaucaaaauca

SEQ ID NO: 1656302 - RNA, 16 nt, Homo sapiens
ccuccagaauggagcu

SEQ ID NO: 1656303 - RNA, 10 nt, Homo sapiens
ccuccaggga

SEQ ID NO: 1656304 - RNA, 21 nt, Homo sapiens
ccucccaaagugcugggauua

SEQ ID NO: 1656305 - RNA, 14 nt, Homo sapiens
ccucccacagugac

SEQ ID NO: 1656306 - RNA, 17 nt, Homo sapiens
ccucccuucaugcaugg

SEQ ID NO: 1656307 - RNA, 13 nt, Homo sapiens
ccuccguggcaca

SEQ ID NO: 1656308 - RNA, 11 nt, Homo sapiens
ccuccucacaa

SEQ ID NO: 1656309 - RNA, 14 nt, Homo sapiens
ccuccucugugaaa

SEQ ID NO: 1656310 - RNA, 15 nt, Homo sapiens
ccuccucugugaaac

SEQ ID NO: 1656311 - RNA, 20 nt, Homo sapiens
ccuccugaguagcugggauu

SEQ ID NO: 1656312 - RNA, 18 nt, Homo sapiens
ccucgaggcggaucuuug

SEQ ID NO: 1656313 - RNA, 22 nt, Homo sapiens
ccucgauguccuccucugugaa

SEQ ID NO: 1656314 - RNA, 16 nt, Homo sapiens
ccucgcccuccacaaa

SEQ ID NO: 1656315 - RNA, 14 nt, Homo sapiens
ccucgcugccagcu

SEQ ID NO: 1656316 - RNA, 13 nt, Homo sapiens
ccucuaugaacua

SEQ ID NO: 1656317 - RNA, 21 nt, Homo sapiens
ccucuccagaugagaguacac

SEQ ID NO: 1656318 - RNA, 12 nt, Homo sapiens
ccucucugcucu

SEQ ID NO: 1656319 - RNA, 12 nt, Homo sapiens
ccucugacucag

SEQ ID NO: 1656320 - RNA, 16 nt, Homo sapiens
ccucugcuauuugcug

SEQ ID NO: 1656321 - RNA, 18 nt, Homo sapiens
ccucuguccaggcacuga

SEQ ID NO: 1656322 - RNA, 19 nt, Homo sapiens
ccucuguccccuucucuca

SEQ ID NO: 1656323 - RNA, 21 nt, Homo sapiens
ccucuguucugcacacagcac

SEQ ID NO: 1656324 - RNA, 14 nt, Homo sapiens
ccugaaauuaauuu

SEQ ID NO: 1656325 - RNA, 21 nt, Homo sapiens
ccugaaguaagcaaagacuuu

SEQ ID NO: 1656326 - RNA, 22 nt, Homo sapiens
ccugaaguaagcaaagacuuuc

SEQ ID NO: 1656327 - RNA, 13 nt, Homo sapiens
ccugaagucacac

SEQ ID NO: 1656328 - RNA, 14 nt, Homo sapiens
ccugaagucacaca

SEQ ID NO: 1656329 - RNA, 23 nt, Homo sapiens
ccugacaacacucauugaccuga

SEQ ID NO: 1656330 - RNA, 14 nt, Homo sapiens
ccugaccucaggua

SEQ ID NO: 1656331 - RNA, 22 nt, Homo sapiens
ccacaagacccuugugguccca

SEQ ID NO: 1656332 - RNA, 23 nt, Homo sapiens
ccacaaggaauccccagauauuu

SEQ ID NO: 1656333 - RNA, 23 nt, Homo sapiens
ccacagaacacagcaauuccuca

SEQ ID NO: 1656334 - RNA, 13 nt, Homo sapiens
ccacagcacuaau

SEQ ID NO: 1656335 - RNA, 14 nt, Homo sapiens
ccacaguggaacca

SEQ ID NO: 1656336 - RNA, 21 nt, Homo sapiens
ccacauccuccacguucugcu

SEQ ID NO: 1656337 - RNA, 17 nt, Homo sapiens
ccacaucuugcucugcu

SEQ ID NO: 1656338 - RNA, 15 nt, Homo sapiens
ccaccaacauacucc

SEQ ID NO: 1656339 - RNA, 19 nt, Homo sapiens
ccaccaccugcucacuggu

SEQ ID NO: 1656340 - RNA, 13 nt, Homo sapiens
ccaccacugcucc

SEQ ID NO: 1656341 - RNA, 22 nt, Homo sapiens
ccaccaggagggaguggcagcu

SEQ ID NO: 1656342 - RNA, 22 nt, Homo sapiens
ccacccagaugggggaaagcac

SEQ ID NO: 1656343 - RNA, 24 nt, Homo sapiens
ccacccucaugcugugugacucaa

SEQ ID NO: 1656344 - RNA, 14 nt, Homo sapiens
ccaccuagucugua

SEQ ID NO: 1656345 - RNA, 23 nt, Homo sapiens
ccaccuaguggcuguccagugcc

SEQ ID NO: 1656346 - RNA, 15 nt, Homo sapiens
ccaccuccuucucug

SEQ ID NO: 1656347 - RNA, 20 nt, Homo sapiens
ccaccuggaccccugcauug

SEQ ID NO: 1656348 - RNA, 22 nt, Homo sapiens
ccacgagcuguuuacuagggau

SEQ ID NO: 1656349 - RNA, 17 nt, Homo sapiens
ccacgcggccaccucac

SEQ ID NO: 1656350 - RNA, 19 nt, Homo sapiens
ccacuauugcuugcacaaa

SEQ ID NO: 1656351 - RNA, 15 nt, Homo sapiens
ccacuauuugcagag

SEQ ID NO: 1656352 - RNA, 20 nt, Homo sapiens
ccacugcacccccuccugcu

SEQ ID NO: 1656353 - RNA, 19 nt, Homo sapiens
ccacuggacugucuaugaa

SEQ ID NO: 1656354 - RNA, 22 nt, Homo sapiens
ccacuucccugggcaaaugaau

SEQ ID NO: 1656355 - RNA, 16 nt, Homo sapiens
ccacuuguucauucug

SEQ ID NO: 1656356 - RNA, 15 nt, Homo sapiens
ccacuuuuugcagcu

SEQ ID NO: 1656357 - RNA, 11 nt, Homo sapiens
ccagacuccag

SEQ ID NO: 1656358 - RNA, 20 nt, Homo sapiens
ccagagaccuucugaucucc

SEQ ID NO: 1656359 - RNA, 14 nt, Homo sapiens
ccagagacugggac

SEQ ID NO: 1656360 - RNA, 16 nt, Homo sapiens
ccagagcagaugcaga

SEQ ID NO: 1656361 - RNA, 17 nt, Homo sapiens
ccagagccucaaaugag

SEQ ID NO: 1656362 - RNA, 21 nt, Homo sapiens
ccagaguuccccaugcagaca

SEQ ID NO: 1656363 - RNA, 19 nt, Homo sapiens
ccagauuggcucacacuga

SEQ ID NO: 1656364 - RNA, 23 nt, Homo sapiens
ccagauuggcucacacugagaau

SEQ ID NO: 1656365 - RNA, 13 nt, Homo sapiens
ccagccacagugu

SEQ ID NO: 1656366 - RNA, 14 nt, Homo sapiens
ccagccacugugau

SEQ ID NO: 1656367 - RNA, 12 nt, Homo sapiens
ccagccuugacc

SEQ ID NO: 1656368 - RNA, 16 nt, Homo sapiens
ccaggaaccucagggc

SEQ ID NO: 1656369 - RNA, 13 nt, Homo sapiens
ccaggacugagau

SEQ ID NO: 1656370 - RNA, 20 nt, Homo sapiens
ccaggauucccccaacacac

SEQ ID NO: 1656371 - RNA, 18 nt, Homo sapiens
ccaggcaggucuugaacu

SEQ ID NO: 1656372 - RNA, 18 nt, Homo sapiens
ccaggcuggagugcagug

SEQ ID NO: 1656373 - RNA, 19 nt, Homo sapiens
ccaggcuggagugcagugg

SEQ ID NO: 1656374 - RNA, 20 nt, Homo sapiens
ccaggcuggagugcaguggc

SEQ ID NO: 1656375 - RNA, 21 nt, Homo sapiens
ccagggagagcccaggagcuc

SEQ ID NO: 1656376 - RNA, 13 nt, Homo sapiens
ccagggucucacu

SEQ ID NO: 1656377 - RNA, 13 nt, Homo sapiens
ccaggucagggag

SEQ ID NO: 1656378 - RNA, 22 nt, Homo sapiens
ccaggugcuaggaacacuccuu

SEQ ID NO: 1656379 - RNA, 22 nt, Homo sapiens
ccaggugggcgggcagcacagc

SEQ ID NO: 1656380 - RNA, 20 nt, Homo sapiens
ccagguuuuuggucugaccc

SEQ ID NO: 1656381 - RNA, 17 nt, Homo sapiens
ccagucauuauguuaau

SEQ ID NO: 1656382 - RNA, 20 nt, Homo sapiens
ccaguggaacagucuuccca

SEQ ID NO: 1656383 - RNA, 15 nt, Homo sapiens
ccagugggguggagu

SEQ ID NO: 1656384 - RNA, 21 nt, Homo sapiens
ccaguuuaaccugaugcaguc

SEQ ID NO: 1656385 - RNA, 12 nt, Homo sapiens
ccauaagcuauu

SEQ ID NO: 1656386 - RNA, 15 nt, Homo sapiens
ccauaugaauaacau

SEQ ID NO: 1656387 - RNA, 12 nt, Homo sapiens
ccauauuuucac

SEQ ID NO: 1656388 - RNA, 14 nt, Homo sapiens
ccaucagugcuccc

SEQ ID NO: 1656389 - RNA, 12 nt, Homo sapiens
ccauccagguuc

SEQ ID NO: 1656390 - RNA, 14 nt, Homo sapiens
ccauccucaaacac

SEQ ID NO: 1656391 - RNA, 15 nt, Homo sapiens
ccauccuugagucaa

SEQ ID NO: 1656392 - RNA, 17 nt, Homo sapiens
ccaucuccucagcaccc

SEQ ID NO: 1656393 - RNA, 14 nt, Homo sapiens
ccaucucuacugaa

SEQ ID NO: 1656394 - RNA, 23 nt, Homo sapiens
ccaugaaaaugcaacaacaugua

SEQ ID NO: 1656395 - RNA, 16 nt, Homo sapiens
ccaugcagugccccua

SEQ ID NO: 1656396 - RNA, 20 nt, Homo sapiens
ccaugcauuuaaaguauucu

SEQ ID NO: 1656397 - RNA, 21 nt, Homo sapiens
ccaugccucuccaacaucuuc

SEQ ID NO: 1656398 - RNA, 18 nt, Homo sapiens
ccaugggggcaacagcca

SEQ ID NO: 1656399 - RNA, 17 nt, Homo sapiens
ccauguccauagccaua

SEQ ID NO: 1656400 - RNA, 16 nt, Homo sapiens
ccaugucuaugcuccc

SEQ ID NO: 1656401 - RNA, 14 nt, Homo sapiens
auaaagcauuauaa

SEQ ID NO: 1656402 - RNA, 14 nt, Homo sapiens
auaaaggauaaaga

SEQ ID NO: 1656403 - RNA, 20 nt, Homo sapiens
auaaaggggagggacucauc

SEQ ID NO: 1656404 - RNA, 22 nt, Homo sapiens
auaaaguacaagagcuuaacag

SEQ ID NO: 1656405 - RNA, 22 nt, Homo sapiens
auaaaguguuugaaagcuuuau

SEQ ID NO: 1656406 - RNA, 13 nt, Homo sapiens
auaaauaugcagu

SEQ ID NO: 1656407 - RNA, 14 nt, Homo sapiens
auaaaucaauucau

SEQ ID NO: 1656408 - RNA, 15 nt, Homo sapiens
auaaaugaacugcau

SEQ ID NO: 1656409 - RNA, 23 nt, Homo sapiens
auaaauguaccagagagaguugu

SEQ ID NO: 1656410 - RNA, 22 nt, Homo sapiens
auaacaauaaaagacaaggaaa

SEQ ID NO: 1656411 - RNA, 12 nt, Homo sapiens
auaacagcacug

SEQ ID NO: 1656412 - RNA, 11 nt, Homo sapiens
auaacaguguu

SEQ ID NO: 1656413 - RNA, 22 nt, Homo sapiens
auaacgauaaaagacagugaaa

SEQ ID NO: 1656414 - RNA, 13 nt, Homo sapiens
auaagacauaacg

SEQ ID NO: 1656415 - RNA, 13 nt, Homo sapiens
auaagagauucac

SEQ ID NO: 1656416 - RNA, 17 nt, Homo sapiens
auaagugguguguguau

SEQ ID NO: 1656417 - RNA, 16 nt, Homo sapiens
auaauaaugccuaccu

SEQ ID NO: 1656418 - RNA, 13 nt, Homo sapiens
auaauacccagga

SEQ ID NO: 1656419 - RNA, 23 nt, Homo sapiens
auaauagguuugugacuuuccua

SEQ ID NO: 1656420 - RNA, 17 nt, Homo sapiens
auaauauuuuauaccaa

SEQ ID NO: 1656421 - RNA, 21 nt, Homo sapiens
auaauccuaaacauaugaauu

SEQ ID NO: 1656422 - RNA, 17 nt, Homo sapiens
auaaucuacuguacaca

SEQ ID NO: 1656423 - RNA, 15 nt, Homo sapiens
auaaucuugcucaca

SEQ ID NO: 1656424 - RNA, 18 nt, Homo sapiens
auaauggggccuguuaca

SEQ ID NO: 1656425 - RNA, 17 nt, Homo sapiens
auaauguuuauaaguca

SEQ ID NO: 1656426 - RNA, 20 nt, Homo sapiens
auaauuuuaguuuauauuaa

SEQ ID NO: 1656427 - RNA, 24 nt, Homo sapiens
auaauuuuccugugacacuuauaa

SEQ ID NO: 1656428 - RNA, 15 nt, Homo sapiens
auacaaauacuaucc

SEQ ID NO: 1656429 - RNA, 17 nt, Homo sapiens
auacaccuuauuaauga

SEQ ID NO: 1656430 - RNA, 15 nt, Homo sapiens
auacagagcucucug

SEQ ID NO: 1656431 - RNA, 18 nt, Homo sapiens
auacagagcucucugagg

SEQ ID NO: 1656432 - RNA, 20 nt, Homo sapiens
cauagauccuaagccauaaa

SEQ ID NO: 1656433 - RNA, 16 nt, Homo sapiens
cauagauguuaugcaa

SEQ ID NO: 1656434 - RNA, 15 nt, Homo sapiens
cauaggcccagugag

SEQ ID NO: 1656435 - RNA, 22 nt, Homo sapiens
cauaugaaaaggcuaagcuuca

SEQ ID NO: 1656436 - RNA, 19 nt, Homo sapiens
cauauucaggaagcucagg

SEQ ID NO: 1656437 - RNA, 19 nt, Homo sapiens
cauauucccacagcacuaa

SEQ ID NO: 1656438 - RNA, 21 nt, Homo sapiens
cauauuuucuuuaaaagacaa

SEQ ID NO: 1656439 - RNA, 19 nt, Homo sapiens
caucaaauggaagacacau

SEQ ID NO: 1656440 - RNA, 22 nt, Homo sapiens
caucaaggcacugccugaugga

SEQ ID NO: 1656441 - RNA, 16 nt, Homo sapiens
caucacguuagcuguc

SEQ ID NO: 1656442 - RNA, 18 nt, Homo sapiens
caucaggaguuccagugc

SEQ ID NO: 1656443 - RNA, 20 nt, Homo sapiens
caucaggaguuccagugcug

SEQ ID NO: 1656444 - RNA, 17 nt, Homo sapiens
caucagugcucccucac

SEQ ID NO: 1656445 - RNA, 17 nt, Homo sapiens
caucauucucugucuca

SEQ ID NO: 1656446 - RNA, 13 nt, Homo sapiens
caucauuuccauu

SEQ ID NO: 1656447 - RNA, 21 nt, Homo sapiens
caucauuuccugggagaaaga

SEQ ID NO: 1656448 - RNA, 14 nt, Homo sapiens
cauccacugugcca

SEQ ID NO: 1656449 - RNA, 13 nt, Homo sapiens
caucccaggaucg

SEQ ID NO: 1656450 - RNA, 14 nt, Homo sapiens
cauccuacaagaca

SEQ ID NO: 1656451 - RNA, 19 nt, Homo sapiens
cauccuuagaccaagggau

SEQ ID NO: 1656452 - RNA, 24 nt, Homo sapiens
cauccuuggaaauuggaagagcac

SEQ ID NO: 1656453 - RNA, 18 nt, Homo sapiens
caucgugaucacugagcc

SEQ ID NO: 1656454 - RNA, 17 nt, Homo sapiens
caucuaaauugaucauu

SEQ ID NO: 1656455 - RNA, 14 nt, Homo sapiens
caucuacauacaca

SEQ ID NO: 1656456 - RNA, 23 nt, Homo sapiens
caucucccaaagugcugggauua

SEQ ID NO: 1656457 - RNA, 21 nt, Homo sapiens
caucucccagauaaugugaaa

SEQ ID NO: 1656458 - RNA, 18 nt, Homo sapiens
caucucuggaugccugau

SEQ ID NO: 1656459 - RNA, 22 nt, Homo sapiens
caucugccuccccuucacuccc

SEQ ID NO: 1656460 - RNA, 15 nt, Homo sapiens
caucugcuacugugu

SEQ ID NO: 1656461 - RNA, 22 nt, Homo sapiens
caucuugcucugcugacagaca

SEQ ID NO: 1656462 - RNA, 23 nt, Homo sapiens
caucuugcucugcugacagacac

SEQ ID NO: 1656463 - RNA, 13 nt, Homo sapiens
caucuuuaacaca

SEQ ID NO: 1656464 - RNA, 14 nt, Homo sapiens
caucuuuaacacaa

SEQ ID NO: 1656465 - RNA, 21 nt, Homo sapiens
caugaaauaaaauauaucuua

SEQ ID NO: 1656466 - RNA, 16 nt, Homo sapiens
caugaagauucuuucc

SEQ ID NO: 1656467 - RNA, 21 nt, Homo sapiens
caugagccucagcauccuggc

SEQ ID NO: 1656468 - RNA, 15 nt, Homo sapiens
caugaggaccaggug

SEQ ID NO: 1656469 - RNA, 14 nt, Homo sapiens
caugaucaucacaa

SEQ ID NO: 1656470 - RNA, 23 nt, Homo sapiens
caugccuguaaucccagcacuug

SEQ ID NO: 1656471 - RNA, 15 nt, Homo sapiens
caugcgagugcucau

SEQ ID NO: 1656472 - RNA, 17 nt, Homo sapiens
caugcguuuaaucacau

SEQ ID NO: 1656473 - RNA, 18 nt, Homo sapiens
caugcugaagccaaagcc

SEQ ID NO: 1656474 - RNA, 21 nt, Homo sapiens
caugcuggccugugugauaca

SEQ ID NO: 1656475 - RNA, 16 nt, Homo sapiens
cauggaaaacagagua

SEQ ID NO: 1656476 - RNA, 15 nt, Homo sapiens
cauggaaauucccuu

SEQ ID NO: 1656477 - RNA, 18 nt, Homo sapiens
cauggagagcuggagccu

SEQ ID NO: 1656478 - RNA, 23 nt, Homo sapiens
cauggccuuggcaggcugcugga

SEQ ID NO: 1656479 - RNA, 15 nt, Homo sapiens
cauggcuggugccug

SEQ ID NO: 1656480 - RNA, 15 nt, Homo sapiens
cauguaaacauacca

SEQ ID NO: 1656481 - RNA, 19 nt, Homo sapiens
cauguauuagccagucauu

SEQ ID NO: 1656482 - RNA, 17 nt, Homo sapiens
caugucacuacuguccg

SEQ ID NO: 1656483 - RNA, 15 nt, Homo sapiens
caugugcucagggaa

SEQ ID NO: 1656484 - RNA, 17 nt, Homo sapiens
cauguggagaaggugac

SEQ ID NO: 1656485 - RNA, 18 nt, Homo sapiens
cauguggcccuccagugu

SEQ ID NO: 1656486 - RNA, 18 nt, Homo sapiens
caugugguuacuaguaca

SEQ ID NO: 1656487 - RNA, 22 nt, Homo sapiens
cauguuaggaagguacugucau

SEQ ID NO: 1656488 - RNA, 22 nt, Homo sapiens
cauguuggccaggcuggucuca

SEQ ID NO: 1656489 - RNA, 17 nt, Homo sapiens
cauguuuaaaccugaca

SEQ ID NO: 1656490 - RNA, 17 nt, Homo sapiens
cauuaccuucucccuca

SEQ ID NO: 1656491 - RNA, 20 nt, Homo sapiens
cauuagccuaugugcaugca

SEQ ID NO: 1656492 - RNA, 12 nt, Homo sapiens
cauuaucuauga

SEQ ID NO: 1656493 - RNA, 13 nt, Homo sapiens
cauuaucuaugau

SEQ ID NO: 1656494 - RNA, 18 nt, Homo sapiens
cauucauuccauucugga

SEQ ID NO: 1656495 - RNA, 16 nt, Homo sapiens
cauuccauucuggaag

SEQ ID NO: 1656496 - RNA, 15 nt, Homo sapiens
cauucgaguguuuca

SEQ ID NO: 1656497 - RNA, 21 nt, Homo sapiens
cauucuacguaucugcuacuu

SEQ ID NO: 1656498 - RNA, 18 nt, Homo sapiens
cauucuauuguggcaagg

SEQ ID NO: 1656499 - RNA, 24 nt, Homo sapiens
cauucucaccuaaacccucuguga

SEQ ID NO: 1656500 - RNA, 21 nt, Homo sapiens
cauucuccugccucagccucc

SEQ ID NO: 1656501 - RNA, 14 nt, Homo sapiens
cauucuuuuguuua

SEQ ID NO: 1656502 - RNA, 16 nt, Homo sapiens
uugggcagacccugag

SEQ ID NO: 1656503 - RNA, 22 nt, Homo sapiens
uuggggguccuccuccagggac

SEQ ID NO: 1656504 - RNA, 15 nt, Homo sapiens
uugguuguacuuugg

SEQ ID NO: 1656505 - RNA, 20 nt, Homo sapiens
uuguaaacuuccaagucauu

SEQ ID NO: 1656506 - RNA, 21 nt, Homo sapiens
uuguaagaaauauauuugaua

SEQ ID NO: 1656507 - RNA, 15 nt, Homo sapiens
uuguaagaguguaga

SEQ ID NO: 1656508 - RNA, 22 nt, Homo sapiens
uuguaagaguguagaagcauuc

SEQ ID NO: 1656509 - RNA, 18 nt, Homo sapiens
uuguaagguggucacugu

SEQ ID NO: 1656510 - RNA, 16 nt, Homo sapiens
uuguaauugcauuaua

SEQ ID NO: 1656511 - RNA, 17 nt, Homo sapiens
uuguauuaucaacagca

SEQ ID NO: 1656512 - RNA, 13 nt, Homo sapiens
uugucaacaaagu

SEQ ID NO: 1656513 - RNA, 22 nt, Homo sapiens
uugucaagcaguagacaagcaa

SEQ ID NO: 1656514 - RNA, 16 nt, Homo sapiens
uugugaacuccaucau

SEQ ID NO: 1656515 - RNA, 15 nt, Homo sapiens
uugugggauacuauu

SEQ ID NO: 1656516 - RNA, 14 nt, Homo sapiens
uugugucaaaacug

SEQ ID NO: 1656517 - RNA, 17 nt, Homo sapiens
uugugucaaaacugguu

SEQ ID NO: 1656518 - RNA, 13 nt, Homo sapiens
uuguuauuuacac

SEQ ID NO: 1656519 - RNA, 14 nt, Homo sapiens
uuguuauuuacacu

SEQ ID NO: 1656520 - RNA, 15 nt, Homo sapiens
uuguucauucuguga

SEQ ID NO: 1656521 - RNA, 16 nt, Homo sapiens
uuguucauucugugac

SEQ ID NO: 1656522 - RNA, 16 nt, Homo sapiens
uuguuccagagcugcu

SEQ ID NO: 1656523 - RNA, 14 nt, Homo sapiens
uuguuguaauugca

SEQ ID NO: 1656524 - RNA, 16 nt, Homo sapiens
uuguuuggagacagag

SEQ ID NO: 1656525 - RNA, 19 nt, Homo sapiens
uuuaaaaaugcaccacuuu

SEQ ID NO: 1656526 - RNA, 18 nt, Homo sapiens
uuuaaaaggauuaaucug

SEQ ID NO: 1656527 - RNA, 14 nt, Homo sapiens
uuuaaaaucuguca

SEQ ID NO: 1656528 - RNA, 12 nt, Homo sapiens
uuuaaacagugu

SEQ ID NO: 1656529 - RNA, 18 nt, Homo sapiens
uuuaaaccugacaauggu

SEQ ID NO: 1656530 - RNA, 13 nt, Homo sapiens
uuuaaacuaugau

SEQ ID NO: 1656531 - RNA, 14 nt, Homo sapiens
uuuaaacugcagcg

SEQ ID NO: 1656532 - RNA, 12 nt, Homo sapiens
uuuaaacuuuga

SEQ ID NO: 1656533 - RNA, 18 nt, Homo sapiens
uuuaaaguaaaggcaaac

SEQ ID NO: 1656534 - RNA, 15 nt, Homo sapiens
uuuaacaacuaugau

SEQ ID NO: 1656535 - RNA, 14 nt, Homo sapiens
uuuaacaguguucu

SEQ ID NO: 1656536 - RNA, 17 nt, Homo sapiens
uuuaacccucacuggga

SEQ ID NO: 1656537 - RNA, 21 nt, Homo sapiens
uuuaauguagccaugggacca

SEQ ID NO: 1656538 - RNA, 21 nt, Homo sapiens
uuuaauuuugucagauucaca

SEQ ID NO: 1656539 - RNA, 22 nt, Homo sapiens
uuuaauuuugucagauucacac

SEQ ID NO: 1656540 - RNA, 16 nt, Homo sapiens
uuuacuagaaaggcau

SEQ ID NO: 1656541 - RNA, 15 nt, Homo sapiens
uuuacuccaugaagg

SEQ ID NO: 1656542 - RNA, 17 nt, Homo sapiens
uuuacugagacaaugua

SEQ ID NO: 1656543 - RNA, 22 nt, Homo sapiens
uuuagagugaaauauaugcuau

SEQ ID NO: 1656544 - RNA, 17 nt, Homo sapiens
uuuagugcuuaucuaau

SEQ ID NO: 1656545 - RNA, 14 nt, Homo sapiens
uuuauacacuguaa

SEQ ID NO: 1656546 - RNA, 21 nt, Homo sapiens
uuuaucuauggcacccaugca

SEQ ID NO: 1656547 - RNA, 11 nt, Homo sapiens
uuuaugugcaa

SEQ ID NO: 1656548 - RNA, 23 nt, Homo sapiens
uuuauuaauuugaaaccaggaca

SEQ ID NO: 1656549 - RNA, 21 nt, Homo sapiens
uuuauuacaguuuaucuaugg

SEQ ID NO: 1656550 - RNA, 20 nt, Homo sapiens
uuuauuauguccauuauuca

SEQ ID NO: 1656551 - RNA, 13 nt, Homo sapiens
uuuauugccauga

SEQ ID NO: 1656552 - RNA, 17 nt, Homo sapiens
uuucaagaagacuggca

SEQ ID NO: 1656553 - RNA, 22 nt, Homo sapiens
uuucaauacuuacauaucugac

SEQ ID NO: 1656554 - RNA, 12 nt, Homo sapiens
uuucacucacau

SEQ ID NO: 1656555 - RNA, 15 nt, Homo sapiens
uuucagaaauauuca

SEQ ID NO: 1656556 - RNA, 21 nt, Homo sapiens
uuucaggccacauggcuaaag

SEQ ID NO: 1656557 - RNA, 16 nt, Homo sapiens
uucauaaguauuucaa

SEQ ID NO: 1656558 - RNA, 19 nt, Homo sapiens
uucauaauuucuucacuca

SEQ ID NO: 1656559 - RNA, 17 nt, Homo sapiens
uucauacauuaucucac

SEQ ID NO: 1656560 - RNA, 21 nt, Homo sapiens
uucauaugacauucaugccug

SEQ ID NO: 1656561 - RNA, 12 nt, Homo sapiens
uucauauugcau

SEQ ID NO: 1656562 - RNA, 14 nt, Homo sapiens
uucauauugcauca

SEQ ID NO: 1656563 - RNA, 16 nt, Homo sapiens
uucauauugcaucaua

SEQ ID NO: 1656564 - RNA, 15 nt, Homo sapiens
uucaugaucaucaca

SEQ ID NO: 1656565 - RNA, 14 nt, Homo sapiens
uucaugcauggaaa

SEQ ID NO: 1656566 - RNA, 16 nt, Homo sapiens
uucaugcauuugcacu

SEQ ID NO: 1656567 - RNA, 23 nt, Homo sapiens
uucaugcuggccugugugauaca

SEQ ID NO: 1656568 - RNA, 13 nt, Homo sapiens
uucauggaacuca

SEQ ID NO: 1656569 - RNA, 15 nt, Homo sapiens
uucauuuguaacuuu

SEQ ID NO: 1656570 - RNA, 21 nt, Homo sapiens
uuccacuuguucauucuguga

SEQ ID NO: 1656571 - RNA, 22 nt, Homo sapiens
uuccauauuuaaccuauuucca

SEQ ID NO: 1656572 - RNA, 16 nt, Homo sapiens
uuccauuugcaaggga

SEQ ID NO: 1656573 - RNA, 19 nt, Homo sapiens
uucccaaaagcccauucau

SEQ ID NO: 1656574 - RNA, 19 nt, Homo sapiens
uucccacagcacuaauuca

SEQ ID NO: 1656575 - RNA, 11 nt, Homo sapiens
uucccaccacc

SEQ ID NO: 1656576 - RNA, 16 nt, Homo sapiens
uucccacucugaagau

SEQ ID NO: 1656577 - RNA, 18 nt, Homo sapiens
uuccccaaugacuaauga

SEQ ID NO: 1656578 - RNA, 21 nt, Homo sapiens
uucccuauuuugccaguggga

SEQ ID NO: 1656579 - RNA, 13 nt, Homo sapiens
uucccuccaguga

SEQ ID NO: 1656580 - RNA, 19 nt, Homo sapiens
uucccuuugauacagucaa

SEQ ID NO: 1656581 - RNA, 21 nt, Homo sapiens
uuccgcaccaauaaagccuuc

SEQ ID NO: 1656582 - RNA, 20 nt, Homo sapiens
uuccuaagacugcugcugaa

SEQ ID NO: 1656583 - RNA, 12 nt, Homo sapiens
uuccuagcugug

SEQ ID NO: 1656584 - RNA, 19 nt, Homo sapiens
uuccuauacgugugucuuu

SEQ ID NO: 1656585 - RNA, 18 nt, Homo sapiens
uuccucaaagcauuugca

SEQ ID NO: 1656586 - RNA, 14 nt, Homo sapiens
uuccucacuuugaa

SEQ ID NO: 1656587 - RNA, 19 nt, Homo sapiens
uuccucuugggcuuuugaa

SEQ ID NO: 1656588 - RNA, 12 nt, Homo sapiens
uuccugaggcug

SEQ ID NO: 1656589 - RNA, 17 nt, Homo sapiens
uuccugauggcaggaug

SEQ ID NO: 1656590 - RNA, 20 nt, Homo sapiens
uuccugggacuaugcuguaa

SEQ ID NO: 1656591 - RNA, 17 nt, Homo sapiens
uucgauguacagucuca

SEQ ID NO: 1656592 - RNA, 17 nt, Homo sapiens
uucggauuuggggugga

SEQ ID NO: 1656593 - RNA, 13 nt, Homo sapiens
uucuaaaacugcc

SEQ ID NO: 1656594 - RNA, 13 nt, Homo sapiens
uucuacaguauua

SEQ ID NO: 1656595 - RNA, 18 nt, Homo sapiens
uucuacaucuuuuauaca

SEQ ID NO: 1656596 - RNA, 16 nt, Homo sapiens
uucuaggaagcuccag

SEQ ID NO: 1656597 - RNA, 15 nt, Homo sapiens
uucuauauccuugac

SEQ ID NO: 1656598 - RNA, 17 nt, Homo sapiens
uucuauuacgugcaaua

SEQ ID NO: 1656599 - RNA, 22 nt, Homo sapiens
uucuauuacgugcaauacuuca

SEQ ID NO: 1656600 - RNA, 19 nt, Homo sapiens
uucuauucaucucaaggaa

SEQ ID NO: 1656601 - RNA, 23 nt, Homo sapiens
uucucaccuaaacccucugugaa

SEQ ID NO: 1656602 - RNA, 14 nt, Homo sapiens
uucucauuucaccc

SEQ ID NO: 1656603 - RNA, 17 nt, Homo sapiens
uucuccaagcaggacau

SEQ ID NO: 1656604 - RNA, 16 nt, Homo sapiens
uucuccaggaugucaa

SEQ ID NO: 1656605 - RNA, 18 nt, Homo sapiens
uucuccugugauguccca

SEQ ID NO: 1656606 - RNA, 15 nt, Homo sapiens
uucucuuaucugcca

SEQ ID NO: 1656607 - RNA, 13 nt, Homo sapiens
uucugaaagggac

SEQ ID NO: 1656608 - RNA, 16 nt, Homo sapiens
uucugaauugacugua

SEQ ID NO: 1656609 - RNA, 12 nt, Homo sapiens
uguuuuccauga

SEQ ID NO: 1656610 - RNA, 20 nt, Homo sapiens
uguuuuuguucaaagccagc

SEQ ID NO: 1656611 - RNA, 19 nt, Homo sapiens
uuaaaaaugcaccacuuuu

SEQ ID NO: 1656612 - RNA, 16 nt, Homo sapiens
uuaaaaucacugucaa

SEQ ID NO: 1656613 - RNA, 15 nt, Homo sapiens
uuaaaaucauaaaua

SEQ ID NO: 1656614 - RNA, 13 nt, Homo sapiens
uuaaaaucuguca

SEQ ID NO: 1656615 - RNA, 23 nt, Homo sapiens
uuaaaaugcaaaauaaugucuua

SEQ ID NO: 1656616 - RNA, 15 nt, Homo sapiens
uuaaacacaugcaua

SEQ ID NO: 1656617 - RNA, 19 nt, Homo sapiens
uuaaacauaggaaagaaga

SEQ ID NO: 1656618 - RNA, 21 nt, Homo sapiens
uuaaacccuauugguaaagaa

SEQ ID NO: 1656619 - RNA, 22 nt, Homo sapiens
uuaaagaaaaugugucugcaac

SEQ ID NO: 1656620 - RNA, 19 nt, Homo sapiens
uuaaagagaguuugccacu

SEQ ID NO: 1656621 - RNA, 19 nt, Homo sapiens
uuaaagcugaaaacugcaa

SEQ ID NO: 1656622 - RNA, 19 nt, Homo sapiens
uuaaagcuugcucacaucu

SEQ ID NO: 1656623 - RNA, 17 nt, Homo sapiens
uuaaaggaauaaggugu

SEQ ID NO: 1656624 - RNA, 18 nt, Homo sapiens
uuaaaggacaaacaguga

SEQ ID NO: 1656625 - RNA, 18 nt, Homo sapiens
uuaaauccugaagagcau

SEQ ID NO: 1656626 - RNA, 15 nt, Homo sapiens
uuaaauguauagcug

SEQ ID NO: 1656627 - RNA, 16 nt, Homo sapiens
uuaacacucauuucca

SEQ ID NO: 1656628 - RNA, 14 nt, Homo sapiens
uuaacacuguaaua

SEQ ID NO: 1656629 - RNA, 20 nt, Homo sapiens
uuaagaggcagggucucacu

SEQ ID NO: 1656630 - RNA, 18 nt, Homo sapiens
uuaagccauguguuccaa

SEQ ID NO: 1656631 - RNA, 18 nt, Homo sapiens
uuaaggaaaaauaaauau

SEQ ID NO: 1656632 - RNA, 21 nt, Homo sapiens
uuaagucuuaucaagcagcca

SEQ ID NO: 1656633 - RNA, 13 nt, Homo sapiens
uuaaguucacuuu

SEQ ID NO: 1656634 - RNA, 20 nt, Homo sapiens
uuaaguugauggugaugaaa

SEQ ID NO: 1656635 - RNA, 14 nt, Homo sapiens
uuaauaaaaguaca

SEQ ID NO: 1656636 - RNA, 13 nt, Homo sapiens
uuaauaaagaagu

SEQ ID NO: 1656637 - RNA, 15 nt, Homo sapiens
uuaauauuucugagg

SEQ ID NO: 1656638 - RNA, 21 nt, Homo sapiens
uuaauccacaucuuuacucag

SEQ ID NO: 1656639 - RNA, 15 nt, Homo sapiens
uuaaucuuuucacaa

SEQ ID NO: 1656640 - RNA, 13 nt, Homo sapiens
uuaaugauaauau

SEQ ID NO: 1656641 - RNA, 15 nt, Homo sapiens
uuaauuugaaaccag

SEQ ID NO: 1656642 - RNA, 18 nt, Homo sapiens
uuaauuugauaguauugu

SEQ ID NO: 1656643 - RNA, 14 nt, Homo sapiens
uuacaaaccaacca

SEQ ID NO: 1656644 - RNA, 12 nt, Homo sapiens
uuacacaugaca

SEQ ID NO: 1656645 - RNA, 14 nt, Homo sapiens
uuacaccaguuuga

SEQ ID NO: 1656646 - RNA, 22 nt, Homo sapiens
uuacaggugugagccaccacgc

SEQ ID NO: 1656647 - RNA, 23 nt, Homo sapiens
uuacaguaggagcccagcucuga

SEQ ID NO: 1656648 - RNA, 19 nt, Homo sapiens
uuacaguuuaucuauggca

SEQ ID NO: 1656649 - RNA, 14 nt, Homo sapiens
uuacauacagugau

SEQ ID NO: 1656650 - RNA, 18 nt, Homo sapiens
uuacauuagugauuccau

SEQ ID NO: 1656651 - RNA, 17 nt, Homo sapiens
uuacauuugaaaucuau

SEQ ID NO: 1656652 - RNA, 19 nt, Homo sapiens
uuacauuugaaaucuauga

SEQ ID NO: 1656653 - RNA, 20 nt, Homo sapiens
uuacuauuucaauacuuaca

SEQ ID NO: 1656654 - RNA, 13 nt, Homo sapiens
uuacugugucagg

SEQ ID NO: 1656655 - RNA, 14 nt, Homo sapiens
uuagaagucacaca

SEQ ID NO: 1656656 - RNA, 17 nt, Homo sapiens
uuagacagagucucacu

SEQ ID NO: 1656657 - RNA, 23 nt, Homo sapiens
uuagacagcaguaguagcucccu

SEQ ID NO: 1656658 - RNA, 23 nt, Homo sapiens
uuagagaauuuccuuacucuuga

SEQ ID NO: 1656659 - RNA, 15 nt, Homo sapiens
ugguaaaauacauau

SEQ ID NO: 1656660 - RNA, 22 nt, Homo sapiens
uggucacuggaacucaguguga

SEQ ID NO: 1656661 - RNA, 14 nt, Homo sapiens
uggucuacacugug

SEQ ID NO: 1656662 - RNA, 16 nt, Homo sapiens
uggugcuaauaugaca

SEQ ID NO: 1656663 - RNA, 15 nt, Homo sapiens
ugguggagggccaca

SEQ ID NO: 1656664 - RNA, 21 nt, Homo sapiens
ugguggcucacaccuguaauc

SEQ ID NO: 1656665 - RNA, 22 nt, Homo sapiens
ugguggggcccauggaggagac

SEQ ID NO: 1656666 - RNA, 17 nt, Homo sapiens
ugguuaagacuacugaa

SEQ ID NO: 1656667 - RNA, 14 nt, Homo sapiens
ugguuagaaguaag

SEQ ID NO: 1656668 - RNA, 15 nt, Homo sapiens
ugguucagcuacuuu

SEQ ID NO: 1656669 - RNA, 14 nt, Homo sapiens
ugguucaggguugg

SEQ ID NO: 1656670 - RNA, 15 nt, Homo sapiens
ugguucucaucuuuc

SEQ ID NO: 1656671 - RNA, 18 nt, Homo sapiens
ugguuucaauaaaccuaa

SEQ ID NO: 1656672 - RNA, 18 nt, Homo sapiens
ugguuuuucaguuuucag

SEQ ID NO: 1656673 - RNA, 23 nt, Homo sapiens
ugguuuuuguugagucucugaac

SEQ ID NO: 1656674 - RNA, 22 nt, Homo sapiens
uguaaaaaaaaaugccuuugag

SEQ ID NO: 1656675 - RNA, 13 nt, Homo sapiens
uguaaaaauaacc

SEQ ID NO: 1656676 - RNA, 15 nt, Homo sapiens
uguaaacugugcacc

SEQ ID NO: 1656677 - RNA, 20 nt, Homo sapiens
uguaaauacuguuuuuaaca

SEQ ID NO: 1656678 - RNA, 19 nt, Homo sapiens
uguaaaugaagggucauuu

SEQ ID NO: 1656679 - RNA, 21 nt, Homo sapiens
uguaaauuucucuacugucuc

SEQ ID NO: 1656680 - RNA, 20 nt, Homo sapiens
uguaagaaaacaaacuaaau

SEQ ID NO: 1656681 - RNA, 13 nt, Homo sapiens
uguaauaugggga

SEQ ID NO: 1656682 - RNA, 17 nt, Homo sapiens
uguaaucccagcacuug

SEQ ID NO: 1656683 - RNA, 20 nt, Homo sapiens
uguaaucccagcauuuuggg

SEQ ID NO: 1656684 - RNA, 14 nt, Homo sapiens
uguaauugcauuau

SEQ ID NO: 1656685 - RNA, 22 nt, Homo sapiens
uguaauuggaaucuucaccuca

SEQ ID NO: 1656686 - RNA, 21 nt, Homo sapiens
uguacacgaagaccauccauc

SEQ ID NO: 1656687 - RNA, 16 nt, Homo sapiens
uguacaggcagaugaa

SEQ ID NO: 1656688 - RNA, 15 nt, Homo sapiens
uguaccugugcacgu

SEQ ID NO: 1656689 - RNA, 19 nt, Homo sapiens
uguagguuuucuguguuua

SEQ ID NO: 1656690 - RNA, 19 nt, Homo sapiens
uguaguuucugcauuucaa

SEQ ID NO: 1656691 - RNA, 18 nt, Homo sapiens
uguauacugugugcuaaa

SEQ ID NO: 1656692 - RNA, 19 nt, Homo sapiens
uguauagcuggcaccuuag

SEQ ID NO: 1656693 - RNA, 19 nt, Homo sapiens
uguauauucaggacuugaa

SEQ ID NO: 1656694 - RNA, 18 nt, Homo sapiens
uguauauuuuuauauugu

SEQ ID NO: 1656695 - RNA, 16 nt, Homo sapiens
uguaucaaaugugaca

SEQ ID NO: 1656696 - RNA, 18 nt, Homo sapiens
uguaucaaaugugacauu

SEQ ID NO: 1656697 - RNA, 20 nt, Homo sapiens
uguauccucugaccuacaua

SEQ ID NO: 1656698 - RNA, 21 nt, Homo sapiens
uguaugauccuaaugaaugca

SEQ ID NO: 1656699 - RNA, 13 nt, Homo sapiens
uguauggauaugu

SEQ ID NO: 1656700 - RNA, 21 nt, Homo sapiens
uguauuagccagucauuguaa

SEQ ID NO: 1656701 - RNA, 19 nt, Homo sapiens
uguauuuaaaugaaaguga

SEQ ID NO: 1656702 - RNA, 14 nt, Homo sapiens
ugucaaccccaaau

SEQ ID NO: 1656703 - RNA, 19 nt, Homo sapiens
ugucaauguaaagccaaaa

SEQ ID NO: 1656704 - RNA, 18 nt, Homo sapiens
ugucaauucuugccaaau

SEQ ID NO: 1656705 - RNA, 13 nt, Homo sapiens
ucacuuugcuaca

SEQ ID NO: 1656706 - RNA, 22 nt, Homo sapiens
ucagaagacacugaugggcaac

SEQ ID NO: 1656707 - RNA, 19 nt, Homo sapiens
ucagaaucuccaucccuga

SEQ ID NO: 1656708 - RNA, 13 nt, Homo sapiens
ucagagacaucag

SEQ ID NO: 1656709 - RNA, 17 nt, Homo sapiens
ucagagcugacacagga

SEQ ID NO: 1656710 - RNA, 22 nt, Homo sapiens
ucagaguggaguugaaacugcu

SEQ ID NO: 1656711 - RNA, 18 nt, Homo sapiens
ucagaugcucauugcuuu

SEQ ID NO: 1656712 - RNA, 13 nt, Homo sapiens
ucagcaacagagc

SEQ ID NO: 1656713 - RNA, 17 nt, Homo sapiens
ucagcaagaagauccua

SEQ ID NO: 1656714 - RNA, 22 nt, Homo sapiens
ucagcaccuacaguguacaguc

SEQ ID NO: 1656715 - RNA, 18 nt, Homo sapiens
ucagccacaaccaaaaaa

SEQ ID NO: 1656716 - RNA, 21 nt, Homo sapiens
ucagccccugauccugugaag

SEQ ID NO: 1656717 - RNA, 22 nt, Homo sapiens
ucagccuuuaagauaccuugau

SEQ ID NO: 1656718 - RNA, 15 nt, Homo sapiens
ucagcuaccauucaa

SEQ ID NO: 1656719 - RNA, 14 nt, Homo sapiens
ucagcuggaucucc

SEQ ID NO: 1656720 - RNA, 20 nt, Homo sapiens
ucaggaguuccagugcugca

SEQ ID NO: 1656721 - RNA, 23 nt, Homo sapiens
ucaggccacauggcuaaagaagg

SEQ ID NO: 1656722 - RNA, 16 nt, Homo sapiens
ucagggaccacagcaa

SEQ ID NO: 1656723 - RNA, 18 nt, Homo sapiens
ucagggcugagaggagaa

SEQ ID NO: 1656724 - RNA, 23 nt, Homo sapiens
ucagggugggguggucucugaua

SEQ ID NO: 1656725 - RNA, 17 nt, Homo sapiens
ucaguaaguaucuggag

SEQ ID NO: 1656726 - RNA, 15 nt, Homo sapiens
ucagucaauucugau

SEQ ID NO: 1656727 - RNA, 13 nt, Homo sapiens
ucagucucugagc

SEQ ID NO: 1656728 - RNA, 19 nt, Homo sapiens
ucagucucugagcagugaa

SEQ ID NO: 1656729 - RNA, 17 nt, Homo sapiens
ucagucuuuuccaugaa

SEQ ID NO: 1656730 - RNA, 20 nt, Homo sapiens
ucagucuuuuccaugaacuu

SEQ ID NO: 1656731 - RNA, 18 nt, Homo sapiens
ucagugaauaaaccauca

SEQ ID NO: 1656732 - RNA, 16 nt, Homo sapiens
ucagugaauuugucca

SEQ ID NO: 1656733 - RNA, 22 nt, Homo sapiens
ucaguucugcucuaagaagcug

SEQ ID NO: 1656734 - RNA, 18 nt, Homo sapiens
ucaguucuuacacauucc

SEQ ID NO: 1656735 - RNA, 23 nt, Homo sapiens
ucaguuguuauuuauugaaauga

SEQ ID NO: 1656736 - RNA, 18 nt, Homo sapiens
ucauaauuucuucacuca

SEQ ID NO: 1656737 - RNA, 19 nt, Homo sapiens
ucauaauuucuucacucaa

SEQ ID NO: 1656738 - RNA, 20 nt, Homo sapiens
ucauacauuaucucacuugu

SEQ ID NO: 1656739 - RNA, 12 nt, Homo sapiens
ucauacuguaac

SEQ ID NO: 1656740 - RNA, 20 nt, Homo sapiens
ucauaugcaugcccuuccuu

SEQ ID NO: 1656741 - RNA, 20 nt, Homo sapiens
ucauauugaugugugucuag

SEQ ID NO: 1656742 - RNA, 18 nt, Homo sapiens
ucaucaaggcacugccug

SEQ ID NO: 1656743 - RNA, 19 nt, Homo sapiens
ucaucaggagaaaaagccu

SEQ ID NO: 1656744 - RNA, 20 nt, Homo sapiens
ucaucaggaguuccagugcu

SEQ ID NO: 1656745 - RNA, 16 nt, Homo sapiens
ucaucaugugugucca

SEQ ID NO: 1656746 - RNA, 17 nt, Homo sapiens
ucauccaggacugagau

SEQ ID NO: 1656747 - RNA, 13 nt, Homo sapiens
ucauccauuugcg

SEQ ID NO: 1656748 - RNA, 23 nt, Homo sapiens
ucaucccucccugccuaaggaag

SEQ ID NO: 1656749 - RNA, 24 nt, Homo sapiens
ucaugcaaaggcugggaccacgug

SEQ ID NO: 1656750 - RNA, 13 nt, Homo sapiens
ucaugcauuugca

SEQ ID NO: 1656751 - RNA, 18 nt, Homo sapiens
ucaugcugugugacucaa

SEQ ID NO: 1656752 - RNA, 23 nt, Homo sapiens
ucauguguguccacgacugucuc

SEQ ID NO: 1656753 - RNA, 15 nt, Homo sapiens
ucauuaauucaauga

SEQ ID NO: 1656754 - RNA, 16 nt, Homo sapiens
ucauuccauucuggaa

SEQ ID NO: 1656755 - RNA, 15 nt, Homo sapiens
ucauucucauucuca

SEQ ID NO: 1656756 - RNA, 23 nt, Homo sapiens
ucauugucaaaauuaauaugauu

SEQ ID NO: 1656757 - RNA, 16 nt, Homo sapiens
uaucucaaacuacugg

SEQ ID NO: 1656758 - RNA, 23 nt, Homo sapiens
uaucucaaacuacuggcaauuug

SEQ ID NO: 1656759 - RNA, 19 nt, Homo sapiens
uaucugguaucugcaugua

SEQ ID NO: 1656760 - RNA, 21 nt, Homo sapiens
uaugaaaacaaguuccaaauc

SEQ ID NO: 1656761 - RNA, 15 nt, Homo sapiens
uaugaacuugcaaac

SEQ ID NO: 1656762 - RNA, 18 nt, Homo sapiens
uaugacaauaagccacga

SEQ ID NO: 1656763 - RNA, 23 nt, Homo sapiens
uaugaccucgcccuccacaaaug

SEQ ID NO: 1656764 - RNA, 15 nt, Homo sapiens
uaugauauugcagcu

SEQ ID NO: 1656765 - RNA, 18 nt, Homo sapiens
uaugauuuugaugcacaa

SEQ ID NO: 1656766 - RNA, 23 nt, Homo sapiens
uaugcaaccuuuggaugcacuuu

SEQ ID NO: 1656767 - RNA, 15 nt, Homo sapiens
uaugcaccaaaucau

SEQ ID NO: 1656768 - RNA, 19 nt, Homo sapiens
uaugcagagguccacaaca

SEQ ID NO: 1656769 - RNA, 18 nt, Homo sapiens
uaugcauguaauggacua

SEQ ID NO: 1656770 - RNA, 22 nt, Homo sapiens
uaugcauguaauggacuaugca

SEQ ID NO: 1656771 - RNA, 23 nt, Homo sapiens
uaugccugaaugacuccacuguu

SEQ ID NO: 1656772 - RNA, 18 nt, Homo sapiens
uaugcuauugaaguuuug

SEQ ID NO: 1656773 - RNA, 19 nt, Homo sapiens
uaugcuuugaaugcaaaag

SEQ ID NO: 1656774 - RNA, 13 nt, Homo sapiens
uauguaacaugua

SEQ ID NO: 1656775 - RNA, 13 nt, Homo sapiens
uauguagcaguau

SEQ ID NO: 1656776 - RNA, 15 nt, Homo sapiens
uaugucucagaccac

SEQ ID NO: 1656777 - RNA, 14 nt, Homo sapiens
uaugugauguggca

SEQ ID NO: 1656778 - RNA, 9 nt, Homo sapiens
uaugugcaa

SEQ ID NO: 1656779 - RNA, 11 nt, Homo sapiens
uaugugcaaua

SEQ ID NO: 1656780 - RNA, 12 nt, Homo sapiens
uaugugcacauc

SEQ ID NO: 1656781 - RNA, 13 nt, Homo sapiens
uauuaaauuugaa

SEQ ID NO: 1656782 - RNA, 15 nt, Homo sapiens
uauuaagccacuuaa

SEQ ID NO: 1656783 - RNA, 21 nt, Homo sapiens
uauuaagucauuguuucccau

SEQ ID NO: 1656784 - RNA, 21 nt, Homo sapiens
uauuaagucguucaauucaug

SEQ ID NO: 1656785 - RNA, 15 nt, Homo sapiens
uauuacgugcaauac

SEQ ID NO: 1656786 - RNA, 14 nt, Homo sapiens
uauuauauuaucau

SEQ ID NO: 1656787 - RNA, 23 nt, Homo sapiens
uauucaauggugagcagacugca

SEQ ID NO: 1656788 - RNA, 13 nt, Homo sapiens
uauucaguucuua

SEQ ID NO: 1656789 - RNA, 14 nt, Homo sapiens
uauucauauguuua

SEQ ID NO: 1656790 - RNA, 15 nt, Homo sapiens
uauucaugaguauuc

SEQ ID NO: 1656791 - RNA, 21 nt, Homo sapiens
uauucccaaaaauuacuuugg

SEQ ID NO: 1656792 - RNA, 23 nt, Homo sapiens
uauuccugauagagguauggaaa

SEQ ID NO: 1656793 - RNA, 13 nt, Homo sapiens
uauucugauaaug

SEQ ID NO: 1656794 - RNA, 16 nt, Homo sapiens
uauucuuaacuauuca

SEQ ID NO: 1656795 - RNA, 20 nt, Homo sapiens
uauucuuggagaauaucaaa

SEQ ID NO: 1656796 - RNA, 16 nt, Homo sapiens
uauugaauaagccauu

SEQ ID NO: 1656797 - RNA, 19 nt, Homo sapiens
uauugcagcuuauauucau

SEQ ID NO: 1656798 - RNA, 16 nt, Homo sapiens
uauuguuucaauugca

SEQ ID NO: 1656799 - RNA, 18 nt, Homo sapiens
uauuuaaccuauuuccac

SEQ ID NO: 1656800 - RNA, 12 nt, Homo sapiens
uauuuaccugaa

SEQ ID NO: 1656801 - RNA, 15 nt, Homo sapiens
uauuuauagcuguag

SEQ ID NO: 1656802 - RNA, 15 nt, Homo sapiens
uauuuauugcugaau

SEQ ID NO: 1656803 - RNA, 18 nt, Homo sapiens
uauuucuggaauggaaaa

SEQ ID NO: 1656804 - RNA, 14 nt, Homo sapiens
uauuugcacaaguu

SEQ ID NO: 1656805 - RNA, 21 nt, Homo sapiens
uauuugugaugacaacuggaa

SEQ ID NO: 1656806 - RNA, 17 nt, Homo sapiens
uauuuuauagagcagaa

SEQ ID NO: 1656807 - RNA, 14 nt, Homo sapiens
uauuuuccaugaaa

SEQ ID NO: 1656808 - RNA, 15 nt, Homo sapiens
ucaaaagcacuuugu

SEQ ID NO: 1656809 - RNA, 22 nt, Homo sapiens
ucaaacgugaaaaugcuguauu

SEQ ID NO: 1656810 - RNA, 19 nt, Homo sapiens
ucaaacucuugaccucagg

SEQ ID NO: 1656811 - RNA, 22 nt, Homo sapiens
uacagugagggcuauacauggu

SEQ ID NO: 1656812 - RNA, 14 nt, Homo sapiens
uacaguucauaaau

SEQ ID NO: 1656813 - RNA, 14 nt, Homo sapiens
uacaguuuaucuau

SEQ ID NO: 1656814 - RNA, 16 nt, Homo sapiens
uacauuagugauucca

SEQ ID NO: 1656815 - RNA, 18 nt, Homo sapiens
uaccaaaucugacauauu

SEQ ID NO: 1656816 - RNA, 18 nt, Homo sapiens
uaccauaagugacaccaa

SEQ ID NO: 1656817 - RNA, 22 nt, Homo sapiens
uaccauagcuacaucaguuuga

SEQ ID NO: 1656818 - RNA, 17 nt, Homo sapiens
uacccuccucuauuucu

SEQ ID NO: 1656819 - RNA, 23 nt, Homo sapiens
uacccuuggaaagaaauguagau

SEQ ID NO: 1656820 - RNA, 20 nt, Homo sapiens
uaccugaaauaaaauucauu

SEQ ID NO: 1656821 - RNA, 17 nt, Homo sapiens
uaccuuacugcaauuug

SEQ ID NO: 1656822 - RNA, 18 nt, Homo sapiens
uaccuuuugugguucuca

SEQ ID NO: 1656823 - RNA, 20 nt, Homo sapiens
uacgcuccaucgcugucauc

SEQ ID NO: 1656824 - RNA, 18 nt, Homo sapiens
uacguaugagauccuuua

SEQ ID NO: 1656825 - RNA, 17 nt, Homo sapiens
uacgucuuucacaguuu

SEQ ID NO: 1656826 - RNA, 11 nt, Homo sapiens
uacgugcaaua

SEQ ID NO: 1656827 - RNA, 17 nt, Homo sapiens
uacuagauugugauccc

SEQ ID NO: 1656828 - RNA, 14 nt, Homo sapiens
uacuaucaugucaa

SEQ ID NO: 1656829 - RNA, 17 nt, Homo sapiens
uacuauuucaauacuua

SEQ ID NO: 1656830 - RNA, 17 nt, Homo sapiens
uacuccaggagacccac

SEQ ID NO: 1656831 - RNA, 16 nt, Homo sapiens
uacucccuccacccuc

SEQ ID NO: 1656832 - RNA, 18 nt, Homo sapiens
uacugcccaaggauaggu

SEQ ID NO: 1656833 - RNA, 17 nt, Homo sapiens
uacugcccugagccuga

SEQ ID NO: 1656834 - RNA, 14 nt, Homo sapiens
uacuggacucagga

SEQ ID NO: 1656835 - RNA, 17 nt, Homo sapiens
uacugggacugugcuca

SEQ ID NO: 1656836 - RNA, 21 nt, Homo sapiens
uacugggacugugcucagaga

SEQ ID NO: 1656837 - RNA, 19 nt, Homo sapiens
uacuguauggaaacacuga

SEQ ID NO: 1656838 - RNA, 23 nt, Homo sapiens
uacuguggcuucuuaaucuuuuc

SEQ ID NO: 1656839 - RNA, 12 nt, Homo sapiens
uacugugucagg

SEQ ID NO: 1656840 - RNA, 21 nt, Homo sapiens
uacugugucaggaaacauauu

SEQ ID NO: 1656841 - RNA, 22 nt, Homo sapiens
uacuuaaauuugguuuguuaau

SEQ ID NO: 1656842 - RNA, 21 nt, Homo sapiens
uacuuacauaucugacuucua

SEQ ID NO: 1656843 - RNA, 17 nt, Homo sapiens
uacuuauuaaucuguau

SEQ ID NO: 1656844 - RNA, 23 nt, Homo sapiens
uacuuauuauuccagaucugcag

SEQ ID NO: 1656845 - RNA, 16 nt, Homo sapiens
uacuucaagaucugaa

SEQ ID NO: 1656846 - RNA, 20 nt, Homo sapiens
uacuugccuaucugacuuca

SEQ ID NO: 1656847 - RNA, 17 nt, Homo sapiens
uacuuguggacacagcu

SEQ ID NO: 1656848 - RNA, 16 nt, Homo sapiens
uacuuucgaaauuuca

SEQ ID NO: 1656849 - RNA, 21 nt, Homo sapiens
uacuuugaagucauaccaaug

SEQ ID NO: 1656850 - RNA, 14 nt, Homo sapiens
uacuuugacagugu

SEQ ID NO: 1656851 - RNA, 19 nt, Homo sapiens
uagaaacauugaagaugaa

SEQ ID NO: 1656852 - RNA, 15 nt, Homo sapiens
uagaacacaguuugu

SEQ ID NO: 1656853 - RNA, 22 nt, Homo sapiens
uagaacuggaucccaacaccaa

SEQ ID NO: 1656854 - RNA, 19 nt, Homo sapiens
uagaagauauuagucuugg

SEQ ID NO: 1656855 - RNA, 20 nt, Homo sapiens
uagaagggcuagaaccugga

SEQ ID NO: 1656856 - RNA, 22 nt, Homo sapiens
uagaagguucucuccuccccaa

SEQ ID NO: 1656857 - RNA, 16 nt, Homo sapiens
uagaagucacacagua

SEQ ID NO: 1656858 - RNA, 21 nt, Homo sapiens
uagaaguugacaggcagugcc

SEQ ID NO: 1656859 - RNA, 14 nt, Homo sapiens
uagaauugcacaua

SEQ ID NO: 1656860 - RNA, 14 nt, Homo sapiens
uagacuaaggccau

SEQ ID NO: 1656861 - RNA, 17 nt, Homo sapiens
uagagaaauuugccaau

SEQ ID NO: 1656862 - RNA, 19 nt, Homo sapiens
uagagacgggguuucacca

SEQ ID NO: 1656863 - RNA, 22 nt, Homo sapiens
uagagacgggguuucaccaugu

SEQ ID NO: 1656864 - RNA, 13 nt, Homo sapiens
uagagcucuuuau

SEQ ID NO: 1656865 - RNA, 16 nt, Homo sapiens
aaaaacuguugcuauu

SEQ ID NO: 1656866 - RNA, 12 nt, Homo sapiens
aaaaaguuuaca

SEQ ID NO: 1656867 - RNA, 15 nt, Homo sapiens
aaaaauaacacugua

SEQ ID NO: 1656868 - RNA, 14 nt, Homo sapiens
aaaaauauauguaa

SEQ ID NO: 1656869 - RNA, 22 nt, Homo sapiens
aaaaaugcuugcuucaacccca

SEQ ID NO: 1656870 - RNA, 16 nt, Homo sapiens
aaaaauuaacauguca

SEQ ID NO: 1656871 - RNA, 23 nt, Homo sapiens
aaaacaagagaccacuuccuuaa

SEQ ID NO: 1656872 - RNA, 16 nt, Homo sapiens
aaaacaagguccagua

SEQ ID NO: 1656873 - RNA, 24 nt, Homo sapiens
aaaacagaccagcauaguucugca

SEQ ID NO: 1656874 - RNA, 11 nt, Homo sapiens
aaaacauaucu

SEQ ID NO: 1656875 - RNA, 21 nt, Homo sapiens
aaaacauuguccccaaugaau

SEQ ID NO: 1656876 - RNA, 14 nt, Homo sapiens
aaaaccuuacuuaa

SEQ ID NO: 1656877 - RNA, 11 nt, Homo sapiens
aaaacugugac

SEQ ID NO: 1656878 - RNA, 12 nt, Homo sapiens
aaaacugugaca

SEQ ID NO: 1656879 - RNA, 23 nt, Homo sapiens
aaaagaaucccuguucauuguaa

SEQ ID NO: 1656880 - RNA, 16 nt, Homo sapiens
aaaagaggcuauguga

SEQ ID NO: 1656881 - RNA, 12 nt, Homo sapiens
aaaagcaacuuu

SEQ ID NO: 1656882 - RNA, 16 nt, Homo sapiens
aaaagcaucuauguga

SEQ ID NO: 1656883 - RNA, 19 nt, Homo sapiens
aaaagggaaaaaagcaacu

SEQ ID NO: 1656884 - RNA, 14 nt, Homo sapiens
aaaagggagaacau

SEQ ID NO: 1656885 - RNA, 19 nt, Homo sapiens
aaaaguaagagagcacagu

SEQ ID NO: 1656886 - RNA, 15 nt, Homo sapiens
aaaauaaccaguuaa

SEQ ID NO: 1656887 - RNA, 13 nt, Homo sapiens
aaaauacuucuuu

SEQ ID NO: 1656888 - RNA, 12 nt, Homo sapiens
aaaauaguagca

SEQ ID NO: 1656889 - RNA, 18 nt, Homo sapiens
aaaauaguguguccaugc

SEQ ID NO: 1656890 - RNA, 19 nt, Homo sapiens
aaaaucacaaacucaucca

SEQ ID NO: 1656891 - RNA, 13 nt, Homo sapiens
aaaaucaucaaag

SEQ ID NO: 1656892 - RNA, 17 nt, Homo sapiens
aaaaucauucuacugaa

SEQ ID NO: 1656893 - RNA, 20 nt, Homo sapiens
aaaaucauucuacugaacag

SEQ ID NO: 1656894 - RNA, 21 nt, Homo sapiens
aaaaucccucuuccuccaaag

SEQ ID NO: 1656895 - RNA, 21 nt, Homo sapiens
aaaaucuuuguuacucuguaa

SEQ ID NO: 1656896 - RNA, 11 nt, Homo sapiens
aaaaugcuuuc

SEQ ID NO: 1656897 - RNA, 14 nt, Homo sapiens
aaaauggacauauu

SEQ ID NO: 1656898 - RNA, 20 nt, Homo sapiens
aaaaugguguuuucauguaa

SEQ ID NO: 1656899 - RNA, 21 nt, Homo sapiens
aaaauguucugacagcauuuc

SEQ ID NO: 1656900 - RNA, 14 nt, Homo sapiens
aaacaaaaacuguu

SEQ ID NO: 1656901 - RNA, 14 nt, Homo sapiens
aaacaaaauccuug

SEQ ID NO: 1656902 - RNA, 21 nt, Homo sapiens
aaacaaauauacucauuugga

SEQ ID NO: 1656903 - RNA, 11 nt, Homo sapiens
aaacaaauggc

SEQ ID NO: 1656904 - RNA, 13 nt, Homo sapiens
aaacaaauuccuu

SEQ ID NO: 1656905 - RNA, 15 nt, Homo sapiens
aaacacaaaccacaa

SEQ ID NO: 1656906 - RNA, 22 nt, Homo sapiens
aaacacggaguuuccauuugga

SEQ ID NO: 1656907 - RNA, 14 nt, Homo sapiens
aaacacggcugaua

SEQ ID NO: 1656908 - RNA, 15 nt, Homo sapiens
aaacacuucuccuua

SEQ ID NO: 1656909 - RNA, 16 nt, Homo sapiens
aaacacuucuccuuaa

SEQ ID NO: 1656910 - RNA, 19 nt, Homo sapiens
aaacagauuuguucauucc

SEQ ID NO: 1656911 - RNA, 17 nt, Homo sapiens
aaacagugacaccugca

SEQ ID NO: 1656912 - RNA, 13 nt, Homo sapiens
aaacaguguggau

SEQ ID NO: 1656913 - RNA, 17 nt, Homo sapiens
aaacaguguggauguaa

SEQ ID NO: 1656914 - RNA, 14 nt, Homo sapiens
aaacauaauaucuu

SEQ ID NO: 1656915 - RNA, 19 nt, Homo sapiens
aaacauaauaucuugaaga

SEQ ID NO: 1656916 - RNA, 14 nt, Homo sapiens
aaacauagugguau

SEQ ID NO: 1656917 - RNA, 22 nt, Homo sapiens
aaacauguggcaaccuguucuu

SEQ ID NO: 1656918 - RNA, 23 nt, Homo sapiens
aaacauuuaucuuuguacguucu

SEQ ID NO: 1656919 - RNA, 14 nt, Homo sapiens
aaaccagacucacu

SEQ ID NO: 1656920 - RNA, 21 nt, Homo sapiens
aaaccaggccuccaagccagg

SEQ ID NO: 1656921 - RNA, 21 nt, Homo sapiens
aaacccagauugaagcuaaaa

SEQ ID NO: 1656922 - RNA, 19 nt, Homo sapiens
aaacccuacgaaagcacag

SEQ ID NO: 1656923 - RNA, 15 nt, Homo sapiens
aaaccggauccuguu

SEQ ID NO: 1656924 - RNA, 22 nt, Homo sapiens
aaaccuaccuuauagagcacaa

SEQ ID NO: 1656925 - RNA, 22 nt, Homo sapiens
aaaccucuauauguugcugaaa

SEQ ID NO: 1656926 - RNA, 15 nt, Homo sapiens
aaaccugugcuuuca

SEQ ID NO: 1656927 - RNA, 22 nt, Homo sapiens
aaaccuguuccugacuguucuc

SEQ ID NO: 1656928 - RNA, 14 nt, Homo sapiens
agcuugcaguuuca

SEQ ID NO: 1656929 - RNA, 15 nt, Homo sapiens
agcuugcaguuucau

SEQ ID NO: 1656930 - RNA, 14 nt, Homo sapiens
agcuuggagugcca

SEQ ID NO: 1656931 - RNA, 17 nt, Homo sapiens
agcuuggagugccacgu

SEQ ID NO: 1656932 - RNA, 23 nt, Homo sapiens
agcuuguccaacaacuccaggaa

SEQ ID NO: 1656933 - RNA, 19 nt, Homo sapiens
agcuuguuguuuuuugcua

SEQ ID NO: 1656934 - RNA, 16 nt, Homo sapiens
agcuuuacagugccac

SEQ ID NO: 1656935 - RNA, 19 nt, Homo sapiens
agcuuuagagaagccauaa

SEQ ID NO: 1656936 - RNA, 15 nt, Homo sapiens
aggaaaacaugacau

SEQ ID NO: 1656937 - RNA, 15 nt, Homo sapiens
aggaaaaggcuugag

SEQ ID NO: 1656938 - RNA, 14 nt, Homo sapiens
aggaaagcccuccc

SEQ ID NO: 1656939 - RNA, 21 nt, Homo sapiens
aggaaagccucacugauauau

SEQ ID NO: 1656940 - RNA, 20 nt, Homo sapiens
aggaacaaagacaaccacug

SEQ ID NO: 1656941 - RNA, 14 nt, Homo sapiens
aggaacaagcaaug

SEQ ID NO: 1656942 - RNA, 20 nt, Homo sapiens
aggaacauuggagccugcaa

SEQ ID NO: 1656943 - RNA, 17 nt, Homo sapiens
aggaaccgaggacucca

SEQ ID NO: 1656944 - RNA, 18 nt, Homo sapiens
aggaacugcuugugcacu

SEQ ID NO: 1656945 - RNA, 15 nt, Homo sapiens
aggaagcacaugccu

SEQ ID NO: 1656946 - RNA, 17 nt, Homo sapiens
aggaaucaaaaauugaa

SEQ ID NO: 1656947 - RNA, 12 nt, Homo sapiens
aggaauucucac

SEQ ID NO: 1656948 - RNA, 19 nt, Homo sapiens
aggacccagggaaugccag

SEQ ID NO: 1656949 - RNA, 22 nt, Homo sapiens
aggaccuggagauugugcucug

SEQ ID NO: 1656950 - RNA, 15 nt, Homo sapiens
aggagaugaggcugg

SEQ ID NO: 1656951 - RNA, 16 nt, Homo sapiens
aggagcacacauccaa

SEQ ID NO: 1656952 - RNA, 13 nt, Homo sapiens
aggagcguguacu

SEQ ID NO: 1656953 - RNA, 20 nt, Homo sapiens
aggagcguguacuaccccag

SEQ ID NO: 1656954 - RNA, 13 nt, Homo sapiens
aggagcguguccu

SEQ ID NO: 1656955 - RNA, 16 nt, Homo sapiens
aggaggaaaagcccag

SEQ ID NO: 1656956 - RNA, 13 nt, Homo sapiens
aggaguaagggaa

SEQ ID NO: 1656957 - RNA, 20 nt, Homo sapiens
aggaugauuguacagaauca

SEQ ID NO: 1656958 - RNA, 15 nt, Homo sapiens
aggaugcaugcaggg

SEQ ID NO: 1656959 - RNA, 15 nt, Homo sapiens
aggauggagugcagu

SEQ ID NO: 1656960 - RNA, 16 nt, Homo sapiens
aggauuuaccaaauag

SEQ ID NO: 1656961 - RNA, 19 nt, Homo sapiens
aggcaaaaccaacucucua

SEQ ID NO: 1656962 - RNA, 21 nt, Homo sapiens
aggcaaaggcccccaucacac

SEQ ID NO: 1656963 - RNA, 17 nt, Homo sapiens
aggcaaaggcuuguaaa

SEQ ID NO: 1656964 - RNA, 19 nt, Homo sapiens
aggcaagacaccuucccag

SEQ ID NO: 1656965 - RNA, 22 nt, Homo sapiens
aggcaauggugaacugucauua

SEQ ID NO: 1656966 - RNA, 21 nt, Homo sapiens
aggcacccgcccuuuccuugc

SEQ ID NO: 1656967 - RNA, 17 nt, Homo sapiens
aggcaggagaauggcgu

SEQ ID NO: 1656968 - RNA, 21 nt, Homo sapiens
aggcaggcagcugccugcucu

SEQ ID NO: 1656969 - RNA, 21 nt, Homo sapiens
aggcagggaagcucuaccgca

SEQ ID NO: 1656970 - RNA, 16 nt, Homo sapiens
aggcagugcaguacuc

SEQ ID NO: 1656971 - RNA, 14 nt, Homo sapiens
aggccaucaccaca

SEQ ID NO: 1656972 - RNA, 16 nt, Homo sapiens
aggccauuuguguuua

SEQ ID NO: 1656973 - RNA, 14 nt, Homo sapiens
aggcccacucuguu

SEQ ID NO: 1656974 - RNA, 17 nt, Homo sapiens
aggcccuggaacucuau

SEQ ID NO: 1656975 - RNA, 23 nt, Homo sapiens
aggccuauaacuuuugguaucua

SEQ ID NO: 1656976 - RNA, 12 nt, Homo sapiens
aggccucaggga

SEQ ID NO: 1656977 - RNA, 23 nt, Homo sapiens
aggccuccagccacuuauuucca

SEQ ID NO: 1656978 - RNA, 14 nt, Homo sapiens
aggcggucacugcc

SEQ ID NO: 1656979 - RNA, 17 nt, Homo sapiens
aggcuaguccggaccca

SEQ ID NO: 1656980 - RNA, 15 nt, Homo sapiens
aggcucccacugccc

SEQ ID NO: 1656981 - RNA, 16 nt, Homo sapiens
aggcucuaauguacaa

SEQ ID NO: 1656982 - RNA, 17 nt, Homo sapiens
aggcucuaauguacaau

SEQ ID NO: 1656983 - RNA, 18 nt, Homo sapiens
aggcucuaauguacaaua

SEQ ID NO: 1656984 - RNA, 17 nt, Homo sapiens
aggcugcugaaaaccau

SEQ ID NO: 1656985 - RNA, 16 nt, Homo sapiens
aggcuggaccaacugc

SEQ ID NO: 1656986 - RNA, 17 nt, Homo sapiens
aggcuggagugcagugg

SEQ ID NO: 1656987 - RNA, 15 nt, Homo sapiens
aggcuuagugcuugg

SEQ ID NO: 1656988 - RNA, 15 nt, Homo sapiens
agggaaaaaugggaa

SEQ ID NO: 1656989 - RNA, 17 nt, Homo sapiens
agggaaauucacacugu

SEQ ID NO: 1656990 - RNA, 17 nt, Homo sapiens
agggaacagcauaugca

SEQ ID NO: 1656991 - RNA, 15 nt, Homo sapiens
agggaagcaccauga

SEQ ID NO: 1656992 - RNA, 19 nt, Homo sapiens
agggaagggcugguguuga

SEQ ID NO: 1656993 - RNA, 16 nt, Homo sapiens
agggaaggugagccag

SEQ ID NO: 1656994 - RNA, 17 nt, Homo sapiens
agggacaagcauguuga

SEQ ID NO: 1656995 - RNA, 11 nt, Homo sapiens
agggaccaagg

SEQ ID NO: 1656996 - RNA, 16 nt, Homo sapiens
agggacgacuuucuuu

SEQ ID NO: 1656997 - RNA, 12 nt, Homo sapiens
agggacugccuc

SEQ ID NO: 1656998 - RNA, 13 nt, Homo sapiens
agggcaacuugag

SEQ ID NO: 1656999 - RNA, 17 nt, Homo sapiens
agggcagaggccaugaa

SEQ ID NO: 1657000 - RNA, 16 nt, Homo sapiens
agggccuguaauccca

SEQ ID NO: 1657001 - RNA, 20 nt, Homo sapiens
agggcgagguaaaguuuaug

SEQ ID NO: 1657002 - RNA, 19 nt, Homo sapiens
agggcgcugagggcagggu

SEQ ID NO: 1657003 - RNA, 21 nt, Homo sapiens
agggcugaccugccucucaca

SEQ ID NO: 1657004 - RNA, 15 nt, Homo sapiens
aggggccagaccacg

SEQ ID NO: 1657005 - RNA, 19 nt, Homo sapiens
aggggccugggcugugagg

SEQ ID NO: 1657006 - RNA, 18 nt, Homo sapiens
agggggcaugaagcacau

SEQ ID NO: 1657007 - RNA, 15 nt, Homo sapiens
aggguaaggcugugg

SEQ ID NO: 1657008 - RNA, 23 nt, Homo sapiens
agggucuuccuccuaaauuucca

SEQ ID NO: 1657009 - RNA, 16 nt, Homo sapiens
agggugaagaguccaa

SEQ ID NO: 1657010 - RNA, 22 nt, Homo sapiens
agggugcauguccccugcuuga

SEQ ID NO: 1657011 - RNA, 20 nt, Homo sapiens
agggugggaccccauuccag

SEQ ID NO: 1657012 - RNA, 17 nt, Homo sapiens
aggguuccagacagggu

SEQ ID NO: 1657013 - RNA, 22 nt, Homo sapiens
aggucaggugccucccagcccu

SEQ ID NO: 1657014 - RNA, 20 nt, Homo sapiens
aggucauugguggcagagug

SEQ ID NO: 1657015 - RNA, 21 nt, Homo sapiens
aggucuccaccccucaagcca

SEQ ID NO: 1657016 - RNA, 19 nt, Homo sapiens
aggucuuaagaugcaaauc

SEQ ID NO: 1657017 - RNA, 16 nt, Homo sapiens
aggucuugaguuucau

SEQ ID NO: 1657018 - RNA, 18 nt, Homo sapiens
aggugaccagaaugaggc

SEQ ID NO: 1657019 - RNA, 21 nt, Homo sapiens
aggugacuuuccuaugacacu

SEQ ID NO: 1657020 - RNA, 23 nt, Homo sapiens
aggugacuuuccuaugacacuca

SEQ ID NO: 1657021 - RNA, 12 nt, Homo sapiens
aggugagccaga

SEQ ID NO: 1657022 - RNA, 13 nt, Homo sapiens
aggugagccagac

SEQ ID NO: 1657023 - RNA, 17 nt, Homo sapiens
aggugaggaagcaaaag

SEQ ID NO: 1657024 - RNA, 19 nt, Homo sapiens
aggugaugguaacugcaca

SEQ ID NO: 1657025 - RNA, 23 nt, Homo sapiens
aggugauugucaccaugaucacu

SEQ ID NO: 1657026 - RNA, 17 nt, Homo sapiens
agguggauucaugucca

SEQ ID NO: 1657027 - RNA, 22 nt, Homo sapiens
aggugggucaacuccaaggcaa

SEQ ID NO: 1657028 - RNA, 16 nt, Homo sapiens
aggugguggugguggu

SEQ ID NO: 1657029 - RNA, 16 nt, Homo sapiens
aggugucccugagaac

SEQ ID NO: 1657030 - RNA, 16 nt, Homo sapiens
aggugucucugagaau

SEQ ID NO: 1657031 - RNA, 13 nt, Homo sapiens
agguuacuaaagg

SEQ ID NO: 1657032 - RNA, 18 nt, Homo sapiens
agguuauuguaggaauaa

SEQ ID NO: 1657033 - RNA, 20 nt, Homo sapiens
agguuggagugcaguggcgu

SEQ ID NO: 1657034 - RNA, 14 nt, Homo sapiens
agguuggagugcau

SEQ ID NO: 1657035 - RNA, 14 nt, Homo sapiens
aguaaaaacaauuc

SEQ ID NO: 1657036 - RNA, 14 nt, Homo sapiens
aguaaauauacuug

SEQ ID NO: 1657037 - RNA, 16 nt, Homo sapiens
aguaaaucagugcagu

SEQ ID NO: 1657038 - RNA, 21 nt, Homo sapiens
aguaaaucuaucucuauauaa

SEQ ID NO: 1657039 - RNA, 13 nt, Homo sapiens
aguaacacagugc

SEQ ID NO: 1657040 - RNA, 16 nt, Homo sapiens
aguaacacagugcagu

SEQ ID NO: 1657041 - RNA, 13 nt, Homo sapiens
aguaacacagugu

SEQ ID NO: 1657042 - RNA, 17 nt, Homo sapiens
aguaacacucaccauca

SEQ ID NO: 1657043 - RNA, 17 nt, Homo sapiens
aguaacaguauuuccau

SEQ ID NO: 1657044 - RNA, 19 nt, Homo sapiens
aguaacccugucuaaugaa

SEQ ID NO: 1657045 - RNA, 21 nt, Homo sapiens
aguaagacagugcagugcuca

SEQ ID NO: 1657046 - RNA, 21 nt, Homo sapiens
aguaaucuguugacagugcca

SEQ ID NO: 1657047 - RNA, 17 nt, Homo sapiens
aguaauuuucuucucau

SEQ ID NO: 1657048 - RNA, 14 nt, Homo sapiens
cccuuuuacaguca

SEQ ID NO: 1657049 - RNA, 14 nt, Homo sapiens
ccgaagugcaauga

SEQ ID NO: 1657050 - RNA, 11 nt, Homo sapiens
ccgacaugccu

SEQ ID NO: 1657051 - RNA, 21 nt, Homo sapiens
ccgagauaucgccacugcacu

SEQ ID NO: 1657052 - RNA, 17 nt, Homo sapiens
ccgagccaggaacugug

SEQ ID NO: 1657053 - RNA, 18 nt, Homo sapiens
ccgcugggagaaaagcca

SEQ ID NO: 1657054 - RNA, 21 nt, Homo sapiens
ccggaaagccuuccucaagau

SEQ ID NO: 1657055 - RNA, 23 nt, Homo sapiens
ccggaaugaaugagcauucugca

SEQ ID NO: 1657056 - RNA, 14 nt, Homo sapiens
ccgggcacugucau

SEQ ID NO: 1657057 - RNA, 17 nt, Homo sapiens
ccgggcacugucaugcc

SEQ ID NO: 1657058 - RNA, 23 nt, Homo sapiens
ccguggugugaggcccccggagg

SEQ ID NO: 1657059 - RNA, 15 nt, Homo sapiens
ccuaaacauaguggu

SEQ ID NO: 1657060 - RNA, 17 nt, Homo sapiens
ccuaaagaaaacaaaca

SEQ ID NO: 1657061 - RNA, 20 nt, Homo sapiens
ccuaaagggaagcccugaca

SEQ ID NO: 1657062 - RNA, 23 nt, Homo sapiens
ccuaauucucuucgcugugaugc

SEQ ID NO: 1657063 - RNA, 13 nt, Homo sapiens
ccuaccacauuca

SEQ ID NO: 1657064 - RNA, 22 nt, Homo sapiens
ccuacuuagacccagucauucu

SEQ ID NO: 1657065 - RNA, 20 nt, Homo sapiens
ccuacuuauuucagauucac

SEQ ID NO: 1657066 - RNA, 19 nt, Homo sapiens
auucaguaaggcagugaag

SEQ ID NO: 1657067 - RNA, 16 nt, Homo sapiens
auucauaaugacuuaa

SEQ ID NO: 1657068 - RNA, 18 nt, Homo sapiens
auucauccucacaugugg

SEQ ID NO: 1657069 - RNA, 22 nt, Homo sapiens
auucaugcagcaaauaugggcu

SEQ ID NO: 1657070 - RNA, 14 nt, Homo sapiens
auucauuccauuug

SEQ ID NO: 1657071 - RNA, 15 nt, Homo sapiens
auuccaauacauuga

SEQ ID NO: 1657072 - RNA, 17 nt, Homo sapiens
auuccagggaaccagag

SEQ ID NO: 1657073 - RNA, 20 nt, Homo sapiens
auucccaugguagacuguga

SEQ ID NO: 1657074 - RNA, 23 nt, Homo sapiens
auuccuccugucuccucugucag

SEQ ID NO: 1657075 - RNA, 19 nt, Homo sapiens
auuccuguucccaugagau

SEQ ID NO: 1657076 - RNA, 21 nt, Homo sapiens
auucuaaaagauaaguguguu

SEQ ID NO: 1657077 - RNA, 18 nt, Homo sapiens
auucuccagaaaaaucaa

SEQ ID NO: 1657078 - RNA, 17 nt, Homo sapiens
auucucugaugcacugu

SEQ ID NO: 1657079 - RNA, 18 nt, Homo sapiens
auucucuucgcugugaug

SEQ ID NO: 1657080 - RNA, 18 nt, Homo sapiens
auucugaaggccuuguua

SEQ ID NO: 1657081 - RNA, 23 nt, Homo sapiens
auucuuaaauauguggaguucau

SEQ ID NO: 1657082 - RNA, 14 nt, Homo sapiens
auucuuuaucacau

SEQ ID NO: 1657083 - RNA, 22 nt, Homo sapiens
auugaagcuaaaauaaaccaga

SEQ ID NO: 1657084 - RNA, 16 nt, Homo sapiens
auugaaggauugugaa

SEQ ID NO: 1657085 - RNA, 16 nt, Homo sapiens
auugaaugaugugaua

SEQ ID NO: 1657086 - RNA, 13 nt, Homo sapiens
auugaaugugauu

SEQ ID NO: 1657087 - RNA, 18 nt, Homo sapiens
auugagauaacauuucca

SEQ ID NO: 1657088 - RNA, 12 nt, Homo sapiens
auugagcacaua

SEQ ID NO: 1657089 - RNA, 14 nt, Homo sapiens
auugaggaugaacu

SEQ ID NO: 1657090 - RNA, 18 nt, Homo sapiens
auugauauugaaugaugu

SEQ ID NO: 1657091 - RNA, 15 nt, Homo sapiens
auugaugaacugcca

SEQ ID NO: 1657092 - RNA, 17 nt, Homo sapiens
auugaugaacugccaaa

SEQ ID NO: 1657093 - RNA, 16 nt, Homo sapiens
auugauguaacugugu

SEQ ID NO: 1657094 - RNA, 18 nt, Homo sapiens
auugcacugcaguuauuu

SEQ ID NO: 1657095 - RNA, 21 nt, Homo sapiens
auugccaauaaugugugagaa

SEQ ID NO: 1657096 - RNA, 12 nt, Homo sapiens
auugcccaugau

SEQ ID NO: 1657097 - RNA, 19 nt, Homo sapiens
auugcugagauguuuagua

SEQ ID NO: 1657098 - RNA, 18 nt, Homo sapiens
auugcuuggacuaccuau

SEQ ID NO: 1657099 - RNA, 14 nt, Homo sapiens
auuggagccugcaa

SEQ ID NO: 1657100 - RNA, 16 nt, Homo sapiens
auuggcugaacugaau

SEQ ID NO: 1657101 - RNA, 19 nt, Homo sapiens
augcacuaaucaauacuuu

SEQ ID NO: 1657102 - RNA, 15 nt, Homo sapiens
augcacuauauacau

SEQ ID NO: 1657103 - RNA, 18 nt, Homo sapiens
augcacugacccuuccag

SEQ ID NO: 1657104 - RNA, 21 nt, Homo sapiens
augcagauggcagugcagcaa

SEQ ID NO: 1657105 - RNA, 19 nt, Homo sapiens
augcagcaaauaugggcug

SEQ ID NO: 1657106 - RNA, 18 nt, Homo sapiens
augcagugucagcuccuc

SEQ ID NO: 1657107 - RNA, 13 nt, Homo sapiens
augcaugagcacc

SEQ ID NO: 1657108 - RNA, 16 nt, Homo sapiens
augcaugagcucccuc

SEQ ID NO: 1657109 - RNA, 17 nt, Homo sapiens
augccaauuucucuuaa

SEQ ID NO: 1657110 - RNA, 15 nt, Homo sapiens
augccaccacccacc

SEQ ID NO: 1657111 - RNA, 21 nt, Homo sapiens
augcccagcuuggagugccac

SEQ ID NO: 1657112 - RNA, 10 nt, Homo sapiens
augcccuccc

SEQ ID NO: 1657113 - RNA, 19 nt, Homo sapiens
augccgggcacaggccagg

SEQ ID NO: 1657114 - RNA, 15 nt, Homo sapiens
augccucucucaggc

SEQ ID NO: 1657115 - RNA, 19 nt, Homo sapiens
augccucucucaggccaaa

SEQ ID NO: 1657116 - RNA, 23 nt, Homo sapiens
augccuuguugaugaagcacauu

SEQ ID NO: 1657117 - RNA, 15 nt, Homo sapiens
augcgucuacccaga

SEQ ID NO: 1657118 - RNA, 18 nt, Homo sapiens
augcucaguuggugcugc

SEQ ID NO: 1657119 - RNA, 19 nt, Homo sapiens
augcucaguuggugcugcu

SEQ ID NO: 1657120 - RNA, 22 nt, Homo sapiens
augcucaguuggugcugcuuuc

SEQ ID NO: 1657121 - RNA, 23 nt, Homo sapiens
augcugggccgggguguggaauc

SEQ ID NO: 1657122 - RNA, 15 nt, Homo sapiens
augcugucccuuacg

SEQ ID NO: 1657123 - RNA, 16 nt, Homo sapiens
augcugugcagcacuu

SEQ ID NO: 1657124 - RNA, 14 nt, Homo sapiens
augcuuaaaugauc

SEQ ID NO: 1657125 - RNA, 20 nt, Homo sapiens
augcuugcuucaaccccaug

SEQ ID NO: 1657126 - RNA, 23 nt, Homo sapiens
augcuugcuucaaccccaugaga

SEQ ID NO: 1657127 - RNA, 23 nt, Homo sapiens
auggaaagguccugcuguggaaa

SEQ ID NO: 1657128 - RNA, 20 nt, Homo sapiens
auggaaauccuguuacuuaa

SEQ ID NO: 1657129 - RNA, 20 nt, Homo sapiens
auggaauccuucccugguga

SEQ ID NO: 1657130 - RNA, 15 nt, Homo sapiens
auggacaaugaccca

SEQ ID NO: 1657131 - RNA, 21 nt, Homo sapiens
auggacauauucuuuuuggaa

SEQ ID NO: 1657132 - RNA, 12 nt, Homo sapiens
auggaccacuga

SEQ ID NO: 1657133 - RNA, 15 nt, Homo sapiens
auggaccacugagag

SEQ ID NO: 1657134 - RNA, 15 nt, Homo sapiens
auggacugcacaaaa

SEQ ID NO: 1657135 - RNA, 17 nt, Homo sapiens
auggagaaccaccauuc

SEQ ID NO: 1657136 - RNA, 18 nt, Homo sapiens
auggagugcaguggcuca

SEQ ID NO: 1657137 - RNA, 13 nt, Homo sapiens
auggauucacuuc

SEQ ID NO: 1657138 - RNA, 15 nt, Homo sapiens
auggauucacuucua

SEQ ID NO: 1657139 - RNA, 22 nt, Homo sapiens
aucacugcaccucuuugucaca

SEQ ID NO: 1657140 - RNA, 14 nt, Homo sapiens
aucagaauguuuca

SEQ ID NO: 1657141 - RNA, 22 nt, Homo sapiens
aucagaggugaaugcacaguga

SEQ ID NO: 1657142 - RNA, 14 nt, Homo sapiens
aucagaguauguca

SEQ ID NO: 1657143 - RNA, 14 nt, Homo sapiens
aucagcacugaaaa

SEQ ID NO: 1657144 - RNA, 21 nt, Homo sapiens
aucagggggcaugaagcacau

SEQ ID NO: 1657145 - RNA, 22 nt, Homo sapiens
aucagggggcaugaagcacauu

SEQ ID NO: 1657146 - RNA, 22 nt, Homo sapiens
aucaguccucgcggcucuccag

SEQ ID NO: 1657147 - RNA, 20 nt, Homo sapiens
aucaguuugcuaauguuucc

SEQ ID NO: 1657148 - RNA, 14 nt, Homo sapiens
aucauaugggauac

SEQ ID NO: 1657149 - RNA, 19 nt, Homo sapiens
aucauauuuaccugugaau

SEQ ID NO: 1657150 - RNA, 14 nt, Homo sapiens
aucaucucagcuca

SEQ ID NO: 1657151 - RNA, 20 nt, Homo sapiens
aucaucuccaaaucuugcca

SEQ ID NO: 1657152 - RNA, 17 nt, Homo sapiens
aucaugcaugcacucuu

SEQ ID NO: 1657153 - RNA, 19 nt, Homo sapiens
auccaaauucucugagaug

SEQ ID NO: 1657154 - RNA, 22 nt, Homo sapiens
auccaacuauuucuuucaucag

SEQ ID NO: 1657155 - RNA, 19 nt, Homo sapiens
auccaccaccuugccaaug

SEQ ID NO: 1657156 - RNA, 20 nt, Homo sapiens
auccacuacauucugaaggc

SEQ ID NO: 1657157 - RNA, 15 nt, Homo sapiens
auccacuucacaguu

SEQ ID NO: 1657158 - RNA, 18 nt, Homo sapiens
auccauagacacaguauu

SEQ ID NO: 1657159 - RNA, 15 nt, Homo sapiens
auccauaucagcucu

SEQ ID NO: 1657160 - RNA, 22 nt, Homo sapiens
auccaucauacauuagugccau

SEQ ID NO: 1657161 - RNA, 14 nt, Homo sapiens
auccaugugcugcu

SEQ ID NO: 1657162 - RNA, 18 nt, Homo sapiens
aucccauaugccugggca

SEQ ID NO: 1657163 - RNA, 13 nt, Homo sapiens
auccccagugcca

SEQ ID NO: 1657164 - RNA, 18 nt, Homo sapiens
aucccucggucagcaccg

SEQ ID NO: 1657165 - RNA, 12 nt, Homo sapiens
aucccuguucau

SEQ ID NO: 1657166 - RNA, 17 nt, Homo sapiens
aucccuucucacagcac

SEQ ID NO: 1657167 - RNA, 13 nt, Homo sapiens
auccuagcacuuu

SEQ ID NO: 1657168 - RNA, 14 nt, Homo sapiens
auccuggaguucug

SEQ ID NO: 1657169 - RNA, 15 nt, Homo sapiens
auccuucaucuggau

SEQ ID NO: 1657170 - RNA, 18 nt, Homo sapiens
auccuucccgcagcacca

SEQ ID NO: 1657171 - RNA, 21 nt, Homo sapiens
auccuuuauuuuaaaugaucu

SEQ ID NO: 1657172 - RNA, 21 nt, Homo sapiens
auccuuuuuuccuuuccugau

SEQ ID NO: 1657173 - RNA, 14 nt, Homo sapiens
aucgaaaguaaaaa

SEQ ID NO: 1657174 - RNA, 15 nt, Homo sapiens
aucgaaaguaaaaaa

SEQ ID NO: 1657175 - RNA, 22 nt, Homo sapiens
aucgaucuggaaagagcuguuu

SEQ ID NO: 1657176 - RNA, 19 nt, Homo sapiens
aucgcuuucuacacuguau

SEQ ID NO: 1657177 - RNA, 13 nt, Homo sapiens
aucuaaaucuuca

SEQ ID NO: 1657178 - RNA, 15 nt, Homo sapiens
cuaugugagcacaaa

SEQ ID NO: 1657179 - RNA, 19 nt, Homo sapiens
cuaugugccuuucacuuua

SEQ ID NO: 1657180 - RNA, 14 nt, Homo sapiens
cuauuaacucugca

SEQ ID NO: 1657181 - RNA, 19 nt, Homo sapiens
cuauucccuggggcugcug

SEQ ID NO: 1657182 - RNA, 16 nt, Homo sapiens
cuauuuaaguggacug

SEQ ID NO: 1657183 - RNA, 16 nt, Homo sapiens
cuauuuuaguuaacua

SEQ ID NO: 1657184 - RNA, 20 nt, Homo sapiens
cuauuuuaguuaacuaugau

SEQ ID NO: 1657185 - RNA, 20 nt, Homo sapiens
cucaaaaaucaucaaagugu

SEQ ID NO: 1657186 - RNA, 16 nt, Homo sapiens
cucaaaacaggccuga

SEQ ID NO: 1657187 - RNA, 18 nt, Homo sapiens
cucaacccugugaucuau

SEQ ID NO: 1657188 - RNA, 13 nt, Homo sapiens
cucaagacuggca

SEQ ID NO: 1657189 - RNA, 15 nt, Homo sapiens
cucaagauccugucu

SEQ ID NO: 1657190 - RNA, 17 nt, Homo sapiens
cucaagauuguagaaac

SEQ ID NO: 1657191 - RNA, 21 nt, Homo sapiens
guauauuucuaguauggcaca

SEQ ID NO: 1657192 - RNA, 20 nt, Homo sapiens
guaucaugcuucuacuccau

SEQ ID NO: 1657193 - RNA, 11 nt, Homo sapiens
guauggugcug

SEQ ID NO: 1657194 - RNA, 13 nt, Homo sapiens
guauuacuuccuc

SEQ ID NO: 1657195 - RNA, 15 nt, Homo sapiens
guauuuucacuggag

SEQ ID NO: 1657196 - RNA, 14 nt, Homo sapiens
guauuuuucuuugu

SEQ ID NO: 1657197 - RNA, 16 nt, Homo sapiens
gucaaucaagaugggu

SEQ ID NO: 1657198 - RNA, 21 nt, Homo sapiens
gucacaauaaaagaaacugug

SEQ ID NO: 1657199 - RNA, 18 nt, Homo sapiens
gucacagagagacacggg

SEQ ID NO: 1657200 - RNA, 14 nt, Homo sapiens
gucaccaugaucac

SEQ ID NO: 1657201 - RNA, 11 nt, Homo sapiens
gucaccuuccu

SEQ ID NO: 1657202 - RNA, 17 nt, Homo sapiens
gucacgugacccugugc

SEQ ID NO: 1657203 - RNA, 22 nt, Homo sapiens
gucagcacauguugcuaaugac

SEQ ID NO: 1657204 - RNA, 19 nt, Homo sapiens
gucagcagggccacugagu

SEQ ID NO: 1657205 - RNA, 21 nt, Homo sapiens
gucaggcucugaaucucucaa

SEQ ID NO: 1657206 - RNA, 23 nt, Homo sapiens
gucaguugcaaauuuuagcguua

SEQ ID NO: 1657207 - RNA, 14 nt, Homo sapiens
gucaugacuuucag

SEQ ID NO: 1657208 - RNA, 17 nt, Homo sapiens
gucauucucauccaaaa

SEQ ID NO: 1657209 - RNA, 19 nt, Homo sapiens
guccaaacuuaacagauca

SEQ ID NO: 1657210 - RNA, 15 nt, Homo sapiens
guccaagaagccagc

SEQ ID NO: 1657211 - RNA, 10 nt, Homo sapiens
guccacaggg

SEQ ID NO: 1657212 - RNA, 22 nt, Homo sapiens
guccacccccauugugaauguu

SEQ ID NO: 1657213 - RNA, 16 nt, Homo sapiens
guccagcaagugucau

SEQ ID NO: 1657214 - RNA, 22 nt, Homo sapiens
guccaggagaugaggcuggaua

SEQ ID NO: 1657215 - RNA, 18 nt, Homo sapiens
gucccgggcacugucaug

SEQ ID NO: 1657216 - RNA, 13 nt, Homo sapiens
gucccugcagggc

SEQ ID NO: 1657217 - RNA, 12 nt, Homo sapiens
guccucagucca

SEQ ID NO: 1657218 - RNA, 16 nt, Homo sapiens
guccucucagaacucc

SEQ ID NO: 1657219 - RNA, 15 nt, Homo sapiens
guccugaggccaaga

SEQ ID NO: 1657220 - RNA, 14 nt, Homo sapiens
guccugcacugucc

SEQ ID NO: 1657221 - RNA, 14 nt, Homo sapiens
guccuggggugguu

SEQ ID NO: 1657222 - RNA, 19 nt, Homo sapiens
guccugggugcugucaugc

SEQ ID NO: 1657223 - RNA, 20 nt, Homo sapiens
guccuuuaaaaaaaucccau

SEQ ID NO: 1657224 - RNA, 15 nt, Homo sapiens
guccuuucccaccca

SEQ ID NO: 1657225 - RNA, 13 nt, Homo sapiens
gucgcuuugccau

SEQ ID NO: 1657226 - RNA, 19 nt, Homo sapiens
gucuaaaaaugauucucua

SEQ ID NO: 1657227 - RNA, 11 nt, Homo sapiens
gucuacacugc

SEQ ID NO: 1657228 - RNA, 12 nt, Homo sapiens
gucuacacugcc

SEQ ID NO: 1657229 - RNA, 13 nt, Homo sapiens
gucuacacugccu

SEQ ID NO: 1657230 - RNA, 22 nt, Homo sapiens
gucuauaacuccuuguuucaga

SEQ ID NO: 1657231 - RNA, 14 nt, Homo sapiens
gucucacgauucca

SEQ ID NO: 1657232 - RNA, 21 nt, Homo sapiens
gucuccuaagcuggagugcag

SEQ ID NO: 1657233 - RNA, 16 nt, Homo sapiens
gucuccucugcagcuc

SEQ ID NO: 1657234 - RNA, 18 nt, Homo sapiens
gucucucuaaacccaaau

SEQ ID NO: 1657235 - RNA, 20 nt, Homo sapiens
gucucucuaaacccaaauaa

SEQ ID NO: 1657236 - RNA, 17 nt, Homo sapiens
gucugaaaaaguguuuu

SEQ ID NO: 1657237 - RNA, 23 nt, Homo sapiens
gucugaggauaccuuccaucuca

SEQ ID NO: 1657238 - RNA, 20 nt, Homo sapiens
gucuggggcagcagagccau

SEQ ID NO: 1657239 - RNA, 14 nt, Homo sapiens
gucugucaccagcu

SEQ ID NO: 1657240 - RNA, 22 nt, Homo sapiens
gucugugaaagucuccuguauc

SEQ ID NO: 1657241 - RNA, 22 nt, Homo sapiens
gucuguugaagugcauguuaaa

SEQ ID NO: 1657242 - RNA, 15 nt, Homo sapiens
gucuuaaucauuugu

SEQ ID NO: 1657243 - RNA, 16 nt, Homo sapiens
gucuuacuguugcaua

SEQ ID NO: 1657244 - RNA, 15 nt, Homo sapiens
gucuucccugcuuca

SEQ ID NO: 1657245 - RNA, 19 nt, Homo sapiens
gucuucguagguugugaug

SEQ ID NO: 1657246 - RNA, 20 nt, Homo sapiens
gucuugauccucacugagaa

SEQ ID NO: 1657247 - RNA, 16 nt, Homo sapiens
gucuuuguacagacaa

SEQ ID NO: 1657248 - RNA, 20 nt, Homo sapiens
gugaaagucuccuguaucau

SEQ ID NO: 1657249 - RNA, 13 nt, Homo sapiens
gugaagauuucau

SEQ ID NO: 1657250 - RNA, 22 nt, Homo sapiens
gugaagauuucauggacacuga

SEQ ID NO: 1657251 - RNA, 23 nt, Homo sapiens
gugaagcugggagaaccaaaaag

SEQ ID NO: 1657252 - RNA, 17 nt, Homo sapiens
uacucaggcagugcaau

SEQ ID NO: 1657253 - RNA, 21 nt, Homo sapiens
uacucaguaacacagugcagu

SEQ ID NO: 1657254 - RNA, 22 nt, Homo sapiens
uacucaguaacacagugcagua

SEQ ID NO: 1657255 - RNA, 20 nt, Homo sapiens
uacucaguaacagugcagua

SEQ ID NO: 1657256 - RNA, 22 nt, Homo sapiens
uacucaguuaggcagugcagua

SEQ ID NO: 1657257 - RNA, 15 nt, Homo sapiens
uacugagauagcuua

SEQ ID NO: 1657258 - RNA, 14 nt, Homo sapiens
uacugauuaacuca

SEQ ID NO: 1657259 - RNA, 20 nt, Homo sapiens
uacuggauuuaacuaccuuu

SEQ ID NO: 1657260 - RNA, 19 nt, Homo sapiens
uacuucuacauccaaugua

SEQ ID NO: 1657261 - RNA, 21 nt, Homo sapiens
uacuucuucauccauagacac

SEQ ID NO: 1657262 - RNA, 23 nt, Homo sapiens
uacuucuugugcuuuacucugaa

SEQ ID NO: 1657263 - RNA, 18 nt, Homo sapiens
uacuugaaaacuucucau

SEQ ID NO: 1657264 - RNA, 23 nt, Homo sapiens
uacuuuaauucuuuucccagaag

SEQ ID NO: 1657265 - RNA, 16 nt, Homo sapiens
uacuuuagacuaaaga

SEQ ID NO: 1657266 - RNA, 21 nt, Homo sapiens
uacuuuguuauuguaccuaag

SEQ ID NO: 1657267 - RNA, 12 nt, Homo sapiens
uagaaaaccaua

SEQ ID NO: 1657268 - RNA, 15 nt, Homo sapiens
uagaaacaugacacu

SEQ ID NO: 1657269 - RNA, 13 nt, Homo sapiens
uagaauacuguau

SEQ ID NO: 1657270 - RNA, 14 nt, Homo sapiens
uagaauacuguauu

SEQ ID NO: 1657271 - RNA, 19 nt, Homo sapiens
uagaaucaagucugugaaa

SEQ ID NO: 1657272 - RNA, 16 nt, Homo sapiens
uagaauggaccacuga

SEQ ID NO: 1657273 - RNA, 17 nt, Homo sapiens
uagaauggggcuuccau

SEQ ID NO: 1657274 - RNA, 16 nt, Homo sapiens
uagacaaagagccaga

SEQ ID NO: 1657275 - RNA, 22 nt, Homo sapiens
uagacaaaggccuuaacaaacg

SEQ ID NO: 1657276 - RNA, 22 nt, Homo sapiens
uagacaugcacacccauucaca

SEQ ID NO: 1657277 - RNA, 21 nt, Homo sapiens
uagacgagcaggcuucuuccc

SEQ ID NO: 1657278 - RNA, 13 nt, Homo sapiens
uagacuagucuca

SEQ ID NO: 1657279 - RNA, 19 nt, Homo sapiens
uagacucaaagaaguacug

SEQ ID NO: 1657280 - RNA, 19 nt, Homo sapiens
uagacuguuagacaaaagu

SEQ ID NO: 1657281 - RNA, 14 nt, Homo sapiens
uagagaagccauaa

SEQ ID NO: 1657282 - RNA, 24 nt, Homo sapiens
uagagacuucuaaaucauaaucau

SEQ ID NO: 1657283 - RNA, 12 nt, Homo sapiens
uagagaggacag

SEQ ID NO: 1657284 - RNA, 15 nt, Homo sapiens
uagagcuagaugugu

SEQ ID NO: 1657285 - RNA, 18 nt, Homo sapiens
uagaggcuugaucaugaa

SEQ ID NO: 1657286 - RNA, 23 nt, Homo sapiens
uagauggggagaaaacacaguug

SEQ ID NO: 1657287 - RNA, 16 nt, Homo sapiens
uagaugugucuuacca

SEQ ID NO: 1657288 - RNA, 17 nt, Homo sapiens
uagauuuccacacgcca

SEQ ID NO: 1657289 - RNA, 18 nt, Homo sapiens
uagcaaauuccaauacau

SEQ ID NO: 1657290 - RNA, 15 nt, Homo sapiens
uagcacaguauuuaa

SEQ ID NO: 1657291 - RNA, 12 nt, Homo sapiens
uagcacuuuaua

SEQ ID NO: 1657292 - RNA, 23 nt, Homo sapiens
uagcagcuuuagccaagugcagg

SEQ ID NO: 1657293 - RNA, 13 nt, Homo sapiens
uagcauauauaau

SEQ ID NO: 1657294 - RNA, 15 nt, Homo sapiens
uagcauggcugccaa

SEQ ID NO: 1657295 - RNA, 16 nt, Homo sapiens
uagcauugggaggaag

SEQ ID NO: 1657296 - RNA, 21 nt, Homo sapiens
uagcauugggaggaagcacag

SEQ ID NO: 1657297 - RNA, 21 nt, Homo sapiens
uagcauugggaggaagcucag

SEQ ID NO: 1657298 - RNA, 14 nt, Homo sapiens
uagccuggucugug

SEQ ID NO: 1657299 - RNA, 15 nt, Homo sapiens
uagcgcccaagcuca

SEQ ID NO: 1657300 - RNA, 13 nt, Homo sapiens
uagcuaaguagca

SEQ ID NO: 1657301 - RNA, 17 nt, Homo sapiens
uagcuaauuuaggaguu

SEQ ID NO: 1657302 - RNA, 13 nt, Homo sapiens
uagcugagcacag

SEQ ID NO: 1657303 - RNA, 22 nt, Homo sapiens
uagcugagcacagcaagggagg

SEQ ID NO: 1657304 - RNA, 16 nt, Homo sapiens
uagcuuacugauuaac

SEQ ID NO: 1657305 - RNA, 16 nt, Homo sapiens
uagcuugcaguuucau

SEQ ID NO: 1657306 - RNA, 20 nt, Homo sapiens
uagcuuggagggauggagag

SEQ ID NO: 1657307 - RNA, 14 nt, Homo sapiens
uagcuuuuauucau

SEQ ID NO: 1657308 - RNA, 13 nt, Homo sapiens
uaggagcuuccag

SEQ ID NO: 1657309 - RNA, 16 nt, Homo sapiens
uaggaucuucacuguc

SEQ ID NO: 1657310 - RNA, 13 nt, Homo sapiens
uaggcagugcagu

SEQ ID NO: 1657311 - RNA, 15 nt, Homo sapiens
uaggcagugcaguac

SEQ ID NO: 1657312 - RNA, 20 nt, Homo sapiens
ugacgagcaugagcuggaug

SEQ ID NO: 1657313 - RNA, 14 nt, Homo sapiens
ugacgcaaaaccac

SEQ ID NO: 1657314 - RNA, 21 nt, Homo sapiens
ugacgcucaguaaccaugcaa

SEQ ID NO: 1657315 - RNA, 21 nt, Homo sapiens
ugacggcccugcaauguaucc

SEQ ID NO: 1657316 - RNA, 18 nt, Homo sapiens
ugacucagugcagggaca

SEQ ID NO: 1657317 - RNA, 19 nt, Homo sapiens
ugacucuuuauugucugua

SEQ ID NO: 1657318 - RNA, 12 nt, Homo sapiens
ugacugguggaa

SEQ ID NO: 1657319 - RNA, 16 nt, Homo sapiens
ugacuuaagcacacuu

SEQ ID NO: 1657320 - RNA, 21 nt, Homo sapiens
ugacuuccccuuaaguauaac

SEQ ID NO: 1657321 - RNA, 17 nt, Homo sapiens
ugacuucuuuuuggcau

SEQ ID NO: 1657322 - RNA, 17 nt, Homo sapiens
ugacuugccacugccau

SEQ ID NO: 1657323 - RNA, 21 nt, Homo sapiens
ugacuuuccuaugacacucau

SEQ ID NO: 1657324 - RNA, 16 nt, Homo sapiens
ugagaaaacaggcuca

SEQ ID NO: 1657325 - RNA, 17 nt, Homo sapiens
ugagaaacuuccuuuga

SEQ ID NO: 1657326 - RNA, 23 nt, Homo sapiens
ugagaaauuuuuuuccagaauug

SEQ ID NO: 1657327 - RNA, 18 nt, Homo sapiens
ugagaaccaaccaaguaa

SEQ ID NO: 1657328 - RNA, 18 nt, Homo sapiens
ugagaaccaaccaaugaa

SEQ ID NO: 1657329 - RNA, 19 nt, Homo sapiens
ugagaaccaaccaaugaaa

SEQ ID NO: 1657330 - RNA, 12 nt, Homo sapiens
ugagaacuguga

SEQ ID NO: 1657331 - RNA, 23 nt, Homo sapiens
ugagaagauaaaaacugcccauu

SEQ ID NO: 1657332 - RNA, 23 nt, Homo sapiens
ugagaagauucaauuuaaaauca

SEQ ID NO: 1657333 - RNA, 17 nt, Homo sapiens
ugagaagugcaacugcu

SEQ ID NO: 1657334 - RNA, 21 nt, Homo sapiens
ugagaaucgaccucacuguca

SEQ ID NO: 1657335 - RNA, 22 nt, Homo sapiens
ugagaaucugugcagucaucaa

SEQ ID NO: 1657336 - RNA, 20 nt, Homo sapiens
ugagacagagucuugcucug

SEQ ID NO: 1657337 - RNA, 21 nt, Homo sapiens
ugagacgcaaggaucacuuga

SEQ ID NO: 1657338 - RNA, 19 nt, Homo sapiens
ugagagggcugcugaccau

SEQ ID NO: 1657339 - RNA, 21 nt, Homo sapiens
ugagauaacauuuccaaagcu

SEQ ID NO: 1657340 - RNA, 22 nt, Homo sapiens
ugagauaacauuuccaaagcuu

SEQ ID NO: 1657341 - RNA, 15 nt, Homo sapiens
ugagauccucaaaaa

SEQ ID NO: 1657342 - RNA, 20 nt, Homo sapiens
ugagauccucaaaaaucauc

SEQ ID NO: 1657343 - RNA, 20 nt, Homo sapiens
ugagaugauuuccaagccuc

SEQ ID NO: 1657344 - RNA, 14 nt, Homo sapiens
ugagauguguauca

SEQ ID NO: 1657345 - RNA, 22 nt, Homo sapiens
ugagcaauccugcaagaacaag

SEQ ID NO: 1657346 - RNA, 19 nt, Homo sapiens
ugagcacaaagguagcuuu

SEQ ID NO: 1657347 - RNA, 22 nt, Homo sapiens
ugagcagaacccagacccugag

SEQ ID NO: 1657348 - RNA, 23 nt, Homo sapiens
ugagcaugcucccucaugcagau

SEQ ID NO: 1657349 - RNA, 12 nt, Homo sapiens
ugagccaaagag

SEQ ID NO: 1657350 - RNA, 23 nt, Homo sapiens
ugagcccuggacucaucuuggga

SEQ ID NO: 1657351 - RNA, 21 nt, Homo sapiens
ugagccuggcccauagaaaca

SEQ ID NO: 1657352 - RNA, 23 nt, Homo sapiens
ugagcgaugggcaucacacccuc

SEQ ID NO: 1657353 - RNA, 16 nt, Homo sapiens
ugagcguccaggugau

SEQ ID NO: 1657354 - RNA, 15 nt, Homo sapiens
ugagcuaccaggaag

SEQ ID NO: 1657355 - RNA, 14 nt, Homo sapiens
ugagcucaaaguac

SEQ ID NO: 1657356 - RNA, 19 nt, Homo sapiens
ugagcucccucgcuguaug

SEQ ID NO: 1657357 - RNA, 17 nt, Homo sapiens
ugagcugacccaacacu

SEQ ID NO: 1657358 - RNA, 19 nt, Homo sapiens
ugagcugacccaacacuua

SEQ ID NO: 1657359 - RNA, 17 nt, Homo sapiens
ugaggaaacugcacugu

SEQ ID NO: 1657360 - RNA, 18 nt, Homo sapiens
ugaggaccaggugucucu

SEQ ID NO: 1657361 - RNA, 17 nt, Homo sapiens
ugaggagugaugggcaa

SEQ ID NO: 1657362 - RNA, 23 nt, Homo sapiens
ugaggaugaaaaaauaacacugu

SEQ ID NO: 1657363 - RNA, 19 nt, Homo sapiens
ugaggcagggcaaaugaca

SEQ ID NO: 1657364 - RNA, 13 nt, Homo sapiens
ugaggccaagaaa

SEQ ID NO: 1657365 - RNA, 22 nt, Homo sapiens
ugaggccaagaguuugagacca

SEQ ID NO: 1657366 - RNA, 16 nt, Homo sapiens
ugaggcgugggaucca

SEQ ID NO: 1657367 - RNA, 13 nt, Homo sapiens
ugagggacugccu

SEQ ID NO: 1657368 - RNA, 14 nt, Homo sapiens
ugagggacugccuc

SEQ ID NO: 1657369 - RNA, 13 nt, Homo sapiens
ugagggcccuucc

SEQ ID NO: 1657370 - RNA, 21 nt, Homo sapiens
ugaggguccucaguccacugc

SEQ ID NO: 1657371 - RNA, 15 nt, Homo sapiens
ugagguuaaggggau

SEQ ID NO: 1657372 - RNA, 24 nt, Homo sapiens
ugagguuaaggggaucuaaaagga

SEQ ID NO: 1657373 - RNA, 13 nt, Homo sapiens
uuggguuccagac

SEQ ID NO: 1657374 - RNA, 12 nt, Homo sapiens
uugguacccugg

SEQ ID NO: 1657375 - RNA, 17 nt, Homo sapiens
uuggucacaaagcuauu

SEQ ID NO: 1657376 - RNA, 23 nt, Homo sapiens
uugguggcagaguggauucuuga

SEQ ID NO: 1657377 - RNA, 15 nt, Homo sapiens
uuggugguuaugucc

SEQ ID NO: 1657378 - RNA, 22 nt, Homo sapiens
uuggugguuaugucccaugacc

SEQ ID NO: 1657379 - RNA, 15 nt, Homo sapiens
uuguaaaacugugac

SEQ ID NO: 1657380 - RNA, 18 nt, Homo sapiens
uuguaaaccggcuggacc

SEQ ID NO: 1657381 - RNA, 18 nt, Homo sapiens
uuguacaauuacugugag

SEQ ID NO: 1657382 - RNA, 17 nt, Homo sapiens
uuguacccauugucauc

SEQ ID NO: 1657383 - RNA, 18 nt, Homo sapiens
uuguauuuuaauaaagau

SEQ ID NO: 1657384 - RNA, 14 nt, Homo sapiens
uugucaccaugauc

SEQ ID NO: 1657385 - RNA, 22 nt, Homo sapiens
uugucauguggcuaaaugccua

SEQ ID NO: 1657386 - RNA, 13 nt, Homo sapiens
uugucugagacag

SEQ ID NO: 1657387 - RNA, 15 nt, Homo sapiens
uugucugagacagaa

SEQ ID NO: 1657388 - RNA, 17 nt, Homo sapiens
uugucugagucuugggu

SEQ ID NO: 1657389 - RNA, 16 nt, Homo sapiens
uugucuuacuguugca

SEQ ID NO: 1657390 - RNA, 14 nt, Homo sapiens
uugugaagauuuca

SEQ ID NO: 1657391 - RNA, 21 nt, Homo sapiens
uugugaaugugucccaugcau

SEQ ID NO: 1657392 - RNA, 20 nt, Homo sapiens
uugugaugauagcacugguu

SEQ ID NO: 1657393 - RNA, 13 nt, Homo sapiens
uugugcacuggau

SEQ ID NO: 1657394 - RNA, 20 nt, Homo sapiens
uugugcugugggcagcaccc

SEQ ID NO: 1657395 - RNA, 23 nt, Homo sapiens
uuguguggagaaguguguucuga

SEQ ID NO: 1657396 - RNA, 23 nt, Homo sapiens
uuguuaugugaauugagcacaua

SEQ ID NO: 1657397 - RNA, 18 nt, Homo sapiens
uuguucuucaaugugaaa

SEQ ID NO: 1657398 - RNA, 20 nt, Homo sapiens
uuguucuuguaaaacuguga

SEQ ID NO: 1657399 - RNA, 15 nt, Homo sapiens
uuguugcaguucaga

SEQ ID NO: 1657400 - RNA, 19 nt, Homo sapiens
uuuaaaaaaaauauucugu

SEQ ID NO: 1657401 - RNA, 20 nt, Homo sapiens
uuuaaaacuaguuagauuca

SEQ ID NO: 1657402 - RNA, 22 nt, Homo sapiens
uuuaaacaaaauuuaugucauu

SEQ ID NO: 1657403 - RNA, 13 nt, Homo sapiens
uuuaaaugauuua

SEQ ID NO: 1657404 - RNA, 17 nt, Homo sapiens
uuuaacuuuaccaugcu

SEQ ID NO: 1657405 - RNA, 18 nt, Homo sapiens
uuuaagagaaaugagcug

SEQ ID NO: 1657406 - RNA, 11 nt, Homo sapiens
uuuaagccagg

SEQ ID NO: 1657407 - RNA, 13 nt, Homo sapiens
uuuaaucauuucc

SEQ ID NO: 1657408 - RNA, 15 nt, Homo sapiens
uuuaauuugcaucac

SEQ ID NO: 1657409 - RNA, 20 nt, Homo sapiens
uuuacagacaauaaaaugga

SEQ ID NO: 1657410 - RNA, 14 nt, Homo sapiens
uuuacagugccacg

SEQ ID NO: 1657411 - RNA, 13 nt, Homo sapiens
uuuacauucuugc

SEQ ID NO: 1657412 - RNA, 18 nt, Homo sapiens
uuuacccaaugcaguuug

SEQ ID NO: 1657413 - RNA, 23 nt, Homo sapiens
uuuagaacauggacuacacacaa

SEQ ID NO: 1657414 - RNA, 20 nt, Homo sapiens
uuuagaaucaagucugugaa

SEQ ID NO: 1657415 - RNA, 16 nt, Homo sapiens
uuuagagaagccauaa

SEQ ID NO: 1657416 - RNA, 22 nt, Homo sapiens
uuuagaguaugcaagaagaaua

SEQ ID NO: 1657417 - RNA, 19 nt, Homo sapiens
uuuagguaaaaagcuuaaa

SEQ ID NO: 1657418 - RNA, 22 nt, Homo sapiens
uuuagguaguagaaucucagca

SEQ ID NO: 1657419 - RNA, 18 nt, Homo sapiens
uuuaguaaccguccagca

SEQ ID NO: 1657420 - RNA, 12 nt, Homo sapiens
uuuaguccucac

SEQ ID NO: 1657421 - RNA, 22 nt, Homo sapiens
uuuauaauuuuaaaauugcagc

SEQ ID NO: 1657422 - RNA, 12 nt, Homo sapiens
uuuaucuauggg

SEQ ID NO: 1657423 - RNA, 18 nt, Homo sapiens
uuuauuuccaauguuuca

SEQ ID NO: 1657424 - RNA, 20 nt, Homo sapiens
uuucaaagaaaaggugucau

SEQ ID NO: 1657425 - RNA, 16 nt, Homo sapiens
uuucaaugcugacugg

SEQ ID NO: 1657426 - RNA, 18 nt, Homo sapiens
uuucacuggggaagccag

SEQ ID NO: 1657427 - RNA, 18 nt, Homo sapiens
uuucacuuaaaaguauca

SEQ ID NO: 1657428 - RNA, 22 nt, Homo sapiens
uuucacuuaaacuuugucacuu

SEQ ID NO: 1657429 - RNA, 20 nt, Homo sapiens
uuucauccaggcucccaaaa

SEQ ID NO: 1657430 - RNA, 20 nt, Homo sapiens
uuucauggacacugaucacu

SEQ ID NO: 1657431 - RNA, 14 nt, Homo sapiens
uuuccaacacacaa

SEQ ID NO: 1657432 - RNA, 17 nt, Homo sapiens
uuuccaagggucuuccu

SEQ ID NO: 1657433 - RNA, 22 nt, Homo sapiens
uuuccaagggucuuccuccuaa

SEQ ID NO: 1657434 - RNA, 21 nt, Homo sapiens
ugcucaguaaggcagugcaau

SEQ ID NO: 1657435 - RNA, 24 nt, Homo sapiens
ugcucaguggaucacacacaugga

SEQ ID NO: 1657436 - RNA, 20 nt, Homo sapiens
ugcuccaguauaaauuacau

SEQ ID NO: 1657437 - RNA, 11 nt, Homo sapiens
ugcugcacugc

SEQ ID NO: 1657438 - RNA, 13 nt, Homo sapiens
ugcugcaucuccc

SEQ ID NO: 1657439 - RNA, 21 nt, Homo sapiens
ugcugcaucuccccucagauu

SEQ ID NO: 1657440 - RNA, 21 nt, Homo sapiens
ugcugccaggcucccacugcc

SEQ ID NO: 1657441 - RNA, 22 nt, Homo sapiens
ugcuguccagggcagaggccau

SEQ ID NO: 1657442 - RNA, 19 nt, Homo sapiens
ugcuguuagauguccucag

SEQ ID NO: 1657443 - RNA, 22 nt, Homo sapiens
ugcuucuccagccucagccucc

SEQ ID NO: 1657444 - RNA, 22 nt, Homo sapiens
ugcuucucuaaaacagcacuau

SEQ ID NO: 1657445 - RNA, 17 nt, Homo sapiens
ugcuucuuuccucuuaa

SEQ ID NO: 1657446 - RNA, 15 nt, Homo sapiens
ugcuuucuaucuaau

SEQ ID NO: 1657447 - RNA, 17 nt, Homo sapiens
ugcuuucucaugcauag

SEQ ID NO: 1657448 - RNA, 14 nt, Homo sapiens
ugcuuuuuccuuag

SEQ ID NO: 1657449 - RNA, 14 nt, Homo sapiens
uggaaaacuguuaa

SEQ ID NO: 1657450 - RNA, 18 nt, Homo sapiens
uggaaauccuguuacuua

SEQ ID NO: 1657451 - RNA, 18 nt, Homo sapiens
uggaaaugaauccaucau

SEQ ID NO: 1657452 - RNA, 16 nt, Homo sapiens
uggaaauuauguggaa

SEQ ID NO: 1657453 - RNA, 22 nt, Homo sapiens
uggaaccaacgaucauaucugu

SEQ ID NO: 1657454 - RNA, 14 nt, Homo sapiens
uggaacguucucua

SEQ ID NO: 1657455 - RNA, 16 nt, Homo sapiens
uggaagagauaagcua

SEQ ID NO: 1657456 - RNA, 12 nt, Homo sapiens
uggaagauuucu

SEQ ID NO: 1657457 - RNA, 14 nt, Homo sapiens
uggaaguacauaaa

SEQ ID NO: 1657458 - RNA, 15 nt, Homo sapiens
uggaaucacagccaa

SEQ ID NO: 1657459 - RNA, 15 nt, Homo sapiens
uggaauuacauaaca

SEQ ID NO: 1657460 - RNA, 17 nt, Homo sapiens
uggacagcaaaaccauu

SEQ ID NO: 1657461 - RNA, 17 nt, Homo sapiens
uggacaguucacacccu

SEQ ID NO: 1657462 - RNA, 20 nt, Homo sapiens
uggacaguucacacccugca

SEQ ID NO: 1657463 - RNA, 21 nt, Homo sapiens
uggaccuucccuaccaaaggg

SEQ ID NO: 1657464 - RNA, 22 nt, Homo sapiens
uggagauaccagagacucugaa

SEQ ID NO: 1657465 - RNA, 23 nt, Homo sapiens
uggagauuaccaggcagaugaua

SEQ ID NO: 1657466 - RNA, 16 nt, Homo sapiens
uggaggaacugcuugu

SEQ ID NO: 1657467 - RNA, 22 nt, Homo sapiens
uggaggaacugcuugugcacug

SEQ ID NO: 1657468 - RNA, 19 nt, Homo sapiens
uggaggauaauugaggcua

SEQ ID NO: 1657469 - RNA, 23 nt, Homo sapiens
uggagggagaagcugucagggac

SEQ ID NO: 1657470 - RNA, 19 nt, Homo sapiens
uggagggucccuaauucuc

SEQ ID NO: 1657471 - RNA, 11 nt, Homo sapiens
uggagugcagu

SEQ ID NO: 1657472 - RNA, 17 nt, Homo sapiens
uggaucaggaacccuua

SEQ ID NO: 1657473 - RNA, 22 nt, Homo sapiens
uggauuccucuaagaucuugcc

SEQ ID NO: 1657474 - RNA, 13 nt, Homo sapiens
uggcaaacauuua

SEQ ID NO: 1657475 - RNA, 19 nt, Homo sapiens
uggcaccaaagaugcagcc

SEQ ID NO: 1657476 - RNA, 20 nt, Homo sapiens
uggcagaggcagggaagcuc

SEQ ID NO: 1657477 - RNA, 17 nt, Homo sapiens
uggcagauuuucuucua

SEQ ID NO: 1657478 - RNA, 15 nt, Homo sapiens
uggcaucaucucagc

SEQ ID NO: 1657479 - RNA, 18 nt, Homo sapiens
uggcaucaucucagcuca

SEQ ID NO: 1657480 - RNA, 14 nt, Homo sapiens
uggcaucuaucugg

SEQ ID NO: 1657481 - RNA, 15 nt, Homo sapiens
uggccaaaaugcaga

SEQ ID NO: 1657482 - RNA, 16 nt, Homo sapiens
uggccaauagucauau

SEQ ID NO: 1657483 - RNA, 13 nt, Homo sapiens
uggccacucuuga

SEQ ID NO: 1657484 - RNA, 22 nt, Homo sapiens
uggccaggccucagggaccaag

SEQ ID NO: 1657485 - RNA, 20 nt, Homo sapiens
uggccaugguccccagcuga

SEQ ID NO: 1657486 - RNA, 22 nt, Homo sapiens
uggcccauagaaacaugacacu

SEQ ID NO: 1657487 - RNA, 12 nt, Homo sapiens
uggccccaguga

SEQ ID NO: 1657488 - RNA, 12 nt, Homo sapiens
uggcccuguuaa

SEQ ID NO: 1657489 - RNA, 15 nt, Homo sapiens
uggccucugugccau

SEQ ID NO: 1657490 - RNA, 15 nt, Homo sapiens
uggccuuaacuggcc

SEQ ID NO: 1657491 - RNA, 12 nt, Homo sapiens
uggccuuagccc

SEQ ID NO: 1657492 - RNA, 22 nt, Homo sapiens
uggccuugggagagaugccuuc

SEQ ID NO: 1657493 - RNA, 16 nt, Homo sapiens
uggcgcgaucucagcu

SEQ ID NO: 1657494 - RNA, 17 nt, Homo sapiens
uuauucauuagcuguga

SEQ ID NO: 1657495 - RNA, 23 nt, Homo sapiens
uuauugaauaacgcacaguauuu

SEQ ID NO: 1657496 - RNA, 14 nt, Homo sapiens
uuauugaaugugau

SEQ ID NO: 1657497 - RNA, 15 nt, Homo sapiens
uuauugaaugugauu

SEQ ID NO: 1657498 - RNA, 19 nt, Homo sapiens
uuauugcuggaaucuacua

SEQ ID NO: 1657499 - RNA, 14 nt, Homo sapiens
uuauuuauauauga

SEQ ID NO: 1657500 - RNA, 13 nt, Homo sapiens
uuauuuccaugga

SEQ ID NO: 1657501 - RNA, 15 nt, Homo sapiens
uuauuuccauggauu

SEQ ID NO: 1657502 - RNA, 17 nt, Homo sapiens
uuauuuggacagccaag

SEQ ID NO: 1657503 - RNA, 17 nt, Homo sapiens
uuauuuucuguaauucu

SEQ ID NO: 1657504 - RNA, 14 nt, Homo sapiens
uucaaaaauuucac

SEQ ID NO: 1657505 - RNA, 17 nt, Homo sapiens
uucaaacaguuccauac

SEQ ID NO: 1657506 - RNA, 20 nt, Homo sapiens
uucaaacaguuccauaccaa

SEQ ID NO: 1657507 - RNA, 14 nt, Homo sapiens
uucaaagucucaau

SEQ ID NO: 1657508 - RNA, 13 nt, Homo sapiens
uucaaagucucac

SEQ ID NO: 1657509 - RNA, 15 nt, Homo sapiens
uucaaccccaugaga

SEQ ID NO: 1657510 - RNA, 14 nt, Homo sapiens
uucaagacuuccuc

SEQ ID NO: 1657511 - RNA, 20 nt, Homo sapiens
uucaauccccauaaugcuuc

SEQ ID NO: 1657512 - RNA, 13 nt, Homo sapiens
uucaaugugaauu

SEQ ID NO: 1657513 - RNA, 15 nt, Homo sapiens
uucaauuaccaagaa

SEQ ID NO: 1657514 - RNA, 15 nt, Homo sapiens
uucaauucugugaua

SEQ ID NO: 1657515 - RNA, 14 nt, Homo sapiens
uucacacccugcaa

SEQ ID NO: 1657516 - RNA, 13 nt, Homo sapiens
uucacaucuguau

SEQ ID NO: 1657517 - RNA, 21 nt, Homo sapiens
uucacaucuguauaucagcuc

SEQ ID NO: 1657518 - RNA, 13 nt, Homo sapiens
uucacauuccuga

SEQ ID NO: 1657519 - RNA, 19 nt, Homo sapiens
uucacauucuuacuagugu

SEQ ID NO: 1657520 - RNA, 19 nt, Homo sapiens
uucacccaaaacaaaguaa

SEQ ID NO: 1657521 - RNA, 19 nt, Homo sapiens
uucaccuaacuuucauuaa

SEQ ID NO: 1657522 - RNA, 21 nt, Homo sapiens
uucaccuccauuaaccaagaa

SEQ ID NO: 1657523 - RNA, 20 nt, Homo sapiens
uucaccuguaaaacuuuauu

SEQ ID NO: 1657524 - RNA, 14 nt, Homo sapiens
uucacgcaacuuga

SEQ ID NO: 1657525 - RNA, 18 nt, Homo sapiens
uucacuggggaagccagu

SEQ ID NO: 1657526 - RNA, 15 nt, Homo sapiens
uucagaaaagcaccu

SEQ ID NO: 1657527 - RNA, 13 nt, Homo sapiens
uucagagauguac

SEQ ID NO: 1657528 - RNA, 20 nt, Homo sapiens
uucagauaaaucaugggcau

SEQ ID NO: 1657529 - RNA, 16 nt, Homo sapiens
uucagucaucaucuca

SEQ ID NO: 1657530 - RNA, 16 nt, Homo sapiens
uucauaaaaaucccuc

SEQ ID NO: 1657531 - RNA, 13 nt, Homo sapiens
uucauacuacauu

SEQ ID NO: 1657532 - RNA, 18 nt, Homo sapiens
uucauagcuugcaguuuc

SEQ ID NO: 1657533 - RNA, 14 nt, Homo sapiens
uucauauucucaga

SEQ ID NO: 1657534 - RNA, 20 nt, Homo sapiens
uucauccaggcucccaaaag

SEQ ID NO: 1657535 - RNA, 18 nt, Homo sapiens
uucaucugaggaguccaa

SEQ ID NO: 1657536 - RNA, 13 nt, Homo sapiens
uucaugcugcuua

SEQ ID NO: 1657537 - RNA, 23 nt, Homo sapiens
uucauggaguagagucaggagaa

SEQ ID NO: 1657538 - RNA, 17 nt, Homo sapiens
uucauuaaaacaagaga

SEQ ID NO: 1657539 - RNA, 14 nt, Homo sapiens
uucauuccauuugc

SEQ ID NO: 1657540 - RNA, 13 nt, Homo sapiens
uuccaaaguuuug

SEQ ID NO: 1657541 - RNA, 14 nt, Homo sapiens
uuccaacacacaau

SEQ ID NO: 1657542 - RNA, 14 nt, Homo sapiens
uuccaacaugugau

SEQ ID NO: 1657543 - RNA, 21 nt, Homo sapiens
uuccaacccaggucugcuuug

SEQ ID NO: 1657544 - RNA, 19 nt, Homo sapiens
uuccaagugugugugcaau

SEQ ID NO: 1657545 - RNA, 19 nt, Homo sapiens
uuccaaugcuuugaucccu

SEQ ID NO: 1657546 - RNA, 12 nt, Homo sapiens
uuccacccugcc

SEQ ID NO: 1657547 - RNA, 18 nt, Homo sapiens
uuccacuucucuagagaa

SEQ ID NO: 1657548 - RNA, 15 nt, Homo sapiens
uuccagcaaaauaua

SEQ ID NO: 1657549 - RNA, 20 nt, Homo sapiens
uuccagcuaagccugaugau

SEQ ID NO: 1657550 - RNA, 16 nt, Homo sapiens
uuccagguuccaucca

SEQ ID NO: 1657551 - RNA, 21 nt, Homo sapiens
uuccagguuccauccaccacc

SEQ ID NO: 1657552 - RNA, 23 nt, Homo sapiens
uuccauagcuucauccacugaau

SEQ ID NO: 1657553 - RNA, 19 nt, Homo sapiens
uuccaucuguuugauacag

SEQ ID NO: 1657554 - RNA, 18 nt, Homo sapiens
uuccauggauuccccugg

SEQ ID NO: 1657555 - RNA, 20 nt, Homo sapiens
uucccaaggcagcuggauug

SEQ ID NO: 1657556 - RNA, 23 nt, Homo sapiens
uucccaauuaucaaaaaacagaa

SEQ ID NO: 1657557 - RNA, 12 nt, Homo sapiens
ggcuuccaagaa

SEQ ID NO: 1657558 - RNA, 14 nt, Homo sapiens
ggcuucugggacag

SEQ ID NO: 1657559 - RNA, 18 nt, Homo sapiens
ggcuuuggguagugccau

SEQ ID NO: 1657560 - RNA, 15 nt, Homo sapiens
gggaaaggaggcaug

SEQ ID NO: 1657561 - RNA, 17 nt, Homo sapiens
gggaaauucacacugug

SEQ ID NO: 1657562 - RNA, 22 nt, Homo sapiens
gggaaugaaugucagugugacu

SEQ ID NO: 1657563 - RNA, 23 nt, Homo sapiens
gggacagaggauuucugcuuagg

SEQ ID NO: 1657564 - RNA, 13 nt, Homo sapiens
gggacagccugca

SEQ ID NO: 1657565 - RNA, 17 nt, Homo sapiens
gggaccagagcugccac

SEQ ID NO: 1657566 - RNA, 14 nt, Homo sapiens
gggaccagggaugg

SEQ ID NO: 1657567 - RNA, 12 nt, Homo sapiens
gggaccccaaac

SEQ ID NO: 1657568 - RNA, 13 nt, Homo sapiens
gggaccucaggcc

SEQ ID NO: 1657569 - RNA, 20 nt, Homo sapiens
gggacuuuggaauucugcuu

SEQ ID NO: 1657570 - RNA, 21 nt, Homo sapiens
gggagaagaaggcaacccaaa

SEQ ID NO: 1657571 - RNA, 14 nt, Homo sapiens
gggagcccucaggc

SEQ ID NO: 1657572 - RNA, 13 nt, Homo sapiens
gggaggaacaaag

SEQ ID NO: 1657573 - RNA, 14 nt, Homo sapiens
gggaggaacaaaga

SEQ ID NO: 1657574 - RNA, 11 nt, Homo sapiens
gggagugccac

SEQ ID NO: 1657575 - RNA, 23 nt, Homo sapiens
gggaucagaguucccaagaaagg

SEQ ID NO: 1657576 - RNA, 21 nt, Homo sapiens
gggauccaccgccacacuggc

SEQ ID NO: 1657577 - RNA, 23 nt, Homo sapiens
gggauuccaccuacuuauuucag

SEQ ID NO: 1657578 - RNA, 17 nt, Homo sapiens
gggauugucuuacuguu

SEQ ID NO: 1657579 - RNA, 16 nt, Homo sapiens
gggcaacccuggugac

SEQ ID NO: 1657580 - RNA, 11 nt, Homo sapiens
gggcacuguca

SEQ ID NO: 1657581 - RNA, 13 nt, Homo sapiens
gggcacugucaug

SEQ ID NO: 1657582 - RNA, 14 nt, Homo sapiens
gggcagaaccaaga

SEQ ID NO: 1657583 - RNA, 21 nt, Homo sapiens
gggccaggaaggggacaggau

SEQ ID NO: 1657584 - RNA, 16 nt, Homo sapiens
gggccaggagaaagaa

SEQ ID NO: 1657585 - RNA, 22 nt, Homo sapiens
gggcccaaguaagggcacagau

SEQ ID NO: 1657586 - RNA, 13 nt, Homo sapiens
gggcgacugugaa

SEQ ID NO: 1657587 - RNA, 18 nt, Homo sapiens
gggcuaggggacaucaga

SEQ ID NO: 1657588 - RNA, 21 nt, Homo sapiens
gggcugaccugccucucacac

SEQ ID NO: 1657589 - RNA, 19 nt, Homo sapiens
gggggcauaucucagucag

SEQ ID NO: 1657590 - RNA, 19 nt, Homo sapiens
ggggguguaucacagucag

SEQ ID NO: 1657591 - RNA, 13 nt, Homo sapiens
gggguaugggaga

SEQ ID NO: 1657592 - RNA, 19 nt, Homo sapiens
ggggucuccucugcagcuc

SEQ ID NO: 1657593 - RNA, 19 nt, Homo sapiens
ggguacucagucagcccag

SEQ ID NO: 1657594 - RNA, 17 nt, Homo sapiens
ggguccucggcccugua

SEQ ID NO: 1657595 - RNA, 23 nt, Homo sapiens
gggucugcuccugggaauggggu

SEQ ID NO: 1657596 - RNA, 15 nt, Homo sapiens
gggucuggcauuaua

SEQ ID NO: 1657597 - RNA, 21 nt, Homo sapiens
gggugacagagcgagacucca

SEQ ID NO: 1657598 - RNA, 21 nt, Homo sapiens
gggugcucagggcaugcuuau

SEQ ID NO: 1657599 - RNA, 18 nt, Homo sapiens
gggugcugucaugcccag

SEQ ID NO: 1657600 - RNA, 23 nt, Homo sapiens
ggguuuuuaaucuuugugacagg

SEQ ID NO: 1657601 - RNA, 21 nt, Homo sapiens
gguaaagcuuauggaacugag

SEQ ID NO: 1657602 - RNA, 22 nt, Homo sapiens
gguagaaacuuuggaaguuuua

SEQ ID NO: 1657603 - RNA, 17 nt, Homo sapiens
gguagaguccuaggaca

SEQ ID NO: 1657604 - RNA, 14 nt, Homo sapiens
gguccgacaugccu

SEQ ID NO: 1657605 - RNA, 14 nt, Homo sapiens
gguccugaggccaa

SEQ ID NO: 1657606 - RNA, 14 nt, Homo sapiens
gguccugcacuguc

SEQ ID NO: 1657607 - RNA, 15 nt, Homo sapiens
gguccugcacugucc

SEQ ID NO: 1657608 - RNA, 21 nt, Homo sapiens
gguccugggggcugcugcacu

SEQ ID NO: 1657609 - RNA, 21 nt, Homo sapiens
ggucucuauacuacauuauua

SEQ ID NO: 1657610 - RNA, 15 nt, Homo sapiens
ggucugcuccuggga

SEQ ID NO: 1657611 - RNA, 20 nt, Homo sapiens
ggucugugugugacaccacc

SEQ ID NO: 1657612 - RNA, 23 nt, Homo sapiens
ggugaagaguccaagaagccagc

SEQ ID NO: 1657613 - RNA, 18 nt, Homo sapiens
ggugacuuuccuaugaca

SEQ ID NO: 1657614 - RNA, 22 nt, Homo sapiens
ggugcauguccccugcuugaac

SEQ ID NO: 1657615 - RNA, 17 nt, Homo sapiens
ggugcuaauccaggaca

SEQ ID NO: 1657616 - RNA, 21 nt, Homo sapiens
ggugcugcuuucuuguugcug

SEQ ID NO: 1657617 - RNA, 16 nt, Homo sapiens
gcaaggggccaggaag

SEQ ID NO: 1657618 - RNA, 19 nt, Homo sapiens
gcaauaaaugucccaaaua

SEQ ID NO: 1657619 - RNA, 13 nt, Homo sapiens
gcaauaacaguuu

SEQ ID NO: 1657620 - RNA, 11 nt, Homo sapiens
gcaauaaucuu

SEQ ID NO: 1657621 - RNA, 12 nt, Homo sapiens
gcaaucuugccc

SEQ ID NO: 1657622 - RNA, 21 nt, Homo sapiens
gcaaugacaaguuuaacauau

SEQ ID NO: 1657623 - RNA, 17 nt, Homo sapiens
gcaaugagaaggccagg

SEQ ID NO: 1657624 - RNA, 17 nt, Homo sapiens
gcaauggugcgaucuca

SEQ ID NO: 1657625 - RNA, 19 nt, Homo sapiens
gcaauuuuuccaaaagcca

SEQ ID NO: 1657626 - RNA, 15 nt, Homo sapiens
gcacaauuccaugaa

SEQ ID NO: 1657627 - RNA, 16 nt, Homo sapiens
gcacaauuccaugaau

SEQ ID NO: 1657628 - RNA, 20 nt, Homo sapiens
gcacacaugguuuccaaggg

SEQ ID NO: 1657629 - RNA, 22 nt, Homo sapiens
gcacacugcuugugaaaggaaa

SEQ ID NO: 1657630 - RNA, 15 nt, Homo sapiens
gcacacuggccucca

SEQ ID NO: 1657631 - RNA, 15 nt, Homo sapiens
gcacaggccaggaca

SEQ ID NO: 1657632 - RNA, 21 nt, Homo sapiens
gcacaugccucucucaggcca

SEQ ID NO: 1657633 - RNA, 19 nt, Homo sapiens
gcacauguugcuaaugaca

SEQ ID NO: 1657634 - RNA, 20 nt, Homo sapiens
gcacauugguuuaagcccag

SEQ ID NO: 1657635 - RNA, 18 nt, Homo sapiens
gcaccucagccaucugua

SEQ ID NO: 1657636 - RNA, 22 nt, Homo sapiens
gcacuaaaagugaugugauuua

SEQ ID NO: 1657637 - RNA, 22 nt, Homo sapiens
gcacuaaucaauacuuugaaca

SEQ ID NO: 1657638 - RNA, 22 nt, Homo sapiens
gcacucaggagcacagccauag

SEQ ID NO: 1657639 - RNA, 22 nt, Homo sapiens
gcacucccuaaguccacucuag

SEQ ID NO: 1657640 - RNA, 14 nt, Homo sapiens
gcacugacagagaa

SEQ ID NO: 1657641 - RNA, 12 nt, Homo sapiens
gcacugcaguua

SEQ ID NO: 1657642 - RNA, 14 nt, Homo sapiens
gcacugcuccagug

SEQ ID NO: 1657643 - RNA, 17 nt, Homo sapiens
gcacuguauccaaguua

SEQ ID NO: 1657644 - RNA, 12 nt, Homo sapiens
gcacugucaugc

SEQ ID NO: 1657645 - RNA, 14 nt, Homo sapiens
gcacugucaugccc

SEQ ID NO: 1657646 - RNA, 22 nt, Homo sapiens
gcacugucaugcccagcuugga

SEQ ID NO: 1657647 - RNA, 16 nt, Homo sapiens
gcacuguuucuucuca

SEQ ID NO: 1657648 - RNA, 15 nt, Homo sapiens
gcacuugcuacuuca

SEQ ID NO: 1657649 - RNA, 20 nt, Homo sapiens
gcagaaggaagacuucaucc

SEQ ID NO: 1657650 - RNA, 23 nt, Homo sapiens
gcagacacuguagucagaccuca

SEQ ID NO: 1657651 - RNA, 20 nt, Homo sapiens
gcagacuaaaacaaguacau

SEQ ID NO: 1657652 - RNA, 17 nt, Homo sapiens
gcagagccaauggugca

SEQ ID NO: 1657653 - RNA, 19 nt, Homo sapiens
gcagaucacguugcaaugg

SEQ ID NO: 1657654 - RNA, 15 nt, Homo sapiens
gcagaucaucuccaa

SEQ ID NO: 1657655 - RNA, 24 nt, Homo sapiens
gcagcaaggagaaggcaggaacau

SEQ ID NO: 1657656 - RNA, 22 nt, Homo sapiens
gcagccugcagaccacacucug

SEQ ID NO: 1657657 - RNA, 12 nt, Homo sapiens
gcagcucaggga

SEQ ID NO: 1657658 - RNA, 23 nt, Homo sapiens
gcagcuccggaaggacacaguca

SEQ ID NO: 1657659 - RNA, 14 nt, Homo sapiens
gcagcuuuccaguu

SEQ ID NO: 1657660 - RNA, 20 nt, Homo sapiens
gcaggaaaaggcugcagcua

SEQ ID NO: 1657661 - RNA, 17 nt, Homo sapiens
gcaggagaauggcguga

SEQ ID NO: 1657662 - RNA, 14 nt, Homo sapiens
gcaggcaaaggccc

SEQ ID NO: 1657663 - RNA, 16 nt, Homo sapiens
gcaggcgguggggaga

SEQ ID NO: 1657664 - RNA, 15 nt, Homo sapiens
gcagggcaaaugaca

SEQ ID NO: 1657665 - RNA, 23 nt, Homo sapiens
gcagggcaaaugacaugcacuga

SEQ ID NO: 1657666 - RNA, 21 nt, Homo sapiens
gcaggggggcaguaacucccc

SEQ ID NO: 1657667 - RNA, 23 nt, Homo sapiens
gcaggguggggggccauguuccc

SEQ ID NO: 1657668 - RNA, 20 nt, Homo sapiens
gcaguaaaguuccaugaaga

SEQ ID NO: 1657669 - RNA, 17 nt, Homo sapiens
gcagugcaguacucagu

SEQ ID NO: 1657670 - RNA, 21 nt, Homo sapiens
gcaguggagaggggacuugga

SEQ ID NO: 1657671 - RNA, 22 nt, Homo sapiens
gcaguggcaucaucucagcuca

SEQ ID NO: 1657672 - RNA, 15 nt, Homo sapiens
gcaguggugucucug

SEQ ID NO: 1657673 - RNA, 22 nt, Homo sapiens
gcaguguguacuucuucaucca

SEQ ID NO: 1657674 - RNA, 17 nt, Homo sapiens
gcaguuguuauauucau

SEQ ID NO: 1657675 - RNA, 17 nt, Homo sapiens
gcauaaauauuagcaaa

SEQ ID NO: 1657676 - RNA, 21 nt, Homo sapiens
gcauauuauaucagacugcuu

SEQ ID NO: 1657677 - RNA, 15 nt, Homo sapiens
gcaucaagaugugac

SEQ ID NO: 1657678 - RNA, 17 nt, Homo sapiens
ggagguacgaaaagagg

SEQ ID NO: 1657679 - RNA, 23 nt, Homo sapiens
ggaguaguugcuacucuucagaa

SEQ ID NO: 1657680 - RNA, 19 nt, Homo sapiens
ggaguccacuuuccucucu

SEQ ID NO: 1657681 - RNA, 12 nt, Homo sapiens
ggagugcaaugg

SEQ ID NO: 1657682 - RNA, 13 nt, Homo sapiens
ggagugugccuug

SEQ ID NO: 1657683 - RNA, 15 nt, Homo sapiens
ggaguucagcugcuu

SEQ ID NO: 1657684 - RNA, 16 nt, Homo sapiens
ggauaauugaggcuaa

SEQ ID NO: 1657685 - RNA, 15 nt, Homo sapiens
ggaucaggaacccuu

SEQ ID NO: 1657686 - RNA, 18 nt, Homo sapiens
ggauggcuuaagccugug

SEQ ID NO: 1657687 - RNA, 17 nt, Homo sapiens
ggaugggcucuucgcca

SEQ ID NO: 1657688 - RNA, 16 nt, Homo sapiens
ggauucacagccuuug

SEQ ID NO: 1657689 - RNA, 22 nt, Homo sapiens
ggauuccagagcacugcuccag

SEQ ID NO: 1657690 - RNA, 17 nt, Homo sapiens
ggauuguccaccuucug

SEQ ID NO: 1657691 - RNA, 18 nt, Homo sapiens
ggauugugaagauuucau

SEQ ID NO: 1657692 - RNA, 22 nt, Homo sapiens
ggauugugaagauuucauggac

SEQ ID NO: 1657693 - RNA, 20 nt, Homo sapiens
ggauuuauuuuuuguaacuc

SEQ ID NO: 1657694 - RNA, 23 nt, Homo sapiens
ggauuucugcuuaggccccucag

SEQ ID NO: 1657695 - RNA, 14 nt, Homo sapiens
ggcaaaaccaacuc

SEQ ID NO: 1657696 - RNA, 15 nt, Homo sapiens
ggcaaccaauggcag

SEQ ID NO: 1657697 - RNA, 22 nt, Homo sapiens
ggcaacuucaguccugggagac

SEQ ID NO: 1657698 - RNA, 14 nt, Homo sapiens
ggcaaggaagggug

SEQ ID NO: 1657699 - RNA, 23 nt, Homo sapiens
ggcaauaaucuuuuaacaguguu

SEQ ID NO: 1657700 - RNA, 22 nt, Homo sapiens
ggcaauauaaggggaugaggaa

SEQ ID NO: 1657701 - RNA, 14 nt, Homo sapiens
ggcacaaccagaaa

SEQ ID NO: 1657702 - RNA, 18 nt, Homo sapiens
ggcacaggccaggacaaa

SEQ ID NO: 1657703 - RNA, 13 nt, Homo sapiens
ggcacccaccacu

SEQ ID NO: 1657704 - RNA, 13 nt, Homo sapiens
ggcaccugaccac

SEQ ID NO: 1657705 - RNA, 14 nt, Homo sapiens
ggcacucucuuuug

SEQ ID NO: 1657706 - RNA, 16 nt, Homo sapiens
ggcacugucaugccca

SEQ ID NO: 1657707 - RNA, 22 nt, Homo sapiens
ggcacuuggguguggcuccucu

SEQ ID NO: 1657708 - RNA, 21 nt, Homo sapiens
ggcagaaccaagaacauaaac

SEQ ID NO: 1657709 - RNA, 19 nt, Homo sapiens
ggcagaauggugggcucca

SEQ ID NO: 1657710 - RNA, 20 nt, Homo sapiens
ggcagagggaugaaaugcca

SEQ ID NO: 1657711 - RNA, 20 nt, Homo sapiens
ggcaggagaauggcgugaac

SEQ ID NO: 1657712 - RNA, 17 nt, Homo sapiens
ggcaggugguaggccau

SEQ ID NO: 1657713 - RNA, 11 nt, Homo sapiens
ggcagugcagu

SEQ ID NO: 1657714 - RNA, 18 nt, Homo sapiens
ggcauguuucaccacaac

SEQ ID NO: 1657715 - RNA, 20 nt, Homo sapiens
ggccaagaaagaaaccagac

SEQ ID NO: 1657716 - RNA, 16 nt, Homo sapiens
ggccagcccacacagc

SEQ ID NO: 1657717 - RNA, 15 nt, Homo sapiens
ggccaggacaaaaug

SEQ ID NO: 1657718 - RNA, 13 nt, Homo sapiens
ggcccccaucaca

SEQ ID NO: 1657719 - RNA, 14 nt, Homo sapiens
ggcccgccaccuug

SEQ ID NO: 1657720 - RNA, 17 nt, Homo sapiens
ggccgucucugauucuc

SEQ ID NO: 1657721 - RNA, 15 nt, Homo sapiens
ggccuaugacccugu

SEQ ID NO: 1657722 - RNA, 13 nt, Homo sapiens
ggccuccaagcca

SEQ ID NO: 1657723 - RNA, 18 nt, Homo sapiens
ggccuccaagccaggugc

SEQ ID NO: 1657724 - RNA, 13 nt, Homo sapiens
ggccucccagcca

SEQ ID NO: 1657725 - RNA, 18 nt, Homo sapiens
ggccugccaaacuguaca

SEQ ID NO: 1657726 - RNA, 16 nt, Homo sapiens
ggccuuagaaaacaug

SEQ ID NO: 1657727 - RNA, 18 nt, Homo sapiens
ggccuucuccacagggac

SEQ ID NO: 1657728 - RNA, 11 nt, Homo sapiens
ggcgccaagug

SEQ ID NO: 1657729 - RNA, 19 nt, Homo sapiens
ggcgcuccucccagcugua

SEQ ID NO: 1657730 - RNA, 20 nt, Homo sapiens
ggcucacaugccacuggaaa

SEQ ID NO: 1657731 - RNA, 15 nt, Homo sapiens
ggcucaugccuguaa

SEQ ID NO: 1657732 - RNA, 14 nt, Homo sapiens
ggcuccacuacaga

SEQ ID NO: 1657733 - RNA, 22 nt, Homo sapiens
ggcucccacugccccugcaccu

SEQ ID NO: 1657734 - RNA, 16 nt, Homo sapiens
ggcucucaggccagcu

SEQ ID NO: 1657735 - RNA, 12 nt, Homo sapiens
ggcucugaccag

SEQ ID NO: 1657736 - RNA, 17 nt, Homo sapiens
ggcugcucuccaucucu

SEQ ID NO: 1657737 - RNA, 13 nt, Homo sapiens
ggcugcugaccau

SEQ ID NO: 1657738 - RNA, 13 nt, Homo sapiens
ggcugcugcacug

SEQ ID NO: 1657739 - RNA, 21 nt, Homo sapiens
ggcugucugucaccagcuauc

SEQ ID NO: 1657740 - RNA, 22 nt, Homo sapiens
cugcuccaugcagaucuagcca

SEQ ID NO: 1657741 - RNA, 15 nt, Homo sapiens
cugcuccuccaguac

SEQ ID NO: 1657742 - RNA, 18 nt, Homo sapiens
cugcugagagggcugcug

SEQ ID NO: 1657743 - RNA, 23 nt, Homo sapiens
cugcugagagggcugcugaccau

SEQ ID NO: 1657744 - RNA, 18 nt, Homo sapiens
cugcuguauuugaggaaa

SEQ ID NO: 1657745 - RNA, 16 nt, Homo sapiens
cugcuucucuuucaca

SEQ ID NO: 1657746 - RNA, 13 nt, Homo sapiens
cugcuugugcacu

SEQ ID NO: 1657747 - RNA, 15 nt, Homo sapiens
cugcuugugcacugg

SEQ ID NO: 1657748 - RNA, 22 nt, Homo sapiens
cugcuugugcacuggauguggc

SEQ ID NO: 1657749 - RNA, 23 nt, Homo sapiens
cugcuugugcacuggauguggcc

SEQ ID NO: 1657750 - RNA, 16 nt, Homo sapiens
cugcuuucccaaaggc

SEQ ID NO: 1657751 - RNA, 18 nt, Homo sapiens
cugcuuucugauacaucu

SEQ ID NO: 1657752 - RNA, 20 nt, Homo sapiens
cugcuuucuuguugcugcau

SEQ ID NO: 1657753 - RNA, 21 nt, Homo sapiens
cuggaaaaaaaaaaauaugag

SEQ ID NO: 1657754 - RNA, 20 nt, Homo sapiens
cuggaaaaccugaggccaaa

SEQ ID NO: 1657755 - RNA, 15 nt, Homo sapiens
cuggaaaacugccac

SEQ ID NO: 1657756 - RNA, 20 nt, Homo sapiens
cuggaaaauuccagagcuau

SEQ ID NO: 1657757 - RNA, 20 nt, Homo sapiens
cuggaaauaacugagcacuu

SEQ ID NO: 1657758 - RNA, 17 nt, Homo sapiens
cuggaauugauauugaa

SEQ ID NO: 1657759 - RNA, 23 nt, Homo sapiens
cuggaauugauauugaaugaugu

SEQ ID NO: 1657760 - RNA, 23 nt, Homo sapiens
cuggagaguguggggaaugggaa

SEQ ID NO: 1657761 - RNA, 17 nt, Homo sapiens
cuggagcugaagcguua

SEQ ID NO: 1657762 - RNA, 14 nt, Homo sapiens
cuggagugcagugg

SEQ ID NO: 1657763 - RNA, 20 nt, Homo sapiens
cuggagugcaguggcgcgau

SEQ ID NO: 1657764 - RNA, 13 nt, Homo sapiens
cuggaucaguaaa

SEQ ID NO: 1657765 - RNA, 18 nt, Homo sapiens
cuggcagcgccucccgcc

SEQ ID NO: 1657766 - RNA, 16 nt, Homo sapiens
cuggcaucuagucaag

SEQ ID NO: 1657767 - RNA, 21 nt, Homo sapiens
cuggcauggacaucagcauca

SEQ ID NO: 1657768 - RNA, 20 nt, Homo sapiens
cuggcaugggaaugaauguc

SEQ ID NO: 1657769 - RNA, 15 nt, Homo sapiens
cuggcauuacaggug

SEQ ID NO: 1657770 - RNA, 17 nt, Homo sapiens
cuggcauuacaggugug

SEQ ID NO: 1657771 - RNA, 22 nt, Homo sapiens
cuggccauuuaacuagcacuuu

SEQ ID NO: 1657772 - RNA, 19 nt, Homo sapiens
cuggcccugcccugaggaa

SEQ ID NO: 1657773 - RNA, 13 nt, Homo sapiens
cuggccgcuggga

SEQ ID NO: 1657774 - RNA, 22 nt, Homo sapiens
cuggccuauuuuggacguguga

SEQ ID NO: 1657775 - RNA, 23 nt, Homo sapiens
cuggccuauuuuggacgugugag

SEQ ID NO: 1657776 - RNA, 22 nt, Homo sapiens
cuggcugcccuucuucuugacc

SEQ ID NO: 1657777 - RNA, 15 nt, Homo sapiens
cuggcugcugcaguc

SEQ ID NO: 1657778 - RNA, 16 nt, Homo sapiens
cuggcuucugcauuac

SEQ ID NO: 1657779 - RNA, 22 nt, Homo sapiens
cuggcuuuacauggguucaauu

SEQ ID NO: 1657780 - RNA, 14 nt, Homo sapiens
cugggaaaugagau

SEQ ID NO: 1657781 - RNA, 17 nt, Homo sapiens
cugggagcccucaggca

SEQ ID NO: 1657782 - RNA, 23 nt, Homo sapiens
cugggagguggagcuugcaguga

SEQ ID NO: 1657783 - RNA, 15 nt, Homo sapiens
cugggcccuaggcau

SEQ ID NO: 1657784 - RNA, 14 nt, Homo sapiens
cuggggucugugau

SEQ ID NO: 1657785 - RNA, 19 nt, Homo sapiens
cugggguuuugacuugcca

SEQ ID NO: 1657786 - RNA, 20 nt, Homo sapiens
cugggucaccuuccugggca

SEQ ID NO: 1657787 - RNA, 23 nt, Homo sapiens
cugggugcucagggcaugcuuau

SEQ ID NO: 1657788 - RNA, 18 nt, Homo sapiens
cuggguugguauggaguu

SEQ ID NO: 1657789 - RNA, 16 nt, Homo sapiens
cuggucaauaaaccac

SEQ ID NO: 1657790 - RNA, 15 nt, Homo sapiens
cugguccugcacugu

SEQ ID NO: 1657791 - RNA, 17 nt, Homo sapiens
cugguccugcacugucc

SEQ ID NO: 1657792 - RNA, 17 nt, Homo sapiens
cuggucgcuuugccauc

SEQ ID NO: 1657793 - RNA, 13 nt, Homo sapiens
cuggugauggucc

SEQ ID NO: 1657794 - RNA, 16 nt, Homo sapiens
cugguggcaccagaug

SEQ ID NO: 1657795 - RNA, 20 nt, Homo sapiens
cugguggcaccagaugcaac

SEQ ID NO: 1657796 - RNA, 17 nt, Homo sapiens
cugguucuguacaugug

SEQ ID NO: 1657797 - RNA, 15 nt, Homo sapiens
cuguaaaauacaugg

SEQ ID NO: 1657798 - RNA, 16 nt, Homo sapiens
cuguaauuuuguagua

SEQ ID NO: 1657799 - RNA, 23 nt, Homo sapiens
cuguacaguuucuuccccaagag

SEQ ID NO: 1657800 - RNA, 16 nt, Homo sapiens
cuacauucugaaggcc

SEQ ID NO: 1657801 - RNA, 21 nt, Homo sapiens
cuacauugacgagcaugagcu

SEQ ID NO: 1657802 - RNA, 11 nt, Homo sapiens
cuaccaaaggg

SEQ ID NO: 1657803 - RNA, 22 nt, Homo sapiens
cuaccacauucacuacugcaaa

SEQ ID NO: 1657804 - RNA, 17 nt, Homo sapiens
cuaccauuauggcuuug

SEQ ID NO: 1657805 - RNA, 13 nt, Homo sapiens
cuacccacgugcc

SEQ ID NO: 1657806 - RNA, 15 nt, Homo sapiens
cuacgaaagcacagu

SEQ ID NO: 1657807 - RNA, 17 nt, Homo sapiens
cuacucagaucugcacu

SEQ ID NO: 1657808 - RNA, 15 nt, Homo sapiens
cuacucgaguuacag

SEQ ID NO: 1657809 - RNA, 16 nt, Homo sapiens
cuacuuaaacaaaaac

SEQ ID NO: 1657810 - RNA, 20 nt, Homo sapiens
cuacuuaaacaaaaacuuuc

SEQ ID NO: 1657811 - RNA, 13 nt, Homo sapiens
cuacuuauuucag

SEQ ID NO: 1657812 - RNA, 16 nt, Homo sapiens
cuacuucuacauccaa

SEQ ID NO: 1657813 - RNA, 19 nt, Homo sapiens
cuagaaagagaaaaagccc

SEQ ID NO: 1657814 - RNA, 23 nt, Homo sapiens
cuagaaccuucuaauccaugugc

SEQ ID NO: 1657815 - RNA, 14 nt, Homo sapiens
cuagaauacuaaua

SEQ ID NO: 1657816 - RNA, 15 nt, Homo sapiens
cuagagaacaugccc

SEQ ID NO: 1657817 - RNA, 20 nt, Homo sapiens
cuagagcuaugcacaccaaa

SEQ ID NO: 1657818 - RNA, 14 nt, Homo sapiens
cuagaguaugugua

SEQ ID NO: 1657819 - RNA, 20 nt, Homo sapiens
cuagauguuuagaugagguu

SEQ ID NO: 1657820 - RNA, 18 nt, Homo sapiens
cuagcaauugcuucucua

SEQ ID NO: 1657821 - RNA, 16 nt, Homo sapiens
cuagccagaggcucua

SEQ ID NO: 1657822 - RNA, 22 nt, Homo sapiens
cuaggugggucaacuccaaggc

SEQ ID NO: 1657823 - RNA, 23 nt, Homo sapiens
cuaggugggucaacuccaaggca

SEQ ID NO: 1657824 - RNA, 17 nt, Homo sapiens
cuaguaacaguauuucc

SEQ ID NO: 1657825 - RNA, 15 nt, Homo sapiens
cuagucacauaucaa

SEQ ID NO: 1657826 - RNA, 22 nt, Homo sapiens
cuaguccccagccugcucccua

SEQ ID NO: 1657827 - RNA, 16 nt, Homo sapiens
cuagucugucagggcc

SEQ ID NO: 1657828 - RNA, 14 nt, Homo sapiens
cuaguguuaaucca

SEQ ID NO: 1657829 - RNA, 20 nt, Homo sapiens
cuaguuugaccucacaguga

SEQ ID NO: 1657830 - RNA, 14 nt, Homo sapiens
cuauaaauggacuu

SEQ ID NO: 1657831 - RNA, 21 nt, Homo sapiens
cuauaacuuuugguaucuacu

SEQ ID NO: 1657832 - RNA, 14 nt, Homo sapiens
cuaucaaagcacau

SEQ ID NO: 1657833 - RNA, 22 nt, Homo sapiens
cuauccuuuuuuccuuuccuga

SEQ ID NO: 1657834 - RNA, 13 nt, Homo sapiens
cuaucuagugucu

SEQ ID NO: 1657835 - RNA, 19 nt, Homo sapiens
cuaucuuugguauaugaua

SEQ ID NO: 1657836 - RNA, 23 nt, Homo sapiens
cuaugacaauaaauuuuaucuca

SEQ ID NO: 1657837 - RNA, 14 nt, Homo sapiens
cuaugacccugugc

SEQ ID NO: 1657838 - RNA, 17 nt, Homo sapiens
cuaugcaagcaaacaca

SEQ ID NO: 1657839 - RNA, 15 nt, Homo sapiens
cuaugcacaccaaau

SEQ ID NO: 1657840 - RNA, 16 nt, Homo sapiens
cuaugccugucuuuac

SEQ ID NO: 1657841 - RNA, 17 nt, Homo sapiens
cuaugccugucuuuacc

SEQ ID NO: 1657842 - RNA, 17 nt, Homo sapiens
cuaugccuguugaucua

SEQ ID NO: 1657843 - RNA, 13 nt, Homo sapiens
cuaugccuugaaa

SEQ ID NO: 1657844 - RNA, 23 nt, Homo sapiens
cuaugucgucguuuucaccagca

SEQ ID NO: 1657845 - RNA, 18 nt, Homo sapiens
cuauuaacucugcauaga

SEQ ID NO: 1657846 - RNA, 18 nt, Homo sapiens
cuauucccaggcagggag

SEQ ID NO: 1657847 - RNA, 22 nt, Homo sapiens
cuauuguccuuguguauccuga

SEQ ID NO: 1657848 - RNA, 21 nt, Homo sapiens
cuauugugcuuucuaucuaau

SEQ ID NO: 1657849 - RNA, 16 nt, Homo sapiens
cuauuuuggacgugug

SEQ ID NO: 1657850 - RNA, 20 nt, Homo sapiens
cucaaaaugugccgucuuug

SEQ ID NO: 1657851 - RNA, 19 nt, Homo sapiens
cucaaacuccugaccucaa

SEQ ID NO: 1657852 - RNA, 14 nt, Homo sapiens
cucaaaugcuaaau

SEQ ID NO: 1657853 - RNA, 18 nt, Homo sapiens
cucaaaugcuacucagua

SEQ ID NO: 1657854 - RNA, 20 nt, Homo sapiens
cucaaggcugcagugagcca

SEQ ID NO: 1657855 - RNA, 19 nt, Homo sapiens
cucaauaaggcagugcagu

SEQ ID NO: 1657856 - RNA, 20 nt, Homo sapiens
cucaauaaggcagugcagug

SEQ ID NO: 1657857 - RNA, 18 nt, Homo sapiens
cucaaugcuuuucuagca

SEQ ID NO: 1657858 - RNA, 16 nt, Homo sapiens
cucaauugaguuaaau

SEQ ID NO: 1657859 - RNA, 16 nt, Homo sapiens
cugaacugcaacacug

SEQ ID NO: 1657860 - RNA, 16 nt, Homo sapiens
cugaagaaacacagca

SEQ ID NO: 1657861 - RNA, 18 nt, Homo sapiens
cugaagucuuuguacaga

SEQ ID NO: 1657862 - RNA, 21 nt, Homo sapiens
cugaagucuuuguacagacaa

SEQ ID NO: 1657863 - RNA, 22 nt, Homo sapiens
cugaaguuucauuuaugauaca

SEQ ID NO: 1657864 - RNA, 20 nt, Homo sapiens
cugaauuaaagucuacacug

SEQ ID NO: 1657865 - RNA, 12 nt, Homo sapiens
cugacacaggaa

SEQ ID NO: 1657866 - RNA, 13 nt, Homo sapiens
cugacacaggaaa

SEQ ID NO: 1657867 - RNA, 21 nt, Homo sapiens
cugacaccugccgcugcuuga

SEQ ID NO: 1657868 - RNA, 11 nt, Homo sapiens
cugacacuguc

SEQ ID NO: 1657869 - RNA, 13 nt, Homo sapiens
cugacagagaaau

SEQ ID NO: 1657870 - RNA, 18 nt, Homo sapiens
cugacagcgccaugugug

SEQ ID NO: 1657871 - RNA, 15 nt, Homo sapiens
cugacccaacacuua

SEQ ID NO: 1657872 - RNA, 19 nt, Homo sapiens
cugaccucuugaucugccc

SEQ ID NO: 1657873 - RNA, 21 nt, Homo sapiens
cugacgcucaguaaccaugca

SEQ ID NO: 1657874 - RNA, 15 nt, Homo sapiens
cugacuaacgccauc

SEQ ID NO: 1657875 - RNA, 13 nt, Homo sapiens
cugagaaacuucc

SEQ ID NO: 1657876 - RNA, 15 nt, Homo sapiens
cugagaaacuuccuu

SEQ ID NO: 1657877 - RNA, 22 nt, Homo sapiens
cugagacgcaaggaucacuuga

SEQ ID NO: 1657878 - RNA, 17 nt, Homo sapiens
cugagcacagcaaggga

SEQ ID NO: 1657879 - RNA, 19 nt, Homo sapiens
cugagcaccgaauauugag

SEQ ID NO: 1657880 - RNA, 20 nt, Homo sapiens
cugagcccccugcacccacc

SEQ ID NO: 1657881 - RNA, 17 nt, Homo sapiens
cugaggacacucagugu

SEQ ID NO: 1657882 - RNA, 13 nt, Homo sapiens
cugaggaccucag

SEQ ID NO: 1657883 - RNA, 14 nt, Homo sapiens
cugaggaguccaaa

SEQ ID NO: 1657884 - RNA, 16 nt, Homo sapiens
cugaggauaccuucca

SEQ ID NO: 1657885 - RNA, 21 nt, Homo sapiens
cugaguagucauuuugcccau

SEQ ID NO: 1657886 - RNA, 19 nt, Homo sapiens
cugagugagaagauaaaaa

SEQ ID NO: 1657887 - RNA, 17 nt, Homo sapiens
cugaguuugaacacaga

SEQ ID NO: 1657888 - RNA, 14 nt, Homo sapiens
cugauaacucugua

SEQ ID NO: 1657889 - RNA, 19 nt, Homo sapiens
cugauaugggacugagccu

SEQ ID NO: 1657890 - RNA, 20 nt, Homo sapiens
cugaucucucgugauugaua

SEQ ID NO: 1657891 - RNA, 18 nt, Homo sapiens
cugauucagcacuuugcu

SEQ ID NO: 1657892 - RNA, 12 nt, Homo sapiens
cugauugggcac

SEQ ID NO: 1657893 - RNA, 22 nt, Homo sapiens
cugauuuaaacuucuuaacugg

SEQ ID NO: 1657894 - RNA, 12 nt, Homo sapiens
cugcaacagugg

SEQ ID NO: 1657895 - RNA, 13 nt, Homo sapiens
cugcaacccauga

SEQ ID NO: 1657896 - RNA, 22 nt, Homo sapiens
cugcaaccucggggagugccac

SEQ ID NO: 1657897 - RNA, 13 nt, Homo sapiens
cugcacuccauga

SEQ ID NO: 1657898 - RNA, 15 nt, Homo sapiens
cugcacuccaugagu

SEQ ID NO: 1657899 - RNA, 18 nt, Homo sapiens
cugcagagggcacagaaa

SEQ ID NO: 1657900 - RNA, 11 nt, Homo sapiens
cugcagccaac

SEQ ID NO: 1657901 - RNA, 15 nt, Homo sapiens
cugcagcucagggac

SEQ ID NO: 1657902 - RNA, 15 nt, Homo sapiens
cugcaucaagaugug

SEQ ID NO: 1657903 - RNA, 20 nt, Homo sapiens
cugcaucaagaugugacaug

SEQ ID NO: 1657904 - RNA, 18 nt, Homo sapiens
cugcauuuuacuguacag

SEQ ID NO: 1657905 - RNA, 17 nt, Homo sapiens
cugccaagaguccaagc

SEQ ID NO: 1657906 - RNA, 15 nt, Homo sapiens
cugccacaaugugau

SEQ ID NO: 1657907 - RNA, 16 nt, Homo sapiens
cugccacgguccuuug

SEQ ID NO: 1657908 - RNA, 15 nt, Homo sapiens
cugccaggacacugc

SEQ ID NO: 1657909 - RNA, 23 nt, Homo sapiens
cugcccacucugaccgggcuucc

SEQ ID NO: 1657910 - RNA, 22 nt, Homo sapiens
cugcccaggcagucuuugcuca

SEQ ID NO: 1657911 - RNA, 16 nt, Homo sapiens
cugccgguggggccag

SEQ ID NO: 1657912 - RNA, 16 nt, Homo sapiens
cugccuacccacgugc

SEQ ID NO: 1657913 - RNA, 23 nt, Homo sapiens
cugccucccguguucaagcgauu

SEQ ID NO: 1657914 - RNA, 15 nt, Homo sapiens
cugccugaacaaagg

SEQ ID NO: 1657915 - RNA, 15 nt, Homo sapiens
cugccugacugccag

SEQ ID NO: 1657916 - RNA, 18 nt, Homo sapiens
cugccugggacagccacu

SEQ ID NO: 1657917 - RNA, 15 nt, Homo sapiens
cugccuuacagacag

SEQ ID NO: 1657918 - RNA, 14 nt, Homo sapiens
cugcguucuuucaa

SEQ ID NO: 1657919 - RNA, 16 nt, Homo sapiens
cugcuacugaccaucu

SEQ ID NO: 1657920 - RNA, 21 nt, Homo sapiens
cugcucacccgccucuugccc

SEQ ID NO: 1657921 - RNA, 17 nt, Homo sapiens
cugcucacgucugugag

SEQ ID NO: 1657922 - RNA, 12 nt, Homo sapiens
cugcuccaugca

SEQ ID NO: 1657923 - RNA, 14 nt, Homo sapiens
aaaaaaaugauacu

SEQ ID NO: 1657924 - RNA, 13 nt, Homo sapiens
aaaaaauacagua

SEQ ID NO: 1657925 - RNA, 15 nt, Homo sapiens
aaaaacccugcuaaa

SEQ ID NO: 1657926 - RNA, 22 nt, Homo sapiens
aaaaacccugcuaaaugacuua

SEQ ID NO: 1657927 - RNA, 22 nt, Homo sapiens
aaaaagaaagaaaaaagugcaa

SEQ ID NO: 1657928 - RNA, 23 nt, Homo sapiens
aaaaagcaucuguauuaauguaa

SEQ ID NO: 1657929 - RNA, 17 nt, Homo sapiens
aaaaaguuaaucuucau

SEQ ID NO: 1657930 - RNA, 15 nt, Homo sapiens
aaaaaguugcacauu

SEQ ID NO: 1657931 - RNA, 15 nt, Homo sapiens
aaaaauagcagcuuu

SEQ ID NO: 1657932 - RNA, 12 nt, Homo sapiens
aaaacacaacau

SEQ ID NO: 1657933 - RNA, 11 nt, Homo sapiens
aaaacauucac

SEQ ID NO: 1657934 - RNA, 10 nt, Homo sapiens
aaaaccaaag

SEQ ID NO: 1657935 - RNA, 14 nt, Homo sapiens
aaaaccacuuuccu

SEQ ID NO: 1657936 - RNA, 17 nt, Homo sapiens
aaaacugcccauuguaa

SEQ ID NO: 1657937 - RNA, 17 nt, Homo sapiens
aaaacugugcugagaaa

SEQ ID NO: 1657938 - RNA, 17 nt, Homo sapiens
aaaacuucucauuuaug

SEQ ID NO: 1657939 - RNA, 13 nt, Homo sapiens
aaaagaaacugug

SEQ ID NO: 1657940 - RNA, 14 nt, Homo sapiens
aaaagaacugucuc

SEQ ID NO: 1657941 - RNA, 14 nt, Homo sapiens
aaaagaauucucag

SEQ ID NO: 1657942 - RNA, 15 nt, Homo sapiens
aaaagaccaugcauu

SEQ ID NO: 1657943 - RNA, 18 nt, Homo sapiens
aaaagcccuuuccaaagg

SEQ ID NO: 1657944 - RNA, 19 nt, Homo sapiens
aaaaggguguugcuaagcu

SEQ ID NO: 1657945 - RNA, 10 nt, Homo sapiens
aaaagugcaa

SEQ ID NO: 1657946 - RNA, 19 nt, Homo sapiens
aaaaguguuuuuacauaua

SEQ ID NO: 1657947 - RNA, 16 nt, Homo sapiens
aaaaguuuacagauca

SEQ ID NO: 1657948 - RNA, 15 nt, Homo sapiens
aaaaguuuucaagca

SEQ ID NO: 1657949 - RNA, 19 nt, Homo sapiens
aaaauaauaaaagaaucau

SEQ ID NO: 1657950 - RNA, 20 nt, Homo sapiens
aaaauacaguauuauuuagu

SEQ ID NO: 1657951 - RNA, 14 nt, Homo sapiens
aaaauacauacuau

SEQ ID NO: 1657952 - RNA, 14 nt, Homo sapiens
aaaauagcuauaaa

SEQ ID NO: 1657953 - RNA, 22 nt, Homo sapiens
aaaauaguugcaaagcauuuga

SEQ ID NO: 1657954 - RNA, 14 nt, Homo sapiens
aaaauauauguaau

SEQ ID NO: 1657955 - RNA, 20 nt, Homo sapiens
aaaaucaguuuguuguucag

SEQ ID NO: 1657956 - RNA, 23 nt, Homo sapiens
aaaaugaagacaccagaguguau

SEQ ID NO: 1657957 - RNA, 11 nt, Homo sapiens
aaaaugcagac

SEQ ID NO: 1657958 - RNA, 12 nt, Homo sapiens
aaaauguucauu

SEQ ID NO: 1657959 - RNA, 14 nt, Homo sapiens
aaaauguucauucu

SEQ ID NO: 1657960 - RNA, 14 nt, Homo sapiens
aaaauucauuccau

SEQ ID NO: 1657961 - RNA, 18 nt, Homo sapiens
aaaauuggagaacugcug

SEQ ID NO: 1657962 - RNA, 20 nt, Homo sapiens
aaacaaaaaaacccaggggc

SEQ ID NO: 1657963 - RNA, 18 nt, Homo sapiens
acauacucaagagcauaa

SEQ ID NO: 1657964 - RNA, 19 nt, Homo sapiens
acauagauuaauggcacug

SEQ ID NO: 1657965 - RNA, 21 nt, Homo sapiens
acauagauuaauggcacugau

SEQ ID NO: 1657966 - RNA, 19 nt, Homo sapiens
acauauauaugaaugcuug

SEQ ID NO: 1657967 - RNA, 16 nt, Homo sapiens
acauauucaaaguaua

SEQ ID NO: 1657968 - RNA, 14 nt, Homo sapiens
acaucaacauuccc

SEQ ID NO: 1657969 - RNA, 13 nt, Homo sapiens
acaucagcaucac

SEQ ID NO: 1657970 - RNA, 17 nt, Homo sapiens
acauccccuucugcaau

SEQ ID NO: 1657971 - RNA, 15 nt, Homo sapiens
acaucugcauuucua

SEQ ID NO: 1657972 - RNA, 19 nt, Homo sapiens
acaucuguccuacacuuga

SEQ ID NO: 1657973 - RNA, 14 nt, Homo sapiens
acaugacacugacc

SEQ ID NO: 1657974 - RNA, 15 nt, Homo sapiens
acaugacauccacau

SEQ ID NO: 1657975 - RNA, 18 nt, Homo sapiens
acauguauucuguuggcc

SEQ ID NO: 1657976 - RNA, 11 nt, Homo sapiens
acaugugauug

SEQ ID NO: 1657977 - RNA, 14 nt, Homo sapiens
acaugugauuguga

SEQ ID NO: 1657978 - RNA, 20 nt, Homo sapiens
acauguggcacguaaggucu

SEQ ID NO: 1657979 - RNA, 15 nt, Homo sapiens
acauuagacacacau

SEQ ID NO: 1657980 - RNA, 13 nt, Homo sapiens
acauuccacccca

SEQ ID NO: 1657981 - RNA, 18 nt, Homo sapiens
acauugaacacauuuccu

SEQ ID NO: 1657982 - RNA, 14 nt, Homo sapiens
acauugucccugcc

SEQ ID NO: 1657983 - RNA, 17 nt, Homo sapiens
acauuucccccuagccu

SEQ ID NO: 1657984 - RNA, 23 nt, Homo sapiens
acauuuguuccugggacuggcag

SEQ ID NO: 1657985 - RNA, 20 nt, Homo sapiens
acauuuuucauagauaccau

SEQ ID NO: 1657986 - RNA, 19 nt, Homo sapiens
accaagaaaaccaguggaa

SEQ ID NO: 1657987 - RNA, 11 nt, Homo sapiens
accaagcuaua

SEQ ID NO: 1657988 - RNA, 14 nt, Homo sapiens
accaaucucuguga

SEQ ID NO: 1657989 - RNA, 19 nt, Homo sapiens
accacaacugacacaggaa

SEQ ID NO: 1657990 - RNA, 21 nt, Homo sapiens
accacacgcccccacaggcuc

SEQ ID NO: 1657991 - RNA, 18 nt, Homo sapiens
accaccaaccacugcgac

SEQ ID NO: 1657992 - RNA, 20 nt, Homo sapiens
accacccccaucaucaccga

SEQ ID NO: 1657993 - RNA, 16 nt, Homo sapiens
accacgguuucagcuu

SEQ ID NO: 1657994 - RNA, 15 nt, Homo sapiens
accacucucaggacc

SEQ ID NO: 1657995 - RNA, 13 nt, Homo sapiens
accacuguuugau

SEQ ID NO: 1657996 - RNA, 21 nt, Homo sapiens
accacuuucccacacugugaa

SEQ ID NO: 1657997 - RNA, 19 nt, Homo sapiens
accacuuugucucugagaa

SEQ ID NO: 1657998 - RNA, 18 nt, Homo sapiens
accagaaaucuaaucucu

SEQ ID NO: 1657999 - RNA, 14 nt, Homo sapiens
accagagcugccac

SEQ ID NO: 1658000 - RNA, 16 nt, Homo sapiens
accagcaaugagaagg

SEQ ID NO: 1658001 - RNA, 21 nt, Homo sapiens
accagcuuguccaacaacucc

SEQ ID NO: 1658002 - RNA, 17 nt, Homo sapiens
accaggccuccaagcca

SEQ ID NO: 1658003 - RNA, 19 nt, Homo sapiens
accaggcuacaguugauau

SEQ ID NO: 1658004 - RNA, 14 nt, Homo sapiens
accagguuaccuca

SEQ ID NO: 1658005 - RNA, 16 nt, Homo sapiens
accagguuaccucacu

SEQ ID NO: 1658006 - RNA, 17 nt, Homo sapiens
accaguggaagauuucu

SEQ ID NO: 1658007 - RNA, 14 nt, Homo sapiens
accagugugcuugg

SEQ ID NO: 1658008 - RNA, 17 nt, Homo sapiens
accaguucuuugggcug

SEQ ID NO: 1658009 - RNA, 21 nt, Homo sapiens
accaguuugaaccaagaacuu

SEQ ID NO: 1658010 - RNA, 21 nt, Homo sapiens
accauaagcuuuuucucugaa

SEQ ID NO: 1658011 - RNA, 22 nt, Homo sapiens
accaucaaacaaaucauuuuga

SEQ ID NO: 1658012 - RNA, 21 nt, Homo sapiens
accaucucuccuccuuuucac

SEQ ID NO: 1658013 - RNA, 21 nt, Homo sapiens
accaugaauuaaaggugccag

SEQ ID NO: 1658014 - RNA, 14 nt, Homo sapiens
accaugcccagcua

SEQ ID NO: 1658015 - RNA, 22 nt, Homo sapiens
accauguuggcuagacuagucu

SEQ ID NO: 1658016 - RNA, 19 nt, Homo sapiens
accauuauggcuuugugcu

SEQ ID NO: 1658017 - RNA, 22 nt, Homo sapiens
accauuauggcuuugugcuugu

SEQ ID NO: 1658018 - RNA, 20 nt, Homo sapiens
accauuuagcacacugcuug

SEQ ID NO: 1658019 - RNA, 21 nt, Homo sapiens
accauuuggucaggauuccug

SEQ ID NO: 1658020 - RNA, 17 nt, Homo sapiens
acccagaaauccauuug

SEQ ID NO: 1658021 - RNA, 19 nt, Homo sapiens
acccagguuggagugcagu

SEQ ID NO: 1658022 - RNA, 20 nt, Homo sapiens
acccagguuggagugcagug

SEQ ID NO: 1658023 - RNA, 17 nt, Homo sapiens
acccaguguucagcaua

SEQ ID NO: 1658024 - RNA, 18 nt, Homo sapiens
aacggaugaccauaugca

SEQ ID NO: 1658025 - RNA, 21 nt, Homo sapiens
aacgggucugugggacuggcc

SEQ ID NO: 1658026 - RNA, 23 nt, Homo sapiens
aacguggauugugaagauuucau

SEQ ID NO: 1658027 - RNA, 22 nt, Homo sapiens
aacuaaaggaaacaaagcaaua

SEQ ID NO: 1658028 - RNA, 13 nt, Homo sapiens
aacuaaauguugc

SEQ ID NO: 1658029 - RNA, 16 nt, Homo sapiens
aacuaaugacaaguga

SEQ ID NO: 1658030 - RNA, 20 nt, Homo sapiens
aacuacagaaagagcgucau

SEQ ID NO: 1658031 - RNA, 21 nt, Homo sapiens
aacuagcacuuuauaagccaa

SEQ ID NO: 1658032 - RNA, 13 nt, Homo sapiens
aacuauugcugcu

SEQ ID NO: 1658033 - RNA, 20 nt, Homo sapiens
aacuauuucuacacaguggg

SEQ ID NO: 1658034 - RNA, 12 nt, Homo sapiens
aacucaccaggg

SEQ ID NO: 1658035 - RNA, 19 nt, Homo sapiens
aacucagcaauggcagauu

SEQ ID NO: 1658036 - RNA, 13 nt, Homo sapiens
aacucagcugucu

SEQ ID NO: 1658037 - RNA, 10 nt, Homo sapiens
aacucaggga

SEQ ID NO: 1658038 - RNA, 15 nt, Homo sapiens
aacucaguccugaca

SEQ ID NO: 1658039 - RNA, 21 nt, Homo sapiens
aacucauaaaggagcauauaa

SEQ ID NO: 1658040 - RNA, 16 nt, Homo sapiens
aacuccuuggccuagc

SEQ ID NO: 1658041 - RNA, 21 nt, Homo sapiens
aacucucagucagugucauga

SEQ ID NO: 1658042 - RNA, 22 nt, Homo sapiens
aacucugacaagggcugaccug

SEQ ID NO: 1658043 - RNA, 22 nt, Homo sapiens
aacucuuacggcuaucuaguug

SEQ ID NO: 1658044 - RNA, 18 nt, Homo sapiens
aacugaaagguagacuuu

SEQ ID NO: 1658045 - RNA, 17 nt, Homo sapiens
aacugaagcagagucaa

SEQ ID NO: 1658046 - RNA, 12 nt, Homo sapiens
aacugaagccca

SEQ ID NO: 1658047 - RNA, 14 nt, Homo sapiens
aacugaagcccaca

SEQ ID NO: 1658048 - RNA, 16 nt, Homo sapiens
aacugagcacuuugaa

SEQ ID NO: 1658049 - RNA, 20 nt, Homo sapiens
aacugaguuagaauguugaa

SEQ ID NO: 1658050 - RNA, 12 nt, Homo sapiens
aacugauuucca

SEQ ID NO: 1658051 - RNA, 10 nt, Homo sapiens
aacugcauuu

SEQ ID NO: 1658052 - RNA, 17 nt, Homo sapiens
aacugccacaagcacaa

SEQ ID NO: 1658053 - RNA, 22 nt, Homo sapiens
aacugcuacugaccaucugcac

SEQ ID NO: 1658054 - RNA, 19 nt, Homo sapiens
aacugcuugugcacuggau

SEQ ID NO: 1658055 - RNA, 19 nt, Homo sapiens
aacuguaguaauuguuaca

SEQ ID NO: 1658056 - RNA, 15 nt, Homo sapiens
aacugucucuuucag

SEQ ID NO: 1658057 - RNA, 22 nt, Homo sapiens
aacuguggaaggcacacugagc

SEQ ID NO: 1658058 - RNA, 14 nt, Homo sapiens
aacuucaucugucu

SEQ ID NO: 1658059 - RNA, 14 nt, Homo sapiens
aacuuccaguauca

SEQ ID NO: 1658060 - RNA, 21 nt, Homo sapiens
aacuuccauagcuucauccac

SEQ ID NO: 1658061 - RNA, 19 nt, Homo sapiens
aacuuuauuggucuugccc

SEQ ID NO: 1658062 - RNA, 21 nt, Homo sapiens
aacuuucccuccaccagugug

SEQ ID NO: 1658063 - RNA, 20 nt, Homo sapiens
aacuuuuaagccauuuauca

SEQ ID NO: 1658064 - RNA, 20 nt, Homo sapiens
aacuuuuccuggacacuuua

SEQ ID NO: 1658065 - RNA, 15 nt, Homo sapiens
aagaaaacccaacuc

SEQ ID NO: 1658066 - RNA, 15 nt, Homo sapiens
aagaaagaaaccaga

SEQ ID NO: 1658067 - RNA, 22 nt, Homo sapiens
aagaaaugagaaauugugccaa

SEQ ID NO: 1658068 - RNA, 18 nt, Homo sapiens
aagaaccuacgugaccau

SEQ ID NO: 1658069 - RNA, 21 nt, Homo sapiens
aagaaccuuuugagugccuua

SEQ ID NO: 1658070 - RNA, 15 nt, Homo sapiens
aagaacucaugugau

SEQ ID NO: 1658071 - RNA, 17 nt, Homo sapiens
aagaacugucucuuuca

SEQ ID NO: 1658072 - RNA, 16 nt, Homo sapiens
aagaagagaucaggaa

SEQ ID NO: 1658073 - RNA, 17 nt, Homo sapiens
aagaagccagcaccacc

SEQ ID NO: 1658074 - RNA, 14 nt, Homo sapiens
aagaaggcaaccca

SEQ ID NO: 1658075 - RNA, 18 nt, Homo sapiens
aagaaguaugucaguuau

SEQ ID NO: 1658076 - RNA, 17 nt, Homo sapiens
aagaaguccaugugaua

SEQ ID NO: 1658077 - RNA, 18 nt, Homo sapiens
aagaauaaaaugcaguga

SEQ ID NO: 1658078 - RNA, 20 nt, Homo sapiens
aagaauaaaaugcagugaaa

SEQ ID NO: 1658079 - RNA, 13 nt, Homo sapiens
aagaauguauucg

SEQ ID NO: 1658080 - RNA, 20 nt, Homo sapiens
aagaauuggcagaagcaguu

SEQ ID NO: 1658081 - RNA, 23 nt, Homo sapiens
aagaauugugccucucccaaguc

SEQ ID NO: 1658082 - RNA, 17 nt, Homo sapiens
aagaauuuuaauauugc

SEQ ID NO: 1658083 - RNA, 20 nt, Homo sapiens
aagaauuuuaauauugccau

SEQ ID NO: 1658084 - RNA, 22 nt, Homo sapiens
aagacaaaugggccugccaaac

SEQ ID NO: 1658085 - RNA, 17 nt, Homo sapiens
aagacaauuuuaauguu

SEQ ID NO: 1658086 - RNA, 12 nt, Homo sapiens
aagacaccacca

SEQ ID NO: 1658087 - RNA, 21 nt, Homo sapiens
aagacacguucuugccagcuu

SEQ ID NO: 1658088 - RNA, 13 nt, Homo sapiens
aagacauucacca

SEQ ID NO: 1658089 - RNA, 17 nt, Homo sapiens
aagacauucaccaacaa

SEQ ID NO: 1658090 - RNA, 17 nt, Homo sapiens
aagacccuaggugcuca

SEQ ID NO: 1658091 - RNA, 15 nt, Homo sapiens
aagacccucaguuau

SEQ ID NO: 1658092 - RNA, 20 nt, Homo sapiens
aagacgaggcggcaaagauc

SEQ ID NO: 1658093 - RNA, 17 nt, Homo sapiens
aagacuaucaaagacaa

SEQ ID NO: 1658094 - RNA, 16 nt, Homo sapiens
aagacuuuucuuucag

SEQ ID NO: 1658095 - RNA, 15 nt, Homo sapiens
aagagaaaugagcuu

SEQ ID NO: 1658096 - RNA, 16 nt, Homo sapiens
aagagaccacuuccuu

SEQ ID NO: 1658097 - RNA, 22 nt, Homo sapiens
aagagacuuggaaaugggagac

SEQ ID NO: 1658098 - RNA, 21 nt, Homo sapiens
aagagaguggaagaacugcaa

SEQ ID NO: 1658099 - RNA, 14 nt, Homo sapiens
aagagaucaggaag

SEQ ID NO: 1658100 - RNA, 17 nt, Homo sapiens
aagagcgucauguccuu

SEQ ID NO: 1658101 - RNA, 11 nt, Homo sapiens
aagagcuguuc

SEQ ID NO: 1658102 - RNA, 20 nt, Homo sapiens
aagagggaggggcccuguca

SEQ ID NO: 1658103 - RNA, 23 nt, Homo sapiens
aagagucuuugauucaccaaaca

SEQ ID NO: 1658104 - RNA, 22 nt, Homo sapiens
aagauaaaaucuucaacuaauu

SEQ ID NO: 1658105 - RNA, 20 nt, Homo sapiens
aagauaaguguguuugcaaa

SEQ ID NO: 1658106 - RNA, 13 nt, Homo sapiens
aagauaguuguaa

SEQ ID NO: 1658107 - RNA, 13 nt, Homo sapiens
aagaucaagcucc

SEQ ID NO: 1658108 - RNA, 16 nt, Homo sapiens
aagaugugucuucaau

SEQ ID NO: 1658109 - RNA, 17 nt, Homo sapiens
aagauugauuaaugaac

SEQ ID NO: 1658110 - RNA, 20 nt, Homo sapiens
aagauuucauggacacugau

SEQ ID NO: 1658111 - RNA, 14 nt, Homo sapiens
aagcaaacacacuc

SEQ ID NO: 1658112 - RNA, 12 nt, Homo sapiens
aagcaauguggu

SEQ ID NO: 1658113 - RNA, 22 nt, Homo sapiens
aagcaauuagaagccauccuaa

SEQ ID NO: 1658114 - RNA, 12 nt, Homo sapiens
aagcaauucuaa

SEQ ID NO: 1658115 - RNA, 19 nt, Homo sapiens
aagcacaugccucucucag

SEQ ID NO: 1658116 - RNA, 13 nt, Homo sapiens
aagcaccaugaau

SEQ ID NO: 1658117 - RNA, 19 nt, Homo sapiens
aagcacuggacuacaaggg

SEQ ID NO: 1658118 - RNA, 12 nt, Homo sapiens
aagcagcagcua

SEQ ID NO: 1658119 - RNA, 13 nt, Homo sapiens
aagcagccuccac

SEQ ID NO: 1658120 - RNA, 19 nt, Homo sapiens
aagcaguuuacucuagacu

SEQ ID NO: 1658121 - RNA, 18 nt, Homo sapiens
aagcauuacccauagguc

SEQ ID NO: 1658122 - RNA, 20 nt, Homo sapiens
aagccagcaggcucucaggc

SEQ ID NO: 1658123 - RNA, 18 nt, Homo sapiens
aagcccccuacugagaaa

SEQ ID NO: 1658124 - RNA, 13 nt, Homo sapiens
aagcucacacuug

SEQ ID NO: 1658125 - RNA, 15 nt, Homo sapiens
aagcucagcuuagaa

SEQ ID NO: 1658126 - RNA, 18 nt, Homo sapiens
aagcucauagcacauguu

SEQ ID NO: 1658127 - RNA, 16 nt, Homo sapiens
aagcuccaguagcucc

SEQ ID NO: 1658128 - RNA, 13 nt, Homo sapiens
aagcucuguccaa

SEQ ID NO: 1658129 - RNA, 15 nt, Homo sapiens
aagcuggagugcagu

SEQ ID NO: 1658130 - RNA, 20 nt, Homo sapiens
aagcuggagugcaguggcau

SEQ ID NO: 1658131 - RNA, 20 nt, Homo sapiens
aagcugggagaaccaaaaag

SEQ ID NO: 1658132 - RNA, 22 nt, Homo sapiens
aagcuuguauuaucagugaaua

SEQ ID NO: 1658133 - RNA, 14 nt, Homo sapiens
aaggaagcacaugc

SEQ ID NO: 1658134 - RNA, 13 nt, Homo sapiens
aaggacugaagaa

SEQ ID NO: 1658135 - RNA, 17 nt, Homo sapiens
aaggaguucagauguuu

SEQ ID NO: 1658136 - RNA, 14 nt, Homo sapiens
aaggauugugaacu

SEQ ID NO: 1658137 - RNA, 15 nt, Homo sapiens
aaggauuuauucuca

SEQ ID NO: 1658138 - RNA, 15 nt, Homo sapiens
aaggcacacugagca

SEQ ID NO: 1658139 - RNA, 22 nt, Homo sapiens
aaggcagagggaugaaaugcca

SEQ ID NO: 1658140 - RNA, 24 nt, Homo sapiens
aaggcauccacuucacaguucuga

SEQ ID NO: 1658141 - RNA, 15 nt, Homo sapiens
aaggcaucuaagaca

SEQ ID NO: 1658142 - RNA, 22 nt, Homo sapiens
aaggcccagccuguaacugucc

SEQ ID NO: 1658143 - RNA, 17 nt, Homo sapiens
aaggccccaagguuuac

SEQ ID NO: 1658144 - RNA, 16 nt, Homo sapiens
aaggcuccaucuccag

SEQ ID NO: 1658145 - RNA, 20 nt, Homo sapiens
aaggcugucaauuacaggaa

SEQ ID NO: 1658146 - RNA, 13 nt, Homo sapiens
acccucgcugcca

SEQ ID NO: 1658147 - RNA, 21 nt, Homo sapiens
acccugucuaaugaaaccugu

SEQ ID NO: 1658148 - RNA, 13 nt, Homo sapiens
accggccacugca

SEQ ID NO: 1658149 - RNA, 15 nt, Homo sapiens
accggccacugcaac

SEQ ID NO: 1658150 - RNA, 16 nt, Homo sapiens
accgggaaaggcaucu

SEQ ID NO: 1658151 - RNA, 22 nt, Homo sapiens
accgggagccucccccucagau

SEQ ID NO: 1658152 - RNA, 14 nt, Homo sapiens
accgugacugcaag

SEQ ID NO: 1658153 - RNA, 14 nt, Homo sapiens
accuaccacauuca

SEQ ID NO: 1658154 - RNA, 16 nt, Homo sapiens
accuaccacauucacu

SEQ ID NO: 1658155 - RNA, 21 nt, Homo sapiens
accuaccuuauagagcacaau

SEQ ID NO: 1658156 - RNA, 17 nt, Homo sapiens
accuaugugugugcuuu

SEQ ID NO: 1658157 - RNA, 12 nt, Homo sapiens
accucacaguga

SEQ ID NO: 1658158 - RNA, 14 nt, Homo sapiens
accucagcuugcac

SEQ ID NO: 1658159 - RNA, 24 nt, Homo sapiens
accuccccugguccugcacugucc

SEQ ID NO: 1658160 - RNA, 18 nt, Homo sapiens
accucgaaugcuccuaaa

SEQ ID NO: 1658161 - RNA, 17 nt, Homo sapiens
accucggggagugccac

SEQ ID NO: 1658162 - RNA, 16 nt, Homo sapiens
accucucaacuuacau

SEQ ID NO: 1658163 - RNA, 16 nt, Homo sapiens
accucugaggaccuca

SEQ ID NO: 1658164 - RNA, 14 nt, Homo sapiens
accucuuagcuuuu

SEQ ID NO: 1658165 - RNA, 18 nt, Homo sapiens
accucuugaagaacugac

SEQ ID NO: 1658166 - RNA, 22 nt, Homo sapiens
accucuuuggauguuuucccca

SEQ ID NO: 1658167 - RNA, 23 nt, Homo sapiens
accugaauuaaagucuacacugc

SEQ ID NO: 1658168 - RNA, 22 nt, Homo sapiens
accugacuuuggagacgaugcu

SEQ ID NO: 1658169 - RNA, 19 nt, Homo sapiens
accugauacaauuugccca

SEQ ID NO: 1658170 - RNA, 15 nt, Homo sapiens
accugcccacgcuag

SEQ ID NO: 1658171 - RNA, 15 nt, Homo sapiens
accugcuucauucaa

SEQ ID NO: 1658172 - RNA, 23 nt, Homo sapiens
accugcuuugagauuuccugaca

SEQ ID NO: 1658173 - RNA, 18 nt, Homo sapiens
accuggaaagccagguug

SEQ ID NO: 1658174 - RNA, 17 nt, Homo sapiens
accuggagccaucuucc

SEQ ID NO: 1658175 - RNA, 18 nt, Homo sapiens
accuggaggcuggaccaa

SEQ ID NO: 1658176 - RNA, 23 nt, Homo sapiens
accuggcccagugcaaucugucc

SEQ ID NO: 1658177 - RNA, 15 nt, Homo sapiens
accuguaauagccuc

SEQ ID NO: 1658178 - RNA, 16 nt, Homo sapiens
accuguaauagccuca

SEQ ID NO: 1658179 - RNA, 17 nt, Homo sapiens
accuguagaaaagugag

SEQ ID NO: 1658180 - RNA, 18 nt, Homo sapiens
accugucaaccugaauua

SEQ ID NO: 1658181 - RNA, 22 nt, Homo sapiens
accuguucacgugacuccucaa

SEQ ID NO: 1658182 - RNA, 19 nt, Homo sapiens
accuuaauuugaaauaaca

SEQ ID NO: 1658183 - RNA, 22 nt, Homo sapiens
accuuauagagcacaauauuaa

SEQ ID NO: 1658184 - RNA, 16 nt, Homo sapiens
accuucaugguguuca

SEQ ID NO: 1658185 - RNA, 18 nt, Homo sapiens
accuuccugggcagccca

SEQ ID NO: 1658186 - RNA, 23 nt, Homo sapiens
accuuccugggcagcccagagag

SEQ ID NO: 1658187 - RNA, 14 nt, Homo sapiens
accuucugaugaag

SEQ ID NO: 1658188 - RNA, 20 nt, Homo sapiens
accuucugaugaaguuguac

SEQ ID NO: 1658189 - RNA, 12 nt, Homo sapiens
accuugcugcua

SEQ ID NO: 1658190 - RNA, 13 nt, Homo sapiens
accuuguuucccu

SEQ ID NO: 1658191 - RNA, 21 nt, Homo sapiens
accuuucaugugccugaaggc

SEQ ID NO: 1658192 - RNA, 15 nt, Homo sapiens
accuuugggcaaagg

SEQ ID NO: 1658193 - RNA, 22 nt, Homo sapiens
accuuugucucacgauuccagu

SEQ ID NO: 1658194 - RNA, 15 nt, Homo sapiens
accuuuuuaauccag

SEQ ID NO: 1658195 - RNA, 13 nt, Homo sapiens
acgcucucugucu

SEQ ID NO: 1658196 - RNA, 17 nt, Homo sapiens
acggaugaccauaugca

SEQ ID NO: 1658197 - RNA, 16 nt, Homo sapiens
acgguccaauccagcc

SEQ ID NO: 1658198 - RNA, 20 nt, Homo sapiens
acgguguccaugccuuccau

SEQ ID NO: 1658199 - RNA, 13 nt, Homo sapiens
acgguuucagcuu

SEQ ID NO: 1658200 - RNA, 15 nt, Homo sapiens
acguaaggucucauu

SEQ ID NO: 1658201 - RNA, 18 nt, Homo sapiens
acguaauuuguuauauca

SEQ ID NO: 1658202 - RNA, 19 nt, Homo sapiens
acgucccgggcacugucau

SEQ ID NO: 1658203 - RNA, 23 nt, Homo sapiens
acgucccgggcacugucaugccc

SEQ ID NO: 1658204 - RNA, 12 nt, Homo sapiens
acgucugugagu

SEQ ID NO: 1658205 - RNA, 13 nt, Homo sapiens
acgugacuuucaa

SEQ ID NO: 1658206 - RNA, 17 nt, Homo sapiens
acgugccugcuuaccug

SEQ ID NO: 1658207 - RNA, 15 nt, Homo sapiens
acguggccgcugccc

SEQ ID NO: 1658208 - RNA, 14 nt, Homo sapiens
acgugucaaugugu

SEQ ID NO: 1658209 - RNA, 19 nt, Homo sapiens
acguuuguuucuucgugcc

SEQ ID NO: 1658210 - RNA, 22 nt, Homo sapiens
acuaaaacaaguacaucuguac

SEQ ID NO: 1658211 - RNA, 15 nt, Homo sapiens
acuaaagggugcaug

SEQ ID NO: 1658212 - RNA, 13 nt, Homo sapiens
acuaacacuggcu

SEQ ID NO: 1658213 - RNA, 20 nt, Homo sapiens
acuaaccccaacgcacagga

SEQ ID NO: 1658214 - RNA, 23 nt, Homo sapiens
acuaaguaaccucuacaggcauu

SEQ ID NO: 1658215 - RNA, 16 nt, Homo sapiens
acuaauaaaauacaua

SEQ ID NO: 1658216 - RNA, 17 nt, Homo sapiens
acuaaucaauacuuuga

SEQ ID NO: 1658217 - RNA, 16 nt, Homo sapiens
acuaaugucagcacau

SEQ ID NO: 1658218 - RNA, 11 nt, Homo sapiens
acuacagugag

SEQ ID NO: 1658219 - RNA, 13 nt, Homo sapiens
acuacauuugcau

SEQ ID NO: 1658220 - RNA, 20 nt, Homo sapiens
acuaccccaggaugcaugca

SEQ ID NO: 1658221 - RNA, 14 nt, Homo sapiens
acuacgacuggcau

SEQ ID NO: 1658222 - RNA, 13 nt, Homo sapiens
acuagaagcacag

SEQ ID NO: 1658223 - RNA, 23 nt, Homo sapiens
acuaucagggcaagcucauagca

SEQ ID NO: 1658224 - RNA, 20 nt, Homo sapiens
acuauguuuagugugauugu

SEQ ID NO: 1658225 - RNA, 13 nt, Homo sapiens
acuauugcugcuu

SEQ ID NO: 1658226 - RNA, 21 nt, Homo sapiens
acuauuggacagacacagagg

SEQ ID NO: 1658227 - RNA, 15 nt, Homo sapiens
acucaagauacugga

SEQ ID NO: 1658228 - RNA, 20 nt, Homo sapiens
acucaggagcacagccauag

SEQ ID NO: 1658229 - RNA, 20 nt, Homo sapiens
acucaguaaaucagugcagu

SEQ ID NO: 1658230 - RNA, 18 nt, Homo sapiens
acucaguaacagugcagu

SEQ ID NO: 1658231 - RNA, 21 nt, Homo sapiens
acucaguaaggcagugcagua

SEQ ID NO: 1658232 - RNA, 17 nt, Homo sapiens
acucaguauauagccuu

SEQ ID NO: 1658233 - RNA, 22 nt, Homo sapiens
acucauacagucucuauuugau

SEQ ID NO: 1658234 - RNA, 20 nt, Homo sapiens
acucauacucagagcauuau

SEQ ID NO: 1658235 - RNA, 14 nt, Homo sapiens
acucauccauuaau

SEQ ID NO: 1658236 - RNA, 19 nt, Homo sapiens
acucaucccccaucagaug

SEQ ID NO: 1658237 - RNA, 22 nt, Homo sapiens
acucaucuugggaagggccaug

SEQ ID NO: 1658238 - RNA, 17 nt, Homo sapiens
acucauguucauucagc

SEQ ID NO: 1658239 - RNA, 22 nt, Homo sapiens
acuccagccugggugacagagc

SEQ ID NO: 1658240 - RNA, 22 nt, Homo sapiens
acuccucuccuccccccaagcu

SEQ ID NO: 1658241 - RNA, 21 nt, Homo sapiens
acuccucugucauaugcagaa

SEQ ID NO: 1658242 - RNA, 16 nt, Homo sapiens
acucggcgugcuccuu

SEQ ID NO: 1658243 - RNA, 17 nt, Homo sapiens
acucggcgugcuccuuu

SEQ ID NO: 1658244 - RNA, 18 nt, Homo sapiens
acucggucugagaagauu

SEQ ID NO: 1658245 - RNA, 21 nt, Homo sapiens
acucucagucagugucaugaa

SEQ ID NO: 1658246 - RNA, 18 nt, Homo sapiens
acucucccuuguccuccu

SEQ ID NO: 1658247 - RNA, 18 nt, Homo sapiens
acucugacuguaaaauac

SEQ ID NO: 1658248 - RNA, 15 nt, Homo sapiens
acucugcaccuaauc

SEQ ID NO: 1658249 - RNA, 15 nt, Homo sapiens
acucuggcugccaag

SEQ ID NO: 1658250 - RNA, 18 nt, Homo sapiens
acucuuuaguugauuuaa

SEQ ID NO: 1658251 - RNA, 17 nt, Homo sapiens
acugaaagguagacuuu

SEQ ID NO: 1658252 - RNA, 16 nt, Homo sapiens
acugaaauuaguguuu

SEQ ID NO: 1658253 - RNA, 17 nt, Homo sapiens
acugaacgauccuucaa

SEQ ID NO: 1658254 - RNA, 13 nt, Homo sapiens
acugaccaucugc

SEQ ID NO: 1658255 - RNA, 14 nt, Homo sapiens
acugaccaucugca

SEQ ID NO: 1658256 - RNA, 19 nt, Homo sapiens
acugacuccaaccauucaa

SEQ ID NO: 1658257 - RNA, 14 nt, Homo sapiens
acugagcacuuuga

SEQ ID NO: 1658258 - RNA, 17 nt, Homo sapiens
acugaugguugcuuuga

SEQ ID NO: 1658259 - RNA, 16 nt, Homo sapiens
acugcaagcucugccu

SEQ ID NO: 1658260 - RNA, 12 nt, Homo sapiens
acugcacaaaag

SEQ ID NO: 1658261 - RNA, 20 nt, Homo sapiens
acugcacacaugguuuccaa

SEQ ID NO: 1658262 - RNA, 21 nt, Homo sapiens
acugcauccuguaaggucugu

SEQ ID NO: 1658263 - RNA, 23 nt, Homo sapiens
acugccauuuuuugucugugaua

SEQ ID NO: 1658264 - RNA, 16 nt, Homo sapiens
acugcccagagccaca

SEQ ID NO: 1658265 - RNA, 17 nt, Homo sapiens
acugcccccuccacugg

SEQ ID NO: 1658266 - RNA, 22 nt, Homo sapiens
acugccgaaacccuugacuguu

SEQ ID NO: 1658267 - RNA, 19 nt, Homo sapiens
acugccuggaaagcccuuc

SEQ ID NO: 1658268 - RNA, 17 nt, Homo sapiens
aggcggucacugcccac

SEQ ID NO: 1658269 - RNA, 13 nt, Homo sapiens
aggcggugagcaa

SEQ ID NO: 1658270 - RNA, 22 nt, Homo sapiens
aggcguugugaaugugucccau

SEQ ID NO: 1658271 - RNA, 15 nt, Homo sapiens
aggcucacaacuguu

SEQ ID NO: 1658272 - RNA, 15 nt, Homo sapiens
aggcucuaauguaca

SEQ ID NO: 1658273 - RNA, 13 nt, Homo sapiens
aggcugaaaccau

SEQ ID NO: 1658274 - RNA, 17 nt, Homo sapiens
aggcugggccugaacua

SEQ ID NO: 1658275 - RNA, 16 nt, Homo sapiens
aggcuucuauguccaa

SEQ ID NO: 1658276 - RNA, 21 nt, Homo sapiens
aggcuucuuccccccaaaacu

SEQ ID NO: 1658277 - RNA, 23 nt, Homo sapiens
aggcuugaucaugaaucacugca

SEQ ID NO: 1658278 - RNA, 14 nt, Homo sapiens
agggaaaaauggga

SEQ ID NO: 1658279 - RNA, 23 nt, Homo sapiens
agggaaaacaaauauuucacuua

SEQ ID NO: 1658280 - RNA, 16 nt, Homo sapiens
agggaagcaccaugaa

SEQ ID NO: 1658281 - RNA, 17 nt, Homo sapiens
agggaagcaccaugaau

SEQ ID NO: 1658282 - RNA, 17 nt, Homo sapiens
agggaaggugagccaga

SEQ ID NO: 1658283 - RNA, 15 nt, Homo sapiens
agggaaugccaggga

SEQ ID NO: 1658284 - RNA, 19 nt, Homo sapiens
agggacacacgugagccac

SEQ ID NO: 1658285 - RNA, 19 nt, Homo sapiens
agggacagccugcacagug

SEQ ID NO: 1658286 - RNA, 16 nt, Homo sapiens
agggacugccucugcc

SEQ ID NO: 1658287 - RNA, 12 nt, Homo sapiens
agggaggggaag

SEQ ID NO: 1658288 - RNA, 23 nt, Homo sapiens
agggcaaaaugaacuaacugcca

SEQ ID NO: 1658289 - RNA, 19 nt, Homo sapiens
agggcaacuugaggucuga

SEQ ID NO: 1658290 - RNA, 19 nt, Homo sapiens
agggcaagcucauagcaca

SEQ ID NO: 1658291 - RNA, 16 nt, Homo sapiens
agggcacaaccagaaa

SEQ ID NO: 1658292 - RNA, 22 nt, Homo sapiens
agggcagaaccaagaacauaaa

SEQ ID NO: 1658293 - RNA, 19 nt, Homo sapiens
agggcagccaccaggagag

SEQ ID NO: 1658294 - RNA, 17 nt, Homo sapiens
agggcaggguucuagaa

SEQ ID NO: 1658295 - RNA, 16 nt, Homo sapiens
agggcuagaagcacag

SEQ ID NO: 1658296 - RNA, 20 nt, Homo sapiens
agggcugggcgccucugucc

SEQ ID NO: 1658297 - RNA, 14 nt, Homo sapiens
agggcuucuaccag

SEQ ID NO: 1658298 - RNA, 23 nt, Homo sapiens
aggggagguggccagcccgcaga

SEQ ID NO: 1658299 - RNA, 15 nt, Homo sapiens
aggggcaacugauga

SEQ ID NO: 1658300 - RNA, 15 nt, Homo sapiens
aggggccaggacaaa

SEQ ID NO: 1658301 - RNA, 17 nt, Homo sapiens
agggggauaaagagggu

SEQ ID NO: 1658302 - RNA, 14 nt, Homo sapiens
aggggguacagucc

SEQ ID NO: 1658303 - RNA, 15 nt, Homo sapiens
aggggucagcagggg

SEQ ID NO: 1658304 - RNA, 17 nt, Homo sapiens
agggguuaaugcagaug

SEQ ID NO: 1658305 - RNA, 14 nt, Homo sapiens
agggugaaccaagc

SEQ ID NO: 1658306 - RNA, 19 nt, Homo sapiens
agggugaggcccacucugu

SEQ ID NO: 1658307 - RNA, 19 nt, Homo sapiens
aggguggcacccaccacuc

SEQ ID NO: 1658308 - RNA, 14 nt, Homo sapiens
agguagcuuaccug

SEQ ID NO: 1658309 - RNA, 17 nt, Homo sapiens
agguaguagaaucucag

SEQ ID NO: 1658310 - RNA, 22 nt, Homo sapiens
agguaguagaaucucagcacuu

SEQ ID NO: 1658311 - RNA, 23 nt, Homo sapiens
agguaguagaaucucagcacuuu

SEQ ID NO: 1658312 - RNA, 18 nt, Homo sapiens
agguaucaaaauguuguc

SEQ ID NO: 1658313 - RNA, 14 nt, Homo sapiens
agguaucugaugau

SEQ ID NO: 1658314 - RNA, 22 nt, Homo sapiens
agguaugugucagccaugacca

SEQ ID NO: 1658315 - RNA, 16 nt, Homo sapiens
agguccugcuguggaa

SEQ ID NO: 1658316 - RNA, 17 nt, Homo sapiens
aggucuccaccccucaa

SEQ ID NO: 1658317 - RNA, 22 nt, Homo sapiens
aggucuguugaagugcauguua

SEQ ID NO: 1658318 - RNA, 18 nt, Homo sapiens
aggugaugguaacugcac

SEQ ID NO: 1658319 - RNA, 13 nt, Homo sapiens
aggugcuuaccuc

SEQ ID NO: 1658320 - RNA, 13 nt, Homo sapiens
aggugugccaaac

SEQ ID NO: 1658321 - RNA, 14 nt, Homo sapiens
agguuggagugcag

SEQ ID NO: 1658322 - RNA, 22 nt, Homo sapiens
agguugugaugauagcacuggu

SEQ ID NO: 1658323 - RNA, 19 nt, Homo sapiens
agguuucacuguucaugaa

SEQ ID NO: 1658324 - RNA, 14 nt, Homo sapiens
agguuuuaugagac

SEQ ID NO: 1658325 - RNA, 19 nt, Homo sapiens
aguaaaauuauacugugug

SEQ ID NO: 1658326 - RNA, 16 nt, Homo sapiens
aguaaauacauuauug

SEQ ID NO: 1658327 - RNA, 13 nt, Homo sapiens
aguaaauccacag

SEQ ID NO: 1658328 - RNA, 22 nt, Homo sapiens
aguaacacagggcagcuaguac

SEQ ID NO: 1658329 - RNA, 21 nt, Homo sapiens
aguaacacagugcagugcuca

SEQ ID NO: 1658330 - RNA, 20 nt, Homo sapiens
aguaacccugucuaaugaaa

SEQ ID NO: 1658331 - RNA, 19 nt, Homo sapiens
aguaaccucuacaggcauu

SEQ ID NO: 1658332 - RNA, 17 nt, Homo sapiens
aguaagacagugcagug

SEQ ID NO: 1658333 - RNA, 18 nt, Homo sapiens
aguaauaaaacauuagua

SEQ ID NO: 1658334 - RNA, 21 nt, Homo sapiens
aguaauacaauacaguacuca

SEQ ID NO: 1658335 - RNA, 21 nt, Homo sapiens
aguaauacaguacaguacuca

SEQ ID NO: 1658336 - RNA, 19 nt, Homo sapiens
aguaauagucccaguucca

SEQ ID NO: 1658337 - RNA, 17 nt, Homo sapiens
aguaauauauaaugugg

SEQ ID NO: 1658338 - RNA, 21 nt, Homo sapiens
aguacauaaggaguugccgca

SEQ ID NO: 1658339 - RNA, 13 nt, Homo sapiens
aguacauacucaa

SEQ ID NO: 1658340 - RNA, 20 nt, Homo sapiens
aguacucaggcagugcagua

SEQ ID NO: 1658341 - RNA, 19 nt, Homo sapiens
aguacucaguaacacagug

SEQ ID NO: 1658342 - RNA, 15 nt, Homo sapiens
aguacucaguaauac

SEQ ID NO: 1658343 - RNA, 24 nt, Homo sapiens
aguacucaguuaggcagugcagua

SEQ ID NO: 1658344 - RNA, 15 nt, Homo sapiens
aguacuuugucuuga

SEQ ID NO: 1658345 - RNA, 22 nt, Homo sapiens
aguacuuugucuugauccucac

SEQ ID NO: 1658346 - RNA, 22 nt, Homo sapiens
aguagaggguccagucuucuag

SEQ ID NO: 1658347 - RNA, 17 nt, Homo sapiens
aguagcucgugugcuua

SEQ ID NO: 1658348 - RNA, 23 nt, Homo sapiens
aguaguacuucuucuguaauauu

SEQ ID NO: 1658349 - RNA, 16 nt, Homo sapiens
aguagugccugugauc

SEQ ID NO: 1658350 - RNA, 21 nt, Homo sapiens
aguagugcuaucucaugacaa

SEQ ID NO: 1658351 - RNA, 20 nt, Homo sapiens
aguauaacuaauuugcucug

SEQ ID NO: 1658352 - RNA, 18 nt, Homo sapiens
aguaugauuuguuccuuu

SEQ ID NO: 1658353 - RNA, 21 nt, Homo sapiens
aguaugguucucggaguccaa

SEQ ID NO: 1658354 - RNA, 22 nt, Homo sapiens
aguauguacaggcugagacaca

SEQ ID NO: 1658355 - RNA, 21 nt, Homo sapiens
aguauguguauguacuuacau

SEQ ID NO: 1658356 - RNA, 21 nt, Homo sapiens
aguauuccuuuccugaucacu

SEQ ID NO: 1658357 - RNA, 17 nt, Homo sapiens
aguauuguacagcacug

SEQ ID NO: 1658358 - RNA, 16 nt, Homo sapiens
agucaagggcauuaca

SEQ ID NO: 1658359 - RNA, 20 nt, Homo sapiens
agucagaaaauuagcaugaa

SEQ ID NO: 1658360 - RNA, 14 nt, Homo sapiens
agucagaacaaauu

SEQ ID NO: 1658361 - RNA, 19 nt, Homo sapiens
agucagaccucagcaauau

SEQ ID NO: 1658362 - RNA, 13 nt, Homo sapiens
agucagacugaaa

SEQ ID NO: 1658363 - RNA, 13 nt, Homo sapiens
agucagccagcuu

SEQ ID NO: 1658364 - RNA, 20 nt, Homo sapiens
agucagcggagaggacccca

SEQ ID NO: 1658365 - RNA, 12 nt, Homo sapiens
agucagugucau

SEQ ID NO: 1658366 - RNA, 21 nt, Homo sapiens
agucauguuucugcaguauuc

SEQ ID NO: 1658367 - RNA, 22 nt, Homo sapiens
aguccaaaggguuuuaagccag

SEQ ID NO: 1658368 - RNA, 17 nt, Homo sapiens
aguccacccccauugug

SEQ ID NO: 1658369 - RNA, 16 nt, Homo sapiens
aguccacuuuccucuc

SEQ ID NO: 1658370 - RNA, 19 nt, Homo sapiens
agucccccuauccuuggca

SEQ ID NO: 1658371 - RNA, 20 nt, Homo sapiens
agucccggaggccuucccuu

SEQ ID NO: 1658372 - RNA, 17 nt, Homo sapiens
agucccuccacauuucc

SEQ ID NO: 1658373 - RNA, 23 nt, Homo sapiens
agucccuccgacuucucuagaca

SEQ ID NO: 1658374 - RNA, 12 nt, Homo sapiens
aguccggugccu

SEQ ID NO: 1658375 - RNA, 22 nt, Homo sapiens
aguccggugccuuccacccugc

SEQ ID NO: 1658376 - RNA, 13 nt, Homo sapiens
aguccugggagac

SEQ ID NO: 1658377 - RNA, 13 nt, Homo sapiens
agucuacacugcc

SEQ ID NO: 1658378 - RNA, 15 nt, Homo sapiens
agucuacacugccuu

SEQ ID NO: 1658379 - RNA, 17 nt, Homo sapiens
agucuacacugccuuug

SEQ ID NO: 1658380 - RNA, 22 nt, Homo sapiens
agucuaccugccuugccuguua

SEQ ID NO: 1658381 - RNA, 22 nt, Homo sapiens
agucucacuuuuauugauaaaa

SEQ ID NO: 1658382 - RNA, 21 nt, Homo sapiens
agucucuauuugauuugcaac

SEQ ID NO: 1658383 - RNA, 16 nt, Homo sapiens
agucucuugauucaua

SEQ ID NO: 1658384 - RNA, 17 nt, Homo sapiens
agucuuuagcuauuacu

SEQ ID NO: 1658385 - RNA, 18 nt, Homo sapiens
agucuuugauucaccaaa

SEQ ID NO: 1658386 - RNA, 18 nt, Homo sapiens
agugaaaggucaucucau

SEQ ID NO: 1658387 - RNA, 23 nt, Homo sapiens
agugaacuauuucuacacagugg

SEQ ID NO: 1658388 - RNA, 22 nt, Homo sapiens
agugaagcugggagaaccaaaa

SEQ ID NO: 1658389 - RNA, 17 nt, Homo sapiens
ccacacuaccaguuuca

SEQ ID NO: 1658390 - RNA, 19 nt, Homo sapiens
ccacagccccuugcuucua

SEQ ID NO: 1658391 - RNA, 19 nt, Homo sapiens
ccacauucacuacugcaaa

SEQ ID NO: 1658392 - RNA, 19 nt, Homo sapiens
ccacauugcuucauuaaaa

SEQ ID NO: 1658393 - RNA, 12 nt, Homo sapiens
ccaccagaugag

SEQ ID NO: 1658394 - RNA, 20 nt, Homo sapiens
ccaccauuuccccugugguu

SEQ ID NO: 1658395 - RNA, 14 nt, Homo sapiens
ccacccauaucaug

SEQ ID NO: 1658396 - RNA, 22 nt, Homo sapiens
ccaccuacuuauuucagauuca

SEQ ID NO: 1658397 - RNA, 15 nt, Homo sapiens
ccaccuagagcuaga

SEQ ID NO: 1658398 - RNA, 22 nt, Homo sapiens
ccaccuagagcuagaugugucu

SEQ ID NO: 1658399 - RNA, 16 nt, Homo sapiens
ccaccugcagccuguu

SEQ ID NO: 1658400 - RNA, 17 nt, Homo sapiens
ccaccuucacaccacuu

SEQ ID NO: 1658401 - RNA, 12 nt, Homo sapiens
ccaccuugccaa

SEQ ID NO: 1658402 - RNA, 14 nt, Homo sapiens
ccacgacauggcug

SEQ ID NO: 1658403 - RNA, 17 nt, Homo sapiens
ccacgcauggugcagga

SEQ ID NO: 1658404 - RNA, 12 nt, Homo sapiens
ccacguagcaaa

SEQ ID NO: 1658405 - RNA, 22 nt, Homo sapiens
ccacgucccucgagcucuguag

SEQ ID NO: 1658406 - RNA, 21 nt, Homo sapiens
ccacguugcagaaaaagagcu

SEQ ID NO: 1658407 - RNA, 14 nt, Homo sapiens
ccacuacauucuga

SEQ ID NO: 1658408 - RNA, 18 nt, Homo sapiens
ccacucucccuuguccuc

SEQ ID NO: 1658409 - RNA, 20 nt, Homo sapiens
ccacugccccugcaccugcu

SEQ ID NO: 1658410 - RNA, 17 nt, Homo sapiens
ccacuuauuuccaugga

SEQ ID NO: 1658411 - RNA, 22 nt, Homo sapiens
ccacuucccugcaaggugcacc

SEQ ID NO: 1658412 - RNA, 19 nt, Homo sapiens
ccacuuucuagccagagga

SEQ ID NO: 1658413 - RNA, 16 nt, Homo sapiens
ccacuuugucucugag

SEQ ID NO: 1658414 - RNA, 15 nt, Homo sapiens
ccagaaaaguggcuc

SEQ ID NO: 1658415 - RNA, 15 nt, Homo sapiens
ccagaagcagcagcu

SEQ ID NO: 1658416 - RNA, 13 nt, Homo sapiens
ccagacacagugc

SEQ ID NO: 1658417 - RNA, 20 nt, Homo sapiens
ccagacguggugcuucucac

SEQ ID NO: 1658418 - RNA, 22 nt, Homo sapiens
ccagacugcagguuggacccca

SEQ ID NO: 1658419 - RNA, 16 nt, Homo sapiens
ccagagaccugcucca

SEQ ID NO: 1658420 - RNA, 20 nt, Homo sapiens
ccagagcacugcuccagugg

SEQ ID NO: 1658421 - RNA, 20 nt, Homo sapiens
ccagagccuauggaaagggu

SEQ ID NO: 1658422 - RNA, 16 nt, Homo sapiens
ccagccaggggaacuc

SEQ ID NO: 1658423 - RNA, 15 nt, Homo sapiens
ccagccugcucccua

SEQ ID NO: 1658424 - RNA, 18 nt, Homo sapiens
ccagcggggcuucugggc

SEQ ID NO: 1658425 - RNA, 14 nt, Homo sapiens
ccagcuaucuguca

SEQ ID NO: 1658426 - RNA, 22 nt, Homo sapiens
ccagcuguaccggccacugcaa

SEQ ID NO: 1658427 - RNA, 16 nt, Homo sapiens
ccagcuuggagugcca

SEQ ID NO: 1658428 - RNA, 22 nt, Homo sapiens
ccagcuuggugguuauguccca

SEQ ID NO: 1658429 - RNA, 21 nt, Homo sapiens
ccaggaagaggggcgcugccc

SEQ ID NO: 1658430 - RNA, 14 nt, Homo sapiens
ccaggaagccagca

SEQ ID NO: 1658431 - RNA, 22 nt, Homo sapiens
ccaggaaguaauuuucuucuca

SEQ ID NO: 1658432 - RNA, 17 nt, Homo sapiens
ccaggaccuugcuuccu

SEQ ID NO: 1658433 - RNA, 14 nt, Homo sapiens
ccaggacgcaugca

SEQ ID NO: 1658434 - RNA, 17 nt, Homo sapiens
ccaggauggagugcagu

SEQ ID NO: 1658435 - RNA, 22 nt, Homo sapiens
ccaggauugaccuguguguaag

SEQ ID NO: 1658436 - RNA, 15 nt, Homo sapiens
ccaggcuggagugca

SEQ ID NO: 1658437 - RNA, 19 nt, Homo sapiens
ccagggaaggugagccaga

SEQ ID NO: 1658438 - RNA, 20 nt, Homo sapiens
ccagggugcaggcgcgcacc

SEQ ID NO: 1658439 - RNA, 15 nt, Homo sapiens
ccaggguuccagaca

SEQ ID NO: 1658440 - RNA, 21 nt, Homo sapiens
ccaggguuccagacagggugg

SEQ ID NO: 1658441 - RNA, 22 nt, Homo sapiens
ccaggugaucccccaaacagca

SEQ ID NO: 1658442 - RNA, 16 nt, Homo sapiens
ccagguuaccucacuu

SEQ ID NO: 1658443 - RNA, 17 nt, Homo sapiens
ccagguuggagugcagu

SEQ ID NO: 1658444 - RNA, 18 nt, Homo sapiens
ccagguuggagugcagug

SEQ ID NO: 1658445 - RNA, 17 nt, Homo sapiens
ccaguccggaucuccac

SEQ ID NO: 1658446 - RNA, 11 nt, Homo sapiens
ccagugacaca

SEQ ID NO: 1658447 - RNA, 19 nt, Homo sapiens
ccagugcaguagugccaaa

SEQ ID NO: 1658448 - RNA, 23 nt, Homo sapiens
ccaguguauuuucuguguuguuc

SEQ ID NO: 1658449 - RNA, 22 nt, Homo sapiens
ccagugugcuugggaucuucaa

SEQ ID NO: 1658450 - RNA, 14 nt, Homo sapiens
ccaguucugaugag

SEQ ID NO: 1658451 - RNA, 23 nt, Homo sapiens
ccaguucuugcaauaagauauua

SEQ ID NO: 1658452 - RNA, 23 nt, Homo sapiens
ccauaaaauuagacauaccucuc

SEQ ID NO: 1658453 - RNA, 19 nt, Homo sapiens
ccauaacuuguuuguaaaa

SEQ ID NO: 1658454 - RNA, 16 nt, Homo sapiens
ccauagacacaguauu

SEQ ID NO: 1658455 - RNA, 20 nt, Homo sapiens
ccaucaaacgcagacacugu

SEQ ID NO: 1658456 - RNA, 11 nt, Homo sapiens
ccaucaagaaa

SEQ ID NO: 1658457 - RNA, 19 nt, Homo sapiens
ccaucacccucagcaguuc

SEQ ID NO: 1658458 - RNA, 18 nt, Homo sapiens
ccaucaggccuaaucuca

SEQ ID NO: 1658459 - RNA, 13 nt, Homo sapiens
ccauccaccaccu

SEQ ID NO: 1658460 - RNA, 19 nt, Homo sapiens
ccauccuucccgcagcacc

SEQ ID NO: 1658461 - RNA, 14 nt, Homo sapiens
ccaucgauuuguau

SEQ ID NO: 1658462 - RNA, 13 nt, Homo sapiens
ccaucuccagugg

SEQ ID NO: 1658463 - RNA, 16 nt, Homo sapiens
ccaucucuccugcuca

SEQ ID NO: 1658464 - RNA, 14 nt, Homo sapiens
ccaucugauaugac

SEQ ID NO: 1658465 - RNA, 21 nt, Homo sapiens
ccaugacugcauuuuacugua

SEQ ID NO: 1658466 - RNA, 15 nt, Homo sapiens
ccaugauauaacuuu

SEQ ID NO: 1658467 - RNA, 16 nt, Homo sapiens
ccaugaucacuuauca

SEQ ID NO: 1658468 - RNA, 16 nt, Homo sapiens
ccaugcccucccugcu

SEQ ID NO: 1658469 - RNA, 20 nt, Homo sapiens
ccauggaucuugcuggagaa

SEQ ID NO: 1658470 - RNA, 15 nt, Homo sapiens
ccauggccccagcug

SEQ ID NO: 1658471 - RNA, 17 nt, Homo sapiens
ccauggcuggaugugca

SEQ ID NO: 1658472 - RNA, 16 nt, Homo sapiens
ccaugggcaaagccau

SEQ ID NO: 1658473 - RNA, 15 nt, Homo sapiens
ccaugguagacugug

SEQ ID NO: 1658474 - RNA, 22 nt, Homo sapiens
ccauguuauuuauaguguugcu

SEQ ID NO: 1658475 - RNA, 19 nt, Homo sapiens
ccauguucuugagcagcug

SEQ ID NO: 1658476 - RNA, 23 nt, Homo sapiens
ccauguuggcuagacuagucuca

SEQ ID NO: 1658477 - RNA, 14 nt, Homo sapiens
ccauuccugggcua

SEQ ID NO: 1658478 - RNA, 19 nt, Homo sapiens
ccauuuagcacacugcuug

SEQ ID NO: 1658479 - RNA, 21 nt, Homo sapiens
cccaacaguugucaaauugau

SEQ ID NO: 1658480 - RNA, 16 nt, Homo sapiens
cccaacgcacaggaaa

SEQ ID NO: 1658481 - RNA, 21 nt, Homo sapiens
cccaaggaaagggucagguua

SEQ ID NO: 1658482 - RNA, 19 nt, Homo sapiens
cccaaggaagaacaaauau

SEQ ID NO: 1658483 - RNA, 16 nt, Homo sapiens
cccaagguggucuugg

SEQ ID NO: 1658484 - RNA, 19 nt, Homo sapiens
cccaaguuggagugcagug

SEQ ID NO: 1658485 - RNA, 15 nt, Homo sapiens
cccaaucccauuccu

SEQ ID NO: 1658486 - RNA, 16 nt, Homo sapiens
cccaaucccauuccug

SEQ ID NO: 1658487 - RNA, 16 nt, Homo sapiens
cccacaagaaauucau

SEQ ID NO: 1658488 - RNA, 19 nt, Homo sapiens
cccacaggagcguguacua

SEQ ID NO: 1658489 - RNA, 22 nt, Homo sapiens
cccacaggagcguguacuaccc

SEQ ID NO: 1658490 - RNA, 23 nt, Homo sapiens
cccacaggagcguguacuacccc

SEQ ID NO: 1658491 - RNA, 20 nt, Homo sapiens
cccacaggagcguguccuau

SEQ ID NO: 1658492 - RNA, 17 nt, Homo sapiens
cccaccaggaaugccgu

SEQ ID NO: 1658493 - RNA, 20 nt, Homo sapiens
cccaccugggcccuaggcau

SEQ ID NO: 1658494 - RNA, 18 nt, Homo sapiens
cccacgccuccauccaca

SEQ ID NO: 1658495 - RNA, 21 nt, Homo sapiens
cccacguccugggugcuguca

SEQ ID NO: 1658496 - RNA, 13 nt, Homo sapiens
cccacuccagaag

SEQ ID NO: 1658497 - RNA, 23 nt, Homo sapiens
cccacuggagcguguacuacccc

SEQ ID NO: 1658498 - RNA, 16 nt, Homo sapiens
cccagaacgcaugcag

SEQ ID NO: 1658499 - RNA, 17 nt, Homo sapiens
cccagaacgcaugcagg

SEQ ID NO: 1658500 - RNA, 20 nt, Homo sapiens
cccagaagcucaaggcugca

SEQ ID NO: 1658501 - RNA, 23 nt, Homo sapiens
cccagaagcucaaggcugcagug

SEQ ID NO: 1658502 - RNA, 16 nt, Homo sapiens
cccagagccacagaaa

SEQ ID NO: 1658503 - RNA, 19 nt, Homo sapiens
cccagccucccccaggcug

SEQ ID NO: 1658504 - RNA, 16 nt, Homo sapiens
cccaggacgcaugcag

SEQ ID NO: 1658505 - RNA, 19 nt, Homo sapiens
cccaggauggagugcagug

SEQ ID NO: 1658506 - RNA, 18 nt, Homo sapiens
cccaggccaucaccacag

SEQ ID NO: 1658507 - RNA, 19 nt, Homo sapiens
cccaggcggucacugccca

SEQ ID NO: 1658508 - RNA, 15 nt, Homo sapiens
cccagggaaugccag

SEQ ID NO: 1658509 - RNA, 23 nt, Homo sapiens
cccagugucuggcccagccaugg

SEQ ID NO: 1658510 - RNA, 16 nt, Homo sapiens
cuccaaggaguggaaa

SEQ ID NO: 1658511 - RNA, 15 nt, Homo sapiens
cuccaagguggcaua

SEQ ID NO: 1658512 - RNA, 20 nt, Homo sapiens
cuccacaguuaggccaagaa

SEQ ID NO: 1658513 - RNA, 13 nt, Homo sapiens
cuccaccagugug

SEQ ID NO: 1658514 - RNA, 14 nt, Homo sapiens
cuccacuacagacc

SEQ ID NO: 1658515 - RNA, 17 nt, Homo sapiens
cuccacuugccuuguga

SEQ ID NO: 1658516 - RNA, 20 nt, Homo sapiens
cuccagaacaaaccucuaua

SEQ ID NO: 1658517 - RNA, 18 nt, Homo sapiens
cuccagacucuagauguu

SEQ ID NO: 1658518 - RNA, 20 nt, Homo sapiens
cuccagacucuagauguuua

SEQ ID NO: 1658519 - RNA, 12 nt, Homo sapiens
cuccaucuccag

SEQ ID NO: 1658520 - RNA, 15 nt, Homo sapiens
cuccaucuccagugg

SEQ ID NO: 1658521 - RNA, 13 nt, Homo sapiens
cuccauuaaccaa

SEQ ID NO: 1658522 - RNA, 20 nt, Homo sapiens
cucccaagcaccugggauua

SEQ ID NO: 1658523 - RNA, 16 nt, Homo sapiens
cucccaagcacuucaa

SEQ ID NO: 1658524 - RNA, 23 nt, Homo sapiens
cucccaagcugauggacaugaga

SEQ ID NO: 1658525 - RNA, 20 nt, Homo sapiens
cucccccucgcccuaugcaa

SEQ ID NO: 1658526 - RNA, 17 nt, Homo sapiens
cuccccucagauuccac

SEQ ID NO: 1658527 - RNA, 18 nt, Homo sapiens
cuccccuccagaccccua

SEQ ID NO: 1658528 - RNA, 16 nt, Homo sapiens
cuccccugguccugca

SEQ ID NO: 1658529 - RNA, 14 nt, Homo sapiens
cucccuagccagag

SEQ ID NO: 1658530 - RNA, 14 nt, Homo sapiens
cucccucacuucuu

SEQ ID NO: 1658531 - RNA, 18 nt, Homo sapiens
cucccucaguccuuuauu

SEQ ID NO: 1658532 - RNA, 17 nt, Homo sapiens
cucccuuaaucugccag

SEQ ID NO: 1658533 - RNA, 17 nt, Homo sapiens
cuccgcccuucccugac

SEQ ID NO: 1658534 - RNA, 18 nt, Homo sapiens
cuccuaaauuuccagggg

SEQ ID NO: 1658535 - RNA, 19 nt, Homo sapiens
cuccuaagcuggagugcag

SEQ ID NO: 1658536 - RNA, 14 nt, Homo sapiens
cuccucacugccac

SEQ ID NO: 1658537 - RNA, 13 nt, Homo sapiens
cuccuccaugcug

SEQ ID NO: 1658538 - RNA, 16 nt, Homo sapiens
cuccucccaagcacuu

SEQ ID NO: 1658539 - RNA, 16 nt, Homo sapiens
cuccucccagcuguac

SEQ ID NO: 1658540 - RNA, 13 nt, Homo sapiens
cuccucuguuauu

SEQ ID NO: 1658541 - RNA, 22 nt, Homo sapiens
cuccugccauaggguccugaau

SEQ ID NO: 1658542 - RNA, 14 nt, Homo sapiens
cuccugggugccag

SEQ ID NO: 1658543 - RNA, 20 nt, Homo sapiens
cuccuggucgcuuugccauc

SEQ ID NO: 1658544 - RNA, 19 nt, Homo sapiens
cuccugguguggaagagcu

SEQ ID NO: 1658545 - RNA, 13 nt, Homo sapiens
cuccugugugugg

SEQ ID NO: 1658546 - RNA, 15 nt, Homo sapiens
cuccuuccaccacaa

SEQ ID NO: 1658547 - RNA, 19 nt, Homo sapiens
cuccuugguuuugccucuu

SEQ ID NO: 1658548 - RNA, 17 nt, Homo sapiens
cuccuuguaaaagccua

SEQ ID NO: 1658549 - RNA, 21 nt, Homo sapiens
cucgccgggccauucugauug

SEQ ID NO: 1658550 - RNA, 16 nt, Homo sapiens
cucggcccuguagccc

SEQ ID NO: 1658551 - RNA, 16 nt, Homo sapiens
cucggcucacugcaaa

SEQ ID NO: 1658552 - RNA, 15 nt, Homo sapiens
cucggcugcaauugu

SEQ ID NO: 1658553 - RNA, 16 nt, Homo sapiens
cucgugccaugaucug

SEQ ID NO: 1658554 - RNA, 17 nt, Homo sapiens
cucguguuucacagugg

SEQ ID NO: 1658555 - RNA, 20 nt, Homo sapiens
cucuaaacacaaauugugaa

SEQ ID NO: 1658556 - RNA, 15 nt, Homo sapiens
cucuaagaucuugcc

SEQ ID NO: 1658557 - RNA, 16 nt, Homo sapiens
cucuaagaucuugccu

SEQ ID NO: 1658558 - RNA, 16 nt, Homo sapiens
cucuaauguacaauaa

SEQ ID NO: 1658559 - RNA, 22 nt, Homo sapiens
cucuaauguacaauaaagcaau

SEQ ID NO: 1658560 - RNA, 13 nt, Homo sapiens
cucuagacaucua

SEQ ID NO: 1658561 - RNA, 17 nt, Homo sapiens
cucuagacaucuagucu

SEQ ID NO: 1658562 - RNA, 15 nt, Homo sapiens
cucuagagaacaugc

SEQ ID NO: 1658563 - RNA, 18 nt, Homo sapiens
cucucaggccaaacucac

SEQ ID NO: 1658564 - RNA, 14 nt, Homo sapiens
cucucaggccagcu

SEQ ID NO: 1658565 - RNA, 13 nt, Homo sapiens
cucucaucacuga

SEQ ID NO: 1658566 - RNA, 20 nt, Homo sapiens
cucucccaaguccaguguga

SEQ ID NO: 1658567 - RNA, 21 nt, Homo sapiens
cucucuggaccugaccagacu

SEQ ID NO: 1658568 - RNA, 22 nt, Homo sapiens
cucucuuucuuuugugcauaug

SEQ ID NO: 1658569 - RNA, 16 nt, Homo sapiens
cucugaaccagagaaa

SEQ ID NO: 1658570 - RNA, 22 nt, Homo sapiens
cucugcaugauuagugcaauaa

SEQ ID NO: 1658571 - RNA, 17 nt, Homo sapiens
cucugccuacccacgug

SEQ ID NO: 1658572 - RNA, 19 nt, Homo sapiens
cucugcuaugucugugaug

SEQ ID NO: 1658573 - RNA, 16 nt, Homo sapiens
cucuggaccugaccag

SEQ ID NO: 1658574 - RNA, 14 nt, Homo sapiens
cucuggcacuuuga

SEQ ID NO: 1658575 - RNA, 21 nt, Homo sapiens
cucuggcuacgacuugggacg

SEQ ID NO: 1658576 - RNA, 13 nt, Homo sapiens
cucuguacagcaa

SEQ ID NO: 1658577 - RNA, 15 nt, Homo sapiens
cucugucuccuaagc

SEQ ID NO: 1658578 - RNA, 16 nt, Homo sapiens
cucugucuuuccagca

SEQ ID NO: 1658579 - RNA, 14 nt, Homo sapiens
cucuguuuacccuc

SEQ ID NO: 1658580 - RNA, 17 nt, Homo sapiens
cucuguuuaggugccuc

SEQ ID NO: 1658581 - RNA, 19 nt, Homo sapiens
cucuuaaauauacaacuuu

SEQ ID NO: 1658582 - RNA, 13 nt, Homo sapiens
cucuuaaguacca

SEQ ID NO: 1658583 - RNA, 18 nt, Homo sapiens
cucuuaaugucucaaaau

SEQ ID NO: 1658584 - RNA, 15 nt, Homo sapiens
cucuuaauucccaau

SEQ ID NO: 1658585 - RNA, 22 nt, Homo sapiens
cucuucagaauauggacaaaga

SEQ ID NO: 1658586 - RNA, 20 nt, Homo sapiens
cucuucucauuuuuuccuga

SEQ ID NO: 1658587 - RNA, 18 nt, Homo sapiens
cucuugccuaaguauucc

SEQ ID NO: 1658588 - RNA, 23 nt, Homo sapiens
cucuuuaguugauuuaaacucuu

SEQ ID NO: 1658589 - RNA, 15 nt, Homo sapiens
cucuuucuucaauua

SEQ ID NO: 1658590 - RNA, 18 nt, Homo sapiens
cucuuugggccuggcucc

SEQ ID NO: 1658591 - RNA, 20 nt, Homo sapiens
cucuuuuuaucgccauucca

SEQ ID NO: 1658592 - RNA, 15 nt, Homo sapiens
cugaaaacuggaaua

SEQ ID NO: 1658593 - RNA, 19 nt, Homo sapiens
cugaaaauggagaaagcca

SEQ ID NO: 1658594 - RNA, 13 nt, Homo sapiens
cugaaaccauccg

SEQ ID NO: 1658595 - RNA, 13 nt, Homo sapiens
cugaaacuauaga

SEQ ID NO: 1658596 - RNA, 22 nt, Homo sapiens
cugaaacuauagaauaaagccu

SEQ ID NO: 1658597 - RNA, 20 nt, Homo sapiens
cugaaauauuuucuacuuua

SEQ ID NO: 1658598 - RNA, 24 nt, Homo sapiens
cugaauuaaagucuacacugccuu

SEQ ID NO: 1658599 - RNA, 19 nt, Homo sapiens
cugaauuucucacaaagga

SEQ ID NO: 1658600 - RNA, 19 nt, Homo sapiens
cugaauuuggggcuacuua

SEQ ID NO: 1658601 - RNA, 21 nt, Homo sapiens
cugacacaaugguagcucuga

SEQ ID NO: 1658602 - RNA, 17 nt, Homo sapiens
cugacacaggaaaccaa

SEQ ID NO: 1658603 - RNA, 21 nt, Homo sapiens
cugacagcuguccugagcuaa

SEQ ID NO: 1658604 - RNA, 23 nt, Homo sapiens
cugacaggccuuccuccucucaa

SEQ ID NO: 1658605 - RNA, 17 nt, Homo sapiens
cugacauauaucuauua

SEQ ID NO: 1658606 - RNA, 13 nt, Homo sapiens
cugaccaccugca

SEQ ID NO: 1658607 - RNA, 19 nt, Homo sapiens
cugaccccaaguuauccac

SEQ ID NO: 1658608 - RNA, 14 nt, Homo sapiens
cugacgcucaguaa

SEQ ID NO: 1658609 - RNA, 17 nt, Homo sapiens
cugacucuucaagugcc

SEQ ID NO: 1658610 - RNA, 22 nt, Homo sapiens
cugacugugaggugggccuuug

SEQ ID NO: 1658611 - RNA, 18 nt, Homo sapiens
cugagaaacuuccuuuga

SEQ ID NO: 1658612 - RNA, 11 nt, Homo sapiens
cugagaccacg

SEQ ID NO: 1658613 - RNA, 19 nt, Homo sapiens
cugagaggagcguguccua

SEQ ID NO: 1658614 - RNA, 22 nt, Homo sapiens
cugaggagcaggugucccugag

SEQ ID NO: 1658615 - RNA, 18 nt, Homo sapiens
cugaggcaggagaauggc

SEQ ID NO: 1658616 - RNA, 15 nt, Homo sapiens
cugagggcaggguuc

SEQ ID NO: 1658617 - RNA, 20 nt, Homo sapiens
cugaguagcauauauaauuu

SEQ ID NO: 1658618 - RNA, 20 nt, Homo sapiens
cugaguagucauuuugccca

SEQ ID NO: 1658619 - RNA, 21 nt, Homo sapiens
cugauaacucuguacgaggcu

SEQ ID NO: 1658620 - RNA, 20 nt, Homo sapiens
cugauacaauuugcccaagg

SEQ ID NO: 1658621 - RNA, 23 nt, Homo sapiens
cugauagaagaaggacugaagaa

SEQ ID NO: 1658622 - RNA, 21 nt, Homo sapiens
cugauagauauccuuggcaca

SEQ ID NO: 1658623 - RNA, 22 nt, Homo sapiens
cugauagauauccuuggcacau

SEQ ID NO: 1658624 - RNA, 15 nt, Homo sapiens
cugaucagugugaua

SEQ ID NO: 1658625 - RNA, 16 nt, Homo sapiens
cugaucagugugauaa

SEQ ID NO: 1658626 - RNA, 15 nt, Homo sapiens
cugauccuuguggca

SEQ ID NO: 1658627 - RNA, 23 nt, Homo sapiens
cugauuugggcugaauguaugua

SEQ ID NO: 1658628 - RNA, 23 nt, Homo sapiens
cugcaaaaaagaaguaugucagu

SEQ ID NO: 1658629 - RNA, 14 nt, Homo sapiens
cugcaaaaugaaga

SEQ ID NO: 1658630 - RNA, 16 nt, Homo sapiens
cugcaaugucuguccc

SEQ ID NO: 1658631 - RNA, 14 nt, Homo sapiens
cugcacuaauauaa

SEQ ID NO: 1658632 - RNA, 15 nt, Homo sapiens
cuuuacuaacacugg

SEQ ID NO: 1658633 - RNA, 14 nt, Homo sapiens
cuuuagacuaaaga

SEQ ID NO: 1658634 - RNA, 16 nt, Homo sapiens
cuuuagagaagccaua

SEQ ID NO: 1658635 - RNA, 17 nt, Homo sapiens
cuuuaguugauuuaaac

SEQ ID NO: 1658636 - RNA, 16 nt, Homo sapiens
cuuuauucacaguauc

SEQ ID NO: 1658637 - RNA, 15 nt, Homo sapiens
cuuuccucaaagaag

SEQ ID NO: 1658638 - RNA, 16 nt, Homo sapiens
cuuuccucuuaauucc

SEQ ID NO: 1658639 - RNA, 18 nt, Homo sapiens
cuuuccucuuaauuccca

SEQ ID NO: 1658640 - RNA, 22 nt, Homo sapiens
cuuuccugaucaaggugcucuu

SEQ ID NO: 1658641 - RNA, 12 nt, Homo sapiens
cuuuccuugccu

SEQ ID NO: 1658642 - RNA, 17 nt, Homo sapiens
cuuucuagccagaggag

SEQ ID NO: 1658643 - RNA, 21 nt, Homo sapiens
cuuucugauacaucugucagu

SEQ ID NO: 1658644 - RNA, 15 nt, Homo sapiens
cuuucugauacuuau

SEQ ID NO: 1658645 - RNA, 19 nt, Homo sapiens
cuuucuggaauugggcucc

SEQ ID NO: 1658646 - RNA, 14 nt, Homo sapiens
cuuucuuaucccag

SEQ ID NO: 1658647 - RNA, 22 nt, Homo sapiens
cuuugacacuuuucauaucauu

SEQ ID NO: 1658648 - RNA, 12 nt, Homo sapiens
cuuugacccagg

SEQ ID NO: 1658649 - RNA, 20 nt, Homo sapiens
cuuugacugaucagugugau

SEQ ID NO: 1658650 - RNA, 13 nt, Homo sapiens
cuuugagccucuu

SEQ ID NO: 1658651 - RNA, 12 nt, Homo sapiens
cuuugagugaag

SEQ ID NO: 1658652 - RNA, 13 nt, Homo sapiens
cuuugcaaugcaa

SEQ ID NO: 1658653 - RNA, 13 nt, Homo sapiens
cuuugccacugaa

SEQ ID NO: 1658654 - RNA, 23 nt, Homo sapiens
cuuugcucaguggaucacacaca

SEQ ID NO: 1658655 - RNA, 15 nt, Homo sapiens
cuuuggaucaggaaa

SEQ ID NO: 1658656 - RNA, 15 nt, Homo sapiens
cuuugucacagggug

SEQ ID NO: 1658657 - RNA, 21 nt, Homo sapiens
cuuuguuucauauucucagau

SEQ ID NO: 1658658 - RNA, 20 nt, Homo sapiens
cuuuuauucauuagcuguga

SEQ ID NO: 1658659 - RNA, 13 nt, Homo sapiens
cuuuucaaugugu

SEQ ID NO: 1658660 - RNA, 16 nt, Homo sapiens
cuuuucacuucuuaag

SEQ ID NO: 1658661 - RNA, 20 nt, Homo sapiens
cuuuucgcuuucuuucugca

SEQ ID NO: 1658662 - RNA, 15 nt, Homo sapiens
cuuuucugcaauuca

SEQ ID NO: 1658663 - RNA, 17 nt, Homo sapiens
cuuuugaaucaaucugg

SEQ ID NO: 1658664 - RNA, 23 nt, Homo sapiens
cuuuugacagcugugcuguaaca

SEQ ID NO: 1658665 - RNA, 15 nt, Homo sapiens
cuuuugccagccugu

SEQ ID NO: 1658666 - RNA, 16 nt, Homo sapiens
cuuuuuuccugucaau

SEQ ID NO: 1658667 - RNA, 18 nt, Homo sapiens
cuuuuuuuucuucaccuc

SEQ ID NO: 1658668 - RNA, 22 nt, Homo sapiens
cuuuuuuuuuuuuuugguugca

SEQ ID NO: 1658669 - RNA, 17 nt, Homo sapiens
gaaaaaaaaauguucau

SEQ ID NO: 1658670 - RNA, 16 nt, Homo sapiens
gaaaaaagaacaggau

SEQ ID NO: 1658671 - RNA, 22 nt, Homo sapiens
gaaaaaguguuuuuacauauag

SEQ ID NO: 1658672 - RNA, 16 nt, Homo sapiens
gaaaacagacccuccc

SEQ ID NO: 1658673 - RNA, 15 nt, Homo sapiens
gaaaacaucucauca

SEQ ID NO: 1658674 - RNA, 23 nt, Homo sapiens
gaaaacuguuaagggaagcugau

SEQ ID NO: 1658675 - RNA, 16 nt, Homo sapiens
gaaaagcaccucuuga

SEQ ID NO: 1658676 - RNA, 15 nt, Homo sapiens
gaaaaggcuugaguc

SEQ ID NO: 1658677 - RNA, 21 nt, Homo sapiens
gaaaaggcuugagucuggaua

SEQ ID NO: 1658678 - RNA, 13 nt, Homo sapiens
gaaaauaaauaca

SEQ ID NO: 1658679 - RNA, 22 nt, Homo sapiens
gaaaauaauaaaagaaucauuu

SEQ ID NO: 1658680 - RNA, 18 nt, Homo sapiens
gaaaauggagaaagccca

SEQ ID NO: 1658681 - RNA, 23 nt, Homo sapiens
gaaacagcggcuccacuaaagac

SEQ ID NO: 1658682 - RNA, 17 nt, Homo sapiens
gaaacauacguucuuuu

SEQ ID NO: 1658683 - RNA, 14 nt, Homo sapiens
gaaacaugacacug

SEQ ID NO: 1658684 - RNA, 16 nt, Homo sapiens
gaaaccaacacccaaa

SEQ ID NO: 1658685 - RNA, 20 nt, Homo sapiens
gaaacccuacgaaagcacag

SEQ ID NO: 1658686 - RNA, 19 nt, Homo sapiens
gaaacugacuugcugugac

SEQ ID NO: 1658687 - RNA, 14 nt, Homo sapiens
gaaagaaaccagac

SEQ ID NO: 1658688 - RNA, 14 nt, Homo sapiens
gaaagaaaucagcu

SEQ ID NO: 1658689 - RNA, 18 nt, Homo sapiens
gaaagaagagagaccgag

SEQ ID NO: 1658690 - RNA, 22 nt, Homo sapiens
gaaagagcuggcaaacugugaa

SEQ ID NO: 1658691 - RNA, 19 nt, Homo sapiens
gaaagaguaaaaccaaagg

SEQ ID NO: 1658692 - RNA, 15 nt, Homo sapiens
gaaagcagugcagua

SEQ ID NO: 1658693 - RNA, 19 nt, Homo sapiens
gaaaggcaucuaagacauu

SEQ ID NO: 1658694 - RNA, 13 nt, Homo sapiens
gaaagugcugacu

SEQ ID NO: 1658695 - RNA, 15 nt, Homo sapiens
gaaauaaaccccagu

SEQ ID NO: 1658696 - RNA, 16 nt, Homo sapiens
gaaauaaccugugaau

SEQ ID NO: 1658697 - RNA, 12 nt, Homo sapiens
gaaauacauaug

SEQ ID NO: 1658698 - RNA, 13 nt, Homo sapiens
gaaauacauauga

SEQ ID NO: 1658699 - RNA, 15 nt, Homo sapiens
gaaauaucugugaag

SEQ ID NO: 1658700 - RNA, 13 nt, Homo sapiens
gaaaugaauauuc

SEQ ID NO: 1658701 - RNA, 17 nt, Homo sapiens
gaaaugagcugcacucc

SEQ ID NO: 1658702 - RNA, 18 nt, Homo sapiens
gaaaugccagugguggag

SEQ ID NO: 1658703 - RNA, 22 nt, Homo sapiens
gaaaugccgggcacaggccagg

SEQ ID NO: 1658704 - RNA, 17 nt, Homo sapiens
gaaauggcuuuccacau

SEQ ID NO: 1658705 - RNA, 15 nt, Homo sapiens
gaaauuagggcucua

SEQ ID NO: 1658706 - RNA, 18 nt, Homo sapiens
gaaauuauaucugugguc

SEQ ID NO: 1658707 - RNA, 16 nt, Homo sapiens
gaaauucacaaaguua

SEQ ID NO: 1658708 - RNA, 18 nt, Homo sapiens
gaaauucccgccuaauaa

SEQ ID NO: 1658709 - RNA, 21 nt, Homo sapiens
gaaauuuuaucucuucuuccu

SEQ ID NO: 1658710 - RNA, 20 nt, Homo sapiens
gaaauuuuuuuccagaauug

SEQ ID NO: 1658711 - RNA, 21 nt, Homo sapiens
gaaauuuuuuuccagaauuga

SEQ ID NO: 1658712 - RNA, 13 nt, Homo sapiens
gaacaaauuuuca

SEQ ID NO: 1658713 - RNA, 16 nt, Homo sapiens
gaacaagcaaugagaa

SEQ ID NO: 1658714 - RNA, 21 nt, Homo sapiens
gaacacuaaugaggaaacugc

SEQ ID NO: 1658715 - RNA, 14 nt, Homo sapiens
gaacagcauaugca

SEQ ID NO: 1658716 - RNA, 21 nt, Homo sapiens
gaacauggccaauagucauau

SEQ ID NO: 1658717 - RNA, 22 nt, Homo sapiens
gaacauuaacaaaagcaauugu

SEQ ID NO: 1658718 - RNA, 17 nt, Homo sapiens
gaaccaaaaagaggcua

SEQ ID NO: 1658719 - RNA, 12 nt, Homo sapiens
gaaccaagaacu

SEQ ID NO: 1658720 - RNA, 21 nt, Homo sapiens
gaaccaagaacuuuccaggaa

SEQ ID NO: 1658721 - RNA, 15 nt, Homo sapiens
gaaccagcaaugaga

SEQ ID NO: 1658722 - RNA, 13 nt, Homo sapiens
gaacccucaccca

SEQ ID NO: 1658723 - RNA, 18 nt, Homo sapiens
gaaccucaaacuggguau

SEQ ID NO: 1658724 - RNA, 13 nt, Homo sapiens
gaacggugucauc

SEQ ID NO: 1658725 - RNA, 18 nt, Homo sapiens
gaacguggauugugaaga

SEQ ID NO: 1658726 - RNA, 14 nt, Homo sapiens
gaacucaugugauu

SEQ ID NO: 1658727 - RNA, 17 nt, Homo sapiens
gaacugaagcagaguca

SEQ ID NO: 1658728 - RNA, 20 nt, Homo sapiens
gaacugcuugugcacuggau

SEQ ID NO: 1658729 - RNA, 18 nt, Homo sapiens
gaacuguuggauacagga

SEQ ID NO: 1658730 - RNA, 12 nt, Homo sapiens
gaagaagcaaac

SEQ ID NO: 1658731 - RNA, 13 nt, Homo sapiens
gaagaagcaguuu

SEQ ID NO: 1658732 - RNA, 16 nt, Homo sapiens
gaagaaguaguuuacu

SEQ ID NO: 1658733 - RNA, 17 nt, Homo sapiens
gaagaauugaaaaacca

SEQ ID NO: 1658734 - RNA, 23 nt, Homo sapiens
gaagaauuggcagaagcaguugc

SEQ ID NO: 1658735 - RNA, 22 nt, Homo sapiens
gaagacagcucuuauauugcca

SEQ ID NO: 1658736 - RNA, 20 nt, Homo sapiens
gaagaccuucugaagaucuc

SEQ ID NO: 1658737 - RNA, 16 nt, Homo sapiens
gaagagagauauaucu

SEQ ID NO: 1658738 - RNA, 18 nt, Homo sapiens
gaagagaguauggugcug

SEQ ID NO: 1658739 - RNA, 18 nt, Homo sapiens
gaagagggaacuaagcau

SEQ ID NO: 1658740 - RNA, 21 nt, Homo sapiens
gaagauuucauggacacugau

SEQ ID NO: 1658741 - RNA, 12 nt, Homo sapiens
gaagcacugccu

SEQ ID NO: 1658742 - RNA, 22 nt, Homo sapiens
gaagcaguugcaauaaacucag

SEQ ID NO: 1658743 - RNA, 23 nt, Homo sapiens
gaagccauuuccacuacagugag

SEQ ID NO: 1658744 - RNA, 14 nt, Homo sapiens
gaagcccacccgcc

SEQ ID NO: 1658745 - RNA, 21 nt, Homo sapiens
gaagcccucugagcuccagag

SEQ ID NO: 1658746 - RNA, 21 nt, Homo sapiens
gaagccuuuaucuaugggaga

SEQ ID NO: 1658747 - RNA, 17 nt, Homo sapiens
gaaggaaccagcaauga

SEQ ID NO: 1658748 - RNA, 15 nt, Homo sapiens
gaaggaaugcaauaa

SEQ ID NO: 1658749 - RNA, 16 nt, Homo sapiens
gaaggcagcuagacac

SEQ ID NO: 1658750 - RNA, 15 nt, Homo sapiens
gaaggcccagccugu

SEQ ID NO: 1658751 - RNA, 16 nt, Homo sapiens
gaagggaccccagaua

SEQ ID NO: 1658752 - RNA, 17 nt, Homo sapiens
gaagggcaggagcucac

SEQ ID NO: 1658753 - RNA, 15 nt, Homo sapiens
gaaggugagccagac

SEQ ID NO: 1658754 - RNA, 17 nt, Homo sapiens
gccguaguaccucccag

SEQ ID NO: 1658755 - RNA, 16 nt, Homo sapiens
gccguugcugcguucu

SEQ ID NO: 1658756 - RNA, 20 nt, Homo sapiens
gccuaauauucaugcugccu

SEQ ID NO: 1658757 - RNA, 21 nt, Homo sapiens
gccuagacucuguaacaucac

SEQ ID NO: 1658758 - RNA, 15 nt, Homo sapiens
gccucagggaccaag

SEQ ID NO: 1658759 - RNA, 22 nt, Homo sapiens
gccucauuauuuuucacugccc

SEQ ID NO: 1658760 - RNA, 19 nt, Homo sapiens
gccuccccccacaagaacu

SEQ ID NO: 1658761 - RNA, 12 nt, Homo sapiens
gccucuugcccc

SEQ ID NO: 1658762 - RNA, 11 nt, Homo sapiens
gccugauggcc

SEQ ID NO: 1658763 - RNA, 19 nt, Homo sapiens
gccugcgccccccagugga

SEQ ID NO: 1658764 - RNA, 21 nt, Homo sapiens
gccugcgcccugacaugcuaa

SEQ ID NO: 1658765 - RNA, 21 nt, Homo sapiens
gccuggaaagcccuucggaga

SEQ ID NO: 1658766 - RNA, 22 nt, Homo sapiens
gccuggagaaggguucagccca

SEQ ID NO: 1658767 - RNA, 21 nt, Homo sapiens
gccuggcaggggccaggacaa

SEQ ID NO: 1658768 - RNA, 23 nt, Homo sapiens
gccuggcccauagaaacaugaca

SEQ ID NO: 1658769 - RNA, 16 nt, Homo sapiens
gccuggcuucaccgca

SEQ ID NO: 1658770 - RNA, 17 nt, Homo sapiens
gccuggcuucaccgcau

SEQ ID NO: 1658771 - RNA, 14 nt, Homo sapiens
gccuggcuucuggg

SEQ ID NO: 1658772 - RNA, 21 nt, Homo sapiens
gccuggguccucggcccugua

SEQ ID NO: 1658773 - RNA, 17 nt, Homo sapiens
gccuggucaauaaacca

SEQ ID NO: 1658774 - RNA, 22 nt, Homo sapiens
gccuggucaauaaaccacuguu

SEQ ID NO: 1658775 - RNA, 22 nt, Homo sapiens
gccuguaauccgagcacuuugg

SEQ ID NO: 1658776 - RNA, 18 nt, Homo sapiens
gccuuaauucuuaccuca

SEQ ID NO: 1658777 - RNA, 11 nt, Homo sapiens
gccuuacacaa

SEQ ID NO: 1658778 - RNA, 22 nt, Homo sapiens
gccuugaaaccagaaaucuaau

SEQ ID NO: 1658779 - RNA, 22 nt, Homo sapiens
gccuugggagagaugccuucca

SEQ ID NO: 1658780 - RNA, 13 nt, Homo sapiens
gccuugugaucac

SEQ ID NO: 1658781 - RNA, 22 nt, Homo sapiens
gccuuucugccucacaucagcc

SEQ ID NO: 1658782 - RNA, 17 nt, Homo sapiens
gccuuugacccaggaac

SEQ ID NO: 1658783 - RNA, 15 nt, Homo sapiens
gccuuuuccuaugua

SEQ ID NO: 1658784 - RNA, 21 nt, Homo sapiens
gcgcaggaaccgaggacucca

SEQ ID NO: 1658785 - RNA, 18 nt, Homo sapiens
gcgcccaagcucagcuua

SEQ ID NO: 1658786 - RNA, 17 nt, Homo sapiens
gcgccuaccaccaugcc

SEQ ID NO: 1658787 - RNA, 19 nt, Homo sapiens
gcgccuguaguuccagcua

SEQ ID NO: 1658788 - RNA, 19 nt, Homo sapiens
gcggaaagcagucagcgga

SEQ ID NO: 1658789 - RNA, 13 nt, Homo sapiens
gcggaggggcuug

SEQ ID NO: 1658790 - RNA, 21 nt, Homo sapiens
gcggcucuuccuggacaguga

SEQ ID NO: 1658791 - RNA, 16 nt, Homo sapiens
gcggggagcaugaaga

SEQ ID NO: 1658792 - RNA, 23 nt, Homo sapiens
gcguauccuaugguaacugauga

SEQ ID NO: 1658793 - RNA, 13 nt, Homo sapiens
gcguccaggugau

SEQ ID NO: 1658794 - RNA, 13 nt, Homo sapiens
gcguuaaagucag

SEQ ID NO: 1658795 - RNA, 15 nt, Homo sapiens
gcguuggagacauac

SEQ ID NO: 1658796 - RNA, 20 nt, Homo sapiens
gcuaaaauaaaccagacuca

SEQ ID NO: 1658797 - RNA, 14 nt, Homo sapiens
gcuaacucugaccu

SEQ ID NO: 1658798 - RNA, 22 nt, Homo sapiens
gcuaacuuuuauuaucuucuau

SEQ ID NO: 1658799 - RNA, 14 nt, Homo sapiens
gcuaagccugauga

SEQ ID NO: 1658800 - RNA, 15 nt, Homo sapiens
gcuaauguacuacgu

SEQ ID NO: 1658801 - RNA, 23 nt, Homo sapiens
gcuacacguuggaguauaccuau

SEQ ID NO: 1658802 - RNA, 16 nt, Homo sapiens
gcuaggggacaucaga

SEQ ID NO: 1658803 - RNA, 21 nt, Homo sapiens
gcuaguccggacccaccucac

SEQ ID NO: 1658804 - RNA, 15 nt, Homo sapiens
gcuagucugucaggg

SEQ ID NO: 1658805 - RNA, 16 nt, Homo sapiens
gcuaugugagcacaaa

SEQ ID NO: 1658806 - RNA, 20 nt, Homo sapiens
gcuauuuuuaauuuccugug

SEQ ID NO: 1658807 - RNA, 17 nt, Homo sapiens
gcucaaacaacauucca

SEQ ID NO: 1658808 - RNA, 20 nt, Homo sapiens
gcucaauaaggcagugcagu

SEQ ID NO: 1658809 - RNA, 21 nt, Homo sapiens
gcucaauaaggcagugcagug

SEQ ID NO: 1658810 - RNA, 13 nt, Homo sapiens
gcucaaucucagg

SEQ ID NO: 1658811 - RNA, 17 nt, Homo sapiens
gcucacugcaaccucug

SEQ ID NO: 1658812 - RNA, 19 nt, Homo sapiens
gcucagagcagaaccaaag

SEQ ID NO: 1658813 - RNA, 17 nt, Homo sapiens
gcucagccccagaccug

SEQ ID NO: 1658814 - RNA, 20 nt, Homo sapiens
gcucaguaacacagugcagu

SEQ ID NO: 1658815 - RNA, 21 nt, Homo sapiens
gcucaguaacacagugcagug

SEQ ID NO: 1658816 - RNA, 20 nt, Homo sapiens
gcucaguggaucacacacau

SEQ ID NO: 1658817 - RNA, 15 nt, Homo sapiens
gcucaguuggugcug

SEQ ID NO: 1658818 - RNA, 21 nt, Homo sapiens
gcuccaagagaauucacuuua

SEQ ID NO: 1658819 - RNA, 13 nt, Homo sapiens
gcuccauuccuga

SEQ ID NO: 1658820 - RNA, 17 nt, Homo sapiens
gcucccacuucuuggga

SEQ ID NO: 1658821 - RNA, 13 nt, Homo sapiens
gcucccuagccag

SEQ ID NO: 1658822 - RNA, 18 nt, Homo sapiens
gcuccuaguuugaccuca

SEQ ID NO: 1658823 - RNA, 16 nt, Homo sapiens
gcucgcucugcaugau

SEQ ID NO: 1658824 - RNA, 23 nt, Homo sapiens
gcucuaaagcagagauguauuau

SEQ ID NO: 1658825 - RNA, 15 nt, Homo sapiens
gcucuaauguacaau

SEQ ID NO: 1658826 - RNA, 22 nt, Homo sapiens
gcucuccaagcacuagccuucc

SEQ ID NO: 1658827 - RNA, 18 nt, Homo sapiens
gcucucccucacaccucc

SEQ ID NO: 1658828 - RNA, 15 nt, Homo sapiens
gcucuccuucacucu

SEQ ID NO: 1658829 - RNA, 17 nt, Homo sapiens
gcucugcauaagauuau

SEQ ID NO: 1658830 - RNA, 15 nt, Homo sapiens
gcugaaagacaguaa

SEQ ID NO: 1658831 - RNA, 21 nt, Homo sapiens
gcugacaaggcgucucuucaa

SEQ ID NO: 1658832 - RNA, 23 nt, Homo sapiens
gcugaggcugucauuccaugagu

SEQ ID NO: 1658833 - RNA, 23 nt, Homo sapiens
gcugaugucaaugcuauggacug

SEQ ID NO: 1658834 - RNA, 15 nt, Homo sapiens
gcugcaccaucccag

SEQ ID NO: 1658835 - RNA, 14 nt, Homo sapiens
gcugcacuccauga

SEQ ID NO: 1658836 - RNA, 13 nt, Homo sapiens
gcugcacugcccu

SEQ ID NO: 1658837 - RNA, 14 nt, Homo sapiens
gcugcaggaaucaa

SEQ ID NO: 1658838 - RNA, 13 nt, Homo sapiens
gcugcagggacag

SEQ ID NO: 1658839 - RNA, 18 nt, Homo sapiens
gcugcaucuccccucaga

SEQ ID NO: 1658840 - RNA, 21 nt, Homo sapiens
gcugcaucuccccucagauuc

SEQ ID NO: 1658841 - RNA, 14 nt, Homo sapiens
gcugccgucugucc

SEQ ID NO: 1658842 - RNA, 16 nt, Homo sapiens
gcugcucccuuuauca

SEQ ID NO: 1658843 - RNA, 13 nt, Homo sapiens
gcugcugcacugc

SEQ ID NO: 1658844 - RNA, 19 nt, Homo sapiens
gcuggaugugcuuucaucc

SEQ ID NO: 1658845 - RNA, 14 nt, Homo sapiens
gcugggagaaccaa

SEQ ID NO: 1658846 - RNA, 18 nt, Homo sapiens
gcugggucaaggcaaagc

SEQ ID NO: 1658847 - RNA, 17 nt, Homo sapiens
gcugggucccgggugcc

SEQ ID NO: 1658848 - RNA, 18 nt, Homo sapiens
gcuggguuugggcagugg

SEQ ID NO: 1658849 - RNA, 17 nt, Homo sapiens
gcugguaaaaacauggg

SEQ ID NO: 1658850 - RNA, 10 nt, Homo sapiens
gcuggugggg

SEQ ID NO: 1658851 - RNA, 15 nt, Homo sapiens
gcugguuuucucuga

SEQ ID NO: 1658852 - RNA, 15 nt, Homo sapiens
gcuguagacaucugu

SEQ ID NO: 1658853 - RNA, 23 nt, Homo sapiens
gcuguaucaaacuagugcaugaa

SEQ ID NO: 1658854 - RNA, 19 nt, Homo sapiens
gcuguaugcggaauuccac

SEQ ID NO: 1658855 - RNA, 13 nt, Homo sapiens
gcugucaugccca

SEQ ID NO: 1658856 - RNA, 20 nt, Homo sapiens
gcugucaugcccagcuugga

SEQ ID NO: 1658857 - RNA, 12 nt, Homo sapiens
gcuguguguucu

SEQ ID NO: 1658858 - RNA, 14 nt, Homo sapiens
gcuguuuuauaugu

SEQ ID NO: 1658859 - RNA, 13 nt, Homo sapiens
gcuuaaacauuuu

SEQ ID NO: 1658860 - RNA, 17 nt, Homo sapiens
gcuucaccgcauuccag

SEQ ID NO: 1658861 - RNA, 18 nt, Homo sapiens
gcuucaccgcauuccagg

SEQ ID NO: 1658862 - RNA, 12 nt, Homo sapiens
gcuucagaauug

SEQ ID NO: 1658863 - RNA, 19 nt, Homo sapiens
gcuucauucaagcuucaua

SEQ ID NO: 1658864 - RNA, 19 nt, Homo sapiens
gcuuccuccugguguggaa

SEQ ID NO: 1658865 - RNA, 16 nt, Homo sapiens
gcuuccucuaaacuuc

SEQ ID NO: 1658866 - RNA, 21 nt, Homo sapiens
gcuucuccuggcaaucuguca

SEQ ID NO: 1658867 - RNA, 24 nt, Homo sapiens
gcuucugggacaggcaccaugcug

SEQ ID NO: 1658868 - RNA, 18 nt, Homo sapiens
gcuugaccgugaggccag

SEQ ID NO: 1658869 - RNA, 16 nt, Homo sapiens
gcuugcaggaaccagc

SEQ ID NO: 1658870 - RNA, 22 nt, Homo sapiens
gcuuguucuuccucuuaccugu

SEQ ID NO: 1658871 - RNA, 14 nt, Homo sapiens
gcuuguuuguucua

SEQ ID NO: 1658872 - RNA, 14 nt, Homo sapiens
gcuuuacagugcca

SEQ ID NO: 1658873 - RNA, 15 nt, Homo sapiens
gcuuuacagugccac

SEQ ID NO: 1658874 - RNA, 23 nt, Homo sapiens
gcuuucggaauuccugcaggaaa

SEQ ID NO: 1658875 - RNA, 16 nt, Homo sapiens
gcuuuggguagugcca

SEQ ID NO: 1658876 - RNA, 17 nt, Homo sapiens
guggugagaggcaucca

SEQ ID NO: 1658877 - RNA, 23 nt, Homo sapiens
guggugggcccugaugcugccag

SEQ ID NO: 1658878 - RNA, 13 nt, Homo sapiens
gugguugucaugu

SEQ ID NO: 1658879 - RNA, 21 nt, Homo sapiens
guguacauuugauuugauaua

SEQ ID NO: 1658880 - RNA, 13 nt, Homo sapiens
guguauguauaca

SEQ ID NO: 1658881 - RNA, 17 nt, Homo sapiens
gugucaucaaguaguag

SEQ ID NO: 1658882 - RNA, 20 nt, Homo sapiens
guguccgugaaaguugugau

SEQ ID NO: 1658883 - RNA, 17 nt, Homo sapiens
gugucuaauaaacacag

SEQ ID NO: 1658884 - RNA, 16 nt, Homo sapiens
gugucuuuuguucucu

SEQ ID NO: 1658885 - RNA, 20 nt, Homo sapiens
gugugcaugagaaugucauu

SEQ ID NO: 1658886 - RNA, 11 nt, Homo sapiens
gugugccaaac

SEQ ID NO: 1658887 - RNA, 14 nt, Homo sapiens
guguggaguggagg

SEQ ID NO: 1658888 - RNA, 17 nt, Homo sapiens
guguggcuuaaacauuu

SEQ ID NO: 1658889 - RNA, 16 nt, Homo sapiens
guguggggaauggaaa

SEQ ID NO: 1658890 - RNA, 13 nt, Homo sapiens
gugugugcaguga

SEQ ID NO: 1658891 - RNA, 18 nt, Homo sapiens
guguugaggaggggagca

SEQ ID NO: 1658892 - RNA, 12 nt, Homo sapiens
guguuguucaua

SEQ ID NO: 1658893 - RNA, 23 nt, Homo sapiens
guguuugaaacacucgugugcau

SEQ ID NO: 1658894 - RNA, 18 nt, Homo sapiens
guguuuuaaaacauucac

SEQ ID NO: 1658895 - RNA, 13 nt, Homo sapiens
guguuuuuacaua

SEQ ID NO: 1658896 - RNA, 13 nt, Homo sapiens
guuaaaaagucaa

SEQ ID NO: 1658897 - RNA, 15 nt, Homo sapiens
guuaaaggucuccca

SEQ ID NO: 1658898 - RNA, 18 nt, Homo sapiens
guuaaaucaguaaucugu

SEQ ID NO: 1658899 - RNA, 13 nt, Homo sapiens
guuaaaugaacuu

SEQ ID NO: 1658900 - RNA, 15 nt, Homo sapiens
guuaacuuaugucuc

SEQ ID NO: 1658901 - RNA, 20 nt, Homo sapiens
guuaauaaagugcacugcca

SEQ ID NO: 1658902 - RNA, 10 nt, Homo sapiens
guuaaugugc

SEQ ID NO: 1658903 - RNA, 14 nt, Homo sapiens
guuaaugugccaaa

SEQ ID NO: 1658904 - RNA, 16 nt, Homo sapiens
guuaaugugccaaaau

SEQ ID NO: 1658905 - RNA, 16 nt, Homo sapiens
guuaggcagugcagua

SEQ ID NO: 1658906 - RNA, 16 nt, Homo sapiens
guuauaauaaccuggu

SEQ ID NO: 1658907 - RNA, 15 nt, Homo sapiens
guuaucuaaccuguu

SEQ ID NO: 1658908 - RNA, 19 nt, Homo sapiens
guuaucuaaccuguuccau

SEQ ID NO: 1658909 - RNA, 16 nt, Homo sapiens
guuaugucccaugacc

SEQ ID NO: 1658910 - RNA, 15 nt, Homo sapiens
guuauuuguccucau

SEQ ID NO: 1658911 - RNA, 18 nt, Homo sapiens
guucaauuggacaauuau

SEQ ID NO: 1658912 - RNA, 18 nt, Homo sapiens
guucacaaguaaucuguu

SEQ ID NO: 1658913 - RNA, 17 nt, Homo sapiens
guucacgcaacuugaaa

SEQ ID NO: 1658914 - RNA, 17 nt, Homo sapiens
guucauguuuugcuaau

SEQ ID NO: 1658915 - RNA, 22 nt, Homo sapiens
guuccauuccauggaaccaugg

SEQ ID NO: 1658916 - RNA, 22 nt, Homo sapiens
guuccucuagguaaacuagcaa

SEQ ID NO: 1658917 - RNA, 16 nt, Homo sapiens
guucuaugauauacaa

SEQ ID NO: 1658918 - RNA, 20 nt, Homo sapiens
guucuucuugagcugaccca

SEQ ID NO: 1658919 - RNA, 19 nt, Homo sapiens
guucuuguaaaacugugac

SEQ ID NO: 1658920 - RNA, 16 nt, Homo sapiens
guugaauaaugcuguu

SEQ ID NO: 1658921 - RNA, 17 nt, Homo sapiens
guugauguguccgugaa

SEQ ID NO: 1658922 - RNA, 21 nt, Homo sapiens
guugccaggcuggagugcagu

SEQ ID NO: 1658923 - RNA, 18 nt, Homo sapiens
guugcuaaugacagugga

SEQ ID NO: 1658924 - RNA, 14 nt, Homo sapiens
guugcugcaucucc

SEQ ID NO: 1658925 - RNA, 16 nt, Homo sapiens
guugcuuuuuuuccaa

SEQ ID NO: 1658926 - RNA, 19 nt, Homo sapiens
guugguuaccuauugcugu

SEQ ID NO: 1658927 - RNA, 14 nt, Homo sapiens
guuguuuaccuguu

SEQ ID NO: 1658928 - RNA, 22 nt, Homo sapiens
guuuaaaaaucaguuuguuguu

SEQ ID NO: 1658929 - RNA, 18 nt, Homo sapiens
guuuaacugaguuagaau

SEQ ID NO: 1658930 - RNA, 18 nt, Homo sapiens
guuuagaaucaagucugu

SEQ ID NO: 1658931 - RNA, 20 nt, Homo sapiens
guuuagaaucaagucuguga

SEQ ID NO: 1658932 - RNA, 21 nt, Homo sapiens
guuuagcguuguuuuguggau

SEQ ID NO: 1658933 - RNA, 18 nt, Homo sapiens
guuuaguaauacagccug

SEQ ID NO: 1658934 - RNA, 17 nt, Homo sapiens
guuuagugugauuguga

SEQ ID NO: 1658935 - RNA, 16 nt, Homo sapiens
guuuauugaaugugau

SEQ ID NO: 1658936 - RNA, 13 nt, Homo sapiens
guuucacaguggg

SEQ ID NO: 1658937 - RNA, 15 nt, Homo sapiens
guuucagcauuccca

SEQ ID NO: 1658938 - RNA, 14 nt, Homo sapiens
guuuccagugacac

SEQ ID NO: 1658939 - RNA, 16 nt, Homo sapiens
guuucuggaauugaua

SEQ ID NO: 1658940 - RNA, 13 nt, Homo sapiens
guuugaacacaga

SEQ ID NO: 1658941 - RNA, 16 nt, Homo sapiens
guuugaaccaagaacu

SEQ ID NO: 1658942 - RNA, 20 nt, Homo sapiens
guuugcccgggaauguuuca

SEQ ID NO: 1658943 - RNA, 20 nt, Homo sapiens
guuugcucccauuacucaaa

SEQ ID NO: 1658944 - RNA, 13 nt, Homo sapiens
guuuguguuugaa

SEQ ID NO: 1658945 - RNA, 13 nt, Homo sapiens
guuuuaucuggaa

SEQ ID NO: 1658946 - RNA, 16 nt, Homo sapiens
guuuucagauuguaaa

SEQ ID NO: 1658947 - RNA, 19 nt, Homo sapiens
guuuugcauggaguauuau

SEQ ID NO: 1658948 - RNA, 16 nt, Homo sapiens
guuuuuaaguacucac

SEQ ID NO: 1658949 - RNA, 19 nt, Homo sapiens
guuuuucuuguuguuauuc

SEQ ID NO: 1658950 - RNA, 15 nt, Homo sapiens
guuuuuggauggcuu

SEQ ID NO: 1658951 - RNA, 16 nt, Homo sapiens
guuuuuugccauguua

SEQ ID NO: 1658952 - RNA, 19 nt, Homo sapiens
uaaaaacugcccauuguaa

SEQ ID NO: 1658953 - RNA, 22 nt, Homo sapiens
uaaaaaggaauaugaaagucuu

SEQ ID NO: 1658954 - RNA, 17 nt, Homo sapiens
uaaaaaguuaaucuuca

SEQ ID NO: 1658955 - RNA, 18 nt, Homo sapiens
uaaaaaguuaaucuucau

SEQ ID NO: 1658956 - RNA, 21 nt, Homo sapiens
uaaaacaagagaccacuuccu

SEQ ID NO: 1658957 - RNA, 21 nt, Homo sapiens
uaaaacaaguacaucuguaca

SEQ ID NO: 1658958 - RNA, 18 nt, Homo sapiens
uaaaacacaagacuguca

SEQ ID NO: 1658959 - RNA, 23 nt, Homo sapiens
uaaaacaguguuuccagugacac

SEQ ID NO: 1658960 - RNA, 17 nt, Homo sapiens
uaaaaccucucuuucca

SEQ ID NO: 1658961 - RNA, 16 nt, Homo sapiens
uaaaacgauuacugac

SEQ ID NO: 1658962 - RNA, 17 nt, Homo sapiens
uaaaacuaucagcagcg

SEQ ID NO: 1658963 - RNA, 11 nt, Homo sapiens
uaaaacuguga

SEQ ID NO: 1658964 - RNA, 19 nt, Homo sapiens
uaaaagaaagaugcugaug

SEQ ID NO: 1658965 - RNA, 19 nt, Homo sapiens
uaaaagucucguugcucau

SEQ ID NO: 1658966 - RNA, 14 nt, Homo sapiens
uaaaauaaaccaga

SEQ ID NO: 1658967 - RNA, 19 nt, Homo sapiens
uaaaauagucucauugcca

SEQ ID NO: 1658968 - RNA, 17 nt, Homo sapiens
uaaaaucagacucuuua

SEQ ID NO: 1658969 - RNA, 20 nt, Homo sapiens
uaaaauccaagcugcucauu

SEQ ID NO: 1658970 - RNA, 21 nt, Homo sapiens
uaaaaugguguuuucauguaa

SEQ ID NO: 1658971 - RNA, 18 nt, Homo sapiens
uaaaauugcagcaguugc

SEQ ID NO: 1658972 - RNA, 13 nt, Homo sapiens
uaaacacaguaag

SEQ ID NO: 1658973 - RNA, 13 nt, Homo sapiens
uaaaccauaaaau

SEQ ID NO: 1658974 - RNA, 20 nt, Homo sapiens
uaaacccacauaaacacuuc

SEQ ID NO: 1658975 - RNA, 22 nt, Homo sapiens
uaaaccuguuccugacuguucu

SEQ ID NO: 1658976 - RNA, 23 nt, Homo sapiens
uaaaccuguuccugacuguucuc

SEQ ID NO: 1658977 - RNA, 17 nt, Homo sapiens
uaaacgugaugugcuca

SEQ ID NO: 1658978 - RNA, 17 nt, Homo sapiens
uaaacucugaccaacag

SEQ ID NO: 1658979 - RNA, 22 nt, Homo sapiens
uaaacuuucccuauacuuaggc

SEQ ID NO: 1658980 - RNA, 23 nt, Homo sapiens
uaaagaaguggauuguauuguga

SEQ ID NO: 1658981 - RNA, 18 nt, Homo sapiens
uaaagccucugugcugca

SEQ ID NO: 1658982 - RNA, 23 nt, Homo sapiens
uaaagcuuguuuguucuaguuag

SEQ ID NO: 1658983 - RNA, 17 nt, Homo sapiens
uaaagguuuauguggaa

SEQ ID NO: 1658984 - RNA, 19 nt, Homo sapiens
uaaagguuucacuguucau

SEQ ID NO: 1658985 - RNA, 15 nt, Homo sapiens
uaaaguauuccaccu

SEQ ID NO: 1658986 - RNA, 15 nt, Homo sapiens
uaaagucaggauuua

SEQ ID NO: 1658987 - RNA, 16 nt, Homo sapiens
uaaagucaggauuuau

SEQ ID NO: 1658988 - RNA, 16 nt, Homo sapiens
uaaagucuacacugcc

SEQ ID NO: 1658989 - RNA, 18 nt, Homo sapiens
uaaagucuacacugccuu

SEQ ID NO: 1658990 - RNA, 23 nt, Homo sapiens
uaaagugauuccuucuugcucag

SEQ ID NO: 1658991 - RNA, 12 nt, Homo sapiens
uaaagugugagg

SEQ ID NO: 1658992 - RNA, 16 nt, Homo sapiens
uaaaguuccaugaaga

SEQ ID NO: 1658993 - RNA, 13 nt, Homo sapiens
uaaauaaugauuc

SEQ ID NO: 1658994 - RNA, 17 nt, Homo sapiens
uaaauacugcuguauaa

SEQ ID NO: 1658995 - RNA, 20 nt, Homo sapiens
uaaauauauauauauuucuc

SEQ ID NO: 1658996 - RNA, 14 nt, Homo sapiens
uaaaucagugcagu

SEQ ID NO: 1658997 - RNA, 21 nt, Homo sapiens
uaaauccaacucugacuguaa

SEQ ID NO: 1658998 - RNA, 14 nt, Homo sapiens
uuugacuugccacu

SEQ ID NO: 1658999 - RNA, 10 nt, Homo sapiens
uuugagacag

SEQ ID NO: 1659000 - RNA, 16 nt, Homo sapiens
uuugauucaccaaaca

SEQ ID NO: 1659001 - RNA, 15 nt, Homo sapiens
uuugcaagagugaug

SEQ ID NO: 1659002 - RNA, 15 nt, Homo sapiens
uuugcacuuugccau

SEQ ID NO: 1659003 - RNA, 12 nt, Homo sapiens
uuugccacugaa

SEQ ID NO: 1659004 - RNA, 18 nt, Homo sapiens
uuugccaucaagaaacau

SEQ ID NO: 1659005 - RNA, 18 nt, Homo sapiens
uuugcucuuuucaaugug

SEQ ID NO: 1659006 - RNA, 15 nt, Homo sapiens
uuuggaauucaaugg

SEQ ID NO: 1659007 - RNA, 19 nt, Homo sapiens
uuuggagauucccaucuga

SEQ ID NO: 1659008 - RNA, 21 nt, Homo sapiens
uuugggaccugcuucauucaa

SEQ ID NO: 1659009 - RNA, 20 nt, Homo sapiens
uuugggggugcuaauccagg

SEQ ID NO: 1659010 - RNA, 15 nt, Homo sapiens
uuugguugcaauugu

SEQ ID NO: 1659011 - RNA, 16 nt, Homo sapiens
uuuguaagcaauucua

SEQ ID NO: 1659012 - RNA, 17 nt, Homo sapiens
uuuguauuuuuccucuu

SEQ ID NO: 1659013 - RNA, 22 nt, Homo sapiens
uuugucacaaauaaacauaaua

SEQ ID NO: 1659014 - RNA, 17 nt, Homo sapiens
uuugucaguguagauca

SEQ ID NO: 1659015 - RNA, 21 nt, Homo sapiens
uuugucucuaguugacuucaa

SEQ ID NO: 1659016 - RNA, 23 nt, Homo sapiens
uuugucugagacagaaucucagu

SEQ ID NO: 1659017 - RNA, 21 nt, Homo sapiens
uuuguucuccggguguggccu

SEQ ID NO: 1659018 - RNA, 17 nt, Homo sapiens
uuuguugagacuaucaa

SEQ ID NO: 1659019 - RNA, 17 nt, Homo sapiens
uuuuaaaacauucacac

SEQ ID NO: 1659020 - RNA, 16 nt, Homo sapiens
uuuuaaacaaauggcu

SEQ ID NO: 1659021 - RNA, 12 nt, Homo sapiens
uuuuaaguauuu

SEQ ID NO: 1659022 - RNA, 16 nt, Homo sapiens
uuuuaaugucaucucu

SEQ ID NO: 1659023 - RNA, 19 nt, Homo sapiens
uuuuaauuuauuucaucca

SEQ ID NO: 1659024 - RNA, 18 nt, Homo sapiens
uuuuagcguuaaagucag

SEQ ID NO: 1659025 - RNA, 18 nt, Homo sapiens
uuuuauaagagggaacaa

SEQ ID NO: 1659026 - RNA, 19 nt, Homo sapiens
uuuucaauguacuguauug

SEQ ID NO: 1659027 - RNA, 20 nt, Homo sapiens
uuuucgucuucccugcuuca

SEQ ID NO: 1659028 - RNA, 16 nt, Homo sapiens
uuuucugagacagagu

SEQ ID NO: 1659029 - RNA, 16 nt, Homo sapiens
uuuucuguaauucuuc

SEQ ID NO: 1659030 - RNA, 14 nt, Homo sapiens
uuuucuucaccuca

SEQ ID NO: 1659031 - RNA, 13 nt, Homo sapiens
uuuugagacagag

SEQ ID NO: 1659032 - RNA, 17 nt, Homo sapiens
uuuugcagaaugagcca

SEQ ID NO: 1659033 - RNA, 21 nt, Homo sapiens
uuuugcagaaugagccagagu

SEQ ID NO: 1659034 - RNA, 15 nt, Homo sapiens
uuuugcucugcucug

SEQ ID NO: 1659035 - RNA, 12 nt, Homo sapiens
uuuugguaucua

SEQ ID NO: 1659036 - RNA, 21 nt, Homo sapiens
uuuugucugcuuaguaucuca

SEQ ID NO: 1659037 - RNA, 15 nt, Homo sapiens
uuuuuaagacucaau

SEQ ID NO: 1659038 - RNA, 14 nt, Homo sapiens
uuuuuaagcucaaa

SEQ ID NO: 1659039 - RNA, 12 nt, Homo sapiens
uuuuuacuauua

SEQ ID NO: 1659040 - RNA, 20 nt, Homo sapiens
uuuuuccaauuuuguugcau

SEQ ID NO: 1659041 - RNA, 22 nt, Homo sapiens
agcugaccucagaggaguuuaa

SEQ ID NO: 1659042 - RNA, 22 nt, Homo sapiens
agcugagacuacaggcacacac

SEQ ID NO: 1659043 - RNA, 14 nt, Homo sapiens
agcugcaacagugg

SEQ ID NO: 1659044 - RNA, 17 nt, Homo sapiens
agcugcaacaguggugu

SEQ ID NO: 1659045 - RNA, 14 nt, Homo sapiens
agcugcaccagcag

SEQ ID NO: 1659046 - RNA, 18 nt, Homo sapiens
agcugcaguuagcacaga

SEQ ID NO: 1659047 - RNA, 11 nt, Homo sapiens
agcugccaaaa

SEQ ID NO: 1659048 - RNA, 17 nt, Homo sapiens
agcugggacuacaggca

SEQ ID NO: 1659049 - RNA, 19 nt, Homo sapiens
agcugggagaaccaaaaag

SEQ ID NO: 1659050 - RNA, 20 nt, Homo sapiens
agcugggagaaccaaaaaga

SEQ ID NO: 1659051 - RNA, 23 nt, Homo sapiens
agcugggguggggaccucaggcc

SEQ ID NO: 1659052 - RNA, 14 nt, Homo sapiens
agcuguaaccgaua

SEQ ID NO: 1659053 - RNA, 18 nt, Homo sapiens
agcuuaccugacacaaga

SEQ ID NO: 1659054 - RNA, 19 nt, Homo sapiens
agcuucccugaacacucau

SEQ ID NO: 1659055 - RNA, 14 nt, Homo sapiens
agcuuggagggaug

SEQ ID NO: 1659056 - RNA, 19 nt, Homo sapiens
aggaaaaguuauugugaua

SEQ ID NO: 1659057 - RNA, 20 nt, Homo sapiens
aggaaaaguuauugugauaa

SEQ ID NO: 1659058 - RNA, 17 nt, Homo sapiens
aggaaacuguagccuga

SEQ ID NO: 1659059 - RNA, 14 nt, Homo sapiens
aggaaagaucccaa

SEQ ID NO: 1659060 - RNA, 17 nt, Homo sapiens
aggaaagcagugcagua

SEQ ID NO: 1659061 - RNA, 22 nt, Homo sapiens
aggaaaugaauauucaacagcu

SEQ ID NO: 1659062 - RNA, 14 nt, Homo sapiens
aggaacacuggagc

SEQ ID NO: 1659063 - RNA, 15 nt, Homo sapiens
aggaacuccuuggcc

SEQ ID NO: 1659064 - RNA, 17 nt, Homo sapiens
aggaacugcuugugcac

SEQ ID NO: 1659065 - RNA, 21 nt, Homo sapiens
aggaagacuuccagcuuucuc

SEQ ID NO: 1659066 - RNA, 17 nt, Homo sapiens
aggaagcagccuccacu

SEQ ID NO: 1659067 - RNA, 19 nt, Homo sapiens
aggaagccucuucaucucc

SEQ ID NO: 1659068 - RNA, 21 nt, Homo sapiens
aggaagguaugugucagccau

SEQ ID NO: 1659069 - RNA, 15 nt, Homo sapiens
aggacacugaugggu

SEQ ID NO: 1659070 - RNA, 22 nt, Homo sapiens
aggacaguacacacuuggguaa

SEQ ID NO: 1659071 - RNA, 22 nt, Homo sapiens
aggaccaggagccagguguccu

SEQ ID NO: 1659072 - RNA, 22 nt, Homo sapiens
aggaccucagcuugcacaaaga

SEQ ID NO: 1659073 - RNA, 22 nt, Homo sapiens
aggaccuuucugaggaguaaaa

SEQ ID NO: 1659074 - RNA, 14 nt, Homo sapiens
aggacgcaugcagg

SEQ ID NO: 1659075 - RNA, 15 nt, Homo sapiens
aggacgcaugcaggg

SEQ ID NO: 1659076 - RNA, 15 nt, Homo sapiens
aggacucccugcuua

SEQ ID NO: 1659077 - RNA, 17 nt, Homo sapiens
aggacuucugcagcuau

SEQ ID NO: 1659078 - RNA, 18 nt, Homo sapiens
aggagaagaaacagcagc

SEQ ID NO: 1659079 - RNA, 18 nt, Homo sapiens
aggagaagaaacagcggc

SEQ ID NO: 1659080 - RNA, 13 nt, Homo sapiens
aggagaguguuua

SEQ ID NO: 1659081 - RNA, 18 nt, Homo sapiens
aggaggauucagcucagg

SEQ ID NO: 1659082 - RNA, 22 nt, Homo sapiens
aggagggcagagacuuuguguu

SEQ ID NO: 1659083 - RNA, 23 nt, Homo sapiens
aggagguuucaaagaaaaggugu

SEQ ID NO: 1659084 - RNA, 15 nt, Homo sapiens
aggagugaugggcaa

SEQ ID NO: 1659085 - RNA, 16 nt, Homo sapiens
aggagugaugggcaag

SEQ ID NO: 1659086 - RNA, 14 nt, Homo sapiens
aggaguuuugagaa

SEQ ID NO: 1659087 - RNA, 17 nt, Homo sapiens
aggaucauuugagccca

SEQ ID NO: 1659088 - RNA, 23 nt, Homo sapiens
aggaugacgguauuaugcuucuu

SEQ ID NO: 1659089 - RNA, 12 nt, Homo sapiens
aggauggucucc

SEQ ID NO: 1659090 - RNA, 17 nt, Homo sapiens
aggauuccuucuucccc

SEQ ID NO: 1659091 - RNA, 15 nt, Homo sapiens
aggauuuaccaaaua

SEQ ID NO: 1659092 - RNA, 13 nt, Homo sapiens
aggcaaaggcccc

SEQ ID NO: 1659093 - RNA, 17 nt, Homo sapiens
aggcaagcaagcucucu

SEQ ID NO: 1659094 - RNA, 21 nt, Homo sapiens
aggcaagcaagcucucuugcc

SEQ ID NO: 1659095 - RNA, 16 nt, Homo sapiens
aggcagcuagacacca

SEQ ID NO: 1659096 - RNA, 15 nt, Homo sapiens
aggcagggaagcucu

SEQ ID NO: 1659097 - RNA, 20 nt, Homo sapiens
aggcagggagggaaacccgg

SEQ ID NO: 1659098 - RNA, 17 nt, Homo sapiens
aggcagggcaaaugaca

SEQ ID NO: 1659099 - RNA, 19 nt, Homo sapiens
aggcaguaugccaaggguc

SEQ ID NO: 1659100 - RNA, 11 nt, Homo sapiens
aggcagugcag

SEQ ID NO: 1659101 - RNA, 13 nt, Homo sapiens
aggcagugcagua

SEQ ID NO: 1659102 - RNA, 18 nt, Homo sapiens
aggcaguucaaagcagga

SEQ ID NO: 1659103 - RNA, 22 nt, Homo sapiens
aggcauccaguaucuugaagac

SEQ ID NO: 1659104 - RNA, 18 nt, Homo sapiens
aggccaaacucaccugcc

SEQ ID NO: 1659105 - RNA, 13 nt, Homo sapiens
aggccaacugccc

SEQ ID NO: 1659106 - RNA, 21 nt, Homo sapiens
aggccaagaaagaaaccagac

SEQ ID NO: 1659107 - RNA, 18 nt, Homo sapiens
aggccaccaagcugcucu

SEQ ID NO: 1659108 - RNA, 20 nt, Homo sapiens
aggccaggacaaaaugcaga

SEQ ID NO: 1659109 - RNA, 23 nt, Homo sapiens
aggcccacucuguuccuacugga

SEQ ID NO: 1659110 - RNA, 17 nt, Homo sapiens
aggccccuuaccugcag

SEQ ID NO: 1659111 - RNA, 10 nt, Homo sapiens
aggcccuccc

SEQ ID NO: 1659112 - RNA, 16 nt, Homo sapiens
aggccugggaccuccc

SEQ ID NO: 1659113 - RNA, 18 nt, Homo sapiens
aggcuccaucuccagugg

SEQ ID NO: 1659114 - RNA, 14 nt, Homo sapiens
aggcucccaaaaga

SEQ ID NO: 1659115 - RNA, 15 nt, Homo sapiens
aggcucugagacuaa

SEQ ID NO: 1659116 - RNA, 20 nt, Homo sapiens
aggcugaaaccauccgcaac

SEQ ID NO: 1659117 - RNA, 23 nt, Homo sapiens
aggcugagucagccccacuccac

SEQ ID NO: 1659118 - RNA, 15 nt, Homo sapiens
aggcuggagugcagu

SEQ ID NO: 1659119 - RNA, 14 nt, Homo sapiens
aggcuguagcaucu

SEQ ID NO: 1659120 - RNA, 17 nt, Homo sapiens
aggcuguucugcacuga

SEQ ID NO: 1659121 - RNA, 17 nt, Homo sapiens
aggcuucccacacugcc

SEQ ID NO: 1659122 - RNA, 23 nt, Homo sapiens
agggaaaauagaaaagaaccuac

SEQ ID NO: 1659123 - RNA, 18 nt, Homo sapiens
agggaaauucacacugug

SEQ ID NO: 1659124 - RNA, 14 nt, Homo sapiens
agggaauccauauc

SEQ ID NO: 1659125 - RNA, 20 nt, Homo sapiens
agggaauccauaucagcucu

SEQ ID NO: 1659126 - RNA, 22 nt, Homo sapiens
agggaaugccagggacauuuuc

SEQ ID NO: 1659127 - RNA, 15 nt, Homo sapiens
agggacaagcauguu

SEQ ID NO: 1659128 - RNA, 23 nt, Homo sapiens
agggaccccagauaccugugagg

SEQ ID NO: 1659129 - RNA, 16 nt, Homo sapiens
agggacgacccggggc

SEQ ID NO: 1659130 - RNA, 18 nt, Homo sapiens
agggacuccagaagcagc

SEQ ID NO: 1659131 - RNA, 13 nt, Homo sapiens
agggacuggcaca

SEQ ID NO: 1659132 - RNA, 19 nt, Homo sapiens
agggagugugaugcaggaa

SEQ ID NO: 1659133 - RNA, 18 nt, Homo sapiens
agggaucugcuugauauc

SEQ ID NO: 1659134 - RNA, 15 nt, Homo sapiens
agggcccccacagga

SEQ ID NO: 1659135 - RNA, 13 nt, Homo sapiens
aggggcaggugaa

SEQ ID NO: 1659136 - RNA, 19 nt, Homo sapiens
aggguccucaguccacugc

SEQ ID NO: 1659137 - RNA, 16 nt, Homo sapiens
agggucugucccgggu

SEQ ID NO: 1659138 - RNA, 22 nt, Homo sapiens
aggguggggggccauguuccca

SEQ ID NO: 1659139 - RNA, 15 nt, Homo sapiens
agggugucuguaauc

SEQ ID NO: 1659140 - RNA, 19 nt, Homo sapiens
aggguguugcagagaggga

SEQ ID NO: 1659141 - RNA, 15 nt, Homo sapiens
agguaaacuagcaaa

SEQ ID NO: 1659142 - RNA, 14 nt, Homo sapiens
agguaaauaaucau

SEQ ID NO: 1659143 - RNA, 22 nt, Homo sapiens
agguaaauaaucauacacagaa

SEQ ID NO: 1659144 - RNA, 15 nt, Homo sapiens
agguacgaaaagagg

SEQ ID NO: 1659145 - RNA, 15 nt, Homo sapiens
agguaucaaaauguu

SEQ ID NO: 1659146 - RNA, 16 nt, Homo sapiens
agguaugugucagcca

SEQ ID NO: 1659147 - RNA, 12 nt, Homo sapiens
aggucaggagau

SEQ ID NO: 1659148 - RNA, 15 nt, Homo sapiens
aggucauugguggca

SEQ ID NO: 1659149 - RNA, 17 nt, Homo sapiens
aggugaaggaucugucc

SEQ ID NO: 1659150 - RNA, 18 nt, Homo sapiens
aggugaaugcacagugaa

SEQ ID NO: 1659151 - RNA, 16 nt, Homo sapiens
aggugaggaagcaaaa

SEQ ID NO: 1659152 - RNA, 16 nt, Homo sapiens
agguggaguaggugaa

SEQ ID NO: 1659153 - RNA, 21 nt, Homo sapiens
agguggggagggccucuggac

SEQ ID NO: 1659154 - RNA, 10 nt, Homo sapiens
agguucaagc

SEQ ID NO: 1659155 - RNA, 22 nt, Homo sapiens
agguuccauccaccaccuugcc

SEQ ID NO: 1659156 - RNA, 15 nt, Homo sapiens
agguuggagugcagu

SEQ ID NO: 1659157 - RNA, 21 nt, Homo sapiens
agguuggagugcauucauuca

SEQ ID NO: 1659158 - RNA, 20 nt, Homo sapiens
agguugugcugccuguggug

SEQ ID NO: 1659159 - RNA, 21 nt, Homo sapiens
agguuuuccugaagaauugaa

SEQ ID NO: 1659160 - RNA, 12 nt, Homo sapiens
aguaaagaccau

SEQ ID NO: 1659161 - RNA, 18 nt, Homo sapiens
aguaaauacauuauugaa

SEQ ID NO: 1659162 - RNA, 17 nt, Homo sapiens
aguaaaucagugcagua

SEQ ID NO: 1659163 - RNA, 15 nt, Homo sapiens
auaaacacagauuau

SEQ ID NO: 1659164 - RNA, 14 nt, Homo sapiens
auaaaccagacuca

SEQ ID NO: 1659165 - RNA, 15 nt, Homo sapiens
auaaaccauaaaaua

SEQ ID NO: 1659166 - RNA, 16 nt, Homo sapiens
auaaacugugagauaa

SEQ ID NO: 1659167 - RNA, 17 nt, Homo sapiens
auaaacuuguacuuaca

SEQ ID NO: 1659168 - RNA, 12 nt, Homo sapiens
auaaagauucca

SEQ ID NO: 1659169 - RNA, 23 nt, Homo sapiens
auaaagccuugugaucacuuucu

SEQ ID NO: 1659170 - RNA, 15 nt, Homo sapiens
auaaauacugcugua

SEQ ID NO: 1659171 - RNA, 11 nt, Homo sapiens
auaaauccaac

SEQ ID NO: 1659172 - RNA, 12 nt, Homo sapiens
auaaauggacuu

SEQ ID NO: 1659173 - RNA, 16 nt, Homo sapiens
auaaauggugucauaa

SEQ ID NO: 1659174 - RNA, 15 nt, Homo sapiens
auaaauguacuacau

SEQ ID NO: 1659175 - RNA, 12 nt, Homo sapiens
auaaauguggau

SEQ ID NO: 1659176 - RNA, 15 nt, Homo sapiens
auaaauuauuuaacu

SEQ ID NO: 1659177 - RNA, 15 nt, Homo sapiens
auaaauuuuggucag

SEQ ID NO: 1659178 - RNA, 17 nt, Homo sapiens
auaacaaaucguccaaa

SEQ ID NO: 1659179 - RNA, 19 nt, Homo sapiens
auaacacuguacugcaaua

SEQ ID NO: 1659180 - RNA, 16 nt, Homo sapiens
auaacuauugcugcuu

SEQ ID NO: 1659181 - RNA, 15 nt, Homo sapiens
auaacugagcacuuu

SEQ ID NO: 1659182 - RNA, 23 nt, Homo sapiens
auaagaaccuuuugagugccuua

SEQ ID NO: 1659183 - RNA, 13 nt, Homo sapiens
auaagaagcaaau

SEQ ID NO: 1659184 - RNA, 22 nt, Homo sapiens
auaaggaguugccgcauauuau

SEQ ID NO: 1659185 - RNA, 17 nt, Homo sapiens
auaagucaaaauaaucu

SEQ ID NO: 1659186 - RNA, 15 nt, Homo sapiens
auaaguguguuugca

SEQ ID NO: 1659187 - RNA, 16 nt, Homo sapiens
auaauaaaauucauuc

SEQ ID NO: 1659188 - RNA, 17 nt, Homo sapiens
auaauaaaggcauuuca

SEQ ID NO: 1659189 - RNA, 18 nt, Homo sapiens
auaauaaccacgauucca

SEQ ID NO: 1659190 - RNA, 16 nt, Homo sapiens
auaauaauggcuaacu

SEQ ID NO: 1659191 - RNA, 16 nt, Homo sapiens
auaauagcucacagca

SEQ ID NO: 1659192 - RNA, 17 nt, Homo sapiens
auaaucccauacucuca

SEQ ID NO: 1659193 - RNA, 20 nt, Homo sapiens
auaaugacuuaagcacacuu

SEQ ID NO: 1659194 - RNA, 18 nt, Homo sapiens
auaauggcucugggcuau

SEQ ID NO: 1659195 - RNA, 13 nt, Homo sapiens
auaauuacuuucc

SEQ ID NO: 1659196 - RNA, 15 nt, Homo sapiens
auaauugacaaacuu

SEQ ID NO: 1659197 - RNA, 17 nt, Homo sapiens
auaauugacugguggaa

SEQ ID NO: 1659198 - RNA, 21 nt, Homo sapiens
auaauuguaaaggugaugaau

SEQ ID NO: 1659199 - RNA, 18 nt, Homo sapiens
auaauuuccuaugccugu

SEQ ID NO: 1659200 - RNA, 17 nt, Homo sapiens
auacaaaaauaccuacu

SEQ ID NO: 1659201 - RNA, 17 nt, Homo sapiens
auacaaccuucauuuaa

SEQ ID NO: 1659202 - RNA, 12 nt, Homo sapiens
auacaaugcaug

SEQ ID NO: 1659203 - RNA, 13 nt, Homo sapiens
auacagaccucca

SEQ ID NO: 1659204 - RNA, 23 nt, Homo sapiens
auacagucucuauuugauuugca

SEQ ID NO: 1659205 - RNA, 22 nt, Homo sapiens
auacauaaaaaagggacaagca

SEQ ID NO: 1659206 - RNA, 19 nt, Homo sapiens
auacauaaaaucgcuuuca

SEQ ID NO: 1659207 - RNA, 14 nt, Homo sapiens
auacaugaugauuu

SEQ ID NO: 1659208 - RNA, 16 nt, Homo sapiens
auacauuagugccaua

SEQ ID NO: 1659209 - RNA, 17 nt, Homo sapiens
auacauuagugccauag

SEQ ID NO: 1659210 - RNA, 19 nt, Homo sapiens
auacauuauuggacuucca

SEQ ID NO: 1659211 - RNA, 21 nt, Homo sapiens
auacauuauuucuguauauag

SEQ ID NO: 1659212 - RNA, 16 nt, Homo sapiens
auaccuucugaugaag

SEQ ID NO: 1659213 - RNA, 19 nt, Homo sapiens
auacgaaacacaaaccaca

SEQ ID NO: 1659214 - RNA, 20 nt, Homo sapiens
auacggcucuaacagauuag

SEQ ID NO: 1659215 - RNA, 16 nt, Homo sapiens
auacucaagagcauaa

SEQ ID NO: 1659216 - RNA, 15 nt, Homo sapiens
auacucgaaucagac

SEQ ID NO: 1659217 - RNA, 16 nt, Homo sapiens
auacuucuaccaacau

SEQ ID NO: 1659218 - RNA, 13 nt, Homo sapiens
auacuucuuuuua

SEQ ID NO: 1659219 - RNA, 16 nt, Homo sapiens
auagaaacaugacacu

SEQ ID NO: 1659220 - RNA, 15 nt, Homo sapiens
auagacacaguauug

SEQ ID NO: 1659221 - RNA, 19 nt, Homo sapiens
auagacacaguauugacuu

SEQ ID NO: 1659222 - RNA, 18 nt, Homo sapiens
auagauaccauuuugaaa

SEQ ID NO: 1659223 - RNA, 19 nt, Homo sapiens
auagaugucuguguauaca

SEQ ID NO: 1659224 - RNA, 13 nt, Homo sapiens
auagcauguaaua

SEQ ID NO: 1659225 - RNA, 18 nt, Homo sapiens
auagccucaccuucccua

SEQ ID NO: 1659226 - RNA, 22 nt, Homo sapiens
auagcgugcaguagagagcaaa

SEQ ID NO: 1659227 - RNA, 14 nt, Homo sapiens
auagcuaaguagca

SEQ ID NO: 1659228 - RNA, 16 nt, Homo sapiens
auagcuaaguagcauc

SEQ ID NO: 1659229 - RNA, 13 nt, Homo sapiens
auagcuucaucca

SEQ ID NO: 1659230 - RNA, 20 nt, Homo sapiens
auagcuuuagagaagccaua

SEQ ID NO: 1659231 - RNA, 12 nt, Homo sapiens
auaggaggacag

SEQ ID NO: 1659232 - RNA, 20 nt, Homo sapiens
auaggauccgaagugcaaug

SEQ ID NO: 1659233 - RNA, 16 nt, Homo sapiens
auaggcuuagugcuug

SEQ ID NO: 1659234 - RNA, 14 nt, Homo sapiens
auaguaaaacuaaa

SEQ ID NO: 1659235 - RNA, 14 nt, Homo sapiens
auagucaaucaaac

SEQ ID NO: 1659236 - RNA, 22 nt, Homo sapiens
auagucuguacuucaguucuca

SEQ ID NO: 1659237 - RNA, 22 nt, Homo sapiens
auagucuucuuucuuagauucu

SEQ ID NO: 1659238 - RNA, 21 nt, Homo sapiens
auagugaugugcuagaacuuu

SEQ ID NO: 1659239 - RNA, 16 nt, Homo sapiens
auagugggacccuguc

SEQ ID NO: 1659240 - RNA, 16 nt, Homo sapiens
auagugucccacggug

SEQ ID NO: 1659241 - RNA, 14 nt, Homo sapiens
auauaaacugugag

SEQ ID NO: 1659242 - RNA, 20 nt, Homo sapiens
auauaaaucguaaccuauga

SEQ ID NO: 1659243 - RNA, 12 nt, Homo sapiens
auauaagccaua

SEQ ID NO: 1659244 - RNA, 22 nt, Homo sapiens
auauacaacuuuggaauuugaa

SEQ ID NO: 1659245 - RNA, 19 nt, Homo sapiens
auauacagaccuccagauu

SEQ ID NO: 1659246 - RNA, 23 nt, Homo sapiens
auauacauuagacacacauauac

SEQ ID NO: 1659247 - RNA, 16 nt, Homo sapiens
auauacucauuuggau

SEQ ID NO: 1659248 - RNA, 17 nt, Homo sapiens
auauaguagacaaagag

SEQ ID NO: 1659249 - RNA, 15 nt, Homo sapiens
auauauaagccaaaa

SEQ ID NO: 1659250 - RNA, 17 nt, Homo sapiens
auauauuauauauacau

SEQ ID NO: 1659251 - RNA, 17 nt, Homo sapiens
auaucaagguuccugau

SEQ ID NO: 1659252 - RNA, 21 nt, Homo sapiens
auaucaagguuccugauucag

SEQ ID NO: 1659253 - RNA, 17 nt, Homo sapiens
auaucagcucugcauaa

SEQ ID NO: 1659254 - RNA, 17 nt, Homo sapiens
auauccuuggcacaucc

SEQ ID NO: 1659255 - RNA, 20 nt, Homo sapiens
auaucuaucuauauauacau

SEQ ID NO: 1659256 - RNA, 15 nt, Homo sapiens
auaucuguggucuuc

SEQ ID NO: 1659257 - RNA, 17 nt, Homo sapiens
auaugaguacauacuca

SEQ ID NO: 1659258 - RNA, 18 nt, Homo sapiens
auaugggacugagccugg

SEQ ID NO: 1659259 - RNA, 14 nt, Homo sapiens
auaugucaaaggcu

SEQ ID NO: 1659260 - RNA, 22 nt, Homo sapiens
auaugugaaaggauaugaaucu

SEQ ID NO: 1659261 - RNA, 13 nt, Homo sapiens
auauuaaaguuac

SEQ ID NO: 1659262 - RNA, 15 nt, Homo sapiens
auauuauauauacau

SEQ ID NO: 1659263 - RNA, 20 nt, Homo sapiens
auauuauaucagacugcuuu

SEQ ID NO: 1659264 - RNA, 22 nt, Homo sapiens
auauucccaugguagacuguga

SEQ ID NO: 1659265 - RNA, 14 nt, Homo sapiens
auauucugugauca

SEQ ID NO: 1659266 - RNA, 18 nt, Homo sapiens
auauugagcaauauguca

SEQ ID NO: 1659267 - RNA, 20 nt, Homo sapiens
auauugagcaauaugucagu

SEQ ID NO: 1659268 - RNA, 19 nt, Homo sapiens
auauuguuuaaugcaaaug

SEQ ID NO: 1659269 - RNA, 18 nt, Homo sapiens
auauuuaaagucuugaau

SEQ ID NO: 1659270 - RNA, 21 nt, Homo sapiens
auauuuaauaggauaaauuaa

SEQ ID NO: 1659271 - RNA, 16 nt, Homo sapiens
aucaacagaccuaaga

SEQ ID NO: 1659272 - RNA, 15 nt, Homo sapiens
aucaacucauguuaa

SEQ ID NO: 1659273 - RNA, 17 nt, Homo sapiens
aucaagaaacauucaga

SEQ ID NO: 1659274 - RNA, 18 nt, Homo sapiens
aucaaggugcucuucuca

SEQ ID NO: 1659275 - RNA, 18 nt, Homo sapiens
aucaaugacaauggugcc

SEQ ID NO: 1659276 - RNA, 11 nt, Homo sapiens
aucacagucag

SEQ ID NO: 1659277 - RNA, 23 nt, Homo sapiens
aucacccuugaaaacucucaguc

SEQ ID NO: 1659278 - RNA, 18 nt, Homo sapiens
aucacggauguuggcucc

SEQ ID NO: 1659279 - RNA, 22 nt, Homo sapiens
aucacuauugcuuccuaaaggu

SEQ ID NO: 1659280 - RNA, 18 nt, Homo sapiens
aucacucauuuauuucca

SEQ ID NO: 1659281 - RNA, 15 nt, Homo sapiens
aucagaaacaauuuc

SEQ ID NO: 1659282 - RNA, 15 nt, Homo sapiens
aucagaguaugucag

SEQ ID NO: 1659283 - RNA, 23 nt, Homo sapiens
aucagggugggaccccauuccag

SEQ ID NO: 1659284 - RNA, 22 nt, Homo sapiens
aucaguaauguauucuaucucu

SEQ ID NO: 1659285 - RNA, 14 nt, Homo sapiens
caacaaaagggaaa

SEQ ID NO: 1659286 - RNA, 21 nt, Homo sapiens
caacaauuuaggaaugcucaa

SEQ ID NO: 1659287 - RNA, 17 nt, Homo sapiens
caacacccaaagcaugg

SEQ ID NO: 1659288 - RNA, 22 nt, Homo sapiens
caacaggcuguucugcacugaa

SEQ ID NO: 1659289 - RNA, 14 nt, Homo sapiens
caacagucagccag

SEQ ID NO: 1659290 - RNA, 16 nt, Homo sapiens
caacagugaacagcuu

SEQ ID NO: 1659291 - RNA, 17 nt, Homo sapiens
caacaguggugugguuc

SEQ ID NO: 1659292 - RNA, 22 nt, Homo sapiens
caaccaaugaaaacagucccau

SEQ ID NO: 1659293 - RNA, 14 nt, Homo sapiens
caaccaauggcaga

SEQ ID NO: 1659294 - RNA, 20 nt, Homo sapiens
caaccaggcuacaguugaua

SEQ ID NO: 1659295 - RNA, 22 nt, Homo sapiens
caacccugugaucuauaccacc

SEQ ID NO: 1659296 - RNA, 19 nt, Homo sapiens
caaccuccccugguccugc

SEQ ID NO: 1659297 - RNA, 19 nt, Homo sapiens
caaccucggggagugccac

SEQ ID NO: 1659298 - RNA, 17 nt, Homo sapiens
caaccucucuacuagca

SEQ ID NO: 1659299 - RNA, 21 nt, Homo sapiens
caacgcacaggaaaagguagc

SEQ ID NO: 1659300 - RNA, 15 nt, Homo sapiens
caacuauuucuuuca

SEQ ID NO: 1659301 - RNA, 20 nt, Homo sapiens
caacuauuucuuucaucaga

SEQ ID NO: 1659302 - RNA, 15 nt, Homo sapiens
caacuccucuccucc

SEQ ID NO: 1659303 - RNA, 19 nt, Homo sapiens
caacugcaucaagauguga

SEQ ID NO: 1659304 - RNA, 23 nt, Homo sapiens
caacugcaucaagaugugacaug

SEQ ID NO: 1659305 - RNA, 18 nt, Homo sapiens
caacugcccagagccaca

SEQ ID NO: 1659306 - RNA, 23 nt, Homo sapiens
caacuguuuuugaagaagggaaa

SEQ ID NO: 1659307 - RNA, 19 nt, Homo sapiens
caacuuaaaccugugcuuu

SEQ ID NO: 1659308 - RNA, 19 nt, Homo sapiens
caacuugaaauuauaucug

SEQ ID NO: 1659309 - RNA, 13 nt, Homo sapiens
caacuuuccagac

SEQ ID NO: 1659310 - RNA, 20 nt, Homo sapiens
caagaagugggauucaggaa

SEQ ID NO: 1659311 - RNA, 16 nt, Homo sapiens
caagacggauccacag

SEQ ID NO: 1659312 - RNA, 12 nt, Homo sapiens
caagacuucaaa

SEQ ID NO: 1659313 - RNA, 19 nt, Homo sapiens
caagacuuccucaugaauc

SEQ ID NO: 1659314 - RNA, 19 nt, Homo sapiens
caagagaccacuuccuuaa

SEQ ID NO: 1659315 - RNA, 15 nt, Homo sapiens
caagagccugaguga

SEQ ID NO: 1659316 - RNA, 14 nt, Homo sapiens
caagauaaacacaa

SEQ ID NO: 1659317 - RNA, 23 nt, Homo sapiens
caagaucaaacuuccauagcuuc

SEQ ID NO: 1659318 - RNA, 22 nt, Homo sapiens
caagauccugucuugcugaggg

SEQ ID NO: 1659319 - RNA, 15 nt, Homo sapiens
caagcaagcucucuu

SEQ ID NO: 1659320 - RNA, 16 nt, Homo sapiens
caagcaaugagaagac

SEQ ID NO: 1659321 - RNA, 18 nt, Homo sapiens
caagcaaugagaagacca

SEQ ID NO: 1659322 - RNA, 19 nt, Homo sapiens
caagcacaauugaucucuu

SEQ ID NO: 1659323 - RNA, 17 nt, Homo sapiens
caagcacuggacuacaa

SEQ ID NO: 1659324 - RNA, 13 nt, Homo sapiens
caagccaggguuc

SEQ ID NO: 1659325 - RNA, 18 nt, Homo sapiens
caagccaggguuccagac

SEQ ID NO: 1659326 - RNA, 18 nt, Homo sapiens
caagcgaccuaaacagcu

SEQ ID NO: 1659327 - RNA, 18 nt, Homo sapiens
caagcucucuugccgagg

SEQ ID NO: 1659328 - RNA, 11 nt, Homo sapiens
caagcucugcc

SEQ ID NO: 1659329 - RNA, 23 nt, Homo sapiens
caagcugcucuccuucacucuga

SEQ ID NO: 1659330 - RNA, 22 nt, Homo sapiens
caaggcaaggaaggguguugca

SEQ ID NO: 1659331 - RNA, 14 nt, Homo sapiens
caaggcacugagcg

SEQ ID NO: 1659332 - RNA, 11 nt, Homo sapiens
caaggccaaag

SEQ ID NO: 1659333 - RNA, 20 nt, Homo sapiens
caaggccagcccacacagcc

SEQ ID NO: 1659334 - RNA, 15 nt, Homo sapiens
caaggcuccacaagc

SEQ ID NO: 1659335 - RNA, 22 nt, Homo sapiens
caagggaagugaccaaggugaa

SEQ ID NO: 1659336 - RNA, 21 nt, Homo sapiens
caagggagggguuaaugcaga

SEQ ID NO: 1659337 - RNA, 16 nt, Homo sapiens
caaggugcucuucuca

SEQ ID NO: 1659338 - RNA, 12 nt, Homo sapiens
caagguuuacau

SEQ ID NO: 1659339 - RNA, 18 nt, Homo sapiens
caaguaaaucuaucucua

SEQ ID NO: 1659340 - RNA, 20 nt, Homo sapiens
caaguauuuuaucuguguug

SEQ ID NO: 1659341 - RNA, 18 nt, Homo sapiens
caagugcgccaaggagaa

SEQ ID NO: 1659342 - RNA, 20 nt, Homo sapiens
caagugcuucuccagccuca

SEQ ID NO: 1659343 - RNA, 21 nt, Homo sapiens
caaguggggucuuucagaaca

SEQ ID NO: 1659344 - RNA, 20 nt, Homo sapiens
caagugugugugcaauguuc

SEQ ID NO: 1659345 - RNA, 23 nt, Homo sapiens
caaguucacaccacugccauuuc

SEQ ID NO: 1659346 - RNA, 15 nt, Homo sapiens
caaguuucagaguca

SEQ ID NO: 1659347 - RNA, 16 nt, Homo sapiens
caaguuuuugguaaug

SEQ ID NO: 1659348 - RNA, 15 nt, Homo sapiens
caauaaacucaguca

SEQ ID NO: 1659349 - RNA, 17 nt, Homo sapiens
caauaaacucagucaaa

SEQ ID NO: 1659350 - RNA, 14 nt, Homo sapiens
caauaaagcaaugu

SEQ ID NO: 1659351 - RNA, 15 nt, Homo sapiens
caauaaagugugagg

SEQ ID NO: 1659352 - RNA, 19 nt, Homo sapiens
caauaaggauuuauucuca

SEQ ID NO: 1659353 - RNA, 17 nt, Homo sapiens
caauaaggcagugcagu

SEQ ID NO: 1659354 - RNA, 18 nt, Homo sapiens
caauaaggcagugcagug

SEQ ID NO: 1659355 - RNA, 22 nt, Homo sapiens
caauaaggggagaguaacccug

SEQ ID NO: 1659356 - RNA, 23 nt, Homo sapiens
caauacucagugcgguacucagu

SEQ ID NO: 1659357 - RNA, 16 nt, Homo sapiens
caauagccccaucucu

SEQ ID NO: 1659358 - RNA, 20 nt, Homo sapiens
caauaugggaggaacaaaga

SEQ ID NO: 1659359 - RNA, 15 nt, Homo sapiens
caaucacaagccaag

SEQ ID NO: 1659360 - RNA, 19 nt, Homo sapiens
caaucugucagaacggugu

SEQ ID NO: 1659361 - RNA, 22 nt, Homo sapiens
caaucuuggcagacuaaaacaa

SEQ ID NO: 1659362 - RNA, 19 nt, Homo sapiens
caaugaaauauuugcuuau

SEQ ID NO: 1659363 - RNA, 14 nt, Homo sapiens
caaugaacugugcu

SEQ ID NO: 1659364 - RNA, 20 nt, Homo sapiens
caaugaaucaaugugcuccu

SEQ ID NO: 1659365 - RNA, 21 nt, Homo sapiens
caaugaaucaaugugcuccuu

SEQ ID NO: 1659366 - RNA, 17 nt, Homo sapiens
caaugaccacauccuga

SEQ ID NO: 1659367 - RNA, 21 nt, Homo sapiens
caaugcuauggacugcacaaa

SEQ ID NO: 1659368 - RNA, 16 nt, Homo sapiens
caauggcagauaucua

SEQ ID NO: 1659369 - RNA, 17 nt, Homo sapiens
caauggugaacugucau

SEQ ID NO: 1659370 - RNA, 14 nt, Homo sapiens
caaugguguagcug

SEQ ID NO: 1659371 - RNA, 13 nt, Homo sapiens
caaugugauaugu

SEQ ID NO: 1659372 - RNA, 23 nt, Homo sapiens
caaugugcuguugauucuuucaa

SEQ ID NO: 1659373 - RNA, 20 nt, Homo sapiens
caauguggaauuacauaaca

SEQ ID NO: 1659374 - RNA, 17 nt, Homo sapiens
caauuacuacuuuguua

SEQ ID NO: 1659375 - RNA, 18 nt, Homo sapiens
caauuaucaaaaaacaga

SEQ ID NO: 1659376 - RNA, 14 nt, Homo sapiens
caauucugugauau

SEQ ID NO: 1659377 - RNA, 14 nt, Homo sapiens
caauuggguuguga

SEQ ID NO: 1659378 - RNA, 19 nt, Homo sapiens
caauuucacagaguacaaa

SEQ ID NO: 1659379 - RNA, 15 nt, Homo sapiens
caauuuguauaaaau

SEQ ID NO: 1659380 - RNA, 14 nt, Homo sapiens
cacaaaagucucaa

SEQ ID NO: 1659381 - RNA, 12 nt, Homo sapiens
cacaaaaugcaa

SEQ ID NO: 1659382 - RNA, 17 nt, Homo sapiens
cacaaaaugcaagguga

SEQ ID NO: 1659383 - RNA, 23 nt, Homo sapiens
cacaacaugcacauucauccuca

SEQ ID NO: 1659384 - RNA, 18 nt, Homo sapiens
cacaacugacacaggaaa

SEQ ID NO: 1659385 - RNA, 19 nt, Homo sapiens
cacaacugacacaggaaac

SEQ ID NO: 1659386 - RNA, 17 nt, Homo sapiens
cacaacuuugcuuuuag

SEQ ID NO: 1659387 - RNA, 23 nt, Homo sapiens
cacaaugguuuuguuucuuuccu

SEQ ID NO: 1659388 - RNA, 15 nt, Homo sapiens
cacaauuccaugaau

SEQ ID NO: 1659389 - RNA, 12 nt, Homo sapiens
cacacaacugug

SEQ ID NO: 1659390 - RNA, 13 nt, Homo sapiens
cacacaacugugg

SEQ ID NO: 1659391 - RNA, 13 nt, Homo sapiens
cacacacauggaa

SEQ ID NO: 1659392 - RNA, 18 nt, Homo sapiens
cacacccucacucugcca

SEQ ID NO: 1659393 - RNA, 13 nt, Homo sapiens
cacaccucccuuc

SEQ ID NO: 1659394 - RNA, 20 nt, Homo sapiens
cacacucucuucuuacugua

SEQ ID NO: 1659395 - RNA, 13 nt, Homo sapiens
cacacugagcaag

SEQ ID NO: 1659396 - RNA, 18 nt, Homo sapiens
cacacugcccucugccac

SEQ ID NO: 1659397 - RNA, 17 nt, Homo sapiens
cacacuugggagcaaaa

SEQ ID NO: 1659398 - RNA, 16 nt, Homo sapiens
cacagacccacaagag

SEQ ID NO: 1659399 - RNA, 11 nt, Homo sapiens
cacagccagaa

SEQ ID NO: 1659400 - RNA, 18 nt, Homo sapiens
cacagccccuugcuucua

SEQ ID NO: 1659401 - RNA, 13 nt, Homo sapiens
cacagcuacucag

SEQ ID NO: 1659402 - RNA, 16 nt, Homo sapiens
cacaggagcguguacu

SEQ ID NO: 1659403 - RNA, 17 nt, Homo sapiens
cacaggagcguguacua

SEQ ID NO: 1659404 - RNA, 23 nt, Homo sapiens
cacagggacacacgugagccaca

SEQ ID NO: 1659405 - RNA, 19 nt, Homo sapiens
cacagggcuagaagcacag

SEQ ID NO: 1659406 - RNA, 18 nt, Homo sapiens
cacaggucccacugcccu

SEQ ID NO: 1659407 - RNA, 15 nt, Homo sapiens
ccaucuguuugauac

SEQ ID NO: 1659408 - RNA, 21 nt, Homo sapiens
ccaucuguuugauacaguauu

SEQ ID NO: 1659409 - RNA, 19 nt, Homo sapiens
ccaugaagaagugcuuccg

SEQ ID NO: 1659410 - RNA, 14 nt, Homo sapiens
ccaugaccuugacg

SEQ ID NO: 1659411 - RNA, 17 nt, Homo sapiens
ccaugcagaucuagcca

SEQ ID NO: 1659412 - RNA, 14 nt, Homo sapiens
ccaugccaccaccc

SEQ ID NO: 1659413 - RNA, 21 nt, Homo sapiens
ccaugguagacugugacacag

SEQ ID NO: 1659414 - RNA, 23 nt, Homo sapiens
ccauguuauuuauaguguugcuu

SEQ ID NO: 1659415 - RNA, 21 nt, Homo sapiens
ccauguuuaaguguacuggau

SEQ ID NO: 1659416 - RNA, 19 nt, Homo sapiens
ccauguuuuugcaaauacu

SEQ ID NO: 1659417 - RNA, 22 nt, Homo sapiens
ccauuacucaaaaugcaggaca

SEQ ID NO: 1659418 - RNA, 17 nt, Homo sapiens
ccauuagcccacugccu

SEQ ID NO: 1659419 - RNA, 13 nt, Homo sapiens
ccauucauuuaca

SEQ ID NO: 1659420 - RNA, 19 nt, Homo sapiens
ccauuccaauacauugaac

SEQ ID NO: 1659421 - RNA, 13 nt, Homo sapiens
ccauuccugggcu

SEQ ID NO: 1659422 - RNA, 18 nt, Homo sapiens
ccauucuccggccucagu

SEQ ID NO: 1659423 - RNA, 11 nt, Homo sapiens
ccauucugcuu

SEQ ID NO: 1659424 - RNA, 12 nt, Homo sapiens
ccauucugggac

SEQ ID NO: 1659425 - RNA, 12 nt, Homo sapiens
ccauucuguucc

SEQ ID NO: 1659426 - RNA, 20 nt, Homo sapiens
ccauucuguuccaccacugu

SEQ ID NO: 1659427 - RNA, 23 nt, Homo sapiens
ccauuuccaaaccuccacugcug

SEQ ID NO: 1659428 - RNA, 15 nt, Homo sapiens
ccauuuccauggugc

SEQ ID NO: 1659429 - RNA, 14 nt, Homo sapiens
ccauuuguauacuu

SEQ ID NO: 1659430 - RNA, 14 nt, Homo sapiens
ccauuugugauacu

SEQ ID NO: 1659431 - RNA, 17 nt, Homo sapiens
ccauuugugauacuucc

SEQ ID NO: 1659432 - RNA, 17 nt, Homo sapiens
cccaaacagcaugugcu

SEQ ID NO: 1659433 - RNA, 14 nt, Homo sapiens
cccaacgcacagga

SEQ ID NO: 1659434 - RNA, 15 nt, Homo sapiens
cccaacgcacaggaa

SEQ ID NO: 1659435 - RNA, 21 nt, Homo sapiens
cccaagguaaacaguuugaaa

SEQ ID NO: 1659436 - RNA, 21 nt, Homo sapiens
cccaagugaagacgaggccaa

SEQ ID NO: 1659437 - RNA, 16 nt, Homo sapiens
cccaaguuauccaccu

SEQ ID NO: 1659438 - RNA, 15 nt, Homo sapiens
cccaaucagcacuga

SEQ ID NO: 1659439 - RNA, 14 nt, Homo sapiens
cccacaacuugcca

SEQ ID NO: 1659440 - RNA, 16 nt, Homo sapiens
cccacaaguauugccc

SEQ ID NO: 1659441 - RNA, 13 nt, Homo sapiens
cccacacugugaa

SEQ ID NO: 1659442 - RNA, 22 nt, Homo sapiens
cccacagagguggaacuuaauu

SEQ ID NO: 1659443 - RNA, 11 nt, Homo sapiens
cccacccaguc

SEQ ID NO: 1659444 - RNA, 17 nt, Homo sapiens
cccacccgggagcagug

SEQ ID NO: 1659445 - RNA, 20 nt, Homo sapiens
cccacccgggagcagugucc

SEQ ID NO: 1659446 - RNA, 21 nt, Homo sapiens
cccaccugucaaccugaauua

SEQ ID NO: 1659447 - RNA, 22 nt, Homo sapiens
cccacgucccgggcacugucau

SEQ ID NO: 1659448 - RNA, 18 nt, Homo sapiens
cccacugccagacaugcc

SEQ ID NO: 1659449 - RNA, 19 nt, Homo sapiens
cccacuggagcguguacua

SEQ ID NO: 1659450 - RNA, 13 nt, Homo sapiens
cccagaacaugga

SEQ ID NO: 1659451 - RNA, 16 nt, Homo sapiens
cccagaaccuugaugg

SEQ ID NO: 1659452 - RNA, 15 nt, Homo sapiens
cccagagaagccuca

SEQ ID NO: 1659453 - RNA, 15 nt, Homo sapiens
cccagagccacagaa

SEQ ID NO: 1659454 - RNA, 16 nt, Homo sapiens
cccagccaagugguga

SEQ ID NO: 1659455 - RNA, 16 nt, Homo sapiens
cccagcggcucuuccu

SEQ ID NO: 1659456 - RNA, 22 nt, Homo sapiens
cccagcgugggaccccaaguga

SEQ ID NO: 1659457 - RNA, 16 nt, Homo sapiens
cccagcuaacucugac

SEQ ID NO: 1659458 - RNA, 17 nt, Homo sapiens
cccagcuuggagugcca

SEQ ID NO: 1659459 - RNA, 12 nt, Homo sapiens
cccaggaaccga

SEQ ID NO: 1659460 - RNA, 14 nt, Homo sapiens
cccaggccaucacc

SEQ ID NO: 1659461 - RNA, 19 nt, Homo sapiens
cccaguccggugccuucca

SEQ ID NO: 1659462 - RNA, 21 nt, Homo sapiens
cccauagaaacaugacacuga

SEQ ID NO: 1659463 - RNA, 17 nt, Homo sapiens
cccaucacacucggcca

SEQ ID NO: 1659464 - RNA, 22 nt, Homo sapiens
cccaugaccuugacgugugugg

SEQ ID NO: 1659465 - RNA, 18 nt, Homo sapiens
cccaugguagacugugac

SEQ ID NO: 1659466 - RNA, 19 nt, Homo sapiens
cccauuagcccacugccug

SEQ ID NO: 1659467 - RNA, 15 nt, Homo sapiens
cccauuuuuguaaua

SEQ ID NO: 1659468 - RNA, 17 nt, Homo sapiens
ccccaaacagcaugugc

SEQ ID NO: 1659469 - RNA, 20 nt, Homo sapiens
ccccacaacacaccuugccc

SEQ ID NO: 1659470 - RNA, 20 nt, Homo sapiens
ccccacacaggccuggccca

SEQ ID NO: 1659471 - RNA, 15 nt, Homo sapiens
ccccacagauccauc

SEQ ID NO: 1659472 - RNA, 18 nt, Homo sapiens
ccccacuggagcguguac

SEQ ID NO: 1659473 - RNA, 24 nt, Homo sapiens
ccccagagcuuuacagugccacga

SEQ ID NO: 1659474 - RNA, 23 nt, Homo sapiens
ccccagccugcucccuagccaga

SEQ ID NO: 1659475 - RNA, 16 nt, Homo sapiens
ccccauccucacacag

SEQ ID NO: 1659476 - RNA, 14 nt, Homo sapiens
ccccauucugggac

SEQ ID NO: 1659477 - RNA, 14 nt, Homo sapiens
cccccaagcucagu

SEQ ID NO: 1659478 - RNA, 23 nt, Homo sapiens
cccccacccgggagcaguguccu

SEQ ID NO: 1659479 - RNA, 14 nt, Homo sapiens
cccccuccugcaag

SEQ ID NO: 1659480 - RNA, 17 nt, Homo sapiens
ccccuaacugauuucca

SEQ ID NO: 1659481 - RNA, 22 nt, Homo sapiens
ccccuauccuuggcaccaaaga

SEQ ID NO: 1659482 - RNA, 15 nt, Homo sapiens
ccccucagauuccac

SEQ ID NO: 1659483 - RNA, 16 nt, Homo sapiens
ccccucagauuccacc

SEQ ID NO: 1659484 - RNA, 17 nt, Homo sapiens
ccccuccgugcuuuucu

SEQ ID NO: 1659485 - RNA, 16 nt, Homo sapiens
ccccuccuccaugcug

SEQ ID NO: 1659486 - RNA, 16 nt, Homo sapiens
ccccuccucgccgggc

SEQ ID NO: 1659487 - RNA, 21 nt, Homo sapiens
ccccuggggggcacagccaga

SEQ ID NO: 1659488 - RNA, 14 nt, Homo sapiens
ccccuucuguguca

SEQ ID NO: 1659489 - RNA, 12 nt, Homo sapiens
cccgaaaccuca

SEQ ID NO: 1659490 - RNA, 23 nt, Homo sapiens
cccgcccaggccaucaccacagc

SEQ ID NO: 1659491 - RNA, 23 nt, Homo sapiens
cccggggcgggcugaugucuucu

SEQ ID NO: 1659492 - RNA, 16 nt, Homo sapiens
cccgguguaugcagug

SEQ ID NO: 1659493 - RNA, 18 nt, Homo sapiens
cccgugcccuguuuccaa

SEQ ID NO: 1659494 - RNA, 22 nt, Homo sapiens
cccguggugagguugugcugcc

SEQ ID NO: 1659495 - RNA, 14 nt, Homo sapiens
cccuaaacugugaa

SEQ ID NO: 1659496 - RNA, 19 nt, Homo sapiens
cccuagggcucuccaagca

SEQ ID NO: 1659497 - RNA, 22 nt, Homo sapiens
cccuagggcucuccaagcacua

SEQ ID NO: 1659498 - RNA, 15 nt, Homo sapiens
cccuaucucccacaa

SEQ ID NO: 1659499 - RNA, 14 nt, Homo sapiens
cccucacucugcca

SEQ ID NO: 1659500 - RNA, 20 nt, Homo sapiens
cccucagauuccaccuagag

SEQ ID NO: 1659501 - RNA, 17 nt, Homo sapiens
cccucagccaaugaauc

SEQ ID NO: 1659502 - RNA, 15 nt, Homo sapiens
cccuccccuuuugaa

SEQ ID NO: 1659503 - RNA, 15 nt, Homo sapiens
cccuccuccaugcug

SEQ ID NO: 1659504 - RNA, 20 nt, Homo sapiens
cccucguuaaucacaggauc

SEQ ID NO: 1659505 - RNA, 13 nt, Homo sapiens
cccugcaaccucg

SEQ ID NO: 1659506 - RNA, 15 nt, Homo sapiens
cccugcccugaccuc

SEQ ID NO: 1659507 - RNA, 20 nt, Homo sapiens
cccugccuccacuugccuug

SEQ ID NO: 1659508 - RNA, 16 nt, Homo sapiens
cccugucuuuccagca

SEQ ID NO: 1659509 - RNA, 20 nt, Homo sapiens
cccugugaucuauaccaccu

SEQ ID NO: 1659510 - RNA, 16 nt, Homo sapiens
cccugugggcucacac

SEQ ID NO: 1659511 - RNA, 13 nt, Homo sapiens
cccuguugcuaca

SEQ ID NO: 1659512 - RNA, 19 nt, Homo sapiens
cccuucaaugcaaaauaca

SEQ ID NO: 1659513 - RNA, 21 nt, Homo sapiens
cccuucauccuucuggaauaa

SEQ ID NO: 1659514 - RNA, 11 nt, Homo sapiens
cccuuccccau

SEQ ID NO: 1659515 - RNA, 13 nt, Homo sapiens
cccuugacuguua

SEQ ID NO: 1659516 - RNA, 19 nt, Homo sapiens
cccuuuaucauguguuucu

SEQ ID NO: 1659517 - RNA, 19 nt, Homo sapiens
ccgaaacccuugacuguua

SEQ ID NO: 1659518 - RNA, 20 nt, Homo sapiens
ccgaagaaugaagucuuucc

SEQ ID NO: 1659519 - RNA, 15 nt, Homo sapiens
ccgaagugcaaugau

SEQ ID NO: 1659520 - RNA, 22 nt, Homo sapiens
ccgacacugcagcagaaucucu

SEQ ID NO: 1659521 - RNA, 15 nt, Homo sapiens
ccgauauaagccaua

SEQ ID NO: 1659522 - RNA, 18 nt, Homo sapiens
ccgcagggcgcuccggca

SEQ ID NO: 1659523 - RNA, 16 nt, Homo sapiens
ccgccagaguguccug

SEQ ID NO: 1659524 - RNA, 21 nt, Homo sapiens
ccgcgcucugccccuccgucc

SEQ ID NO: 1659525 - RNA, 17 nt, Homo sapiens
ccgcuguuuguauuucu

SEQ ID NO: 1659526 - RNA, 22 nt, Homo sapiens
ccgcuguuuuggggucuuaggg

SEQ ID NO: 1659527 - RNA, 18 nt, Homo sapiens
ccggaaagccuuccucaa

SEQ ID NO: 1659528 - RNA, 13 nt, Homo sapiens
ccggcacugugca

SEQ ID NO: 1659529 - RNA, 12 nt, Homo sapiens
cuaugacccugu

SEQ ID NO: 1659530 - RNA, 18 nt, Homo sapiens
cuaugaggggguuuggca

SEQ ID NO: 1659531 - RNA, 19 nt, Homo sapiens
cuaugaggggguuuggcac

SEQ ID NO: 1659532 - RNA, 15 nt, Homo sapiens
cuaugauaugugcuu

SEQ ID NO: 1659533 - RNA, 23 nt, Homo sapiens
cuaugcugugugcagaguauaca

SEQ ID NO: 1659534 - RNA, 12 nt, Homo sapiens
cuaugucuguga

SEQ ID NO: 1659535 - RNA, 10 nt, Homo sapiens
cuauguguau

SEQ ID NO: 1659536 - RNA, 14 nt, Homo sapiens
cuauuaccuuguga

SEQ ID NO: 1659537 - RNA, 15 nt, Homo sapiens
cuauuaccuugugaa

SEQ ID NO: 1659538 - RNA, 21 nt, Homo sapiens
cuauuauuuacuccuuaccaa

SEQ ID NO: 1659539 - RNA, 12 nt, Homo sapiens
cuauucauuaca

SEQ ID NO: 1659540 - RNA, 16 nt, Homo sapiens
cuauuguuucuuucaa

SEQ ID NO: 1659541 - RNA, 17 nt, Homo sapiens
cuauuucuacacagugg

SEQ ID NO: 1659542 - RNA, 20 nt, Homo sapiens
cuauuugaaacacacaguga

SEQ ID NO: 1659543 - RNA, 21 nt, Homo sapiens
cuauuuggucucuuguaccca

SEQ ID NO: 1659544 - RNA, 16 nt, Homo sapiens
cuauuuuaaugaauga

SEQ ID NO: 1659545 - RNA, 17 nt, Homo sapiens
cuauuuuggacguguga

SEQ ID NO: 1659546 - RNA, 15 nt, Homo sapiens
cucaaaauaaaacca

SEQ ID NO: 1659547 - RNA, 18 nt, Homo sapiens
cucaaagaaguacuguac

SEQ ID NO: 1659548 - RNA, 21 nt, Homo sapiens
cucaaagaggccaguacuuug

SEQ ID NO: 1659549 - RNA, 21 nt, Homo sapiens
cucaacaaaucucagucccug

SEQ ID NO: 1659550 - RNA, 17 nt, Homo sapiens
cucaacccugugaucua

SEQ ID NO: 1659551 - RNA, 12 nt, Homo sapiens
cucaagauccug

SEQ ID NO: 1659552 - RNA, 19 nt, Homo sapiens
cucaagauccugucuugcu

SEQ ID NO: 1659553 - RNA, 20 nt, Homo sapiens
cucaagauuguagaaacuca

SEQ ID NO: 1659554 - RNA, 21 nt, Homo sapiens
cucaaggcugcagugagccaa

SEQ ID NO: 1659555 - RNA, 12 nt, Homo sapiens
cucaagugccau

SEQ ID NO: 1659556 - RNA, 14 nt, Homo sapiens
cucaauacccacug

SEQ ID NO: 1659557 - RNA, 13 nt, Homo sapiens
cucaaucucaggu

SEQ ID NO: 1659558 - RNA, 14 nt, Homo sapiens
cucacacacauaga

SEQ ID NO: 1659559 - RNA, 15 nt, Homo sapiens
cucacagaugggcaa

SEQ ID NO: 1659560 - RNA, 18 nt, Homo sapiens
cucacaugccacuggaaa

SEQ ID NO: 1659561 - RNA, 17 nt, Homo sapiens
cucaccaacuacagaaa

SEQ ID NO: 1659562 - RNA, 18 nt, Homo sapiens
cucaccaggguuuaguuu

SEQ ID NO: 1659563 - RNA, 13 nt, Homo sapiens
cucacgauuccag

SEQ ID NO: 1659564 - RNA, 19 nt, Homo sapiens
cucacgauuccagugcagu

SEQ ID NO: 1659565 - RNA, 12 nt, Homo sapiens
cucacucuguca

SEQ ID NO: 1659566 - RNA, 15 nt, Homo sapiens
cucacugguuuucaa

SEQ ID NO: 1659567 - RNA, 17 nt, Homo sapiens
cucagcaaucacaagcc

SEQ ID NO: 1659568 - RNA, 18 nt, Homo sapiens
cucagcaaucacaagcca

SEQ ID NO: 1659569 - RNA, 12 nt, Homo sapiens
cucagcacuuug

SEQ ID NO: 1659570 - RNA, 14 nt, Homo sapiens
cucagcaguggugu

SEQ ID NO: 1659571 - RNA, 17 nt, Homo sapiens
cucagccaucuguagaa

SEQ ID NO: 1659572 - RNA, 18 nt, Homo sapiens
cucagccucccaaagugc

SEQ ID NO: 1659573 - RNA, 22 nt, Homo sapiens
cucaggaaugcagcacaguacu

SEQ ID NO: 1659574 - RNA, 17 nt, Homo sapiens
cucaggacccagggaau

SEQ ID NO: 1659575 - RNA, 17 nt, Homo sapiens
cucaggcaccugcacuu

SEQ ID NO: 1659576 - RNA, 13 nt, Homo sapiens
cucaggcuuucua

SEQ ID NO: 1659577 - RNA, 13 nt, Homo sapiens
cucagggaccaag

SEQ ID NO: 1659578 - RNA, 15 nt, Homo sapiens
cucagggaccaagga

SEQ ID NO: 1659579 - RNA, 20 nt, Homo sapiens
cucaguaaaucagugcagua

SEQ ID NO: 1659580 - RNA, 22 nt, Homo sapiens
cucaguaacacaauacaguacu

SEQ ID NO: 1659581 - RNA, 20 nt, Homo sapiens
cucaguaacacagugcagua

SEQ ID NO: 1659582 - RNA, 18 nt, Homo sapiens
cucaguaacagugcagua

SEQ ID NO: 1659583 - RNA, 20 nt, Homo sapiens
cucaguaagacagugcagug

SEQ ID NO: 1659584 - RNA, 19 nt, Homo sapiens
cucaguaaggcagugcagu

SEQ ID NO: 1659585 - RNA, 11 nt, Homo sapiens
cucaguaauac

SEQ ID NO: 1659586 - RNA, 21 nt, Homo sapiens
cucagucccugacuaacagcc

SEQ ID NO: 1659587 - RNA, 16 nt, Homo sapiens
cucagugcaccugggg

SEQ ID NO: 1659588 - RNA, 21 nt, Homo sapiens
cucaguguccaguugcagcug

SEQ ID NO: 1659589 - RNA, 17 nt, Homo sapiens
cucaguuggugcugcuu

SEQ ID NO: 1659590 - RNA, 18 nt, Homo sapiens
cucaguuucucuggagac

SEQ ID NO: 1659591 - RNA, 13 nt, Homo sapiens
cucauagcacaug

SEQ ID NO: 1659592 - RNA, 14 nt, Homo sapiens
cucaucaacaaaga

SEQ ID NO: 1659593 - RNA, 15 nt, Homo sapiens
cucaucacugaaauc

SEQ ID NO: 1659594 - RNA, 12 nt, Homo sapiens
cucauccagaac

SEQ ID NO: 1659595 - RNA, 20 nt, Homo sapiens
cucaugauguauuguugcuu

SEQ ID NO: 1659596 - RNA, 15 nt, Homo sapiens
cucauguucauucag

SEQ ID NO: 1659597 - RNA, 20 nt, Homo sapiens
cucauuauuaccacuuagaa

SEQ ID NO: 1659598 - RNA, 16 nt, Homo sapiens
cucauuuagcauugaa

SEQ ID NO: 1659599 - RNA, 11 nt, Homo sapiens
cucauuugcau

SEQ ID NO: 1659600 - RNA, 19 nt, Homo sapiens
cucauuuuuauauucauuu

SEQ ID NO: 1659601 - RNA, 20 nt, Homo sapiens
cuccaacuuucccuccacca

SEQ ID NO: 1659602 - RNA, 12 nt, Homo sapiens
cuccacagggca

SEQ ID NO: 1659603 - RNA, 12 nt, Homo sapiens
cuccacauuucc

SEQ ID NO: 1659604 - RNA, 17 nt, Homo sapiens
cuccaccagugugcuug

SEQ ID NO: 1659605 - RNA, 19 nt, Homo sapiens
cuccacgguagcacuugac

SEQ ID NO: 1659606 - RNA, 12 nt, Homo sapiens
cuccacuccucc

SEQ ID NO: 1659607 - RNA, 15 nt, Homo sapiens
cuccacucugaaguc

SEQ ID NO: 1659608 - RNA, 17 nt, Homo sapiens
cuccagaacaaaccucu

SEQ ID NO: 1659609 - RNA, 16 nt, Homo sapiens
cuccagaagggcagcu

SEQ ID NO: 1659610 - RNA, 16 nt, Homo sapiens
cuccaggauuguccac

SEQ ID NO: 1659611 - RNA, 17 nt, Homo sapiens
cuccaugagugcagcuc

SEQ ID NO: 1659612 - RNA, 20 nt, Homo sapiens
cucccaaagugcugggauua

SEQ ID NO: 1659613 - RNA, 18 nt, Homo sapiens
cucccaaguccaguguga

SEQ ID NO: 1659614 - RNA, 18 nt, Homo sapiens
cucccagcuguaccggcc

SEQ ID NO: 1659615 - RNA, 21 nt, Homo sapiens
cuccccaauccaacccaugca

SEQ ID NO: 1659616 - RNA, 14 nt, Homo sapiens
cuccccauggugca

SEQ ID NO: 1659617 - RNA, 20 nt, Homo sapiens
cuccccauggugcagugaag

SEQ ID NO: 1659618 - RNA, 22 nt, Homo sapiens
cucccccagagguggauacugg

SEQ ID NO: 1659619 - RNA, 15 nt, Homo sapiens
cuccccccacaagaa

SEQ ID NO: 1659620 - RNA, 16 nt, Homo sapiens
cuccccucagauucca

SEQ ID NO: 1659621 - RNA, 20 nt, Homo sapiens
cucccggggguguaucugag

SEQ ID NO: 1659622 - RNA, 17 nt, Homo sapiens
cucccuaccguccuccu

SEQ ID NO: 1659623 - RNA, 12 nt, Homo sapiens
cucccuagccag

SEQ ID NO: 1659624 - RNA, 17 nt, Homo sapiens
cucccuagccagaggcu

SEQ ID NO: 1659625 - RNA, 22 nt, Homo sapiens
cucccuagccagaggcucuaau

SEQ ID NO: 1659626 - RNA, 23 nt, Homo sapiens
cucccuuccuuaugcauacugag

SEQ ID NO: 1659627 - RNA, 15 nt, Homo sapiens
cucccuuggauuuuu

SEQ ID NO: 1659628 - RNA, 15 nt, Homo sapiens
cucccuuguccuucu

SEQ ID NO: 1659629 - RNA, 17 nt, Homo sapiens
cucccuuuuuaaacaaa

SEQ ID NO: 1659630 - RNA, 14 nt, Homo sapiens
cuccuaaaacacac

SEQ ID NO: 1659631 - RNA, 15 nt, Homo sapiens
cuccuccugcauguc

SEQ ID NO: 1659632 - RNA, 19 nt, Homo sapiens
cuccucgguggcauuugcu

SEQ ID NO: 1659633 - RNA, 22 nt, Homo sapiens
cuccucuccagcccugcagcua

SEQ ID NO: 1659634 - RNA, 20 nt, Homo sapiens
cuccuggcaaucugucagaa

SEQ ID NO: 1659635 - RNA, 23 nt, Homo sapiens
cuccugggggcauaucucaguca

SEQ ID NO: 1659636 - RNA, 18 nt, Homo sapiens
cuccuggucgcuuugcca

SEQ ID NO: 1659637 - RNA, 21 nt, Homo sapiens
cuccugguguggaagagcucc

SEQ ID NO: 1659638 - RNA, 20 nt, Homo sapiens
cuccuucacucccugucaua

SEQ ID NO: 1659639 - RNA, 14 nt, Homo sapiens
cuccuuccaccaca

SEQ ID NO: 1659640 - RNA, 17 nt, Homo sapiens
cuccuugaaaccagcuc

SEQ ID NO: 1659641 - RNA, 16 nt, Homo sapiens
cuccuuuaauauacuc

SEQ ID NO: 1659642 - RNA, 21 nt, Homo sapiens
cuccuuuaccacccagaaauc

SEQ ID NO: 1659643 - RNA, 14 nt, Homo sapiens
cucgaaucacucau

SEQ ID NO: 1659644 - RNA, 17 nt, Homo sapiens
cucgagcucuguagccu

SEQ ID NO: 1659645 - RNA, 12 nt, Homo sapiens
cucgccaccugc

SEQ ID NO: 1659646 - RNA, 12 nt, Homo sapiens
cucgcccugugc

SEQ ID NO: 1659647 - RNA, 16 nt, Homo sapiens
cucggaguccaaaggg

SEQ ID NO: 1659648 - RNA, 16 nt, Homo sapiens
cucggggagugccacu

SEQ ID NO: 1659649 - RNA, 21 nt, Homo sapiens
cucgggugcauuugagagaag

SEQ ID NO: 1659650 - RNA, 22 nt, Homo sapiens
cucgguucaaaaccuugcacag

SEQ ID NO: 1659651 - RNA, 11 nt, Homo sapiens
cucgugccaug

SEQ ID NO: 1659652 - RNA, 16 nt, Homo sapiens
guucccaauacaaaaa

SEQ ID NO: 1659653 - RNA, 13 nt, Homo sapiens
guucccaugagau

SEQ ID NO: 1659654 - RNA, 20 nt, Homo sapiens
guuccucauggcuguuaucu

SEQ ID NO: 1659655 - RNA, 14 nt, Homo sapiens
guuccugugaucuc

SEQ ID NO: 1659656 - RNA, 12 nt, Homo sapiens
guucgugcuugu

SEQ ID NO: 1659657 - RNA, 15 nt, Homo sapiens
guucuaccauuacca

SEQ ID NO: 1659658 - RNA, 20 nt, Homo sapiens
guucucaauacccacugcca

SEQ ID NO: 1659659 - RNA, 17 nt, Homo sapiens
guucucggaguccaaag

SEQ ID NO: 1659660 - RNA, 15 nt, Homo sapiens
guucugaugaggcau

SEQ ID NO: 1659661 - RNA, 14 nt, Homo sapiens
guucugcacugaaa

SEQ ID NO: 1659662 - RNA, 16 nt, Homo sapiens
guucugccacuuaggg

SEQ ID NO: 1659663 - RNA, 20 nt, Homo sapiens
guucuuugagggacugccuc

SEQ ID NO: 1659664 - RNA, 15 nt, Homo sapiens
guugaagaaggcaaa

SEQ ID NO: 1659665 - RNA, 15 nt, Homo sapiens
guugagcuaugauau

SEQ ID NO: 1659666 - RNA, 12 nt, Homo sapiens
guugaguuugcu

SEQ ID NO: 1659667 - RNA, 16 nt, Homo sapiens
guugaguuugcuguau

SEQ ID NO: 1659668 - RNA, 19 nt, Homo sapiens
guugauaaaaagaaaguuu

SEQ ID NO: 1659669 - RNA, 15 nt, Homo sapiens
guugaugaagcacau

SEQ ID NO: 1659670 - RNA, 19 nt, Homo sapiens
guugccuuuauauccaaaa

SEQ ID NO: 1659671 - RNA, 13 nt, Homo sapiens
guuggugcugcuu

SEQ ID NO: 1659672 - RNA, 23 nt, Homo sapiens
guuggugcugcuuucuuguugcu

SEQ ID NO: 1659673 - RNA, 17 nt, Homo sapiens
guuguacuaacauauua

SEQ ID NO: 1659674 - RNA, 16 nt, Homo sapiens
guuuaagguucuugcu

SEQ ID NO: 1659675 - RNA, 13 nt, Homo sapiens
guuuaaugcaaau

SEQ ID NO: 1659676 - RNA, 15 nt, Homo sapiens
guuuaauguuuaguc

SEQ ID NO: 1659677 - RNA, 19 nt, Homo sapiens
guuuacucuagacuaaaga

SEQ ID NO: 1659678 - RNA, 18 nt, Homo sapiens
guuuagugugauugugaa

SEQ ID NO: 1659679 - RNA, 19 nt, Homo sapiens
guuuauugucaaaguggug

SEQ ID NO: 1659680 - RNA, 12 nt, Homo sapiens
guuucacagugg

SEQ ID NO: 1659681 - RNA, 19 nt, Homo sapiens
guuucacuguguuagccac

SEQ ID NO: 1659682 - RNA, 15 nt, Homo sapiens
guuucagagucagaa

SEQ ID NO: 1659683 - RNA, 23 nt, Homo sapiens
guuucagaugauucuaugucuca

SEQ ID NO: 1659684 - RNA, 15 nt, Homo sapiens
guuucauauucucag

SEQ ID NO: 1659685 - RNA, 15 nt, Homo sapiens
guuuccagugacaca

SEQ ID NO: 1659686 - RNA, 18 nt, Homo sapiens
guuucuauggauucacuu

SEQ ID NO: 1659687 - RNA, 14 nt, Homo sapiens
guuucuguccugua

SEQ ID NO: 1659688 - RNA, 14 nt, Homo sapiens
guuucuguuugaau

SEQ ID NO: 1659689 - RNA, 16 nt, Homo sapiens
guuugcuaauguuucc

SEQ ID NO: 1659690 - RNA, 20 nt, Homo sapiens
guuuuagagacuauggagcc

SEQ ID NO: 1659691 - RNA, 17 nt, Homo sapiens
guuuuuaucauggguau

SEQ ID NO: 1659692 - RNA, 18 nt, Homo sapiens
guuuuuuuacaacauuca

SEQ ID NO: 1659693 - RNA, 13 nt, Homo sapiens
uaaaaacauguga

SEQ ID NO: 1659694 - RNA, 13 nt, Homo sapiens
uaaaaagguuuaa

SEQ ID NO: 1659695 - RNA, 12 nt, Homo sapiens
uaaaaaguugca

SEQ ID NO: 1659696 - RNA, 13 nt, Homo sapiens
uaaaacaagagac

SEQ ID NO: 1659697 - RNA, 17 nt, Homo sapiens
uaaaacauuaguaguuu

SEQ ID NO: 1659698 - RNA, 11 nt, Homo sapiens
uaaaaccaaag

SEQ ID NO: 1659699 - RNA, 22 nt, Homo sapiens
uaaaaccuuacuuaaagcuugu

SEQ ID NO: 1659700 - RNA, 17 nt, Homo sapiens
uaaaacgauuacugacu

SEQ ID NO: 1659701 - RNA, 14 nt, Homo sapiens
uaaaacugugacau

SEQ ID NO: 1659702 - RNA, 17 nt, Homo sapiens
uaaaacuuacuauggua

SEQ ID NO: 1659703 - RNA, 16 nt, Homo sapiens
uaaaagaaacuguggu

SEQ ID NO: 1659704 - RNA, 18 nt, Homo sapiens
uaaaagagaacuugauag

SEQ ID NO: 1659705 - RNA, 16 nt, Homo sapiens
uaaaagcccuuuccaa

SEQ ID NO: 1659706 - RNA, 22 nt, Homo sapiens
uaaaagccuaugugccuuucac

SEQ ID NO: 1659707 - RNA, 19 nt, Homo sapiens
uaaaauaaaucuacuguuu

SEQ ID NO: 1659708 - RNA, 21 nt, Homo sapiens
uaaaaucacaaacucauccau

SEQ ID NO: 1659709 - RNA, 14 nt, Homo sapiens
uaaaaucagacucu

SEQ ID NO: 1659710 - RNA, 17 nt, Homo sapiens
uaaaauuauacugugug

SEQ ID NO: 1659711 - RNA, 17 nt, Homo sapiens
uaaacacaaauugugaa

SEQ ID NO: 1659712 - RNA, 22 nt, Homo sapiens
uaaacacauagauucaccugua

SEQ ID NO: 1659713 - RNA, 20 nt, Homo sapiens
uaaacagcugcuuuaugaaa

SEQ ID NO: 1659714 - RNA, 19 nt, Homo sapiens
uaaacauuuuuaaguauuu

SEQ ID NO: 1659715 - RNA, 15 nt, Homo sapiens
uaaaccagacucacu

SEQ ID NO: 1659716 - RNA, 18 nt, Homo sapiens
uaaacucagucaaaugua

SEQ ID NO: 1659717 - RNA, 21 nt, Homo sapiens
uaaagaccuugaaaagcagua

SEQ ID NO: 1659718 - RNA, 16 nt, Homo sapiens
uaaagaggcgucuugu

SEQ ID NO: 1659719 - RNA, 23 nt, Homo sapiens
uaaagaguucuccuuguacuuga

SEQ ID NO: 1659720 - RNA, 17 nt, Homo sapiens
uaaagcaaugugguagu

SEQ ID NO: 1659721 - RNA, 16 nt, Homo sapiens
uaaagccuugugauca

SEQ ID NO: 1659722 - RNA, 15 nt, Homo sapiens
uaaaggagcauauaa

SEQ ID NO: 1659723 - RNA, 22 nt, Homo sapiens
uaaaggcuugguugguagauau

SEQ ID NO: 1659724 - RNA, 14 nt, Homo sapiens
uaaaggugccagag

SEQ ID NO: 1659725 - RNA, 11 nt, Homo sapiens
uaaagguuuau

SEQ ID NO: 1659726 - RNA, 20 nt, Homo sapiens
uaaagugagaaaacugugac

SEQ ID NO: 1659727 - RNA, 15 nt, Homo sapiens
uaaagugcacugcca

SEQ ID NO: 1659728 - RNA, 15 nt, Homo sapiens
uaaauaacugugacu

SEQ ID NO: 1659729 - RNA, 13 nt, Homo sapiens
uaaauaaugcuua

SEQ ID NO: 1659730 - RNA, 16 nt, Homo sapiens
uaaauauauauuuauc

SEQ ID NO: 1659731 - RNA, 15 nt, Homo sapiens
uaaauccaacucuga

SEQ ID NO: 1659732 - RNA, 15 nt, Homo sapiens
uaaaucguaaccuau

SEQ ID NO: 1659733 - RNA, 14 nt, Homo sapiens
uaaaucuacuguuu

SEQ ID NO: 1659734 - RNA, 18 nt, Homo sapiens
uaaaugcaaacacugugu

SEQ ID NO: 1659735 - RNA, 13 nt, Homo sapiens
uaaaugccuaaua

SEQ ID NO: 1659736 - RNA, 15 nt, Homo sapiens
uaaaugucccaaaua

SEQ ID NO: 1659737 - RNA, 14 nt, Homo sapiens
uaaauuacaugcau

SEQ ID NO: 1659738 - RNA, 16 nt, Homo sapiens
uaaauuugacuguuau

SEQ ID NO: 1659739 - RNA, 16 nt, Homo sapiens
uaacaaaagcaauugu

SEQ ID NO: 1659740 - RNA, 18 nt, Homo sapiens
uaacaaaucguccaaaga

SEQ ID NO: 1659741 - RNA, 15 nt, Homo sapiens
uaacaagacuucaaa

SEQ ID NO: 1659742 - RNA, 16 nt, Homo sapiens
uaacaauaaaguguga

SEQ ID NO: 1659743 - RNA, 20 nt, Homo sapiens
uaacacacacacacauacac

SEQ ID NO: 1659744 - RNA, 14 nt, Homo sapiens
uaacacuguacugc

SEQ ID NO: 1659745 - RNA, 16 nt, Homo sapiens
uaacagaaaaaugaaa

SEQ ID NO: 1659746 - RNA, 19 nt, Homo sapiens
uaacagaaaaaugaaauuu

SEQ ID NO: 1659747 - RNA, 14 nt, Homo sapiens
uaacauaucauuca

SEQ ID NO: 1659748 - RNA, 15 nt, Homo sapiens
uaacaucaaagacuc

SEQ ID NO: 1659749 - RNA, 21 nt, Homo sapiens
uaacaucacuauccaugcacc

SEQ ID NO: 1659750 - RNA, 17 nt, Homo sapiens
uaacauggaaguacuau

SEQ ID NO: 1659751 - RNA, 18 nt, Homo sapiens
uaaccgauaugcacuuga

SEQ ID NO: 1659752 - RNA, 16 nt, Homo sapiens
uaaccgggacuacaga

SEQ ID NO: 1659753 - RNA, 20 nt, Homo sapiens
uaaccucuacaggcauuuaa

SEQ ID NO: 1659754 - RNA, 15 nt, Homo sapiens
uaacuauugcugcuu

SEQ ID NO: 1659755 - RNA, 16 nt, Homo sapiens
uaacugagcacuuuga

SEQ ID NO: 1659756 - RNA, 13 nt, Homo sapiens
uaacugauuucca

SEQ ID NO: 1659757 - RNA, 21 nt, Homo sapiens
uaacugcacacaugguuucca

SEQ ID NO: 1659758 - RNA, 22 nt, Homo sapiens
uaacugcacacaugguuuccaa

SEQ ID NO: 1659759 - RNA, 22 nt, Homo sapiens
uaacuguccguaguaucagaga

SEQ ID NO: 1659760 - RNA, 13 nt, Homo sapiens
uaacuguuacagu

SEQ ID NO: 1659761 - RNA, 23 nt, Homo sapiens
uaacuugugauuccagggcuguu

SEQ ID NO: 1659762 - RNA, 13 nt, Homo sapiens
uaagaaauaucug

SEQ ID NO: 1659763 - RNA, 20 nt, Homo sapiens
uaagaagcaaauaaauauca

SEQ ID NO: 1659764 - RNA, 14 nt, Homo sapiens
uaagacaacaggca

SEQ ID NO: 1659765 - RNA, 12 nt, Homo sapiens
uaagacauucac

SEQ ID NO: 1659766 - RNA, 23 nt, Homo sapiens
uaagauguuaucaaugacaaugg

SEQ ID NO: 1659767 - RNA, 14 nt, Homo sapiens
uaagauuuugccug

SEQ ID NO: 1659768 - RNA, 15 nt, Homo sapiens
uaagcaacuguaaaa

SEQ ID NO: 1659769 - RNA, 12 nt, Homo sapiens
uaagccagggca

SEQ ID NO: 1659770 - RNA, 22 nt, Homo sapiens
uaagccauugcuucucccucac

SEQ ID NO: 1659771 - RNA, 16 nt, Homo sapiens
uaagcucacacagcua

SEQ ID NO: 1659772 - RNA, 16 nt, Homo sapiens
uaagcuggagugcagu

SEQ ID NO: 1659773 - RNA, 18 nt, Homo sapiens
uaagcuggagugcagugg

SEQ ID NO: 1659774 - RNA, 23 nt, Homo sapiens
uaagcuguaagauaauguugcuu

SEQ ID NO: 1659775 - RNA, 22 nt, Homo sapiens
uauuguuaaaaccuuacuuaaa

SEQ ID NO: 1659776 - RNA, 14 nt, Homo sapiens
uauuuauaacauug

SEQ ID NO: 1659777 - RNA, 13 nt, Homo sapiens
uauuucaauguaa

SEQ ID NO: 1659778 - RNA, 20 nt, Homo sapiens
uauuucacuuaaacuuuguc

SEQ ID NO: 1659779 - RNA, 16 nt, Homo sapiens
uauuucauccaguuug

SEQ ID NO: 1659780 - RNA, 22 nt, Homo sapiens
uauuuccauauuaaaaucacaa

SEQ ID NO: 1659781 - RNA, 14 nt, Homo sapiens
uauuucuacacagu

SEQ ID NO: 1659782 - RNA, 14 nt, Homo sapiens
ucaaaauaaucuga

SEQ ID NO: 1659783 - RNA, 13 nt, Homo sapiens
ucaaaauguggac

SEQ ID NO: 1659784 - RNA, 15 nt, Homo sapiens
ucaaacagaaaagaa

SEQ ID NO: 1659785 - RNA, 20 nt, Homo sapiens
ucaaacagggacacuacaaa

SEQ ID NO: 1659786 - RNA, 17 nt, Homo sapiens
ucaaacuccugaccuca

SEQ ID NO: 1659787 - RNA, 17 nt, Homo sapiens
ucaaacuuucaccucag

SEQ ID NO: 1659788 - RNA, 18 nt, Homo sapiens
ucaaagaaucaccuaauu

SEQ ID NO: 1659789 - RNA, 18 nt, Homo sapiens
ucaaaggagcaagaacuu

SEQ ID NO: 1659790 - RNA, 13 nt, Homo sapiens
ucaaaguguuuaa

SEQ ID NO: 1659791 - RNA, 21 nt, Homo sapiens
ucaaaugaauaaugccuuugu

SEQ ID NO: 1659792 - RNA, 14 nt, Homo sapiens
ucaaaugcauuuug

SEQ ID NO: 1659793 - RNA, 16 nt, Homo sapiens
ucaaauuucagaccag

SEQ ID NO: 1659794 - RNA, 13 nt, Homo sapiens
ucaacaaaucuca

SEQ ID NO: 1659795 - RNA, 16 nt, Homo sapiens
ucaacagaccuaagaa

SEQ ID NO: 1659796 - RNA, 12 nt, Homo sapiens
ucaacagaucaa

SEQ ID NO: 1659797 - RNA, 13 nt, Homo sapiens
ucaacagaucaau

SEQ ID NO: 1659798 - RNA, 13 nt, Homo sapiens
ucaacaugugcuc

SEQ ID NO: 1659799 - RNA, 23 nt, Homo sapiens
ucaacuucaggaaagcagcaguu

SEQ ID NO: 1659800 - RNA, 18 nt, Homo sapiens
ucaagacuuccucaugaa

SEQ ID NO: 1659801 - RNA, 20 nt, Homo sapiens
ucaagagggggcaagucaca

SEQ ID NO: 1659802 - RNA, 21 nt, Homo sapiens
ucaagauccugucuugcugag

SEQ ID NO: 1659803 - RNA, 15 nt, Homo sapiens
ucaaggcugcaguga

SEQ ID NO: 1659804 - RNA, 15 nt, Homo sapiens
ucaaguugugugcua

SEQ ID NO: 1659805 - RNA, 18 nt, Homo sapiens
ucaauaaggcagugcagu

SEQ ID NO: 1659806 - RNA, 17 nt, Homo sapiens
ucaauaccaccaagagg

SEQ ID NO: 1659807 - RNA, 16 nt, Homo sapiens
ucaauacccacugcca

SEQ ID NO: 1659808 - RNA, 15 nt, Homo sapiens
ucaauacccuuguga

SEQ ID NO: 1659809 - RNA, 13 nt, Homo sapiens
ucaaucaaacagg

SEQ ID NO: 1659810 - RNA, 18 nt, Homo sapiens
ucaaucaagaugggugau

SEQ ID NO: 1659811 - RNA, 13 nt, Homo sapiens
ucaaugaacugug

SEQ ID NO: 1659812 - RNA, 17 nt, Homo sapiens
ucaaugcaaugcaucug

SEQ ID NO: 1659813 - RNA, 14 nt, Homo sapiens
ucaaugcuauggac

SEQ ID NO: 1659814 - RNA, 15 nt, Homo sapiens
ucaaugcucuaacaa

SEQ ID NO: 1659815 - RNA, 21 nt, Homo sapiens
ucaaugcugacuggacugugu

SEQ ID NO: 1659816 - RNA, 18 nt, Homo sapiens
ucaaugugaaauaaagag

SEQ ID NO: 1659817 - RNA, 18 nt, Homo sapiens
ucaauuacaggaaguacu

SEQ ID NO: 1659818 - RNA, 15 nt, Homo sapiens
ucacaaacucaucca

SEQ ID NO: 1659819 - RNA, 13 nt, Homo sapiens
ucacaaagcuauu

SEQ ID NO: 1659820 - RNA, 18 nt, Homo sapiens
ucacaaaguuaaacguga

SEQ ID NO: 1659821 - RNA, 21 nt, Homo sapiens
ucacacacacacaauggcaag

SEQ ID NO: 1659822 - RNA, 14 nt, Homo sapiens
ucacacacauggaa

SEQ ID NO: 1659823 - RNA, 15 nt, Homo sapiens
ucacaccacuuguga

SEQ ID NO: 1659824 - RNA, 14 nt, Homo sapiens
ucacagaguacaaa

SEQ ID NO: 1659825 - RNA, 20 nt, Homo sapiens
ucacauuuuacgacaaggau

SEQ ID NO: 1659826 - RNA, 14 nt, Homo sapiens
ucaccaaacaugaa

SEQ ID NO: 1659827 - RNA, 14 nt, Homo sapiens
ucaccacagcugca

SEQ ID NO: 1659828 - RNA, 18 nt, Homo sapiens
ucaccagcuaucugucau

SEQ ID NO: 1659829 - RNA, 13 nt, Homo sapiens
ucacccaaaacaa

SEQ ID NO: 1659830 - RNA, 19 nt, Homo sapiens
ucacccagguuggagugca

SEQ ID NO: 1659831 - RNA, 23 nt, Homo sapiens
ucaccccggcaggcccugcagug

SEQ ID NO: 1659832 - RNA, 13 nt, Homo sapiens
ucaccuaucugga

SEQ ID NO: 1659833 - RNA, 16 nt, Homo sapiens
ucaccuggcuucccag

SEQ ID NO: 1659834 - RNA, 18 nt, Homo sapiens
ucaccuguaaaacuuuau

SEQ ID NO: 1659835 - RNA, 19 nt, Homo sapiens
ucacgauuccagugcagua

SEQ ID NO: 1659836 - RNA, 18 nt, Homo sapiens
ucacuaaauccuuuccaa

SEQ ID NO: 1659837 - RNA, 15 nt, Homo sapiens
ucacuaugguaugcu

SEQ ID NO: 1659838 - RNA, 14 nt, Homo sapiens
ucacucacaaaagg

SEQ ID NO: 1659839 - RNA, 16 nt, Homo sapiens
ucacuccucugucaua

SEQ ID NO: 1659840 - RNA, 17 nt, Homo sapiens
ucacucugucagccagc

SEQ ID NO: 1659841 - RNA, 17 nt, Homo sapiens
ucacugaaaucccucua

SEQ ID NO: 1659842 - RNA, 18 nt, Homo sapiens
ucacugauauauuuucca

SEQ ID NO: 1659843 - RNA, 14 nt, Homo sapiens
ucacugcaaccucc

SEQ ID NO: 1659844 - RNA, 22 nt, Homo sapiens
ucacugcuuuuuccuuagcuua

SEQ ID NO: 1659845 - RNA, 17 nt, Homo sapiens
ucacuggggaagccagu

SEQ ID NO: 1659846 - RNA, 21 nt, Homo sapiens
ucacuuaaacuuugucacuuc

SEQ ID NO: 1659847 - RNA, 18 nt, Homo sapiens
ucacuuguuuguguuuga

SEQ ID NO: 1659848 - RNA, 18 nt, Homo sapiens
ucagaaaauuagcaugaa

SEQ ID NO: 1659849 - RNA, 18 nt, Homo sapiens
ucagaagauuagcaugaa

SEQ ID NO: 1659850 - RNA, 22 nt, Homo sapiens
ucagaauugaaccgucaaugug

SEQ ID NO: 1659851 - RNA, 20 nt, Homo sapiens
ucagacaaauguaacacaca

SEQ ID NO: 1659852 - RNA, 13 nt, Homo sapiens
ucagaccacaagg

SEQ ID NO: 1659853 - RNA, 14 nt, Homo sapiens
ucagaggaguuuaa

SEQ ID NO: 1659854 - RNA, 12 nt, Homo sapiens
ucagauuccacc

SEQ ID NO: 1659855 - RNA, 15 nt, Homo sapiens
ucagauuuucuggac

SEQ ID NO: 1659856 - RNA, 20 nt, Homo sapiens
ucagcaacccuacaguauau

SEQ ID NO: 1659857 - RNA, 18 nt, Homo sapiens
ucagcaagacaaugacac

SEQ ID NO: 1659858 - RNA, 22 nt, Homo sapiens
ucagcaaucacaagccaagguc

SEQ ID NO: 1659859 - RNA, 11 nt, Homo sapiens
ucagcacugaa

SEQ ID NO: 1659860 - RNA, 20 nt, Homo sapiens
ucagcaguggugucucugaa

SEQ ID NO: 1659861 - RNA, 21 nt, Homo sapiens
ucagcaguucagcuccuucca

SEQ ID NO: 1659862 - RNA, 21 nt, Homo sapiens
ucagcaugauguguuguguau

SEQ ID NO: 1659863 - RNA, 23 nt, Homo sapiens
ucagccucccaagcaccugggau

SEQ ID NO: 1659864 - RNA, 13 nt, Homo sapiens
ucagccugugaac

SEQ ID NO: 1659865 - RNA, 19 nt, Homo sapiens
ucagcgggagucuccucac

SEQ ID NO: 1659866 - RNA, 14 nt, Homo sapiens
ucagcuccuuccac

SEQ ID NO: 1659867 - RNA, 14 nt, Homo sapiens
ucagcucuaaagca

SEQ ID NO: 1659868 - RNA, 15 nt, Homo sapiens
ucagcuuuguuaaau

SEQ ID NO: 1659869 - RNA, 18 nt, Homo sapiens
ucaggaaauaucugugaa

SEQ ID NO: 1659870 - RNA, 19 nt, Homo sapiens
ucaggaaauaucugugaag

SEQ ID NO: 1659871 - RNA, 19 nt, Homo sapiens
ucaggaaugcagcacagua

SEQ ID NO: 1659872 - RNA, 16 nt, Homo sapiens
ucaggaccacccugcc

SEQ ID NO: 1659873 - RNA, 15 nt, Homo sapiens
ucaggaccaugugau

SEQ ID NO: 1659874 - RNA, 21 nt, Homo sapiens
ucaggacccagggaaugccag

SEQ ID NO: 1659875 - RNA, 14 nt, Homo sapiens
ucaggcagugcagu

SEQ ID NO: 1659876 - RNA, 16 nt, Homo sapiens
ucaggcagugcaguac

SEQ ID NO: 1659877 - RNA, 14 nt, Homo sapiens
ucaggcccuggaac

SEQ ID NO: 1659878 - RNA, 18 nt, Homo sapiens
ucaggcucugaaucucuc

SEQ ID NO: 1659879 - RNA, 12 nt, Homo sapiens
ucagggaccaag

SEQ ID NO: 1659880 - RNA, 14 nt, Homo sapiens
ucagggaccaagga

SEQ ID NO: 1659881 - RNA, 19 nt, Homo sapiens
ucaguaacacagugcagug

SEQ ID NO: 1659882 - RNA, 15 nt, Homo sapiens
ucaguaacagugaag

SEQ ID NO: 1659883 - RNA, 16 nt, Homo sapiens
ucaguaacagugcagu

SEQ ID NO: 1659884 - RNA, 21 nt, Homo sapiens
ucaguaacagugcaguacuca

SEQ ID NO: 1659885 - RNA, 17 nt, Homo sapiens
ucaguaagacagugcag

SEQ ID NO: 1659886 - RNA, 17 nt, Homo sapiens
ucaguaaggcagugcaa

SEQ ID NO: 1659887 - RNA, 18 nt, Homo sapiens
ucaguagugccugugauc

SEQ ID NO: 1659888 - RNA, 15 nt, Homo sapiens
ucagucaucaucuca

SEQ ID NO: 1659889 - RNA, 18 nt, Homo sapiens
ucagucccugacuaacag

SEQ ID NO: 1659890 - RNA, 23 nt, Homo sapiens
ucaguccugggagacccauguaa

SEQ ID NO: 1659891 - RNA, 12 nt, Homo sapiens
ucagugcaguac

SEQ ID NO: 1659892 - RNA, 21 nt, Homo sapiens
ucaguguacucugaguccuca

SEQ ID NO: 1659893 - RNA, 18 nt, Homo sapiens
ucaguuauaauaaccugg

SEQ ID NO: 1659894 - RNA, 12 nt, Homo sapiens
ucaguugcaaau

SEQ ID NO: 1659895 - RNA, 13 nt, Homo sapiens
ucauaaacaaaga

SEQ ID NO: 1659896 - RNA, 17 nt, Homo sapiens
ucauacauuagugccau

SEQ ID NO: 1659897 - RNA, 18 nt, Homo sapiens
ucauacucagagcauuau

SEQ ID NO: 1659898 - RNA, 17 nt, Homo sapiens
ugcaguagagagcaaag

SEQ ID NO: 1659899 - RNA, 20 nt, Homo sapiens
ugcagucagaagaucuuucu

SEQ ID NO: 1659900 - RNA, 20 nt, Homo sapiens
ugcaguggcgcgaucucagc

SEQ ID NO: 1659901 - RNA, 18 nt, Homo sapiens
ugcaguggcgugaucuca

SEQ ID NO: 1659902 - RNA, 19 nt, Homo sapiens
ugcaguggcgugaucucag

SEQ ID NO: 1659903 - RNA, 22 nt, Homo sapiens
ugcauaaauauuagcaaagcau

SEQ ID NO: 1659904 - RNA, 20 nt, Homo sapiens
ugcauaaccgcacagacauu

SEQ ID NO: 1659905 - RNA, 18 nt, Homo sapiens
ugcauauagaauuuugau

SEQ ID NO: 1659906 - RNA, 22 nt, Homo sapiens
ugcaucuccccucagauuccac

SEQ ID NO: 1659907 - RNA, 14 nt, Homo sapiens
ugcaucuucccaca

SEQ ID NO: 1659908 - RNA, 22 nt, Homo sapiens
ugcaugagcucccucgcuguau

SEQ ID NO: 1659909 - RNA, 16 nt, Homo sapiens
ugcaugcugucccuua

SEQ ID NO: 1659910 - RNA, 16 nt, Homo sapiens
ugccaagauaccuuca

SEQ ID NO: 1659911 - RNA, 16 nt, Homo sapiens
ugccacaaugugauau

SEQ ID NO: 1659912 - RNA, 21 nt, Homo sapiens
ugccacauggccgcugcccac

SEQ ID NO: 1659913 - RNA, 17 nt, Homo sapiens
ugccacauugcuucauu

SEQ ID NO: 1659914 - RNA, 19 nt, Homo sapiens
ugccacauugcuucauuaa

SEQ ID NO: 1659915 - RNA, 23 nt, Homo sapiens
ugccacgguccuuugagugucag

SEQ ID NO: 1659916 - RNA, 12 nt, Homo sapiens
ugccaggcagug

SEQ ID NO: 1659917 - RNA, 19 nt, Homo sapiens
ugccaggcuggagugcagu

SEQ ID NO: 1659918 - RNA, 21 nt, Homo sapiens
ugccauaguuugaauucaugc

SEQ ID NO: 1659919 - RNA, 17 nt, Homo sapiens
ugccauauucuguagua

SEQ ID NO: 1659920 - RNA, 15 nt, Homo sapiens
ugccauguguuuauc

SEQ ID NO: 1659921 - RNA, 22 nt, Homo sapiens
ugcccacgucccgggcacuguc

SEQ ID NO: 1659922 - RNA, 13 nt, Homo sapiens
ugcccagagccac

SEQ ID NO: 1659923 - RNA, 17 nt, Homo sapiens
ugcccagagccacagaa

SEQ ID NO: 1659924 - RNA, 21 nt, Homo sapiens
ugcccaggcagucuuugcuca

SEQ ID NO: 1659925 - RNA, 22 nt, Homo sapiens
ugcccauuguaacuuauuucag

SEQ ID NO: 1659926 - RNA, 14 nt, Homo sapiens
ugccccagugcuac

SEQ ID NO: 1659927 - RNA, 20 nt, Homo sapiens
ugcccuguuuccaaugccaa

SEQ ID NO: 1659928 - RNA, 20 nt, Homo sapiens
ugccgaaacccuugacuguu

SEQ ID NO: 1659929 - RNA, 21 nt, Homo sapiens
ugccgaaacccuugacuguua

SEQ ID NO: 1659930 - RNA, 18 nt, Homo sapiens
ugccuccaggaccuugcu

SEQ ID NO: 1659931 - RNA, 17 nt, Homo sapiens
ugccuccccccacaaga

SEQ ID NO: 1659932 - RNA, 23 nt, Homo sapiens
ugccucucccaaguccaguguga

SEQ ID NO: 1659933 - RNA, 22 nt, Homo sapiens
ugccucuuuuaaugucaucucu

SEQ ID NO: 1659934 - RNA, 14 nt, Homo sapiens
ugccuuaauucuua

SEQ ID NO: 1659935 - RNA, 22 nt, Homo sapiens
ugccuuccaggcagacacagcu

SEQ ID NO: 1659936 - RNA, 14 nt, Homo sapiens
ugccuuggggacaa

SEQ ID NO: 1659937 - RNA, 18 nt, Homo sapiens
ugccuuuuccuauguaaa

SEQ ID NO: 1659938 - RNA, 13 nt, Homo sapiens
ugcgcuuaccuuc

SEQ ID NO: 1659939 - RNA, 15 nt, Homo sapiens
ugcggugugucucca

SEQ ID NO: 1659940 - RNA, 15 nt, Homo sapiens
ugcgugugaaacagc

SEQ ID NO: 1659941 - RNA, 19 nt, Homo sapiens
ugcuaauccaggacagcau

SEQ ID NO: 1659942 - RNA, 19 nt, Homo sapiens
ugcuaccuuugucucacga

SEQ ID NO: 1659943 - RNA, 23 nt, Homo sapiens
ugcucaccaagcuguuccacuuc

SEQ ID NO: 1659944 - RNA, 21 nt, Homo sapiens
ugcucaguaacacagugcagu

SEQ ID NO: 1659945 - RNA, 15 nt, Homo sapiens
ugcucaguggaucac

SEQ ID NO: 1659946 - RNA, 13 nt, Homo sapiens
ugcucauuauuac

SEQ ID NO: 1659947 - RNA, 12 nt, Homo sapiens
ugcuccaugcag

SEQ ID NO: 1659948 - RNA, 15 nt, Homo sapiens
ugcucccuagccaga

SEQ ID NO: 1659949 - RNA, 15 nt, Homo sapiens
ugcucucccagguga

SEQ ID NO: 1659950 - RNA, 14 nt, Homo sapiens
ugcucucugcucac

SEQ ID NO: 1659951 - RNA, 18 nt, Homo sapiens
ugcucugcuggucuucaa

SEQ ID NO: 1659952 - RNA, 19 nt, Homo sapiens
ugcucugcuggucuucaau

SEQ ID NO: 1659953 - RNA, 18 nt, Homo sapiens
ugcucuguuuugcaugga

SEQ ID NO: 1659954 - RNA, 14 nt, Homo sapiens
ugcugccaucucca

SEQ ID NO: 1659955 - RNA, 18 nt, Homo sapiens
ugcugcccugaugcgucu

SEQ ID NO: 1659956 - RNA, 10 nt, Homo sapiens
ugcugcugaa

SEQ ID NO: 1659957 - RNA, 17 nt, Homo sapiens
ugcuggaggugagacac

SEQ ID NO: 1659958 - RNA, 16 nt, Homo sapiens
ugcuggcuugcacuuu

SEQ ID NO: 1659959 - RNA, 19 nt, Homo sapiens
ugcugugacaggcaguguu

SEQ ID NO: 1659960 - RNA, 15 nt, Homo sapiens
ugcuguuuacuugaa

SEQ ID NO: 1659961 - RNA, 13 nt, Homo sapiens
ugcuguuucuaca

SEQ ID NO: 1659962 - RNA, 17 nt, Homo sapiens
ugcuuaaaaugcaagga

SEQ ID NO: 1659963 - RNA, 12 nt, Homo sapiens
ugcuuaccucac

SEQ ID NO: 1659964 - RNA, 21 nt, Homo sapiens
ugcuuagagcauguucuugga

SEQ ID NO: 1659965 - RNA, 15 nt, Homo sapiens
ugcuuaguaucucau

SEQ ID NO: 1659966 - RNA, 20 nt, Homo sapiens
ugcuuagugucccuuaccug

SEQ ID NO: 1659967 - RNA, 14 nt, Homo sapiens
ugcuucuccaccuc

SEQ ID NO: 1659968 - RNA, 23 nt, Homo sapiens
ugcuugggaucuucaaugaacug

SEQ ID NO: 1659969 - RNA, 22 nt, Homo sapiens
ugcuuucuccugaaaacuuuag

SEQ ID NO: 1659970 - RNA, 15 nt, Homo sapiens
ugcuuuuuugcaaua

SEQ ID NO: 1659971 - RNA, 14 nt, Homo sapiens
ugcuuuuuuuccaa

SEQ ID NO: 1659972 - RNA, 17 nt, Homo sapiens
uggaaaaaauuagacaa

SEQ ID NO: 1659973 - RNA, 19 nt, Homo sapiens
uggaaaaccugaggccaaa

SEQ ID NO: 1659974 - RNA, 22 nt, Homo sapiens
uggaaaacugccacaagcacaa

SEQ ID NO: 1659975 - RNA, 19 nt, Homo sapiens
uggaaauaaaauacuucua

SEQ ID NO: 1659976 - RNA, 19 nt, Homo sapiens
uggaaauccuguuacuuaa

SEQ ID NO: 1659977 - RNA, 20 nt, Homo sapiens
uggaaaugaauccaucauac

SEQ ID NO: 1659978 - RNA, 23 nt, Homo sapiens
uggaaauuugugugcuucacaca

SEQ ID NO: 1659979 - RNA, 11 nt, Homo sapiens
uggaagacagc

SEQ ID NO: 1659980 - RNA, 23 nt, Homo sapiens
uggaagagagaaagcauauugac

SEQ ID NO: 1659981 - RNA, 18 nt, Homo sapiens
uggaagggccuucuccac

SEQ ID NO: 1659982 - RNA, 17 nt, Homo sapiens
uggaauaaggagaauga

SEQ ID NO: 1659983 - RNA, 16 nt, Homo sapiens
uggaauacuaaaguua

SEQ ID NO: 1659984 - RNA, 12 nt, Homo sapiens
uggacagcagcu

SEQ ID NO: 1659985 - RNA, 18 nt, Homo sapiens
uggacagucucaccuccu

SEQ ID NO: 1659986 - RNA, 16 nt, Homo sapiens
uggacaugcacagcua

SEQ ID NO: 1659987 - RNA, 16 nt, Homo sapiens
uggagacgaugcuuua

SEQ ID NO: 1659988 - RNA, 19 nt, Homo sapiens
uggagagagcaaucuugcu

SEQ ID NO: 1659989 - RNA, 21 nt, Homo sapiens
uggagauaccagagacucuga

SEQ ID NO: 1659990 - RNA, 13 nt, Homo sapiens
uggagccugcaau

SEQ ID NO: 1659991 - RNA, 20 nt, Homo sapiens
uggagcguguacuaccccag

SEQ ID NO: 1659992 - RNA, 20 nt, Homo sapiens
uggagucagggcugugcuuu

SEQ ID NO: 1659993 - RNA, 19 nt, Homo sapiens
uggagugcaauggugcgau

SEQ ID NO: 1659994 - RNA, 12 nt, Homo sapiens
uggagugcagug

SEQ ID NO: 1659995 - RNA, 23 nt, Homo sapiens
uggaguuccucaucagugucauu

SEQ ID NO: 1659996 - RNA, 17 nt, Homo sapiens
uggauaaauuuuggaag

SEQ ID NO: 1659997 - RNA, 14 nt, Homo sapiens
uggaucaaguauua

SEQ ID NO: 1659998 - RNA, 18 nt, Homo sapiens
uggauuguauugugagau

SEQ ID NO: 1659999 - RNA, 19 nt, Homo sapiens
uggauugugaagauuucau

SEQ ID NO: 1660000 - RNA, 23 nt, Homo sapiens
uggauugugaagauuucauggac

SEQ ID NO: 1660001 - RNA, 14 nt, Homo sapiens
uggcaaucuugccc

SEQ ID NO: 1660002 - RNA, 19 nt, Homo sapiens
uggcacaugauaugaguca

SEQ ID NO: 1660003 - RNA, 14 nt, Homo sapiens
uggcacccaccacu

SEQ ID NO: 1660004 - RNA, 16 nt, Homo sapiens
uggcagauuuucuucu

SEQ ID NO: 1660005 - RNA, 14 nt, Homo sapiens
uggcagcgccuccc

SEQ ID NO: 1660006 - RNA, 18 nt, Homo sapiens
uggcagcugcaacagugg

SEQ ID NO: 1660007 - RNA, 18 nt, Homo sapiens
uggcaugggaaugaaugu

SEQ ID NO: 1660008 - RNA, 15 nt, Homo sapiens
uggcauuaucucuuu

SEQ ID NO: 1660009 - RNA, 14 nt, Homo sapiens
uggccaaaaugcag

SEQ ID NO: 1660010 - RNA, 18 nt, Homo sapiens
uggccaauagucauaugu

SEQ ID NO: 1660011 - RNA, 14 nt, Homo sapiens
uggccacacuggaa

SEQ ID NO: 1660012 - RNA, 12 nt, Homo sapiens
uggccacagccc

SEQ ID NO: 1660013 - RNA, 15 nt, Homo sapiens
uggccacaguggcac

SEQ ID NO: 1660014 - RNA, 18 nt, Homo sapiens
uggccauguucauucaca

SEQ ID NO: 1660015 - RNA, 21 nt, Homo sapiens
uggccauuuaacuagcacuuu

SEQ ID NO: 1660016 - RNA, 18 nt, Homo sapiens
uggcccagugcaaucugu

SEQ ID NO: 1660017 - RNA, 20 nt, Homo sapiens
uggcccauagaaacaugaca

SEQ ID NO: 1660018 - RNA, 22 nt, Homo sapiens
uggccccacccuuuccucuuaa

SEQ ID NO: 1660019 - RNA, 19 nt, Homo sapiens
uggccgacagucuggaaau

SEQ ID NO: 1660020 - RNA, 14 nt, Homo sapiens
uugauuaaaacauu

SEQ ID NO: 1660021 - RNA, 16 nt, Homo sapiens
uugauuaaaacauuau

SEQ ID NO: 1660022 - RNA, 14 nt, Homo sapiens
uugauuaaugaacu

SEQ ID NO: 1660023 - RNA, 16 nt, Homo sapiens
uugauuuagagaugau

SEQ ID NO: 1660024 - RNA, 21 nt, Homo sapiens
uugcaaccuuguacuuuacaa

SEQ ID NO: 1660025 - RNA, 21 nt, Homo sapiens
uugcacuaaaagugaugugau

SEQ ID NO: 1660026 - RNA, 15 nt, Homo sapiens
uugcaggaaccagca

SEQ ID NO: 1660027 - RNA, 20 nt, Homo sapiens
uugcaggaagagaugcucua

SEQ ID NO: 1660028 - RNA, 12 nt, Homo sapiens
uugccaaaacag

SEQ ID NO: 1660029 - RNA, 22 nt, Homo sapiens
uugcccacacuugggagcaaaa

SEQ ID NO: 1660030 - RNA, 14 nt, Homo sapiens
uugccuaaguauuc

SEQ ID NO: 1660031 - RNA, 23 nt, Homo sapiens
uugcuaacauauuuaaagucuug

SEQ ID NO: 1660032 - RNA, 22 nt, Homo sapiens
uugcucaguggaucacacacau

SEQ ID NO: 1660033 - RNA, 18 nt, Homo sapiens
uugcugaauaacaacaau

SEQ ID NO: 1660034 - RNA, 13 nt, Homo sapiens
uugcugcaucucc

SEQ ID NO: 1660035 - RNA, 21 nt, Homo sapiens
uugcugcaucuccccucagau

SEQ ID NO: 1660036 - RNA, 19 nt, Homo sapiens
uugcuggaaaacugccaca

SEQ ID NO: 1660037 - RNA, 20 nt, Homo sapiens
uugcuuaugacaugaucgcu

SEQ ID NO: 1660038 - RNA, 16 nt, Homo sapiens
uugcuuuuuuuccaau

SEQ ID NO: 1660039 - RNA, 14 nt, Homo sapiens
uuggagugcaaugg

SEQ ID NO: 1660040 - RNA, 21 nt, Homo sapiens
uuggauaauaacuagaucucc

SEQ ID NO: 1660041 - RNA, 20 nt, Homo sapiens
uuggccacagccccaaacaa

SEQ ID NO: 1660042 - RNA, 19 nt, Homo sapiens
uuggccuagcccacccugc

SEQ ID NO: 1660043 - RNA, 15 nt, Homo sapiens
uuggcuuaauuccaa

SEQ ID NO: 1660044 - RNA, 21 nt, Homo sapiens
uugggcguuugaacucaggga

SEQ ID NO: 1660045 - RNA, 14 nt, Homo sapiens
uugggcuucauccu

SEQ ID NO: 1660046 - RNA, 10 nt, Homo sapiens
uuggggacca

SEQ ID NO: 1660047 - RNA, 18 nt, Homo sapiens
uuggggugauuucucacc

SEQ ID NO: 1660048 - RNA, 23 nt, Homo sapiens
uuggggugauuucucacccucug

SEQ ID NO: 1660049 - RNA, 16 nt, Homo sapiens
uugggugcauuugccc

SEQ ID NO: 1660050 - RNA, 16 nt, Homo sapiens
uuggugcugcuuucuu

SEQ ID NO: 1660051 - RNA, 23 nt, Homo sapiens
uuguaaaacugugacauuccaca

SEQ ID NO: 1660052 - RNA, 21 nt, Homo sapiens
uuguaaugccacucauacuca

SEQ ID NO: 1660053 - RNA, 21 nt, Homo sapiens
uuguagaggggcaacugauga

SEQ ID NO: 1660054 - RNA, 18 nt, Homo sapiens
uuguagccuaauauucau

SEQ ID NO: 1660055 - RNA, 18 nt, Homo sapiens
uuguauccuccauuguau

SEQ ID NO: 1660056 - RNA, 21 nt, Homo sapiens
uuguauuaauguagggcagaa

SEQ ID NO: 1660057 - RNA, 13 nt, Homo sapiens
uugucaacaguau

SEQ ID NO: 1660058 - RNA, 20 nt, Homo sapiens
uugucacaaauaaacauaau

SEQ ID NO: 1660059 - RNA, 15 nt, Homo sapiens
uugucaugacuuuca

SEQ ID NO: 1660060 - RNA, 13 nt, Homo sapiens
uugucaugugaug

SEQ ID NO: 1660061 - RNA, 21 nt, Homo sapiens
uugucauucucauccaaaagu

SEQ ID NO: 1660062 - RNA, 15 nt, Homo sapiens
uugucggguucuccc

SEQ ID NO: 1660063 - RNA, 19 nt, Homo sapiens
uugucuaaagcuaaacaaa

SEQ ID NO: 1660064 - RNA, 17 nt, Homo sapiens
uugucuuacuguugcau

SEQ ID NO: 1660065 - RNA, 19 nt, Homo sapiens
uugugaaguaggugaucuu

SEQ ID NO: 1660066 - RNA, 19 nt, Homo sapiens
uuguggcacacaacugugg

SEQ ID NO: 1660067 - RNA, 14 nt, Homo sapiens
uuguggcugucaaa

SEQ ID NO: 1660068 - RNA, 13 nt, Homo sapiens
uuguguacuguaa

SEQ ID NO: 1660069 - RNA, 16 nt, Homo sapiens
uugugugaaaauguga

SEQ ID NO: 1660070 - RNA, 19 nt, Homo sapiens
uugugugugugugcaguga

SEQ ID NO: 1660071 - RNA, 22 nt, Homo sapiens
uuguguuuauauauaagccaaa

SEQ ID NO: 1660072 - RNA, 19 nt, Homo sapiens
uuguuaaaaccuuacuuaa

SEQ ID NO: 1660073 - RNA, 11 nt, Homo sapiens
uuguucaggga

SEQ ID NO: 1660074 - RNA, 17 nt, Homo sapiens
uuguucauuccgaaaaa

SEQ ID NO: 1660075 - RNA, 21 nt, Homo sapiens
uuguugcaguuaauucuugcc

SEQ ID NO: 1660076 - RNA, 12 nt, Homo sapiens
uuguugcaguuc

SEQ ID NO: 1660077 - RNA, 12 nt, Homo sapiens
uuguugucuaaa

SEQ ID NO: 1660078 - RNA, 14 nt, Homo sapiens
uuguuuaacccaaa

SEQ ID NO: 1660079 - RNA, 15 nt, Homo sapiens
uuuaaaauugcagca

SEQ ID NO: 1660080 - RNA, 20 nt, Homo sapiens
uuuaaauuaugacgugcaca

SEQ ID NO: 1660081 - RNA, 22 nt, Homo sapiens
uuuaaccagucugaaguuucau

SEQ ID NO: 1660082 - RNA, 16 nt, Homo sapiens
uuuaacuuuaccaugc

SEQ ID NO: 1660083 - RNA, 21 nt, Homo sapiens
uuuaauucuuuucccagaaga

SEQ ID NO: 1660084 - RNA, 17 nt, Homo sapiens
uuuaauuuaugauauaa

SEQ ID NO: 1660085 - RNA, 18 nt, Homo sapiens
uuuaauuuugacacugaa

SEQ ID NO: 1660086 - RNA, 16 nt, Homo sapiens
uuuaccuugcauuuua

SEQ ID NO: 1660087 - RNA, 19 nt, Homo sapiens
uuuacugucuguaagagaa

SEQ ID NO: 1660088 - RNA, 18 nt, Homo sapiens
uuuagaaucaagucugug

SEQ ID NO: 1660089 - RNA, 23 nt, Homo sapiens
uuuaggaaugcucaaugugcugu

SEQ ID NO: 1660090 - RNA, 15 nt, Homo sapiens
uuuaguuaacuauga

SEQ ID NO: 1660091 - RNA, 23 nt, Homo sapiens
uuuauaaaugaagaugcauuuua

SEQ ID NO: 1660092 - RNA, 14 nt, Homo sapiens
uuuauaguguugcu

SEQ ID NO: 1660093 - RNA, 22 nt, Homo sapiens
uuuauauuguuuuuauauauua

SEQ ID NO: 1660094 - RNA, 14 nt, Homo sapiens
uuuaugaugcagca

SEQ ID NO: 1660095 - RNA, 11 nt, Homo sapiens
uuuaugcauuu

SEQ ID NO: 1660096 - RNA, 19 nt, Homo sapiens
uuuauucauuagcugugau

SEQ ID NO: 1660097 - RNA, 21 nt, Homo sapiens
uuuauucauuagcugugauuu

SEQ ID NO: 1660098 - RNA, 23 nt, Homo sapiens
uuuauuuaaggggaauuaacaau

SEQ ID NO: 1660099 - RNA, 14 nt, Homo sapiens
uuucaaagucucac

SEQ ID NO: 1660100 - RNA, 15 nt, Homo sapiens
uuucaaccaguuuga

SEQ ID NO: 1660101 - RNA, 12 nt, Homo sapiens
uuucaaguugca

SEQ ID NO: 1660102 - RNA, 19 nt, Homo sapiens
uuucaaguugcagucagaa

SEQ ID NO: 1660103 - RNA, 11 nt, Homo sapiens
uuucacagugg

SEQ ID NO: 1660104 - RNA, 15 nt, Homo sapiens
uuucaccauguuggc

SEQ ID NO: 1660105 - RNA, 21 nt, Homo sapiens
uuucagaaacaaagcauuuga

SEQ ID NO: 1660106 - RNA, 23 nt, Homo sapiens
uuucagaaacaaagcauuugacu

SEQ ID NO: 1660107 - RNA, 17 nt, Homo sapiens
uuucagucaucaucuca

SEQ ID NO: 1660108 - RNA, 17 nt, Homo sapiens
uuucauauaauuugcca

SEQ ID NO: 1660109 - RNA, 15 nt, Homo sapiens
uuucauauucucaga

SEQ ID NO: 1660110 - RNA, 18 nt, Homo sapiens
uuucauuuaggugaggaa

SEQ ID NO: 1660111 - RNA, 12 nt, Homo sapiens
uuuccaaaagua

SEQ ID NO: 1660112 - RNA, 21 nt, Homo sapiens
uuuccaaagguuucaacugua

SEQ ID NO: 1660113 - RNA, 18 nt, Homo sapiens
uuuccaaauacauuccag

SEQ ID NO: 1660114 - RNA, 13 nt, Homo sapiens
uuuccaaugccaa

SEQ ID NO: 1660115 - RNA, 17 nt, Homo sapiens
uuuccaauuuuguugca

SEQ ID NO: 1660116 - RNA, 12 nt, Homo sapiens
uuuccagaauug

SEQ ID NO: 1660117 - RNA, 14 nt, Homo sapiens
uuuccagugcugcu

SEQ ID NO: 1660118 - RNA, 11 nt, Homo sapiens
uuuccauuugc

SEQ ID NO: 1660119 - RNA, 17 nt, Homo sapiens
uuucccacacugugaac

SEQ ID NO: 1660120 - RNA, 22 nt, Homo sapiens
uuuccccuuuuaaaaacucaga

SEQ ID NO: 1660121 - RNA, 19 nt, Homo sapiens
uuucccuccaccagugugc

SEQ ID NO: 1660122 - RNA, 20 nt, Homo sapiens
uuuccucccugcagagccaa

SEQ ID NO: 1660123 - RNA, 18 nt, Homo sapiens
uuuccucuuaauucccaa

SEQ ID NO: 1660124 - RNA, 16 nt, Homo sapiens
uuuccugugccuaaca

SEQ ID NO: 1660125 - RNA, 15 nt, Homo sapiens
uuuccuuugaccucu

SEQ ID NO: 1660126 - RNA, 22 nt, Homo sapiens
uuucucaugguauuaucuagua

SEQ ID NO: 1660127 - RNA, 15 nt, Homo sapiens
uuucucauucuugcc

SEQ ID NO: 1660128 - RNA, 18 nt, Homo sapiens
uuucucgggugcauuuga

SEQ ID NO: 1660129 - RNA, 19 nt, Homo sapiens
uuucugcaugacuauugua

SEQ ID NO: 1660130 - RNA, 13 nt, Homo sapiens
uuucugccucaca

SEQ ID NO: 1660131 - RNA, 18 nt, Homo sapiens
uuucugccuucuccugca

SEQ ID NO: 1660132 - RNA, 18 nt, Homo sapiens
uuucugcuguaaagaaag

SEQ ID NO: 1660133 - RNA, 19 nt, Homo sapiens
uuucuuaugccugucuuua

SEQ ID NO: 1660134 - RNA, 15 nt, Homo sapiens
uuucuucaccucacu

SEQ ID NO: 1660135 - RNA, 18 nt, Homo sapiens
uuucuugcaagcuccagu

SEQ ID NO: 1660136 - RNA, 16 nt, Homo sapiens
uuucuuuaacauauca

SEQ ID NO: 1660137 - RNA, 14 nt, Homo sapiens
uuugaacucaggga

SEQ ID NO: 1660138 - RNA, 22 nt, Homo sapiens
uuugacugaauguuuuauggaa

SEQ ID NO: 1660139 - RNA, 19 nt, Homo sapiens
uuugcccuuggaggauccc

SEQ ID NO: 1660140 - RNA, 16 nt, Homo sapiens
uuuggaugaaugcagu

SEQ ID NO: 1660141 - RNA, 19 nt, Homo sapiens
uuugggcugggucaaggca

SEQ ID NO: 1660142 - RNA, 12 nt, Homo sapiens
gcuaauguuucc

SEQ ID NO: 1660143 - RNA, 22 nt, Homo sapiens
gcuacauugacgagcaugagcu

SEQ ID NO: 1660144 - RNA, 18 nt, Homo sapiens
gcuagaugugucuuacca

SEQ ID NO: 1660145 - RNA, 15 nt, Homo sapiens
gcuagucacauauca

SEQ ID NO: 1660146 - RNA, 18 nt, Homo sapiens
gcuagucugucagggccu

SEQ ID NO: 1660147 - RNA, 15 nt, Homo sapiens
gcuaugucugugaug

SEQ ID NO: 1660148 - RNA, 23 nt, Homo sapiens
gcuauuuuuaauuuccugugagg

SEQ ID NO: 1660149 - RNA, 18 nt, Homo sapiens
gcucaaugugcuguugau

SEQ ID NO: 1660150 - RNA, 12 nt, Homo sapiens
gcucacacagcu

SEQ ID NO: 1660151 - RNA, 20 nt, Homo sapiens
gcucacccgccucuugcccc

SEQ ID NO: 1660152 - RNA, 15 nt, Homo sapiens
gcucacgucugugag

SEQ ID NO: 1660153 - RNA, 16 nt, Homo sapiens
gcucacuacaaccucc

SEQ ID NO: 1660154 - RNA, 18 nt, Homo sapiens
ugaauuuuaaaaugcaaa

SEQ ID NO: 1660155 - RNA, 23 nt, Homo sapiens
ugacaaaaguaagagagcacagu

SEQ ID NO: 1660156 - RNA, 19 nt, Homo sapiens
ugacaacaacuaucaccaa

SEQ ID NO: 1660157 - RNA, 18 nt, Homo sapiens
ugacaaccgacgaagaaa

SEQ ID NO: 1660158 - RNA, 12 nt, Homo sapiens
ugacacaacuca

SEQ ID NO: 1660159 - RNA, 18 nt, Homo sapiens
ugacacacucaccauuua

SEQ ID NO: 1660160 - RNA, 22 nt, Homo sapiens
ugacaccaccacugugucccag

SEQ ID NO: 1660161 - RNA, 11 nt, Homo sapiens
ugacacugucu

SEQ ID NO: 1660162 - RNA, 13 nt, Homo sapiens
ugacagugccaau

SEQ ID NO: 1660163 - RNA, 14 nt, Homo sapiens
ugacaucagcacug

SEQ ID NO: 1660164 - RNA, 21 nt, Homo sapiens
ugacauggaucagcaacucca

SEQ ID NO: 1660165 - RNA, 20 nt, Homo sapiens
ugacauggucagucuacuaa

SEQ ID NO: 1660166 - RNA, 17 nt, Homo sapiens
ugacauucacacagaga

SEQ ID NO: 1660167 - RNA, 17 nt, Homo sapiens
ugaccacugacagccuc

SEQ ID NO: 1660168 - RNA, 16 nt, Homo sapiens
ugaccacuuguagucc

SEQ ID NO: 1660169 - RNA, 20 nt, Homo sapiens
ugaccauaaaauuagacaua

SEQ ID NO: 1660170 - RNA, 15 nt, Homo sapiens
ugaccauaugcacaa

SEQ ID NO: 1660171 - RNA, 21 nt, Homo sapiens
ugaccauaugcacaauuccau

SEQ ID NO: 1660172 - RNA, 17 nt, Homo sapiens
ugacccccugcugccau

SEQ ID NO: 1660173 - RNA, 21 nt, Homo sapiens
ugacccuccaccgcagaagga

SEQ ID NO: 1660174 - RNA, 21 nt, Homo sapiens
ugacccugugccccgccuccc

SEQ ID NO: 1660175 - RNA, 18 nt, Homo sapiens
ugaccucgugaucugccc

SEQ ID NO: 1660176 - RNA, 18 nt, Homo sapiens
ugaccucuugaucugccc

SEQ ID NO: 1660177 - RNA, 21 nt, Homo sapiens
ugaccuguguguaagucccaa

SEQ ID NO: 1660178 - RNA, 20 nt, Homo sapiens
ugacgguguccaugccuucc

SEQ ID NO: 1660179 - RNA, 21 nt, Homo sapiens
ugacuaacagccucagcacau

SEQ ID NO: 1660180 - RNA, 13 nt, Homo sapiens
ugacucagggcau

SEQ ID NO: 1660181 - RNA, 21 nt, Homo sapiens
ugacucggucugagaagauuc

SEQ ID NO: 1660182 - RNA, 23 nt, Homo sapiens
ugacugccagccccaugccaugg

SEQ ID NO: 1660183 - RNA, 14 nt, Homo sapiens
ugacuggacugugu

SEQ ID NO: 1660184 - RNA, 16 nt, Homo sapiens
ugacugucccuucgac

SEQ ID NO: 1660185 - RNA, 23 nt, Homo sapiens
ugacuuccugaacucccagucau

SEQ ID NO: 1660186 - RNA, 22 nt, Homo sapiens
ugagaaaacaggcucacagaga

SEQ ID NO: 1660187 - RNA, 12 nt, Homo sapiens
ugagaaagacaa

SEQ ID NO: 1660188 - RNA, 22 nt, Homo sapiens
ugagaacagacguuaccaauua

SEQ ID NO: 1660189 - RNA, 22 nt, Homo sapiens
ugagaacauuaacaaaagcaau

SEQ ID NO: 1660190 - RNA, 12 nt, Homo sapiens
ugagaagauuca

SEQ ID NO: 1660191 - RNA, 12 nt, Homo sapiens
ugagaaggccag

SEQ ID NO: 1660192 - RNA, 18 nt, Homo sapiens
ugagaauaaaaccuucaa

SEQ ID NO: 1660193 - RNA, 17 nt, Homo sapiens
ugagacagaaucucagu

SEQ ID NO: 1660194 - RNA, 20 nt, Homo sapiens
ugagacagagucuuacucug

SEQ ID NO: 1660195 - RNA, 20 nt, Homo sapiens
ugagacagagucuuccucug

SEQ ID NO: 1660196 - RNA, 17 nt, Homo sapiens
ugagagaaagccacaaa

SEQ ID NO: 1660197 - RNA, 13 nt, Homo sapiens
ugagauacuuugc

SEQ ID NO: 1660198 - RNA, 15 nt, Homo sapiens
ugagaucagucagcu

SEQ ID NO: 1660199 - RNA, 17 nt, Homo sapiens
ugagaucagucagcucc

SEQ ID NO: 1660200 - RNA, 21 nt, Homo sapiens
ugagaugggaggaucacuuga

SEQ ID NO: 1660201 - RNA, 23 nt, Homo sapiens
ugagcaaguuuucaccuaucugg

SEQ ID NO: 1660202 - RNA, 21 nt, Homo sapiens
ugagcagaacccagacccuga

SEQ ID NO: 1660203 - RNA, 13 nt, Homo sapiens
ugagccacagggc

SEQ ID NO: 1660204 - RNA, 19 nt, Homo sapiens
ugagccaucgcuuuugacc

SEQ ID NO: 1660205 - RNA, 23 nt, Homo sapiens
ugagcccaauguauuaugaucuc

SEQ ID NO: 1660206 - RNA, 19 nt, Homo sapiens
ugagcccccugcacccacc

SEQ ID NO: 1660207 - RNA, 23 nt, Homo sapiens
ugagcuccuaagcugccagccuu

SEQ ID NO: 1660208 - RNA, 19 nt, Homo sapiens
ugaggacauaaaucuucca

SEQ ID NO: 1660209 - RNA, 15 nt, Homo sapiens
ugaggaccucagcuu

SEQ ID NO: 1660210 - RNA, 18 nt, Homo sapiens
ugaggagggcagcuggag

SEQ ID NO: 1660211 - RNA, 15 nt, Homo sapiens
ugaggaguaaaaaga

SEQ ID NO: 1660212 - RNA, 18 nt, Homo sapiens
ugaggauagagacuugca

SEQ ID NO: 1660213 - RNA, 13 nt, Homo sapiens
ugaggcaggagaa

SEQ ID NO: 1660214 - RNA, 22 nt, Homo sapiens
ugaggcaggagaauggcgugaa

SEQ ID NO: 1660215 - RNA, 20 nt, Homo sapiens
ugaggcggggagcaugaaga

SEQ ID NO: 1660216 - RNA, 13 nt, Homo sapiens
ugaggcugucauu

SEQ ID NO: 1660217 - RNA, 14 nt, Homo sapiens
ugagggcaggguuc

SEQ ID NO: 1660218 - RNA, 15 nt, Homo sapiens
ugaggucuuugcauu

SEQ ID NO: 1660219 - RNA, 15 nt, Homo sapiens
ugagguugugcugcc

SEQ ID NO: 1660220 - RNA, 14 nt, Homo sapiens
ugaguaaacagaua

SEQ ID NO: 1660221 - RNA, 16 nt, Homo sapiens
ugagucuucagaagaa

SEQ ID NO: 1660222 - RNA, 13 nt, Homo sapiens
ugaguguauguau

SEQ ID NO: 1660223 - RNA, 19 nt, Homo sapiens
ugaguuaaaucaguaaucu

SEQ ID NO: 1660224 - RNA, 22 nt, Homo sapiens
ugaguuaaaucaguaaucuguc

SEQ ID NO: 1660225 - RNA, 19 nt, Homo sapiens
ugaguucccuugauucaaa

SEQ ID NO: 1660226 - RNA, 18 nt, Homo sapiens
ugaguucugcacauacag

SEQ ID NO: 1660227 - RNA, 16 nt, Homo sapiens
ugaguuugaacacaga

SEQ ID NO: 1660228 - RNA, 22 nt, Homo sapiens
ugaguuugcuguauacaaacag

SEQ ID NO: 1660229 - RNA, 14 nt, Homo sapiens
ugauaaauuugacu

SEQ ID NO: 1660230 - RNA, 20 nt, Homo sapiens
ugauaaauuugacuguuauu

SEQ ID NO: 1660231 - RNA, 19 nt, Homo sapiens
ugauaaucccauacucuca

SEQ ID NO: 1660232 - RNA, 19 nt, Homo sapiens
ugauaauggaaacugucaa

SEQ ID NO: 1660233 - RNA, 15 nt, Homo sapiens
ugauacuuccucaua

SEQ ID NO: 1660234 - RNA, 16 nt, Homo sapiens
ugauagaauaaagccu

SEQ ID NO: 1660235 - RNA, 13 nt, Homo sapiens
ugauagguuacau

SEQ ID NO: 1660236 - RNA, 13 nt, Homo sapiens
ugauagucaauau

SEQ ID NO: 1660237 - RNA, 14 nt, Homo sapiens
ugauaugggacuga

SEQ ID NO: 1660238 - RNA, 14 nt, Homo sapiens
ugaucaaggugcuc

SEQ ID NO: 1660239 - RNA, 16 nt, Homo sapiens
ugaucccccaaacagc

SEQ ID NO: 1660240 - RNA, 14 nt, Homo sapiens
ugaugaacugccaa

SEQ ID NO: 1660241 - RNA, 13 nt, Homo sapiens
ugaugaagcacau

SEQ ID NO: 1660242 - RNA, 13 nt, Homo sapiens
ugaugcaugagcu

SEQ ID NO: 1660243 - RNA, 21 nt, Homo sapiens
ugaugcgucuacccagacuca

SEQ ID NO: 1660244 - RNA, 20 nt, Homo sapiens
ugauggccaggccucaggga

SEQ ID NO: 1660245 - RNA, 21 nt, Homo sapiens
ugauggccaggccucagggac

SEQ ID NO: 1660246 - RNA, 20 nt, Homo sapiens
ugauuccaauuacuacuuug

SEQ ID NO: 1660247 - RNA, 13 nt, Homo sapiens
ugauucuaugucu

SEQ ID NO: 1660248 - RNA, 15 nt, Homo sapiens
ugauucuaugucuca

SEQ ID NO: 1660249 - RNA, 20 nt, Homo sapiens
ugauucuuuucccaucacca

SEQ ID NO: 1660250 - RNA, 21 nt, Homo sapiens
ugauuguuuaauuguagguca

SEQ ID NO: 1660251 - RNA, 16 nt, Homo sapiens
ugauuuccauuugcaa

SEQ ID NO: 1660252 - RNA, 16 nt, Homo sapiens
ugcaaaccaaaccauu

SEQ ID NO: 1660253 - RNA, 14 nt, Homo sapiens
ugcaaaucaacucu

SEQ ID NO: 1660254 - RNA, 16 nt, Homo sapiens
ugcaaccucacuaugg

SEQ ID NO: 1660255 - RNA, 18 nt, Homo sapiens
ugcaagcuccaguagcuc

SEQ ID NO: 1660256 - RNA, 13 nt, Homo sapiens
ugcaagguuuuga

SEQ ID NO: 1660257 - RNA, 13 nt, Homo sapiens
ugcaauggcucaa

SEQ ID NO: 1660258 - RNA, 21 nt, Homo sapiens
ugcaauguuccguucaucuga

SEQ ID NO: 1660259 - RNA, 17 nt, Homo sapiens
ugcacagcuaacaugga

SEQ ID NO: 1660260 - RNA, 17 nt, Homo sapiens
ugcacaggucccacugc

SEQ ID NO: 1660261 - RNA, 11 nt, Homo sapiens
ugcacagugaa

SEQ ID NO: 1660262 - RNA, 13 nt, Homo sapiens
ugcaccaucccag

SEQ ID NO: 1660263 - RNA, 18 nt, Homo sapiens
ugcaccucuuugucacag

SEQ ID NO: 1660264 - RNA, 14 nt, Homo sapiens
ugcacuaaaaguga

SEQ ID NO: 1660265 - RNA, 14 nt, Homo sapiens
ugcacuccaugagu

SEQ ID NO: 1660266 - RNA, 15 nt, Homo sapiens
ugcagacccugccag

SEQ ID NO: 1660267 - RNA, 13 nt, Homo sapiens
ugcagagagggaa

SEQ ID NO: 1660268 - RNA, 18 nt, Homo sapiens
ugcagauggcagugcagc

SEQ ID NO: 1660269 - RNA, 17 nt, Homo sapiens
gaugggaccagggaugg

SEQ ID NO: 1660270 - RNA, 22 nt, Homo sapiens
gaugggguuucaccauguuggc

SEQ ID NO: 1660271 - RNA, 20 nt, Homo sapiens
gauggguuuuguuaggggug

SEQ ID NO: 1660272 - RNA, 16 nt, Homo sapiens
gauguaccauguuaaa

SEQ ID NO: 1660273 - RNA, 20 nt, Homo sapiens
gaugucuugguuuccaucaa

SEQ ID NO: 1660274 - RNA, 21 nt, Homo sapiens
gauguggauggaggugaugaa

SEQ ID NO: 1660275 - RNA, 15 nt, Homo sapiens
gauguuaucaaugac

SEQ ID NO: 1660276 - RNA, 20 nt, Homo sapiens
gauuaacccuauuaaucuau

SEQ ID NO: 1660277 - RNA, 21 nt, Homo sapiens
gauuacaggcgugagccaccg

SEQ ID NO: 1660278 - RNA, 18 nt, Homo sapiens
gauucaucaucccuuaau

SEQ ID NO: 1660279 - RNA, 22 nt, Homo sapiens
gauuccagugcaguagugccaa

SEQ ID NO: 1660280 - RNA, 23 nt, Homo sapiens
gauuccagugcaguagugccaaa

SEQ ID NO: 1660281 - RNA, 14 nt, Homo sapiens
gauucccaucugau

SEQ ID NO: 1660282 - RNA, 17 nt, Homo sapiens
gauuccccuggacauau

SEQ ID NO: 1660283 - RNA, 21 nt, Homo sapiens
gauuccucuaagaucuugccu

SEQ ID NO: 1660284 - RNA, 17 nt, Homo sapiens
gauucuaaauguucaug

SEQ ID NO: 1660285 - RNA, 23 nt, Homo sapiens
gauucuagguugaaaauguuaua

SEQ ID NO: 1660286 - RNA, 18 nt, Homo sapiens
gauugagagcagccucuu

SEQ ID NO: 1660287 - RNA, 16 nt, Homo sapiens
gauugauuaaugaacu

SEQ ID NO: 1660288 - RNA, 19 nt, Homo sapiens
gauugucaccaugaucacu

SEQ ID NO: 1660289 - RNA, 17 nt, Homo sapiens
gauugugaagauuucau

SEQ ID NO: 1660290 - RNA, 18 nt, Homo sapiens
gauuuauucuggugucua

SEQ ID NO: 1660291 - RNA, 23 nt, Homo sapiens
gauuuguauuuauauuagagugc

SEQ ID NO: 1660292 - RNA, 21 nt, Homo sapiens
gauuuucaagaucaaacuucc

SEQ ID NO: 1660293 - RNA, 17 nt, Homo sapiens
gcaaaaccaacucucua

SEQ ID NO: 1660294 - RNA, 18 nt, Homo sapiens
gcaaaaccaacucucuac

SEQ ID NO: 1660295 - RNA, 18 nt, Homo sapiens
gcaaaagcaucuauguga

SEQ ID NO: 1660296 - RNA, 22 nt, Homo sapiens
gcaaaagugcaguagugucacu

SEQ ID NO: 1660297 - RNA, 22 nt, Homo sapiens
gcaaagccuagccugcauauca

SEQ ID NO: 1660298 - RNA, 23 nt, Homo sapiens
gcaaauuuuagcguuaaagucag

SEQ ID NO: 1660299 - RNA, 17 nt, Homo sapiens
gcaagaccccaucucaa

SEQ ID NO: 1660300 - RNA, 21 nt, Homo sapiens
gcaagagguuucagcauuccc

SEQ ID NO: 1660301 - RNA, 18 nt, Homo sapiens
gcaagcucuucauugcac

SEQ ID NO: 1660302 - RNA, 14 nt, Homo sapiens
gcaaggaucacuug

SEQ ID NO: 1660303 - RNA, 17 nt, Homo sapiens
gcaauaaacucagucaa

SEQ ID NO: 1660304 - RNA, 13 nt, Homo sapiens
gcaauaauugaca

SEQ ID NO: 1660305 - RNA, 22 nt, Homo sapiens
gcaauccucccacuucagccuc

SEQ ID NO: 1660306 - RNA, 19 nt, Homo sapiens
gcaauguaucccuucucac

SEQ ID NO: 1660307 - RNA, 16 nt, Homo sapiens
gcaauuuacuuggaau

SEQ ID NO: 1660308 - RNA, 20 nt, Homo sapiens
gcaauuuuuccaaaagccag

SEQ ID NO: 1660309 - RNA, 22 nt, Homo sapiens
gcacaaaagucucaauguucca

SEQ ID NO: 1660310 - RNA, 15 nt, Homo sapiens
gcacacaccugccug

SEQ ID NO: 1660311 - RNA, 12 nt, Homo sapiens
gcacacuggccu

SEQ ID NO: 1660312 - RNA, 21 nt, Homo sapiens
gcacacuugcacccaugugua

SEQ ID NO: 1660313 - RNA, 12 nt, Homo sapiens
gcacagccagaa

SEQ ID NO: 1660314 - RNA, 21 nt, Homo sapiens
gcacagcugggguggggaccu

SEQ ID NO: 1660315 - RNA, 19 nt, Homo sapiens
gcacaggucccacugcccu

SEQ ID NO: 1660316 - RNA, 12 nt, Homo sapiens
gcacaguacuca

SEQ ID NO: 1660317 - RNA, 11 nt, Homo sapiens
gcacaguauuu

SEQ ID NO: 1660318 - RNA, 17 nt, Homo sapiens
gcacagugguccagggu

SEQ ID NO: 1660319 - RNA, 22 nt, Homo sapiens
gcacccgcccuuuccuugccuu

SEQ ID NO: 1660320 - RNA, 13 nt, Homo sapiens
gcaccugaccaca

SEQ ID NO: 1660321 - RNA, 13 nt, Homo sapiens
gcacuccaugagu

SEQ ID NO: 1660322 - RNA, 11 nt, Homo sapiens
gcacucucuuu

SEQ ID NO: 1660323 - RNA, 19 nt, Homo sapiens
gcacugaaaauaccaucag

SEQ ID NO: 1660324 - RNA, 16 nt, Homo sapiens
gcacuggccuugccuc

SEQ ID NO: 1660325 - RNA, 19 nt, Homo sapiens
gcacugggcuuggggacca

SEQ ID NO: 1660326 - RNA, 15 nt, Homo sapiens
gcacugucaugccca

SEQ ID NO: 1660327 - RNA, 14 nt, Homo sapiens
gcacuuuguuucau

SEQ ID NO: 1660328 - RNA, 22 nt, Homo sapiens
gcagaaaaccuaccacauucac

SEQ ID NO: 1660329 - RNA, 18 nt, Homo sapiens
gcagaaaugccgggcaca

SEQ ID NO: 1660330 - RNA, 12 nt, Homo sapiens
gcagaaccaaag

SEQ ID NO: 1660331 - RNA, 13 nt, Homo sapiens
gcagaaccaaagc

SEQ ID NO: 1660332 - RNA, 18 nt, Homo sapiens
gcagacaguuaagagaaa

SEQ ID NO: 1660333 - RNA, 12 nt, Homo sapiens
gcagaggccaug

SEQ ID NO: 1660334 - RNA, 14 nt, Homo sapiens
gcagaggccaugaa

SEQ ID NO: 1660335 - RNA, 15 nt, Homo sapiens
gcagaggccaugaag

SEQ ID NO: 1660336 - RNA, 19 nt, Homo sapiens
gcagagguugggaggccau

SEQ ID NO: 1660337 - RNA, 23 nt, Homo sapiens
gcagaucaacagaccuaagaaau

SEQ ID NO: 1660338 - RNA, 19 nt, Homo sapiens
gcagcagcuuuugacuguu

SEQ ID NO: 1660339 - RNA, 23 nt, Homo sapiens
gcagccaaccccauccucacaca

SEQ ID NO: 1660340 - RNA, 13 nt, Homo sapiens
gcagcccagagag

SEQ ID NO: 1660341 - RNA, 21 nt, Homo sapiens
gcagccccuccccauggugca

SEQ ID NO: 1660342 - RNA, 15 nt, Homo sapiens
gcagccgccuuccuu

SEQ ID NO: 1660343 - RNA, 13 nt, Homo sapiens
gcagcuagacacc

SEQ ID NO: 1660344 - RNA, 14 nt, Homo sapiens
gcagcuaguacuca

SEQ ID NO: 1660345 - RNA, 22 nt, Homo sapiens
gcagcuccacagggcagggccu

SEQ ID NO: 1660346 - RNA, 23 nt, Homo sapiens
gcagcugggccuccugggugcca

SEQ ID NO: 1660347 - RNA, 15 nt, Homo sapiens
gcaggaaagaaauca

SEQ ID NO: 1660348 - RNA, 14 nt, Homo sapiens
gcaggaacacugga

SEQ ID NO: 1660349 - RNA, 14 nt, Homo sapiens
gcaggaacauugga

SEQ ID NO: 1660350 - RNA, 19 nt, Homo sapiens
gcaggaaccagcaaugaga

SEQ ID NO: 1660351 - RNA, 20 nt, Homo sapiens
gcaggagggacuggacagau

SEQ ID NO: 1660352 - RNA, 19 nt, Homo sapiens
gcaggaugauuguacagaa

SEQ ID NO: 1660353 - RNA, 15 nt, Homo sapiens
gcaggcccugcagug

SEQ ID NO: 1660354 - RNA, 14 nt, Homo sapiens
gcaggcucucaggc

SEQ ID NO: 1660355 - RNA, 16 nt, Homo sapiens
gcaggcucucaggcca

SEQ ID NO: 1660356 - RNA, 20 nt, Homo sapiens
gcagggcagccaccaggaga

SEQ ID NO: 1660357 - RNA, 17 nt, Homo sapiens
gcagggcccccacagga

SEQ ID NO: 1660358 - RNA, 22 nt, Homo sapiens
gcaggugggguuuucacuuccu

SEQ ID NO: 1660359 - RNA, 17 nt, Homo sapiens
gcaggugguaggccaug

SEQ ID NO: 1660360 - RNA, 16 nt, Homo sapiens
gcaggugucccugaga

SEQ ID NO: 1660361 - RNA, 23 nt, Homo sapiens
gcaguacucaguaacagugcagu

SEQ ID NO: 1660362 - RNA, 13 nt, Homo sapiens
gcaguagugucac

SEQ ID NO: 1660363 - RNA, 19 nt, Homo sapiens
gcaguauguacaggcugag

SEQ ID NO: 1660364 - RNA, 15 nt, Homo sapiens
gcagugaaguacuca

SEQ ID NO: 1660365 - RNA, 17 nt, Homo sapiens
gcagugaaguacucagu

SEQ ID NO: 1660366 - RNA, 16 nt, Homo sapiens
gcaguggcaucaucuc

SEQ ID NO: 1660367 - RNA, 18 nt, Homo sapiens
gcaguggcgugaucucag

SEQ ID NO: 1660368 - RNA, 22 nt, Homo sapiens
gcaguggcgugaucucagcuca

SEQ ID NO: 1660369 - RNA, 22 nt, Homo sapiens
gcaguguaacccaagcauuugu

SEQ ID NO: 1660370 - RNA, 15 nt, Homo sapiens
gcaguuagcacagag

SEQ ID NO: 1660371 - RNA, 17 nt, Homo sapiens
gcauaacacacuacugg

SEQ ID NO: 1660372 - RNA, 20 nt, Homo sapiens
gcauaggcuggggacacagg

SEQ ID NO: 1660373 - RNA, 12 nt, Homo sapiens
gcauaguacuca

SEQ ID NO: 1660374 - RNA, 14 nt, Homo sapiens
gcaucuccccucag

SEQ ID NO: 1660375 - RNA, 17 nt, Homo sapiens
gcaucuccccucagauu

SEQ ID NO: 1660376 - RNA, 21 nt, Homo sapiens
gcaucuggccuaugacccugu

SEQ ID NO: 1660377 - RNA, 22 nt, Homo sapiens
gcaugaggugagagaaagccac

SEQ ID NO: 1660378 - RNA, 18 nt, Homo sapiens
gcaugauugugaccucca

SEQ ID NO: 1660379 - RNA, 21 nt, Homo sapiens
gcaugcucaguuggugcugcu

SEQ ID NO: 1660380 - RNA, 12 nt, Homo sapiens
gcauuacaggug

SEQ ID NO: 1660381 - RNA, 22 nt, Homo sapiens
gcauuccugcagucagugcuaa

SEQ ID NO: 1660382 - RNA, 22 nt, Homo sapiens
gcauuuaggaaagcagugcagu

SEQ ID NO: 1660383 - RNA, 17 nt, Homo sapiens
cacagaguuacugccac

SEQ ID NO: 1660384 - RNA, 20 nt, Homo sapiens
cacagaugggcaaggccuuu

SEQ ID NO: 1660385 - RNA, 16 nt, Homo sapiens
cacagcagcaaagguc

SEQ ID NO: 1660386 - RNA, 18 nt, Homo sapiens
cacagccaauaaacacca

SEQ ID NO: 1660387 - RNA, 12 nt, Homo sapiens
cacagccauagc

SEQ ID NO: 1660388 - RNA, 23 nt, Homo sapiens
cacagcgucccuagcagugaacu

SEQ ID NO: 1660389 - RNA, 22 nt, Homo sapiens
cacaggaaaccaacacccaaag

SEQ ID NO: 1660390 - RNA, 19 nt, Homo sapiens
cacaggagcguguacuacc

SEQ ID NO: 1660391 - RNA, 23 nt, Homo sapiens
cacaggagcguguacuaccccag

SEQ ID NO: 1660392 - RNA, 18 nt, Homo sapiens
cacaggauucucuucuca

SEQ ID NO: 1660393 - RNA, 13 nt, Homo sapiens
cacagggacacag

SEQ ID NO: 1660394 - RNA, 13 nt, Homo sapiens
cacagguguaaau

SEQ ID NO: 1660395 - RNA, 12 nt, Homo sapiens
cacagugcagug

SEQ ID NO: 1660396 - RNA, 14 nt, Homo sapiens
cacaucagcccugu

SEQ ID NO: 1660397 - RNA, 20 nt, Homo sapiens
cacaucagcccuguguauaa

SEQ ID NO: 1660398 - RNA, 16 nt, Homo sapiens
cacaugacauccacau

SEQ ID NO: 1660399 - RNA, 18 nt, Homo sapiens
cacaugccucucucaggc

SEQ ID NO: 1660400 - RNA, 16 nt, Homo sapiens
cacaugguuuccaagg

SEQ ID NO: 1660401 - RNA, 17 nt, Homo sapiens
cacauguugcuaaugac

SEQ ID NO: 1660402 - RNA, 15 nt, Homo sapiens
cacauucauccucac

SEQ ID NO: 1660403 - RNA, 12 nt, Homo sapiens
cacauuccugac

SEQ ID NO: 1660404 - RNA, 13 nt, Homo sapiens
cacauuccugacc

SEQ ID NO: 1660405 - RNA, 17 nt, Homo sapiens
cacauugaaacuguauu

SEQ ID NO: 1660406 - RNA, 22 nt, Homo sapiens
caccaacaacagucagccagcu

SEQ ID NO: 1660407 - RNA, 14 nt, Homo sapiens
caccaccaaccacu

SEQ ID NO: 1660408 - RNA, 21 nt, Homo sapiens
caccacuuucccacacuguga

SEQ ID NO: 1660409 - RNA, 17 nt, Homo sapiens
caccagaguguaugcau

SEQ ID NO: 1660410 - RNA, 15 nt, Homo sapiens
caccagccugagcca

SEQ ID NO: 1660411 - RNA, 13 nt, Homo sapiens
caccauggcuuua

SEQ ID NO: 1660412 - RNA, 15 nt, Homo sapiens
caccauggcuuuaaa

SEQ ID NO: 1660413 - RNA, 15 nt, Homo sapiens
cauuauuacuuuucc

SEQ ID NO: 1660414 - RNA, 16 nt, Homo sapiens
cauuauucauucuccc

SEQ ID NO: 1660415 - RNA, 21 nt, Homo sapiens
cauuauucucugaugcacugu

SEQ ID NO: 1660416 - RNA, 22 nt, Homo sapiens
cauuauucucugaugcacuguu

SEQ ID NO: 1660417 - RNA, 19 nt, Homo sapiens
cauuauuuuucacugcccc

SEQ ID NO: 1660418 - RNA, 15 nt, Homo sapiens
cauucccaauuauca

SEQ ID NO: 1660419 - RNA, 13 nt, Homo sapiens
cauucgucaucac

SEQ ID NO: 1660420 - RNA, 14 nt, Homo sapiens
cauucuccggccuc

SEQ ID NO: 1660421 - RNA, 15 nt, Homo sapiens
cauugaaacuguauu

SEQ ID NO: 1660422 - RNA, 16 nt, Homo sapiens
cauugaaauaauaaua

SEQ ID NO: 1660423 - RNA, 18 nt, Homo sapiens
cauugaagggggaugcag

SEQ ID NO: 1660424 - RNA, 13 nt, Homo sapiens
cauugacccucac

SEQ ID NO: 1660425 - RNA, 20 nt, Homo sapiens
cauugagaaauaaagcacau

SEQ ID NO: 1660426 - RNA, 18 nt, Homo sapiens
cauugaugaacugccaaa

SEQ ID NO: 1660427 - RNA, 19 nt, Homo sapiens
cauugaugaacugccaaag

SEQ ID NO: 1660428 - RNA, 23 nt, Homo sapiens
cauuguacaguuuguuuacacac

SEQ ID NO: 1660429 - RNA, 22 nt, Homo sapiens
cauuuaaucauuuccagcaaaa

SEQ ID NO: 1660430 - RNA, 15 nt, Homo sapiens
cauuuaugcaugaga

SEQ ID NO: 1660431 - RNA, 17 nt, Homo sapiens
cauuuauuuacauguga

SEQ ID NO: 1660432 - RNA, 16 nt, Homo sapiens
cauuucacuauucugu

SEQ ID NO: 1660433 - RNA, 12 nt, Homo sapiens
cauuucauauaa

SEQ ID NO: 1660434 - RNA, 18 nt, Homo sapiens
cauuuccacuacagugag

SEQ ID NO: 1660435 - RNA, 17 nt, Homo sapiens
cauuugacuuucugucu

SEQ ID NO: 1660436 - RNA, 21 nt, Homo sapiens
gacggguuucaccauguuggc

SEQ ID NO: 1660437 - RNA, 20 nt, Homo sapiens
gacgguagagagaaacagcu

SEQ ID NO: 1660438 - RNA, 18 nt, Homo sapiens
gacuaagaaaugccagug

SEQ ID NO: 1660439 - RNA, 21 nt, Homo sapiens
gacuacaggcaccugccacca

SEQ ID NO: 1660440 - RNA, 19 nt, Homo sapiens
gacuagccugaaaauccaa

SEQ ID NO: 1660441 - RNA, 16 nt, Homo sapiens
gacucagggcauaaug

SEQ ID NO: 1660442 - RNA, 22 nt, Homo sapiens
gacucaucuugggaagggccau

SEQ ID NO: 1660443 - RNA, 13 nt, Homo sapiens
gacugagcuugau

SEQ ID NO: 1660444 - RNA, 18 nt, Homo sapiens
gacugcugucuuacuaau

SEQ ID NO: 1660445 - RNA, 17 nt, Homo sapiens
gacuggcacacuggccu

SEQ ID NO: 1660446 - RNA, 18 nt, Homo sapiens
gacuguccuacaauauca

SEQ ID NO: 1660447 - RNA, 17 nt, Homo sapiens
gacuguuagacaaaagu

SEQ ID NO: 1660448 - RNA, 15 nt, Homo sapiens
gacuucuaaaucaua

SEQ ID NO: 1660449 - RNA, 20 nt, Homo sapiens
gacuucuuuacuaacacugg

SEQ ID NO: 1660450 - RNA, 9 nt, Homo sapiens
gacuuggaa

SEQ ID NO: 1660451 - RNA, 13 nt, Homo sapiens
gagaaacuuccuu

SEQ ID NO: 1660452 - RNA, 20 nt, Homo sapiens
gagaaauaaagcacauuuga

SEQ ID NO: 1660453 - RNA, 15 nt, Homo sapiens
gagaacauggccaau

SEQ ID NO: 1660454 - RNA, 20 nt, Homo sapiens
gagaagaaacagcggcucca

SEQ ID NO: 1660455 - RNA, 16 nt, Homo sapiens
gagaagauucaauuua

SEQ ID NO: 1660456 - RNA, 11 nt, Homo sapiens
gagaagccaua

SEQ ID NO: 1660457 - RNA, 14 nt, Homo sapiens
gagaagccucaguc

SEQ ID NO: 1660458 - RNA, 21 nt, Homo sapiens
gagaaggcaggaacacuggag

SEQ ID NO: 1660459 - RNA, 21 nt, Homo sapiens
gagacuguagggaugaaauaa

SEQ ID NO: 1660460 - RNA, 14 nt, Homo sapiens
gagagaaagccaca

SEQ ID NO: 1660461 - RNA, 15 nt, Homo sapiens
gagagaggacuggag

SEQ ID NO: 1660462 - RNA, 16 nt, Homo sapiens
gagagcagccucuuga

SEQ ID NO: 1660463 - RNA, 15 nt, Homo sapiens
gagagcggcuucccc

SEQ ID NO: 1660464 - RNA, 15 nt, Homo sapiens
gagaggcugcuguca

SEQ ID NO: 1660465 - RNA, 23 nt, Homo sapiens
gagaguuucuauggauucacuuc

SEQ ID NO: 1660466 - RNA, 18 nt, Homo sapiens
gagauagccaaggccaaa

SEQ ID NO: 1660467 - RNA, 18 nt, Homo sapiens
gagauagcuuagugucuc

SEQ ID NO: 1660468 - RNA, 21 nt, Homo sapiens
gagaucuuaagauuccauuuu

SEQ ID NO: 1660469 - RNA, 17 nt, Homo sapiens
gagaugaggcuggauag

SEQ ID NO: 1660470 - RNA, 22 nt, Homo sapiens
gagauggguugaguuugcugua

SEQ ID NO: 1660471 - RNA, 23 nt, Homo sapiens
gagauugcucuggggcuugcuau

SEQ ID NO: 1660472 - RNA, 22 nt, Homo sapiens
gagauuuccugacagggaaaag

SEQ ID NO: 1660473 - RNA, 18 nt, Homo sapiens
gagcaagaccccaucuca

SEQ ID NO: 1660474 - RNA, 15 nt, Homo sapiens
gagcacagcaaggga

SEQ ID NO: 1660475 - RNA, 17 nt, Homo sapiens
gagcagugcagccacca

SEQ ID NO: 1660476 - RNA, 21 nt, Homo sapiens
gagcauggccgcaacuuccca

SEQ ID NO: 1660477 - RNA, 21 nt, Homo sapiens
gagccaaguucacaccacugc

SEQ ID NO: 1660478 - RNA, 13 nt, Homo sapiens
gagccacagaaaa

SEQ ID NO: 1660479 - RNA, 23 nt, Homo sapiens
gagcccaauguauuaugaucucu

SEQ ID NO: 1660480 - RNA, 20 nt, Homo sapiens
gagccccauuauucauucuc

SEQ ID NO: 1660481 - RNA, 15 nt, Homo sapiens
gagcccccacccggg

SEQ ID NO: 1660482 - RNA, 20 nt, Homo sapiens
gagcccccacccgggagcag

SEQ ID NO: 1660483 - RNA, 12 nt, Homo sapiens
gagccugaguga

SEQ ID NO: 1660484 - RNA, 23 nt, Homo sapiens
gagccugcaauaagggaaaaaug

SEQ ID NO: 1660485 - RNA, 13 nt, Homo sapiens
gagcgggggcuaa

SEQ ID NO: 1660486 - RNA, 18 nt, Homo sapiens
gagcuagaugugucuuac

SEQ ID NO: 1660487 - RNA, 19 nt, Homo sapiens
gagcuagaugugucuuacc

SEQ ID NO: 1660488 - RNA, 22 nt, Homo sapiens
gagcugacccccaggaacagcu

SEQ ID NO: 1660489 - RNA, 20 nt, Homo sapiens
gagcugcccacaacuugcca

SEQ ID NO: 1660490 - RNA, 18 nt, Homo sapiens
gagcuugcaggaaccagc

SEQ ID NO: 1660491 - RNA, 13 nt, Homo sapiens
gagcuuucugaua

SEQ ID NO: 1660492 - RNA, 23 nt, Homo sapiens
gaggaaaauaguggcaggacugu

SEQ ID NO: 1660493 - RNA, 16 nt, Homo sapiens
gaggaaacugcacugu

SEQ ID NO: 1660494 - RNA, 15 nt, Homo sapiens
gaggaaagcaaagga

SEQ ID NO: 1660495 - RNA, 20 nt, Homo sapiens
gaggaacugcuugugcacug

SEQ ID NO: 1660496 - RNA, 23 nt, Homo sapiens
gaggaacugcuugugcacuggau

SEQ ID NO: 1660497 - RNA, 23 nt, Homo sapiens
gaggaauaagaauggagcaguac

SEQ ID NO: 1660498 - RNA, 23 nt, Homo sapiens
gaggacagggcccccacagggga

SEQ ID NO: 1660499 - RNA, 15 nt, Homo sapiens
gaggacggcuucccc

SEQ ID NO: 1660500 - RNA, 23 nt, Homo sapiens
gaggacucccugcuuagcucugu

SEQ ID NO: 1660501 - RNA, 23 nt, Homo sapiens
gaggagcaagguuuaaauuuguu

SEQ ID NO: 1660502 - RNA, 19 nt, Homo sapiens
gaggagcacacauccaaga

SEQ ID NO: 1660503 - RNA, 15 nt, Homo sapiens
gaggaggauccgggc

SEQ ID NO: 1660504 - RNA, 12 nt, Homo sapiens
gaggaucacuug

SEQ ID NO: 1660505 - RNA, 22 nt, Homo sapiens
gaggauugagauaacauuucca

SEQ ID NO: 1660506 - RNA, 22 nt, Homo sapiens
gaggccaagaaagaaaccagac

SEQ ID NO: 1660507 - RNA, 19 nt, Homo sapiens
gaggcgugggauccagaga

SEQ ID NO: 1660508 - RNA, 18 nt, Homo sapiens
gaggcuccggauguuucu

SEQ ID NO: 1660509 - RNA, 14 nt, Homo sapiens
gagggaacuaagca

SEQ ID NO: 1660510 - RNA, 21 nt, Homo sapiens
gagggcacagaaaauggaaga

SEQ ID NO: 1660511 - RNA, 17 nt, Homo sapiens
gagggcaggguucuaga

SEQ ID NO: 1660512 - RNA, 19 nt, Homo sapiens
gagggcugcugaccauuug

SEQ ID NO: 1660513 - RNA, 22 nt, Homo sapiens
gagguauuugguaacuugcugu

SEQ ID NO: 1660514 - RNA, 19 nt, Homo sapiens
gaggugaaugcacagugaa

SEQ ID NO: 1660515 - RNA, 18 nt, Homo sapiens
gagguggauucaugucca

SEQ ID NO: 1660516 - RNA, 18 nt, Homo sapiens
gagguggccccaccugag

SEQ ID NO: 1660517 - RNA, 15 nt, Homo sapiens
gagguugugcugccu

SEQ ID NO: 1660518 - RNA, 13 nt, Homo sapiens
gaguaaaaccaaa

SEQ ID NO: 1660519 - RNA, 14 nt, Homo sapiens
gaguacauacucaa

SEQ ID NO: 1660520 - RNA, 22 nt, Homo sapiens
gagucuucagaagaaaggacag

SEQ ID NO: 1660521 - RNA, 13 nt, Homo sapiens
gagugaugggcaa

SEQ ID NO: 1660522 - RNA, 12 nt, Homo sapiens
gagugcaauggu

SEQ ID NO: 1660523 - RNA, 21 nt, Homo sapiens
gagugcaguggcaucaucuca

SEQ ID NO: 1660524 - RNA, 15 nt, Homo sapiens
gaguggaaaugggga

SEQ ID NO: 1660525 - RNA, 13 nt, Homo sapiens
gaguggaucugga

SEQ ID NO: 1660526 - RNA, 16 nt, Homo sapiens
gaguucaucuugaauu

SEQ ID NO: 1660527 - RNA, 17 nt, Homo sapiens
gaguuccggaaagccuu

SEQ ID NO: 1660528 - RNA, 18 nt, Homo sapiens
gaguuccggaaagccuuc

SEQ ID NO: 1660529 - RNA, 14 nt, Homo sapiens
gaguugaagacaga

SEQ ID NO: 1660530 - RNA, 20 nt, Homo sapiens
gaguuguuuaaacagucaaa

SEQ ID NO: 1660531 - RNA, 15 nt, Homo sapiens
gaguuucuauggauu

SEQ ID NO: 1660532 - RNA, 19 nt, Homo sapiens
gauaacagcaauuguucag

SEQ ID NO: 1660533 - RNA, 19 nt, Homo sapiens
gauaauaaaggcauuucaa

SEQ ID NO: 1660534 - RNA, 15 nt, Homo sapiens
gauacgcuccaguac

SEQ ID NO: 1660535 - RNA, 22 nt, Homo sapiens
gauagaauaaagccuugugauc

SEQ ID NO: 1660536 - RNA, 19 nt, Homo sapiens
gauagauauccuuggcaca

SEQ ID NO: 1660537 - RNA, 18 nt, Homo sapiens
gauagcuuggagggaugg

SEQ ID NO: 1660538 - RNA, 18 nt, Homo sapiens
gauauacucgaaucagac

SEQ ID NO: 1660539 - RNA, 22 nt, Homo sapiens
gauaucacagaggccuauaacu

SEQ ID NO: 1660540 - RNA, 19 nt, Homo sapiens
gauaugaguacauacucaa

SEQ ID NO: 1660541 - RNA, 23 nt, Homo sapiens
gauaugcacuugaaaugauggua

SEQ ID NO: 1660542 - RNA, 13 nt, Homo sapiens
gauaugggacuga

SEQ ID NO: 1660543 - RNA, 15 nt, Homo sapiens
gaucaacucauguua

SEQ ID NO: 1660544 - RNA, 19 nt, Homo sapiens
gaucaacucugucuugggc

SEQ ID NO: 1660545 - RNA, 16 nt, Homo sapiens
gaucauagcugacuca

SEQ ID NO: 1660546 - RNA, 18 nt, Homo sapiens
gaucauugguaucugaua

SEQ ID NO: 1660547 - RNA, 19 nt, Homo sapiens
gauccaccgccacacuggc

SEQ ID NO: 1660548 - RNA, 17 nt, Homo sapiens
gaucccugagagucucu

SEQ ID NO: 1660549 - RNA, 21 nt, Homo sapiens
gaucuaaaaggaggacaggga

SEQ ID NO: 1660550 - RNA, 19 nt, Homo sapiens
gaucuugagcaaggcaaga

SEQ ID NO: 1660551 - RNA, 19 nt, Homo sapiens
gaugaaaaaauaacacugu

SEQ ID NO: 1660552 - RNA, 17 nt, Homo sapiens
acuuauuucagauucac

SEQ ID NO: 1660553 - RNA, 21 nt, Homo sapiens
acuuauuucagauucaccucc

SEQ ID NO: 1660554 - RNA, 19 nt, Homo sapiens
acuucaaaggaacuggaau

SEQ ID NO: 1660555 - RNA, 15 nt, Homo sapiens
acuucaaauguguaa

SEQ ID NO: 1660556 - RNA, 20 nt, Homo sapiens
acuucaaauguguaacuuua

SEQ ID NO: 1660557 - RNA, 21 nt, Homo sapiens
acuucccagagaguaucugag

SEQ ID NO: 1660558 - RNA, 13 nt, Homo sapiens
acuuccucaugaa

SEQ ID NO: 1660559 - RNA, 14 nt, Homo sapiens
acuucuacauccaa

SEQ ID NO: 1660560 - RNA, 21 nt, Homo sapiens
acuucuacauccaauguauga

SEQ ID NO: 1660561 - RNA, 16 nt, Homo sapiens
acuucuaguuuggcau

SEQ ID NO: 1660562 - RNA, 22 nt, Homo sapiens
acuucuaguuuggcauuucaca

SEQ ID NO: 1660563 - RNA, 23 nt, Homo sapiens
acuucuucuguaauauuuacaau

SEQ ID NO: 1660564 - RNA, 14 nt, Homo sapiens
acuucuuuaguauu

SEQ ID NO: 1660565 - RNA, 15 nt, Homo sapiens
acuucuuuaguauua

SEQ ID NO: 1660566 - RNA, 19 nt, Homo sapiens
acuucuuuauucacaguau

SEQ ID NO: 1660567 - RNA, 17 nt, Homo sapiens
acuugcaugcagcagcu

SEQ ID NO: 1660568 - RNA, 15 nt, Homo sapiens
acuugccuugugaua

SEQ ID NO: 1660569 - RNA, 16 nt, Homo sapiens
acuugccuugugauau

SEQ ID NO: 1660570 - RNA, 22 nt, Homo sapiens
acuugcugguuuugcggcuugu

SEQ ID NO: 1660571 - RNA, 22 nt, Homo sapiens
acuuguuuguaaaagagcuguu

SEQ ID NO: 1660572 - RNA, 12 nt, Homo sapiens
acuuuaccaugc

SEQ ID NO: 1660573 - RNA, 13 nt, Homo sapiens
acuuuaccaugcu

SEQ ID NO: 1660574 - RNA, 16 nt, Homo sapiens
acuuuaccaugcucaa

SEQ ID NO: 1660575 - RNA, 17 nt, Homo sapiens
acuuuaccaugcucaau

SEQ ID NO: 1660576 - RNA, 18 nt, Homo sapiens
acuuuauuggucuugccc

SEQ ID NO: 1660577 - RNA, 21 nt, Homo sapiens
acuuucccuauacuuaggcau

SEQ ID NO: 1660578 - RNA, 22 nt, Homo sapiens
acuuugagccucuuaggcagaa

SEQ ID NO: 1660579 - RNA, 15 nt, Homo sapiens
acuuuggacuaaaga

SEQ ID NO: 1660580 - RNA, 16 nt, Homo sapiens
acuuugucacuucugc

SEQ ID NO: 1660581 - RNA, 17 nt, Homo sapiens
acuuugucucugagaac

SEQ ID NO: 1660582 - RNA, 22 nt, Homo sapiens
acuuuguuauuguaccuaagua

SEQ ID NO: 1660583 - RNA, 17 nt, Homo sapiens
acuuuuaauuagugaug

SEQ ID NO: 1660584 - RNA, 15 nt, Homo sapiens
acuuuuaccacuugc

SEQ ID NO: 1660585 - RNA, 20 nt, Homo sapiens
acuuuuaugagaacaaugga

SEQ ID NO: 1660586 - RNA, 20 nt, Homo sapiens
acuuuucuuucagccaagaa

SEQ ID NO: 1660587 - RNA, 23 nt, Homo sapiens
acuuuugguaucuacuucuacau

SEQ ID NO: 1660588 - RNA, 20 nt, Homo sapiens
acuuuuuauucucaguuuaa

SEQ ID NO: 1660589 - RNA, 19 nt, Homo sapiens
acuuuuuuccugucaauau

SEQ ID NO: 1660590 - RNA, 14 nt, Homo sapiens
agaaaaaacuggaa

SEQ ID NO: 1660591 - RNA, 16 nt, Homo sapiens
agaaaaaagugcaacu

SEQ ID NO: 1660592 - RNA, 13 nt, Homo sapiens
agaaaaacaaauc

SEQ ID NO: 1660593 - RNA, 19 nt, Homo sapiens
agaaaacaagguccaguaa

SEQ ID NO: 1660594 - RNA, 21 nt, Homo sapiens
agaaaaccaguggaagauuuc

SEQ ID NO: 1660595 - RNA, 13 nt, Homo sapiens
agaaaagccagau

SEQ ID NO: 1660596 - RNA, 19 nt, Homo sapiens
agaaaauggacguguuaug

SEQ ID NO: 1660597 - RNA, 17 nt, Homo sapiens
agaaacacggcugauau

SEQ ID NO: 1660598 - RNA, 20 nt, Homo sapiens
agaaacacggcugauaucuu

SEQ ID NO: 1660599 - RNA, 18 nt, Homo sapiens
agaaacaugacacugacc

SEQ ID NO: 1660600 - RNA, 11 nt, Homo sapiens
agaaaccucac

SEQ ID NO: 1660601 - RNA, 13 nt, Homo sapiens
agaaaccucggaa

SEQ ID NO: 1660602 - RNA, 18 nt, Homo sapiens
agaaacucgggcacuccc

SEQ ID NO: 1660603 - RNA, 19 nt, Homo sapiens
accauccgcaaccugagga

SEQ ID NO: 1660604 - RNA, 23 nt, Homo sapiens
accauccuggcuaacacagugaa

SEQ ID NO: 1660605 - RNA, 13 nt, Homo sapiens
accauggcuuuaa

SEQ ID NO: 1660606 - RNA, 22 nt, Homo sapiens
accauucuccggccucagucuc

SEQ ID NO: 1660607 - RNA, 17 nt, Homo sapiens
accauuuccccuguggu

SEQ ID NO: 1660608 - RNA, 19 nt, Homo sapiens
acccaaaugguggccauug

SEQ ID NO: 1660609 - RNA, 12 nt, Homo sapiens
acccaaccuggc

SEQ ID NO: 1660610 - RNA, 14 nt, Homo sapiens
acccaagggucaga

SEQ ID NO: 1660611 - RNA, 22 nt, Homo sapiens
acccaaguuuauuauaucauua

SEQ ID NO: 1660612 - RNA, 21 nt, Homo sapiens
acccacaaguauugcccuuua

SEQ ID NO: 1660613 - RNA, 13 nt, Homo sapiens
acccacugccaga

SEQ ID NO: 1660614 - RNA, 16 nt, Homo sapiens
acccagggaaugccag

SEQ ID NO: 1660615 - RNA, 15 nt, Homo sapiens
acccaguccugcaca

SEQ ID NO: 1660616 - RNA, 20 nt, Homo sapiens
accccaaacuuccagguucc

SEQ ID NO: 1660617 - RNA, 19 nt, Homo sapiens
accccagucccagcuaacu

SEQ ID NO: 1660618 - RNA, 15 nt, Homo sapiens
acccccagcagcuca

SEQ ID NO: 1660619 - RNA, 19 nt, Homo sapiens
accccgucugccccuugac

SEQ ID NO: 1660620 - RNA, 21 nt, Homo sapiens
acccgcccuuagaccaggcag

SEQ ID NO: 1660621 - RNA, 15 nt, Homo sapiens
acccgccucuugccc

SEQ ID NO: 1660622 - RNA, 16 nt, Homo sapiens
acccuacaguauauaa

SEQ ID NO: 1660623 - RNA, 14 nt, Homo sapiens
acccuaggugcuca

SEQ ID NO: 1660624 - RNA, 23 nt, Homo sapiens
acccuccccauuaguauccuguu

SEQ ID NO: 1660625 - RNA, 14 nt, Homo sapiens
acccugaaucagag

SEQ ID NO: 1660626 - RNA, 16 nt, Homo sapiens
acccugccaacuuucc

SEQ ID NO: 1660627 - RNA, 22 nt, Homo sapiens
acccuucccaaucagcacugaa

SEQ ID NO: 1660628 - RNA, 14 nt, Homo sapiens
acccuugacuguua

SEQ ID NO: 1660629 - RNA, 20 nt, Homo sapiens
acccuuuccucuuaauuccc

SEQ ID NO: 1660630 - RNA, 21 nt, Homo sapiens
acccuuuuacagucacauuca

SEQ ID NO: 1660631 - RNA, 21 nt, Homo sapiens
accgcauuccaggggcugcag

SEQ ID NO: 1660632 - RNA, 13 nt, Homo sapiens
accgucaauguga

SEQ ID NO: 1660633 - RNA, 24 nt, Homo sapiens
accguccagcaagugucaucacuu

SEQ ID NO: 1660634 - RNA, 15 nt, Homo sapiens
accguugauguugau

SEQ ID NO: 1660635 - RNA, 17 nt, Homo sapiens
accuaacuuucauuaaa

SEQ ID NO: 1660636 - RNA, 15 nt, Homo sapiens
accuaccacauucac

SEQ ID NO: 1660637 - RNA, 12 nt, Homo sapiens
accuacugcuga

SEQ ID NO: 1660638 - RNA, 13 nt, Homo sapiens
accuauugcugua

SEQ ID NO: 1660639 - RNA, 18 nt, Homo sapiens
accucaccccauugauug

SEQ ID NO: 1660640 - RNA, 17 nt, Homo sapiens
accucagaggaguuuaa

SEQ ID NO: 1660641 - RNA, 13 nt, Homo sapiens
accucagcaauau

SEQ ID NO: 1660642 - RNA, 22 nt, Homo sapiens
accucagcaauauaggaggcaa

SEQ ID NO: 1660643 - RNA, 23 nt, Homo sapiens
accucaggccugggggcugggca

SEQ ID NO: 1660644 - RNA, 14 nt, Homo sapiens
accuccacugcugc

SEQ ID NO: 1660645 - RNA, 19 nt, Homo sapiens
accuccagucccccuaucc

SEQ ID NO: 1660646 - RNA, 12 nt, Homo sapiens
accucccacugc

SEQ ID NO: 1660647 - RNA, 23 nt, Homo sapiens
accucccacugcccccuccacug

SEQ ID NO: 1660648 - RNA, 12 nt, Homo sapiens
accucccagcgu

SEQ ID NO: 1660649 - RNA, 14 nt, Homo sapiens
accucccccaggga

SEQ ID NO: 1660650 - RNA, 17 nt, Homo sapiens
accucuacaggcauuua

SEQ ID NO: 1660651 - RNA, 23 nt, Homo sapiens
accucucugaacugcaacacugg

SEQ ID NO: 1660652 - RNA, 14 nt, Homo sapiens
accucugaccaaca

SEQ ID NO: 1660653 - RNA, 11 nt, Homo sapiens
accucuuguuu

SEQ ID NO: 1660654 - RNA, 21 nt, Homo sapiens
accugaauaagggacuuugga

SEQ ID NO: 1660655 - RNA, 18 nt, Homo sapiens
accugauuuccauuugca

SEQ ID NO: 1660656 - RNA, 19 nt, Homo sapiens
accugccaggaagccagca

SEQ ID NO: 1660657 - RNA, 18 nt, Homo sapiens
accugcuuugagauuucc

SEQ ID NO: 1660658 - RNA, 21 nt, Homo sapiens
accuggagauugugcucugca

SEQ ID NO: 1660659 - RNA, 19 nt, Homo sapiens
accuggagccaucuuccua

SEQ ID NO: 1660660 - RNA, 15 nt, Homo sapiens
accugggcccuaggc

SEQ ID NO: 1660661 - RNA, 19 nt, Homo sapiens
accuguguguaagucccaa

SEQ ID NO: 1660662 - RNA, 23 nt, Homo sapiens
accuguucacgugacuccucaau

SEQ ID NO: 1660663 - RNA, 18 nt, Homo sapiens
accuguuccugacuguuc

SEQ ID NO: 1660664 - RNA, 13 nt, Homo sapiens
accuguuccuguu

SEQ ID NO: 1660665 - RNA, 21 nt, Homo sapiens
accuguucuuccuaccaaaua

SEQ ID NO: 1660666 - RNA, 22 nt, Homo sapiens
accuguucuuccuaccaaauau

SEQ ID NO: 1660667 - RNA, 19 nt, Homo sapiens
accuuacuuaaagcuuguu

SEQ ID NO: 1660668 - RNA, 14 nt, Homo sapiens
accuucaacaugug

SEQ ID NO: 1660669 - RNA, 18 nt, Homo sapiens
accuucccuaccaaaggg

SEQ ID NO: 1660670 - RNA, 13 nt, Homo sapiens
accuucugaugaa

SEQ ID NO: 1660671 - RNA, 22 nt, Homo sapiens
ugcaguacucaguaaggcagug

SEQ ID NO: 1660672 - RNA, 19 nt, Homo sapiens
ugcaguggcaucaucucag

SEQ ID NO: 1660673 - RNA, 17 nt, Homo sapiens
ugcaguggugaugccua

SEQ ID NO: 1660674 - RNA, 15 nt, Homo sapiens
ugcaguucaguucuu

SEQ ID NO: 1660675 - RNA, 17 nt, Homo sapiens
ugcaguuuuuguuuaca

SEQ ID NO: 1660676 - RNA, 17 nt, Homo sapiens
ugcauaaccgcacagac

SEQ ID NO: 1660677 - RNA, 18 nt, Homo sapiens
ugcauaaccgcacagaca

SEQ ID NO: 1660678 - RNA, 19 nt, Homo sapiens
ugcaucaugcaugcacucu

SEQ ID NO: 1660679 - RNA, 14 nt, Homo sapiens
ugcaucauguugaa

SEQ ID NO: 1660680 - RNA, 16 nt, Homo sapiens
ugcaucggggauucca

SEQ ID NO: 1660681 - RNA, 21 nt, Homo sapiens
ugcaucuccccucagauucca

SEQ ID NO: 1660682 - RNA, 19 nt, Homo sapiens
ugcaucuggccuaugaccc

SEQ ID NO: 1660683 - RNA, 18 nt, Homo sapiens
ugcaucuucccacagugg

SEQ ID NO: 1660684 - RNA, 16 nt, Homo sapiens
ugcaugagaacuaaau

SEQ ID NO: 1660685 - RNA, 18 nt, Homo sapiens
ugccaaacaucagucaau

SEQ ID NO: 1660686 - RNA, 13 nt, Homo sapiens
ugccaacuuucca

SEQ ID NO: 1660687 - RNA, 19 nt, Homo sapiens
ugccaagacucuaugcucu

SEQ ID NO: 1660688 - RNA, 14 nt, Homo sapiens
ugccacaaucacua

SEQ ID NO: 1660689 - RNA, 14 nt, Homo sapiens
ugccaccacccacc

SEQ ID NO: 1660690 - RNA, 20 nt, Homo sapiens
ugccaccacccaccccaaac

SEQ ID NO: 1660691 - RNA, 16 nt, Homo sapiens
ugccacgguccuuuga

SEQ ID NO: 1660692 - RNA, 17 nt, Homo sapiens
ugccaggacacugccuu

SEQ ID NO: 1660693 - RNA, 21 nt, Homo sapiens
ugccaggccugggaccuccca

SEQ ID NO: 1660694 - RNA, 20 nt, Homo sapiens
ugccaggcuggagugcagug

SEQ ID NO: 1660695 - RNA, 18 nt, Homo sapiens
ugccaguaauguauuuua

SEQ ID NO: 1660696 - RNA, 12 nt, Homo sapiens
ugccaugaucug

SEQ ID NO: 1660697 - RNA, 22 nt, Homo sapiens
ugcccacacuugggagcaaaag

SEQ ID NO: 1660698 - RNA, 18 nt, Homo sapiens
ugcccaccacaacuaaca

SEQ ID NO: 1660699 - RNA, 17 nt, Homo sapiens
ugcccacccguguucuc

SEQ ID NO: 1660700 - RNA, 17 nt, Homo sapiens
ugcccacgucccgggca

SEQ ID NO: 1660701 - RNA, 19 nt, Homo sapiens
ugcccagcuuggagugcca

SEQ ID NO: 1660702 - RNA, 20 nt, Homo sapiens
ugcccagcuuggagugccac

SEQ ID NO: 1660703 - RNA, 19 nt, Homo sapiens
ugccccagagaagccucag

SEQ ID NO: 1660704 - RNA, 21 nt, Homo sapiens
ugccccaguaacucacuuuaa

SEQ ID NO: 1660705 - RNA, 18 nt, Homo sapiens
ugcccccgggggcucaca

SEQ ID NO: 1660706 - RNA, 22 nt, Homo sapiens
ugccccucaacucuccuccaga

SEQ ID NO: 1660707 - RNA, 13 nt, Homo sapiens
ugccccuccgucc

SEQ ID NO: 1660708 - RNA, 20 nt, Homo sapiens
ugcccucucacugacuucuc

SEQ ID NO: 1660709 - RNA, 22 nt, Homo sapiens
ugcccugaugcgucuacccaga

SEQ ID NO: 1660710 - RNA, 21 nt, Homo sapiens
ugcccuuuaacaagacuucaa

SEQ ID NO: 1660711 - RNA, 14 nt, Homo sapiens
ugccuauuuaugaa

SEQ ID NO: 1660712 - RNA, 18 nt, Homo sapiens
ugccucccagguucaagu

SEQ ID NO: 1660713 - RNA, 23 nt, Homo sapiens
ugccucccuggcagcacaggaaa

SEQ ID NO: 1660714 - RNA, 20 nt, Homo sapiens
ugccucucucucccaacugc

SEQ ID NO: 1660715 - RNA, 21 nt, Homo sapiens
ugccuuguugaugaagcacau

SEQ ID NO: 1660716 - RNA, 11 nt, Homo sapiens
ugccuuugacc

SEQ ID NO: 1660717 - RNA, 14 nt, Homo sapiens
ugcgacaggcauuu

SEQ ID NO: 1660718 - RNA, 22 nt, Homo sapiens
ugcgacgauccccauggaacag

SEQ ID NO: 1660719 - RNA, 15 nt, Homo sapiens
ugcgcaauguggcau

SEQ ID NO: 1660720 - RNA, 15 nt, Homo sapiens
ugcgccgagccucag

SEQ ID NO: 1660721 - RNA, 13 nt, Homo sapiens
ugcggaauuccac

SEQ ID NO: 1660722 - RNA, 13 nt, Homo sapiens
ugcggcuugugag

SEQ ID NO: 1660723 - RNA, 21 nt, Homo sapiens
ugcguaggagagaacagggau

SEQ ID NO: 1660724 - RNA, 22 nt, Homo sapiens
ugcguaggagagaacagggaug

SEQ ID NO: 1660725 - RNA, 12 nt, Homo sapiens
ugcgucuaccca

SEQ ID NO: 1660726 - RNA, 12 nt, Homo sapiens
ugcgugugaaac

SEQ ID NO: 1660727 - RNA, 13 nt, Homo sapiens
ugcuaaaugcaaa

SEQ ID NO: 1660728 - RNA, 15 nt, Homo sapiens
ugcucaagacuggca

SEQ ID NO: 1660729 - RNA, 17 nt, Homo sapiens
ugcucaauaaggcagug

SEQ ID NO: 1660730 - RNA, 21 nt, Homo sapiens
ugcucaauaaggcagugcagu

SEQ ID NO: 1660731 - RNA, 17 nt, Homo sapiens
ugcucaguaaggcagug

SEQ ID NO: 1660732 - RNA, 16 nt, Homo sapiens
ugcucaguauugagac

SEQ ID NO: 1660733 - RNA, 17 nt, Homo sapiens
ugcucaguuggugcugc

SEQ ID NO: 1660734 - RNA, 18 nt, Homo sapiens
ugcucaguuggugcugcu

SEQ ID NO: 1660735 - RNA, 17 nt, Homo sapiens
ugcucauuucacuauuc

SEQ ID NO: 1660736 - RNA, 17 nt, Homo sapiens
ugcuccaguauaaauua

SEQ ID NO: 1660737 - RNA, 16 nt, Homo sapiens
ugcucccuagccagag

SEQ ID NO: 1660738 - RNA, 20 nt, Homo sapiens
ugcucccuagccagaggcuc

SEQ ID NO: 1660739 - RNA, 13 nt, Homo sapiens
ugcucucccaggu

SEQ ID NO: 1660740 - RNA, 18 nt, Homo sapiens
ugcucuggggcuugcuau

SEQ ID NO: 1660741 - RNA, 14 nt, Homo sapiens
ugcucuuuaccuug

SEQ ID NO: 1660742 - RNA, 17 nt, Homo sapiens
ugcugaaaaccaucugg

SEQ ID NO: 1660743 - RNA, 13 nt, Homo sapiens
ugcugcacugccc

SEQ ID NO: 1660744 - RNA, 15 nt, Homo sapiens
ugcugcgcuuaccuu

SEQ ID NO: 1660745 - RNA, 22 nt, Homo sapiens
ugcugggccgggguguggaauc

SEQ ID NO: 1660746 - RNA, 13 nt, Homo sapiens
ugcuggucuucaa

SEQ ID NO: 1660747 - RNA, 23 nt, Homo sapiens
ugcuggucuucaauuaccaagaa

SEQ ID NO: 1660748 - RNA, 13 nt, Homo sapiens
ugcugucaugccc

SEQ ID NO: 1660749 - RNA, 16 nt, Homo sapiens
ugcugugaaacagugu

SEQ ID NO: 1660750 - RNA, 14 nt, Homo sapiens
ugcuguugauucuu

SEQ ID NO: 1660751 - RNA, 22 nt, Homo sapiens
ugcuuaacauaaacuuguacuu

SEQ ID NO: 1660752 - RNA, 14 nt, Homo sapiens
ugcuuaguaucuca

SEQ ID NO: 1660753 - RNA, 18 nt, Homo sapiens
ugcuuaguaucucaucaa

SEQ ID NO: 1660754 - RNA, 18 nt, Homo sapiens
ugcuucaaccccaugaga

SEQ ID NO: 1660755 - RNA, 22 nt, Homo sapiens
ugcuuccuucucaucuugccuc

SEQ ID NO: 1660756 - RNA, 23 nt, Homo sapiens
ugcuucucugccgguggggccag

SEQ ID NO: 1660757 - RNA, 15 nt, Homo sapiens
ugcuucucuuucaca

SEQ ID NO: 1660758 - RNA, 19 nt, Homo sapiens
ugcuucuuggagucuucca

SEQ ID NO: 1660759 - RNA, 19 nt, Homo sapiens
ugcuucuuuccucuuaaug

SEQ ID NO: 1660760 - RNA, 19 nt, Homo sapiens
ugcuugaguggacagcagc

SEQ ID NO: 1660761 - RNA, 21 nt, Homo sapiens
ugcuugaguggacagcagcug

SEQ ID NO: 1660762 - RNA, 17 nt, Homo sapiens
ugcuugggaucuucaau

SEQ ID NO: 1660763 - RNA, 19 nt, Homo sapiens
ugcuugguccgacaugccu

SEQ ID NO: 1660764 - RNA, 20 nt, Homo sapiens
ugcuugugcacuggaugugg

SEQ ID NO: 1660765 - RNA, 19 nt, Homo sapiens
ugcuuguguguaugucuau

SEQ ID NO: 1660766 - RNA, 20 nt, Homo sapiens
ugcuuucucuucuacuucuu

SEQ ID NO: 1660767 - RNA, 19 nt, Homo sapiens
ugcuuucuuaucccaguga

SEQ ID NO: 1660768 - RNA, 19 nt, Homo sapiens
ugcuuucuuguugcugcau

SEQ ID NO: 1660769 - RNA, 17 nt, Homo sapiens
ugcuuugagaaaucuca

SEQ ID NO: 1660770 - RNA, 20 nt, Homo sapiens
uggaaaaaugccaucaaaug

SEQ ID NO: 1660771 - RNA, 22 nt, Homo sapiens
uggaaaauaauaaaagaaucau

SEQ ID NO: 1660772 - RNA, 13 nt, Homo sapiens
uggaaaaugauua

SEQ ID NO: 1660773 - RNA, 13 nt, Homo sapiens
uggaaacaucuga

SEQ ID NO: 1660774 - RNA, 23 nt, Homo sapiens
uggaaaccuugcugcuaugcugu

SEQ ID NO: 1660775 - RNA, 13 nt, Homo sapiens
uggaaacugucaa

SEQ ID NO: 1660776 - RNA, 12 nt, Homo sapiens
uggaaagccagg

SEQ ID NO: 1660777 - RNA, 20 nt, Homo sapiens
uggaaauaacugagcacuuu

SEQ ID NO: 1660778 - RNA, 22 nt, Homo sapiens
uggaaauaacugagcacuuuga

SEQ ID NO: 1660779 - RNA, 16 nt, Homo sapiens
uggaacugaguguuag

SEQ ID NO: 1660780 - RNA, 18 nt, Homo sapiens
uggaagacagagauggca

SEQ ID NO: 1660781 - RNA, 16 nt, Homo sapiens
uggaagacagcucuua

SEQ ID NO: 1660782 - RNA, 21 nt, Homo sapiens
uggaagagcugcuguauuuga

SEQ ID NO: 1660783 - RNA, 13 nt, Homo sapiens
auauacacaaaga

SEQ ID NO: 1660784 - RNA, 19 nt, Homo sapiens
auauaguguuguguuacaa

SEQ ID NO: 1660785 - RNA, 14 nt, Homo sapiens
auauauaagccaaa

SEQ ID NO: 1660786 - RNA, 18 nt, Homo sapiens
auauauacauauacacaa

SEQ ID NO: 1660787 - RNA, 13 nt, Homo sapiens
auauauauuuauc

SEQ ID NO: 1660788 - RNA, 15 nt, Homo sapiens
auaucgccacugcac

SEQ ID NO: 1660789 - RNA, 20 nt, Homo sapiens
auaucuuugagggcugacaa

SEQ ID NO: 1660790 - RNA, 14 nt, Homo sapiens
auaugaaagucuua

SEQ ID NO: 1660791 - RNA, 19 nt, Homo sapiens
auaugagcaugcucccuca

SEQ ID NO: 1660792 - RNA, 13 nt, Homo sapiens
auaugagucacug

SEQ ID NO: 1660793 - RNA, 21 nt, Homo sapiens
auaugauaaauuugacuguua

SEQ ID NO: 1660794 - RNA, 13 nt, Homo sapiens
auaugcacuugaa

SEQ ID NO: 1660795 - RNA, 15 nt, Homo sapiens
auaugcuuuuuugca

SEQ ID NO: 1660796 - RNA, 16 nt, Homo sapiens
auauggaaauccuguu

SEQ ID NO: 1660797 - RNA, 14 nt, Homo sapiens
auaugggaggaaca

SEQ ID NO: 1660798 - RNA, 21 nt, Homo sapiens
auauguaauauauacauauuc

SEQ ID NO: 1660799 - RNA, 18 nt, Homo sapiens
auaugugaagacagagca

SEQ ID NO: 1660800 - RNA, 13 nt, Homo sapiens
auauguugcugaa

SEQ ID NO: 1660801 - RNA, 18 nt, Homo sapiens
auauucaacagcucacca

SEQ ID NO: 1660802 - RNA, 12 nt, Homo sapiens
auauucccaugg

SEQ ID NO: 1660803 - RNA, 17 nt, Homo sapiens
auauucuguaguauuuu

SEQ ID NO: 1660804 - RNA, 21 nt, Homo sapiens
auauugagcagaauucauuca

SEQ ID NO: 1660805 - RNA, 17 nt, Homo sapiens
auauugccauuucuucc

SEQ ID NO: 1660806 - RNA, 20 nt, Homo sapiens
auauugcuuggacuaccuau

SEQ ID NO: 1660807 - RNA, 21 nt, Homo sapiens
auauuuauuauuuucauauaa

SEQ ID NO: 1660808 - RNA, 20 nt, Homo sapiens
auauuucucauuuagcauug

SEQ ID NO: 1660809 - RNA, 13 nt, Homo sapiens
auauuuguuccca

SEQ ID NO: 1660810 - RNA, 12 nt, Homo sapiens
aucaaacagaaa

SEQ ID NO: 1660811 - RNA, 18 nt, Homo sapiens
aucaaacgcagacacugu

SEQ ID NO: 1660812 - RNA, 19 nt, Homo sapiens
aucaaacgcagacacugua

SEQ ID NO: 1660813 - RNA, 20 nt, Homo sapiens
aucaagaaacauucagacca

SEQ ID NO: 1660814 - RNA, 15 nt, Homo sapiens
aucaagaugugacau

SEQ ID NO: 1660815 - RNA, 17 nt, Homo sapiens
aucaagcuccaucuuau

SEQ ID NO: 1660816 - RNA, 19 nt, Homo sapiens
aucaaggugcucuucucau

SEQ ID NO: 1660817 - RNA, 21 nt, Homo sapiens
aucaauacccuugugauuucu

SEQ ID NO: 1660818 - RNA, 22 nt, Homo sapiens
aucaauuuaaaggaaaguucua

SEQ ID NO: 1660819 - RNA, 20 nt, Homo sapiens
aucaccugccaaaugaauaa

SEQ ID NO: 1660820 - RNA, 17 nt, Homo sapiens
aucacuauugcuuccua

SEQ ID NO: 1660821 - RNA, 19 nt, Homo sapiens
aucacucauuuauuuccau

SEQ ID NO: 1660822 - RNA, 18 nt, Homo sapiens
aucagacugcuuugagaa

SEQ ID NO: 1660823 - RNA, 14 nt, Homo sapiens
aucagaggugaaug

SEQ ID NO: 1660824 - RNA, 12 nt, Homo sapiens
aucagcacugaa

SEQ ID NO: 1660825 - RNA, 16 nt, Homo sapiens
aucagcucuaaagcag

SEQ ID NO: 1660826 - RNA, 22 nt, Homo sapiens
aucagcuuuauaauaaacuguu

SEQ ID NO: 1660827 - RNA, 19 nt, Homo sapiens
aucaguaaaauuauacugu

SEQ ID NO: 1660828 - RNA, 20 nt, Homo sapiens
aucaguccacccccauugug

SEQ ID NO: 1660829 - RNA, 12 nt, Homo sapiens
aucagugcagua

SEQ ID NO: 1660830 - RNA, 15 nt, Homo sapiens
aucauagcugacuca

SEQ ID NO: 1660831 - RNA, 22 nt, Homo sapiens
aucauauaugcuuuuuugcaau

SEQ ID NO: 1660832 - RNA, 14 nt, Homo sapiens
aucaugcaugcacu

SEQ ID NO: 1660833 - RNA, 24 nt, Homo sapiens
aucaugcuucuacuccauggugaa

SEQ ID NO: 1660834 - RNA, 21 nt, Homo sapiens
aucauguugaauaaugcuguu

SEQ ID NO: 1660835 - RNA, 21 nt, Homo sapiens
aucauucauucauucaccuaa

SEQ ID NO: 1660836 - RNA, 23 nt, Homo sapiens
aucauugagaaauaaagcacauu

SEQ ID NO: 1660837 - RNA, 12 nt, Homo sapiens
auccaacgugaa

SEQ ID NO: 1660838 - RNA, 22 nt, Homo sapiens
auccaagaccuuacaaccacau

SEQ ID NO: 1660839 - RNA, 22 nt, Homo sapiens
auccaagcccagccuaucucuc

SEQ ID NO: 1660840 - RNA, 16 nt, Homo sapiens
auccacacacagcagc

SEQ ID NO: 1660841 - RNA, 16 nt, Homo sapiens
auccagagagaagcac

SEQ ID NO: 1660842 - RNA, 20 nt, Homo sapiens
auccauagacacaguauuga

SEQ ID NO: 1660843 - RNA, 14 nt, Homo sapiens
auccauaucagcuc

SEQ ID NO: 1660844 - RNA, 18 nt, Homo sapiens
auccauaucagcucugca

SEQ ID NO: 1660845 - RNA, 21 nt, Homo sapiens
auccauccuuuugcuucaucu

SEQ ID NO: 1660846 - RNA, 20 nt, Homo sapiens
auccaugugcugcuguggca

SEQ ID NO: 1660847 - RNA, 21 nt, Homo sapiens
auccaugugcugcuguggcau

SEQ ID NO: 1660848 - RNA, 23 nt, Homo sapiens
auccaugugcugcuguggcauca

SEQ ID NO: 1660849 - RNA, 21 nt, Homo sapiens
auccauguguccccccugugg

SEQ ID NO: 1660850 - RNA, 23 nt, Homo sapiens
auccauuuccaaaccuccacugc

SEQ ID NO: 1660851 - RNA, 13 nt, Homo sapiens
aucccauacucuc

SEQ ID NO: 1660852 - RNA, 16 nt, Homo sapiens
aucccauacucucaau

SEQ ID NO: 1660853 - RNA, 13 nt, Homo sapiens
aucccauuccugg

SEQ ID NO: 1660854 - RNA, 23 nt, Homo sapiens
aucccuguucauuguaagcacuu

SEQ ID NO: 1660855 - RNA, 20 nt, Homo sapiens
aucccuucacaaaauuuugu

SEQ ID NO: 1660856 - RNA, 19 nt, Homo sapiens
auccuaugguaacugauga

SEQ ID NO: 1660857 - RNA, 13 nt, Homo sapiens
auccucacacaga

SEQ ID NO: 1660858 - RNA, 21 nt, Homo sapiens
auccucugacagcuguccuga

SEQ ID NO: 1660859 - RNA, 17 nt, Homo sapiens
auccugacaaaagggac

SEQ ID NO: 1660860 - RNA, 16 nt, Homo sapiens
auccugcaaugggaga

SEQ ID NO: 1660861 - RNA, 14 nt, Homo sapiens
auccuuuugcuuca

SEQ ID NO: 1660862 - RNA, 13 nt, Homo sapiens
aucuacaacauaa

SEQ ID NO: 1660863 - RNA, 22 nt, Homo sapiens
aucuagucaagcgauugucuga

SEQ ID NO: 1660864 - RNA, 18 nt, Homo sapiens
aucuauauauaagcucau

SEQ ID NO: 1660865 - RNA, 17 nt, Homo sapiens
aucuauauuuguuccca

SEQ ID NO: 1660866 - RNA, 20 nt, Homo sapiens
aucuauggauuggguaucaa

SEQ ID NO: 1660867 - RNA, 21 nt, Homo sapiens
aucuauuuaucugucugagcc

SEQ ID NO: 1660868 - RNA, 17 nt, Homo sapiens
aucucaacaaaucucag

SEQ ID NO: 1660869 - RNA, 15 nt, Homo sapiens
aucucaagugccaua

SEQ ID NO: 1660870 - RNA, 16 nt, Homo sapiens
aucucagcaaucacaa

SEQ ID NO: 1660871 - RNA, 13 nt, Homo sapiens
aucucagcucacu

SEQ ID NO: 1660872 - RNA, 17 nt, Homo sapiens
aucucagcucacugcaa

SEQ ID NO: 1660873 - RNA, 12 nt, Homo sapiens
aucucaggucuu

SEQ ID NO: 1660874 - RNA, 21 nt, Homo sapiens
aucucgcacuacaucugauau

SEQ ID NO: 1660875 - RNA, 23 nt, Homo sapiens
aucucgcacuacaucugauauca

SEQ ID NO: 1660876 - RNA, 17 nt, Homo sapiens
aucucggacuuugcagg

SEQ ID NO: 1660877 - RNA, 13 nt, Homo sapiens
aucucuuccuguc

SEQ ID NO: 1660878 - RNA, 21 nt, Homo sapiens
aucucuucuuauacagauaaa

SEQ ID NO: 1660879 - RNA, 15 nt, Homo sapiens
aucucuucuuccuuu

SEQ ID NO: 1660880 - RNA, 11 nt, Homo sapiens
aucucuuguca

SEQ ID NO: 1660881 - RNA, 12 nt, Homo sapiens
aucucuugucau

SEQ ID NO: 1660882 - RNA, 16 nt, Homo sapiens
aucucuugucauucuc

SEQ ID NO: 1660883 - RNA, 17 nt, Homo sapiens
aucucuugucauucuca

SEQ ID NO: 1660884 - RNA, 18 nt, Homo sapiens
aucucuugucauucucau

SEQ ID NO: 1660885 - RNA, 21 nt, Homo sapiens
aucugauaugaccccaguuca

SEQ ID NO: 1660886 - RNA, 22 nt, Homo sapiens
aucugauaugaccccaguucag

SEQ ID NO: 1660887 - RNA, 15 nt, Homo sapiens
aucugcauaaccgca

SEQ ID NO: 1660888 - RNA, 20 nt, Homo sapiens
aucugcauaaccgcacagac

SEQ ID NO: 1660889 - RNA, 21 nt, Homo sapiens
aucuggccuaugacccugugc

SEQ ID NO: 1660890 - RNA, 14 nt, Homo sapiens
aucuguauaucagc

SEQ ID NO: 1660891 - RNA, 16 nt, Homo sapiens
aucuguauuggcagca

SEQ ID NO: 1660892 - RNA, 12 nt, Homo sapiens
aucuguccaaaa

SEQ ID NO: 1660893 - RNA, 13 nt, Homo sapiens
aucuguccagaca

SEQ ID NO: 1660894 - RNA, 16 nt, Homo sapiens
aucugucucuucuaca

SEQ ID NO: 1660895 - RNA, 20 nt, Homo sapiens
aucugugcagucaucaacaa

SEQ ID NO: 1660896 - RNA, 16 nt, Homo sapiens
aucuguggucuucaaa

SEQ ID NO: 1660897 - RNA, 15 nt, Homo sapiens
aucuguguugucucu

SEQ ID NO: 1660898 - RNA, 18 nt, Homo sapiens
aucuguugggaaccagag

SEQ ID NO: 1660899 - RNA, 17 nt, Homo sapiens
aucuuaaaagcuaucuu

SEQ ID NO: 1660900 - RNA, 14 nt, Homo sapiens
aucuuaagauucca

SEQ ID NO: 1660901 - RNA, 17 nt, Homo sapiens
aucuuaagauuccauuu

SEQ ID NO: 1660902 - RNA, 14 nt, Homo sapiens
aucuuaauguauau

SEQ ID NO: 1660903 - RNA, 11 nt, Homo sapiens
aucuucaauga

SEQ ID NO: 1660904 - RNA, 22 nt, Homo sapiens
aucuucaaugaacugugcuuuu

SEQ ID NO: 1660905 - RNA, 18 nt, Homo sapiens
cacaaaccuucuuuucaa

SEQ ID NO: 1660906 - RNA, 15 nt, Homo sapiens
cacaaacucauccau

SEQ ID NO: 1660907 - RNA, 22 nt, Homo sapiens
cacaaacucuguacagcaaggu

SEQ ID NO: 1660908 - RNA, 16 nt, Homo sapiens
cacaacuccaguguuc

SEQ ID NO: 1660909 - RNA, 16 nt, Homo sapiens
cacaacuuugcuuuua

SEQ ID NO: 1660910 - RNA, 16 nt, Homo sapiens
cacaagggcaguggaa

SEQ ID NO: 1660911 - RNA, 14 nt, Homo sapiens
cacaaggggcucca

SEQ ID NO: 1660912 - RNA, 21 nt, Homo sapiens
cacaagguugcuggcauuugc

SEQ ID NO: 1660913 - RNA, 23 nt, Homo sapiens
cacaagguugcuggcauuugcug

SEQ ID NO: 1660914 - RNA, 14 nt, Homo sapiens
cacaaguauuacac

SEQ ID NO: 1660915 - RNA, 21 nt, Homo sapiens
cacaaguauugcccuuuaaca

SEQ ID NO: 1660916 - RNA, 22 nt, Homo sapiens
cacaauaaaagaaacugugguc

SEQ ID NO: 1660917 - RNA, 15 nt, Homo sapiens
cacaauacaguacuc

SEQ ID NO: 1660918 - RNA, 23 nt, Homo sapiens
cacaauauuaaguguuguacaau

SEQ ID NO: 1660919 - RNA, 15 nt, Homo sapiens
cacaauuuugucucu

SEQ ID NO: 1660920 - RNA, 23 nt, Homo sapiens
cacacaaagugaaauuaguauuu

SEQ ID NO: 1660921 - RNA, 16 nt, Homo sapiens
cacacacacacacaaa

SEQ ID NO: 1660922 - RNA, 14 nt, Homo sapiens
cacacacacacaua

SEQ ID NO: 1660923 - RNA, 16 nt, Homo sapiens
cacacacuucuuccaa

SEQ ID NO: 1660924 - RNA, 14 nt, Homo sapiens
cacacacuuuugca

SEQ ID NO: 1660925 - RNA, 21 nt, Homo sapiens
cacacaggccuggcccagcca

SEQ ID NO: 1660926 - RNA, 14 nt, Homo sapiens
cacacccauucaca

SEQ ID NO: 1660927 - RNA, 17 nt, Homo sapiens
cacacccccuuuccauc

SEQ ID NO: 1660928 - RNA, 20 nt, Homo sapiens
cacagaaaauggaagacagc

SEQ ID NO: 1660929 - RNA, 21 nt, Homo sapiens
cacagauggaaucuuguuuaa

SEQ ID NO: 1660930 - RNA, 13 nt, Homo sapiens
cacagauuuccaa

SEQ ID NO: 1660931 - RNA, 15 nt, Homo sapiens
cacagcaugcauuua

SEQ ID NO: 1660932 - RNA, 15 nt, Homo sapiens
cacagcuaacaugga

SEQ ID NO: 1660933 - RNA, 23 nt, Homo sapiens
cacagcuaacauggaaguacuau

SEQ ID NO: 1660934 - RNA, 19 nt, Homo sapiens
cacagcugggguggggacc

SEQ ID NO: 1660935 - RNA, 17 nt, Homo sapiens
cacaggagcguguccua

SEQ ID NO: 1660936 - RNA, 14 nt, Homo sapiens
cacagggacacagu

SEQ ID NO: 1660937 - RNA, 16 nt, Homo sapiens
cacagggcuagaagca

SEQ ID NO: 1660938 - RNA, 15 nt, Homo sapiens
cacaggguguuggaa

SEQ ID NO: 1660939 - RNA, 12 nt, Homo sapiens
cacaggucccac

SEQ ID NO: 1660940 - RNA, 22 nt, Homo sapiens
cacagucuggugcccagacuca

SEQ ID NO: 1660941 - RNA, 20 nt, Homo sapiens
cacagugaaaccccgucucu

SEQ ID NO: 1660942 - RNA, 21 nt, Homo sapiens
cacauagauucaccuguaaaa

SEQ ID NO: 1660943 - RNA, 16 nt, Homo sapiens
cacauaguguuuguaa

SEQ ID NO: 1660944 - RNA, 20 nt, Homo sapiens
cacauccugaaaaggguguu

SEQ ID NO: 1660945 - RNA, 23 nt, Homo sapiens
cacauguagaauuauaacuaauu

SEQ ID NO: 1660946 - RNA, 23 nt, Homo sapiens
caccaacaacagucagccagcuu

SEQ ID NO: 1660947 - RNA, 15 nt, Homo sapiens
caccaagcucugucc

SEQ ID NO: 1660948 - RNA, 20 nt, Homo sapiens
caccaagcucuguccaauca

SEQ ID NO: 1660949 - RNA, 21 nt, Homo sapiens
caccaagcucuguccaaucag

SEQ ID NO: 1660950 - RNA, 20 nt, Homo sapiens
caccaagcugcucuccuuca

SEQ ID NO: 1660951 - RNA, 13 nt, Homo sapiens
caccaccuugcca

SEQ ID NO: 1660952 - RNA, 16 nt, Homo sapiens
caccacgccuggcuaa

SEQ ID NO: 1660953 - RNA, 15 nt, Homo sapiens
caccacuuugucucu

SEQ ID NO: 1660954 - RNA, 16 nt, Homo sapiens
caccagcuaucuguca

SEQ ID NO: 1660955 - RNA, 13 nt, Homo sapiens
caccaugaucacu

SEQ ID NO: 1660956 - RNA, 11 nt, Homo sapiens
caccauucacc

SEQ ID NO: 1660957 - RNA, 17 nt, Homo sapiens
caccauucgucaucacu

SEQ ID NO: 1660958 - RNA, 19 nt, Homo sapiens
cacccagcgcccucuaccu

SEQ ID NO: 1660959 - RNA, 19 nt, Homo sapiens
cacccagguuggagugcag

SEQ ID NO: 1660960 - RNA, 12 nt, Homo sapiens
cacccauucaca

SEQ ID NO: 1660961 - RNA, 21 nt, Homo sapiens
caccccgucguauacccugga

SEQ ID NO: 1660962 - RNA, 13 nt, Homo sapiens
cacccuuuccucu

SEQ ID NO: 1660963 - RNA, 12 nt, Homo sapiens
caccgcauucca

SEQ ID NO: 1660964 - RNA, 16 nt, Homo sapiens
caccucuuucuucaau

SEQ ID NO: 1660965 - RNA, 14 nt, Homo sapiens
caccucuuugucac

SEQ ID NO: 1660966 - RNA, 18 nt, Homo sapiens
caccugccaaaugaauaa

SEQ ID NO: 1660967 - RNA, 21 nt, Homo sapiens
caccuggaggaacugcuugug

SEQ ID NO: 1660968 - RNA, 18 nt, Homo sapiens
caccuuugggcaaaggcc

SEQ ID NO: 1660969 - RNA, 15 nt, Homo sapiens
cacgauggucuccau

SEQ ID NO: 1660970 - RNA, 19 nt, Homo sapiens
cacgccacaacuccagugu

SEQ ID NO: 1660971 - RNA, 20 nt, Homo sapiens
cacgccgauauaagccauag

SEQ ID NO: 1660972 - RNA, 21 nt, Homo sapiens
cacgccugguucuguacaugu

SEQ ID NO: 1660973 - RNA, 21 nt, Homo sapiens
cacgcguccacauacacugca

SEQ ID NO: 1660974 - RNA, 22 nt, Homo sapiens
cacggccgucucugauucuccc

SEQ ID NO: 1660975 - RNA, 16 nt, Homo sapiens
cacggcuuauaccagg

SEQ ID NO: 1660976 - RNA, 20 nt, Homo sapiens
cacgucccucgagcucugua

SEQ ID NO: 1660977 - RNA, 19 nt, Homo sapiens
cacguggccgcugcuguga

SEQ ID NO: 1660978 - RNA, 13 nt, Homo sapiens
cacuaacugagga

SEQ ID NO: 1660979 - RNA, 21 nt, Homo sapiens
cacucaggagcacagccauag

SEQ ID NO: 1660980 - RNA, 19 nt, Homo sapiens
cacucauuuauuuccauau

SEQ ID NO: 1660981 - RNA, 15 nt, Homo sapiens
cacuccccucaucca

SEQ ID NO: 1660982 - RNA, 14 nt, Homo sapiens
cacucgugugcaug

SEQ ID NO: 1660983 - RNA, 21 nt, Homo sapiens
cacucuuuugagcaguaaaug

SEQ ID NO: 1660984 - RNA, 23 nt, Homo sapiens
cacugaguagucauuuugcccau

SEQ ID NO: 1660985 - RNA, 15 nt, Homo sapiens
cacugauuuuguaca

SEQ ID NO: 1660986 - RNA, 16 nt, Homo sapiens
cacugcaacccaugag

SEQ ID NO: 1660987 - RNA, 15 nt, Homo sapiens
cacugcacccuccac

SEQ ID NO: 1660988 - RNA, 20 nt, Homo sapiens
cacugccccagacacagugc

SEQ ID NO: 1660989 - RNA, 9 nt, Homo sapiens
cacugccuc

SEQ ID NO: 1660990 - RNA, 15 nt, Homo sapiens
cacugcgaccacaag

SEQ ID NO: 1660991 - RNA, 15 nt, Homo sapiens
cacuggccuugccuc

SEQ ID NO: 1660992 - RNA, 21 nt, Homo sapiens
cacuggcuuuggguagugcca

SEQ ID NO: 1660993 - RNA, 22 nt, Homo sapiens
cacuggcuuuggguagugccau

SEQ ID NO: 1660994 - RNA, 21 nt, Homo sapiens
cacugucccggagcucaggcc

SEQ ID NO: 1660995 - RNA, 17 nt, Homo sapiens
cacugugaacuaaugac

SEQ ID NO: 1660996 - RNA, 13 nt, Homo sapiens
cacugugucucau

SEQ ID NO: 1660997 - RNA, 23 nt, Homo sapiens
cacuguuuuauuuuaauucaguu

SEQ ID NO: 1660998 - RNA, 15 nt, Homo sapiens
cacuuaaacuuuguc

SEQ ID NO: 1660999 - RNA, 19 nt, Homo sapiens
cacuuaucaguuugcuaau

SEQ ID NO: 1661000 - RNA, 21 nt, Homo sapiens
cacuucaggguucuaaccuuu

SEQ ID NO: 1661001 - RNA, 14 nt, Homo sapiens
cacuucaguuccuu

SEQ ID NO: 1661002 - RNA, 19 nt, Homo sapiens
cacuucuaguuuggcauuu

SEQ ID NO: 1661003 - RNA, 21 nt, Homo sapiens
cacuucuaguuuggcauuuca

SEQ ID NO: 1661004 - RNA, 17 nt, Homo sapiens
cacuugccuugugauau

SEQ ID NO: 1661005 - RNA, 19 nt, Homo sapiens
cacuugggauugucuuacu

SEQ ID NO: 1661006 - RNA, 13 nt, Homo sapiens
cacuuuacauucu

SEQ ID NO: 1661007 - RNA, 22 nt, Homo sapiens
cagaaaaaaauaaaaacauaaa

SEQ ID NO: 1661008 - RNA, 15 nt, Homo sapiens
cagaaauccauuuga

SEQ ID NO: 1661009 - RNA, 23 nt, Homo sapiens
cagaaauugaccugauuuccauu

SEQ ID NO: 1661010 - RNA, 20 nt, Homo sapiens
cagaaauuuuaagccaaaaa

SEQ ID NO: 1661011 - RNA, 15 nt, Homo sapiens
cagaaccuagucuug

SEQ ID NO: 1661012 - RNA, 14 nt, Homo sapiens
cagaacuccuuucu

SEQ ID NO: 1661013 - RNA, 20 nt, Homo sapiens
cagaagaaagauugcuauaa

SEQ ID NO: 1661014 - RNA, 23 nt, Homo sapiens
cagaagauuagcaugaaagcagu

SEQ ID NO: 1661015 - RNA, 18 nt, Homo sapiens
cagaagcaguugcaauaa

SEQ ID NO: 1661016 - RNA, 19 nt, Homo sapiens
cagaaugagccagaguuca

SEQ ID NO: 1661017 - RNA, 13 nt, Homo sapiens
cagaaugugcaaa

SEQ ID NO: 1661018 - RNA, 19 nt, Homo sapiens
cagaauguguuauuuguca

SEQ ID NO: 1661019 - RNA, 15 nt, Homo sapiens
cagacaaauguaaca

SEQ ID NO: 1661020 - RNA, 12 nt, Homo sapiens
cagacaccauca

SEQ ID NO: 1661021 - RNA, 23 nt, Homo sapiens
cagacacuguagucagaccucag

SEQ ID NO: 1661022 - RNA, 18 nt, Homo sapiens
cagacauacgaaacacaa

SEQ ID NO: 1661023 - RNA, 19 nt, Homo sapiens
cagaccacaaaauguaaua

SEQ ID NO: 1661024 - RNA, 18 nt, Homo sapiens
cagaccuaagaaauagca

SEQ ID NO: 1661025 - RNA, 20 nt, Homo sapiens
cagacguggugcuucucaca

SEQ ID NO: 1661026 - RNA, 17 nt, Homo sapiens
caugaagauaaauccaa

SEQ ID NO: 1661027 - RNA, 19 nt, Homo sapiens
caugaaggucuaccugaaa

SEQ ID NO: 1661028 - RNA, 19 nt, Homo sapiens
caugaaucacugcaccucu

SEQ ID NO: 1661029 - RNA, 18 nt, Homo sapiens
caugacauccacaugcac

SEQ ID NO: 1661030 - RNA, 20 nt, Homo sapiens
caugacuauuguaacuagau

SEQ ID NO: 1661031 - RNA, 21 nt, Homo sapiens
caugacucuuuauugucugua

SEQ ID NO: 1661032 - RNA, 23 nt, Homo sapiens
caugacuucuuuacuaacacugg

SEQ ID NO: 1661033 - RNA, 23 nt, Homo sapiens
caugaggugagagaaagccacaa

SEQ ID NO: 1661034 - RNA, 14 nt, Homo sapiens
caugauugcccaau

SEQ ID NO: 1661035 - RNA, 18 nt, Homo sapiens
caugcacacccauucaca

SEQ ID NO: 1661036 - RNA, 20 nt, Homo sapiens
caugcacucuuuugagcagu

SEQ ID NO: 1661037 - RNA, 12 nt, Homo sapiens
caugcacugacc

SEQ ID NO: 1661038 - RNA, 13 nt, Homo sapiens
caugcacugaccc

SEQ ID NO: 1661039 - RNA, 20 nt, Homo sapiens
caugcauggccucccagcca

SEQ ID NO: 1661040 - RNA, 21 nt, Homo sapiens
caugcccagcuuggagugcca

SEQ ID NO: 1661041 - RNA, 13 nt, Homo sapiens
caugccucugaua

SEQ ID NO: 1661042 - RNA, 20 nt, Homo sapiens
caugccucugauaugggacu

SEQ ID NO: 1661043 - RNA, 20 nt, Homo sapiens
caugccuuuccagugcugcu

SEQ ID NO: 1661044 - RNA, 15 nt, Homo sapiens
caugcgcagucccca

SEQ ID NO: 1661045 - RNA, 14 nt, Homo sapiens
caugcucaaugaaa

SEQ ID NO: 1661046 - RNA, 18 nt, Homo sapiens
cauggaugauucuuuucc

SEQ ID NO: 1661047 - RNA, 14 nt, Homo sapiens
caugggagguccug

SEQ ID NO: 1661048 - RNA, 15 nt, Homo sapiens
caugggcaaagccau

SEQ ID NO: 1661049 - RNA, 17 nt, Homo sapiens
caugguagacugugaca

SEQ ID NO: 1661050 - RNA, 22 nt, Homo sapiens
caugguagacugugacacagcu

SEQ ID NO: 1661051 - RNA, 19 nt, Homo sapiens
caugguguguguucagcuc

SEQ ID NO: 1661052 - RNA, 13 nt, Homo sapiens
cauguagcauaua

SEQ ID NO: 1661053 - RNA, 13 nt, Homo sapiens
cauguaugccaug

SEQ ID NO: 1661054 - RNA, 17 nt, Homo sapiens
caugugauguguugcuc

SEQ ID NO: 1661055 - RNA, 16 nt, Homo sapiens
caugugccugaaggcu

SEQ ID NO: 1661056 - RNA, 23 nt, Homo sapiens
cauguguccccucacucugucag

SEQ ID NO: 1661057 - RNA, 16 nt, Homo sapiens
cauguguguucaugca

SEQ ID NO: 1661058 - RNA, 18 nt, Homo sapiens
cauguguguucaugcaca

SEQ ID NO: 1661059 - RNA, 11 nt, Homo sapiens
cauguucugug

SEQ ID NO: 1661060 - RNA, 23 nt, Homo sapiens
cauguugacauaugucuaugucc

SEQ ID NO: 1661061 - RNA, 17 nt, Homo sapiens
cauguugcuaaugacag

SEQ ID NO: 1661062 - RNA, 18 nt, Homo sapiens
cauuaaccaagaaaacca

SEQ ID NO: 1661063 - RNA, 17 nt, Homo sapiens
cauuaagagauuuucaa

SEQ ID NO: 1661064 - RNA, 19 nt, Homo sapiens
cauuacacgccacaacucc

SEQ ID NO: 1661065 - RNA, 20 nt, Homo sapiens
cauuagacacacauauacau

SEQ ID NO: 1661066 - RNA, 16 nt, Homo sapiens
cauuaggaacagagua

SEQ ID NO: 1661067 - RNA, 18 nt, Homo sapiens
cauuaggaacagaguaua

SEQ ID NO: 1661068 - RNA, 20 nt, Homo sapiens
cauuagugccauagaguuua

SEQ ID NO: 1661069 - RNA, 21 nt, Homo sapiens
cauuauagauuuucauguucu

SEQ ID NO: 1661070 - RNA, 17 nt, Homo sapiens
cauuauuggacuuccau

SEQ ID NO: 1661071 - RNA, 13 nt, Homo sapiens
cauucacuacugc

SEQ ID NO: 1661072 - RNA, 19 nt, Homo sapiens
cauuccuguucccaugaga

SEQ ID NO: 1661073 - RNA, 15 nt, Homo sapiens
cauucuaugacaaua

SEQ ID NO: 1661074 - RNA, 19 nt, Homo sapiens
cauucuaugacucuugucu

SEQ ID NO: 1661075 - RNA, 20 nt, Homo sapiens
cauucuccagggguuuacag

SEQ ID NO: 1661076 - RNA, 20 nt, Homo sapiens
cauucugaaggccuuguuaa

SEQ ID NO: 1661077 - RNA, 22 nt, Homo sapiens
cauugcuggacugaugguugcu

SEQ ID NO: 1661078 - RNA, 21 nt, Homo sapiens
cauugggaggaagcacagauc

SEQ ID NO: 1661079 - RNA, 22 nt, Homo sapiens
cauuggggugguugucauguga

SEQ ID NO: 1661080 - RNA, 20 nt, Homo sapiens
cauugguuuaagcccagaga

SEQ ID NO: 1661081 - RNA, 16 nt, Homo sapiens
cauuguagccuaauau

SEQ ID NO: 1661082 - RNA, 21 nt, Homo sapiens
cauuguagccuaauauucaug

SEQ ID NO: 1661083 - RNA, 15 nt, Homo sapiens
cauugucugucugca

SEQ ID NO: 1661084 - RNA, 19 nt, Homo sapiens
cauuguguacaaaauaucc

SEQ ID NO: 1661085 - RNA, 18 nt, Homo sapiens
cauuuaaaaagguuuaaa

SEQ ID NO: 1661086 - RNA, 22 nt, Homo sapiens
cauuuaacugccuuacagacag

SEQ ID NO: 1661087 - RNA, 20 nt, Homo sapiens
cauuuaaugaguuuuaucuu

SEQ ID NO: 1661088 - RNA, 21 nt, Homo sapiens
cauuuaggaaagcagugcagu

SEQ ID NO: 1661089 - RNA, 22 nt, Homo sapiens
cauuuaggaaagcagugcagua

SEQ ID NO: 1661090 - RNA, 21 nt, Homo sapiens
cauuuaggugaggaagcaaaa

SEQ ID NO: 1661091 - RNA, 19 nt, Homo sapiens
cauuuauuuacaugugauu

SEQ ID NO: 1661092 - RNA, 14 nt, Homo sapiens
cauuucagcuguga

SEQ ID NO: 1661093 - RNA, 13 nt, Homo sapiens
cauuucuguaacc

SEQ ID NO: 1661094 - RNA, 18 nt, Homo sapiens
cauuucuugguaugauca

SEQ ID NO: 1661095 - RNA, 18 nt, Homo sapiens
cauuugauuugauauaca

SEQ ID NO: 1661096 - RNA, 11 nt, Homo sapiens
cauuugcugca

SEQ ID NO: 1661097 - RNA, 20 nt, Homo sapiens
cauuugggauuuucuuugcc

SEQ ID NO: 1661098 - RNA, 17 nt, Homo sapiens
cauuuuuaaguauuuca

SEQ ID NO: 1661099 - RNA, 14 nt, Homo sapiens
cauuuuuauauuca

SEQ ID NO: 1661100 - RNA, 20 nt, Homo sapiens
ccaaacaacagucuucauuu

SEQ ID NO: 1661101 - RNA, 16 nt, Homo sapiens
ccaaacagcaugugcu

SEQ ID NO: 1661102 - RNA, 18 nt, Homo sapiens
ccaaacagcaugugcuca

SEQ ID NO: 1661103 - RNA, 16 nt, Homo sapiens
ccaaacaugaauguac

SEQ ID NO: 1661104 - RNA, 15 nt, Homo sapiens
ccaaacucaccugcc

SEQ ID NO: 1661105 - RNA, 22 nt, Homo sapiens
ccaaacuguaguaauuguuaca

SEQ ID NO: 1661106 - RNA, 12 nt, Homo sapiens
ccaaagaucuca

SEQ ID NO: 1661107 - RNA, 22 nt, Homo sapiens
ccaaagcaugauugugaccucc

SEQ ID NO: 1661108 - RNA, 16 nt, Homo sapiens
ccaaauaaauuuauaa

SEQ ID NO: 1661109 - RNA, 19 nt, Homo sapiens
ccaaauauaaacuugugua

SEQ ID NO: 1661110 - RNA, 14 nt, Homo sapiens
ccaaaucucaaaag

SEQ ID NO: 1661111 - RNA, 22 nt, Homo sapiens
ccaacaggcuguucugcacuga

SEQ ID NO: 1661112 - RNA, 23 nt, Homo sapiens
ccaacaggcuguucugcacugaa

SEQ ID NO: 1661113 - RNA, 13 nt, Homo sapiens
ccaaccccagcaa

SEQ ID NO: 1661114 - RNA, 16 nt, Homo sapiens
ccaacgcacaggaaaa

SEQ ID NO: 1661115 - RNA, 15 nt, Homo sapiens
ccaacuacagaaaga

SEQ ID NO: 1661116 - RNA, 23 nt, Homo sapiens
ccaacugcugcuuaaaaugcaag

SEQ ID NO: 1661117 - RNA, 17 nt, Homo sapiens
ccaagaauucuccaaaa

SEQ ID NO: 1661118 - RNA, 19 nt, Homo sapiens
ccaagagccugagugacag

SEQ ID NO: 1661119 - RNA, 22 nt, Homo sapiens
ccaagagccugagugacagagc

SEQ ID NO: 1661120 - RNA, 20 nt, Homo sapiens
ccaagaggaaaauauugaca

SEQ ID NO: 1661121 - RNA, 17 nt, Homo sapiens
ccaagaguuugagacca

SEQ ID NO: 1661122 - RNA, 18 nt, Homo sapiens
ccaagcaggcaaggcaag

SEQ ID NO: 1661123 - RNA, 21 nt, Homo sapiens
ccaagcucacagccagcuccu

SEQ ID NO: 1661124 - RNA, 19 nt, Homo sapiens
ccaagcucuguccaaucag

SEQ ID NO: 1661125 - RNA, 14 nt, Homo sapiens
ccaaggagaaggca

SEQ ID NO: 1661126 - RNA, 13 nt, Homo sapiens
ccaaggaguggaa

SEQ ID NO: 1661127 - RNA, 15 nt, Homo sapiens
ccaaggccaaaggaa

SEQ ID NO: 1661128 - RNA, 19 nt, Homo sapiens
ccaaggccagcccacacag

SEQ ID NO: 1661129 - RNA, 15 nt, Homo sapiens
ccaagggcagaucac

SEQ ID NO: 1661130 - RNA, 14 nt, Homo sapiens
ccaagggucuuccu

SEQ ID NO: 1661131 - RNA, 23 nt, Homo sapiens
ccaaguagcugggacuacaggcg

SEQ ID NO: 1661132 - RNA, 20 nt, Homo sapiens
ccaagucucucuaagacaaa

SEQ ID NO: 1661133 - RNA, 16 nt, Homo sapiens
ccaagugcuaugacag

SEQ ID NO: 1661134 - RNA, 20 nt, Homo sapiens
ccaagugcuaugacagaggu

SEQ ID NO: 1661135 - RNA, 21 nt, Homo sapiens
ccaaguguacauuugauuuga

SEQ ID NO: 1661136 - RNA, 18 nt, Homo sapiens
ccaagugugugugcaaug

SEQ ID NO: 1661137 - RNA, 14 nt, Homo sapiens
ccaauaaagcucac

SEQ ID NO: 1661138 - RNA, 23 nt, Homo sapiens
ccaauacauuauuggacuuccau

SEQ ID NO: 1661139 - RNA, 18 nt, Homo sapiens
ccaaucagaucaacucug

SEQ ID NO: 1661140 - RNA, 18 nt, Homo sapiens
ccaaucccauuccugggc

SEQ ID NO: 1661141 - RNA, 17 nt, Homo sapiens
ccaaugaaaacaguccc

SEQ ID NO: 1661142 - RNA, 19 nt, Homo sapiens
ccaaugguguagcuguccu

SEQ ID NO: 1661143 - RNA, 11 nt, Homo sapiens
ccaauguuuca

SEQ ID NO: 1661144 - RNA, 18 nt, Homo sapiens
ccacaacugacacaggaa

SEQ ID NO: 1661145 - RNA, 21 nt, Homo sapiens
ccacaauaagccacugguauc

SEQ ID NO: 1661146 - RNA, 14 nt, Homo sapiens
ccacacaccacaga

SEQ ID NO: 1661147 - RNA, 15 nt, Homo sapiens
uaucgccuuuugaca

SEQ ID NO: 1661148 - RNA, 20 nt, Homo sapiens
uaucuaguaggucugcacac

SEQ ID NO: 1661149 - RNA, 13 nt, Homo sapiens
uaucucaugacaa

SEQ ID NO: 1661150 - RNA, 15 nt, Homo sapiens
uaucucccacaaaua

SEQ ID NO: 1661151 - RNA, 15 nt, Homo sapiens
uaucugaacucacag

SEQ ID NO: 1661152 - RNA, 14 nt, Homo sapiens
uaucugucaucucu

SEQ ID NO: 1661153 - RNA, 13 nt, Homo sapiens
uaucugugcuuug

SEQ ID NO: 1661154 - RNA, 22 nt, Homo sapiens
uaucuguucuauggaccaaaug

SEQ ID NO: 1661155 - RNA, 21 nt, Homo sapiens
uaucuucguuaguaaucugua

SEQ ID NO: 1661156 - RNA, 23 nt, Homo sapiens
uaugaaagagaaaaugcuuucuc

SEQ ID NO: 1661157 - RNA, 21 nt, Homo sapiens
uaugaacgcacaacaugcaca

SEQ ID NO: 1661158 - RNA, 22 nt, Homo sapiens
uaugauaugcauguagcauaua

SEQ ID NO: 1661159 - RNA, 23 nt, Homo sapiens
uaugaugguggaucaagacauaa

SEQ ID NO: 1661160 - RNA, 21 nt, Homo sapiens
uaugauucuccucucccaaau

SEQ ID NO: 1661161 - RNA, 15 nt, Homo sapiens
uauggaaacagagca

SEQ ID NO: 1661162 - RNA, 18 nt, Homo sapiens
uauggaaacagagcaaaa

SEQ ID NO: 1661163 - RNA, 21 nt, Homo sapiens
uauggaaacagagcaaaagaa

SEQ ID NO: 1661164 - RNA, 18 nt, Homo sapiens
uauggaaccuucccucca

SEQ ID NO: 1661165 - RNA, 14 nt, Homo sapiens
uauggauucacuuc

SEQ ID NO: 1661166 - RNA, 18 nt, Homo sapiens
uaugguaaauaacuguga

SEQ ID NO: 1661167 - RNA, 10 nt, Homo sapiens
uauguauaca

SEQ ID NO: 1661168 - RNA, 14 nt, Homo sapiens
uauguauguaaaaa

SEQ ID NO: 1661169 - RNA, 15 nt, Homo sapiens
uaugucaguccaaua

SEQ ID NO: 1661170 - RNA, 19 nt, Homo sapiens
uaugucccaugaccuugac

SEQ ID NO: 1661171 - RNA, 16 nt, Homo sapiens
uaugucuauguguaua

SEQ ID NO: 1661172 - RNA, 19 nt, Homo sapiens
uaugugccuuucacuuuag

SEQ ID NO: 1661173 - RNA, 13 nt, Homo sapiens
uauuaacucugca

SEQ ID NO: 1661174 - RNA, 17 nt, Homo sapiens
uauuaaggcuuacuagu

SEQ ID NO: 1661175 - RNA, 12 nt, Homo sapiens
uauuacacauca

SEQ ID NO: 1661176 - RNA, 22 nt, Homo sapiens
uauuaucuuaaacccacauaaa

SEQ ID NO: 1661177 - RNA, 13 nt, Homo sapiens
uauuauguucaau

SEQ ID NO: 1661178 - RNA, 15 nt, Homo sapiens
uauucacaguaucug

SEQ ID NO: 1661179 - RNA, 22 nt, Homo sapiens
uauucagaaaagaugugcagau

SEQ ID NO: 1661180 - RNA, 18 nt, Homo sapiens
uauucauuagcugugauu

SEQ ID NO: 1661181 - RNA, 14 nt, Homo sapiens
uauuccaccuuaaa

SEQ ID NO: 1661182 - RNA, 21 nt, Homo sapiens
uauucuaagaaauaucuguga

SEQ ID NO: 1661183 - RNA, 14 nt, Homo sapiens
uauucugugaucac

SEQ ID NO: 1661184 - RNA, 21 nt, Homo sapiens
uauucuuauuuggacagccaa

SEQ ID NO: 1661185 - RNA, 19 nt, Homo sapiens
uauucuuuuguauaacuac

SEQ ID NO: 1661186 - RNA, 22 nt, Homo sapiens
uauucuuuuguauaacuacuaa

SEQ ID NO: 1661187 - RNA, 20 nt, Homo sapiens
uauugacgaccuacaucuga

SEQ ID NO: 1661188 - RNA, 12 nt, Homo sapiens
uauugacugccu

SEQ ID NO: 1661189 - RNA, 15 nt, Homo sapiens
uauuggacagucuca

SEQ ID NO: 1661190 - RNA, 12 nt, Homo sapiens
uauuguaccuaa

SEQ ID NO: 1661191 - RNA, 22 nt, Homo sapiens
uauuuacuccuuaccaagggaa

SEQ ID NO: 1661192 - RNA, 17 nt, Homo sapiens
uauuuaggcaugagcuc

SEQ ID NO: 1661193 - RNA, 15 nt, Homo sapiens
uauuuaucacauagc

SEQ ID NO: 1661194 - RNA, 21 nt, Homo sapiens
uauuucccaacccaggauuca

SEQ ID NO: 1661195 - RNA, 23 nt, Homo sapiens
uauuucuaaaacauuaauugagg

SEQ ID NO: 1661196 - RNA, 21 nt, Homo sapiens
uauuugaggaaacucauacag

SEQ ID NO: 1661197 - RNA, 12 nt, Homo sapiens
uauuugucacaa

SEQ ID NO: 1661198 - RNA, 19 nt, Homo sapiens
uauuuguccaaacuguugg

SEQ ID NO: 1661199 - RNA, 14 nt, Homo sapiens
uauuuuaauuuugc

SEQ ID NO: 1661200 - RNA, 23 nt, Homo sapiens
uauuuuauauaauaaaguauucc

SEQ ID NO: 1661201 - RNA, 20 nt, Homo sapiens
uauuuucauuauacaugaaa

SEQ ID NO: 1661202 - RNA, 12 nt, Homo sapiens
uauuuugaacaa

SEQ ID NO: 1661203 - RNA, 23 nt, Homo sapiens
uauuuuguaugaaauauauguga

SEQ ID NO: 1661204 - RNA, 15 nt, Homo sapiens
ucaaaagcaaauggg

SEQ ID NO: 1661205 - RNA, 15 nt, Homo sapiens
ucaaacaacauucca

SEQ ID NO: 1661206 - RNA, 17 nt, Homo sapiens
ucaaaguaaccucugag

SEQ ID NO: 1661207 - RNA, 20 nt, Homo sapiens
ucaaaguguuuaauuguaua

SEQ ID NO: 1661208 - RNA, 23 nt, Homo sapiens
ucaaauugucuuuugucaugugg

SEQ ID NO: 1661209 - RNA, 23 nt, Homo sapiens
ucaaauuuauuuccaauguuuca

SEQ ID NO: 1661210 - RNA, 18 nt, Homo sapiens
ucaacaugguuaccucug

SEQ ID NO: 1661211 - RNA, 11 nt, Homo sapiens
ucaacaugugc

SEQ ID NO: 1661212 - RNA, 14 nt, Homo sapiens
ucaacccugugauc

SEQ ID NO: 1661213 - RNA, 20 nt, Homo sapiens
ucaacccugugaucuauacc

SEQ ID NO: 1661214 - RNA, 23 nt, Homo sapiens
ucaaccugaauuaaagucuacac

SEQ ID NO: 1661215 - RNA, 15 nt, Homo sapiens
ucaacucuccuccag

SEQ ID NO: 1661216 - RNA, 15 nt, Homo sapiens
ucaacuuacauaugu

SEQ ID NO: 1661217 - RNA, 16 nt, Homo sapiens
ucaagacacagacaaa

SEQ ID NO: 1661218 - RNA, 22 nt, Homo sapiens
ucaagcaggcgccaagugcuau

SEQ ID NO: 1661219 - RNA, 14 nt, Homo sapiens
ucaagcauugcuaa

SEQ ID NO: 1661220 - RNA, 14 nt, Homo sapiens
ucaagggcauuaca

SEQ ID NO: 1661221 - RNA, 16 nt, Homo sapiens
ucaauaacuauugcug

SEQ ID NO: 1661222 - RNA, 18 nt, Homo sapiens
ucaauaacuauugcugcu

SEQ ID NO: 1661223 - RNA, 19 nt, Homo sapiens
ucaauaacuauugcugcuu

SEQ ID NO: 1661224 - RNA, 17 nt, Homo sapiens
ucaauaaggcagugcag

SEQ ID NO: 1661225 - RNA, 20 nt, Homo sapiens
ucaaucuggcuucugcauua

SEQ ID NO: 1661226 - RNA, 19 nt, Homo sapiens
ucaaugugcuguugauucu

SEQ ID NO: 1661227 - RNA, 14 nt, Homo sapiens
ucaauuucaaaagg

SEQ ID NO: 1661228 - RNA, 20 nt, Homo sapiens
ucaauuuuuaacuuaucucc

SEQ ID NO: 1661229 - RNA, 19 nt, Homo sapiens
ucacaaaaguauauucaaa

SEQ ID NO: 1661230 - RNA, 20 nt, Homo sapiens
ucacaaacucauccauuaau

SEQ ID NO: 1661231 - RNA, 15 nt, Homo sapiens
ucacaagccaagguc

SEQ ID NO: 1661232 - RNA, 21 nt, Homo sapiens
ucacacacauggaaggugaug

SEQ ID NO: 1661233 - RNA, 17 nt, Homo sapiens
ucacacagagaggcaga

SEQ ID NO: 1661234 - RNA, 14 nt, Homo sapiens
ucacagacugcugu

SEQ ID NO: 1661235 - RNA, 24 nt, Homo sapiens
ucacagagauuugguuaagcucac

SEQ ID NO: 1661236 - RNA, 14 nt, Homo sapiens
ucacagaugggcaa

SEQ ID NO: 1661237 - RNA, 22 nt, Homo sapiens
ucacagauuuccaaaaguacua

SEQ ID NO: 1661238 - RNA, 19 nt, Homo sapiens
ucacagugacccuucccaa

SEQ ID NO: 1661239 - RNA, 15 nt, Homo sapiens
ucacaugacauccac

SEQ ID NO: 1661240 - RNA, 17 nt, Homo sapiens
ucacauucagagucgcu

SEQ ID NO: 1661241 - RNA, 19 nt, Homo sapiens
ucacauuccugacccucac

SEQ ID NO: 1661242 - RNA, 22 nt, Homo sapiens
ucaccaggaagaaggcccggga

SEQ ID NO: 1661243 - RNA, 13 nt, Homo sapiens
ucaccaugaucac

SEQ ID NO: 1661244 - RNA, 17 nt, Homo sapiens
ucacccgccucuugccc

SEQ ID NO: 1661245 - RNA, 21 nt, Homo sapiens
ucaccucacuuguggcagcuu

SEQ ID NO: 1661246 - RNA, 23 nt, Homo sapiens
ucaccuuugggcaaaggcccccu

SEQ ID NO: 1661247 - RNA, 15 nt, Homo sapiens
ucacgauuccagugc

SEQ ID NO: 1661248 - RNA, 18 nt, Homo sapiens
ucacgauuccagugcagu

SEQ ID NO: 1661249 - RNA, 19 nt, Homo sapiens
ucacgcaacuugaaauuau

SEQ ID NO: 1661250 - RNA, 23 nt, Homo sapiens
ucacuaaagaaaaacuaauguca

SEQ ID NO: 1661251 - RNA, 15 nt, Homo sapiens
ucacuauccaugcac

SEQ ID NO: 1661252 - RNA, 15 nt, Homo sapiens
ucacuaugcauuuua

SEQ ID NO: 1661253 - RNA, 17 nt, Homo sapiens
ucacuccucugucauau

SEQ ID NO: 1661254 - RNA, 17 nt, Homo sapiens
ucacucugacaguauua

SEQ ID NO: 1661255 - RNA, 12 nt, Homo sapiens
ucacucugucag

SEQ ID NO: 1661256 - RNA, 17 nt, Homo sapiens
ucacugcaccucuuugu

SEQ ID NO: 1661257 - RNA, 15 nt, Homo sapiens
ucacugcccaccugc

SEQ ID NO: 1661258 - RNA, 17 nt, Homo sapiens
ucacugcuuuuuccuua

SEQ ID NO: 1661259 - RNA, 17 nt, Homo sapiens
ucacugucuuacucaag

SEQ ID NO: 1661260 - RNA, 16 nt, Homo sapiens
ucacuguucaugaaua

SEQ ID NO: 1661261 - RNA, 24 nt, Homo sapiens
ucacuucuaguuuggcauuucaca

SEQ ID NO: 1661262 - RNA, 16 nt, Homo sapiens
ucagaaaauccugaca

SEQ ID NO: 1661263 - RNA, 15 nt, Homo sapiens
ucagaaacaaagcau

SEQ ID NO: 1661264 - RNA, 20 nt, Homo sapiens
ucagaacacgacagaaacag

SEQ ID NO: 1661265 - RNA, 20 nt, Homo sapiens
ucagaacuccuuucuaagga

SEQ ID NO: 1661266 - RNA, 23 nt, Homo sapiens
ucagaagaaaggacagcucagaa

SEQ ID NO: 1661267 - RNA, 19 nt, Homo sapiens
ucagaagauuagcaugaaa

SEQ ID NO: 1661268 - RNA, 13 nt, Homo sapiens
ucucauuugccag

SEQ ID NO: 1661269 - RNA, 13 nt, Homo sapiens
ucuccacagggac

SEQ ID NO: 1661270 - RNA, 20 nt, Homo sapiens
ucuccaccccucaagccagg

SEQ ID NO: 1661271 - RNA, 20 nt, Homo sapiens
ucuccacgguagcacuugac

SEQ ID NO: 1661272 - RNA, 17 nt, Homo sapiens
ucuccaucuaccuucca

SEQ ID NO: 1661273 - RNA, 23 nt, Homo sapiens
ucuccaucucuugaccucgugau

SEQ ID NO: 1661274 - RNA, 19 nt, Homo sapiens
ucucccuggccccagugac

SEQ ID NO: 1661275 - RNA, 14 nt, Homo sapiens
ucuccucacugcca

SEQ ID NO: 1661276 - RNA, 16 nt, Homo sapiens
ucuccugcagucugug

SEQ ID NO: 1661277 - RNA, 17 nt, Homo sapiens
ucuccuggcaaucuguc

SEQ ID NO: 1661278 - RNA, 17 nt, Homo sapiens
ucucgcuagccauauau

SEQ ID NO: 1661279 - RNA, 23 nt, Homo sapiens
ucucggaguccaaaggguuuuaa

SEQ ID NO: 1661280 - RNA, 22 nt, Homo sapiens
ucucgugauugauaagaaccuu

SEQ ID NO: 1661281 - RNA, 20 nt, Homo sapiens
ucucuagacaucuagucuca

SEQ ID NO: 1661282 - RNA, 17 nt, Homo sapiens
ucucuccccauggggca

SEQ ID NO: 1661283 - RNA, 21 nt, Homo sapiens
ucucuccuggucgcuuugcca

SEQ ID NO: 1661284 - RNA, 21 nt, Homo sapiens
ucucuccuuuccuuuugucua

SEQ ID NO: 1661285 - RNA, 14 nt, Homo sapiens
ucucugagaacaga

SEQ ID NO: 1661286 - RNA, 23 nt, Homo sapiens
ucucugauggcacuuuugagcuc

SEQ ID NO: 1661287 - RNA, 14 nt, Homo sapiens
ucucuggaccugac

SEQ ID NO: 1661288 - RNA, 21 nt, Homo sapiens
ucucuggcaaucuugcccuua

SEQ ID NO: 1661289 - RNA, 23 nt, Homo sapiens
ucucuugauucauaaugacuuaa

SEQ ID NO: 1661290 - RNA, 14 nt, Homo sapiens
ucucuuuugcucau

SEQ ID NO: 1661291 - RNA, 22 nt, Homo sapiens
ucugagaaagccuggcuuguau

SEQ ID NO: 1661292 - RNA, 19 nt, Homo sapiens
ucugagaagaggagcccuc

SEQ ID NO: 1661293 - RNA, 18 nt, Homo sapiens
ucugagacagaaucucag

SEQ ID NO: 1661294 - RNA, 13 nt, Homo sapiens
ucugagcaguugu

SEQ ID NO: 1661295 - RNA, 13 nt, Homo sapiens
ucugaggaccuca

SEQ ID NO: 1661296 - RNA, 21 nt, Homo sapiens
ucugcagcgagccccccaugu

SEQ ID NO: 1661297 - RNA, 23 nt, Homo sapiens
ucugccagggcagugcuagugag

SEQ ID NO: 1661298 - RNA, 18 nt, Homo sapiens
ucugccggucccccaugc

SEQ ID NO: 1661299 - RNA, 15 nt, Homo sapiens
ucugcuggucuucaa

SEQ ID NO: 1661300 - RNA, 21 nt, Homo sapiens
ucugcuucucuuucacaacuu

SEQ ID NO: 1661301 - RNA, 19 nt, Homo sapiens
ucuggaauugauauugaau

SEQ ID NO: 1661302 - RNA, 16 nt, Homo sapiens
ucuggcuucugcauua

SEQ ID NO: 1661303 - RNA, 19 nt, Homo sapiens
ucuggggcagcagagccau

SEQ ID NO: 1661304 - RNA, 19 nt, Homo sapiens
ucuguaacaucacuaucca

SEQ ID NO: 1661305 - RNA, 14 nt, Homo sapiens
ucuguaagagaauu

SEQ ID NO: 1661306 - RNA, 15 nt, Homo sapiens
ucuguauaucagcuc

SEQ ID NO: 1661307 - RNA, 21 nt, Homo sapiens
ucugucaccagcuaucuguca

SEQ ID NO: 1661308 - RNA, 19 nt, Homo sapiens
ucugugcagucaucaacaa

SEQ ID NO: 1661309 - RNA, 13 nt, Homo sapiens
ucuguuauacaca

SEQ ID NO: 1661310 - RNA, 22 nt, Homo sapiens
ucuguuccaagugugugugcaa

SEQ ID NO: 1661311 - RNA, 23 nt, Homo sapiens
ucuguuuugggaaacacuuugag

SEQ ID NO: 1661312 - RNA, 17 nt, Homo sapiens
ucuuaaauauacaacuu

SEQ ID NO: 1661313 - RNA, 13 nt, Homo sapiens
ucuuaaugucuca

SEQ ID NO: 1661314 - RNA, 19 nt, Homo sapiens
ucuuaauucccaaucccau

SEQ ID NO: 1661315 - RNA, 12 nt, Homo sapiens
ucuuacaguauu

SEQ ID NO: 1661316 - RNA, 23 nt, Homo sapiens
ucuuacccgguaaguaaacaguc

SEQ ID NO: 1661317 - RNA, 17 nt, Homo sapiens
ucuuagaagaaauauga

SEQ ID NO: 1661318 - RNA, 19 nt, Homo sapiens
ucuuaggguacagcccagg

SEQ ID NO: 1661319 - RNA, 23 nt, Homo sapiens
ucuuaguacauccucacuuuuau

SEQ ID NO: 1661320 - RNA, 22 nt, Homo sapiens
ucuuauggaggagaguguuuaa

SEQ ID NO: 1661321 - RNA, 16 nt, Homo sapiens
ucuuauuuaaaacugu

SEQ ID NO: 1661322 - RNA, 13 nt, Homo sapiens
ucuucaacuaauu

SEQ ID NO: 1661323 - RNA, 23 nt, Homo sapiens
ucuucaauuaauggaaaacuguu

SEQ ID NO: 1661324 - RNA, 20 nt, Homo sapiens
ucuucaccaggaagaaggcc

SEQ ID NO: 1661325 - RNA, 12 nt, Homo sapiens
ucuucaccucac

SEQ ID NO: 1661326 - RNA, 17 nt, Homo sapiens
ucuucagagcaagcacu

SEQ ID NO: 1661327 - RNA, 14 nt, Homo sapiens
ucuucauguugaug

SEQ ID NO: 1661328 - RNA, 17 nt, Homo sapiens
ucuuccaaguucauuca

SEQ ID NO: 1661329 - RNA, 22 nt, Homo sapiens
ucuucccaccugucaaccugaa

SEQ ID NO: 1661330 - RNA, 14 nt, Homo sapiens
ucuuccuaccaaau

SEQ ID NO: 1661331 - RNA, 15 nt, Homo sapiens
ucuuccucuuaccug

SEQ ID NO: 1661332 - RNA, 21 nt, Homo sapiens
ucuucguagguugugaugaua

SEQ ID NO: 1661333 - RNA, 20 nt, Homo sapiens
ucuucucagcuccacucuga

SEQ ID NO: 1661334 - RNA, 14 nt, Homo sapiens
ucuucucuuucuca

SEQ ID NO: 1661335 - RNA, 13 nt, Homo sapiens
ucuucuuacugua

SEQ ID NO: 1661336 - RNA, 17 nt, Homo sapiens
ucuucuugagcugaccc

SEQ ID NO: 1661337 - RNA, 14 nt, Homo sapiens
ucuugaagaauauu

SEQ ID NO: 1661338 - RNA, 13 nt, Homo sapiens
ucuugaagacuuu

SEQ ID NO: 1661339 - RNA, 22 nt, Homo sapiens
ucuugaucuuuggaaugcaugc

SEQ ID NO: 1661340 - RNA, 17 nt, Homo sapiens
ucuugauucauaaugac

SEQ ID NO: 1661341 - RNA, 23 nt, Homo sapiens
ucuugcacuggccuucugaugaa

SEQ ID NO: 1661342 - RNA, 17 nt, Homo sapiens
ucuugcagucaucagaa

SEQ ID NO: 1661343 - RNA, 22 nt, Homo sapiens
ucuugcugccaggcccacacau

SEQ ID NO: 1661344 - RNA, 20 nt, Homo sapiens
ucuugcuguuuaccgcccac

SEQ ID NO: 1661345 - RNA, 23 nt, Homo sapiens
ucuuggagaggagguguggagug

SEQ ID NO: 1661346 - RNA, 17 nt, Homo sapiens
ucuugguuuccaucaaa

SEQ ID NO: 1661347 - RNA, 22 nt, Homo sapiens
ucuuguaaauaaugcuuaacau

SEQ ID NO: 1661348 - RNA, 15 nt, Homo sapiens
ucuuguuuaccaaag

SEQ ID NO: 1661349 - RNA, 14 nt, Homo sapiens
ucuuuauaaaccau

SEQ ID NO: 1661350 - RNA, 16 nt, Homo sapiens
ucuuuauucacaguau

SEQ ID NO: 1661351 - RNA, 21 nt, Homo sapiens
ucuuucacuggggaagccagu

SEQ ID NO: 1661352 - RNA, 14 nt, Homo sapiens
ucuuucaucaauca

SEQ ID NO: 1661353 - RNA, 20 nt, Homo sapiens
ucuuucccuggugauggucu

SEQ ID NO: 1661354 - RNA, 16 nt, Homo sapiens
ucuuuccuccucauga

SEQ ID NO: 1661355 - RNA, 12 nt, Homo sapiens
ucuuugcucagu

SEQ ID NO: 1661356 - RNA, 16 nt, Homo sapiens
ucuuuguauauuucua

SEQ ID NO: 1661357 - RNA, 23 nt, Homo sapiens
ucuuuugggggcuggggcuuuag

SEQ ID NO: 1661358 - RNA, 12 nt, Homo sapiens
ucuuuuugacug

SEQ ID NO: 1661359 - RNA, 18 nt, Homo sapiens
ugaaaaaagaacaggaua

SEQ ID NO: 1661360 - RNA, 17 nt, Homo sapiens
ugaaaaaauaacacugu

SEQ ID NO: 1661361 - RNA, 19 nt, Homo sapiens
ugaaaaaauaacacuguac

SEQ ID NO: 1661362 - RNA, 22 nt, Homo sapiens
ugaaaaauaguguguccaugca

SEQ ID NO: 1661363 - RNA, 16 nt, Homo sapiens
ugaaaacucucaguca

SEQ ID NO: 1661364 - RNA, 18 nt, Homo sapiens
ugaaaaggguguugcuaa

SEQ ID NO: 1661365 - RNA, 20 nt, Homo sapiens
ugaaaaggugauugucacca

SEQ ID NO: 1661366 - RNA, 16 nt, Homo sapiens
ugaaacacacaggcca

SEQ ID NO: 1661367 - RNA, 19 nt, Homo sapiens
ugaaaccagaaaucuaauc

SEQ ID NO: 1661368 - RNA, 21 nt, Homo sapiens
ugaaacugacuugcugugacu

SEQ ID NO: 1661369 - RNA, 19 nt, Homo sapiens
ugaaagaguaaaaccaaag

SEQ ID NO: 1661370 - RNA, 21 nt, Homo sapiens
ugaaaggauaugaaucugaga

SEQ ID NO: 1661371 - RNA, 18 nt, Homo sapiens
ugaaagucuccuguauca

SEQ ID NO: 1661372 - RNA, 17 nt, Homo sapiens
ugaaauaacagccuuaa

SEQ ID NO: 1661373 - RNA, 14 nt, Homo sapiens
ugaaauacauauga

SEQ ID NO: 1661374 - RNA, 23 nt, Homo sapiens
ugaaauauaaaaaaggugguggu

SEQ ID NO: 1661375 - RNA, 15 nt, Homo sapiens
ugaaauauuugcuua

SEQ ID NO: 1661376 - RNA, 13 nt, Homo sapiens
ugaaauccaaaau

SEQ ID NO: 1661377 - RNA, 12 nt, Homo sapiens
ugaaauccacac

SEQ ID NO: 1661378 - RNA, 17 nt, Homo sapiens
ugaaauuaguguuuuca

SEQ ID NO: 1661379 - RNA, 15 nt, Homo sapiens
ugaaauuaugucaaa

SEQ ID NO: 1661380 - RNA, 16 nt, Homo sapiens
ugaacaauaugaaauc

SEQ ID NO: 1661381 - RNA, 13 nt, Homo sapiens
ugaacacucuugg

SEQ ID NO: 1661382 - RNA, 15 nt, Homo sapiens
ugaacagaacaaaag

SEQ ID NO: 1661383 - RNA, 16 nt, Homo sapiens
ugaacuagccaaucag

SEQ ID NO: 1661384 - RNA, 19 nt, Homo sapiens
ugaacucacagacugcugu

SEQ ID NO: 1661385 - RNA, 16 nt, Homo sapiens
ugaacugcaacacugg

SEQ ID NO: 1661386 - RNA, 12 nt, Homo sapiens
ugaacugccaaa

SEQ ID NO: 1661387 - RNA, 16 nt, Homo sapiens
ugaagaaucuacuuaa

SEQ ID NO: 1661388 - RNA, 18 nt, Homo sapiens
ugaagaaugaaaggcaau

SEQ ID NO: 1661389 - RNA, 13 nt, Homo sapiens
aacacaccuugcc

SEQ ID NO: 1661390 - RNA, 15 nt, Homo sapiens
aacacacucucaccu

SEQ ID NO: 1661391 - RNA, 11 nt, Homo sapiens
aacacagugaa

SEQ ID NO: 1661392 - RNA, 16 nt, Homo sapiens
aacaccaccaaaugac

SEQ ID NO: 1661393 - RNA, 21 nt, Homo sapiens
aacaccacuuugucucugaga

SEQ ID NO: 1661394 - RNA, 19 nt, Homo sapiens
aacacccaaagcauggacu

SEQ ID NO: 1661395 - RNA, 17 nt, Homo sapiens
aacaccguccaacauuc

SEQ ID NO: 1661396 - RNA, 23 nt, Homo sapiens
aacacuaaugaggaaacugcacu

SEQ ID NO: 1661397 - RNA, 16 nt, Homo sapiens
aacacuaauggccaag

SEQ ID NO: 1661398 - RNA, 11 nt, Homo sapiens
aacacuuugag

SEQ ID NO: 1661399 - RNA, 17 nt, Homo sapiens
aacagagugauuuguaa

SEQ ID NO: 1661400 - RNA, 22 nt, Homo sapiens
aacagaucacaugccccucuua

SEQ ID NO: 1661401 - RNA, 22 nt, Homo sapiens
aacagcaauuguucagggaaua

SEQ ID NO: 1661402 - RNA, 16 nt, Homo sapiens
aacagcauaugcaaag

SEQ ID NO: 1661403 - RNA, 12 nt, Homo sapiens
aacagccagcuu

SEQ ID NO: 1661404 - RNA, 18 nt, Homo sapiens
aacagcgaagccagucca

SEQ ID NO: 1661405 - RNA, 15 nt, Homo sapiens
aacagcucaccaacu

SEQ ID NO: 1661406 - RNA, 19 nt, Homo sapiens
aacaggauaacagcaauug

SEQ ID NO: 1661407 - RNA, 17 nt, Homo sapiens
aacaggcucacagagau

SEQ ID NO: 1661408 - RNA, 18 nt, Homo sapiens
aacaggcucacagagauu

SEQ ID NO: 1661409 - RNA, 21 nt, Homo sapiens
aacaggcuguucugcacugaa

SEQ ID NO: 1661410 - RNA, 18 nt, Homo sapiens
aacaguguuuccagugac

SEQ ID NO: 1661411 - RNA, 14 nt, Homo sapiens
aacauauuaaaggu

SEQ ID NO: 1661412 - RNA, 20 nt, Homo sapiens
aacauauuuaaagucuugaa

SEQ ID NO: 1661413 - RNA, 22 nt, Homo sapiens
aacaugcugucuuagaucagga

SEQ ID NO: 1661414 - RNA, 12 nt, Homo sapiens
aaccaagcuaua

SEQ ID NO: 1661415 - RNA, 19 nt, Homo sapiens
aaccacccuaucaucaguu

SEQ ID NO: 1661416 - RNA, 20 nt, Homo sapiens
aaccaccgcgcccagccuuu

SEQ ID NO: 1661417 - RNA, 19 nt, Homo sapiens
aaccauauauauacauaua

SEQ ID NO: 1661418 - RNA, 17 nt, Homo sapiens
aaccaucaccagaauua

SEQ ID NO: 1661419 - RNA, 11 nt, Homo sapiens
aacccaaauaa

SEQ ID NO: 1661420 - RNA, 12 nt, Homo sapiens
aacccaagagag

SEQ ID NO: 1661421 - RNA, 20 nt, Homo sapiens
aacccaguguucagcauaga

SEQ ID NO: 1661422 - RNA, 14 nt, Homo sapiens
aacccaucacugug

SEQ ID NO: 1661423 - RNA, 20 nt, Homo sapiens
aacccaucacugugucucau

SEQ ID NO: 1661424 - RNA, 15 nt, Homo sapiens
aaccccccuccccaa

SEQ ID NO: 1661425 - RNA, 13 nt, Homo sapiens
aacccugcuucug

SEQ ID NO: 1661426 - RNA, 14 nt, Homo sapiens
aacccuuccaccaa

SEQ ID NO: 1661427 - RNA, 15 nt, Homo sapiens
aaccuaccacauuca

SEQ ID NO: 1661428 - RNA, 21 nt, Homo sapiens
aaccuaccuuauagagcacaa

SEQ ID NO: 1661429 - RNA, 20 nt, Homo sapiens
aaccuccaccucgcagguuc

SEQ ID NO: 1661430 - RNA, 13 nt, Homo sapiens
aaccuccacugcu

SEQ ID NO: 1661431 - RNA, 18 nt, Homo sapiens
aaccucggggagugccac

SEQ ID NO: 1661432 - RNA, 19 nt, Homo sapiens
aaccucucuacuagcacca

SEQ ID NO: 1661433 - RNA, 17 nt, Homo sapiens
aaccugaaagggcauuu

SEQ ID NO: 1661434 - RNA, 14 nt, Homo sapiens
aaccugaauuaaag

SEQ ID NO: 1661435 - RNA, 19 nt, Homo sapiens
aaccugguggcaccagaug

SEQ ID NO: 1661436 - RNA, 21 nt, Homo sapiens
aaccuucuuuucaaugcaaug

SEQ ID NO: 1661437 - RNA, 23 nt, Homo sapiens
aaccuugcacaggucccacugcc

SEQ ID NO: 1661438 - RNA, 12 nt, Homo sapiens
aaccuugcugcu

SEQ ID NO: 1661439 - RNA, 21 nt, Homo sapiens
aaccuuguacuuuacaaucau

SEQ ID NO: 1661440 - RNA, 21 nt, Homo sapiens
aaccuuuugagugccuuacac

SEQ ID NO: 1661441 - RNA, 21 nt, Homo sapiens
aacgauccuucaaagucucaa

SEQ ID NO: 1661442 - RNA, 12 nt, Homo sapiens
aacgcacaggaa

SEQ ID NO: 1661443 - RNA, 18 nt, Homo sapiens
aacgcugcuccaugcaca

SEQ ID NO: 1661444 - RNA, 20 nt, Homo sapiens
aacggaugaccauaugcaca

SEQ ID NO: 1661445 - RNA, 18 nt, Homo sapiens
aacguccuuccacuucag

SEQ ID NO: 1661446 - RNA, 23 nt, Homo sapiens
aacguccuuccacuucaggguuc

SEQ ID NO: 1661447 - RNA, 22 nt, Homo sapiens
aacgugggaguucagcugcuuc

SEQ ID NO: 1661448 - RNA, 22 nt, Homo sapiens
aacuaaugucagcacauguugc

SEQ ID NO: 1661449 - RNA, 14 nt, Homo sapiens
aacuagccaaucag

SEQ ID NO: 1661450 - RNA, 12 nt, Homo sapiens
aacuagugcucu

SEQ ID NO: 1661451 - RNA, 13 nt, Homo sapiens
uccaccagugugc

SEQ ID NO: 1661452 - RNA, 18 nt, Homo sapiens
uccaccgcagaaggaagg

SEQ ID NO: 1661453 - RNA, 24 nt, Homo sapiens
uccaccuuaaauuaaacaauuuau

SEQ ID NO: 1661454 - RNA, 23 nt, Homo sapiens
uccacguaucuuuccuaggcaga

SEQ ID NO: 1661455 - RNA, 22 nt, Homo sapiens
uccacuaggugcccagucuuga

SEQ ID NO: 1661456 - RNA, 20 nt, Homo sapiens
uccacucuaguuguggacuu

SEQ ID NO: 1661457 - RNA, 16 nt, Homo sapiens
uccagaggguugugau

SEQ ID NO: 1661458 - RNA, 21 nt, Homo sapiens
uccagaguaggugggucuugg

SEQ ID NO: 1661459 - RNA, 11 nt, Homo sapiens
uccagcacauc

SEQ ID NO: 1661460 - RNA, 22 nt, Homo sapiens
uccagccacuuauuuccaugga

SEQ ID NO: 1661461 - RNA, 15 nt, Homo sapiens
uccagcccugcagcu

SEQ ID NO: 1661462 - RNA, 18 nt, Homo sapiens
uccagcggggcuucuggg

SEQ ID NO: 1661463 - RNA, 19 nt, Homo sapiens
uccagcggggcuucugggc

SEQ ID NO: 1661464 - RNA, 17 nt, Homo sapiens
uccagggcagaggccau

SEQ ID NO: 1661465 - RNA, 23 nt, Homo sapiens
uccagggcagaggccaugaagaa

SEQ ID NO: 1661466 - RNA, 12 nt, Homo sapiens
uccagggcuccc

SEQ ID NO: 1661467 - RNA, 19 nt, Homo sapiens
uccaguaauagcaagucuu

SEQ ID NO: 1661468 - RNA, 23 nt, Homo sapiens
uccauacccccugccccagagaa

SEQ ID NO: 1661469 - RNA, 20 nt, Homo sapiens
uccaucauacauuagugcca

SEQ ID NO: 1661470 - RNA, 22 nt, Homo sapiens
uccaucauacauuagugccaua

SEQ ID NO: 1661471 - RNA, 19 nt, Homo sapiens
uccauccacacacagcagc

SEQ ID NO: 1661472 - RNA, 16 nt, Homo sapiens
uccaucucaagugcca

SEQ ID NO: 1661473 - RNA, 18 nt, Homo sapiens
uccaucucaagugccaua

SEQ ID NO: 1661474 - RNA, 23 nt, Homo sapiens
uccaugacaguagcauacugaug

SEQ ID NO: 1661475 - RNA, 18 nt, Homo sapiens
uccaugagucuucagaag

SEQ ID NO: 1661476 - RNA, 11 nt, Homo sapiens
uccauggugcc

SEQ ID NO: 1661477 - RNA, 16 nt, Homo sapiens
uccauuaaccaagaaa

SEQ ID NO: 1661478 - RNA, 17 nt, Homo sapiens
uccauucccaacucucu

SEQ ID NO: 1661479 - RNA, 16 nt, Homo sapiens
ucccaaaucucaaaag

SEQ ID NO: 1661480 - RNA, 20 nt, Homo sapiens
ucccaagcaccugggauuac

SEQ ID NO: 1661481 - RNA, 17 nt, Homo sapiens
ucccaaggaaaauggac

SEQ ID NO: 1661482 - RNA, 21 nt, Homo sapiens
ucccaagguucaauaaggccu

SEQ ID NO: 1661483 - RNA, 20 nt, Homo sapiens
ucccaaguagcugagacuac

SEQ ID NO: 1661484 - RNA, 17 nt, Homo sapiens
ucccaaguccaguguga

SEQ ID NO: 1661485 - RNA, 13 nt, Homo sapiens
ucccaauacaaaa

SEQ ID NO: 1661486 - RNA, 16 nt, Homo sapiens
ucccaaucagcacuga

SEQ ID NO: 1661487 - RNA, 14 nt, Homo sapiens
ucccacacugugaa

SEQ ID NO: 1661488 - RNA, 21 nt, Homo sapiens
ucccacugcccccuccacugg

SEQ ID NO: 1661489 - RNA, 22 nt, Homo sapiens
ucccacugcccccuccacugga

SEQ ID NO: 1661490 - RNA, 21 nt, Homo sapiens
ucccacugccccugcaccugc

SEQ ID NO: 1661491 - RNA, 15 nt, Homo sapiens
ucccagaaccuugau

SEQ ID NO: 1661492 - RNA, 19 nt, Homo sapiens
ucccagcccugcccagagu

SEQ ID NO: 1661493 - RNA, 14 nt, Homo sapiens
ucccagcuacaggg

SEQ ID NO: 1661494 - RNA, 18 nt, Homo sapiens
ucccaguccggugccuuc

SEQ ID NO: 1661495 - RNA, 13 nt, Homo sapiens
ucccagugaucac

SEQ ID NO: 1661496 - RNA, 16 nt, Homo sapiens
ucccaguuaacuguua

SEQ ID NO: 1661497 - RNA, 14 nt, Homo sapiens
ucccauacucucaa

SEQ ID NO: 1661498 - RNA, 18 nt, Homo sapiens
ucccaugguagacuguga

SEQ ID NO: 1661499 - RNA, 14 nt, Homo sapiens
ucccauuggccuua

SEQ ID NO: 1661500 - RNA, 16 nt, Homo sapiens
uccccaagagcuguua

SEQ ID NO: 1661501 - RNA, 23 nt, Homo sapiens
uccccaagugguuuccacaugcu

SEQ ID NO: 1661502 - RNA, 21 nt, Homo sapiens
uccccaauccaacccaugcau

SEQ ID NO: 1661503 - RNA, 22 nt, Homo sapiens
uccccagagcuuuacagugcca

SEQ ID NO: 1661504 - RNA, 23 nt, Homo sapiens
uccccagagcuuuacagugccac

SEQ ID NO: 1661505 - RNA, 18 nt, Homo sapiens
uccccagccugcucccua

SEQ ID NO: 1661506 - RNA, 12 nt, Homo sapiens
uccccagggugc

SEQ ID NO: 1661507 - RNA, 17 nt, Homo sapiens
uccccaucuguguguga

SEQ ID NO: 1661508 - RNA, 20 nt, Homo sapiens
ucccccacgccuccauccac

SEQ ID NO: 1661509 - RNA, 14 nt, Homo sapiens
uccccccacaagaa

SEQ ID NO: 1661510 - RNA, 14 nt, Homo sapiens
uccccucagauucc

SEQ ID NO: 1661511 - RNA, 14 nt, Homo sapiens
uccccuccaaguga

SEQ ID NO: 1661512 - RNA, 17 nt, Homo sapiens
uccccugccucaccagc

SEQ ID NO: 1661513 - RNA, 14 nt, Homo sapiens
uccccuggacauau

SEQ ID NO: 1661514 - RNA, 11 nt, Homo sapiens
uaggcuucuau

SEQ ID NO: 1661515 - RNA, 22 nt, Homo sapiens
uagggcaaagaaucaacaguga

SEQ ID NO: 1661516 - RNA, 14 nt, Homo sapiens
uaggugguguuugu

SEQ ID NO: 1661517 - RNA, 22 nt, Homo sapiens
uaguaccuuuuuuuagaaacag

SEQ ID NO: 1661518 - RNA, 12 nt, Homo sapiens
uaguacucagua

SEQ ID NO: 1661519 - RNA, 15 nt, Homo sapiens
uaguacuucuucugu

SEQ ID NO: 1661520 - RNA, 20 nt, Homo sapiens
uaguagacaaagagccagaa

SEQ ID NO: 1661521 - RNA, 18 nt, Homo sapiens
uaguagcagagucauugu

SEQ ID NO: 1661522 - RNA, 12 nt, Homo sapiens
uaguaguacuua

SEQ ID NO: 1661523 - RNA, 13 nt, Homo sapiens
uagucaauaucaa

SEQ ID NO: 1661524 - RNA, 18 nt, Homo sapiens
uagucaaucaaacaggga

SEQ ID NO: 1661525 - RNA, 21 nt, Homo sapiens
uagucaguguacucugagucc

SEQ ID NO: 1661526 - RNA, 19 nt, Homo sapiens
uagucccggaggccuuccc

SEQ ID NO: 1661527 - RNA, 19 nt, Homo sapiens
uaguccggacccaccucac

SEQ ID NO: 1661528 - RNA, 17 nt, Homo sapiens
uagugacuuuggcauuu

SEQ ID NO: 1661529 - RNA, 22 nt, Homo sapiens
uagugccaaaaggccccuuccc

SEQ ID NO: 1661530 - RNA, 20 nt, Homo sapiens
uagugucuaaaacacuauuc

SEQ ID NO: 1661531 - RNA, 20 nt, Homo sapiens
uaguguuucguuaagcagua

SEQ ID NO: 1661532 - RNA, 15 nt, Homo sapiens
uaguuaacuaugauu

SEQ ID NO: 1661533 - RNA, 14 nt, Homo sapiens
uaguugcacuucag

SEQ ID NO: 1661534 - RNA, 19 nt, Homo sapiens
uaguuuacuuuggacuaaa

SEQ ID NO: 1661535 - RNA, 14 nt, Homo sapiens
uauaaaacaguguu

SEQ ID NO: 1661536 - RNA, 12 nt, Homo sapiens
uauaaacuguga

SEQ ID NO: 1661537 - RNA, 20 nt, Homo sapiens
uauaaaucguaaccuaugaa

SEQ ID NO: 1661538 - RNA, 22 nt, Homo sapiens
uauaaauguacuacauuugcau

SEQ ID NO: 1661539 - RNA, 19 nt, Homo sapiens
uauaacuccuuguuucaga

SEQ ID NO: 1661540 - RNA, 12 nt, Homo sapiens
uauaagccauag

SEQ ID NO: 1661541 - RNA, 14 nt, Homo sapiens
uauaauaaccuggu

SEQ ID NO: 1661542 - RNA, 20 nt, Homo sapiens
uauaauuuuauugcuggaau

SEQ ID NO: 1661543 - RNA, 13 nt, Homo sapiens
uauacaaacaggu

SEQ ID NO: 1661544 - RNA, 14 nt, Homo sapiens
uauacaaacaggug

SEQ ID NO: 1661545 - RNA, 14 nt, Homo sapiens
uauacaaacaugug

SEQ ID NO: 1661546 - RNA, 23 nt, Homo sapiens
uauacauuagacacacauauaca

SEQ ID NO: 1661547 - RNA, 16 nt, Homo sapiens
uauaccagguuaccuc

SEQ ID NO: 1661548 - RNA, 18 nt, Homo sapiens
uauaccagguuaccucac

SEQ ID NO: 1661549 - RNA, 21 nt, Homo sapiens
uauagauucuuuauuagugaa

SEQ ID NO: 1661550 - RNA, 19 nt, Homo sapiens
uauaucagcagacacucca

SEQ ID NO: 1661551 - RNA, 19 nt, Homo sapiens
uauauguauaucuguguaa

SEQ ID NO: 1661552 - RNA, 16 nt, Homo sapiens
uauauuauauauacau

SEQ ID NO: 1661553 - RNA, 21 nt, Homo sapiens
uauauuuucugaguagcauau

SEQ ID NO: 1661554 - RNA, 14 nt, Homo sapiens
uaucaaugacaaug

SEQ ID NO: 1661555 - RNA, 17 nt, Homo sapiens
uaucaccugaauuauua

SEQ ID NO: 1661556 - RNA, 20 nt, Homo sapiens
uaucauucagaaugugcaaa

SEQ ID NO: 1661557 - RNA, 19 nt, Homo sapiens
uauccagaggguugugauu

SEQ ID NO: 1661558 - RNA, 15 nt, Homo sapiens
uaucccagugaucac

SEQ ID NO: 1661559 - RNA, 21 nt, Homo sapiens
uauccccggacgcaugcaggg

SEQ ID NO: 1661560 - RNA, 21 nt, Homo sapiens
uaucuacauaccuacaccuau

SEQ ID NO: 1661561 - RNA, 23 nt, Homo sapiens
uaucuggaaaauuccagagcuau

SEQ ID NO: 1661562 - RNA, 16 nt, Homo sapiens
uaucuguuugcuucua

SEQ ID NO: 1661563 - RNA, 23 nt, Homo sapiens
uaucuuaaaauugguuaaugaaa

SEQ ID NO: 1661564 - RNA, 22 nt, Homo sapiens
uaucuugaagacuuuucuuuca

SEQ ID NO: 1661565 - RNA, 21 nt, Homo sapiens
uaugacaugaucgcuuucuac

SEQ ID NO: 1661566 - RNA, 16 nt, Homo sapiens
uaugacuccagaauuu

SEQ ID NO: 1661567 - RNA, 15 nt, Homo sapiens
uaugagauacuuugc

SEQ ID NO: 1661568 - RNA, 24 nt, Homo sapiens
uaugaggggguuuggcaccaagcu

SEQ ID NO: 1661569 - RNA, 20 nt, Homo sapiens
uaugcacaccaaauugcuga

SEQ ID NO: 1661570 - RNA, 13 nt, Homo sapiens
uaugcagugucag

SEQ ID NO: 1661571 - RNA, 18 nt, Homo sapiens
uaugcauguagcauauaa

SEQ ID NO: 1661572 - RNA, 15 nt, Homo sapiens
uaugccuguugaucu

SEQ ID NO: 1661573 - RNA, 17 nt, Homo sapiens
uaugcgcaauguggcau

SEQ ID NO: 1661574 - RNA, 16 nt, Homo sapiens
uaugcuguaucugugc

SEQ ID NO: 1661575 - RNA, 13 nt, Homo sapiens
uauggaaagggug

SEQ ID NO: 1661576 - RNA, 22 nt, Homo sapiens
uauggaucuguugggaaccaga

SEQ ID NO: 1661577 - RNA, 17 nt, Homo sapiens
uaugggaggaacaaaga

SEQ ID NO: 1661578 - RNA, 19 nt, Homo sapiens
uaugguaaauaacugugac

SEQ ID NO: 1661579 - RNA, 16 nt, Homo sapiens
uauguaaacaucauaa

SEQ ID NO: 1661580 - RNA, 14 nt, Homo sapiens
uaugucucaugaug

SEQ ID NO: 1661581 - RNA, 23 nt, Homo sapiens
uaugucugugugccccuccugcc

SEQ ID NO: 1661582 - RNA, 14 nt, Homo sapiens
uaugugaagacaga

SEQ ID NO: 1661583 - RNA, 20 nt, Homo sapiens
uauguggaguucaucuugaa

SEQ ID NO: 1661584 - RNA, 12 nt, Homo sapiens
uauuaagcacau

SEQ ID NO: 1661585 - RNA, 14 nt, Homo sapiens
uauuaagcacauua

SEQ ID NO: 1661586 - RNA, 16 nt, Homo sapiens
uauuaguuccccaaau

SEQ ID NO: 1661587 - RNA, 15 nt, Homo sapiens
uauuauaucauuaac

SEQ ID NO: 1661588 - RNA, 17 nt, Homo sapiens
uauuauuuuugagacag

SEQ ID NO: 1661589 - RNA, 19 nt, Homo sapiens
uauucauuuauuggcuuaa

SEQ ID NO: 1661590 - RNA, 21 nt, Homo sapiens
uauucuaaggagcaaauaccu

SEQ ID NO: 1661591 - RNA, 18 nt, Homo sapiens
uauugaaugaugugauac

SEQ ID NO: 1661592 - RNA, 20 nt, Homo sapiens
uauugaaugaugugauacaa

SEQ ID NO: 1661593 - RNA, 18 nt, Homo sapiens
uauugagacacugucaag

SEQ ID NO: 1661594 - RNA, 23 nt, Homo sapiens
uauugauaauaaaauucauucca

SEQ ID NO: 1661595 - RNA, 15 nt, Homo sapiens
uauuggucuugcccu

SEQ ID NO: 1661596 - RNA, 21 nt, Homo sapiens
uauuguugcuuuuuuuccaau

SEQ ID NO: 1661597 - RNA, 11 nt, Homo sapiens
uauuucacuua

SEQ ID NO: 1661598 - RNA, 16 nt, Homo sapiens
uauuucagacacuaug

SEQ ID NO: 1661599 - RNA, 17 nt, Homo sapiens
uauuucagauucaccuc

SEQ ID NO: 1661600 - RNA, 19 nt, Homo sapiens
uauuucagucaucaucuca

SEQ ID NO: 1661601 - RNA, 14 nt, Homo sapiens
uauuuucacuggag

SEQ ID NO: 1661602 - RNA, 11 nt, Homo sapiens
ucaaaaaucau

SEQ ID NO: 1661603 - RNA, 20 nt, Homo sapiens
ucaaaagaucuccugugcac

SEQ ID NO: 1661604 - RNA, 22 nt, Homo sapiens
ucaaaauguggaccaguucccu

SEQ ID NO: 1661605 - RNA, 20 nt, Homo sapiens
ucaaaauguuguccuuuccc

SEQ ID NO: 1661606 - RNA, 15 nt, Homo sapiens
ucaaagaaguacugu

SEQ ID NO: 1661607 - RNA, 17 nt, Homo sapiens
ucaaaugcuacucagua

SEQ ID NO: 1661608 - RNA, 13 nt, Homo sapiens
ucaaauggaugua

SEQ ID NO: 1661609 - RNA, 15 nt, Homo sapiens
ucaaauuucagacca

SEQ ID NO: 1661610 - RNA, 21 nt, Homo sapiens
ucaaauuucagaccaguucuu

SEQ ID NO: 1661611 - RNA, 17 nt, Homo sapiens
ucaacagugaacagcuu

SEQ ID NO: 1661612 - RNA, 21 nt, Homo sapiens
ucaacauucccccaacauuac

SEQ ID NO: 1661613 - RNA, 12 nt, Homo sapiens
ucaaccccauga

SEQ ID NO: 1661614 - RNA, 15 nt, Homo sapiens
ucaaccccaugagac

SEQ ID NO: 1661615 - RNA, 16 nt, Homo sapiens
ucaacccccuaccccg

SEQ ID NO: 1661616 - RNA, 21 nt, Homo sapiens
ucaaccugguggcaccagaug

SEQ ID NO: 1661617 - RNA, 17 nt, Homo sapiens
ucaacucucuccugguc

SEQ ID NO: 1661618 - RNA, 14 nt, Homo sapiens
ucaacuucaggaaa

SEQ ID NO: 1661619 - RNA, 14 nt, Homo sapiens
ucaagaaugcagua

SEQ ID NO: 1661620 - RNA, 19 nt, Homo sapiens
ucaagacacagacaaaguc

SEQ ID NO: 1661621 - RNA, 19 nt, Homo sapiens
ucaagacuggcauggacau

SEQ ID NO: 1661622 - RNA, 13 nt, Homo sapiens
ucaagauccuguc

SEQ ID NO: 1661623 - RNA, 18 nt, Homo sapiens
ucaagauccugucuugcu

SEQ ID NO: 1661624 - RNA, 13 nt, Homo sapiens
ucaagaugugaca

SEQ ID NO: 1661625 - RNA, 21 nt, Homo sapiens
ucaagcaggcgccaagugcua

SEQ ID NO: 1661626 - RNA, 19 nt, Homo sapiens
ucaagcgauugucugagga

SEQ ID NO: 1661627 - RNA, 22 nt, Homo sapiens
ucaaguagcguuggagacauac

SEQ ID NO: 1661628 - RNA, 12 nt, Homo sapiens
ucaagugccaua

SEQ ID NO: 1661629 - RNA, 14 nt, Homo sapiens
ucaaguuaauucuc

SEQ ID NO: 1661630 - RNA, 14 nt, Homo sapiens
ucaauaaaauacuu

SEQ ID NO: 1661631 - RNA, 13 nt, Homo sapiens
ucaauaaggcagu

SEQ ID NO: 1661632 - RNA, 16 nt, Homo sapiens
ucaauacuuugaacac

SEQ ID NO: 1661633 - RNA, 15 nt, Homo sapiens
ucaaucaaacaggga

SEQ ID NO: 1661634 - RNA, 14 nt, Homo sapiens
ucaaugaacugugc

SEQ ID NO: 1661635 - RNA, 19 nt, Homo sapiens
ucaaugccaggcagugcag

SEQ ID NO: 1661636 - RNA, 22 nt, Homo sapiens
ucaauuuaaaaucagacucuuu

SEQ ID NO: 1661637 - RNA, 13 nt, Homo sapiens
ucaauuuaaagga

SEQ ID NO: 1661638 - RNA, 17 nt, Homo sapiens
ucacaaauaaacauaau

SEQ ID NO: 1661639 - RNA, 13 nt, Homo sapiens
ucacaacuuugcu

SEQ ID NO: 1661640 - RNA, 12 nt, Homo sapiens
ucacaagccaag

SEQ ID NO: 1661641 - RNA, 19 nt, Homo sapiens
ucacaccacuugugagcug

SEQ ID NO: 1661642 - RNA, 18 nt, Homo sapiens
ucacaccuuacaaagcca

SEQ ID NO: 1661643 - RNA, 20 nt, Homo sapiens
ucacacucggccacuagugg

SEQ ID NO: 1661644 - RNA, 23 nt, Homo sapiens
ucacacucucuucuuacuguauu

SEQ ID NO: 1661645 - RNA, 16 nt, Homo sapiens
ucacagacccacaaga

SEQ ID NO: 1661646 - RNA, 22 nt, Homo sapiens
ucacagcugauugggcaccuga

SEQ ID NO: 1661647 - RNA, 18 nt, Homo sapiens
ucacaugccccucuuaga

SEQ ID NO: 1661648 - RNA, 13 nt, Homo sapiens
ucacauucaugca

SEQ ID NO: 1661649 - RNA, 15 nt, Homo sapiens
ucaccaagcaggcaa

SEQ ID NO: 1661650 - RNA, 17 nt, Homo sapiens
ucaccaccgagacaguu

SEQ ID NO: 1661651 - RNA, 21 nt, Homo sapiens
ucaccauuuaaucauuuccag

SEQ ID NO: 1661652 - RNA, 20 nt, Homo sapiens
ucacccagguuggagugcag

SEQ ID NO: 1661653 - RNA, 21 nt, Homo sapiens
ucacccagguuggagugcagu

SEQ ID NO: 1661654 - RNA, 16 nt, Homo sapiens
ucaccgugacauucca

SEQ ID NO: 1661655 - RNA, 17 nt, Homo sapiens
ucaccuaauuaauuuca

SEQ ID NO: 1661656 - RNA, 19 nt, Homo sapiens
ucaccucaggaccauguga

SEQ ID NO: 1661657 - RNA, 23 nt, Homo sapiens
ucaccucaggaccaugugauaau

SEQ ID NO: 1661658 - RNA, 13 nt, Homo sapiens
ucaccuguaaaac

SEQ ID NO: 1661659 - RNA, 21 nt, Homo sapiens
ucacgcuuucaugaccacugg

SEQ ID NO: 1661660 - RNA, 20 nt, Homo sapiens
ucacuauccaugcaccaaac

SEQ ID NO: 1661661 - RNA, 23 nt, Homo sapiens
ucacucaaugccaggcagugcag

SEQ ID NO: 1661662 - RNA, 14 nt, Homo sapiens
ucacugcaaccucu

SEQ ID NO: 1661663 - RNA, 18 nt, Homo sapiens
ucacugcuuuuuccuuag

SEQ ID NO: 1661664 - RNA, 21 nt, Homo sapiens
ucacugcuuuuuccuuagcuu

SEQ ID NO: 1661665 - RNA, 14 nt, Homo sapiens
ucacuggaacacua

SEQ ID NO: 1661666 - RNA, 14 nt, Homo sapiens
ucacugugucucau

SEQ ID NO: 1661667 - RNA, 16 nt, Homo sapiens
ucacuuaaaaguauca

SEQ ID NO: 1661668 - RNA, 13 nt, Homo sapiens
ucacuuccccaau

SEQ ID NO: 1661669 - RNA, 21 nt, Homo sapiens
ucacuuuuaauuagugaugca

SEQ ID NO: 1661670 - RNA, 18 nt, Homo sapiens
ucacuuuuuuccugucaa

SEQ ID NO: 1661671 - RNA, 19 nt, Homo sapiens
ucagaaaauuagcaugaaa

SEQ ID NO: 1661672 - RNA, 23 nt, Homo sapiens
ucagacgggcugagaggaugaac

SEQ ID NO: 1661673 - RNA, 17 nt, Homo sapiens
ucagaucugaaguagug

SEQ ID NO: 1661674 - RNA, 16 nt, Homo sapiens
ucagaugaucucucca

SEQ ID NO: 1661675 - RNA, 20 nt, Homo sapiens
ucagaugauucuaugucuca

SEQ ID NO: 1661676 - RNA, 23 nt, Homo sapiens
ucagaugauucuaugucucauga

SEQ ID NO: 1661677 - RNA, 12 nt, Homo sapiens
ucagauucaccu

SEQ ID NO: 1661678 - RNA, 19 nt, Homo sapiens
ucagauuuuuaaaagcccu

SEQ ID NO: 1661679 - RNA, 21 nt, Homo sapiens
ucagcaacccuacaguauaua

SEQ ID NO: 1661680 - RNA, 22 nt, Homo sapiens
ucagcaaggaacaucccugaga

SEQ ID NO: 1661681 - RNA, 17 nt, Homo sapiens
ucagcaaucacaagcca

SEQ ID NO: 1661682 - RNA, 12 nt, Homo sapiens
ucagcacauguu

SEQ ID NO: 1661683 - RNA, 14 nt, Homo sapiens
ucagcaucacgaca

SEQ ID NO: 1661684 - RNA, 22 nt, Homo sapiens
ucagcccuguguauaaagccau

SEQ ID NO: 1661685 - RNA, 14 nt, Homo sapiens
ucagccucccaaag

SEQ ID NO: 1661686 - RNA, 21 nt, Homo sapiens
ucagcuagauuuguguccaca

SEQ ID NO: 1661687 - RNA, 14 nt, Homo sapiens
ucagcucacugcaa

SEQ ID NO: 1661688 - RNA, 12 nt, Homo sapiens
ucagcuccuucc

SEQ ID NO: 1661689 - RNA, 13 nt, Homo sapiens
ucagcucugcaua

SEQ ID NO: 1661690 - RNA, 23 nt, Homo sapiens
ucagcuuuauaauaaacuguuua

SEQ ID NO: 1661691 - RNA, 22 nt, Homo sapiens
ucaggaaauguucacugaauaa

SEQ ID NO: 1661692 - RNA, 21 nt, Homo sapiens
ucaggaaugcagcacaguacu

SEQ ID NO: 1661693 - RNA, 17 nt, Homo sapiens
ucaggaccaugugauaa

SEQ ID NO: 1661694 - RNA, 20 nt, Homo sapiens
ucaggacccagggaaugcca

SEQ ID NO: 1661695 - RNA, 17 nt, Homo sapiens
ucaggagaaaccccuga

SEQ ID NO: 1661696 - RNA, 15 nt, Homo sapiens
ucaggagaaacucgg

SEQ ID NO: 1661697 - RNA, 21 nt, Homo sapiens
ucaggauugaggaugaacuca

SEQ ID NO: 1661698 - RNA, 16 nt, Homo sapiens
ucaggcucugaaucuc

SEQ ID NO: 1661699 - RNA, 12 nt, Homo sapiens
ucaggcuuucua

SEQ ID NO: 1661700 - RNA, 15 nt, Homo sapiens
gaccucccacugccc

SEQ ID NO: 1661701 - RNA, 21 nt, Homo sapiens
gaccuggauaauuauaucaga

SEQ ID NO: 1661702 - RNA, 18 nt, Homo sapiens
gaccuggggggggcaaga

SEQ ID NO: 1661703 - RNA, 18 nt, Homo sapiens
gaccuugaaugaugccau

SEQ ID NO: 1661704 - RNA, 18 nt, Homo sapiens
gaccuugcuuccuucuca

SEQ ID NO: 1661705 - RNA, 13 nt, Homo sapiens
gaccuuuauuuau

SEQ ID NO: 1661706 - RNA, 15 nt, Homo sapiens
gacgagcaugagcug

SEQ ID NO: 1661707 - RNA, 14 nt, Homo sapiens
gacgcaugcagggc

SEQ ID NO: 1661708 - RNA, 19 nt, Homo sapiens
gacuagaacacaaauccaa

SEQ ID NO: 1661709 - RNA, 14 nt, Homo sapiens
gacuaguuuacaaa

SEQ ID NO: 1661710 - RNA, 12 nt, Homo sapiens
gacuauggagcc

SEQ ID NO: 1661711 - RNA, 22 nt, Homo sapiens
gacucgauagugguggugaaca

SEQ ID NO: 1661712 - RNA, 22 nt, Homo sapiens
gacucuguaacaucacuaucca

SEQ ID NO: 1661713 - RNA, 19 nt, Homo sapiens
gacuggacagaucugagga

SEQ ID NO: 1661714 - RNA, 16 nt, Homo sapiens
gacuggacuguguuuu

SEQ ID NO: 1661715 - RNA, 14 nt, Homo sapiens
gacuggcacacugg

SEQ ID NO: 1661716 - RNA, 21 nt, Homo sapiens
gacugguggaaggaaaacaaa

SEQ ID NO: 1661717 - RNA, 22 nt, Homo sapiens
gacuguguuuuuccuaugcagu

SEQ ID NO: 1661718 - RNA, 21 nt, Homo sapiens
gacuugagcccagagugaaca

SEQ ID NO: 1661719 - RNA, 19 nt, Homo sapiens
gagaaaacaggcucacaga

SEQ ID NO: 1661720 - RNA, 13 nt, Homo sapiens
gagaaaagccaga

SEQ ID NO: 1661721 - RNA, 14 nt, Homo sapiens
gagaaaagccagau

SEQ ID NO: 1661722 - RNA, 14 nt, Homo sapiens
gagaaaccucggaa

SEQ ID NO: 1661723 - RNA, 23 nt, Homo sapiens
gagaaacgaaaaccacaaaaaga

SEQ ID NO: 1661724 - RNA, 19 nt, Homo sapiens
gagaaauugugccaaagau

SEQ ID NO: 1661725 - RNA, 12 nt, Homo sapiens
gagaacagggau

SEQ ID NO: 1661726 - RNA, 18 nt, Homo sapiens
gagaacccaaacuuccca

SEQ ID NO: 1661727 - RNA, 17 nt, Homo sapiens
gagaagaaguuugacca

SEQ ID NO: 1661728 - RNA, 16 nt, Homo sapiens
gagaagcugucaggga

SEQ ID NO: 1661729 - RNA, 14 nt, Homo sapiens
gagaaggaaggcuc

SEQ ID NO: 1661730 - RNA, 15 nt, Homo sapiens
gagaaggccaggaaa

SEQ ID NO: 1661731 - RNA, 15 nt, Homo sapiens
gagaauaacacuggc

SEQ ID NO: 1661732 - RNA, 17 nt, Homo sapiens
gagaaucaacagaucaa

SEQ ID NO: 1661733 - RNA, 16 nt, Homo sapiens
gagaaugucauuugcu

SEQ ID NO: 1661734 - RNA, 21 nt, Homo sapiens
gagacagagucuuacucuguu

SEQ ID NO: 1661735 - RNA, 16 nt, Homo sapiens
gagacuauggagccug

SEQ ID NO: 1661736 - RNA, 21 nt, Homo sapiens
gagacuaugugucaugauuuc

SEQ ID NO: 1661737 - RNA, 15 nt, Homo sapiens
gagacuccaucucaa

SEQ ID NO: 1661738 - RNA, 13 nt, Homo sapiens
gagacuugcaguu

SEQ ID NO: 1661739 - RNA, 16 nt, Homo sapiens
gagagaacagggaugc

SEQ ID NO: 1661740 - RNA, 21 nt, Homo sapiens
gagagaacagggaugcuaucu

SEQ ID NO: 1661741 - RNA, 21 nt, Homo sapiens
gagagagcaaucuugcuguga

SEQ ID NO: 1661742 - RNA, 20 nt, Homo sapiens
gagagcaaucuugcugugaa

SEQ ID NO: 1661743 - RNA, 18 nt, Homo sapiens
gagagcccucugcugcuu

SEQ ID NO: 1661744 - RNA, 16 nt, Homo sapiens
gagagcgccacccgcc

SEQ ID NO: 1661745 - RNA, 14 nt, Homo sapiens
gagagcggcuuccc

SEQ ID NO: 1661746 - RNA, 18 nt, Homo sapiens
gagagggcugcugaccau

SEQ ID NO: 1661747 - RNA, 12 nt, Homo sapiens
gagaguaucuga

SEQ ID NO: 1661748 - RNA, 22 nt, Homo sapiens
gagaguuucuauggauucacuu

SEQ ID NO: 1661749 - RNA, 20 nt, Homo sapiens
gagauaaccuuaaacucuga

SEQ ID NO: 1661750 - RNA, 20 nt, Homo sapiens
gagaucaugucauugaugaa

SEQ ID NO: 1661751 - RNA, 17 nt, Homo sapiens
gagaucuuaagauucca

SEQ ID NO: 1661752 - RNA, 14 nt, Homo sapiens
gagauggccaugua

SEQ ID NO: 1661753 - RNA, 21 nt, Homo sapiens
gagaugggguuucaccauguu

SEQ ID NO: 1661754 - RNA, 12 nt, Homo sapiens
gagauugugcuc

SEQ ID NO: 1661755 - RNA, 14 nt, Homo sapiens
gagcacagccauag

SEQ ID NO: 1661756 - RNA, 14 nt, Homo sapiens
gagcagccucuuga

SEQ ID NO: 1661757 - RNA, 22 nt, Homo sapiens
gagcagccucuugaaugcuuaa

SEQ ID NO: 1661758 - RNA, 20 nt, Homo sapiens
gagcaguguuuugcagaaug

SEQ ID NO: 1661759 - RNA, 16 nt, Homo sapiens
gagccaccacauccag

SEQ ID NO: 1661760 - RNA, 22 nt, Homo sapiens
gagccaccacauccagccuaac

SEQ ID NO: 1661761 - RNA, 16 nt, Homo sapiens
cuugcaugugcugcag

SEQ ID NO: 1661762 - RNA, 14 nt, Homo sapiens
cuugccacugccau

SEQ ID NO: 1661763 - RNA, 14 nt, Homo sapiens
cuugcccuuaauau

SEQ ID NO: 1661764 - RNA, 16 nt, Homo sapiens
cuugccucauuuugcu

SEQ ID NO: 1661765 - RNA, 19 nt, Homo sapiens
cuugcugccccacaacaca

SEQ ID NO: 1661766 - RNA, 15 nt, Homo sapiens
cuugcugugaaauga

SEQ ID NO: 1661767 - RNA, 14 nt, Homo sapiens
cuuggaacauggaa

SEQ ID NO: 1661768 - RNA, 13 nt, Homo sapiens
cuuggagugccac

SEQ ID NO: 1661769 - RNA, 17 nt, Homo sapiens
cuuggcugcuguaucuu

SEQ ID NO: 1661770 - RNA, 13 nt, Homo sapiens
cuugggagcaaaa

SEQ ID NO: 1661771 - RNA, 19 nt, Homo sapiens
cuuggucuguguucucaac

SEQ ID NO: 1661772 - RNA, 21 nt, Homo sapiens
cuuggugguuaugucccauga

SEQ ID NO: 1661773 - RNA, 18 nt, Homo sapiens
cuugguuuugauguugaa

SEQ ID NO: 1661774 - RNA, 16 nt, Homo sapiens
cuugguuuugccucuu

SEQ ID NO: 1661775 - RNA, 22 nt, Homo sapiens
cuuguaaaaacuuuuaagccau

SEQ ID NO: 1661776 - RNA, 13 nt, Homo sapiens
cuuguaaugcuca

SEQ ID NO: 1661777 - RNA, 21 nt, Homo sapiens
cuuguaccagcccaggcaaua

SEQ ID NO: 1661778 - RNA, 14 nt, Homo sapiens
cuuguacuuuacaa

SEQ ID NO: 1661779 - RNA, 19 nt, Homo sapiens
cuugugagcaagguggugu

SEQ ID NO: 1661780 - RNA, 12 nt, Homo sapiens
cuuguguacaaa

SEQ ID NO: 1661781 - RNA, 16 nt, Homo sapiens
cuuguguucaaucugu

SEQ ID NO: 1661782 - RNA, 20 nt, Homo sapiens
cuuguuaaaugagcuuaaug

SEQ ID NO: 1661783 - RNA, 12 nt, Homo sapiens
cuuguugcugca

SEQ ID NO: 1661784 - RNA, 14 nt, Homo sapiens
cuuguugcugcauc

SEQ ID NO: 1661785 - RNA, 15 nt, Homo sapiens
cuuuaaaaugauuca

SEQ ID NO: 1661786 - RNA, 14 nt, Homo sapiens
cuuuaacaagacuu

SEQ ID NO: 1661787 - RNA, 21 nt, Homo sapiens
cuuuaauucuuuucccagaag

SEQ ID NO: 1661788 - RNA, 16 nt, Homo sapiens
cuuuagccaagugcag

SEQ ID NO: 1661789 - RNA, 18 nt, Homo sapiens
cuuuaguauuauauuaau

SEQ ID NO: 1661790 - RNA, 20 nt, Homo sapiens
cuuuaguugauuuaaacucu

SEQ ID NO: 1661791 - RNA, 13 nt, Homo sapiens
cuuuaugauuuca

SEQ ID NO: 1661792 - RNA, 12 nt, Homo sapiens
cuuucaccucag

SEQ ID NO: 1661793 - RNA, 18 nt, Homo sapiens
cuuucauccaacuggaag

SEQ ID NO: 1661794 - RNA, 13 nt, Homo sapiens
cuuucauccucag

SEQ ID NO: 1661795 - RNA, 23 nt, Homo sapiens
cuuuccaggaaggcuaaagggaa

SEQ ID NO: 1661796 - RNA, 15 nt, Homo sapiens
cuuucccaucuuaaa

SEQ ID NO: 1661797 - RNA, 20 nt, Homo sapiens
cuuuccucuuaaugucucaa

SEQ ID NO: 1661798 - RNA, 21 nt, Homo sapiens
cuuuccucuuaaugucucaaa

SEQ ID NO: 1661799 - RNA, 20 nt, Homo sapiens
cuuuccugaucacuaugcau

SEQ ID NO: 1661800 - RNA, 17 nt, Homo sapiens
cuuuccuuucauccuca

SEQ ID NO: 1661801 - RNA, 16 nt, Homo sapiens
cuuucggucuccuuaa

SEQ ID NO: 1661802 - RNA, 18 nt, Homo sapiens
cuuucuauuggcauggau

SEQ ID NO: 1661803 - RNA, 17 nt, Homo sapiens
cuuucucagcaguggug

SEQ ID NO: 1661804 - RNA, 15 nt, Homo sapiens
cuuucucucuuucca

SEQ ID NO: 1661805 - RNA, 13 nt, Homo sapiens
cuuucugcaugac

SEQ ID NO: 1661806 - RNA, 15 nt, Homo sapiens
cuuucuuguugcugc

SEQ ID NO: 1661807 - RNA, 21 nt, Homo sapiens
cuuucuuguugcugcaucucc

SEQ ID NO: 1661808 - RNA, 21 nt, Homo sapiens
cuuucuuuaacauaucauuca

SEQ ID NO: 1661809 - RNA, 20 nt, Homo sapiens
cuuucuuugagaaagacaau

SEQ ID NO: 1661810 - RNA, 16 nt, Homo sapiens
cuuugagggcugacaa

SEQ ID NO: 1661811 - RNA, 16 nt, Homo sapiens
cuuugauucaccaaac

SEQ ID NO: 1661812 - RNA, 21 nt, Homo sapiens
cuuugccaucaagaaacauuc

SEQ ID NO: 1661813 - RNA, 17 nt, Homo sapiens
cuuugccauccuugcac

SEQ ID NO: 1661814 - RNA, 23 nt, Homo sapiens
cuuugcccuuggaggauccccag

SEQ ID NO: 1661815 - RNA, 15 nt, Homo sapiens
cuuugcucaguggau

SEQ ID NO: 1661816 - RNA, 21 nt, Homo sapiens
cuuuggcuuaauuccaaucau

SEQ ID NO: 1661817 - RNA, 14 nt, Homo sapiens
cuuuguacagacaa

SEQ ID NO: 1661818 - RNA, 14 nt, Homo sapiens
cuuuguacugauga

SEQ ID NO: 1661819 - RNA, 15 nt, Homo sapiens
cuuuuaagccaauau

SEQ ID NO: 1661820 - RNA, 17 nt, Homo sapiens
cuuuuaaugucaucucu

SEQ ID NO: 1661821 - RNA, 17 nt, Homo sapiens
cuuuucccaaacugauc

SEQ ID NO: 1661822 - RNA, 19 nt, Homo sapiens
cuuuuccuggacacuuuac

SEQ ID NO: 1661823 - RNA, 18 nt, Homo sapiens
cuuuuccugggugcucag

SEQ ID NO: 1661824 - RNA, 15 nt, Homo sapiens
uccccuggacauauu

SEQ ID NO: 1661825 - RNA, 20 nt, Homo sapiens
uccccugguccugcacuguc

SEQ ID NO: 1661826 - RNA, 14 nt, Homo sapiens
uccccuucugcaau

SEQ ID NO: 1661827 - RNA, 14 nt, Homo sapiens
ucccgcaugcugcc

SEQ ID NO: 1661828 - RNA, 15 nt, Homo sapiens
ucccgccauuggccu

SEQ ID NO: 1661829 - RNA, 21 nt, Homo sapiens
ucccgggcacugucaugccca

SEQ ID NO: 1661830 - RNA, 21 nt, Homo sapiens
ucccgguguaugcagugguga

SEQ ID NO: 1661831 - RNA, 23 nt, Homo sapiens
ucccuaaguccacucuaguugug

SEQ ID NO: 1661832 - RNA, 14 nt, Homo sapiens
ucccuagcagugaa

SEQ ID NO: 1661833 - RNA, 13 nt, Homo sapiens
ucccuagccagag

SEQ ID NO: 1661834 - RNA, 20 nt, Homo sapiens
ucccuagccagaggcucuaa

SEQ ID NO: 1661835 - RNA, 12 nt, Homo sapiens
ucccuagcuuau

SEQ ID NO: 1661836 - RNA, 15 nt, Homo sapiens
ucccucaguccuuua

SEQ ID NO: 1661837 - RNA, 15 nt, Homo sapiens
ucccuccacauuucc

SEQ ID NO: 1661838 - RNA, 22 nt, Homo sapiens
ucccuccagggccacugcuuga

SEQ ID NO: 1661839 - RNA, 22 nt, Homo sapiens
ucccuccccuccccguccacag

SEQ ID NO: 1661840 - RNA, 14 nt, Homo sapiens
ucccuccuuuacca

SEQ ID NO: 1661841 - RNA, 14 nt, Homo sapiens
ucccucgcuguaug

SEQ ID NO: 1661842 - RNA, 14 nt, Homo sapiens
ucccugaacacuca

SEQ ID NO: 1661843 - RNA, 14 nt, Homo sapiens
ucccugacacuguc

SEQ ID NO: 1661844 - RNA, 11 nt, Homo sapiens
ucccugagaaa

SEQ ID NO: 1661845 - RNA, 20 nt, Homo sapiens
ucccugcaaggugcaccugc

SEQ ID NO: 1661846 - RNA, 15 nt, Homo sapiens
ucccugcagagccaa

SEQ ID NO: 1661847 - RNA, 12 nt, Homo sapiens
ucccugcaguaa

SEQ ID NO: 1661848 - RNA, 23 nt, Homo sapiens
ucccuggaaauaacugagcacuu

SEQ ID NO: 1661849 - RNA, 14 nt, Homo sapiens
ucccuggugauggu

SEQ ID NO: 1661850 - RNA, 23 nt, Homo sapiens
ucccugucugucugucucucuuu

SEQ ID NO: 1661851 - RNA, 16 nt, Homo sapiens
ucccuuaaucugccag

SEQ ID NO: 1661852 - RNA, 16 nt, Homo sapiens
ucccuuccccacaaua

SEQ ID NO: 1661853 - RNA, 21 nt, Homo sapiens
ucccuuccccacaauaggcuu

SEQ ID NO: 1661854 - RNA, 20 nt, Homo sapiens
ucccuucucacagcacaugc

SEQ ID NO: 1661855 - RNA, 20 nt, Homo sapiens
ucccuuuuuaaacaaauggc

SEQ ID NO: 1661856 - RNA, 20 nt, Homo sapiens
uccgaagaaugaagucuuuc

SEQ ID NO: 1661857 - RNA, 21 nt, Homo sapiens
uccgaagaaugaagucuuucc

SEQ ID NO: 1661858 - RNA, 20 nt, Homo sapiens
uccgacuucucuagacaucu

SEQ ID NO: 1661859 - RNA, 17 nt, Homo sapiens
uccgcagacuuggucau

SEQ ID NO: 1661860 - RNA, 20 nt, Homo sapiens
uccgcgugucucauuugcca

SEQ ID NO: 1661861 - RNA, 18 nt, Homo sapiens
uccuaagcuggagugcag

SEQ ID NO: 1661862 - RNA, 11 nt, Homo sapiens
uccuacaaggg

SEQ ID NO: 1661863 - RNA, 14 nt, Homo sapiens
uccuacaauaucau

SEQ ID NO: 1661864 - RNA, 21 nt, Homo sapiens
uccuacuuuacauaugcuuua

SEQ ID NO: 1661865 - RNA, 19 nt, Homo sapiens
uccuagccucuccgcccac

SEQ ID NO: 1661866 - RNA, 19 nt, Homo sapiens
uccuaggggccgagggaaa

SEQ ID NO: 1661867 - RNA, 14 nt, Homo sapiens
uccuaguuugaccu

SEQ ID NO: 1661868 - RNA, 22 nt, Homo sapiens
uccuaucccuggacgcaugcag

SEQ ID NO: 1661869 - RNA, 15 nt, Homo sapiens
uccucaaaaaucauc

SEQ ID NO: 1661870 - RNA, 16 nt, Homo sapiens
uccucaauuccaggga

SEQ ID NO: 1661871 - RNA, 12 nt, Homo sapiens
uccucacacaga

SEQ ID NO: 1661872 - RNA, 12 nt, Homo sapiens
uccucacugcca

SEQ ID NO: 1661873 - RNA, 13 nt, Homo sapiens
uccucacuuuuau

SEQ ID NO: 1661874 - RNA, 22 nt, Homo sapiens
uccucauauacuugaauauuau

SEQ ID NO: 1661875 - RNA, 20 nt, Homo sapiens
uccuccaaagccugggcaga

SEQ ID NO: 1661876 - RNA, 14 nt, Homo sapiens
uccuccuucacucc

SEQ ID NO: 1661877 - RNA, 15 nt, Homo sapiens
uccucugcuugucau

SEQ ID NO: 1661878 - RNA, 12 nt, Homo sapiens
uccucuuaauuc

SEQ ID NO: 1661879 - RNA, 12 nt, Homo sapiens
uccucuuaccug

SEQ ID NO: 1661880 - RNA, 11 nt, Homo sapiens
uccucuuucac

SEQ ID NO: 1661881 - RNA, 18 nt, Homo sapiens
uccucuuucacuucuuau

SEQ ID NO: 1661882 - RNA, 19 nt, Homo sapiens
uccugaaaaggguguugcu

SEQ ID NO: 1661883 - RNA, 16 nt, Homo sapiens
uccugacaaaagggac

SEQ ID NO: 1661884 - RNA, 17 nt, Homo sapiens
uccugacaaaagggaca

SEQ ID NO: 1661885 - RNA, 19 nt, Homo sapiens
aaacaaaacuugcaugcag

SEQ ID NO: 1661886 - RNA, 23 nt, Homo sapiens
aaacaaaauuuaugucauuuuca

SEQ ID NO: 1661887 - RNA, 18 nt, Homo sapiens
aaacaacaaauaagucaa

SEQ ID NO: 1661888 - RNA, 23 nt, Homo sapiens
aaacaaccugccacaaugugaua

SEQ ID NO: 1661889 - RNA, 19 nt, Homo sapiens
aaacacaagacugucauua

SEQ ID NO: 1661890 - RNA, 21 nt, Homo sapiens
aaacagcggcuccacuaaaga

SEQ ID NO: 1661891 - RNA, 21 nt, Homo sapiens
aaacagcggcuccacuacaga

SEQ ID NO: 1661892 - RNA, 22 nt, Homo sapiens
aaacagcguaacggagggugaa

SEQ ID NO: 1661893 - RNA, 16 nt, Homo sapiens
aaacagcuugaugcug

SEQ ID NO: 1661894 - RNA, 12 nt, Homo sapiens
aaacaggugcua

SEQ ID NO: 1661895 - RNA, 15 nt, Homo sapiens
aaacaggugcuaaca

SEQ ID NO: 1661896 - RNA, 22 nt, Homo sapiens
aaacaguguuuccagugacaca

SEQ ID NO: 1661897 - RNA, 17 nt, Homo sapiens
aaacauaauaaaaggag

SEQ ID NO: 1661898 - RNA, 14 nt, Homo sapiens
aaacaugaauguac

SEQ ID NO: 1661899 - RNA, 13 nt, Homo sapiens
aaaccaccuuccc

SEQ ID NO: 1661900 - RNA, 15 nt, Homo sapiens
aaaccaggccuccaa

SEQ ID NO: 1661901 - RNA, 14 nt, Homo sapiens
aaaccaucuggccu

SEQ ID NO: 1661902 - RNA, 23 nt, Homo sapiens
aaacccaaauaaauguguaaaug

SEQ ID NO: 1661903 - RNA, 16 nt, Homo sapiens
aaacccaacuccucuc

SEQ ID NO: 1661904 - RNA, 19 nt, Homo sapiens
aaacccacauaaacacuuc

SEQ ID NO: 1661905 - RNA, 13 nt, Homo sapiens
aaaccuccacugc

SEQ ID NO: 1661906 - RNA, 22 nt, Homo sapiens
aaaccugauacaauuugcccaa

SEQ ID NO: 1661907 - RNA, 12 nt, Homo sapiens
aaacugcacugu

SEQ ID NO: 1661908 - RNA, 23 nt, Homo sapiens
aaacuggaaaguacguuaugaua

SEQ ID NO: 1661909 - RNA, 23 nt, Homo sapiens
aaacuguacaguuucuuccccaa

SEQ ID NO: 1661910 - RNA, 21 nt, Homo sapiens
aaacugugagauaaauaucau

SEQ ID NO: 1661911 - RNA, 15 nt, Homo sapiens
aaacuuccagguucc

SEQ ID NO: 1661912 - RNA, 24 nt, Homo sapiens
aaacuuccauagcuucauccacug

SEQ ID NO: 1661913 - RNA, 16 nt, Homo sapiens
aaacuucucacccgcu

SEQ ID NO: 1661914 - RNA, 19 nt, Homo sapiens
aaacuuguacuuacacuga

SEQ ID NO: 1661915 - RNA, 23 nt, Homo sapiens
aaacuuugacgagucaccuucca

SEQ ID NO: 1661916 - RNA, 12 nt, Homo sapiens
aaagaaucauuu

SEQ ID NO: 1661917 - RNA, 22 nt, Homo sapiens
aaagaaucccuguucauuguaa

SEQ ID NO: 1661918 - RNA, 22 nt, Homo sapiens
aaagacaaaugggccugccaaa

SEQ ID NO: 1661919 - RNA, 17 nt, Homo sapiens
aaagaggcuaugugagc

SEQ ID NO: 1661920 - RNA, 18 nt, Homo sapiens
aaagaggggaagagacuu

SEQ ID NO: 1661921 - RNA, 20 nt, Homo sapiens
aaagaugcagccgccuuccu

SEQ ID NO: 1661922 - RNA, 17 nt, Homo sapiens
aaagauggaaguguauu

SEQ ID NO: 1661923 - RNA, 18 nt, Homo sapiens
aaagauggcuuccgugag

SEQ ID NO: 1661924 - RNA, 17 nt, Homo sapiens
aaagauucuacaaagcu

SEQ ID NO: 1661925 - RNA, 16 nt, Homo sapiens
aaagcaaugugguagu

SEQ ID NO: 1661926 - RNA, 12 nt, Homo sapiens
aaagcagugcag

SEQ ID NO: 1661927 - RNA, 23 nt, Homo sapiens
aaagcagugcaugcugucccuua

SEQ ID NO: 1661928 - RNA, 18 nt, Homo sapiens
aaagcaucuaugugagac

SEQ ID NO: 1661929 - RNA, 18 nt, Homo sapiens
aaagcaugcucaguauug

SEQ ID NO: 1661930 - RNA, 15 nt, Homo sapiens
aaagccaaguguccu

SEQ ID NO: 1661931 - RNA, 15 nt, Homo sapiens
aaagccauggugugu

SEQ ID NO: 1661932 - RNA, 17 nt, Homo sapiens
aaagccucugugcugca

SEQ ID NO: 1661933 - RNA, 21 nt, Homo sapiens
aaagcuaaacaaaacuugcau

SEQ ID NO: 1661934 - RNA, 13 nt, Homo sapiens
aaaggaacuggaa

SEQ ID NO: 1661935 - RNA, 21 nt, Homo sapiens
aaaggaagccucuucaucucc

SEQ ID NO: 1661936 - RNA, 19 nt, Homo sapiens
aaaggagcauauaaggcua

SEQ ID NO: 1661937 - RNA, 16 nt, Homo sapiens
aaaggaugcccaaaga

SEQ ID NO: 1661938 - RNA, 21 nt, Homo sapiens
aaaggcuggaugugcuuucau

SEQ ID NO: 1661939 - RNA, 16 nt, Homo sapiens
aaagggaaaacaaaua

SEQ ID NO: 1661940 - RNA, 18 nt, Homo sapiens
aaagggagccaugcucuu

SEQ ID NO: 1661941 - RNA, 18 nt, Homo sapiens
aaagguagcuuaccugac

SEQ ID NO: 1661942 - RNA, 12 nt, Homo sapiens
aaaggugguggu

SEQ ID NO: 1661943 - RNA, 15 nt, Homo sapiens
aaagguucugaaaag

SEQ ID NO: 1661944 - RNA, 22 nt, Homo sapiens
aaagugauuccuucuugcucag

SEQ ID NO: 1661945 - RNA, 9 nt, Homo sapiens
aaagugcaa

SEQ ID NO: 1661946 - RNA, 18 nt, Homo sapiens
acgaaacacaaaccacaa

SEQ ID NO: 1661947 - RNA, 12 nt, Homo sapiens
acgaaagcacag

SEQ ID NO: 1661948 - RNA, 14 nt, Homo sapiens
acgaagaccccagg

SEQ ID NO: 1661949 - RNA, 19 nt, Homo sapiens
acgcaaccaccaccaacca

SEQ ID NO: 1661950 - RNA, 20 nt, Homo sapiens
acgcacacacacgcaaauac

SEQ ID NO: 1661951 - RNA, 21 nt, Homo sapiens
acgcagacauuuuuuagggga

SEQ ID NO: 1661952 - RNA, 13 nt, Homo sapiens
acgccuccaucca

SEQ ID NO: 1661953 - RNA, 14 nt, Homo sapiens
acgcuugacaguua

SEQ ID NO: 1661954 - RNA, 11 nt, Homo sapiens
acggaaccuac

SEQ ID NO: 1661955 - RNA, 22 nt, Homo sapiens
acggaccugcuuugagauuucc

SEQ ID NO: 1661956 - RNA, 23 nt, Homo sapiens
acggaguuuaguuuuauauugcu

SEQ ID NO: 1661957 - RNA, 16 nt, Homo sapiens
acggccgucccugacu

SEQ ID NO: 1661958 - RNA, 19 nt, Homo sapiens
acgguccuuugagugucag

SEQ ID NO: 1661959 - RNA, 17 nt, Homo sapiens
acgucccgggcacuguc

SEQ ID NO: 1661960 - RNA, 23 nt, Homo sapiens
acguccugggugcugucaugccc

SEQ ID NO: 1661961 - RNA, 19 nt, Homo sapiens
acgugaauagcgcccucaa

SEQ ID NO: 1661962 - RNA, 13 nt, Homo sapiens
acgugacccugug

SEQ ID NO: 1661963 - RNA, 22 nt, Homo sapiens
acguggugcuucucacacugga

SEQ ID NO: 1661964 - RNA, 19 nt, Homo sapiens
acguguuaugacuccagaa

SEQ ID NO: 1661965 - RNA, 16 nt, Homo sapiens
acuaaaagugauguga

SEQ ID NO: 1661966 - RNA, 12 nt, Homo sapiens
acuaacacuggc

SEQ ID NO: 1661967 - RNA, 16 nt, Homo sapiens
acuaacgccauccagg

SEQ ID NO: 1661968 - RNA, 17 nt, Homo sapiens
acuaauccucucugcaa

SEQ ID NO: 1661969 - RNA, 15 nt, Homo sapiens
acuaaugacaaguga

SEQ ID NO: 1661970 - RNA, 20 nt, Homo sapiens
acuaaugaggaaacugcacu

SEQ ID NO: 1661971 - RNA, 19 nt, Homo sapiens
acuaaugucagcacauguu

SEQ ID NO: 1661972 - RNA, 13 nt, Homo sapiens
acuacaagggcau

SEQ ID NO: 1661973 - RNA, 15 nt, Homo sapiens
acuacagaaguggaa

SEQ ID NO: 1661974 - RNA, 16 nt, Homo sapiens
acuacagaaguggaag

SEQ ID NO: 1661975 - RNA, 15 nt, Homo sapiens
acuacagacauuaaa

SEQ ID NO: 1661976 - RNA, 20 nt, Homo sapiens
acuaccccagaacgcaugca

SEQ ID NO: 1661977 - RNA, 21 nt, Homo sapiens
acuaccuuuggcuuaauucca

SEQ ID NO: 1661978 - RNA, 18 nt, Homo sapiens
acuagaacacaaauccaa

SEQ ID NO: 1661979 - RNA, 18 nt, Homo sapiens
acuagaguauguguaugu

SEQ ID NO: 1661980 - RNA, 22 nt, Homo sapiens
acuagcaauaaguugaaugaua

SEQ ID NO: 1661981 - RNA, 24 nt, Homo sapiens
acuaguaaucuuggcccuauucau

SEQ ID NO: 1661982 - RNA, 16 nt, Homo sapiens
acuaugauuccaauua

SEQ ID NO: 1661983 - RNA, 17 nt, Homo sapiens
acuaugccuguugaucu

SEQ ID NO: 1661984 - RNA, 19 nt, Homo sapiens
acuauggagccuggcacag

SEQ ID NO: 1661985 - RNA, 18 nt, Homo sapiens
acuauuugauaaugcaua

SEQ ID NO: 1661986 - RNA, 20 nt, Homo sapiens
acucacuaaaaguucucaaa

SEQ ID NO: 1661987 - RNA, 22 nt, Homo sapiens
acucaguaacacagugcaguac

SEQ ID NO: 1661988 - RNA, 19 nt, Homo sapiens
acucaguaacagugcagua

SEQ ID NO: 1661989 - RNA, 17 nt, Homo sapiens
acucagucagcccagug

SEQ ID NO: 1661990 - RNA, 21 nt, Homo sapiens
acucaguuaggcagugcagua

SEQ ID NO: 1661991 - RNA, 16 nt, Homo sapiens
acucauguucauucag

SEQ ID NO: 1661992 - RNA, 15 nt, Homo sapiens
acucauuuauuucca

SEQ ID NO: 1661993 - RNA, 21 nt, Homo sapiens
acuccagaauuucccaaagca

SEQ ID NO: 1661994 - RNA, 14 nt, Homo sapiens
acucccuaagucca

SEQ ID NO: 1661995 - RNA, 21 nt, Homo sapiens
acucccucguuaaucacagga

SEQ ID NO: 1661996 - RNA, 17 nt, Homo sapiens
acuccguuuccaaauac

SEQ ID NO: 1661997 - RNA, 23 nt, Homo sapiens
acuccucccccuccuccaugcug

SEQ ID NO: 1661998 - RNA, 16 nt, Homo sapiens
acuccuuggccuagcc

SEQ ID NO: 1661999 - RNA, 21 nt, Homo sapiens
acucgggcacucccuaagucc

SEQ ID NO: 1662000 - RNA, 18 nt, Homo sapiens
acucgugugcaugagaau

SEQ ID NO: 1662001 - RNA, 16 nt, Homo sapiens
acucuaaaacuaucag

SEQ ID NO: 1662002 - RNA, 22 nt, Homo sapiens
acucucaauugaguuaaaucag

SEQ ID NO: 1662003 - RNA, 12 nt, Homo sapiens
acucucugcaag

SEQ ID NO: 1662004 - RNA, 15 nt, Homo sapiens
acucugacaguauua

SEQ ID NO: 1662005 - RNA, 20 nt, Homo sapiens
acucuuacuaaccaccauuu

SEQ ID NO: 1662006 - RNA, 17 nt, Homo sapiens
acugaagcagagucaag

SEQ ID NO: 1662007 - RNA, 17 nt, Homo sapiens
agccaagggcagaucac

SEQ ID NO: 1662008 - RNA, 13 nt, Homo sapiens
agccaauggugca

SEQ ID NO: 1662009 - RNA, 15 nt, Homo sapiens
agccaauggugcaca

SEQ ID NO: 1662010 - RNA, 13 nt, Homo sapiens
agccacagugggg

SEQ ID NO: 1662011 - RNA, 17 nt, Homo sapiens
agccaccacauccagcc

SEQ ID NO: 1662012 - RNA, 11 nt, Homo sapiens
agccagaggag

SEQ ID NO: 1662013 - RNA, 16 nt, Homo sapiens
agccagaggcucuaau

SEQ ID NO: 1662014 - RNA, 12 nt, Homo sapiens
agccagggcaca

SEQ ID NO: 1662015 - RNA, 16 nt, Homo sapiens
agccagggcacaacca

SEQ ID NO: 1662016 - RNA, 15 nt, Homo sapiens
agccagucaagggca

SEQ ID NO: 1662017 - RNA, 20 nt, Homo sapiens
agccauauauuuucugagua

SEQ ID NO: 1662018 - RNA, 23 nt, Homo sapiens
agccaugguguguguucagcucu

SEQ ID NO: 1662019 - RNA, 21 nt, Homo sapiens
agccauuauucucugaugcac

SEQ ID NO: 1662020 - RNA, 18 nt, Homo sapiens
agccauuccuguucccau

SEQ ID NO: 1662021 - RNA, 23 nt, Homo sapiens
agcccacccugcugccuucugac

SEQ ID NO: 1662022 - RNA, 22 nt, Homo sapiens
agcccaggcggucacugcccac

SEQ ID NO: 1662023 - RNA, 14 nt, Homo sapiens
agccccacuccaca

SEQ ID NO: 1662024 - RNA, 22 nt, Homo sapiens
agccccagggcccugcucaggc

SEQ ID NO: 1662025 - RNA, 20 nt, Homo sapiens
agccccaucccaaacccuuc

SEQ ID NO: 1662026 - RNA, 13 nt, Homo sapiens
agccccaugccau

SEQ ID NO: 1662027 - RNA, 18 nt, Homo sapiens
agcccucucccucagucc

SEQ ID NO: 1662028 - RNA, 23 nt, Homo sapiens
agcccucucccucaguccuuuau

SEQ ID NO: 1662029 - RNA, 20 nt, Homo sapiens
agcccuguguauaaagccau

SEQ ID NO: 1662030 - RNA, 19 nt, Homo sapiens
agccucccaaguagcugag

SEQ ID NO: 1662031 - RNA, 22 nt, Homo sapiens
agccucccccucagaugaucuc

SEQ ID NO: 1662032 - RNA, 17 nt, Homo sapiens
agccucugggugacaaa

SEQ ID NO: 1662033 - RNA, 18 nt, Homo sapiens
agccucugggugacaaaa

SEQ ID NO: 1662034 - RNA, 14 nt, Homo sapiens
agccugcacagugg

SEQ ID NO: 1662035 - RNA, 12 nt, Homo sapiens
agccugcucccu

SEQ ID NO: 1662036 - RNA, 17 nt, Homo sapiens
agccugcucccuagcca

SEQ ID NO: 1662037 - RNA, 18 nt, Homo sapiens
agccugcucccuagccag

SEQ ID NO: 1662038 - RNA, 20 nt, Homo sapiens
agccuggggccuggcaggga

SEQ ID NO: 1662039 - RNA, 15 nt, Homo sapiens
agccuuccucaagau

SEQ ID NO: 1662040 - RNA, 17 nt, Homo sapiens
agcgaugggcaucacac

SEQ ID NO: 1662041 - RNA, 21 nt, Homo sapiens
agcgauucuccugccuuggcc

SEQ ID NO: 1662042 - RNA, 19 nt, Homo sapiens
agcgucauguccuuggcag

SEQ ID NO: 1662043 - RNA, 19 nt, Homo sapiens
agcuaucugucaucucucu

SEQ ID NO: 1662044 - RNA, 17 nt, Homo sapiens
agcuaugcuguaucugu

SEQ ID NO: 1662045 - RNA, 17 nt, Homo sapiens
agcucacugcaaccucc

SEQ ID NO: 1662046 - RNA, 17 nt, Homo sapiens
agcucacugcaaccucu

SEQ ID NO: 1662047 - RNA, 18 nt, Homo sapiens
agcucaggcccuggugag

SEQ ID NO: 1662048 - RNA, 11 nt, Homo sapiens
agcucagggac

SEQ ID NO: 1662049 - RNA, 22 nt, Homo sapiens
agcucagggacuggcacacugg

SEQ ID NO: 1662050 - RNA, 17 nt, Homo sapiens
agcucaggggcagcuca

SEQ ID NO: 1662051 - RNA, 15 nt, Homo sapiens
agcucauagcacaug

SEQ ID NO: 1662052 - RNA, 16 nt, Homo sapiens
agcucaugguagaaaa

SEQ ID NO: 1662053 - RNA, 20 nt, Homo sapiens
agcucaugguagaaaaccau

SEQ ID NO: 1662054 - RNA, 22 nt, Homo sapiens
agcuccagugcuuuauccacau

SEQ ID NO: 1662055 - RNA, 15 nt, Homo sapiens
agcucccagaacuuc

SEQ ID NO: 1662056 - RNA, 16 nt, Homo sapiens
agcuccgcgugucuca

SEQ ID NO: 1662057 - RNA, 17 nt, Homo sapiens
agcuccgcgugucucau

SEQ ID NO: 1662058 - RNA, 20 nt, Homo sapiens
agcucguggugggugcucaa

SEQ ID NO: 1662059 - RNA, 13 nt, Homo sapiens
agcucucuugccg

SEQ ID NO: 1662060 - RNA, 21 nt, Homo sapiens
agcucucuugccgaggagcca

SEQ ID NO: 1662061 - RNA, 15 nt, Homo sapiens
agcucugcauaagau

SEQ ID NO: 1662062 - RNA, 15 nt, Homo sapiens
agcucuuuugagcau

SEQ ID NO: 1662063 - RNA, 16 nt, Homo sapiens
agcugaaaauggagaa

SEQ ID NO: 1662064 - RNA, 22 nt, Homo sapiens
agcugaaagauugauuaaugaa

SEQ ID NO: 1662065 - RNA, 18 nt, Homo sapiens
agcugagcacagcagggg

SEQ ID NO: 1662066 - RNA, 15 nt, Homo sapiens
agcugccaccugccu

SEQ ID NO: 1662067 - RNA, 22 nt, Homo sapiens
agcugcccacaacuugccaaaa

SEQ ID NO: 1662068 - RNA, 19 nt, Homo sapiens
aguucagcuccuuccacca

SEQ ID NO: 1662069 - RNA, 17 nt, Homo sapiens
aguucauucauacucaa

SEQ ID NO: 1662070 - RNA, 16 nt, Homo sapiens
aguuccggaaagccuu

SEQ ID NO: 1662071 - RNA, 16 nt, Homo sapiens
aguucugaaaacuguu

SEQ ID NO: 1662072 - RNA, 13 nt, Homo sapiens
aguucuuccugua

SEQ ID NO: 1662073 - RNA, 15 nt, Homo sapiens
aguugcuagcaacaa

SEQ ID NO: 1662074 - RNA, 21 nt, Homo sapiens
aguugcuagcaacaacuuacu

SEQ ID NO: 1662075 - RNA, 19 nt, Homo sapiens
aguuggagugcaauggugc

SEQ ID NO: 1662076 - RNA, 12 nt, Homo sapiens
aguuggugcugc

SEQ ID NO: 1662077 - RNA, 19 nt, Homo sapiens
aguuguauuuuaauaaaga

SEQ ID NO: 1662078 - RNA, 14 nt, Homo sapiens
aguugucaaauuga

SEQ ID NO: 1662079 - RNA, 16 nt, Homo sapiens
aguuguggacuuuucc

SEQ ID NO: 1662080 - RNA, 15 nt, Homo sapiens
aguuguuauauucau

SEQ ID NO: 1662081 - RNA, 24 nt, Homo sapiens
aguuucagauaaaucaugggcauu

SEQ ID NO: 1662082 - RNA, 18 nt, Homo sapiens
aguuucauuuaugauaca

SEQ ID NO: 1662083 - RNA, 23 nt, Homo sapiens
aguuuccacaggcagcaucccaa

SEQ ID NO: 1662084 - RNA, 23 nt, Homo sapiens
aguuugccuaauucauguuuuca

SEQ ID NO: 1662085 - RNA, 22 nt, Homo sapiens
auaaaaacugcccauuguaacu

SEQ ID NO: 1662086 - RNA, 21 nt, Homo sapiens
auaaaaaucccucuuccucca

SEQ ID NO: 1662087 - RNA, 22 nt, Homo sapiens
auaaaacaaaacaaacaaccug

SEQ ID NO: 1662088 - RNA, 19 nt, Homo sapiens
auaaaagaaagaugcugau

SEQ ID NO: 1662089 - RNA, 15 nt, Homo sapiens
auaaaagacaugaaa

SEQ ID NO: 1662090 - RNA, 21 nt, Homo sapiens
auaaaauauacaaacaugugg

SEQ ID NO: 1662091 - RNA, 17 nt, Homo sapiens
auaaaaucagugugcuu

SEQ ID NO: 1662092 - RNA, 22 nt, Homo sapiens
auaaaaugguguuuucauguaa

SEQ ID NO: 1662093 - RNA, 14 nt, Homo sapiens
auaaacucagucaa

SEQ ID NO: 1662094 - RNA, 13 nt, Homo sapiens
auaaacugugaga

SEQ ID NO: 1662095 - RNA, 14 nt, Homo sapiens
auaaagaguucucc

SEQ ID NO: 1662096 - RNA, 15 nt, Homo sapiens
auaaagcaauguggu

SEQ ID NO: 1662097 - RNA, 17 nt, Homo sapiens
auaaagcaaugugguag

SEQ ID NO: 1662098 - RNA, 20 nt, Homo sapiens
auaaaggcauuucaaagucu

SEQ ID NO: 1662099 - RNA, 14 nt, Homo sapiens
auaaauacugcugu

SEQ ID NO: 1662100 - RNA, 16 nt, Homo sapiens
auaaauacugcuguau

SEQ ID NO: 1662101 - RNA, 16 nt, Homo sapiens
auaaauccaacucuga

SEQ ID NO: 1662102 - RNA, 16 nt, Homo sapiens
auaaaucuuccaaagu

SEQ ID NO: 1662103 - RNA, 20 nt, Homo sapiens
auaaauguacuacauuugca

SEQ ID NO: 1662104 - RNA, 17 nt, Homo sapiens
auaacuaauuugcucug

SEQ ID NO: 1662105 - RNA, 19 nt, Homo sapiens
auaacuagaguauguguau

SEQ ID NO: 1662106 - RNA, 22 nt, Homo sapiens
auaacuccuuguuucagaugau

SEQ ID NO: 1662107 - RNA, 17 nt, Homo sapiens
auaacugagcacuuuga

SEQ ID NO: 1662108 - RNA, 21 nt, Homo sapiens
auaacuuuugguaucuacuuc

SEQ ID NO: 1662109 - RNA, 16 nt, Homo sapiens
auaagcuaugucacua

SEQ ID NO: 1662110 - RNA, 13 nt, Homo sapiens
auaagcugaauaa

SEQ ID NO: 1662111 - RNA, 21 nt, Homo sapiens
auaaggcuaaauguaaaacac

SEQ ID NO: 1662112 - RNA, 13 nt, Homo sapiens
auaaguaaauaca

SEQ ID NO: 1662113 - RNA, 18 nt, Homo sapiens
auaagucaaaauaaucug

SEQ ID NO: 1662114 - RNA, 16 nt, Homo sapiens
auaaguguguuugcaa

SEQ ID NO: 1662115 - RNA, 18 nt, Homo sapiens
auaauaaaaggaguucag

SEQ ID NO: 1662116 - RNA, 18 nt, Homo sapiens
auaauaaaggcauuucaa

SEQ ID NO: 1662117 - RNA, 14 nt, Homo sapiens
auaaucauacacag

SEQ ID NO: 1662118 - RNA, 15 nt, Homo sapiens
auaaucccauacucu

SEQ ID NO: 1662119 - RNA, 18 nt, Homo sapiens
auaaucccauacucucaa

SEQ ID NO: 1662120 - RNA, 15 nt, Homo sapiens
auaaucgaaguaauu

SEQ ID NO: 1662121 - RNA, 18 nt, Homo sapiens
auaaugacaggcauccaa

SEQ ID NO: 1662122 - RNA, 17 nt, Homo sapiens
auaaugacuuaagcaca

SEQ ID NO: 1662123 - RNA, 19 nt, Homo sapiens
auaauguuaguagcacuga

SEQ ID NO: 1662124 - RNA, 13 nt, Homo sapiens
auaauugacaaac

SEQ ID NO: 1662125 - RNA, 21 nt, Homo sapiens
auaauugccuuuuccuaugua

SEQ ID NO: 1662126 - RNA, 15 nt, Homo sapiens
auacaauuugcccaa

SEQ ID NO: 1662127 - RNA, 16 nt, Homo sapiens
auacaauuugcccaag

SEQ ID NO: 1662128 - RNA, 23 nt, Homo sapiens
auacagaugguguccugcaugua

SEQ ID NO: 1662129 - RNA, 13 nt, Homo sapiens
auacauauguuaa

SEQ ID NO: 1662130 - RNA, 15 nt, Homo sapiens
auacauuagacacac

SEQ ID NO: 1662131 - RNA, 17 nt, Homo sapiens
gcccucaucuugaaggg

SEQ ID NO: 1662132 - RNA, 15 nt, Homo sapiens
gcccuccgcccuucc

SEQ ID NO: 1662133 - RNA, 15 nt, Homo sapiens
gcccucucuccgccc

SEQ ID NO: 1662134 - RNA, 14 nt, Homo sapiens
gcccucugcugcuu

SEQ ID NO: 1662135 - RNA, 21 nt, Homo sapiens
gcccugcaccuugggcacggg

SEQ ID NO: 1662136 - RNA, 19 nt, Homo sapiens
gcccuguuuccaaugccaa

SEQ ID NO: 1662137 - RNA, 14 nt, Homo sapiens
gcccuuaccugcca

SEQ ID NO: 1662138 - RNA, 21 nt, Homo sapiens
gcccuuccucaucuccaugcu

SEQ ID NO: 1662139 - RNA, 17 nt, Homo sapiens
gccgauauaagccauag

SEQ ID NO: 1662140 - RNA, 12 nt, Homo sapiens
gccgcugggaga

SEQ ID NO: 1662141 - RNA, 15 nt, Homo sapiens
gccgucacgcuuuca

SEQ ID NO: 1662142 - RNA, 16 nt, Homo sapiens
gccgucucugauucuc

SEQ ID NO: 1662143 - RNA, 14 nt, Homo sapiens
gccucagggaccaa

SEQ ID NO: 1662144 - RNA, 23 nt, Homo sapiens
gccucauuauuuuucacugcccc

SEQ ID NO: 1662145 - RNA, 17 nt, Homo sapiens
gccucccaaagugcugg

SEQ ID NO: 1662146 - RNA, 21 nt, Homo sapiens
gccucccaaagugcugggauu

SEQ ID NO: 1662147 - RNA, 14 nt, Homo sapiens
gccucccaagcacc

SEQ ID NO: 1662148 - RNA, 19 nt, Homo sapiens
gccuccccugccucaccag

SEQ ID NO: 1662149 - RNA, 17 nt, Homo sapiens
gccucccgcaugcugcc

SEQ ID NO: 1662150 - RNA, 20 nt, Homo sapiens
gccugaagaaacaaggcauu

SEQ ID NO: 1662151 - RNA, 12 nt, Homo sapiens
gccugacauuca

SEQ ID NO: 1662152 - RNA, 15 nt, Homo sapiens
gccugaugauggaag

SEQ ID NO: 1662153 - RNA, 13 nt, Homo sapiens
gccugauggccag

SEQ ID NO: 1662154 - RNA, 15 nt, Homo sapiens
gccugcacacaccug

SEQ ID NO: 1662155 - RNA, 19 nt, Homo sapiens
gccugggacagccacugga

SEQ ID NO: 1662156 - RNA, 21 nt, Homo sapiens
gccugggaccucccacugccc

SEQ ID NO: 1662157 - RNA, 19 nt, Homo sapiens
gccugggagaugcagcugg

SEQ ID NO: 1662158 - RNA, 21 nt, Homo sapiens
gccugggcugugaggacaggg

SEQ ID NO: 1662159 - RNA, 23 nt, Homo sapiens
gccugucgcaugagaacauuaac

SEQ ID NO: 1662160 - RNA, 23 nt, Homo sapiens
gccuucauggaacucagcugucu

SEQ ID NO: 1662161 - RNA, 21 nt, Homo sapiens
gccuuccaggcagacacagcu

SEQ ID NO: 1662162 - RNA, 23 nt, Homo sapiens
gccuucuccacagggacacaguc

SEQ ID NO: 1662163 - RNA, 16 nt, Homo sapiens
gccuucuccacuuugg

SEQ ID NO: 1662164 - RNA, 18 nt, Homo sapiens
gccuuuauauccaaaaua

SEQ ID NO: 1662165 - RNA, 16 nt, Homo sapiens
gccuuugauguggaug

SEQ ID NO: 1662166 - RNA, 23 nt, Homo sapiens
gcgacagagugaccagaaacccu

SEQ ID NO: 1662167 - RNA, 13 nt, Homo sapiens
gcgaucucagcuc

SEQ ID NO: 1662168 - RNA, 15 nt, Homo sapiens
gcgaugggcaucaca

SEQ ID NO: 1662169 - RNA, 16 nt, Homo sapiens
gcgcaagcgacacagg

SEQ ID NO: 1662170 - RNA, 16 nt, Homo sapiens
gcgcagagcugacccc

SEQ ID NO: 1662171 - RNA, 15 nt, Homo sapiens
gcgcccucuaccucc

SEQ ID NO: 1662172 - RNA, 15 nt, Homo sapiens
gcgcuauccacagaa

SEQ ID NO: 1662173 - RNA, 20 nt, Homo sapiens
gcgcuccucugcagccugag

SEQ ID NO: 1662174 - RNA, 21 nt, Homo sapiens
gcggccucgugccaugaucug

SEQ ID NO: 1662175 - RNA, 22 nt, Homo sapiens
gcggcuuccugaugauggucau

SEQ ID NO: 1662176 - RNA, 16 nt, Homo sapiens
gcguacaaagugaucu

SEQ ID NO: 1662177 - RNA, 20 nt, Homo sapiens
gcguaggagagaacagggau

SEQ ID NO: 1662178 - RNA, 20 nt, Homo sapiens
gcgucccugagggcccuucc

SEQ ID NO: 1662179 - RNA, 20 nt, Homo sapiens
gcgugcuugcaugugcugca

SEQ ID NO: 1662180 - RNA, 17 nt, Homo sapiens
gcguguacuaccccaga

SEQ ID NO: 1662181 - RNA, 18 nt, Homo sapiens
gcguguacuaccccagga

SEQ ID NO: 1662182 - RNA, 20 nt, Homo sapiens
gcguuucaaauuucagacca

SEQ ID NO: 1662183 - RNA, 22 nt, Homo sapiens
gcuaaaaugaaaaauagugugu

SEQ ID NO: 1662184 - RNA, 17 nt, Homo sapiens
gcuaaccucucugaacu

SEQ ID NO: 1662185 - RNA, 15 nt, Homo sapiens
gcuaagccugaugau

SEQ ID NO: 1662186 - RNA, 14 nt, Homo sapiens
gcuagacuagucuc

SEQ ID NO: 1662187 - RNA, 16 nt, Homo sapiens
gcuaguccggacccac

SEQ ID NO: 1662188 - RNA, 16 nt, Homo sapiens
gcuaugucugugaugu

SEQ ID NO: 1662189 - RNA, 19 nt, Homo sapiens
gcucaaaguacuacagcaa

SEQ ID NO: 1662190 - RNA, 20 nt, Homo sapiens
gcucaaaguacuacagcaaa

SEQ ID NO: 1662191 - RNA, 22 nt, Homo sapiens
gcucaaaguacuacagcaaagc

SEQ ID NO: 1662192 - RNA, 21 nt, Homo sapiens
gaucaucuccaaaucuugcca

SEQ ID NO: 1662193 - RNA, 17 nt, Homo sapiens
gauccucaaaaaucauc

SEQ ID NO: 1662194 - RNA, 18 nt, Homo sapiens
gauccugucuugcugagg

SEQ ID NO: 1662195 - RNA, 13 nt, Homo sapiens
gaucgcuccgccg

SEQ ID NO: 1662196 - RNA, 14 nt, Homo sapiens
gaucucagcucacu

SEQ ID NO: 1662197 - RNA, 23 nt, Homo sapiens
gaucucagcucacugcaaccucc

SEQ ID NO: 1662198 - RNA, 22 nt, Homo sapiens
gaucucucgagcugucuugcug

SEQ ID NO: 1662199 - RNA, 12 nt, Homo sapiens
gaucugcauaac

SEQ ID NO: 1662200 - RNA, 12 nt, Homo sapiens
gaucugcuccau

SEQ ID NO: 1662201 - RNA, 16 nt, Homo sapiens
gaucuguuguaauauc

SEQ ID NO: 1662202 - RNA, 12 nt, Homo sapiens
gaugacaaagaa

SEQ ID NO: 1662203 - RNA, 14 nt, Homo sapiens
gaugcaaaucaacu

SEQ ID NO: 1662204 - RNA, 23 nt, Homo sapiens
gaugcagaaauguggaugcucuu

SEQ ID NO: 1662205 - RNA, 13 nt, Homo sapiens
gaugcaugagcuc

SEQ ID NO: 1662206 - RNA, 14 nt, Homo sapiens
gaugcaugcagggc

SEQ ID NO: 1662207 - RNA, 22 nt, Homo sapiens
gaugcauuuuaaaugucuauaa

SEQ ID NO: 1662208 - RNA, 22 nt, Homo sapiens
gaugcuaucucgcuagccauau

SEQ ID NO: 1662209 - RNA, 14 nt, Homo sapiens
gaugcugcugagca

SEQ ID NO: 1662210 - RNA, 15 nt, Homo sapiens
gaugggggaugcuuc

SEQ ID NO: 1662211 - RNA, 18 nt, Homo sapiens
gauggguaucaugcuucu

SEQ ID NO: 1662212 - RNA, 18 nt, Homo sapiens
gaugguaacugcacacau

SEQ ID NO: 1662213 - RNA, 15 nt, Homo sapiens
gauguauuguugcuu

SEQ ID NO: 1662214 - RNA, 16 nt, Homo sapiens
gaugugccuagacacg

SEQ ID NO: 1662215 - RNA, 14 nt, Homo sapiens
gaugugucuuacca

SEQ ID NO: 1662216 - RNA, 15 nt, Homo sapiens
gaugugucuuaccag

SEQ ID NO: 1662217 - RNA, 18 nt, Homo sapiens
gauguuuaguaauacagc

SEQ ID NO: 1662218 - RNA, 19 nt, Homo sapiens
gauguuucuggaauugaua

SEQ ID NO: 1662219 - RNA, 20 nt, Homo sapiens
gauuaauuuguguagauugu

SEQ ID NO: 1662220 - RNA, 19 nt, Homo sapiens
gauuacaggcgugagccac

SEQ ID NO: 1662221 - RNA, 15 nt, Homo sapiens
gauuacaggugugag

SEQ ID NO: 1662222 - RNA, 19 nt, Homo sapiens
gauuacaggugugagccac

SEQ ID NO: 1662223 - RNA, 14 nt, Homo sapiens
gauuauuuaucaca

SEQ ID NO: 1662224 - RNA, 15 nt, Homo sapiens
gauuauuuaucacau

SEQ ID NO: 1662225 - RNA, 22 nt, Homo sapiens
gauucaaauaacccugaaucag

SEQ ID NO: 1662226 - RNA, 13 nt, Homo sapiens
gauucaccaaaca

SEQ ID NO: 1662227 - RNA, 15 nt, Homo sapiens
gauucuaugucucau

SEQ ID NO: 1662228 - RNA, 22 nt, Homo sapiens
gauucucccuuuaugaagcugc

SEQ ID NO: 1662229 - RNA, 22 nt, Homo sapiens
gauugguaccagagccuaugga

SEQ ID NO: 1662230 - RNA, 18 nt, Homo sapiens
gauugucuuacuguugca

SEQ ID NO: 1662231 - RNA, 15 nt, Homo sapiens
gauuguuugaugaau

SEQ ID NO: 1662232 - RNA, 23 nt, Homo sapiens
gauuuacuaacaguaacugccau

SEQ ID NO: 1662233 - RNA, 12 nt, Homo sapiens
gauuuaugcauu

SEQ ID NO: 1662234 - RNA, 20 nt, Homo sapiens
gauuuccauuugcaacagga

SEQ ID NO: 1662235 - RNA, 23 nt, Homo sapiens
gauuuuauguuuaaaauggcauu

SEQ ID NO: 1662236 - RNA, 23 nt, Homo sapiens
gauuuuccucccugcagagccaa

SEQ ID NO: 1662237 - RNA, 17 nt, Homo sapiens
gauuuucucagcacaaa

SEQ ID NO: 1662238 - RNA, 20 nt, Homo sapiens
gcaaaaccaacucucuacua

SEQ ID NO: 1662239 - RNA, 11 nt, Homo sapiens
gcaaacauuua

SEQ ID NO: 1662240 - RNA, 19 nt, Homo sapiens
gcaaagacaguuucuugca

SEQ ID NO: 1662241 - RNA, 13 nt, Homo sapiens
gcaaagcaguaug

SEQ ID NO: 1662242 - RNA, 17 nt, Homo sapiens
gcaaaggcccccaucac

SEQ ID NO: 1662243 - RNA, 18 nt, Homo sapiens
gcaaaggcccccaucaca

SEQ ID NO: 1662244 - RNA, 15 nt, Homo sapiens
gcaaaguaguacuuc

SEQ ID NO: 1662245 - RNA, 23 nt, Homo sapiens
gcaaaucuguauaaaugugaaau

SEQ ID NO: 1662246 - RNA, 15 nt, Homo sapiens
gcaaaugacaugcac

SEQ ID NO: 1662247 - RNA, 20 nt, Homo sapiens
gcaaauguccaagcaucagc

SEQ ID NO: 1662248 - RNA, 16 nt, Homo sapiens
gcaaauuccaauacau

SEQ ID NO: 1662249 - RNA, 13 nt, Homo sapiens
gcaaccaauggca

SEQ ID NO: 1662250 - RNA, 22 nt, Homo sapiens
gcaacccaugagcguccaggug

SEQ ID NO: 1662251 - RNA, 19 nt, Homo sapiens
gcaaccucggggagugcca

SEQ ID NO: 1662252 - RNA, 20 nt, Homo sapiens
gcaaccucggggagugccac

SEQ ID NO: 1662253 - RNA, 22 nt, Homo sapiens
cauuuuggauucuuauggacaa

SEQ ID NO: 1662254 - RNA, 15 nt, Homo sapiens
cauuuuucuacugcu

SEQ ID NO: 1662255 - RNA, 16 nt, Homo sapiens
cauuuuuuccugagaa

SEQ ID NO: 1662256 - RNA, 14 nt, Homo sapiens
cauuuuuugucugu

SEQ ID NO: 1662257 - RNA, 20 nt, Homo sapiens
cauuuuuuuuuuaucagagu

SEQ ID NO: 1662258 - RNA, 14 nt, Homo sapiens
ccaaaagccaguca

SEQ ID NO: 1662259 - RNA, 15 nt, Homo sapiens
ccaaacagcaugugc

SEQ ID NO: 1662260 - RNA, 18 nt, Homo sapiens
ccaaaccaccgacucuca

SEQ ID NO: 1662261 - RNA, 17 nt, Homo sapiens
ccaaagagaaaagauua

SEQ ID NO: 1662262 - RNA, 16 nt, Homo sapiens
ccaaagaucucaaagu

SEQ ID NO: 1662263 - RNA, 18 nt, Homo sapiens
ccaaaggaagcacaugcc

SEQ ID NO: 1662264 - RNA, 16 nt, Homo sapiens
ccaaagggaguguuga

SEQ ID NO: 1662265 - RNA, 19 nt, Homo sapiens
ccaaagguuucaacuguaa

SEQ ID NO: 1662266 - RNA, 14 nt, Homo sapiens
ccaaaguuauccag

SEQ ID NO: 1662267 - RNA, 14 nt, Homo sapiens
ccaaauacauucca

SEQ ID NO: 1662268 - RNA, 17 nt, Homo sapiens
ccaacagcgaagccagu

SEQ ID NO: 1662269 - RNA, 15 nt, Homo sapiens
ccaaccugcucauuu

SEQ ID NO: 1662270 - RNA, 23 nt, Homo sapiens
ccaacuuucccuccaccagugug

SEQ ID NO: 1662271 - RNA, 15 nt, Homo sapiens
ccaacuuuucaucca

SEQ ID NO: 1662272 - RNA, 15 nt, Homo sapiens
ccaagaguccaagcc

SEQ ID NO: 1662273 - RNA, 21 nt, Homo sapiens
ccaagcuguuccacuucucua

SEQ ID NO: 1662274 - RNA, 14 nt, Homo sapiens
ccaaggccaaagga

SEQ ID NO: 1662275 - RNA, 15 nt, Homo sapiens
ccaaggccagcccac

SEQ ID NO: 1662276 - RNA, 21 nt, Homo sapiens
ccaagggcagaucacagguua

SEQ ID NO: 1662277 - RNA, 18 nt, Homo sapiens
ccaagguaaacaguuuga

SEQ ID NO: 1662278 - RNA, 14 nt, Homo sapiens
ccaaguccagugug

SEQ ID NO: 1662279 - RNA, 18 nt, Homo sapiens
ccaaguuggagugcaaug

SEQ ID NO: 1662280 - RNA, 18 nt, Homo sapiens
ccaaguuggagugcagug

SEQ ID NO: 1662281 - RNA, 12 nt, Homo sapiens
ccaauacauuau

SEQ ID NO: 1662282 - RNA, 19 nt, Homo sapiens
ccaaugaaaacagucccau

SEQ ID NO: 1662283 - RNA, 18 nt, Homo sapiens
ccaaugccaauucaucuc

SEQ ID NO: 1662284 - RNA, 15 nt, Homo sapiens
ccaaugcucuuuuca

SEQ ID NO: 1662285 - RNA, 15 nt, Homo sapiens
ccaaugggagcucau

SEQ ID NO: 1662286 - RNA, 22 nt, Homo sapiens
ccaauuaaguccuacuuuacau

SEQ ID NO: 1662287 - RNA, 16 nt, Homo sapiens
ccaauuacuacuuugu

SEQ ID NO: 1662288 - RNA, 14 nt, Homo sapiens
ccaauuucucuuaa

SEQ ID NO: 1662289 - RNA, 15 nt, Homo sapiens
ccaauuuuguugcau

SEQ ID NO: 1662290 - RNA, 13 nt, Homo sapiens
ccacaagcacaau

SEQ ID NO: 1662291 - RNA, 16 nt, Homo sapiens
ccacacacagcagcuc

SEQ ID NO: 1662292 - RNA, 19 nt, Homo sapiens
ccacacuugcagagcugcu

SEQ ID NO: 1662293 - RNA, 17 nt, Homo sapiens
ccacaggagcauguccu

SEQ ID NO: 1662294 - RNA, 17 nt, Homo sapiens
ccacaggagcguguccu

SEQ ID NO: 1662295 - RNA, 16 nt, Homo sapiens
ccacaggcucugacca

SEQ ID NO: 1662296 - RNA, 12 nt, Homo sapiens
ccacauccagcc

SEQ ID NO: 1662297 - RNA, 19 nt, Homo sapiens
ccacauggccgcugcccac

SEQ ID NO: 1662298 - RNA, 17 nt, Homo sapiens
ccacauugcuucauuaa

SEQ ID NO: 1662299 - RNA, 16 nt, Homo sapiens
ccaccacuguguccca

SEQ ID NO: 1662300 - RNA, 18 nt, Homo sapiens
ccacccaguccugcacac

SEQ ID NO: 1662301 - RNA, 19 nt, Homo sapiens
ccaccuagagcuagaugug

SEQ ID NO: 1662302 - RNA, 21 nt, Homo sapiens
ccaccuccaucaaacgcagac

SEQ ID NO: 1662303 - RNA, 22 nt, Homo sapiens
ccaccuggauggaucugcucca

SEQ ID NO: 1662304 - RNA, 18 nt, Homo sapiens
ccaccugggcccuaggca

SEQ ID NO: 1662305 - RNA, 18 nt, Homo sapiens
ccaccugucaaccugaau

SEQ ID NO: 1662306 - RNA, 19 nt, Homo sapiens
ccacgcagagccccggagc

SEQ ID NO: 1662307 - RNA, 14 nt, Homo sapiens
ccacgcauggugca

SEQ ID NO: 1662308 - RNA, 12 nt, Homo sapiens
ccacgcucaaga

SEQ ID NO: 1662309 - RNA, 16 nt, Homo sapiens
ccacgcucaaucucag

SEQ ID NO: 1662310 - RNA, 21 nt, Homo sapiens
ccacguccugggugcugucau

SEQ ID NO: 1662311 - RNA, 13 nt, Homo sapiens
ccacuacagugag

SEQ ID NO: 1662312 - RNA, 13 nt, Homo sapiens
ccacuccacaguu

SEQ ID NO: 1662313 - RNA, 22 nt, Homo sapiens
ccacucuguuccuacuggagau

SEQ ID NO: 1662314 - RNA, 12 nt, Homo sapiens
ccacugccagac

SEQ ID NO: 1662315 - RNA, 13 nt, Homo sapiens
ccacuucacaguu

SEQ ID NO: 1662316 - RNA, 17 nt, Homo sapiens
ccagaaaaaucaaucau

SEQ ID NO: 1662317 - RNA, 15 nt, Homo sapiens
cccguccacagggca

SEQ ID NO: 1662318 - RNA, 17 nt, Homo sapiens
cccuacagccugcacac

SEQ ID NO: 1662319 - RNA, 22 nt, Homo sapiens
cccuaccguccuccugagccac

SEQ ID NO: 1662320 - RNA, 11 nt, Homo sapiens
cccuagcuuau

SEQ ID NO: 1662321 - RNA, 16 nt, Homo sapiens
cccuagggcucuccaa

SEQ ID NO: 1662322 - RNA, 16 nt, Homo sapiens
cccuauacuuaggcau

SEQ ID NO: 1662323 - RNA, 17 nt, Homo sapiens
cccuauccuuggcacca

SEQ ID NO: 1662324 - RNA, 15 nt, Homo sapiens
cccucagauuccacc

SEQ ID NO: 1662325 - RNA, 16 nt, Homo sapiens
cccuccccuuuugaaa

SEQ ID NO: 1662326 - RNA, 17 nt, Homo sapiens
cccuccucccuguuaaa

SEQ ID NO: 1662327 - RNA, 15 nt, Homo sapiens
cccuccugccucauc

SEQ ID NO: 1662328 - RNA, 20 nt, Homo sapiens
cccucugcuaugucugugau

SEQ ID NO: 1662329 - RNA, 22 nt, Homo sapiens
cccugaaauauuuucuacuuua

SEQ ID NO: 1662330 - RNA, 16 nt, Homo sapiens
cccugagaacccaaac

SEQ ID NO: 1662331 - RNA, 21 nt, Homo sapiens
cccugcagagccaauggugca

SEQ ID NO: 1662332 - RNA, 23 nt, Homo sapiens
cccuggaaauaacugagcacuuu

SEQ ID NO: 1662333 - RNA, 13 nt, Homo sapiens
cccuggacagggc

SEQ ID NO: 1662334 - RNA, 18 nt, Homo sapiens
cccuggggggcacagcca

SEQ ID NO: 1662335 - RNA, 18 nt, Homo sapiens
cccuggggucucugagca

SEQ ID NO: 1662336 - RNA, 17 nt, Homo sapiens
cccugguccugcacugu

SEQ ID NO: 1662337 - RNA, 16 nt, Homo sapiens
cccuguagcucugaau

SEQ ID NO: 1662338 - RNA, 17 nt, Homo sapiens
cccugucucuacaaaaa

SEQ ID NO: 1662339 - RNA, 14 nt, Homo sapiens
cccugugaucuaua

SEQ ID NO: 1662340 - RNA, 22 nt, Homo sapiens
cccuugagcugguuuucucuga

SEQ ID NO: 1662341 - RNA, 21 nt, Homo sapiens
cccuuuccucuuaauucccaa

SEQ ID NO: 1662342 - RNA, 21 nt, Homo sapiens
cccuuuuacagucacauucag

SEQ ID NO: 1662343 - RNA, 23 nt, Homo sapiens
ccgaaaugaaaauggcugaagaa

SEQ ID NO: 1662344 - RNA, 12 nt, Homo sapiens
ccgaauauugag

SEQ ID NO: 1662345 - RNA, 15 nt, Homo sapiens
ccgacagucuggaaa

SEQ ID NO: 1662346 - RNA, 16 nt, Homo sapiens
ccgaggacuccagggg

SEQ ID NO: 1662347 - RNA, 14 nt, Homo sapiens
ccgauuagaaggca

SEQ ID NO: 1662348 - RNA, 15 nt, Homo sapiens
ccgccagaguguccu

SEQ ID NO: 1662349 - RNA, 14 nt, Homo sapiens
ccgcccaccugggc

SEQ ID NO: 1662350 - RNA, 23 nt, Homo sapiens
ccgcugcuugaguggacagcagc

SEQ ID NO: 1662351 - RNA, 20 nt, Homo sapiens
ccgucaugaauucuucucaa

SEQ ID NO: 1662352 - RNA, 17 nt, Homo sapiens
ccuaaacauagugguau

SEQ ID NO: 1662353 - RNA, 14 nt, Homo sapiens
ccuaaccuggguug

SEQ ID NO: 1662354 - RNA, 17 nt, Homo sapiens
ccuaaggugcuuaccuc

SEQ ID NO: 1662355 - RNA, 21 nt, Homo sapiens
ccuaauucucuucgcugugau

SEQ ID NO: 1662356 - RNA, 13 nt, Homo sapiens
ccuacaucugaaa

SEQ ID NO: 1662357 - RNA, 12 nt, Homo sapiens
ccuaccaaauau

SEQ ID NO: 1662358 - RNA, 22 nt, Homo sapiens
ccuacuaauccucucugcaagu

SEQ ID NO: 1662359 - RNA, 21 nt, Homo sapiens
ccuagaagcccucugagcucc

SEQ ID NO: 1662360 - RNA, 14 nt, Homo sapiens
ccuagaauguuuca

SEQ ID NO: 1662361 - RNA, 20 nt, Homo sapiens
ccuagacucuaaaacuauca

SEQ ID NO: 1662362 - RNA, 17 nt, Homo sapiens
ccuagagcuagaugugu

SEQ ID NO: 1662363 - RNA, 12 nt, Homo sapiens
ccuaugccuguc

SEQ ID NO: 1662364 - RNA, 16 nt, Homo sapiens
ccuauugcuguaaaua

SEQ ID NO: 1662365 - RNA, 18 nt, Homo sapiens
ccuauuuuggacguguga

SEQ ID NO: 1662366 - RNA, 21 nt, Homo sapiens
ccucaacaagaagaauuugaa

SEQ ID NO: 1662367 - RNA, 19 nt, Homo sapiens
ccucaacccugugaucuau

SEQ ID NO: 1662368 - RNA, 14 nt, Homo sapiens
ccucaccuucccua

SEQ ID NO: 1662369 - RNA, 15 nt, Homo sapiens
ccucacugauauauu

SEQ ID NO: 1662370 - RNA, 14 nt, Homo sapiens
ccucagaugaucuc

SEQ ID NO: 1662371 - RNA, 16 nt, Homo sapiens
ccucaggaccauguga

SEQ ID NO: 1662372 - RNA, 13 nt, Homo sapiens
ccucagggaccaa

SEQ ID NO: 1662373 - RNA, 17 nt, Homo sapiens
ccucagggaccaaggag

SEQ ID NO: 1662374 - RNA, 14 nt, Homo sapiens
ccucaguccacugc

SEQ ID NO: 1662375 - RNA, 16 nt, Homo sapiens
ccucauuuugcuuccc

SEQ ID NO: 1662376 - RNA, 13 nt, Homo sapiens
ccucccaccagga

SEQ ID NO: 1662377 - RNA, 15 nt, Homo sapiens
cgcuaauguacuacg

SEQ ID NO: 1662378 - RNA, 16 nt, Homo sapiens
cgcugccugcucugcg

SEQ ID NO: 1662379 - RNA, 20 nt, Homo sapiens
cgcugggagaaaagccagau

SEQ ID NO: 1662380 - RNA, 16 nt, Homo sapiens
cgcugguaacuguuaa

SEQ ID NO: 1662381 - RNA, 22 nt, Homo sapiens
cgcuucuccuggcaaucuguca

SEQ ID NO: 1662382 - RNA, 17 nt, Homo sapiens
cgcuuucccaucuuaaa

SEQ ID NO: 1662383 - RNA, 12 nt, Homo sapiens
cggaaagccuuc

SEQ ID NO: 1662384 - RNA, 13 nt, Homo sapiens
cggaaaugauuga

SEQ ID NO: 1662385 - RNA, 15 nt, Homo sapiens
cggaaguggccugag

SEQ ID NO: 1662386 - RNA, 16 nt, Homo sapiens
cggaauuccaccugga

SEQ ID NO: 1662387 - RNA, 16 nt, Homo sapiens
cggacaccaucuuggg

SEQ ID NO: 1662388 - RNA, 12 nt, Homo sapiens
cggaguccaaag

SEQ ID NO: 1662389 - RNA, 23 nt, Homo sapiens
cggccgaggccugcgcccugaca

SEQ ID NO: 1662390 - RNA, 17 nt, Homo sapiens
cggccgcucuccgcccc

SEQ ID NO: 1662391 - RNA, 15 nt, Homo sapiens
cgggaagucagggac

SEQ ID NO: 1662392 - RNA, 20 nt, Homo sapiens
cgggcacucccuaaguccac

SEQ ID NO: 1662393 - RNA, 14 nt, Homo sapiens
cgggcacugucaug

SEQ ID NO: 1662394 - RNA, 15 nt, Homo sapiens
cggguaaugagccau

SEQ ID NO: 1662395 - RNA, 19 nt, Homo sapiens
cggguacucagucagccca

SEQ ID NO: 1662396 - RNA, 15 nt, Homo sapiens
cggucccccaugcca

SEQ ID NO: 1662397 - RNA, 22 nt, Homo sapiens
cgguuccacgugggguggaauu

SEQ ID NO: 1662398 - RNA, 16 nt, Homo sapiens
cgguuucagcuuccuc

SEQ ID NO: 1662399 - RNA, 13 nt, Homo sapiens
cguccacagggca

SEQ ID NO: 1662400 - RNA, 14 nt, Homo sapiens
cguccguccgcccg

SEQ ID NO: 1662401 - RNA, 16 nt, Homo sapiens
cgucuacccagacuca

SEQ ID NO: 1662402 - RNA, 20 nt, Homo sapiens
cgucucuacuaaaaauacaa

SEQ ID NO: 1662403 - RNA, 15 nt, Homo sapiens
cgucugggcucccug

SEQ ID NO: 1662404 - RNA, 13 nt, Homo sapiens
cgugacccugugc

SEQ ID NO: 1662405 - RNA, 14 nt, Homo sapiens
cgugccaugaucug

SEQ ID NO: 1662406 - RNA, 19 nt, Homo sapiens
cgugccugcuuaccugcca

SEQ ID NO: 1662407 - RNA, 15 nt, Homo sapiens
cgugggauccagaga

SEQ ID NO: 1662408 - RNA, 19 nt, Homo sapiens
cguggugggugcucaagac

SEQ ID NO: 1662409 - RNA, 22 nt, Homo sapiens
cgugguguccucuguccgucug

SEQ ID NO: 1662410 - RNA, 16 nt, Homo sapiens
cgugucucauuugcca

SEQ ID NO: 1662411 - RNA, 14 nt, Homo sapiens
cguucuuucaaugc

SEQ ID NO: 1662412 - RNA, 19 nt, Homo sapiens
cguugcugcguucuuucaa

SEQ ID NO: 1662413 - RNA, 16 nt, Homo sapiens
cguuugaacucaggga

SEQ ID NO: 1662414 - RNA, 15 nt, Homo sapiens
cguuuucaccagcaa

SEQ ID NO: 1662415 - RNA, 22 nt, Homo sapiens
cuaaaaugcuguucucaaucau

SEQ ID NO: 1662416 - RNA, 17 nt, Homo sapiens
cuaaacacaaauuguga

SEQ ID NO: 1662417 - RNA, 12 nt, Homo sapiens
cuaaacauuuca

SEQ ID NO: 1662418 - RNA, 14 nt, Homo sapiens
cuaaacugagacaa

SEQ ID NO: 1662419 - RNA, 21 nt, Homo sapiens
cuaaagucaggccauucaguc

SEQ ID NO: 1662420 - RNA, 15 nt, Homo sapiens
cuaaauuuccagggg

SEQ ID NO: 1662421 - RNA, 19 nt, Homo sapiens
cuaacaaguagcacacuga

SEQ ID NO: 1662422 - RNA, 11 nt, Homo sapiens
cuaacacuggc

SEQ ID NO: 1662423 - RNA, 13 nt, Homo sapiens
cuaagcuguaacc

SEQ ID NO: 1662424 - RNA, 17 nt, Homo sapiens
cuaaggagcacuagaau

SEQ ID NO: 1662425 - RNA, 15 nt, Homo sapiens
cuaaguccacucuag

SEQ ID NO: 1662426 - RNA, 17 nt, Homo sapiens
cuaaguguuuucaaaua

SEQ ID NO: 1662427 - RNA, 16 nt, Homo sapiens
cuaauaaaacuuugac

SEQ ID NO: 1662428 - RNA, 15 nt, Homo sapiens
cuaaugaaaccugug

SEQ ID NO: 1662429 - RNA, 14 nt, Homo sapiens
cuaaugacaaguga

SEQ ID NO: 1662430 - RNA, 12 nt, Homo sapiens
cuaauggaauau

SEQ ID NO: 1662431 - RNA, 20 nt, Homo sapiens
cuaauggaauaugcguaguu

SEQ ID NO: 1662432 - RNA, 13 nt, Homo sapiens
cuaauguacaaua

SEQ ID NO: 1662433 - RNA, 19 nt, Homo sapiens
cuaauguacaauaaagcaa

SEQ ID NO: 1662434 - RNA, 20 nt, Homo sapiens
cuaauuccccuuccauuccc

SEQ ID NO: 1662435 - RNA, 21 nt, Homo sapiens
cuaauuccccuuccauuccca

SEQ ID NO: 1662436 - RNA, 18 nt, Homo sapiens
cuaauucuuauuuuauaa

SEQ ID NO: 1662437 - RNA, 21 nt, Homo sapiens
cuaauuguacccuucuugucu

SEQ ID NO: 1662438 - RNA, 19 nt, Homo sapiens
cuacaauacaacacauuga

SEQ ID NO: 1662439 - RNA, 14 nt, Homo sapiens
cuacacugccuuug

SEQ ID NO: 1662440 - RNA, 13 nt, Homo sapiens
cuacagacauuaa

SEQ ID NO: 1662441 - RNA, 15 nt, Homo sapiens
cuacaggcauuuaac

SEQ ID NO: 1662442 - RNA, 20 nt, Homo sapiens
auacauuauuggacuuccau

SEQ ID NO: 1662443 - RNA, 13 nt, Homo sapiens
auaccaccuucaa

SEQ ID NO: 1662444 - RNA, 17 nt, Homo sapiens
auaccaccuucaauauc

SEQ ID NO: 1662445 - RNA, 16 nt, Homo sapiens
auaccagguuaccuca

SEQ ID NO: 1662446 - RNA, 15 nt, Homo sapiens
auaccaguucuugca

SEQ ID NO: 1662447 - RNA, 13 nt, Homo sapiens
auacccaucccau

SEQ ID NO: 1662448 - RNA, 14 nt, Homo sapiens
auaccuacugcuga

SEQ ID NO: 1662449 - RNA, 16 nt, Homo sapiens
auaccugccugggaca

SEQ ID NO: 1662450 - RNA, 22 nt, Homo sapiens
auaccugccugggacagccacu

SEQ ID NO: 1662451 - RNA, 15 nt, Homo sapiens
auacugaugagacaa

SEQ ID NO: 1662452 - RNA, 21 nt, Homo sapiens
auacuucuuuauucacaguau

SEQ ID NO: 1662453 - RNA, 17 nt, Homo sapiens
auacuuuguauacaagu

SEQ ID NO: 1662454 - RNA, 12 nt, Homo sapiens
auagaauccaaa

SEQ ID NO: 1662455 - RNA, 20 nt, Homo sapiens
auagaugucuguguauacau

SEQ ID NO: 1662456 - RNA, 21 nt, Homo sapiens
auagaugucuguguauacaua

SEQ ID NO: 1662457 - RNA, 16 nt, Homo sapiens
auagauuaauggcacu

SEQ ID NO: 1662458 - RNA, 22 nt, Homo sapiens
auagauuuucauguucuugcag

SEQ ID NO: 1662459 - RNA, 15 nt, Homo sapiens
auagcagcuuuagcc

SEQ ID NO: 1662460 - RNA, 17 nt, Homo sapiens
auagcagcuuuagccaa

SEQ ID NO: 1662461 - RNA, 15 nt, Homo sapiens
auagccaaggccaaa

SEQ ID NO: 1662462 - RNA, 18 nt, Homo sapiens
auagcuccuucaugcuuu

SEQ ID NO: 1662463 - RNA, 12 nt, Homo sapiens
auagcugagcac

SEQ ID NO: 1662464 - RNA, 17 nt, Homo sapiens
auagcuuaagaaguauc

SEQ ID NO: 1662465 - RNA, 17 nt, Homo sapiens
auaguauacacaucaua

SEQ ID NO: 1662466 - RNA, 13 nt, Homo sapiens
auaguauuucaga

SEQ ID NO: 1662467 - RNA, 12 nt, Homo sapiens
auaguguugcuu

SEQ ID NO: 1662468 - RNA, 20 nt, Homo sapiens
auaguguuguguuacaauaa

SEQ ID NO: 1662469 - RNA, 13 nt, Homo sapiens
auauaagccauag

SEQ ID NO: 1662470 - RNA, 14 nt, Homo sapiens
auauaagccauagc

SEQ ID NO: 1662471 - RNA, 18 nt, Homo sapiens
auauaauucuuaugccau

SEQ ID NO: 1662472 - RNA, 15 nt, Homo sapiens
auauacacuuuacau

SEQ ID NO: 1662473 - RNA, 14 nt, Homo sapiens
auauacucgaauca

SEQ ID NO: 1662474 - RNA, 18 nt, Homo sapiens
auaucagaguaugucagu

SEQ ID NO: 1662475 - RNA, 17 nt, Homo sapiens
auaucaguuacaguggc

SEQ ID NO: 1662476 - RNA, 21 nt, Homo sapiens
auaucauccugccuucaugga

SEQ ID NO: 1662477 - RNA, 19 nt, Homo sapiens
auaucaugcacacaauuag

SEQ ID NO: 1662478 - RNA, 23 nt, Homo sapiens
auaugaacgcacaacaugcacau

SEQ ID NO: 1662479 - RNA, 18 nt, Homo sapiens
auaugaguacauacucaa

SEQ ID NO: 1662480 - RNA, 19 nt, Homo sapiens
auauggaaacagagcaaaa

SEQ ID NO: 1662481 - RNA, 16 nt, Homo sapiens
auaugggaggaacaaa

SEQ ID NO: 1662482 - RNA, 19 nt, Homo sapiens
auauguacaguuauacaua

SEQ ID NO: 1662483 - RNA, 19 nt, Homo sapiens
auaugugcuuguguguaug

SEQ ID NO: 1662484 - RNA, 15 nt, Homo sapiens
auauuaaaaucacaa

SEQ ID NO: 1662485 - RNA, 23 nt, Homo sapiens
auauuaaggcuuacuaguaucac

SEQ ID NO: 1662486 - RNA, 21 nt, Homo sapiens
auauuacccucagaauauuaa

SEQ ID NO: 1662487 - RNA, 18 nt, Homo sapiens
auauuauuugcuaauuaa

SEQ ID NO: 1662488 - RNA, 21 nt, Homo sapiens
auauucagagauguaccaugu

SEQ ID NO: 1662489 - RNA, 23 nt, Homo sapiens
auauucaggaaauguucacugaa

SEQ ID NO: 1662490 - RNA, 20 nt, Homo sapiens
auauuuaaaagauccauuua

SEQ ID NO: 1662491 - RNA, 14 nt, Homo sapiens
auauuuacaaugua

SEQ ID NO: 1662492 - RNA, 12 nt, Homo sapiens
auauuucacuua

SEQ ID NO: 1662493 - RNA, 20 nt, Homo sapiens
auauuugugugaaaauguga

SEQ ID NO: 1662494 - RNA, 18 nt, Homo sapiens
auauuuucugaguagcau

SEQ ID NO: 1662495 - RNA, 14 nt, Homo sapiens
aucaaaauguuguc

SEQ ID NO: 1662496 - RNA, 24 nt, Homo sapiens
aucaacaaguucuuguugacucag

SEQ ID NO: 1662497 - RNA, 22 nt, Homo sapiens
aucaacauucccccaacauuac

SEQ ID NO: 1662498 - RNA, 21 nt, Homo sapiens
aucaacugcaucaagauguga

SEQ ID NO: 1662499 - RNA, 16 nt, Homo sapiens
aucaagaugugacaug

SEQ ID NO: 1662500 - RNA, 21 nt, Homo sapiens
aucaaggugaaggaucugucc

SEQ ID NO: 1662501 - RNA, 14 nt, Homo sapiens
aucaagucugugaa

SEQ ID NO: 1662502 - RNA, 18 nt, Homo sapiens
cagcucaccaacuacaga

SEQ ID NO: 1662503 - RNA, 11 nt, Homo sapiens
cagcucaggga

SEQ ID NO: 1662504 - RNA, 16 nt, Homo sapiens
cagcuccaaccuggag

SEQ ID NO: 1662505 - RNA, 14 nt, Homo sapiens
cagcuccacucuga

SEQ ID NO: 1662506 - RNA, 13 nt, Homo sapiens
cagcugcagccaa

SEQ ID NO: 1662507 - RNA, 23 nt, Homo sapiens
cagcugugugugcccguggugag

SEQ ID NO: 1662508 - RNA, 14 nt, Homo sapiens
cagcuuaugagcuc

SEQ ID NO: 1662509 - RNA, 20 nt, Homo sapiens
cagcuucccugaacacucau

SEQ ID NO: 1662510 - RNA, 19 nt, Homo sapiens
cagcuugcacaaagaggau

SEQ ID NO: 1662511 - RNA, 20 nt, Homo sapiens
cagcuuggagugccacgugg

SEQ ID NO: 1662512 - RNA, 20 nt, Homo sapiens
caggaaaagaaagagcugaa

SEQ ID NO: 1662513 - RNA, 18 nt, Homo sapiens
caggaaagaucccaaguc

SEQ ID NO: 1662514 - RNA, 21 nt, Homo sapiens
caggaaagaucccaagucaaa

SEQ ID NO: 1662515 - RNA, 14 nt, Homo sapiens
caggaaauucuguu

SEQ ID NO: 1662516 - RNA, 20 nt, Homo sapiens
caggaacauuggagccugca

SEQ ID NO: 1662517 - RNA, 16 nt, Homo sapiens
caggaaccagcaauga

SEQ ID NO: 1662518 - RNA, 21 nt, Homo sapiens
caggaagccagcaggcucuca

SEQ ID NO: 1662519 - RNA, 16 nt, Homo sapiens
caggaagggaccccac

SEQ ID NO: 1662520 - RNA, 22 nt, Homo sapiens
caggaaguaauuuucuucucau

SEQ ID NO: 1662521 - RNA, 16 nt, Homo sapiens
caggaccaugugauaa

SEQ ID NO: 1662522 - RNA, 21 nt, Homo sapiens
caggacccagggaaugccagg

SEQ ID NO: 1662523 - RNA, 23 nt, Homo sapiens
caggaccuugcuuccuucucauc

SEQ ID NO: 1662524 - RNA, 19 nt, Homo sapiens
caggagcguguccuauccc

SEQ ID NO: 1662525 - RNA, 15 nt, Homo sapiens
caggaggcaagcaag

SEQ ID NO: 1662526 - RNA, 22 nt, Homo sapiens
caggauaacagcaauuguucag

SEQ ID NO: 1662527 - RNA, 16 nt, Homo sapiens
caggauaugaguacau

SEQ ID NO: 1662528 - RNA, 21 nt, Homo sapiens
caggauaugaguacauacuca

SEQ ID NO: 1662529 - RNA, 12 nt, Homo sapiens
caggauggagug

SEQ ID NO: 1662530 - RNA, 16 nt, Homo sapiens
caggauggagugcagu

SEQ ID NO: 1662531 - RNA, 13 nt, Homo sapiens
caggcagugcagu

SEQ ID NO: 1662532 - RNA, 19 nt, Homo sapiens
caggccaaacucaccugcc

SEQ ID NO: 1662533 - RNA, 13 nt, Homo sapiens
caggccagcugcu

SEQ ID NO: 1662534 - RNA, 16 nt, Homo sapiens
caggcuacaguugaua

SEQ ID NO: 1662535 - RNA, 15 nt, Homo sapiens
caggcucacagagau

SEQ ID NO: 1662536 - RNA, 23 nt, Homo sapiens
caggcugcaggugggguuuucac

SEQ ID NO: 1662537 - RNA, 15 nt, Homo sapiens
caggcuggagugcag

SEQ ID NO: 1662538 - RNA, 22 nt, Homo sapiens
cagggaacggaaagaagagaga

SEQ ID NO: 1662539 - RNA, 15 nt, Homo sapiens
cagggacauuuucaa

SEQ ID NO: 1662540 - RNA, 13 nt, Homo sapiens
cagggaccaagga

SEQ ID NO: 1662541 - RNA, 15 nt, Homo sapiens
cagggaucauagcug

SEQ ID NO: 1662542 - RNA, 16 nt, Homo sapiens
cagggaucauagcuga

SEQ ID NO: 1662543 - RNA, 18 nt, Homo sapiens
cagggcaaaaugaacuaa

SEQ ID NO: 1662544 - RNA, 14 nt, Homo sapiens
cagggcaaucaaug

SEQ ID NO: 1662545 - RNA, 16 nt, Homo sapiens
cagggcagaaccaaga

SEQ ID NO: 1662546 - RNA, 19 nt, Homo sapiens
cagggcucccugcccugac

SEQ ID NO: 1662547 - RNA, 23 nt, Homo sapiens
cagggggguuggguuccagacag

SEQ ID NO: 1662548 - RNA, 20 nt, Homo sapiens
cagggugaagaguccaagaa

SEQ ID NO: 1662549 - RNA, 20 nt, Homo sapiens
caggguggcacccaccacuc

SEQ ID NO: 1662550 - RNA, 23 nt, Homo sapiens
caggguggggggccauguuccca

SEQ ID NO: 1662551 - RNA, 16 nt, Homo sapiens
caggugcuuguggaca

SEQ ID NO: 1662552 - RNA, 20 nt, Homo sapiens
cagguuccucaaaacaggcc

SEQ ID NO: 1662553 - RNA, 17 nt, Homo sapiens
cagguuggagugcagug

SEQ ID NO: 1662554 - RNA, 21 nt, Homo sapiens
cagguugugugugugugcagu

SEQ ID NO: 1662555 - RNA, 23 nt, Homo sapiens
cagguugugugugugugcaguga

SEQ ID NO: 1662556 - RNA, 21 nt, Homo sapiens
caguaaagaccauuuaguccu

SEQ ID NO: 1662557 - RNA, 22 nt, Homo sapiens
caguaaagaccauuuaguccuc

SEQ ID NO: 1662558 - RNA, 17 nt, Homo sapiens
caguaaaucagugcagu

SEQ ID NO: 1662559 - RNA, 22 nt, Homo sapiens
caguaacacaauacaguacuca

SEQ ID NO: 1662560 - RNA, 18 nt, Homo sapiens
caguaacacagugcagua

SEQ ID NO: 1662561 - RNA, 22 nt, Homo sapiens
caguaacacagugcaguacuca

SEQ ID NO: 1662562 - RNA, 13 nt, Homo sapiens
caguaacagugca

SEQ ID NO: 1662563 - RNA, 14 nt, Homo sapiens
caguaacagugcag

SEQ ID NO: 1662564 - RNA, 22 nt, Homo sapiens
gcuucucacacuggaggagcac

SEQ ID NO: 1662565 - RNA, 20 nt, Homo sapiens
gcuucucuaaaacagcacua

SEQ ID NO: 1662566 - RNA, 22 nt, Homo sapiens
gcuucugcugcccugaugcguc

SEQ ID NO: 1662567 - RNA, 16 nt, Homo sapiens
gcuugggaucuucaau

SEQ ID NO: 1662568 - RNA, 14 nt, Homo sapiens
gcuugugcacugga

SEQ ID NO: 1662569 - RNA, 15 nt, Homo sapiens
gcuugugcacuggau

SEQ ID NO: 1662570 - RNA, 13 nt, Homo sapiens
gcuuuaauauuca

SEQ ID NO: 1662571 - RNA, 18 nt, Homo sapiens
gcuuuacauggguucaau

SEQ ID NO: 1662572 - RNA, 19 nt, Homo sapiens
gcuuucauccaacuggaag

SEQ ID NO: 1662573 - RNA, 13 nt, Homo sapiens
gcuuuccaaaacc

SEQ ID NO: 1662574 - RNA, 16 nt, Homo sapiens
gcuuuccacaucccca

SEQ ID NO: 1662575 - RNA, 14 nt, Homo sapiens
gcuuucucuucuaa

SEQ ID NO: 1662576 - RNA, 22 nt, Homo sapiens
gcuuuggguagugccauggcca

SEQ ID NO: 1662577 - RNA, 13 nt, Homo sapiens
gcuuuucugcaau

SEQ ID NO: 1662578 - RNA, 20 nt, Homo sapiens
gcuuuugacccaaaugcaaa

SEQ ID NO: 1662579 - RNA, 14 nt, Homo sapiens
gcuuuuuugcaaua

SEQ ID NO: 1662580 - RNA, 13 nt, Homo sapiens
ggaaaagauuucu

SEQ ID NO: 1662581 - RNA, 18 nt, Homo sapiens
ggaaaagauuucugucca

SEQ ID NO: 1662582 - RNA, 22 nt, Homo sapiens
ggaaaagguagcuuaccugaca

SEQ ID NO: 1662583 - RNA, 18 nt, Homo sapiens
ggaaagauuauauuuuau

SEQ ID NO: 1662584 - RNA, 19 nt, Homo sapiens
ggaaagcagugcaguacuc

SEQ ID NO: 1662585 - RNA, 16 nt, Homo sapiens
ggaaaggagaguacuu

SEQ ID NO: 1662586 - RNA, 20 nt, Homo sapiens
ggaaaggaggcaugccucug

SEQ ID NO: 1662587 - RNA, 16 nt, Homo sapiens
ggaaauaucugugaag

SEQ ID NO: 1662588 - RNA, 17 nt, Homo sapiens
ggaaaugaauccaucau

SEQ ID NO: 1662589 - RNA, 22 nt, Homo sapiens
ggaacugaguguuagugacuuu

SEQ ID NO: 1662590 - RNA, 17 nt, Homo sapiens
ggaagaggagaugacag

SEQ ID NO: 1662591 - RNA, 20 nt, Homo sapiens
ggaagccagcaggcucucag

SEQ ID NO: 1662592 - RNA, 15 nt, Homo sapiens
ggaagcucuaccgca

SEQ ID NO: 1662593 - RNA, 14 nt, Homo sapiens
ggaaggacauuucc

SEQ ID NO: 1662594 - RNA, 16 nt, Homo sapiens
ggaaggccguaaaaug

SEQ ID NO: 1662595 - RNA, 16 nt, Homo sapiens
ggaauaagaagcaaau

SEQ ID NO: 1662596 - RNA, 19 nt, Homo sapiens
ggaaugcagcacaguacuc

SEQ ID NO: 1662597 - RNA, 12 nt, Homo sapiens
ggaaugcucaau

SEQ ID NO: 1662598 - RNA, 20 nt, Homo sapiens
ggaaugggaagaaguaguuu

SEQ ID NO: 1662599 - RNA, 14 nt, Homo sapiens
ggacaaaaugcaga

SEQ ID NO: 1662600 - RNA, 18 nt, Homo sapiens
ggacagccugcacagugg

SEQ ID NO: 1662601 - RNA, 16 nt, Homo sapiens
ggacaucagcaucacg

SEQ ID NO: 1662602 - RNA, 12 nt, Homo sapiens
ggaccagggaug

SEQ ID NO: 1662603 - RNA, 18 nt, Homo sapiens
ggacccagggaaugccag

SEQ ID NO: 1662604 - RNA, 19 nt, Homo sapiens
ggaccuuugcacuuugcca

SEQ ID NO: 1662605 - RNA, 23 nt, Homo sapiens
ggacucaucuugggaagggccau

SEQ ID NO: 1662606 - RNA, 17 nt, Homo sapiens
ggacuggcacacuggcc

SEQ ID NO: 1662607 - RNA, 19 nt, Homo sapiens
ggacuguguuuuuccuaug

SEQ ID NO: 1662608 - RNA, 22 nt, Homo sapiens
ggacuguuggcugauuggaaaa

SEQ ID NO: 1662609 - RNA, 16 nt, Homo sapiens
ggacuucugcagcuau

SEQ ID NO: 1662610 - RNA, 19 nt, Homo sapiens
ggagaaagcccaagaguua

SEQ ID NO: 1662611 - RNA, 17 nt, Homo sapiens
ggagaaccaccauucac

SEQ ID NO: 1662612 - RNA, 22 nt, Homo sapiens
ggagaagaggcagauucaauuu

SEQ ID NO: 1662613 - RNA, 19 nt, Homo sapiens
ggagaaggaaggcuccauc

SEQ ID NO: 1662614 - RNA, 22 nt, Homo sapiens
ggagacccauguaaauaccaga

SEQ ID NO: 1662615 - RNA, 22 nt, Homo sapiens
ggagaguaacccugucuaauga

SEQ ID NO: 1662616 - RNA, 14 nt, Homo sapiens
ggagaguacuuugg

SEQ ID NO: 1662617 - RNA, 16 nt, Homo sapiens
ggagccauaagggaca

SEQ ID NO: 1662618 - RNA, 20 nt, Homo sapiens
ggagccccauuauucauucu

SEQ ID NO: 1662619 - RNA, 18 nt, Homo sapiens
ggagccugcaauaaggga

SEQ ID NO: 1662620 - RNA, 17 nt, Homo sapiens
ggagcguguacuacccc

SEQ ID NO: 1662621 - RNA, 18 nt, Homo sapiens
ggaggaacugcuugugca

SEQ ID NO: 1662622 - RNA, 21 nt, Homo sapiens
ggaggaacugcuugugcacug

SEQ ID NO: 1662623 - RNA, 14 nt, Homo sapiens
ggaggaagcacaga

SEQ ID NO: 1662624 - RNA, 22 nt, Homo sapiens
ggaggccugggagaugcagcug

SEQ ID NO: 1662625 - RNA, 12 nt, Homo sapiens
aaggcuguguca

SEQ ID NO: 1662626 - RNA, 21 nt, Homo sapiens
aagggagggguuaaugcagau

SEQ ID NO: 1662627 - RNA, 12 nt, Homo sapiens
aagggucuuccu

SEQ ID NO: 1662628 - RNA, 17 nt, Homo sapiens
aagggugcccaccucuu

SEQ ID NO: 1662629 - RNA, 12 nt, Homo sapiens
aaggucaucuca

SEQ ID NO: 1662630 - RNA, 18 nt, Homo sapiens
aagguccugcuguggaaa

SEQ ID NO: 1662631 - RNA, 21 nt, Homo sapiens
aaggucugaacccuuccacca

SEQ ID NO: 1662632 - RNA, 16 nt, Homo sapiens
aaggucugcuuuucau

SEQ ID NO: 1662633 - RNA, 18 nt, Homo sapiens
aaggugaugaauuuacca

SEQ ID NO: 1662634 - RNA, 20 nt, Homo sapiens
aagguuggaggaucauuuga

SEQ ID NO: 1662635 - RNA, 16 nt, Homo sapiens
aagguuucacuguuca

SEQ ID NO: 1662636 - RNA, 14 nt, Homo sapiens
aaguaaacagucag

SEQ ID NO: 1662637 - RNA, 19 nt, Homo sapiens
aaguaaauacauuauugaa

SEQ ID NO: 1662638 - RNA, 13 nt, Homo sapiens
aaguaacacucac

SEQ ID NO: 1662639 - RNA, 17 nt, Homo sapiens
aaguaagagagcacagu

SEQ ID NO: 1662640 - RNA, 23 nt, Homo sapiens
aaguaaucuguugacagugccaa

SEQ ID NO: 1662641 - RNA, 21 nt, Homo sapiens
aaguaauuuacaaaccucuca

SEQ ID NO: 1662642 - RNA, 18 nt, Homo sapiens
aaguaauuuucuucucau

SEQ ID NO: 1662643 - RNA, 22 nt, Homo sapiens
aaguagcguuggagacauacac

SEQ ID NO: 1662644 - RNA, 11 nt, Homo sapiens
aaguauuccac

SEQ ID NO: 1662645 - RNA, 23 nt, Homo sapiens
aagucaaacuuucaccucagauu

SEQ ID NO: 1662646 - RNA, 13 nt, Homo sapiens
aagucaggccauu

SEQ ID NO: 1662647 - RNA, 11 nt, Homo sapiens
aaguccacucu

SEQ ID NO: 1662648 - RNA, 17 nt, Homo sapiens
aagucucucuaagacaa

SEQ ID NO: 1662649 - RNA, 13 nt, Homo sapiens
aagucuuacuguu

SEQ ID NO: 1662650 - RNA, 17 nt, Homo sapiens
aagugacuuauuugcuc

SEQ ID NO: 1662651 - RNA, 13 nt, Homo sapiens
aagugaggaugaa

SEQ ID NO: 1662652 - RNA, 14 nt, Homo sapiens
aagugaugugauuu

SEQ ID NO: 1662653 - RNA, 14 nt, Homo sapiens
aagugauguuauag

SEQ ID NO: 1662654 - RNA, 11 nt, Homo sapiens
aagugcauguu

SEQ ID NO: 1662655 - RNA, 15 nt, Homo sapiens
aagugcucaguauug

SEQ ID NO: 1662656 - RNA, 19 nt, Homo sapiens
aagugcuucuccagccuca

SEQ ID NO: 1662657 - RNA, 16 nt, Homo sapiens
aagugcuugaggccaa

SEQ ID NO: 1662658 - RNA, 14 nt, Homo sapiens
aaguggacuguauu

SEQ ID NO: 1662659 - RNA, 17 nt, Homo sapiens
aagugucaucacuuuua

SEQ ID NO: 1662660 - RNA, 16 nt, Homo sapiens
aaguuaaucuucaugg

SEQ ID NO: 1662661 - RNA, 15 nt, Homo sapiens
aaguuauugugauaa

SEQ ID NO: 1662662 - RNA, 19 nt, Homo sapiens
aaguucauucauacucaaa

SEQ ID NO: 1662663 - RNA, 16 nt, Homo sapiens
aaguuggagugcaaug

SEQ ID NO: 1662664 - RNA, 16 nt, Homo sapiens
aaguuggagugcagug

SEQ ID NO: 1662665 - RNA, 16 nt, Homo sapiens
aaguuuaacauauaca

SEQ ID NO: 1662666 - RNA, 17 nt, Homo sapiens
aaguuuugauacuugua

SEQ ID NO: 1662667 - RNA, 20 nt, Homo sapiens
aauaaaacucccuuccuuau

SEQ ID NO: 1662668 - RNA, 13 nt, Homo sapiens
aauaaaacucugc

SEQ ID NO: 1662669 - RNA, 17 nt, Homo sapiens
aauaaaagaaucauuug

SEQ ID NO: 1662670 - RNA, 13 nt, Homo sapiens
aauaaaaugauua

SEQ ID NO: 1662671 - RNA, 18 nt, Homo sapiens
aauaaagcaaugugguag

SEQ ID NO: 1662672 - RNA, 11 nt, Homo sapiens
aauaaagccuc

SEQ ID NO: 1662673 - RNA, 22 nt, Homo sapiens
aauaaauuauuuaacuaauuaa

SEQ ID NO: 1662674 - RNA, 18 nt, Homo sapiens
aauaacaaaucguccaaa

SEQ ID NO: 1662675 - RNA, 12 nt, Homo sapiens
aauaacacugua

SEQ ID NO: 1662676 - RNA, 13 nt, Homo sapiens
aauaacacuguac

SEQ ID NO: 1662677 - RNA, 17 nt, Homo sapiens
aauaacacuguacugca

SEQ ID NO: 1662678 - RNA, 19 nt, Homo sapiens
aauaaccguaaagguuuau

SEQ ID NO: 1662679 - RNA, 20 nt, Homo sapiens
aauaacugagcacuuugaau

SEQ ID NO: 1662680 - RNA, 13 nt, Homo sapiens
aauaaugauuuaa

SEQ ID NO: 1662681 - RNA, 15 nt, Homo sapiens
aauacaacacauuga

SEQ ID NO: 1662682 - RNA, 12 nt, Homo sapiens
aauacaguauua

SEQ ID NO: 1662683 - RNA, 21 nt, Homo sapiens
aauaccuuagcucccuugagc

SEQ ID NO: 1662684 - RNA, 15 nt, Homo sapiens
aauagcgccucuuuu

SEQ ID NO: 1662685 - RNA, 13 nt, Homo sapiens
aauagcuuuucac

SEQ ID NO: 1662686 - RNA, 11 nt, Homo sapiens
aauaggcuugu

SEQ ID NO: 1662687 - RNA, 16 nt, Homo sapiens
aauauaaaaugccaag

SEQ ID NO: 1662688 - RNA, 15 nt, Homo sapiens
aauauaguagcagga

SEQ ID NO: 1662689 - RNA, 15 nt, Homo sapiens
aauaucacucauuaa

SEQ ID NO: 1662690 - RNA, 20 nt, Homo sapiens
aauauccaagcccagccuau

SEQ ID NO: 1662691 - RNA, 19 nt, Homo sapiens
aauaugauaauaaaggcau

SEQ ID NO: 1662692 - RNA, 17 nt, Homo sapiens
aauauuaaggcuuacua

SEQ ID NO: 1662693 - RNA, 15 nt, Homo sapiens
aauauuauuugcuaa

SEQ ID NO: 1662694 - RNA, 17 nt, Homo sapiens
aauauuauuugcuaauu

SEQ ID NO: 1662695 - RNA, 15 nt, Homo sapiens
aauauucaugcugcc

SEQ ID NO: 1662696 - RNA, 23 nt, Homo sapiens
aauauuuauaaaugaagaugcau

SEQ ID NO: 1662697 - RNA, 13 nt, Homo sapiens
aauauuucacuua

SEQ ID NO: 1662698 - RNA, 12 nt, Homo sapiens
aaucaauguuca

SEQ ID NO: 1662699 - RNA, 21 nt, Homo sapiens
aaucaccccucucagugcacc

SEQ ID NO: 1662700 - RNA, 20 nt, Homo sapiens
aaucaccuaauuaauuucag

SEQ ID NO: 1662701 - RNA, 11 nt, Homo sapiens
aaucaguuugc

SEQ ID NO: 1662702 - RNA, 22 nt, Homo sapiens
aaucauaaauacugcuguauaa

SEQ ID NO: 1662703 - RNA, 19 nt, Homo sapiens
aaucauuauuuucaaccau

SEQ ID NO: 1662704 - RNA, 23 nt, Homo sapiens
aaucauugagaaauaaagcacau

SEQ ID NO: 1662705 - RNA, 14 nt, Homo sapiens
aauccacaguauug

SEQ ID NO: 1662706 - RNA, 12 nt, Homo sapiens
aauccauaucag

SEQ ID NO: 1662707 - RNA, 23 nt, Homo sapiens
aauccaucauacauuagugccau

SEQ ID NO: 1662708 - RNA, 22 nt, Homo sapiens
aauccauuugagucugcuccuu

SEQ ID NO: 1662709 - RNA, 17 nt, Homo sapiens
aaucccauuccugggcu

SEQ ID NO: 1662710 - RNA, 19 nt, Homo sapiens
aaucccauuuaugcaauuu

SEQ ID NO: 1662711 - RNA, 18 nt, Homo sapiens
aauccuuuguacugauga

SEQ ID NO: 1662712 - RNA, 16 nt, Homo sapiens
aaucguaaccuaugaa

SEQ ID NO: 1662713 - RNA, 16 nt, Homo sapiens
aaucucaggucuucac

SEQ ID NO: 1662714 - RNA, 18 nt, Homo sapiens
aaucucuaaaaugcuguu

SEQ ID NO: 1662715 - RNA, 15 nt, Homo sapiens
aaucugggaccaaaa

SEQ ID NO: 1662716 - RNA, 14 nt, Homo sapiens
aaucuguccagaca

SEQ ID NO: 1662717 - RNA, 21 nt, Homo sapiens
aaucuguugacagugccaaua

SEQ ID NO: 1662718 - RNA, 22 nt, Homo sapiens
aaucuguuuccuguguuaguca

SEQ ID NO: 1662719 - RNA, 18 nt, Homo sapiens
aaucuuuagaauaguuaa

SEQ ID NO: 1662720 - RNA, 22 nt, Homo sapiens
aaugaaaccugugucucugaga

SEQ ID NO: 1662721 - RNA, 14 nt, Homo sapiens
aaugaagucuuucc

SEQ ID NO: 1662722 - RNA, 17 nt, Homo sapiens
aaugaaugucaguguga

SEQ ID NO: 1662723 - RNA, 18 nt, Homo sapiens
aaugacaugcacugaccc

SEQ ID NO: 1662724 - RNA, 12 nt, Homo sapiens
aaugaccccaga

SEQ ID NO: 1662725 - RNA, 20 nt, Homo sapiens
aaugagaaauugugccaaag

SEQ ID NO: 1662726 - RNA, 22 nt, Homo sapiens
aaugagccauuuccauggugcc

SEQ ID NO: 1662727 - RNA, 17 nt, Homo sapiens
aaugagcuuaaugucuu

SEQ ID NO: 1662728 - RNA, 12 nt, Homo sapiens
aaugaggcacau

SEQ ID NO: 1662729 - RNA, 16 nt, Homo sapiens
aaugaugguaaguuaa

SEQ ID NO: 1662730 - RNA, 14 nt, Homo sapiens
aaugaugugauaca

SEQ ID NO: 1662731 - RNA, 21 nt, Homo sapiens
aaugcaaaauacaugaugauu

SEQ ID NO: 1662732 - RNA, 12 nt, Homo sapiens
aaugcacaguga

SEQ ID NO: 1662733 - RNA, 20 nt, Homo sapiens
aaugcacagugaagggugau

SEQ ID NO: 1662734 - RNA, 18 nt, Homo sapiens
aaugccaauucaucucag

SEQ ID NO: 1662735 - RNA, 19 nt, Homo sapiens
aaugccagggacauuuuca

SEQ ID NO: 1662736 - RNA, 15 nt, Homo sapiens
aaugcuaaaugcaaa

SEQ ID NO: 1662737 - RNA, 14 nt, Homo sapiens
aaugcucaaugugc

SEQ ID NO: 1662738 - RNA, 16 nt, Homo sapiens
aaugcuuucucaugca

SEQ ID NO: 1662739 - RNA, 17 nt, Homo sapiens
aauggaaagaagcaguu

SEQ ID NO: 1662740 - RNA, 15 nt, Homo sapiens
aauggaacucgcuca

SEQ ID NO: 1662741 - RNA, 13 nt, Homo sapiens
aauggaagacagc

SEQ ID NO: 1662742 - RNA, 16 nt, Homo sapiens
aauggagaaaaccaga

SEQ ID NO: 1662743 - RNA, 19 nt, Homo sapiens
aauggauccuugucaguug

SEQ ID NO: 1662744 - RNA, 16 nt, Homo sapiens
aauggcccuguagcuc

SEQ ID NO: 1662745 - RNA, 13 nt, Homo sapiens
aauggcugaagaa

SEQ ID NO: 1662746 - RNA, 17 nt, Homo sapiens
aauggcuuguucaguca

SEQ ID NO: 1662747 - RNA, 12 nt, Homo sapiens
aaugguagcucu

SEQ ID NO: 1662748 - RNA, 17 nt, Homo sapiens
aauguacaauaaagcaa

SEQ ID NO: 1662749 - RNA, 17 nt, Homo sapiens
acugcuugugcacugga

SEQ ID NO: 1662750 - RNA, 22 nt, Homo sapiens
acugcuugugcacuggaugugg

SEQ ID NO: 1662751 - RNA, 21 nt, Homo sapiens
acugcuuugagaaaucucauc

SEQ ID NO: 1662752 - RNA, 23 nt, Homo sapiens
acugcuuuuuccuuagcuuaaug

SEQ ID NO: 1662753 - RNA, 20 nt, Homo sapiens
acuggaucucuuaagacagc

SEQ ID NO: 1662754 - RNA, 21 nt, Homo sapiens
acuggauguggccccacccuu

SEQ ID NO: 1662755 - RNA, 22 nt, Homo sapiens
acuggcauggacaucagcauca

SEQ ID NO: 1662756 - RNA, 16 nt, Homo sapiens
acuggcccaccccucu

SEQ ID NO: 1662757 - RNA, 12 nt, Homo sapiens
acuggccuccag

SEQ ID NO: 1662758 - RNA, 21 nt, Homo sapiens
acugggccugcuagucuguca

SEQ ID NO: 1662759 - RNA, 20 nt, Homo sapiens
acuguaguaauuguuacaau

SEQ ID NO: 1662760 - RNA, 18 nt, Homo sapiens
acuguagucagaccucag

SEQ ID NO: 1662761 - RNA, 18 nt, Homo sapiens
acuguauauuuguaugau

SEQ ID NO: 1662762 - RNA, 22 nt, Homo sapiens
acuguauuucggcuaugucuca

SEQ ID NO: 1662763 - RNA, 16 nt, Homo sapiens
acugucaugcccagcu

SEQ ID NO: 1662764 - RNA, 17 nt, Homo sapiens
acuguccuacaauauca

SEQ ID NO: 1662765 - RNA, 18 nt, Homo sapiens
acugucuucaacccugcc

SEQ ID NO: 1662766 - RNA, 14 nt, Homo sapiens
acugugacacagcu

SEQ ID NO: 1662767 - RNA, 17 nt, Homo sapiens
acugugacauuccacag

SEQ ID NO: 1662768 - RNA, 17 nt, Homo sapiens
acugugagaacugugaa

SEQ ID NO: 1662769 - RNA, 21 nt, Homo sapiens
acugugaggugggccuuugag

SEQ ID NO: 1662770 - RNA, 22 nt, Homo sapiens
acugugucccagugucuggccc

SEQ ID NO: 1662771 - RNA, 13 nt, Homo sapiens
acugugucucaug

SEQ ID NO: 1662772 - RNA, 12 nt, Homo sapiens
acuguguuggcc

SEQ ID NO: 1662773 - RNA, 21 nt, Homo sapiens
acuguuaaauaaggccucauc

SEQ ID NO: 1662774 - RNA, 13 nt, Homo sapiens
acuguuugcccca

SEQ ID NO: 1662775 - RNA, 16 nt, Homo sapiens
acuguuuuguuuguua

SEQ ID NO: 1662776 - RNA, 15 nt, Homo sapiens
acuuaaccugaagcu

SEQ ID NO: 1662777 - RNA, 21 nt, Homo sapiens
acuuaauuaccuaagagccac

SEQ ID NO: 1662778 - RNA, 14 nt, Homo sapiens
acuuaucaguuugc

SEQ ID NO: 1662779 - RNA, 16 nt, Homo sapiens
acuuauuuccauggau

SEQ ID NO: 1662780 - RNA, 13 nt, Homo sapiens
acuucaagcuuuu

SEQ ID NO: 1662781 - RNA, 14 nt, Homo sapiens
acuucagacucucu

SEQ ID NO: 1662782 - RNA, 16 nt, Homo sapiens
acuucaguucucaucu

SEQ ID NO: 1662783 - RNA, 12 nt, Homo sapiens
acuucccaagga

SEQ ID NO: 1662784 - RNA, 14 nt, Homo sapiens
acuucccaaggaaa

SEQ ID NO: 1662785 - RNA, 22 nt, Homo sapiens
acuucgggggcggcucugggaa

SEQ ID NO: 1662786 - RNA, 16 nt, Homo sapiens
acuucguacccuuugc

SEQ ID NO: 1662787 - RNA, 14 nt, Homo sapiens
acuucugcagcuau

SEQ ID NO: 1662788 - RNA, 20 nt, Homo sapiens
acuucugcuguacagauauc

SEQ ID NO: 1662789 - RNA, 21 nt, Homo sapiens
acuucuuaacuggcaacaguu

SEQ ID NO: 1662790 - RNA, 13 nt, Homo sapiens
acuugcuccuuuc

SEQ ID NO: 1662791 - RNA, 17 nt, Homo sapiens
acuuggaaaugggagac

SEQ ID NO: 1662792 - RNA, 20 nt, Homo sapiens
acuugggacggaaguggccu

SEQ ID NO: 1662793 - RNA, 18 nt, Homo sapiens
acuuguacuuacacugaa

SEQ ID NO: 1662794 - RNA, 20 nt, Homo sapiens
acuuguguucaaucugugaa

SEQ ID NO: 1662795 - RNA, 12 nt, Homo sapiens
acuuuagcauug

SEQ ID NO: 1662796 - RNA, 17 nt, Homo sapiens
acuuucccacacuguga

SEQ ID NO: 1662797 - RNA, 19 nt, Homo sapiens
acuuucccacacugugaac

SEQ ID NO: 1662798 - RNA, 22 nt, Homo sapiens
acuuucccagguugacuaagaa

SEQ ID NO: 1662799 - RNA, 21 nt, Homo sapiens
acuuucccuccaccagugugc

SEQ ID NO: 1662800 - RNA, 14 nt, Homo sapiens
acuuucuaaaugcc

SEQ ID NO: 1662801 - RNA, 20 nt, Homo sapiens
acuuugagccucuuaggcag

SEQ ID NO: 1662802 - RNA, 20 nt, Homo sapiens
acuuugccaucugaugucgu

SEQ ID NO: 1662803 - RNA, 20 nt, Homo sapiens
acuuugucacuucugcugua

SEQ ID NO: 1662804 - RNA, 19 nt, Homo sapiens
acuuuguuucauauucuca

SEQ ID NO: 1662805 - RNA, 15 nt, Homo sapiens
acuuuuauaaauuaa

SEQ ID NO: 1662806 - RNA, 12 nt, Homo sapiens
acuuuuccccau

SEQ ID NO: 1662807 - RNA, 17 nt, Homo sapiens
acuuuugggaacucucc

SEQ ID NO: 1662808 - RNA, 17 nt, Homo sapiens
agaaaaaucaaucauuu

SEQ ID NO: 1662809 - RNA, 23 nt, Homo sapiens
agaaaaaucuuuguuacucugua

SEQ ID NO: 1662810 - RNA, 22 nt, Homo sapiens
agaaaagaugugcagauaucac

SEQ ID NO: 1662811 - RNA, 16 nt, Homo sapiens
agaaaaugcuuucuca

SEQ ID NO: 1662812 - RNA, 21 nt, Homo sapiens
agaaacaagguguacaacuuc

SEQ ID NO: 1662813 - RNA, 23 nt, Homo sapiens
agaaacagcggcuccacuacaga

SEQ ID NO: 1662814 - RNA, 20 nt, Homo sapiens
agaaacaugacacugaccuu

SEQ ID NO: 1662815 - RNA, 20 nt, Homo sapiens
agaaacccccucauggaucu

SEQ ID NO: 1662816 - RNA, 13 nt, Homo sapiens
agaaacugugguc

SEQ ID NO: 1662817 - RNA, 17 nt, Homo sapiens
agaaacuuccuuugaga

SEQ ID NO: 1662818 - RNA, 24 nt, Homo sapiens
agaaacuuuggaaguuuuacuuga

SEQ ID NO: 1662819 - RNA, 15 nt, Homo sapiens
agaaaucuaaucucu

SEQ ID NO: 1662820 - RNA, 18 nt, Homo sapiens
agaaaugagcugcacucc

SEQ ID NO: 1662821 - RNA, 15 nt, Homo sapiens
agaaauggcuuucca

SEQ ID NO: 1662822 - RNA, 23 nt, Homo sapiens
agaaauggcuuuccacaucccca

SEQ ID NO: 1662823 - RNA, 19 nt, Homo sapiens
agaacagggaugcuaucuc

SEQ ID NO: 1662824 - RNA, 19 nt, Homo sapiens
agaaccaaaaagaggcuau

SEQ ID NO: 1662825 - RNA, 12 nt, Homo sapiens
agaaccaaagca

SEQ ID NO: 1662826 - RNA, 21 nt, Homo sapiens
agaaccaagaacauaaacccu

SEQ ID NO: 1662827 - RNA, 21 nt, Homo sapiens
agaaccugaaagggcauuuug

SEQ ID NO: 1662828 - RNA, 16 nt, Homo sapiens
agaacgaagccaccuu

SEQ ID NO: 1662829 - RNA, 19 nt, Homo sapiens
agaacuccuuucuaaggag

SEQ ID NO: 1662830 - RNA, 21 nt, Homo sapiens
agaagaguagauaagugcuca

SEQ ID NO: 1662831 - RNA, 13 nt, Homo sapiens
agaagcagcagcu

SEQ ID NO: 1662832 - RNA, 12 nt, Homo sapiens
agaagcaguuua

SEQ ID NO: 1662833 - RNA, 20 nt, Homo sapiens
agaagccacgcuguccucuc

SEQ ID NO: 1662834 - RNA, 21 nt, Homo sapiens
agaagcugucagggacccagg

SEQ ID NO: 1662835 - RNA, 13 nt, Homo sapiens
agaaggaaggcag

SEQ ID NO: 1662836 - RNA, 23 nt, Homo sapiens
agaaggagcuugggugcauuugc

SEQ ID NO: 1662837 - RNA, 16 nt, Homo sapiens
agaauaacacuggcuu

SEQ ID NO: 1662838 - RNA, 12 nt, Homo sapiens
agaauacuguau

SEQ ID NO: 1662839 - RNA, 17 nt, Homo sapiens
agaauauauugggcgaa

SEQ ID NO: 1662840 - RNA, 16 nt, Homo sapiens
agaaucaacagaucaa

SEQ ID NO: 1662841 - RNA, 14 nt, Homo sapiens
agaaucaacaguga

SEQ ID NO: 1662842 - RNA, 15 nt, Homo sapiens
agaaucaagucugug

SEQ ID NO: 1662843 - RNA, 18 nt, Homo sapiens
agaaucccuguucauugu

SEQ ID NO: 1662844 - RNA, 22 nt, Homo sapiens
agaaucucagucugucacccag

SEQ ID NO: 1662845 - RNA, 18 nt, Homo sapiens
agaaucugugcagucauc

SEQ ID NO: 1662846 - RNA, 19 nt, Homo sapiens
agaaucuuguuaauuucau

SEQ ID NO: 1662847 - RNA, 21 nt, Homo sapiens
agaaugaaaggcaaugacaag

SEQ ID NO: 1662848 - RNA, 16 nt, Homo sapiens
agaaugagccagaguu

SEQ ID NO: 1662849 - RNA, 11 nt, Homo sapiens
agaaugcacaa

SEQ ID NO: 1662850 - RNA, 11 nt, Homo sapiens
agaaugcagua

SEQ ID NO: 1662851 - RNA, 15 nt, Homo sapiens
agaauggaccacuga

SEQ ID NO: 1662852 - RNA, 17 nt, Homo sapiens
agaauggaccacugaga

SEQ ID NO: 1662853 - RNA, 12 nt, Homo sapiens
agaaugugcaaa

SEQ ID NO: 1662854 - RNA, 17 nt, Homo sapiens
agaauguggucugucag

SEQ ID NO: 1662855 - RNA, 14 nt, Homo sapiens
agaauuuagcugua

SEQ ID NO: 1662856 - RNA, 19 nt, Homo sapiens
agaauuucccaaagcagug

SEQ ID NO: 1662857 - RNA, 17 nt, Homo sapiens
agacaacuugcuccuuu

SEQ ID NO: 1662858 - RNA, 22 nt, Homo sapiens
agacaagcccugcuugcuggaa

SEQ ID NO: 1662859 - RNA, 15 nt, Homo sapiens
agacaagucugagua

SEQ ID NO: 1662860 - RNA, 23 nt, Homo sapiens
agacacagcgucccuagcaguga

SEQ ID NO: 1662861 - RNA, 15 nt, Homo sapiens
agacagaaucucagu

SEQ ID NO: 1662862 - RNA, 13 nt, Homo sapiens
agacagagacaau

SEQ ID NO: 1662863 - RNA, 20 nt, Homo sapiens
agacagagauggcagagcca

SEQ ID NO: 1662864 - RNA, 21 nt, Homo sapiens
agacaguugguuuugcauguc

SEQ ID NO: 1662865 - RNA, 20 nt, Homo sapiens
agacccccaugguaauguaa

SEQ ID NO: 1662866 - RNA, 23 nt, Homo sapiens
agacccgcccuuagaccaggcag

SEQ ID NO: 1662867 - RNA, 12 nt, Homo sapiens
agacccucagac

SEQ ID NO: 1662868 - RNA, 19 nt, Homo sapiens
agaccuucugaagaucuca

SEQ ID NO: 1662869 - RNA, 21 nt, Homo sapiens
agacgcaaggaucacuugagc

SEQ ID NO: 1662870 - RNA, 18 nt, Homo sapiens
agugagccugguggaaca

SEQ ID NO: 1662871 - RNA, 15 nt, Homo sapiens
agugaugugguggga

SEQ ID NO: 1662872 - RNA, 17 nt, Homo sapiens
agugauuccuucuugcu

SEQ ID NO: 1662873 - RNA, 14 nt, Homo sapiens
agugcaaucugucc

SEQ ID NO: 1662874 - RNA, 16 nt, Homo sapiens
agugcaguagugucac

SEQ ID NO: 1662875 - RNA, 15 nt, Homo sapiens
agugcagugcucagu

SEQ ID NO: 1662876 - RNA, 20 nt, Homo sapiens
agugcaguggcgcgaucuca

SEQ ID NO: 1662877 - RNA, 21 nt, Homo sapiens
agugcaguggcgugaucucag

SEQ ID NO: 1662878 - RNA, 23 nt, Homo sapiens
agugcaguggcgugaucucagcu

SEQ ID NO: 1662879 - RNA, 14 nt, Homo sapiens
agugccaauccaag

SEQ ID NO: 1662880 - RNA, 15 nt, Homo sapiens
agugcuaugacagag

SEQ ID NO: 1662881 - RNA, 22 nt, Homo sapiens
agugcuucuccagccucagccu

SEQ ID NO: 1662882 - RNA, 19 nt, Homo sapiens
aguggaaaccuugcugcua

SEQ ID NO: 1662883 - RNA, 13 nt, Homo sapiens
aguggacuguauu

SEQ ID NO: 1662884 - RNA, 15 nt, Homo sapiens
aguggaucacacaca

SEQ ID NO: 1662885 - RNA, 13 nt, Homo sapiens
aguggcaguauug

SEQ ID NO: 1662886 - RNA, 15 nt, Homo sapiens
aguggcaucaucuca

SEQ ID NO: 1662887 - RNA, 17 nt, Homo sapiens
aguggcaucaucucagc

SEQ ID NO: 1662888 - RNA, 16 nt, Homo sapiens
aguggcgcgaucucag

SEQ ID NO: 1662889 - RNA, 20 nt, Homo sapiens
aguggcgcgaucucagcuca

SEQ ID NO: 1662890 - RNA, 20 nt, Homo sapiens
aguggcgugaucucagcuca

SEQ ID NO: 1662891 - RNA, 15 nt, Homo sapiens
agugggaacucugac

SEQ ID NO: 1662892 - RNA, 19 nt, Homo sapiens
agugggguccugaggccaa

SEQ ID NO: 1662893 - RNA, 23 nt, Homo sapiens
agugguggugaacagaacaaaag

SEQ ID NO: 1662894 - RNA, 21 nt, Homo sapiens
agugguguuuagaaugucagu

SEQ ID NO: 1662895 - RNA, 16 nt, Homo sapiens
aguguagugcucagua

SEQ ID NO: 1662896 - RNA, 14 nt, Homo sapiens
agugugccugcuau

SEQ ID NO: 1662897 - RNA, 15 nt, Homo sapiens
aguguuuuuacauau

SEQ ID NO: 1662898 - RNA, 16 nt, Homo sapiens
aguguuuuuacauaua

SEQ ID NO: 1662899 - RNA, 19 nt, Homo sapiens
aguuaagacaacaggcauu

SEQ ID NO: 1662900 - RNA, 13 nt, Homo sapiens
aguuagauucacu

SEQ ID NO: 1662901 - RNA, 23 nt, Homo sapiens
aguuagcccggccaaggacacug

SEQ ID NO: 1662902 - RNA, 16 nt, Homo sapiens
aguuaggcagugcagu

SEQ ID NO: 1662903 - RNA, 11 nt, Homo sapiens
aguuaggugug

SEQ ID NO: 1662904 - RNA, 22 nt, Homo sapiens
aguuaucugagcuuaaacauuu

SEQ ID NO: 1662905 - RNA, 17 nt, Homo sapiens
aguucacacccugcaag

SEQ ID NO: 1662906 - RNA, 17 nt, Homo sapiens
aguucagcuccuuccac

SEQ ID NO: 1662907 - RNA, 15 nt, Homo sapiens
aguucaucuugaauu

SEQ ID NO: 1662908 - RNA, 19 nt, Homo sapiens
aguuccacaauuuugucuc

SEQ ID NO: 1662909 - RNA, 14 nt, Homo sapiens
aguuccuuucaucc

SEQ ID NO: 1662910 - RNA, 18 nt, Homo sapiens
aguucuauuaucuggguu

SEQ ID NO: 1662911 - RNA, 20 nt, Homo sapiens
aguucuccuuguacuugaau

SEQ ID NO: 1662912 - RNA, 11 nt, Homo sapiens
aguucugauga

SEQ ID NO: 1662913 - RNA, 12 nt, Homo sapiens
aguucugaugag

SEQ ID NO: 1662914 - RNA, 17 nt, Homo sapiens
aguucuuguugacucag

SEQ ID NO: 1662915 - RNA, 13 nt, Homo sapiens
aguugaagacaga

SEQ ID NO: 1662916 - RNA, 21 nt, Homo sapiens
aguugcacuucaguuccuuuc

SEQ ID NO: 1662917 - RNA, 14 nt, Homo sapiens
aguuggacagcaaa

SEQ ID NO: 1662918 - RNA, 16 nt, Homo sapiens
aguuggagugcaaugg

SEQ ID NO: 1662919 - RNA, 22 nt, Homo sapiens
aguuggcucugagauacuaaua

SEQ ID NO: 1662920 - RNA, 14 nt, Homo sapiens
aguuggugcugcuu

SEQ ID NO: 1662921 - RNA, 22 nt, Homo sapiens
aguuuaggacccaagguggucu

SEQ ID NO: 1662922 - RNA, 20 nt, Homo sapiens
aguuucauuuaugauacaaa

SEQ ID NO: 1662923 - RNA, 21 nt, Homo sapiens
aguuuccaaguuuauugcccu

SEQ ID NO: 1662924 - RNA, 22 nt, Homo sapiens
aguuuccagcuaagccugauga

SEQ ID NO: 1662925 - RNA, 19 nt, Homo sapiens
aguuucuuccccaagagcu

SEQ ID NO: 1662926 - RNA, 14 nt, Homo sapiens
aguuugaaccaaga

SEQ ID NO: 1662927 - RNA, 18 nt, Homo sapiens
aguuugaccucacaguga

SEQ ID NO: 1662928 - RNA, 15 nt, Homo sapiens
aguuuguuguucaga

SEQ ID NO: 1662929 - RNA, 20 nt, Homo sapiens
auaaaaaucauucuacugaa

SEQ ID NO: 1662930 - RNA, 21 nt, Homo sapiens
auaaaaaucauucuacugaac

SEQ ID NO: 1662931 - RNA, 13 nt, Homo sapiens
auaaaagaaucau

SEQ ID NO: 1662932 - RNA, 18 nt, Homo sapiens
auaaaauucauuccauuu

SEQ ID NO: 1662933 - RNA, 19 nt, Homo sapiens
auaaacucagucaaaugua

SEQ ID NO: 1662934 - RNA, 16 nt, Homo sapiens
auaaacuuguacuuac

SEQ ID NO: 1662935 - RNA, 17 nt, Homo sapiens
auaaagaacagcugagg

SEQ ID NO: 1662936 - RNA, 14 nt, Homo sapiens
auaaagcaaugugg

SEQ ID NO: 1662937 - RNA, 20 nt, Homo sapiens
auaaagcacuguuuggauau

SEQ ID NO: 1662938 - RNA, 19 nt, Homo sapiens
auaaagccucugugcugca

SEQ ID NO: 1662939 - RNA, 16 nt, Homo sapiens
auaaaggagcauauaa

SEQ ID NO: 1662940 - RNA, 15 nt, Homo sapiens
auaaaggcauuucaa

SEQ ID NO: 1662941 - RNA, 23 nt, Homo sapiens
auaaaggcauuucaaagucucac

SEQ ID NO: 1662942 - RNA, 18 nt, Homo sapiens
auaaagguucuaugauau

SEQ ID NO: 1662943 - RNA, 19 nt, Homo sapiens
auaaaguauuccaccuuaa

SEQ ID NO: 1662944 - RNA, 14 nt, Homo sapiens
auaaauaguauuuc

SEQ ID NO: 1662945 - RNA, 15 nt, Homo sapiens
auaaauauuagcaaa

SEQ ID NO: 1662946 - RNA, 14 nt, Homo sapiens
auaaauguguaaau

SEQ ID NO: 1662947 - RNA, 16 nt, Homo sapiens
auaaauuacaugcaug

SEQ ID NO: 1662948 - RNA, 21 nt, Homo sapiens
auaaauuauuuaacuaauuaa

SEQ ID NO: 1662949 - RNA, 22 nt, Homo sapiens
auaaauuauuuuugaggacugu

SEQ ID NO: 1662950 - RNA, 14 nt, Homo sapiens
auaaccgcacagac

SEQ ID NO: 1662951 - RNA, 18 nt, Homo sapiens
auaaccugugaauccaau

SEQ ID NO: 1662952 - RNA, 17 nt, Homo sapiens
auaacuagaguaugugu

SEQ ID NO: 1662953 - RNA, 11 nt, Homo sapiens
auaacugugac

SEQ ID NO: 1662954 - RNA, 18 nt, Homo sapiens
auaagaugcugcugagca

SEQ ID NO: 1662955 - RNA, 15 nt, Homo sapiens
auaaggcagugcagu

SEQ ID NO: 1662956 - RNA, 19 nt, Homo sapiens
auaagucaaaauaaucuga

SEQ ID NO: 1662957 - RNA, 15 nt, Homo sapiens
auaagucacugacau

SEQ ID NO: 1662958 - RNA, 20 nt, Homo sapiens
auaaugaguuccugagacau

SEQ ID NO: 1662959 - RNA, 12 nt, Homo sapiens
auaauguuauag

SEQ ID NO: 1662960 - RNA, 16 nt, Homo sapiens
auaauugacuggugga

SEQ ID NO: 1662961 - RNA, 15 nt, Homo sapiens
auaauuggaguagau

SEQ ID NO: 1662962 - RNA, 19 nt, Homo sapiens
auacaaacaggugcuaaca

SEQ ID NO: 1662963 - RNA, 14 nt, Homo sapiens
auacaacacauuga

SEQ ID NO: 1662964 - RNA, 14 nt, Homo sapiens
auacaaguguuucu

SEQ ID NO: 1662965 - RNA, 22 nt, Homo sapiens
auacaguacucaggcagugcag

SEQ ID NO: 1662966 - RNA, 17 nt, Homo sapiens
auacauacuauagauuc

SEQ ID NO: 1662967 - RNA, 15 nt, Homo sapiens
auacauauacacaaa

SEQ ID NO: 1662968 - RNA, 18 nt, Homo sapiens
auaccagcuuaugagcuc

SEQ ID NO: 1662969 - RNA, 20 nt, Homo sapiens
auaccagguuaccucacuuu

SEQ ID NO: 1662970 - RNA, 12 nt, Homo sapiens
auaccaguucuu

SEQ ID NO: 1662971 - RNA, 17 nt, Homo sapiens
auaccaguucuugcaau

SEQ ID NO: 1662972 - RNA, 14 nt, Homo sapiens
auacccacugccag

SEQ ID NO: 1662973 - RNA, 14 nt, Homo sapiens
auaccucugaccaa

SEQ ID NO: 1662974 - RNA, 23 nt, Homo sapiens
auacucaaagaggccaguacuuu

SEQ ID NO: 1662975 - RNA, 17 nt, Homo sapiens
auacucaagagcauaau

SEQ ID NO: 1662976 - RNA, 21 nt, Homo sapiens
auacucaagagcauaauggua

SEQ ID NO: 1662977 - RNA, 18 nt, Homo sapiens
auacugcuguauaaggua

SEQ ID NO: 1662978 - RNA, 15 nt, Homo sapiens
auacuggagaccagc

SEQ ID NO: 1662979 - RNA, 22 nt, Homo sapiens
auacuucuuuauucacaguauc

SEQ ID NO: 1662980 - RNA, 18 nt, Homo sapiens
auagaaacaugacacuga

SEQ ID NO: 1662981 - RNA, 21 nt, Homo sapiens
auagauauccuuggcacaucc

SEQ ID NO: 1662982 - RNA, 24 nt, Homo sapiens
auagcaagucuuaguacauccuca

SEQ ID NO: 1662983 - RNA, 21 nt, Homo sapiens
auagcacugguuuguuucuca

SEQ ID NO: 1662984 - RNA, 18 nt, Homo sapiens
auagcuugcaguuucaug

SEQ ID NO: 1662985 - RNA, 15 nt, Homo sapiens
auaggacaaggggug

SEQ ID NO: 1662986 - RNA, 18 nt, Homo sapiens
auaggaggacagaaccaa

SEQ ID NO: 1662987 - RNA, 23 nt, Homo sapiens
auagucauguuucugcaguauuc

SEQ ID NO: 1662988 - RNA, 23 nt, Homo sapiens
auagugguggugaacagaacaaa

SEQ ID NO: 1662989 - RNA, 14 nt, Homo sapiens
auaguguguccaug

SEQ ID NO: 1662990 - RNA, 21 nt, Homo sapiens
auauaaaucguaaccuaugaa

SEQ ID NO: 1662991 - RNA, 15 nt, Homo sapiens
auauacaaacaugug

SEQ ID NO: 1662992 - RNA, 19 nt, Homo sapiens
cccauaacuuccaguauca

SEQ ID NO: 1662993 - RNA, 21 nt, Homo sapiens
cccauaacuuccaguaucauu

SEQ ID NO: 1662994 - RNA, 23 nt, Homo sapiens
cccauagaaacaugacacugacc

SEQ ID NO: 1662995 - RNA, 16 nt, Homo sapiens
cccauccgcaucucaa

SEQ ID NO: 1662996 - RNA, 13 nt, Homo sapiens
cccauccucacac

SEQ ID NO: 1662997 - RNA, 13 nt, Homo sapiens
cccaucucaaaaa

SEQ ID NO: 1662998 - RNA, 19 nt, Homo sapiens
cccaucugaagaguggaaa

SEQ ID NO: 1662999 - RNA, 22 nt, Homo sapiens
cccaugauuuggggugauuucu

SEQ ID NO: 1663000 - RNA, 18 nt, Homo sapiens
cccauugugaauguuguc

SEQ ID NO: 1663001 - RNA, 18 nt, Homo sapiens
cccauuuguaauguaucu

SEQ ID NO: 1663002 - RNA, 15 nt, Homo sapiens
ccccaaacccugcuu

SEQ ID NO: 1663003 - RNA, 14 nt, Homo sapiens
ccccaagcucaguu

SEQ ID NO: 1663004 - RNA, 13 nt, Homo sapiens
ccccacugaagaa

SEQ ID NO: 1663005 - RNA, 10 nt, Homo sapiens
ccccagagau

SEQ ID NO: 1663006 - RNA, 20 nt, Homo sapiens
ccccagagcuuuacagugcc

SEQ ID NO: 1663007 - RNA, 22 nt, Homo sapiens
ccccagagcuuuacagugccac

SEQ ID NO: 1663008 - RNA, 14 nt, Homo sapiens
ccccagccugcucc

SEQ ID NO: 1663009 - RNA, 21 nt, Homo sapiens
ccccagguaucugaugauguu

SEQ ID NO: 1663010 - RNA, 12 nt, Homo sapiens
cccccacaagaa

SEQ ID NO: 1663011 - RNA, 20 nt, Homo sapiens
cccccacaggagcauguccu

SEQ ID NO: 1663012 - RNA, 20 nt, Homo sapiens
cccccacaggagcguguccu

SEQ ID NO: 1663013 - RNA, 14 nt, Homo sapiens
cccccugcugccau

SEQ ID NO: 1663014 - RNA, 21 nt, Homo sapiens
ccccucagauuccaccuagag

SEQ ID NO: 1663015 - RNA, 12 nt, Homo sapiens
ccccuccacugg

SEQ ID NO: 1663016 - RNA, 19 nt, Homo sapiens
ccccucgcuucauaggcag

SEQ ID NO: 1663017 - RNA, 16 nt, Homo sapiens
ccccuggcauguuuca

SEQ ID NO: 1663018 - RNA, 18 nt, Homo sapiens
ccccugguccugcacugu

SEQ ID NO: 1663019 - RNA, 13 nt, Homo sapiens
cccgccccagaga

SEQ ID NO: 1663020 - RNA, 15 nt, Homo sapiens
cccgggaauguuuca

SEQ ID NO: 1663021 - RNA, 14 nt, Homo sapiens
cccgggcauccagu

SEQ ID NO: 1663022 - RNA, 13 nt, Homo sapiens
cccggguacucag

SEQ ID NO: 1663023 - RNA, 18 nt, Homo sapiens
cccgguaaguaaacaguc

SEQ ID NO: 1663024 - RNA, 16 nt, Homo sapiens
cccuacgaaagcacag

SEQ ID NO: 1663025 - RNA, 13 nt, Homo sapiens
cccuacugagaaa

SEQ ID NO: 1663026 - RNA, 17 nt, Homo sapiens
cccuagccagaggcucu

SEQ ID NO: 1663027 - RNA, 18 nt, Homo sapiens
cccuauuauaauugucau

SEQ ID NO: 1663028 - RNA, 13 nt, Homo sapiens
cccucagauucca

SEQ ID NO: 1663029 - RNA, 16 nt, Homo sapiens
cccucagauuccaccu

SEQ ID NO: 1663030 - RNA, 17 nt, Homo sapiens
cccucagauuccaccua

SEQ ID NO: 1663031 - RNA, 19 nt, Homo sapiens
cccuccagggccacugcuu

SEQ ID NO: 1663032 - RNA, 15 nt, Homo sapiens
cccucccugcugcca

SEQ ID NO: 1663033 - RNA, 21 nt, Homo sapiens
cccucgagcucuguagccugg

SEQ ID NO: 1663034 - RNA, 12 nt, Homo sapiens
cccucuaccuuc

SEQ ID NO: 1663035 - RNA, 18 nt, Homo sapiens
cccucuggcacuccagaa

SEQ ID NO: 1663036 - RNA, 14 nt, Homo sapiens
cccugaacuggccc

SEQ ID NO: 1663037 - RNA, 12 nt, Homo sapiens
cccugacacugu

SEQ ID NO: 1663038 - RNA, 23 nt, Homo sapiens
cccugacuaacagccucagcaca

SEQ ID NO: 1663039 - RNA, 17 nt, Homo sapiens
cccugacuucccagcug

SEQ ID NO: 1663040 - RNA, 22 nt, Homo sapiens
cccugauuuauucuggugucua

SEQ ID NO: 1663041 - RNA, 20 nt, Homo sapiens
cccugcauggcugagagggu

SEQ ID NO: 1663042 - RNA, 19 nt, Homo sapiens
cccugcgucuccugcccac

SEQ ID NO: 1663043 - RNA, 11 nt, Homo sapiens
cccugcugagu

SEQ ID NO: 1663044 - RNA, 22 nt, Homo sapiens
cccugcuugcuggaaaacugcc

SEQ ID NO: 1663045 - RNA, 21 nt, Homo sapiens
cccuggcauguuucaccacaa

SEQ ID NO: 1663046 - RNA, 22 nt, Homo sapiens
cccuggggccuagacucuguaa

SEQ ID NO: 1663047 - RNA, 16 nt, Homo sapiens
cccugguccugcacug

SEQ ID NO: 1663048 - RNA, 14 nt, Homo sapiens
cccuggugaugguc

SEQ ID NO: 1663049 - RNA, 21 nt, Homo sapiens
cccugugaucuauaccaccuu

SEQ ID NO: 1663050 - RNA, 15 nt, Homo sapiens
cccugugggagucca

SEQ ID NO: 1663051 - RNA, 12 nt, Homo sapiens
cccuguuuccaa

SEQ ID NO: 1663052 - RNA, 17 nt, Homo sapiens
cccuguuuccaaugcca

SEQ ID NO: 1663053 - RNA, 20 nt, Homo sapiens
cccuucaaugcaaaauacau

SEQ ID NO: 1663054 - RNA, 11 nt, Homo sapiens
cccuuccccac

SEQ ID NO: 1663055 - RNA, 21 nt, Homo sapiens
cccuucgacacggaccugcuu

SEQ ID NO: 1663056 - RNA, 18 nt, Homo sapiens
cccuucuucuugacccau

SEQ ID NO: 1663057 - RNA, 20 nt, Homo sapiens
cccuugaaaacucucaguca

SEQ ID NO: 1663058 - RNA, 14 nt, Homo sapiens
cccuugugauuucu

SEQ ID NO: 1663059 - RNA, 14 nt, Homo sapiens
cccuuuccucuuaa

SEQ ID NO: 1663060 - RNA, 12 nt, Homo sapiens
cccuuugcacac

SEQ ID NO: 1663061 - RNA, 12 nt, Homo sapiens
ccgaaaagcaaa

SEQ ID NO: 1663062 - RNA, 17 nt, Homo sapiens
ccgauguggaccucuac

SEQ ID NO: 1663063 - RNA, 16 nt, Homo sapiens
ccgcacugggcuuggg

SEQ ID NO: 1663064 - RNA, 18 nt, Homo sapiens
ccgcaggcuucguuugcc

SEQ ID NO: 1663065 - RNA, 19 nt, Homo sapiens
ccgcgugucucauuugcca

SEQ ID NO: 1663066 - RNA, 20 nt, Homo sapiens
ccgcugggagaaaagccaga

SEQ ID NO: 1663067 - RNA, 13 nt, Homo sapiens
ccggaaagccuuc

SEQ ID NO: 1663068 - RNA, 16 nt, Homo sapiens
ccggauggaaucacag

SEQ ID NO: 1663069 - RNA, 18 nt, Homo sapiens
ccggcaggcccugcagug

SEQ ID NO: 1663070 - RNA, 18 nt, Homo sapiens
ccggcccccugugcaggg

SEQ ID NO: 1663071 - RNA, 23 nt, Homo sapiens
ccggcuuggcuagucacauauca

SEQ ID NO: 1663072 - RNA, 16 nt, Homo sapiens
ccgggagcaguguccu

SEQ ID NO: 1663073 - RNA, 14 nt, Homo sapiens
ccgggcaagacuuu

SEQ ID NO: 1663074 - RNA, 23 nt, Homo sapiens
ccgggcuggccugacacaauggu

SEQ ID NO: 1663075 - RNA, 18 nt, Homo sapiens
ccgggguggagucagggc

SEQ ID NO: 1663076 - RNA, 15 nt, Homo sapiens
ccgggguguggaauc

SEQ ID NO: 1663077 - RNA, 14 nt, Homo sapiens
ccguaguaccuccc

SEQ ID NO: 1663078 - RNA, 13 nt, Homo sapiens
ccguccacagggc

SEQ ID NO: 1663079 - RNA, 13 nt, Homo sapiens
ccgugacugcaag

SEQ ID NO: 1663080 - RNA, 16 nt, Homo sapiens
ccgugaggccagagac

SEQ ID NO: 1663081 - RNA, 23 nt, Homo sapiens
ccgugcccuguuuccaaugccaa

SEQ ID NO: 1663082 - RNA, 21 nt, Homo sapiens
ccguggugagguugugcugcc

SEQ ID NO: 1663083 - RNA, 21 nt, Homo sapiens
ccuaaauuaacaaauucagug

SEQ ID NO: 1663084 - RNA, 12 nt, Homo sapiens
ccuaagagccac

SEQ ID NO: 1663085 - RNA, 17 nt, Homo sapiens
ccuaagcuggagugcag

SEQ ID NO: 1663086 - RNA, 19 nt, Homo sapiens
ccuaagcuggagugcagug

SEQ ID NO: 1663087 - RNA, 23 nt, Homo sapiens
ccuaauccccauaacuuccagua

SEQ ID NO: 1663088 - RNA, 15 nt, Homo sapiens
ccuaauccucuagga

SEQ ID NO: 1663089 - RNA, 16 nt, Homo sapiens
ccuaaucucauaccuc

SEQ ID NO: 1663090 - RNA, 14 nt, Homo sapiens
ccuaauuaauuuca

SEQ ID NO: 1663091 - RNA, 16 nt, Homo sapiens
ccuacccucuucucag

SEQ ID NO: 1663092 - RNA, 22 nt, Homo sapiens
ccuaccgaugugugaugucucc

SEQ ID NO: 1663093 - RNA, 15 nt, Homo sapiens
ccuacgaaagcacag

SEQ ID NO: 1663094 - RNA, 11 nt, Homo sapiens
ccuacugcuga

SEQ ID NO: 1663095 - RNA, 18 nt, Homo sapiens
ccuagagcuagauguguc

SEQ ID NO: 1663096 - RNA, 18 nt, Homo sapiens
ccuagccagaggcucuaa

SEQ ID NO: 1663097 - RNA, 20 nt, Homo sapiens
ccuaggugggucaacuccaa

SEQ ID NO: 1663098 - RNA, 22 nt, Homo sapiens
ccuaguccccagccugcucccu

SEQ ID NO: 1663099 - RNA, 16 nt, Homo sapiens
ccuauaccggagcucc

SEQ ID NO: 1663100 - RNA, 14 nt, Homo sapiens
ccuaucaucaguua

SEQ ID NO: 1663101 - RNA, 21 nt, Homo sapiens
ccuaugacccugugccugugu

SEQ ID NO: 1663102 - RNA, 14 nt, Homo sapiens
ccucaccaccgaga

SEQ ID NO: 1663103 - RNA, 20 nt, Homo sapiens
ccucagaauauuaagcacau

SEQ ID NO: 1663104 - RNA, 11 nt, Homo sapiens
ccucagaugau

SEQ ID NO: 1663105 - RNA, 13 nt, Homo sapiens
ccucagauuccac

SEQ ID NO: 1663106 - RNA, 23 nt, Homo sapiens
ccucagauuuucuggacuuaguc

SEQ ID NO: 1663107 - RNA, 21 nt, Homo sapiens
ccucagcacauccgacaccuc

SEQ ID NO: 1663108 - RNA, 15 nt, Homo sapiens
ccucaggacccaggg

SEQ ID NO: 1663109 - RNA, 22 nt, Homo sapiens
ccucaggacccagggaaugcca

SEQ ID NO: 1663110 - RNA, 12 nt, Homo sapiens
ccucagggacca

SEQ ID NO: 1663111 - RNA, 21 nt, Homo sapiens
ccucauauacuugaauauuau

SEQ ID NO: 1663112 - RNA, 19 nt, Homo sapiens
ccuccaagugaaugaguuu

SEQ ID NO: 1663113 - RNA, 14 nt, Homo sapiens
ccuccaccagugug

SEQ ID NO: 1663114 - RNA, 18 nt, Homo sapiens
ccuccacuugccuuguga

SEQ ID NO: 1663115 - RNA, 21 nt, Homo sapiens
cugcacuccaugagugcagcu

SEQ ID NO: 1663116 - RNA, 20 nt, Homo sapiens
cugcacuggcaucuagucaa

SEQ ID NO: 1663117 - RNA, 20 nt, Homo sapiens
cugcagaaaauuaauugaaa

SEQ ID NO: 1663118 - RNA, 11 nt, Homo sapiens
cugcagagcca

SEQ ID NO: 1663119 - RNA, 23 nt, Homo sapiens
cugcagagggcacagaaaaugga

SEQ ID NO: 1663120 - RNA, 21 nt, Homo sapiens
cugcagcgagccccccaugua

SEQ ID NO: 1663121 - RNA, 15 nt, Homo sapiens
cugcaggaaucaaaa

SEQ ID NO: 1663122 - RNA, 23 nt, Homo sapiens
cugcagucagacugaaauauaaa

SEQ ID NO: 1663123 - RNA, 16 nt, Homo sapiens
cugcaguuagcacaga

SEQ ID NO: 1663124 - RNA, 12 nt, Homo sapiens
cugcaucccucc

SEQ ID NO: 1663125 - RNA, 23 nt, Homo sapiens
cugcaucuccccucagauuccac

SEQ ID NO: 1663126 - RNA, 14 nt, Homo sapiens
cugcauuacuauua

SEQ ID NO: 1663127 - RNA, 16 nt, Homo sapiens
cugcauuuuacuguac

SEQ ID NO: 1663128 - RNA, 22 nt, Homo sapiens
cugccaaccagcuuguccaaca

SEQ ID NO: 1663129 - RNA, 15 nt, Homo sapiens
cugccaagaguccaa

SEQ ID NO: 1663130 - RNA, 20 nt, Homo sapiens
cugccacaagcacaauugau

SEQ ID NO: 1663131 - RNA, 14 nt, Homo sapiens
cugccacaauguga

SEQ ID NO: 1663132 - RNA, 16 nt, Homo sapiens
cugccacaaugugaua

SEQ ID NO: 1663133 - RNA, 21 nt, Homo sapiens
cugccauuuuuugucugugau

SEQ ID NO: 1663134 - RNA, 21 nt, Homo sapiens
cugcccacgucccgggcacug

SEQ ID NO: 1663135 - RNA, 23 nt, Homo sapiens
cugcccacgucccgggcacuguc

SEQ ID NO: 1663136 - RNA, 21 nt, Homo sapiens
cugccccccuucccaccccua

SEQ ID NO: 1663137 - RNA, 18 nt, Homo sapiens
cugccccgaaagugcuga

SEQ ID NO: 1663138 - RNA, 20 nt, Homo sapiens
cugccggucccccaugccac

SEQ ID NO: 1663139 - RNA, 21 nt, Homo sapiens
cugccuggucaauaaaccacu

SEQ ID NO: 1663140 - RNA, 22 nt, Homo sapiens
cugccuggucaauaaaccacug

SEQ ID NO: 1663141 - RNA, 13 nt, Homo sapiens
cugccugugguga

SEQ ID NO: 1663142 - RNA, 14 nt, Homo sapiens
cugccuguggugag

SEQ ID NO: 1663143 - RNA, 23 nt, Homo sapiens
cugcgaguggcuaguuuucacau

SEQ ID NO: 1663144 - RNA, 16 nt, Homo sapiens
cugcgggucauauuca

SEQ ID NO: 1663145 - RNA, 22 nt, Homo sapiens
cugcguaggagagaacagggau

SEQ ID NO: 1663146 - RNA, 13 nt, Homo sapiens
cugcgucuccugc

SEQ ID NO: 1663147 - RNA, 14 nt, Homo sapiens
cugcucaugacaca

SEQ ID NO: 1663148 - RNA, 18 nt, Homo sapiens
cugcucccggcucugagg

SEQ ID NO: 1663149 - RNA, 15 nt, Homo sapiens
cugcucccuagccag

SEQ ID NO: 1663150 - RNA, 11 nt, Homo sapiens
cugcuccuaga

SEQ ID NO: 1663151 - RNA, 20 nt, Homo sapiens
cugcugaaaaccaucuggcc

SEQ ID NO: 1663152 - RNA, 16 nt, Homo sapiens
cugcugaaggucagua

SEQ ID NO: 1663153 - RNA, 17 nt, Homo sapiens
cugcugcagucagcaca

SEQ ID NO: 1663154 - RNA, 16 nt, Homo sapiens
cugcugccaucuccag

SEQ ID NO: 1663155 - RNA, 17 nt, Homo sapiens
cugcuugugcacuggau

SEQ ID NO: 1663156 - RNA, 21 nt, Homo sapiens
cugcuuucuuguugcugcauc

SEQ ID NO: 1663157 - RNA, 21 nt, Homo sapiens
cugcuuuguuuuggcugcucu

SEQ ID NO: 1663158 - RNA, 17 nt, Homo sapiens
cuggacaccuagcuuua

SEQ ID NO: 1663159 - RNA, 19 nt, Homo sapiens
cuggagaaaauggacgugu

SEQ ID NO: 1663160 - RNA, 22 nt, Homo sapiens
cuggagaguaucugagaaccaa

SEQ ID NO: 1663161 - RNA, 20 nt, Homo sapiens
cuggagccugcaauaaggga

SEQ ID NO: 1663162 - RNA, 18 nt, Homo sapiens
cuggagcugaagcguuac

SEQ ID NO: 1663163 - RNA, 23 nt, Homo sapiens
cuggaggaacugcuugugcacug

SEQ ID NO: 1663164 - RNA, 15 nt, Homo sapiens
cuggaggugagacac

SEQ ID NO: 1663165 - RNA, 13 nt, Homo sapiens
cuggcacacuggc

SEQ ID NO: 1663166 - RNA, 18 nt, Homo sapiens
cuggcauuauaaagaaca

SEQ ID NO: 1663167 - RNA, 15 nt, Homo sapiens
cuggcauuugcugca

SEQ ID NO: 1663168 - RNA, 15 nt, Homo sapiens
cuggccaaaaugcag

SEQ ID NO: 1663169 - RNA, 16 nt, Homo sapiens
cuggccagcacccucu

SEQ ID NO: 1663170 - RNA, 13 nt, Homo sapiens
cuggcucacagcc

SEQ ID NO: 1663171 - RNA, 20 nt, Homo sapiens
cuggcuuuggguagugccau

SEQ ID NO: 1663172 - RNA, 19 nt, Homo sapiens
cuggcuuuuaagccaauau

SEQ ID NO: 1663173 - RNA, 18 nt, Homo sapiens
cugggaccucccacugcc

SEQ ID NO: 1663174 - RNA, 20 nt, Homo sapiens
cugggaccucccacugcccc

SEQ ID NO: 1663175 - RNA, 15 nt, Homo sapiens
cugggacuacaggca

SEQ ID NO: 1663176 - RNA, 17 nt, Homo sapiens
cugggaucagcuggugu

SEQ ID NO: 1663177 - RNA, 23 nt, Homo sapiens
cugggauuaacagguaugaacca

SEQ ID NO: 1663178 - RNA, 18 nt, Homo sapiens
cugggauuacagguguga

SEQ ID NO: 1663179 - RNA, 22 nt, Homo sapiens
cugggauuacaggugugagcca

SEQ ID NO: 1663180 - RNA, 16 nt, Homo sapiens
cugggcugucugucac

SEQ ID NO: 1663181 - RNA, 21 nt, Homo sapiens
cugggcugucugucaccagcu

SEQ ID NO: 1663182 - RNA, 14 nt, Homo sapiens
cuggggaagccagu

SEQ ID NO: 1663183 - RNA, 15 nt, Homo sapiens
cuggggcuuuagcua

SEQ ID NO: 1663184 - RNA, 20 nt, Homo sapiens
cugggggcauaucucaguca

SEQ ID NO: 1663185 - RNA, 22 nt, Homo sapiens
cugggugugaccugacaccugc

SEQ ID NO: 1663186 - RNA, 14 nt, Homo sapiens
cuggucuucaauua

SEQ ID NO: 1663187 - RNA, 19 nt, Homo sapiens
cuggugaccagcaccaucu

SEQ ID NO: 1663188 - RNA, 17 nt, Homo sapiens
cuggugccguugcugcg

SEQ ID NO: 1663189 - RNA, 21 nt, Homo sapiens
cuggugggggccucuuuacca

SEQ ID NO: 1663190 - RNA, 17 nt, Homo sapiens
cugguguggaagagcuc

SEQ ID NO: 1663191 - RNA, 16 nt, Homo sapiens
cugguugccaaauacu

SEQ ID NO: 1663192 - RNA, 17 nt, Homo sapiens
cuguaaaauacuucuuu

SEQ ID NO: 1663193 - RNA, 17 nt, Homo sapiens
cuguacaugacuguaua

SEQ ID NO: 1663194 - RNA, 18 nt, Homo sapiens
cuguagccuggucugugc

SEQ ID NO: 1663195 - RNA, 14 nt, Homo sapiens
cuguagcuccuuag

SEQ ID NO: 1663196 - RNA, 22 nt, Homo sapiens
cuguauaauacuuuguauacaa

SEQ ID NO: 1663197 - RNA, 16 nt, Homo sapiens
cuguauauuuguauga

SEQ ID NO: 1663198 - RNA, 21 nt, Homo sapiens
cuguauguuauccacuacagg

SEQ ID NO: 1663199 - RNA, 11 nt, Homo sapiens
cugucagggac

SEQ ID NO: 1663200 - RNA, 19 nt, Homo sapiens
cugucagucguguugcuua

SEQ ID NO: 1663201 - RNA, 19 nt, Homo sapiens
cugucaugcccagcuugga

SEQ ID NO: 1663202 - RNA, 19 nt, Homo sapiens
cuguccguaguaucagaga

SEQ ID NO: 1663203 - RNA, 22 nt, Homo sapiens
cugucgcaugagaacauuaaca

SEQ ID NO: 1663204 - RNA, 16 nt, Homo sapiens
cugucuugcugaggga

SEQ ID NO: 1663205 - RNA, 14 nt, Homo sapiens
cugugaagccuuua

SEQ ID NO: 1663206 - RNA, 15 nt, Homo sapiens
cugugaauaaagcca

SEQ ID NO: 1663207 - RNA, 16 nt, Homo sapiens
cugugagaagugcaac

SEQ ID NO: 1663208 - RNA, 14 nt, Homo sapiens
cugugaucuauacc

SEQ ID NO: 1663209 - RNA, 14 nt, Homo sapiens
cugugcagucauca

SEQ ID NO: 1663210 - RNA, 11 nt, Homo sapiens
cugugccuaac

SEQ ID NO: 1663211 - RNA, 21 nt, Homo sapiens
cuguggaaaguugguuuugua

SEQ ID NO: 1663212 - RNA, 19 nt, Homo sapiens
cuguggcuucccaugucuu

SEQ ID NO: 1663213 - RNA, 14 nt, Homo sapiens
cugugggaguccac

SEQ ID NO: 1663214 - RNA, 15 nt, Homo sapiens
cugugggcagcaccc

SEQ ID NO: 1663215 - RNA, 12 nt, Homo sapiens
cuguggucugug

SEQ ID NO: 1663216 - RNA, 23 nt, Homo sapiens
cugugguuuguuaucaguacaau

SEQ ID NO: 1663217 - RNA, 16 nt, Homo sapiens
cugugucaucugucag

SEQ ID NO: 1663218 - RNA, 12 nt, Homo sapiens
cugugugcagag

SEQ ID NO: 1663219 - RNA, 20 nt, Homo sapiens
cuguguguaaguccuaauaa

SEQ ID NO: 1663220 - RNA, 21 nt, Homo sapiens
cugugugugacaccaccacug

SEQ ID NO: 1663221 - RNA, 22 nt, Homo sapiens
cuguguuucauguucuguguca

SEQ ID NO: 1663222 - RNA, 16 nt, Homo sapiens
cuguuacuauuccuuu

SEQ ID NO: 1663223 - RNA, 13 nt, Homo sapiens
cuguuauacacag

SEQ ID NO: 1663224 - RNA, 17 nt, Homo sapiens
cuguuauuuguccucau

SEQ ID NO: 1663225 - RNA, 20 nt, Homo sapiens
cuguucuaauggauuauaau

SEQ ID NO: 1663226 - RNA, 20 nt, Homo sapiens
cuguucucugacuaacgcca

SEQ ID NO: 1663227 - RNA, 15 nt, Homo sapiens
cuguucugcacugaa

SEQ ID NO: 1663228 - RNA, 16 nt, Homo sapiens
cuguucugcacugaaa

SEQ ID NO: 1663229 - RNA, 15 nt, Homo sapiens
cuguugacagugcca

SEQ ID NO: 1663230 - RNA, 18 nt, Homo sapiens
cuguugggaaccagagag

SEQ ID NO: 1663231 - RNA, 20 nt, Homo sapiens
cuguuucccuucccuuccac

SEQ ID NO: 1663232 - RNA, 18 nt, Homo sapiens
cuguuugaaacuuuucaa

SEQ ID NO: 1663233 - RNA, 18 nt, Homo sapiens
cuguuugauacaguauua

SEQ ID NO: 1663234 - RNA, 16 nt, Homo sapiens
cuuaaacccacauaaa

SEQ ID NO: 1663235 - RNA, 16 nt, Homo sapiens
cuuaaaugaucaagga

SEQ ID NO: 1663236 - RNA, 17 nt, Homo sapiens
gagcucuguagccuggu

SEQ ID NO: 1663237 - RNA, 17 nt, Homo sapiens
gagcugaggacucucac

SEQ ID NO: 1663238 - RNA, 10 nt, Homo sapiens
gagcuucccc

SEQ ID NO: 1663239 - RNA, 12 nt, Homo sapiens
gaggaaaagccc

SEQ ID NO: 1663240 - RNA, 21 nt, Homo sapiens
gaggaacaaagacaaccacug

SEQ ID NO: 1663241 - RNA, 18 nt, Homo sapiens
gaggaacugcuugugcac

SEQ ID NO: 1663242 - RNA, 15 nt, Homo sapiens
gaggacagcuucccc

SEQ ID NO: 1663243 - RNA, 20 nt, Homo sapiens
gaggacccucccagguuucc

SEQ ID NO: 1663244 - RNA, 18 nt, Homo sapiens
gaggacucucacgauaug

SEQ ID NO: 1663245 - RNA, 13 nt, Homo sapiens
gaggagcuucccc

SEQ ID NO: 1663246 - RNA, 21 nt, Homo sapiens
gaggcagaauggugggcucca

SEQ ID NO: 1663247 - RNA, 16 nt, Homo sapiens
gaggcaggaccaggca

SEQ ID NO: 1663248 - RNA, 22 nt, Homo sapiens
gaggccugggugugaccugaca

SEQ ID NO: 1663249 - RNA, 23 nt, Homo sapiens
gaggccugggugugaccugacac

SEQ ID NO: 1663250 - RNA, 18 nt, Homo sapiens
gaggcugagacgcaagga

SEQ ID NO: 1663251 - RNA, 15 nt, Homo sapiens
gaggcuggaucucuc

SEQ ID NO: 1663252 - RNA, 19 nt, Homo sapiens
gaggcuugaaggaaccagc

SEQ ID NO: 1663253 - RNA, 14 nt, Homo sapiens
gagggaagcagugu

SEQ ID NO: 1663254 - RNA, 18 nt, Homo sapiens
gagggaagcccacccgcc

SEQ ID NO: 1663255 - RNA, 20 nt, Homo sapiens
gagggcagcuggagaucuua

SEQ ID NO: 1663256 - RNA, 14 nt, Homo sapiens
gaggguccucaguc

SEQ ID NO: 1663257 - RNA, 15 nt, Homo sapiens
gaggugaaugcacag

SEQ ID NO: 1663258 - RNA, 23 nt, Homo sapiens
gaggugagagaaagccacaaagu

SEQ ID NO: 1663259 - RNA, 13 nt, Homo sapiens
gaguauggugcug

SEQ ID NO: 1663260 - RNA, 22 nt, Homo sapiens
gaguauggugcuggguccuuaa

SEQ ID NO: 1663261 - RNA, 21 nt, Homo sapiens
gaguaugugagaaccaaccaa

SEQ ID NO: 1663262 - RNA, 12 nt, Homo sapiens
gaguauguguau

SEQ ID NO: 1663263 - RNA, 17 nt, Homo sapiens
gaguauguuauuucucu

SEQ ID NO: 1663264 - RNA, 17 nt, Homo sapiens
gaguccaagaagccagc

SEQ ID NO: 1663265 - RNA, 21 nt, Homo sapiens
gagugcaauggugcgaucuca

SEQ ID NO: 1663266 - RNA, 11 nt, Homo sapiens
gagugcagugg

SEQ ID NO: 1663267 - RNA, 14 nt, Homo sapiens
gagugccaauccaa

SEQ ID NO: 1663268 - RNA, 23 nt, Homo sapiens
gagugcuuauaauauacauaacu

SEQ ID NO: 1663269 - RNA, 22 nt, Homo sapiens
gaguggaccacgaccucgucca

SEQ ID NO: 1663270 - RNA, 22 nt, Homo sapiens
gaguggcucguguuucacagug

SEQ ID NO: 1663271 - RNA, 20 nt, Homo sapiens
gaguguggcuuaguaauaga

SEQ ID NO: 1663272 - RNA, 19 nt, Homo sapiens
gaguguuuuaaaacauuca

SEQ ID NO: 1663273 - RNA, 16 nt, Homo sapiens
gaguuacagacaaagc

SEQ ID NO: 1663274 - RNA, 15 nt, Homo sapiens
gaguuauuuuguguc

SEQ ID NO: 1663275 - RNA, 19 nt, Homo sapiens
gaguuccggaaagccuucc

SEQ ID NO: 1663276 - RNA, 19 nt, Homo sapiens
gaguuguuuaaacagucaa

SEQ ID NO: 1663277 - RNA, 15 nt, Homo sapiens
gaguuuaguuuuaua

SEQ ID NO: 1663278 - RNA, 20 nt, Homo sapiens
gaguuuccagcuaagccuga

SEQ ID NO: 1663279 - RNA, 13 nt, Homo sapiens
gauaaagcacugu

SEQ ID NO: 1663280 - RNA, 21 nt, Homo sapiens
gauaagauguuaucaaugaca

SEQ ID NO: 1663281 - RNA, 16 nt, Homo sapiens
gauaaucccauacucu

SEQ ID NO: 1663282 - RNA, 17 nt, Homo sapiens
gauaccuucaugguguu

SEQ ID NO: 1663283 - RNA, 16 nt, Homo sapiens
gauaccuuccaucuca

SEQ ID NO: 1663284 - RNA, 20 nt, Homo sapiens
gauacuaauaggugugugag

SEQ ID NO: 1663285 - RNA, 14 nt, Homo sapiens
gauacuuguaacuu

SEQ ID NO: 1663286 - RNA, 19 nt, Homo sapiens
gauagaggaugggcagcug

SEQ ID NO: 1663287 - RNA, 20 nt, Homo sapiens
gauagaucuuggcccuguua

SEQ ID NO: 1663288 - RNA, 15 nt, Homo sapiens
gauagccaaggccaa

SEQ ID NO: 1663289 - RNA, 14 nt, Homo sapiens
gauauaagccauag

SEQ ID NO: 1663290 - RNA, 23 nt, Homo sapiens
gauauauuuuccagggcaaucaa

SEQ ID NO: 1663291 - RNA, 22 nt, Homo sapiens
gauaucaggaaauaucugugaa

SEQ ID NO: 1663292 - RNA, 18 nt, Homo sapiens
gauaugaguacauacuca

SEQ ID NO: 1663293 - RNA, 22 nt, Homo sapiens
gauauuuucgcccaccuaaagg

SEQ ID NO: 1663294 - RNA, 14 nt, Homo sapiens
gaucaacucugucu

SEQ ID NO: 1663295 - RNA, 13 nt, Homo sapiens
gaucacagguuau

SEQ ID NO: 1663296 - RNA, 19 nt, Homo sapiens
gaucacgaggucaggagau

SEQ ID NO: 1663297 - RNA, 16 nt, Homo sapiens
gaucacguugcaaugg

SEQ ID NO: 1663298 - RNA, 19 nt, Homo sapiens
gauccaacuauuucuuuca

SEQ ID NO: 1663299 - RNA, 23 nt, Homo sapiens
gauccauuuaaaacaagcugaua

SEQ ID NO: 1663300 - RNA, 20 nt, Homo sapiens
gaucuaauauugacugccuc

SEQ ID NO: 1663301 - RNA, 18 nt, Homo sapiens
gaucugagaagacaugaa

SEQ ID NO: 1663302 - RNA, 19 nt, Homo sapiens
gaucuguugggaaccagag

SEQ ID NO: 1663303 - RNA, 21 nt, Homo sapiens
gaucuguugggaaccagagag

SEQ ID NO: 1663304 - RNA, 16 nt, Homo sapiens
gaugaacaucuuuuaa

SEQ ID NO: 1663305 - RNA, 19 nt, Homo sapiens
gaugaccuugaaugaugcc

SEQ ID NO: 1663306 - RNA, 16 nt, Homo sapiens
gaugagaaaacaggcu

SEQ ID NO: 1663307 - RNA, 12 nt, Homo sapiens
gaugcaaaucaa

SEQ ID NO: 1663308 - RNA, 21 nt, Homo sapiens
gaugcacugaaguagccaaca

SEQ ID NO: 1663309 - RNA, 13 nt, Homo sapiens
gaugcaugcaggg

SEQ ID NO: 1663310 - RNA, 23 nt, Homo sapiens
gaugcuccuaguuugaccucaca

SEQ ID NO: 1663311 - RNA, 20 nt, Homo sapiens
gaugcugcugagcacaucuc

SEQ ID NO: 1663312 - RNA, 20 nt, Homo sapiens
gauggcagugcagcaaggag

SEQ ID NO: 1663313 - RNA, 12 nt, Homo sapiens
gauggucucuca

SEQ ID NO: 1663314 - RNA, 13 nt, Homo sapiens
gauggucucucac

SEQ ID NO: 1663315 - RNA, 22 nt, Homo sapiens
gauguccuuccaagaauggaau

SEQ ID NO: 1663316 - RNA, 15 nt, Homo sapiens
gaugugccuagacac

SEQ ID NO: 1663317 - RNA, 19 nt, Homo sapiens
gauguggugggagcacagc

SEQ ID NO: 1663318 - RNA, 16 nt, Homo sapiens
gaugugucuuaccaga

SEQ ID NO: 1663319 - RNA, 14 nt, Homo sapiens
gaugugugaugucu

SEQ ID NO: 1663320 - RNA, 16 nt, Homo sapiens
gauuaaguauaucuau

SEQ ID NO: 1663321 - RNA, 18 nt, Homo sapiens
gauuaauuaaaacacaac

SEQ ID NO: 1663322 - RNA, 21 nt, Homo sapiens
gauuaauuaaaacacaacauc

SEQ ID NO: 1663323 - RNA, 21 nt, Homo sapiens
gauuagaaagaauuagccaac

SEQ ID NO: 1663324 - RNA, 14 nt, Homo sapiens
gauuagugcaauaa

SEQ ID NO: 1663325 - RNA, 23 nt, Homo sapiens
gauuaucgacaucuuugaagcug

SEQ ID NO: 1663326 - RNA, 11 nt, Homo sapiens
gauucaaugug

SEQ ID NO: 1663327 - RNA, 13 nt, Homo sapiens
gauucaauuuaaa

SEQ ID NO: 1663328 - RNA, 22 nt, Homo sapiens
gauucaccuccauuaaccaaga

SEQ ID NO: 1663329 - RNA, 17 nt, Homo sapiens
gauucagaauguguuau

SEQ ID NO: 1663330 - RNA, 15 nt, Homo sapiens
gauucagcacuuugc

SEQ ID NO: 1663331 - RNA, 18 nt, Homo sapiens
gauucaggaaugggccaa

SEQ ID NO: 1663332 - RNA, 17 nt, Homo sapiens
gauuccuucuugcucag

SEQ ID NO: 1663333 - RNA, 18 nt, Homo sapiens
gauucuuuuuucaaugua

SEQ ID NO: 1663334 - RNA, 19 nt, Homo sapiens
gauugagcagaacccagac

SEQ ID NO: 1663335 - RNA, 16 nt, Homo sapiens
gauugugaagauuuca

SEQ ID NO: 1663336 - RNA, 19 nt, Homo sapiens
gauugugcgugcaugugug

SEQ ID NO: 1663337 - RNA, 14 nt, Homo sapiens
gauuuaagcauuuu

SEQ ID NO: 1663338 - RNA, 14 nt, Homo sapiens
gauuuacucauuau

SEQ ID NO: 1663339 - RNA, 22 nt, Homo sapiens
gauuuauuuuuuguaacucuuu

SEQ ID NO: 1663340 - RNA, 18 nt, Homo sapiens
gauuuccaaaaguacuag

SEQ ID NO: 1663341 - RNA, 23 nt, Homo sapiens
gauuucucacccucuguccuucc

SEQ ID NO: 1663342 - RNA, 15 nt, Homo sapiens
gauuugcaacacugc

SEQ ID NO: 1663343 - RNA, 16 nt, Homo sapiens
gauuuuucucaucucc

SEQ ID NO: 1663344 - RNA, 17 nt, Homo sapiens
gauuuuucugcacuaau

SEQ ID NO: 1663345 - RNA, 13 nt, Homo sapiens
gcaaaaugcaaac

SEQ ID NO: 1663346 - RNA, 15 nt, Homo sapiens
gcaaacacuguguau

SEQ ID NO: 1663347 - RNA, 14 nt, Homo sapiens
gcaaaccaaaccau

SEQ ID NO: 1663348 - RNA, 20 nt, Homo sapiens
gcaaagacaguuucuugcaa

SEQ ID NO: 1663349 - RNA, 11 nt, Homo sapiens
gcaaaggcccc

SEQ ID NO: 1663350 - RNA, 21 nt, Homo sapiens
gcaaaugacaugcacugaccc

SEQ ID NO: 1663351 - RNA, 18 nt, Homo sapiens
gcaacuggugacuguccc

SEQ ID NO: 1663352 - RNA, 19 nt, Homo sapiens
gcaagaagugggauucagg

SEQ ID NO: 1663353 - RNA, 13 nt, Homo sapiens
gcaaggcugcuaa

SEQ ID NO: 1663354 - RNA, 18 nt, Homo sapiens
gcaaguacuuugucuuga

SEQ ID NO: 1663355 - RNA, 14 nt, Homo sapiens
gcaauaaguugaau

SEQ ID NO: 1663356 - RNA, 19 nt, Homo sapiens
gcaaucacaagccaagguc

SEQ ID NO: 1663357 - RNA, 15 nt, Homo sapiens
gcacaacaugcacau

SEQ ID NO: 1663358 - RNA, 14 nt, Homo sapiens
guaugguacucagu

SEQ ID NO: 1663359 - RNA, 20 nt, Homo sapiens
guauuaagcuccagugcuuu

SEQ ID NO: 1663360 - RNA, 18 nt, Homo sapiens
guauuaauguaaagauac

SEQ ID NO: 1663361 - RNA, 17 nt, Homo sapiens
guauuauggugauacuc

SEQ ID NO: 1663362 - RNA, 17 nt, Homo sapiens
guauucuuucaccucuu

SEQ ID NO: 1663363 - RNA, 18 nt, Homo sapiens
guauugagacacugucaa

SEQ ID NO: 1663364 - RNA, 21 nt, Homo sapiens
guauuuauauuagagugcccu

SEQ ID NO: 1663365 - RNA, 18 nt, Homo sapiens
guauuuuuccucuuucac

SEQ ID NO: 1663366 - RNA, 15 nt, Homo sapiens
gucaaaauaaucuga

SEQ ID NO: 1663367 - RNA, 21 nt, Homo sapiens
gucaaccugaauuaaagucua

SEQ ID NO: 1663368 - RNA, 21 nt, Homo sapiens
gucaagagggggcaagucaca

SEQ ID NO: 1663369 - RNA, 21 nt, Homo sapiens
gucaagugugccugcuaucca

SEQ ID NO: 1663370 - RNA, 17 nt, Homo sapiens
gucaauaaaccacuguu

SEQ ID NO: 1663371 - RNA, 17 nt, Homo sapiens
gucaccagcugccaaaa

SEQ ID NO: 1663372 - RNA, 22 nt, Homo sapiens
gucacccagguuggagugcagu

SEQ ID NO: 1663373 - RNA, 16 nt, Homo sapiens
gucacgugacccugug

SEQ ID NO: 1663374 - RNA, 19 nt, Homo sapiens
gucaggugccucaagagaa

SEQ ID NO: 1663375 - RNA, 12 nt, Homo sapiens
gucaucaucuca

SEQ ID NO: 1663376 - RNA, 16 nt, Homo sapiens
gucaucucaaacacug

SEQ ID NO: 1663377 - RNA, 21 nt, Homo sapiens
gucauguuucugcaguauucu

SEQ ID NO: 1663378 - RNA, 13 nt, Homo sapiens
gucauuugcuaau

SEQ ID NO: 1663379 - RNA, 20 nt, Homo sapiens
guccaaaauaucgagugaau

SEQ ID NO: 1663380 - RNA, 18 nt, Homo sapiens
guccacagggcagccuga

SEQ ID NO: 1663381 - RNA, 17 nt, Homo sapiens
guccacccccauuguga

SEQ ID NO: 1663382 - RNA, 15 nt, Homo sapiens
guccaugccuuccau

SEQ ID NO: 1663383 - RNA, 14 nt, Homo sapiens
guccaugugauaau

SEQ ID NO: 1663384 - RNA, 14 nt, Homo sapiens
guccccagccugcu

SEQ ID NO: 1663385 - RNA, 15 nt, Homo sapiens
guccccccugugguc

SEQ ID NO: 1663386 - RNA, 16 nt, Homo sapiens
guccccgcacugggcu

SEQ ID NO: 1663387 - RNA, 16 nt, Homo sapiens
gucccgggcacuguca

SEQ ID NO: 1663388 - RNA, 17 nt, Homo sapiens
gucccgggcacugucau

SEQ ID NO: 1663389 - RNA, 19 nt, Homo sapiens
gucccgggcacugucaugc

SEQ ID NO: 1663390 - RNA, 21 nt, Homo sapiens
gucccuaauaaaaacuugcug

SEQ ID NO: 1663391 - RNA, 18 nt, Homo sapiens
gucccucgagcucuguag

SEQ ID NO: 1663392 - RNA, 18 nt, Homo sapiens
gucccugcgucuccugcc

SEQ ID NO: 1663393 - RNA, 14 nt, Homo sapiens
guccggacccaccu

SEQ ID NO: 1663394 - RNA, 19 nt, Homo sapiens
guccucaguccacugcuga

SEQ ID NO: 1663395 - RNA, 20 nt, Homo sapiens
guccucaguccacugcugag

SEQ ID NO: 1663396 - RNA, 15 nt, Homo sapiens
guccucauuguucag

SEQ ID NO: 1663397 - RNA, 22 nt, Homo sapiens
guccugaauguuucagaccaca

SEQ ID NO: 1663398 - RNA, 18 nt, Homo sapiens
guccugggauuacaggug

SEQ ID NO: 1663399 - RNA, 21 nt, Homo sapiens
guccugggggcugcugcacug

SEQ ID NO: 1663400 - RNA, 18 nt, Homo sapiens
guccugggugcugucaug

SEQ ID NO: 1663401 - RNA, 22 nt, Homo sapiens
guccugucuaaaaaugauucuc

SEQ ID NO: 1663402 - RNA, 18 nt, Homo sapiens
guccugugucaucuguca

SEQ ID NO: 1663403 - RNA, 17 nt, Homo sapiens
gucgccaaguuggagug

SEQ ID NO: 1663404 - RNA, 19 nt, Homo sapiens
gucggucuccuuauccccc

SEQ ID NO: 1663405 - RNA, 14 nt, Homo sapiens
gucuaaagcuaaac

SEQ ID NO: 1663406 - RNA, 16 nt, Homo sapiens
gucuaauaaacacaga

SEQ ID NO: 1663407 - RNA, 14 nt, Homo sapiens
gucuacacugccuu

SEQ ID NO: 1663408 - RNA, 17 nt, Homo sapiens
gucuaggaaucaugugc

SEQ ID NO: 1663409 - RNA, 17 nt, Homo sapiens
gucuccucugcagcuca

SEQ ID NO: 1663410 - RNA, 21 nt, Homo sapiens
gucuccucugcagcucaggga

SEQ ID NO: 1663411 - RNA, 15 nt, Homo sapiens
gucucuauacuacau

SEQ ID NO: 1663412 - RNA, 20 nt, Homo sapiens
gucugaacccuuccaccaaa

SEQ ID NO: 1663413 - RNA, 15 nt, Homo sapiens
gucugagucuugggu

SEQ ID NO: 1663414 - RNA, 22 nt, Homo sapiens
gucugcuuuggggcuuaucaga

SEQ ID NO: 1663415 - RNA, 21 nt, Homo sapiens
gucugggcucccugcgccuga

SEQ ID NO: 1663416 - RNA, 17 nt, Homo sapiens
gucuguaagagaauucu

SEQ ID NO: 1663417 - RNA, 16 nt, Homo sapiens
gucuguccuuucccac

SEQ ID NO: 1663418 - RNA, 16 nt, Homo sapiens
gucuuacaacugacug

SEQ ID NO: 1663419 - RNA, 21 nt, Homo sapiens
gucuuccuccuaaauuuccag

SEQ ID NO: 1663420 - RNA, 22 nt, Homo sapiens
gucuuucccuggugaugguccc

SEQ ID NO: 1663421 - RNA, 23 nt, Homo sapiens
gucuuugauucaccaaacaugaa

SEQ ID NO: 1663422 - RNA, 20 nt, Homo sapiens
gucuuuggcuucagaauugu

SEQ ID NO: 1663423 - RNA, 21 nt, Homo sapiens
gucuuuuuuuucuucaccuca

SEQ ID NO: 1663424 - RNA, 22 nt, Homo sapiens
gucuuuuuuuucuucaccucac

SEQ ID NO: 1663425 - RNA, 13 nt, Homo sapiens
gugaaaaugugac

SEQ ID NO: 1663426 - RNA, 17 nt, Homo sapiens
gugaagauuucauggac

SEQ ID NO: 1663427 - RNA, 19 nt, Homo sapiens
gugaagauuucauggacac

SEQ ID NO: 1663428 - RNA, 15 nt, Homo sapiens
gugaagcugggagaa

SEQ ID NO: 1663429 - RNA, 17 nt, Homo sapiens
gugaaguaggugaucuu

SEQ ID NO: 1663430 - RNA, 15 nt, Homo sapiens
gugaaugguugcaaa

SEQ ID NO: 1663431 - RNA, 20 nt, Homo sapiens
gugaauuuuaaaaugcaaau

SEQ ID NO: 1663432 - RNA, 15 nt, Homo sapiens
gugacaccaccacug

SEQ ID NO: 1663433 - RNA, 16 nt, Homo sapiens
gugacaccaccacugu

SEQ ID NO: 1663434 - RNA, 18 nt, Homo sapiens
gugacaccaccacugugu

SEQ ID NO: 1663435 - RNA, 16 nt, Homo sapiens
gugacagcugagcacc

SEQ ID NO: 1663436 - RNA, 12 nt, Homo sapiens
gugacauuccac

SEQ ID NO: 1663437 - RNA, 12 nt, Homo sapiens
gugagacucuga

SEQ ID NO: 1663438 - RNA, 15 nt, Homo sapiens
gugagagaaagccac

SEQ ID NO: 1663439 - RNA, 17 nt, Homo sapiens
gugagagaaagccacaa

SEQ ID NO: 1663440 - RNA, 15 nt, Homo sapiens
gugagcacaaaggua

SEQ ID NO: 1663441 - RNA, 23 nt, Homo sapiens
gugagccaccgcgccuggccaaa

SEQ ID NO: 1663442 - RNA, 11 nt, Homo sapiens
gugagccagac

SEQ ID NO: 1663443 - RNA, 14 nt, Homo sapiens
gugaggaagcaaaa

SEQ ID NO: 1663444 - RNA, 15 nt, Homo sapiens
gugaggaagcaaaag

SEQ ID NO: 1663445 - RNA, 18 nt, Homo sapiens
gugaggacugguugucuc

SEQ ID NO: 1663446 - RNA, 19 nt, Homo sapiens
gugaggcuccggauguuuc

SEQ ID NO: 1663447 - RNA, 16 nt, Homo sapiens
gugaguguauguauac

SEQ ID NO: 1663448 - RNA, 16 nt, Homo sapiens
gugauacaaauugaua

SEQ ID NO: 1663449 - RNA, 12 nt, Homo sapiens
gugaucuauacc

SEQ ID NO: 1663450 - RNA, 12 nt, Homo sapiens
gugauguuauag

SEQ ID NO: 1663451 - RNA, 16 nt, Homo sapiens
gugauugucaccauga

SEQ ID NO: 1663452 - RNA, 13 nt, Homo sapiens
gugauuucucacc

SEQ ID NO: 1663453 - RNA, 13 nt, Homo sapiens
gugcaaauauuca

SEQ ID NO: 1663454 - RNA, 14 nt, Homo sapiens
gugcaacaaacuca

SEQ ID NO: 1663455 - RNA, 14 nt, Homo sapiens
gugcaccugcccca

SEQ ID NO: 1663456 - RNA, 16 nt, Homo sapiens
gugcagcuuuccaguu

SEQ ID NO: 1663457 - RNA, 12 nt, Homo sapiens
gugcaguacuca

SEQ ID NO: 1663458 - RNA, 15 nt, Homo sapiens
gugcagugauguggu

SEQ ID NO: 1663459 - RNA, 19 nt, Homo sapiens
gugcaguggcgcgaucuca

SEQ ID NO: 1663460 - RNA, 20 nt, Homo sapiens
gugcaugaauagauucucuc

SEQ ID NO: 1663461 - RNA, 21 nt, Homo sapiens
gugccacauggccgcugccca

SEQ ID NO: 1663462 - RNA, 22 nt, Homo sapiens
gugcccuguuuccaaugccaau

SEQ ID NO: 1663463 - RNA, 15 nt, Homo sapiens
gugccuaacuccuua

SEQ ID NO: 1663464 - RNA, 19 nt, Homo sapiens
gugccugcuuaccugccag

SEQ ID NO: 1663465 - RNA, 19 nt, Homo sapiens
gugcuccuucauaagccau

SEQ ID NO: 1663466 - RNA, 16 nt, Homo sapiens
gugcucuucuguucuc

SEQ ID NO: 1663467 - RNA, 21 nt, Homo sapiens
gugcugcuguggcaucaggaa

SEQ ID NO: 1663468 - RNA, 19 nt, Homo sapiens
gugcuggcauuacaggugu

SEQ ID NO: 1663469 - RNA, 21 nt, Homo sapiens
gugcuggcauuacagguguga

SEQ ID NO: 1663470 - RNA, 19 nt, Homo sapiens
gugcugggauuaacaggua

SEQ ID NO: 1663471 - RNA, 18 nt, Homo sapiens
gugcugugggcagcaccc

SEQ ID NO: 1663472 - RNA, 14 nt, Homo sapiens
gugcuuguucuucc

SEQ ID NO: 1663473 - RNA, 15 nt, Homo sapiens
guggaaaacucacag

SEQ ID NO: 1663474 - RNA, 17 nt, Homo sapiens
guggaccaguucccuca

SEQ ID NO: 1663475 - RNA, 20 nt, Homo sapiens
guggaugaagacccuaucuc

SEQ ID NO: 1663476 - RNA, 17 nt, Homo sapiens
guggcacccaccacucu

SEQ ID NO: 1663477 - RNA, 22 nt, Homo sapiens
gugggccuuugagagccuccag

SEQ ID NO: 1663478 - RNA, 21 nt, Homo sapiens
guggguuucuaaagcugccag

SEQ ID NO: 1663479 - RNA, 14 nt, Homo sapiens
gugguauuuuaaca

SEQ ID NO: 1663480 - RNA, 14 nt, Homo sapiens
uuaucccgccaggg

SEQ ID NO: 1663481 - RNA, 17 nt, Homo sapiens
uuauccuccuucacucc

SEQ ID NO: 1663482 - RNA, 18 nt, Homo sapiens
uuaucuggaaaauuccag

SEQ ID NO: 1663483 - RNA, 17 nt, Homo sapiens
uuaucugucucuucuac

SEQ ID NO: 1663484 - RNA, 12 nt, Homo sapiens
uuaugacaugau

SEQ ID NO: 1663485 - RNA, 19 nt, Homo sapiens
uuaugguaccucugucuau

SEQ ID NO: 1663486 - RNA, 14 nt, Homo sapiens
uuaugucuauaacu

SEQ ID NO: 1663487 - RNA, 21 nt, Homo sapiens
uuauucaauaacuauugcugc

SEQ ID NO: 1663488 - RNA, 20 nt, Homo sapiens
uuauuuacaugugauuguga

SEQ ID NO: 1663489 - RNA, 20 nt, Homo sapiens
uuauuuacugacauauaucu

SEQ ID NO: 1663490 - RNA, 14 nt, Homo sapiens
uucaaaaccuugca

SEQ ID NO: 1663491 - RNA, 16 nt, Homo sapiens
uucaaagaaaacagac

SEQ ID NO: 1663492 - RNA, 16 nt, Homo sapiens
uucaacagcucaccaa

SEQ ID NO: 1663493 - RNA, 13 nt, Homo sapiens
uucaacaugugcu

SEQ ID NO: 1663494 - RNA, 16 nt, Homo sapiens
uucaaggcccuuacac

SEQ ID NO: 1663495 - RNA, 17 nt, Homo sapiens
uucaagugcuucuccag

SEQ ID NO: 1663496 - RNA, 18 nt, Homo sapiens
uucaaguuaauucucaga

SEQ ID NO: 1663497 - RNA, 23 nt, Homo sapiens
uucaauauccccaagcaguguga

SEQ ID NO: 1663498 - RNA, 13 nt, Homo sapiens
uucaaugaacugu

SEQ ID NO: 1663499 - RNA, 15 nt, Homo sapiens
uucaauguacuguau

SEQ ID NO: 1663500 - RNA, 16 nt, Homo sapiens
uucacaauuugaaaag

SEQ ID NO: 1663501 - RNA, 13 nt, Homo sapiens
uucacacaaagug

SEQ ID NO: 1663502 - RNA, 16 nt, Homo sapiens
uucaccaggaagaagg

SEQ ID NO: 1663503 - RNA, 22 nt, Homo sapiens
uucaccaguuuccaaguuuauu

SEQ ID NO: 1663504 - RNA, 16 nt, Homo sapiens
uucaccauguugccaa

SEQ ID NO: 1663505 - RNA, 15 nt, Homo sapiens
uucaccuccauuaac

SEQ ID NO: 1663506 - RNA, 20 nt, Homo sapiens
uucaccucuucccacaagaa

SEQ ID NO: 1663507 - RNA, 11 nt, Homo sapiens
uucaccuguaa

SEQ ID NO: 1663508 - RNA, 17 nt, Homo sapiens
uucacucccugucauag

SEQ ID NO: 1663509 - RNA, 18 nt, Homo sapiens
uucacucugacaguauua

SEQ ID NO: 1663510 - RNA, 22 nt, Homo sapiens
uucacugccccagacacagugc

SEQ ID NO: 1663511 - RNA, 19 nt, Homo sapiens
uucagaugauucuaugucu

SEQ ID NO: 1663512 - RNA, 15 nt, Homo sapiens
uucagcuccuuccac

SEQ ID NO: 1663513 - RNA, 13 nt, Homo sapiens
uucauaagccauu

SEQ ID NO: 1663514 - RNA, 20 nt, Homo sapiens
uucauacuacauuugaacag

SEQ ID NO: 1663515 - RNA, 22 nt, Homo sapiens
uucaucaaguagcguuggagac

SEQ ID NO: 1663516 - RNA, 14 nt, Homo sapiens
uucauccacugaau

SEQ ID NO: 1663517 - RNA, 16 nt, Homo sapiens
uucaucuggauuccag

SEQ ID NO: 1663518 - RNA, 13 nt, Homo sapiens
uucauguuuugcu

SEQ ID NO: 1663519 - RNA, 20 nt, Homo sapiens
uucauguuuugcuaaugcuc

SEQ ID NO: 1663520 - RNA, 21 nt, Homo sapiens
uucauuuaggugaggaagcaa

SEQ ID NO: 1663521 - RNA, 22 nt, Homo sapiens
uucauuuaggugaggaagcaaa

SEQ ID NO: 1663522 - RNA, 23 nt, Homo sapiens
uuccaaaaguacuagcaauaagu

SEQ ID NO: 1663523 - RNA, 21 nt, Homo sapiens
uuccaaagguuucaacuguaa

SEQ ID NO: 1663524 - RNA, 17 nt, Homo sapiens
uuccaaguuuauugccc

SEQ ID NO: 1663525 - RNA, 22 nt, Homo sapiens
uuccaauaauugacugguggaa

SEQ ID NO: 1663526 - RNA, 20 nt, Homo sapiens
uuccaauuuuguugcaucau

SEQ ID NO: 1663527 - RNA, 18 nt, Homo sapiens
uuccacaauuuugucucu

SEQ ID NO: 1663528 - RNA, 15 nt, Homo sapiens
uuccacuacagugag

SEQ ID NO: 1663529 - RNA, 12 nt, Homo sapiens
uuccacugccuc

SEQ ID NO: 1663530 - RNA, 20 nt, Homo sapiens
uuccagacaggguggggcuu

SEQ ID NO: 1663531 - RNA, 19 nt, Homo sapiens
uuccagagcuauuauuuac

SEQ ID NO: 1663532 - RNA, 16 nt, Homo sapiens
uuccagggaaccagag

SEQ ID NO: 1663533 - RNA, 22 nt, Homo sapiens
uuccauacgugcccauuucaca

SEQ ID NO: 1663534 - RNA, 12 nt, Homo sapiens
uuccauggugcc

SEQ ID NO: 1663535 - RNA, 13 nt, Homo sapiens
uucccaaacugau

SEQ ID NO: 1663536 - RNA, 15 nt, Homo sapiens
uucccaacaauacuu

SEQ ID NO: 1663537 - RNA, 17 nt, Homo sapiens
uucccaaucccauuccu

SEQ ID NO: 1663538 - RNA, 23 nt, Homo sapiens
uucccaaucccauuccugggcua

SEQ ID NO: 1663539 - RNA, 18 nt, Homo sapiens
uucccacacugugaacua

SEQ ID NO: 1663540 - RNA, 19 nt, Homo sapiens
uucccaccugucaaccuga

SEQ ID NO: 1663541 - RNA, 16 nt, Homo sapiens
uucccagguugacuaa

SEQ ID NO: 1663542 - RNA, 13 nt, Homo sapiens
uucccauggaaug

SEQ ID NO: 1663543 - RNA, 23 nt, Homo sapiens
uucccauuuuccuucaccgugac

SEQ ID NO: 1663544 - RNA, 20 nt, Homo sapiens
uuccccaucgccuucugggg

SEQ ID NO: 1663545 - RNA, 21 nt, Homo sapiens
uuccccaucugugugugaauu

SEQ ID NO: 1663546 - RNA, 17 nt, Homo sapiens
uuccccccaaaacugau

SEQ ID NO: 1663547 - RNA, 17 nt, Homo sapiens
uucccuccaccagugug

SEQ ID NO: 1663548 - RNA, 22 nt, Homo sapiens
uucccuccgaacgcugcuccau

SEQ ID NO: 1663549 - RNA, 15 nt, Homo sapiens
uucccuucaaugcaa

SEQ ID NO: 1663550 - RNA, 19 nt, Homo sapiens
uuccgugagagucaucuca

SEQ ID NO: 1663551 - RNA, 12 nt, Homo sapiens
uuccuacuggag

SEQ ID NO: 1663552 - RNA, 16 nt, Homo sapiens
uuccuacugggggcaa

SEQ ID NO: 1663553 - RNA, 16 nt, Homo sapiens
uuccuaugcaguguca

SEQ ID NO: 1663554 - RNA, 23 nt, Homo sapiens
uuccucauuuuuauauucauuua

SEQ ID NO: 1663555 - RNA, 22 nt, Homo sapiens
uuccugaagaauugaaaaacca

SEQ ID NO: 1663556 - RNA, 19 nt, Homo sapiens
uuccugggcagcccagaga

SEQ ID NO: 1663557 - RNA, 16 nt, Homo sapiens
uuccugucaauauaua

SEQ ID NO: 1663558 - RNA, 12 nt, Homo sapiens
uuccuuaguaua

SEQ ID NO: 1663559 - RNA, 13 nt, Homo sapiens
uuccuucuggccu

SEQ ID NO: 1663560 - RNA, 19 nt, Homo sapiens
uuccuugccacaaucacua

SEQ ID NO: 1663561 - RNA, 15 nt, Homo sapiens
uuccuuggcccagca

SEQ ID NO: 1663562 - RNA, 15 nt, Homo sapiens
uucggcuaugucuca

SEQ ID NO: 1663563 - RNA, 21 nt, Homo sapiens
uucguccuuagaauacuguau

SEQ ID NO: 1663564 - RNA, 18 nt, Homo sapiens
uucuaaggagcacuagaa

SEQ ID NO: 1663565 - RNA, 16 nt, Homo sapiens
uucuaauccaugugcu

SEQ ID NO: 1663566 - RNA, 22 nt, Homo sapiens
uucuacucgaguuacagacaaa

SEQ ID NO: 1663567 - RNA, 17 nt, Homo sapiens
uucuacugaacagucca

SEQ ID NO: 1663568 - RNA, 16 nt, Homo sapiens
uucuagauuaccauga

SEQ ID NO: 1663569 - RNA, 15 nt, Homo sapiens
uucucaucuugccuc

SEQ ID NO: 1663570 - RNA, 14 nt, Homo sapiens
uucucauucuugcc

SEQ ID NO: 1663571 - RNA, 17 nt, Homo sapiens
uucucauuuagcauuga

SEQ ID NO: 1663572 - RNA, 16 nt, Homo sapiens
uucuccaccuccccca

SEQ ID NO: 1663573 - RNA, 21 nt, Homo sapiens
uucuccaccugaagugaugau

SEQ ID NO: 1663574 - RNA, 18 nt, Homo sapiens
uucuccugaaaacuuuag

SEQ ID NO: 1663575 - RNA, 13 nt, Homo sapiens
uucuccuuguaaa

SEQ ID NO: 1663576 - RNA, 18 nt, Homo sapiens
uucuccuuguacuugaau

SEQ ID NO: 1663577 - RNA, 16 nt, Homo sapiens
uucucgugacaccacc

SEQ ID NO: 1663578 - RNA, 19 nt, Homo sapiens
uucucuaaacuuucccuau

SEQ ID NO: 1663579 - RNA, 21 nt, Homo sapiens
uucucuagacaucuagucuca

SEQ ID NO: 1663580 - RNA, 12 nt, Homo sapiens
uucucucugugu

SEQ ID NO: 1663581 - RNA, 22 nt, Homo sapiens
uucucucuuucuuuugugcaua

SEQ ID NO: 1663582 - RNA, 20 nt, Homo sapiens
uucucugccgguggggccag

SEQ ID NO: 1663583 - RNA, 17 nt, Homo sapiens
uucucuucgcugugaug

SEQ ID NO: 1663584 - RNA, 22 nt, Homo sapiens
uucucuuuguggggcuuggcgu

SEQ ID NO: 1663585 - RNA, 14 nt, Homo sapiens
uucugaagaucuca

SEQ ID NO: 1663586 - RNA, 17 nt, Homo sapiens
uucugaguagcauauau

SEQ ID NO: 1663587 - RNA, 13 nt, Homo sapiens
uucugcaauucaa

SEQ ID NO: 1663588 - RNA, 18 nt, Homo sapiens
uucugcuucucuuucaca

SEQ ID NO: 1663589 - RNA, 22 nt, Homo sapiens
uucuggugucuaauaaacacag

SEQ ID NO: 1663590 - RNA, 12 nt, Homo sapiens
uucuguccugua

SEQ ID NO: 1663591 - RNA, 18 nt, Homo sapiens
uucugugauauuguccaa

SEQ ID NO: 1663592 - RNA, 14 nt, Homo sapiens
uucuguuauacaca

SEQ ID NO: 1663593 - RNA, 23 nt, Homo sapiens
uucuuauuauuuuugagacagag

SEQ ID NO: 1663594 - RNA, 13 nt, Homo sapiens
uucuucaccucac

SEQ ID NO: 1663595 - RNA, 14 nt, Homo sapiens
uucuucaccucacu

SEQ ID NO: 1663596 - RNA, 21 nt, Homo sapiens
uucuucaccucacuuguggca

SEQ ID NO: 1663597 - RNA, 16 nt, Homo sapiens
uucuucccuuaggcaa

SEQ ID NO: 1663598 - RNA, 21 nt, Homo sapiens
uucuuccuuuuguauccucca

SEQ ID NO: 1663599 - RNA, 15 nt, Homo sapiens
uucuucuugagcuga

SEQ ID NO: 1663600 - RNA, 16 nt, Homo sapiens
uucuugagcagcugaa

SEQ ID NO: 1663601 - RNA, 21 nt, Homo sapiens
uucuugcucugcucaucuaca

SEQ ID NO: 1663602 - RNA, 16 nt, Homo sapiens
aaacgcagacacugua

SEQ ID NO: 1663603 - RNA, 11 nt, Homo sapiens
aaacucaaaau

SEQ ID NO: 1663604 - RNA, 19 nt, Homo sapiens
aaacugauuacaacugcua

SEQ ID NO: 1663605 - RNA, 22 nt, Homo sapiens
aaacugccacaagcacaauuga

SEQ ID NO: 1663606 - RNA, 22 nt, Homo sapiens
aaacuggaaugcuguuacuuug

SEQ ID NO: 1663607 - RNA, 16 nt, Homo sapiens
aaacuucuacugagca

SEQ ID NO: 1663608 - RNA, 15 nt, Homo sapiens
aaacuuguacuuaca

SEQ ID NO: 1663609 - RNA, 14 nt, Homo sapiens
aaacuuucaccuca

SEQ ID NO: 1663610 - RNA, 17 nt, Homo sapiens
aaacuuucaccucagau

SEQ ID NO: 1663611 - RNA, 22 nt, Homo sapiens
aaacuuuccaugacaguagcau

SEQ ID NO: 1663612 - RNA, 20 nt, Homo sapiens
aaagaaaacuuguguucaau

SEQ ID NO: 1663613 - RNA, 16 nt, Homo sapiens
aaagaaaaggugucau

SEQ ID NO: 1663614 - RNA, 12 nt, Homo sapiens
aaagaaguggau

SEQ ID NO: 1663615 - RNA, 17 nt, Homo sapiens
aaagagcgucauguccu

SEQ ID NO: 1663616 - RNA, 15 nt, Homo sapiens
aaagaggcuauguga

SEQ ID NO: 1663617 - RNA, 19 nt, Homo sapiens
aaagaguaaaaccaaaggu

SEQ ID NO: 1663618 - RNA, 12 nt, Homo sapiens
aaagauaagugu

SEQ ID NO: 1663619 - RNA, 20 nt, Homo sapiens
aaagauugauuaaugaacua

SEQ ID NO: 1663620 - RNA, 19 nt, Homo sapiens
aaagauugcuauaauguau

SEQ ID NO: 1663621 - RNA, 14 nt, Homo sapiens
aaagcacuggccuu

SEQ ID NO: 1663622 - RNA, 13 nt, Homo sapiens
aaagcagugcagu

SEQ ID NO: 1663623 - RNA, 14 nt, Homo sapiens
aaagcagugcagua

SEQ ID NO: 1663624 - RNA, 18 nt, Homo sapiens
aaagccagucaagggcau

SEQ ID NO: 1663625 - RNA, 14 nt, Homo sapiens
aaagcccagggucu

SEQ ID NO: 1663626 - RNA, 23 nt, Homo sapiens
aaagccugggcagaaaugugcug

SEQ ID NO: 1663627 - RNA, 11 nt, Homo sapiens
aaagccuuccu

SEQ ID NO: 1663628 - RNA, 19 nt, Homo sapiens
aaagccuugugaucacuuu

SEQ ID NO: 1663629 - RNA, 22 nt, Homo sapiens
aaagcuagaggagauugcucug

SEQ ID NO: 1663630 - RNA, 20 nt, Homo sapiens
aaagcuuaaacauugccuua

SEQ ID NO: 1663631 - RNA, 15 nt, Homo sapiens
aaaggaggacaggga

SEQ ID NO: 1663632 - RNA, 20 nt, Homo sapiens
aaaggcauuucaaagucuca

SEQ ID NO: 1663633 - RNA, 20 nt, Homo sapiens
aaaggcuggaugugcuuuca

SEQ ID NO: 1663634 - RNA, 19 nt, Homo sapiens
aaagggagaacauggccaa

SEQ ID NO: 1663635 - RNA, 19 nt, Homo sapiens
aaagguagcuuaccugaca

SEQ ID NO: 1663636 - RNA, 14 nt, Homo sapiens
aaagguauuuucac

SEQ ID NO: 1663637 - RNA, 14 nt, Homo sapiens
aaagguucugaaaa

SEQ ID NO: 1663638 - RNA, 13 nt, Homo sapiens
aaagguucuucau

SEQ ID NO: 1663639 - RNA, 18 nt, Homo sapiens
aaagguucuucaucccuu

SEQ ID NO: 1663640 - RNA, 15 nt, Homo sapiens
aaaguauuccaccuu

SEQ ID NO: 1663641 - RNA, 15 nt, Homo sapiens
aaaguccgaaaagca

SEQ ID NO: 1663642 - RNA, 16 nt, Homo sapiens
aaagucuacacugccu

SEQ ID NO: 1663643 - RNA, 21 nt, Homo sapiens
aaagugcugggauuacaggcg

SEQ ID NO: 1663644 - RNA, 15 nt, Homo sapiens
aaaguuaaacgugau

SEQ ID NO: 1663645 - RNA, 17 nt, Homo sapiens
aaauaaaaauagcuaua

SEQ ID NO: 1663646 - RNA, 14 nt, Homo sapiens
aaauaaaaauauuc

SEQ ID NO: 1663647 - RNA, 15 nt, Homo sapiens
aaauaaaccccaguc

SEQ ID NO: 1663648 - RNA, 20 nt, Homo sapiens
aaauaaaccccagucuccca

SEQ ID NO: 1663649 - RNA, 19 nt, Homo sapiens
aaauaacacuguacugcaa

SEQ ID NO: 1663650 - RNA, 18 nt, Homo sapiens
aaauaacccugaaucaga

SEQ ID NO: 1663651 - RNA, 18 nt, Homo sapiens
aaauaacugagcacuuug

SEQ ID NO: 1663652 - RNA, 19 nt, Homo sapiens
aaauaaugauucaauguga

SEQ ID NO: 1663653 - RNA, 12 nt, Homo sapiens
aaauacauauga

SEQ ID NO: 1663654 - RNA, 21 nt, Homo sapiens
aaauacaugccuuuccagugc

SEQ ID NO: 1663655 - RNA, 15 nt, Homo sapiens
aaauacuauuggaca

SEQ ID NO: 1663656 - RNA, 16 nt, Homo sapiens
aaauacucagcaacug

SEQ ID NO: 1663657 - RNA, 15 nt, Homo sapiens
aaauacucuuccaaa

SEQ ID NO: 1663658 - RNA, 17 nt, Homo sapiens
aaauaggcauaucaagg

SEQ ID NO: 1663659 - RNA, 18 nt, Homo sapiens
aaauauaaacugugagau

SEQ ID NO: 1663660 - RNA, 18 nt, Homo sapiens
aaauauacaaacaugugg

SEQ ID NO: 1663661 - RNA, 14 nt, Homo sapiens
aaauauacaacuuu

SEQ ID NO: 1663662 - RNA, 16 nt, Homo sapiens
aaauauccuuacuuua

SEQ ID NO: 1663663 - RNA, 16 nt, Homo sapiens
guuauucaauaacuau

SEQ ID NO: 1663664 - RNA, 15 nt, Homo sapiens
guuauuuauaguguu

SEQ ID NO: 1663665 - RNA, 20 nt, Homo sapiens
guucaaaaccuugcacaggu

SEQ ID NO: 1663666 - RNA, 16 nt, Homo sapiens
guucagaaaagcaccu

SEQ ID NO: 1663667 - RNA, 18 nt, Homo sapiens
guuccucauggcuguuau

SEQ ID NO: 1663668 - RNA, 18 nt, Homo sapiens
guucucaaucauugucag

SEQ ID NO: 1663669 - RNA, 15 nt, Homo sapiens
guucugcacugaaaa

SEQ ID NO: 1663670 - RNA, 17 nt, Homo sapiens
guucuuucauacuacau

SEQ ID NO: 1663671 - RNA, 13 nt, Homo sapiens
guugauguugaua

SEQ ID NO: 1663672 - RNA, 14 nt, Homo sapiens
guugcagaaaaaga

SEQ ID NO: 1663673 - RNA, 16 nt, Homo sapiens
guugcaucauguugaa

SEQ ID NO: 1663674 - RNA, 20 nt, Homo sapiens
guugccaggcuggagugcag

SEQ ID NO: 1663675 - RNA, 22 nt, Homo sapiens
uaaguguuggccaucauuucau

SEQ ID NO: 1663676 - RNA, 19 nt, Homo sapiens
uaaguuauaccagcaaaag

SEQ ID NO: 1663677 - RNA, 15 nt, Homo sapiens
uaauaaaacucugca

SEQ ID NO: 1663678 - RNA, 16 nt, Homo sapiens
uaauaacuagaucucc

SEQ ID NO: 1663679 - RNA, 23 nt, Homo sapiens
uaauaagucacugacaucagcac

SEQ ID NO: 1663680 - RNA, 21 nt, Homo sapiens
uaauauaggguuuguuugcug

SEQ ID NO: 1663681 - RNA, 16 nt, Homo sapiens
uaauauauacauauuc

SEQ ID NO: 1663682 - RNA, 12 nt, Homo sapiens
uaaucacuauug

SEQ ID NO: 1663683 - RNA, 12 nt, Homo sapiens
uaauccaugugc

SEQ ID NO: 1663684 - RNA, 21 nt, Homo sapiens
gucccugagaacccaaacuuc

SEQ ID NO: 1663685 - RNA, 12 nt, Homo sapiens
gucccuuaccug

SEQ ID NO: 1663686 - RNA, 15 nt, Homo sapiens
guccugacuguccua

SEQ ID NO: 1663687 - RNA, 12 nt, Homo sapiens
guccugcacugu

SEQ ID NO: 1663688 - RNA, 20 nt, Homo sapiens
guccugggggcugcugcacu

SEQ ID NO: 1663689 - RNA, 19 nt, Homo sapiens
guccuuagaauacuguauu

SEQ ID NO: 1663690 - RNA, 14 nt, Homo sapiens
gucgcuuugccauc

SEQ ID NO: 1663691 - RNA, 19 nt, Homo sapiens
gucggguucucccaugauu

SEQ ID NO: 1663692 - RNA, 21 nt, Homo sapiens
gucguaccucgguucacuguu

SEQ ID NO: 1663693 - RNA, 23 nt, Homo sapiens
ggucaccuuccugggcagcccag

SEQ ID NO: 1663694 - RNA, 22 nt, Homo sapiens
ggucagcgauuccugccaagua

SEQ ID NO: 1663695 - RNA, 15 nt, Homo sapiens
ggucccccaugccac

SEQ ID NO: 1663696 - RNA, 21 nt, Homo sapiens
gguccccugcccugucuuucc

SEQ ID NO: 1663697 - RNA, 23 nt, Homo sapiens
ggucccuaauucucuucgcugug

SEQ ID NO: 1663698 - RNA, 20 nt, Homo sapiens
gguccucaguccacugcuga

SEQ ID NO: 1663699 - RNA, 22 nt, Homo sapiens
gguccucggcccuguagcccug

SEQ ID NO: 1663700 - RNA, 18 nt, Homo sapiens
gguccugaggccaagaaa

SEQ ID NO: 1663701 - RNA, 16 nt, Homo sapiens
ggucuccucugcagcu

SEQ ID NO: 1663702 - RNA, 21 nt, Homo sapiens
ggucuggcauuauaaagaaca

SEQ ID NO: 1663703 - RNA, 21 nt, Homo sapiens
ggucuggggcagcagagccau

SEQ ID NO: 1663704 - RNA, 14 nt, Homo sapiens
ggucuuucagaaca

SEQ ID NO: 1663705 - RNA, 17 nt, Homo sapiens
ggugaacugaagcagag

SEQ ID NO: 1663706 - RNA, 18 nt, Homo sapiens
ggugaaggcccagccugu

SEQ ID NO: 1663707 - RNA, 15 nt, Homo sapiens
ggugaccagcaccau

SEQ ID NO: 1663708 - RNA, 13 nt, Homo sapiens
ggugagguccugu

SEQ ID NO: 1663709 - RNA, 17 nt, Homo sapiens
ggugcauuugcccucau

SEQ ID NO: 1663710 - RNA, 18 nt, Homo sapiens
ggugccaguccaucucaa

SEQ ID NO: 1663711 - RNA, 20 nt, Homo sapiens
ggugcugcuuucuuguugcu

SEQ ID NO: 1663712 - RNA, 15 nt, Homo sapiens
ggugcugucaugccc

SEQ ID NO: 1663713 - RNA, 13 nt, Homo sapiens
ggugcuucucaca

SEQ ID NO: 1663714 - RNA, 18 nt, Homo sapiens
gguggcaugaguugaaga

SEQ ID NO: 1663715 - RNA, 14 nt, Homo sapiens
gguggggagucuga

SEQ ID NO: 1663716 - RNA, 22 nt, Homo sapiens
ggugggugcucaagacuggcau

SEQ ID NO: 1663717 - RNA, 14 nt, Homo sapiens
gguggucuuggaga

SEQ ID NO: 1663718 - RNA, 21 nt, Homo sapiens
gguguaguggcucaugccugu

SEQ ID NO: 1663719 - RNA, 19 nt, Homo sapiens
ggugugagccaccacaucc

SEQ ID NO: 1663720 - RNA, 17 nt, Homo sapiens
gguuaaagaaaggcaga

SEQ ID NO: 1663721 - RNA, 17 nt, Homo sapiens
gguuaugucccaugacc

SEQ ID NO: 1663722 - RNA, 22 nt, Homo sapiens
gguuaugucccaugaccuugac

SEQ ID NO: 1663723 - RNA, 12 nt, Homo sapiens
gguuccauccac

SEQ ID NO: 1663724 - RNA, 16 nt, Homo sapiens
gguuggagugcagugg

SEQ ID NO: 1663725 - RNA, 20 nt, Homo sapiens
gguuggagugcaguggcgug

SEQ ID NO: 1663726 - RNA, 13 nt, Homo sapiens
gguuuagaaucaa

SEQ ID NO: 1663727 - RNA, 13 nt, Homo sapiens
gguuuuaagccag

SEQ ID NO: 1663728 - RNA, 12 nt, Homo sapiens
guaaaaccaaag

SEQ ID NO: 1663729 - RNA, 17 nt, Homo sapiens
guaaaagccuaugugcc

SEQ ID NO: 1663730 - RNA, 13 nt, Homo sapiens
guaaaauacuucu

SEQ ID NO: 1663731 - RNA, 22 nt, Homo sapiens
guaaaauauuuauaaaugaaga

SEQ ID NO: 1663732 - RNA, 16 nt, Homo sapiens
guaaagaaagcuguaa

SEQ ID NO: 1663733 - RNA, 15 nt, Homo sapiens
guaaaggugaugaau

SEQ ID NO: 1663734 - RNA, 16 nt, Homo sapiens
guaaauaacugugacu

SEQ ID NO: 1663735 - RNA, 20 nt, Homo sapiens
guaacacacacacacauaca

SEQ ID NO: 1663736 - RNA, 16 nt, Homo sapiens
guaagacagugcagug

SEQ ID NO: 1663737 - RNA, 12 nt, Homo sapiens
guaaggcugugg

SEQ ID NO: 1663738 - RNA, 16 nt, Homo sapiens
guaagggaagaggucc

SEQ ID NO: 1663739 - RNA, 18 nt, Homo sapiens
guaaucuguugacagugc

SEQ ID NO: 1663740 - RNA, 23 nt, Homo sapiens
guaaugccacucauacucagagc

SEQ ID NO: 1663741 - RNA, 14 nt, Homo sapiens
guaauuguuacaau

SEQ ID NO: 1663742 - RNA, 16 nt, Homo sapiens
guacaauaaagcaaug

SEQ ID NO: 1663743 - RNA, 17 nt, Homo sapiens
guacaauaaagcaaugu

SEQ ID NO: 1663744 - RNA, 19 nt, Homo sapiens
guacaauaaagcaaugugg

SEQ ID NO: 1663745 - RNA, 21 nt, Homo sapiens
guacaauaaagcaauguggua

SEQ ID NO: 1663746 - RNA, 10 nt, Homo sapiens
guacaguacu

SEQ ID NO: 1663747 - RNA, 17 nt, Homo sapiens
guacaguuauacauacc

SEQ ID NO: 1663748 - RNA, 21 nt, Homo sapiens
guacauauggaaauccuguua

SEQ ID NO: 1663749 - RNA, 19 nt, Homo sapiens
guacaucuugugcaugcaa

SEQ ID NO: 1663750 - RNA, 19 nt, Homo sapiens
guaccucccagcaggguga

SEQ ID NO: 1663751 - RNA, 19 nt, Homo sapiens
guacgucugguguucucaa

SEQ ID NO: 1663752 - RNA, 14 nt, Homo sapiens
guacuacauuugca

SEQ ID NO: 1663753 - RNA, 15 nt, Homo sapiens
guacuacauuugcau

SEQ ID NO: 1663754 - RNA, 15 nt, Homo sapiens
guacuaccccagaac

SEQ ID NO: 1663755 - RNA, 16 nt, Homo sapiens
guacuaucuagugucu

SEQ ID NO: 1663756 - RNA, 19 nt, Homo sapiens
guacucaggcagugcagua

SEQ ID NO: 1663757 - RNA, 23 nt, Homo sapiens
guacucaggcagugcaguacuca

SEQ ID NO: 1663758 - RNA, 10 nt, Homo sapiens
guacucagua

SEQ ID NO: 1663759 - RNA, 22 nt, Homo sapiens
guacucaguaaaucagugcagu

SEQ ID NO: 1663760 - RNA, 23 nt, Homo sapiens
guacucaguaacacagugcagua

SEQ ID NO: 1663761 - RNA, 21 nt, Homo sapiens
guacucaguaacagugcagua

SEQ ID NO: 1663762 - RNA, 20 nt, Homo sapiens
guacuggagaaaauggacgu

SEQ ID NO: 1663763 - RNA, 20 nt, Homo sapiens
guacuguacuuucccagguu

SEQ ID NO: 1663764 - RNA, 14 nt, Homo sapiens
guagaaacucagca

SEQ ID NO: 1663765 - RNA, 19 nt, Homo sapiens
guagacaagcguugagcca

SEQ ID NO: 1663766 - RNA, 15 nt, Homo sapiens
guagauauuaauuaa

SEQ ID NO: 1663767 - RNA, 20 nt, Homo sapiens
guagaucaacucauguuaau

SEQ ID NO: 1663768 - RNA, 18 nt, Homo sapiens
guagccuggucugugcau

SEQ ID NO: 1663769 - RNA, 17 nt, Homo sapiens
guagcugggacuacagg

SEQ ID NO: 1663770 - RNA, 16 nt, Homo sapiens
guaggugggucuugga

SEQ ID NO: 1663771 - RNA, 16 nt, Homo sapiens
guagucauuuugccca

SEQ ID NO: 1663772 - RNA, 21 nt, Homo sapiens
guauaagguaauaaaacucug

SEQ ID NO: 1663773 - RNA, 15 nt, Homo sapiens
guauacaaguguuuc

SEQ ID NO: 1663774 - RNA, 12 nt, Homo sapiens
guauacauaugu

SEQ ID NO: 1663775 - RNA, 12 nt, Homo sapiens
guauaucagcuc

SEQ ID NO: 1663776 - RNA, 20 nt, Homo sapiens
guauauugauguaacugugu

SEQ ID NO: 1663777 - RNA, 21 nt, Homo sapiens
guaucacugcuuuuuccuuag

SEQ ID NO: 1663778 - RNA, 21 nt, Homo sapiens
guaucagaggugaaugcacag

SEQ ID NO: 1663779 - RNA, 20 nt, Homo sapiens
guaugcacuaaucaauacuu

SEQ ID NO: 1663780 - RNA, 14 nt, Homo sapiens
guaugguucucgga

SEQ ID NO: 1663781 - RNA, 18 nt, Homo sapiens
guauguagacaugcacac

SEQ ID NO: 1663782 - RNA, 19 nt, Homo sapiens
guauuugccuucuccacuu

SEQ ID NO: 1663783 - RNA, 22 nt, Homo sapiens
guauuuucaucaaguagcguug

SEQ ID NO: 1663784 - RNA, 16 nt, Homo sapiens
gucaaaauaaucugaa

SEQ ID NO: 1663785 - RNA, 15 nt, Homo sapiens
gucaaauccaugugu

SEQ ID NO: 1663786 - RNA, 23 nt, Homo sapiens
gucaaccugaauuaaagucuaca

SEQ ID NO: 1663787 - RNA, 23 nt, Homo sapiens
gucaauuuuuaacuuaucuccag

SEQ ID NO: 1663788 - RNA, 11 nt, Homo sapiens
gucacauucag

SEQ ID NO: 1663789 - RNA, 18 nt, Homo sapiens
gucaccagcuaucuguca

SEQ ID NO: 1663790 - RNA, 14 nt, Homo sapiens
gucagcacauguug

SEQ ID NO: 1663791 - RNA, 23 nt, Homo sapiens
gucagcagggggguuggguucca

SEQ ID NO: 1663792 - RNA, 11 nt, Homo sapiens
gucagccagcu

SEQ ID NO: 1663793 - RNA, 13 nt, Homo sapiens
gucagcccagugg

SEQ ID NO: 1663794 - RNA, 18 nt, Homo sapiens
gucaguagugccugugau

SEQ ID NO: 1663795 - RNA, 15 nt, Homo sapiens
gucauaccauccauc

SEQ ID NO: 1663796 - RNA, 17 nt, Homo sapiens
gucauaugugaagacag

SEQ ID NO: 1663797 - RNA, 18 nt, Homo sapiens
gucaucaacaaaagggag

SEQ ID NO: 1663798 - RNA, 19 nt, Homo sapiens
gucaucacuccucugucau

SEQ ID NO: 1663799 - RNA, 13 nt, Homo sapiens
gucaucacuuuua

SEQ ID NO: 1663800 - RNA, 12 nt, Homo sapiens
gucaucugucag

SEQ ID NO: 1663801 - RNA, 13 nt, Homo sapiens
gucauugaugaac

SEQ ID NO: 1663802 - RNA, 22 nt, Homo sapiens
guccaaaggguuuuaagccagg

SEQ ID NO: 1663803 - RNA, 20 nt, Homo sapiens
guccaacaacuccaggaaaa

SEQ ID NO: 1663804 - RNA, 16 nt, Homo sapiens
guccacauacacugca

SEQ ID NO: 1663805 - RNA, 18 nt, Homo sapiens
guccagaagagggguccg

SEQ ID NO: 1663806 - RNA, 15 nt, Homo sapiens
guccagcaaguguca

SEQ ID NO: 1663807 - RNA, 15 nt, Homo sapiens
guccaguugcagcug

SEQ ID NO: 1663808 - RNA, 18 nt, Homo sapiens
guccaucucaagugccau

SEQ ID NO: 1663809 - RNA, 17 nt, Homo sapiens
gucccaguuaacuguua

SEQ ID NO: 1663810 - RNA, 16 nt, Homo sapiens
gucccaucgcucuuag

SEQ ID NO: 1663811 - RNA, 22 nt, Homo sapiens
guccccagccugcucccuagcc

SEQ ID NO: 1663812 - RNA, 20 nt, Homo sapiens
guccccccuguggucugugu

SEQ ID NO: 1663813 - RNA, 22 nt, Homo sapiens
guccccggacgcuggcucggga

SEQ ID NO: 1663814 - RNA, 18 nt, Homo sapiens
guccccucacucugucag

SEQ ID NO: 1663815 - RNA, 15 nt, Homo sapiens
gucccgggcacuguc

SEQ ID NO: 1663816 - RNA, 15 nt, Homo sapiens
cuugaacccugagag

SEQ ID NO: 1663817 - RNA, 16 nt, Homo sapiens
cuugaagaauauuguu

SEQ ID NO: 1663818 - RNA, 20 nt, Homo sapiens
cuugaaugcuuaaaugauca

SEQ ID NO: 1663819 - RNA, 17 nt, Homo sapiens
cuugacccauguucuca

SEQ ID NO: 1663820 - RNA, 18 nt, Homo sapiens
cuugaccuggagccaucu

SEQ ID NO: 1663821 - RNA, 14 nt, Homo sapiens
cuugacuauuucac

SEQ ID NO: 1663822 - RNA, 18 nt, Homo sapiens
ggauaauaacuagaucuc

SEQ ID NO: 1663823 - RNA, 19 nt, Homo sapiens
ggauaauaacuagaucucc

SEQ ID NO: 1663824 - RNA, 14 nt, Homo sapiens
ggaucaagacauaa

SEQ ID NO: 1663825 - RNA, 17 nt, Homo sapiens
ggaucucuuaagacagc

SEQ ID NO: 1663826 - RNA, 20 nt, Homo sapiens
ggaucuguugggaaccagag

SEQ ID NO: 1663827 - RNA, 11 nt, Homo sapiens
ggaucuucaau

SEQ ID NO: 1663828 - RNA, 20 nt, Homo sapiens
ggaugaaaaaauaacacugu

SEQ ID NO: 1663829 - RNA, 23 nt, Homo sapiens
ggaugaggaaccucaaacugggu

SEQ ID NO: 1663830 - RNA, 23 nt, Homo sapiens
ggauguggccccacccuuuccuc

SEQ ID NO: 1663831 - RNA, 23 nt, Homo sapiens
ggauguggcuuaugagauacuuu

SEQ ID NO: 1663832 - RNA, 23 nt, Homo sapiens
ggauguucuagcauggcugccaa

SEQ ID NO: 1663833 - RNA, 21 nt, Homo sapiens
ggauucauguccagagcucau

SEQ ID NO: 1663834 - RNA, 17 nt, Homo sapiens
ggauugaccugugugua

SEQ ID NO: 1663835 - RNA, 22 nt, Homo sapiens
ggauugucuuacuguugcauaa

SEQ ID NO: 1663836 - RNA, 21 nt, Homo sapiens
ggcaaaaugaacuaacugcca

SEQ ID NO: 1663837 - RNA, 17 nt, Homo sapiens
ggcaacuugaggucuga

SEQ ID NO: 1663838 - RNA, 18 nt, Homo sapiens
ggcaauggugaacuguca

SEQ ID NO: 1663839 - RNA, 18 nt, Homo sapiens
ggcacaugacagugguua

SEQ ID NO: 1663840 - RNA, 22 nt, Homo sapiens
ggcaccccuuaauggaaacacg

SEQ ID NO: 1663841 - RNA, 13 nt, Homo sapiens
ggcacugucaugc

SEQ ID NO: 1663842 - RNA, 15 nt, Homo sapiens
ggcacugucaugccc

SEQ ID NO: 1663843 - RNA, 12 nt, Homo sapiens
ggcagagaagaa

SEQ ID NO: 1663844 - RNA, 14 nt, Homo sapiens
ggcagagccaucca

SEQ ID NO: 1663845 - RNA, 19 nt, Homo sapiens
ggcauaucaagguuccuga

SEQ ID NO: 1663846 - RNA, 13 nt, Homo sapiens
ggcauccaguauc

SEQ ID NO: 1663847 - RNA, 20 nt, Homo sapiens
ggcauggacaucagcaucac

SEQ ID NO: 1663848 - RNA, 21 nt, Homo sapiens
ggcauuuagcacaguauuuaa

SEQ ID NO: 1663849 - RNA, 15 nt, Homo sapiens
ggcauuuuguacaau

SEQ ID NO: 1663850 - RNA, 14 nt, Homo sapiens
ggccaaaaugcaga

SEQ ID NO: 1663851 - RNA, 14 nt, Homo sapiens
ggcccagccauggc

SEQ ID NO: 1663852 - RNA, 19 nt, Homo sapiens
ggcccagugcaaucugucc

SEQ ID NO: 1663853 - RNA, 14 nt, Homo sapiens
ggcccccacaggag

SEQ ID NO: 1663854 - RNA, 14 nt, Homo sapiens
ggcccccaccucug

SEQ ID NO: 1663855 - RNA, 22 nt, Homo sapiens
ggcccuguagcccuggcccggu

SEQ ID NO: 1663856 - RNA, 22 nt, Homo sapiens
ggcccuguuaaggcauccacuu

SEQ ID NO: 1663857 - RNA, 15 nt, Homo sapiens
ggccucagggaccaa

SEQ ID NO: 1663858 - RNA, 20 nt, Homo sapiens
ggccucagguccuacugggg

SEQ ID NO: 1663859 - RNA, 22 nt, Homo sapiens
ggccugagcgaugggcaucaca

SEQ ID NO: 1663860 - RNA, 15 nt, Homo sapiens
ggccugcacucuuau

SEQ ID NO: 1663861 - RNA, 15 nt, Homo sapiens
ggccuggcccagcca

SEQ ID NO: 1663862 - RNA, 14 nt, Homo sapiens
ggcgugacuucaga

SEQ ID NO: 1663863 - RNA, 23 nt, Homo sapiens
ggcuacgugaauagcgcccucaa

SEQ ID NO: 1663864 - RNA, 21 nt, Homo sapiens
ggcuagucugugccucaguga

SEQ ID NO: 1663865 - RNA, 15 nt, Homo sapiens
ggcuaugugagcaca

SEQ ID NO: 1663866 - RNA, 19 nt, Homo sapiens
ggcucaaacaacauuccac

SEQ ID NO: 1663867 - RNA, 14 nt, Homo sapiens
ggcucaaucucggc

SEQ ID NO: 1663868 - RNA, 15 nt, Homo sapiens
ggcucaggcugccca

SEQ ID NO: 1663869 - RNA, 19 nt, Homo sapiens
ggcuccaucuccaguggga

SEQ ID NO: 1663870 - RNA, 14 nt, Homo sapiens
ggcucccacugccc

SEQ ID NO: 1663871 - RNA, 13 nt, Homo sapiens
ggcuccucaccac

SEQ ID NO: 1663872 - RNA, 15 nt, Homo sapiens
ggcuccuuaguuuau

SEQ ID NO: 1663873 - RNA, 19 nt, Homo sapiens
ggcucguguuucacagugg

SEQ ID NO: 1663874 - RNA, 15 nt, Homo sapiens
ggcucuaauguacaa

SEQ ID NO: 1663875 - RNA, 17 nt, Homo sapiens
ggcugaagaaacacagc

SEQ ID NO: 1663876 - RNA, 15 nt, Homo sapiens
ggcuggagugcagug

SEQ ID NO: 1663877 - RNA, 16 nt, Homo sapiens
ggcuggagugcagugg

SEQ ID NO: 1663878 - RNA, 20 nt, Homo sapiens
ggcuggagugcaguggcgcg

SEQ ID NO: 1663879 - RNA, 18 nt, Homo sapiens
ggcuggaugugcuuucau

SEQ ID NO: 1663880 - RNA, 17 nt, Homo sapiens
ggcuggggacacaggau

SEQ ID NO: 1663881 - RNA, 18 nt, Homo sapiens
ggcuguacgucugguguu

SEQ ID NO: 1663882 - RNA, 16 nt, Homo sapiens
ggcuuagaauggggcu

SEQ ID NO: 1663883 - RNA, 22 nt, Homo sapiens
ggcuucccaaaguccugggauu

SEQ ID NO: 1663884 - RNA, 13 nt, Homo sapiens
ggcuuggggacca

SEQ ID NO: 1663885 - RNA, 23 nt, Homo sapiens
ggcuuuggacuccuuguuugccu

SEQ ID NO: 1663886 - RNA, 23 nt, Homo sapiens
gggaaaggcagggcccugaaaug

SEQ ID NO: 1663887 - RNA, 19 nt, Homo sapiens
gggaacagcauaugcaaag

SEQ ID NO: 1663888 - RNA, 16 nt, Homo sapiens
gggaaggccugaggga

SEQ ID NO: 1663889 - RNA, 16 nt, Homo sapiens
gggacaacguccuucc

SEQ ID NO: 1663890 - RNA, 18 nt, Homo sapiens
gggacagccugcacagug

SEQ ID NO: 1663891 - RNA, 16 nt, Homo sapiens
gggacuccaagcccug

SEQ ID NO: 1663892 - RNA, 20 nt, Homo sapiens
gggagaaacgaaaaccacaa

SEQ ID NO: 1663893 - RNA, 13 nt, Homo sapiens
gggagacugagcu

SEQ ID NO: 1663894 - RNA, 18 nt, Homo sapiens
gggagauuaaaaccagag

SEQ ID NO: 1663895 - RNA, 19 nt, Homo sapiens
gggagggguuaaugcagau

SEQ ID NO: 1663896 - RNA, 12 nt, Homo sapiens
gggagugccacu

SEQ ID NO: 1663897 - RNA, 14 nt, Homo sapiens
gggagugugccuug

SEQ ID NO: 1663898 - RNA, 16 nt, Homo sapiens
gggauaaagaggguga

SEQ ID NO: 1663899 - RNA, 13 nt, Homo sapiens
gggcaacugauga

SEQ ID NO: 1663900 - RNA, 20 nt, Homo sapiens
gggcacagaaaauggaagac

SEQ ID NO: 1663901 - RNA, 23 nt, Homo sapiens
gggcacagauccccccacaaagu

SEQ ID NO: 1663902 - RNA, 14 nt, Homo sapiens
gggcacagccagaa

SEQ ID NO: 1663903 - RNA, 14 nt, Homo sapiens
gggcaccugaccac

SEQ ID NO: 1663904 - RNA, 21 nt, Homo sapiens
gggcaccuugaaaaaagaaca

SEQ ID NO: 1663905 - RNA, 14 nt, Homo sapiens
gggcagaggccaug

SEQ ID NO: 1663906 - RNA, 15 nt, Homo sapiens
gggcaggccucccaa

SEQ ID NO: 1663907 - RNA, 23 nt, Homo sapiens
gggccaagccaggguuccagaca

SEQ ID NO: 1663908 - RNA, 21 nt, Homo sapiens
gggccacugcuugaagaagaa

SEQ ID NO: 1663909 - RNA, 19 nt, Homo sapiens
gggccauuucacauuccug

SEQ ID NO: 1663910 - RNA, 19 nt, Homo sapiens
gggccgccuccuccagacu

SEQ ID NO: 1663911 - RNA, 14 nt, Homo sapiens
gggcuggccugaca

SEQ ID NO: 1663912 - RNA, 11 nt, Homo sapiens
gggcuggugac

SEQ ID NO: 1663913 - RNA, 22 nt, Homo sapiens
ggggaccgccccaggcaccgcc

SEQ ID NO: 1663914 - RNA, 14 nt, Homo sapiens
ggggcacuguuucu

SEQ ID NO: 1663915 - RNA, 16 nt, Homo sapiens
ggggccuagacucugu

SEQ ID NO: 1663916 - RNA, 23 nt, Homo sapiens
ggggucuuugaacacaccucucu

SEQ ID NO: 1663917 - RNA, 12 nt, Homo sapiens
ggguagugccau

SEQ ID NO: 1663918 - RNA, 18 nt, Homo sapiens
ggguccucaguccacugc

SEQ ID NO: 1663919 - RNA, 17 nt, Homo sapiens
gggugcugucaugccca

SEQ ID NO: 1663920 - RNA, 17 nt, Homo sapiens
gggugggccccacagug

SEQ ID NO: 1663921 - RNA, 20 nt, Homo sapiens
ggguugguauggaguuggca

SEQ ID NO: 1663922 - RNA, 16 nt, Homo sapiens
gguaaguaaacaguca

SEQ ID NO: 1663923 - RNA, 17 nt, Homo sapiens
gguaaguaaacagucag

SEQ ID NO: 1663924 - RNA, 23 nt, Homo sapiens
gguacucaguaacacagugcagu

SEQ ID NO: 1663925 - RNA, 14 nt, Homo sapiens
gguagacugugaca

SEQ ID NO: 1663926 - RNA, 18 nt, Homo sapiens
gguagagagaaacagcuu

SEQ ID NO: 1663927 - RNA, 21 nt, Homo sapiens
gguagcuuaccugacacaaga

SEQ ID NO: 1663928 - RNA, 17 nt, Homo sapiens
gguaucugaugauguuc

SEQ ID NO: 1663929 - RNA, 14 nt, Homo sapiens
ggucaaggcaaagc

SEQ ID NO: 1663930 - RNA, 14 nt, Homo sapiens
ggucaauuccuuag

SEQ ID NO: 1663931 - RNA, 14 nt, Homo sapiens
cugaacacucaucc

SEQ ID NO: 1663932 - RNA, 12 nt, Homo sapiens
cugaaccagaga

SEQ ID NO: 1663933 - RNA, 14 nt, Homo sapiens
cugaacucccaguc

SEQ ID NO: 1663934 - RNA, 15 nt, Homo sapiens
cugaagcagagucaa

SEQ ID NO: 1663935 - RNA, 18 nt, Homo sapiens
cugaagcguuacuacagc

SEQ ID NO: 1663936 - RNA, 20 nt, Homo sapiens
cugaagucuuuguacagaca

SEQ ID NO: 1663937 - RNA, 15 nt, Homo sapiens
cugaaguuucauuua

SEQ ID NO: 1663938 - RNA, 14 nt, Homo sapiens
cugaaugacaucaa

SEQ ID NO: 1663939 - RNA, 21 nt, Homo sapiens
cugaauuaaagucuacacugc

SEQ ID NO: 1663940 - RNA, 21 nt, Homo sapiens
cugaauucuuuuucucagcaa

SEQ ID NO: 1663941 - RNA, 17 nt, Homo sapiens
cugacaaauuuuaauua

SEQ ID NO: 1663942 - RNA, 11 nt, Homo sapiens
cugacacaaga

SEQ ID NO: 1663943 - RNA, 23 nt, Homo sapiens
cugacagccuccaccuugagcac

SEQ ID NO: 1663944 - RNA, 18 nt, Homo sapiens
cugacauucacacagaga

SEQ ID NO: 1663945 - RNA, 16 nt, Homo sapiens
cugacgcaaaaccacu

SEQ ID NO: 1663946 - RNA, 17 nt, Homo sapiens
cugagaauccaaacauc

SEQ ID NO: 1663947 - RNA, 18 nt, Homo sapiens
cugagacacagcccagag

SEQ ID NO: 1663948 - RNA, 19 nt, Homo sapiens
cugagauagcuuagugucu

SEQ ID NO: 1663949 - RNA, 13 nt, Homo sapiens
cugagcagugggg

SEQ ID NO: 1663950 - RNA, 19 nt, Homo sapiens
cugagccuggcccauagaa

SEQ ID NO: 1663951 - RNA, 20 nt, Homo sapiens
cugagcgaugggcaucacac

SEQ ID NO: 1663952 - RNA, 22 nt, Homo sapiens
cugaggauaccuuccaucucaa

SEQ ID NO: 1663953 - RNA, 15 nt, Homo sapiens
cugaggucaucugua

SEQ ID NO: 1663954 - RNA, 23 nt, Homo sapiens
cugauacaauuugcccaagguaa

SEQ ID NO: 1663955 - RNA, 19 nt, Homo sapiens
cugauaugaccccaguuca

SEQ ID NO: 1663956 - RNA, 17 nt, Homo sapiens
cugauaugggacugagc

SEQ ID NO: 1663957 - RNA, 18 nt, Homo sapiens
cugauaugggacugagcc

SEQ ID NO: 1663958 - RNA, 22 nt, Homo sapiens
cugaucaaggugcucuucucau

SEQ ID NO: 1663959 - RNA, 13 nt, Homo sapiens
cugaugcacuguu

SEQ ID NO: 1663960 - RNA, 22 nt, Homo sapiens
cugauggccaggccucagggac

SEQ ID NO: 1663961 - RNA, 12 nt, Homo sapiens
cugaugguugcu

SEQ ID NO: 1663962 - RNA, 13 nt, Homo sapiens
cugcaacacugga

SEQ ID NO: 1663963 - RNA, 14 nt, Homo sapiens
cugcaacaguggug

SEQ ID NO: 1663964 - RNA, 21 nt, Homo sapiens
cugcaagucuccuagaagccc

SEQ ID NO: 1663965 - RNA, 11 nt, Homo sapiens
cugcacagugg

SEQ ID NO: 1663966 - RNA, 23 nt, Homo sapiens
cugcacucuuauuucacuaaaga

SEQ ID NO: 1663967 - RNA, 15 nt, Homo sapiens
cugcacuuacaggcc

SEQ ID NO: 1663968 - RNA, 17 nt, Homo sapiens
cugcagaugacuggaaa

SEQ ID NO: 1663969 - RNA, 12 nt, Homo sapiens
cugcaguuauuu

SEQ ID NO: 1663970 - RNA, 18 nt, Homo sapiens
cugcaucaagaugugaca

SEQ ID NO: 1663971 - RNA, 18 nt, Homo sapiens
cugcaucuccccucagau

SEQ ID NO: 1663972 - RNA, 15 nt, Homo sapiens
cugcauuuuacugua

SEQ ID NO: 1663973 - RNA, 16 nt, Homo sapiens
cugccaagaguccaag

SEQ ID NO: 1663974 - RNA, 22 nt, Homo sapiens
cugcccacgcuaguuccaucca

SEQ ID NO: 1663975 - RNA, 22 nt, Homo sapiens
cugcccacgucccgggcacugu

SEQ ID NO: 1663976 - RNA, 18 nt, Homo sapiens
cugcccagagccacagaa

SEQ ID NO: 1663977 - RNA, 19 nt, Homo sapiens
cugcccagagccacagaaa

SEQ ID NO: 1663978 - RNA, 12 nt, Homo sapiens
cugccccagaga

SEQ ID NO: 1663979 - RNA, 21 nt, Homo sapiens
cugccccaggcucaggcugcc

SEQ ID NO: 1663980 - RNA, 15 nt, Homo sapiens
cugcccgcacacccu

SEQ ID NO: 1663981 - RNA, 16 nt, Homo sapiens
cugcccuuaccugcca

SEQ ID NO: 1663982 - RNA, 12 nt, Homo sapiens
cugccgcugcuu

SEQ ID NO: 1663983 - RNA, 21 nt, Homo sapiens
cugccuccacuugccuuguga

SEQ ID NO: 1663984 - RNA, 14 nt, Homo sapiens
cugccugcagagca

SEQ ID NO: 1663985 - RNA, 20 nt, Homo sapiens
cugccuguggugagguccug

SEQ ID NO: 1663986 - RNA, 18 nt, Homo sapiens
cugccuguugggccagga

SEQ ID NO: 1663987 - RNA, 16 nt, Homo sapiens
cugcgccugacauuca

SEQ ID NO: 1663988 - RNA, 21 nt, Homo sapiens
cugcgcuccucugcagccuga

SEQ ID NO: 1663989 - RNA, 13 nt, Homo sapiens
cugcuccaugcag

SEQ ID NO: 1663990 - RNA, 17 nt, Homo sapiens
cugcuccuacaagggaa

SEQ ID NO: 1663991 - RNA, 18 nt, Homo sapiens
cugcucgggaaggccuga

SEQ ID NO: 1663992 - RNA, 18 nt, Homo sapiens
cugcugaccauuugguca

SEQ ID NO: 1663993 - RNA, 15 nt, Homo sapiens
cugcugcacugcccu

SEQ ID NO: 1663994 - RNA, 14 nt, Homo sapiens
cugcuggucuucaa

SEQ ID NO: 1663995 - RNA, 14 nt, Homo sapiens
cugcuguaucuuua

SEQ ID NO: 1663996 - RNA, 17 nt, Homo sapiens
cugcuguggcaucagga

SEQ ID NO: 1663997 - RNA, 14 nt, Homo sapiens
cugcuuaguaucuc

SEQ ID NO: 1663998 - RNA, 20 nt, Homo sapiens
cugcuucacgauucuuaccc

SEQ ID NO: 1663999 - RNA, 13 nt, Homo sapiens
cugcuucucagcg

SEQ ID NO: 1664000 - RNA, 14 nt, Homo sapiens
cugcuugugcacug

SEQ ID NO: 1664001 - RNA, 16 nt, Homo sapiens
cugcuugugcacugga

SEQ ID NO: 1664002 - RNA, 14 nt, Homo sapiens
cugcuuucuuguug

SEQ ID NO: 1664003 - RNA, 17 nt, Homo sapiens
cugcuuucuuguugcug

SEQ ID NO: 1664004 - RNA, 13 nt, Homo sapiens
cuggaaauaaccu

SEQ ID NO: 1664005 - RNA, 21 nt, Homo sapiens
cuggaaauaacugagcacuuu

SEQ ID NO: 1664006 - RNA, 20 nt, Homo sapiens
cuggaaggcuuuauucuucc

SEQ ID NO: 1664007 - RNA, 19 nt, Homo sapiens
cuggaauaagaagcaaaua

SEQ ID NO: 1664008 - RNA, 13 nt, Homo sapiens
cuggaaucaaaua

SEQ ID NO: 1664009 - RNA, 14 nt, Homo sapiens
cuggacagggcuuu

SEQ ID NO: 1664010 - RNA, 22 nt, Homo sapiens
cuggaggaacugcuugugcacu

SEQ ID NO: 1664011 - RNA, 21 nt, Homo sapiens
cuggagggaagcaccaugaau

SEQ ID NO: 1664012 - RNA, 23 nt, Homo sapiens
cuggagggaauccauaucagcuc

SEQ ID NO: 1664013 - RNA, 12 nt, Homo sapiens
cuggagugcagu

SEQ ID NO: 1664014 - RNA, 13 nt, Homo sapiens
cuggagugcagug

SEQ ID NO: 1664015 - RNA, 21 nt, Homo sapiens
cuggauguggccccacccuuu

SEQ ID NO: 1664016 - RNA, 23 nt, Homo sapiens
cuggauuccucuaagaucuugcc

SEQ ID NO: 1664017 - RNA, 20 nt, Homo sapiens
cuggcagaguugaagacaga

SEQ ID NO: 1664018 - RNA, 21 nt, Homo sapiens
cuggcaugggaaugaauguca

SEQ ID NO: 1664019 - RNA, 22 nt, Homo sapiens
cuggcauuacaggugugagcca

SEQ ID NO: 1664020 - RNA, 21 nt, Homo sapiens
cuggccaaaaugcagacauuu

SEQ ID NO: 1664021 - RNA, 14 nt, Homo sapiens
cuggccacacugga

SEQ ID NO: 1664022 - RNA, 21 nt, Homo sapiens
cuggccauuuaacuagcacuu

SEQ ID NO: 1664023 - RNA, 13 nt, Homo sapiens
cuggccccaggcg

SEQ ID NO: 1664024 - RNA, 17 nt, Homo sapiens
cuggccuaccacagcug

SEQ ID NO: 1664025 - RNA, 18 nt, Homo sapiens
cuggccugagaauugagg

SEQ ID NO: 1664026 - RNA, 15 nt, Homo sapiens
cuggcucacagccac

SEQ ID NO: 1664027 - RNA, 22 nt, Homo sapiens
cuggcugagugcgaccaccacu

SEQ ID NO: 1664028 - RNA, 19 nt, Homo sapiens
cuggcuucaccgcauucca

SEQ ID NO: 1664029 - RNA, 20 nt, Homo sapiens
cuggcuucaccgcauuccag

SEQ ID NO: 1664030 - RNA, 23 nt, Homo sapiens
cuggcuuuacauggguucaauug

SEQ ID NO: 1664031 - RNA, 18 nt, Homo sapiens
cugggaagaauguauucg

SEQ ID NO: 1664032 - RNA, 17 nt, Homo sapiens
cugggacagccacugga

SEQ ID NO: 1664033 - RNA, 17 nt, Homo sapiens
cugggaccucccacugc

SEQ ID NO: 1664034 - RNA, 16 nt, Homo sapiens
cugggagaaaagccag

SEQ ID NO: 1664035 - RNA, 17 nt, Homo sapiens
cugggagaaccaaaaag

SEQ ID NO: 1664036 - RNA, 18 nt, Homo sapiens
cugggagaaccaaaaaga

SEQ ID NO: 1664037 - RNA, 16 nt, Homo sapiens
cugggagcccucaggc

SEQ ID NO: 1664038 - RNA, 15 nt, Homo sapiens
cugggauuacaggug

SEQ ID NO: 1664039 - RNA, 21 nt, Homo sapiens
cugggcagaaggaagacuuca

SEQ ID NO: 1664040 - RNA, 22 nt, Homo sapiens
cugggcagaggaaagcaaagga

SEQ ID NO: 1664041 - RNA, 16 nt, Homo sapiens
cugggcccuaggcaua

SEQ ID NO: 1664042 - RNA, 15 nt, Homo sapiens
cugggccucaguuca

SEQ ID NO: 1664043 - RNA, 16 nt, Homo sapiens
aacuuuuuauucucag

SEQ ID NO: 1664044 - RNA, 22 nt, Homo sapiens
aacuuuuuuuuaguauuugccc

SEQ ID NO: 1664045 - RNA, 15 nt, Homo sapiens
aagaaaaaagugcaa

SEQ ID NO: 1664046 - RNA, 16 nt, Homo sapiens
aagaaaauggaugaca

SEQ ID NO: 1664047 - RNA, 14 nt, Homo sapiens
aagaaacauucaga

SEQ ID NO: 1664048 - RNA, 15 nt, Homo sapiens
aagaaagauugcuau

SEQ ID NO: 1664049 - RNA, 16 nt, Homo sapiens
aagaaagauugcuaua

SEQ ID NO: 1664050 - RNA, 21 nt, Homo sapiens
aagaaauccugugugucgcuu

SEQ ID NO: 1664051 - RNA, 23 nt, Homo sapiens
aagaaauggcuuuccacaucccc

SEQ ID NO: 1664052 - RNA, 20 nt, Homo sapiens
aagaaauuagggcucuaauu

SEQ ID NO: 1664053 - RNA, 13 nt, Homo sapiens
aagaagcaugagg

SEQ ID NO: 1664054 - RNA, 15 nt, Homo sapiens
aagaaguuugaccau

SEQ ID NO: 1664055 - RNA, 14 nt, Homo sapiens
aagaauaaaaugca

SEQ ID NO: 1664056 - RNA, 18 nt, Homo sapiens
aagaauaauaauggcuaa

SEQ ID NO: 1664057 - RNA, 14 nt, Homo sapiens
aagaauuaaugaca

SEQ ID NO: 1664058 - RNA, 12 nt, Homo sapiens
aagaauucauga

SEQ ID NO: 1664059 - RNA, 21 nt, Homo sapiens
aagaauuuuaauauugccaua

SEQ ID NO: 1664060 - RNA, 16 nt, Homo sapiens
aagacacuuuuaccga

SEQ ID NO: 1664061 - RNA, 18 nt, Homo sapiens
aagacaguaaagaccauu

SEQ ID NO: 1664062 - RNA, 13 nt, Homo sapiens
aagacagugcagu

SEQ ID NO: 1664063 - RNA, 17 nt, Homo sapiens
aagacaguuucuugcaa

SEQ ID NO: 1664064 - RNA, 21 nt, Homo sapiens
aagacuggcauggacaucagc

SEQ ID NO: 1664065 - RNA, 17 nt, Homo sapiens
aagacugguauucucuu

SEQ ID NO: 1664066 - RNA, 14 nt, Homo sapiens
aagagaaaugagcu

SEQ ID NO: 1664067 - RNA, 20 nt, Homo sapiens
aagagaccacccauaucaug

SEQ ID NO: 1664068 - RNA, 12 nt, Homo sapiens
aagagcugaaaa

SEQ ID NO: 1664069 - RNA, 16 nt, Homo sapiens
aagaggauugagauaa

SEQ ID NO: 1664070 - RNA, 19 nt, Homo sapiens
aagagggggcaagucacau

SEQ ID NO: 1664071 - RNA, 17 nt, Homo sapiens
aagaguccaagaagcca

SEQ ID NO: 1664072 - RNA, 15 nt, Homo sapiens
aagaguuauaugacu

SEQ ID NO: 1664073 - RNA, 16 nt, Homo sapiens
aagaucaaacuuccau

SEQ ID NO: 1664074 - RNA, 16 nt, Homo sapiens
aagauccugucuugcu

SEQ ID NO: 1664075 - RNA, 19 nt, Homo sapiens
aagauccugucuugcugag

SEQ ID NO: 1664076 - RNA, 22 nt, Homo sapiens
aagauggcuuccgugagacaca

SEQ ID NO: 1664077 - RNA, 12 nt, Homo sapiens
aagauuaauuaa

SEQ ID NO: 1664078 - RNA, 19 nt, Homo sapiens
aagauugauuaaugaacua

SEQ ID NO: 1664079 - RNA, 12 nt, Homo sapiens
aagauugcuaua

SEQ ID NO: 1664080 - RNA, 18 nt, Homo sapiens
aagcaaacacacucucac

SEQ ID NO: 1664081 - RNA, 20 nt, Homo sapiens
aagcaauccucccacuucag

SEQ ID NO: 1664082 - RNA, 24 nt, Homo sapiens
aagcacaaccauguucuugagcag

SEQ ID NO: 1664083 - RNA, 21 nt, Homo sapiens
aagcacaugccucucucaggc

SEQ ID NO: 1664084 - RNA, 13 nt, Homo sapiens
aagcacuagccuu

SEQ ID NO: 1664085 - RNA, 16 nt, Homo sapiens
aagcacuagccuuccc

SEQ ID NO: 1664086 - RNA, 18 nt, Homo sapiens
aagcagcacacauugugu

SEQ ID NO: 1664087 - RNA, 23 nt, Homo sapiens
aagcaugcucaguauugagacac

SEQ ID NO: 1664088 - RNA, 22 nt, Homo sapiens
aagcauuacccauaggucuuaa

SEQ ID NO: 1664089 - RNA, 18 nt, Homo sapiens
aagccagcaggcucucag

SEQ ID NO: 1664090 - RNA, 19 nt, Homo sapiens
aagccagcaggcucucagg

SEQ ID NO: 1664091 - RNA, 18 nt, Homo sapiens
aagccaggguuccagaca

SEQ ID NO: 1664092 - RNA, 12 nt, Homo sapiens
aagccaguuucc

SEQ ID NO: 1664093 - RNA, 21 nt, Homo sapiens
aagccauuuccacuacaguga

SEQ ID NO: 1664094 - RNA, 22 nt, Homo sapiens
aagccauuuccacuacagugag

SEQ ID NO: 1664095 - RNA, 21 nt, Homo sapiens
aagcccagccuaucucucuuc

SEQ ID NO: 1664096 - RNA, 22 nt, Homo sapiens
aagcccagccuaucucucuucu

SEQ ID NO: 1664097 - RNA, 13 nt, Homo sapiens
aagcccucugagc

SEQ ID NO: 1664098 - RNA, 16 nt, Homo sapiens
aagccuaugugccuuu

SEQ ID NO: 1664099 - RNA, 12 nt, Homo sapiens
aagccugaugau

SEQ ID NO: 1664100 - RNA, 22 nt, Homo sapiens
aagccugggcagaaaugugcug

SEQ ID NO: 1664101 - RNA, 15 nt, Homo sapiens
aagccuuccucaaga

SEQ ID NO: 1664102 - RNA, 22 nt, Homo sapiens
aagcgugguggacaugcacagc

SEQ ID NO: 1664103 - RNA, 11 nt, Homo sapiens
aagcuacauau

SEQ ID NO: 1664104 - RNA, 22 nt, Homo sapiens
aagcucagucgucccagcagca

SEQ ID NO: 1664105 - RNA, 13 nt, Homo sapiens
auugggcaccuga

SEQ ID NO: 1664106 - RNA, 18 nt, Homo sapiens
auuguagaaacucagcag

SEQ ID NO: 1664107 - RNA, 18 nt, Homo sapiens
auuguauaauuaugaagc

SEQ ID NO: 1664108 - RNA, 16 nt, Homo sapiens
auugucaugacuuuca

SEQ ID NO: 1664109 - RNA, 16 nt, Homo sapiens
auuguccccaaugaau

SEQ ID NO: 1664110 - RNA, 14 nt, Homo sapiens
auugucucaaagac

SEQ ID NO: 1664111 - RNA, 14 nt, Homo sapiens
auugucuuacuguu

SEQ ID NO: 1664112 - RNA, 18 nt, Homo sapiens
auuguuacagguguacua

SEQ ID NO: 1664113 - RNA, 14 nt, Homo sapiens
auuguuagucucuu

SEQ ID NO: 1664114 - RNA, 21 nt, Homo sapiens
auuguucuuguaaaacuguga

SEQ ID NO: 1664115 - RNA, 21 nt, Homo sapiens
auuguucuuuuuuaagacuca

SEQ ID NO: 1664116 - RNA, 15 nt, Homo sapiens
auuguuuacagagcu

SEQ ID NO: 1664117 - RNA, 20 nt, Homo sapiens
auuuaaaaucagacucuuua

SEQ ID NO: 1664118 - RNA, 16 nt, Homo sapiens
auuuaagggugcaugu

SEQ ID NO: 1664119 - RNA, 16 nt, Homo sapiens
auuuaaucauuuccag

SEQ ID NO: 1664120 - RNA, 13 nt, Homo sapiens
auuuaccaaauag

SEQ ID NO: 1664121 - RNA, 17 nt, Homo sapiens
auuuaccugaagucuuu

SEQ ID NO: 1664122 - RNA, 15 nt, Homo sapiens
auuuagaaacaguga

SEQ ID NO: 1664123 - RNA, 13 nt, Homo sapiens
auuuagagaugau

SEQ ID NO: 1664124 - RNA, 20 nt, Homo sapiens
auuuaguaaaauuaucuguu

SEQ ID NO: 1664125 - RNA, 14 nt, Homo sapiens
auuuaguuccauaa

SEQ ID NO: 1664126 - RNA, 21 nt, Homo sapiens
auuuaugaauaaauauuacaa

SEQ ID NO: 1664127 - RNA, 12 nt, Homo sapiens
auuuauucucag

SEQ ID NO: 1664128 - RNA, 23 nt, Homo sapiens
auuucagguuaaauuaaaccaag

SEQ ID NO: 1664129 - RNA, 21 nt, Homo sapiens
auuuccaaaccuccacugcug

SEQ ID NO: 1664130 - RNA, 11 nt, Homo sapiens
auuuccagggg

SEQ ID NO: 1664131 - RNA, 11 nt, Homo sapiens
auuuccaugga

SEQ ID NO: 1664132 - RNA, 14 nt, Homo sapiens
auuuccauggugcc

SEQ ID NO: 1664133 - RNA, 21 nt, Homo sapiens
auuuccgugagagucaucuca

SEQ ID NO: 1664134 - RNA, 15 nt, Homo sapiens
auuuccuuaaagcaa

SEQ ID NO: 1664135 - RNA, 20 nt, Homo sapiens
auuugagagaagccacgcug

SEQ ID NO: 1664136 - RNA, 16 nt, Homo sapiens
auuuggacagccaagg

SEQ ID NO: 1664137 - RNA, 14 nt, Homo sapiens
auuuuaaaauugca

SEQ ID NO: 1664138 - RNA, 17 nt, Homo sapiens
auuuuaguuaacuauga

SEQ ID NO: 1664139 - RNA, 22 nt, Homo sapiens
auuuucaagacacagacaaagu

SEQ ID NO: 1664140 - RNA, 20 nt, Homo sapiens
auuuucaaguggaaaccuug

SEQ ID NO: 1664141 - RNA, 22 nt, Homo sapiens
auuuucauguucuugcagucau

SEQ ID NO: 1664142 - RNA, 14 nt, Homo sapiens
auuuuccaauuaau

SEQ ID NO: 1664143 - RNA, 17 nt, Homo sapiens
auuuucuauuuuaguua

SEQ ID NO: 1664144 - RNA, 15 nt, Homo sapiens
auuuuggacguguga

SEQ ID NO: 1664145 - RNA, 18 nt, Homo sapiens
auuuuguauaaaugggaa

SEQ ID NO: 1664146 - RNA, 14 nt, Homo sapiens
auuuuguuucacau

SEQ ID NO: 1664147 - RNA, 13 nt, Homo sapiens
auuuuuauauuca

SEQ ID NO: 1664148 - RNA, 17 nt, Homo sapiens
auuuuucacugccccag

SEQ ID NO: 1664149 - RNA, 14 nt, Homo sapiens
auuuuucuguuacc

SEQ ID NO: 1664150 - RNA, 18 nt, Homo sapiens
auuuuuugucugugauaa

SEQ ID NO: 1664151 - RNA, 22 nt, Homo sapiens
caaaaaaaaaaaaacaaaagaa

SEQ ID NO: 1664152 - RNA, 13 nt, Homo sapiens
caaaaaacagaaa

SEQ ID NO: 1664153 - RNA, 13 nt, Homo sapiens
caaaaaucaucaa

SEQ ID NO: 1664154 - RNA, 15 nt, Homo sapiens
caaaaaugaauucac

SEQ ID NO: 1664155 - RNA, 20 nt, Homo sapiens
caaaaauuauauuuugaaca

SEQ ID NO: 1664156 - RNA, 22 nt, Homo sapiens
caaaacaaacaaccugccacaa

SEQ ID NO: 1664157 - RNA, 13 nt, Homo sapiens
caaaacauaucuu

SEQ ID NO: 1664158 - RNA, 16 nt, Homo sapiens
caaaaccaacucucua

SEQ ID NO: 1664159 - RNA, 17 nt, Homo sapiens
caaaaccaacucucuac

SEQ ID NO: 1664160 - RNA, 14 nt, Homo sapiens
caaaaccuugcaca

SEQ ID NO: 1664161 - RNA, 18 nt, Homo sapiens
caaaagauaaaacuaauu

SEQ ID NO: 1664162 - RNA, 18 nt, Homo sapiens
caaaagcaauuguauuac

SEQ ID NO: 1664163 - RNA, 23 nt, Homo sapiens
caaaaggcuggaugugcuuucau

SEQ ID NO: 1664164 - RNA, 15 nt, Homo sapiens
caaaagggacacaua

SEQ ID NO: 1664165 - RNA, 13 nt, Homo sapiens
caaaauaaucuga

SEQ ID NO: 1664166 - RNA, 14 nt, Homo sapiens
caaaauccuugccu

SEQ ID NO: 1664167 - RNA, 15 nt, Homo sapiens
caaaaugcaaaccaa

SEQ ID NO: 1664168 - RNA, 11 nt, Homo sapiens
caaaaugcaga

SEQ ID NO: 1664169 - RNA, 12 nt, Homo sapiens
caaaaugcagac

SEQ ID NO: 1664170 - RNA, 18 nt, Homo sapiens
caaacaaaaacuguugcu

SEQ ID NO: 1664171 - RNA, 15 nt, Homo sapiens
caaacaaacaaaaag

SEQ ID NO: 1664172 - RNA, 19 nt, Homo sapiens
caaacacugcuuaaggaaa

SEQ ID NO: 1664173 - RNA, 15 nt, Homo sapiens
caaaccacaacugac

SEQ ID NO: 1664174 - RNA, 16 nt, Homo sapiens
caaaccacaacugaca

SEQ ID NO: 1664175 - RNA, 16 nt, Homo sapiens
caaaccaggccuccaa

SEQ ID NO: 1664176 - RNA, 22 nt, Homo sapiens
caaaccggccaacacuuaggga

SEQ ID NO: 1664177 - RNA, 17 nt, Homo sapiens
caaaccucucagcacua

SEQ ID NO: 1664178 - RNA, 17 nt, Homo sapiens
caaacuccugaccucaa

SEQ ID NO: 1664179 - RNA, 15 nt, Homo sapiens
caaacuucccagaga

SEQ ID NO: 1664180 - RNA, 22 nt, Homo sapiens
caaacuuuuccuggacacuuua

SEQ ID NO: 1664181 - RNA, 18 nt, Homo sapiens
caaagaaucaacagugaa

SEQ ID NO: 1664182 - RNA, 19 nt, Homo sapiens
caaagaggauugagauaac

SEQ ID NO: 1664183 - RNA, 22 nt, Homo sapiens
caaagaggccaguacuuugcca

SEQ ID NO: 1664184 - RNA, 13 nt, Homo sapiens
caaagauccagcg

SEQ ID NO: 1664185 - RNA, 21 nt, Homo sapiens
caaagauuugacaugcuccac

SEQ ID NO: 1664186 - RNA, 20 nt, Homo sapiens
caaagcacuggccuugccuc

SEQ ID NO: 1664187 - RNA, 23 nt, Homo sapiens
caaagcgugguggacaugcacag

SEQ ID NO: 1664188 - RNA, 23 nt, Homo sapiens
caaagcucuuuugagcauuuaga

SEQ ID NO: 1664189 - RNA, 15 nt, Homo sapiens
caaaggaagcacaug

SEQ ID NO: 1664190 - RNA, 13 nt, Homo sapiens
caaaggacaguac

SEQ ID NO: 1664191 - RNA, 18 nt, Homo sapiens
caaaggcccccaucacac

SEQ ID NO: 1664192 - RNA, 19 nt, Homo sapiens
caaaggcccccaucacacu

SEQ ID NO: 1664193 - RNA, 22 nt, Homo sapiens
caaaggccguuagggaaaucca

SEQ ID NO: 1664194 - RNA, 13 nt, Homo sapiens
ccagcugcuuggg

SEQ ID NO: 1664195 - RNA, 18 nt, Homo sapiens
ccagcuuaugagcucaaa

SEQ ID NO: 1664196 - RNA, 23 nt, Homo sapiens
ccaggaaguaauuuucuucucau

SEQ ID NO: 1664197 - RNA, 13 nt, Homo sapiens
ccaggacacugcc

SEQ ID NO: 1664198 - RNA, 14 nt, Homo sapiens
ccaggacacugccu

SEQ ID NO: 1664199 - RNA, 17 nt, Homo sapiens
ccaggagaaagaaggcu

SEQ ID NO: 1664200 - RNA, 18 nt, Homo sapiens
ccaggccggccagccuca

SEQ ID NO: 1664201 - RNA, 14 nt, Homo sapiens
ccaggccucaggga

SEQ ID NO: 1664202 - RNA, 15 nt, Homo sapiens
ccaggccucagggac

SEQ ID NO: 1664203 - RNA, 17 nt, Homo sapiens
ccaggcucaggcugccc

SEQ ID NO: 1664204 - RNA, 15 nt, Homo sapiens
ccaggcuuccaagaa

SEQ ID NO: 1664205 - RNA, 20 nt, Homo sapiens
ccagggcagaggccaugaag

SEQ ID NO: 1664206 - RNA, 17 nt, Homo sapiens
ccagggcagugcuagug

SEQ ID NO: 1664207 - RNA, 19 nt, Homo sapiens
ccagggggaagaugccaag

SEQ ID NO: 1664208 - RNA, 18 nt, Homo sapiens
ccagggucuggggcagca

SEQ ID NO: 1664209 - RNA, 17 nt, Homo sapiens
ccagguucaauguccuc

SEQ ID NO: 1664210 - RNA, 19 nt, Homo sapiens
ccagguucaauguccuccg

SEQ ID NO: 1664211 - RNA, 15 nt, Homo sapiens
ccagguuccauccac

SEQ ID NO: 1664212 - RNA, 16 nt, Homo sapiens
ccagguuggagugcag

SEQ ID NO: 1664213 - RNA, 13 nt, Homo sapiens
ccaguaucuugaa

SEQ ID NO: 1664214 - RNA, 13 nt, Homo sapiens
ccaguccagaaga

SEQ ID NO: 1664215 - RNA, 12 nt, Homo sapiens
ccuuucacuuua

SEQ ID NO: 1664216 - RNA, 22 nt, Homo sapiens
ccuuucacuuuagaggcuugau

SEQ ID NO: 1664217 - RNA, 18 nt, Homo sapiens
ccuuucaucccuucacaa

SEQ ID NO: 1664218 - RNA, 22 nt, Homo sapiens
ccuuuccugaucacuaugcauu

SEQ ID NO: 1664219 - RNA, 15 nt, Homo sapiens
ccuuugauguggaug

SEQ ID NO: 1664220 - RNA, 18 nt, Homo sapiens
ccuuugcgcucuggguuu

SEQ ID NO: 1664221 - RNA, 22 nt, Homo sapiens
ccuuugcuagggggcaaauaca

SEQ ID NO: 1664222 - RNA, 21 nt, Homo sapiens
cgaaaaaaaaauguucauucu

SEQ ID NO: 1664223 - RNA, 19 nt, Homo sapiens
cgaaacccuugacuguuau

SEQ ID NO: 1664224 - RNA, 18 nt, Homo sapiens
cgaacauggcaugugaaa

SEQ ID NO: 1664225 - RNA, 22 nt, Homo sapiens
cgaagaccuucugaagaucuca

SEQ ID NO: 1664226 - RNA, 13 nt, Homo sapiens
cgagcaugagcug

SEQ ID NO: 1664227 - RNA, 18 nt, Homo sapiens
cgaggccuggcucuggag

SEQ ID NO: 1664228 - RNA, 18 nt, Homo sapiens
cgaguggcgaguccagac

SEQ ID NO: 1664229 - RNA, 12 nt, Homo sapiens
cgaucucagcuc

SEQ ID NO: 1664230 - RNA, 20 nt, Homo sapiens
cgauugucugaggaaaggau

SEQ ID NO: 1664231 - RNA, 19 nt, Homo sapiens
cgcacugggcauuggguaa

SEQ ID NO: 1664232 - RNA, 19 nt, Homo sapiens
cgcaggucugggagccaga

SEQ ID NO: 1664233 - RNA, 19 nt, Homo sapiens
cgcaugagaacauuaacaa

SEQ ID NO: 1664234 - RNA, 13 nt, Homo sapiens
cgcauuucaucaa

SEQ ID NO: 1664235 - RNA, 18 nt, Homo sapiens
cgcauuuucuaccugaaa

SEQ ID NO: 1664236 - RNA, 18 nt, Homo sapiens
cgccccccggccugaugg

SEQ ID NO: 1664237 - RNA, 16 nt, Homo sapiens
cgcugcagucagcaca

SEQ ID NO: 1664238 - RNA, 22 nt, Homo sapiens
cgcuuggcuccaugcuccucac

SEQ ID NO: 1664239 - RNA, 16 nt, Homo sapiens
cgcuuucuuucugcau

SEQ ID NO: 1664240 - RNA, 11 nt, Homo sapiens
cggaaagccuu

SEQ ID NO: 1664241 - RNA, 21 nt, Homo sapiens
cggauguuucuggaauugaua

SEQ ID NO: 1664242 - RNA, 17 nt, Homo sapiens
cggcaggcccugcagug

SEQ ID NO: 1664243 - RNA, 19 nt, Homo sapiens
cggcuaagaggcugcugaa

SEQ ID NO: 1664244 - RNA, 23 nt, Homo sapiens
cggcuuggcuagucacauaucaa

SEQ ID NO: 1664245 - RNA, 21 nt, Homo sapiens
cgggaagaggagaugacagga

SEQ ID NO: 1664246 - RNA, 21 nt, Homo sapiens
cgggagucuccucacugccac

SEQ ID NO: 1664247 - RNA, 21 nt, Homo sapiens
cgggcacugucaugcccagcu

SEQ ID NO: 1664248 - RNA, 17 nt, Homo sapiens
cguaucuuuccuaggca

SEQ ID NO: 1664249 - RNA, 17 nt, Homo sapiens
cguaucuuuuaaugauc

SEQ ID NO: 1664250 - RNA, 11 nt, Homo sapiens
cguccacaggg

SEQ ID NO: 1664251 - RNA, 22 nt, Homo sapiens
cgucccgggcacugucaugccc

SEQ ID NO: 1664252 - RNA, 18 nt, Homo sapiens
cguccuuagaauacugua

SEQ ID NO: 1664253 - RNA, 14 nt, Homo sapiens
cgugaucucagcuc

SEQ ID NO: 1664254 - RNA, 17 nt, Homo sapiens
cgugccuuccccgugcg

SEQ ID NO: 1664255 - RNA, 14 nt, Homo sapiens
cguggccgcugccc

SEQ ID NO: 1664256 - RNA, 17 nt, Homo sapiens
cgugucucauuugccag

SEQ ID NO: 1664257 - RNA, 14 nt, Homo sapiens
cgugugaggaugug

SEQ ID NO: 1664258 - RNA, 18 nt, Homo sapiens
cguuaugauaguguccca

SEQ ID NO: 1664259 - RNA, 15 nt, Homo sapiens
cguuucaaccucucu

SEQ ID NO: 1664260 - RNA, 17 nt, Homo sapiens
cuaaaagugaugugauu

SEQ ID NO: 1664261 - RNA, 13 nt, Homo sapiens
cuaaacuucucac

SEQ ID NO: 1664262 - RNA, 17 nt, Homo sapiens
cuaaagcuaaacaaaac

SEQ ID NO: 1664263 - RNA, 13 nt, Homo sapiens
cuaaagcugccag

SEQ ID NO: 1664264 - RNA, 16 nt, Homo sapiens
cuaaaucuacucuuaa

SEQ ID NO: 1664265 - RNA, 19 nt, Homo sapiens
cuaacagccucagcacauc

SEQ ID NO: 1664266 - RNA, 23 nt, Homo sapiens
cuaacucuuacggcuaucuaguu

SEQ ID NO: 1664267 - RNA, 17 nt, Homo sapiens
cuaagaaagaaaugcua

SEQ ID NO: 1664268 - RNA, 23 nt, Homo sapiens
cuaagaccuccucccaagcacuu

SEQ ID NO: 1664269 - RNA, 21 nt, Homo sapiens
cuaagauaauuaaaugaaaua

SEQ ID NO: 1664270 - RNA, 14 nt, Homo sapiens
cuaagccugaugau

SEQ ID NO: 1664271 - RNA, 16 nt, Homo sapiens
cuaagcuggagugcag

SEQ ID NO: 1664272 - RNA, 17 nt, Homo sapiens
cuaagcuggagugcagu

SEQ ID NO: 1664273 - RNA, 18 nt, Homo sapiens
cuaagcuggagugcagug

SEQ ID NO: 1664274 - RNA, 17 nt, Homo sapiens
cuaaguccacucuaguu

SEQ ID NO: 1664275 - RNA, 13 nt, Homo sapiens
cuaauaaacaauu

SEQ ID NO: 1664276 - RNA, 20 nt, Homo sapiens
cuaaucaauacuuugaacac

SEQ ID NO: 1664277 - RNA, 20 nt, Homo sapiens
cuaauccugucagcugagga

SEQ ID NO: 1664278 - RNA, 22 nt, Homo sapiens
cuaaucucauaccucugaccaa

SEQ ID NO: 1664279 - RNA, 21 nt, Homo sapiens
cuaauguacaauaaagcaaug

SEQ ID NO: 1664280 - RNA, 22 nt, Homo sapiens
cuacacagugggaacucugaca

SEQ ID NO: 1664281 - RNA, 17 nt, Homo sapiens
cuacagaaagagcguca

SEQ ID NO: 1664282 - RNA, 13 nt, Homo sapiens
cuacagagcagac

SEQ ID NO: 1664283 - RNA, 23 nt, Homo sapiens
cuacaggggaggcugagacgcaa

SEQ ID NO: 1664284 - RNA, 14 nt, Homo sapiens
cuacagugagaaag

SEQ ID NO: 1664285 - RNA, 19 nt, Homo sapiens
cuacauauuuuaauaauaa

SEQ ID NO: 1664286 - RNA, 17 nt, Homo sapiens
cuacauccaauguauga

SEQ ID NO: 1664287 - RNA, 14 nt, Homo sapiens
cuaccacauucacu

SEQ ID NO: 1664288 - RNA, 19 nt, Homo sapiens
cuacugaccaucugcacug

SEQ ID NO: 1664289 - RNA, 17 nt, Homo sapiens
cuacuggggaucagagu

SEQ ID NO: 1664290 - RNA, 18 nt, Homo sapiens
cuacugggggcaacccug

SEQ ID NO: 1664291 - RNA, 18 nt, Homo sapiens
cuacuuuaaauuguggau

SEQ ID NO: 1664292 - RNA, 19 nt, Homo sapiens
cuacuuuaaauuguggaug

SEQ ID NO: 1664293 - RNA, 22 nt, Homo sapiens
cuagaccuggaccuggguggga

SEQ ID NO: 1664294 - RNA, 12 nt, Homo sapiens
cuagacuaaaga

SEQ ID NO: 1664295 - RNA, 14 nt, Homo sapiens
cuagagaacaugcc

SEQ ID NO: 1664296 - RNA, 17 nt, Homo sapiens
cuagagcuagauguguc

SEQ ID NO: 1664297 - RNA, 21 nt, Homo sapiens
cuagagcuagaugugucuuac

SEQ ID NO: 1664298 - RNA, 22 nt, Homo sapiens
cuagagcuagaugugucuuacc

SEQ ID NO: 1664299 - RNA, 23 nt, Homo sapiens
cuagagcuagaugugucuuacca

SEQ ID NO: 1664300 - RNA, 17 nt, Homo sapiens
cuagaggggacaagcca

SEQ ID NO: 1664301 - RNA, 13 nt, Homo sapiens
cuagauauagcuu

SEQ ID NO: 1664302 - RNA, 14 nt, Homo sapiens
cuagaugugucuua

SEQ ID NO: 1664303 - RNA, 17 nt, Homo sapiens
cuagaugugucuuacca

SEQ ID NO: 1664304 - RNA, 23 nt, Homo sapiens
cuagccugcauaucauucaccca

SEQ ID NO: 1664305 - RNA, 19 nt, Homo sapiens
cuaggaaucaugugccaag

SEQ ID NO: 1664306 - RNA, 18 nt, Homo sapiens
cuaggaucuucacugucu

SEQ ID NO: 1664307 - RNA, 14 nt, Homo sapiens
cuagucacauauca

SEQ ID NO: 1664308 - RNA, 19 nt, Homo sapiens
cuaguuccauccacgcuca

SEQ ID NO: 1664309 - RNA, 21 nt, Homo sapiens
cuaguugacuucaaaugugua

SEQ ID NO: 1664310 - RNA, 18 nt, Homo sapiens
cuauaagagacaaaguuu

SEQ ID NO: 1664311 - RNA, 15 nt, Homo sapiens
cuauaccaccuucaa

SEQ ID NO: 1664312 - RNA, 17 nt, Homo sapiens
cuauagaauaaagccuc

SEQ ID NO: 1664313 - RNA, 23 nt, Homo sapiens
cuauauuauauaaauaguauuuc

SEQ ID NO: 1664314 - RNA, 22 nt, Homo sapiens
cuaucagggcaagcucauagca

SEQ ID NO: 1664315 - RNA, 20 nt, Homo sapiens
cuauccagccgcaaauccau

SEQ ID NO: 1664316 - RNA, 15 nt, Homo sapiens
cuaucuuaggaguaa

SEQ ID NO: 1664317 - RNA, 17 nt, Homo sapiens
cuaugacagagguguga

SEQ ID NO: 1664318 - RNA, 16 nt, Homo sapiens
cuaugauuaaacuggg

SEQ ID NO: 1664319 - RNA, 13 nt, Homo sapiens
cuaugcaagcaaa

SEQ ID NO: 1664320 - RNA, 16 nt, Homo sapiens
cuauggauucacuucu

SEQ ID NO: 1664321 - RNA, 19 nt, Homo sapiens
cuaugucgucguuuucacc

SEQ ID NO: 1664322 - RNA, 16 nt, Homo sapiens
uagcucgugugcuuag

SEQ ID NO: 1664323 - RNA, 20 nt, Homo sapiens
uagcuuuagagaagccauaa

SEQ ID NO: 1664324 - RNA, 21 nt, Homo sapiens
uaggaaaaguuauugugauaa

SEQ ID NO: 1664325 - RNA, 17 nt, Homo sapiens
uaggaaagcagugcagu

SEQ ID NO: 1664326 - RNA, 18 nt, Homo sapiens
uaggaaagcagugcagua

SEQ ID NO: 1664327 - RNA, 17 nt, Homo sapiens
uaggagagaacagggau

SEQ ID NO: 1664328 - RNA, 19 nt, Homo sapiens
uaggcauacucuccaggau

SEQ ID NO: 1664329 - RNA, 21 nt, Homo sapiens
aguaacacaauacaguacuca

SEQ ID NO: 1664330 - RNA, 21 nt, Homo sapiens
aguaacacagugcaguacuca

SEQ ID NO: 1664331 - RNA, 23 nt, Homo sapiens
aguaacagugaaguacucaguaa

SEQ ID NO: 1664332 - RNA, 14 nt, Homo sapiens
aguaacagugcagu

SEQ ID NO: 1664333 - RNA, 23 nt, Homo sapiens
aguaacagugcaguacucaguaa

SEQ ID NO: 1664334 - RNA, 15 nt, Homo sapiens
aguaaccguccagca

SEQ ID NO: 1664335 - RNA, 16 nt, Homo sapiens
aguaagacagugcagu

SEQ ID NO: 1664336 - RNA, 16 nt, Homo sapiens
aguaagagagcacagu

SEQ ID NO: 1664337 - RNA, 16 nt, Homo sapiens
aguaaggcagugcagu

SEQ ID NO: 1664338 - RNA, 17 nt, Homo sapiens
aguaaggcagugcagua

SEQ ID NO: 1664339 - RNA, 15 nt, Homo sapiens
aguaauaacuguuag

SEQ ID NO: 1664340 - RNA, 15 nt, Homo sapiens
aguaaucuguugaca

SEQ ID NO: 1664341 - RNA, 18 nt, Homo sapiens
aguacauccucacuuuua

SEQ ID NO: 1664342 - RNA, 15 nt, Homo sapiens
aguacuagagauauu

SEQ ID NO: 1664343 - RNA, 20 nt, Homo sapiens
aguacucacuaaaaguucuc

SEQ ID NO: 1664344 - RNA, 18 nt, Homo sapiens
aguacucaggcagugcaa

SEQ ID NO: 1664345 - RNA, 24 nt, Homo sapiens
aguacucaguaaaucagugcagua

SEQ ID NO: 1664346 - RNA, 19 nt, Homo sapiens
aguacucaguaacacaggg

SEQ ID NO: 1664347 - RNA, 22 nt, Homo sapiens
aguacucaguaacagugcagua

SEQ ID NO: 1664348 - RNA, 17 nt, Homo sapiens
aguagaaucucagcacu

SEQ ID NO: 1664349 - RNA, 18 nt, Homo sapiens
aguagagacggguuucac

SEQ ID NO: 1664350 - RNA, 19 nt, Homo sapiens
aguagagacggguuucacc

SEQ ID NO: 1664351 - RNA, 14 nt, Homo sapiens
aguagagucacugg

SEQ ID NO: 1664352 - RNA, 15 nt, Homo sapiens
aguagagucacugga

SEQ ID NO: 1664353 - RNA, 21 nt, Homo sapiens
aguagcuccgcgugucucauu

SEQ ID NO: 1664354 - RNA, 22 nt, Homo sapiens
aguagcugggacuauaggcaug

SEQ ID NO: 1664355 - RNA, 13 nt, Homo sapiens
aguaggugggucu

SEQ ID NO: 1664356 - RNA, 17 nt, Homo sapiens
aguaguuuuuaucugaa

SEQ ID NO: 1664357 - RNA, 17 nt, Homo sapiens
aguauaacuaauuugcu

SEQ ID NO: 1664358 - RNA, 14 nt, Homo sapiens
aguauauagccuua

SEQ ID NO: 1664359 - RNA, 20 nt, Homo sapiens
aguauauagccuuaagucuu

SEQ ID NO: 1664360 - RNA, 21 nt, Homo sapiens
aguaucagaggugaaugcaca

SEQ ID NO: 1664361 - RNA, 21 nt, Homo sapiens
aguaugccccaccuaucuuug

SEQ ID NO: 1664362 - RNA, 16 nt, Homo sapiens
aguaugggcacucagg

SEQ ID NO: 1664363 - RNA, 17 nt, Homo sapiens
aguauuucagaugcuuu

SEQ ID NO: 1664364 - RNA, 18 nt, Homo sapiens
agucaaacuuucaccuca

SEQ ID NO: 1664365 - RNA, 19 nt, Homo sapiens
agucaaacuuucaccucag

SEQ ID NO: 1664366 - RNA, 15 nt, Homo sapiens
agucaagcugaugaa

SEQ ID NO: 1664367 - RNA, 14 nt, Homo sapiens
agucaagugugccu

SEQ ID NO: 1664368 - RNA, 15 nt, Homo sapiens
agucacauucagagu

SEQ ID NO: 1664369 - RNA, 21 nt, Homo sapiens
agucagaaaauuagcaugaaa

SEQ ID NO: 1664370 - RNA, 21 nt, Homo sapiens
agucagaaacuaaaacaaaua

SEQ ID NO: 1664371 - RNA, 17 nt, Homo sapiens
agucagaagaucuuucu

SEQ ID NO: 1664372 - RNA, 15 nt, Homo sapiens
agucagcacagagag

SEQ ID NO: 1664373 - RNA, 19 nt, Homo sapiens
agucagcuccgaguggcuc

SEQ ID NO: 1664374 - RNA, 14 nt, Homo sapiens
agucaggagccagc

SEQ ID NO: 1664375 - RNA, 14 nt, Homo sapiens
agucauaccaucca

SEQ ID NO: 1664376 - RNA, 21 nt, Homo sapiens
agucaucucaaacacugcuua

SEQ ID NO: 1664377 - RNA, 21 nt, Homo sapiens
aguccaaaauaucgagugaau

SEQ ID NO: 1664378 - RNA, 13 nt, Homo sapiens
aguccacugcuga

SEQ ID NO: 1664379 - RNA, 16 nt, Homo sapiens
aguccagugugacuuu

SEQ ID NO: 1664380 - RNA, 13 nt, Homo sapiens
aguccaucucaag

SEQ ID NO: 1664381 - RNA, 19 nt, Homo sapiens
aguccaucucaagugccau

SEQ ID NO: 1664382 - RNA, 19 nt, Homo sapiens
aguccucgcggcucuccag

SEQ ID NO: 1664383 - RNA, 12 nt, Homo sapiens
agucuacacugc

SEQ ID NO: 1664384 - RNA, 14 nt, Homo sapiens
agucuauugcaguu

SEQ ID NO: 1664385 - RNA, 23 nt, Homo sapiens
agucucaauguuccauucagucu

SEQ ID NO: 1664386 - RNA, 14 nt, Homo sapiens
agucucauugccaa

SEQ ID NO: 1664387 - RNA, 20 nt, Homo sapiens
agucucucuaagacaaaugc

SEQ ID NO: 1664388 - RNA, 15 nt, Homo sapiens
agucugagaaagccu

SEQ ID NO: 1664389 - RNA, 19 nt, Homo sapiens
agucugugaauaaagccac

SEQ ID NO: 1664390 - RNA, 20 nt, Homo sapiens
agucuuccaaaccaccuucc

SEQ ID NO: 1664391 - RNA, 22 nt, Homo sapiens
agucuuccaaaccaccuucccu

SEQ ID NO: 1664392 - RNA, 10 nt, Homo sapiens
agucuucuca

SEQ ID NO: 1664393 - RNA, 12 nt, Homo sapiens
agucuuugcuca

SEQ ID NO: 1664394 - RNA, 18 nt, Homo sapiens
agucuuugucaaugcucu

SEQ ID NO: 1664395 - RNA, 20 nt, Homo sapiens
agugacagagcaagacccca

SEQ ID NO: 1664396 - RNA, 21 nt, Homo sapiens
agugaccaggcucacaacugu

SEQ ID NO: 1664397 - RNA, 15 nt, Homo sapiens
agugagccuggugga

SEQ ID NO: 1664398 - RNA, 15 nt, Homo sapiens
agugaucaccugcca

SEQ ID NO: 1664399 - RNA, 13 nt, Homo sapiens
agugaucuuguuc

SEQ ID NO: 1664400 - RNA, 19 nt, Homo sapiens
agugauuccuucuugcuca

SEQ ID NO: 1664401 - RNA, 18 nt, Homo sapiens
agugcagcaaggagaagg

SEQ ID NO: 1664402 - RNA, 16 nt, Homo sapiens
agugcagugcucagua

SEQ ID NO: 1664403 - RNA, 22 nt, Homo sapiens
agugcaguggcaucaucucagc

SEQ ID NO: 1664404 - RNA, 21 nt, Homo sapiens
agugcaguggcgcgaucucag

SEQ ID NO: 1664405 - RNA, 22 nt, Homo sapiens
agugcaguggcgugaucucagc

SEQ ID NO: 1664406 - RNA, 14 nt, Homo sapiens
agugcauucauuca

SEQ ID NO: 1664407 - RNA, 15 nt, Homo sapiens
agugcuuggcugcug

SEQ ID NO: 1664408 - RNA, 13 nt, Homo sapiens
aguggacagcagc

SEQ ID NO: 1664409 - RNA, 23 nt, Homo sapiens
aguggaggaggggguacaguccu

SEQ ID NO: 1664410 - RNA, 20 nt, Homo sapiens
aguggcaucaucucagcuca

SEQ ID NO: 1664411 - RNA, 17 nt, Homo sapiens
aguggcuaguuuucaca

SEQ ID NO: 1664412 - RNA, 12 nt, Homo sapiens
aguggcucucuu

SEQ ID NO: 1664413 - RNA, 23 nt, Homo sapiens
agugggaagaauaaaaugcagug

SEQ ID NO: 1664414 - RNA, 20 nt, Homo sapiens
agugguguuuagaaugucag

SEQ ID NO: 1664415 - RNA, 15 nt, Homo sapiens
aguguagugcucagu

SEQ ID NO: 1664416 - RNA, 15 nt, Homo sapiens
aguguauguauacac

SEQ ID NO: 1664417 - RNA, 20 nt, Homo sapiens
agugucaccagcugccaaaa

SEQ ID NO: 1664418 - RNA, 15 nt, Homo sapiens
agugucccuuaccug

SEQ ID NO: 1664419 - RNA, 14 nt, Homo sapiens
agugugauugugaa

SEQ ID NO: 1664420 - RNA, 16 nt, Homo sapiens
agugugcucggacaca

SEQ ID NO: 1664421 - RNA, 14 nt, Homo sapiens
agugugugugcaau

SEQ ID NO: 1664422 - RNA, 19 nt, Homo sapiens
aguguuagaaaaaacugga

SEQ ID NO: 1664423 - RNA, 16 nt, Homo sapiens
aguguuguacaauuac

SEQ ID NO: 1664424 - RNA, 14 nt, Homo sapiens
aguguuuugcagaa

SEQ ID NO: 1664425 - RNA, 19 nt, Homo sapiens
aguuaaaucccccaccucc

SEQ ID NO: 1664426 - RNA, 16 nt, Homo sapiens
aguuaagucuaucugg

SEQ ID NO: 1664427 - RNA, 14 nt, Homo sapiens
aguuaauucuugcc

SEQ ID NO: 1664428 - RNA, 16 nt, Homo sapiens
aguuacaagcauugaa

SEQ ID NO: 1664429 - RNA, 15 nt, Homo sapiens
aguuacuguccuguu

SEQ ID NO: 1664430 - RNA, 18 nt, Homo sapiens
aguuacuucuuguaaaaa

SEQ ID NO: 1664431 - RNA, 17 nt, Homo sapiens
aguuaggcagugcagua

SEQ ID NO: 1664432 - RNA, 14 nt, Homo sapiens
aguucaucuugaau

SEQ ID NO: 1664433 - RNA, 21 nt, Homo sapiens
aguucauggcaucacaucuuu

SEQ ID NO: 1664434 - RNA, 17 nt, Homo sapiens
aguuccggaaagccuuc

SEQ ID NO: 1664435 - RNA, 19 nt, Homo sapiens
aguucuccuuguacuugaa

SEQ ID NO: 1664436 - RNA, 16 nt, Homo sapiens
aguugaaugauaauag

SEQ ID NO: 1664437 - RNA, 16 nt, Homo sapiens
aguugcaaagcauuug

SEQ ID NO: 1664438 - RNA, 16 nt, Homo sapiens
aguugcacauuaggaa

SEQ ID NO: 1664439 - RNA, 23 nt, Homo sapiens
aguugcacuucaguuccuuucau

SEQ ID NO: 1664440 - RNA, 15 nt, Homo sapiens
aguuggagugcaaug

SEQ ID NO: 1664441 - RNA, 14 nt, Homo sapiens
aguuggagugcagu

SEQ ID NO: 1664442 - RNA, 20 nt, Homo sapiens
aguuuaaaaaucaguuuguu

SEQ ID NO: 1664443 - RNA, 20 nt, Homo sapiens
aguuuaggacccaagguggu

SEQ ID NO: 1664444 - RNA, 19 nt, Homo sapiens
aguuuccaaguuuauugcc

SEQ ID NO: 1664445 - RNA, 12 nt, Homo sapiens
aguuucuugcaa

SEQ ID NO: 1664446 - RNA, 21 nt, Homo sapiens
aguuugcccaccacaacuaac

SEQ ID NO: 1664447 - RNA, 19 nt, Homo sapiens
aguuuucacauucuuacua

SEQ ID NO: 1664448 - RNA, 22 nt, Homo sapiens
auaaaacaguguuuccagugac

SEQ ID NO: 1664449 - RNA, 12 nt, Homo sapiens
auaaaacucugc

SEQ ID NO: 1664450 - RNA, 16 nt, Homo sapiens
auaaaauucauuccau

SEQ ID NO: 1664451 - RNA, 21 nt, Homo sapiens
auucugauuauuacaacaagc

SEQ ID NO: 1664452 - RNA, 20 nt, Homo sapiens
auucugcuaauuuaugaaga

SEQ ID NO: 1664453 - RNA, 14 nt, Homo sapiens
auucuggugucuaa

SEQ ID NO: 1664454 - RNA, 18 nt, Homo sapiens
auucuguagccaacuuaa

SEQ ID NO: 1664455 - RNA, 18 nt, Homo sapiens
auucuuaccucauuugca

SEQ ID NO: 1664456 - RNA, 19 nt, Homo sapiens
auucuuaccucauuugcau

SEQ ID NO: 1664457 - RNA, 22 nt, Homo sapiens
auucuuauuauuuuugagacag

SEQ ID NO: 1664458 - RNA, 13 nt, Homo sapiens
auugaaaaaccau

SEQ ID NO: 1664459 - RNA, 14 nt, Homo sapiens
auugaaugugauuu

SEQ ID NO: 1664460 - RNA, 19 nt, Homo sapiens
auugagaaauaaagcacau

SEQ ID NO: 1664461 - RNA, 19 nt, Homo sapiens
auugagacacugucaagau

SEQ ID NO: 1664462 - RNA, 15 nt, Homo sapiens
auugauaagaaccuu

SEQ ID NO: 1664463 - RNA, 20 nt, Homo sapiens
auugauauugaaugauguga

SEQ ID NO: 1664464 - RNA, 19 nt, Homo sapiens
auugauuaguuugccuaau

SEQ ID NO: 1664465 - RNA, 18 nt, Homo sapiens
auugcacccuaaauccac

SEQ ID NO: 1664466 - RNA, 15 nt, Homo sapiens
auugccaaggcaucc

SEQ ID NO: 1664467 - RNA, 17 nt, Homo sapiens
auugcuuggacuaccua

SEQ ID NO: 1664468 - RNA, 19 nt, Homo sapiens
auuggaccuggcccagugc

SEQ ID NO: 1664469 - RNA, 13 nt, Homo sapiens
auuggcagaagca

SEQ ID NO: 1664470 - RNA, 22 nt, Homo sapiens
auuggcaucucuccccauauau

SEQ ID NO: 1664471 - RNA, 17 nt, Homo sapiens
auugguuuaagcccaga

SEQ ID NO: 1664472 - RNA, 15 nt, Homo sapiens
auugguuucuaggca

SEQ ID NO: 1664473 - RNA, 18 nt, Homo sapiens
auugucugcugccuccaa

SEQ ID NO: 1664474 - RNA, 15 nt, Homo sapiens
auugugaagauuuca

SEQ ID NO: 1664475 - RNA, 20 nt, Homo sapiens
auugugccaaagauagcaga

SEQ ID NO: 1664476 - RNA, 17 nt, Homo sapiens
auuguuaauucuuccua

SEQ ID NO: 1664477 - RNA, 21 nt, Homo sapiens
auuguuagucucuugauucau

SEQ ID NO: 1664478 - RNA, 16 nt, Homo sapiens
auuguuuggcuuccuc

SEQ ID NO: 1664479 - RNA, 18 nt, Homo sapiens
auuuaaaacaagcugaua

SEQ ID NO: 1664480 - RNA, 19 nt, Homo sapiens
auuuaaaacaagcugauag

SEQ ID NO: 1664481 - RNA, 15 nt, Homo sapiens
auuuaagcacaaaaa

SEQ ID NO: 1664482 - RNA, 23 nt, Homo sapiens
auuuacaagaagaacucaccagg

SEQ ID NO: 1664483 - RNA, 20 nt, Homo sapiens
auuuacggaggcguugugaa

SEQ ID NO: 1664484 - RNA, 21 nt, Homo sapiens
auuuacggaggcguugugaau

SEQ ID NO: 1664485 - RNA, 19 nt, Homo sapiens
auuuacugacauauaucua

SEQ ID NO: 1664486 - RNA, 23 nt, Homo sapiens
auuuacuuguuauguuguaauau

SEQ ID NO: 1664487 - RNA, 24 nt, Homo sapiens
auuuagaaacagugacaccugcau

SEQ ID NO: 1664488 - RNA, 21 nt, Homo sapiens
auuuaggaaagcagugcagua

SEQ ID NO: 1664489 - RNA, 15 nt, Homo sapiens
auuuaucaacaaguu

SEQ ID NO: 1664490 - RNA, 16 nt, Homo sapiens
auuuauuuacauguga

SEQ ID NO: 1664491 - RNA, 15 nt, Homo sapiens
auuucacauuccuga

SEQ ID NO: 1664492 - RNA, 22 nt, Homo sapiens
auuucacuuaaacuuugucacu

SEQ ID NO: 1664493 - RNA, 13 nt, Homo sapiens
auuucagaccagu

SEQ ID NO: 1664494 - RNA, 23 nt, Homo sapiens
auuucaugauuagacaaugugga

SEQ ID NO: 1664495 - RNA, 15 nt, Homo sapiens
auuucauggacacug

SEQ ID NO: 1664496 - RNA, 19 nt, Homo sapiens
auuuccaaaccuccacugc

SEQ ID NO: 1664497 - RNA, 16 nt, Homo sapiens
auuuccacuacaguga

SEQ ID NO: 1664498 - RNA, 15 nt, Homo sapiens
auuuccuccugggca

SEQ ID NO: 1664499 - RNA, 15 nt, Homo sapiens
auuucuacacagugg

SEQ ID NO: 1664500 - RNA, 22 nt, Homo sapiens
auuucucacacucuaacuguau

SEQ ID NO: 1664501 - RNA, 12 nt, Homo sapiens
auuugaauuaga

SEQ ID NO: 1664502 - RNA, 14 nt, Homo sapiens
auuugauauacaga

SEQ ID NO: 1664503 - RNA, 13 nt, Homo sapiens
auuugcucauaag

SEQ ID NO: 1664504 - RNA, 16 nt, Homo sapiens
auuugugauacuuccu

SEQ ID NO: 1664505 - RNA, 17 nt, Homo sapiens
auuugugauacuuccuc

SEQ ID NO: 1664506 - RNA, 17 nt, Homo sapiens
auuuguguaacugaaag

SEQ ID NO: 1664507 - RNA, 21 nt, Homo sapiens
auuuguguagcugagcacagc

SEQ ID NO: 1664508 - RNA, 19 nt, Homo sapiens
auuugugugaaaaugugac

SEQ ID NO: 1664509 - RNA, 13 nt, Homo sapiens
auuuguuaaugau

SEQ ID NO: 1664510 - RNA, 17 nt, Homo sapiens
auuuuaaaauaggccaa

SEQ ID NO: 1664511 - RNA, 14 nt, Homo sapiens
auuuuaauuauaau

SEQ ID NO: 1664512 - RNA, 17 nt, Homo sapiens
auuuuauaccagcuuau

SEQ ID NO: 1664513 - RNA, 14 nt, Homo sapiens
auuuuauauaugaa

SEQ ID NO: 1664514 - RNA, 12 nt, Homo sapiens
auuuuaucucag

SEQ ID NO: 1664515 - RNA, 17 nt, Homo sapiens
auuuuaucucuucuucc

SEQ ID NO: 1664516 - RNA, 21 nt, Homo sapiens
auuuucaagaucaaacuucca

SEQ ID NO: 1664517 - RNA, 18 nt, Homo sapiens
auuuuggaaaaugauuag

SEQ ID NO: 1664518 - RNA, 17 nt, Homo sapiens
auuuuggaaauaggcau

SEQ ID NO: 1664519 - RNA, 16 nt, Homo sapiens
auuuuggaagaauuca

SEQ ID NO: 1664520 - RNA, 12 nt, Homo sapiens
auuuuguacaau

SEQ ID NO: 1664521 - RNA, 22 nt, Homo sapiens
auuuuuccucuuucacuucuua

SEQ ID NO: 1664522 - RNA, 23 nt, Homo sapiens
auuuuuuuucuuccaacauguga

SEQ ID NO: 1664523 - RNA, 11 nt, Homo sapiens
caaaaacuggg

SEQ ID NO: 1664524 - RNA, 21 nt, Homo sapiens
caaaaagaggcuaugugagca

SEQ ID NO: 1664525 - RNA, 22 nt, Homo sapiens
caaaaauugaagagagauauau

SEQ ID NO: 1664526 - RNA, 20 nt, Homo sapiens
caaaagaauugugccucucc

SEQ ID NO: 1664527 - RNA, 14 nt, Homo sapiens
caaaagccagucaa

SEQ ID NO: 1664528 - RNA, 20 nt, Homo sapiens
caaaaggcuggaugugcuuu

SEQ ID NO: 1664529 - RNA, 13 nt, Homo sapiens
caaaagucucaau

SEQ ID NO: 1664530 - RNA, 16 nt, Homo sapiens
caaaauaaacuccccu

SEQ ID NO: 1664531 - RNA, 24 nt, Homo sapiens
caaaauauaaaucacagauuucca

SEQ ID NO: 1664532 - RNA, 18 nt, Homo sapiens
caaaaucugggaccaaaa

SEQ ID NO: 1664533 - RNA, 13 nt, Homo sapiens
caaaaugcagaca

SEQ ID NO: 1664534 - RNA, 14 nt, Homo sapiens
caaaaugugugcuu

SEQ ID NO: 1664535 - RNA, 21 nt, Homo sapiens
caaaauuuuguuucacauuca

SEQ ID NO: 1664536 - RNA, 16 nt, Homo sapiens
caaacacacagacucu

SEQ ID NO: 1664537 - RNA, 13 nt, Homo sapiens
caaacacuuuggc

SEQ ID NO: 1664538 - RNA, 16 nt, Homo sapiens
caaacaggugcuaaca

SEQ ID NO: 1664539 - RNA, 18 nt, Homo sapiens
caaacaguuccauaccaa

SEQ ID NO: 1664540 - RNA, 14 nt, Homo sapiens
caaaccaccuuccc

SEQ ID NO: 1664541 - RNA, 14 nt, Homo sapiens
caaaccuccacugc

SEQ ID NO: 1664542 - RNA, 17 nt, Homo sapiens
caaaccugauacaauuu

SEQ ID NO: 1664543 - RNA, 19 nt, Homo sapiens
caaacguaauuuguuauau

SEQ ID NO: 1664544 - RNA, 21 nt, Homo sapiens
caaacuccugaccucaaguga

SEQ ID NO: 1664545 - RNA, 20 nt, Homo sapiens
caaacucuguacagcaaggu

SEQ ID NO: 1664546 - RNA, 16 nt, Homo sapiens
caaacuucccagagag

SEQ ID NO: 1664547 - RNA, 22 nt, Homo sapiens
caaagaaggcacagguguaaau

SEQ ID NO: 1664548 - RNA, 15 nt, Homo sapiens
caaagaaguacugua

SEQ ID NO: 1664549 - RNA, 23 nt, Homo sapiens
caaagacgguagagagaaacagc

SEQ ID NO: 1664550 - RNA, 18 nt, Homo sapiens
caaagaggauugagauaa

SEQ ID NO: 1664551 - RNA, 15 nt, Homo sapiens
caaagaguuauauga

SEQ ID NO: 1664552 - RNA, 20 nt, Homo sapiens
caaagauuugacaugcucca

SEQ ID NO: 1664553 - RNA, 13 nt, Homo sapiens
caaagcagugcau

SEQ ID NO: 1664554 - RNA, 14 nt, Homo sapiens
caaagcaugcucag

SEQ ID NO: 1664555 - RNA, 14 nt, Homo sapiens
caaagcauuugacu

SEQ ID NO: 1664556 - RNA, 21 nt, Homo sapiens
caaagcgugguggacaugcac

SEQ ID NO: 1664557 - RNA, 14 nt, Homo sapiens
caaaggaagcacau

SEQ ID NO: 1664558 - RNA, 23 nt, Homo sapiens
caaaggguuuuaagccagggcac

SEQ ID NO: 1664559 - RNA, 17 nt, Homo sapiens
caaaguccugggauuac

SEQ ID NO: 1664560 - RNA, 16 nt, Homo sapiens
caaagucucaaugaaa

SEQ ID NO: 1664561 - RNA, 22 nt, Homo sapiens
caaagugcugggauuacaggcg

SEQ ID NO: 1664562 - RNA, 17 nt, Homo sapiens
caaauaaauguguaaau

SEQ ID NO: 1664563 - RNA, 13 nt, Homo sapiens
caaauauucagua

SEQ ID NO: 1664564 - RNA, 11 nt, Homo sapiens
caaauauugcu

SEQ ID NO: 1664565 - RNA, 15 nt, Homo sapiens
caaauccaugugucc

SEQ ID NO: 1664566 - RNA, 15 nt, Homo sapiens
caaaucguccaaaga

SEQ ID NO: 1664567 - RNA, 14 nt, Homo sapiens
caaaucucacugua

SEQ ID NO: 1664568 - RNA, 16 nt, Homo sapiens
caaaucucacuguauu

SEQ ID NO: 1664569 - RNA, 19 nt, Homo sapiens
caaauggcuuguucaguca

SEQ ID NO: 1664570 - RNA, 21 nt, Homo sapiens
caaauguuauucaauaacuau

SEQ ID NO: 1664571 - RNA, 15 nt, Homo sapiens
caaauugauagucaa

SEQ ID NO: 1664572 - RNA, 12 nt, Homo sapiens
caacaaaaggga

SEQ ID NO: 1664573 - RNA, 11 nt, Homo sapiens
cacagugcagu

SEQ ID NO: 1664574 - RNA, 12 nt, Homo sapiens
cacagugcagua

SEQ ID NO: 1664575 - RNA, 13 nt, Homo sapiens
cacagugcaguac

SEQ ID NO: 1664576 - RNA, 15 nt, Homo sapiens
cacaguggcuucaca

SEQ ID NO: 1664577 - RNA, 19 nt, Homo sapiens
cacauagauuaauggcacu

SEQ ID NO: 1664578 - RNA, 15 nt, Homo sapiens
cacauagauucaccu

SEQ ID NO: 1664579 - RNA, 14 nt, Homo sapiens
cacauccagccuaa

SEQ ID NO: 1664580 - RNA, 22 nt, Homo sapiens
cacaucuggagcugaagcguua

SEQ ID NO: 1664581 - RNA, 19 nt, Homo sapiens
cacaugccccucuuagaag

SEQ ID NO: 1664582 - RNA, 17 nt, Homo sapiens
cacauggaaggugaugg

SEQ ID NO: 1664583 - RNA, 19 nt, Homo sapiens
cacauggccgcugcccacg

SEQ ID NO: 1664584 - RNA, 18 nt, Homo sapiens
cacauugguuuaagccca

SEQ ID NO: 1664585 - RNA, 21 nt, Homo sapiens
cacauuguagccuaauauuca

SEQ ID NO: 1664586 - RNA, 19 nt, Homo sapiens
cacauuuuacgacaaggau

SEQ ID NO: 1664587 - RNA, 21 nt, Homo sapiens
caccaaauacuuucugagaug

SEQ ID NO: 1664588 - RNA, 14 nt, Homo sapiens
caccaaauagcuuu

SEQ ID NO: 1664589 - RNA, 11 nt, Homo sapiens
caccaccacug

SEQ ID NO: 1664590 - RNA, 22 nt, Homo sapiens
caccacuuucccacacugugaa

SEQ ID NO: 1664591 - RNA, 20 nt, Homo sapiens
caccacuuugucucugagaa

SEQ ID NO: 1664592 - RNA, 15 nt, Homo sapiens
caccagcugccaaaa

SEQ ID NO: 1664593 - RNA, 14 nt, Homo sapiens
caccagggacugca

SEQ ID NO: 1664594 - RNA, 13 nt, Homo sapiens
caccauguuggcc

SEQ ID NO: 1664595 - RNA, 13 nt, Homo sapiens
cacccaaagcaug

SEQ ID NO: 1664596 - RNA, 20 nt, Homo sapiens
cacccagcgcccucuaccuc

SEQ ID NO: 1664597 - RNA, 18 nt, Homo sapiens
cacccagguuggagugca

SEQ ID NO: 1664598 - RNA, 13 nt, Homo sapiens
cacccauaucaug

SEQ ID NO: 1664599 - RNA, 13 nt, Homo sapiens
cacccgggagcag

SEQ ID NO: 1664600 - RNA, 13 nt, Homo sapiens
cacccucugccua

SEQ ID NO: 1664601 - RNA, 22 nt, Homo sapiens
cacccuuuccucuuaauuccca

SEQ ID NO: 1664602 - RNA, 19 nt, Homo sapiens
caccgacccgacacucuca

SEQ ID NO: 1664603 - RNA, 15 nt, Homo sapiens
caccgccagcaauaa

SEQ ID NO: 1664604 - RNA, 16 nt, Homo sapiens
caccuacuuauuucag

SEQ ID NO: 1664605 - RNA, 15 nt, Homo sapiens
caccuaucuuuggua

SEQ ID NO: 1664606 - RNA, 18 nt, Homo sapiens
caccucaccccguuacag

SEQ ID NO: 1664607 - RNA, 19 nt, Homo sapiens
caccucaggaccaugugau

SEQ ID NO: 1664608 - RNA, 21 nt, Homo sapiens
caccucaggaccaugugauaa

SEQ ID NO: 1664609 - RNA, 22 nt, Homo sapiens
caccugccaccacgcccggcua

SEQ ID NO: 1664610 - RNA, 21 nt, Homo sapiens
caccugcccacgcuaguucca

SEQ ID NO: 1664611 - RNA, 22 nt, Homo sapiens
caccuggauggaucugcuccau

SEQ ID NO: 1664612 - RNA, 21 nt, Homo sapiens
caccuguauaauguuuuguaa

SEQ ID NO: 1664613 - RNA, 19 nt, Homo sapiens
caccugucaaccugaauua

SEQ ID NO: 1664614 - RNA, 22 nt, Homo sapiens
cacgauaugcaaguucauccaa

SEQ ID NO: 1664615 - RNA, 13 nt, Homo sapiens
cacgcauggugca

SEQ ID NO: 1664616 - RNA, 17 nt, Homo sapiens
cacgguccaauccagcc

SEQ ID NO: 1664617 - RNA, 16 nt, Homo sapiens
cacguauguuauacaa

SEQ ID NO: 1664618 - RNA, 18 nt, Homo sapiens
cacgucccgggcacuguc

SEQ ID NO: 1664619 - RNA, 22 nt, Homo sapiens
cacgucucccuggccccaguga

SEQ ID NO: 1664620 - RNA, 19 nt, Homo sapiens
cacgugguccuaaucuucu

SEQ ID NO: 1664621 - RNA, 20 nt, Homo sapiens
cacguguccccagagcuuua

SEQ ID NO: 1664622 - RNA, 18 nt, Homo sapiens
cacuaaaaggaagacagu

SEQ ID NO: 1664623 - RNA, 18 nt, Homo sapiens
cacuaaauccuuuccaau

SEQ ID NO: 1664624 - RNA, 21 nt, Homo sapiens
cacuaaguaaccucuacaggc

SEQ ID NO: 1664625 - RNA, 21 nt, Homo sapiens
cacucaaugccaggcagugca

SEQ ID NO: 1664626 - RNA, 23 nt, Homo sapiens
cacucaaugccaggcagugcagc

SEQ ID NO: 1664627 - RNA, 16 nt, Homo sapiens
cacucauuuauuucca

SEQ ID NO: 1664628 - RNA, 22 nt, Homo sapiens
cacuccacaguuaggccaagaa

SEQ ID NO: 1664629 - RNA, 19 nt, Homo sapiens
cacuccagaacaaaccucu

SEQ ID NO: 1664630 - RNA, 11 nt, Homo sapiens
cacuccaugag

SEQ ID NO: 1664631 - RNA, 12 nt, Homo sapiens
cacuccaugagu

SEQ ID NO: 1664632 - RNA, 20 nt, Homo sapiens
cacucucuucuuacuguauu

SEQ ID NO: 1664633 - RNA, 15 nt, Homo sapiens
cacucugacaguauu

SEQ ID NO: 1664634 - RNA, 16 nt, Homo sapiens
cacugaaguagccaac

SEQ ID NO: 1664635 - RNA, 22 nt, Homo sapiens
cacugcuuuuuccuuagcuuaa

SEQ ID NO: 1664636 - RNA, 23 nt, Homo sapiens
cacuggaggggucuccucugcag

SEQ ID NO: 1664637 - RNA, 16 nt, Homo sapiens
cacuggggaagccagu

SEQ ID NO: 1664638 - RNA, 18 nt, Homo sapiens
cacugguaccggaugcag

SEQ ID NO: 1664639 - RNA, 13 nt, Homo sapiens
cacugguuuucaa

SEQ ID NO: 1664640 - RNA, 15 nt, Homo sapiens
cacuguuucuucuca

SEQ ID NO: 1664641 - RNA, 15 nt, Homo sapiens
cacuuauuuccaugg

SEQ ID NO: 1664642 - RNA, 16 nt, Homo sapiens
cacuuauuuccaugga

SEQ ID NO: 1664643 - RNA, 13 nt, Homo sapiens
cacuucagccucc

SEQ ID NO: 1664644 - RNA, 21 nt, Homo sapiens
cacuucucuagagaacaugcc

SEQ ID NO: 1664645 - RNA, 18 nt, Homo sapiens
cacuugggagcaaaagau

SEQ ID NO: 1664646 - RNA, 17 nt, Homo sapiens
cacuugggauugucuua

SEQ ID NO: 1664647 - RNA, 15 nt, Homo sapiens
cacuuuaaaaccucu

SEQ ID NO: 1664648 - RNA, 20 nt, Homo sapiens
cacuuuaccuucagcaguua

SEQ ID NO: 1664649 - RNA, 17 nt, Homo sapiens
cacuuucugaaauucac

SEQ ID NO: 1664650 - RNA, 13 nt, Homo sapiens
cacuuuguuucau

SEQ ID NO: 1664651 - RNA, 14 nt, Homo sapiens
cacuuuucauauca

SEQ ID NO: 1664652 - RNA, 18 nt, Homo sapiens
cacuuuuuuccugucaau

SEQ ID NO: 1664653 - RNA, 17 nt, Homo sapiens
cagaaaagaugugcaga

SEQ ID NO: 1664654 - RNA, 15 nt, Homo sapiens
cagaaaaucaaagag

SEQ ID NO: 1664655 - RNA, 15 nt, Homo sapiens
cagaaaggaguuauu

SEQ ID NO: 1664656 - RNA, 22 nt, Homo sapiens
cagaaauccacgcucaaucuca

SEQ ID NO: 1664657 - RNA, 12 nt, Homo sapiens
cagaaaugugcu

SEQ ID NO: 1664658 - RNA, 16 nt, Homo sapiens
cagaaaugugcugcaa

SEQ ID NO: 1664659 - RNA, 23 nt, Homo sapiens
cagaacaaaagauaaaacuaauu

SEQ ID NO: 1664660 - RNA, 19 nt, Homo sapiens
cagaacuucguacccuuug

SEQ ID NO: 1664661 - RNA, 20 nt, Homo sapiens
cagaagagucuuugauucac

SEQ ID NO: 1664662 - RNA, 15 nt, Homo sapiens
cagaagcagcagcua

SEQ ID NO: 1664663 - RNA, 22 nt, Homo sapiens
cagaagcaucgcuccucuccag

SEQ ID NO: 1664664 - RNA, 22 nt, Homo sapiens
cagaagcgcccaucugauauga

SEQ ID NO: 1664665 - RNA, 23 nt, Homo sapiens
cagaaguggaaggauaaugagau

SEQ ID NO: 1664666 - RNA, 17 nt, Homo sapiens
cagaauauggacaaaga

SEQ ID NO: 1664667 - RNA, 12 nt, Homo sapiens
cagaaugagaug

SEQ ID NO: 1664668 - RNA, 20 nt, Homo sapiens
cagacacuauguagucuguu

SEQ ID NO: 1664669 - RNA, 21 nt, Homo sapiens
cagacauuuuuuaggggaaua

SEQ ID NO: 1664670 - RNA, 23 nt, Homo sapiens
cagaccccugggggaggcuucca

SEQ ID NO: 1664671 - RNA, 18 nt, Homo sapiens
cagacguggugcuucuca

SEQ ID NO: 1664672 - RNA, 21 nt, Homo sapiens
cagacuuucuacaugcaaauc

SEQ ID NO: 1664673 - RNA, 14 nt, Homo sapiens
cagagacucugaaa

SEQ ID NO: 1664674 - RNA, 22 nt, Homo sapiens
cagagagggaacagcauaugca

SEQ ID NO: 1664675 - RNA, 20 nt, Homo sapiens
cagagaguaucugagaacca

SEQ ID NO: 1664676 - RNA, 14 nt, Homo sapiens
cagagauggccaug

SEQ ID NO: 1664677 - RNA, 19 nt, Homo sapiens
cagagcacugcuccagugg

SEQ ID NO: 1664678 - RNA, 14 nt, Homo sapiens
cagagcagaaccaa

SEQ ID NO: 1664679 - RNA, 16 nt, Homo sapiens
cagagcagaaccaaag

SEQ ID NO: 1664680 - RNA, 14 nt, Homo sapiens
cagagcagugcagc

SEQ ID NO: 1664681 - RNA, 10 nt, Homo sapiens
cagagccauc

SEQ ID NO: 1664682 - RNA, 15 nt, Homo sapiens
cagagcucaccaggc

SEQ ID NO: 1664683 - RNA, 13 nt, Homo sapiens
cagagcugagcau

SEQ ID NO: 1664684 - RNA, 13 nt, Homo sapiens
cagagcugagucg

SEQ ID NO: 1664685 - RNA, 11 nt, Homo sapiens
cagagcugcca

SEQ ID NO: 1664686 - RNA, 13 nt, Homo sapiens
cagagcugccacc

SEQ ID NO: 1664687 - RNA, 18 nt, Homo sapiens
cagaggagagaggacccc

SEQ ID NO: 1664688 - RNA, 13 nt, Homo sapiens
cagaggccaugaa

SEQ ID NO: 1664689 - RNA, 22 nt, Homo sapiens
cagaggccuauaacuuuuggua

SEQ ID NO: 1664690 - RNA, 17 nt, Homo sapiens
cagaggcucuaauguac

SEQ ID NO: 1664691 - RNA, 16 nt, Homo sapiens
cagagggucccuaggu

SEQ ID NO: 1664692 - RNA, 17 nt, Homo sapiens
cagaguggauucuugaa

SEQ ID NO: 1664693 - RNA, 13 nt, Homo sapiens
cagaguguaugca

SEQ ID NO: 1664694 - RNA, 13 nt, Homo sapiens
cagaucaucucca

SEQ ID NO: 1664695 - RNA, 20 nt, Homo sapiens
cauuucauugagggaaaaca

SEQ ID NO: 1664696 - RNA, 14 nt, Homo sapiens
cauuuccauggugc

SEQ ID NO: 1664697 - RNA, 15 nt, Homo sapiens
cauuuccauggugcc

SEQ ID NO: 1664698 - RNA, 17 nt, Homo sapiens
cauuuccgaagaccuuc

SEQ ID NO: 1664699 - RNA, 22 nt, Homo sapiens
cauuucuucucucugugcuggu

SEQ ID NO: 1664700 - RNA, 21 nt, Homo sapiens
cauuugcugaauaacaacaau

SEQ ID NO: 1664701 - RNA, 17 nt, Homo sapiens
cauuuugcuucccaucu

SEQ ID NO: 1664702 - RNA, 15 nt, Homo sapiens
cauuuuggucucuau

SEQ ID NO: 1664703 - RNA, 11 nt, Homo sapiens
cauuuuugcuu

SEQ ID NO: 1664704 - RNA, 12 nt, Homo sapiens
ccaaaagccagu

SEQ ID NO: 1664705 - RNA, 20 nt, Homo sapiens
ccaaaaggaagccucuucau

SEQ ID NO: 1664706 - RNA, 17 nt, Homo sapiens
ccaaaccuccacugcug

SEQ ID NO: 1664707 - RNA, 18 nt, Homo sapiens
ccaaacuguacaguuucu

SEQ ID NO: 1664708 - RNA, 15 nt, Homo sapiens
ccaaagcauggacua

SEQ ID NO: 1664709 - RNA, 22 nt, Homo sapiens
ccaaagcauggacuaaccccaa

SEQ ID NO: 1664710 - RNA, 20 nt, Homo sapiens
ccaaaggguuuuaagccagg

SEQ ID NO: 1664711 - RNA, 16 nt, Homo sapiens
ccaaauaaauguguaa

SEQ ID NO: 1664712 - RNA, 13 nt, Homo sapiens
ccaaaucuugcca

SEQ ID NO: 1664713 - RNA, 23 nt, Homo sapiens
ccaaaugacaagucacacccucc

SEQ ID NO: 1664714 - RNA, 23 nt, Homo sapiens
ccaaaugaguucccuugauucaa

SEQ ID NO: 1664715 - RNA, 15 nt, Homo sapiens
ccaacacuuagggaa

SEQ ID NO: 1664716 - RNA, 20 nt, Homo sapiens
ccaacagcgaagccagucca

SEQ ID NO: 1664717 - RNA, 11 nt, Homo sapiens
ccaacauguga

SEQ ID NO: 1664718 - RNA, 21 nt, Homo sapiens
ccaacaugugauguguugcuc

SEQ ID NO: 1664719 - RNA, 20 nt, Homo sapiens
ccaacauuccuuguuuguaa

SEQ ID NO: 1664720 - RNA, 13 nt, Homo sapiens
ccaacgcacagga

SEQ ID NO: 1664721 - RNA, 15 nt, Homo sapiens
ccaacuccaggguua

SEQ ID NO: 1664722 - RNA, 17 nt, Homo sapiens
ccaacucggcugcaauu

SEQ ID NO: 1664723 - RNA, 17 nt, Homo sapiens
ccaagaaagaaaccaga

SEQ ID NO: 1664724 - RNA, 22 nt, Homo sapiens
ccaagaacauaaacccuccaag

SEQ ID NO: 1664725 - RNA, 13 nt, Homo sapiens
ccaagaagccagc

SEQ ID NO: 1664726 - RNA, 18 nt, Homo sapiens
ccaagaagccagcaccac

SEQ ID NO: 1664727 - RNA, 20 nt, Homo sapiens
ccaagaggaaccucugauuu

SEQ ID NO: 1664728 - RNA, 17 nt, Homo sapiens
ccaagagggacuccaag

SEQ ID NO: 1664729 - RNA, 14 nt, Homo sapiens
ccaagccaggguuc

SEQ ID NO: 1664730 - RNA, 21 nt, Homo sapiens
ccaagccaggguuccagacag

SEQ ID NO: 1664731 - RNA, 17 nt, Homo sapiens
ccaagcugcucauuuca

SEQ ID NO: 1664732 - RNA, 15 nt, Homo sapiens
ccaaggaaaauggac

SEQ ID NO: 1664733 - RNA, 23 nt, Homo sapiens
ccaaggcccccaccucugugacc

SEQ ID NO: 1664734 - RNA, 16 nt, Homo sapiens
ccaagguaaacaguuu

SEQ ID NO: 1664735 - RNA, 19 nt, Homo sapiens
ccaagguaaacaguuugaa

SEQ ID NO: 1664736 - RNA, 23 nt, Homo sapiens
ccaagugaaugaguuuccagcua

SEQ ID NO: 1664737 - RNA, 11 nt, Homo sapiens
ccaaguguccu

SEQ ID NO: 1664738 - RNA, 17 nt, Homo sapiens
ccaagugugugugcaau

SEQ ID NO: 1664739 - RNA, 17 nt, Homo sapiens
ccaaguuggagugcaau

SEQ ID NO: 1664740 - RNA, 20 nt, Homo sapiens
ccaaguuggagugcaauggu

SEQ ID NO: 1664741 - RNA, 15 nt, Homo sapiens
ccaaucagcacugaa

SEQ ID NO: 1664742 - RNA, 11 nt, Homo sapiens
ccaauccagcc

SEQ ID NO: 1664743 - RNA, 14 nt, Homo sapiens
ccaaucccauuccu

SEQ ID NO: 1664744 - RNA, 15 nt, Homo sapiens
ccaaugaaaacaguc

SEQ ID NO: 1664745 - RNA, 20 nt, Homo sapiens
ccaaugaagcaaacacacag

SEQ ID NO: 1664746 - RNA, 11 nt, Homo sapiens
ccaaugcuuug

SEQ ID NO: 1664747 - RNA, 21 nt, Homo sapiens
ccaauuuaguggaaaaaaaca

SEQ ID NO: 1664748 - RNA, 12 nt, Homo sapiens
ccacaaaugucc

SEQ ID NO: 1664749 - RNA, 16 nt, Homo sapiens
ccacaacccuguugcu

SEQ ID NO: 1664750 - RNA, 17 nt, Homo sapiens
ccacaacccuguugcua

SEQ ID NO: 1664751 - RNA, 12 nt, Homo sapiens
ccacaacuccag

SEQ ID NO: 1664752 - RNA, 15 nt, Homo sapiens
ccacaacugacacag

SEQ ID NO: 1664753 - RNA, 14 nt, Homo sapiens
ccacacacagcagc

SEQ ID NO: 1664754 - RNA, 20 nt, Homo sapiens
ccacacuaccaguuucacac

SEQ ID NO: 1664755 - RNA, 16 nt, Homo sapiens
ccacacucugacgcaa

SEQ ID NO: 1664756 - RNA, 12 nt, Homo sapiens
ccacacuggccg

SEQ ID NO: 1664757 - RNA, 18 nt, Homo sapiens
ccacaggaggcaagcaag

SEQ ID NO: 1664758 - RNA, 14 nt, Homo sapiens
ccacaguggcuuca

SEQ ID NO: 1664759 - RNA, 15 nt, Homo sapiens
ccacauacacugcau

SEQ ID NO: 1664760 - RNA, 22 nt, Homo sapiens
ccacauugcuucauuaaaacaa

SEQ ID NO: 1664761 - RNA, 23 nt, Homo sapiens
ccacauuguagccuaauauucau

SEQ ID NO: 1664762 - RNA, 21 nt, Homo sapiens
ccaccacugugucccaguguc

SEQ ID NO: 1664763 - RNA, 22 nt, Homo sapiens
ccaccacugugucccagugucu

SEQ ID NO: 1664764 - RNA, 16 nt, Homo sapiens
ccaccacuugaugucu

SEQ ID NO: 1664765 - RNA, 14 nt, Homo sapiens
ccacccugucugca

SEQ ID NO: 1664766 - RNA, 12 nt, Homo sapiens
ccacgcuuaggg

SEQ ID NO: 1664767 - RNA, 13 nt, Homo sapiens
ccacguaucuuuc

SEQ ID NO: 1664768 - RNA, 17 nt, Homo sapiens
ccacguggccgcugccc

SEQ ID NO: 1664769 - RNA, 19 nt, Homo sapiens
ccacguggccgcugcccac

SEQ ID NO: 1664770 - RNA, 21 nt, Homo sapiens
ccacguguccccagagcuuua

SEQ ID NO: 1664771 - RNA, 18 nt, Homo sapiens
ccacuccgguaacuuugg

SEQ ID NO: 1664772 - RNA, 14 nt, Homo sapiens
ccacugaagaguau

SEQ ID NO: 1664773 - RNA, 14 nt, Homo sapiens
ccacugccagacau

SEQ ID NO: 1664774 - RNA, 14 nt, Homo sapiens
ccacuuucccacac

SEQ ID NO: 1664775 - RNA, 17 nt, Homo sapiens
ccagaaaucuaaucucu

SEQ ID NO: 1664776 - RNA, 13 nt, Homo sapiens
ccagacaugccac

SEQ ID NO: 1664777 - RNA, 12 nt, Homo sapiens
ccagagccacag

SEQ ID NO: 1664778 - RNA, 13 nt, Homo sapiens
ccagagcuuuaca

SEQ ID NO: 1664779 - RNA, 22 nt, Homo sapiens
ccagaggcucuaauguacaaua

SEQ ID NO: 1664780 - RNA, 23 nt, Homo sapiens
ccagaggcucuaauguacaauaa

SEQ ID NO: 1664781 - RNA, 15 nt, Homo sapiens
ccagaggggugcgca

SEQ ID NO: 1664782 - RNA, 17 nt, Homo sapiens
ccagcaaugagaaggcc

SEQ ID NO: 1664783 - RNA, 19 nt, Homo sapiens
ccagcacugauuuuguaca

SEQ ID NO: 1664784 - RNA, 16 nt, Homo sapiens
ccagcaggacagugac

SEQ ID NO: 1664785 - RNA, 15 nt, Homo sapiens
ccagccaagugguga

SEQ ID NO: 1664786 - RNA, 14 nt, Homo sapiens
ccagcccacacagc

SEQ ID NO: 1664787 - RNA, 18 nt, Homo sapiens
ccagccccagguucaaug

SEQ ID NO: 1664788 - RNA, 20 nt, Homo sapiens
ccagccugcucccuagccag

SEQ ID NO: 1664789 - RNA, 15 nt, Homo sapiens
ccagcuaacugggcg

SEQ ID NO: 1664790 - RNA, 20 nt, Homo sapiens
ccagcugaggagcagguguc

SEQ ID NO: 1664791 - RNA, 21 nt, Homo sapiens
ccagcuuaugagcucaaagua

SEQ ID NO: 1664792 - RNA, 16 nt, Homo sapiens
ccaggacaaaaugcag

SEQ ID NO: 1664793 - RNA, 16 nt, Homo sapiens
ccaggcaggcaaaggc

SEQ ID NO: 1664794 - RNA, 17 nt, Homo sapiens
ccaggcaggcaaaggcc

SEQ ID NO: 1664795 - RNA, 19 nt, Homo sapiens
ccaggccaucaccacagcu

SEQ ID NO: 1664796 - RNA, 15 nt, Homo sapiens
ccaggcugcaggugg

SEQ ID NO: 1664797 - RNA, 16 nt, Homo sapiens
ccaggcuggagugcag

SEQ ID NO: 1664798 - RNA, 18 nt, Homo sapiens
ccaggcuggagugcagug

SEQ ID NO: 1664799 - RNA, 16 nt, Homo sapiens
ccaggggaacucgcca

SEQ ID NO: 1664800 - RNA, 14 nt, Homo sapiens
ccaggguuccagac

SEQ ID NO: 1664801 - RNA, 19 nt, Homo sapiens
ccaggguuccagacagggu

SEQ ID NO: 1664802 - RNA, 22 nt, Homo sapiens
ccagguagagagaccacaagca

SEQ ID NO: 1664803 - RNA, 20 nt, Homo sapiens
ccagguuaccucacuuuuaa

SEQ ID NO: 1664804 - RNA, 19 nt, Homo sapiens
ccagguuggagugcagugg

SEQ ID NO: 1664805 - RNA, 21 nt, Homo sapiens
ccagguuuaaggucaccugca

SEQ ID NO: 1664806 - RNA, 17 nt, Homo sapiens
ccaguacauaaggaguu

SEQ ID NO: 1664807 - RNA, 17 nt, Homo sapiens
ccagugacacaacucau

SEQ ID NO: 1664808 - RNA, 18 nt, Homo sapiens
ccagugcuuuauccacau

SEQ ID NO: 1664809 - RNA, 15 nt, Homo sapiens
ccaguggcagcuccc

SEQ ID NO: 1664810 - RNA, 13 nt, Homo sapiens
ccauagaaacaug

SEQ ID NO: 1664811 - RNA, 22 nt, Homo sapiens
ccauaggguccugaauguuuca

SEQ ID NO: 1664812 - RNA, 13 nt, Homo sapiens
ccauaggucuuaa

SEQ ID NO: 1664813 - RNA, 16 nt, Homo sapiens
ccaucaauaaaacaca

SEQ ID NO: 1664814 - RNA, 22 nt, Homo sapiens
ccaucauacauuagugccauag

SEQ ID NO: 1664815 - RNA, 21 nt, Homo sapiens
ccauccaggcugggaggggaa

SEQ ID NO: 1664816 - RNA, 23 nt, Homo sapiens
ccaucugcacuggcaucuaguca

SEQ ID NO: 1664817 - RNA, 18 nt, Homo sapiens
cucuaaaacagcacuauc

SEQ ID NO: 1664818 - RNA, 15 nt, Homo sapiens
cucuaaaacuaucag

SEQ ID NO: 1664819 - RNA, 16 nt, Homo sapiens
cucuaaaaugcuguuc

SEQ ID NO: 1664820 - RNA, 23 nt, Homo sapiens
cucuaaaaugcuguucucaauca

SEQ ID NO: 1664821 - RNA, 16 nt, Homo sapiens
cucuaagaauucagua

SEQ ID NO: 1664822 - RNA, 15 nt, Homo sapiens
cucuaauguacaaua

SEQ ID NO: 1664823 - RNA, 21 nt, Homo sapiens
cucuaccuucaacaugugcuc

SEQ ID NO: 1664824 - RNA, 14 nt, Homo sapiens
cucuacuacacagg

SEQ ID NO: 1664825 - RNA, 23 nt, Homo sapiens
cucuagacaucuagucucagugc

SEQ ID NO: 1664826 - RNA, 19 nt, Homo sapiens
cucucaaaacccugucucc

SEQ ID NO: 1664827 - RNA, 12 nt, Homo sapiens
cucucaacuuac

SEQ ID NO: 1664828 - RNA, 14 nt, Homo sapiens
cucucaucacugaa

SEQ ID NO: 1664829 - RNA, 14 nt, Homo sapiens
cucuccaagcacua

SEQ ID NO: 1664830 - RNA, 18 nt, Homo sapiens
cucucccaaguccagugu

SEQ ID NO: 1664831 - RNA, 21 nt, Homo sapiens
cucucccuuguccuucugggg

SEQ ID NO: 1664832 - RNA, 22 nt, Homo sapiens
cucuccugauuauuuaucacau

SEQ ID NO: 1664833 - RNA, 16 nt, Homo sapiens
cucucuaaacccaaau

SEQ ID NO: 1664834 - RNA, 17 nt, Homo sapiens
cucucuaaacccaaaua

SEQ ID NO: 1664835 - RNA, 22 nt, Homo sapiens
cucucucccaacugcugcuuaa

SEQ ID NO: 1664836 - RNA, 23 nt, Homo sapiens
cucucuuuugguuugugggucca

SEQ ID NO: 1664837 - RNA, 21 nt, Homo sapiens
cucugacaagggcugaccugc

SEQ ID NO: 1664838 - RNA, 15 nt, Homo sapiens
cucugacagcugucc

SEQ ID NO: 1664839 - RNA, 21 nt, Homo sapiens
cucugacaguauuaacaucaa

SEQ ID NO: 1664840 - RNA, 23 nt, Homo sapiens
cucugacuguaaaauacauggua

SEQ ID NO: 1664841 - RNA, 15 nt, Homo sapiens
cucugauggcacuuu

SEQ ID NO: 1664842 - RNA, 16 nt, Homo sapiens
cucugcagcucaggga

SEQ ID NO: 1664843 - RNA, 14 nt, Homo sapiens
cucugcauagacaa

SEQ ID NO: 1664844 - RNA, 16 nt, Homo sapiens
cucugccgguccccca

SEQ ID NO: 1664845 - RNA, 19 nt, Homo sapiens
cucuggcuaaauucaugcu

SEQ ID NO: 1664846 - RNA, 17 nt, Homo sapiens
cucugggcuauaugccu

SEQ ID NO: 1664847 - RNA, 20 nt, Homo sapiens
cucuguaacaucacuaucca

SEQ ID NO: 1664848 - RNA, 12 nt, Homo sapiens
cucuguacgagg

SEQ ID NO: 1664849 - RNA, 14 nt, Homo sapiens
cucugucauaugca

SEQ ID NO: 1664850 - RNA, 21 nt, Homo sapiens
cucuguccuucccccagcaca

SEQ ID NO: 1664851 - RNA, 23 nt, Homo sapiens
cucuguuauuuguccucauguga

SEQ ID NO: 1664852 - RNA, 20 nt, Homo sapiens
cucuuaaacuaacaauucaa

SEQ ID NO: 1664853 - RNA, 14 nt, Homo sapiens
cucuuaauucccaa

SEQ ID NO: 1664854 - RNA, 20 nt, Homo sapiens
cucuuaauucccaaucccau

SEQ ID NO: 1664855 - RNA, 21 nt, Homo sapiens
cucuuaauucccaaucccauu

SEQ ID NO: 1664856 - RNA, 16 nt, Homo sapiens
cucuuccuggacagug

SEQ ID NO: 1664857 - RNA, 13 nt, Homo sapiens
cucuucuacuucu

SEQ ID NO: 1664858 - RNA, 15 nt, Homo sapiens
cucuucuuacuguau

SEQ ID NO: 1664859 - RNA, 22 nt, Homo sapiens
cucuugauucauaaugacuuaa

SEQ ID NO: 1664860 - RNA, 16 nt, Homo sapiens
cucuugggaagcaguu

SEQ ID NO: 1664861 - RNA, 12 nt, Homo sapiens
cucuuuccauuc

SEQ ID NO: 1664862 - RNA, 14 nt, Homo sapiens
cucuuucuucaauu

SEQ ID NO: 1664863 - RNA, 23 nt, Homo sapiens
cucuuuuuaaagaaaaaugcuaa

SEQ ID NO: 1664864 - RNA, 13 nt, Homo sapiens
cugaaaaaguguu

SEQ ID NO: 1664865 - RNA, 13 nt, Homo sapiens
cugaaaauucaac

SEQ ID NO: 1664866 - RNA, 22 nt, Homo sapiens
cugaaaccauccgcaaccugag

SEQ ID NO: 1664867 - RNA, 20 nt, Homo sapiens
cugaaagauugauuaaugaa

SEQ ID NO: 1664868 - RNA, 21 nt, Homo sapiens
cugaaaucccucuaccuucuc

SEQ ID NO: 1664869 - RNA, 16 nt, Homo sapiens
cugaaaugagagauuu

SEQ ID NO: 1664870 - RNA, 17 nt, Homo sapiens
cugaacugcaacacugg

SEQ ID NO: 1664871 - RNA, 18 nt, Homo sapiens
cugaacugcaacacugga

SEQ ID NO: 1664872 - RNA, 14 nt, Homo sapiens
cugaacuugaauua

SEQ ID NO: 1664873 - RNA, 20 nt, Homo sapiens
cugaagucacguagcacaga

SEQ ID NO: 1664874 - RNA, 18 nt, Homo sapiens
cugaauuaaagucuacac

SEQ ID NO: 1664875 - RNA, 15 nt, Homo sapiens
cugacaaaagggaca

SEQ ID NO: 1664876 - RNA, 15 nt, Homo sapiens
cugacacaagaggaa

SEQ ID NO: 1664877 - RNA, 12 nt, Homo sapiens
cugacacugucu

SEQ ID NO: 1664878 - RNA, 13 nt, Homo sapiens
cugaccagacugu

SEQ ID NO: 1664879 - RNA, 16 nt, Homo sapiens
cugaccagacuguggg

SEQ ID NO: 1664880 - RNA, 16 nt, Homo sapiens
cugaccauuuggucag

SEQ ID NO: 1664881 - RNA, 14 nt, Homo sapiens
cugaccucaaguga

SEQ ID NO: 1664882 - RNA, 14 nt, Homo sapiens
cugacuaacagccu

SEQ ID NO: 1664883 - RNA, 17 nt, Homo sapiens
cugacuaacgccaucca

SEQ ID NO: 1664884 - RNA, 15 nt, Homo sapiens
cugacugacuuagca

SEQ ID NO: 1664885 - RNA, 13 nt, Homo sapiens
cugacuguucucu

SEQ ID NO: 1664886 - RNA, 14 nt, Homo sapiens
cugacuguucucuu

SEQ ID NO: 1664887 - RNA, 14 nt, Homo sapiens
cugacuuccugaac

SEQ ID NO: 1664888 - RNA, 18 nt, Homo sapiens
cugagaaccaaccaauga

SEQ ID NO: 1664889 - RNA, 20 nt, Homo sapiens
cugagaaccaaccaaugaaa

SEQ ID NO: 1664890 - RNA, 21 nt, Homo sapiens
cugagaagaggagcccucauc

SEQ ID NO: 1664891 - RNA, 9 nt, Homo sapiens
cugagacag

SEQ ID NO: 1664892 - RNA, 22 nt, Homo sapiens
cugagacccccaugguaaugua

SEQ ID NO: 1664893 - RNA, 15 nt, Homo sapiens
cugagagccacagga

SEQ ID NO: 1664894 - RNA, 14 nt, Homo sapiens
cugagauagcuuag

SEQ ID NO: 1664895 - RNA, 22 nt, Homo sapiens
cugagcaguuguuauauucauu

SEQ ID NO: 1664896 - RNA, 23 nt, Homo sapiens
cugaggaaggccguaaaaugggg

SEQ ID NO: 1664897 - RNA, 23 nt, Homo sapiens
cugaggccaagaaagaaaccaga

SEQ ID NO: 1664898 - RNA, 21 nt, Homo sapiens
cugagucugugaauaaagcca

SEQ ID NO: 1664899 - RNA, 22 nt, Homo sapiens
cugagucugugaauaaagccac

SEQ ID NO: 1664900 - RNA, 22 nt, Homo sapiens
cugaucacuuccccaaucaaua

SEQ ID NO: 1664901 - RNA, 18 nt, Homo sapiens
cugauuauuuaucacaua

SEQ ID NO: 1664902 - RNA, 18 nt, Homo sapiens
cugauuuaaacuucuuaa

SEQ ID NO: 1664903 - RNA, 14 nt, Homo sapiens
cugauuuccaucca

SEQ ID NO: 1664904 - RNA, 23 nt, Homo sapiens
cugcaauaagggaaaaaugggaa

SEQ ID NO: 1664905 - RNA, 21 nt, Homo sapiens
cugcacaaaagucucaauguu

SEQ ID NO: 1664906 - RNA, 14 nt, Homo sapiens
cugcacacauaaca

SEQ ID NO: 1664907 - RNA, 21 nt, Homo sapiens
cugcacagugguccagggucc

SEQ ID NO: 1664908 - RNA, 14 nt, Homo sapiens
cugcacuccagccu

SEQ ID NO: 1664909 - RNA, 15 nt, Homo sapiens
cugcagagcaggaaa

SEQ ID NO: 1664910 - RNA, 23 nt, Homo sapiens
cugcagcucagggacuggcacac

SEQ ID NO: 1664911 - RNA, 14 nt, Homo sapiens
cugcaggaaucaaa

SEQ ID NO: 1664912 - RNA, 16 nt, Homo sapiens
cugcagucagcacaga

SEQ ID NO: 1664913 - RNA, 17 nt, Homo sapiens
cugcagucagugcuaau

SEQ ID NO: 1664914 - RNA, 16 nt, Homo sapiens
cugcaucaagauguga

SEQ ID NO: 1664915 - RNA, 22 nt, Homo sapiens
cugcaucuccccucagauucca

SEQ ID NO: 1664916 - RNA, 20 nt, Homo sapiens
cugcaucuucccacaguggc

SEQ ID NO: 1664917 - RNA, 10 nt, Homo sapiens
cugcauuuca

SEQ ID NO: 1664918 - RNA, 20 nt, Homo sapiens
cugcauuucaaguuaauucu

SEQ ID NO: 1664919 - RNA, 13 nt, Homo sapiens
cugccaaggccag

SEQ ID NO: 1664920 - RNA, 14 nt, Homo sapiens
cugccacaagcaca

SEQ ID NO: 1664921 - RNA, 15 nt, Homo sapiens
cugccagacaugcca

SEQ ID NO: 1664922 - RNA, 19 nt, Homo sapiens
cugccagauaaccaaguga

SEQ ID NO: 1664923 - RNA, 17 nt, Homo sapiens
cugccagccccaugcca

SEQ ID NO: 1664924 - RNA, 18 nt, Homo sapiens
cugccagccccaugccau

SEQ ID NO: 1664925 - RNA, 19 nt, Homo sapiens
cugccagccgagauagcca

SEQ ID NO: 1664926 - RNA, 19 nt, Homo sapiens
cugcccacaacuugccaaa

SEQ ID NO: 1664927 - RNA, 14 nt, Homo sapiens
cugcccagagccac

SEQ ID NO: 1664928 - RNA, 18 nt, Homo sapiens
cugcccauuguaacuuau

SEQ ID NO: 1664929 - RNA, 16 nt, Homo sapiens
cugccccagccuccuc

SEQ ID NO: 1664930 - RNA, 19 nt, Homo sapiens
cugcccccucccccgcaga

SEQ ID NO: 1664931 - RNA, 16 nt, Homo sapiens
cugccgcugcaccacg

SEQ ID NO: 1664932 - RNA, 19 nt, Homo sapiens
cugccggucccccaugcca

SEQ ID NO: 1664933 - RNA, 19 nt, Homo sapiens
cugccuaaauccacucugc

SEQ ID NO: 1664934 - RNA, 14 nt, Homo sapiens
cugccucagccucc

SEQ ID NO: 1664935 - RNA, 17 nt, Homo sapiens
cugccugggacagccac

SEQ ID NO: 1664936 - RNA, 19 nt, Homo sapiens
cugccugggacagccacug

SEQ ID NO: 1664937 - RNA, 22 nt, Homo sapiens
cugccuucuccccuccaaguga

SEQ ID NO: 1664938 - RNA, 14 nt, Homo sapiens
cugcuagucuguca

SEQ ID NO: 1664939 - RNA, 14 nt, Homo sapiens
uaaggcagugcagu

SEQ ID NO: 1664940 - RNA, 15 nt, Homo sapiens
uaaggcagugcagug

SEQ ID NO: 1664941 - RNA, 20 nt, Homo sapiens
uaaggcagugcagugcucag

SEQ ID NO: 1664942 - RNA, 17 nt, Homo sapiens
uaagggaagagguccuc

SEQ ID NO: 1664943 - RNA, 15 nt, Homo sapiens
uaaggugcuuaccuc

SEQ ID NO: 1664944 - RNA, 23 nt, Homo sapiens
uaaguacucacuaaaaguucuca

SEQ ID NO: 1664945 - RNA, 22 nt, Homo sapiens
uaaguacugaaauacauaugau

SEQ ID NO: 1664946 - RNA, 24 nt, Homo sapiens
uaaguacuuucguuaaucuugcug

SEQ ID NO: 1664947 - RNA, 13 nt, Homo sapiens
uaaguauaucuau

SEQ ID NO: 1664948 - RNA, 21 nt, Homo sapiens
uaaguaugcuuucuccugaaa

SEQ ID NO: 1664949 - RNA, 20 nt, Homo sapiens
uaaguauuucagaugcuuua

SEQ ID NO: 1664950 - RNA, 14 nt, Homo sapiens
uaaguccuaauaaa

SEQ ID NO: 1664951 - RNA, 18 nt, Homo sapiens
uaaguccuaauaaacuua

SEQ ID NO: 1664952 - RNA, 13 nt, Homo sapiens
uaagucuaucugg

SEQ ID NO: 1664953 - RNA, 17 nt, Homo sapiens
uaagucuuaaucauuug

SEQ ID NO: 1664954 - RNA, 22 nt, Homo sapiens
uaaguugaaugauaauagcuca

SEQ ID NO: 1664955 - RNA, 13 nt, Homo sapiens
uaaguugucuuac

SEQ ID NO: 1664956 - RNA, 17 nt, Homo sapiens
uaauaaaaggaguucag

SEQ ID NO: 1664957 - RNA, 18 nt, Homo sapiens
uaauaaaauucauuccau

SEQ ID NO: 1664958 - RNA, 17 nt, Homo sapiens
uaauaaauuuuggucag

SEQ ID NO: 1664959 - RNA, 18 nt, Homo sapiens
uaauaagcaacuguaaaa

SEQ ID NO: 1664960 - RNA, 12 nt, Homo sapiens
uaauaaguacuu

SEQ ID NO: 1664961 - RNA, 20 nt, Homo sapiens
uaauauuuguuccucuaggu

SEQ ID NO: 1664962 - RNA, 20 nt, Homo sapiens
uaaucaggaguucugccagg

SEQ ID NO: 1664963 - RNA, 23 nt, Homo sapiens
uaaucauaaauacugcuguauaa

SEQ ID NO: 1664964 - RNA, 14 nt, Homo sapiens
uaaucccagcauuu

SEQ ID NO: 1664965 - RNA, 14 nt, Homo sapiens
uaaucccauacucu

SEQ ID NO: 1664966 - RNA, 12 nt, Homo sapiens
uaaucuacuuuc

SEQ ID NO: 1664967 - RNA, 17 nt, Homo sapiens
uaaucuagagcuaugca

SEQ ID NO: 1664968 - RNA, 20 nt, Homo sapiens
uaaucuagagcuaugcacac

SEQ ID NO: 1664969 - RNA, 17 nt, Homo sapiens
uaaucucauaccucuga

SEQ ID NO: 1664970 - RNA, 19 nt, Homo sapiens
uaaucuguugacagugcca

SEQ ID NO: 1664971 - RNA, 14 nt, Homo sapiens
uaaugacaagugac

SEQ ID NO: 1664972 - RNA, 17 nt, Homo sapiens
uaaugacuuaagcacac

SEQ ID NO: 1664973 - RNA, 14 nt, Homo sapiens
uaaugacuuacuua

SEQ ID NO: 1664974 - RNA, 12 nt, Homo sapiens
uaaugcucacuu

SEQ ID NO: 1664975 - RNA, 11 nt, Homo sapiens
uaaugcuucuu

SEQ ID NO: 1664976 - RNA, 13 nt, Homo sapiens
uaaugucaucucu

SEQ ID NO: 1664977 - RNA, 15 nt, Homo sapiens
uaauuaaaacacaac

SEQ ID NO: 1664978 - RNA, 20 nt, Homo sapiens
uaauuaaaugaaauacuuga

SEQ ID NO: 1664979 - RNA, 22 nt, Homo sapiens
uaauuacuuuccagcagguguu

SEQ ID NO: 1664980 - RNA, 13 nt, Homo sapiens
uaauuagauuaac

SEQ ID NO: 1664981 - RNA, 19 nt, Homo sapiens
uaauuguuacaauuuucua

SEQ ID NO: 1664982 - RNA, 19 nt, Homo sapiens
uaauuuaccugaagucuuu

SEQ ID NO: 1664983 - RNA, 15 nt, Homo sapiens
uaauuuccugugagg

SEQ ID NO: 1664984 - RNA, 21 nt, Homo sapiens
uacaaaaauaccuacugcuga

SEQ ID NO: 1664985 - RNA, 16 nt, Homo sapiens
uacaaauuuuuacuca

SEQ ID NO: 1664986 - RNA, 21 nt, Homo sapiens
uacaacacauugaaacuguau

SEQ ID NO: 1664987 - RNA, 23 nt, Homo sapiens
uacaauuacugugagaacuguga

SEQ ID NO: 1664988 - RNA, 14 nt, Homo sapiens
uacaauuugcccaa

SEQ ID NO: 1664989 - RNA, 20 nt, Homo sapiens
uacacagugggaacucugac

SEQ ID NO: 1664990 - RNA, 11 nt, Homo sapiens
uacacauauaa

SEQ ID NO: 1664991 - RNA, 19 nt, Homo sapiens
uacacauaugaacgcacaa

SEQ ID NO: 1664992 - RNA, 21 nt, Homo sapiens
uacacguuggaguauaccuau

SEQ ID NO: 1664993 - RNA, 18 nt, Homo sapiens
uacacguuucaaccucuc

SEQ ID NO: 1664994 - RNA, 18 nt, Homo sapiens
uacacucaagcaugaaga

SEQ ID NO: 1664995 - RNA, 23 nt, Homo sapiens
uacagaugguguccugcauguau

SEQ ID NO: 1664996 - RNA, 18 nt, Homo sapiens
uacagauugcugcuucug

SEQ ID NO: 1664997 - RNA, 20 nt, Homo sapiens
uacaggccuugcucacagcu

SEQ ID NO: 1664998 - RNA, 11 nt, Homo sapiens
uacagugccac

SEQ ID NO: 1664999 - RNA, 13 nt, Homo sapiens
uacagugccacga

SEQ ID NO: 1665000 - RNA, 19 nt, Homo sapiens
uacauacucaagagcauaa

SEQ ID NO: 1665001 - RNA, 15 nt, Homo sapiens
uacauauguaugugu

SEQ ID NO: 1665002 - RNA, 15 nt, Homo sapiens
uacaugccuuuccag

SEQ ID NO: 1665003 - RNA, 21 nt, Homo sapiens
uacauguggaaaacucacaga

SEQ ID NO: 1665004 - RNA, 19 nt, Homo sapiens
uacauucuuaaagugucga

SEQ ID NO: 1665005 - RNA, 20 nt, Homo sapiens
uacauuugauuugauauaca

SEQ ID NO: 1665006 - RNA, 22 nt, Homo sapiens
uaccacccagaaauccauuuga

SEQ ID NO: 1665007 - RNA, 12 nt, Homo sapiens
uaccacuuagaa

SEQ ID NO: 1665008 - RNA, 15 nt, Homo sapiens
uaccagagacucuga

SEQ ID NO: 1665009 - RNA, 19 nt, Homo sapiens
uaccagcauccacucuccc

SEQ ID NO: 1665010 - RNA, 22 nt, Homo sapiens
uaccagguuaccucacuuuuaa

SEQ ID NO: 1665011 - RNA, 14 nt, Homo sapiens
uacccagacucaga

SEQ ID NO: 1665012 - RNA, 18 nt, Homo sapiens
uaccccaggacgcaugca

SEQ ID NO: 1665013 - RNA, 13 nt, Homo sapiens
uacccuccuguaa

SEQ ID NO: 1665014 - RNA, 15 nt, Homo sapiens
uacccuuucccaaac

SEQ ID NO: 1665015 - RNA, 18 nt, Homo sapiens
uaccgaugugugaugucu

SEQ ID NO: 1665016 - RNA, 12 nt, Homo sapiens
uaccucacuuuu

SEQ ID NO: 1665017 - RNA, 22 nt, Homo sapiens
uaccugaagucuuuguacagac

SEQ ID NO: 1665018 - RNA, 23 nt, Homo sapiens
uaccugaagucuuuguacagaca

SEQ ID NO: 1665019 - RNA, 14 nt, Homo sapiens
uaccugccagauaa

SEQ ID NO: 1665020 - RNA, 22 nt, Homo sapiens
uaccuuugucucacgauuccag

SEQ ID NO: 1665021 - RNA, 22 nt, Homo sapiens
uacguagggcuucuaccagaga

SEQ ID NO: 1665022 - RNA, 14 nt, Homo sapiens
uacguucuuuucaa

SEQ ID NO: 1665023 - RNA, 12 nt, Homo sapiens
uacuaaagacag

SEQ ID NO: 1665024 - RNA, 12 nt, Homo sapiens
uacuaacacugg

SEQ ID NO: 1665025 - RNA, 12 nt, Homo sapiens
uacuaccccaga

SEQ ID NO: 1665026 - RNA, 20 nt, Homo sapiens
uacuaccccagaacgcaugc

SEQ ID NO: 1665027 - RNA, 21 nt, Homo sapiens
uacuaccccaggaugcaugca

SEQ ID NO: 1665028 - RNA, 22 nt, Homo sapiens
uacuaccccaggaugcaugcag

SEQ ID NO: 1665029 - RNA, 16 nt, Homo sapiens
uacuaucuagugucua

SEQ ID NO: 1665030 - RNA, 22 nt, Homo sapiens
uacucagcaacuguuagcuggg

SEQ ID NO: 1665031 - RNA, 16 nt, Homo sapiens
uacucaggcagugcag

SEQ ID NO: 1665032 - RNA, 17 nt, Homo sapiens
uacucaggcagugcagu

SEQ ID NO: 1665033 - RNA, 22 nt, Homo sapiens
uacucaguaaaucagugcagua

SEQ ID NO: 1665034 - RNA, 21 nt, Homo sapiens
uacucaguaaggcagugcagu

SEQ ID NO: 1665035 - RNA, 21 nt, Homo sapiens
uacucaguuaggcagugcagu

SEQ ID NO: 1665036 - RNA, 16 nt, Homo sapiens
uacucgaguuacagac

SEQ ID NO: 1665037 - RNA, 16 nt, Homo sapiens
uacucuuuucccaaga

SEQ ID NO: 1665038 - RNA, 15 nt, Homo sapiens
uacugaccaucugca

SEQ ID NO: 1665039 - RNA, 14 nt, Homo sapiens
uacugaugagacaa

SEQ ID NO: 1665040 - RNA, 19 nt, Homo sapiens
uacuggagaaaauggacgu

SEQ ID NO: 1665041 - RNA, 16 nt, Homo sapiens
uacuggggaucagagu

SEQ ID NO: 1665042 - RNA, 12 nt, Homo sapiens
uacuguccuguu

SEQ ID NO: 1665043 - RNA, 20 nt, Homo sapiens
uacugugagaacugugaaua

SEQ ID NO: 1665044 - RNA, 22 nt, Homo sapiens
uacuuacacugaaauccaaaau

SEQ ID NO: 1665045 - RNA, 12 nt, Homo sapiens
uacuucuuuauu

SEQ ID NO: 1665046 - RNA, 21 nt, Homo sapiens
uacuugauuaaggacuacaga

SEQ ID NO: 1665047 - RNA, 21 nt, Homo sapiens
uacuuugaacacaaagccugu

SEQ ID NO: 1665048 - RNA, 19 nt, Homo sapiens
uacuuugagccucuuaggc

SEQ ID NO: 1665049 - RNA, 22 nt, Homo sapiens
uacuuugugucuuuuguucucu

SEQ ID NO: 1665050 - RNA, 15 nt, Homo sapiens
uagaaacuuuggaag

SEQ ID NO: 1665051 - RNA, 18 nt, Homo sapiens
uagaacauggacuacaca

SEQ ID NO: 1665052 - RNA, 21 nt, Homo sapiens
uagaacuguuggauacaggag

SEQ ID NO: 1665053 - RNA, 21 nt, Homo sapiens
uagaagccauccuaaggugcu

SEQ ID NO: 1665054 - RNA, 22 nt, Homo sapiens
uagaauacuaauaaaauacaua

SEQ ID NO: 1665055 - RNA, 14 nt, Homo sapiens
uagaaugacaggaa

SEQ ID NO: 1665056 - RNA, 20 nt, Homo sapiens
uagaaugcugcgcuuaccuu

SEQ ID NO: 1665057 - RNA, 18 nt, Homo sapiens
uagaauguuucauuugca

SEQ ID NO: 1665058 - RNA, 16 nt, Homo sapiens
uagacacacauauaca

SEQ ID NO: 1665059 - RNA, 14 nt, Homo sapiens
uagacacaguauug

SEQ ID NO: 1665060 - RNA, 14 nt, Homo sapiens
uagacauaccucuc

SEQ ID NO: 1665061 - RNA, 21 nt, Homo sapiens
uccuauccccggacgcaugca

SEQ ID NO: 1665062 - RNA, 22 nt, Homo sapiens
uccuauccccggacgcaugcag

SEQ ID NO: 1665063 - RNA, 15 nt, Homo sapiens
uccuaugcaguguca

SEQ ID NO: 1665064 - RNA, 17 nt, Homo sapiens
uccuaugccugucuuua

SEQ ID NO: 1665065 - RNA, 11 nt, Homo sapiens
uccucaaagaa

SEQ ID NO: 1665066 - RNA, 14 nt, Homo sapiens
uccucacacagauu

SEQ ID NO: 1665067 - RNA, 14 nt, Homo sapiens
uccucacauucaca

SEQ ID NO: 1665068 - RNA, 14 nt, Homo sapiens
uccucaguccacug

SEQ ID NO: 1665069 - RNA, 18 nt, Homo sapiens
uccucaguccacugcuga

SEQ ID NO: 1665070 - RNA, 18 nt, Homo sapiens
uccucauauacuugaaua

SEQ ID NO: 1665071 - RNA, 14 nt, Homo sapiens
uccucauggcuguu

SEQ ID NO: 1665072 - RNA, 18 nt, Homo sapiens
uccucaugugagaaagca

SEQ ID NO: 1665073 - RNA, 19 nt, Homo sapiens
uccucccccacgccuccau

SEQ ID NO: 1665074 - RNA, 16 nt, Homo sapiens
uccucuuaauucccaa

SEQ ID NO: 1665075 - RNA, 14 nt, Homo sapiens
uccugaacucccag

SEQ ID NO: 1665076 - RNA, 18 nt, Homo sapiens
uccugaggccaagaaaga

SEQ ID NO: 1665077 - RNA, 14 nt, Homo sapiens
uccugaugaugguc

SEQ ID NO: 1665078 - RNA, 17 nt, Homo sapiens
uccugauucagcacuuu

SEQ ID NO: 1665079 - RNA, 11 nt, Homo sapiens
uccugcacugu

SEQ ID NO: 1665080 - RNA, 19 nt, Homo sapiens
uccugcuccuccaguacaa

SEQ ID NO: 1665081 - RNA, 18 nt, Homo sapiens
uccuggggaagagaagga

SEQ ID NO: 1665082 - RNA, 16 nt, Homo sapiens
uccugggugcugucau

SEQ ID NO: 1665083 - RNA, 21 nt, Homo sapiens
uccugggugcugucaugccca

SEQ ID NO: 1665084 - RNA, 15 nt, Homo sapiens
uccugucuugcugag

SEQ ID NO: 1665085 - RNA, 16 nt, Homo sapiens
uccugugcuuucugca

SEQ ID NO: 1665086 - RNA, 16 nt, Homo sapiens
uccuguucgugcuugu

SEQ ID NO: 1665087 - RNA, 12 nt, Homo sapiens
uccuuagcuuaa

SEQ ID NO: 1665088 - RNA, 15 nt, Homo sapiens
uccuucauaagccau

SEQ ID NO: 1665089 - RNA, 24 nt, Homo sapiens
uccuuccaaccuguucacgugacu

SEQ ID NO: 1665090 - RNA, 17 nt, Homo sapiens
uccuuccaccaaauacu

SEQ ID NO: 1665091 - RNA, 23 nt, Homo sapiens
uccuucccgcagcaccagccuga

SEQ ID NO: 1665092 - RNA, 13 nt, Homo sapiens
uccuucucagccu

SEQ ID NO: 1665093 - RNA, 20 nt, Homo sapiens
uccuucucagccuugguucc

SEQ ID NO: 1665094 - RNA, 14 nt, Homo sapiens
uccuucugggggug

SEQ ID NO: 1665095 - RNA, 23 nt, Homo sapiens
uccuugaguuaauuccagugaag

SEQ ID NO: 1665096 - RNA, 19 nt, Homo sapiens
uccuuggaccuagaggauu

SEQ ID NO: 1665097 - RNA, 13 nt, Homo sapiens
uccuugugguuuu

SEQ ID NO: 1665098 - RNA, 16 nt, Homo sapiens
uccuuuguacugauga

SEQ ID NO: 1665099 - RNA, 11 nt, Homo sapiens
ucgcagacuua

SEQ ID NO: 1665100 - RNA, 14 nt, Homo sapiens
ucgcagguucaagc

SEQ ID NO: 1665101 - RNA, 17 nt, Homo sapiens
ucgcccaggauggagug

SEQ ID NO: 1665102 - RNA, 21 nt, Homo sapiens
ucgccccaggcccucccugac

SEQ ID NO: 1665103 - RNA, 17 nt, Homo sapiens
ucgcuauucccaggcag

SEQ ID NO: 1665104 - RNA, 18 nt, Homo sapiens
ucggaguccaaaggguuu

SEQ ID NO: 1665105 - RNA, 15 nt, Homo sapiens
ucggccucuugagag

SEQ ID NO: 1665106 - RNA, 23 nt, Homo sapiens
ucggcgccuuaaggauguucuag

SEQ ID NO: 1665107 - RNA, 16 nt, Homo sapiens
ucggggagugccacuu

SEQ ID NO: 1665108 - RNA, 16 nt, Homo sapiens
ucguaaguucugugca

SEQ ID NO: 1665109 - RNA, 19 nt, Homo sapiens
ucguccuuagaauacugua

SEQ ID NO: 1665110 - RNA, 21 nt, Homo sapiens
ucgucugggguggcucugcag

SEQ ID NO: 1665111 - RNA, 17 nt, Homo sapiens
ucguggugggugcucaa

SEQ ID NO: 1665112 - RNA, 17 nt, Homo sapiens
ucuaaaaaugauucucu

SEQ ID NO: 1665113 - RNA, 15 nt, Homo sapiens
ucuaaaacuacugcc

SEQ ID NO: 1665114 - RNA, 13 nt, Homo sapiens
ucuaaaggggaca

SEQ ID NO: 1665115 - RNA, 21 nt, Homo sapiens
ucuaacaaacucaaaaucugg

SEQ ID NO: 1665116 - RNA, 22 nt, Homo sapiens
ucuaagacauucaccaacaaca

SEQ ID NO: 1665117 - RNA, 14 nt, Homo sapiens
ucuaagaucuugcc

SEQ ID NO: 1665118 - RNA, 20 nt, Homo sapiens
ucuaauaaacacagauuauu

SEQ ID NO: 1665119 - RNA, 11 nt, Homo sapiens
ucuacacugcc

SEQ ID NO: 1665120 - RNA, 20 nt, Homo sapiens
ucuaccuucaacaugugcuc

SEQ ID NO: 1665121 - RNA, 17 nt, Homo sapiens
ucuacugaacaguccau

SEQ ID NO: 1665122 - RNA, 11 nt, Homo sapiens
ucuacugagca

SEQ ID NO: 1665123 - RNA, 21 nt, Homo sapiens
ucuacuuuccaggcuaguccg

SEQ ID NO: 1665124 - RNA, 17 nt, Homo sapiens
ucuagcauggcugccaa

SEQ ID NO: 1665125 - RNA, 14 nt, Homo sapiens
ucuauaacuccuug

SEQ ID NO: 1665126 - RNA, 16 nt, Homo sapiens
ucuauaccaccuucaa

SEQ ID NO: 1665127 - RNA, 13 nt, Homo sapiens
ucuauggauucac

SEQ ID NO: 1665128 - RNA, 15 nt, Homo sapiens
ucuaugguguaugac

SEQ ID NO: 1665129 - RNA, 15 nt, Homo sapiens
ucuaugucucaugau

SEQ ID NO: 1665130 - RNA, 23 nt, Homo sapiens
ucucaaaaaaaaaaacaaacaaa

SEQ ID NO: 1665131 - RNA, 22 nt, Homo sapiens
ucucaaaaugugccgucuuugg

SEQ ID NO: 1665132 - RNA, 20 nt, Homo sapiens
ucucaaacuccugaccucaa

SEQ ID NO: 1665133 - RNA, 14 nt, Homo sapiens
ucucaaagauuuga

SEQ ID NO: 1665134 - RNA, 18 nt, Homo sapiens
ucucaagugccauauucu

SEQ ID NO: 1665135 - RNA, 14 nt, Homo sapiens
ucucaauguuccau

SEQ ID NO: 1665136 - RNA, 19 nt, Homo sapiens
ucucaauguuccauucagu

SEQ ID NO: 1665137 - RNA, 16 nt, Homo sapiens
ucucacgauaugcaag

SEQ ID NO: 1665138 - RNA, 15 nt, Homo sapiens
ucucacgauuccagu

SEQ ID NO: 1665139 - RNA, 19 nt, Homo sapiens
ucucacgauuccagugcag

SEQ ID NO: 1665140 - RNA, 14 nt, Homo sapiens
ucucagaacuccug

SEQ ID NO: 1665141 - RNA, 20 nt, Homo sapiens
ucucagaacuccugugugug

SEQ ID NO: 1665142 - RNA, 19 nt, Homo sapiens
ucucagauuguaccauuga

SEQ ID NO: 1665143 - RNA, 22 nt, Homo sapiens
ucucagcacuaauuagugucca

SEQ ID NO: 1665144 - RNA, 13 nt, Homo sapiens
ucucagcacuuug

SEQ ID NO: 1665145 - RNA, 20 nt, Homo sapiens
ucucagcucacuacaaccuc

SEQ ID NO: 1665146 - RNA, 13 nt, Homo sapiens
ucucagcucacug

SEQ ID NO: 1665147 - RNA, 15 nt, Homo sapiens
ucucagcucacugca

SEQ ID NO: 1665148 - RNA, 21 nt, Homo sapiens
ucucagcucacugcaaccucu

SEQ ID NO: 1665149 - RNA, 16 nt, Homo sapiens
ucucaggccagcugcu

SEQ ID NO: 1665150 - RNA, 13 nt, Homo sapiens
ucucauugccaag

SEQ ID NO: 1665151 - RNA, 21 nt, Homo sapiens
ucuccaauuggguugugaaau

SEQ ID NO: 1665152 - RNA, 18 nt, Homo sapiens
ucuccaccucccccaaac

SEQ ID NO: 1665153 - RNA, 18 nt, Homo sapiens
ucuccaggauuguccaca

SEQ ID NO: 1665154 - RNA, 20 nt, Homo sapiens
ucucccaaguccagugugac

SEQ ID NO: 1665155 - RNA, 19 nt, Homo sapiens
ucuccuaauccugucagcu

SEQ ID NO: 1665156 - RNA, 16 nt, Homo sapiens
ucuccucacugccacu

SEQ ID NO: 1665157 - RNA, 18 nt, Homo sapiens
ucuccugcccacucugac

SEQ ID NO: 1665158 - RNA, 23 nt, Homo sapiens
ucuccuucacucugacaguauua

SEQ ID NO: 1665159 - RNA, 21 nt, Homo sapiens
ucuccuuguaaaagccuaugu

SEQ ID NO: 1665160 - RNA, 22 nt, Homo sapiens
ucuccuuuaauauacuccuuaa

SEQ ID NO: 1665161 - RNA, 20 nt, Homo sapiens
ucucgaacuccugaccccaa

SEQ ID NO: 1665162 - RNA, 13 nt, Homo sapiens
ucucuaagacaaa

SEQ ID NO: 1665163 - RNA, 13 nt, Homo sapiens
ucucuacuacaca

SEQ ID NO: 1665164 - RNA, 14 nt, Homo sapiens
ucucuagacaucua

SEQ ID NO: 1665165 - RNA, 18 nt, Homo sapiens
ucucuccaucuaccuucc

SEQ ID NO: 1665166 - RNA, 14 nt, Homo sapiens
ucucugaacugcaa

SEQ ID NO: 1665167 - RNA, 15 nt, Homo sapiens
ucucugaacugcaac

SEQ ID NO: 1665168 - RNA, 15 nt, Homo sapiens
ucucuguucuuucau

SEQ ID NO: 1665169 - RNA, 16 nt, Homo sapiens
ucucuguuuacccucc

SEQ ID NO: 1665170 - RNA, 21 nt, Homo sapiens
ucucuucaugcgcagucccca

SEQ ID NO: 1665171 - RNA, 13 nt, Homo sapiens
ucucuucuuccuu

SEQ ID NO: 1665172 - RNA, 12 nt, Homo sapiens
ucucuugauuca

SEQ ID NO: 1665173 - RNA, 22 nt, Homo sapiens
ucugaaaaaguguuuuuacaua

SEQ ID NO: 1665174 - RNA, 20 nt, Homo sapiens
ucugaacccuuccaccaaaa

SEQ ID NO: 1665175 - RNA, 18 nt, Homo sapiens
ucugaacugcaacacugg

SEQ ID NO: 1665176 - RNA, 13 nt, Homo sapiens
ucugaagaucuca

SEQ ID NO: 1665177 - RNA, 22 nt, Homo sapiens
ucugaagccuuuuccugagguc

SEQ ID NO: 1665178 - RNA, 15 nt, Homo sapiens
ucugaaggcugaguc

SEQ ID NO: 1665179 - RNA, 14 nt, Homo sapiens
ucugacuaacgcca

SEQ ID NO: 1665180 - RNA, 10 nt, Homo sapiens
ucugagacag

SEQ ID NO: 1665181 - RNA, 18 nt, Homo sapiens
ucugagacuaaaugagag

SEQ ID NO: 1665182 - RNA, 19 nt, Homo sapiens
ucugagacuaaaugagagg

SEQ ID NO: 1665183 - RNA, 13 nt, Homo sapiens
ucugagauacuaa

SEQ ID NO: 1665184 - RNA, 16 nt, Homo sapiens
uggccucaggcauuug

SEQ ID NO: 1665185 - RNA, 18 nt, Homo sapiens
uggccucccaccaggaau

SEQ ID NO: 1665186 - RNA, 14 nt, Homo sapiens
uggccuuuaggaag

SEQ ID NO: 1665187 - RNA, 14 nt, Homo sapiens
uggcuaaauucaug

SEQ ID NO: 1665188 - RNA, 16 nt, Homo sapiens
uggcuaccucuguccc

SEQ ID NO: 1665189 - RNA, 13 nt, Homo sapiens
uggcucacagcca

SEQ ID NO: 1665190 - RNA, 13 nt, Homo sapiens
uggcucaccuuug

SEQ ID NO: 1665191 - RNA, 16 nt, Homo sapiens
uggcucccaggguccu

SEQ ID NO: 1665192 - RNA, 19 nt, Homo sapiens
uggcucugagauacuaaua

SEQ ID NO: 1665193 - RNA, 16 nt, Homo sapiens
uggcuggaugugcauc

SEQ ID NO: 1665194 - RNA, 15 nt, Homo sapiens
uggcuuaagccugug

SEQ ID NO: 1665195 - RNA, 15 nt, Homo sapiens
ugggaaacacuuuga

SEQ ID NO: 1665196 - RNA, 21 nt, Homo sapiens
ugggaaacacuuugaggacau

SEQ ID NO: 1665197 - RNA, 20 nt, Homo sapiens
ugggaaauucuugcacugua

SEQ ID NO: 1665198 - RNA, 17 nt, Homo sapiens
ugggagaaaagccagau

SEQ ID NO: 1665199 - RNA, 23 nt, Homo sapiens
ugggagaggagaggcugcuguca

SEQ ID NO: 1665200 - RNA, 13 nt, Homo sapiens
ugggagcacagcu

SEQ ID NO: 1665201 - RNA, 15 nt, Homo sapiens
ugggaggaacaaaga

SEQ ID NO: 1665202 - RNA, 20 nt, Homo sapiens
ugggaguucagcugcuucuc

SEQ ID NO: 1665203 - RNA, 16 nt, Homo sapiens
ugggccaagccagggu

SEQ ID NO: 1665204 - RNA, 23 nt, Homo sapiens
ugggccaccccuaaucacuauug

SEQ ID NO: 1665205 - RNA, 13 nt, Homo sapiens
ugggcccuaggca

SEQ ID NO: 1665206 - RNA, 19 nt, Homo sapiens
ugggccuccugggugccag

SEQ ID NO: 1665207 - RNA, 14 nt, Homo sapiens
ugggccugccaaac

SEQ ID NO: 1665208 - RNA, 21 nt, Homo sapiens
ugggcguuugaacucagggag

SEQ ID NO: 1665209 - RNA, 21 nt, Homo sapiens
uggggacagaggauuucugcu

SEQ ID NO: 1665210 - RNA, 19 nt, Homo sapiens
uggggagcccggaggacag

SEQ ID NO: 1665211 - RNA, 19 nt, Homo sapiens
uggggccagcgcugaacag

SEQ ID NO: 1665212 - RNA, 18 nt, Homo sapiens
uggggggcacagccagaa

SEQ ID NO: 1665213 - RNA, 19 nt, Homo sapiens
uggggggcaggccucccaa

SEQ ID NO: 1665214 - RNA, 18 nt, Homo sapiens
uggggguggggcugcauc

SEQ ID NO: 1665215 - RNA, 17 nt, Homo sapiens
ugggguagagaggacag

SEQ ID NO: 1665216 - RNA, 14 nt, Homo sapiens
uggggucugugaug

SEQ ID NO: 1665217 - RNA, 21 nt, Homo sapiens
uggggucuuaggguacagccc

SEQ ID NO: 1665218 - RNA, 18 nt, Homo sapiens
uggguccucggcccugua

SEQ ID NO: 1665219 - RNA, 15 nt, Homo sapiens
ugggugggaggaaac

SEQ ID NO: 1665220 - RNA, 13 nt, Homo sapiens
ugguaaaucuuuu

SEQ ID NO: 1665221 - RNA, 14 nt, Homo sapiens
ugguaaaugucaca

SEQ ID NO: 1665222 - RNA, 12 nt, Homo sapiens
ugguaacugcac

SEQ ID NO: 1665223 - RNA, 16 nt, Homo sapiens
ugguaacugcacacau

SEQ ID NO: 1665224 - RNA, 14 nt, Homo sapiens
ugguagacugugac

SEQ ID NO: 1665225 - RNA, 20 nt, Homo sapiens
ugguaggaggcagagucucu

SEQ ID NO: 1665226 - RNA, 14 nt, Homo sapiens
ugguagguuacuca

SEQ ID NO: 1665227 - RNA, 17 nt, Homo sapiens
ugguaucuacuucuaca

SEQ ID NO: 1665228 - RNA, 23 nt, Homo sapiens
ugguccacacaccacagaagcuu

SEQ ID NO: 1665229 - RNA, 22 nt, Homo sapiens
ugguccuuaaaaaauaugcucu

SEQ ID NO: 1665230 - RNA, 16 nt, Homo sapiens
uggucugugugugaca

SEQ ID NO: 1665231 - RNA, 22 nt, Homo sapiens
uggugagaaucgaccucacugu

SEQ ID NO: 1665232 - RNA, 14 nt, Homo sapiens
uggugauggucucu

SEQ ID NO: 1665233 - RNA, 14 nt, Homo sapiens
ugguggacaugcac

SEQ ID NO: 1665234 - RNA, 23 nt, Homo sapiens
ugguggcagaguggauucuugaa

SEQ ID NO: 1665235 - RNA, 17 nt, Homo sapiens
uggugggccauggccau

SEQ ID NO: 1665236 - RNA, 12 nt, Homo sapiens
ugguggugguga

SEQ ID NO: 1665237 - RNA, 12 nt, Homo sapiens
ugguuaccucug

SEQ ID NO: 1665238 - RNA, 18 nt, Homo sapiens
ugguuagugcaugucaca

SEQ ID NO: 1665239 - RNA, 23 nt, Homo sapiens
ugguuagugcaugucacaugaca

SEQ ID NO: 1665240 - RNA, 21 nt, Homo sapiens
ugguuaucuaaccuguuccau

SEQ ID NO: 1665241 - RNA, 15 nt, Homo sapiens
ugguuaugucccaug

SEQ ID NO: 1665242 - RNA, 17 nt, Homo sapiens
ugguuaugucccaugac

SEQ ID NO: 1665243 - RNA, 23 nt, Homo sapiens
ugguuguugcaguucagacaaau

SEQ ID NO: 1665244 - RNA, 16 nt, Homo sapiens
ugguuuccaucaaagc

SEQ ID NO: 1665245 - RNA, 19 nt, Homo sapiens
ugguuuugcaugucugcau

SEQ ID NO: 1665246 - RNA, 15 nt, Homo sapiens
uguaaaaacuuuuaa

SEQ ID NO: 1665247 - RNA, 21 nt, Homo sapiens
uguaaaacugugacauuccac

SEQ ID NO: 1665248 - RNA, 15 nt, Homo sapiens
uguaaacaucauaaa

SEQ ID NO: 1665249 - RNA, 18 nt, Homo sapiens
uguaaagaauuuagcugu

SEQ ID NO: 1665250 - RNA, 22 nt, Homo sapiens
uguaaauaaugcuuaacauaaa

SEQ ID NO: 1665251 - RNA, 21 nt, Homo sapiens
uguaacggaugaccauaugca

SEQ ID NO: 1665252 - RNA, 13 nt, Homo sapiens
uguaagcaauucu

SEQ ID NO: 1665253 - RNA, 14 nt, Homo sapiens
uguaauauuuugcu

SEQ ID NO: 1665254 - RNA, 16 nt, Homo sapiens
uguaauuccucuagcu

SEQ ID NO: 1665255 - RNA, 18 nt, Homo sapiens
uguacaaaauauccaagc

SEQ ID NO: 1665256 - RNA, 23 nt, Homo sapiens
uguacaauaaagcaaugugguag

SEQ ID NO: 1665257 - RNA, 19 nt, Homo sapiens
uguacaguuauacauaccu

SEQ ID NO: 1665258 - RNA, 20 nt, Homo sapiens
uguacaguuauacauaccuc

SEQ ID NO: 1665259 - RNA, 20 nt, Homo sapiens
uguacauaguggucauuugg

SEQ ID NO: 1665260 - RNA, 18 nt, Homo sapiens
uguacauuuucuaacaaa

SEQ ID NO: 1665261 - RNA, 11 nt, Homo sapiens
uguacuacccc

SEQ ID NO: 1665262 - RNA, 13 nt, Homo sapiens
uguacuaccccag

SEQ ID NO: 1665263 - RNA, 14 nt, Homo sapiens
uguacuaccccagg

SEQ ID NO: 1665264 - RNA, 23 nt, Homo sapiens
uguacuggauuuaacuaccuuug

SEQ ID NO: 1665265 - RNA, 17 nt, Homo sapiens
uguagauaaagcacugu

SEQ ID NO: 1665266 - RNA, 14 nt, Homo sapiens
uguagcaacccagg

SEQ ID NO: 1665267 - RNA, 13 nt, Homo sapiens
uguagcauauaaa

SEQ ID NO: 1665268 - RNA, 23 nt, Homo sapiens
uguauaaaaaagaaaacuugugu

SEQ ID NO: 1665269 - RNA, 15 nt, Homo sapiens
uguauaauacuuugu

SEQ ID NO: 1665270 - RNA, 18 nt, Homo sapiens
uguauaucguuaucacug

SEQ ID NO: 1665271 - RNA, 17 nt, Homo sapiens
uguaugucuauguguau

SEQ ID NO: 1665272 - RNA, 16 nt, Homo sapiens
uguauucggcaccuuc

SEQ ID NO: 1665273 - RNA, 19 nt, Homo sapiens
uguauucucuucuacaaua

SEQ ID NO: 1665274 - RNA, 16 nt, Homo sapiens
uguauuuucacuggag

SEQ ID NO: 1665275 - RNA, 15 nt, Homo sapiens
ugucaaauggaugua

SEQ ID NO: 1665276 - RNA, 15 nt, Homo sapiens
ugucaaccugaauua

SEQ ID NO: 1665277 - RNA, 20 nt, Homo sapiens
ugucaguuugugaagugauu

SEQ ID NO: 1665278 - RNA, 22 nt, Homo sapiens
ugucauugaugaacugccaaag

SEQ ID NO: 1665279 - RNA, 14 nt, Homo sapiens
uguccacaaauguc

SEQ ID NO: 1665280 - RNA, 19 nt, Homo sapiens
uguccacaaauguccucag

SEQ ID NO: 1665281 - RNA, 20 nt, Homo sapiens
uguccacacuaccaguuuca

SEQ ID NO: 1665282 - RNA, 22 nt, Homo sapiens
uguccacguaucuuugggucuu

SEQ ID NO: 1665283 - RNA, 19 nt, Homo sapiens
uguccagggcagaggccau

SEQ ID NO: 1665284 - RNA, 13 nt, Homo sapiens
uguccuaaaugca

SEQ ID NO: 1665285 - RNA, 14 nt, Homo sapiens
uguccuacaauauc

SEQ ID NO: 1665286 - RNA, 16 nt, Homo sapiens
uguccugcaucaucuu

SEQ ID NO: 1665287 - RNA, 15 nt, Homo sapiens
uguccuuccaagaau

SEQ ID NO: 1665288 - RNA, 22 nt, Homo sapiens
uguccuuggcagaggcagggaa

SEQ ID NO: 1665289 - RNA, 19 nt, Homo sapiens
ugucgcaugagaacauuaa

SEQ ID NO: 1665290 - RNA, 19 nt, Homo sapiens
ugucuaauaaacacagauu

SEQ ID NO: 1665291 - RNA, 15 nt, Homo sapiens
ugucucuacaaaaaa

SEQ ID NO: 1665292 - RNA, 19 nt, Homo sapiens
ugucugagacagaaucuca

SEQ ID NO: 1665293 - RNA, 22 nt, Homo sapiens
ugucugcaugaaggucuaccug

SEQ ID NO: 1665294 - RNA, 17 nt, Homo sapiens
ugucuggccacacugga

SEQ ID NO: 1665295 - RNA, 23 nt, Homo sapiens
ugucuuuuuuuucuucaccucac

SEQ ID NO: 1665296 - RNA, 16 nt, Homo sapiens
ugugaaauacucuucc

SEQ ID NO: 1665297 - RNA, 18 nt, Homo sapiens
ugugaaauacucuuccaa

SEQ ID NO: 1665298 - RNA, 22 nt, Homo sapiens
ugugaagccuuuaucuauggga

SEQ ID NO: 1665299 - RNA, 23 nt, Homo sapiens
ugugaagccuuuaucuaugggag

SEQ ID NO: 1665300 - RNA, 16 nt, Homo sapiens
ugugaagugauugaca

SEQ ID NO: 1665301 - RNA, 13 nt, Homo sapiens
ugugacugaucuc

SEQ ID NO: 1665302 - RNA, 19 nt, Homo sapiens
ugugaggauagagacuugc

SEQ ID NO: 1665303 - RNA, 13 nt, Homo sapiens
ugugcagauauca

SEQ ID NO: 1665304 - RNA, 19 nt, Homo sapiens
ugugccaaaaugucaauuu

SEQ ID NO: 1665305 - RNA, 19 nt, Homo sapiens
ugugcuaaguugucuuaca

SEQ ID NO: 1665306 - RNA, 19 nt, Homo sapiens
auuaauguagggcagaaua

SEQ ID NO: 1665307 - RNA, 21 nt, Homo sapiens
auuacauccucugcuugucau

SEQ ID NO: 1665308 - RNA, 14 nt, Homo sapiens
auuaccauuuguua

SEQ ID NO: 1665309 - RNA, 14 nt, Homo sapiens
auuagacaaugugg

SEQ ID NO: 1665310 - RNA, 18 nt, Homo sapiens
auuagcucucaucuaguu

SEQ ID NO: 1665311 - RNA, 13 nt, Homo sapiens
auuagcugugauu

SEQ ID NO: 1665312 - RNA, 11 nt, Homo sapiens
auuagugccau

SEQ ID NO: 1665313 - RNA, 14 nt, Homo sapiens
auuauaaguugacc

SEQ ID NO: 1665314 - RNA, 14 nt, Homo sapiens
auuauauauacauu

SEQ ID NO: 1665315 - RNA, 20 nt, Homo sapiens
auuauauucccaaaucucaa

SEQ ID NO: 1665316 - RNA, 16 nt, Homo sapiens
auuauauuguuuuaua

SEQ ID NO: 1665317 - RNA, 14 nt, Homo sapiens
auuauccucaaguu

SEQ ID NO: 1665318 - RNA, 18 nt, Homo sapiens
auuauuacaacaagcaaa

SEQ ID NO: 1665319 - RNA, 13 nt, Homo sapiens
auuauuacuguuc

SEQ ID NO: 1665320 - RNA, 18 nt, Homo sapiens
auuauuggacuuccauuu

SEQ ID NO: 1665321 - RNA, 20 nt, Homo sapiens
auuauuuuugagacagaguc

SEQ ID NO: 1665322 - RNA, 22 nt, Homo sapiens
auucaaagaaucaccuaauuaa

SEQ ID NO: 1665323 - RNA, 14 nt, Homo sapiens
auucaacauuugcu

SEQ ID NO: 1665324 - RNA, 14 nt, Homo sapiens
auucaccaauauca

SEQ ID NO: 1665325 - RNA, 15 nt, Homo sapiens
auucacuuuaccuuc

SEQ ID NO: 1665326 - RNA, 19 nt, Homo sapiens
auucauaaugacuuaagca

SEQ ID NO: 1665327 - RNA, 18 nt, Homo sapiens
auucauaccuucugauga

SEQ ID NO: 1665328 - RNA, 16 nt, Homo sapiens
auuccaaucauuguua

SEQ ID NO: 1665329 - RNA, 22 nt, Homo sapiens
auuccaaucauuguuaaaguaa

SEQ ID NO: 1665330 - RNA, 19 nt, Homo sapiens
auuccaccuagagcuagau

SEQ ID NO: 1665331 - RNA, 15 nt, Homo sapiens
auuccaugaauuaaa

SEQ ID NO: 1665332 - RNA, 23 nt, Homo sapiens
auucccaaucccauuccugggcu

SEQ ID NO: 1665333 - RNA, 15 nt, Homo sapiens
auucccgccuaauaa

SEQ ID NO: 1665334 - RNA, 22 nt, Homo sapiens
auuccgaaaaaaaaauguucau

SEQ ID NO: 1665335 - RNA, 16 nt, Homo sapiens
auuccuucuugcucag

SEQ ID NO: 1665336 - RNA, 22 nt, Homo sapiens
auucguccuuagaauacuguau

SEQ ID NO: 1665337 - RNA, 18 nt, Homo sapiens
auucuaauuagauuaacc

SEQ ID NO: 1665338 - RNA, 14 nt, Homo sapiens
auucuacugaacag

SEQ ID NO: 1665339 - RNA, 15 nt, Homo sapiens
auucuagauuaccau

SEQ ID NO: 1665340 - RNA, 14 nt, Homo sapiens
auucuaugacaaua

SEQ ID NO: 1665341 - RNA, 17 nt, Homo sapiens
auucuauuaccuuguga

SEQ ID NO: 1665342 - RNA, 21 nt, Homo sapiens
auucuauuucaacuucaggaa

SEQ ID NO: 1665343 - RNA, 15 nt, Homo sapiens
auucucacagguuca

SEQ ID NO: 1665344 - RNA, 15 nt, Homo sapiens
auucucccuuuauga

SEQ ID NO: 1665345 - RNA, 14 nt, Homo sapiens
auucucccuuuauu

SEQ ID NO: 1665346 - RNA, 20 nt, Homo sapiens
auucugcccuggacagggcu

SEQ ID NO: 1665347 - RNA, 22 nt, Homo sapiens
auucugcuugguuccacaauca

SEQ ID NO: 1665348 - RNA, 23 nt, Homo sapiens
auucugcuugguuccacaaucau

SEQ ID NO: 1665349 - RNA, 19 nt, Homo sapiens
auucuuccaaguucauuca

SEQ ID NO: 1665350 - RNA, 20 nt, Homo sapiens
auucuugugucaucaaguag

SEQ ID NO: 1665351 - RNA, 19 nt, Homo sapiens
auugaaaagcaaaucugua

SEQ ID NO: 1665352 - RNA, 22 nt, Homo sapiens
auugaaugaugugauacaaauu

SEQ ID NO: 1665353 - RNA, 20 nt, Homo sapiens
auugacaagcacgcacacac

SEQ ID NO: 1665354 - RNA, 12 nt, Homo sapiens
auugacuucuuu

SEQ ID NO: 1665355 - RNA, 17 nt, Homo sapiens
auugacuucuuuuuggc

SEQ ID NO: 1665356 - RNA, 16 nt, Homo sapiens
auugagacacugucaa

SEQ ID NO: 1665357 - RNA, 20 nt, Homo sapiens
auugaggcuaaguaaccuga

SEQ ID NO: 1665358 - RNA, 15 nt, Homo sapiens
auugauuaaugaacu

SEQ ID NO: 1665359 - RNA, 16 nt, Homo sapiens
auugauuaaugaacua

SEQ ID NO: 1665360 - RNA, 22 nt, Homo sapiens
auugauuaaugaacuauuguua

SEQ ID NO: 1665361 - RNA, 18 nt, Homo sapiens
auugauuuuuaaacagca

SEQ ID NO: 1665362 - RNA, 20 nt, Homo sapiens
auugcuucauuaaaacaaga

SEQ ID NO: 1665363 - RNA, 16 nt, Homo sapiens
auuggacuuccauuug

SEQ ID NO: 1665364 - RNA, 22 nt, Homo sapiens
auuggaucaggaacccuuacag

SEQ ID NO: 1665365 - RNA, 17 nt, Homo sapiens
auuggcuuaaguaugcu

SEQ ID NO: 1665366 - RNA, 18 nt, Homo sapiens
auuguaaggaaugauuaa

SEQ ID NO: 1665367 - RNA, 15 nt, Homo sapiens
auuguaaucauaaau

SEQ ID NO: 1665368 - RNA, 14 nt, Homo sapiens
auuguacagaauca

SEQ ID NO: 1665369 - RNA, 20 nt, Homo sapiens
auuguacccuucuugucucu

SEQ ID NO: 1665370 - RNA, 17 nt, Homo sapiens
auuguauaaaacagugu

SEQ ID NO: 1665371 - RNA, 20 nt, Homo sapiens
auugucuccuugguuauauu

SEQ ID NO: 1665372 - RNA, 17 nt, Homo sapiens
auugugaagauuucaug

SEQ ID NO: 1665373 - RNA, 22 nt, Homo sapiens
auugugguuuauugaaugugau

SEQ ID NO: 1665374 - RNA, 15 nt, Homo sapiens
auuguguuaacuuau

SEQ ID NO: 1665375 - RNA, 20 nt, Homo sapiens
auuguuaaaaccuuacuuaa

SEQ ID NO: 1665376 - RNA, 21 nt, Homo sapiens
auuguuacagguguacuaugg

SEQ ID NO: 1665377 - RNA, 14 nt, Homo sapiens
auuguuucuuucaa

SEQ ID NO: 1665378 - RNA, 18 nt, Homo sapiens
auuuaaaagauccauuua

SEQ ID NO: 1665379 - RNA, 15 nt, Homo sapiens
auuuaaacuucuuaa

SEQ ID NO: 1665380 - RNA, 18 nt, Homo sapiens
auuuaaaggaaaguucua

SEQ ID NO: 1665381 - RNA, 15 nt, Homo sapiens
auuuaacuagcacuu

SEQ ID NO: 1665382 - RNA, 14 nt, Homo sapiens
auuuacaugugauu

SEQ ID NO: 1665383 - RNA, 19 nt, Homo sapiens
auuuacaugugauugugau

SEQ ID NO: 1665384 - RNA, 16 nt, Homo sapiens
auuuagcacaguauuu

SEQ ID NO: 1665385 - RNA, 13 nt, Homo sapiens
auuuauaacaauu

SEQ ID NO: 1665386 - RNA, 22 nt, Homo sapiens
auuuauaguguugcuuuccuug

SEQ ID NO: 1665387 - RNA, 14 nt, Homo sapiens
auuuaucugugaau

SEQ ID NO: 1665388 - RNA, 21 nt, Homo sapiens
auuuaucuuccauaugcucuu

SEQ ID NO: 1665389 - RNA, 24 nt, Homo sapiens
auuuauuaguuaggugugccaaac

SEQ ID NO: 1665390 - RNA, 16 nt, Homo sapiens
auuuauuucauccagu

SEQ ID NO: 1665391 - RNA, 15 nt, Homo sapiens
auuuauuuuguauga

SEQ ID NO: 1665392 - RNA, 13 nt, Homo sapiens
auuucaacuucag

SEQ ID NO: 1665393 - RNA, 13 nt, Homo sapiens
auuucaaugauug

SEQ ID NO: 1665394 - RNA, 23 nt, Homo sapiens
auuucagaccaguucuuugggcu

SEQ ID NO: 1665395 - RNA, 18 nt, Homo sapiens
auuucagucaucaucuca

SEQ ID NO: 1665396 - RNA, 22 nt, Homo sapiens
auuuccaaaccuccacugcugc

SEQ ID NO: 1665397 - RNA, 17 nt, Homo sapiens
auuuccacuacagugag

SEQ ID NO: 1665398 - RNA, 11 nt, Homo sapiens
auuuccuuuac

SEQ ID NO: 1665399 - RNA, 15 nt, Homo sapiens
auuucucacacucua

SEQ ID NO: 1665400 - RNA, 21 nt, Homo sapiens
auuucuccauuaaacuucuac

SEQ ID NO: 1665401 - RNA, 14 nt, Homo sapiens
auuucuuaugccug

SEQ ID NO: 1665402 - RNA, 23 nt, Homo sapiens
auuucuucuggagggaagcacca

SEQ ID NO: 1665403 - RNA, 21 nt, Homo sapiens
auuugaagaauuaaugacaac

SEQ ID NO: 1665404 - RNA, 15 nt, Homo sapiens
auuuggucucuugua

SEQ ID NO: 1665405 - RNA, 22 nt, Homo sapiens
auuugucacaaauaaacauaau

SEQ ID NO: 1665406 - RNA, 16 nt, Homo sapiens
auuuguuaauaucacu

SEQ ID NO: 1665407 - RNA, 13 nt, Homo sapiens
auuuuaauaaaga

SEQ ID NO: 1665408 - RNA, 19 nt, Homo sapiens
auuuuagcguuaaagucag

SEQ ID NO: 1665409 - RNA, 19 nt, Homo sapiens
auuuuauugcuggaaucua

SEQ ID NO: 1665410 - RNA, 13 nt, Homo sapiens
auuuuauuucaau

SEQ ID NO: 1665411 - RNA, 12 nt, Homo sapiens
auuuuccaauua

SEQ ID NO: 1665412 - RNA, 21 nt, Homo sapiens
auuuuccugagaugacugagu

SEQ ID NO: 1665413 - RNA, 21 nt, Homo sapiens
auuuuggaaauaggcauauca

SEQ ID NO: 1665414 - RNA, 23 nt, Homo sapiens
auuuuggucagaccgguugcucu

SEQ ID NO: 1665415 - RNA, 16 nt, Homo sapiens
auuuuguaaaauguau

SEQ ID NO: 1665416 - RNA, 12 nt, Homo sapiens
auuuuguugcau

SEQ ID NO: 1665417 - RNA, 18 nt, Homo sapiens
auuuuuacauaauugcca

SEQ ID NO: 1665418 - RNA, 14 nt, Homo sapiens
auuuuuaccuuuca

SEQ ID NO: 1665419 - RNA, 15 nt, Homo sapiens
auuuuucucaucucc

SEQ ID NO: 1665420 - RNA, 16 nt, Homo sapiens
auuuuugagacagagu

SEQ ID NO: 1665421 - RNA, 19 nt, Homo sapiens
caaaaaaaaaauuugccaa

SEQ ID NO: 1665422 - RNA, 21 nt, Homo sapiens
caaaaaaaaaauuugccaaga

SEQ ID NO: 1665423 - RNA, 19 nt, Homo sapiens
caaaaaaaggcggugagca

SEQ ID NO: 1665424 - RNA, 13 nt, Homo sapiens
caaaaacaacaac

SEQ ID NO: 1665425 - RNA, 12 nt, Homo sapiens
caaaaacugggu

SEQ ID NO: 1665426 - RNA, 19 nt, Homo sapiens
caaaaacuuuccaugacag

SEQ ID NO: 1665427 - RNA, 15 nt, Homo sapiens
caaaaagaaaaccca

SEQ ID NO: 1665428 - RNA, 18 nt, Homo sapiens
cagacuuaagcguacaaa

SEQ ID NO: 1665429 - RNA, 16 nt, Homo sapiens
cagacuucgcuauucc

SEQ ID NO: 1665430 - RNA, 15 nt, Homo sapiens
cagagacacaagccu

SEQ ID NO: 1665431 - RNA, 19 nt, Homo sapiens
cagagacuuuguguuuaca

SEQ ID NO: 1665432 - RNA, 15 nt, Homo sapiens
cagagagaaagaaga

SEQ ID NO: 1665433 - RNA, 18 nt, Homo sapiens
cagagagacccugccaac

SEQ ID NO: 1665434 - RNA, 22 nt, Homo sapiens
cagagauggcagagccauccac

SEQ ID NO: 1665435 - RNA, 19 nt, Homo sapiens
cagagauuuuccucuccaa

SEQ ID NO: 1665436 - RNA, 13 nt, Homo sapiens
cagagcagaucag

SEQ ID NO: 1665437 - RNA, 16 nt, Homo sapiens
cagagcauuauucuua

SEQ ID NO: 1665438 - RNA, 16 nt, Homo sapiens
cagagccaauggugca

SEQ ID NO: 1665439 - RNA, 14 nt, Homo sapiens
cagagccauccacc

SEQ ID NO: 1665440 - RNA, 12 nt, Homo sapiens
cagagcucccuc

SEQ ID NO: 1665441 - RNA, 17 nt, Homo sapiens
cagagcugccaccugcc

SEQ ID NO: 1665442 - RNA, 17 nt, Homo sapiens
cagagcuuuacagugcc

SEQ ID NO: 1665443 - RNA, 19 nt, Homo sapiens
cagagcuuuacagugccac

SEQ ID NO: 1665444 - RNA, 14 nt, Homo sapiens
cagaggccaugaag

SEQ ID NO: 1665445 - RNA, 14 nt, Homo sapiens
cagaggguugugau

SEQ ID NO: 1665446 - RNA, 21 nt, Homo sapiens
cagaggugugaauaaaagcau

SEQ ID NO: 1665447 - RNA, 17 nt, Homo sapiens
cagagucaagcugauga

SEQ ID NO: 1665448 - RNA, 19 nt, Homo sapiens
cagagucuuccucugucuc

SEQ ID NO: 1665449 - RNA, 20 nt, Homo sapiens
cagaguguccugcuaccuuu

SEQ ID NO: 1665450 - RNA, 16 nt, Homo sapiens
cagaguugguggagaa

SEQ ID NO: 1665451 - RNA, 15 nt, Homo sapiens
cagauaccugugagg

SEQ ID NO: 1665452 - RNA, 16 nt, Homo sapiens
cagaucaaaugugaaa

SEQ ID NO: 1665453 - RNA, 17 nt, Homo sapiens
cagauugcggugugaga

SEQ ID NO: 1665454 - RNA, 16 nt, Homo sapiens
cagcaaauaugggcug

SEQ ID NO: 1665455 - RNA, 16 nt, Homo sapiens
cagcaauaauugacaa

SEQ ID NO: 1665456 - RNA, 15 nt, Homo sapiens
cagcaauggcagauu

SEQ ID NO: 1665457 - RNA, 17 nt, Homo sapiens
cagcaauuguucaggga

SEQ ID NO: 1665458 - RNA, 20 nt, Homo sapiens
cagcaauuguucagggaaua

SEQ ID NO: 1665459 - RNA, 20 nt, Homo sapiens
cagcacauccgacaccuccc

SEQ ID NO: 1665460 - RNA, 15 nt, Homo sapiens
cagcacauguugcua

SEQ ID NO: 1665461 - RNA, 11 nt, Homo sapiens
cagcacccucc

SEQ ID NO: 1665462 - RNA, 20 nt, Homo sapiens
cagcacugaaaauaccauca

SEQ ID NO: 1665463 - RNA, 20 nt, Homo sapiens
cagcacuuugcucuuuuaau

SEQ ID NO: 1665464 - RNA, 11 nt, Homo sapiens
cagcagagcca

SEQ ID NO: 1665465 - RNA, 16 nt, Homo sapiens
cagcagagcucaagau

SEQ ID NO: 1665466 - RNA, 14 nt, Homo sapiens
cagcagcagcaguu

SEQ ID NO: 1665467 - RNA, 14 nt, Homo sapiens
cagcaggcucucag

SEQ ID NO: 1665468 - RNA, 16 nt, Homo sapiens
cagcaggcucucaggc

SEQ ID NO: 1665469 - RNA, 23 nt, Homo sapiens
cagcagggccacugaguagucau

SEQ ID NO: 1665470 - RNA, 20 nt, Homo sapiens
cagcagggugaagaguccaa

SEQ ID NO: 1665471 - RNA, 23 nt, Homo sapiens
cagcaguugcuagcaacaacuua

SEQ ID NO: 1665472 - RNA, 17 nt, Homo sapiens
cagcaguuuucuuuuaa

SEQ ID NO: 1665473 - RNA, 13 nt, Homo sapiens
cagcauaugcaaa

SEQ ID NO: 1665474 - RNA, 18 nt, Homo sapiens
cagcaucugccaggacac

SEQ ID NO: 1665475 - RNA, 23 nt, Homo sapiens
cagcaucugccaggacacugccu

SEQ ID NO: 1665476 - RNA, 21 nt, Homo sapiens
cagcaugugcucagccccaga

SEQ ID NO: 1665477 - RNA, 16 nt, Homo sapiens
cagccaccaccuggau

SEQ ID NO: 1665478 - RNA, 17 nt, Homo sapiens
cagccacggggacucag

SEQ ID NO: 1665479 - RNA, 16 nt, Homo sapiens
cagccacuuauuucca

SEQ ID NO: 1665480 - RNA, 12 nt, Homo sapiens
cagccaucugua

SEQ ID NO: 1665481 - RNA, 23 nt, Homo sapiens
cagccaucuguagaagguucuac

SEQ ID NO: 1665482 - RNA, 16 nt, Homo sapiens
cagccaugauucuuuu

SEQ ID NO: 1665483 - RNA, 16 nt, Homo sapiens
cagccauggcuggaug

SEQ ID NO: 1665484 - RNA, 19 nt, Homo sapiens
cagccccacuccacaguua

SEQ ID NO: 1665485 - RNA, 20 nt, Homo sapiens
cagccucccaaguagcugag

SEQ ID NO: 1665486 - RNA, 15 nt, Homo sapiens
cagccucugaaguug

SEQ ID NO: 1665487 - RNA, 19 nt, Homo sapiens
cagccugcacacaccugcc

SEQ ID NO: 1665488 - RNA, 21 nt, Homo sapiens
cagccuggccaacauaguggg

SEQ ID NO: 1665489 - RNA, 16 nt, Homo sapiens
cagccuguaacugucc

SEQ ID NO: 1665490 - RNA, 19 nt, Homo sapiens
cagccuguucucugacuaa

SEQ ID NO: 1665491 - RNA, 21 nt, Homo sapiens
cagcggagaggaccccauucu

SEQ ID NO: 1665492 - RNA, 19 nt, Homo sapiens
cagcuaacaaguagcacac

SEQ ID NO: 1665493 - RNA, 21 nt, Homo sapiens
cagcuaacucugaccugggag

SEQ ID NO: 1665494 - RNA, 17 nt, Homo sapiens
cagcucaccaacuacag

SEQ ID NO: 1665495 - RNA, 20 nt, Homo sapiens
cagcucucccucacaccucc

SEQ ID NO: 1665496 - RNA, 22 nt, Homo sapiens
cagcugaaagauugauuaauga

SEQ ID NO: 1665497 - RNA, 17 nt, Homo sapiens
cagcugaggcugucauu

SEQ ID NO: 1665498 - RNA, 20 nt, Homo sapiens
cagcugaggcugucauucca

SEQ ID NO: 1665499 - RNA, 15 nt, Homo sapiens
cagcugauugggcac

SEQ ID NO: 1665500 - RNA, 22 nt, Homo sapiens
cagcugauugggcaccugacca

SEQ ID NO: 1665501 - RNA, 15 nt, Homo sapiens
cagcugcaacagugg

SEQ ID NO: 1665502 - RNA, 16 nt, Homo sapiens
cagcugcaccagcagg

SEQ ID NO: 1665503 - RNA, 18 nt, Homo sapiens
cagcugcuugggcuucau

SEQ ID NO: 1665504 - RNA, 23 nt, Homo sapiens
cagcugggccuccugggugccag

SEQ ID NO: 1665505 - RNA, 16 nt, Homo sapiens
cagcugucuguggcuu

SEQ ID NO: 1665506 - RNA, 13 nt, Homo sapiens
cagcugugcugua

SEQ ID NO: 1665507 - RNA, 15 nt, Homo sapiens
cagcuucccugaaca

SEQ ID NO: 1665508 - RNA, 15 nt, Homo sapiens
cagcuuggagugcca

SEQ ID NO: 1665509 - RNA, 22 nt, Homo sapiens
cagcuuuauaauaaacuguuua

SEQ ID NO: 1665510 - RNA, 21 nt, Homo sapiens
cagcuuucucuuuguucuuca

SEQ ID NO: 1665511 - RNA, 14 nt, Homo sapiens
caggaaaccaacac

SEQ ID NO: 1665512 - RNA, 18 nt, Homo sapiens
caggaaauaucugugaag

SEQ ID NO: 1665513 - RNA, 14 nt, Homo sapiens
caggaacacuggag

SEQ ID NO: 1665514 - RNA, 22 nt, Homo sapiens
caggaacauuggagccugcaau

SEQ ID NO: 1665515 - RNA, 23 nt, Homo sapiens
caggaacccaucacugugucuca

SEQ ID NO: 1665516 - RNA, 13 nt, Homo sapiens
caggaaguacugg

SEQ ID NO: 1665517 - RNA, 14 nt, Homo sapiens
caggaaguacugga

SEQ ID NO: 1665518 - RNA, 21 nt, Homo sapiens
caggaaugcagcacaguacuc

SEQ ID NO: 1665519 - RNA, 21 nt, Homo sapiens
caggagaaaccccugacaccu

SEQ ID NO: 1665520 - RNA, 14 nt, Homo sapiens
caggagaaagaagg

SEQ ID NO: 1665521 - RNA, 14 nt, Homo sapiens
caggagagcccucu

SEQ ID NO: 1665522 - RNA, 15 nt, Homo sapiens
caggagcguguccua

SEQ ID NO: 1665523 - RNA, 12 nt, Homo sapiens
caggaguuccuu

SEQ ID NO: 1665524 - RNA, 22 nt, Homo sapiens
caggauaugaguacauacucaa

SEQ ID NO: 1665525 - RNA, 19 nt, Homo sapiens
caggauuggccacauugcc

SEQ ID NO: 1665526 - RNA, 14 nt, Homo sapiens
caggcaccaugcug

SEQ ID NO: 1665527 - RNA, 23 nt, Homo sapiens
caggcaccugcacuuacaggccu

SEQ ID NO: 1665528 - RNA, 14 nt, Homo sapiens
caggcagcugccug

SEQ ID NO: 1665529 - RNA, 12 nt, Homo sapiens
caggcagugcaa

SEQ ID NO: 1665530 - RNA, 11 nt, Homo sapiens
caggcauuuaa

SEQ ID NO: 1665531 - RNA, 17 nt, Homo sapiens
caggccccuuaccugca

SEQ ID NO: 1665532 - RNA, 18 nt, Homo sapiens
caggccggccagccucac

SEQ ID NO: 1665533 - RNA, 14 nt, Homo sapiens
caggccucagggac

SEQ ID NO: 1665534 - RNA, 14 nt, Homo sapiens
caggcucucaggcc

SEQ ID NO: 1665535 - RNA, 13 nt, Homo sapiens
caggcucugacca

SEQ ID NO: 1665536 - RNA, 18 nt, Homo sapiens
caggcuggagugcagugg

SEQ ID NO: 1665537 - RNA, 13 nt, Homo sapiens
cagggaaggugag

SEQ ID NO: 1665538 - RNA, 17 nt, Homo sapiens
cagggaaggugagccag

SEQ ID NO: 1665539 - RNA, 21 nt, Homo sapiens
cagggacagccugcacagugg

SEQ ID NO: 1665540 - RNA, 17 nt, Homo sapiens
cagggaucauagcugac

SEQ ID NO: 1665541 - RNA, 17 nt, Homo sapiens
cagggcagugcuaguga

SEQ ID NO: 1665542 - RNA, 20 nt, Homo sapiens
cagggccguaguaccuccca

SEQ ID NO: 1665543 - RNA, 18 nt, Homo sapiens
cagggccuguaaucccag

SEQ ID NO: 1665544 - RNA, 17 nt, Homo sapiens
cagggcgcuccggcaga

SEQ ID NO: 1665545 - RNA, 22 nt, Homo sapiens
caggguauaccucuaauaaccu

SEQ ID NO: 1665546 - RNA, 18 nt, Homo sapiens
cagguggugggccauggc

SEQ ID NO: 1665547 - RNA, 23 nt, Homo sapiens
cagguuccauccaccaccuugcc

SEQ ID NO: 1665548 - RNA, 18 nt, Homo sapiens
cagguuggagugcagugg

SEQ ID NO: 1665549 - RNA, 15 nt, Homo sapiens
caguaaauauacacu

SEQ ID NO: 1665550 - RNA, 15 nt, Homo sapiens
uaaauccacagugag

SEQ ID NO: 1665551 - RNA, 16 nt, Homo sapiens
uaaaucguaaccuaug

SEQ ID NO: 1665552 - RNA, 18 nt, Homo sapiens
uaaauguacuacauuugc

SEQ ID NO: 1665553 - RNA, 23 nt, Homo sapiens
uaaaugucuucauguugaugugu

SEQ ID NO: 1665554 - RNA, 12 nt, Homo sapiens
uaaauguuauau

SEQ ID NO: 1665555 - RNA, 16 nt, Homo sapiens
uaaauucaaaccuaag

SEQ ID NO: 1665556 - RNA, 15 nt, Homo sapiens
uaaauucaugcugcu

SEQ ID NO: 1665557 - RNA, 15 nt, Homo sapiens
uaaauuuucuuuaag

SEQ ID NO: 1665558 - RNA, 12 nt, Homo sapiens
uaacacagugca

SEQ ID NO: 1665559 - RNA, 13 nt, Homo sapiens
uaacacagugcag

SEQ ID NO: 1665560 - RNA, 14 nt, Homo sapiens
uaacacagugcagu

SEQ ID NO: 1665561 - RNA, 21 nt, Homo sapiens
uaacagcaauuguucagggaa

SEQ ID NO: 1665562 - RNA, 19 nt, Homo sapiens
uaacagcauaauugccuuu

SEQ ID NO: 1665563 - RNA, 18 nt, Homo sapiens
uaacaguaacugccauuu

SEQ ID NO: 1665564 - RNA, 14 nt, Homo sapiens
uaacagugcaguac

SEQ ID NO: 1665565 - RNA, 19 nt, Homo sapiens
uaacauaaacuuguacuua

SEQ ID NO: 1665566 - RNA, 14 nt, Homo sapiens
uaacaucaaagacu

SEQ ID NO: 1665567 - RNA, 16 nt, Homo sapiens
uaacauggaaguacua

SEQ ID NO: 1665568 - RNA, 17 nt, Homo sapiens
uaacaugucacaaugua

SEQ ID NO: 1665569 - RNA, 17 nt, Homo sapiens
uaaccccuagugucuuu

SEQ ID NO: 1665570 - RNA, 14 nt, Homo sapiens
uaaccucuacaggc

SEQ ID NO: 1665571 - RNA, 21 nt, Homo sapiens
uaaccucucugaacugcaaca

SEQ ID NO: 1665572 - RNA, 20 nt, Homo sapiens
uaaccucugaggaccucagc

SEQ ID NO: 1665573 - RNA, 13 nt, Homo sapiens
uaacuaauuugcu

SEQ ID NO: 1665574 - RNA, 16 nt, Homo sapiens
uaacuaauuugcucug

SEQ ID NO: 1665575 - RNA, 16 nt, Homo sapiens
uaacuagaguaugugu

SEQ ID NO: 1665576 - RNA, 13 nt, Homo sapiens
uaacuagaucucc

SEQ ID NO: 1665577 - RNA, 15 nt, Homo sapiens
uaacuccguuuccaa

SEQ ID NO: 1665578 - RNA, 20 nt, Homo sapiens
uaacucugaccugggagccc

SEQ ID NO: 1665579 - RNA, 13 nt, Homo sapiens
uaacucugcauag

SEQ ID NO: 1665580 - RNA, 17 nt, Homo sapiens
uaacugauuuccaucca

SEQ ID NO: 1665581 - RNA, 20 nt, Homo sapiens
uaacuuacaagaauggaauu

SEQ ID NO: 1665582 - RNA, 15 nt, Homo sapiens
uaacuuuaccaugcu

SEQ ID NO: 1665583 - RNA, 23 nt, Homo sapiens
uaacuuuuuuuuaguauuugccc

SEQ ID NO: 1665584 - RNA, 22 nt, Homo sapiens
uaagaaccuuuugagugccuua

SEQ ID NO: 1665585 - RNA, 22 nt, Homo sapiens
uaagacaacaaagagaagcaga

SEQ ID NO: 1665586 - RNA, 22 nt, Homo sapiens
uaagaccuccucccaagcacuu

SEQ ID NO: 1665587 - RNA, 12 nt, Homo sapiens
uaagagaaauga

SEQ ID NO: 1665588 - RNA, 21 nt, Homo sapiens
uaagaggcugcugaaaaccau

SEQ ID NO: 1665589 - RNA, 15 nt, Homo sapiens
uaagauaauguugcu

SEQ ID NO: 1665590 - RNA, 20 nt, Homo sapiens
uaagcacacuugacaucaac

SEQ ID NO: 1665591 - RNA, 22 nt, Homo sapiens
uaagccagggcacaaccagaaa

SEQ ID NO: 1665592 - RNA, 14 nt, Homo sapiens
uaagcucacacagc

SEQ ID NO: 1665593 - RNA, 21 nt, Homo sapiens
uaagcugcccaauuucacaga

SEQ ID NO: 1665594 - RNA, 23 nt, Homo sapiens
uaaggacuuuaggaaaaaaagca

SEQ ID NO: 1665595 - RNA, 17 nt, Homo sapiens
uaagggaaaaaugggaa

SEQ ID NO: 1665596 - RNA, 14 nt, Homo sapiens
uaagggaagcugau

SEQ ID NO: 1665597 - RNA, 19 nt, Homo sapiens
uaaggucugacaucagagg

SEQ ID NO: 1665598 - RNA, 16 nt, Homo sapiens
uaaguauuccuuggcc

SEQ ID NO: 1665599 - RNA, 19 nt, Homo sapiens
uaagucaaaauaaucugaa

SEQ ID NO: 1665600 - RNA, 16 nt, Homo sapiens
uaagucaccuguauaa

SEQ ID NO: 1665601 - RNA, 16 nt, Homo sapiens
uaagugcucaguauug

SEQ ID NO: 1665602 - RNA, 15 nt, Homo sapiens
uaaguggacuguauu

SEQ ID NO: 1665603 - RNA, 19 nt, Homo sapiens
uaauaaaagaaucauuugc

SEQ ID NO: 1665604 - RNA, 19 nt, Homo sapiens
uaauaaaauacauacuaua

SEQ ID NO: 1665605 - RNA, 13 nt, Homo sapiens
uaauaaagugcac

SEQ ID NO: 1665606 - RNA, 18 nt, Homo sapiens
uaauagcaagucuuagua

SEQ ID NO: 1665607 - RNA, 15 nt, Homo sapiens
uaauauuuauugcuu

SEQ ID NO: 1665608 - RNA, 15 nt, Homo sapiens
uaaucaauacuuuga

SEQ ID NO: 1665609 - RNA, 17 nt, Homo sapiens
uaauccaggacagcauu

SEQ ID NO: 1665610 - RNA, 18 nt, Homo sapiens
uaauccaggacagcauua

SEQ ID NO: 1665611 - RNA, 19 nt, Homo sapiens
uaaucgaaguaauuuuggg

SEQ ID NO: 1665612 - RNA, 17 nt, Homo sapiens
uaaugaaaccugugucu

SEQ ID NO: 1665613 - RNA, 19 nt, Homo sapiens
uaaugacuuaagcacacuu

SEQ ID NO: 1665614 - RNA, 21 nt, Homo sapiens
uaaugacuuaagcacacuuga

SEQ ID NO: 1665615 - RNA, 16 nt, Homo sapiens
uaaugauucaauguga

SEQ ID NO: 1665616 - RNA, 13 nt, Homo sapiens
uaauggcacugau

SEQ ID NO: 1665617 - RNA, 21 nt, Homo sapiens
uaauggcccuguagcucugaa

SEQ ID NO: 1665618 - RNA, 23 nt, Homo sapiens
uaauguacaauaaagcaaugugg

SEQ ID NO: 1665619 - RNA, 19 nt, Homo sapiens
uaauguagauaaagcacug

SEQ ID NO: 1665620 - RNA, 18 nt, Homo sapiens
uaauguuccaugucugaa

SEQ ID NO: 1665621 - RNA, 19 nt, Homo sapiens
uaauguuuacaacaauaaa

SEQ ID NO: 1665622 - RNA, 20 nt, Homo sapiens
uaauguuuuguaauuuugca

SEQ ID NO: 1665623 - RNA, 15 nt, Homo sapiens
uaauuaacuaacuca

SEQ ID NO: 1665624 - RNA, 13 nt, Homo sapiens
uaauuagugucca

SEQ ID NO: 1665625 - RNA, 22 nt, Homo sapiens
uaauuauaagcuaugucacuac

SEQ ID NO: 1665626 - RNA, 15 nt, Homo sapiens
uaauucccaauccca

SEQ ID NO: 1665627 - RNA, 20 nt, Homo sapiens
uaauucccaaucccauuccu

SEQ ID NO: 1665628 - RNA, 20 nt, Homo sapiens
uaauucucuucgcugugaug

SEQ ID NO: 1665629 - RNA, 15 nt, Homo sapiens
uaauucuuaccucau

SEQ ID NO: 1665630 - RNA, 16 nt, Homo sapiens
uaauucuuuaucacau

SEQ ID NO: 1665631 - RNA, 20 nt, Homo sapiens
uaauuguaaaggugaugaau

SEQ ID NO: 1665632 - RNA, 13 nt, Homo sapiens
uaauuuuguagua

SEQ ID NO: 1665633 - RNA, 16 nt, Homo sapiens
uacaaaaauaccuacu

SEQ ID NO: 1665634 - RNA, 22 nt, Homo sapiens
uacaaaaauaccuacugcugag

SEQ ID NO: 1665635 - RNA, 14 nt, Homo sapiens
uacaaaauauccaa

SEQ ID NO: 1665636 - RNA, 22 nt, Homo sapiens
uacaaacaggugcuaacacugu

SEQ ID NO: 1665637 - RNA, 21 nt, Homo sapiens
uacaaagugaucuuguucaca

SEQ ID NO: 1665638 - RNA, 22 nt, Homo sapiens
uacaaauuuuuacucaggcuuu

SEQ ID NO: 1665639 - RNA, 22 nt, Homo sapiens
uacaacacauugaaacuguauu

SEQ ID NO: 1665640 - RNA, 20 nt, Homo sapiens
uacaacaccagcaacauuau

SEQ ID NO: 1665641 - RNA, 17 nt, Homo sapiens
uacaaccuccgccuccc

SEQ ID NO: 1665642 - RNA, 15 nt, Homo sapiens
uacaagcuacauaug

SEQ ID NO: 1665643 - RNA, 20 nt, Homo sapiens
uacaaggccccaagguuuac

SEQ ID NO: 1665644 - RNA, 15 nt, Homo sapiens
uacaauacaguacuc

SEQ ID NO: 1665645 - RNA, 16 nt, Homo sapiens
uacaauacaguacuca

SEQ ID NO: 1665646 - RNA, 12 nt, Homo sapiens
uacaauguauca

SEQ ID NO: 1665647 - RNA, 20 nt, Homo sapiens
uacaauucuuuguugcuuaa

SEQ ID NO: 1665648 - RNA, 11 nt, Homo sapiens
uacacugccuu

SEQ ID NO: 1665649 - RNA, 15 nt, Homo sapiens
uacacuguauuacau

SEQ ID NO: 1665650 - RNA, 13 nt, Homo sapiens
uacagacaacaaa

SEQ ID NO: 1665651 - RNA, 14 nt, Homo sapiens
uacagacagaauau

SEQ ID NO: 1665652 - RNA, 22 nt, Homo sapiens
uacagaccacaaaauguaauau

SEQ ID NO: 1665653 - RNA, 16 nt, Homo sapiens
uacaggagaagaaaca

SEQ ID NO: 1665654 - RNA, 13 nt, Homo sapiens
uacaggugugagc

SEQ ID NO: 1665655 - RNA, 15 nt, Homo sapiens
uacagucacauucag

SEQ ID NO: 1665656 - RNA, 20 nt, Homo sapiens
uacaguggcaguauugacaa

SEQ ID NO: 1665657 - RNA, 20 nt, Homo sapiens
uacauaauguuaguagcacu

SEQ ID NO: 1665658 - RNA, 14 nt, Homo sapiens
uacauaugcuuuaa

SEQ ID NO: 1665659 - RNA, 20 nt, Homo sapiens
uacauauggaaauccuguua

SEQ ID NO: 1665660 - RNA, 21 nt, Homo sapiens
uacaugccuuuccagugcugc

SEQ ID NO: 1665661 - RNA, 14 nt, Homo sapiens
uacauggguucaau

SEQ ID NO: 1665662 - RNA, 23 nt, Homo sapiens
uacaugugauugugauucaucau

SEQ ID NO: 1665663 - RNA, 21 nt, Homo sapiens
uacauguuuauuauguucaau

SEQ ID NO: 1665664 - RNA, 19 nt, Homo sapiens
uacauguuuuagacagaga

SEQ ID NO: 1665665 - RNA, 16 nt, Homo sapiens
uacauuagugccauag

SEQ ID NO: 1665666 - RNA, 12 nt, Homo sapiens
uacauuugcaug

SEQ ID NO: 1665667 - RNA, 18 nt, Homo sapiens
uaccaaagaagaguuuac

SEQ ID NO: 1665668 - RNA, 13 nt, Homo sapiens
uaccaaaugccuu

SEQ ID NO: 1665669 - RNA, 20 nt, Homo sapiens
uaccaaaugccuuucuagca

SEQ ID NO: 1665670 - RNA, 20 nt, Homo sapiens
uaccaagugcuuugcucuag

SEQ ID NO: 1665671 - RNA, 13 nt, Homo sapiens
uaccacauucacu

SEQ ID NO: 1665672 - RNA, 23 nt, Homo sapiens
ucagaagcaucgcuccucuccag

SEQ ID NO: 1665673 - RNA, 23 nt, Homo sapiens
ucagaagcccauuaaaauaguua

SEQ ID NO: 1665674 - RNA, 18 nt, Homo sapiens
ucagaauauuaagcacau

SEQ ID NO: 1665675 - RNA, 14 nt, Homo sapiens
ucagaauguguuau

SEQ ID NO: 1665676 - RNA, 14 nt, Homo sapiens
ucagaccaguucuu

SEQ ID NO: 1665677 - RNA, 16 nt, Homo sapiens
ucagagcaagcacugg

SEQ ID NO: 1665678 - RNA, 22 nt, Homo sapiens
ucagagcccaggaauucucaca

SEQ ID NO: 1665679 - RNA, 18 nt, Homo sapiens
ucagaggugaaugcacag

SEQ ID NO: 1665680 - RNA, 21 nt, Homo sapiens
ucagaucccucggucagcacc

SEQ ID NO: 1665681 - RNA, 14 nt, Homo sapiens
ucagauuccaccua

SEQ ID NO: 1665682 - RNA, 15 nt, Homo sapiens
ucagauuccaccuag

SEQ ID NO: 1665683 - RNA, 20 nt, Homo sapiens
ucagcaacuguuagcuggga

SEQ ID NO: 1665684 - RNA, 23 nt, Homo sapiens
ucagcaugauguguuguguauaa

SEQ ID NO: 1665685 - RNA, 22 nt, Homo sapiens
ucagccauuccuguucccauga

SEQ ID NO: 1665686 - RNA, 18 nt, Homo sapiens
ucagccccuucauggaag

SEQ ID NO: 1665687 - RNA, 19 nt, Homo sapiens
ucaggaaaggaagauguaa

SEQ ID NO: 1665688 - RNA, 20 nt, Homo sapiens
ucaggaaugggccaagccag

SEQ ID NO: 1665689 - RNA, 18 nt, Homo sapiens
ucaggaccacccugccaa

SEQ ID NO: 1665690 - RNA, 12 nt, Homo sapiens
ucaggcaccugc

SEQ ID NO: 1665691 - RNA, 15 nt, Homo sapiens
ucaggcagugcagua

SEQ ID NO: 1665692 - RNA, 13 nt, Homo sapiens
ucaggccauucag

SEQ ID NO: 1665693 - RNA, 20 nt, Homo sapiens
ucaggcucugaaucucucaa

SEQ ID NO: 1665694 - RNA, 18 nt, Homo sapiens
ucaguaaaucagugcagu

SEQ ID NO: 1665695 - RNA, 19 nt, Homo sapiens
ucaguaaaucagugcagua

SEQ ID NO: 1665696 - RNA, 19 nt, Homo sapiens
ucaguaacacagugcagua

SEQ ID NO: 1665697 - RNA, 23 nt, Homo sapiens
ucaguaacacagugcaguacuca

SEQ ID NO: 1665698 - RNA, 21 nt, Homo sapiens
ucaguaacaguguaguacuca

SEQ ID NO: 1665699 - RNA, 15 nt, Homo sapiens
ucaguaaccaugcaa

SEQ ID NO: 1665700 - RNA, 18 nt, Homo sapiens
ucaguaagacagugcagu

SEQ ID NO: 1665701 - RNA, 19 nt, Homo sapiens
ucaguaagacagugcagug

SEQ ID NO: 1665702 - RNA, 14 nt, Homo sapiens
ucaguaagaucaag

SEQ ID NO: 1665703 - RNA, 23 nt, Homo sapiens
ucaguaaggcagugaaguacuca

SEQ ID NO: 1665704 - RNA, 23 nt, Homo sapiens
ucaguaaggcagugcaguacuca

SEQ ID NO: 1665705 - RNA, 21 nt, Homo sapiens
ucaguaauacaauacaguacu

SEQ ID NO: 1665706 - RNA, 13 nt, Homo sapiens
ucaguaaucuguc

SEQ ID NO: 1665707 - RNA, 16 nt, Homo sapiens
ucaguagugccuguga

SEQ ID NO: 1665708 - RNA, 15 nt, Homo sapiens
ucaguauugagacac

SEQ ID NO: 1665709 - RNA, 21 nt, Homo sapiens
ucagugaagcccaggaggacc

SEQ ID NO: 1665710 - RNA, 21 nt, Homo sapiens
ucagugccaaaaacaacaaca

SEQ ID NO: 1665711 - RNA, 15 nt, Homo sapiens
ucaguguacucugag

SEQ ID NO: 1665712 - RNA, 21 nt, Homo sapiens
ucagugugauaaggacuuuag

SEQ ID NO: 1665713 - RNA, 21 nt, Homo sapiens
ucaguuacaguggcaguauug

SEQ ID NO: 1665714 - RNA, 22 nt, Homo sapiens
ucaguucauggcaucacaucuu

SEQ ID NO: 1665715 - RNA, 16 nt, Homo sapiens
ucaguuccuuucaucc

SEQ ID NO: 1665716 - RNA, 14 nt, Homo sapiens
ucaguuggugcugc

SEQ ID NO: 1665717 - RNA, 16 nt, Homo sapiens
ucaguuggugcugcuu

SEQ ID NO: 1665718 - RNA, 13 nt, Homo sapiens
ucauaaugacuua

SEQ ID NO: 1665719 - RNA, 14 nt, Homo sapiens
ucauaccauccauc

SEQ ID NO: 1665720 - RNA, 16 nt, Homo sapiens
ucauaccucugaccaa

SEQ ID NO: 1665721 - RNA, 15 nt, Homo sapiens
ucauacuacauuuga

SEQ ID NO: 1665722 - RNA, 14 nt, Homo sapiens
ucauacucaaagag

SEQ ID NO: 1665723 - RNA, 12 nt, Homo sapiens
ucauaugcagaa

SEQ ID NO: 1665724 - RNA, 21 nt, Homo sapiens
ucaucaacaaagaaauauuau

SEQ ID NO: 1665725 - RNA, 22 nt, Homo sapiens
ucaucacuuaauuacuuacuca

SEQ ID NO: 1665726 - RNA, 16 nt, Homo sapiens
ucauccagaacugucu

SEQ ID NO: 1665727 - RNA, 15 nt, Homo sapiens
ucauccuccacugaa

SEQ ID NO: 1665728 - RNA, 16 nt, Homo sapiens
ucaucucagcucacug

SEQ ID NO: 1665729 - RNA, 17 nt, Homo sapiens
ucaucugaggaguccaa

SEQ ID NO: 1665730 - RNA, 12 nt, Homo sapiens
ucaucugucagc

SEQ ID NO: 1665731 - RNA, 22 nt, Homo sapiens
ucaucuuguaaauaaugcuuaa

SEQ ID NO: 1665732 - RNA, 20 nt, Homo sapiens
ucaugauggugguuggggug

SEQ ID NO: 1665733 - RNA, 23 nt, Homo sapiens
ucaugcccagcuuggagugccac

SEQ ID NO: 1665734 - RNA, 20 nt, Homo sapiens
ucaugcugcuuagaugacau

SEQ ID NO: 1665735 - RNA, 16 nt, Homo sapiens
ucaugcuucuacucca

SEQ ID NO: 1665736 - RNA, 15 nt, Homo sapiens
ucauguucaucucag

SEQ ID NO: 1665737 - RNA, 13 nt, Homo sapiens
ucauguucauuca

SEQ ID NO: 1665738 - RNA, 18 nt, Homo sapiens
ucauguuuaauuugcauc

SEQ ID NO: 1665739 - RNA, 13 nt, Homo sapiens
ucauucuacugaa

SEQ ID NO: 1665740 - RNA, 20 nt, Homo sapiens
ucauucuacugaacagucca

SEQ ID NO: 1665741 - RNA, 12 nt, Homo sapiens
ucauucugcuaa

SEQ ID NO: 1665742 - RNA, 13 nt, Homo sapiens
ucauuuagcauug

SEQ ID NO: 1665743 - RNA, 13 nt, Homo sapiens
ucauuuauuucca

SEQ ID NO: 1665744 - RNA, 11 nt, Homo sapiens
ucauuugcauc

SEQ ID NO: 1665745 - RNA, 23 nt, Homo sapiens
ucauuuucuagcccucucccuca

SEQ ID NO: 1665746 - RNA, 22 nt, Homo sapiens
ucauuuucuguuauacacaguu

SEQ ID NO: 1665747 - RNA, 12 nt, Homo sapiens
uccaaaccucca

SEQ ID NO: 1665748 - RNA, 19 nt, Homo sapiens
uccaaaccuccacugcugc

SEQ ID NO: 1665749 - RNA, 17 nt, Homo sapiens
uccaaagcugaagacuu

SEQ ID NO: 1665750 - RNA, 23 nt, Homo sapiens
uccaaagcuuguucuucuugagc

SEQ ID NO: 1665751 - RNA, 21 nt, Homo sapiens
uccaaaggguuuuaagccagg

SEQ ID NO: 1665752 - RNA, 14 nt, Homo sapiens
uccaaaguuaucca

SEQ ID NO: 1665753 - RNA, 15 nt, Homo sapiens
uccaaaucuugccau

SEQ ID NO: 1665754 - RNA, 19 nt, Homo sapiens
uccaagaauaaagucuuuc

SEQ ID NO: 1665755 - RNA, 23 nt, Homo sapiens
uccaagccucucuggcacuuuga

SEQ ID NO: 1665756 - RNA, 19 nt, Homo sapiens
uccaagugaaugaguuucc

SEQ ID NO: 1665757 - RNA, 17 nt, Homo sapiens
uccaagugugugugcaa

SEQ ID NO: 1665758 - RNA, 17 nt, Homo sapiens
uccaaugccaauucauc

SEQ ID NO: 1665759 - RNA, 18 nt, Homo sapiens
uccaaugccaauucaucu

SEQ ID NO: 1665760 - RNA, 18 nt, Homo sapiens
uccacaauuuugucucua

SEQ ID NO: 1665761 - RNA, 15 nt, Homo sapiens
uccacacacagcagc

SEQ ID NO: 1665762 - RNA, 22 nt, Homo sapiens
uccacagggacacacgugagcc

SEQ ID NO: 1665763 - RNA, 16 nt, Homo sapiens
uccacaugcucugaga

SEQ ID NO: 1665764 - RNA, 21 nt, Homo sapiens
uccaccccagcaggacaguga

SEQ ID NO: 1665765 - RNA, 16 nt, Homo sapiens
uccacgcucaaucuca

SEQ ID NO: 1665766 - RNA, 14 nt, Homo sapiens
uccacuacagugag

SEQ ID NO: 1665767 - RNA, 21 nt, Homo sapiens
uccagaacugucuuagucaua

SEQ ID NO: 1665768 - RNA, 16 nt, Homo sapiens
uccagacaccaucacc

SEQ ID NO: 1665769 - RNA, 15 nt, Homo sapiens
uccagacauacgaaa

SEQ ID NO: 1665770 - RNA, 18 nt, Homo sapiens
uccagaggggugcgcaga

SEQ ID NO: 1665771 - RNA, 19 nt, Homo sapiens
uccagaugugccuagacac

SEQ ID NO: 1665772 - RNA, 18 nt, Homo sapiens
uccagcauccacucuccc

SEQ ID NO: 1665773 - RNA, 22 nt, Homo sapiens
uccaggagaugaggcuggauag

SEQ ID NO: 1665774 - RNA, 16 nt, Homo sapiens
uccagguuacuaaagg

SEQ ID NO: 1665775 - RNA, 15 nt, Homo sapiens
uccagguuccaucca

SEQ ID NO: 1665776 - RNA, 23 nt, Homo sapiens
uccaguagcuccgcgugucucau

SEQ ID NO: 1665777 - RNA, 16 nt, Homo sapiens
uccagugugacuuuau

SEQ ID NO: 1665778 - RNA, 17 nt, Homo sapiens
uccauagacacaguauu

SEQ ID NO: 1665779 - RNA, 18 nt, Homo sapiens
uccauagacacaguauug

SEQ ID NO: 1665780 - RNA, 14 nt, Homo sapiens
uccauaucagcucu

SEQ ID NO: 1665781 - RNA, 15 nt, Homo sapiens
uccaucuaccuucca

SEQ ID NO: 1665782 - RNA, 14 nt, Homo sapiens
uccaucuccagugg

SEQ ID NO: 1665783 - RNA, 22 nt, Homo sapiens
uccaugacugcauuuuacugua

SEQ ID NO: 1665784 - RNA, 23 nt, Homo sapiens
uccaugacugcauuuuacuguac

SEQ ID NO: 1665785 - RNA, 15 nt, Homo sapiens
uccauucagucugca

SEQ ID NO: 1665786 - RNA, 12 nt, Homo sapiens
ucccaaacccuu

SEQ ID NO: 1665787 - RNA, 13 nt, Homo sapiens
ucccaaagugcug

SEQ ID NO: 1665788 - RNA, 15 nt, Homo sapiens
ucccaagaugcagaa

SEQ ID NO: 1665789 - RNA, 19 nt, Homo sapiens
ucccaaucagcacugaaaa

SEQ ID NO: 1665790 - RNA, 18 nt, Homo sapiens
ucccaaucccauuccugg

SEQ ID NO: 1665791 - RNA, 20 nt, Homo sapiens
ucccacccccagcagcucac

SEQ ID NO: 1665792 - RNA, 17 nt, Homo sapiens
ucccaguuaacuguuaa

SEQ ID NO: 1665793 - RNA, 20 nt, Homo sapiens
ucccaucugaagaguggaaa

SEQ ID NO: 1665794 - RNA, 17 nt, Homo sapiens
ugaagaguggaaauggg

SEQ ID NO: 1665795 - RNA, 12 nt, Homo sapiens
ugaagauuucau

SEQ ID NO: 1665796 - RNA, 17 nt, Homo sapiens
ugaagcguuacuacagc

SEQ ID NO: 1665797 - RNA, 21 nt, Homo sapiens
ugaagcugggagaaccaaaaa

SEQ ID NO: 1665798 - RNA, 14 nt, Homo sapiens
ugaaggaaugcaau

SEQ ID NO: 1665799 - RNA, 14 nt, Homo sapiens
ugaaggacuacagg

SEQ ID NO: 1665800 - RNA, 17 nt, Homo sapiens
ugaaguacucaguaaua

SEQ ID NO: 1665801 - RNA, 17 nt, Homo sapiens
ugaagucccucuauguc

SEQ ID NO: 1665802 - RNA, 20 nt, Homo sapiens
ugaaguuugccccagugcua

SEQ ID NO: 1665803 - RNA, 13 nt, Homo sapiens
ugaauaaaagcau

SEQ ID NO: 1665804 - RNA, 17 nt, Homo sapiens
ugaauaaauaaguaaau

SEQ ID NO: 1665805 - RNA, 19 nt, Homo sapiens
ugaauaagacaacaaagag

SEQ ID NO: 1665806 - RNA, 21 nt, Homo sapiens
ugaauagcgcccucaacccug

SEQ ID NO: 1665807 - RNA, 18 nt, Homo sapiens
ugaauauaaauguacuac

SEQ ID NO: 1665808 - RNA, 16 nt, Homo sapiens
ugaauauucaacagcu

SEQ ID NO: 1665809 - RNA, 15 nt, Homo sapiens
ugaauauuuugcaau

SEQ ID NO: 1665810 - RNA, 14 nt, Homo sapiens
ugaaugccagucca

SEQ ID NO: 1665811 - RNA, 20 nt, Homo sapiens
ugaaugugucccaugcauaa

SEQ ID NO: 1665812 - RNA, 16 nt, Homo sapiens
ugaauuuuggcugugu

SEQ ID NO: 1665813 - RNA, 13 nt, Homo sapiens
ugacaauaagaaa

SEQ ID NO: 1665814 - RNA, 13 nt, Homo sapiens
ugacaauggugcc

SEQ ID NO: 1665815 - RNA, 18 nt, Homo sapiens
ugacagcagagaaguauu

SEQ ID NO: 1665816 - RNA, 22 nt, Homo sapiens
ugacaggaacccaucacugugu

SEQ ID NO: 1665817 - RNA, 14 nt, Homo sapiens
ugacaggauaugag

SEQ ID NO: 1665818 - RNA, 14 nt, Homo sapiens
ugacaggcaguguu

SEQ ID NO: 1665819 - RNA, 14 nt, Homo sapiens
ugacaggccuuccu

SEQ ID NO: 1665820 - RNA, 20 nt, Homo sapiens
ugacaguagcauacugauga

SEQ ID NO: 1665821 - RNA, 12 nt, Homo sapiens
ugacaugcucca

SEQ ID NO: 1665822 - RNA, 23 nt, Homo sapiens
ugaccagcauaccaguucuugca

SEQ ID NO: 1665823 - RNA, 19 nt, Homo sapiens
ugacccccugcugccaucu

SEQ ID NO: 1665824 - RNA, 16 nt, Homo sapiens
ugacccuccaccgcag

SEQ ID NO: 1665825 - RNA, 18 nt, Homo sapiens
ugacccugugccuguguu

SEQ ID NO: 1665826 - RNA, 18 nt, Homo sapiens
ugaccuuggagagacaca

SEQ ID NO: 1665827 - RNA, 21 nt, Homo sapiens
ugaccuuggagagacacagcg

SEQ ID NO: 1665828 - RNA, 16 nt, Homo sapiens
ugaccuuuagguauua

SEQ ID NO: 1665829 - RNA, 22 nt, Homo sapiens
ugacuauuucaccauguugcca

SEQ ID NO: 1665830 - RNA, 23 nt, Homo sapiens
ugacugugaggugggccuuugag

SEQ ID NO: 1665831 - RNA, 12 nt, Homo sapiens
ugacuguuuaca

SEQ ID NO: 1665832 - RNA, 15 nt, Homo sapiens
ugacuuaagcacacu

SEQ ID NO: 1665833 - RNA, 23 nt, Homo sapiens
ugacuuaagcacacuugacauca

SEQ ID NO: 1665834 - RNA, 14 nt, Homo sapiens
ugacuuaugugcag

SEQ ID NO: 1665835 - RNA, 14 nt, Homo sapiens
ugagaaaacuguga

SEQ ID NO: 1665836 - RNA, 20 nt, Homo sapiens
ugagaaagccuggcuuguau

SEQ ID NO: 1665837 - RNA, 15 nt, Homo sapiens
ugagaaaucucaucc

SEQ ID NO: 1665838 - RNA, 18 nt, Homo sapiens
ugagaaauugugccaaag

SEQ ID NO: 1665839 - RNA, 16 nt, Homo sapiens
ugagaagaccaggaaa

SEQ ID NO: 1665840 - RNA, 18 nt, Homo sapiens
ugagaagugcaacugcua

SEQ ID NO: 1665841 - RNA, 21 nt, Homo sapiens
ugagaaucaccccucucagug

SEQ ID NO: 1665842 - RNA, 23 nt, Homo sapiens
ugagaauugaggggagguggcca

SEQ ID NO: 1665843 - RNA, 14 nt, Homo sapiens
ugagacacugucaa

SEQ ID NO: 1665844 - RNA, 21 nt, Homo sapiens
ugagacuuccuauuaauuuau

SEQ ID NO: 1665845 - RNA, 15 nt, Homo sapiens
ugagagaaagccaca

SEQ ID NO: 1665846 - RNA, 16 nt, Homo sapiens
ugagagaaagccacaa

SEQ ID NO: 1665847 - RNA, 13 nt, Homo sapiens
ugagagccuccag

SEQ ID NO: 1665848 - RNA, 14 nt, Homo sapiens
ugagauaacauuuc

SEQ ID NO: 1665849 - RNA, 20 nt, Homo sapiens
ugagauuuccugacagggaa

SEQ ID NO: 1665850 - RNA, 18 nt, Homo sapiens
ugagcaaacugaagccca

SEQ ID NO: 1665851 - RNA, 16 nt, Homo sapiens
ugagcacagcaaggga

SEQ ID NO: 1665852 - RNA, 20 nt, Homo sapiens
ugagcauuuagacucucgac

SEQ ID NO: 1665853 - RNA, 15 nt, Homo sapiens
ugagccacucagagc

SEQ ID NO: 1665854 - RNA, 15 nt, Homo sapiens
ugagccagaguucac

SEQ ID NO: 1665855 - RNA, 14 nt, Homo sapiens
ugagcuugauucua

SEQ ID NO: 1665856 - RNA, 13 nt, Homo sapiens
ugaggaaggccgu

SEQ ID NO: 1665857 - RNA, 23 nt, Homo sapiens
ugaggaccaggugucucugagaa

SEQ ID NO: 1665858 - RNA, 15 nt, Homo sapiens
ugaggacccucccag

SEQ ID NO: 1665859 - RNA, 17 nt, Homo sapiens
ugaggacuguuggcuga

SEQ ID NO: 1665860 - RNA, 18 nt, Homo sapiens
ugaggaggauguauguca

SEQ ID NO: 1665861 - RNA, 17 nt, Homo sapiens
ugaggcaggagaauggc

SEQ ID NO: 1665862 - RNA, 23 nt, Homo sapiens
ugaggccaaauauugaucuguau

SEQ ID NO: 1665863 - RNA, 15 nt, Homo sapiens
ugaggcccacucugu

SEQ ID NO: 1665864 - RNA, 16 nt, Homo sapiens
ugaggcccacucuguu

SEQ ID NO: 1665865 - RNA, 17 nt, Homo sapiens
ugagggaaaacauaaua

SEQ ID NO: 1665866 - RNA, 16 nt, Homo sapiens
ugaguguauguauaca

SEQ ID NO: 1665867 - RNA, 19 nt, Homo sapiens
ugaguguccacagggacac

SEQ ID NO: 1665868 - RNA, 20 nt, Homo sapiens
ugaguuggggcgacugugaa

SEQ ID NO: 1665869 - RNA, 22 nt, Homo sapiens
ugaguuucauuuuucauuuucu

SEQ ID NO: 1665870 - RNA, 17 nt, Homo sapiens
ugaguuugaacacagau

SEQ ID NO: 1665871 - RNA, 14 nt, Homo sapiens
ugauaacagaguga

SEQ ID NO: 1665872 - RNA, 16 nt, Homo sapiens
ugauaauuacuuucca

SEQ ID NO: 1665873 - RNA, 22 nt, Homo sapiens
ugauagaagaaggacugaagaa

SEQ ID NO: 1665874 - RNA, 23 nt, Homo sapiens
ugauagugucccacggugccuug

SEQ ID NO: 1665875 - RNA, 14 nt, Homo sapiens
ugauauauuuucca

SEQ ID NO: 1665876 - RNA, 17 nt, Homo sapiens
ugauauguguaauauca

SEQ ID NO: 1665877 - RNA, 22 nt, Homo sapiens
ugauccguguguaccaucuuug

SEQ ID NO: 1665878 - RNA, 15 nt, Homo sapiens
ugaucgcuuucuaca

SEQ ID NO: 1665879 - RNA, 12 nt, Homo sapiens
ugaucugagaag

SEQ ID NO: 1665880 - RNA, 18 nt, Homo sapiens
ugaucuuuggaaugcaug

SEQ ID NO: 1665881 - RNA, 19 nt, Homo sapiens
ugaugagacaacacacaca

SEQ ID NO: 1665882 - RNA, 12 nt, Homo sapiens
ugaugauguucu

SEQ ID NO: 1665883 - RNA, 13 nt, Homo sapiens
ugaugauguucug

SEQ ID NO: 1665884 - RNA, 14 nt, Homo sapiens
ugaugcaggcagug

SEQ ID NO: 1665885 - RNA, 23 nt, Homo sapiens
ugauggccaggccucagggacca

SEQ ID NO: 1665886 - RNA, 21 nt, Homo sapiens
ugauggggaguaaacccugga

SEQ ID NO: 1665887 - RNA, 21 nt, Homo sapiens
ugauggguccccuccagguua

SEQ ID NO: 1665888 - RNA, 12 nt, Homo sapiens
ugaugugcucau

SEQ ID NO: 1665889 - RNA, 15 nt, Homo sapiens
ugauuaaaacauuau

SEQ ID NO: 1665890 - RNA, 16 nt, Homo sapiens
ugauuaaggacuacag

SEQ ID NO: 1665891 - RNA, 13 nt, Homo sapiens
ugauucaccaaac

SEQ ID NO: 1665892 - RNA, 13 nt, Homo sapiens
ugauucuaaaggg

SEQ ID NO: 1665893 - RNA, 17 nt, Homo sapiens
ugauugcaggaagggaa

SEQ ID NO: 1665894 - RNA, 18 nt, Homo sapiens
ugauugcccaauggaacu

SEQ ID NO: 1665895 - RNA, 14 nt, Homo sapiens
ugauuuccauccaa

SEQ ID NO: 1665896 - RNA, 17 nt, Homo sapiens
ugauuucuuaugccugu

SEQ ID NO: 1665897 - RNA, 15 nt, Homo sapiens
ugcaaaccaaaccau

SEQ ID NO: 1665898 - RNA, 19 nt, Homo sapiens
ugcaaagaguuauaugacu

SEQ ID NO: 1665899 - RNA, 23 nt, Homo sapiens
ugcaaauuuuagcguuaaaguca

SEQ ID NO: 1665900 - RNA, 20 nt, Homo sapiens
ugcaaccacugcaauaucuu

SEQ ID NO: 1665901 - RNA, 21 nt, Homo sapiens
ugcaaccucggggagugccac

SEQ ID NO: 1665902 - RNA, 17 nt, Homo sapiens
ugcaaccuuguacuuua

SEQ ID NO: 1665903 - RNA, 16 nt, Homo sapiens
ugcaacugcuacugac

SEQ ID NO: 1665904 - RNA, 16 nt, Homo sapiens
ugcaauaaagaguaaa

SEQ ID NO: 1665905 - RNA, 22 nt, Homo sapiens
ugcaauaaggauuuauucucag

SEQ ID NO: 1665906 - RNA, 14 nt, Homo sapiens
ugcaauacucagug

SEQ ID NO: 1665907 - RNA, 19 nt, Homo sapiens
ugcacaaaagucucaaugu

SEQ ID NO: 1665908 - RNA, 22 nt, Homo sapiens
ugcacaaaccuucuuuucaaug

SEQ ID NO: 1665909 - RNA, 15 nt, Homo sapiens
ugcacacauuaggca

SEQ ID NO: 1665910 - RNA, 17 nt, Homo sapiens
ugcacacauuaggcauu

SEQ ID NO: 1665911 - RNA, 23 nt, Homo sapiens
ugcacagcuaacauggaaguacu

SEQ ID NO: 1665912 - RNA, 18 nt, Homo sapiens
ugcacgcggacuccgggg

SEQ ID NO: 1665913 - RNA, 17 nt, Homo sapiens
ugcagaaauugaccuga

SEQ ID NO: 1665914 - RNA, 22 nt, Homo sapiens
ugcagaaugagccagaguucac

SEQ ID NO: 1665915 - RNA, 19 nt, Homo sapiens
ugcagagagggaacagcau

SEQ ID NO: 1665916 - RNA, 20 nt, Homo sapiens
aauuucccaaagcagugcau

SEQ ID NO: 1665917 - RNA, 15 nt, Homo sapiens
aauuuccuaugccug

SEQ ID NO: 1665918 - RNA, 17 nt, Homo sapiens
aauuuccuaugccuguc

SEQ ID NO: 1665919 - RNA, 12 nt, Homo sapiens
aauuucucuuaa

SEQ ID NO: 1665920 - RNA, 18 nt, Homo sapiens
aauuuuauugcuggaauc

SEQ ID NO: 1665921 - RNA, 21 nt, Homo sapiens
aauuuuggaagaauucaugau

SEQ ID NO: 1665922 - RNA, 16 nt, Homo sapiens
aauuuuuuccuaccau

SEQ ID NO: 1665923 - RNA, 15 nt, Homo sapiens
acaaaaacuaaaaac

SEQ ID NO: 1665924 - RNA, 20 nt, Homo sapiens
acaaaaggcuggaugugcuu

SEQ ID NO: 1665925 - RNA, 16 nt, Homo sapiens
acaaaaguaaaagaga

SEQ ID NO: 1665926 - RNA, 18 nt, Homo sapiens
acaaaauauaaaucacag

SEQ ID NO: 1665927 - RNA, 12 nt, Homo sapiens
acaaaaugcaag

SEQ ID NO: 1665928 - RNA, 13 nt, Homo sapiens
acaaaaugcagac

SEQ ID NO: 1665929 - RNA, 12 nt, Homo sapiens
acaaacucugua

SEQ ID NO: 1665930 - RNA, 24 nt, Homo sapiens
acaaagcgugguggacaugcacag

SEQ ID NO: 1665931 - RNA, 23 nt, Homo sapiens
acaaagugaaauuaguauuuuga

SEQ ID NO: 1665932 - RNA, 19 nt, Homo sapiens
acaaauauugcuuggacua

SEQ ID NO: 1665933 - RNA, 15 nt, Homo sapiens
acaaaucguccaaag

SEQ ID NO: 1665934 - RNA, 20 nt, Homo sapiens
acaaauggcuuguucaguca

SEQ ID NO: 1665935 - RNA, 22 nt, Homo sapiens
acaaauggcuuguucagucacu

SEQ ID NO: 1665936 - RNA, 22 nt, Homo sapiens
acaaauugauagucaauaucaa

SEQ ID NO: 1665937 - RNA, 13 nt, Homo sapiens
acaacaaagagaa

SEQ ID NO: 1665938 - RNA, 22 nt, Homo sapiens
acaacaaagcaugcucaguauu

SEQ ID NO: 1665939 - RNA, 13 nt, Homo sapiens
acaacaugcacau

SEQ ID NO: 1665940 - RNA, 14 nt, Homo sapiens
acaacaugcacauu

SEQ ID NO: 1665941 - RNA, 16 nt, Homo sapiens
acaacaugcacauuca

SEQ ID NO: 1665942 - RNA, 14 nt, Homo sapiens
acaaccauguucuu

SEQ ID NO: 1665943 - RNA, 23 nt, Homo sapiens
acaaccuccuccuccaguucuga

SEQ ID NO: 1665944 - RNA, 13 nt, Homo sapiens
acaacucauccag

SEQ ID NO: 1665945 - RNA, 17 nt, Homo sapiens
acaacucgaaucacuca

SEQ ID NO: 1665946 - RNA, 14 nt, Homo sapiens
acaacuuccagauu

SEQ ID NO: 1665947 - RNA, 13 nt, Homo sapiens
acaacuugccaaa

SEQ ID NO: 1665948 - RNA, 15 nt, Homo sapiens
acaagcgccaccgug

SEQ ID NO: 1665949 - RNA, 23 nt, Homo sapiens
acaagggaagcuucuugcugcca

SEQ ID NO: 1665950 - RNA, 22 nt, Homo sapiens
acaaggggcuccacaccuuugc

SEQ ID NO: 1665951 - RNA, 19 nt, Homo sapiens
acaagggguggaagggcag

SEQ ID NO: 1665952 - RNA, 17 nt, Homo sapiens
acaaguacaucuguaca

SEQ ID NO: 1665953 - RNA, 14 nt, Homo sapiens
acaaguccucagug

SEQ ID NO: 1665954 - RNA, 13 nt, Homo sapiens
acaagucugagua

SEQ ID NO: 1665955 - RNA, 19 nt, Homo sapiens
acaagugacuuauuugcuc

SEQ ID NO: 1665956 - RNA, 21 nt, Homo sapiens
acaauaaaauggaaagguccu

SEQ ID NO: 1665957 - RNA, 17 nt, Homo sapiens
acaauacaguacucagg

SEQ ID NO: 1665958 - RNA, 16 nt, Homo sapiens
acaaugguagcucuga

SEQ ID NO: 1665959 - RNA, 20 nt, Homo sapiens
acaaugguuuuguuucuuuc

SEQ ID NO: 1665960 - RNA, 21 nt, Homo sapiens
acaauguaacggaugaccaua

SEQ ID NO: 1665961 - RNA, 22 nt, Homo sapiens
acaauuacugugagaacuguga

SEQ ID NO: 1665962 - RNA, 14 nt, Homo sapiens
acaauuugcccaag

SEQ ID NO: 1665963 - RNA, 14 nt, Homo sapiens
acacaaagugaaau

SEQ ID NO: 1665964 - RNA, 13 nt, Homo sapiens
acacaaauccaac

SEQ ID NO: 1665965 - RNA, 17 nt, Homo sapiens
acacacagagacacauc

SEQ ID NO: 1665966 - RNA, 13 nt, Homo sapiens
acacacagcagcu

SEQ ID NO: 1665967 - RNA, 12 nt, Homo sapiens
acacacauggaa

SEQ ID NO: 1665968 - RNA, 21 nt, Homo sapiens
acacacgugagccacagggcu

SEQ ID NO: 1665969 - RNA, 19 nt, Homo sapiens
acacagacucugugagauu

SEQ ID NO: 1665970 - RNA, 22 nt, Homo sapiens
acacagaucagauuaucugguc

SEQ ID NO: 1665971 - RNA, 17 nt, Homo sapiens
acacagcaugcauuuag

SEQ ID NO: 1665972 - RNA, 13 nt, Homo sapiens
acacagcuaacaa

SEQ ID NO: 1665973 - RNA, 23 nt, Homo sapiens
acacagcuaacaaguagcacacu

SEQ ID NO: 1665974 - RNA, 15 nt, Homo sapiens
acacaggccugauaa

SEQ ID NO: 1665975 - RNA, 22 nt, Homo sapiens
acacauagauuaauggcacuga

SEQ ID NO: 1665976 - RNA, 19 nt, Homo sapiens
acacauaguguuuguaaca

SEQ ID NO: 1665977 - RNA, 16 nt, Homo sapiens
augugugcuuggaaaa

SEQ ID NO: 1665978 - RNA, 14 nt, Homo sapiens
augugugugcuuug

SEQ ID NO: 1665979 - RNA, 22 nt, Homo sapiens
auguuauacaaccuucauuuaa

SEQ ID NO: 1665980 - RNA, 16 nt, Homo sapiens
auguuccguucaucug

SEQ ID NO: 1665981 - RNA, 17 nt, Homo sapiens
auguucuugagcagcug

SEQ ID NO: 1665982 - RNA, 19 nt, Homo sapiens
auguucuuggaacauggaa

SEQ ID NO: 1665983 - RNA, 17 nt, Homo sapiens
auguugcacaacacaga

SEQ ID NO: 1665984 - RNA, 16 nt, Homo sapiens
auguuuagugugauug

SEQ ID NO: 1665985 - RNA, 17 nt, Homo sapiens
auuaaacaaauuccuuc

SEQ ID NO: 1665986 - RNA, 15 nt, Homo sapiens
auuaaagguucugaa

SEQ ID NO: 1665987 - RNA, 16 nt, Homo sapiens
auuaaagucuacacug

SEQ ID NO: 1665988 - RNA, 15 nt, Homo sapiens
auuaacaucaaagac

SEQ ID NO: 1665989 - RNA, 11 nt, Homo sapiens
auuaacauguc

SEQ ID NO: 1665990 - RNA, 13 nt, Homo sapiens
auuaagcacauua

SEQ ID NO: 1665991 - RNA, 16 nt, Homo sapiens
auuaaggcaguaugcc

SEQ ID NO: 1665992 - RNA, 12 nt, Homo sapiens
auuaaugaacua

SEQ ID NO: 1665993 - RNA, 19 nt, Homo sapiens
auuaaugaguuuuauccaa

SEQ ID NO: 1665994 - RNA, 20 nt, Homo sapiens
auuaauuaagucaccuguau

SEQ ID NO: 1665995 - RNA, 18 nt, Homo sapiens
auuacaggugugagccac

SEQ ID NO: 1665996 - RNA, 16 nt, Homo sapiens
auuacccauaggucuu

SEQ ID NO: 1665997 - RNA, 12 nt, Homo sapiens
auuagaugacug

SEQ ID NO: 1665998 - RNA, 23 nt, Homo sapiens
auuagcagucccuccacauuucc

SEQ ID NO: 1665999 - RNA, 17 nt, Homo sapiens
auuagcuuacugauuaa

SEQ ID NO: 1666000 - RNA, 22 nt, Homo sapiens
auuagguagaugagaaaacagg

SEQ ID NO: 1666001 - RNA, 19 nt, Homo sapiens
auuagugaaguaugcacua

SEQ ID NO: 1666002 - RNA, 12 nt, Homo sapiens
auuagugccaua

SEQ ID NO: 1666003 - RNA, 19 nt, Homo sapiens
auuauagauuuucauguuc

SEQ ID NO: 1666004 - RNA, 17 nt, Homo sapiens
auuauagcauguaauau

SEQ ID NO: 1666005 - RNA, 18 nt, Homo sapiens
auuauagucuguacuuca

SEQ ID NO: 1666006 - RNA, 19 nt, Homo sapiens
auuauggcuuugugcuugu

SEQ ID NO: 1666007 - RNA, 18 nt, Homo sapiens
auuauggugauacuccaa

SEQ ID NO: 1666008 - RNA, 19 nt, Homo sapiens
auuauguggaagaagcaaa

SEQ ID NO: 1666009 - RNA, 16 nt, Homo sapiens
auuauucucugaugca

SEQ ID NO: 1666010 - RNA, 16 nt, Homo sapiens
auuauuuacaagaaga

SEQ ID NO: 1666011 - RNA, 17 nt, Homo sapiens
auucaagcuucauauau

SEQ ID NO: 1666012 - RNA, 22 nt, Homo sapiens
auucaccaacaacagucagcca

SEQ ID NO: 1666013 - RNA, 17 nt, Homo sapiens
auucacccaagggucag

SEQ ID NO: 1666014 - RNA, 15 nt, Homo sapiens
auucacuacugcaaa

SEQ ID NO: 1666015 - RNA, 15 nt, Homo sapiens
auucagaccagggaa

SEQ ID NO: 1666016 - RNA, 15 nt, Homo sapiens
auucauacacucccu

SEQ ID NO: 1666017 - RNA, 20 nt, Homo sapiens
auucauagcuugcaguuuca

SEQ ID NO: 1666018 - RNA, 21 nt, Homo sapiens
auucaucucagcaaucacaag

SEQ ID NO: 1666019 - RNA, 15 nt, Homo sapiens
auucaugauugccca

SEQ ID NO: 1666020 - RNA, 16 nt, Homo sapiens
auucaugauugcccaa

SEQ ID NO: 1666021 - RNA, 18 nt, Homo sapiens
auucauuuacaacuucca

SEQ ID NO: 1666022 - RNA, 15 nt, Homo sapiens
auuccaccuagagcu

SEQ ID NO: 1666023 - RNA, 23 nt, Homo sapiens
auuccagagcacugcuccagugg

SEQ ID NO: 1666024 - RNA, 16 nt, Homo sapiens
auuccagggaaccaga

SEQ ID NO: 1666025 - RNA, 23 nt, Homo sapiens
auucccaagccaaaaaccuuagc

SEQ ID NO: 1666026 - RNA, 19 nt, Homo sapiens
auucccaauuaucaaaaaa

SEQ ID NO: 1666027 - RNA, 19 nt, Homo sapiens
auuccucuaagaucuugcc

SEQ ID NO: 1666028 - RNA, 14 nt, Homo sapiens
auuccugcaggaaa

SEQ ID NO: 1666029 - RNA, 20 nt, Homo sapiens
auuccugcagucagugcuaa

SEQ ID NO: 1666030 - RNA, 18 nt, Homo sapiens
auuccuguucccaugaga

SEQ ID NO: 1666031 - RNA, 14 nt, Homo sapiens
auucuaaaggggac

SEQ ID NO: 1666032 - RNA, 16 nt, Homo sapiens
auucuaagauuguaca

SEQ ID NO: 1666033 - RNA, 20 nt, Homo sapiens
auucuaaggagcaaauaccu

SEQ ID NO: 1666034 - RNA, 19 nt, Homo sapiens
auucuagagggauccaccg

SEQ ID NO: 1666035 - RNA, 13 nt, Homo sapiens
auucuaugacaau

SEQ ID NO: 1666036 - RNA, 18 nt, Homo sapiens
auucuccugccucagccu

SEQ ID NO: 1666037 - RNA, 23 nt, Homo sapiens
auuuugucugcuuaguaucucau

SEQ ID NO: 1666038 - RNA, 15 nt, Homo sapiens
auuuuguugcaucau

SEQ ID NO: 1666039 - RNA, 22 nt, Homo sapiens
auuuuucacugccccagacaca

SEQ ID NO: 1666040 - RNA, 14 nt, Homo sapiens
auuuuuccaaaagc

SEQ ID NO: 1666041 - RNA, 18 nt, Homo sapiens
auuuuuccaaaagccagu

SEQ ID NO: 1666042 - RNA, 12 nt, Homo sapiens
auuuuucugcac

SEQ ID NO: 1666043 - RNA, 21 nt, Homo sapiens
auuuuuuuuuuuaagcucaaa

SEQ ID NO: 1666044 - RNA, 21 nt, Homo sapiens
caaaaaaaaaaaaacaaaaga

SEQ ID NO: 1666045 - RNA, 18 nt, Homo sapiens
caaaaagaggcuauguga

SEQ ID NO: 1666046 - RNA, 20 nt, Homo sapiens
caaaacaaaaaaacccaggg

SEQ ID NO: 1666047 - RNA, 12 nt, Homo sapiens
caaaacauaucu

SEQ ID NO: 1666048 - RNA, 18 nt, Homo sapiens
caaaagguuaauggaugg

SEQ ID NO: 1666049 - RNA, 17 nt, Homo sapiens
caaaagugauguuauag

SEQ ID NO: 1666050 - RNA, 21 nt, Homo sapiens
caaaauaguuguaggggaaau

SEQ ID NO: 1666051 - RNA, 16 nt, Homo sapiens
caaaauauaaaucaca

SEQ ID NO: 1666052 - RNA, 20 nt, Homo sapiens
caaaaugaaugccaguccag

SEQ ID NO: 1666053 - RNA, 12 nt, Homo sapiens
caaacaaacaaa

SEQ ID NO: 1666054 - RNA, 23 nt, Homo sapiens
caaacacugcuuaaggaaaagag

SEQ ID NO: 1666055 - RNA, 19 nt, Homo sapiens
caaacccagauugaagcua

SEQ ID NO: 1666056 - RNA, 15 nt, Homo sapiens
caaacucaccugccc

SEQ ID NO: 1666057 - RNA, 13 nt, Homo sapiens
caaacuccugacc

SEQ ID NO: 1666058 - RNA, 15 nt, Homo sapiens
caaacuguacaguuu

SEQ ID NO: 1666059 - RNA, 20 nt, Homo sapiens
caaacuguacaguuucuucc

SEQ ID NO: 1666060 - RNA, 22 nt, Homo sapiens
caaacuguacaguuucuucccc

SEQ ID NO: 1666061 - RNA, 22 nt, Homo sapiens
caaacuuaacagaucacaugcc

SEQ ID NO: 1666062 - RNA, 14 nt, Homo sapiens
caaacuucccugac

SEQ ID NO: 1666063 - RNA, 18 nt, Homo sapiens
caaagcgugguggacaug

SEQ ID NO: 1666064 - RNA, 15 nt, Homo sapiens
caaagcugucacuca

SEQ ID NO: 1666065 - RNA, 15 nt, Homo sapiens
caaaggaaacccaau

SEQ ID NO: 1666066 - RNA, 21 nt, Homo sapiens
caaaggcccccaucacacucg

SEQ ID NO: 1666067 - RNA, 11 nt, Homo sapiens
caaaguaauag

SEQ ID NO: 1666068 - RNA, 18 nt, Homo sapiens
caaagugcuggcauuaca

SEQ ID NO: 1666069 - RNA, 16 nt, Homo sapiens
caaaguuaaacgugau

SEQ ID NO: 1666070 - RNA, 16 nt, Homo sapiens
caaauaacaguggcaa

SEQ ID NO: 1666071 - RNA, 22 nt, Homo sapiens
caaauagggcaaagaaucaaca

SEQ ID NO: 1666072 - RNA, 17 nt, Homo sapiens
caaauaugggcugaggu

SEQ ID NO: 1666073 - RNA, 17 nt, Homo sapiens
caaaucauuuugaugua

SEQ ID NO: 1666074 - RNA, 14 nt, Homo sapiens
caaauccauguguc

SEQ ID NO: 1666075 - RNA, 23 nt, Homo sapiens
caaaucguccaaagaucucaaag

SEQ ID NO: 1666076 - RNA, 14 nt, Homo sapiens
caaaucuggcuuag

SEQ ID NO: 1666077 - RNA, 17 nt, Homo sapiens
caaaugcuacucaguau

SEQ ID NO: 1666078 - RNA, 12 nt, Homo sapiens
caaauguuauag

SEQ ID NO: 1666079 - RNA, 20 nt, Homo sapiens
caaauuauauuugugugaaa

SEQ ID NO: 1666080 - RNA, 17 nt, Homo sapiens
caaauucaguggacauu

SEQ ID NO: 1666081 - RNA, 16 nt, Homo sapiens
caaauucucugagaug

SEQ ID NO: 1666082 - RNA, 15 nt, Homo sapiens
caacacaccuugccc

SEQ ID NO: 1666083 - RNA, 16 nt, Homo sapiens
caacacaccuugccca

SEQ ID NO: 1666084 - RNA, 16 nt, Homo sapiens
caacagaucaaugaca

SEQ ID NO: 1666085 - RNA, 23 nt, Homo sapiens
caacaggcuguucugcacugaaa

SEQ ID NO: 1666086 - RNA, 21 nt, Homo sapiens
caacaugcacauucauccuca

SEQ ID NO: 1666087 - RNA, 17 nt, Homo sapiens
caacaugguuaccucug

SEQ ID NO: 1666088 - RNA, 23 nt, Homo sapiens
caacauuacuccauuacuaaaga

SEQ ID NO: 1666089 - RNA, 21 nt, Homo sapiens
caacauuugcuuuuugcuugu

SEQ ID NO: 1666090 - RNA, 17 nt, Homo sapiens
caacccuacaguauaua

SEQ ID NO: 1666091 - RNA, 16 nt, Homo sapiens
caacccugugaucuau

SEQ ID NO: 1666092 - RNA, 21 nt, Homo sapiens
caaccucggggagugccacuu

SEQ ID NO: 1666093 - RNA, 14 nt, Homo sapiens
caaccucugccucc

SEQ ID NO: 1666094 - RNA, 14 nt, Homo sapiens
caacgggucugugg

SEQ ID NO: 1666095 - RNA, 14 nt, Homo sapiens
caacuccaggguua

SEQ ID NO: 1666096 - RNA, 17 nt, Homo sapiens
cuuagcaggaauuuaau

SEQ ID NO: 1666097 - RNA, 19 nt, Homo sapiens
cuuaggauuuaccaaauag

SEQ ID NO: 1666098 - RNA, 20 nt, Homo sapiens
cuuaguaaauuccuaauucu

SEQ ID NO: 1666099 - RNA, 22 nt, Homo sapiens
cuuaguauaauauuaaggcuua

SEQ ID NO: 1666100 - RNA, 15 nt, Homo sapiens
cuuagugugugcaau

SEQ ID NO: 1666101 - RNA, 18 nt, Homo sapiens
cuuaucccagugaucacc

SEQ ID NO: 1666102 - RNA, 17 nt, Homo sapiens
cuuaugagauacuuugc

SEQ ID NO: 1666103 - RNA, 15 nt, Homo sapiens
cuuauuacguaugua

SEQ ID NO: 1666104 - RNA, 23 nt, Homo sapiens
cuucaaauugucuuuugucaugu

SEQ ID NO: 1666105 - RNA, 20 nt, Homo sapiens
cuucaacaugguuaccucug

SEQ ID NO: 1666106 - RNA, 17 nt, Homo sapiens
cuucaaugcaaaauaca

SEQ ID NO: 1666107 - RNA, 22 nt, Homo sapiens
cuucacauuuuacgacaaggau

SEQ ID NO: 1666108 - RNA, 17 nt, Homo sapiens
cuucaccgcauuccagg

SEQ ID NO: 1666109 - RNA, 21 nt, Homo sapiens
cuucaccgugacauuccagca

SEQ ID NO: 1666110 - RNA, 11 nt, Homo sapiens
cuucaccucac

SEQ ID NO: 1666111 - RNA, 18 nt, Homo sapiens
cuucacucugacaguauu

SEQ ID NO: 1666112 - RNA, 17 nt, Homo sapiens
cuucagaauuguuuuua

SEQ ID NO: 1666113 - RNA, 21 nt, Homo sapiens
cuucagugccaaaaacaacaa

SEQ ID NO: 1666114 - RNA, 14 nt, Homo sapiens
cuucauaagccauu

SEQ ID NO: 1666115 - RNA, 22 nt, Homo sapiens
cuucauccauagacacaguauu

SEQ ID NO: 1666116 - RNA, 14 nt, Homo sapiens
cuucauggaacuca

SEQ ID NO: 1666117 - RNA, 21 nt, Homo sapiens
cuucauggaacucagcugucu

SEQ ID NO: 1666118 - RNA, 16 nt, Homo sapiens
cuuccaacaugugaug

SEQ ID NO: 1666119 - RNA, 22 nt, Homo sapiens
cuuccauagcuucauccacuga

SEQ ID NO: 1666120 - RNA, 20 nt, Homo sapiens
cuucccaaucagcacugaaa

SEQ ID NO: 1666121 - RNA, 21 nt, Homo sapiens
cuucccaugucuuucuccaaa

SEQ ID NO: 1666122 - RNA, 15 nt, Homo sapiens
cuucccccagggucc

SEQ ID NO: 1666123 - RNA, 15 nt, Homo sapiens
cuuccccccaaaacu

SEQ ID NO: 1666124 - RNA, 21 nt, Homo sapiens
cuuccuauaccggagcuccag

SEQ ID NO: 1666125 - RNA, 18 nt, Homo sapiens
cuuccugccucucucaug

SEQ ID NO: 1666126 - RNA, 17 nt, Homo sapiens
cuuccuucucagccuug

SEQ ID NO: 1666127 - RNA, 21 nt, Homo sapiens
cuuccuucucaucuugccuca

SEQ ID NO: 1666128 - RNA, 12 nt, Homo sapiens
cuucgugccugu

SEQ ID NO: 1666129 - RNA, 15 nt, Homo sapiens
cuucuaagggaucca

SEQ ID NO: 1666130 - RNA, 16 nt, Homo sapiens
cuucuaauccaugugc

SEQ ID NO: 1666131 - RNA, 13 nt, Homo sapiens
cuucuaccagaga

SEQ ID NO: 1666132 - RNA, 22 nt, Homo sapiens
cuucuaguuuggcauuucacaa

SEQ ID NO: 1666133 - RNA, 19 nt, Homo sapiens
cuucuaucaaagcacauaa

SEQ ID NO: 1666134 - RNA, 17 nt, Homo sapiens
cuucuauguccaacaga

SEQ ID NO: 1666135 - RNA, 14 nt, Homo sapiens
cuucucaucuugcc

SEQ ID NO: 1666136 - RNA, 17 nt, Homo sapiens
cuucuccacaaccuccu

SEQ ID NO: 1666137 - RNA, 15 nt, Homo sapiens
cuucuccacagggac

SEQ ID NO: 1666138 - RNA, 23 nt, Homo sapiens
cuucuccacagggacacagucug

SEQ ID NO: 1666139 - RNA, 18 nt, Homo sapiens
cuucucccgggucguguc

SEQ ID NO: 1666140 - RNA, 12 nt, Homo sapiens
cuucuccuggca

SEQ ID NO: 1666141 - RNA, 19 nt, Homo sapiens
cuucugaagaucucagaua

SEQ ID NO: 1666142 - RNA, 20 nt, Homo sapiens
cuucuggagggaagcaccau

SEQ ID NO: 1666143 - RNA, 12 nt, Homo sapiens
cuucuguuguca

SEQ ID NO: 1666144 - RNA, 21 nt, Homo sapiens
cuucuuccccaaggcacugag

SEQ ID NO: 1666145 - RNA, 13 nt, Homo sapiens
cuucuucuugacc

SEQ ID NO: 1666146 - RNA, 17 nt, Homo sapiens
cuucuuuccucuuaaug

SEQ ID NO: 1666147 - RNA, 13 nt, Homo sapiens
cuucuuuucaaug

SEQ ID NO: 1666148 - RNA, 16 nt, Homo sapiens
cuugaaaacuucucau

SEQ ID NO: 1666149 - RNA, 13 nt, Homo sapiens
cuugaaaugaugg

SEQ ID NO: 1666150 - RNA, 22 nt, Homo sapiens
cuugaaaugaugguaaguuaau

SEQ ID NO: 1666151 - RNA, 21 nt, Homo sapiens
cuugaccgugaggccagagac

SEQ ID NO: 1666152 - RNA, 12 nt, Homo sapiens
cuugagcagcug

SEQ ID NO: 1666153 - RNA, 15 nt, Homo sapiens
cuugagcugacccaa

SEQ ID NO: 1666154 - RNA, 18 nt, Homo sapiens
cuugaucaugaaucacug

SEQ ID NO: 1666155 - RNA, 15 nt, Homo sapiens
cuugcacccaugugu

SEQ ID NO: 1666156 - RNA, 18 nt, Homo sapiens
gaaauguucacugaauaa

SEQ ID NO: 1666157 - RNA, 14 nt, Homo sapiens
gaaauuaguguuuu

SEQ ID NO: 1666158 - RNA, 18 nt, Homo sapiens
gaaauuuacccacaguga

SEQ ID NO: 1666159 - RNA, 16 nt, Homo sapiens
gaaauuuuaagccaaa

SEQ ID NO: 1666160 - RNA, 20 nt, Homo sapiens
gaaauuuuaagccaaaaaca

SEQ ID NO: 1666161 - RNA, 12 nt, Homo sapiens
gaacacaccucu

SEQ ID NO: 1666162 - RNA, 13 nt, Homo sapiens
gaacacagaucau

SEQ ID NO: 1666163 - RNA, 23 nt, Homo sapiens
gaacacuaaugaggaaacugcac

SEQ ID NO: 1666164 - RNA, 16 nt, Homo sapiens
gaacagcauaugcaaa

SEQ ID NO: 1666165 - RNA, 15 nt, Homo sapiens
gaacagggcaaaaug

SEQ ID NO: 1666166 - RNA, 14 nt, Homo sapiens
gaacauacuuucua

SEQ ID NO: 1666167 - RNA, 15 nt, Homo sapiens
gaacauggcauguga

SEQ ID NO: 1666168 - RNA, 19 nt, Homo sapiens
gaaccauccaguacuugug

SEQ ID NO: 1666169 - RNA, 16 nt, Homo sapiens
gaacccucacccagag

SEQ ID NO: 1666170 - RNA, 12 nt, Homo sapiens
gaacccugagag

SEQ ID NO: 1666171 - RNA, 14 nt, Homo sapiens
gaaccgauuaucua

SEQ ID NO: 1666172 - RNA, 14 nt, Homo sapiens
gaaccucaaacugg

SEQ ID NO: 1666173 - RNA, 18 nt, Homo sapiens
gaaccuuugucaacuuca

SEQ ID NO: 1666174 - RNA, 15 nt, Homo sapiens
gaacgaagccaccuu

SEQ ID NO: 1666175 - RNA, 19 nt, Homo sapiens
gaacgcugcuccaugcaca

SEQ ID NO: 1666176 - RNA, 18 nt, Homo sapiens
gaacguucucuaccuuca

SEQ ID NO: 1666177 - RNA, 16 nt, Homo sapiens
gaacuaacugccaugu

SEQ ID NO: 1666178 - RNA, 16 nt, Homo sapiens
gaacugcuugugcacu

SEQ ID NO: 1666179 - RNA, 17 nt, Homo sapiens
gaacugcuugugcacug

SEQ ID NO: 1666180 - RNA, 13 nt, Homo sapiens
gaacugugcuuuu

SEQ ID NO: 1666181 - RNA, 18 nt, Homo sapiens
gaagaaagauugcuauaa

SEQ ID NO: 1666182 - RNA, 14 nt, Homo sapiens
gaagaacucaccag

SEQ ID NO: 1666183 - RNA, 22 nt, Homo sapiens
gaagacaaauaguguggaguga

SEQ ID NO: 1666184 - RNA, 17 nt, Homo sapiens
gaagaguuuacagacaa

SEQ ID NO: 1666185 - RNA, 19 nt, Homo sapiens
gaagaguuuacagacaaua

SEQ ID NO: 1666186 - RNA, 16 nt, Homo sapiens
gaagauuagcaugaaa

SEQ ID NO: 1666187 - RNA, 17 nt, Homo sapiens
gaagcaaauaaauauca

SEQ ID NO: 1666188 - RNA, 22 nt, Homo sapiens
gaagcacaugccucucucaggc

SEQ ID NO: 1666189 - RNA, 23 nt, Homo sapiens
gaagcagaaugagaugauuuaau

SEQ ID NO: 1666190 - RNA, 16 nt, Homo sapiens
gaagcagccuccacuu

SEQ ID NO: 1666191 - RNA, 21 nt, Homo sapiens
gaagcauccaaggaacuucau

SEQ ID NO: 1666192 - RNA, 13 nt, Homo sapiens
gaagcuucuugcu

SEQ ID NO: 1666193 - RNA, 17 nt, Homo sapiens
gaagcuucuugcugcca

SEQ ID NO: 1666194 - RNA, 19 nt, Homo sapiens
gaaggcuccaucuccagug

SEQ ID NO: 1666195 - RNA, 22 nt, Homo sapiens
gaagggccuucuccacagggac

SEQ ID NO: 1666196 - RNA, 23 nt, Homo sapiens
gaagggccuucuccacagggaca

SEQ ID NO: 1666197 - RNA, 13 nt, Homo sapiens
gaagggcgcagga

SEQ ID NO: 1666198 - RNA, 18 nt, Homo sapiens
gaaggggcgcuccuccca

SEQ ID NO: 1666199 - RNA, 14 nt, Homo sapiens
gaaggucacgcuga

SEQ ID NO: 1666200 - RNA, 18 nt, Homo sapiens
gaaguauagaugguagaa

SEQ ID NO: 1666201 - RNA, 16 nt, Homo sapiens
gaagucuuuguacaga

SEQ ID NO: 1666202 - RNA, 13 nt, Homo sapiens
gaagugaccaagg

SEQ ID NO: 1666203 - RNA, 19 nt, Homo sapiens
gaaguuuuacuugauuaag

SEQ ID NO: 1666204 - RNA, 12 nt, Homo sapiens
gaauaaagccac

SEQ ID NO: 1666205 - RNA, 15 nt, Homo sapiens
gaauaaugcuguuuu

SEQ ID NO: 1666206 - RNA, 18 nt, Homo sapiens
gaauaaugcuguuuuaua

SEQ ID NO: 1666207 - RNA, 15 nt, Homo sapiens
gaauauaaauguacu

SEQ ID NO: 1666208 - RNA, 16 nt, Homo sapiens
gaauauguauguuucu

SEQ ID NO: 1666209 - RNA, 16 nt, Homo sapiens
gaaucaaaaauugaag

SEQ ID NO: 1666210 - RNA, 13 nt, Homo sapiens
gaaucaaauccaa

SEQ ID NO: 1666211 - RNA, 21 nt, Homo sapiens
gaaucaacagaucaaugacau

SEQ ID NO: 1666212 - RNA, 13 nt, Homo sapiens
gaaucacagccaa

SEQ ID NO: 1666213 - RNA, 13 nt, Homo sapiens
gaaucagacugaa

SEQ ID NO: 1666214 - RNA, 22 nt, Homo sapiens
gaaucaguccuagaauguuuca

SEQ ID NO: 1666215 - RNA, 15 nt, Homo sapiens
gaaucauaugggaua

SEQ ID NO: 1666216 - RNA, 19 nt, Homo sapiens
gaaucuccugaccacuugu

SEQ ID NO: 1666217 - RNA, 18 nt, Homo sapiens
gaaugaaaggcaaugaca

SEQ ID NO: 1666218 - RNA, 21 nt, Homo sapiens
gaaugaaauauaaacugugag

SEQ ID NO: 1666219 - RNA, 12 nt, Homo sapiens
gaugaagcacau

SEQ ID NO: 1666220 - RNA, 15 nt, Homo sapiens
gaugaaggggccaga

SEQ ID NO: 1666221 - RNA, 22 nt, Homo sapiens
gaugauaaucccauacucucaa

SEQ ID NO: 1666222 - RNA, 17 nt, Homo sapiens
gaugauucuaugucuca

SEQ ID NO: 1666223 - RNA, 15 nt, Homo sapiens
gaugcaugagcuccc

SEQ ID NO: 1666224 - RNA, 14 nt, Homo sapiens
gaugcgucuaccca

SEQ ID NO: 1666225 - RNA, 19 nt, Homo sapiens
gauggagugcaguggcuca

SEQ ID NO: 1666226 - RNA, 21 nt, Homo sapiens
gauggccauguauuaccugaa

SEQ ID NO: 1666227 - RNA, 20 nt, Homo sapiens
gccacuaaaauccacccagc

SEQ ID NO: 1666228 - RNA, 19 nt, Homo sapiens
gccacucagagcucccuca

SEQ ID NO: 1666229 - RNA, 22 nt, Homo sapiens
gccagacgugcuccugcugacc

SEQ ID NO: 1666230 - RNA, 17 nt, Homo sapiens
gccagcaggcucucagg

SEQ ID NO: 1666231 - RNA, 18 nt, Homo sapiens
gccagcaggcucucaggc

SEQ ID NO: 1666232 - RNA, 12 nt, Homo sapiens
gccagcccuguu

SEQ ID NO: 1666233 - RNA, 13 nt, Homo sapiens
gccaggaagccag

SEQ ID NO: 1666234 - RNA, 17 nt, Homo sapiens
gccaggacaaaaugcag

SEQ ID NO: 1666235 - RNA, 13 nt, Homo sapiens
gccaggacacugc

SEQ ID NO: 1666236 - RNA, 15 nt, Homo sapiens
gccaggacacugccu

SEQ ID NO: 1666237 - RNA, 21 nt, Homo sapiens
gccaggauggucucgaucucc

SEQ ID NO: 1666238 - RNA, 18 nt, Homo sapiens
gccaggccucagggacca

SEQ ID NO: 1666239 - RNA, 18 nt, Homo sapiens
gccaggcucccacugccc

SEQ ID NO: 1666240 - RNA, 16 nt, Homo sapiens
gccaggcuggagugca

SEQ ID NO: 1666241 - RNA, 20 nt, Homo sapiens
gccaggcuggagugcagugg

SEQ ID NO: 1666242 - RNA, 22 nt, Homo sapiens
gccaguccaucucaagugccau

SEQ ID NO: 1666243 - RNA, 14 nt, Homo sapiens
gccauaggguccug

SEQ ID NO: 1666244 - RNA, 19 nt, Homo sapiens
gccauaggguccugaaugu

SEQ ID NO: 1666245 - RNA, 20 nt, Homo sapiens
gccauauucuguaguauuuu

SEQ ID NO: 1666246 - RNA, 14 nt, Homo sapiens
gccaucaagaaaca

SEQ ID NO: 1666247 - RNA, 19 nt, Homo sapiens
gccaucaagaaacauucag

SEQ ID NO: 1666248 - RNA, 19 nt, Homo sapiens
gccaucagaugaggcuccu

SEQ ID NO: 1666249 - RNA, 22 nt, Homo sapiens
gccauccuaaggugcuuaccuc

SEQ ID NO: 1666250 - RNA, 15 nt, Homo sapiens
gccaucgcaucaugu

SEQ ID NO: 1666251 - RNA, 21 nt, Homo sapiens
gccaucgcuuuugacccaaau

SEQ ID NO: 1666252 - RNA, 16 nt, Homo sapiens
gcccacacuugggagc

SEQ ID NO: 1666253 - RNA, 17 nt, Homo sapiens
gcccaccacaacuaaca

SEQ ID NO: 1666254 - RNA, 20 nt, Homo sapiens
gcccacgcuaguuccaucca

SEQ ID NO: 1666255 - RNA, 16 nt, Homo sapiens
gcccacucugaccggg

SEQ ID NO: 1666256 - RNA, 20 nt, Homo sapiens
gcccagacucaaggccucca

SEQ ID NO: 1666257 - RNA, 19 nt, Homo sapiens
gcccagagccacagaaaau

SEQ ID NO: 1666258 - RNA, 19 nt, Homo sapiens
gcccaggauggagugcagu

SEQ ID NO: 1666259 - RNA, 20 nt, Homo sapiens
gcccaggauggagugcagug

SEQ ID NO: 1666260 - RNA, 14 nt, Homo sapiens
gcccaggcagucuu

SEQ ID NO: 1666261 - RNA, 18 nt, Homo sapiens
gccccacccuuuccucuu

SEQ ID NO: 1666262 - RNA, 17 nt, Homo sapiens
gccccacgcauggugca

SEQ ID NO: 1666263 - RNA, 16 nt, Homo sapiens
gccccagacacagugc

SEQ ID NO: 1666264 - RNA, 14 nt, Homo sapiens
gccccagaccugcc

SEQ ID NO: 1666265 - RNA, 21 nt, Homo sapiens
gccccagcuccucuuccugcc

SEQ ID NO: 1666266 - RNA, 22 nt, Homo sapiens
gcccccacaggagcguguacua

SEQ ID NO: 1666267 - RNA, 14 nt, Homo sapiens
gccccccuucccac

SEQ ID NO: 1666268 - RNA, 15 nt, Homo sapiens
gcccccuccugcaag

SEQ ID NO: 1666269 - RNA, 16 nt, Homo sapiens
gccccgccucccgggg

SEQ ID NO: 1666270 - RNA, 14 nt, Homo sapiens
gccccuccucgggc

SEQ ID NO: 1666271 - RNA, 16 nt, Homo sapiens
gccccucuuagaagaa

SEQ ID NO: 1666272 - RNA, 14 nt, Homo sapiens
gccccugccugaga

SEQ ID NO: 1666273 - RNA, 13 nt, Homo sapiens
gcccgccaccuug

SEQ ID NO: 1666274 - RNA, 15 nt, Homo sapiens
gcccucacuccacuc

SEQ ID NO: 1666275 - RNA, 16 nt, Homo sapiens
gcccucagaacaaucc

SEQ ID NO: 1666276 - RNA, 21 nt, Homo sapiens
gcccucagccccacuucucag

SEQ ID NO: 1666277 - RNA, 19 nt, Homo sapiens
gcccucugcugcuuuccaa

SEQ ID NO: 1666278 - RNA, 15 nt, Homo sapiens
gcccucuucaauccc

SEQ ID NO: 1666279 - RNA, 13 nt, Homo sapiens
gcccugcaccuug

SEQ ID NO: 1666280 - RNA, 20 nt, Homo sapiens
gcccuucccugacacugucu

SEQ ID NO: 1666281 - RNA, 11 nt, Homo sapiens
gcccuuccuuc

SEQ ID NO: 1666282 - RNA, 20 nt, Homo sapiens
gcccuucuaccuuccugcaa

SEQ ID NO: 1666283 - RNA, 22 nt, Homo sapiens
gccgaaccugauaccugccugg

SEQ ID NO: 1666284 - RNA, 21 nt, Homo sapiens
gccgagauagccaaggccaaa

SEQ ID NO: 1666285 - RNA, 21 nt, Homo sapiens
gccgagauaucgccacugcac

SEQ ID NO: 1666286 - RNA, 13 nt, Homo sapiens
gccggguguagug

SEQ ID NO: 1666287 - RNA, 19 nt, Homo sapiens
gccgguaaguaaacaguca

SEQ ID NO: 1666288 - RNA, 15 nt, Homo sapiens
gccggucccccaugc

SEQ ID NO: 1666289 - RNA, 23 nt, Homo sapiens
gccguaguaccucccagcagggu

SEQ ID NO: 1666290 - RNA, 17 nt, Homo sapiens
gccgucacgcuuucaug

SEQ ID NO: 1666291 - RNA, 14 nt, Homo sapiens
gccuccaagccagg

SEQ ID NO: 1666292 - RNA, 20 nt, Homo sapiens
gccucccaaggaaaauggac

SEQ ID NO: 1666293 - RNA, 16 nt, Homo sapiens
gccucccaccaggaau

SEQ ID NO: 1666294 - RNA, 14 nt, Homo sapiens
gccucccagccacc

SEQ ID NO: 1666295 - RNA, 15 nt, Homo sapiens
gccucccagccaccc

SEQ ID NO: 1666296 - RNA, 15 nt, Homo sapiens
gccucccauguucaa

SEQ ID NO: 1666297 - RNA, 17 nt, Homo sapiens
gccucccauguucaagc

SEQ ID NO: 1666298 - RNA, 21 nt, Homo sapiens
gccucccccucagaugaucuc

SEQ ID NO: 1666299 - RNA, 15 nt, Homo sapiens
gccucccguccgucc

SEQ ID NO: 1666300 - RNA, 13 nt, Homo sapiens
gccuccuggccag

SEQ ID NO: 1666301 - RNA, 17 nt, Homo sapiens
gccucgugccaugaucu

SEQ ID NO: 1666302 - RNA, 21 nt, Homo sapiens
gccucucccaaguccagugug

SEQ ID NO: 1666303 - RNA, 16 nt, Homo sapiens
gccucucucaggccaa

SEQ ID NO: 1666304 - RNA, 17 nt, Homo sapiens
gccucucucaggccaaa

SEQ ID NO: 1666305 - RNA, 22 nt, Homo sapiens
gccucucucucccaacugcugc

SEQ ID NO: 1666306 - RNA, 19 nt, Homo sapiens
gccucucugguugccaaau

SEQ ID NO: 1666307 - RNA, 20 nt, Homo sapiens
gccucuuaggcagaaaaccu

SEQ ID NO: 1666308 - RNA, 23 nt, Homo sapiens
gccugaugauggaagggccuucu

SEQ ID NO: 1666309 - RNA, 12 nt, Homo sapiens
gccugcacacac

SEQ ID NO: 1666310 - RNA, 23 nt, Homo sapiens
gccugcucccuagccagaggcuc

SEQ ID NO: 1666311 - RNA, 19 nt, Homo sapiens
gccuggccccaaauguucu

SEQ ID NO: 1666312 - RNA, 15 nt, Homo sapiens
gccuggcuucuggga

SEQ ID NO: 1666313 - RNA, 22 nt, Homo sapiens
gccugggggcugggcagaggaa

SEQ ID NO: 1666314 - RNA, 21 nt, Homo sapiens
gccugggugugaccugacacc

SEQ ID NO: 1666315 - RNA, 17 nt, Homo sapiens
gccugucgcaugagaac

SEQ ID NO: 1666316 - RNA, 19 nt, Homo sapiens
gccugugaucguguguugc

SEQ ID NO: 1666317 - RNA, 12 nt, Homo sapiens
gccuuaacaaac

SEQ ID NO: 1666318 - RNA, 16 nt, Homo sapiens
gccuucuccacaggga

SEQ ID NO: 1666319 - RNA, 22 nt, Homo sapiens
gccuucuccacagggacacagu

SEQ ID NO: 1666320 - RNA, 20 nt, Homo sapiens
gccuucuccccuccaaguga

SEQ ID NO: 1666321 - RNA, 21 nt, Homo sapiens
gccuugccccaccuccaucaa

SEQ ID NO: 1666322 - RNA, 20 nt, Homo sapiens
gccuuuauauccaaaauaaa

SEQ ID NO: 1666323 - RNA, 14 nt, Homo sapiens
gcgaagaauagagg

SEQ ID NO: 1666324 - RNA, 14 nt, Homo sapiens
gcgaucucagcuca

SEQ ID NO: 1666325 - RNA, 22 nt, Homo sapiens
gcgccugacauucacacagaga

SEQ ID NO: 1666326 - RNA, 17 nt, Homo sapiens
gcgcgaucucagcucac

SEQ ID NO: 1666327 - RNA, 14 nt, Homo sapiens
gcggagcaucggga

SEQ ID NO: 1666328 - RNA, 14 nt, Homo sapiens
gcgucuccugccca

SEQ ID NO: 1666329 - RNA, 13 nt, Homo sapiens
gcgucugcugcuc

SEQ ID NO: 1666330 - RNA, 22 nt, Homo sapiens
gcgugggaguauguuauuucuc

SEQ ID NO: 1666331 - RNA, 14 nt, Homo sapiens
gcguguacuacccc

SEQ ID NO: 1666332 - RNA, 16 nt, Homo sapiens
gcguguacuaccccag

SEQ ID NO: 1666333 - RNA, 20 nt, Homo sapiens
gcguuaaagucaggauuuau

SEQ ID NO: 1666334 - RNA, 17 nt, Homo sapiens
gcguuugaacucaggga

SEQ ID NO: 1666335 - RNA, 16 nt, Homo sapiens
gcuaaaauaaaccaga

SEQ ID NO: 1666336 - RNA, 12 nt, Homo sapiens
gcuaaagggaaa

SEQ ID NO: 1666337 - RNA, 12 nt, Homo sapiens
gcuaaaugcaaa

SEQ ID NO: 1666338 - RNA, 17 nt, Homo sapiens
gcuaaguggaagacaga

SEQ ID NO: 1666339 - RNA, 22 nt, Homo sapiens
gcuaaugaauuuuaaaagcaua

SEQ ID NO: 1666340 - RNA, 20 nt, Homo sapiens
cagagagaaucaacagauca

SEQ ID NO: 1666341 - RNA, 23 nt, Homo sapiens
cagagagggaacagcauaugcaa

SEQ ID NO: 1666342 - RNA, 19 nt, Homo sapiens
cagagauucccaagccaaa

SEQ ID NO: 1666343 - RNA, 17 nt, Homo sapiens
cagagcagaucagucuu

SEQ ID NO: 1666344 - RNA, 22 nt, Homo sapiens
cagagcuuuacagugccacgac

SEQ ID NO: 1666345 - RNA, 16 nt, Homo sapiens
cagaggacagcuuccc

SEQ ID NO: 1666346 - RNA, 16 nt, Homo sapiens
cagaggacggcuuccc

SEQ ID NO: 1666347 - RNA, 19 nt, Homo sapiens
cagaggagguuucaaagaa

SEQ ID NO: 1666348 - RNA, 16 nt, Homo sapiens
cagaggauggcuuccc

SEQ ID NO: 1666349 - RNA, 19 nt, Homo sapiens
cagaggcucuaauguacaa

SEQ ID NO: 1666350 - RNA, 22 nt, Homo sapiens
cagaggcucuaauguacaauaa

SEQ ID NO: 1666351 - RNA, 18 nt, Homo sapiens
cagagggaugaaaugcca

SEQ ID NO: 1666352 - RNA, 20 nt, Homo sapiens
cagaggggugcgcagagcug

SEQ ID NO: 1666353 - RNA, 21 nt, Homo sapiens
cagaggugaaugcacagugaa

SEQ ID NO: 1666354 - RNA, 17 nt, Homo sapiens
cagaguaugggcacuca

SEQ ID NO: 1666355 - RNA, 16 nt, Homo sapiens
cagaguggacucuucc

SEQ ID NO: 1666356 - RNA, 16 nt, Homo sapiens
cagaguguccugcuac

SEQ ID NO: 1666357 - RNA, 16 nt, Homo sapiens
cagaguugaagacaga

SEQ ID NO: 1666358 - RNA, 22 nt, Homo sapiens
cagaguugguggagaacagaaa

SEQ ID NO: 1666359 - RNA, 14 nt, Homo sapiens
cagauaccugugag

SEQ ID NO: 1666360 - RNA, 20 nt, Homo sapiens
cagauaucuauggcagcaca

SEQ ID NO: 1666361 - RNA, 22 nt, Homo sapiens
cagaucaucuccaaaucuugcc

SEQ ID NO: 1666362 - RNA, 12 nt, Homo sapiens
cagaugaucucu

SEQ ID NO: 1666363 - RNA, 22 nt, Homo sapiens
cagaugauucuaugucucauga

SEQ ID NO: 1666364 - RNA, 16 nt, Homo sapiens
cagauggcagugcagc

SEQ ID NO: 1666365 - RNA, 17 nt, Homo sapiens
cagauuguaccauugag

SEQ ID NO: 1666366 - RNA, 16 nt, Homo sapiens
cagcaaaagugcagua

SEQ ID NO: 1666367 - RNA, 11 nt, Homo sapiens
cauuugcugaa

SEQ ID NO: 1666368 - RNA, 16 nt, Homo sapiens
cauuugcugcauuuca

SEQ ID NO: 1666369 - RNA, 16 nt, Homo sapiens
cauuugugcguaugca

SEQ ID NO: 1666370 - RNA, 15 nt, Homo sapiens
cauuuuacugucugu

SEQ ID NO: 1666371 - RNA, 19 nt, Homo sapiens
cauuuuccuucaccgugac

SEQ ID NO: 1666372 - RNA, 19 nt, Homo sapiens
cauuuuucauagauaccau

SEQ ID NO: 1666373 - RNA, 18 nt, Homo sapiens
cauuuuucuacugcucuu

SEQ ID NO: 1666374 - RNA, 22 nt, Homo sapiens
cauuuuuguaauauaagacaag

SEQ ID NO: 1666375 - RNA, 16 nt, Homo sapiens
cauuuuuugucuguga

SEQ ID NO: 1666376 - RNA, 20 nt, Homo sapiens
ccaaaaaaugcuugcuucaa

SEQ ID NO: 1666377 - RNA, 17 nt, Homo sapiens
ccaaaaucguagguguu

SEQ ID NO: 1666378 - RNA, 23 nt, Homo sapiens
ccaaaccaggccuccaagccagg

SEQ ID NO: 1666379 - RNA, 14 nt, Homo sapiens
ccaaacucaccugc

SEQ ID NO: 1666380 - RNA, 14 nt, Homo sapiens
ccaaaggaagcaca

SEQ ID NO: 1666381 - RNA, 17 nt, Homo sapiens
ccaaaggaagcacaugc

SEQ ID NO: 1666382 - RNA, 18 nt, Homo sapiens
ccaaauaaauguguaaau

SEQ ID NO: 1666383 - RNA, 16 nt, Homo sapiens
ccaaauauugaucugu

SEQ ID NO: 1666384 - RNA, 13 nt, Homo sapiens
ccaaauugcugag

SEQ ID NO: 1666385 - RNA, 18 nt, Homo sapiens
ccaacaacuccaggaaaa

SEQ ID NO: 1666386 - RNA, 15 nt, Homo sapiens
ccaacaauacuuugu

SEQ ID NO: 1666387 - RNA, 12 nt, Homo sapiens
ccaacacccaaa

SEQ ID NO: 1666388 - RNA, 13 nt, Homo sapiens
ccaacacccaaag

SEQ ID NO: 1666389 - RNA, 14 nt, Homo sapiens
ccaacacuuaggga

SEQ ID NO: 1666390 - RNA, 16 nt, Homo sapiens
ccaacaugugaugugu

SEQ ID NO: 1666391 - RNA, 23 nt, Homo sapiens
ccaacauuacuccauuacuaaag

SEQ ID NO: 1666392 - RNA, 14 nt, Homo sapiens
ccaacguacuccuc

SEQ ID NO: 1666393 - RNA, 15 nt, Homo sapiens
ccaacugcugcuuaa

SEQ ID NO: 1666394 - RNA, 18 nt, Homo sapiens
ccaagaaagaaaccagac

SEQ ID NO: 1666395 - RNA, 13 nt, Homo sapiens
ccaagaacauaaa

SEQ ID NO: 1666396 - RNA, 17 nt, Homo sapiens
ccaagaagccagcacca

SEQ ID NO: 1666397 - RNA, 20 nt, Homo sapiens
ccaagaccuuacaaccacau

SEQ ID NO: 1666398 - RNA, 16 nt, Homo sapiens
ccaagugaaugaguuu

SEQ ID NO: 1666399 - RNA, 17 nt, Homo sapiens
ccaaguuggagugcagu

SEQ ID NO: 1666400 - RNA, 13 nt, Homo sapiens
ccaauagucauau

SEQ ID NO: 1666401 - RNA, 13 nt, Homo sapiens
ccaaucagaucaa

SEQ ID NO: 1666402 - RNA, 20 nt, Homo sapiens
ccaauggaacucgcucagaa

SEQ ID NO: 1666403 - RNA, 13 nt, Homo sapiens
ccacaacugacac

SEQ ID NO: 1666404 - RNA, 17 nt, Homo sapiens
ccacaacugacacagga

SEQ ID NO: 1666405 - RNA, 19 nt, Homo sapiens
ccacaacugacacaggaaa

SEQ ID NO: 1666406 - RNA, 12 nt, Homo sapiens
ccacaagcacaa

SEQ ID NO: 1666407 - RNA, 18 nt, Homo sapiens
ccacaagggcaguggaag

SEQ ID NO: 1666408 - RNA, 23 nt, Homo sapiens
ccacaaguauugcccuuuaacaa

SEQ ID NO: 1666409 - RNA, 21 nt, Homo sapiens
ccacaaucacuaaauaucuag

SEQ ID NO: 1666410 - RNA, 16 nt, Homo sapiens
ccacaggagcguguac

SEQ ID NO: 1666411 - RNA, 18 nt, Homo sapiens
ccacaggagcguguccua

SEQ ID NO: 1666412 - RNA, 17 nt, Homo sapiens
ccacaggcucugaccag

SEQ ID NO: 1666413 - RNA, 18 nt, Homo sapiens
ccacagggcagggccuca

SEQ ID NO: 1666414 - RNA, 20 nt, Homo sapiens
ccacagggcuagaagcacag

SEQ ID NO: 1666415 - RNA, 16 nt, Homo sapiens
ccacauaaacacuucu

SEQ ID NO: 1666416 - RNA, 22 nt, Homo sapiens
ccacauaaacacuucuccuuaa

SEQ ID NO: 1666417 - RNA, 12 nt, Homo sapiens
ccacauguuuca

SEQ ID NO: 1666418 - RNA, 18 nt, Homo sapiens
ccacauucacuacugcaa

SEQ ID NO: 1666419 - RNA, 16 nt, Homo sapiens
ccaccaaaaacugggu

SEQ ID NO: 1666420 - RNA, 12 nt, Homo sapiens
ccaccacuugau

SEQ ID NO: 1666421 - RNA, 21 nt, Homo sapiens
ccaccccagcaggacagugac

SEQ ID NO: 1666422 - RNA, 19 nt, Homo sapiens
ccaccccauccgcaucuca

SEQ ID NO: 1666423 - RNA, 12 nt, Homo sapiens
ccacccuaucau

SEQ ID NO: 1666424 - RNA, 18 nt, Homo sapiens
ccacccuuuccucuuaau

SEQ ID NO: 1666425 - RNA, 19 nt, Homo sapiens
ccaccuggauggaucugcu

SEQ ID NO: 1666426 - RNA, 14 nt, Homo sapiens
ccacgacauaagcu

SEQ ID NO: 1666427 - RNA, 15 nt, Homo sapiens
ccacgcucaaucuca

SEQ ID NO: 1666428 - RNA, 21 nt, Homo sapiens
ccacgucccgggcacugucau

SEQ ID NO: 1666429 - RNA, 23 nt, Homo sapiens
ccacguccugggugcugucaugc

SEQ ID NO: 1666430 - RNA, 18 nt, Homo sapiens
ccacgugacuuucaacaa

SEQ ID NO: 1666431 - RNA, 17 nt, Homo sapiens
ccacgugggguggaauu

SEQ ID NO: 1666432 - RNA, 15 nt, Homo sapiens
ccacuccagaagcau

SEQ ID NO: 1666433 - RNA, 10 nt, Homo sapiens
ccacucuguu

SEQ ID NO: 1666434 - RNA, 17 nt, Homo sapiens
ccacugccagacaugcc

SEQ ID NO: 1666435 - RNA, 18 nt, Homo sapiens
ccacugccagacaugcca

SEQ ID NO: 1666436 - RNA, 15 nt, Homo sapiens
ccacugcgaccacaa

SEQ ID NO: 1666437 - RNA, 15 nt, Homo sapiens
ccacuggaaacaaca

SEQ ID NO: 1666438 - RNA, 18 nt, Homo sapiens
ccacuggaaacaacagac

SEQ ID NO: 1666439 - RNA, 17 nt, Homo sapiens
ccacuucgggagaagaa

SEQ ID NO: 1666440 - RNA, 18 nt, Homo sapiens
ccagaaaucuaaucucug

SEQ ID NO: 1666441 - RNA, 22 nt, Homo sapiens
ccagaacaaaccucuauauguu

SEQ ID NO: 1666442 - RNA, 23 nt, Homo sapiens
ccagaagagggguccgcugggag

SEQ ID NO: 1666443 - RNA, 19 nt, Homo sapiens
ccagaagccggcggagcuc

SEQ ID NO: 1666444 - RNA, 22 nt, Homo sapiens
ccagaagcucaaggcugcagug

SEQ ID NO: 1666445 - RNA, 17 nt, Homo sapiens
ccagacaccaucaccac

SEQ ID NO: 1666446 - RNA, 20 nt, Homo sapiens
ccagacauacgaaacacaaa

SEQ ID NO: 1666447 - RNA, 21 nt, Homo sapiens
ccagacauacgaaacacaaac

SEQ ID NO: 1666448 - RNA, 19 nt, Homo sapiens
ccagagagacccugccaac

SEQ ID NO: 1666449 - RNA, 16 nt, Homo sapiens
ccagagcuccaugcau

SEQ ID NO: 1666450 - RNA, 19 nt, Homo sapiens
ccagagcuuuacagugcca

SEQ ID NO: 1666451 - RNA, 18 nt, Homo sapiens
ccagaggcucuaauguac

SEQ ID NO: 1666452 - RNA, 22 nt, Homo sapiens
ccagaggggugcgcagagcuga

SEQ ID NO: 1666453 - RNA, 17 nt, Homo sapiens
ccagaggguugugauuu

SEQ ID NO: 1666454 - RNA, 15 nt, Homo sapiens
ccagagugcuuauaa

SEQ ID NO: 1666455 - RNA, 12 nt, Homo sapiens
ccagaguguccu

SEQ ID NO: 1666456 - RNA, 12 nt, Homo sapiens
ccagaguuauuu

SEQ ID NO: 1666457 - RNA, 16 nt, Homo sapiens
ccagauaaccaaguga

SEQ ID NO: 1666458 - RNA, 16 nt, Homo sapiens
ccagcaaaagugcagu

SEQ ID NO: 1666459 - RNA, 16 nt, Homo sapiens
ccagcaccaccccauc

SEQ ID NO: 1666460 - RNA, 12 nt, Homo sapiens
ccagcacccucu

SEQ ID NO: 1666461 - RNA, 15 nt, Homo sapiens
ccagcaggacaguga

SEQ ID NO: 1666462 - RNA, 15 nt, Homo sapiens
ccagcccaaccggga

SEQ ID NO: 1666463 - RNA, 20 nt, Homo sapiens
ccagcccugggcacauagca

SEQ ID NO: 1666464 - RNA, 16 nt, Homo sapiens
ccagccgcaaauccau

SEQ ID NO: 1666465 - RNA, 14 nt, Homo sapiens
ccagcgugggaccc

SEQ ID NO: 1666466 - RNA, 17 nt, Homo sapiens
ccagcuaacucugaccu

SEQ ID NO: 1666467 - RNA, 20 nt, Homo sapiens
ccagcucaggcuacugccac

SEQ ID NO: 1666468 - RNA, 14 nt, Homo sapiens
uggaaugcaugcca

SEQ ID NO: 1666469 - RNA, 12 nt, Homo sapiens
uggaauucugcu

SEQ ID NO: 1666470 - RNA, 13 nt, Homo sapiens
uggaauucugcuu

SEQ ID NO: 1666471 - RNA, 22 nt, Homo sapiens
uggacagccaagggcagaucac

SEQ ID NO: 1666472 - RNA, 13 nt, Homo sapiens
uggacgcaugcag

SEQ ID NO: 1666473 - RNA, 13 nt, Homo sapiens
uggacuacacaca

SEQ ID NO: 1666474 - RNA, 15 nt, Homo sapiens
uggacuuccauuugg

SEQ ID NO: 1666475 - RNA, 21 nt, Homo sapiens
uggagaaggaaggcuccaucu

SEQ ID NO: 1666476 - RNA, 19 nt, Homo sapiens
uggagauaccagagacucu

SEQ ID NO: 1666477 - RNA, 15 nt, Homo sapiens
uggagauucccaucu

SEQ ID NO: 1666478 - RNA, 14 nt, Homo sapiens
uggagcuugcagug

SEQ ID NO: 1666479 - RNA, 21 nt, Homo sapiens
ucugagaaccaaccaaugaaa

SEQ ID NO: 1666480 - RNA, 17 nt, Homo sapiens
ucugagacagaaucuca

SEQ ID NO: 1666481 - RNA, 23 nt, Homo sapiens
ucugagcccugcccucacuccac

SEQ ID NO: 1666482 - RNA, 15 nt, Homo sapiens
ucugagcuuaaacau

SEQ ID NO: 1666483 - RNA, 15 nt, Homo sapiens
ucugaggaguccaaa

SEQ ID NO: 1666484 - RNA, 16 nt, Homo sapiens
ucugaggccucagagu

SEQ ID NO: 1666485 - RNA, 17 nt, Homo sapiens
ucugaguagcauauaua

SEQ ID NO: 1666486 - RNA, 14 nt, Homo sapiens
ucugaucaguauug

SEQ ID NO: 1666487 - RNA, 13 nt, Homo sapiens
ucugcacugaaaa

SEQ ID NO: 1666488 - RNA, 19 nt, Homo sapiens
ucugcauaaccgcacagac

SEQ ID NO: 1666489 - RNA, 15 nt, Homo sapiens
ucugccacacucuga

SEQ ID NO: 1666490 - RNA, 14 nt, Homo sapiens
ucugccagguuuaa

SEQ ID NO: 1666491 - RNA, 14 nt, Homo sapiens
ucugcuccaugcag

SEQ ID NO: 1666492 - RNA, 15 nt, Homo sapiens
ucugcugcuuuccaa

SEQ ID NO: 1666493 - RNA, 17 nt, Homo sapiens
ucugcuucucuuucaca

SEQ ID NO: 1666494 - RNA, 22 nt, Homo sapiens
ucuggagggaagcaccaugaau

SEQ ID NO: 1666495 - RNA, 16 nt, Homo sapiens
ucuggagucugaagga

SEQ ID NO: 1666496 - RNA, 16 nt, Homo sapiens
ucuggcaaucuugccc

SEQ ID NO: 1666497 - RNA, 24 nt, Homo sapiens
ucuggcauuauaaagaacagcuga

SEQ ID NO: 1666498 - RNA, 16 nt, Homo sapiens
ucuggcccccugaaga

SEQ ID NO: 1666499 - RNA, 19 nt, Homo sapiens
ucuggccuaugacccugug

SEQ ID NO: 1666500 - RNA, 20 nt, Homo sapiens
ucuggccuaugacccugugc

SEQ ID NO: 1666501 - RNA, 11 nt, Homo sapiens
ucugggcuccc

SEQ ID NO: 1666502 - RNA, 17 nt, Homo sapiens
ucuguacaugacuguau

SEQ ID NO: 1666503 - RNA, 16 nt, Homo sapiens
ucugucauaugcagaa

SEQ ID NO: 1666504 - RNA, 17 nt, Homo sapiens
ucugucuauaggacuua

SEQ ID NO: 1666505 - RNA, 23 nt, Homo sapiens
ucugugaaagucuccuguaucau

SEQ ID NO: 1666506 - RNA, 14 nt, Homo sapiens
ucugugcaucuggc

SEQ ID NO: 1666507 - RNA, 21 nt, Homo sapiens
ucugugcauuguggcugucaa

SEQ ID NO: 1666508 - RNA, 15 nt, Homo sapiens
ucuguuuaggugccu

SEQ ID NO: 1666509 - RNA, 16 nt, Homo sapiens
ucuguuuaggugccuc

SEQ ID NO: 1666510 - RNA, 18 nt, Homo sapiens
ucuguuugauacaguauu

SEQ ID NO: 1666511 - RNA, 20 nt, Homo sapiens
ucuguuuugcauggaguauu

SEQ ID NO: 1666512 - RNA, 17 nt, Homo sapiens
ucuuaaguaccagaagc

SEQ ID NO: 1666513 - RNA, 23 nt, Homo sapiens
ucuuaauucccaaucccauuccu

SEQ ID NO: 1666514 - RNA, 13 nt, Homo sapiens
ucuuacaguauuu

SEQ ID NO: 1666515 - RNA, 23 nt, Homo sapiens
ucuuaccagaucuaauauugacu

SEQ ID NO: 1666516 - RNA, 20 nt, Homo sapiens
ucuuacuaaccaccauuucc

SEQ ID NO: 1666517 - RNA, 21 nt, Homo sapiens
ucuuagugaaaggucaucuca

SEQ ID NO: 1666518 - RNA, 19 nt, Homo sapiens
ucuuaugccauauaauuca

SEQ ID NO: 1666519 - RNA, 17 nt, Homo sapiens
ucuucaaacaguuccau

SEQ ID NO: 1666520 - RNA, 23 nt, Homo sapiens
ucuucaaacaguuccauaccaag

SEQ ID NO: 1666521 - RNA, 20 nt, Homo sapiens
ucuucccuuaggcaauggug

SEQ ID NO: 1666522 - RNA, 24 nt, Homo sapiens
ucuuccgcagacuuggucaucgac

SEQ ID NO: 1666523 - RNA, 23 nt, Homo sapiens
ucuucgcugugaugcaugagcuc

SEQ ID NO: 1666524 - RNA, 18 nt, Homo sapiens
ucuucguagguugugaug

SEQ ID NO: 1666525 - RNA, 19 nt, Homo sapiens
ucuucuccacuuucuagcc

SEQ ID NO: 1666526 - RNA, 24 nt, Homo sapiens
ucuucuguaauauuuacaauguau

SEQ ID NO: 1666527 - RNA, 22 nt, Homo sapiens
ucuugaauguugaagaacucau

SEQ ID NO: 1666528 - RNA, 16 nt, Homo sapiens
ucuugagcugacccaa

SEQ ID NO: 1666529 - RNA, 13 nt, Homo sapiens
ucuuggauuggua

SEQ ID NO: 1666530 - RNA, 12 nt, Homo sapiens
ucuugguguugu

SEQ ID NO: 1666531 - RNA, 22 nt, Homo sapiens
ucuuguaaaacugugacauucc

SEQ ID NO: 1666532 - RNA, 13 nt, Homo sapiens
ucuuguugacuca

SEQ ID NO: 1666533 - RNA, 18 nt, Homo sapiens
ucuuguugcugcaucucc

SEQ ID NO: 1666534 - RNA, 16 nt, Homo sapiens
ucuuuacuaacacugg

SEQ ID NO: 1666535 - RNA, 18 nt, Homo sapiens
ucuuuacuaacacuggcu

SEQ ID NO: 1666536 - RNA, 20 nt, Homo sapiens
ucuuucaauccacaguauug

SEQ ID NO: 1666537 - RNA, 21 nt, Homo sapiens
ucuuucagaacacgacagaaa

SEQ ID NO: 1666538 - RNA, 22 nt, Homo sapiens
ucuuucagccaagaauucuuaa

SEQ ID NO: 1666539 - RNA, 14 nt, Homo sapiens
ucuuuccucaaaga

SEQ ID NO: 1666540 - RNA, 14 nt, Homo sapiens
ucuuuccuguaaag

SEQ ID NO: 1666541 - RNA, 15 nt, Homo sapiens
ucuuucucucuuucc

SEQ ID NO: 1666542 - RNA, 15 nt, Homo sapiens
ucuuucugcaugacu

SEQ ID NO: 1666543 - RNA, 23 nt, Homo sapiens
ucuuucuuagauucucuuuguug

SEQ ID NO: 1666544 - RNA, 21 nt, Homo sapiens
ucuuugguuccucauggcugu

SEQ ID NO: 1666545 - RNA, 15 nt, Homo sapiens
ucuuuguacagacaa

SEQ ID NO: 1666546 - RNA, 20 nt, Homo sapiens
ucuuuguauauuucuaguau

SEQ ID NO: 1666547 - RNA, 21 nt, Homo sapiens
ucuuugucaaugcucuaacaa

SEQ ID NO: 1666548 - RNA, 16 nt, Homo sapiens
ucuuuugagcauuuag

SEQ ID NO: 1666549 - RNA, 21 nt, Homo sapiens
ucuuuugcucucucauuccca

SEQ ID NO: 1666550 - RNA, 19 nt, Homo sapiens
ucuuuugggggcuggggcu

SEQ ID NO: 1666551 - RNA, 21 nt, Homo sapiens
ucuuuuggggucaucuuugau

SEQ ID NO: 1666552 - RNA, 20 nt, Homo sapiens
ucuuuuuuuuuucgucuucc

SEQ ID NO: 1666553 - RNA, 13 nt, Homo sapiens
ugaaaaaauaaca

SEQ ID NO: 1666554 - RNA, 21 nt, Homo sapiens
ugaaaaauaguguguccaugc

SEQ ID NO: 1666555 - RNA, 18 nt, Homo sapiens
ugaaaaaucugaauuucu

SEQ ID NO: 1666556 - RNA, 20 nt, Homo sapiens
ugaaaaauucccucuuucca

SEQ ID NO: 1666557 - RNA, 16 nt, Homo sapiens
ugaaaagacaaauggg

SEQ ID NO: 1666558 - RNA, 15 nt, Homo sapiens
ugaaaaggguguugc

SEQ ID NO: 1666559 - RNA, 21 nt, Homo sapiens
ugaaaauggagaaaaccagag

SEQ ID NO: 1666560 - RNA, 15 nt, Homo sapiens
ugaaacaaauauacu

SEQ ID NO: 1666561 - RNA, 17 nt, Homo sapiens
ugaaacacucgugugca

SEQ ID NO: 1666562 - RNA, 18 nt, Homo sapiens
ugaaacaguguggaugua

SEQ ID NO: 1666563 - RNA, 22 nt, Homo sapiens
ugaaaccccgucucuacuaaaa

SEQ ID NO: 1666564 - RNA, 22 nt, Homo sapiens
ugaaacgcaaccaccaccaacc

SEQ ID NO: 1666565 - RNA, 18 nt, Homo sapiens
ugaaauauaaacugugag

SEQ ID NO: 1666566 - RNA, 12 nt, Homo sapiens
ugaaauaucauc

SEQ ID NO: 1666567 - RNA, 13 nt, Homo sapiens
ugaaauaucauca

SEQ ID NO: 1666568 - RNA, 22 nt, Homo sapiens
ugaaauaugauaauaaaggcau

SEQ ID NO: 1666569 - RNA, 23 nt, Homo sapiens
ugaaaucuacaacauaaugauac

SEQ ID NO: 1666570 - RNA, 14 nt, Homo sapiens
ugaaaugaugguaa

SEQ ID NO: 1666571 - RNA, 13 nt, Homo sapiens
ugaaauucacaaa

SEQ ID NO: 1666572 - RNA, 13 nt, Homo sapiens
ugaaauugaguca

SEQ ID NO: 1666573 - RNA, 16 nt, Homo sapiens
ugaaauuuaagcacaa

SEQ ID NO: 1666574 - RNA, 19 nt, Homo sapiens
ugaacaccacuuugucucu

SEQ ID NO: 1666575 - RNA, 15 nt, Homo sapiens
ugaacacucuuggua

SEQ ID NO: 1666576 - RNA, 23 nt, Homo sapiens
ugaacauuaauccacauguuuca

SEQ ID NO: 1666577 - RNA, 15 nt, Homo sapiens
ugaaccgucaaugug

SEQ ID NO: 1666578 - RNA, 15 nt, Homo sapiens
ugaacugcaacacug

SEQ ID NO: 1666579 - RNA, 17 nt, Homo sapiens
ugaacugcaacacugga

SEQ ID NO: 1666580 - RNA, 14 nt, Homo sapiens
ugaagaaacauuua

SEQ ID NO: 1666581 - RNA, 17 nt, Homo sapiens
ugaagacccuaucuccc

SEQ ID NO: 1666582 - RNA, 23 nt, Homo sapiens
ugaagcaaacacacagacucugu

SEQ ID NO: 1666583 - RNA, 19 nt, Homo sapiens
ugaagcaaauuucuagaua

SEQ ID NO: 1666584 - RNA, 22 nt, Homo sapiens
ugaaggccggguaaugagccau

SEQ ID NO: 1666585 - RNA, 19 nt, Homo sapiens
ugaaggggcugguggagau

SEQ ID NO: 1666586 - RNA, 16 nt, Homo sapiens
ugaaguaggugaucuu

SEQ ID NO: 1666587 - RNA, 22 nt, Homo sapiens
ugaaguuuauuuucuauuuuag

SEQ ID NO: 1666588 - RNA, 15 nt, Homo sapiens
ugaauaaagccacau

SEQ ID NO: 1666589 - RNA, 18 nt, Homo sapiens
ugaauaaagccacauaac

SEQ ID NO: 1666590 - RNA, 16 nt, Homo sapiens
ugaauagcgcccucaa

SEQ ID NO: 1666591 - RNA, 12 nt, Homo sapiens
ugaauaugugua

SEQ ID NO: 1666592 - RNA, 15 nt, Homo sapiens
ugaauauuauacuuc

SEQ ID NO: 1666593 - RNA, 17 nt, Homo sapiens
ugaauauuauacuucuu

SEQ ID NO: 1666594 - RNA, 22 nt, Homo sapiens
ugaaucacugcaccucuuuguc

SEQ ID NO: 1666595 - RNA, 15 nt, Homo sapiens
ugaaugaugccauga

SEQ ID NO: 1666596 - RNA, 16 nt, Homo sapiens
ugcagcacaguacuca

SEQ ID NO: 1666597 - RNA, 22 nt, Homo sapiens
ugcagcccagaacgggccuccc

SEQ ID NO: 1666598 - RNA, 18 nt, Homo sapiens
ugcagcccccugcuucuc

SEQ ID NO: 1666599 - RNA, 20 nt, Homo sapiens
ugcaggaaccagcaaugaga

SEQ ID NO: 1666600 - RNA, 23 nt, Homo sapiens
ugcagggacagccugcacagugg

SEQ ID NO: 1666601 - RNA, 18 nt, Homo sapiens
ugcagggcccccacugga

SEQ ID NO: 1666602 - RNA, 21 nt, Homo sapiens
ugcagggccuguaaucccagc

SEQ ID NO: 1666603 - RNA, 19 nt, Homo sapiens
ugcaggggggcaguaacuc

SEQ ID NO: 1666604 - RNA, 15 nt, Homo sapiens
aauuaaagucuacac

SEQ ID NO: 1666605 - RNA, 22 nt, Homo sapiens
aauuaaauauauguauguaaaa

SEQ ID NO: 1666606 - RNA, 14 nt, Homo sapiens
aauuaacuaacuca

SEQ ID NO: 1666607 - RNA, 15 nt, Homo sapiens
aauuaaugacaacaa

SEQ ID NO: 1666608 - RNA, 20 nt, Homo sapiens
aauuaaugaguuuuauccaa

SEQ ID NO: 1666609 - RNA, 14 nt, Homo sapiens
aauuacaugcauga

SEQ ID NO: 1666610 - RNA, 16 nt, Homo sapiens
aauuacaugcaugagc

SEQ ID NO: 1666611 - RNA, 16 nt, Homo sapiens
aauuagauccauuaau

SEQ ID NO: 1666612 - RNA, 13 nt, Homo sapiens
aauuagaugacug

SEQ ID NO: 1666613 - RNA, 13 nt, Homo sapiens
aauuauaugauau

SEQ ID NO: 1666614 - RNA, 20 nt, Homo sapiens
aauuauauuuugaacaacuc

SEQ ID NO: 1666615 - RNA, 12 nt, Homo sapiens
aauuauccuccu

SEQ ID NO: 1666616 - RNA, 22 nt, Homo sapiens
aauuauuucagucaucaucuca

SEQ ID NO: 1666617 - RNA, 17 nt, Homo sapiens
aauucauguuuucacuu

SEQ ID NO: 1666618 - RNA, 19 nt, Homo sapiens
aauuccaccuggaaagcca

SEQ ID NO: 1666619 - RNA, 19 nt, Homo sapiens
aauucccaaucccauuccu

SEQ ID NO: 1666620 - RNA, 14 nt, Homo sapiens
aauuccgacuuucu

SEQ ID NO: 1666621 - RNA, 20 nt, Homo sapiens
aauucuagauuaccaugaag

SEQ ID NO: 1666622 - RNA, 18 nt, Homo sapiens
aauucucuucgcugugau

SEQ ID NO: 1666623 - RNA, 22 nt, Homo sapiens
aauucugaaggggaaaaccuca

SEQ ID NO: 1666624 - RNA, 12 nt, Homo sapiens
aauucuucucca

SEQ ID NO: 1666625 - RNA, 19 nt, Homo sapiens
aauugauuaguuugccuaa

SEQ ID NO: 1666626 - RNA, 16 nt, Homo sapiens
aauugcuccauuccug

SEQ ID NO: 1666627 - RNA, 15 nt, Homo sapiens
aauuggguugugaaa

SEQ ID NO: 1666628 - RNA, 20 nt, Homo sapiens
aauugucuuuugucaugugg

SEQ ID NO: 1666629 - RNA, 12 nt, Homo sapiens
aauugugccaaa

SEQ ID NO: 1666630 - RNA, 17 nt, Homo sapiens
aauuguuuuuugcucuu

SEQ ID NO: 1666631 - RNA, 14 nt, Homo sapiens
aauuuccugugagg

SEQ ID NO: 1666632 - RNA, 16 nt, Homo sapiens
aauuucugccauuuca

SEQ ID NO: 1666633 - RNA, 16 nt, Homo sapiens
aauuuguucugugcaa

SEQ ID NO: 1666634 - RNA, 17 nt, Homo sapiens
aauuuuaucucuucuuc

SEQ ID NO: 1666635 - RNA, 19 nt, Homo sapiens
acaaaaaaaaaauuugcca

SEQ ID NO: 1666636 - RNA, 23 nt, Homo sapiens
acaaaaaggaaaugaauauucaa

SEQ ID NO: 1666637 - RNA, 16 nt, Homo sapiens
acaaaaugcaaacuuu

SEQ ID NO: 1666638 - RNA, 20 nt, Homo sapiens
acaaacccguuuuaugauuu

SEQ ID NO: 1666639 - RNA, 15 nt, Homo sapiens
acaaagaugagauaa

SEQ ID NO: 1666640 - RNA, 19 nt, Homo sapiens
acaaagcauuugacuuucu

SEQ ID NO: 1666641 - RNA, 19 nt, Homo sapiens
acaaauggcuuguucaguc

SEQ ID NO: 1666642 - RNA, 13 nt, Homo sapiens
acaaauguaacac

SEQ ID NO: 1666643 - RNA, 21 nt, Homo sapiens
acaacaaaccuguuucugcag

SEQ ID NO: 1666644 - RNA, 14 nt, Homo sapiens
acaaccacugggau

SEQ ID NO: 1666645 - RNA, 16 nt, Homo sapiens
acaacccuugcugaaa

SEQ ID NO: 1666646 - RNA, 19 nt, Homo sapiens
acaaccugccacaauguga

SEQ ID NO: 1666647 - RNA, 16 nt, Homo sapiens
acaacucgaaucacuc

SEQ ID NO: 1666648 - RNA, 17 nt, Homo sapiens
acaagagaagcugaugg

SEQ ID NO: 1666649 - RNA, 17 nt, Homo sapiens
acaagagacaugagauu

SEQ ID NO: 1666650 - RNA, 20 nt, Homo sapiens
acaagagaccacuuccuuaa

SEQ ID NO: 1666651 - RNA, 22 nt, Homo sapiens
acaaggcgucucuucaaacagu

SEQ ID NO: 1666652 - RNA, 17 nt, Homo sapiens
acaaggcuccacaagcg

SEQ ID NO: 1666653 - RNA, 13 nt, Homo sapiens
acaaguagcacac

SEQ ID NO: 1666654 - RNA, 18 nt, Homo sapiens
acaaguagcacacugagu

SEQ ID NO: 1666655 - RNA, 19 nt, Homo sapiens
acaaguagcacacugaguu

SEQ ID NO: 1666656 - RNA, 16 nt, Homo sapiens
acaaguauuacacauc

SEQ ID NO: 1666657 - RNA, 14 nt, Homo sapiens
acaauaaagcaaug

SEQ ID NO: 1666658 - RNA, 18 nt, Homo sapiens
acaauacaacacauugaa

SEQ ID NO: 1666659 - RNA, 16 nt, Homo sapiens
acaauacagugguaua

SEQ ID NO: 1666660 - RNA, 13 nt, Homo sapiens
acaaucaugccua

SEQ ID NO: 1666661 - RNA, 19 nt, Homo sapiens
acaaugaccacauccugaa

SEQ ID NO: 1666662 - RNA, 17 nt, Homo sapiens
accuucuuuucaaugca

SEQ ID NO: 1666663 - RNA, 18 nt, Homo sapiens
accuugaaugaugccaug

SEQ ID NO: 1666664 - RNA, 14 nt, Homo sapiens
accuugacgugugu

SEQ ID NO: 1666665 - RNA, 14 nt, Homo sapiens
accuugcacagguc

SEQ ID NO: 1666666 - RNA, 21 nt, Homo sapiens
accuuguacagaaccagcacu

SEQ ID NO: 1666667 - RNA, 21 nt, Homo sapiens
accuuugucucacgauuccag

SEQ ID NO: 1666668 - RNA, 15 nt, Homo sapiens
acgaaacacaaacca

SEQ ID NO: 1666669 - RNA, 23 nt, Homo sapiens
acgaaacacaaaccacaacugac

SEQ ID NO: 1666670 - RNA, 13 nt, Homo sapiens
acgaaagcacagu

SEQ ID NO: 1666671 - RNA, 22 nt, Homo sapiens
acgaauuaauuaccuggcacca

SEQ ID NO: 1666672 - RNA, 21 nt, Homo sapiens
acgaggccaaggcugaaacca

SEQ ID NO: 1666673 - RNA, 12 nt, Homo sapiens
acgauggucucc

SEQ ID NO: 1666674 - RNA, 19 nt, Homo sapiens
acgauuauaguaccacugc

SEQ ID NO: 1666675 - RNA, 16 nt, Homo sapiens
acgcaaauacaugccu

SEQ ID NO: 1666676 - RNA, 19 nt, Homo sapiens
acgcacaacaugcacauuc

SEQ ID NO: 1666677 - RNA, 13 nt, Homo sapiens
acgcacaggaaaa

SEQ ID NO: 1666678 - RNA, 19 nt, Homo sapiens
acgcauggugcaggaggga

SEQ ID NO: 1666679 - RNA, 19 nt, Homo sapiens
acgccccccggccugaugg

SEQ ID NO: 1666680 - RNA, 23 nt, Homo sapiens
acgccccccggccugauggccag

SEQ ID NO: 1666681 - RNA, 19 nt, Homo sapiens
acgccgauauaagccauag

SEQ ID NO: 1666682 - RNA, 14 nt, Homo sapiens
acgccuccauccac

SEQ ID NO: 1666683 - RNA, 15 nt, Homo sapiens
acgcuaguuccaucc

SEQ ID NO: 1666684 - RNA, 21 nt, Homo sapiens
acgcucaguaaccaugcaaaa

SEQ ID NO: 1666685 - RNA, 18 nt, Homo sapiens
acgcuuuucccaccucuu

SEQ ID NO: 1666686 - RNA, 14 nt, Homo sapiens
acggcccugcaaug

SEQ ID NO: 1666687 - RNA, 15 nt, Homo sapiens
acgucccgggcacug

SEQ ID NO: 1666688 - RNA, 18 nt, Homo sapiens
acgucccgggcacuguca

SEQ ID NO: 1666689 - RNA, 20 nt, Homo sapiens
acgucccgggcacugucaug

SEQ ID NO: 1666690 - RNA, 15 nt, Homo sapiens
acguccuuccacuuc

SEQ ID NO: 1666691 - RNA, 14 nt, Homo sapiens
acgugacuccucaa

SEQ ID NO: 1666692 - RNA, 13 nt, Homo sapiens
acgugagccacag

SEQ ID NO: 1666693 - RNA, 18 nt, Homo sapiens
acgugcucuucuguucuc

SEQ ID NO: 1666694 - RNA, 15 nt, Homo sapiens
acgugggguggaauu

SEQ ID NO: 1666695 - RNA, 21 nt, Homo sapiens
acuaaccccaacgcacaggaa

SEQ ID NO: 1666696 - RNA, 13 nt, Homo sapiens
acuaacgccaucc

SEQ ID NO: 1666697 - RNA, 22 nt, Homo sapiens
acuaagggcaggaagacuucca

SEQ ID NO: 1666698 - RNA, 23 nt, Homo sapiens
acuaaugaggaaacugcacuguu

SEQ ID NO: 1666699 - RNA, 15 nt, Homo sapiens
acuaauuagugucca

SEQ ID NO: 1666700 - RNA, 12 nt, Homo sapiens
acuacaaccucc

SEQ ID NO: 1666701 - RNA, 18 nt, Homo sapiens
acuacagacccagcccca

SEQ ID NO: 1666702 - RNA, 21 nt, Homo sapiens
acuacagguauuuucaucaag

SEQ ID NO: 1666703 - RNA, 14 nt, Homo sapiens
acuacaucugauau

SEQ ID NO: 1666704 - RNA, 23 nt, Homo sapiens
acuaccccaggaugcaugcaggg

SEQ ID NO: 1666705 - RNA, 11 nt, Homo sapiens
acuagaucucc

SEQ ID NO: 1666706 - RNA, 18 nt, Homo sapiens
acuagcccucuuucucuc

SEQ ID NO: 1666707 - RNA, 20 nt, Homo sapiens
acuaguuagauucacuuuga

SEQ ID NO: 1666708 - RNA, 21 nt, Homo sapiens
acuaucauugcccucuucaag

SEQ ID NO: 1666709 - RNA, 14 nt, Homo sapiens
acuauggagccugg

SEQ ID NO: 1666710 - RNA, 20 nt, Homo sapiens
acuaugguaaauaacuguga

SEQ ID NO: 1666711 - RNA, 21 nt, Homo sapiens
acuaugguaaauaacugugac

SEQ ID NO: 1666712 - RNA, 15 nt, Homo sapiens
acuauguagucuguu

SEQ ID NO: 1666713 - RNA, 16 nt, Homo sapiens
acuauuaacucugcau

SEQ ID NO: 1666714 - RNA, 21 nt, Homo sapiens
acuauuuuugauagcacacau

SEQ ID NO: 1666715 - RNA, 13 nt, Homo sapiens
caccauguuggcu

SEQ ID NO: 1666716 - RNA, 17 nt, Homo sapiens
cacccaaagcauggacu

SEQ ID NO: 1666717 - RNA, 20 nt, Homo sapiens
cacccagguuggagugcagu

SEQ ID NO: 1666718 - RNA, 18 nt, Homo sapiens
cacccccucuguugcaca

SEQ ID NO: 1666719 - RNA, 14 nt, Homo sapiens
caccccucaagcca

SEQ ID NO: 1666720 - RNA, 13 nt, Homo sapiens
cacccguguucuc

SEQ ID NO: 1666721 - RNA, 15 nt, Homo sapiens
cacccuaucaucagu

SEQ ID NO: 1666722 - RNA, 23 nt, Homo sapiens
cacccucugcuaugucugugaug

SEQ ID NO: 1666723 - RNA, 16 nt, Homo sapiens
cacccuuuccucuuaa

SEQ ID NO: 1666724 - RNA, 21 nt, Homo sapiens
cacccuuuccucuuaauuccc

SEQ ID NO: 1666725 - RNA, 14 nt, Homo sapiens
caccgagacaguug

SEQ ID NO: 1666726 - RNA, 22 nt, Homo sapiens
caccgagaggaaaaaggcuucu

SEQ ID NO: 1666727 - RNA, 14 nt, Homo sapiens
caccgcagaaggaa

SEQ ID NO: 1666728 - RNA, 16 nt, Homo sapiens
caccgcauuccagggg

SEQ ID NO: 1666729 - RNA, 19 nt, Homo sapiens
caccuagagcuagaugugu

SEQ ID NO: 1666730 - RNA, 12 nt, Homo sapiens
caccucagccau

SEQ ID NO: 1666731 - RNA, 18 nt, Homo sapiens
caccucaggaccauguga

SEQ ID NO: 1666732 - RNA, 23 nt, Homo sapiens
caccucaggaccaugugauaauu

SEQ ID NO: 1666733 - RNA, 17 nt, Homo sapiens
caccuccaucaaacgca

SEQ ID NO: 1666734 - RNA, 19 nt, Homo sapiens
caccuccauuaaccaagaa

SEQ ID NO: 1666735 - RNA, 20 nt, Homo sapiens
caccucggccucccaaagug

SEQ ID NO: 1666736 - RNA, 13 nt, Homo sapiens
caccucuuuguca

SEQ ID NO: 1666737 - RNA, 18 nt, Homo sapiens
caccugcagccuguugaa

SEQ ID NO: 1666738 - RNA, 17 nt, Homo sapiens
caccugccaaaugaaua

SEQ ID NO: 1666739 - RNA, 18 nt, Homo sapiens
caccugccccaggcucag

SEQ ID NO: 1666740 - RNA, 18 nt, Homo sapiens
caccuguaaaacuuuauu

SEQ ID NO: 1666741 - RNA, 15 nt, Homo sapiens
caccugucaaccuga

SEQ ID NO: 1666742 - RNA, 16 nt, Homo sapiens
caccuguuacuacuuc

SEQ ID NO: 1666743 - RNA, 21 nt, Homo sapiens
caccuucccuaguucuuugca

SEQ ID NO: 1666744 - RNA, 19 nt, Homo sapiens
caccuugcccaugcacaag

SEQ ID NO: 1666745 - RNA, 14 nt, Homo sapiens
cacgauuccagugc

SEQ ID NO: 1666746 - RNA, 22 nt, Homo sapiens
cacgccugguucuguacaugug

SEQ ID NO: 1666747 - RNA, 18 nt, Homo sapiens
cacgcuaguuccauccac

SEQ ID NO: 1666748 - RNA, 15 nt, Homo sapiens
cacguaaggucucau

SEQ ID NO: 1666749 - RNA, 21 nt, Homo sapiens
cacguagcaaaucguacauug

SEQ ID NO: 1666750 - RNA, 20 nt, Homo sapiens
cacgucccgggcacugucau

SEQ ID NO: 1666751 - RNA, 21 nt, Homo sapiens
cacgucccgggcacugucaug

SEQ ID NO: 1666752 - RNA, 19 nt, Homo sapiens
cacguggccgcugcccacg

SEQ ID NO: 1666753 - RNA, 16 nt, Homo sapiens
cacguuucaaccucuc

SEQ ID NO: 1666754 - RNA, 23 nt, Homo sapiens
cacuaaagaaaaacuaaugucag

SEQ ID NO: 1666755 - RNA, 18 nt, Homo sapiens
cacuaaggccgugucucu

SEQ ID NO: 1666756 - RNA, 15 nt, Homo sapiens
cacuaaguaaccucu

SEQ ID NO: 1666757 - RNA, 16 nt, Homo sapiens
cacuaaguaaccucua

SEQ ID NO: 1666758 - RNA, 22 nt, Homo sapiens
cacuacaaccuccgccucccau

SEQ ID NO: 1666759 - RNA, 14 nt, Homo sapiens
cacuacauucugaa

SEQ ID NO: 1666760 - RNA, 20 nt, Homo sapiens
cacuacccuccuguaaaaua

SEQ ID NO: 1666761 - RNA, 23 nt, Homo sapiens
cacuagugggguccugaggccaa

SEQ ID NO: 1666762 - RNA, 18 nt, Homo sapiens
cacucaucagguaaacug

SEQ ID NO: 1666763 - RNA, 16 nt, Homo sapiens
cacucuaacuguauau

SEQ ID NO: 1666764 - RNA, 21 nt, Homo sapiens
cacucuuauuucacuaaagaa

SEQ ID NO: 1666765 - RNA, 18 nt, Homo sapiens
cacugaauaaauaaguaa

SEQ ID NO: 1666766 - RNA, 23 nt, Homo sapiens
cacugacagccuccaccuugagc

SEQ ID NO: 1666767 - RNA, 18 nt, Homo sapiens
cacugaguuugaacacag

SEQ ID NO: 1666768 - RNA, 15 nt, Homo sapiens
cacugcacaucaugu

SEQ ID NO: 1666769 - RNA, 21 nt, Homo sapiens
cacugccaaacaucagucaau

SEQ ID NO: 1666770 - RNA, 19 nt, Homo sapiens
cacugccccagacacagug

SEQ ID NO: 1666771 - RNA, 18 nt, Homo sapiens
cacugcccccuccacugg

SEQ ID NO: 1666772 - RNA, 14 nt, Homo sapiens
cacugcuccagugg

SEQ ID NO: 1666773 - RNA, 21 nt, Homo sapiens
cacugcugaggacacucagug

SEQ ID NO: 1666774 - RNA, 16 nt, Homo sapiens
cacuggagcguguacu

SEQ ID NO: 1666775 - RNA, 17 nt, Homo sapiens
cacuggcuuuacauggg

SEQ ID NO: 1666776 - RNA, 19 nt, Homo sapiens
cacugguuuguuucucaag

SEQ ID NO: 1666777 - RNA, 13 nt, Homo sapiens
cacugucaugccc

SEQ ID NO: 1666778 - RNA, 15 nt, Homo sapiens
cacugucaugcccag

SEQ ID NO: 1666779 - RNA, 18 nt, Homo sapiens
cacuuccuuaacagcugu

SEQ ID NO: 1666780 - RNA, 9 nt, Homo sapiens
cacuucuua

SEQ ID NO: 1666781 - RNA, 19 nt, Homo sapiens
cacuucuuuccucaaagaa

SEQ ID NO: 1666782 - RNA, 13 nt, Homo sapiens
cacuugacaucaa

SEQ ID NO: 1666783 - RNA, 14 nt, Homo sapiens
cacuugccuuguga

SEQ ID NO: 1666784 - RNA, 18 nt, Homo sapiens
cacuuuguuucauauucu

SEQ ID NO: 1666785 - RNA, 14 nt, Homo sapiens
cagaaaaccuacca

SEQ ID NO: 1666786 - RNA, 21 nt, Homo sapiens
cagaaaaccuaccacauucac

SEQ ID NO: 1666787 - RNA, 13 nt, Homo sapiens
cagaaaagcaccu

SEQ ID NO: 1666788 - RNA, 19 nt, Homo sapiens
cagaaacacggaguuucca

SEQ ID NO: 1666789 - RNA, 22 nt, Homo sapiens
cagaaacccuuuuacagucaca

SEQ ID NO: 1666790 - RNA, 17 nt, Homo sapiens
cagaaacugaacuggcc

SEQ ID NO: 1666791 - RNA, 18 nt, Homo sapiens
cagaaaucuaaucucugu

SEQ ID NO: 1666792 - RNA, 18 nt, Homo sapiens
cagaaaugugcugcaaag

SEQ ID NO: 1666793 - RNA, 22 nt, Homo sapiens
cagaaauuuuaagccaaaaaca

SEQ ID NO: 1666794 - RNA, 13 nt, Homo sapiens
cagaaccaaagca

SEQ ID NO: 1666795 - RNA, 18 nt, Homo sapiens
cagaacccagacccugag

SEQ ID NO: 1666796 - RNA, 23 nt, Homo sapiens
cagaaccuagucuuguuguucau

SEQ ID NO: 1666797 - RNA, 21 nt, Homo sapiens
cagaagaacguggauugugaa

SEQ ID NO: 1666798 - RNA, 18 nt, Homo sapiens
cagaagauuagcaugaaa

SEQ ID NO: 1666799 - RNA, 15 nt, Homo sapiens
cagaagggagugaaa

SEQ ID NO: 1666800 - RNA, 12 nt, Homo sapiens
cagaauagcuga

SEQ ID NO: 1666801 - RNA, 18 nt, Homo sapiens
cagaauggggacaucuug

SEQ ID NO: 1666802 - RNA, 21 nt, Homo sapiens
cagaauggugggcuccagagu

SEQ ID NO: 1666803 - RNA, 13 nt, Homo sapiens
cagaauguguuau

SEQ ID NO: 1666804 - RNA, 15 nt, Homo sapiens
cagacaccuagacuc

SEQ ID NO: 1666805 - RNA, 15 nt, Homo sapiens
cagacggacgggaca

SEQ ID NO: 1666806 - RNA, 17 nt, Homo sapiens
cagacuuucuacaugca

SEQ ID NO: 1666807 - RNA, 18 nt, Homo sapiens
cagagacuggaggcauuu

SEQ ID NO: 1666808 - RNA, 17 nt, Homo sapiens
acaguucuuggugacug

SEQ ID NO: 1666809 - RNA, 16 nt, Homo sapiens
acaguugguuuugcau

SEQ ID NO: 1666810 - RNA, 16 nt, Homo sapiens
acaguuucuuccccaa

SEQ ID NO: 1666811 - RNA, 15 nt, Homo sapiens
acauaaaaaagggac

SEQ ID NO: 1666812 - RNA, 12 nt, Homo sapiens
acauaaacacuu

SEQ ID NO: 1666813 - RNA, 21 nt, Homo sapiens
acauaauguuaguagcacuga

SEQ ID NO: 1666814 - RNA, 20 nt, Homo sapiens
acauacacaaaugggcauac

SEQ ID NO: 1666815 - RNA, 20 nt, Homo sapiens
acauaccuacaccuaucuau

SEQ ID NO: 1666816 - RNA, 23 nt, Homo sapiens
acauaccucucaacuuacauaug

SEQ ID NO: 1666817 - RNA, 23 nt, Homo sapiens
acaucaguccacccccauuguga

SEQ ID NO: 1666818 - RNA, 15 nt, Homo sapiens
acauccucacuuuua

SEQ ID NO: 1666819 - RNA, 19 nt, Homo sapiens
acaucuagucucagugcua

SEQ ID NO: 1666820 - RNA, 12 nt, Homo sapiens
acaucucuucau

SEQ ID NO: 1666821 - RNA, 14 nt, Homo sapiens
acaucucuucaugc

SEQ ID NO: 1666822 - RNA, 21 nt, Homo sapiens
acaugaacguuuucucuucac

SEQ ID NO: 1666823 - RNA, 15 nt, Homo sapiens
acaugacuguauaau

SEQ ID NO: 1666824 - RNA, 18 nt, Homo sapiens
acaugcaaaucuggcuua

SEQ ID NO: 1666825 - RNA, 17 nt, Homo sapiens
acaugcacagcuaacau

SEQ ID NO: 1666826 - RNA, 14 nt, Homo sapiens
acaugcacugaccc

SEQ ID NO: 1666827 - RNA, 18 nt, Homo sapiens
acaugccucucucaggcc

SEQ ID NO: 1666828 - RNA, 14 nt, Homo sapiens
acaugccuugaaac

SEQ ID NO: 1666829 - RNA, 16 nt, Homo sapiens
acauggacuacacaca

SEQ ID NO: 1666830 - RNA, 17 nt, Homo sapiens
acauggcaacaaaggau

SEQ ID NO: 1666831 - RNA, 17 nt, Homo sapiens
acauggccaauagucau

SEQ ID NO: 1666832 - RNA, 13 nt, Homo sapiens
acauucacaccau

SEQ ID NO: 1666833 - RNA, 17 nt, Homo sapiens
acauucaccaacaacag

SEQ ID NO: 1666834 - RNA, 21 nt, Homo sapiens
acauucaccaacaacagucag

SEQ ID NO: 1666835 - RNA, 23 nt, Homo sapiens
acauucuuggucacaaagcuauu

SEQ ID NO: 1666836 - RNA, 23 nt, Homo sapiens
acauugcaggaagagaugcucua

SEQ ID NO: 1666837 - RNA, 16 nt, Homo sapiens
acauugcuucauuaaa

SEQ ID NO: 1666838 - RNA, 23 nt, Homo sapiens
acauuugcuuuuugcuuguguac

SEQ ID NO: 1666839 - RNA, 19 nt, Homo sapiens
acauuuguuccugggacug

SEQ ID NO: 1666840 - RNA, 21 nt, Homo sapiens
acauuuucuaacaaacucaaa

SEQ ID NO: 1666841 - RNA, 16 nt, Homo sapiens
accaaaccauuauuca

SEQ ID NO: 1666842 - RNA, 18 nt, Homo sapiens
accaaugaaaacaguccc

SEQ ID NO: 1666843 - RNA, 20 nt, Homo sapiens
accaaugaaaacagucccau

SEQ ID NO: 1666844 - RNA, 15 nt, Homo sapiens
accacaacugacaca

SEQ ID NO: 1666845 - RNA, 19 nt, Homo sapiens
accacacgcccccacaggc

SEQ ID NO: 1666846 - RNA, 18 nt, Homo sapiens
accacagaagcuuguauu

SEQ ID NO: 1666847 - RNA, 20 nt, Homo sapiens
accacagcugccuccgggcc

SEQ ID NO: 1666848 - RNA, 14 nt, Homo sapiens
accaccaaccacug

SEQ ID NO: 1666849 - RNA, 15 nt, Homo sapiens
accaccacugugucc

SEQ ID NO: 1666850 - RNA, 10 nt, Homo sapiens
accacccacc

SEQ ID NO: 1666851 - RNA, 11 nt, Homo sapiens
accacccagaa

SEQ ID NO: 1666852 - RNA, 14 nt, Homo sapiens
accacccugccaag

SEQ ID NO: 1666853 - RNA, 13 nt, Homo sapiens
accaccuucaaua

SEQ ID NO: 1666854 - RNA, 17 nt, Homo sapiens
accacgugacuuucaac

SEQ ID NO: 1666855 - RNA, 13 nt, Homo sapiens
accacucucagga

SEQ ID NO: 1666856 - RNA, 22 nt, Homo sapiens
accagaaugaggcacaugacag

SEQ ID NO: 1666857 - RNA, 14 nt, Homo sapiens
accagcugccaaaa

SEQ ID NO: 1666858 - RNA, 18 nt, Homo sapiens
accaggugucucugagaa

SEQ ID NO: 1666859 - RNA, 21 nt, Homo sapiens
accagguuaccucacuuuuaa

SEQ ID NO: 1666860 - RNA, 22 nt, Homo sapiens
accauaaaauaaauaaucucau

SEQ ID NO: 1666861 - RNA, 23 nt, Homo sapiens
accauaugcacaauuccaugaau

SEQ ID NO: 1666862 - RNA, 17 nt, Homo sapiens
accaucaaacaaaucau

SEQ ID NO: 1666863 - RNA, 15 nt, Homo sapiens
ggagaaaagccagau

SEQ ID NO: 1666864 - RNA, 21 nt, Homo sapiens
ggagaaccaccauucacccaa

SEQ ID NO: 1666865 - RNA, 20 nt, Homo sapiens
ggagaagaaggcaacccaaa

SEQ ID NO: 1666866 - RNA, 14 nt, Homo sapiens
ggagacgcauugua

SEQ ID NO: 1666867 - RNA, 19 nt, Homo sapiens
ggagccugcaauaagggaa

SEQ ID NO: 1666868 - RNA, 15 nt, Homo sapiens
ggagcucacaccgca

SEQ ID NO: 1666869 - RNA, 14 nt, Homo sapiens
ggagcuugcaguga

SEQ ID NO: 1666870 - RNA, 12 nt, Homo sapiens
ggaggcuugaag

SEQ ID NO: 1666871 - RNA, 15 nt, Homo sapiens
ggagugaaaaccucu

SEQ ID NO: 1666872 - RNA, 13 nt, Homo sapiens
ggagugacucugg

SEQ ID NO: 1666873 - RNA, 12 nt, Homo sapiens
ggagugcagugg

SEQ ID NO: 1666874 - RNA, 23 nt, Homo sapiens
ggagugcaguggcaucaucucag

SEQ ID NO: 1666875 - RNA, 22 nt, Homo sapiens
ggagugggcucucuggaccuga

SEQ ID NO: 1666876 - RNA, 16 nt, Homo sapiens
ggaguucagauguuuu

SEQ ID NO: 1666877 - RNA, 18 nt, Homo sapiens
aagggcauuuuguacaau

SEQ ID NO: 1666878 - RNA, 22 nt, Homo sapiens
aagggcgcugagggcaggguuc

SEQ ID NO: 1666879 - RNA, 14 nt, Homo sapiens
aaggguucagccca

SEQ ID NO: 1666880 - RNA, 15 nt, Homo sapiens
aagguaaacaguuug

SEQ ID NO: 1666881 - RNA, 13 nt, Homo sapiens
aagguauguguca

SEQ ID NO: 1666882 - RNA, 17 nt, Homo sapiens
aagguaugugucagcca

SEQ ID NO: 1666883 - RNA, 18 nt, Homo sapiens
aagguaugugucagccau

SEQ ID NO: 1666884 - RNA, 13 nt, Homo sapiens
aaggugagccaga

SEQ ID NO: 1666885 - RNA, 21 nt, Homo sapiens
aagguuguacauaguggucau

SEQ ID NO: 1666886 - RNA, 13 nt, Homo sapiens
aaguaaacaguca

SEQ ID NO: 1666887 - RNA, 15 nt, Homo sapiens
aaguaaacagucaga

SEQ ID NO: 1666888 - RNA, 16 nt, Homo sapiens
aaguaaaugagccuuu

SEQ ID NO: 1666889 - RNA, 17 nt, Homo sapiens
aaguaaccucuacaggc

SEQ ID NO: 1666890 - RNA, 21 nt, Homo sapiens
aaguacagggcagaaccaaga

SEQ ID NO: 1666891 - RNA, 15 nt, Homo sapiens
aaguacuacagcaaa

SEQ ID NO: 1666892 - RNA, 16 nt, Homo sapiens
aaguagcacacugagu

SEQ ID NO: 1666893 - RNA, 16 nt, Homo sapiens
aaguaggacuaucaca

SEQ ID NO: 1666894 - RNA, 19 nt, Homo sapiens
aaguaggugaucuuuguga

SEQ ID NO: 1666895 - RNA, 20 nt, Homo sapiens
aaguauaucuaucuauauau

SEQ ID NO: 1666896 - RNA, 15 nt, Homo sapiens
aaguauuccuuuccu

SEQ ID NO: 1666897 - RNA, 15 nt, Homo sapiens
aagucaaacuuucac

SEQ ID NO: 1666898 - RNA, 13 nt, Homo sapiens
aagucaugggaga

SEQ ID NO: 1666899 - RNA, 14 nt, Homo sapiens
aagucaugggagaa

SEQ ID NO: 1666900 - RNA, 13 nt, Homo sapiens
aaguccaguguga

SEQ ID NO: 1666901 - RNA, 19 nt, Homo sapiens
aaguccagugugacuuuau

SEQ ID NO: 1666902 - RNA, 21 nt, Homo sapiens
aaguccagugugacuuuaucu

SEQ ID NO: 1666903 - RNA, 23 nt, Homo sapiens
aagucccuaauaaaaacuugcug

SEQ ID NO: 1666904 - RNA, 23 nt, Homo sapiens
aaguccgaggccuggcucuggag

SEQ ID NO: 1666905 - RNA, 21 nt, Homo sapiens
aaguccuaauaaacuuagcua

SEQ ID NO: 1666906 - RNA, 20 nt, Homo sapiens
aagucuacacugccuuugug

SEQ ID NO: 1666907 - RNA, 12 nt, Homo sapiens
aagugaugugau

SEQ ID NO: 1666908 - RNA, 20 nt, Homo sapiens
aagugauuccuucuugcuca

SEQ ID NO: 1666909 - RNA, 22 nt, Homo sapiens
aagugcuaugacagagguguga

SEQ ID NO: 1666910 - RNA, 19 nt, Homo sapiens
aagugcucacgugcagcuc

SEQ ID NO: 1666911 - RNA, 17 nt, Homo sapiens
aagugcuucuccagccu

SEQ ID NO: 1666912 - RNA, 23 nt, Homo sapiens
aagugggggaguggccacagaaa

SEQ ID NO: 1666913 - RNA, 19 nt, Homo sapiens
aagugguaggaaagccuca

SEQ ID NO: 1666914 - RNA, 15 nt, Homo sapiens
aaguguacuggauuu

SEQ ID NO: 1666915 - RNA, 21 nt, Homo sapiens
aaguguuggccaucauuucau

SEQ ID NO: 1666916 - RNA, 16 nt, Homo sapiens
aaguguuuuuacauau

SEQ ID NO: 1666917 - RNA, 17 nt, Homo sapiens
aaguuacauuaugugua

SEQ ID NO: 1666918 - RNA, 16 nt, Homo sapiens
aaguucuuguugacuc

SEQ ID NO: 1666919 - RNA, 20 nt, Homo sapiens
aaguuggaagggaccccaga

SEQ ID NO: 1666920 - RNA, 19 nt, Homo sapiens
aaguuuauaucuugauuau

SEQ ID NO: 1666921 - RNA, 21 nt, Homo sapiens
aaguuuuauaaaagacaugaa

SEQ ID NO: 1666922 - RNA, 15 nt, Homo sapiens
aaguuuucugcugua

SEQ ID NO: 1666923 - RNA, 21 nt, Homo sapiens
aauaaaaauacgguggcaaua

SEQ ID NO: 1666924 - RNA, 15 nt, Homo sapiens
aauaaaauacauacu

SEQ ID NO: 1666925 - RNA, 14 nt, Homo sapiens
aauaaacucaguca

SEQ ID NO: 1666926 - RNA, 15 nt, Homo sapiens
aauaaagcaaugugg

SEQ ID NO: 1666927 - RNA, 12 nt, Homo sapiens
aauaaagccucu

SEQ ID NO: 1666928 - RNA, 14 nt, Homo sapiens
aauaaagucuuucc

SEQ ID NO: 1666929 - RNA, 17 nt, Homo sapiens
aauaaauaaaaauauuc

SEQ ID NO: 1666930 - RNA, 14 nt, Homo sapiens
aauaaauaaucuca

SEQ ID NO: 1666931 - RNA, 14 nt, Homo sapiens
aauaacuaugguaa

SEQ ID NO: 1666932 - RNA, 20 nt, Homo sapiens
aauaaggauuuauucucaga

SEQ ID NO: 1666933 - RNA, 19 nt, Homo sapiens
aauaaggccucauccucca

SEQ ID NO: 1666934 - RNA, 18 nt, Homo sapiens
aauaaguaaauacauuau

SEQ ID NO: 1666935 - RNA, 15 nt, Homo sapiens
aauaagucacugaca

SEQ ID NO: 1666936 - RNA, 17 nt, Homo sapiens
aauaauauaaaugaaug

SEQ ID NO: 1666937 - RNA, 19 nt, Homo sapiens
aauaaucuuuuaacagugu

SEQ ID NO: 1666938 - RNA, 16 nt, Homo sapiens
aauacaguacaguacu

SEQ ID NO: 1666939 - RNA, 18 nt, Homo sapiens
aacuauguuuagugugau

SEQ ID NO: 1666940 - RNA, 16 nt, Homo sapiens
aacuauuguuaauucu

SEQ ID NO: 1666941 - RNA, 22 nt, Homo sapiens
aacuauuugaaacacacaguga

SEQ ID NO: 1666942 - RNA, 11 nt, Homo sapiens
aacucagggag

SEQ ID NO: 1666943 - RNA, 16 nt, Homo sapiens
aacucgccaccugccc

SEQ ID NO: 1666944 - RNA, 13 nt, Homo sapiens
aacucgcucagaa

SEQ ID NO: 1666945 - RNA, 22 nt, Homo sapiens
aacucucagucagugucaugaa

SEQ ID NO: 1666946 - RNA, 14 nt, Homo sapiens
aacucugacaaggg

SEQ ID NO: 1666947 - RNA, 10 nt, Homo sapiens
aacugacaca

SEQ ID NO: 1666948 - RNA, 14 nt, Homo sapiens
aacugacacaggaa

SEQ ID NO: 1666949 - RNA, 22 nt, Homo sapiens
aacugagaccaagucucucuaa

SEQ ID NO: 1666950 - RNA, 13 nt, Homo sapiens
aacugagcacuuu

SEQ ID NO: 1666951 - RNA, 18 nt, Homo sapiens
aacugaguguuagugacu

SEQ ID NO: 1666952 - RNA, 15 nt, Homo sapiens
aacugcaacacugga

SEQ ID NO: 1666953 - RNA, 21 nt, Homo sapiens
aacugcuuuguuuuggcugcu

SEQ ID NO: 1666954 - RNA, 18 nt, Homo sapiens
aacuguaaaauacuucuu

SEQ ID NO: 1666955 - RNA, 12 nt, Homo sapiens
aacuguuggaua

SEQ ID NO: 1666956 - RNA, 15 nt, Homo sapiens
aacuuacauaugucu

SEQ ID NO: 1666957 - RNA, 15 nt, Homo sapiens
aacuucaugcugucu

SEQ ID NO: 1666958 - RNA, 19 nt, Homo sapiens
aacuuccagguuccaucca

SEQ ID NO: 1666959 - RNA, 22 nt, Homo sapiens
aacuucccagagaguaucugag

SEQ ID NO: 1666960 - RNA, 19 nt, Homo sapiens
aacuugcuccuuuccauca

SEQ ID NO: 1666961 - RNA, 16 nt, Homo sapiens
aacuuggugccuaaug

SEQ ID NO: 1666962 - RNA, 21 nt, Homo sapiens
aacuuggugccuaauguucca

SEQ ID NO: 1666963 - RNA, 17 nt, Homo sapiens
aacuuuaccaugcucaa

SEQ ID NO: 1666964 - RNA, 22 nt, Homo sapiens
aacuuucccuccaccagugugc

SEQ ID NO: 1666965 - RNA, 20 nt, Homo sapiens
aacuuuguucguuacuggcu

SEQ ID NO: 1666966 - RNA, 19 nt, Homo sapiens
aacuuuuccuggacacuuu

SEQ ID NO: 1666967 - RNA, 21 nt, Homo sapiens
aagaaaacuuguguucaaucu

SEQ ID NO: 1666968 - RNA, 17 nt, Homo sapiens
aagaaaggacagcucag

SEQ ID NO: 1666969 - RNA, 15 nt, Homo sapiens
aagaagaauauguau

SEQ ID NO: 1666970 - RNA, 13 nt, Homo sapiens
aagaaucauuugc

SEQ ID NO: 1666971 - RNA, 15 nt, Homo sapiens
aagaauucaguagca

SEQ ID NO: 1666972 - RNA, 17 nt, Homo sapiens
aagaauucaugaugcua

SEQ ID NO: 1666973 - RNA, 19 nt, Homo sapiens
aagaauugaaaaaccauuu

SEQ ID NO: 1666974 - RNA, 13 nt, Homo sapiens
aagacaaaugggc

SEQ ID NO: 1666975 - RNA, 20 nt, Homo sapiens
aagacaaaugggccugccaa

SEQ ID NO: 1666976 - RNA, 21 nt, Homo sapiens
aagacaaaugggccugccaaa

SEQ ID NO: 1666977 - RNA, 17 nt, Homo sapiens
aagacaacaggcauuuu

SEQ ID NO: 1666978 - RNA, 20 nt, Homo sapiens
aagacaauuuuaauguuuac

SEQ ID NO: 1666979 - RNA, 14 nt, Homo sapiens
aagacacagacaaa

SEQ ID NO: 1666980 - RNA, 14 nt, Homo sapiens
aagacagagcagau

SEQ ID NO: 1666981 - RNA, 17 nt, Homo sapiens
aagacagagcagaucag

SEQ ID NO: 1666982 - RNA, 18 nt, Homo sapiens
aagacagugcagugcuca

SEQ ID NO: 1666983 - RNA, 15 nt, Homo sapiens
aagaccccaucucaa

SEQ ID NO: 1666984 - RNA, 19 nt, Homo sapiens
aagaccuucugaagaucuc

SEQ ID NO: 1666985 - RNA, 15 nt, Homo sapiens
aagacucuaugcucu

SEQ ID NO: 1666986 - RNA, 13 nt, Homo sapiens
aagacuucauccc

SEQ ID NO: 1666987 - RNA, 21 nt, Homo sapiens
aagagaaaaagcccucuucaa

SEQ ID NO: 1666988 - RNA, 15 nt, Homo sapiens
aagagaaaugagcug

SEQ ID NO: 1666989 - RNA, 18 nt, Homo sapiens
aagagaccacccauauca

SEQ ID NO: 1666990 - RNA, 16 nt, Homo sapiens
aagaguaaaaccaaag

SEQ ID NO: 1666991 - RNA, 18 nt, Homo sapiens
aagaguaaaaccaaaggu

SEQ ID NO: 1666992 - RNA, 13 nt, Homo sapiens
aagaguccaagaa

SEQ ID NO: 1666993 - RNA, 19 nt, Homo sapiens
aagaguccaagaagccagc

SEQ ID NO: 1666994 - RNA, 17 nt, Homo sapiens
aagaguuagaacaguug

SEQ ID NO: 1666995 - RNA, 11 nt, Homo sapiens
aagaguucucc

SEQ ID NO: 1666996 - RNA, 23 nt, Homo sapiens
aagaguucuccuuguacuugaau

SEQ ID NO: 1666997 - RNA, 15 nt, Homo sapiens
aagauaaaacuaauu

SEQ ID NO: 1666998 - RNA, 13 nt, Homo sapiens
aagauaaauccaa

SEQ ID NO: 1666999 - RNA, 13 nt, Homo sapiens
aagauaauguugc

SEQ ID NO: 1667000 - RNA, 20 nt, Homo sapiens
aagaucaagcuccaucuuau

SEQ ID NO: 1667001 - RNA, 20 nt, Homo sapiens
cacaaaccacaacugacaca

SEQ ID NO: 1667002 - RNA, 15 nt, Homo sapiens
cacaaagcacuggcc

SEQ ID NO: 1667003 - RNA, 15 nt, Homo sapiens
cacaaagcuauuuaa

SEQ ID NO: 1667004 - RNA, 13 nt, Homo sapiens
cacaaauugugaa

SEQ ID NO: 1667005 - RNA, 17 nt, Homo sapiens
cacaaccuccuccucca

SEQ ID NO: 1667006 - RNA, 16 nt, Homo sapiens
cacaacggcagugaag

SEQ ID NO: 1667007 - RNA, 14 nt, Homo sapiens
cacaacuaacaaug

SEQ ID NO: 1667008 - RNA, 13 nt, Homo sapiens
cacaacugacaca

SEQ ID NO: 1667009 - RNA, 16 nt, Homo sapiens
cacaacugacacagga

SEQ ID NO: 1667010 - RNA, 21 nt, Homo sapiens
cacaacuugccaaaacagaua

SEQ ID NO: 1667011 - RNA, 19 nt, Homo sapiens
cacaagaggaauaagaaug

SEQ ID NO: 1667012 - RNA, 23 nt, Homo sapiens
cacaagaggaauaagaauggagc

SEQ ID NO: 1667013 - RNA, 15 nt, Homo sapiens
cacaaggggcuccac

SEQ ID NO: 1667014 - RNA, 19 nt, Homo sapiens
cacaauaaaagacauccac

SEQ ID NO: 1667015 - RNA, 19 nt, Homo sapiens
cacaauaagccacugguau

SEQ ID NO: 1667016 - RNA, 21 nt, Homo sapiens
cacaauuaacuccguuuccaa

SEQ ID NO: 1667017 - RNA, 12 nt, Homo sapiens
cacacaccacca

SEQ ID NO: 1667018 - RNA, 13 nt, Homo sapiens
cacacaccugccu

SEQ ID NO: 1667019 - RNA, 19 nt, Homo sapiens
cacacaccugccugcagag

SEQ ID NO: 1667020 - RNA, 20 nt, Homo sapiens
cacacaucaguaauguauuc

SEQ ID NO: 1667021 - RNA, 17 nt, Homo sapiens
cacaccauucgucauca

SEQ ID NO: 1667022 - RNA, 14 nt, Homo sapiens
cacacucggccacu

SEQ ID NO: 1667023 - RNA, 21 nt, Homo sapiens
cacacucucuucuuacuguau

SEQ ID NO: 1667024 - RNA, 13 nt, Homo sapiens
cacacugcuugug

SEQ ID NO: 1667025 - RNA, 19 nt, Homo sapiens
cacacuggaggagcacaca

SEQ ID NO: 1667026 - RNA, 18 nt, Homo sapiens
cacacuugggagcaaaag

SEQ ID NO: 1667027 - RNA, 19 nt, Homo sapiens
cacagauccccccacaaag

SEQ ID NO: 1667028 - RNA, 19 nt, Homo sapiens
cacagcugauugggcaccu

SEQ ID NO: 1667029 - RNA, 23 nt, Homo sapiens
cacagcugggguggggaccucag

SEQ ID NO: 1667030 - RNA, 23 nt, Homo sapiens
cacaggccaggacaaaaugcaga

SEQ ID NO: 1667031 - RNA, 18 nt, Homo sapiens
cacaggggaugguuucac

SEQ ID NO: 1667032 - RNA, 23 nt, Homo sapiens
cacagugcaguacucaguaauac

SEQ ID NO: 1667033 - RNA, 13 nt, Homo sapiens
cacagugggaacu

SEQ ID NO: 1667034 - RNA, 21 nt, Homo sapiens
cacauagauuaauggcacuga

SEQ ID NO: 1667035 - RNA, 22 nt, Homo sapiens
cacauagauuaauggcacugau

SEQ ID NO: 1667036 - RNA, 15 nt, Homo sapiens
cacauaguguuugua

SEQ ID NO: 1667037 - RNA, 21 nt, Homo sapiens
cacauauacauuauuucugua

SEQ ID NO: 1667038 - RNA, 18 nt, Homo sapiens
cacauccgacaccuccca

SEQ ID NO: 1667039 - RNA, 18 nt, Homo sapiens
cacauguugcuaaugaca

SEQ ID NO: 1667040 - RNA, 20 nt, Homo sapiens
cacauuucccccuagccugc

SEQ ID NO: 1667041 - RNA, 15 nt, Homo sapiens
caccaaccacugcga

SEQ ID NO: 1667042 - RNA, 13 nt, Homo sapiens
caccaagccucug

SEQ ID NO: 1667043 - RNA, 18 nt, Homo sapiens
caccaagcugcucuccuu

SEQ ID NO: 1667044 - RNA, 17 nt, Homo sapiens
caccaauaucaguccuc

SEQ ID NO: 1667045 - RNA, 13 nt, Homo sapiens
caccaccacugug

SEQ ID NO: 1667046 - RNA, 19 nt, Homo sapiens
caccacugugucccagugu

SEQ ID NO: 1667047 - RNA, 15 nt, Homo sapiens
caccagcaacauuau

SEQ ID NO: 1667048 - RNA, 15 nt, Homo sapiens
caccagggacugcag

SEQ ID NO: 1667049 - RNA, 14 nt, Homo sapiens
caccauguugccaa

SEQ ID NO: 1667050 - RNA, 18 nt, Homo sapiens
caccauucgucaucacuc

SEQ ID NO: 1667051 - RNA, 20 nt, Homo sapiens
cacccaaguuggagugcagu

SEQ ID NO: 1667052 - RNA, 12 nt, Homo sapiens
cacccaccacuc

SEQ ID NO: 1667053 - RNA, 16 nt, Homo sapiens
caccgagaggaaaaag

SEQ ID NO: 1667054 - RNA, 20 nt, Homo sapiens
caccgccgugggguguauug

SEQ ID NO: 1667055 - RNA, 21 nt, Homo sapiens
caccuagagcuagaugugucu

SEQ ID NO: 1667056 - RNA, 15 nt, Homo sapiens
caccuaucuggaaaa

SEQ ID NO: 1667057 - RNA, 15 nt, Homo sapiens
caccucccugcagcu

SEQ ID NO: 1667058 - RNA, 15 nt, Homo sapiens
caccuggggaucccc

SEQ ID NO: 1667059 - RNA, 17 nt, Homo sapiens
caccugucaaccugaau

SEQ ID NO: 1667060 - RNA, 17 nt, Homo sapiens
caccuuguacagaacca

SEQ ID NO: 1667061 - RNA, 17 nt, Homo sapiens
caccuuuuuucacccca

SEQ ID NO: 1667062 - RNA, 16 nt, Homo sapiens
cacgauuccagugcag

SEQ ID NO: 1667063 - RNA, 15 nt, Homo sapiens
cacgcaaauacaugc

SEQ ID NO: 1667064 - RNA, 16 nt, Homo sapiens
cacgccacaacuccag

SEQ ID NO: 1667065 - RNA, 18 nt, Homo sapiens
cacgccacaacuccagug

SEQ ID NO: 1667066 - RNA, 23 nt, Homo sapiens
cacgccacaacuccaguguuccc

SEQ ID NO: 1667067 - RNA, 15 nt, Homo sapiens
cacgccuccauccac

SEQ ID NO: 1667068 - RNA, 19 nt, Homo sapiens
cacgccugguucuguacau

SEQ ID NO: 1667069 - RNA, 12 nt, Homo sapiens
cacgcuuucaug

SEQ ID NO: 1667070 - RNA, 17 nt, Homo sapiens
cacggcguuuuuuuaca

SEQ ID NO: 1667071 - RNA, 19 nt, Homo sapiens
cacggcugauaucuuugag

SEQ ID NO: 1667072 - RNA, 19 nt, Homo sapiens
cacguaaggucucauuuga

SEQ ID NO: 1667073 - RNA, 19 nt, Homo sapiens
cacgucccgggcacuguca

SEQ ID NO: 1667074 - RNA, 21 nt, Homo sapiens
cacguccugggugcugucaug

SEQ ID NO: 1667075 - RNA, 18 nt, Homo sapiens
cacgugagccacagggcu

SEQ ID NO: 1667076 - RNA, 19 nt, Homo sapiens
cacuaaugaggaaacugca

SEQ ID NO: 1667077 - RNA, 14 nt, Homo sapiens
cacuagaagcacag

SEQ ID NO: 1667078 - RNA, 16 nt, Homo sapiens
cacucccuaaguccac

SEQ ID NO: 1667079 - RNA, 13 nt, Homo sapiens
cacucugccaggg

SEQ ID NO: 1667080 - RNA, 18 nt, Homo sapiens
cacugaaaauaccaucag

SEQ ID NO: 1667081 - RNA, 21 nt, Homo sapiens
cacugaccuuggagagacaca

SEQ ID NO: 1667082 - RNA, 16 nt, Homo sapiens
cacugaguagucauuu

SEQ ID NO: 1667083 - RNA, 21 nt, Homo sapiens
cacugcaccucuuugucacag

SEQ ID NO: 1667084 - RNA, 24 nt, Homo sapiens
cacugccccugcaccugcuucuca

SEQ ID NO: 1667085 - RNA, 22 nt, Homo sapiens
cacuggaaacaacagacucuua

SEQ ID NO: 1667086 - RNA, 16 nt, Homo sapiens
cacuggagccugcaau

SEQ ID NO: 1667087 - RNA, 18 nt, Homo sapiens
cacuggaggggucuccuc

SEQ ID NO: 1667088 - RNA, 17 nt, Homo sapiens
cacuggccuugccucca

SEQ ID NO: 1667089 - RNA, 22 nt, Homo sapiens
cacuguagucagaccucagcaa

SEQ ID NO: 1667090 - RNA, 19 nt, Homo sapiens
cacugucaagauuaaguua

SEQ ID NO: 1667091 - RNA, 16 nt, Homo sapiens
cacugugucucauggu

SEQ ID NO: 1667092 - RNA, 15 nt, Homo sapiens
cacuguuugccccag

SEQ ID NO: 1667093 - RNA, 13 nt, Homo sapiens
cacuucaagcaaa

SEQ ID NO: 1667094 - RNA, 22 nt, Homo sapiens
cacuucccugcaaggugcaccu

SEQ ID NO: 1667095 - RNA, 22 nt, Homo sapiens
cacuuccuuaacagcuguauua

SEQ ID NO: 1667096 - RNA, 16 nt, Homo sapiens
cacuucuuuccucaaa

SEQ ID NO: 1667097 - RNA, 18 nt, Homo sapiens
cacuucuuuccucaaaga

SEQ ID NO: 1667098 - RNA, 22 nt, Homo sapiens
cacuugggauugucuuacuguu

SEQ ID NO: 1667099 - RNA, 18 nt, Homo sapiens
cacuuucccacacuguga

SEQ ID NO: 1667100 - RNA, 20 nt, Homo sapiens
cacuuucccacacugugaac

SEQ ID NO: 1667101 - RNA, 16 nt, Homo sapiens
cacuuucugaaauuca

SEQ ID NO: 1667102 - RNA, 16 nt, Homo sapiens
cacuuuucauaucauu

SEQ ID NO: 1667103 - RNA, 17 nt, Homo sapiens
cacuuuuuuccugucaa

SEQ ID NO: 1667104 - RNA, 21 nt, Homo sapiens
cacuuuuuuccugucaauaua

SEQ ID NO: 1667105 - RNA, 16 nt, Homo sapiens
cacuuuuuuucuauau

SEQ ID NO: 1667106 - RNA, 20 nt, Homo sapiens
cagaaaaccuaccacauuca

SEQ ID NO: 1667107 - RNA, 22 nt, Homo sapiens
cagaaaaccuaccacauucacu

SEQ ID NO: 1667108 - RNA, 18 nt, Homo sapiens
cagaaacacggaguuucc

SEQ ID NO: 1667109 - RNA, 20 nt, Homo sapiens
cagaaacacggaguuuccau

SEQ ID NO: 1667110 - RNA, 20 nt, Homo sapiens
cagaaacccuuuuacaguca

SEQ ID NO: 1667111 - RNA, 14 nt, Homo sapiens
cagaaccuuuguca

SEQ ID NO: 1667112 - RNA, 16 nt, Homo sapiens
cagaacgcaugcaggg

SEQ ID NO: 1667113 - RNA, 14 nt, Homo sapiens
cagaacugucuuag

SEQ ID NO: 1667114 - RNA, 18 nt, Homo sapiens
cagaagauuauuuacuga

SEQ ID NO: 1667115 - RNA, 17 nt, Homo sapiens
cagaaggaagacuucau

SEQ ID NO: 1667116 - RNA, 20 nt, Homo sapiens
cagaaggaagacuucauccc

SEQ ID NO: 1667117 - RNA, 19 nt, Homo sapiens
cagaauauuaagcacauua

SEQ ID NO: 1667118 - RNA, 17 nt, Homo sapiens
cagaauggggacaucuu

SEQ ID NO: 1667119 - RNA, 17 nt, Homo sapiens
cagacaauaaaauggaa

SEQ ID NO: 1667120 - RNA, 20 nt, Homo sapiens
cagacaggauguucaacuua

SEQ ID NO: 1667121 - RNA, 16 nt, Homo sapiens
cagaccucggcugugu

SEQ ID NO: 1667122 - RNA, 19 nt, Homo sapiens
cagacucaaggccuccagc

SEQ ID NO: 1667123 - RNA, 13 nt, Homo sapiens
aucuggugcgugu

SEQ ID NO: 1667124 - RNA, 20 nt, Homo sapiens
aucuguaaaauagucucauu

SEQ ID NO: 1667125 - RNA, 18 nt, Homo sapiens
aucuguacaugacuguau

SEQ ID NO: 1667126 - RNA, 16 nt, Homo sapiens
aucuguauaucagcuc

SEQ ID NO: 1667127 - RNA, 17 nt, Homo sapiens
aucugucuuuaugauuu

SEQ ID NO: 1667128 - RNA, 14 nt, Homo sapiens
aucugugcagucau

SEQ ID NO: 1667129 - RNA, 19 nt, Homo sapiens
aucuguuugauacaguauu

SEQ ID NO: 1667130 - RNA, 20 nt, Homo sapiens
aucuguuugauacaguauua

SEQ ID NO: 1667131 - RNA, 15 nt, Homo sapiens
aucuuaggauuuacc

SEQ ID NO: 1667132 - RNA, 15 nt, Homo sapiens
aucuucccacagugg

SEQ ID NO: 1667133 - RNA, 21 nt, Homo sapiens
aucuugaauuguaaggaauga

SEQ ID NO: 1667134 - RNA, 11 nt, Homo sapiens
aucuugccuca

SEQ ID NO: 1667135 - RNA, 15 nt, Homo sapiens
aucuuuucauuuagg

SEQ ID NO: 1667136 - RNA, 22 nt, Homo sapiens
aucuuuuggggucaucuuugau

SEQ ID NO: 1667137 - RNA, 23 nt, Homo sapiens
augaaaaauaguguguccaugca

SEQ ID NO: 1667138 - RNA, 16 nt, Homo sapiens
augaaauacuugacaa

SEQ ID NO: 1667139 - RNA, 14 nt, Homo sapiens
augaaaucugggca

SEQ ID NO: 1667140 - RNA, 20 nt, Homo sapiens
augaacuaacugccauguag

SEQ ID NO: 1667141 - RNA, 15 nt, Homo sapiens
augaacuauuguuaa

SEQ ID NO: 1667142 - RNA, 14 nt, Homo sapiens
augaagacaaauag

SEQ ID NO: 1667143 - RNA, 13 nt, Homo sapiens
augaaggggccag

SEQ ID NO: 1667144 - RNA, 19 nt, Homo sapiens
augaaggucuaccugaaaa

SEQ ID NO: 1667145 - RNA, 21 nt, Homo sapiens
augaauaaauauuacaaauuc

SEQ ID NO: 1667146 - RNA, 20 nt, Homo sapiens
augaaucgcagacgcaagag

SEQ ID NO: 1667147 - RNA, 14 nt, Homo sapiens
augacaaguggggu

SEQ ID NO: 1667148 - RNA, 11 nt, Homo sapiens
augacacugac

SEQ ID NO: 1667149 - RNA, 15 nt, Homo sapiens
augacaggauaugag

SEQ ID NO: 1667150 - RNA, 15 nt, Homo sapiens
augacaucaacauuc

SEQ ID NO: 1667151 - RNA, 16 nt, Homo sapiens
augacaucaacauucc

SEQ ID NO: 1667152 - RNA, 15 nt, Homo sapiens
augaccauaugcaca

SEQ ID NO: 1667153 - RNA, 23 nt, Homo sapiens
augacuucuuuacuaacacuggc

SEQ ID NO: 1667154 - RNA, 23 nt, Homo sapiens
augagaaaacaggcucacagaga

SEQ ID NO: 1667155 - RNA, 14 nt, Homo sapiens
augagaacuaaaua

SEQ ID NO: 1667156 - RNA, 12 nt, Homo sapiens
augagaccuccc

SEQ ID NO: 1667157 - RNA, 14 nt, Homo sapiens
augagauuggaaaa

SEQ ID NO: 1667158 - RNA, 17 nt, Homo sapiens
augagcguccaggugau

SEQ ID NO: 1667159 - RNA, 11 nt, Homo sapiens
augagcucaaa

SEQ ID NO: 1667160 - RNA, 20 nt, Homo sapiens
augagcugcacuccaugagu

SEQ ID NO: 1667161 - RNA, 12 nt, Homo sapiens
augagcuuaaug

SEQ ID NO: 1667162 - RNA, 16 nt, Homo sapiens
augaggaaacugcacu

SEQ ID NO: 1667163 - RNA, 16 nt, Homo sapiens
augagguugagcuaug

SEQ ID NO: 1667164 - RNA, 18 nt, Homo sapiens
augauacuugguccuuaa

SEQ ID NO: 1667165 - RNA, 15 nt, Homo sapiens
augaucaaaaugcau

SEQ ID NO: 1667166 - RNA, 22 nt, Homo sapiens
augaucgcuuucuacacuguau

SEQ ID NO: 1667167 - RNA, 20 nt, Homo sapiens
augaugcagcagauguugac

SEQ ID NO: 1667168 - RNA, 19 nt, Homo sapiens
augauucuccucucccaaa

SEQ ID NO: 1667169 - RNA, 20 nt, Homo sapiens
augauuguuugaaagucugu

SEQ ID NO: 1667170 - RNA, 15 nt, Homo sapiens
augauuuaggcuucu

SEQ ID NO: 1667171 - RNA, 13 nt, Homo sapiens
augauuucagaaa

SEQ ID NO: 1667172 - RNA, 19 nt, Homo sapiens
augauuuggggugauuucu

SEQ ID NO: 1667173 - RNA, 23 nt, Homo sapiens
augauuuggggugauuucucacc

SEQ ID NO: 1667174 - RNA, 19 nt, Homo sapiens
augcacagcuaacauggaa

SEQ ID NO: 1667175 - RNA, 19 nt, Homo sapiens
augcacuugaaaugauggu

SEQ ID NO: 1667176 - RNA, 19 nt, Homo sapiens
augcagggcccccacagga

SEQ ID NO: 1667177 - RNA, 22 nt, Homo sapiens
augcaugagcucccucgcugua

SEQ ID NO: 1667178 - RNA, 15 nt, Homo sapiens
augcauuuagcauga

SEQ ID NO: 1667179 - RNA, 11 nt, Homo sapiens
augcauuuuaa

SEQ ID NO: 1667180 - RNA, 12 nt, Homo sapiens
augccaccaccc

SEQ ID NO: 1667181 - RNA, 14 nt, Homo sapiens
augccacuggaaac

SEQ ID NO: 1667182 - RNA, 21 nt, Homo sapiens
augccaugggcccucucagca

SEQ ID NO: 1667183 - RNA, 13 nt, Homo sapiens
augccuguugauc

SEQ ID NO: 1667184 - RNA, 20 nt, Homo sapiens
auucugaaggccuuguuaaa

SEQ ID NO: 1667185 - RNA, 18 nt, Homo sapiens
auucuguuccaccacugu

SEQ ID NO: 1667186 - RNA, 14 nt, Homo sapiens
auucuuacuagugu

SEQ ID NO: 1667187 - RNA, 19 nt, Homo sapiens
auucuuauuuggacagcca

SEQ ID NO: 1667188 - RNA, 21 nt, Homo sapiens
auucuucuccacuuucuagcc

SEQ ID NO: 1667189 - RNA, 22 nt, Homo sapiens
auucuuucaauccacaguauug

SEQ ID NO: 1667190 - RNA, 17 nt, Homo sapiens
auugaaggauugugaac

SEQ ID NO: 1667191 - RNA, 21 nt, Homo sapiens
auugaauuauugggcuuaaua

SEQ ID NO: 1667192 - RNA, 15 nt, Homo sapiens
auugaccuuuaggua

SEQ ID NO: 1667193 - RNA, 21 nt, Homo sapiens
auugacuuuuuuugagcgaca

SEQ ID NO: 1667194 - RNA, 15 nt, Homo sapiens
auugagacacuguca

SEQ ID NO: 1667195 - RNA, 19 nt, Homo sapiens
auugagcagaauucauuca

SEQ ID NO: 1667196 - RNA, 16 nt, Homo sapiens
auugaggaugaacuca

SEQ ID NO: 1667197 - RNA, 18 nt, Homo sapiens
auugauagucaauaucaa

SEQ ID NO: 1667198 - RNA, 19 nt, Homo sapiens
auugauuaaguauaucuau

SEQ ID NO: 1667199 - RNA, 20 nt, Homo sapiens
auugauuuuuaaacagcagg

SEQ ID NO: 1667200 - RNA, 17 nt, Homo sapiens
auugcccuuuaacaaga

SEQ ID NO: 1667201 - RNA, 16 nt, Homo sapiens
auuggacagacacaga

SEQ ID NO: 1667202 - RNA, 23 nt, Homo sapiens
auuguauaaaacaguguuuccag

SEQ ID NO: 1667203 - RNA, 13 nt, Homo sapiens
auugucaccauga

SEQ ID NO: 1667204 - RNA, 14 nt, Homo sapiens
auugucaccaugau

SEQ ID NO: 1667205 - RNA, 18 nt, Homo sapiens
auugucuuacuguugcau

SEQ ID NO: 1667206 - RNA, 16 nt, Homo sapiens
auugugaagauuucau

SEQ ID NO: 1667207 - RNA, 20 nt, Homo sapiens
auugugaagauuucauggac

SEQ ID NO: 1667208 - RNA, 13 nt, Homo sapiens
auugugguugguu

SEQ ID NO: 1667209 - RNA, 23 nt, Homo sapiens
auugugguuuauugaaugugauu

SEQ ID NO: 1667210 - RNA, 16 nt, Homo sapiens
auuguguauagcauua

SEQ ID NO: 1667211 - RNA, 13 nt, Homo sapiens
auuguuuuuggau

SEQ ID NO: 1667212 - RNA, 14 nt, Homo sapiens
auuuaaacuucuua

SEQ ID NO: 1667213 - RNA, 22 nt, Homo sapiens
auuuaaagucuugaauguugaa

SEQ ID NO: 1667214 - RNA, 15 nt, Homo sapiens
auuuacaaaccucuc

SEQ ID NO: 1667215 - RNA, 18 nt, Homo sapiens
auuuacaacuuccagauu

SEQ ID NO: 1667216 - RNA, 16 nt, Homo sapiens
auuuacuaacaguaac

SEQ ID NO: 1667217 - RNA, 21 nt, Homo sapiens
auuuagauuuuucucaucucc

SEQ ID NO: 1667218 - RNA, 19 nt, Homo sapiens
auuuaguaaaauuaucugu

SEQ ID NO: 1667219 - RNA, 18 nt, Homo sapiens
auuuauuuacaugugauu

SEQ ID NO: 1667220 - RNA, 17 nt, Homo sapiens
auuucacagaguacaaa

SEQ ID NO: 1667221 - RNA, 17 nt, Homo sapiens
auuucaucaagauuaau

SEQ ID NO: 1667222 - RNA, 18 nt, Homo sapiens
auuucaugaauacauugu

SEQ ID NO: 1667223 - RNA, 18 nt, Homo sapiens
auuuccaaaccuccacug

SEQ ID NO: 1667224 - RNA, 23 nt, Homo sapiens
auuuccaggggccucccaaggaa

SEQ ID NO: 1667225 - RNA, 13 nt, Homo sapiens
auuuccugugagg

SEQ ID NO: 1667226 - RNA, 16 nt, Homo sapiens
auuucuaaaacauuaa

SEQ ID NO: 1667227 - RNA, 14 nt, Homo sapiens
auuucucacccucu

SEQ ID NO: 1667228 - RNA, 20 nt, Homo sapiens
auuugaaauaacagccuuaa

SEQ ID NO: 1667229 - RNA, 24 nt, Homo sapiens
auuugaagaauuaaugacaacaaa

SEQ ID NO: 1667230 - RNA, 16 nt, Homo sapiens
auuugcugaauaacaa

SEQ ID NO: 1667231 - RNA, 15 nt, Homo sapiens
auuugcugcauuuca

SEQ ID NO: 1667232 - RNA, 17 nt, Homo sapiens
auuugggcugaauguau

SEQ ID NO: 1667233 - RNA, 23 nt, Homo sapiens
auuugucacaaauaaacauaaua

SEQ ID NO: 1667234 - RNA, 16 nt, Homo sapiens
auuuguccucauguga

SEQ ID NO: 1667235 - RNA, 12 nt, Homo sapiens
auuuuaaaacaa

SEQ ID NO: 1667236 - RNA, 23 nt, Homo sapiens
auuuuauaguguguugugcuuuc

SEQ ID NO: 1667237 - RNA, 16 nt, Homo sapiens
auuuuauuucucucag

SEQ ID NO: 1667238 - RNA, 23 nt, Homo sapiens
auuuucaaaggcuuccaaugugg

SEQ ID NO: 1667239 - RNA, 13 nt, Homo sapiens
auuuucacuggag

SEQ ID NO: 1667240 - RNA, 14 nt, Homo sapiens
auuuucuacuuuaa

SEQ ID NO: 1667241 - RNA, 22 nt, Homo sapiens
auuuucucuccucgguggcauu

SEQ ID NO: 1667242 - RNA, 12 nt, Homo sapiens
auuuugauucag

SEQ ID NO: 1667243 - RNA, 15 nt, Homo sapiens
auuuugauuccuuga

SEQ ID NO: 1667244 - RNA, 18 nt, Homo sapiens
auuuugcuuuaauauuca

SEQ ID NO: 1667245 - RNA, 16 nt, Homo sapiens
auuuuggacgugugag

SEQ ID NO: 1667246 - RNA, 13 nt, Homo sapiens
auuuuguacaaug

SEQ ID NO: 1667247 - RNA, 23 nt, Homo sapiens
aaugcuauggacugcacaaaagu

SEQ ID NO: 1667248 - RNA, 23 nt, Homo sapiens
aaugcucaguaacacagugcagu

SEQ ID NO: 1667249 - RNA, 17 nt, Homo sapiens
aaugcugcgcuuaccuu

SEQ ID NO: 1667250 - RNA, 19 nt, Homo sapiens
aaugcuggggccuggaaua

SEQ ID NO: 1667251 - RNA, 16 nt, Homo sapiens
aauggaaagguccugc

SEQ ID NO: 1667252 - RNA, 13 nt, Homo sapiens
aauggacuugcuu

SEQ ID NO: 1667253 - RNA, 15 nt, Homo sapiens
aauggagguacagga

SEQ ID NO: 1667254 - RNA, 15 nt, Homo sapiens
aauggaugacaaaga

SEQ ID NO: 1667255 - RNA, 15 nt, Homo sapiens
aaugggagacggggg

SEQ ID NO: 1667256 - RNA, 16 nt, Homo sapiens
aauguacaauaaagca

SEQ ID NO: 1667257 - RNA, 17 nt, Homo sapiens
aauguacuacauuugca

SEQ ID NO: 1667258 - RNA, 17 nt, Homo sapiens
aauguaucaacauauuu

SEQ ID NO: 1667259 - RNA, 18 nt, Homo sapiens
aauguaucuacauaccua

SEQ ID NO: 1667260 - RNA, 19 nt, Homo sapiens
aaugucagcacauguugcu

SEQ ID NO: 1667261 - RNA, 12 nt, Homo sapiens
aaugucauuugc

SEQ ID NO: 1667262 - RNA, 13 nt, Homo sapiens
aaugucucaaaau

SEQ ID NO: 1667263 - RNA, 12 nt, Homo sapiens
aaugugccaaaa

SEQ ID NO: 1667264 - RNA, 18 nt, Homo sapiens
aaugugggaagaaacaaa

SEQ ID NO: 1667265 - RNA, 20 nt, Homo sapiens
aauguguuauuugucacaaa

SEQ ID NO: 1667266 - RNA, 21 nt, Homo sapiens
aauguuccaugucugaaguuu

SEQ ID NO: 1667267 - RNA, 13 nt, Homo sapiens
aauguugcaugac

SEQ ID NO: 1667268 - RNA, 21 nt, Homo sapiens
aauuaaaaaguuaaucuucau

SEQ ID NO: 1667269 - RNA, 14 nt, Homo sapiens
aauuaaacaauuua

SEQ ID NO: 1667270 - RNA, 16 nt, Homo sapiens
aauuaaagucuacacu

SEQ ID NO: 1667271 - RNA, 22 nt, Homo sapiens
aauuaacuccguuuccaaauac

SEQ ID NO: 1667272 - RNA, 18 nt, Homo sapiens
aauuaaguccuacuuuac

SEQ ID NO: 1667273 - RNA, 14 nt, Homo sapiens
aauuacuacuuugu

SEQ ID NO: 1667274 - RNA, 23 nt, Homo sapiens
aauuacuuacucaaauucaauga

SEQ ID NO: 1667275 - RNA, 17 nt, Homo sapiens
aauuagaagaaaaugga

SEQ ID NO: 1667276 - RNA, 17 nt, Homo sapiens
aauuagccaaccaggcu

SEQ ID NO: 1667277 - RNA, 16 nt, Homo sapiens
aauuaggguauaugaa

SEQ ID NO: 1667278 - RNA, 14 nt, Homo sapiens
aauuauaaucucuu

SEQ ID NO: 1667279 - RNA, 16 nt, Homo sapiens
aauuaugucaaaugga

SEQ ID NO: 1667280 - RNA, 21 nt, Homo sapiens
aauucaaagaaucaccuaauu

SEQ ID NO: 1667281 - RNA, 22 nt, Homo sapiens
aauucaaugaaucaaauccaau

SEQ ID NO: 1667282 - RNA, 10 nt, Homo sapiens
aauucaccuu

SEQ ID NO: 1667283 - RNA, 23 nt, Homo sapiens
aauucaucuuucuaacucaagga

SEQ ID NO: 1667284 - RNA, 21 nt, Homo sapiens
aauucaugaugcuaguucuua

SEQ ID NO: 1667285 - RNA, 13 nt, Homo sapiens
aauuccaauacau

SEQ ID NO: 1667286 - RNA, 16 nt, Homo sapiens
aauuccaauacauuau

SEQ ID NO: 1667287 - RNA, 10 nt, Homo sapiens
aauucccaau

SEQ ID NO: 1667288 - RNA, 22 nt, Homo sapiens
aauuccucuagcuaccauuuca

SEQ ID NO: 1667289 - RNA, 22 nt, Homo sapiens
aauucuguuuauguucuugcag

SEQ ID NO: 1667290 - RNA, 14 nt, Homo sapiens
aauugaaaaaccau

SEQ ID NO: 1667291 - RNA, 19 nt, Homo sapiens
aauugaaccgucaauguga

SEQ ID NO: 1667292 - RNA, 16 nt, Homo sapiens
aauugaguuaaaucag

SEQ ID NO: 1667293 - RNA, 19 nt, Homo sapiens
aauugauauugaaugaugu

SEQ ID NO: 1667294 - RNA, 22 nt, Homo sapiens
aauugauuuuuaaacagcaggu

SEQ ID NO: 1667295 - RNA, 17 nt, Homo sapiens
aauugccaauaaugugu

SEQ ID NO: 1667296 - RNA, 20 nt, Homo sapiens
aauuggcugccaagagucca

SEQ ID NO: 1667297 - RNA, 17 nt, Homo sapiens
aauugucaugacuuuca

SEQ ID NO: 1667298 - RNA, 16 nt, Homo sapiens
aauugucuuuugucau

SEQ ID NO: 1667299 - RNA, 19 nt, Homo sapiens
aauugugagaauuacuguu

SEQ ID NO: 1667300 - RNA, 22 nt, Homo sapiens
aauugugguuuauugaauguga

SEQ ID NO: 1667301 - RNA, 19 nt, Homo sapiens
aauuguuuaagaaucaugg

SEQ ID NO: 1667302 - RNA, 17 nt, Homo sapiens
aauuuaaggccugcacu

SEQ ID NO: 1667303 - RNA, 20 nt, Homo sapiens
aauuuaaggccugcacucuu

SEQ ID NO: 1667304 - RNA, 22 nt, Homo sapiens
aauuuaggaaugcucaaugugc

SEQ ID NO: 1667305 - RNA, 19 nt, Homo sapiens
aauuuaugaagauaguuua

SEQ ID NO: 1667306 - RNA, 21 nt, Homo sapiens
aauuuauuuccaauguuucaa

SEQ ID NO: 1667307 - RNA, 18 nt, Homo sapiens
aauuucacagaguacaaa

SEQ ID NO: 1667308 - RNA, 23 nt, Homo sapiens
aauuucagugaaaugguguauag

SEQ ID NO: 1667309 - RNA, 15 nt, Homo sapiens
aacaguuugaaaaga

SEQ ID NO: 1667310 - RNA, 19 nt, Homo sapiens
aacaucaauuggguuuuga

SEQ ID NO: 1667311 - RNA, 15 nt, Homo sapiens
aacaucccugagaaa

SEQ ID NO: 1667312 - RNA, 15 nt, Homo sapiens
aacaugacacugacc

SEQ ID NO: 1667313 - RNA, 14 nt, Homo sapiens
aacaugcacauuca

SEQ ID NO: 1667314 - RNA, 14 nt, Homo sapiens
aacauggaaguacu

SEQ ID NO: 1667315 - RNA, 22 nt, Homo sapiens
aacauggacuacacacaauaca

SEQ ID NO: 1667316 - RNA, 22 nt, Homo sapiens
aacaugugcucgcucugcauga

SEQ ID NO: 1667317 - RNA, 16 nt, Homo sapiens
aaccaacgggucugug

SEQ ID NO: 1667318 - RNA, 16 nt, Homo sapiens
aaccaauugugagaau

SEQ ID NO: 1667319 - RNA, 15 nt, Homo sapiens
aaccacaacugacac

SEQ ID NO: 1667320 - RNA, 18 nt, Homo sapiens
aaccacugcgaccacaag

SEQ ID NO: 1667321 - RNA, 17 nt, Homo sapiens
aaccagaaaucuaaucu

SEQ ID NO: 1667322 - RNA, 19 nt, Homo sapiens
aaccagacccuguaugaca

SEQ ID NO: 1667323 - RNA, 16 nt, Homo sapiens
aaccaggcuacaguug

SEQ ID NO: 1667324 - RNA, 13 nt, Homo sapiens
aaccagucugaag

SEQ ID NO: 1667325 - RNA, 18 nt, Homo sapiens
aaccauagcuaaguagca

SEQ ID NO: 1667326 - RNA, 18 nt, Homo sapiens
aaccauccgcaaccugag

SEQ ID NO: 1667327 - RNA, 12 nt, Homo sapiens
aaccauucugcu

SEQ ID NO: 1667328 - RNA, 23 nt, Homo sapiens
aaccauucugcuugguuccacaa

SEQ ID NO: 1667329 - RNA, 12 nt, Homo sapiens
aacccaaacuuc

SEQ ID NO: 1667330 - RNA, 19 nt, Homo sapiens
aacccuacgaaagcacagu

SEQ ID NO: 1667331 - RNA, 15 nt, Homo sapiens
aacccucacccagag

SEQ ID NO: 1667332 - RNA, 20 nt, Homo sapiens
aacccugugaucuauaccac

SEQ ID NO: 1667333 - RNA, 23 nt, Homo sapiens
aacccuuuuacagucacauucag

SEQ ID NO: 1667334 - RNA, 14 nt, Homo sapiens
aaccuaccacauuc

SEQ ID NO: 1667335 - RNA, 16 nt, Homo sapiens
aaccucaaacugggua

SEQ ID NO: 1667336 - RNA, 15 nt, Homo sapiens
aaccuccacugcugc

SEQ ID NO: 1667337 - RNA, 19 nt, Homo sapiens
aaccuccccugguccugca

SEQ ID NO: 1667338 - RNA, 14 nt, Homo sapiens
aaccucugccuccc

SEQ ID NO: 1667339 - RNA, 14 nt, Homo sapiens
aaccugaaagggca

SEQ ID NO: 1667340 - RNA, 15 nt, Homo sapiens
aaccugauuacaagu

SEQ ID NO: 1667341 - RNA, 15 nt, Homo sapiens
aaccugccacaaugu

SEQ ID NO: 1667342 - RNA, 23 nt, Homo sapiens
aaccuguucacgugacuccucaa

SEQ ID NO: 1667343 - RNA, 17 nt, Homo sapiens
aaccuguuccauuccau

SEQ ID NO: 1667344 - RNA, 17 nt, Homo sapiens
aaccuucuaauccaugu

SEQ ID NO: 1667345 - RNA, 18 nt, Homo sapiens
aaccuucuuuucaaugca

SEQ ID NO: 1667346 - RNA, 21 nt, Homo sapiens
aaccuugaccaaccccagcaa

SEQ ID NO: 1667347 - RNA, 18 nt, Homo sapiens
aaccuugugagcaaggug

SEQ ID NO: 1667348 - RNA, 17 nt, Homo sapiens
aacgaaaaccacaaaaa

SEQ ID NO: 1667349 - RNA, 17 nt, Homo sapiens
aacgcacaacaugcaca

SEQ ID NO: 1667350 - RNA, 14 nt, Homo sapiens
aacguggauuguga

SEQ ID NO: 1667351 - RNA, 14 nt, Homo sapiens
aacuaacaaugccu

SEQ ID NO: 1667352 - RNA, 13 nt, Homo sapiens
aacuaacaauuca

SEQ ID NO: 1667353 - RNA, 17 nt, Homo sapiens
aacuagaguauguguau

SEQ ID NO: 1667354 - RNA, 14 nt, Homo sapiens
aacuaugguaaaua

SEQ ID NO: 1667355 - RNA, 13 nt, Homo sapiens
aacuccaggguua

SEQ ID NO: 1667356 - RNA, 12 nt, Homo sapiens
aacuccuuacag

SEQ ID NO: 1667357 - RNA, 19 nt, Homo sapiens
aacucugaccaacagugag

SEQ ID NO: 1667358 - RNA, 14 nt, Homo sapiens
aacucugcaccuaa

SEQ ID NO: 1667359 - RNA, 23 nt, Homo sapiens
aacucugcauagacaaaggccuu

SEQ ID NO: 1667360 - RNA, 21 nt, Homo sapiens
aacucuguacgaggcuucucu

SEQ ID NO: 1667361 - RNA, 16 nt, Homo sapiens
aacugaaaagcaguuu

SEQ ID NO: 1667362 - RNA, 19 nt, Homo sapiens
aacugauggguaucaugcu

SEQ ID NO: 1667363 - RNA, 19 nt, Homo sapiens
aacugauuuccauccaaac

SEQ ID NO: 1667364 - RNA, 16 nt, Homo sapiens
aacugcacaaauugua

SEQ ID NO: 1667365 - RNA, 22 nt, Homo sapiens
aacugcaucaagaugugacaug

SEQ ID NO: 1667366 - RNA, 18 nt, Homo sapiens
aacugccacaagcacaau

SEQ ID NO: 1667367 - RNA, 17 nt, Homo sapiens
aacugcccagagccaca

SEQ ID NO: 1667368 - RNA, 18 nt, Homo sapiens
aacugcccagagccacag

SEQ ID NO: 1667369 - RNA, 11 nt, Homo sapiens
aacugcuugug

SEQ ID NO: 1667370 - RNA, 13 nt, Homo sapiens
aacugcuugugca

SEQ ID NO: 1667371 - RNA, 14 nt, Homo sapiens
aacugcuugugcac

SEQ ID NO: 1667372 - RNA, 18 nt, Homo sapiens
aacugcuugugcacugga

SEQ ID NO: 1667373 - RNA, 16 nt, Homo sapiens
aacuggaaacaucuga

SEQ ID NO: 1667374 - RNA, 17 nt, Homo sapiens
aacuguaaaauacuucu

SEQ ID NO: 1667375 - RNA, 19 nt, Homo sapiens
aacuguaaaauacuucuuu

SEQ ID NO: 1667376 - RNA, 21 nt, Homo sapiens
aacuguagccugaguguccac

SEQ ID NO: 1667377 - RNA, 16 nt, Homo sapiens
aacugugacauuccac

SEQ ID NO: 1667378 - RNA, 22 nt, Homo sapiens
aacugugacauuccacagaguu

SEQ ID NO: 1667379 - RNA, 22 nt, Homo sapiens
aacuguuuaacgugagguuuca

SEQ ID NO: 1667380 - RNA, 23 nt, Homo sapiens
aacuuaauuaccuaagagccaca

SEQ ID NO: 1667381 - RNA, 13 nt, Homo sapiens
aacuuacauaugu

SEQ ID NO: 1667382 - RNA, 23 nt, Homo sapiens
aacuuagagcacuagaagcacag

SEQ ID NO: 1667383 - RNA, 22 nt, Homo sapiens
aacuucaggaaagcagcaguuu

SEQ ID NO: 1667384 - RNA, 22 nt, Homo sapiens
aacuuccagguuccauccacca

SEQ ID NO: 1667385 - RNA, 15 nt, Homo sapiens
aacuucuacugagca

SEQ ID NO: 1667386 - RNA, 15 nt, Homo sapiens
aacuucuauuuucaa

SEQ ID NO: 1667387 - RNA, 14 nt, Homo sapiens
aacuuucccuccac

SEQ ID NO: 1667388 - RNA, 22 nt, Homo sapiens
aacuuucucuagucuacuguca

SEQ ID NO: 1667389 - RNA, 13 nt, Homo sapiens
aacuuugucacuu

SEQ ID NO: 1667390 - RNA, 13 nt, Homo sapiens
aacuuuucaucca

SEQ ID NO: 1667391 - RNA, 17 nt, Homo sapiens
aacuuuugguaucuacu

SEQ ID NO: 1667392 - RNA, 18 nt, Homo sapiens
aacuuuugguaucuacuu

SEQ ID NO: 1667393 - RNA, 12 nt, Homo sapiens
aacuuuuuauuc

SEQ ID NO: 1667394 - RNA, 15 nt, Homo sapiens
aacuuuuuauucuca

SEQ ID NO: 1667395 - RNA, 22 nt, Homo sapiens
aagaaacacagcaugcauuuag

SEQ ID NO: 1667396 - RNA, 13 nt, Homo sapiens
aagaaagaaacca

SEQ ID NO: 1667397 - RNA, 21 nt, Homo sapiens
aagaaagcuguaauauauagu

SEQ ID NO: 1667398 - RNA, 18 nt, Homo sapiens
aagaacguggauugugaa

SEQ ID NO: 1667399 - RNA, 22 nt, Homo sapiens
aagaacucccuucuccccucag

SEQ ID NO: 1667400 - RNA, 15 nt, Homo sapiens
aagaagagaucagga

SEQ ID NO: 1667401 - RNA, 18 nt, Homo sapiens
aagaagaguuuacagaca

SEQ ID NO: 1667402 - RNA, 12 nt, Homo sapiens
aagaagcaguuu

SEQ ID NO: 1667403 - RNA, 20 nt, Homo sapiens
aagaagcaguuuacucuaga

SEQ ID NO: 1667404 - RNA, 19 nt, Homo sapiens
aagaagcaguuuacuuuag

SEQ ID NO: 1667405 - RNA, 21 nt, Homo sapiens
aagaaguggauuguauuguga

SEQ ID NO: 1667406 - RNA, 14 nt, Homo sapiens
aagaaucaccuaau

SEQ ID NO: 1667407 - RNA, 12 nt, Homo sapiens
aagaauggaauc

SEQ ID NO: 1667408 - RNA, 21 nt, Homo sapiens
aagacaauuuuaauguuuaca

SEQ ID NO: 1667409 - RNA, 23 nt, Homo sapiens
aagacaauuuuaauguuuacaac

SEQ ID NO: 1667410 - RNA, 14 nt, Homo sapiens
aagacaccuuccca

SEQ ID NO: 1667411 - RNA, 16 nt, Homo sapiens
aagacacguucuugcc

SEQ ID NO: 1667412 - RNA, 12 nt, Homo sapiens
aagacagugcag

SEQ ID NO: 1667413 - RNA, 22 nt, Homo sapiens
aagacauucaccaacaacaguc

SEQ ID NO: 1667414 - RNA, 16 nt, Homo sapiens
aagaccaugcauucag

SEQ ID NO: 1667415 - RNA, 20 nt, Homo sapiens
aagaccuucugaagaucuca

SEQ ID NO: 1667416 - RNA, 15 nt, Homo sapiens
aagacggauccacag

SEQ ID NO: 1667417 - RNA, 16 nt, Homo sapiens
aagacugguauucucu

SEQ ID NO: 1667418 - RNA, 20 nt, Homo sapiens
aagacuuccucaugaaucuc

SEQ ID NO: 1667419 - RNA, 21 nt, Homo sapiens
aagagaaacacuaauggccaa

SEQ ID NO: 1667420 - RNA, 14 nt, Homo sapiens
aagagcauaauggu

SEQ ID NO: 1667421 - RNA, 21 nt, Homo sapiens
aagaggccaguacuuugccau

SEQ ID NO: 1667422 - RNA, 21 nt, Homo sapiens
aagauagguucugcuuucuga

SEQ ID NO: 1667423 - RNA, 17 nt, Homo sapiens
aagauauuguauuauca

SEQ ID NO: 1667424 - RNA, 12 nt, Homo sapiens
aagaucuugccu

SEQ ID NO: 1667425 - RNA, 16 nt, Homo sapiens
aagaucuuucuuaaua

SEQ ID NO: 1667426 - RNA, 20 nt, Homo sapiens
aagauggccuaggaucuuca

SEQ ID NO: 1667427 - RNA, 17 nt, Homo sapiens
aagaugggugauuauga

SEQ ID NO: 1667428 - RNA, 15 nt, Homo sapiens
aagaugugucuucaa

SEQ ID NO: 1667429 - RNA, 13 nt, Homo sapiens
aagauucaauuaa

SEQ ID NO: 1667430 - RNA, 19 nt, Homo sapiens
aagcaaacacacagacucu

SEQ ID NO: 1667431 - RNA, 17 nt, Homo sapiens
aagcaaacacacucuca

SEQ ID NO: 1667432 - RNA, 16 nt, Homo sapiens
aagcaaaucuguauaa

SEQ ID NO: 1667433 - RNA, 12 nt, Homo sapiens
aagcacagaucu

SEQ ID NO: 1667434 - RNA, 20 nt, Homo sapiens
aagcacaugccucucucagg

SEQ ID NO: 1667435 - RNA, 11 nt, Homo sapiens
aagcacugccu

SEQ ID NO: 1667436 - RNA, 20 nt, Homo sapiens
aagcacuggccuugccucca

SEQ ID NO: 1667437 - RNA, 17 nt, Homo sapiens
aagcagaucaucuccaa

SEQ ID NO: 1667438 - RNA, 19 nt, Homo sapiens
aagcaguguguacuucuuc

SEQ ID NO: 1667439 - RNA, 20 nt, Homo sapiens
aagcauuugacuuucugucu

SEQ ID NO: 1667440 - RNA, 14 nt, Homo sapiens
aagccaaguguccu

SEQ ID NO: 1667441 - RNA, 16 nt, Homo sapiens
aagccacguugcagaa

SEQ ID NO: 1667442 - RNA, 19 nt, Homo sapiens
aagccagcugcaggaauca

SEQ ID NO: 1667443 - RNA, 15 nt, Homo sapiens
aagccaggugccacc

SEQ ID NO: 1667444 - RNA, 15 nt, Homo sapiens
aagccaguccagaag

SEQ ID NO: 1667445 - RNA, 14 nt, Homo sapiens
aagcccggauccca

SEQ ID NO: 1667446 - RNA, 24 nt, Homo sapiens
aagcccggaucccaacaguuguca

SEQ ID NO: 1667447 - RNA, 20 nt, Homo sapiens
aagccucucuggcacuuuga

SEQ ID NO: 1667448 - RNA, 22 nt, Homo sapiens
aagccucuggcuaccucugucc

SEQ ID NO: 1667449 - RNA, 18 nt, Homo sapiens
aagccugggcagaaaugu

SEQ ID NO: 1667450 - RNA, 17 nt, Homo sapiens
aagcgauucuccugccu

SEQ ID NO: 1667451 - RNA, 16 nt, Homo sapiens
aagcguacaaagugau

SEQ ID NO: 1667452 - RNA, 18 nt, Homo sapiens
aagcgugguggacaugca

SEQ ID NO: 1667453 - RNA, 23 nt, Homo sapiens
aagcuaaaaugaaaaauagugug

SEQ ID NO: 1667454 - RNA, 21 nt, Homo sapiens
aagcuccaucuuauuugucag

SEQ ID NO: 1667455 - RNA, 16 nt, Homo sapiens
aagcucuuguguauac

SEQ ID NO: 1667456 - RNA, 22 nt, Homo sapiens
aagcugaugaaguuaagcacaa

SEQ ID NO: 1667457 - RNA, 16 nt, Homo sapiens
aagcuggagugcagug

SEQ ID NO: 1667458 - RNA, 17 nt, Homo sapiens
aagcuggagugcagugg

SEQ ID NO: 1667459 - RNA, 12 nt, Homo sapiens
aagcugggagaa

SEQ ID NO: 1667460 - RNA, 17 nt, Homo sapiens
aagcuguuccacuucuc

SEQ ID NO: 1667461 - RNA, 14 nt, Homo sapiens
aaggaaagcagugu

SEQ ID NO: 1667462 - RNA, 19 nt, Homo sapiens
aaggaacaucccugagaaa

SEQ ID NO: 1667463 - RNA, 13 nt, Homo sapiens
aaggaucacuuga

SEQ ID NO: 1667464 - RNA, 15 nt, Homo sapiens
aaggaugcccaaaga

SEQ ID NO: 1667465 - RNA, 20 nt, Homo sapiens
aaggcaacauuuccgaagac

SEQ ID NO: 1667466 - RNA, 13 nt, Homo sapiens
aaggcacugagcg

SEQ ID NO: 1667467 - RNA, 12 nt, Homo sapiens
aaggcagugcaa

SEQ ID NO: 1667468 - RNA, 14 nt, Homo sapiens
aaggcagugcagua

SEQ ID NO: 1667469 - RNA, 12 nt, Homo sapiens
aaggcauccacu

SEQ ID NO: 1667470 - RNA, 16 nt, Homo sapiens
aaggcauccccagugc

SEQ ID NO: 1667471 - RNA, 19 nt, Homo sapiens
aaggcaucuaagacauuca

SEQ ID NO: 1667472 - RNA, 20 nt, Homo sapiens
aaggcaucuaagacauucac

SEQ ID NO: 1667473 - RNA, 15 nt, Homo sapiens
aaggcggugagcaau

SEQ ID NO: 1667474 - RNA, 17 nt, Homo sapiens
aagggaagcuucuugcu

SEQ ID NO: 1667475 - RNA, 23 nt, Homo sapiens
aagggacuuuggaauucugcuuc

SEQ ID NO: 1667476 - RNA, 20 nt, Homo sapiens
aagggagggguuaaugcaga

SEQ ID NO: 1667477 - RNA, 22 nt, Homo sapiens
aagggaucugcuugauauccca

SEQ ID NO: 1667478 - RNA, 18 nt, Homo sapiens
aagggcagcuccacaggg

SEQ ID NO: 1667479 - RNA, 15 nt, Homo sapiens
aagggcaggagcuca

SEQ ID NO: 1667480 - RNA, 17 nt, Homo sapiens
aagggcauuuuggcucc

SEQ ID NO: 1667481 - RNA, 15 nt, Homo sapiens
aagggcugguguuga

SEQ ID NO: 1667482 - RNA, 18 nt, Homo sapiens
aaggggagaguaacccug

SEQ ID NO: 1667483 - RNA, 19 nt, Homo sapiens
aaggggccaggaaggggac

SEQ ID NO: 1667484 - RNA, 20 nt, Homo sapiens
aaggggccugggcugugagg

SEQ ID NO: 1667485 - RNA, 23 nt, Homo sapiens
aaggguguugcuaagcuguaacc

SEQ ID NO: 1667486 - RNA, 17 nt, Homo sapiens
aaggguuuuaagccagg

SEQ ID NO: 1667487 - RNA, 21 nt, Homo sapiens
aagguagcuuaccugacacaa

SEQ ID NO: 1667488 - RNA, 16 nt, Homo sapiens
aaggucaccugcacuc

SEQ ID NO: 1667489 - RNA, 18 nt, Homo sapiens
aagguuucacuguucaug

SEQ ID NO: 1667490 - RNA, 20 nt, Homo sapiens
aagguuucacuguucaugaa

SEQ ID NO: 1667491 - RNA, 16 nt, Homo sapiens
aaguaaaucuaucucu

SEQ ID NO: 1667492 - RNA, 22 nt, Homo sapiens
aaguaaauuuucuuuaagucag

SEQ ID NO: 1667493 - RNA, 22 nt, Homo sapiens
aaguaaccucuacaggcauuua

SEQ ID NO: 1667494 - RNA, 22 nt, Homo sapiens
aaguaaucuguugacagugcca

SEQ ID NO: 1667495 - RNA, 13 nt, Homo sapiens
aaguaauuuacaa

SEQ ID NO: 1667496 - RNA, 18 nt, Homo sapiens
aaguacagggcagaacca

SEQ ID NO: 1667497 - RNA, 22 nt, Homo sapiens
aaguacagggcagaaccaagaa

SEQ ID NO: 1667498 - RNA, 18 nt, Homo sapiens
aaguauugcccuuuaaca

SEQ ID NO: 1667499 - RNA, 15 nt, Homo sapiens
aagucaccuguauaa

SEQ ID NO: 1667500 - RNA, 11 nt, Homo sapiens
aaguccagugu

SEQ ID NO: 1667501 - RNA, 16 nt, Homo sapiens
aagucccgaggcagca

SEQ ID NO: 1667502 - RNA, 14 nt, Homo sapiens
aagucccuaauaaa

SEQ ID NO: 1667503 - RNA, 15 nt, Homo sapiens
aagucuacacugccu

SEQ ID NO: 1667504 - RNA, 20 nt, Homo sapiens
aagucucacuuuuauugaua

SEQ ID NO: 1667505 - RNA, 15 nt, Homo sapiens
aagucuccuguauca

SEQ ID NO: 1667506 - RNA, 20 nt, Homo sapiens
aagucuuaaucauuugugac

SEQ ID NO: 1667507 - RNA, 14 nt, Homo sapiens
aagucuuaguacau

SEQ ID NO: 1667508 - RNA, 16 nt, Homo sapiens
aagugagagaggggga

SEQ ID NO: 1667509 - RNA, 14 nt, Homo sapiens
aagugcuaugacag

SEQ ID NO: 1667510 - RNA, 16 nt, Homo sapiens
aagugggucaauuccu

SEQ ID NO: 1667511 - RNA, 13 nt, Homo sapiens
aaguguacuggau

SEQ ID NO: 1667512 - RNA, 20 nt, Homo sapiens
aaguuaaaaagucaaacuuu

SEQ ID NO: 1667513 - RNA, 22 nt, Homo sapiens
aaguuauccagaggguugugau

SEQ ID NO: 1667514 - RNA, 18 nt, Homo sapiens
aaguuugccccagugcua

SEQ ID NO: 1667515 - RNA, 14 nt, Homo sapiens
aaguuuuacuugau

SEQ ID NO: 1667516 - RNA, 22 nt, Homo sapiens
aaguuuucaccuaucuggaaaa

SEQ ID NO: 1667517 - RNA, 13 nt, Homo sapiens
aauaaaaccagaa

SEQ ID NO: 1667518 - RNA, 16 nt, Homo sapiens
aauaaaagaaucauuu

SEQ ID NO: 1667519 - RNA, 22 nt, Homo sapiens
aauaaagccuugugaucacuuu

SEQ ID NO: 1667520 - RNA, 20 nt, Homo sapiens
aauaaagguucuaugauaua

SEQ ID NO: 1667521 - RNA, 15 nt, Homo sapiens
aauaaaguauuccac

SEQ ID NO: 1667522 - RNA, 13 nt, Homo sapiens
aauaaccaguuaa

SEQ ID NO: 1667523 - RNA, 18 nt, Homo sapiens
aauaacccugaaucagag

SEQ ID NO: 1667524 - RNA, 23 nt, Homo sapiens
aauaaguuuuuuuaaaguguuau

SEQ ID NO: 1667525 - RNA, 17 nt, Homo sapiens
aauaaugcuuaacauaa

SEQ ID NO: 1667526 - RNA, 16 nt, Homo sapiens
aauacaauacaguacu

SEQ ID NO: 1667527 - RNA, 11 nt, Homo sapiens
aauacaguauu

SEQ ID NO: 1667528 - RNA, 12 nt, Homo sapiens
aauacaugccuu

SEQ ID NO: 1667529 - RNA, 13 nt, Homo sapiens
aauacccacugcc

SEQ ID NO: 1667530 - RNA, 18 nt, Homo sapiens
aauacuuaacuacuguuu

SEQ ID NO: 1667531 - RNA, 20 nt, Homo sapiens
aauacuugaaaacuucucau

SEQ ID NO: 1667532 - RNA, 18 nt, Homo sapiens
aauacuuugugucuuuug

SEQ ID NO: 1667533 - RNA, 20 nt, Homo sapiens
aauagaggucuugaucuuug

SEQ ID NO: 1667534 - RNA, 21 nt, Homo sapiens
aauagcucacagcacauuugu

SEQ ID NO: 1667535 - RNA, 19 nt, Homo sapiens
aauagcugcaccaucccag

SEQ ID NO: 1667536 - RNA, 13 nt, Homo sapiens
aauagguguguga

SEQ ID NO: 1667537 - RNA, 18 nt, Homo sapiens
aauaguuacaagcauuga

SEQ ID NO: 1667538 - RNA, 12 nt, Homo sapiens
aauauaaacugu

SEQ ID NO: 1667539 - RNA, 16 nt, Homo sapiens
aauauacucauuugga

SEQ ID NO: 1667540 - RNA, 16 nt, Homo sapiens
aauauauacauauuca

SEQ ID NO: 1667541 - RNA, 19 nt, Homo sapiens
aauauauguuuggcugaaa

SEQ ID NO: 1667542 - RNA, 15 nt, Homo sapiens
aauaucgaguuccgg

SEQ ID NO: 1667543 - RNA, 15 nt, Homo sapiens
aauaugaauggagug

SEQ ID NO: 1667544 - RNA, 19 nt, Homo sapiens
aauauggacaaagaaggca

SEQ ID NO: 1667545 - RNA, 14 nt, Homo sapiens
aauauuauacuucu

SEQ ID NO: 1667546 - RNA, 13 nt, Homo sapiens
aauauucugucau

SEQ ID NO: 1667547 - RNA, 19 nt, Homo sapiens
aauauuucuucaaauaucu

SEQ ID NO: 1667548 - RNA, 17 nt, Homo sapiens
aaucaaaguaaccucug

SEQ ID NO: 1667549 - RNA, 14 nt, Homo sapiens
aaucaacagaucaa

SEQ ID NO: 1667550 - RNA, 15 nt, Homo sapiens
aaucaagucugugaa

SEQ ID NO: 1667551 - RNA, 20 nt, Homo sapiens
aaucaaucuggcuucugcau

SEQ ID NO: 1667552 - RNA, 15 nt, Homo sapiens
aaucaaugugcuccu

SEQ ID NO: 1667553 - RNA, 17 nt, Homo sapiens
aaucaauguucacgcaa

SEQ ID NO: 1667554 - RNA, 18 nt, Homo sapiens
aaucaccccucucagugc

SEQ ID NO: 1667555 - RNA, 20 nt, Homo sapiens
aaucaccccucucagugcac

SEQ ID NO: 1667556 - RNA, 19 nt, Homo sapiens
aaucacuauugcuuccuaa

SEQ ID NO: 1667557 - RNA, 15 nt, Homo sapiens
aaucagacucuuuag

SEQ ID NO: 1667558 - RNA, 16 nt, Homo sapiens
aaucauugcuggacug

SEQ ID NO: 1667559 - RNA, 12 nt, Homo sapiens
aaucauugucag

SEQ ID NO: 1667560 - RNA, 22 nt, Homo sapiens
aaucauuuauuuacaugugauu

SEQ ID NO: 1667561 - RNA, 16 nt, Homo sapiens
aauccauaucagcucu

SEQ ID NO: 1667562 - RNA, 20 nt, Homo sapiens
aauccauaucagcucugcau

SEQ ID NO: 1667563 - RNA, 12 nt, Homo sapiens
aauccauuugag

SEQ ID NO: 1667564 - RNA, 13 nt, Homo sapiens
aaucccauuccug

SEQ ID NO: 1667565 - RNA, 23 nt, Homo sapiens
aaucccccaccuccaacuuuccc

SEQ ID NO: 1667566 - RNA, 14 nt, Homo sapiens
aaucccucuaccuu

SEQ ID NO: 1667567 - RNA, 15 nt, Homo sapiens
aauccucccacuuca

SEQ ID NO: 1667568 - RNA, 11 nt, Homo sapiens
aauccuuguag

SEQ ID NO: 1667569 - RNA, 22 nt, Homo sapiens
aaucgaggugugggccagagau

SEQ ID NO: 1667570 - RNA, 15 nt, Homo sapiens
aaucuaaaucuucag

SEQ ID NO: 1667571 - RNA, 22 nt, Homo sapiens
aaucucuaaacacaaauuguga

SEQ ID NO: 1667572 - RNA, 19 nt, Homo sapiens
aaucuguugacagugccaa

SEQ ID NO: 1667573 - RNA, 21 nt, Homo sapiens
aaucuugcccuuaauaucccu

SEQ ID NO: 1667574 - RNA, 14 nt, Homo sapiens
aaucuuugugacag

SEQ ID NO: 1667575 - RNA, 16 nt, Homo sapiens
aaugaaaacaguccca

SEQ ID NO: 1667576 - RNA, 22 nt, Homo sapiens
aaugaaauaguuuuaucuggaa

SEQ ID NO: 1667577 - RNA, 20 nt, Homo sapiens
aaugaauauucaacagcuca

SEQ ID NO: 1667578 - RNA, 13 nt, Homo sapiens
aaugaauccauca

SEQ ID NO: 1667579 - RNA, 23 nt, Homo sapiens
aaugaaugaaauauaaacuguga

SEQ ID NO: 1667580 - RNA, 23 nt, Homo sapiens
aaugacaacaaaagggaaaaaag

SEQ ID NO: 1667581 - RNA, 18 nt, Homo sapiens
aaugacauugaacugaau

SEQ ID NO: 1667582 - RNA, 16 nt, Homo sapiens
aaugacuuaagcacac

SEQ ID NO: 1667583 - RNA, 18 nt, Homo sapiens
aaugacuucuaguguaga

SEQ ID NO: 1667584 - RNA, 15 nt, Homo sapiens
aaugagaaucugugc

SEQ ID NO: 1667585 - RNA, 14 nt, Homo sapiens
aaugagcauucugc

SEQ ID NO: 1667586 - RNA, 16 nt, Homo sapiens
aaugagccuuucugcc

SEQ ID NO: 1667587 - RNA, 16 nt, Homo sapiens
aaugaggaaacugcac

SEQ ID NO: 1667588 - RNA, 13 nt, Homo sapiens
aaugaggcacaug

SEQ ID NO: 1667589 - RNA, 19 nt, Homo sapiens
aaugauacugaauuguuau

SEQ ID NO: 1667590 - RNA, 19 nt, Homo sapiens
aaugauacuugguccuuaa

SEQ ID NO: 1667591 - RNA, 15 nt, Homo sapiens
aaugauucaauguga

SEQ ID NO: 1667592 - RNA, 21 nt, Homo sapiens
aaugauucuugugucaucaag

SEQ ID NO: 1667593 - RNA, 23 nt, Homo sapiens
aaugcaaaugaaggaaugcaaua

SEQ ID NO: 1667594 - RNA, 15 nt, Homo sapiens
aaugcaaugcucagu

SEQ ID NO: 1667595 - RNA, 13 nt, Homo sapiens
aaugcacagugaa

SEQ ID NO: 1667596 - RNA, 15 nt, Homo sapiens
aaugccagacuucua

SEQ ID NO: 1667597 - RNA, 20 nt, Homo sapiens
aaugccagggacauuuucaa

SEQ ID NO: 1667598 - RNA, 14 nt, Homo sapiens
aaugcuaagggcag

SEQ ID NO: 1667599 - RNA, 15 nt, Homo sapiens
aaugcuauuugugua

SEQ ID NO: 1667600 - RNA, 15 nt, Homo sapiens
aaugcucacuuaugu

SEQ ID NO: 1667601 - RNA, 21 nt, Homo sapiens
aaugcugauuuaaacuucuua

SEQ ID NO: 1667602 - RNA, 23 nt, Homo sapiens
aaugcuuaaaggggcuguggcug

SEQ ID NO: 1667603 - RNA, 14 nt, Homo sapiens
aauggaaagguccu

SEQ ID NO: 1667604 - RNA, 15 nt, Homo sapiens
aauggcaagcauagu

SEQ ID NO: 1667605 - RNA, 19 nt, Homo sapiens
aaugggaaauguuuggcca

SEQ ID NO: 1667606 - RNA, 21 nt, Homo sapiens
aauggguuuuguguacuguaa

SEQ ID NO: 1667607 - RNA, 21 nt, Homo sapiens
aaugguguagcuguccucuca

SEQ ID NO: 1667608 - RNA, 22 nt, Homo sapiens
aaugguuuucuuguguguuuau

SEQ ID NO: 1667609 - RNA, 19 nt, Homo sapiens
aauguacaauaaagcaaug

SEQ ID NO: 1667610 - RNA, 16 nt, Homo sapiens
aauguacuacauuugc

SEQ ID NO: 1667611 - RNA, 18 nt, Homo sapiens
aauguacuacauuugcau

SEQ ID NO: 1667612 - RNA, 17 nt, Homo sapiens
aaugucagugugacuga

SEQ ID NO: 1667613 - RNA, 14 nt, Homo sapiens
aaugucauuugcua

SEQ ID NO: 1667614 - RNA, 14 nt, Homo sapiens
aaugucuauauuau

SEQ ID NO: 1667615 - RNA, 23 nt, Homo sapiens
aaugugaaaaaaaaaaguaauua

SEQ ID NO: 1667616 - RNA, 23 nt, Homo sapiens
aaugugacuugagcccagaguga

SEQ ID NO: 1667617 - RNA, 21 nt, Homo sapiens
aaugugccucucaguaucuua

SEQ ID NO: 1667618 - RNA, 15 nt, Homo sapiens
aauguggaugcucuu

SEQ ID NO: 1667619 - RNA, 15 nt, Homo sapiens
aaugugguggcaaua

SEQ ID NO: 1667620 - RNA, 16 nt, Homo sapiens
aauguuauagguuugu

SEQ ID NO: 1667621 - RNA, 20 nt, Homo sapiens
aauguucugacagcauuuca

SEQ ID NO: 1667622 - RNA, 17 nt, Homo sapiens
aauguugaaacugacuu

SEQ ID NO: 1667623 - RNA, 22 nt, Homo sapiens
aauguugaagaacucaugugau

SEQ ID NO: 1667624 - RNA, 18 nt, Homo sapiens
aauguuguccugugucau

SEQ ID NO: 1667625 - RNA, 21 nt, Homo sapiens
aauuaaaccaaggagucugau

SEQ ID NO: 1667626 - RNA, 19 nt, Homo sapiens
aauuaaagucuacacugcc

SEQ ID NO: 1667627 - RNA, 22 nt, Homo sapiens
aauuaacaaauucaguggacau

SEQ ID NO: 1667628 - RNA, 13 nt, Homo sapiens
aauuaacuaacuc

SEQ ID NO: 1667629 - RNA, 20 nt, Homo sapiens
aauuacugugagaacuguga

SEQ ID NO: 1667630 - RNA, 17 nt, Homo sapiens
aauuagacauaccucuc

SEQ ID NO: 1667631 - RNA, 19 nt, Homo sapiens
aauuagacauaccucucaa

SEQ ID NO: 1667632 - RNA, 14 nt, Homo sapiens
aauuagacuaagug

SEQ ID NO: 1667633 - RNA, 20 nt, Homo sapiens
aauuagcaugaaagcaguuu

SEQ ID NO: 1667634 - RNA, 14 nt, Homo sapiens
aauuauaagcuaug

SEQ ID NO: 1667635 - RNA, 17 nt, Homo sapiens
aauuaucaaaaaacaga

SEQ ID NO: 1667636 - RNA, 18 nt, Homo sapiens
aauuaugucaaauggaug

SEQ ID NO: 1667637 - RNA, 14 nt, Homo sapiens
aauucauguuuuca

SEQ ID NO: 1667638 - RNA, 15 nt, Homo sapiens
aauucauuccauuug

SEQ ID NO: 1667639 - RNA, 14 nt, Homo sapiens
aauucccaauccca

SEQ ID NO: 1667640 - RNA, 17 nt, Homo sapiens
aauucccaaucccauuc

SEQ ID NO: 1667641 - RNA, 19 nt, Homo sapiens
aauuccgacuuucucagca

SEQ ID NO: 1667642 - RNA, 14 nt, Homo sapiens
aauucugcuucucu

SEQ ID NO: 1667643 - RNA, 19 nt, Homo sapiens
aauucugcuucucuuucac

SEQ ID NO: 1667644 - RNA, 20 nt, Homo sapiens
aauucugcuucucuuucaca

SEQ ID NO: 1667645 - RNA, 18 nt, Homo sapiens
aauucuuaccucauuugc

SEQ ID NO: 1667646 - RNA, 20 nt, Homo sapiens
aauucuuaccucauuugcau

SEQ ID NO: 1667647 - RNA, 22 nt, Homo sapiens
aauucuuguucauuuugcauuc

SEQ ID NO: 1667648 - RNA, 17 nt, Homo sapiens
aauucuuuuucucagca

SEQ ID NO: 1667649 - RNA, 21 nt, Homo sapiens
aauugaagacacguucuugcc

SEQ ID NO: 1667650 - RNA, 13 nt, Homo sapiens
aauugauagucaa

SEQ ID NO: 1667651 - RNA, 17 nt, Homo sapiens
aauugcagcaguugcua

SEQ ID NO: 1667652 - RNA, 16 nt, Homo sapiens
aauugcaguucaguuc

SEQ ID NO: 1667653 - RNA, 17 nt, Homo sapiens
aauugugcgacuucaca

SEQ ID NO: 1667654 - RNA, 18 nt, Homo sapiens
aauuuaaaaucagacucu

SEQ ID NO: 1667655 - RNA, 16 nt, Homo sapiens
aauuuauaacaauuga

SEQ ID NO: 1667656 - RNA, 19 nt, Homo sapiens
aauuucaaaagggccccau

SEQ ID NO: 1667657 - RNA, 13 nt, Homo sapiens
aauuucauuccaa

SEQ ID NO: 1667658 - RNA, 23 nt, Homo sapiens
aauuucucucuuuuguacucugu

SEQ ID NO: 1667659 - RNA, 16 nt, Homo sapiens
aauuugcuuagccuuu

SEQ ID NO: 1667660 - RNA, 15 nt, Homo sapiens
aauuuguuugugcuu

SEQ ID NO: 1667661 - RNA, 20 nt, Homo sapiens
aauuuuaaagcaaucuuggc

SEQ ID NO: 1667662 - RNA, 13 nt, Homo sapiens
aauuuucuucuca

SEQ ID NO: 1667663 - RNA, 12 nt, Homo sapiens
aauuuuguugca

SEQ ID NO: 1667664 - RNA, 21 nt, Homo sapiens
aauuuuguugcaucauguuga

SEQ ID NO: 1667665 - RNA, 18 nt, Homo sapiens
aauuuuuaacuuaucucc

SEQ ID NO: 1667666 - RNA, 21 nt, Homo sapiens
aauuuuuuuccagaauugaga

SEQ ID NO: 1667667 - RNA, 22 nt, Homo sapiens
aauuuuuuuguauuuucacugg

SEQ ID NO: 1667668 - RNA, 15 nt, Homo sapiens
acaaaaacuuuccau

SEQ ID NO: 1667669 - RNA, 23 nt, Homo sapiens
acaaaaggcuggaugugcuuuca

SEQ ID NO: 1667670 - RNA, 17 nt, Homo sapiens
acaaacaaccugccaca

SEQ ID NO: 1667671 - RNA, 23 nt, Homo sapiens
acaaacaaccugccacaauguga

SEQ ID NO: 1667672 - RNA, 23 nt, Homo sapiens
acaaaccacaacugacacaggaa

SEQ ID NO: 1667673 - RNA, 15 nt, Homo sapiens
acaaaccucucagca

SEQ ID NO: 1667674 - RNA, 18 nt, Homo sapiens
acaaaccucucagcacua

SEQ ID NO: 1667675 - RNA, 18 nt, Homo sapiens
acaaacuucccugacucu

SEQ ID NO: 1667676 - RNA, 16 nt, Homo sapiens
acaaagacaaccacug

SEQ ID NO: 1667677 - RNA, 23 nt, Homo sapiens
acaaagcgugguggacaugcaca

SEQ ID NO: 1667678 - RNA, 23 nt, Homo sapiens
acaaaguggaugccugcugcauc

SEQ ID NO: 1667679 - RNA, 12 nt, Homo sapiens
acaaauauugcu

SEQ ID NO: 1667680 - RNA, 18 nt, Homo sapiens
acaaaucauuuugaugua

SEQ ID NO: 1667681 - RNA, 19 nt, Homo sapiens
acaaaucauuuugauguau

SEQ ID NO: 1667682 - RNA, 21 nt, Homo sapiens
acaaauccaacgcuuuuccca

SEQ ID NO: 1667683 - RNA, 21 nt, Homo sapiens
acaaaucguccaaagaucuca

SEQ ID NO: 1667684 - RNA, 15 nt, Homo sapiens
acaaauguaacacac

SEQ ID NO: 1667685 - RNA, 12 nt, Homo sapiens
acaaauucuaaa

SEQ ID NO: 1667686 - RNA, 19 nt, Homo sapiens
acaacaaagcaugcucagu

SEQ ID NO: 1667687 - RNA, 22 nt, Homo sapiens
acaacaauuuaggaaugcucaa

SEQ ID NO: 1667688 - RNA, 21 nt, Homo sapiens
acaaccacauuucuggccauu

SEQ ID NO: 1667689 - RNA, 13 nt, Homo sapiens
acaaccacuggga

SEQ ID NO: 1667690 - RNA, 20 nt, Homo sapiens
acaacuugccaaaacagaua

SEQ ID NO: 1667691 - RNA, 14 nt, Homo sapiens
acaacuugcuccuu

SEQ ID NO: 1667692 - RNA, 18 nt, Homo sapiens
acaacuuuggaauuugaa

SEQ ID NO: 1667693 - RNA, 15 nt, Homo sapiens
acaagagaccacuuc

SEQ ID NO: 1667694 - RNA, 21 nt, Homo sapiens
acaagcaagcaaaaugcaaac

SEQ ID NO: 1667695 - RNA, 11 nt, Homo sapiens
acaagcacaau

SEQ ID NO: 1667696 - RNA, 22 nt, Homo sapiens
acaagcaggcucaacauaacau

SEQ ID NO: 1667697 - RNA, 15 nt, Homo sapiens
acaagcuacauaugu

SEQ ID NO: 1667698 - RNA, 16 nt, Homo sapiens
acaauaaagcaaugug

SEQ ID NO: 1667699 - RNA, 18 nt, Homo sapiens
acaauaggcuuagugcuu

SEQ ID NO: 1667700 - RNA, 20 nt, Homo sapiens
acaauaucauuuuccuggga

SEQ ID NO: 1667701 - RNA, 23 nt, Homo sapiens
acaauggcuggguuugggcagug

SEQ ID NO: 1667702 - RNA, 15 nt, Homo sapiens
acaauuacugugaga

SEQ ID NO: 1667703 - RNA, 17 nt, Homo sapiens
acaauuuucugcaggau

SEQ ID NO: 1667704 - RNA, 14 nt, Homo sapiens
acaauuuugucucu

SEQ ID NO: 1667705 - RNA, 21 nt, Homo sapiens
acacaaauauugcuuggacua

SEQ ID NO: 1667706 - RNA, 12 nt, Homo sapiens
acacaacugugg

SEQ ID NO: 1667707 - RNA, 21 nt, Homo sapiens
acacaauacagugguauaaac

SEQ ID NO: 1667708 - RNA, 17 nt, Homo sapiens
acacaaugguagcucug

SEQ ID NO: 1667709 - RNA, 12 nt, Homo sapiens
acacacaauuaa

SEQ ID NO: 1667710 - RNA, 19 nt, Homo sapiens
acacacgcaaauacaugcc

SEQ ID NO: 1667711 - RNA, 22 nt, Homo sapiens
acacagaggacagcuuccccau

SEQ ID NO: 1667712 - RNA, 22 nt, Homo sapiens
acacagaggacggcuuccccau

SEQ ID NO: 1667713 - RNA, 12 nt, Homo sapiens
acacagcagcuc

SEQ ID NO: 1667714 - RNA, 13 nt, Homo sapiens
acacagugcagug

SEQ ID NO: 1667715 - RNA, 18 nt, Homo sapiens
acacaguguagugcucag

SEQ ID NO: 1667716 - RNA, 15 nt, Homo sapiens
acacaugguuuccaa

SEQ ID NO: 1667717 - RNA, 14 nt, Homo sapiens
acaccacagaagcu

SEQ ID NO: 1667718 - RNA, 15 nt, Homo sapiens
acaccaccacugugu

SEQ ID NO: 1667719 - RNA, 20 nt, Homo sapiens
acaccaccacugugucccag

SEQ ID NO: 1667720 - RNA, 22 nt, Homo sapiens
acaccacuuucccacacuguga

SEQ ID NO: 1667721 - RNA, 17 nt, Homo sapiens
acacccaaagcauggac

SEQ ID NO: 1667722 - RNA, 13 nt, Homo sapiens
acacccuucccca

SEQ ID NO: 1667723 - RNA, 18 nt, Homo sapiens
acacgaacaaaccaagga

SEQ ID NO: 1667724 - RNA, 18 nt, Homo sapiens
acacgccacaacuccagu

SEQ ID NO: 1667725 - RNA, 19 nt, Homo sapiens
acacgcguccacauacacu

SEQ ID NO: 1667726 - RNA, 15 nt, Homo sapiens
acacucaccauuuaa

SEQ ID NO: 1667727 - RNA, 20 nt, Homo sapiens
acacucgugugcaugagaau

SEQ ID NO: 1667728 - RNA, 22 nt, Homo sapiens
acacucgugugcaugagaaugu

SEQ ID NO: 1667729 - RNA, 19 nt, Homo sapiens
acacugaucacuuccccaa

SEQ ID NO: 1667730 - RNA, 14 nt, Homo sapiens
acacugcuugugaa

SEQ ID NO: 1667731 - RNA, 15 nt, Homo sapiens
acacuguacugcaau

SEQ ID NO: 1667732 - RNA, 14 nt, Homo sapiens
acacuguagucaga

SEQ ID NO: 1667733 - RNA, 19 nt, Homo sapiens
acacuugacaucaacugca

SEQ ID NO: 1667734 - RNA, 17 nt, Homo sapiens
acacuugggagcaaaag

SEQ ID NO: 1667735 - RNA, 21 nt, Homo sapiens
acagaaccaacgggucugugg

SEQ ID NO: 1667736 - RNA, 13 nt, Homo sapiens
acagaaucucagu

SEQ ID NO: 1667737 - RNA, 21 nt, Homo sapiens
acagaccagcauaguucugca

SEQ ID NO: 1667738 - RNA, 18 nt, Homo sapiens
acagaccgggguggaguc

SEQ ID NO: 1667739 - RNA, 15 nt, Homo sapiens
acagacucugugaga

SEQ ID NO: 1667740 - RNA, 14 nt, Homo sapiens
acagagaucagaau

SEQ ID NO: 1667741 - RNA, 19 nt, Homo sapiens
acagagaucagaauugaac

SEQ ID NO: 1667742 - RNA, 21 nt, Homo sapiens
acagagcaagaccccaucuca

SEQ ID NO: 1667743 - RNA, 12 nt, Homo sapiens
acagagcgagac

SEQ ID NO: 1667744 - RNA, 20 nt, Homo sapiens
acagagcgagacuccaucuc

SEQ ID NO: 1667745 - RNA, 16 nt, Homo sapiens
acagaucaaaugugaa

SEQ ID NO: 1667746 - RNA, 13 nt, Homo sapiens
acagauccauccu

SEQ ID NO: 1667747 - RNA, 19 nt, Homo sapiens
acagaucuugagcaaggca

SEQ ID NO: 1667748 - RNA, 15 nt, Homo sapiens
acagauugcugcuuc

SEQ ID NO: 1667749 - RNA, 20 nt, Homo sapiens
acagauuuccaaaaguacua

SEQ ID NO: 1667750 - RNA, 13 nt, Homo sapiens
acagauuuguuca

SEQ ID NO: 1667751 - RNA, 19 nt, Homo sapiens
acagcagcaaaggucacca

SEQ ID NO: 1667752 - RNA, 16 nt, Homo sapiens
acagcagccucugaag

SEQ ID NO: 1667753 - RNA, 14 nt, Homo sapiens
acagcagcuggacu

SEQ ID NO: 1667754 - RNA, 16 nt, Homo sapiens
acagcauaauugccuu

SEQ ID NO: 1667755 - RNA, 17 nt, Homo sapiens
acagccagcuccuggcu

SEQ ID NO: 1667756 - RNA, 12 nt, Homo sapiens
acagccaugauu

SEQ ID NO: 1667757 - RNA, 22 nt, Homo sapiens
acagccaugauucuuuugccca

SEQ ID NO: 1667758 - RNA, 20 nt, Homo sapiens
acagccugcacacaccugcc

SEQ ID NO: 1667759 - RNA, 16 nt, Homo sapiens
acagcucagaaaauca

SEQ ID NO: 1667760 - RNA, 23 nt, Homo sapiens
acagcucuccuccagcccugggc

SEQ ID NO: 1667761 - RNA, 18 nt, Homo sapiens
acagcuguauuaucuuaa

SEQ ID NO: 1667762 - RNA, 18 nt, Homo sapiens
acaggaaaaaaacuuuua

SEQ ID NO: 1667763 - RNA, 15 nt, Homo sapiens
acaggaaaagggcau

SEQ ID NO: 1667764 - RNA, 18 nt, Homo sapiens
acaggagaagaaacagca

SEQ ID NO: 1667765 - RNA, 21 nt, Homo sapiens
acaggagcguguacuacccca

SEQ ID NO: 1667766 - RNA, 15 nt, Homo sapiens
acagggcguccucuc

SEQ ID NO: 1667767 - RNA, 21 nt, Homo sapiens
acaguagcauacugaugagac

SEQ ID NO: 1667768 - RNA, 23 nt, Homo sapiens
acaguauuuccauacgugcccau

SEQ ID NO: 1667769 - RNA, 20 nt, Homo sapiens
acagugaaaccccgucucua

SEQ ID NO: 1667770 - RNA, 15 nt, Homo sapiens
acagugacaccugca

SEQ ID NO: 1667771 - RNA, 15 nt, Homo sapiens
acagugcaguacuca

SEQ ID NO: 1667772 - RNA, 17 nt, Homo sapiens
acagugcaguacucagu

SEQ ID NO: 1667773 - RNA, 11 nt, Homo sapiens
acagugcagug

SEQ ID NO: 1667774 - RNA, 15 nt, Homo sapiens
acagugcagugcuca

SEQ ID NO: 1667775 - RNA, 18 nt, Homo sapiens
acagugccaauaaaugau

SEQ ID NO: 1667776 - RNA, 21 nt, Homo sapiens
acaguuaagagaaaugagcuu

SEQ ID NO: 1667777 - RNA, 19 nt, Homo sapiens
acaguuggauacaggagaa

SEQ ID NO: 1667778 - RNA, 13 nt, Homo sapiens
acauaacacacau

SEQ ID NO: 1667779 - RNA, 14 nt, Homo sapiens
acauacacacacac

SEQ ID NO: 1667780 - RNA, 17 nt, Homo sapiens
acauacgcacugggcau

SEQ ID NO: 1667781 - RNA, 21 nt, Homo sapiens
acauacuauagauucuuuauu

SEQ ID NO: 1667782 - RNA, 19 nt, Homo sapiens
acauaguguuuguaacacc

SEQ ID NO: 1667783 - RNA, 17 nt, Homo sapiens
acauauagcuuugcaac

SEQ ID NO: 1667784 - RNA, 22 nt, Homo sapiens
acauaucauucagaaugugcaa

SEQ ID NO: 1667785 - RNA, 13 nt, Homo sapiens
acaucaacugcau

SEQ ID NO: 1667786 - RNA, 23 nt, Homo sapiens
acaucaacugcaucaagauguga

SEQ ID NO: 1667787 - RNA, 14 nt, Homo sapiens
acauccacaugcac

SEQ ID NO: 1667788 - RNA, 16 nt, Homo sapiens
acauccccuucugcaa

SEQ ID NO: 1667789 - RNA, 15 nt, Homo sapiens
acauccgacaccucc

SEQ ID NO: 1667790 - RNA, 17 nt, Homo sapiens
acaucucaucaugucua

SEQ ID NO: 1667791 - RNA, 16 nt, Homo sapiens
acaucugcauuucuac

SEQ ID NO: 1667792 - RNA, 13 nt, Homo sapiens
acaugacauccac

SEQ ID NO: 1667793 - RNA, 13 nt, Homo sapiens
acaugcacugacc

SEQ ID NO: 1667794 - RNA, 15 nt, Homo sapiens
acaugcacugacccu

SEQ ID NO: 1667795 - RNA, 20 nt, Homo sapiens
acaugccucucucaggccaa

SEQ ID NO: 1667796 - RNA, 15 nt, Homo sapiens
acauggccgcugccc

SEQ ID NO: 1667797 - RNA, 18 nt, Homo sapiens
acaugguaucucuuucuc

SEQ ID NO: 1667798 - RNA, 23 nt, Homo sapiens
acaugucuuuggcuucagaauug

SEQ ID NO: 1667799 - RNA, 16 nt, Homo sapiens
acaugugauugugauu

SEQ ID NO: 1667800 - RNA, 22 nt, Homo sapiens
acauguggcacguaaggucuca

SEQ ID NO: 1667801 - RNA, 19 nt, Homo sapiens
acauguugcuaaugacagu

SEQ ID NO: 1667802 - RNA, 22 nt, Homo sapiens
acauguuuuagacagagacaau

SEQ ID NO: 1667803 - RNA, 18 nt, Homo sapiens
acauuaagagauuuucaa

SEQ ID NO: 1667804 - RNA, 23 nt, Homo sapiens
acauuaagagauuuucaagauca

SEQ ID NO: 1667805 - RNA, 23 nt, Homo sapiens
acauuauagauuuucauguucuu

SEQ ID NO: 1667806 - RNA, 16 nt, Homo sapiens
acauuauugaaaagca

SEQ ID NO: 1667807 - RNA, 17 nt, Homo sapiens
acauuauuggacuucca

SEQ ID NO: 1667808 - RNA, 19 nt, Homo sapiens
acauucaccaacaacaguc

SEQ ID NO: 1667809 - RNA, 15 nt, Homo sapiens
acauucauccucaca

SEQ ID NO: 1667810 - RNA, 15 nt, Homo sapiens
acauucccccaacau

SEQ ID NO: 1667811 - RNA, 20 nt, Homo sapiens
acauuccugacccucacuuu

SEQ ID NO: 1667812 - RNA, 14 nt, Homo sapiens
acauuguaaaugau

SEQ ID NO: 1667813 - RNA, 19 nt, Homo sapiens
acauuuauuaguuccccaa

SEQ ID NO: 1667814 - RNA, 23 nt, Homo sapiens
acauuuccgugagagucaucuca

SEQ ID NO: 1667815 - RNA, 15 nt, Homo sapiens
acauuugaacagggc

SEQ ID NO: 1667816 - RNA, 13 nt, Homo sapiens
accaaaaacuggg

SEQ ID NO: 1667817 - RNA, 12 nt, Homo sapiens
accaaauacuuu

SEQ ID NO: 1667818 - RNA, 20 nt, Homo sapiens
accaaauacuuucugagaug

SEQ ID NO: 1667819 - RNA, 14 nt, Homo sapiens
accaacaacaguca

SEQ ID NO: 1667820 - RNA, 12 nt, Homo sapiens
accaaccacugc

SEQ ID NO: 1667821 - RNA, 13 nt, Homo sapiens
accacaacugaca

SEQ ID NO: 1667822 - RNA, 17 nt, Homo sapiens
accacaagaaggaugau

SEQ ID NO: 1667823 - RNA, 13 nt, Homo sapiens
accacagcugccu

SEQ ID NO: 1667824 - RNA, 15 nt, Homo sapiens
accacauccugaaaa

SEQ ID NO: 1667825 - RNA, 16 nt, Homo sapiens
accacauccugaaaag

SEQ ID NO: 1667826 - RNA, 20 nt, Homo sapiens
accacauccugaaaagggug

SEQ ID NO: 1667827 - RNA, 17 nt, Homo sapiens
accacccucgcugccac

SEQ ID NO: 1667828 - RNA, 14 nt, Homo sapiens
accaccgacucuca

SEQ ID NO: 1667829 - RNA, 18 nt, Homo sapiens
accacugugucccagugu

SEQ ID NO: 1667830 - RNA, 22 nt, Homo sapiens
accacuuucccacacugugaac

SEQ ID NO: 1667831 - RNA, 19 nt, Homo sapiens
accagaauggggacaucuu

SEQ ID NO: 1667832 - RNA, 20 nt, Homo sapiens
accagagaaaugaaagucag

SEQ ID NO: 1667833 - RNA, 14 nt, Homo sapiens
accagagacucuga

SEQ ID NO: 1667834 - RNA, 21 nt, Homo sapiens
accagagauuuuccucuccaa

SEQ ID NO: 1667835 - RNA, 16 nt, Homo sapiens
accagagcgauguguu

SEQ ID NO: 1667836 - RNA, 13 nt, Homo sapiens
accagagcugcca

SEQ ID NO: 1667837 - RNA, 13 nt, Homo sapiens
accagcaaugaga

SEQ ID NO: 1667838 - RNA, 17 nt, Homo sapiens
accagcgugaacccuca

SEQ ID NO: 1667839 - RNA, 16 nt, Homo sapiens
accaggcuuccaagaa

SEQ ID NO: 1667840 - RNA, 19 nt, Homo sapiens
accaggugucucugagaau

SEQ ID NO: 1667841 - RNA, 15 nt, Homo sapiens
accagguuaccucac

SEQ ID NO: 1667842 - RNA, 19 nt, Homo sapiens
accaucaaacaaaucauuu

SEQ ID NO: 1667843 - RNA, 11 nt, Homo sapiens
accaugaucac

SEQ ID NO: 1667844 - RNA, 14 nt, Homo sapiens
accauggccagcua

SEQ ID NO: 1667845 - RNA, 14 nt, Homo sapiens
accauguugccaau

SEQ ID NO: 1667846 - RNA, 20 nt, Homo sapiens
accauugcuucacuacccau

SEQ ID NO: 1667847 - RNA, 21 nt, Homo sapiens
accauuuugaaauauucacaa

SEQ ID NO: 1667848 - RNA, 20 nt, Homo sapiens
acccaaauaaauguguaaau

SEQ ID NO: 1667849 - RNA, 14 nt, Homo sapiens
acccaagcauuugu

SEQ ID NO: 1667850 - RNA, 20 nt, Homo sapiens
acccaaguuggagugcagug

SEQ ID NO: 1667851 - RNA, 22 nt, Homo sapiens
acccaauuaaguccuacuuuac

SEQ ID NO: 1667852 - RNA, 14 nt, Homo sapiens
acccacgugccugc

SEQ ID NO: 1667853 - RNA, 15 nt, Homo sapiens
acccacugccagaca

SEQ ID NO: 1667854 - RNA, 19 nt, Homo sapiens
acccacugccagacaugcc

SEQ ID NO: 1667855 - RNA, 23 nt, Homo sapiens
acccagacguggugcuucucaca

SEQ ID NO: 1667856 - RNA, 21 nt, Homo sapiens
acccagauugaagcuaaaaua

SEQ ID NO: 1667857 - RNA, 18 nt, Homo sapiens
acccagcccaaccgggaa

SEQ ID NO: 1667858 - RNA, 23 nt, Homo sapiens
acccauaggucuuaagaugcaaa

SEQ ID NO: 1667859 - RNA, 21 nt, Homo sapiens
acccauguucucaauacccac

SEQ ID NO: 1667860 - RNA, 21 nt, Homo sapiens
acccauucuguuccaccacug

SEQ ID NO: 1667861 - RNA, 17 nt, Homo sapiens
acccauugucauccugu

SEQ ID NO: 1667862 - RNA, 23 nt, Homo sapiens
accccacacuugcagagcugcug

SEQ ID NO: 1667863 - RNA, 20 nt, Homo sapiens
accccagaacgcaugcaggg

SEQ ID NO: 1667864 - RNA, 18 nt, Homo sapiens
accccauccucacacaga

SEQ ID NO: 1667865 - RNA, 15 nt, Homo sapiens
accccauucugggac

SEQ ID NO: 1667866 - RNA, 16 nt, Homo sapiens
accccguucccagcgc

SEQ ID NO: 1667867 - RNA, 20 nt, Homo sapiens
accccugggggaggcuucca

SEQ ID NO: 1667868 - RNA, 15 nt, Homo sapiens
acccgggagcagugu

SEQ ID NO: 1667869 - RNA, 16 nt, Homo sapiens
acccucaccugaauaa

SEQ ID NO: 1667870 - RNA, 23 nt, Homo sapiens
acccucagaauauuaagcacauu

SEQ ID NO: 1667871 - RNA, 13 nt, Homo sapiens
acccucugcugca

SEQ ID NO: 1667872 - RNA, 15 nt, Homo sapiens
acccuggaccgagug

SEQ ID NO: 1667873 - RNA, 17 nt, Homo sapiens
acccugggucaccuucc

SEQ ID NO: 1667874 - RNA, 23 nt, Homo sapiens
acccuggugaccagcaccaucuc

SEQ ID NO: 1667875 - RNA, 21 nt, Homo sapiens
acccuucccaaucagcacuga

SEQ ID NO: 1667876 - RNA, 15 nt, Homo sapiens
acccuugacuguuau

SEQ ID NO: 1667877 - RNA, 14 nt, Homo sapiens
accgauaugcacuu

SEQ ID NO: 1667878 - RNA, 19 nt, Homo sapiens
accgggcuggccugacaca

SEQ ID NO: 1667879 - RNA, 21 nt, Homo sapiens
accguccagcaagugucauca

SEQ ID NO: 1667880 - RNA, 20 nt, Homo sapiens
accuaagaaauagcaucgau

SEQ ID NO: 1667881 - RNA, 13 nt, Homo sapiens
accuacugcugag

SEQ ID NO: 1667882 - RNA, 19 nt, Homo sapiens
accuaguccccagccugcu

SEQ ID NO: 1667883 - RNA, 23 nt, Homo sapiens
accuaugugugugcuuugccacu

SEQ ID NO: 1667884 - RNA, 13 nt, Homo sapiens
accucacagugac

SEQ ID NO: 1667885 - RNA, 21 nt, Homo sapiens
accucaccccguuacagcucc

SEQ ID NO: 1667886 - RNA, 20 nt, Homo sapiens
accucaggaccaugugauaa

SEQ ID NO: 1667887 - RNA, 14 nt, Homo sapiens
accucauuugcauc

SEQ ID NO: 1667888 - RNA, 16 nt, Homo sapiens
accuccagaggugaug

SEQ ID NO: 1667889 - RNA, 20 nt, Homo sapiens
accuccucccaagcacuuca

SEQ ID NO: 1667890 - RNA, 16 nt, Homo sapiens
accuccuccuccaguu

SEQ ID NO: 1667891 - RNA, 21 nt, Homo sapiens
accuccuccuccaguucugau

SEQ ID NO: 1667892 - RNA, 23 nt, Homo sapiens
accucgaguggcgaguccagaca

SEQ ID NO: 1667893 - RNA, 12 nt, Homo sapiens
accucggcugug

SEQ ID NO: 1667894 - RNA, 14 nt, Homo sapiens
accucuacuuucca

SEQ ID NO: 1667895 - RNA, 13 nt, Homo sapiens
accucuauauguu

SEQ ID NO: 1667896 - RNA, 12 nt, Homo sapiens
accucugaccaa

SEQ ID NO: 1667897 - RNA, 23 nt, Homo sapiens
accucuuuggauguuuuccccaa

SEQ ID NO: 1667898 - RNA, 11 nt, Homo sapiens
accugaagucu

SEQ ID NO: 1667899 - RNA, 14 nt, Homo sapiens
accugacacaagag

SEQ ID NO: 1667900 - RNA, 15 nt, Homo sapiens
accugaccagacugu

SEQ ID NO: 1667901 - RNA, 16 nt, Homo sapiens
accugaggccaaauau

SEQ ID NO: 1667902 - RNA, 16 nt, Homo sapiens
accugauuuccauuug

SEQ ID NO: 1667903 - RNA, 17 nt, Homo sapiens
accugcacuuacaggcc

SEQ ID NO: 1667904 - RNA, 18 nt, Homo sapiens
accugcuucauucaagcu

SEQ ID NO: 1667905 - RNA, 22 nt, Homo sapiens
accuggcuucccaggacccugg

SEQ ID NO: 1667906 - RNA, 17 nt, Homo sapiens
accugggguuuugacuu

SEQ ID NO: 1667907 - RNA, 21 nt, Homo sapiens
accugggguuuugacuugcca

SEQ ID NO: 1667908 - RNA, 19 nt, Homo sapiens
accuggguaacaaagugag

SEQ ID NO: 1667909 - RNA, 19 nt, Homo sapiens
accugucaaccugaauuaa

SEQ ID NO: 1667910 - RNA, 15 nt, Homo sapiens
accuuccccugagga

SEQ ID NO: 1667911 - RNA, 23 nt, Homo sapiens
accuucuaauccaugugcugcug

SEQ ID NO: 1667912 - RNA, 23 nt, Homo sapiens
accuucugccaaggccagcccac

SEQ ID NO: 1667913 - RNA, 11 nt, Homo sapiens
accuugcccau

SEQ ID NO: 1667914 - RNA, 19 nt, Homo sapiens
accuuucugaggaguaaaa

SEQ ID NO: 1667915 - RNA, 12 nt, Homo sapiens
accuuugucaac

SEQ ID NO: 1667916 - RNA, 17 nt, Homo sapiens
accuuuuuucaccccac

SEQ ID NO: 1667917 - RNA, 20 nt, Homo sapiens
acgaguguagucccggaggc

SEQ ID NO: 1667918 - RNA, 17 nt, Homo sapiens
acgauaugcaaguucau

SEQ ID NO: 1667919 - RNA, 22 nt, Homo sapiens
acgauuauaguaccacugcaca

SEQ ID NO: 1667920 - RNA, 12 nt, Homo sapiens
acgcaugcaggg

SEQ ID NO: 1667921 - RNA, 10 nt, Homo sapiens
acgccuccau

SEQ ID NO: 1667922 - RNA, 15 nt, Homo sapiens
acgccuccuggccag

SEQ ID NO: 1667923 - RNA, 19 nt, Homo sapiens
acgcucaguaaccaugcaa

SEQ ID NO: 1667924 - RNA, 23 nt, Homo sapiens
acggccugagaggagcguguccu

SEQ ID NO: 1667925 - RNA, 17 nt, Homo sapiens
acggcuaagaggcugcu

SEQ ID NO: 1667926 - RNA, 13 nt, Homo sapiens
acggcuuccccau

SEQ ID NO: 1667927 - RNA, 15 nt, Homo sapiens
acgguguccaugccu

SEQ ID NO: 1667928 - RNA, 20 nt, Homo sapiens
acgguuucuuuguuacuuua

SEQ ID NO: 1667929 - RNA, 20 nt, Homo sapiens
acguccugggugcugucaug

SEQ ID NO: 1667930 - RNA, 13 nt, Homo sapiens
acgugacuccuca

SEQ ID NO: 1667931 - RNA, 22 nt, Homo sapiens
acgugagguuucaguagcuccu

SEQ ID NO: 1667932 - RNA, 15 nt, Homo sapiens
acgugcccauuucac

SEQ ID NO: 1667933 - RNA, 12 nt, Homo sapiens
acgugugaggau

SEQ ID NO: 1667934 - RNA, 14 nt, Homo sapiens
acuaacagccucag

SEQ ID NO: 1667935 - RNA, 23 nt, Homo sapiens
acuaacugaggagcuaguguuaa

SEQ ID NO: 1667936 - RNA, 18 nt, Homo sapiens
acuaacugcaaaugcauc

SEQ ID NO: 1667937 - RNA, 16 nt, Homo sapiens
acuaauccucucugca

SEQ ID NO: 1667938 - RNA, 16 nt, Homo sapiens
acuaaugacaagugac

SEQ ID NO: 1667939 - RNA, 16 nt, Homo sapiens
acuaauuaaacugaug

SEQ ID NO: 1667940 - RNA, 21 nt, Homo sapiens
acuacaaacauggggagccau

SEQ ID NO: 1667941 - RNA, 17 nt, Homo sapiens
acuacaggcaccugcca

SEQ ID NO: 1667942 - RNA, 14 nt, Homo sapiens
acuacagugagaaa

SEQ ID NO: 1667943 - RNA, 12 nt, Homo sapiens
acuacauuugca

SEQ ID NO: 1667944 - RNA, 20 nt, Homo sapiens
acuaccccaggacgcaugca

SEQ ID NO: 1667945 - RNA, 23 nt, Homo sapiens
acuaccccaggacgcaugcaggg

SEQ ID NO: 1667946 - RNA, 16 nt, Homo sapiens
acuacgacuggcaucu

SEQ ID NO: 1667947 - RNA, 22 nt, Homo sapiens
acuagaaccuucuaauccaugu

SEQ ID NO: 1667948 - RNA, 14 nt, Homo sapiens
acuagaagcacagg

SEQ ID NO: 1667949 - RNA, 16 nt, Homo sapiens
acuagauauagcuuuu

SEQ ID NO: 1667950 - RNA, 13 nt, Homo sapiens
acuauuucuuuca

SEQ ID NO: 1667951 - RNA, 23 nt, Homo sapiens
acucagcaacuguuagcugggaa

SEQ ID NO: 1667952 - RNA, 16 nt, Homo sapiens
acucaggcagugcagu

SEQ ID NO: 1667953 - RNA, 17 nt, Homo sapiens
acucaggcagugcagua

SEQ ID NO: 1667954 - RNA, 20 nt, Homo sapiens
acucaguaacacagugcagu

SEQ ID NO: 1667955 - RNA, 21 nt, Homo sapiens
acucaguaacacagugcagua

SEQ ID NO: 1667956 - RNA, 20 nt, Homo sapiens
acucaguuaggcagugcagu

SEQ ID NO: 1667957 - RNA, 22 nt, Homo sapiens
acucaguuaggcagugcaguac

SEQ ID NO: 1667958 - RNA, 21 nt, Homo sapiens
acucaucuugggaagggccau

SEQ ID NO: 1667959 - RNA, 21 nt, Homo sapiens
acuccaguuugcccaccacaa

SEQ ID NO: 1667960 - RNA, 16 nt, Homo sapiens
acuccauuacuaaaga

SEQ ID NO: 1667961 - RNA, 13 nt, Homo sapiens
acucccuaagucc

SEQ ID NO: 1667962 - RNA, 13 nt, Homo sapiens
acucccugcuuag

SEQ ID NO: 1667963 - RNA, 14 nt, Homo sapiens
acuccucugucaua

SEQ ID NO: 1667964 - RNA, 14 nt, Homo sapiens
acuccuuacagaag

SEQ ID NO: 1667965 - RNA, 15 nt, Homo sapiens
acucggcgugcuccu

SEQ ID NO: 1667966 - RNA, 23 nt, Homo sapiens
acucgugugcaugagaaugucau

SEQ ID NO: 1667967 - RNA, 14 nt, Homo sapiens
acucuaaaacuauc

SEQ ID NO: 1667968 - RNA, 15 nt, Homo sapiens
acucuagacuaaaga

SEQ ID NO: 1667969 - RNA, 17 nt, Homo sapiens
acucucagucaguguca

SEQ ID NO: 1667970 - RNA, 18 nt, Homo sapiens
acucucagucagugucau

SEQ ID NO: 1667971 - RNA, 18 nt, Homo sapiens
acucucccuuguccuucu

SEQ ID NO: 1667972 - RNA, 18 nt, Homo sapiens
acucucuacuacacaggc

SEQ ID NO: 1667973 - RNA, 15 nt, Homo sapiens
acucugaauuuccag

SEQ ID NO: 1667974 - RNA, 18 nt, Homo sapiens
acucugacgcaaaaccac

SEQ ID NO: 1667975 - RNA, 16 nt, Homo sapiens
acucuuauuucacuaa

SEQ ID NO: 1667976 - RNA, 14 nt, Homo sapiens
acugacacaggaaa

SEQ ID NO: 1667977 - RNA, 23 nt, Homo sapiens
acugacgcucaguaaccaugcaa

SEQ ID NO: 1667978 - RNA, 13 nt, Homo sapiens
acugacugacuua

SEQ ID NO: 1667979 - RNA, 18 nt, Homo sapiens
acugaguuagaauguuga

SEQ ID NO: 1667980 - RNA, 18 nt, Homo sapiens
acugaguuugaacacaga

SEQ ID NO: 1667981 - RNA, 13 nt, Homo sapiens
acugaugagacaa

SEQ ID NO: 1667982 - RNA, 16 nt, Homo sapiens
acugauuaacucaguc

SEQ ID NO: 1667983 - RNA, 15 nt, Homo sapiens
acugcaacacuggau

SEQ ID NO: 1667984 - RNA, 12 nt, Homo sapiens
acugcaaccucc

SEQ ID NO: 1667985 - RNA, 13 nt, Homo sapiens
acugccccugcac

SEQ ID NO: 1667986 - RNA, 17 nt, Homo sapiens
acugccucugccuuaga

SEQ ID NO: 1667987 - RNA, 21 nt, Homo sapiens
acugccuuucaaagugcacac

SEQ ID NO: 1667988 - RNA, 16 nt, Homo sapiens
acugcuacugaccauc

SEQ ID NO: 1667989 - RNA, 13 nt, Homo sapiens
acugcuccagugg

SEQ ID NO: 1667990 - RNA, 13 nt, Homo sapiens
acugcugcuuaaa

SEQ ID NO: 1667991 - RNA, 18 nt, Homo sapiens
acugcuugugcacuggau

SEQ ID NO: 1667992 - RNA, 19 nt, Homo sapiens
acugcuugugcacuggaug

SEQ ID NO: 1667993 - RNA, 21 nt, Homo sapiens
acugcuuuuuccuuagcuuaa

SEQ ID NO: 1667994 - RNA, 17 nt, Homo sapiens
acuggaacacuaaugag

SEQ ID NO: 1667995 - RNA, 21 nt, Homo sapiens
acuggagccugcaauaaggga

SEQ ID NO: 1667996 - RNA, 22 nt, Homo sapiens
acuggauguggccccacccuuu

SEQ ID NO: 1667997 - RNA, 15 nt, Homo sapiens
acuggggaagccagu

SEQ ID NO: 1667998 - RNA, 14 nt, Homo sapiens
acuguaaaauacau

SEQ ID NO: 1667999 - RNA, 19 nt, Homo sapiens
acuguagucagaccucagc

SEQ ID NO: 1668000 - RNA, 16 nt, Homo sapiens
acuguauuacauaaau

SEQ ID NO: 1668001 - RNA, 12 nt, Homo sapiens
acugucaugccc

SEQ ID NO: 1668002 - RNA, 12 nt, Homo sapiens
acugugacugug

SEQ ID NO: 1668003 - RNA, 20 nt, Homo sapiens
acugugcguuuuagaguaug

SEQ ID NO: 1668004 - RNA, 22 nt, Homo sapiens
acuguuaaauaaggccucaucc

SEQ ID NO: 1668005 - RNA, 14 nt, Homo sapiens
acuguuagacaaaa

SEQ ID NO: 1668006 - RNA, 17 nt, Homo sapiens
acuguugcauaacuauu

SEQ ID NO: 1668007 - RNA, 20 nt, Homo sapiens
acuuaaaccugugcuuucau

SEQ ID NO: 1668008 - RNA, 19 nt, Homo sapiens
acuuaacagaucacaugcc

SEQ ID NO: 1668009 - RNA, 19 nt, Homo sapiens
acuuaagcacacuugacau

SEQ ID NO: 1668010 - RNA, 19 nt, Homo sapiens
acuuacuaaaucuacucuu

SEQ ID NO: 1668011 - RNA, 22 nt, Homo sapiens
acuuagagcacuagaagcacag

SEQ ID NO: 1668012 - RNA, 16 nt, Homo sapiens
acuuauuucagauuca

SEQ ID NO: 1668013 - RNA, 16 nt, Homo sapiens
acuucaaaauauugag

SEQ ID NO: 1668014 - RNA, 17 nt, Homo sapiens
acuucacaaaaugcaag

SEQ ID NO: 1668015 - RNA, 23 nt, Homo sapiens
acuuccauagcuucauccacuga

SEQ ID NO: 1668016 - RNA, 12 nt, Homo sapiens
acuuccuuaaca

SEQ ID NO: 1668017 - RNA, 15 nt, Homo sapiens
acuuccuuaacagcu

SEQ ID NO: 1668018 - RNA, 19 nt, Homo sapiens
acuucuuuacuaacacugg

SEQ ID NO: 1668019 - RNA, 20 nt, Homo sapiens
acuucuuuacuaacacuggc

SEQ ID NO: 1668020 - RNA, 20 nt, Homo sapiens
acuucuuuauucacaguauc

SEQ ID NO: 1668021 - RNA, 22 nt, Homo sapiens
acuucuuuuuggcauuaucucu

SEQ ID NO: 1668022 - RNA, 16 nt, Homo sapiens
acuugaaaacuucuca

SEQ ID NO: 1668023 - RNA, 16 nt, Homo sapiens
acuugcacccaugugu

SEQ ID NO: 1668024 - RNA, 22 nt, Homo sapiens
acuugcaugcagcagcuuuuga

SEQ ID NO: 1668025 - RNA, 19 nt, Homo sapiens
acuugcccugaccaugcau

SEQ ID NO: 1668026 - RNA, 20 nt, Homo sapiens
acuuggauaggagcuuccag

SEQ ID NO: 1668027 - RNA, 20 nt, Homo sapiens
acuugggcuggcacccacug

SEQ ID NO: 1668028 - RNA, 18 nt, Homo sapiens
acuuggugauuaccugaa

SEQ ID NO: 1668029 - RNA, 20 nt, Homo sapiens
acuuggugauuaccugaaag

SEQ ID NO: 1668030 - RNA, 19 nt, Homo sapiens
acuuguacuuacacugaaa

SEQ ID NO: 1668031 - RNA, 20 nt, Homo sapiens
acuuuagcauugggugcaaa

SEQ ID NO: 1668032 - RNA, 22 nt, Homo sapiens
acuuuagguaguagaaucucag

SEQ ID NO: 1668033 - RNA, 13 nt, Homo sapiens
acuuuccucucuc

SEQ ID NO: 1668034 - RNA, 20 nt, Homo sapiens
acuuucucuaggaaucaaag

SEQ ID NO: 1668035 - RNA, 21 nt, Homo sapiens
acuuugaauuuuuuuuauguc

SEQ ID NO: 1668036 - RNA, 13 nt, Homo sapiens
acuuugcuuuuag

SEQ ID NO: 1668037 - RNA, 22 nt, Homo sapiens
acuuuuccccauugacccucac

SEQ ID NO: 1668038 - RNA, 23 nt, Homo sapiens
acuuuuuuuuuuuuuugguugca

SEQ ID NO: 1668039 - RNA, 15 nt, Homo sapiens
agaaaaaacaccacc

SEQ ID NO: 1668040 - RNA, 17 nt, Homo sapiens
agaaaauaaauacauaa

SEQ ID NO: 1668041 - RNA, 15 nt, Homo sapiens
agaaaaucacacuua

SEQ ID NO: 1668042 - RNA, 20 nt, Homo sapiens
agaaaauggaugacaaagaa

SEQ ID NO: 1668043 - RNA, 17 nt, Homo sapiens
agaaaauuagcaugaaa

SEQ ID NO: 1668044 - RNA, 18 nt, Homo sapiens
agaaacacagcaugcauu

SEQ ID NO: 1668045 - RNA, 12 nt, Homo sapiens
agaaacaugaca

SEQ ID NO: 1668046 - RNA, 15 nt, Homo sapiens
agaaagaaaccagac

SEQ ID NO: 1668047 - RNA, 15 nt, Homo sapiens
agaaauaaagcacau

SEQ ID NO: 1668048 - RNA, 14 nt, Homo sapiens
agaaauaugagcau

SEQ ID NO: 1668049 - RNA, 16 nt, Homo sapiens
agaaauuuuaucucuu

SEQ ID NO: 1668050 - RNA, 21 nt, Homo sapiens
agaaauuuuaucucuucuucc

SEQ ID NO: 1668051 - RNA, 17 nt, Homo sapiens
agaaccaaccaaugaaa

SEQ ID NO: 1668052 - RNA, 13 nt, Homo sapiens
agaaccaccauuc

SEQ ID NO: 1668053 - RNA, 14 nt, Homo sapiens
agaacccaaacuuc

SEQ ID NO: 1668054 - RNA, 20 nt, Homo sapiens
agaaccccccgcaaugugcu

SEQ ID NO: 1668055 - RNA, 17 nt, Homo sapiens
agaaccuucccgucuga

SEQ ID NO: 1668056 - RNA, 18 nt, Homo sapiens
agaaccuuuugagugccu

SEQ ID NO: 1668057 - RNA, 14 nt, Homo sapiens
agaacgcaugcagg

SEQ ID NO: 1668058 - RNA, 17 nt, Homo sapiens
agaacguggauugugaa

SEQ ID NO: 1668059 - RNA, 21 nt, Homo sapiens
agaacuucguacccuuugcac

SEQ ID NO: 1668060 - RNA, 21 nt, Homo sapiens
agaagaaguuugaccaucacc

SEQ ID NO: 1668061 - RNA, 21 nt, Homo sapiens
agaagaauauguauguuucua

SEQ ID NO: 1668062 - RNA, 16 nt, Homo sapiens
agaagacaccaccauu

SEQ ID NO: 1668063 - RNA, 18 nt, Homo sapiens
agaagagaguauggugcu

SEQ ID NO: 1668064 - RNA, 20 nt, Homo sapiens
agaagagggguauaggacaa

SEQ ID NO: 1668065 - RNA, 17 nt, Homo sapiens
agaagauuagcaugaaa

SEQ ID NO: 1668066 - RNA, 18 nt, Homo sapiens
agaagcaaaccugauaca

SEQ ID NO: 1668067 - RNA, 23 nt, Homo sapiens
agaagcccuucuaccuuccugca

SEQ ID NO: 1668068 - RNA, 19 nt, Homo sapiens
agaaggcaggaacacugga

SEQ ID NO: 1668069 - RNA, 21 nt, Homo sapiens
agaagggcagcuccacagggc

SEQ ID NO: 1668070 - RNA, 16 nt, Homo sapiens
agaaggguucagccca

SEQ ID NO: 1668071 - RNA, 23 nt, Homo sapiens
agaaguacagggcagaaccaaga

SEQ ID NO: 1668072 - RNA, 13 nt, Homo sapiens
agaaguuucugcc

SEQ ID NO: 1668073 - RNA, 18 nt, Homo sapiens
agaauacuaauaaaauac

SEQ ID NO: 1668074 - RNA, 18 nt, Homo sapiens
agaauauuaagcacauua

SEQ ID NO: 1668075 - RNA, 14 nt, Homo sapiens
agaauauuguuaaa

SEQ ID NO: 1668076 - RNA, 17 nt, Homo sapiens
agaaucaacagugaaca

SEQ ID NO: 1668077 - RNA, 18 nt, Homo sapiens
agaaucgaccucacuguc

SEQ ID NO: 1668078 - RNA, 16 nt, Homo sapiens
agaaucucagcacuuu

SEQ ID NO: 1668079 - RNA, 13 nt, Homo sapiens
agaaucucagucu

SEQ ID NO: 1668080 - RNA, 11 nt, Homo sapiens
agaaucugugc

SEQ ID NO: 1668081 - RNA, 14 nt, Homo sapiens
agaaugaaaggcaa

SEQ ID NO: 1668082 - RNA, 19 nt, Homo sapiens
agaaugcaccccugagggu

SEQ ID NO: 1668083 - RNA, 14 nt, Homo sapiens
agaauggagcagua

SEQ ID NO: 1668084 - RNA, 21 nt, Homo sapiens
agaauggggcuuccauggugg

SEQ ID NO: 1668085 - RNA, 13 nt, Homo sapiens
agaauggugggcu

SEQ ID NO: 1668086 - RNA, 16 nt, Homo sapiens
agaauggugggcucca

SEQ ID NO: 1668087 - RNA, 15 nt, Homo sapiens
agaaugucaguugau

SEQ ID NO: 1668088 - RNA, 15 nt, Homo sapiens
agaauuaaugacaac

SEQ ID NO: 1668089 - RNA, 21 nt, Homo sapiens
agaauuaaugacaacaaaagg

SEQ ID NO: 1668090 - RNA, 17 nt, Homo sapiens
agaauugaaaaaccauu

SEQ ID NO: 1668091 - RNA, 18 nt, Homo sapiens
agaauugaaaaaccauuu

SEQ ID NO: 1668092 - RNA, 18 nt, Homo sapiens
agaauugugcaaccauca

SEQ ID NO: 1668093 - RNA, 14 nt, Homo sapiens
agacacacauauac

SEQ ID NO: 1668094 - RNA, 18 nt, Homo sapiens
agacacaggccgggacaa

SEQ ID NO: 1668095 - RNA, 13 nt, Homo sapiens
agacacaguauug

SEQ ID NO: 1668096 - RNA, 20 nt, Homo sapiens
agacaccaauggauccuugu

SEQ ID NO: 1668097 - RNA, 14 nt, Homo sapiens
agacaccuagacuc

SEQ ID NO: 1668098 - RNA, 16 nt, Homo sapiens
agacacugucaagauu

SEQ ID NO: 1668099 - RNA, 14 nt, Homo sapiens
agacagaaucucag

SEQ ID NO: 1668100 - RNA, 14 nt, Homo sapiens
agacagagucuuac

SEQ ID NO: 1668101 - RNA, 14 nt, Homo sapiens
agacaguaaagacc

SEQ ID NO: 1668102 - RNA, 12 nt, Homo sapiens
agacagugcagu

SEQ ID NO: 1668103 - RNA, 16 nt, Homo sapiens
agacaguuucuugcaa

SEQ ID NO: 1668104 - RNA, 18 nt, Homo sapiens
agacauaaguaaaugagc

SEQ ID NO: 1668105 - RNA, 21 nt, Homo sapiens
agacauaaguaaaugagccuu

SEQ ID NO: 1668106 - RNA, 21 nt, Homo sapiens
agacauuuuuuaggggaauaa

SEQ ID NO: 1668107 - RNA, 13 nt, Homo sapiens
agacccucagacc

SEQ ID NO: 1668108 - RNA, 24 nt, Homo sapiens
agacgcaagagguuucagcauucc

SEQ ID NO: 1668109 - RNA, 19 nt, Homo sapiens
agacggauccacaguaauc

SEQ ID NO: 1668110 - RNA, 17 nt, Homo sapiens
agacgggguuucacugu

SEQ ID NO: 1668111 - RNA, 18 nt, Homo sapiens
agacuaacuuauuuugau

SEQ ID NO: 1668112 - RNA, 21 nt, Homo sapiens
agacuccagugacugcugccu

SEQ ID NO: 1668113 - RNA, 21 nt, Homo sapiens
agacucuuaaacuaacaauuc

SEQ ID NO: 1668114 - RNA, 19 nt, Homo sapiens
agacugcuucauugggaag

SEQ ID NO: 1668115 - RNA, 17 nt, Homo sapiens
agacuguagggaugaaa

SEQ ID NO: 1668116 - RNA, 16 nt, Homo sapiens
agacuguuagacaaaa

SEQ ID NO: 1668117 - RNA, 18 nt, Homo sapiens
agacuguuagacaaaagu

SEQ ID NO: 1668118 - RNA, 20 nt, Homo sapiens
agacuuggaugucauaucuu

SEQ ID NO: 1668119 - RNA, 13 nt, Homo sapiens
agagaacagggau

SEQ ID NO: 1668120 - RNA, 18 nt, Homo sapiens
agagaaucaacagaucaa

SEQ ID NO: 1668121 - RNA, 14 nt, Homo sapiens
agagaauucacuuu

SEQ ID NO: 1668122 - RNA, 18 nt, Homo sapiens
agagagaaacagcuugau

SEQ ID NO: 1668123 - RNA, 22 nt, Homo sapiens
agagagacccugccaacuuucc

SEQ ID NO: 1668124 - RNA, 17 nt, Homo sapiens
agagagauauaucugaa

SEQ ID NO: 1668125 - RNA, 15 nt, Homo sapiens
agagagcggcuuccc

SEQ ID NO: 1668126 - RNA, 17 nt, Homo sapiens
agagaguaucugagaac

SEQ ID NO: 1668127 - RNA, 16 nt, Homo sapiens
agagaucagaauugaa

SEQ ID NO: 1668128 - RNA, 20 nt, Homo sapiens
agagaucaggaagagaagga

SEQ ID NO: 1668129 - RNA, 20 nt, Homo sapiens
agagauccugcuugagcccu

SEQ ID NO: 1668130 - RNA, 20 nt, Homo sapiens
agagauuugguuaagcucac

SEQ ID NO: 1668131 - RNA, 15 nt, Homo sapiens
agagauuuuccugag

SEQ ID NO: 1668132 - RNA, 21 nt, Homo sapiens
agagcaaucuugcugugaaac

SEQ ID NO: 1668133 - RNA, 15 nt, Homo sapiens
agagcagaaccaaag

SEQ ID NO: 1668134 - RNA, 11 nt, Homo sapiens
agagccuccag

SEQ ID NO: 1668135 - RNA, 15 nt, Homo sapiens
agagcgucauguccu

SEQ ID NO: 1668136 - RNA, 21 nt, Homo sapiens
agagcuagaugugucuuacca

SEQ ID NO: 1668137 - RNA, 22 nt, Homo sapiens
agagcugacccccugcugccau

SEQ ID NO: 1668138 - RNA, 18 nt, Homo sapiens
agagcugauggagaagga

SEQ ID NO: 1668139 - RNA, 16 nt, Homo sapiens
agagcuuuacagugcc

SEQ ID NO: 1668140 - RNA, 23 nt, Homo sapiens
agagcuuuacagugccacgacau

SEQ ID NO: 1668141 - RNA, 23 nt, Homo sapiens
agaggaaauucccgccuaauaaa

SEQ ID NO: 1668142 - RNA, 12 nt, Homo sapiens
agaggacuggag

SEQ ID NO: 1668143 - RNA, 16 nt, Homo sapiens
agaggccaacugccca

SEQ ID NO: 1668144 - RNA, 12 nt, Homo sapiens
agaggccaugaa

SEQ ID NO: 1668145 - RNA, 18 nt, Homo sapiens
agaggcucuaauguacaa

SEQ ID NO: 1668146 - RNA, 18 nt, Homo sapiens
agaggcucuuccucucuu

SEQ ID NO: 1668147 - RNA, 22 nt, Homo sapiens
agagggaggcacguaggaacaa

SEQ ID NO: 1668148 - RNA, 16 nt, Homo sapiens
agaggggacaagccag

SEQ ID NO: 1668149 - RNA, 17 nt, Homo sapiens
agagggguauaggacaa

SEQ ID NO: 1668150 - RNA, 20 nt, Homo sapiens
agaggugaaugcacagugaa

SEQ ID NO: 1668151 - RNA, 19 nt, Homo sapiens
agagguggccccaccugag

SEQ ID NO: 1668152 - RNA, 14 nt, Homo sapiens
agagguggggugcu

SEQ ID NO: 1668153 - RNA, 14 nt, Homo sapiens
agaguaacccuguc

SEQ ID NO: 1668154 - RNA, 21 nt, Homo sapiens
agaguaacccugucuaaugaa

SEQ ID NO: 1668155 - RNA, 14 nt, Homo sapiens
agaguagagucacu

SEQ ID NO: 1668156 - RNA, 13 nt, Homo sapiens
agaguauguguau

SEQ ID NO: 1668157 - RNA, 17 nt, Homo sapiens
agagucaagcugaugaa

SEQ ID NO: 1668158 - RNA, 14 nt, Homo sapiens
agagucacuggaac

SEQ ID NO: 1668159 - RNA, 21 nt, Homo sapiens
agagucucuuuuuacacuuca

SEQ ID NO: 1668160 - RNA, 22 nt, Homo sapiens
agagucuuugauucaccaaaca

SEQ ID NO: 1668161 - RNA, 23 nt, Homo sapiens
agagucuuugauucaccaaacau

SEQ ID NO: 1668162 - RNA, 19 nt, Homo sapiens
agaguguggggaaugggaa

SEQ ID NO: 1668163 - RNA, 13 nt, Homo sapiens
agauaaaucaugg

SEQ ID NO: 1668164 - RNA, 22 nt, Homo sapiens
agauaaccuuaaacucugacca

SEQ ID NO: 1668165 - RNA, 15 nt, Homo sapiens
agauaguauacacau

SEQ ID NO: 1668166 - RNA, 14 nt, Homo sapiens
agauaguaugcacu

SEQ ID NO: 1668167 - RNA, 14 nt, Homo sapiens
agaucaaacuucca

SEQ ID NO: 1668168 - RNA, 23 nt, Homo sapiens
agaucaucuccaaaucuugccau

SEQ ID NO: 1668169 - RNA, 17 nt, Homo sapiens
agaucccagaguuauuu

SEQ ID NO: 1668170 - RNA, 21 nt, Homo sapiens
agaucuaauauugacugccuc

SEQ ID NO: 1668171 - RNA, 22 nt, Homo sapiens
agaucuaauauugacugccucu

SEQ ID NO: 1668172 - RNA, 15 nt, Homo sapiens
agaucuccugugcac

SEQ ID NO: 1668173 - RNA, 21 nt, Homo sapiens
agaucucuuucuaaagacagg

SEQ ID NO: 1668174 - RNA, 14 nt, Homo sapiens
agaucuuaagauuc

SEQ ID NO: 1668175 - RNA, 20 nt, Homo sapiens
agaugauaaucccauacucu

SEQ ID NO: 1668176 - RNA, 13 nt, Homo sapiens
agaugaucucucc

SEQ ID NO: 1668177 - RNA, 22 nt, Homo sapiens
agaugaugccaugggcccucuc

SEQ ID NO: 1668178 - RNA, 15 nt, Homo sapiens
agauggauuugacac

SEQ ID NO: 1668179 - RNA, 16 nt, Homo sapiens
agauggcaagugcacc

SEQ ID NO: 1668180 - RNA, 22 nt, Homo sapiens
agauggcuuccgugagacacaa

SEQ ID NO: 1668181 - RNA, 12 nt, Homo sapiens
agaugucugugu

SEQ ID NO: 1668182 - RNA, 17 nt, Homo sapiens
agaugucuguguauaca

SEQ ID NO: 1668183 - RNA, 16 nt, Homo sapiens
agaugugucuuaccag

SEQ ID NO: 1668184 - RNA, 13 nt, Homo sapiens
agauguugacuaa

SEQ ID NO: 1668185 - RNA, 13 nt, Homo sapiens
agauuaauggcac

SEQ ID NO: 1668186 - RNA, 16 nt, Homo sapiens
agauuaauggcacuga

SEQ ID NO: 1668187 - RNA, 19 nt, Homo sapiens
agauuauuuacugacauau

SEQ ID NO: 1668188 - RNA, 22 nt, Homo sapiens
agauucaauuaaguuauuaaca

SEQ ID NO: 1668189 - RNA, 19 nt, Homo sapiens
agauuccaccuagagcuag

SEQ ID NO: 1668190 - RNA, 18 nt, Homo sapiens
agauugauuaaugaacua

SEQ ID NO: 1668191 - RNA, 21 nt, Homo sapiens
agauugauuaaugaacuauug

SEQ ID NO: 1668192 - RNA, 15 nt, Homo sapiens
agauuguaaagguag

SEQ ID NO: 1668193 - RNA, 14 nt, Homo sapiens
agcaaaagauucua

SEQ ID NO: 1668194 - RNA, 17 nt, Homo sapiens
agcaaacacacucucac

SEQ ID NO: 1668195 - RNA, 21 nt, Homo sapiens
agcaaagacaguuucuugcaa

SEQ ID NO: 1668196 - RNA, 17 nt, Homo sapiens
agcaaauaaauaucauc

SEQ ID NO: 1668197 - RNA, 21 nt, Homo sapiens
agcaaauaucuaaauaauggc

SEQ ID NO: 1668198 - RNA, 20 nt, Homo sapiens
agcaaauuccaauacauuau

SEQ ID NO: 1668199 - RNA, 17 nt, Homo sapiens
agcaacaacuuacuaaa

SEQ ID NO: 1668200 - RNA, 13 nt, Homo sapiens
agcaacuguaaaa

SEQ ID NO: 1668201 - RNA, 17 nt, Homo sapiens
agcaagugucaucacuu

SEQ ID NO: 1668202 - RNA, 14 nt, Homo sapiens
agcaauaaguugaa

SEQ ID NO: 1668203 - RNA, 20 nt, Homo sapiens
agcaauaauugacaaacuuu

SEQ ID NO: 1668204 - RNA, 12 nt, Homo sapiens
agcaauauguca

SEQ ID NO: 1668205 - RNA, 17 nt, Homo sapiens
agcaauccugcaagaac

SEQ ID NO: 1668206 - RNA, 18 nt, Homo sapiens
agcaaugagaaggccagg

SEQ ID NO: 1668207 - RNA, 13 nt, Homo sapiens
agcacagccauag

SEQ ID NO: 1668208 - RNA, 22 nt, Homo sapiens
agcacgccccacgcauggugca

SEQ ID NO: 1668209 - RNA, 16 nt, Homo sapiens
agcacuagaaugagaa

SEQ ID NO: 1668210 - RNA, 18 nt, Homo sapiens
agcacugcuccagugggg

SEQ ID NO: 1668211 - RNA, 19 nt, Homo sapiens
agcacuuuguuucauauuc

SEQ ID NO: 1668212 - RNA, 22 nt, Homo sapiens
agcacuuuguuucauauucuca

SEQ ID NO: 1668213 - RNA, 17 nt, Homo sapiens
agcagcucaccauggcu

SEQ ID NO: 1668214 - RNA, 22 nt, Homo sapiens
agcagcuuuagccaagugcagg

SEQ ID NO: 1668215 - RNA, 20 nt, Homo sapiens
agcaggcgccaagugcuaug

SEQ ID NO: 1668216 - RNA, 19 nt, Homo sapiens
agcaggugucccugagaac

SEQ ID NO: 1668217 - RNA, 18 nt, Homo sapiens
agcaguauguacaggcug

SEQ ID NO: 1668218 - RNA, 20 nt, Homo sapiens
agcaguguccugugcuuucu

SEQ ID NO: 1668219 - RNA, 14 nt, Homo sapiens
agcaguucugcaaa

SEQ ID NO: 1668220 - RNA, 23 nt, Homo sapiens
agcaguuuacuuuagacuaaaga

SEQ ID NO: 1668221 - RNA, 16 nt, Homo sapiens
agcaguuucagauaaa

SEQ ID NO: 1668222 - RNA, 22 nt, Homo sapiens
agcauaggcuggggacacagga

SEQ ID NO: 1668223 - RNA, 14 nt, Homo sapiens
agcaucagcaagac

SEQ ID NO: 1668224 - RNA, 21 nt, Homo sapiens
agcaucugccaggacacugcc

SEQ ID NO: 1668225 - RNA, 14 nt, Homo sapiens
agcauguucuugga

SEQ ID NO: 1668226 - RNA, 18 nt, Homo sapiens
agcauucucauuuugcuu

SEQ ID NO: 1668227 - RNA, 15 nt, Homo sapiens
agcauugggugcaaa

SEQ ID NO: 1668228 - RNA, 22 nt, Homo sapiens
agccaaggccaaaggaagcaca

SEQ ID NO: 1668229 - RNA, 14 nt, Homo sapiens
agccacuaagcaga

SEQ ID NO: 1668230 - RNA, 19 nt, Homo sapiens
agccagcaggcucucaggc

SEQ ID NO: 1668231 - RNA, 17 nt, Homo sapiens
agccagcuuggugguua

SEQ ID NO: 1668232 - RNA, 16 nt, Homo sapiens
agccagucaagggcau

SEQ ID NO: 1668233 - RNA, 22 nt, Homo sapiens
agccauuccuguucccaugaga

SEQ ID NO: 1668234 - RNA, 16 nt, Homo sapiens
agccauugcuucuccc

SEQ ID NO: 1668235 - RNA, 18 nt, Homo sapiens
agcccacccugcugccuu

SEQ ID NO: 1668236 - RNA, 18 nt, Homo sapiens
agcccagagugaacacuc

SEQ ID NO: 1668237 - RNA, 15 nt, Homo sapiens
agcccagauggaaag

SEQ ID NO: 1668238 - RNA, 12 nt, Homo sapiens
agcccagggucu

SEQ ID NO: 1668239 - RNA, 22 nt, Homo sapiens
agcccagugggaucuuacccac

SEQ ID NO: 1668240 - RNA, 15 nt, Homo sapiens
agccccaugccaugg

SEQ ID NO: 1668241 - RNA, 17 nt, Homo sapiens
agccccccguguucaca

SEQ ID NO: 1668242 - RNA, 17 nt, Homo sapiens
agccccuggggccuaga

SEQ ID NO: 1668243 - RNA, 20 nt, Homo sapiens
agcccucugcugcuuuccaa

SEQ ID NO: 1668244 - RNA, 17 nt, Homo sapiens
agcccucuuucucucug

SEQ ID NO: 1668245 - RNA, 18 nt, Homo sapiens
agcccuggcccgguccca

SEQ ID NO: 1668246 - RNA, 18 nt, Homo sapiens
agccuagccugcauauca

SEQ ID NO: 1668247 - RNA, 22 nt, Homo sapiens
agccuaugaggggguuuggcac

SEQ ID NO: 1668248 - RNA, 23 nt, Homo sapiens
agccucagaaggacccuguugag

SEQ ID NO: 1668249 - RNA, 21 nt, Homo sapiens
agccucccccucagaugaucu

SEQ ID NO: 1668250 - RNA, 14 nt, Homo sapiens
agccugagugucca

SEQ ID NO: 1668251 - RNA, 16 nt, Homo sapiens
agccugcaauaaggga

SEQ ID NO: 1668252 - RNA, 19 nt, Homo sapiens
agccugcaauaagggaaaa

SEQ ID NO: 1668253 - RNA, 15 nt, Homo sapiens
agccugcacaguggu

SEQ ID NO: 1668254 - RNA, 14 nt, Homo sapiens
agccuggcacagga

SEQ ID NO: 1668255 - RNA, 17 nt, Homo sapiens
agccuggccccaagcau

SEQ ID NO: 1668256 - RNA, 17 nt, Homo sapiens
agccuggucugugcauu

SEQ ID NO: 1668257 - RNA, 22 nt, Homo sapiens
agccugguuuuuaaguacucac

SEQ ID NO: 1668258 - RNA, 17 nt, Homo sapiens
agccugucucucccuac

SEQ ID NO: 1668259 - RNA, 18 nt, Homo sapiens
agccuuuaauaggcuugu

SEQ ID NO: 1668260 - RNA, 19 nt, Homo sapiens
agccuuuaucuaugggaga

SEQ ID NO: 1668261 - RNA, 16 nt, Homo sapiens
agcggagaggacccca

SEQ ID NO: 1668262 - RNA, 19 nt, Homo sapiens
agcgugggaccccaaguga

SEQ ID NO: 1668263 - RNA, 15 nt, Homo sapiens
agcuaacaaguagca

SEQ ID NO: 1668264 - RNA, 17 nt, Homo sapiens
agcuaacaaguagcaca

SEQ ID NO: 1668265 - RNA, 21 nt, Homo sapiens
agcuaacaaguagcacacuga

SEQ ID NO: 1668266 - RNA, 22 nt, Homo sapiens
agcuaacaauaaagugugagga

SEQ ID NO: 1668267 - RNA, 22 nt, Homo sapiens
agcuaacauggaaguacuauaa

SEQ ID NO: 1668268 - RNA, 16 nt, Homo sapiens
agcuaagccugaugau

SEQ ID NO: 1668269 - RNA, 15 nt, Homo sapiens
agcuaaguagcaucg

SEQ ID NO: 1668270 - RNA, 17 nt, Homo sapiens
agcuaauuaacuaacuc

SEQ ID NO: 1668271 - RNA, 19 nt, Homo sapiens
agcuagaugugucuuacca

SEQ ID NO: 1668272 - RNA, 14 nt, Homo sapiens
agcuauuacuggau

SEQ ID NO: 1668273 - RNA, 23 nt, Homo sapiens
agcucaaaguacuacagcaaagc

SEQ ID NO: 1668274 - RNA, 15 nt, Homo sapiens
agcucacagcacauu

SEQ ID NO: 1668275 - RNA, 20 nt, Homo sapiens
agcucagcauuguguacaaa

SEQ ID NO: 1668276 - RNA, 17 nt, Homo sapiens
agcucaggaguaaggga

SEQ ID NO: 1668277 - RNA, 13 nt, Homo sapiens
agcuccacagggc

SEQ ID NO: 1668278 - RNA, 13 nt, Homo sapiens
agcuccacucuga

SEQ ID NO: 1668279 - RNA, 19 nt, Homo sapiens
agcuccagaauauggaaac

SEQ ID NO: 1668280 - RNA, 15 nt, Homo sapiens
agcugaaaauggaga

SEQ ID NO: 1668281 - RNA, 21 nt, Homo sapiens
agcugaagcguuacuacagca

SEQ ID NO: 1668282 - RNA, 17 nt, Homo sapiens
agcugaauuauuggaca

SEQ ID NO: 1668283 - RNA, 19 nt, Homo sapiens
cugcuaugucugugauguc

SEQ ID NO: 1668284 - RNA, 14 nt, Homo sapiens
cugcuccaugcaga

SEQ ID NO: 1668285 - RNA, 14 nt, Homo sapiens
cugcucccuagcca

SEQ ID NO: 1668286 - RNA, 18 nt, Homo sapiens
cugcuccuccaguacaau

SEQ ID NO: 1668287 - RNA, 16 nt, Homo sapiens
cugcuccuugugguua

SEQ ID NO: 1668288 - RNA, 16 nt, Homo sapiens
cugcucucccagguga

SEQ ID NO: 1668289 - RNA, 23 nt, Homo sapiens
cugcugaauuuggggcuacuuau

SEQ ID NO: 1668290 - RNA, 22 nt, Homo sapiens
cugcugagagggcugcugacca

SEQ ID NO: 1668291 - RNA, 21 nt, Homo sapiens
cugcuggcucccuuacuuuac

SEQ ID NO: 1668292 - RNA, 21 nt, Homo sapiens
cugcuuagugucccuuaccug

SEQ ID NO: 1668293 - RNA, 22 nt, Homo sapiens
cugcuuagugucccuuaccugg

SEQ ID NO: 1668294 - RNA, 18 nt, Homo sapiens
cugcuucacgauucuuac

SEQ ID NO: 1668295 - RNA, 15 nt, Homo sapiens
cugcuucucuuucac

SEQ ID NO: 1668296 - RNA, 16 nt, Homo sapiens
cugcuugaacacugaa

SEQ ID NO: 1668297 - RNA, 18 nt, Homo sapiens
cugcuuugagaaaucuca

SEQ ID NO: 1668298 - RNA, 22 nt, Homo sapiens
cugcuuuggggcuuaucagaac

SEQ ID NO: 1668299 - RNA, 20 nt, Homo sapiens
cugcuuuguuuuggcugcuc

SEQ ID NO: 1668300 - RNA, 16 nt, Homo sapiens
cuggaaaacagcugcu

SEQ ID NO: 1668301 - RNA, 14 nt, Homo sapiens
cuggaaaacugcca

SEQ ID NO: 1668302 - RNA, 14 nt, Homo sapiens
cuggaaaauuccag

SEQ ID NO: 1668303 - RNA, 23 nt, Homo sapiens
cuggaauaagaagcaaauaaaua

SEQ ID NO: 1668304 - RNA, 13 nt, Homo sapiens
cuggaauugauau

SEQ ID NO: 1668305 - RNA, 22 nt, Homo sapiens
cuggagaagcauccaaggaacu

SEQ ID NO: 1668306 - RNA, 16 nt, Homo sapiens
cuggagauugugcucu

SEQ ID NO: 1668307 - RNA, 14 nt, Homo sapiens
cuggagccugcaau

SEQ ID NO: 1668308 - RNA, 21 nt, Homo sapiens
cuggagcguguacuaccccag

SEQ ID NO: 1668309 - RNA, 16 nt, Homo sapiens
cuggaggaacugcuug

SEQ ID NO: 1668310 - RNA, 19 nt, Homo sapiens
cuggagggaagcacugccu

SEQ ID NO: 1668311 - RNA, 16 nt, Homo sapiens
cuggagugcaguggcg

SEQ ID NO: 1668312 - RNA, 20 nt, Homo sapiens
cuggaucucuuaagacagca

SEQ ID NO: 1668313 - RNA, 18 nt, Homo sapiens
cuggaugugcaucuggcc

SEQ ID NO: 1668314 - RNA, 14 nt, Homo sapiens
cuggcaacugcuaa

SEQ ID NO: 1668315 - RNA, 15 nt, Homo sapiens
cuggcaaucuugccc

SEQ ID NO: 1668316 - RNA, 15 nt, Homo sapiens
cuggcacaggacuga

SEQ ID NO: 1668317 - RNA, 15 nt, Homo sapiens
cuggcauggacauca

SEQ ID NO: 1668318 - RNA, 18 nt, Homo sapiens
cuggcauuacagguguga

SEQ ID NO: 1668319 - RNA, 16 nt, Homo sapiens
cuggccaaaaugcaga

SEQ ID NO: 1668320 - RNA, 15 nt, Homo sapiens
cuggccgcugcaguc

SEQ ID NO: 1668321 - RNA, 18 nt, Homo sapiens
cuggccucccaccaggaa

SEQ ID NO: 1668322 - RNA, 15 nt, Homo sapiens
cuggcuugcacuuuc

SEQ ID NO: 1668323 - RNA, 17 nt, Homo sapiens
cuggcuuuacauggguu

SEQ ID NO: 1668324 - RNA, 13 nt, Homo sapiens
cugggacagccac

SEQ ID NO: 1668325 - RNA, 13 nt, Homo sapiens
cugggaccaaaac

SEQ ID NO: 1668326 - RNA, 22 nt, Homo sapiens
cugggacuauaggcaugcgcca

SEQ ID NO: 1668327 - RNA, 22 nt, Homo sapiens
cugggaggggaagagugcucug

SEQ ID NO: 1668328 - RNA, 22 nt, Homo sapiens
cugggauuacaagcaugaguca

SEQ ID NO: 1668329 - RNA, 18 nt, Homo sapiens
cugggcagaaaugugcug

SEQ ID NO: 1668330 - RNA, 13 nt, Homo sapiens
cugggcccuaggc

SEQ ID NO: 1668331 - RNA, 14 nt, Homo sapiens
cugggcccuaggca

SEQ ID NO: 1668332 - RNA, 20 nt, Homo sapiens
cugggccgggguguggaauc

SEQ ID NO: 1668333 - RNA, 13 nt, Homo sapiens
cugggcuagggga

SEQ ID NO: 1668334 - RNA, 19 nt, Homo sapiens
cugggcuauaugccuauau

SEQ ID NO: 1668335 - RNA, 21 nt, Homo sapiens
cugguaggucuggauuuucaa

SEQ ID NO: 1668336 - RNA, 17 nt, Homo sapiens
cuggucaauaaaccacu

SEQ ID NO: 1668337 - RNA, 14 nt, Homo sapiens
cuggucugugcauu

SEQ ID NO: 1668338 - RNA, 15 nt, Homo sapiens
cuggugauggucucu

SEQ ID NO: 1668339 - RNA, 21 nt, Homo sapiens
cuggugucuaauaaacacaga

SEQ ID NO: 1668340 - RNA, 19 nt, Homo sapiens
cugguucuguacaugugga

SEQ ID NO: 1668341 - RNA, 20 nt, Homo sapiens
cugguucuguacauguggaa

SEQ ID NO: 1668342 - RNA, 20 nt, Homo sapiens
cugguugagaucaugucauu

SEQ ID NO: 1668343 - RNA, 21 nt, Homo sapiens
cugguuuuuaaguacucacua

SEQ ID NO: 1668344 - RNA, 18 nt, Homo sapiens
cuguaagauaauguugcu

SEQ ID NO: 1668345 - RNA, 19 nt, Homo sapiens
cuguaagauaauguugcuu

SEQ ID NO: 1668346 - RNA, 15 nt, Homo sapiens
cuguaauauuuacaa

SEQ ID NO: 1668347 - RNA, 20 nt, Homo sapiens
cuguaauauuuacaauguau

SEQ ID NO: 1668348 - RNA, 20 nt, Homo sapiens
cuguaguaauuguuacaauu

SEQ ID NO: 1668349 - RNA, 15 nt, Homo sapiens
cuguaguuccagcua

SEQ ID NO: 1668350 - RNA, 14 nt, Homo sapiens
cugucaaccugaau

SEQ ID NO: 1668351 - RNA, 16 nt, Homo sapiens
cugucaauuacaggaa

SEQ ID NO: 1668352 - RNA, 17 nt, Homo sapiens
cugucagucguguugcu

SEQ ID NO: 1668353 - RNA, 15 nt, Homo sapiens
cugucaugcccagcu

SEQ ID NO: 1668354 - RNA, 14 nt, Homo sapiens
cugucauuccauga

SEQ ID NO: 1668355 - RNA, 22 nt, Homo sapiens
cuguccagacaagcccugcuug

SEQ ID NO: 1668356 - RNA, 21 nt, Homo sapiens
cugucccggguacucagucag

SEQ ID NO: 1668357 - RNA, 16 nt, Homo sapiens
cuguccuacaauauca

SEQ ID NO: 1668358 - RNA, 16 nt, Homo sapiens
cuguccugcucacguc

SEQ ID NO: 1668359 - RNA, 23 nt, Homo sapiens
cugucgccaaguuggagugcaau

SEQ ID NO: 1668360 - RNA, 16 nt, Homo sapiens
cugucuccucugucag

SEQ ID NO: 1668361 - RNA, 17 nt, Homo sapiens
cugucugucaccagcua

SEQ ID NO: 1668362 - RNA, 17 nt, Homo sapiens
cugucuuagucauacca

SEQ ID NO: 1668363 - RNA, 16 nt, Homo sapiens
cugugaauaaagccac

SEQ ID NO: 1668364 - RNA, 16 nt, Homo sapiens
cugugaauauguguaa

SEQ ID NO: 1668365 - RNA, 21 nt, Homo sapiens
cugugcauuguggcugucaaa

SEQ ID NO: 1668366 - RNA, 14 nt, Homo sapiens
cuguggccauuugu

SEQ ID NO: 1668367 - RNA, 22 nt, Homo sapiens
cugugggucgcgugaugcgcau

SEQ ID NO: 1668368 - RNA, 13 nt, Homo sapiens
cuguggucugugu

SEQ ID NO: 1668369 - RNA, 21 nt, Homo sapiens
cuguggucuucaaauugucuu

SEQ ID NO: 1668370 - RNA, 13 nt, Homo sapiens
cuguguauacaua

SEQ ID NO: 1668371 - RNA, 19 nt, Homo sapiens
cugugucacgugacccugu

SEQ ID NO: 1668372 - RNA, 20 nt, Homo sapiens
cugugugucgcuuaugucua

SEQ ID NO: 1668373 - RNA, 19 nt, Homo sapiens
cugugugugcccgugguga

SEQ ID NO: 1668374 - RNA, 14 nt, Homo sapiens
cuguuaaaugucaa

SEQ ID NO: 1668375 - RNA, 15 nt, Homo sapiens
cuguuagacaaaagu

SEQ ID NO: 1668376 - RNA, 23 nt, Homo sapiens
cuguucgugcuuguaaugcucac

SEQ ID NO: 1668377 - RNA, 14 nt, Homo sapiens
cuguucugcacuga

SEQ ID NO: 1668378 - RNA, 16 nt, Homo sapiens
cuguugauucuuucaa

SEQ ID NO: 1668379 - RNA, 17 nt, Homo sapiens
cuguuggccagcacguu

SEQ ID NO: 1668380 - RNA, 15 nt, Homo sapiens
cuguugggaaccaga

SEQ ID NO: 1668381 - RNA, 12 nt, Homo sapiens
cuguuguaauau

SEQ ID NO: 1668382 - RNA, 21 nt, Homo sapiens
cuguuuuaaaaaauacaguau

SEQ ID NO: 1668383 - RNA, 17 nt, Homo sapiens
cuguuuugcauggagua

SEQ ID NO: 1668384 - RNA, 24 nt, Homo sapiens
cuguuuuugaagaagggaaauuca

SEQ ID NO: 1668385 - RNA, 17 nt, Homo sapiens
cuuaaauauacaacuuu

SEQ ID NO: 1668386 - RNA, 20 nt, Homo sapiens
cuuaaauauguggaguucau

SEQ ID NO: 1668387 - RNA, 22 nt, Homo sapiens
cuuaaguacugaaauacauaug

SEQ ID NO: 1668388 - RNA, 19 nt, Homo sapiens
cuuaauauuucuucaaaua

SEQ ID NO: 1668389 - RNA, 16 nt, Homo sapiens
cuuaauuaaauaucaa

SEQ ID NO: 1668390 - RNA, 23 nt, Homo sapiens
cuuaauuaugguaccucugucua

SEQ ID NO: 1668391 - RNA, 18 nt, Homo sapiens
cuuacaggccuugcucac

SEQ ID NO: 1668392 - RNA, 15 nt, Homo sapiens
cuuaccucauuugca

SEQ ID NO: 1668393 - RNA, 14 nt, Homo sapiens
cuuagaauacugua

SEQ ID NO: 1668394 - RNA, 16 nt, Homo sapiens
cuuagaauacuguauu

SEQ ID NO: 1668395 - RNA, 17 nt, Homo sapiens
cuuagcuuuucugcaau

SEQ ID NO: 1668396 - RNA, 13 nt, Homo sapiens
cuuaguaucucau

SEQ ID NO: 1668397 - RNA, 22 nt, Homo sapiens
cuuaguaucucaucaacaaaga

SEQ ID NO: 1668398 - RNA, 20 nt, Homo sapiens
cuuagugaaaggucaucuca

SEQ ID NO: 1668399 - RNA, 15 nt, Homo sapiens
cuuaguugcacuuca

SEQ ID NO: 1668400 - RNA, 19 nt, Homo sapiens
cuuauaccagguuaccuca

SEQ ID NO: 1668401 - RNA, 15 nt, Homo sapiens
cuuauagagcacaau

SEQ ID NO: 1668402 - RNA, 13 nt, Homo sapiens
cuuauauacagac

SEQ ID NO: 1668403 - RNA, 14 nt, Homo sapiens
cuuaugccauauaa

SEQ ID NO: 1668404 - RNA, 21 nt, Homo sapiens
cuucaaaauauaaaaugccaa

SEQ ID NO: 1668405 - RNA, 20 nt, Homo sapiens
cuucaaugaacugugcuuuu

SEQ ID NO: 1668406 - RNA, 16 nt, Homo sapiens
cuucaccgcauuccag

SEQ ID NO: 1668407 - RNA, 17 nt, Homo sapiens
cuucacuuaaaaucaaa

SEQ ID NO: 1668408 - RNA, 18 nt, Homo sapiens
cuucagagcaagcacugg

SEQ ID NO: 1668409 - RNA, 18 nt, Homo sapiens
cuucagcaugauguguug

SEQ ID NO: 1668410 - RNA, 13 nt, Homo sapiens
cuucauaggcaga

SEQ ID NO: 1668411 - RNA, 19 nt, Homo sapiens
cuucauauaugcuuugcag

SEQ ID NO: 1668412 - RNA, 16 nt, Homo sapiens
cuucauccauagacac

SEQ ID NO: 1668413 - RNA, 13 nt, Homo sapiens
cuucaugcuugau

SEQ ID NO: 1668414 - RNA, 14 nt, Homo sapiens
cuucauguugaugu

SEQ ID NO: 1668415 - RNA, 21 nt, Homo sapiens
cuuccaaaccaccuucccuca

SEQ ID NO: 1668416 - RNA, 14 nt, Homo sapiens
cuuccaauguggug

SEQ ID NO: 1668417 - RNA, 15 nt, Homo sapiens
cuuccaccaaauacu

SEQ ID NO: 1668418 - RNA, 16 nt, Homo sapiens
cuuccacuucaggguu

SEQ ID NO: 1668419 - RNA, 17 nt, Homo sapiens
cuuccacuucaggguuc

SEQ ID NO: 1668420 - RNA, 23 nt, Homo sapiens
cuucccaaccuccccugguccug

SEQ ID NO: 1668421 - RNA, 19 nt, Homo sapiens
cuucccaacguacuccuca

SEQ ID NO: 1668422 - RNA, 18 nt, Homo sapiens
cuucccagagaguaucug

SEQ ID NO: 1668423 - RNA, 21 nt, Homo sapiens
cuucccagagaguaucugaga

SEQ ID NO: 1668424 - RNA, 20 nt, Homo sapiens
cuucccagagaguaugugag

SEQ ID NO: 1668425 - RNA, 23 nt, Homo sapiens
cuucccccagcacaaagcacugg

SEQ ID NO: 1668426 - RNA, 16 nt, Homo sapiens
cuucccuaguucuuug

SEQ ID NO: 1668427 - RNA, 16 nt, Homo sapiens
cuucccugacacuguc

SEQ ID NO: 1668428 - RNA, 12 nt, Homo sapiens
cuucccuuccac

SEQ ID NO: 1668429 - RNA, 14 nt, Homo sapiens
cuuccucuuaccug

SEQ ID NO: 1668430 - RNA, 19 nt, Homo sapiens
cuuccugaacucccaguca

SEQ ID NO: 1668431 - RNA, 21 nt, Homo sapiens
cuucgggggcggcucugggaa

SEQ ID NO: 1668432 - RNA, 18 nt, Homo sapiens
cuucuagcgucagugcug

SEQ ID NO: 1668433 - RNA, 17 nt, Homo sapiens
cuucuaucaaagcacau

SEQ ID NO: 1668434 - RNA, 21 nt, Homo sapiens
cuucucaagaccgaguguaca

SEQ ID NO: 1668435 - RNA, 17 nt, Homo sapiens
cuucucacccgcuucuc

SEQ ID NO: 1668436 - RNA, 18 nt, Homo sapiens
cuucuccccuccaaguga

SEQ ID NO: 1668437 - RNA, 21 nt, Homo sapiens
cuucucccgccauuggccuua

SEQ ID NO: 1668438 - RNA, 18 nt, Homo sapiens
cuucucgugacaccacca

SEQ ID NO: 1668439 - RNA, 19 nt, Homo sapiens
cuucucgugacaccaccaa

SEQ ID NO: 1668440 - RNA, 13 nt, Homo sapiens
cuucucuagacau

SEQ ID NO: 1668441 - RNA, 16 nt, Homo sapiens
cuucucuuucacaacu

SEQ ID NO: 1668442 - RNA, 14 nt, Homo sapiens
cuucugaagaucuc

SEQ ID NO: 1668443 - RNA, 13 nt, Homo sapiens
cuucuguugucau

SEQ ID NO: 1668444 - RNA, 13 nt, Homo sapiens
cuucuuacuguau

SEQ ID NO: 1668445 - RNA, 18 nt, Homo sapiens
cuucuuuacuaacacugg

SEQ ID NO: 1668446 - RNA, 16 nt, Homo sapiens
cuucuuuccucaaaga

SEQ ID NO: 1668447 - RNA, 20 nt, Homo sapiens
cuugacccauguucucaaua

SEQ ID NO: 1668448 - RNA, 19 nt, Homo sapiens
cuugaguaguuuuuaucug

SEQ ID NO: 1668449 - RNA, 19 nt, Homo sapiens
cuugauuacauaauguuag

SEQ ID NO: 1668450 - RNA, 21 nt, Homo sapiens
cuugcacaggucccacugccc

SEQ ID NO: 1668451 - RNA, 13 nt, Homo sapiens
cuugccacugcca

SEQ ID NO: 1668452 - RNA, 15 nt, Homo sapiens
cuugccuugugauau

SEQ ID NO: 1668453 - RNA, 12 nt, Homo sapiens
cuugcugugaaa

SEQ ID NO: 1668454 - RNA, 20 nt, Homo sapiens
cuugcugugaaaugacugca

SEQ ID NO: 1668455 - RNA, 19 nt, Homo sapiens
cuugcuucaaccccaugag

SEQ ID NO: 1668456 - RNA, 17 nt, Homo sapiens
cuugcuuccuucucauc

SEQ ID NO: 1668457 - RNA, 17 nt, Homo sapiens
cuuggagucuuccaaac

SEQ ID NO: 1668458 - RNA, 14 nt, Homo sapiens
cuuggagugccaca

SEQ ID NO: 1668459 - RNA, 21 nt, Homo sapiens
cuuggauaggagcuuccagau

SEQ ID NO: 1668460 - RNA, 19 nt, Homo sapiens
cuuggcagaggcagggaag

SEQ ID NO: 1668461 - RNA, 11 nt, Homo sapiens
cuuggccuagc

SEQ ID NO: 1668462 - RNA, 18 nt, Homo sapiens
cuuggccuugguuuugau

SEQ ID NO: 1668463 - RNA, 16 nt, Homo sapiens
cuuggcgcugccccug

SEQ ID NO: 1668464 - RNA, 18 nt, Homo sapiens
cuuggcuagucacauauc

SEQ ID NO: 1668465 - RNA, 15 nt, Homo sapiens
cuuguaaaacuguga

SEQ ID NO: 1668466 - RNA, 14 nt, Homo sapiens
cuuguaaaagccua

SEQ ID NO: 1668467 - RNA, 16 nt, Homo sapiens
cuuguacuugauccuc

SEQ ID NO: 1668468 - RNA, 14 nt, Homo sapiens
cuugucauucucau

SEQ ID NO: 1668469 - RNA, 16 nt, Homo sapiens
cuugugauuccagggc

SEQ ID NO: 1668470 - RNA, 20 nt, Homo sapiens
cuugugcacuggauguggcc

SEQ ID NO: 1668471 - RNA, 14 nt, Homo sapiens
cuuuaaaacaugcu

SEQ ID NO: 1668472 - RNA, 20 nt, Homo sapiens
cuuuaagagaaaugagcugc

SEQ ID NO: 1668473 - RNA, 19 nt, Homo sapiens
cuuuaaguaaaauguuuca

SEQ ID NO: 1668474 - RNA, 14 nt, Homo sapiens
cuuuacagugccac

SEQ ID NO: 1668475 - RNA, 15 nt, Homo sapiens
cuuuacagugccacg

SEQ ID NO: 1668476 - RNA, 15 nt, Homo sapiens
cuuuacauaugcuuu

SEQ ID NO: 1668477 - RNA, 16 nt, Homo sapiens
cuuuacuaacacuggc

SEQ ID NO: 1668478 - RNA, 17 nt, Homo sapiens
cuuuagagaagccauaa

SEQ ID NO: 1668479 - RNA, 20 nt, Homo sapiens
cuuuaggaaaaaaagcaugu

SEQ ID NO: 1668480 - RNA, 16 nt, Homo sapiens
cuuuauaauggcucug

SEQ ID NO: 1668481 - RNA, 17 nt, Homo sapiens
cuuuauuggucuugccc

SEQ ID NO: 1668482 - RNA, 17 nt, Homo sapiens
cuuucaauucugugaua

SEQ ID NO: 1668483 - RNA, 23 nt, Homo sapiens
cuuuccagacuucgcuauuccca

SEQ ID NO: 1668484 - RNA, 19 nt, Homo sapiens
cuuucccuggugauggucu

SEQ ID NO: 1668485 - RNA, 19 nt, Homo sapiens
cuuuccucaaagaagcaug

SEQ ID NO: 1668486 - RNA, 23 nt, Homo sapiens
cuuuccucuuaaugucucaaaau

SEQ ID NO: 1668487 - RNA, 15 nt, Homo sapiens
cuuucuacacuguau

SEQ ID NO: 1668488 - RNA, 17 nt, Homo sapiens
cuuucucaugcauagac

SEQ ID NO: 1668489 - RNA, 16 nt, Homo sapiens
cuuucucauucuugcc

SEQ ID NO: 1668490 - RNA, 15 nt, Homo sapiens
cuuucugaaauucac

SEQ ID NO: 1668491 - RNA, 14 nt, Homo sapiens
cuuucugcaugcuu

SEQ ID NO: 1668492 - RNA, 17 nt, Homo sapiens
cuuucuuagauucucuu

SEQ ID NO: 1668493 - RNA, 18 nt, Homo sapiens
cuuucuuaucccagugau

SEQ ID NO: 1668494 - RNA, 17 nt, Homo sapiens
cuuucuuguugcugcau

SEQ ID NO: 1668495 - RNA, 15 nt, Homo sapiens
cuuugacacuuuuca

SEQ ID NO: 1668496 - RNA, 17 nt, Homo sapiens
cuuugagggacugccuc

SEQ ID NO: 1668497 - RNA, 23 nt, Homo sapiens
cuuugagggacugccucugccac

SEQ ID NO: 1668498 - RNA, 15 nt, Homo sapiens
cuuugauucaccaaa

SEQ ID NO: 1668499 - RNA, 18 nt, Homo sapiens
cuuugauuuagagaugau

SEQ ID NO: 1668500 - RNA, 20 nt, Homo sapiens
cuuugcaaugcaagcccuuu

SEQ ID NO: 1668501 - RNA, 11 nt, Homo sapiens
cuuugccaaau

SEQ ID NO: 1668502 - RNA, 23 nt, Homo sapiens
cuuugccaucaagaaacauucag

SEQ ID NO: 1668503 - RNA, 15 nt, Homo sapiens
cuuuggaaguuuuac

SEQ ID NO: 1668504 - RNA, 15 nt, Homo sapiens
cuuuggaaugcaugc

SEQ ID NO: 1668505 - RNA, 22 nt, Homo sapiens
cuuuggcauuuguguagcugag

SEQ ID NO: 1668506 - RNA, 17 nt, Homo sapiens
cuuuggcuucagaauug

SEQ ID NO: 1668507 - RNA, 19 nt, Homo sapiens
cuuuguaccuguaggucua

SEQ ID NO: 1668508 - RNA, 18 nt, Homo sapiens
cuuugucucacgauucca

SEQ ID NO: 1668509 - RNA, 16 nt, Homo sapiens
cuuuuaacaguguuuu

SEQ ID NO: 1668510 - RNA, 20 nt, Homo sapiens
cuuuuaagaugugucuucaa

SEQ ID NO: 1668511 - RNA, 19 nt, Homo sapiens
cuuuuacagucacauucag

SEQ ID NO: 1668512 - RNA, 17 nt, Homo sapiens
cuuuuauucauuagcug

SEQ ID NO: 1668513 - RNA, 14 nt, Homo sapiens
cuuuucaaugugug

SEQ ID NO: 1668514 - RNA, 16 nt, Homo sapiens
cuuuuccuggacacuu

SEQ ID NO: 1668515 - RNA, 15 nt, Homo sapiens
cuuuugagugccuua

SEQ ID NO: 1668516 - RNA, 16 nt, Homo sapiens
cuuuugagugccuuac

SEQ ID NO: 1668517 - RNA, 21 nt, Homo sapiens
cuuuugccagccuguucucug

SEQ ID NO: 1668518 - RNA, 15 nt, Homo sapiens
cuuuugcucauccac

SEQ ID NO: 1668519 - RNA, 16 nt, Homo sapiens
cuuuugucauguggcu

SEQ ID NO: 1668520 - RNA, 16 nt, Homo sapiens
cuuuuuaggcucugag

SEQ ID NO: 1668521 - RNA, 19 nt, Homo sapiens
cuuuuuuuaaguguucugu

SEQ ID NO: 1668522 - RNA, 13 nt, Homo sapiens
gaaaaaggcuucu

SEQ ID NO: 1668523 - RNA, 20 nt, Homo sapiens
gaaaacaaauauuucacuua

SEQ ID NO: 1668524 - RNA, 13 nt, Homo sapiens
gaaaacaguccca

SEQ ID NO: 1668525 - RNA, 23 nt, Homo sapiens
gaaaacgauuuaauuuauucuaa

SEQ ID NO: 1668526 - RNA, 17 nt, Homo sapiens
gaaaacuaaguucucua

SEQ ID NO: 1668527 - RNA, 22 nt, Homo sapiens
gaaaacugccacaagcacaauu

SEQ ID NO: 1668528 - RNA, 22 nt, Homo sapiens
gaaaagaggggaagagacuugg

SEQ ID NO: 1668529 - RNA, 21 nt, Homo sapiens
gaaaagcaaaccuuaauuuga

SEQ ID NO: 1668530 - RNA, 15 nt, Homo sapiens
gaaaagcaaaucugu

SEQ ID NO: 1668531 - RNA, 16 nt, Homo sapiens
gaaaagcaaaucugua

SEQ ID NO: 1668532 - RNA, 15 nt, Homo sapiens
gaaaagccagaugac

SEQ ID NO: 1668533 - RNA, 16 nt, Homo sapiens
gaaaaggguguugcua

SEQ ID NO: 1668534 - RNA, 21 nt, Homo sapiens
gaaaauaguggcaggacuguc

SEQ ID NO: 1668535 - RNA, 23 nt, Homo sapiens
gaaaauaguggcaggacuguccc

SEQ ID NO: 1668536 - RNA, 22 nt, Homo sapiens
gaaaaugcuuucucaugcauag

SEQ ID NO: 1668537 - RNA, 15 nt, Homo sapiens
gaaaauggaugacaa

SEQ ID NO: 1668538 - RNA, 18 nt, Homo sapiens
gaaacacacaggccauuu

SEQ ID NO: 1668539 - RNA, 15 nt, Homo sapiens
gaaacagcagcucca

SEQ ID NO: 1668540 - RNA, 19 nt, Homo sapiens
gaaacagugacaccugcau

SEQ ID NO: 1668541 - RNA, 17 nt, Homo sapiens
gaaaccggguggcagcg

SEQ ID NO: 1668542 - RNA, 23 nt, Homo sapiens
gaaagaaaugcuaaccuguggaa

SEQ ID NO: 1668543 - RNA, 12 nt, Homo sapiens
gaaagacaguaa

SEQ ID NO: 1668544 - RNA, 20 nt, Homo sapiens
gaaagagaaaaugcuuucuc

SEQ ID NO: 1668545 - RNA, 22 nt, Homo sapiens
gaaagagcgucauguccuuggc

SEQ ID NO: 1668546 - RNA, 16 nt, Homo sapiens
gaaagagcugaaaaug

SEQ ID NO: 1668547 - RNA, 23 nt, Homo sapiens
gaaagagcuggcaaacugugaau

SEQ ID NO: 1668548 - RNA, 21 nt, Homo sapiens
gaaagauugauuaaugaacua

SEQ ID NO: 1668549 - RNA, 15 nt, Homo sapiens
gaaagauugcuauaa

SEQ ID NO: 1668550 - RNA, 13 nt, Homo sapiens
gaaagcccuucuc

SEQ ID NO: 1668551 - RNA, 15 nt, Homo sapiens
gaaaggacagcucag

SEQ ID NO: 1668552 - RNA, 22 nt, Homo sapiens
gaaagucaagucuaccugccuu

SEQ ID NO: 1668553 - RNA, 15 nt, Homo sapiens
gaaauacuugacaac

SEQ ID NO: 1668554 - RNA, 12 nt, Homo sapiens
gaaauaguucca

SEQ ID NO: 1668555 - RNA, 20 nt, Homo sapiens
gaaauaguuuuaucuggaaa

SEQ ID NO: 1668556 - RNA, 13 nt, Homo sapiens
gaaauauucacaa

SEQ ID NO: 1668557 - RNA, 14 nt, Homo sapiens
gaaauauucacaag

SEQ ID NO: 1668558 - RNA, 19 nt, Homo sapiens
gaaaucaauuuaaaggaaa

SEQ ID NO: 1668559 - RNA, 14 nt, Homo sapiens
gaaauccauuugag

SEQ ID NO: 1668560 - RNA, 15 nt, Homo sapiens
gaaauccccuaacug

SEQ ID NO: 1668561 - RNA, 21 nt, Homo sapiens
gaaaugccgggcacaggccag

SEQ ID NO: 1668562 - RNA, 21 nt, Homo sapiens
gaaaugcugauuuaaacuucu

SEQ ID NO: 1668563 - RNA, 19 nt, Homo sapiens
gaaauucuauaagagacaa

SEQ ID NO: 1668564 - RNA, 21 nt, Homo sapiens
gaaauuucaaaguauguuuca

SEQ ID NO: 1668565 - RNA, 16 nt, Homo sapiens
gaacaaaaccccagaa

SEQ ID NO: 1668566 - RNA, 17 nt, Homo sapiens
gaacaaauaugauucuc

SEQ ID NO: 1668567 - RNA, 11 nt, Homo sapiens
gaacaccaagu

SEQ ID NO: 1668568 - RNA, 21 nt, Homo sapiens
gaacauacuuucuaaaugccu

SEQ ID NO: 1668569 - RNA, 15 nt, Homo sapiens
gaacaucccugagaa

SEQ ID NO: 1668570 - RNA, 22 nt, Homo sapiens
gaacauuaauccacauguuuca

SEQ ID NO: 1668571 - RNA, 18 nt, Homo sapiens
gaaccaacgggucugugg

SEQ ID NO: 1668572 - RNA, 18 nt, Homo sapiens
gaaccgcaauaugggagg

SEQ ID NO: 1668573 - RNA, 15 nt, Homo sapiens
gaaccgucaauguga

SEQ ID NO: 1668574 - RNA, 14 nt, Homo sapiens
gaacgcaugcaggg

SEQ ID NO: 1668575 - RNA, 15 nt, Homo sapiens
gaacgcaugcagggc

SEQ ID NO: 1668576 - RNA, 20 nt, Homo sapiens
gaacggugucauccugggga

SEQ ID NO: 1668577 - RNA, 14 nt, Homo sapiens
gaacuaacugccau

SEQ ID NO: 1668578 - RNA, 15 nt, Homo sapiens
gaacuauuucuacac

SEQ ID NO: 1668579 - RNA, 20 nt, Homo sapiens
gaacuauuucuacacagugg

SEQ ID NO: 1668580 - RNA, 11 nt, Homo sapiens
gaacucaggga

SEQ ID NO: 1668581 - RNA, 15 nt, Homo sapiens
gaacugcaacacugg

SEQ ID NO: 1668582 - RNA, 16 nt, Homo sapiens
gaacugcaacacugga

SEQ ID NO: 1668583 - RNA, 15 nt, Homo sapiens
gaagaacgaagccac

SEQ ID NO: 1668584 - RNA, 16 nt, Homo sapiens
gaagaagcaguuuacu

SEQ ID NO: 1668585 - RNA, 19 nt, Homo sapiens
gaagaauuuaucugugaau

SEQ ID NO: 1668586 - RNA, 21 nt, Homo sapiens
gaagaccuucugaagaucuca

SEQ ID NO: 1668587 - RNA, 14 nt, Homo sapiens
gaagacgaggccaa

SEQ ID NO: 1668588 - RNA, 17 nt, Homo sapiens
gaagacuucaaaauauu

SEQ ID NO: 1668589 - RNA, 14 nt, Homo sapiens
gaagacuucauccc

SEQ ID NO: 1668590 - RNA, 16 nt, Homo sapiens
gaagacuucaucccuc

SEQ ID NO: 1668591 - RNA, 17 nt, Homo sapiens
gaagagaguauggugcu

SEQ ID NO: 1668592 - RNA, 14 nt, Homo sapiens
gaagagaugcucua

SEQ ID NO: 1668593 - RNA, 14 nt, Homo sapiens
gaagauaccauaag

SEQ ID NO: 1668594 - RNA, 15 nt, Homo sapiens
gaagauguuguuaaa

SEQ ID NO: 1668595 - RNA, 15 nt, Homo sapiens
gaagauuagcaugaa

SEQ ID NO: 1668596 - RNA, 22 nt, Homo sapiens
gaagauuauuuacugacauaua

SEQ ID NO: 1668597 - RNA, 20 nt, Homo sapiens
gaagcagaaugagaugauuu

SEQ ID NO: 1668598 - RNA, 12 nt, Homo sapiens
gaagcagcagcu

SEQ ID NO: 1668599 - RNA, 21 nt, Homo sapiens
gaagcagugcgugugaaacag

SEQ ID NO: 1668600 - RNA, 21 nt, Homo sapiens
gaagccagcaggcucucaggc

SEQ ID NO: 1668601 - RNA, 15 nt, Homo sapiens
gaagccaguccagaa

SEQ ID NO: 1668602 - RNA, 22 nt, Homo sapiens
gaagcucucgagggaagcagug

SEQ ID NO: 1668603 - RNA, 19 nt, Homo sapiens
gaaggagcuugggugcauu

SEQ ID NO: 1668604 - RNA, 21 nt, Homo sapiens
gaaggcagcuagacaccaaug

SEQ ID NO: 1668605 - RNA, 20 nt, Homo sapiens
gaaggccagaauacuggaga

SEQ ID NO: 1668606 - RNA, 12 nt, Homo sapiens
gaaggccagcuu

SEQ ID NO: 1668607 - RNA, 14 nt, Homo sapiens
gaaggccaggaaaa

SEQ ID NO: 1668608 - RNA, 18 nt, Homo sapiens
gaaguagccaacagcgaa

SEQ ID NO: 1668609 - RNA, 21 nt, Homo sapiens
gaaguagugugaguguuagaa

SEQ ID NO: 1668610 - RNA, 14 nt, Homo sapiens
gaagugcaaugaua

SEQ ID NO: 1668611 - RNA, 18 nt, Homo sapiens
gaagugguaggaaagccu

SEQ ID NO: 1668612 - RNA, 23 nt, Homo sapiens
gaagugguguuuagaaugucagu

SEQ ID NO: 1668613 - RNA, 17 nt, Homo sapiens
gaaguuugaccaucacc

SEQ ID NO: 1668614 - RNA, 12 nt, Homo sapiens
gaauaaauaagu

SEQ ID NO: 1668615 - RNA, 17 nt, Homo sapiens
gaauaagggacuuugga

SEQ ID NO: 1668616 - RNA, 11 nt, Homo sapiens
gaauacuguau

SEQ ID NO: 1668617 - RNA, 24 nt, Homo sapiens
gaauacuguauuguuacagcugaa

SEQ ID NO: 1668618 - RNA, 14 nt, Homo sapiens
gaauauuaagcaca

SEQ ID NO: 1668619 - RNA, 17 nt, Homo sapiens
gaauauucaacagcuca

SEQ ID NO: 1668620 - RNA, 15 nt, Homo sapiens
gaaucaacagaucaa

SEQ ID NO: 1668621 - RNA, 22 nt, Homo sapiens
gaaucaggauuccuucuucccc

SEQ ID NO: 1668622 - RNA, 23 nt, Homo sapiens
gaaucaggauuccuucuucccca

SEQ ID NO: 1668623 - RNA, 20 nt, Homo sapiens
gaaucauugcuuaugacaug

SEQ ID NO: 1668624 - RNA, 16 nt, Homo sapiens
gaauccauaucagcuc

SEQ ID NO: 1668625 - RNA, 14 nt, Homo sapiens
gaauccaugaucaa

SEQ ID NO: 1668626 - RNA, 14 nt, Homo sapiens
gaaucucagcacuu

SEQ ID NO: 1668627 - RNA, 15 nt, Homo sapiens
gaaugaagucuuucc

SEQ ID NO: 1668628 - RNA, 17 nt, Homo sapiens
gaaugaagucuuucccu

SEQ ID NO: 1668629 - RNA, 20 nt, Homo sapiens
gaaugaaugucagugugacu

SEQ ID NO: 1668630 - RNA, 13 nt, Homo sapiens
gaaugcacaguga

SEQ ID NO: 1668631 - RNA, 14 nt, Homo sapiens
gaaugccagggaca

SEQ ID NO: 1668632 - RNA, 19 nt, Homo sapiens
gaauguguuauuugucaca

SEQ ID NO: 1668633 - RNA, 19 nt, Homo sapiens
gaauuaaagucuacacugc

SEQ ID NO: 1668634 - RNA, 20 nt, Homo sapiens
gaauuaaagucuacacugcc

SEQ ID NO: 1668635 - RNA, 15 nt, Homo sapiens
gaauuacugcaaagg

SEQ ID NO: 1668636 - RNA, 19 nt, Homo sapiens
gaauuagaagaaaauggau

SEQ ID NO: 1668637 - RNA, 16 nt, Homo sapiens
gaauuauuagcaccag

SEQ ID NO: 1668638 - RNA, 13 nt, Homo sapiens
gaauucaaugggu

SEQ ID NO: 1668639 - RNA, 23 nt, Homo sapiens
gaauucaccccucccaccucuuu

SEQ ID NO: 1668640 - RNA, 16 nt, Homo sapiens
gaauuccaccuggaaa

SEQ ID NO: 1668641 - RNA, 22 nt, Homo sapiens
gaauugaagacacguucuugcc

SEQ ID NO: 1668642 - RNA, 22 nt, Homo sapiens
gaauugauauugaaugauguga

SEQ ID NO: 1668643 - RNA, 15 nt, Homo sapiens
gaauugccagucuuu

SEQ ID NO: 1668644 - RNA, 17 nt, Homo sapiens
gaauuugcuuagccuuu

SEQ ID NO: 1668645 - RNA, 16 nt, Homo sapiens
gacaaagagccagaaa

SEQ ID NO: 1668646 - RNA, 19 nt, Homo sapiens
gacaaaugggccugccaaa

SEQ ID NO: 1668647 - RNA, 22 nt, Homo sapiens
gacaacgaacauggcaugugaa

SEQ ID NO: 1668648 - RNA, 17 nt, Homo sapiens
gacacacgugagccaca

SEQ ID NO: 1668649 - RNA, 23 nt, Homo sapiens
gacacagaggacagcuuccccau

SEQ ID NO: 1668650 - RNA, 23 nt, Homo sapiens
gacacagaggacggcuuccccau

SEQ ID NO: 1668651 - RNA, 16 nt, Homo sapiens
gacacagcccagagac

SEQ ID NO: 1668652 - RNA, 19 nt, Homo sapiens
gacacaggauccuggccug

SEQ ID NO: 1668653 - RNA, 14 nt, Homo sapiens
gacacuacaaacau

SEQ ID NO: 1668654 - RNA, 15 nt, Homo sapiens
gacacuauguagucu

SEQ ID NO: 1668655 - RNA, 10 nt, Homo sapiens
gacacugucu

SEQ ID NO: 1668656 - RNA, 16 nt, Homo sapiens
gacagagcgagacucc

SEQ ID NO: 1668657 - RNA, 13 nt, Homo sapiens
gacagucuggaaa

SEQ ID NO: 1668658 - RNA, 15 nt, Homo sapiens
gacagugccuaacuc

SEQ ID NO: 1668659 - RNA, 21 nt, Homo sapiens
gacaugaaauugagucauuuu

SEQ ID NO: 1668660 - RNA, 13 nt, Homo sapiens
gacauugaacuga

SEQ ID NO: 1668661 - RNA, 13 nt, Homo sapiens
gacauugucagaa

SEQ ID NO: 1668662 - RNA, 21 nt, Homo sapiens
gacauuuuauuagggggauaa

SEQ ID NO: 1668663 - RNA, 13 nt, Homo sapiens
gaccaacagugag

SEQ ID NO: 1668664 - RNA, 22 nt, Homo sapiens
gaccagcauaccaguucuugca

SEQ ID NO: 1668665 - RNA, 14 nt, Homo sapiens
gaccauaugcacaa

SEQ ID NO: 1668666 - RNA, 18 nt, Homo sapiens
gacccagggaaugccagg

SEQ ID NO: 1668667 - RNA, 13 nt, Homo sapiens
gaccccauuccag

SEQ ID NO: 1668668 - RNA, 16 nt, Homo sapiens
gaccccauucugggac

SEQ ID NO: 1668669 - RNA, 21 nt, Homo sapiens
gacccgcccuuagaccaggca

SEQ ID NO: 1668670 - RNA, 23 nt, Homo sapiens
gacccucaccugaauaagggacu

SEQ ID NO: 1668671 - RNA, 15 nt, Homo sapiens
gacccucacuuuucu

SEQ ID NO: 1668672 - RNA, 13 nt, Homo sapiens
gaccucacaguga

SEQ ID NO: 1668673 - RNA, 17 nt, Homo sapiens
gaccuccaggaagggac

SEQ ID NO: 1668674 - RNA, 19 nt, Homo sapiens
gaccucccugucucuacaa

SEQ ID NO: 1668675 - RNA, 21 nt, Homo sapiens
gaccuccucccaagcacuuca

SEQ ID NO: 1668676 - RNA, 15 nt, Homo sapiens
gaccuccugaugucu

SEQ ID NO: 1668677 - RNA, 22 nt, Homo sapiens
gaccucgaaugcuccuaaaaga

SEQ ID NO: 1668678 - RNA, 19 nt, Homo sapiens
gaccugccucucacacaca

SEQ ID NO: 1668679 - RNA, 16 nt, Homo sapiens
gaccuggauguuauau

SEQ ID NO: 1668680 - RNA, 23 nt, Homo sapiens
gaccugggugggaggaaacugua

SEQ ID NO: 1668681 - RNA, 20 nt, Homo sapiens
gaccuuggagagacacagcg

SEQ ID NO: 1668682 - RNA, 20 nt, Homo sapiens
gaccuuggguucccaauaca

SEQ ID NO: 1668683 - RNA, 19 nt, Homo sapiens
gaccuuuaagagaaaugag

SEQ ID NO: 1668684 - RNA, 18 nt, Homo sapiens
gacgagcaugagcuggau

SEQ ID NO: 1668685 - RNA, 20 nt, Homo sapiens
gacgcauuguauauaauaua

SEQ ID NO: 1668686 - RNA, 16 nt, Homo sapiens
gacggguuucaccaug

SEQ ID NO: 1668687 - RNA, 17 nt, Homo sapiens
gacguggugcuucucac

SEQ ID NO: 1668688 - RNA, 17 nt, Homo sapiens
gacguguuaugacucca

SEQ ID NO: 1668689 - RNA, 23 nt, Homo sapiens
gacuaaccccaacgcacaggaaa

SEQ ID NO: 1668690 - RNA, 13 nt, Homo sapiens
gacuacagacauu

SEQ ID NO: 1668691 - RNA, 19 nt, Homo sapiens
gacuaccuauaaauggacu

SEQ ID NO: 1668692 - RNA, 21 nt, Homo sapiens
gacucucacgauaugcaaguu

SEQ ID NO: 1668693 - RNA, 22 nt, Homo sapiens
gacugccucugccacacucuga

SEQ ID NO: 1668694 - RNA, 22 nt, Homo sapiens
gacuggccaagguuuggggaag

SEQ ID NO: 1668695 - RNA, 22 nt, Homo sapiens
gacuguuuccagagugcuuaua

SEQ ID NO: 1668696 - RNA, 20 nt, Homo sapiens
gacuuaagcacacuugacau

SEQ ID NO: 1668697 - RNA, 19 nt, Homo sapiens
gacuuauugauuaaguaua

SEQ ID NO: 1668698 - RNA, 17 nt, Homo sapiens
gacuucacaaaaugcaa

SEQ ID NO: 1668699 - RNA, 21 nt, Homo sapiens
gacuucagacucucuccucuc

SEQ ID NO: 1668700 - RNA, 14 nt, Homo sapiens
gacuuccugaacuc

SEQ ID NO: 1668701 - RNA, 23 nt, Homo sapiens
gacuucgggggcggcucugggaa

SEQ ID NO: 1668702 - RNA, 15 nt, Homo sapiens
gacuucucuagacau

SEQ ID NO: 1668703 - RNA, 16 nt, Homo sapiens
gagaaauaaagcacau

SEQ ID NO: 1668704 - RNA, 19 nt, Homo sapiens
gagaaauacaucauuugca

SEQ ID NO: 1668705 - RNA, 15 nt, Homo sapiens
gagaaauugugccaa

SEQ ID NO: 1668706 - RNA, 16 nt, Homo sapiens
gagaacagggaugcua

SEQ ID NO: 1668707 - RNA, 15 nt, Homo sapiens
gagaaccaaccaaug

SEQ ID NO: 1668708 - RNA, 20 nt, Homo sapiens
gagaagagaguauggugcug

SEQ ID NO: 1668709 - RNA, 17 nt, Homo sapiens
gagaagcucucgaggga

SEQ ID NO: 1668710 - RNA, 17 nt, Homo sapiens
gagaagcugucagggac

SEQ ID NO: 1668711 - RNA, 20 nt, Homo sapiens
gagaaggcaaccuugacucu

SEQ ID NO: 1668712 - RNA, 20 nt, Homo sapiens
gagaaggcaggaacacugga

SEQ ID NO: 1668713 - RNA, 20 nt, Homo sapiens
gagaaucgaccucacuguca

SEQ ID NO: 1668714 - RNA, 13 nt, Homo sapiens
gagacgaugcuuu

SEQ ID NO: 1668715 - RNA, 18 nt, Homo sapiens
gagaggagcguguccuau

SEQ ID NO: 1668716 - RNA, 16 nt, Homo sapiens
gagagggggauguuuc

SEQ ID NO: 1668717 - RNA, 13 nt, Homo sapiens
gagauacuuugca

SEQ ID NO: 1668718 - RNA, 20 nt, Homo sapiens
gagauagaggaugggcagcu

SEQ ID NO: 1668719 - RNA, 12 nt, Homo sapiens
gagaugauuucc

SEQ ID NO: 1668720 - RNA, 14 nt, Homo sapiens
gagaugccuuccag

SEQ ID NO: 1668721 - RNA, 22 nt, Homo sapiens
gagauugcucuggggcuugcua

SEQ ID NO: 1668722 - RNA, 19 nt, Homo sapiens
gagcaaggcugcuaagugg

SEQ ID NO: 1668723 - RNA, 17 nt, Homo sapiens
gagcacuagaagcacag

SEQ ID NO: 1668724 - RNA, 15 nt, Homo sapiens
gagcagaacccagac

SEQ ID NO: 1668725 - RNA, 23 nt, Homo sapiens
gagcagagcugauggagaaggaa

SEQ ID NO: 1668726 - RNA, 16 nt, Homo sapiens
gagcaugaagauaaau

SEQ ID NO: 1668727 - RNA, 20 nt, Homo sapiens
gagcaugaagauaaauccaa

SEQ ID NO: 1668728 - RNA, 20 nt, Homo sapiens
gagcaugcucaguuggugcu

SEQ ID NO: 1668729 - RNA, 19 nt, Homo sapiens
gagcaugcucccucaugca

SEQ ID NO: 1668730 - RNA, 19 nt, Homo sapiens
gagcccagaagcucaaggc

SEQ ID NO: 1668731 - RNA, 15 nt, Homo sapiens
gagccccuguuucuc

SEQ ID NO: 1668732 - RNA, 18 nt, Homo sapiens
gagcccggaggacaggcu

SEQ ID NO: 1668733 - RNA, 16 nt, Homo sapiens
gagcguguacuacccc

SEQ ID NO: 1668734 - RNA, 16 nt, Homo sapiens
gagcucccucgcugua

SEQ ID NO: 1668735 - RNA, 16 nt, Homo sapiens
gagcuugggugcauuu

SEQ ID NO: 1668736 - RNA, 18 nt, Homo sapiens
gagcuuuacagugccacg

SEQ ID NO: 1668737 - RNA, 16 nt, Homo sapiens
gaggaacugcuugugc

SEQ ID NO: 1668738 - RNA, 15 nt, Homo sapiens
gaggaauaaaaugau

SEQ ID NO: 1668739 - RNA, 21 nt, Homo sapiens
gaggacagggagggaacagac

SEQ ID NO: 1668740 - RNA, 14 nt, Homo sapiens
gaggaccagguguc

SEQ ID NO: 1668741 - RNA, 22 nt, Homo sapiens
gaggagccaggcaacuucaguc

SEQ ID NO: 1668742 - RNA, 21 nt, Homo sapiens
gaggaggggagcaaggcugcu

SEQ ID NO: 1668743 - RNA, 15 nt, Homo sapiens
gaggaugggcagcug

SEQ ID NO: 1668744 - RNA, 14 nt, Homo sapiens
gaggcaauaaucuu

SEQ ID NO: 1668745 - RNA, 19 nt, Homo sapiens
gaggcagagucucuaguuc

SEQ ID NO: 1668746 - RNA, 20 nt, Homo sapiens
gaggcaggagaauggcguga

SEQ ID NO: 1668747 - RNA, 20 nt, Homo sapiens
gaggccaaggcgggcggauc

SEQ ID NO: 1668748 - RNA, 21 nt, Homo sapiens
gaggccugggugugaccugac

SEQ ID NO: 1668749 - RNA, 11 nt, Homo sapiens
gaggcuaugug

SEQ ID NO: 1668750 - RNA, 20 nt, Homo sapiens
gaggcucccacuucuuggga

SEQ ID NO: 1668751 - RNA, 17 nt, Homo sapiens
gagggaacaaauuuuca

SEQ ID NO: 1668752 - RNA, 18 nt, Homo sapiens
gagggaauccauaucagc

SEQ ID NO: 1668753 - RNA, 16 nt, Homo sapiens
gagggguuaaugcaga

SEQ ID NO: 1668754 - RNA, 23 nt, Homo sapiens
gaggguccucaguccacugcuga

SEQ ID NO: 1668755 - RNA, 14 nt, Homo sapiens
gagguacgaaaaga

SEQ ID NO: 1668756 - RNA, 17 nt, Homo sapiens
gaggugaaugcacagug

SEQ ID NO: 1668757 - RNA, 20 nt, Homo sapiens
gagguggagcuugcagugag

SEQ ID NO: 1668758 - RNA, 15 nt, Homo sapiens
gaggugggaggacag

SEQ ID NO: 1668759 - RNA, 18 nt, Homo sapiens
gaguaucugagaaccaac

SEQ ID NO: 1668760 - RNA, 15 nt, Homo sapiens
gagucagaggcagaa

SEQ ID NO: 1668761 - RNA, 15 nt, Homo sapiens
gagucagccccacuc

SEQ ID NO: 1668762 - RNA, 17 nt, Homo sapiens
gagucagggcugugcuu

SEQ ID NO: 1668763 - RNA, 14 nt, Homo sapiens
gagucauuguuaca

SEQ ID NO: 1668764 - RNA, 13 nt, Homo sapiens
gagucuccucacu

SEQ ID NO: 1668765 - RNA, 22 nt, Homo sapiens
gagucuggauaauuuguauaag

SEQ ID NO: 1668766 - RNA, 16 nt, Homo sapiens
gagugcaguggcgcga

SEQ ID NO: 1668767 - RNA, 16 nt, Homo sapiens
gagugcaguggcucaa

SEQ ID NO: 1668768 - RNA, 20 nt, Homo sapiens
gagugucaccagcugccaaa

SEQ ID NO: 1668769 - RNA, 23 nt, Homo sapiens
gaguuccugagacaugcucuuuu

SEQ ID NO: 1668770 - RNA, 23 nt, Homo sapiens
gaguuuccagcuaagccugauga

SEQ ID NO: 1668771 - RNA, 19 nt, Homo sapiens
gaguuucuauggauucacu

SEQ ID NO: 1668772 - RNA, 18 nt, Homo sapiens
gauaaauucuuucuuuga

SEQ ID NO: 1668773 - RNA, 17 nt, Homo sapiens
gauaaauuugacuguua

SEQ ID NO: 1668774 - RNA, 21 nt, Homo sapiens
gauaaauuugacuguuauuug

SEQ ID NO: 1668775 - RNA, 14 nt, Homo sapiens
gauaaggagggcaa

SEQ ID NO: 1668776 - RNA, 18 nt, Homo sapiens
gauaaucccauacucuca

SEQ ID NO: 1668777 - RNA, 17 nt, Homo sapiens
gauaauuaaaugaaaua

SEQ ID NO: 1668778 - RNA, 20 nt, Homo sapiens
gauacaggagaagaaacagc

SEQ ID NO: 1668779 - RNA, 11 nt, Homo sapiens
gauacaguauu

SEQ ID NO: 1668780 - RNA, 13 nt, Homo sapiens
gauacaguauuau

SEQ ID NO: 1668781 - RNA, 13 nt, Homo sapiens
gauaccugugagg

SEQ ID NO: 1668782 - RNA, 16 nt, Homo sapiens
gauacuuguaacuuuu

SEQ ID NO: 1668783 - RNA, 14 nt, Homo sapiens
gauaggagcuucca

SEQ ID NO: 1668784 - RNA, 23 nt, Homo sapiens
gauaucaggaaauaucugugaag

SEQ ID NO: 1668785 - RNA, 14 nt, Homo sapiens
gauaugcacuugaa

SEQ ID NO: 1668786 - RNA, 19 nt, Homo sapiens
gauaugcacuugaaaugau

SEQ ID NO: 1668787 - RNA, 14 nt, Homo sapiens
gauaugggacugag

SEQ ID NO: 1668788 - RNA, 14 nt, Homo sapiens
gaucaagcuccauc

SEQ ID NO: 1668789 - RNA, 12 nt, Homo sapiens
gaucagcuggug

SEQ ID NO: 1668790 - RNA, 18 nt, Homo sapiens
gaucauagcugacucaga

SEQ ID NO: 1668791 - RNA, 19 nt, Homo sapiens
gaucaugaaucacugcacc

SEQ ID NO: 1668792 - RNA, 21 nt, Homo sapiens
gauccagcggggcuucugggc

SEQ ID NO: 1668793 - RNA, 22 nt, Homo sapiens
gauccauuuaaaacaagcugau

SEQ ID NO: 1668794 - RNA, 21 nt, Homo sapiens
gaucccuaaagaaaacaaaca

SEQ ID NO: 1668795 - RNA, 18 nt, Homo sapiens
gaucuaaaaggaggacag

SEQ ID NO: 1668796 - RNA, 15 nt, Homo sapiens
gaucuauaccaccuu

SEQ ID NO: 1668797 - RNA, 13 nt, Homo sapiens
gaucucagcucac

SEQ ID NO: 1668798 - RNA, 13 nt, Homo sapiens
gaucuguccgaca

SEQ ID NO: 1668799 - RNA, 19 nt, Homo sapiens
gaugaaaaccacccuauca

SEQ ID NO: 1668800 - RNA, 21 nt, Homo sapiens
gaugaaauaaaccccagucuc

SEQ ID NO: 1668801 - RNA, 14 nt, Homo sapiens
gaugaaaugccaag

SEQ ID NO: 1668802 - RNA, 14 nt, Homo sapiens
gaugaaggggccag

SEQ ID NO: 1668803 - RNA, 21 nt, Homo sapiens
gaugaaguuguacaacaccag

SEQ ID NO: 1668804 - RNA, 18 nt, Homo sapiens
gaugaccaaucucuguga

SEQ ID NO: 1668805 - RNA, 14 nt, Homo sapiens
gaugaccauaugca

SEQ ID NO: 1668806 - RNA, 14 nt, Homo sapiens
gaugaggcuggaua

SEQ ID NO: 1668807 - RNA, 15 nt, Homo sapiens
gauggcuuaagccug

SEQ ID NO: 1668808 - RNA, 17 nt, Homo sapiens
gaugggguuucaccaug

SEQ ID NO: 1668809 - RNA, 11 nt, Homo sapiens
gaugguugguu

SEQ ID NO: 1668810 - RNA, 23 nt, Homo sapiens
gauguccaaacuuaacagaucac

SEQ ID NO: 1668811 - RNA, 13 nt, Homo sapiens
gaugugauacaaa

SEQ ID NO: 1668812 - RNA, 17 nt, Homo sapiens
gaugugcagauaucaca

SEQ ID NO: 1668813 - RNA, 13 nt, Homo sapiens
gaugugcuuucau

SEQ ID NO: 1668814 - RNA, 21 nt, Homo sapiens
gauguggccccacccuuuccu

SEQ ID NO: 1668815 - RNA, 13 nt, Homo sapiens
gaugugucuucaa

SEQ ID NO: 1668816 - RNA, 15 nt, Homo sapiens
gauguuuccaaugcu

SEQ ID NO: 1668817 - RNA, 14 nt, Homo sapiens
gauuaaaaccagag

SEQ ID NO: 1668818 - RNA, 12 nt, Homo sapiens
gauucaccuuuu

SEQ ID NO: 1668819 - RNA, 21 nt, Homo sapiens
gauucagcacuuugcucuuuu

SEQ ID NO: 1668820 - RNA, 14 nt, Homo sapiens
gauucauaaugacu

SEQ ID NO: 1668821 - RNA, 15 nt, Homo sapiens
gauuccccuggacau

SEQ ID NO: 1668822 - RNA, 18 nt, Homo sapiens
gauucuaaaggggacaga

SEQ ID NO: 1668823 - RNA, 17 nt, Homo sapiens
gauucucuccugauuau

SEQ ID NO: 1668824 - RNA, 23 nt, Homo sapiens
gauugaagcuaaaauaaaccaga

SEQ ID NO: 1668825 - RNA, 17 nt, Homo sapiens
gauugaaggauugugaa

SEQ ID NO: 1668826 - RNA, 21 nt, Homo sapiens
gauugagagcagccucuugaa

SEQ ID NO: 1668827 - RNA, 18 nt, Homo sapiens
gauuggguaucaaaauga

SEQ ID NO: 1668828 - RNA, 13 nt, Homo sapiens
gauugucugagga

SEQ ID NO: 1668829 - RNA, 19 nt, Homo sapiens
gauugugaccuccagaggu

SEQ ID NO: 1668830 - RNA, 17 nt, Homo sapiens
gauuuauuuuguaugaa

SEQ ID NO: 1668831 - RNA, 19 nt, Homo sapiens
gauuuccacacgccaagcu

SEQ ID NO: 1668832 - RNA, 14 nt, Homo sapiens
gauuuccauuugca

SEQ ID NO: 1668833 - RNA, 22 nt, Homo sapiens
gauuugguuaagcucacacagc

SEQ ID NO: 1668834 - RNA, 17 nt, Homo sapiens
gauuuuggagauuccca

SEQ ID NO: 1668835 - RNA, 15 nt, Homo sapiens
gcaaagaaucaacag

SEQ ID NO: 1668836 - RNA, 14 nt, Homo sapiens
gcaaauaaauauca

SEQ ID NO: 1668837 - RNA, 19 nt, Homo sapiens
gcaaaugaaggaaugcaau

SEQ ID NO: 1668838 - RNA, 15 nt, Homo sapiens
gcaacaaacucaaaa

SEQ ID NO: 1668839 - RNA, 18 nt, Homo sapiens
gcaaccucugccucccag

SEQ ID NO: 1668840 - RNA, 15 nt, Homo sapiens
gcaagacaccuuccc

SEQ ID NO: 1668841 - RNA, 20 nt, Homo sapiens
gcaauaaguugaaugauaau

SEQ ID NO: 1668842 - RNA, 15 nt, Homo sapiens
gcaauaauugacaaa

SEQ ID NO: 1668843 - RNA, 20 nt, Homo sapiens
gcaauaugggaggaacaaag

SEQ ID NO: 1668844 - RNA, 17 nt, Homo sapiens
gcaauccugcaagaaca

SEQ ID NO: 1668845 - RNA, 16 nt, Homo sapiens
gcaaucuguccagaca

SEQ ID NO: 1668846 - RNA, 16 nt, Homo sapiens
gcaaugagaaggccag

SEQ ID NO: 1668847 - RNA, 17 nt, Homo sapiens
gcaauggugaacuguca

SEQ ID NO: 1668848 - RNA, 19 nt, Homo sapiens
gcaauggugcgaucucagc

SEQ ID NO: 1668849 - RNA, 13 nt, Homo sapiens
gcaauugcuucuc

SEQ ID NO: 1668850 - RNA, 17 nt, Homo sapiens
gcaauuuuuccaaaagc

SEQ ID NO: 1668851 - RNA, 21 nt, Homo sapiens
gcaauuuuuccaaaagccagu

SEQ ID NO: 1668852 - RNA, 23 nt, Homo sapiens
gcacaaaagucucaauguuccau

SEQ ID NO: 1668853 - RNA, 17 nt, Homo sapiens
gcacaacaugcacauuc

SEQ ID NO: 1668854 - RNA, 13 nt, Homo sapiens
gcacaaccagaaa

SEQ ID NO: 1668855 - RNA, 19 nt, Homo sapiens
gcacagaggauggcuuccc

SEQ ID NO: 1668856 - RNA, 14 nt, Homo sapiens
gcacagaucucuag

SEQ ID NO: 1668857 - RNA, 17 nt, Homo sapiens
gcacauucauccucaca

SEQ ID NO: 1668858 - RNA, 14 nt, Homo sapiens
gcacauuuguuaau

SEQ ID NO: 1668859 - RNA, 17 nt, Homo sapiens
gcaccagccugagccac

SEQ ID NO: 1668860 - RNA, 23 nt, Homo sapiens
gcaccaucacccuugaaaacucu

SEQ ID NO: 1668861 - RNA, 22 nt, Homo sapiens
gcacccucugcuaugucuguga

SEQ ID NO: 1668862 - RNA, 20 nt, Homo sapiens
gcaccgggcuggccugacac

SEQ ID NO: 1668863 - RNA, 21 nt, Homo sapiens
gcaccgggcuggccugacaca

SEQ ID NO: 1668864 - RNA, 13 nt, Homo sapiens
gcaccucuugaag

SEQ ID NO: 1668865 - RNA, 19 nt, Homo sapiens
gcaccuugggcacgggaga

SEQ ID NO: 1668866 - RNA, 19 nt, Homo sapiens
gcacuccaugagugcagcu

SEQ ID NO: 1668867 - RNA, 18 nt, Homo sapiens
gcacugaaguagccaaca

SEQ ID NO: 1668868 - RNA, 15 nt, Homo sapiens
gcacugcuccagugg

SEQ ID NO: 1668869 - RNA, 20 nt, Homo sapiens
gcagaaauuuuaagccaaaa

SEQ ID NO: 1668870 - RNA, 19 nt, Homo sapiens
gcagaaggugaaauggagg

SEQ ID NO: 1668871 - RNA, 22 nt, Homo sapiens
gcagacuuucuacaugcaaauc

SEQ ID NO: 1668872 - RNA, 20 nt, Homo sapiens
gcagagauugggggggcuug

SEQ ID NO: 1668873 - RNA, 16 nt, Homo sapiens
gcagaggccaugaaga

SEQ ID NO: 1668874 - RNA, 22 nt, Homo sapiens
gcagaguugaagacagagcuac

SEQ ID NO: 1668875 - RNA, 14 nt, Homo sapiens
gcagcagagccauc

SEQ ID NO: 1668876 - RNA, 14 nt, Homo sapiens
gcagccugagcucc

SEQ ID NO: 1668877 - RNA, 13 nt, Homo sapiens
gcagcggcuuccu

SEQ ID NO: 1668878 - RNA, 14 nt, Homo sapiens
gcagcuccacaggg

SEQ ID NO: 1668879 - RNA, 20 nt, Homo sapiens
gcagcuccccaaaccaggcc

SEQ ID NO: 1668880 - RNA, 18 nt, Homo sapiens
gcagcuccggaaggacac

SEQ ID NO: 1668881 - RNA, 23 nt, Homo sapiens
gcagcugcaccagcaggugccau

SEQ ID NO: 1668882 - RNA, 12 nt, Homo sapiens
gcagcuggagau

SEQ ID NO: 1668883 - RNA, 17 nt, Homo sapiens
gcagcuggagaucuuaa

SEQ ID NO: 1668884 - RNA, 9 nt, Homo sapiens
gcagcuuua

SEQ ID NO: 1668885 - RNA, 17 nt, Homo sapiens
gcaggcucucaggccag

SEQ ID NO: 1668886 - RNA, 18 nt, Homo sapiens
gcaggcucucaggccagc

SEQ ID NO: 1668887 - RNA, 23 nt, Homo sapiens
gcaggcuucuuccccccaaaacu

SEQ ID NO: 1668888 - RNA, 14 nt, Homo sapiens
gcaggguucuagaa

SEQ ID NO: 1668889 - RNA, 21 nt, Homo sapiens
gcaggugucccugagaaccca

SEQ ID NO: 1668890 - RNA, 17 nt, Homo sapiens
gcagguuggaccccaga

SEQ ID NO: 1668891 - RNA, 13 nt, Homo sapiens
gcaguauugacaa

SEQ ID NO: 1668892 - RNA, 15 nt, Homo sapiens
gcagucagcacagag

SEQ ID NO: 1668893 - RNA, 17 nt, Homo sapiens
gcagugcaauacucagu

SEQ ID NO: 1668894 - RNA, 15 nt, Homo sapiens
gcagugcagugcuca

SEQ ID NO: 1668895 - RNA, 24 nt, Homo sapiens
gcaguggagaggggacuuggauag

SEQ ID NO: 1668896 - RNA, 17 nt, Homo sapiens
gcaguggcgcgaucuca

SEQ ID NO: 1668897 - RNA, 22 nt, Homo sapiens
gcaguggcgcgaucucagcuca

SEQ ID NO: 1668898 - RNA, 17 nt, Homo sapiens
gcaguggcgugaucuca

SEQ ID NO: 1668899 - RNA, 16 nt, Homo sapiens
gcaguggcucaaucuc

SEQ ID NO: 1668900 - RNA, 15 nt, Homo sapiens
gcaguguucuugggg

SEQ ID NO: 1668901 - RNA, 12 nt, Homo sapiens
gcauaucucagu

SEQ ID NO: 1668902 - RNA, 17 nt, Homo sapiens
gcauccauguaaucuau

SEQ ID NO: 1668903 - RNA, 16 nt, Homo sapiens
gcaucuaagacauuca

SEQ ID NO: 1668904 - RNA, 17 nt, Homo sapiens
gcaucuaagacauucac

SEQ ID NO: 1668905 - RNA, 13 nt, Homo sapiens
gcaucuagucaag

SEQ ID NO: 1668906 - RNA, 12 nt, Homo sapiens
gcaucuaucugg

SEQ ID NO: 1668907 - RNA, 20 nt, Homo sapiens
gcaucuaucuggugauuucu

SEQ ID NO: 1668908 - RNA, 9 nt, Homo sapiens
gcaucuccc

SEQ ID NO: 1668909 - RNA, 14 nt, Homo sapiens
gcaugaagcacauu

SEQ ID NO: 1668910 - RNA, 15 nt, Homo sapiens
gcaugaauagauucu

SEQ ID NO: 1668911 - RNA, 13 nt, Homo sapiens
gcaugagcaccuu

SEQ ID NO: 1668912 - RNA, 23 nt, Homo sapiens
gcaugaggugagagaaagccaca

SEQ ID NO: 1668913 - RNA, 21 nt, Homo sapiens
gcaugcccccuccugcaaggg

SEQ ID NO: 1668914 - RNA, 19 nt, Homo sapiens
gcaugcucaguuggugcug

SEQ ID NO: 1668915 - RNA, 14 nt, Homo sapiens
gcauggaguauuau

SEQ ID NO: 1668916 - RNA, 19 nt, Homo sapiens
gcauggccgcaacuuccca

SEQ ID NO: 1668917 - RNA, 20 nt, Homo sapiens
gcauggcugccaaugggagc

SEQ ID NO: 1668918 - RNA, 13 nt, Homo sapiens
gcauguguguuca

SEQ ID NO: 1668919 - RNA, 14 nt, Homo sapiens
gcauuaauguaucu

SEQ ID NO: 1668920 - RNA, 15 nt, Homo sapiens
gcauuuaacugccuu

SEQ ID NO: 1668921 - RNA, 23 nt, Homo sapiens
gcauuuagacucucgacuggcca

SEQ ID NO: 1668922 - RNA, 16 nt, Homo sapiens
gcauuuagcacaguau

SEQ ID NO: 1668923 - RNA, 23 nt, Homo sapiens
gcauuuaggaaagcagugcagua

SEQ ID NO: 1668924 - RNA, 23 nt, Homo sapiens
gcauuucuacauguuuuagacag

SEQ ID NO: 1668925 - RNA, 20 nt, Homo sapiens
gcauuuuacugucuguaaga

SEQ ID NO: 1668926 - RNA, 18 nt, Homo sapiens
gccaaaaaaugcuugcuu

SEQ ID NO: 1668927 - RNA, 18 nt, Homo sapiens
gccaagaaagaaaccaga

SEQ ID NO: 1668928 - RNA, 15 nt, Homo sapiens
gccaaggacacugau

SEQ ID NO: 1668929 - RNA, 16 nt, Homo sapiens
gccaaggccagcccac

SEQ ID NO: 1668930 - RNA, 22 nt, Homo sapiens
gccaaugaaucaaugugcuccu

SEQ ID NO: 1668931 - RNA, 14 nt, Homo sapiens
gccacaagcacaau

SEQ ID NO: 1668932 - RNA, 18 nt, Homo sapiens
gccacacuggccggccca

SEQ ID NO: 1668933 - RNA, 19 nt, Homo sapiens
gccacagggacgacccggg

SEQ ID NO: 1668934 - RNA, 19 nt, Homo sapiens
gccacauggccgcugccca

SEQ ID NO: 1668935 - RNA, 16 nt, Homo sapiens
gccacccaccccaagc

SEQ ID NO: 1668936 - RNA, 19 nt, Homo sapiens
gccacccggaucuccaggc

SEQ ID NO: 1668937 - RNA, 15 nt, Homo sapiens
gccaccuuugaagaa

SEQ ID NO: 1668938 - RNA, 14 nt, Homo sapiens
gccacgacauggcu

SEQ ID NO: 1668939 - RNA, 18 nt, Homo sapiens
gccacguggccgcugccc

SEQ ID NO: 1668940 - RNA, 13 nt, Homo sapiens
gccacugcacucc

SEQ ID NO: 1668941 - RNA, 18 nt, Homo sapiens
gccacugcacuccagccu

SEQ ID NO: 1668942 - RNA, 15 nt, Homo sapiens
gccagaggcucuaau

SEQ ID NO: 1668943 - RNA, 18 nt, Homo sapiens
gccagaggcucuaaugua

SEQ ID NO: 1668944 - RNA, 20 nt, Homo sapiens
gccagaggcucuaauguaca

SEQ ID NO: 1668945 - RNA, 21 nt, Homo sapiens
gccagaggcucuaauguacaa

SEQ ID NO: 1668946 - RNA, 23 nt, Homo sapiens
gccagaggcucuaauguacaaua

SEQ ID NO: 1668947 - RNA, 20 nt, Homo sapiens
gccagcaccaccccauccgc

SEQ ID NO: 1668948 - RNA, 17 nt, Homo sapiens
gccagcagggcgggcca

SEQ ID NO: 1668949 - RNA, 17 nt, Homo sapiens
gccaggacaaaaugcaa

SEQ ID NO: 1668950 - RNA, 19 nt, Homo sapiens
gccaggacaaaaugcagac

SEQ ID NO: 1668951 - RNA, 17 nt, Homo sapiens
gccaggaguggguuucc

SEQ ID NO: 1668952 - RNA, 19 nt, Homo sapiens
gccaggccucagggaccaa

SEQ ID NO: 1668953 - RNA, 19 nt, Homo sapiens
gccaggcucccacugcccc

SEQ ID NO: 1668954 - RNA, 19 nt, Homo sapiens
gccaggcuggagugcagug

SEQ ID NO: 1668955 - RNA, 13 nt, Homo sapiens
gccagggaaacca

SEQ ID NO: 1668956 - RNA, 22 nt, Homo sapiens
gccauuuuuugucugugauaac

SEQ ID NO: 1668957 - RNA, 21 nt, Homo sapiens
gcccaaggcccccaccucugu

SEQ ID NO: 1668958 - RNA, 12 nt, Homo sapiens
gcccacacuugg

SEQ ID NO: 1668959 - RNA, 22 nt, Homo sapiens
gcccaccucuuguuuuccccuu

SEQ ID NO: 1668960 - RNA, 14 nt, Homo sapiens
gcccaccugccagg

SEQ ID NO: 1668961 - RNA, 12 nt, Homo sapiens
gcccagaacggg

SEQ ID NO: 1668962 - RNA, 14 nt, Homo sapiens
gcccagagacugaa

SEQ ID NO: 1668963 - RNA, 22 nt, Homo sapiens
gcccauuaggucuggcaugccc

SEQ ID NO: 1668964 - RNA, 15 nt, Homo sapiens
gccccagugaccggg

SEQ ID NO: 1668965 - RNA, 14 nt, Homo sapiens
gcccccacccggga

SEQ ID NO: 1668966 - RNA, 22 nt, Homo sapiens
gcccccacuggagcguguacua

SEQ ID NO: 1668967 - RNA, 17 nt, Homo sapiens
gcccccccuaucucuuc

SEQ ID NO: 1668968 - RNA, 23 nt, Homo sapiens
gcccccggcucggccucuugaga

SEQ ID NO: 1668969 - RNA, 20 nt, Homo sapiens
gcccccucgcgccccugucc

SEQ ID NO: 1668970 - RNA, 12 nt, Homo sapiens
gccccugccuga

SEQ ID NO: 1668971 - RNA, 22 nt, Homo sapiens
gccccuggggccuagacucugu

SEQ ID NO: 1668972 - RNA, 14 nt, Homo sapiens
gccccuugcuucua

SEQ ID NO: 1668973 - RNA, 21 nt, Homo sapiens
gcccgaaaccucauuagcaau

SEQ ID NO: 1668974 - RNA, 14 nt, Homo sapiens
gcccgcacagcagc

SEQ ID NO: 1668975 - RNA, 16 nt, Homo sapiens
gcccuaugcaagcaaa

SEQ ID NO: 1668976 - RNA, 18 nt, Homo sapiens
gcccucaacccugugauc

SEQ ID NO: 1668977 - RNA, 20 nt, Homo sapiens
gcccucagccccacuucuca

SEQ ID NO: 1668978 - RNA, 16 nt, Homo sapiens
gcccucaggcaccugc

SEQ ID NO: 1668979 - RNA, 16 nt, Homo sapiens
gcccucccucccucca

SEQ ID NO: 1668980 - RNA, 16 nt, Homo sapiens
gcccuggccuaccaca

SEQ ID NO: 1668981 - RNA, 13 nt, Homo sapiens
gcccugucuuucc

SEQ ID NO: 1668982 - RNA, 14 nt, Homo sapiens
gcccuguugaccua

SEQ ID NO: 1668983 - RNA, 14 nt, Homo sapiens
gccgauauaagcca

SEQ ID NO: 1668984 - RNA, 16 nt, Homo sapiens
gccgauauaagccaua

SEQ ID NO: 1668985 - RNA, 14 nt, Homo sapiens
gccgcucuccgccc

SEQ ID NO: 1668986 - RNA, 17 nt, Homo sapiens
gccgcuuaaacauuucc

SEQ ID NO: 1668987 - RNA, 23 nt, Homo sapiens
gccggucccccaugccaccaccc

SEQ ID NO: 1668988 - RNA, 13 nt, Homo sapiens
gccguaguaccuc

SEQ ID NO: 1668989 - RNA, 16 nt, Homo sapiens
gccgucacgcuuucau

SEQ ID NO: 1668990 - RNA, 22 nt, Homo sapiens
gccguuagggaaauccaacucc

SEQ ID NO: 1668991 - RNA, 15 nt, Homo sapiens
gccuauuuaguucca

SEQ ID NO: 1668992 - RNA, 17 nt, Homo sapiens
gccucagggaccaagga

SEQ ID NO: 1668993 - RNA, 18 nt, Homo sapiens
gccucauccuccacugaa

SEQ ID NO: 1668994 - RNA, 20 nt, Homo sapiens
gccuccaagucaugggagaa

SEQ ID NO: 1668995 - RNA, 17 nt, Homo sapiens
gccuccaccuugagcac

SEQ ID NO: 1668996 - RNA, 23 nt, Homo sapiens
gccuccacuugccuugugauauu

SEQ ID NO: 1668997 - RNA, 16 nt, Homo sapiens
gccuccauccacacac

SEQ ID NO: 1668998 - RNA, 20 nt, Homo sapiens
gccucccccucagaugaucu

SEQ ID NO: 1668999 - RNA, 19 nt, Homo sapiens
gccucccgccgccucgggc

SEQ ID NO: 1669000 - RNA, 15 nt, Homo sapiens
gccucccguguucaa

SEQ ID NO: 1669001 - RNA, 18 nt, Homo sapiens
gccucgugccaugaucug

SEQ ID NO: 1669002 - RNA, 18 nt, Homo sapiens
gccucucccaaguccagu

SEQ ID NO: 1669003 - RNA, 20 nt, Homo sapiens
gccucucccaaguccagugu

SEQ ID NO: 1669004 - RNA, 13 nt, Homo sapiens
gccucucucaggc

SEQ ID NO: 1669005 - RNA, 14 nt, Homo sapiens
gccucucucaggcc

SEQ ID NO: 1669006 - RNA, 21 nt, Homo sapiens
gccucuguacgcgcagaucaa

SEQ ID NO: 1669007 - RNA, 18 nt, Homo sapiens
gccucugugccauggaug

SEQ ID NO: 1669008 - RNA, 14 nt, Homo sapiens
gccucugugcugca

SEQ ID NO: 1669009 - RNA, 21 nt, Homo sapiens
gccucuuuuaaugucaucucu

SEQ ID NO: 1669010 - RNA, 18 nt, Homo sapiens
gccugaaggcuauccacu

SEQ ID NO: 1669011 - RNA, 21 nt, Homo sapiens
gccugaguguccacagggaca

SEQ ID NO: 1669012 - RNA, 20 nt, Homo sapiens
gccugcacucuuauuucacu

SEQ ID NO: 1669013 - RNA, 11 nt, Homo sapiens
gccugccaaac

SEQ ID NO: 1669014 - RNA, 16 nt, Homo sapiens
gccugcucccuagcca

SEQ ID NO: 1669015 - RNA, 19 nt, Homo sapiens
gccugcucccuagccagag

SEQ ID NO: 1669016 - RNA, 18 nt, Homo sapiens
gccuggcacaggacugau

SEQ ID NO: 1669017 - RNA, 20 nt, Homo sapiens
gccuggucaauaaaccacug

SEQ ID NO: 1669018 - RNA, 17 nt, Homo sapiens
gccuggucugugcauug

SEQ ID NO: 1669019 - RNA, 22 nt, Homo sapiens
gccugguuuuuaaguacucacu

SEQ ID NO: 1669020 - RNA, 18 nt, Homo sapiens
gccuguguuucauguucu

SEQ ID NO: 1669021 - RNA, 19 nt, Homo sapiens
gccuuaauucuuaccucau

SEQ ID NO: 1669022 - RNA, 19 nt, Homo sapiens
gccuucucuaaacauuuca

SEQ ID NO: 1669023 - RNA, 22 nt, Homo sapiens
gccuucugacggcccugcaaug

SEQ ID NO: 1669024 - RNA, 21 nt, Homo sapiens
gccuuguugaugaagcacauu

SEQ ID NO: 1669025 - RNA, 19 nt, Homo sapiens
gccuuuaauaauguuauag

SEQ ID NO: 1669026 - RNA, 15 nt, Homo sapiens
gccuuucaaagugca

SEQ ID NO: 1669027 - RNA, 17 nt, Homo sapiens
gccuuuuggguuugccu

SEQ ID NO: 1669028 - RNA, 12 nt, Homo sapiens
gcgccacccgcc

SEQ ID NO: 1669029 - RNA, 12 nt, Homo sapiens
gcggcucuccag

SEQ ID NO: 1669030 - RNA, 20 nt, Homo sapiens
gcgucagucgauauucccag

SEQ ID NO: 1669031 - RNA, 17 nt, Homo sapiens
gcgucuacccagacuca

SEQ ID NO: 1669032 - RNA, 12 nt, Homo sapiens
gcuaaccucucu

SEQ ID NO: 1669033 - RNA, 20 nt, Homo sapiens
gcuaauccaggacagcauua

SEQ ID NO: 1669034 - RNA, 17 nt, Homo sapiens
gcuaauuaacuaacuca

SEQ ID NO: 1669035 - RNA, 23 nt, Homo sapiens
gcuacauugacgagcaugagcug

SEQ ID NO: 1669036 - RNA, 22 nt, Homo sapiens
gcuaccauuucaauagccccau

SEQ ID NO: 1669037 - RNA, 17 nt, Homo sapiens
gcuacugaccaucugca

SEQ ID NO: 1669038 - RNA, 16 nt, Homo sapiens
gcuacuuugagccucu

SEQ ID NO: 1669039 - RNA, 20 nt, Homo sapiens
gcuagaaagagaaaaagccc

SEQ ID NO: 1669040 - RNA, 14 nt, Homo sapiens
gcuagaugugucuu

SEQ ID NO: 1669041 - RNA, 19 nt, Homo sapiens
gcuagaugugucuuaccag

SEQ ID NO: 1669042 - RNA, 17 nt, Homo sapiens
gcuaguacucaguacua

SEQ ID NO: 1669043 - RNA, 18 nt, Homo sapiens
gcuaguuuucacauucuu

SEQ ID NO: 1669044 - RNA, 21 nt, Homo sapiens
gcuauaauguauaaugggaaa

SEQ ID NO: 1669045 - RNA, 18 nt, Homo sapiens
gcuaucccgggcauccag

SEQ ID NO: 1669046 - RNA, 17 nt, Homo sapiens
gcuaucucgcuagccau

SEQ ID NO: 1669047 - RNA, 17 nt, Homo sapiens
gcuauggacugcacaaa

SEQ ID NO: 1669048 - RNA, 12 nt, Homo sapiens
gcuaugucucau

SEQ ID NO: 1669049 - RNA, 14 nt, Homo sapiens
gcuauucaccaaua

SEQ ID NO: 1669050 - RNA, 19 nt, Homo sapiens
gcuauucccuggggcugcu

SEQ ID NO: 1669051 - RNA, 12 nt, Homo sapiens
gcucaaucucag

SEQ ID NO: 1669052 - RNA, 15 nt, Homo sapiens
gcucaaugugcuguu

SEQ ID NO: 1669053 - RNA, 14 nt, Homo sapiens
gcucacagccacca

SEQ ID NO: 1669054 - RNA, 18 nt, Homo sapiens
gcucagaaaaucaaagag

SEQ ID NO: 1669055 - RNA, 18 nt, Homo sapiens
gcucaguaacacagugca

SEQ ID NO: 1669056 - RNA, 19 nt, Homo sapiens
gcucaguaaccaugcaaaa

SEQ ID NO: 1669057 - RNA, 18 nt, Homo sapiens
gcucaguuggugcugcuu

SEQ ID NO: 1669058 - RNA, 22 nt, Homo sapiens
gcuccaguauaaauuacaugca

SEQ ID NO: 1669059 - RNA, 18 nt, Homo sapiens
gcuccaucuccaguggga

SEQ ID NO: 1669060 - RNA, 21 nt, Homo sapiens
gcuccaugcagaucuagccag

SEQ ID NO: 1669061 - RNA, 22 nt, Homo sapiens
gcuccccaauccaacccaugca

SEQ ID NO: 1669062 - RNA, 14 nt, Homo sapiens
gcucccggguccug

SEQ ID NO: 1669063 - RNA, 17 nt, Homo sapiens
gcuccuaguuugaccuc

SEQ ID NO: 1669064 - RNA, 20 nt, Homo sapiens
gcucguggugggugcucaag

SEQ ID NO: 1669065 - RNA, 17 nt, Homo sapiens
gcucuaauguacaauaa

SEQ ID NO: 1669066 - RNA, 23 nt, Homo sapiens
gcucuaauguacaauaaagcaau

SEQ ID NO: 1669067 - RNA, 20 nt, Homo sapiens
gcucugcgccgagccucaga

SEQ ID NO: 1669068 - RNA, 21 nt, Homo sapiens
gcucugcgccgagccucagaa

SEQ ID NO: 1669069 - RNA, 17 nt, Homo sapiens
gcucugcuggucuucaa

SEQ ID NO: 1669070 - RNA, 13 nt, Homo sapiens
gcucugucuuucc

SEQ ID NO: 1669071 - RNA, 22 nt, Homo sapiens
gcucuuuagaauggaccacuga

SEQ ID NO: 1669072 - RNA, 15 nt, Homo sapiens
gcugaaaccauccgc

SEQ ID NO: 1669073 - RNA, 22 nt, Homo sapiens
gcugaaagaaggggugccaaaa

SEQ ID NO: 1669074 - RNA, 14 nt, Homo sapiens
gcugaggacacuca

SEQ ID NO: 1669075 - RNA, 20 nt, Homo sapiens
gcugaugaaguuaagcacaa

SEQ ID NO: 1669076 - RNA, 23 nt, Homo sapiens
gcugauuggaaaauaauaaaaga

SEQ ID NO: 1669077 - RNA, 17 nt, Homo sapiens
gcugauugggcaccuga

SEQ ID NO: 1669078 - RNA, 16 nt, Homo sapiens
gcugcagcuugggaga

SEQ ID NO: 1669079 - RNA, 10 nt, Homo sapiens
gcugcaucuc

SEQ ID NO: 1669080 - RNA, 19 nt, Homo sapiens
gcugccccccauuucugua

SEQ ID NO: 1669081 - RNA, 19 nt, Homo sapiens
gcugcccuucuucuugacc

SEQ ID NO: 1669082 - RNA, 15 nt, Homo sapiens
gcugccuguggugag

SEQ ID NO: 1669083 - RNA, 17 nt, Homo sapiens
gcugcuaaguggaagac

SEQ ID NO: 1669084 - RNA, 20 nt, Homo sapiens
gcugcucuccaucucuugua

SEQ ID NO: 1669085 - RNA, 23 nt, Homo sapiens
gcugcuuucuuguugcugcaucu

SEQ ID NO: 1669086 - RNA, 20 nt, Homo sapiens
gcuggagugcaguggcgcga

SEQ ID NO: 1669087 - RNA, 20 nt, Homo sapiens
gcuggaugugcaucuggccu

SEQ ID NO: 1669088 - RNA, 21 nt, Homo sapiens
gcuggcauuugcugcauuuca

SEQ ID NO: 1669089 - RNA, 17 nt, Homo sapiens
gcugggcgccucugucc

SEQ ID NO: 1669090 - RNA, 20 nt, Homo sapiens
gcuguaaccgauaugcacuu

SEQ ID NO: 1669091 - RNA, 12 nt, Homo sapiens
gcugucaugccc

SEQ ID NO: 1669092 - RNA, 14 nt, Homo sapiens
gcugucaugcccag

SEQ ID NO: 1669093 - RNA, 16 nt, Homo sapiens
gcugucauuccaugag

SEQ ID NO: 1669094 - RNA, 21 nt, Homo sapiens
gcuguccagggcagaggccau

SEQ ID NO: 1669095 - RNA, 24 nt, Homo sapiens
gcuguccugagcccccugcaccca

SEQ ID NO: 1669096 - RNA, 15 nt, Homo sapiens
gcugugcgcuccccc

SEQ ID NO: 1669097 - RNA, 15 nt, Homo sapiens
gcuguucugcacuga

SEQ ID NO: 1669098 - RNA, 18 nt, Homo sapiens
gcuuaauaagucacugac

SEQ ID NO: 1669099 - RNA, 22 nt, Homo sapiens
gcuuaaucuagagcuaugcaca

SEQ ID NO: 1669100 - RNA, 21 nt, Homo sapiens
gcuuacaguaggagugagaaa

SEQ ID NO: 1669101 - RNA, 14 nt, Homo sapiens
gcuuaguaucucau

SEQ ID NO: 1669102 - RNA, 15 nt, Homo sapiens
gcuucaaccccauga

SEQ ID NO: 1669103 - RNA, 16 nt, Homo sapiens
gcuucaccgcauucca

SEQ ID NO: 1669104 - RNA, 12 nt, Homo sapiens
gcuuccugauga

SEQ ID NO: 1669105 - RNA, 21 nt, Homo sapiens
gcuuccuucucaucuugccuc

SEQ ID NO: 1669106 - RNA, 13 nt, Homo sapiens
gcuugaacccuga

SEQ ID NO: 1669107 - RNA, 19 nt, Homo sapiens
gcuugaccuuuaagagaaa

SEQ ID NO: 1669108 - RNA, 16 nt, Homo sapiens
gcuugagcccuggacu

SEQ ID NO: 1669109 - RNA, 11 nt, Homo sapiens
gcuugaugcug

SEQ ID NO: 1669110 - RNA, 22 nt, Homo sapiens
gcuuggugguuaugucccauga

SEQ ID NO: 1669111 - RNA, 13 nt, Homo sapiens
gcuugugcacugg

SEQ ID NO: 1669112 - RNA, 20 nt, Homo sapiens
gcuugugcacuggauguggc

SEQ ID NO: 1669113 - RNA, 19 nt, Homo sapiens
gcuuguguacaaacccaga

SEQ ID NO: 1669114 - RNA, 17 nt, Homo sapiens
gcuuuagagaagccaua

SEQ ID NO: 1669115 - RNA, 20 nt, Homo sapiens
gcuuuagguaaaaagcuuaa

SEQ ID NO: 1669116 - RNA, 17 nt, Homo sapiens
gcuuucuuucugcauga

SEQ ID NO: 1669117 - RNA, 18 nt, Homo sapiens
gcuuucuuucugcaugac

SEQ ID NO: 1669118 - RNA, 20 nt, Homo sapiens
gcuuugcagagaacucauaa

SEQ ID NO: 1669119 - RNA, 14 nt, Homo sapiens
gcuuugccacugaa

SEQ ID NO: 1669120 - RNA, 13 nt, Homo sapiens
gcuuuuuccuuag

SEQ ID NO: 1669121 - RNA, 21 nt, Homo sapiens
ggaaaauaauaaaagaaucau

SEQ ID NO: 1669122 - RNA, 23 nt, Homo sapiens
ggaaaauguucugacagcauuuc

SEQ ID NO: 1669123 - RNA, 22 nt, Homo sapiens
ggaaagacguuuuugugcugug

SEQ ID NO: 1669124 - RNA, 22 nt, Homo sapiens
ggaaaggcaucuaagacauuca

SEQ ID NO: 1669125 - RNA, 18 nt, Homo sapiens
ggaacaggagugacucug

SEQ ID NO: 1669126 - RNA, 15 nt, Homo sapiens
ggaaccagcaaugag

SEQ ID NO: 1669127 - RNA, 21 nt, Homo sapiens
ggaacccaucacugugucuca

SEQ ID NO: 1669128 - RNA, 17 nt, Homo sapiens
ggaacugcuugugcacu

SEQ ID NO: 1669129 - RNA, 21 nt, Homo sapiens
ggaagaagcaaaccugauaca

SEQ ID NO: 1669130 - RNA, 10 nt, Homo sapiens
ggaagagcuc

SEQ ID NO: 1669131 - RNA, 14 nt, Homo sapiens
ggaagcacagaucu

SEQ ID NO: 1669132 - RNA, 23 nt, Homo sapiens
ggaagcacaugccucucucaggc

SEQ ID NO: 1669133 - RNA, 19 nt, Homo sapiens
ggaagcuucuugcugccag

SEQ ID NO: 1669134 - RNA, 15 nt, Homo sapiens
ggaagggaccccaga

SEQ ID NO: 1669135 - RNA, 20 nt, Homo sapiens
ggaagggccaugggaggucc

SEQ ID NO: 1669136 - RNA, 16 nt, Homo sapiens
ggaaugaaugucagug

SEQ ID NO: 1669137 - RNA, 15 nt, Homo sapiens
ggaaugccagggaca

SEQ ID NO: 1669138 - RNA, 20 nt, Homo sapiens
ggaauuauuagcaccagcuu

SEQ ID NO: 1669139 - RNA, 18 nt, Homo sapiens
ggaauuuaauuaggucau

SEQ ID NO: 1669140 - RNA, 23 nt, Homo sapiens
ggacagcucagaaaaucaaagag

SEQ ID NO: 1669141 - RNA, 13 nt, Homo sapiens
ggacagugccuaa

SEQ ID NO: 1669142 - RNA, 16 nt, Homo sapiens
ggaccaggagccaggu

SEQ ID NO: 1669143 - RNA, 20 nt, Homo sapiens
ggacccuguugaggguccuc

SEQ ID NO: 1669144 - RNA, 18 nt, Homo sapiens
ggaccggacgcaugcagg

SEQ ID NO: 1669145 - RNA, 22 nt, Homo sapiens
ggacgauagcuuggagggaugg

SEQ ID NO: 1669146 - RNA, 23 nt, Homo sapiens
ggacuaaccccaacgcacaggaa

SEQ ID NO: 1669147 - RNA, 22 nt, Homo sapiens
ggacugagccuggcccauagaa

SEQ ID NO: 1669148 - RNA, 23 nt, Homo sapiens
ggacugccucugccacacucuga

SEQ ID NO: 1669149 - RNA, 20 nt, Homo sapiens
ggagaaggcaggaacacugg

SEQ ID NO: 1669150 - RNA, 14 nt, Homo sapiens
ggagacgggggcag

SEQ ID NO: 1669151 - RNA, 23 nt, Homo sapiens
ggagagagcaaucuugcugugaa

SEQ ID NO: 1669152 - RNA, 22 nt, Homo sapiens
ggagaggcggccucgugccaug

SEQ ID NO: 1669153 - RNA, 14 nt, Homo sapiens
ggagauaccagaga

SEQ ID NO: 1669154 - RNA, 19 nt, Homo sapiens
ggagcaaauaucuaaauaa

SEQ ID NO: 1669155 - RNA, 14 nt, Homo sapiens
ggagccaugcucuu

SEQ ID NO: 1669156 - RNA, 18 nt, Homo sapiens
ggagccucccccucagau

SEQ ID NO: 1669157 - RNA, 20 nt, Homo sapiens
ggaggaacugcuugugcacu

SEQ ID NO: 1669158 - RNA, 15 nt, Homo sapiens
ggaggauguauguca

SEQ ID NO: 1669159 - RNA, 16 nt, Homo sapiens
ggaggcaugccucuga

SEQ ID NO: 1669160 - RNA, 18 nt, Homo sapiens
ggaggccauuuguguuua

SEQ ID NO: 1669161 - RNA, 16 nt, Homo sapiens
ggagggaagcacugcc

SEQ ID NO: 1669162 - RNA, 11 nt, Homo sapiens
ggagugccaca

SEQ ID NO: 1669163 - RNA, 14 nt, Homo sapiens
ggaucccaacaguu

SEQ ID NO: 1669164 - RNA, 15 nt, Homo sapiens
ggaucuucacugucu

SEQ ID NO: 1669165 - RNA, 16 nt, Homo sapiens
ggaugaaggggccaga

SEQ ID NO: 1669166 - RNA, 15 nt, Homo sapiens
ggaugaccauaugca

SEQ ID NO: 1669167 - RNA, 13 nt, Homo sapiens
ggauguucuagca

SEQ ID NO: 1669168 - RNA, 19 nt, Homo sapiens
ggauugagcagaacccaga

SEQ ID NO: 1669169 - RNA, 22 nt, Homo sapiens
ggcaaaugacaugcacugaccc

SEQ ID NO: 1669170 - RNA, 14 nt, Homo sapiens
ggcaagauagcucc

SEQ ID NO: 1669171 - RNA, 13 nt, Homo sapiens
ggcaaggccuuug

SEQ ID NO: 1669172 - RNA, 22 nt, Homo sapiens
ggcaauaaucuuuuaacagugu

SEQ ID NO: 1669173 - RNA, 17 nt, Homo sapiens
ggcaauauuauguaacc

SEQ ID NO: 1669174 - RNA, 13 nt, Homo sapiens
ggcaaucuugccc

SEQ ID NO: 1669175 - RNA, 12 nt, Homo sapiens
ggcacaaccaga

SEQ ID NO: 1669176 - RNA, 18 nt, Homo sapiens
ggcacaggacugauucug

SEQ ID NO: 1669177 - RNA, 20 nt, Homo sapiens
ggcacaugauaugagucacu

SEQ ID NO: 1669178 - RNA, 12 nt, Homo sapiens
ggcacugucaug

SEQ ID NO: 1669179 - RNA, 16 nt, Homo sapiens
ggcagaagaacgugga

SEQ ID NO: 1669180 - RNA, 18 nt, Homo sapiens
ggcagauaucuauggcag

SEQ ID NO: 1669181 - RNA, 16 nt, Homo sapiens
ggcagcuccacagggc

SEQ ID NO: 1669182 - RNA, 22 nt, Homo sapiens
ggcagcuggggggcuguccuga

SEQ ID NO: 1669183 - RNA, 16 nt, Homo sapiens
ggcagggcaaaugaca

SEQ ID NO: 1669184 - RNA, 18 nt, Homo sapiens
ggcauaaugaguuccuga

SEQ ID NO: 1669185 - RNA, 17 nt, Homo sapiens
ggcauacucuccaggau

SEQ ID NO: 1669186 - RNA, 15 nt, Homo sapiens
ggcauagccauucau

SEQ ID NO: 1669187 - RNA, 14 nt, Homo sapiens
ggcaugaagcacau

SEQ ID NO: 1669188 - RNA, 21 nt, Homo sapiens
ggcauuggguaagggacucca

SEQ ID NO: 1669189 - RNA, 22 nt, Homo sapiens
ggcauuucacaaacucuguaca

SEQ ID NO: 1669190 - RNA, 21 nt, Homo sapiens
ggccaacugcccagagccaca

SEQ ID NO: 1669191 - RNA, 18 nt, Homo sapiens
ggccaaguguacauuuga

SEQ ID NO: 1669192 - RNA, 15 nt, Homo sapiens
ggccacuaguggggu

SEQ ID NO: 1669193 - RNA, 23 nt, Homo sapiens
ggccaguauccuggauuccucua

SEQ ID NO: 1669194 - RNA, 18 nt, Homo sapiens
ggccaugggagguccugg

SEQ ID NO: 1669195 - RNA, 20 nt, Homo sapiens
ggccauuucacauuccugac

SEQ ID NO: 1669196 - RNA, 13 nt, Homo sapiens
ggcccccacagga

SEQ ID NO: 1669197 - RNA, 18 nt, Homo sapiens
ggcccucgggcccucucu

SEQ ID NO: 1669198 - RNA, 21 nt, Homo sapiens
ggcccuggacuucccaaggaa

SEQ ID NO: 1669199 - RNA, 19 nt, Homo sapiens
ggcccugggccucaguuca

SEQ ID NO: 1669200 - RNA, 11 nt, Homo sapiens
ggcccugucac

SEQ ID NO: 1669201 - RNA, 13 nt, Homo sapiens
ggcccuuacaccc

SEQ ID NO: 1669202 - RNA, 17 nt, Homo sapiens
ggcccuuguaaugccac

SEQ ID NO: 1669203 - RNA, 18 nt, Homo sapiens
ggccuaaucucauaccuc

SEQ ID NO: 1669204 - RNA, 16 nt, Homo sapiens
ggccuaugacccugug

SEQ ID NO: 1669205 - RNA, 17 nt, Homo sapiens
ggccuaugacccugugc

SEQ ID NO: 1669206 - RNA, 23 nt, Homo sapiens
ggccucaccuggcuucccaggac

SEQ ID NO: 1669207 - RNA, 14 nt, Homo sapiens
ggccucagucuccc

SEQ ID NO: 1669208 - RNA, 15 nt, Homo sapiens
ggccuccaagccagg

SEQ ID NO: 1669209 - RNA, 16 nt, Homo sapiens
ggccucccaccaggaa

SEQ ID NO: 1669210 - RNA, 17 nt, Homo sapiens
ggccuuccuccucucaa

SEQ ID NO: 1669211 - RNA, 20 nt, Homo sapiens
ggccuugccagcaacaccug

SEQ ID NO: 1669212 - RNA, 19 nt, Homo sapiens
ggccuuuggcuuggcgaga

SEQ ID NO: 1669213 - RNA, 13 nt, Homo sapiens
ggcggugagcaau

SEQ ID NO: 1669214 - RNA, 18 nt, Homo sapiens
ggcgugcuccuuuucucu

SEQ ID NO: 1669215 - RNA, 14 nt, Homo sapiens
ggcuagaagcacag

SEQ ID NO: 1669216 - RNA, 16 nt, Homo sapiens
ggcuccacuacagacc

SEQ ID NO: 1669217 - RNA, 22 nt, Homo sapiens
ggcucccucgcccuaagaggcu

SEQ ID NO: 1669218 - RNA, 20 nt, Homo sapiens
ggcuccucaccaccgagaca

SEQ ID NO: 1669219 - RNA, 19 nt, Homo sapiens
ggcucuaauguacaauaaa

SEQ ID NO: 1669220 - RNA, 21 nt, Homo sapiens
ggcucuaauguacaauaaagc

SEQ ID NO: 1669221 - RNA, 14 nt, Homo sapiens
ggcucuccaagcac

SEQ ID NO: 1669222 - RNA, 11 nt, Homo sapiens
ggcucucucac

SEQ ID NO: 1669223 - RNA, 12 nt, Homo sapiens
ggcugcaaaaug

SEQ ID NO: 1669224 - RNA, 22 nt, Homo sapiens
ggcugcuucuccaccuccccca

SEQ ID NO: 1669225 - RNA, 14 nt, Homo sapiens
ggcuggagugggcu

SEQ ID NO: 1669226 - RNA, 13 nt, Homo sapiens
ggcuguucugcac

SEQ ID NO: 1669227 - RNA, 16 nt, Homo sapiens
ggcuuacuaguaucac

SEQ ID NO: 1669228 - RNA, 21 nt, Homo sapiens
ggcuuaucagaacuccuuucu

SEQ ID NO: 1669229 - RNA, 16 nt, Homo sapiens
ggcuucauccuccuca

SEQ ID NO: 1669230 - RNA, 14 nt, Homo sapiens
ggcuuccugaugau

SEQ ID NO: 1669231 - RNA, 12 nt, Homo sapiens
ggcuucuucaac

SEQ ID NO: 1669232 - RNA, 15 nt, Homo sapiens
ggcuuguucagucac

SEQ ID NO: 1669233 - RNA, 17 nt, Homo sapiens
ggcuuuaagcgaggcag

SEQ ID NO: 1669234 - RNA, 20 nt, Homo sapiens
ggcuuuacauggguucaauu

SEQ ID NO: 1669235 - RNA, 21 nt, Homo sapiens
gggaaaggcaucuaagacauu

SEQ ID NO: 1669236 - RNA, 20 nt, Homo sapiens
gggaaauugcuccauuccug

SEQ ID NO: 1669237 - RNA, 22 nt, Homo sapiens
gggaagcugcagcuugggagag

SEQ ID NO: 1669238 - RNA, 17 nt, Homo sapiens
gggaaggugagccagac

SEQ ID NO: 1669239 - RNA, 16 nt, Homo sapiens
gggacaaaacgcagac

SEQ ID NO: 1669240 - RNA, 20 nt, Homo sapiens
gggacagaggauuucugcuu

SEQ ID NO: 1669241 - RNA, 13 nt, Homo sapiens
gggacuacaggcg

SEQ ID NO: 1669242 - RNA, 13 nt, Homo sapiens
gggacuuggauag

SEQ ID NO: 1669243 - RNA, 15 nt, Homo sapiens
gggagaaaagccaga

SEQ ID NO: 1669244 - RNA, 20 nt, Homo sapiens
gggagguggagcuugcagug

SEQ ID NO: 1669245 - RNA, 21 nt, Homo sapiens
gggaucuaaaaggaggacagg

SEQ ID NO: 1669246 - RNA, 19 nt, Homo sapiens
gggaucugcuugauauccc

SEQ ID NO: 1669247 - RNA, 14 nt, Homo sapiens
gggaucuuacccac

SEQ ID NO: 1669248 - RNA, 22 nt, Homo sapiens
gggauugucuuacuguugcaua

SEQ ID NO: 1669249 - RNA, 12 nt, Homo sapiens
gggcacugucau

SEQ ID NO: 1669250 - RNA, 21 nt, Homo sapiens
gggcaggggcugcauccucag

SEQ ID NO: 1669251 - RNA, 21 nt, Homo sapiens
gggccaaauucccaaccugcu

SEQ ID NO: 1669252 - RNA, 14 nt, Homo sapiens
gggccccauggcca

SEQ ID NO: 1669253 - RNA, 15 nt, Homo sapiens
gggcccccacaggag

SEQ ID NO: 1669254 - RNA, 17 nt, Homo sapiens
gggcccccacaggggau

SEQ ID NO: 1669255 - RNA, 16 nt, Homo sapiens
gggcccugggccucag

SEQ ID NO: 1669256 - RNA, 14 nt, Homo sapiens
gggccgccuccucc

SEQ ID NO: 1669257 - RNA, 17 nt, Homo sapiens
aaaaaaauauguguaca

SEQ ID NO: 1669258 - RNA, 20 nt, Homo sapiens
aaaaaaauuaacaugucaca

SEQ ID NO: 1669259 - RNA, 12 nt, Homo sapiens
aaaaaauaugcu

SEQ ID NO: 1669260 - RNA, 22 nt, Homo sapiens
aaaaagggacaagcauguugau

SEQ ID NO: 1669261 - RNA, 20 nt, Homo sapiens
aaaaauaguguguccaugca

SEQ ID NO: 1669262 - RNA, 18 nt, Homo sapiens
aaaaauauucuccaugga

SEQ ID NO: 1669263 - RNA, 20 nt, Homo sapiens
aaaaaucaucaaaguguuua

SEQ ID NO: 1669264 - RNA, 20 nt, Homo sapiens
aaaaaucccauuuaugcaau

SEQ ID NO: 1669265 - RNA, 12 nt, Homo sapiens
aaaaaugauucu

SEQ ID NO: 1669266 - RNA, 23 nt, Homo sapiens
aaaaauucuagauuaccaugaag

SEQ ID NO: 1669267 - RNA, 19 nt, Homo sapiens
aaaaauuugacauugucag

SEQ ID NO: 1669268 - RNA, 23 nt, Homo sapiens
aaaacaaauucaagaaugcagua

SEQ ID NO: 1669269 - RNA, 19 nt, Homo sapiens
aaaacaacccuugcugaaa

SEQ ID NO: 1669270 - RNA, 19 nt, Homo sapiens
aaaacaagagaccacuucc

SEQ ID NO: 1669271 - RNA, 21 nt, Homo sapiens
aaaacagacccucccacuggu

SEQ ID NO: 1669272 - RNA, 16 nt, Homo sapiens
aaaacaugcugucuua

SEQ ID NO: 1669273 - RNA, 18 nt, Homo sapiens
aaaacccaacuccucucc

SEQ ID NO: 1669274 - RNA, 17 nt, Homo sapiens
aaaaccuaccacauuca

SEQ ID NO: 1669275 - RNA, 18 nt, Homo sapiens
aaaacuggaaacaucuga

SEQ ID NO: 1669276 - RNA, 13 nt, Homo sapiens
aaaacuguugcua

SEQ ID NO: 1669277 - RNA, 24 nt, Homo sapiens
aaaacuugcaugcagcagcuuuug

SEQ ID NO: 1669278 - RNA, 23 nt, Homo sapiens
aaaagaaagagcugaaaauggag

SEQ ID NO: 1669279 - RNA, 15 nt, Homo sapiens
aaaagaaucauuugc

SEQ ID NO: 1669280 - RNA, 14 nt, Homo sapiens
aaaagcaacuuucc

SEQ ID NO: 1669281 - RNA, 19 nt, Homo sapiens
aaaagcaggaaagauccca

SEQ ID NO: 1669282 - RNA, 13 nt, Homo sapiens
aaaagccagucaa

SEQ ID NO: 1669283 - RNA, 16 nt, Homo sapiens
aaaagguaacuguaca

SEQ ID NO: 1669284 - RNA, 16 nt, Homo sapiens
aaaaggugauugucac

SEQ ID NO: 1669285 - RNA, 17 nt, Homo sapiens
aaaaguaaaacagauuu

SEQ ID NO: 1669286 - RNA, 22 nt, Homo sapiens
aaaagucaaacuuucaccucag

SEQ ID NO: 1669287 - RNA, 16 nt, Homo sapiens
aaaaguuauugugaua

SEQ ID NO: 1669288 - RNA, 23 nt, Homo sapiens
aaaauaaauguuuuggaauucaa

SEQ ID NO: 1669289 - RNA, 12 nt, Homo sapiens
aaaauacaugau

SEQ ID NO: 1669290 - RNA, 17 nt, Homo sapiens
aaaauacuauuggacag

SEQ ID NO: 1669291 - RNA, 14 nt, Homo sapiens
aaaauagucucauu

SEQ ID NO: 1669292 - RNA, 21 nt, Homo sapiens
aaaauauguguacacauauga

SEQ ID NO: 1669293 - RNA, 12 nt, Homo sapiens
aaaaucaaagag

SEQ ID NO: 1669294 - RNA, 16 nt, Homo sapiens
aaaaucacaaacucau

SEQ ID NO: 1669295 - RNA, 19 nt, Homo sapiens
aaaaucugggaccaaaaca

SEQ ID NO: 1669296 - RNA, 18 nt, Homo sapiens
aaaaugaacuaacugcca

SEQ ID NO: 1669297 - RNA, 17 nt, Homo sapiens
aaaauuaacaugucaca

SEQ ID NO: 1669298 - RNA, 16 nt, Homo sapiens
aaaauuaacugaaaag

SEQ ID NO: 1669299 - RNA, 16 nt, Homo sapiens
aaaauuaucuguucua

SEQ ID NO: 1669300 - RNA, 13 nt, Homo sapiens
aaaauuaugucca

SEQ ID NO: 1669301 - RNA, 23 nt, Homo sapiens
aaaauugcagcaguugcuagcaa

SEQ ID NO: 1669302 - RNA, 17 nt, Homo sapiens
aaacaaauauuucacuu

SEQ ID NO: 1669303 - RNA, 18 nt, Homo sapiens
aaacaaauauuucacuua

SEQ ID NO: 1669304 - RNA, 17 nt, Homo sapiens
aaacaaaucauuuugau

SEQ ID NO: 1669305 - RNA, 22 nt, Homo sapiens
aaacaaauucaagaaugcagua

SEQ ID NO: 1669306 - RNA, 19 nt, Homo sapiens
aaacaagagaccacuuccu

SEQ ID NO: 1669307 - RNA, 21 nt, Homo sapiens
aaacaagguccaguaauagca

SEQ ID NO: 1669308 - RNA, 13 nt, Homo sapiens
aaacacagauuau

SEQ ID NO: 1669309 - RNA, 16 nt, Homo sapiens
aaacagacccucccac

SEQ ID NO: 1669310 - RNA, 14 nt, Homo sapiens
aaacagcuugaugc

SEQ ID NO: 1669311 - RNA, 11 nt, Homo sapiens
aaacagucaaa

SEQ ID NO: 1669312 - RNA, 13 nt, Homo sapiens
aaacauacguucu

SEQ ID NO: 1669313 - RNA, 14 nt, Homo sapiens
aaacauaucuugag

SEQ ID NO: 1669314 - RNA, 13 nt, Homo sapiens
aaacauugccuua

SEQ ID NO: 1669315 - RNA, 16 nt, Homo sapiens
aaacauuuaucuuugu

SEQ ID NO: 1669316 - RNA, 11 nt, Homo sapiens
aaacauuuccc

SEQ ID NO: 1669317 - RNA, 14 nt, Homo sapiens
aaaccaaaccauua

SEQ ID NO: 1669318 - RNA, 21 nt, Homo sapiens
aaaccacaacugacacaggaa

SEQ ID NO: 1669319 - RNA, 14 nt, Homo sapiens
aaaccacuuuccuu

SEQ ID NO: 1669320 - RNA, 20 nt, Homo sapiens
aaaccauagcuaaguagcau

SEQ ID NO: 1669321 - RNA, 12 nt, Homo sapiens
aaacccaaauaa

SEQ ID NO: 1669322 - RNA, 23 nt, Homo sapiens
aaacccuuuuacagucacauuca

SEQ ID NO: 1669323 - RNA, 15 nt, Homo sapiens
aaaccgaauuuucac

SEQ ID NO: 1669324 - RNA, 17 nt, Homo sapiens
aaaccuaccacauucac

SEQ ID NO: 1669325 - RNA, 19 nt, Homo sapiens
aaaccuaccacauucacua

SEQ ID NO: 1669326 - RNA, 11 nt, Homo sapiens
aaaccuaccuu

SEQ ID NO: 1669327 - RNA, 18 nt, Homo sapiens
aaaccuccacugcugcuc

SEQ ID NO: 1669328 - RNA, 22 nt, Homo sapiens
aaaccucuuucggaaaugauug

SEQ ID NO: 1669329 - RNA, 16 nt, Homo sapiens
aaaccuguuucugcag

SEQ ID NO: 1669330 - RNA, 14 nt, Homo sapiens
aaaccuuacuuaaa

SEQ ID NO: 1669331 - RNA, 14 nt, Homo sapiens
aaaccuuagcuccc

SEQ ID NO: 1669332 - RNA, 15 nt, Homo sapiens
aaaccuugcacaggu

SEQ ID NO: 1669333 - RNA, 16 nt, Homo sapiens
aaacuccugaccucaa

SEQ ID NO: 1669334 - RNA, 18 nt, Homo sapiens
aaacucgggcacucccua

SEQ ID NO: 1669335 - RNA, 11 nt, Homo sapiens
aaacugcauuu

SEQ ID NO: 1669336 - RNA, 23 nt, Homo sapiens
aaacuggaaugcuguuacuuuga

SEQ ID NO: 1669337 - RNA, 11 nt, Homo sapiens
aaacuguacag

SEQ ID NO: 1669338 - RNA, 15 nt, Homo sapiens
aaacuguacaguuuc

SEQ ID NO: 1669339 - RNA, 14 nt, Homo sapiens
aaacuucucacccg

SEQ ID NO: 1669340 - RNA, 20 nt, Homo sapiens
aaacuuguauuggaaguaua

SEQ ID NO: 1669341 - RNA, 13 nt, Homo sapiens
aaacuuguguaug

SEQ ID NO: 1669342 - RNA, 15 nt, Homo sapiens
aaacuuuggaaguuu

SEQ ID NO: 1669343 - RNA, 13 nt, Homo sapiens
aaagaaaccagac

SEQ ID NO: 1669344 - RNA, 14 nt, Homo sapiens
aucaguagugcuau

SEQ ID NO: 1669345 - RNA, 23 nt, Homo sapiens
aucagucuuugucaaugcucuaa

SEQ ID NO: 1669346 - RNA, 11 nt, Homo sapiens
aucagugcagu

SEQ ID NO: 1669347 - RNA, 22 nt, Homo sapiens
aucaguuacaguggcaguauug

SEQ ID NO: 1669348 - RNA, 15 nt, Homo sapiens
aucaguucauggcau

SEQ ID NO: 1669349 - RNA, 12 nt, Homo sapiens
aucauaaauacu

SEQ ID NO: 1669350 - RNA, 17 nt, Homo sapiens
aucauagcugacucaga

SEQ ID NO: 1669351 - RNA, 18 nt, Homo sapiens
aucauccugccuucaugg

SEQ ID NO: 1669352 - RNA, 20 nt, Homo sapiens
aucaugcuucuacuccaugg

SEQ ID NO: 1669353 - RNA, 23 nt, Homo sapiens
aucauucagaaugugcaaagcag

SEQ ID NO: 1669354 - RNA, 13 nt, Homo sapiens
aucauucauucau

SEQ ID NO: 1669355 - RNA, 22 nt, Homo sapiens
aucauugagaaauaaagcacau

SEQ ID NO: 1669356 - RNA, 17 nt, Homo sapiens
auccaaacauccuggag

SEQ ID NO: 1669357 - RNA, 14 nt, Homo sapiens
auccaaaccuaccu

SEQ ID NO: 1669358 - RNA, 18 nt, Homo sapiens
auccaacuggaaggcuuu

SEQ ID NO: 1669359 - RNA, 21 nt, Homo sapiens
auccaagaccuuacaaccaca

SEQ ID NO: 1669360 - RNA, 14 nt, Homo sapiens
auccaauguaugaa

SEQ ID NO: 1669361 - RNA, 20 nt, Homo sapiens
auccacagaaccuuugucaa

SEQ ID NO: 1669362 - RNA, 17 nt, Homo sapiens
auccacaguauuguucu

SEQ ID NO: 1669363 - RNA, 12 nt, Homo sapiens
auccaccaccuu

SEQ ID NO: 1669364 - RNA, 18 nt, Homo sapiens
auccaccgccacacuggc

SEQ ID NO: 1669365 - RNA, 18 nt, Homo sapiens
auccagaggguugugauu

SEQ ID NO: 1669366 - RNA, 20 nt, Homo sapiens
auccauaucagcucugcaua

SEQ ID NO: 1669367 - RNA, 14 nt, Homo sapiens
aucccaagucaaac

SEQ ID NO: 1669368 - RNA, 21 nt, Homo sapiens
aucccacgacauaagcuggua

SEQ ID NO: 1669369 - RNA, 16 nt, Homo sapiens
auccccuucugcaauc

SEQ ID NO: 1669370 - RNA, 18 nt, Homo sapiens
aucccuagucuauugcag

SEQ ID NO: 1669371 - RNA, 18 nt, Homo sapiens
aucccuucucacagcaca

SEQ ID NO: 1669372 - RNA, 12 nt, Homo sapiens
aucccuuuccag

SEQ ID NO: 1669373 - RNA, 13 nt, Homo sapiens
auccgacaccucc

SEQ ID NO: 1669374 - RNA, 13 nt, Homo sapiens
auccgcaucucaa

SEQ ID NO: 1669375 - RNA, 17 nt, Homo sapiens
auccguaccaucgguca

SEQ ID NO: 1669376 - RNA, 14 nt, Homo sapiens
auccuggcuaacac

SEQ ID NO: 1669377 - RNA, 21 nt, Homo sapiens
auccuggcuaacacagugaaa

SEQ ID NO: 1669378 - RNA, 12 nt, Homo sapiens
auccuguuacuu

SEQ ID NO: 1669379 - RNA, 16 nt, Homo sapiens
auccuguuaggggaaa

SEQ ID NO: 1669380 - RNA, 15 nt, Homo sapiens
aucgaggggugcuua

SEQ ID NO: 1669381 - RNA, 14 nt, Homo sapiens
aucgccauuccagg

SEQ ID NO: 1669382 - RNA, 18 nt, Homo sapiens
aucuaaccuguuccauuc

SEQ ID NO: 1669383 - RNA, 14 nt, Homo sapiens
aucuaagacauuca

SEQ ID NO: 1669384 - RNA, 21 nt, Homo sapiens
aucuacacauauaaacacagu

SEQ ID NO: 1669385 - RNA, 12 nt, Homo sapiens
aucuaccuucca

SEQ ID NO: 1669386 - RNA, 22 nt, Homo sapiens
aucuaggcgaaaguaaugggga

SEQ ID NO: 1669387 - RNA, 12 nt, Homo sapiens
aucuauaccacc

SEQ ID NO: 1669388 - RNA, 13 nt, Homo sapiens
aucuauaccaccu

SEQ ID NO: 1669389 - RNA, 14 nt, Homo sapiens
aucuauaccaccuu

SEQ ID NO: 1669390 - RNA, 14 nt, Homo sapiens
aucuauagcacaua

SEQ ID NO: 1669391 - RNA, 12 nt, Homo sapiens
aucuaugggaga

SEQ ID NO: 1669392 - RNA, 14 nt, Homo sapiens
aucucaaccuaccu

SEQ ID NO: 1669393 - RNA, 11 nt, Homo sapiens
aucucagcuca

SEQ ID NO: 1669394 - RNA, 16 nt, Homo sapiens
aucuccaaaucuugcc

SEQ ID NO: 1669395 - RNA, 13 nt, Homo sapiens
aucuccaguggga

SEQ ID NO: 1669396 - RNA, 22 nt, Homo sapiens
aucuccagugggaacucuucaa

SEQ ID NO: 1669397 - RNA, 23 nt, Homo sapiens
aucucuaaaaugcuguucucaau

SEQ ID NO: 1669398 - RNA, 22 nt, Homo sapiens
aucucucgagcugucuugcuga

SEQ ID NO: 1669399 - RNA, 22 nt, Homo sapiens
aucucuguuuaggugccucuac

SEQ ID NO: 1669400 - RNA, 14 nt, Homo sapiens
aucugagcuuaaac

SEQ ID NO: 1669401 - RNA, 22 nt, Homo sapiens
aucugagcuuaaacauuuucuc

SEQ ID NO: 1669402 - RNA, 14 nt, Homo sapiens
aucugauaucuguu

SEQ ID NO: 1669403 - RNA, 19 nt, Homo sapiens
aucugcauuucuacauguu

SEQ ID NO: 1669404 - RNA, 20 nt, Homo sapiens
aucuggccuaugacccugug

SEQ ID NO: 1669405 - RNA, 16 nt, Homo sapiens
aucugggaccaaaaca

SEQ ID NO: 1669406 - RNA, 19 nt, Homo sapiens
aucuguaaaauagucucau

SEQ ID NO: 1669407 - RNA, 14 nt, Homo sapiens
aucuguacuaucua

SEQ ID NO: 1669408 - RNA, 17 nt, Homo sapiens
aucuguauaucagcucu

SEQ ID NO: 1669409 - RNA, 15 nt, Homo sapiens
aucugucaucucucu

SEQ ID NO: 1669410 - RNA, 14 nt, Homo sapiens
aucuguuugauaca

SEQ ID NO: 1669411 - RNA, 18 nt, Homo sapiens
aucuguuugauacaguau

SEQ ID NO: 1669412 - RNA, 15 nt, Homo sapiens
aucuuacccuucaau

SEQ ID NO: 1669413 - RNA, 22 nt, Homo sapiens
aucuuacccuucaauguuaaau

SEQ ID NO: 1669414 - RNA, 17 nt, Homo sapiens
aucuuaggauuuaccaa

SEQ ID NO: 1669415 - RNA, 21 nt, Homo sapiens
aucuuaggauuuaccaaauag

SEQ ID NO: 1669416 - RNA, 21 nt, Homo sapiens
aucuucaaugaacugugcuuu

SEQ ID NO: 1669417 - RNA, 17 nt, Homo sapiens
aucuuccauaugcucuu

SEQ ID NO: 1669418 - RNA, 14 nt, Homo sapiens
aucuugugcaugca

SEQ ID NO: 1669419 - RNA, 22 nt, Homo sapiens
aucuuguggucugcugccucag

SEQ ID NO: 1669420 - RNA, 20 nt, Homo sapiens
aucuuuggaaugcaugccag

SEQ ID NO: 1669421 - RNA, 21 nt, Homo sapiens
augaaaccugugucucugaga

SEQ ID NO: 1669422 - RNA, 16 nt, Homo sapiens
augaaaggcaaugaca

SEQ ID NO: 1669423 - RNA, 21 nt, Homo sapiens
augaaaggcaaugacaaguuu

SEQ ID NO: 1669424 - RNA, 18 nt, Homo sapiens
augaaccauuaagaacaa

SEQ ID NO: 1669425 - RNA, 17 nt, Homo sapiens
augaaugacauugaacu

SEQ ID NO: 1669426 - RNA, 15 nt, Homo sapiens
augaauucuucucaa

SEQ ID NO: 1669427 - RNA, 12 nt, Homo sapiens
augacacugacc

SEQ ID NO: 1669428 - RNA, 22 nt, Homo sapiens
augacaguuagagaugcugauu

SEQ ID NO: 1669429 - RNA, 17 nt, Homo sapiens
augacaucugucuagga

SEQ ID NO: 1669430 - RNA, 16 nt, Homo sapiens
augaccacauccugaa

SEQ ID NO: 1669431 - RNA, 20 nt, Homo sapiens
augaccuugaaugaugccau

SEQ ID NO: 1669432 - RNA, 17 nt, Homo sapiens
augacgguauuaugcuu

SEQ ID NO: 1669433 - RNA, 23 nt, Homo sapiens
augacuccagaauuucccaaagc

SEQ ID NO: 1669434 - RNA, 15 nt, Homo sapiens
augacugaguaugga

SEQ ID NO: 1669435 - RNA, 15 nt, Homo sapiens
augacuuacuuagaa

SEQ ID NO: 1669436 - RNA, 21 nt, Homo sapiens
augacuucuuuacuaacacug

SEQ ID NO: 1669437 - RNA, 19 nt, Homo sapiens
augagagauuuuccugaga

SEQ ID NO: 1669438 - RNA, 13 nt, Homo sapiens
augagaugaugcc

SEQ ID NO: 1669439 - RNA, 20 nt, Homo sapiens
augagcaugcucccucaugc

SEQ ID NO: 1669440 - RNA, 12 nt, Homo sapiens
augaggcauuuu

SEQ ID NO: 1669441 - RNA, 21 nt, Homo sapiens
augaguucugcacauacagau

SEQ ID NO: 1669442 - RNA, 15 nt, Homo sapiens
augauaaauuugacu

SEQ ID NO: 1669443 - RNA, 19 nt, Homo sapiens
augauaaauuugacuguua

SEQ ID NO: 1669444 - RNA, 21 nt, Homo sapiens
augauaaucccauacucucaa

SEQ ID NO: 1669445 - RNA, 23 nt, Homo sapiens
augauaugugcuuguguguaugu

SEQ ID NO: 1669446 - RNA, 16 nt, Homo sapiens
augaugcagcagaugu

SEQ ID NO: 1669447 - RNA, 17 nt, Homo sapiens
augauguauuguugcuu

SEQ ID NO: 1669448 - RNA, 16 nt, Homo sapiens
augauuaagugcuuga

SEQ ID NO: 1669449 - RNA, 15 nt, Homo sapiens
augauuagugcaaua

SEQ ID NO: 1669450 - RNA, 14 nt, Homo sapiens
augauucuaugucu

SEQ ID NO: 1669451 - RNA, 13 nt, Homo sapiens
augauuuacucau

SEQ ID NO: 1669452 - RNA, 14 nt, Homo sapiens
augauuuaggcuuc

SEQ ID NO: 1669453 - RNA, 9 nt, Homo sapiens
augcacaaa

SEQ ID NO: 1669454 - RNA, 13 nt, Homo sapiens
augcacaauucca

SEQ ID NO: 1669455 - RNA, 18 nt, Homo sapiens
augcacaauuccaugaau

SEQ ID NO: 1669456 - RNA, 18 nt, Homo sapiens
augcacuugaaaugaugg

SEQ ID NO: 1669457 - RNA, 16 nt, Homo sapiens
augcagcagauguuga

SEQ ID NO: 1669458 - RNA, 19 nt, Homo sapiens
augcauggaaaaguggccu

SEQ ID NO: 1669459 - RNA, 17 nt, Homo sapiens
augcauguagcauauaa

SEQ ID NO: 1669460 - RNA, 16 nt, Homo sapiens
augccaauucaucuca

SEQ ID NO: 1669461 - RNA, 12 nt, Homo sapiens
augccauguaug

SEQ ID NO: 1669462 - RNA, 20 nt, Homo sapiens
augccauguauguugcauga

SEQ ID NO: 1669463 - RNA, 20 nt, Homo sapiens
augcccagcuuggagugcca

SEQ ID NO: 1669464 - RNA, 20 nt, Homo sapiens
augccucucucaggccaaac

SEQ ID NO: 1669465 - RNA, 21 nt, Homo sapiens
augccuguugaucuaugggaa

SEQ ID NO: 1669466 - RNA, 22 nt, Homo sapiens
augccuuguugaugaagcacau

SEQ ID NO: 1669467 - RNA, 19 nt, Homo sapiens
cagaugauucuaugucuca

SEQ ID NO: 1669468 - RNA, 18 nt, Homo sapiens
cagcaaugccugccugaa

SEQ ID NO: 1669469 - RNA, 19 nt, Homo sapiens
cagcacaaaaggaauagau

SEQ ID NO: 1669470 - RNA, 22 nt, Homo sapiens
cagcacuaaacuuggugcuuau

SEQ ID NO: 1669471 - RNA, 16 nt, Homo sapiens
cagcacuuuguuucau

SEQ ID NO: 1669472 - RNA, 18 nt, Homo sapiens
cagcacuuuguuucauau

SEQ ID NO: 1669473 - RNA, 12 nt, Homo sapiens
cagcagagccau

SEQ ID NO: 1669474 - RNA, 18 nt, Homo sapiens
cagcagggccacugagua

SEQ ID NO: 1669475 - RNA, 21 nt, Homo sapiens
cagcagguucucuccugugag

SEQ ID NO: 1669476 - RNA, 18 nt, Homo sapiens
cagcaguuugugaucugu

SEQ ID NO: 1669477 - RNA, 19 nt, Homo sapiens
cagcauaccaguucuugca

SEQ ID NO: 1669478 - RNA, 14 nt, Homo sapiens
cagcauaugcaaag

SEQ ID NO: 1669479 - RNA, 15 nt, Homo sapiens
cagcaugauguguug

SEQ ID NO: 1669480 - RNA, 20 nt, Homo sapiens
cagcauucccaauuaucaaa

SEQ ID NO: 1669481 - RNA, 18 nt, Homo sapiens
cagccaagggcagaucac

SEQ ID NO: 1669482 - RNA, 19 nt, Homo sapiens
cagccaagggcagaucaca

SEQ ID NO: 1669483 - RNA, 19 nt, Homo sapiens
cagccacggggacucagcc

SEQ ID NO: 1669484 - RNA, 22 nt, Homo sapiens
cagccauggcuggaugugcauc

SEQ ID NO: 1669485 - RNA, 19 nt, Homo sapiens
cagccccuccccauggugc

SEQ ID NO: 1669486 - RNA, 15 nt, Homo sapiens
cagccugcacagugg

SEQ ID NO: 1669487 - RNA, 14 nt, Homo sapiens
cagccugcucccua

SEQ ID NO: 1669488 - RNA, 14 nt, Homo sapiens
cagccuguucucug

SEQ ID NO: 1669489 - RNA, 19 nt, Homo sapiens
cagcuaacauggaaguacu

SEQ ID NO: 1669490 - RNA, 12 nt, Homo sapiens
cagcucagaaaa

SEQ ID NO: 1669491 - RNA, 19 nt, Homo sapiens
cagcucagaaaaucaaaga

SEQ ID NO: 1669492 - RNA, 20 nt, Homo sapiens
cagcucagaaaaucaaagag

SEQ ID NO: 1669493 - RNA, 17 nt, Homo sapiens
cagcuccuuccaccaca

SEQ ID NO: 1669494 - RNA, 22 nt, Homo sapiens
cagcucuucagguuugcaaggg

SEQ ID NO: 1669495 - RNA, 23 nt, Homo sapiens
cagcugauugggcaccugaccac

SEQ ID NO: 1669496 - RNA, 23 nt, Homo sapiens
cagcugccaaaaucguagguguu

SEQ ID NO: 1669497 - RNA, 17 nt, Homo sapiens
cagcuggugucaguccc

SEQ ID NO: 1669498 - RNA, 17 nt, Homo sapiens
cagcugugcuguaacac

SEQ ID NO: 1669499 - RNA, 15 nt, Homo sapiens
cagcuugcacaaaga

SEQ ID NO: 1669500 - RNA, 14 nt, Homo sapiens
caggaaaaaaacuu

SEQ ID NO: 1669501 - RNA, 21 nt, Homo sapiens
caggaaaagguagcuuaccug

SEQ ID NO: 1669502 - RNA, 17 nt, Homo sapiens
caggaaauaucugugaa

SEQ ID NO: 1669503 - RNA, 20 nt, Homo sapiens
caggaacacuggagccugca

SEQ ID NO: 1669504 - RNA, 15 nt, Homo sapiens
caggaagagaaggag

SEQ ID NO: 1669505 - RNA, 16 nt, Homo sapiens
caggaagucaggagcc

SEQ ID NO: 1669506 - RNA, 13 nt, Homo sapiens
caggacagcauua

SEQ ID NO: 1669507 - RNA, 21 nt, Homo sapiens
caggaccuugcuuccuucuca

SEQ ID NO: 1669508 - RNA, 11 nt, Homo sapiens
caggagaagaa

SEQ ID NO: 1669509 - RNA, 19 nt, Homo sapiens
caggagcauguccuauccc

SEQ ID NO: 1669510 - RNA, 16 nt, Homo sapiens
caggagccagcagggc

SEQ ID NO: 1669511 - RNA, 17 nt, Homo sapiens
caggaggaaaagcccag

SEQ ID NO: 1669512 - RNA, 20 nt, Homo sapiens
caggaggauucagcucagga

SEQ ID NO: 1669513 - RNA, 13 nt, Homo sapiens
caggaguuccuuu

SEQ ID NO: 1669514 - RNA, 17 nt, Homo sapiens
caggaugaaggggccag

SEQ ID NO: 1669515 - RNA, 19 nt, Homo sapiens
caggauggucucgaucucc

SEQ ID NO: 1669516 - RNA, 20 nt, Homo sapiens
caggauugaggaugaacuca

SEQ ID NO: 1669517 - RNA, 21 nt, Homo sapiens
caggcaacuucaguccuggga

SEQ ID NO: 1669518 - RNA, 16 nt, Homo sapiens
caggcagcugcaguua

SEQ ID NO: 1669519 - RNA, 16 nt, Homo sapiens
caggcauguuuguaca

SEQ ID NO: 1669520 - RNA, 21 nt, Homo sapiens
caggccaggacaaaaugcaga

SEQ ID NO: 1669521 - RNA, 15 nt, Homo sapiens
caggcccugcagugu

SEQ ID NO: 1669522 - RNA, 20 nt, Homo sapiens
caggcgugagccaccgcgcc

SEQ ID NO: 1669523 - RNA, 16 nt, Homo sapiens
caggcucaacauaaca

SEQ ID NO: 1669524 - RNA, 17 nt, Homo sapiens
caggcucccacugcccc

SEQ ID NO: 1669525 - RNA, 21 nt, Homo sapiens
caggcucucaggccagcugcu

SEQ ID NO: 1669526 - RNA, 14 nt, Homo sapiens
caggcucugaccag

SEQ ID NO: 1669527 - RNA, 16 nt, Homo sapiens
caggcuggagugcagu

SEQ ID NO: 1669528 - RNA, 18 nt, Homo sapiens
caggcuguucugcacuga

SEQ ID NO: 1669529 - RNA, 15 nt, Homo sapiens
caggcuuauuaggaa

SEQ ID NO: 1669530 - RNA, 21 nt, Homo sapiens
cagggaucauagcugacucag

SEQ ID NO: 1669531 - RNA, 13 nt, Homo sapiens
cagggcugugcuu

SEQ ID NO: 1669532 - RNA, 21 nt, Homo sapiens
caggggagaaacgaaaaccac

SEQ ID NO: 1669533 - RNA, 21 nt, Homo sapiens
caggggagggguuaaugcaga

SEQ ID NO: 1669534 - RNA, 13 nt, Homo sapiens
caggggcugcauc

SEQ ID NO: 1669535 - RNA, 18 nt, Homo sapiens
caggggcugcauccucag

SEQ ID NO: 1669536 - RNA, 22 nt, Homo sapiens
cagguaucugaugauguucuga

SEQ ID NO: 1669537 - RNA, 13 nt, Homo sapiens
caggucccacugc

SEQ ID NO: 1669538 - RNA, 21 nt, Homo sapiens
caggugacuuuccuaugacac

SEQ ID NO: 1669539 - RNA, 22 nt, Homo sapiens
caggugccaucacgcuugugau

SEQ ID NO: 1669540 - RNA, 17 nt, Homo sapiens
caggugccucaagagaa

SEQ ID NO: 1669541 - RNA, 15 nt, Homo sapiens
cagguggcauuugca

SEQ ID NO: 1669542 - RNA, 17 nt, Homo sapiens
caggugucccugagaac

SEQ ID NO: 1669543 - RNA, 13 nt, Homo sapiens
cagguuaccucac

SEQ ID NO: 1669544 - RNA, 16 nt, Homo sapiens
cagguuaccucacuuu

SEQ ID NO: 1669545 - RNA, 22 nt, Homo sapiens
cagguucaagugcuucuccagc

SEQ ID NO: 1669546 - RNA, 16 nt, Homo sapiens
cagguucacccagcgc

SEQ ID NO: 1669547 - RNA, 16 nt, Homo sapiens
cagguuggagugcagu

SEQ ID NO: 1669548 - RNA, 18 nt, Homo sapiens
caguaaaucagugcagua

SEQ ID NO: 1669549 - RNA, 12 nt, Homo sapiens
caguaaauccaa

SEQ ID NO: 1669550 - RNA, 16 nt, Homo sapiens
caguaacacagugcag

SEQ ID NO: 1669551 - RNA, 17 nt, Homo sapiens
caguaacacagugcagu

SEQ ID NO: 1669552 - RNA, 18 nt, Homo sapiens
caguaacacagugcagug

SEQ ID NO: 1669553 - RNA, 13 nt, Homo sapiens
caguaacagugaa

SEQ ID NO: 1669554 - RNA, 22 nt, Homo sapiens
caguaagacagugcagugcuca

SEQ ID NO: 1669555 - RNA, 15 nt, Homo sapiens
caguaaggcagugaa

SEQ ID NO: 1669556 - RNA, 15 nt, Homo sapiens
caguaaggcagugca

SEQ ID NO: 1669557 - RNA, 18 nt, Homo sapiens
caguaaggcagugcagua

SEQ ID NO: 1669558 - RNA, 22 nt, Homo sapiens
caguaauagcaagucuuaguac

SEQ ID NO: 1669559 - RNA, 22 nt, Homo sapiens
caguaaucuuucggucuccuua

SEQ ID NO: 1669560 - RNA, 13 nt, Homo sapiens
caguagugccaaa

SEQ ID NO: 1669561 - RNA, 17 nt, Homo sapiens
caguagugccugugauc

SEQ ID NO: 1669562 - RNA, 15 nt, Homo sapiens
cagucaauugcuuga

SEQ ID NO: 1669563 - RNA, 12 nt, Homo sapiens
cagucacauuca

SEQ ID NO: 1669564 - RNA, 21 nt, Homo sapiens
cagucacuuguuuguguuuga

SEQ ID NO: 1669565 - RNA, 13 nt, Homo sapiens
cagucagcccagu

SEQ ID NO: 1669566 - RNA, 14 nt, Homo sapiens
caguccacugcuga

SEQ ID NO: 1669567 - RNA, 15 nt, Homo sapiens
caguccacugcugag

SEQ ID NO: 1669568 - RNA, 21 nt, Homo sapiens
cagucccucccuccuggcuca

SEQ ID NO: 1669569 - RNA, 22 nt, Homo sapiens
cagucccugacuaacagccuca

SEQ ID NO: 1669570 - RNA, 15 nt, Homo sapiens
caguccggugccuuc

SEQ ID NO: 1669571 - RNA, 22 nt, Homo sapiens
cagucgucccagcagcaccuca

SEQ ID NO: 1669572 - RNA, 18 nt, Homo sapiens
cagucucccgaguagcug

SEQ ID NO: 1669573 - RNA, 16 nt, Homo sapiens
cagugaaguacucagu

SEQ ID NO: 1669574 - RNA, 20 nt, Homo sapiens
cagugaaguacucaguaaua

SEQ ID NO: 1669575 - RNA, 16 nt, Homo sapiens
cagugccacgacaugg

SEQ ID NO: 1669576 - RNA, 13 nt, Homo sapiens
cagugccuaacuc

SEQ ID NO: 1669577 - RNA, 18 nt, Homo sapiens
cagugcgguacucaguaa

SEQ ID NO: 1669578 - RNA, 20 nt, Homo sapiens
caguggagaggggacuugga

SEQ ID NO: 1669579 - RNA, 18 nt, Homo sapiens
caguggauuuuuuuuuaa

SEQ ID NO: 1669580 - RNA, 16 nt, Homo sapiens
caguggcgcgaucuca

SEQ ID NO: 1669581 - RNA, 20 nt, Homo sapiens
caguggcgugaucucagcuc

SEQ ID NO: 1669582 - RNA, 15 nt, Homo sapiens
caguggcucaaucuc

SEQ ID NO: 1669583 - RNA, 19 nt, Homo sapiens
caguuaaaccagcuacuca

SEQ ID NO: 1669584 - RNA, 23 nt, Homo sapiens
caguuacaguggcaguauugaca

SEQ ID NO: 1669585 - RNA, 17 nt, Homo sapiens
caguuaggcagugcagu

SEQ ID NO: 1669586 - RNA, 18 nt, Homo sapiens
caguuaggcagugcagua

SEQ ID NO: 1669587 - RNA, 19 nt, Homo sapiens
caguuauuuugucacccaa

SEQ ID NO: 1669588 - RNA, 20 nt, Homo sapiens
caguucauggcaucacaucu

SEQ ID NO: 1669589 - RNA, 12 nt, Homo sapiens
ccggccugaugg

SEQ ID NO: 1669590 - RNA, 22 nt, Homo sapiens
ccggcugacucagugcagggac

SEQ ID NO: 1669591 - RNA, 15 nt, Homo sapiens
ccgggcauccagugg

SEQ ID NO: 1669592 - RNA, 16 nt, Homo sapiens
ccgggcuggccugaca

SEQ ID NO: 1669593 - RNA, 22 nt, Homo sapiens
ccggggguguaucugagucagc

SEQ ID NO: 1669594 - RNA, 17 nt, Homo sapiens
ccggucccccaugccac

SEQ ID NO: 1669595 - RNA, 17 nt, Homo sapiens
ccgucugauuguuccuc

SEQ ID NO: 1669596 - RNA, 19 nt, Homo sapiens
ccgugaggccagagacaca

SEQ ID NO: 1669597 - RNA, 17 nt, Homo sapiens
ccguggcuuugugcuua

SEQ ID NO: 1669598 - RNA, 20 nt, Homo sapiens
ccgugggguguauugacugg

SEQ ID NO: 1669599 - RNA, 20 nt, Homo sapiens
ccguugcugcguucuuucaa

SEQ ID NO: 1669600 - RNA, 23 nt, Homo sapiens
ccguuguguggguuuacucugug

SEQ ID NO: 1669601 - RNA, 14 nt, Homo sapiens
ccguuuccaaauac

SEQ ID NO: 1669602 - RNA, 22 nt, Homo sapiens
ccguuuugugaagaaacauuua

SEQ ID NO: 1669603 - RNA, 18 nt, Homo sapiens
ccuaagcuggagugcagu

SEQ ID NO: 1669604 - RNA, 14 nt, Homo sapiens
ccuaauaaacaauu

SEQ ID NO: 1669605 - RNA, 20 nt, Homo sapiens
ccuaauaaauuuuggucaga

SEQ ID NO: 1669606 - RNA, 13 nt, Homo sapiens
ccuaauucucuuc

SEQ ID NO: 1669607 - RNA, 14 nt, Homo sapiens
ccuaccacauucac

SEQ ID NO: 1669608 - RNA, 23 nt, Homo sapiens
ccuaccacauucacuacugcaaa

SEQ ID NO: 1669609 - RNA, 16 nt, Homo sapiens
ccuaccgaugugugau

SEQ ID NO: 1669610 - RNA, 22 nt, Homo sapiens
ccuacgguacaagcuacauaug

SEQ ID NO: 1669611 - RNA, 16 nt, Homo sapiens
ccuagccagaggcucu

SEQ ID NO: 1669612 - RNA, 14 nt, Homo sapiens
ccuaggcagaucac

SEQ ID NO: 1669613 - RNA, 13 nt, Homo sapiens
ccuaggugcucau

SEQ ID NO: 1669614 - RNA, 21 nt, Homo sapiens
ccuaguuugaccucacaguga

SEQ ID NO: 1669615 - RNA, 17 nt, Homo sapiens
ccuaugguaacugauga

SEQ ID NO: 1669616 - RNA, 13 nt, Homo sapiens
ccucacuccacuc

SEQ ID NO: 1669617 - RNA, 22 nt, Homo sapiens
ccucacuucuuuccucaaagaa

SEQ ID NO: 1669618 - RNA, 19 nt, Homo sapiens
ccucagaauauuaagcaca

SEQ ID NO: 1669619 - RNA, 22 nt, Homo sapiens
ccucagauuccaccuagagcua

SEQ ID NO: 1669620 - RNA, 14 nt, Homo sapiens
ccucagccaaugaa

SEQ ID NO: 1669621 - RNA, 18 nt, Homo sapiens
ccucaggacccagggaau

SEQ ID NO: 1669622 - RNA, 22 nt, Homo sapiens
ccucaguccuuuauuguccauu

SEQ ID NO: 1669623 - RNA, 15 nt, Homo sapiens
ccucauauacuugaa

SEQ ID NO: 1669624 - RNA, 20 nt, Homo sapiens
ccucauauacuugaauauua

SEQ ID NO: 1669625 - RNA, 20 nt, Homo sapiens
ccucauuguucagaaaagca

SEQ ID NO: 1669626 - RNA, 13 nt, Homo sapiens
ccuccagccacuu

SEQ ID NO: 1669627 - RNA, 17 nt, Homo sapiens
ccuccauuaaccaagaa

SEQ ID NO: 1669628 - RNA, 15 nt, Homo sapiens
ccucccaagcacuuc

SEQ ID NO: 1669629 - RNA, 22 nt, Homo sapiens
ccucccaagcacuucaaaggaa

SEQ ID NO: 1669630 - RNA, 20 nt, Homo sapiens
ccuccccaaggaagaacaaa

SEQ ID NO: 1669631 - RNA, 13 nt, Homo sapiens
ccuccgacuucuc

SEQ ID NO: 1669632 - RNA, 17 nt, Homo sapiens
ccucgcccuaugcaagc

SEQ ID NO: 1669633 - RNA, 19 nt, Homo sapiens
ccucgccgggccauucuga

SEQ ID NO: 1669634 - RNA, 23 nt, Homo sapiens
ccucgguucaaaaccuugcacag

SEQ ID NO: 1669635 - RNA, 17 nt, Homo sapiens
ccucuaagaucuugccu

SEQ ID NO: 1669636 - RNA, 14 nt, Homo sapiens
ccucuacuuuccag

SEQ ID NO: 1669637 - RNA, 21 nt, Homo sapiens
ccucuccuccccccaagcuca

SEQ ID NO: 1669638 - RNA, 21 nt, Homo sapiens
ccucucucucccaacugcugc

SEQ ID NO: 1669639 - RNA, 22 nt, Homo sapiens
ccucucugaacugcaacacugg

SEQ ID NO: 1669640 - RNA, 23 nt, Homo sapiens
ccucugccggucccccaugccac

SEQ ID NO: 1669641 - RNA, 17 nt, Homo sapiens
ccucugcugcuuuccaa

SEQ ID NO: 1669642 - RNA, 14 nt, Homo sapiens
ccucugucuccuaa

SEQ ID NO: 1669643 - RNA, 17 nt, Homo sapiens
ccucugugccauggaug

SEQ ID NO: 1669644 - RNA, 19 nt, Homo sapiens
ccucugugccauggaugau

SEQ ID NO: 1669645 - RNA, 19 nt, Homo sapiens
ccucuuaauucccaauccc

SEQ ID NO: 1669646 - RNA, 20 nt, Homo sapiens
ccucuuaauucccaauccca

SEQ ID NO: 1669647 - RNA, 19 nt, Homo sapiens
ccucuugaaugcuuaaaug

SEQ ID NO: 1669648 - RNA, 23 nt, Homo sapiens
ccucuugaaugcuuaaaugauca

SEQ ID NO: 1669649 - RNA, 16 nt, Homo sapiens
ccucuugaucugccca

SEQ ID NO: 1669650 - RNA, 14 nt, Homo sapiens
ccucuuuaccauag

SEQ ID NO: 1669651 - RNA, 16 nt, Homo sapiens
ccucuuucacuucuua

SEQ ID NO: 1669652 - RNA, 13 nt, Homo sapiens
ccugaaaauccaa

SEQ ID NO: 1669653 - RNA, 20 nt, Homo sapiens
ccugaauuucucacaaagga

SEQ ID NO: 1669654 - RNA, 16 nt, Homo sapiens
ccugacacugucugcu

SEQ ID NO: 1669655 - RNA, 16 nt, Homo sapiens
ccugaccagacugugg

SEQ ID NO: 1669656 - RNA, 20 nt, Homo sapiens
ccugacuguccuacaauauc

SEQ ID NO: 1669657 - RNA, 22 nt, Homo sapiens
ccugagaaggccagaauacugg

SEQ ID NO: 1669658 - RNA, 20 nt, Homo sapiens
ccugagaggagcguguccua

SEQ ID NO: 1669659 - RNA, 20 nt, Homo sapiens
ccugaugauggucauugggg

SEQ ID NO: 1669660 - RNA, 13 nt, Homo sapiens
ccugaugcaaggg

SEQ ID NO: 1669661 - RNA, 18 nt, Homo sapiens
ccugaugcgucuacccag

SEQ ID NO: 1669662 - RNA, 23 nt, Homo sapiens
ccugauggccaggccucagggac

SEQ ID NO: 1669663 - RNA, 15 nt, Homo sapiens
ccugaugggaacaga

SEQ ID NO: 1669664 - RNA, 17 nt, Homo sapiens
ccugcagucagugcuaa

SEQ ID NO: 1669665 - RNA, 19 nt, Homo sapiens
ccugccagauaaccaagug

SEQ ID NO: 1669666 - RNA, 20 nt, Homo sapiens
ccugccaugggcaaagccau

SEQ ID NO: 1669667 - RNA, 20 nt, Homo sapiens
ccugcccccgggggcucaca

SEQ ID NO: 1669668 - RNA, 16 nt, Homo sapiens
ccugcccugucuuucc

SEQ ID NO: 1669669 - RNA, 17 nt, Homo sapiens
ccugcuaaaugacuuau

SEQ ID NO: 1669670 - RNA, 22 nt, Homo sapiens
ccugcucccuagccagaggcuc

SEQ ID NO: 1669671 - RNA, 13 nt, Homo sapiens
ccugcugcaucuu

SEQ ID NO: 1669672 - RNA, 13 nt, Homo sapiens
ccuggacagggcu

SEQ ID NO: 1669673 - RNA, 13 nt, Homo sapiens
ccuggacagugag

SEQ ID NO: 1669674 - RNA, 16 nt, Homo sapiens
ccuggacauauuccca

SEQ ID NO: 1669675 - RNA, 15 nt, Homo sapiens
ccuggagaguaucug

SEQ ID NO: 1669676 - RNA, 17 nt, Homo sapiens
ccuggcagcacaggaaa

SEQ ID NO: 1669677 - RNA, 14 nt, Homo sapiens
ccuggcuucuggga

SEQ ID NO: 1669678 - RNA, 18 nt, Homo sapiens
ccugggcacauagcauag

SEQ ID NO: 1669679 - RNA, 22 nt, Homo sapiens
ccugggcagaaaugugcugcaa

SEQ ID NO: 1669680 - RNA, 16 nt, Homo sapiens
ccugggcccuaggcau

SEQ ID NO: 1669681 - RNA, 17 nt, Homo sapiens
ccugggcugucugucac

SEQ ID NO: 1669682 - RNA, 17 nt, Homo sapiens
ccuggggggcacagcca

SEQ ID NO: 1669683 - RNA, 15 nt, Homo sapiens
ccugggugcugucau

SEQ ID NO: 1669684 - RNA, 18 nt, Homo sapiens
ccugggugugaccugaca

SEQ ID NO: 1669685 - RNA, 17 nt, Homo sapiens
ccuggucaauaaaccac

SEQ ID NO: 1669686 - RNA, 17 nt, Homo sapiens
ccugguggcaccagaug

SEQ ID NO: 1669687 - RNA, 20 nt, Homo sapiens
ccuguacccauucuguucca

SEQ ID NO: 1669688 - RNA, 14 nt, Homo sapiens
ccuguagcuccuua

SEQ ID NO: 1669689 - RNA, 19 nt, Homo sapiens
ccuguguauaaagccauua

SEQ ID NO: 1669690 - RNA, 18 nt, Homo sapiens
ccuguguguaagucccaa

SEQ ID NO: 1669691 - RNA, 15 nt, Homo sapiens
ccuguguuacugauu

SEQ ID NO: 1669692 - RNA, 21 nt, Homo sapiens
ccuguucuuccuaccaaauau

SEQ ID NO: 1669693 - RNA, 23 nt, Homo sapiens
ccuucaaugcaaaauacaugaug

SEQ ID NO: 1669694 - RNA, 14 nt, Homo sapiens
ccuucauaagccau

SEQ ID NO: 1669695 - RNA, 23 nt, Homo sapiens
ccuuccucaagauccugucuugc

SEQ ID NO: 1669696 - RNA, 15 nt, Homo sapiens
ccuuccuccucucaa

SEQ ID NO: 1669697 - RNA, 16 nt, Homo sapiens
ccuucuaauccaugug

SEQ ID NO: 1669698 - RNA, 16 nt, Homo sapiens
ccuucuccacagggac

SEQ ID NO: 1669699 - RNA, 17 nt, Homo sapiens
ccuucuccacagggaca

SEQ ID NO: 1669700 - RNA, 21 nt, Homo sapiens
ccuucuggcugcugcagucag

SEQ ID NO: 1669701 - RNA, 17 nt, Homo sapiens
ccuucuuuccuuccuuu

SEQ ID NO: 1669702 - RNA, 15 nt, Homo sapiens
ccuugaaaacucuca

SEQ ID NO: 1669703 - RNA, 22 nt, Homo sapiens
ccuugagcugguuuucucugau

SEQ ID NO: 1669704 - RNA, 15 nt, Homo sapiens
ccuugagucucugaa

SEQ ID NO: 1669705 - RNA, 21 nt, Homo sapiens
ccuugcauuuuagcuaauuua

SEQ ID NO: 1669706 - RNA, 17 nt, Homo sapiens
ccuugcuuccuucucau

SEQ ID NO: 1669707 - RNA, 14 nt, Homo sapiens
ccuugucuaaagau

SEQ ID NO: 1669708 - RNA, 20 nt, Homo sapiens
ccuuguuugccuuuaggcag

SEQ ID NO: 1669709 - RNA, 19 nt, Homo sapiens
ccuuuccucuuaauuccca

SEQ ID NO: 1669710 - RNA, 15 nt, Homo sapiens
gggccuguaauccca

SEQ ID NO: 1669711 - RNA, 16 nt, Homo sapiens
gggccuguaaucccag

SEQ ID NO: 1669712 - RNA, 20 nt, Homo sapiens
gggcgccuggguccucccag

SEQ ID NO: 1669713 - RNA, 17 nt, Homo sapiens
gggcucacaugccacug

SEQ ID NO: 1669714 - RNA, 12 nt, Homo sapiens
ggggaagccagu

SEQ ID NO: 1669715 - RNA, 15 nt, Homo sapiens
ggggagaauggcucu

SEQ ID NO: 1669716 - RNA, 12 nt, Homo sapiens
ggggcaggugaa

SEQ ID NO: 1669717 - RNA, 18 nt, Homo sapiens
gggguuuugacuugccac

SEQ ID NO: 1669718 - RNA, 23 nt, Homo sapiens
ggguaccuaguccccagccugcu

SEQ ID NO: 1669719 - RNA, 19 nt, Homo sapiens
ggguuucuaaagcugccag

SEQ ID NO: 1669720 - RNA, 21 nt, Homo sapiens
gguagaaucuuguuaauuuca

SEQ ID NO: 1669721 - RNA, 18 nt, Homo sapiens
gguagauauucaggaaau

SEQ ID NO: 1669722 - RNA, 16 nt, Homo sapiens
gguagcuuaccugaca

SEQ ID NO: 1669723 - RNA, 23 nt, Homo sapiens
gguaguagaaucucagcacuuug

SEQ ID NO: 1669724 - RNA, 15 nt, Homo sapiens
gguaucuacuucuac

SEQ ID NO: 1669725 - RNA, 17 nt, Homo sapiens
ggucaauaaaccacugu

SEQ ID NO: 1669726 - RNA, 13 nt, Homo sapiens
ggucaauuccuua

SEQ ID NO: 1669727 - RNA, 12 nt, Homo sapiens
ggucacugccca

SEQ ID NO: 1669728 - RNA, 14 nt, Homo sapiens
ggucccccaugcca

SEQ ID NO: 1669729 - RNA, 12 nt, Homo sapiens
gguccugcacug

SEQ ID NO: 1669730 - RNA, 17 nt, Homo sapiens
ggucuccucugcagcuc

SEQ ID NO: 1669731 - RNA, 15 nt, Homo sapiens
ggugaagaguccaag

SEQ ID NO: 1669732 - RNA, 13 nt, Homo sapiens
ggugaaugcacag

SEQ ID NO: 1669733 - RNA, 18 nt, Homo sapiens
ggugaggcgugggaucca

SEQ ID NO: 1669734 - RNA, 17 nt, Homo sapiens
ggugauuugucuuacaa

SEQ ID NO: 1669735 - RNA, 24 nt, Homo sapiens
ggugcacauugguuuaagcccaga

SEQ ID NO: 1669736 - RNA, 13 nt, Homo sapiens
ggugcaugccuuc

SEQ ID NO: 1669737 - RNA, 21 nt, Homo sapiens
ggugccuuccacccugcccug

SEQ ID NO: 1669738 - RNA, 13 nt, Homo sapiens
ggugccuugggga

SEQ ID NO: 1669739 - RNA, 17 nt, Homo sapiens
ggugcugcuuucuuguu

SEQ ID NO: 1669740 - RNA, 12 nt, Homo sapiens
gguggggggcca

SEQ ID NO: 1669741 - RNA, 13 nt, Homo sapiens
ggugucuguaauc

SEQ ID NO: 1669742 - RNA, 20 nt, Homo sapiens
ggugugagaauaacacuggc

SEQ ID NO: 1669743 - RNA, 14 nt, Homo sapiens
gguguggcuuggaa

SEQ ID NO: 1669744 - RNA, 18 nt, Homo sapiens
gguuacucaauuucaaaa

SEQ ID NO: 1669745 - RNA, 19 nt, Homo sapiens
gguucaaaaccuugcacag

SEQ ID NO: 1669746 - RNA, 13 nt, Homo sapiens
gguuggauguccu

SEQ ID NO: 1669747 - RNA, 15 nt, Homo sapiens
gguuuagaaugcugc

SEQ ID NO: 1669748 - RNA, 16 nt, Homo sapiens
gguuuuucuguucccu

SEQ ID NO: 1669749 - RNA, 18 nt, Homo sapiens
guaaaacuaaauguugcg

SEQ ID NO: 1669750 - RNA, 14 nt, Homo sapiens
guaaaacugugaca

SEQ ID NO: 1669751 - RNA, 15 nt, Homo sapiens
guaaaacugugacau

SEQ ID NO: 1669752 - RNA, 12 nt, Homo sapiens
guaaacagucag

SEQ ID NO: 1669753 - RNA, 19 nt, Homo sapiens
guaaaguuuauggaacuca

SEQ ID NO: 1669754 - RNA, 15 nt, Homo sapiens
guaaaucagugcagu

SEQ ID NO: 1669755 - RNA, 20 nt, Homo sapiens
guaaaucagugcaguacuca

SEQ ID NO: 1669756 - RNA, 15 nt, Homo sapiens
guaaauccacaguga

SEQ ID NO: 1669757 - RNA, 19 nt, Homo sapiens
guaaaugagccuuucugcc

SEQ ID NO: 1669758 - RNA, 14 nt, Homo sapiens
guaaaugucuucau

SEQ ID NO: 1669759 - RNA, 15 nt, Homo sapiens
guaacacagugcagu

SEQ ID NO: 1669760 - RNA, 16 nt, Homo sapiens
guaacacagugcagua

SEQ ID NO: 1669761 - RNA, 20 nt, Homo sapiens
guaacacagugcaguacuca

SEQ ID NO: 1669762 - RNA, 18 nt, Homo sapiens
guaacagugcaguacuca

SEQ ID NO: 1669763 - RNA, 19 nt, Homo sapiens
guaacaucacuauccaugc

SEQ ID NO: 1669764 - RNA, 12 nt, Homo sapiens
guaaccaugcaa

SEQ ID NO: 1669765 - RNA, 15 nt, Homo sapiens
guaacucacuuuaaa

SEQ ID NO: 1669766 - RNA, 21 nt, Homo sapiens
guaagaauuuuaauauugcca

SEQ ID NO: 1669767 - RNA, 15 nt, Homo sapiens
guaagagauaugcuc

SEQ ID NO: 1669768 - RNA, 14 nt, Homo sapiens
guaaguccuaauaa

SEQ ID NO: 1669769 - RNA, 15 nt, Homo sapiens
guaaguugaagggaa

SEQ ID NO: 1669770 - RNA, 19 nt, Homo sapiens
guaauauauacauauucaa

SEQ ID NO: 1669771 - RNA, 13 nt, Homo sapiens
guaauaucauuuc

SEQ ID NO: 1669772 - RNA, 16 nt, Homo sapiens
guaauccuagcacuuu

SEQ ID NO: 1669773 - RNA, 20 nt, Homo sapiens
guaaucuguugacagugcca

SEQ ID NO: 1669774 - RNA, 19 nt, Homo sapiens
guaauguauucuaucucuc

SEQ ID NO: 1669775 - RNA, 15 nt, Homo sapiens
guaauuguuacaauu

SEQ ID NO: 1669776 - RNA, 15 nt, Homo sapiens
guaauuuugcaaaac

SEQ ID NO: 1669777 - RNA, 19 nt, Homo sapiens
guacaccacuuucccacac

SEQ ID NO: 1669778 - RNA, 22 nt, Homo sapiens
guacauguuuauuauguucaau

SEQ ID NO: 1669779 - RNA, 15 nt, Homo sapiens
guacuaccccaggac

SEQ ID NO: 1669780 - RNA, 20 nt, Homo sapiens
guacucaguaacacagugca

SEQ ID NO: 1669781 - RNA, 22 nt, Homo sapiens
guacucaguaaggcagugcagu

SEQ ID NO: 1669782 - RNA, 22 nt, Homo sapiens
guacucaguuaggcagugcagu

SEQ ID NO: 1669783 - RNA, 23 nt, Homo sapiens
guacucaguuaggcagugcagua

SEQ ID NO: 1669784 - RNA, 13 nt, Homo sapiens
guacuccucagac

SEQ ID NO: 1669785 - RNA, 19 nt, Homo sapiens
guacuggagaaaauggacg

SEQ ID NO: 1669786 - RNA, 20 nt, Homo sapiens
guacuguuuuguuuguuaau

SEQ ID NO: 1669787 - RNA, 15 nt, Homo sapiens
guacuuacacugaaa

SEQ ID NO: 1669788 - RNA, 20 nt, Homo sapiens
guacuucuucauccauagac

SEQ ID NO: 1669789 - RNA, 12 nt, Homo sapiens
guagaaucucag

SEQ ID NO: 1669790 - RNA, 18 nt, Homo sapiens
guagaaucucagcacuuu

SEQ ID NO: 1669791 - RNA, 15 nt, Homo sapiens
guagagucacuggaa

SEQ ID NO: 1669792 - RNA, 15 nt, Homo sapiens
guagccuaauauuca

SEQ ID NO: 1669793 - RNA, 21 nt, Homo sapiens
guagcuuuucccaaacugauc

SEQ ID NO: 1669794 - RNA, 16 nt, Homo sapiens
guauaaauuacaugca

SEQ ID NO: 1669795 - RNA, 21 nt, Homo sapiens
guaucaaaaugaaugccaguc

SEQ ID NO: 1669796 - RNA, 19 nt, Homo sapiens
guaucaugcuucuacucca

SEQ ID NO: 1669797 - RNA, 10 nt, Homo sapiens
guauccucca

SEQ ID NO: 1669798 - RNA, 13 nt, Homo sapiens
guaugcuggccag

SEQ ID NO: 1669799 - RNA, 14 nt, Homo sapiens
guaugguaggguaa

SEQ ID NO: 1669800 - RNA, 18 nt, Homo sapiens
guauuauuuaguaaaauu

SEQ ID NO: 1669801 - RNA, 18 nt, Homo sapiens
guauucaguaaggcagug

SEQ ID NO: 1669802 - RNA, 15 nt, Homo sapiens
guauucuguuggcca

SEQ ID NO: 1669803 - RNA, 20 nt, Homo sapiens
guauuguugcuuuuuuucca

SEQ ID NO: 1669804 - RNA, 22 nt, Homo sapiens
guauuuaacauucuuggucaca

SEQ ID NO: 1669805 - RNA, 13 nt, Homo sapiens
guauuugggauau

SEQ ID NO: 1669806 - RNA, 17 nt, Homo sapiens
guauuuucacuggagac

SEQ ID NO: 1669807 - RNA, 14 nt, Homo sapiens
gucaaaauaaucug

SEQ ID NO: 1669808 - RNA, 16 nt, Homo sapiens
gucaaacuuucaccuc

SEQ ID NO: 1669809 - RNA, 20 nt, Homo sapiens
gucaaacuuucaccucagau

SEQ ID NO: 1669810 - RNA, 16 nt, Homo sapiens
gucaaauccauguguc

SEQ ID NO: 1669811 - RNA, 22 nt, Homo sapiens
gucaagagggggcaagucacau

SEQ ID NO: 1669812 - RNA, 18 nt, Homo sapiens
gucaagcgauugucugag

SEQ ID NO: 1669813 - RNA, 13 nt, Homo sapiens
gucaauuccuuag

SEQ ID NO: 1669814 - RNA, 20 nt, Homo sapiens
gucacaggguguuggaagau

SEQ ID NO: 1669815 - RNA, 22 nt, Homo sapiens
gucacccaaguuggagugcagu

SEQ ID NO: 1669816 - RNA, 21 nt, Homo sapiens
gucacccagguuggagugcag

SEQ ID NO: 1669817 - RNA, 15 nt, Homo sapiens
gucaccuuccaggac

SEQ ID NO: 1669818 - RNA, 19 nt, Homo sapiens
gucacuuuuuuccugucaa

SEQ ID NO: 1669819 - RNA, 13 nt, Homo sapiens
gucagcacagaga

SEQ ID NO: 1669820 - RNA, 18 nt, Homo sapiens
gucagcagagcuucagag

SEQ ID NO: 1669821 - RNA, 18 nt, Homo sapiens
gucagcugugaaucuguu

SEQ ID NO: 1669822 - RNA, 14 nt, Homo sapiens
gucaggagccagca

SEQ ID NO: 1669823 - RNA, 13 nt, Homo sapiens
gucaguaauuccg

SEQ ID NO: 1669824 - RNA, 15 nt, Homo sapiens
gucagucccuacuua

SEQ ID NO: 1669825 - RNA, 20 nt, Homo sapiens
gucaucacuccucugucaua

SEQ ID NO: 1669826 - RNA, 18 nt, Homo sapiens
gucaugaauucuucucaa

SEQ ID NO: 1669827 - RNA, 13 nt, Homo sapiens
gucaugauuucaa

SEQ ID NO: 1669828 - RNA, 20 nt, Homo sapiens
gucauguuucugcaguauuc

SEQ ID NO: 1669829 - RNA, 13 nt, Homo sapiens
gucauucugcuaa

SEQ ID NO: 1669830 - RNA, 21 nt, Homo sapiens
gucauugaugaacugccaaag

SEQ ID NO: 1669831 - RNA, 12 nt, Homo sapiens
guccaaacuguu

SEQ ID NO: 1669832 - RNA, 22 nt, Homo sapiens
guccaacauuccuuguuuguaa

SEQ ID NO: 1669833 - RNA, 12 nt, Homo sapiens
uagaccaggcag

SEQ ID NO: 1669834 - RNA, 17 nt, Homo sapiens
uagacuaagggcaggaa

SEQ ID NO: 1669835 - RNA, 15 nt, Homo sapiens
uagagcuacuuugag

SEQ ID NO: 1669836 - RNA, 16 nt, Homo sapiens
uagagcuagauguguc

SEQ ID NO: 1669837 - RNA, 22 nt, Homo sapiens
uagagcuagaugugucuuacca

SEQ ID NO: 1669838 - RNA, 18 nt, Homo sapiens
uagaggggcaacugauga

SEQ ID NO: 1669839 - RNA, 21 nt, Homo sapiens
uagaguguuuuaaaacauuca

SEQ ID NO: 1669840 - RNA, 13 nt, Homo sapiens
uagaucuccugua

SEQ ID NO: 1669841 - RNA, 20 nt, Homo sapiens
uagaugugucuuaccagauc

SEQ ID NO: 1669842 - RNA, 14 nt, Homo sapiens
uagauuaacccuau

SEQ ID NO: 1669843 - RNA, 13 nt, Homo sapiens
uagauucuuuauu

SEQ ID NO: 1669844 - RNA, 17 nt, Homo sapiens
uagcauacugaugagac

SEQ ID NO: 1669845 - RNA, 15 nt, Homo sapiens
uagcauugggaggaa

SEQ ID NO: 1669846 - RNA, 19 nt, Homo sapiens
uagccagaggcucuaaugu

SEQ ID NO: 1669847 - RNA, 21 nt, Homo sapiens
uagccaucagaugaggcuccu

SEQ ID NO: 1669848 - RNA, 20 nt, Homo sapiens
uagccccuuagccaguugua

SEQ ID NO: 1669849 - RNA, 18 nt, Homo sapiens
uagccuggucugugcauu

SEQ ID NO: 1669850 - RNA, 23 nt, Homo sapiens
uagcuagaagaauuucaaggaaa

SEQ ID NO: 1669851 - RNA, 13 nt, Homo sapiens
uagcucgugugcu

SEQ ID NO: 1669852 - RNA, 15 nt, Homo sapiens
uagcugggacuacag

SEQ ID NO: 1669853 - RNA, 16 nt, Homo sapiens
uagcuguccucucaga

SEQ ID NO: 1669854 - RNA, 16 nt, Homo sapiens
uaggaaagcagugcag

SEQ ID NO: 1669855 - RNA, 19 nt, Homo sapiens
uaggaaagcagugcaguac

SEQ ID NO: 1669856 - RNA, 14 nt, Homo sapiens
uaggaaugcucaau

SEQ ID NO: 1669857 - RNA, 20 nt, Homo sapiens
uaggcaauggugaacuguca

SEQ ID NO: 1669858 - RNA, 14 nt, Homo sapiens
uaggcagugcagua

SEQ ID NO: 1669859 - RNA, 18 nt, Homo sapiens
uaggcuuguguaauuucc

SEQ ID NO: 1669860 - RNA, 15 nt, Homo sapiens
uaggguccugaaugu

SEQ ID NO: 1669861 - RNA, 15 nt, Homo sapiens
uagguugaaggcaaa

SEQ ID NO: 1669862 - RNA, 23 nt, Homo sapiens
uagguugaaggcaaaaccaacuc

SEQ ID NO: 1669863 - RNA, 23 nt, Homo sapiens
uaguaaauaaugauucaauguga

SEQ ID NO: 1669864 - RNA, 16 nt, Homo sapiens
uaguaccucccagcag

SEQ ID NO: 1669865 - RNA, 18 nt, Homo sapiens
uaguaucagagaugucca

SEQ ID NO: 1669866 - RNA, 23 nt, Homo sapiens
uagucaagcgauugucugaggaa

SEQ ID NO: 1669867 - RNA, 21 nt, Homo sapiens
uagucaaucaaacagggacac

SEQ ID NO: 1669868 - RNA, 17 nt, Homo sapiens
uaguccuggaugacucg

SEQ ID NO: 1669869 - RNA, 22 nt, Homo sapiens
uaguggaaaaaaacaacccuug

SEQ ID NO: 1669870 - RNA, 22 nt, Homo sapiens
uagugggccaccccuaaucacu

SEQ ID NO: 1669871 - RNA, 22 nt, Homo sapiens
uagugguauuuuaacauagcag

SEQ ID NO: 1669872 - RNA, 15 nt, Homo sapiens
uagugugugcaauuu

SEQ ID NO: 1669873 - RNA, 18 nt, Homo sapiens
uaguuaaauuggcuuguu

SEQ ID NO: 1669874 - RNA, 18 nt, Homo sapiens
uaguuagauucacuuuga

SEQ ID NO: 1669875 - RNA, 15 nt, Homo sapiens
uaguuccagcuaacu

SEQ ID NO: 1669876 - RNA, 20 nt, Homo sapiens
uaguugccguggcaacugug

SEQ ID NO: 1669877 - RNA, 17 nt, Homo sapiens
uauaaacacaguaagau

SEQ ID NO: 1669878 - RNA, 20 nt, Homo sapiens
uauaaacuuuuuauucucag

SEQ ID NO: 1669879 - RNA, 19 nt, Homo sapiens
uauaaauggaauuacacaa

SEQ ID NO: 1669880 - RNA, 14 nt, Homo sapiens
uauaaauuacaugc

SEQ ID NO: 1669881 - RNA, 22 nt, Homo sapiens
uauaacuuuugguaucuacuuc

SEQ ID NO: 1669882 - RNA, 19 nt, Homo sapiens
uauaauuuuaaaauugcag

SEQ ID NO: 1669883 - RNA, 19 nt, Homo sapiens
uauacaaagcugucacuca

SEQ ID NO: 1669884 - RNA, 19 nt, Homo sapiens
uauacauuauuucuguaua

SEQ ID NO: 1669885 - RNA, 15 nt, Homo sapiens
uauagcauguaauau

SEQ ID NO: 1669886 - RNA, 17 nt, Homo sapiens
uauaguaccacugcaca

SEQ ID NO: 1669887 - RNA, 13 nt, Homo sapiens
uauagucacauuu

SEQ ID NO: 1669888 - RNA, 13 nt, Homo sapiens
uauauaagccaaa

SEQ ID NO: 1669889 - RNA, 18 nt, Homo sapiens
uauauaauuuuauugcug

SEQ ID NO: 1669890 - RNA, 14 nt, Homo sapiens
uauauagucucaag

SEQ ID NO: 1669891 - RNA, 18 nt, Homo sapiens
uauauagugaugugcuag

SEQ ID NO: 1669892 - RNA, 14 nt, Homo sapiens
uauauauaagcuca

SEQ ID NO: 1669893 - RNA, 16 nt, Homo sapiens
uauauauacauguaua

SEQ ID NO: 1669894 - RNA, 17 nt, Homo sapiens
uauauaugaaaacuaag

SEQ ID NO: 1669895 - RNA, 19 nt, Homo sapiens
uauaugcuuuuuugcaaua

SEQ ID NO: 1669896 - RNA, 16 nt, Homo sapiens
uauauguacaguuaua

SEQ ID NO: 1669897 - RNA, 16 nt, Homo sapiens
uauauguuuggcugaa

SEQ ID NO: 1669898 - RNA, 12 nt, Homo sapiens
uauauucccaaa

SEQ ID NO: 1669899 - RNA, 19 nt, Homo sapiens
uaucaaaauguuguccuuu

SEQ ID NO: 1669900 - RNA, 12 nt, Homo sapiens
uaucacagucag

SEQ ID NO: 1669901 - RNA, 20 nt, Homo sapiens
uaucauccugccuucaugga

SEQ ID NO: 1669902 - RNA, 15 nt, Homo sapiens
uaucauuaaccuuau

SEQ ID NO: 1669903 - RNA, 22 nt, Homo sapiens
uaucauuaaccuuaucauaaau

SEQ ID NO: 1669904 - RNA, 14 nt, Homo sapiens
uaucauucacccaa

SEQ ID NO: 1669905 - RNA, 17 nt, Homo sapiens
uaucauuuugcacgugc

SEQ ID NO: 1669906 - RNA, 22 nt, Homo sapiens
uauccaagaccuuacaaccaca

SEQ ID NO: 1669907 - RNA, 18 nt, Homo sapiens
uauccacuacauucugaa

SEQ ID NO: 1669908 - RNA, 19 nt, Homo sapiens
uaucccuggaguuccucau

SEQ ID NO: 1669909 - RNA, 14 nt, Homo sapiens
uauccuuacuuuau

SEQ ID NO: 1669910 - RNA, 19 nt, Homo sapiens
uaucgagaguuucuaugga

SEQ ID NO: 1669911 - RNA, 19 nt, Homo sapiens
uaucucgcuagccauauau

SEQ ID NO: 1669912 - RNA, 18 nt, Homo sapiens
uaucugggagaaaacugu

SEQ ID NO: 1669913 - RNA, 16 nt, Homo sapiens
uaucugucaucucucu

SEQ ID NO: 1669914 - RNA, 18 nt, Homo sapiens
uaucuuacuuuccucuga

SEQ ID NO: 1669915 - RNA, 12 nt, Homo sapiens
uaucuuugguau

SEQ ID NO: 1669916 - RNA, 19 nt, Homo sapiens
uaugaacgcacaacaugca

SEQ ID NO: 1669917 - RNA, 20 nt, Homo sapiens
uaugaauaaauauuacaaau

SEQ ID NO: 1669918 - RNA, 16 nt, Homo sapiens
uaugaauuaagcugua

SEQ ID NO: 1669919 - RNA, 20 nt, Homo sapiens
uaugauaaauuugacuguua

SEQ ID NO: 1669920 - RNA, 21 nt, Homo sapiens
uaugauaugugcuugugugua

SEQ ID NO: 1669921 - RNA, 16 nt, Homo sapiens
uaugcauguagcauau

SEQ ID NO: 1669922 - RNA, 14 nt, Homo sapiens
uaugccugucuuua

SEQ ID NO: 1669923 - RNA, 15 nt, Homo sapiens
uaugccugucuuuac

SEQ ID NO: 1669924 - RNA, 21 nt, Homo sapiens
uaugcuucuuggagucuucca

SEQ ID NO: 1669925 - RNA, 22 nt, Homo sapiens
uauggaaauccuguuacuuaaa

SEQ ID NO: 1669926 - RNA, 23 nt, Homo sapiens
uauggaucuguugggaaccagag

SEQ ID NO: 1669927 - RNA, 19 nt, Homo sapiens
uaugguagaaaaauuucac

SEQ ID NO: 1669928 - RNA, 19 nt, Homo sapiens
uauguaugugugaguguau

SEQ ID NO: 1669929 - RNA, 14 nt, Homo sapiens
uaugucccaugacc

SEQ ID NO: 1669930 - RNA, 15 nt, Homo sapiens
uaugucuauguguau

SEQ ID NO: 1669931 - RNA, 17 nt, Homo sapiens
uaugucuauguguauau

SEQ ID NO: 1669932 - RNA, 19 nt, Homo sapiens
uaugugaauugagcacaua

SEQ ID NO: 1669933 - RNA, 11 nt, Homo sapiens
uaugugagcac

SEQ ID NO: 1669934 - RNA, 17 nt, Homo sapiens
uaugugcagcuuuccag

SEQ ID NO: 1669935 - RNA, 15 nt, Homo sapiens
uauguguaauaucau

SEQ ID NO: 1669936 - RNA, 19 nt, Homo sapiens
uaugugucagccaugacca

SEQ ID NO: 1669937 - RNA, 20 nt, Homo sapiens
uauguuuagugugauuguga

SEQ ID NO: 1669938 - RNA, 14 nt, Homo sapiens
uauuaaucagaaga

SEQ ID NO: 1669939 - RNA, 19 nt, Homo sapiens
uauuagugaaguaugcacu

SEQ ID NO: 1669940 - RNA, 20 nt, Homo sapiens
uauuagugaaguaugcacua

SEQ ID NO: 1669941 - RNA, 18 nt, Homo sapiens
uauuauagucuguacuuc

SEQ ID NO: 1669942 - RNA, 20 nt, Homo sapiens
uauucaacagcucaccaacu

SEQ ID NO: 1669943 - RNA, 21 nt, Homo sapiens
uauucaacagcucaccaacua

SEQ ID NO: 1669944 - RNA, 16 nt, Homo sapiens
uauucccaaaucucaa

SEQ ID NO: 1669945 - RNA, 21 nt, Homo sapiens
uauucccaugguagacuguga

SEQ ID NO: 1669946 - RNA, 17 nt, Homo sapiens
uauuccucacauucaca

SEQ ID NO: 1669947 - RNA, 14 nt, Homo sapiens
uauucuggugucua

SEQ ID NO: 1669948 - RNA, 22 nt, Homo sapiens
uauucuuccaaguucauucaua

SEQ ID NO: 1669949 - RNA, 23 nt, Homo sapiens
uauucuuuuuggaaauaaaauac

SEQ ID NO: 1669950 - RNA, 20 nt, Homo sapiens
uauugcccuuuaacaagacu

SEQ ID NO: 1669951 - RNA, 21 nt, Homo sapiens
uauugcccuuuaacaagacuu

SEQ ID NO: 1669952 - RNA, 13 nt, Homo sapiens
uauuggacagucu

SEQ ID NO: 1669953 - RNA, 13 nt, Homo sapiens
uauuggacuucca

SEQ ID NO: 1669954 - RNA, 22 nt, Homo sapiens
ucugauacaucugucagugagu

SEQ ID NO: 1669955 - RNA, 21 nt, Homo sapiens
ucugaugaaguuguacaacac

SEQ ID NO: 1669956 - RNA, 16 nt, Homo sapiens
ucugcacacauaacac

SEQ ID NO: 1669957 - RNA, 13 nt, Homo sapiens
ucugcagccugag

SEQ ID NO: 1669958 - RNA, 23 nt, Homo sapiens
ucugcauaaauauuagcaaagca

SEQ ID NO: 1669959 - RNA, 18 nt, Homo sapiens
ucugcauuucuacauguu

SEQ ID NO: 1669960 - RNA, 20 nt, Homo sapiens
ucugccagguuuaaggucac

SEQ ID NO: 1669961 - RNA, 18 nt, Homo sapiens
ucugcccaaccuugacca

SEQ ID NO: 1669962 - RNA, 15 nt, Homo sapiens
ucugccgguccccca

SEQ ID NO: 1669963 - RNA, 20 nt, Homo sapiens
ucugcuugucauucugcuaa

SEQ ID NO: 1669964 - RNA, 21 nt, Homo sapiens
ucugcuuucugauacaucugu

SEQ ID NO: 1669965 - RNA, 18 nt, Homo sapiens
ucuggagguacgaaaaga

SEQ ID NO: 1669966 - RNA, 17 nt, Homo sapiens
ucuggauucaaauuuau

SEQ ID NO: 1669967 - RNA, 18 nt, Homo sapiens
ucuggcuacgacuuggga

SEQ ID NO: 1669968 - RNA, 18 nt, Homo sapiens
ucugggaccaaaacauca

SEQ ID NO: 1669969 - RNA, 19 nt, Homo sapiens
ucugggaccaaaacaucaa

SEQ ID NO: 1669970 - RNA, 22 nt, Homo sapiens
ucuggggguguaucacagucag

SEQ ID NO: 1669971 - RNA, 15 nt, Homo sapiens
ucuggggucugugau

SEQ ID NO: 1669972 - RNA, 14 nt, Homo sapiens
ucugggguggggcu

SEQ ID NO: 1669973 - RNA, 23 nt, Homo sapiens
ucuguagccuggucugugcauug

SEQ ID NO: 1669974 - RNA, 15 nt, Homo sapiens
ucuguauaaauguga

SEQ ID NO: 1669975 - RNA, 16 nt, Homo sapiens
ucugucacccagguug

SEQ ID NO: 1669976 - RNA, 15 nt, Homo sapiens
ucugucauaugcaga

SEQ ID NO: 1669977 - RNA, 16 nt, Homo sapiens
ucugucaucucucugg

SEQ ID NO: 1669978 - RNA, 20 nt, Homo sapiens
ucugucccaguuaacuguua

SEQ ID NO: 1669979 - RNA, 15 nt, Homo sapiens
ucugugaaauaucau

SEQ ID NO: 1669980 - RNA, 14 nt, Homo sapiens
ucugugcaacaaac

SEQ ID NO: 1669981 - RNA, 14 nt, Homo sapiens
ucugugugugacac

SEQ ID NO: 1669982 - RNA, 15 nt, Homo sapiens
ucuguuaaaugaacu

SEQ ID NO: 1669983 - RNA, 18 nt, Homo sapiens
ucuguuaaaugaacuuga

SEQ ID NO: 1669984 - RNA, 19 nt, Homo sapiens
ucuguuugauacaguauua

SEQ ID NO: 1669985 - RNA, 18 nt, Homo sapiens
ucuguuuugggaaacacu

SEQ ID NO: 1669986 - RNA, 15 nt, Homo sapiens
ucuuaaugucucaaa

SEQ ID NO: 1669987 - RNA, 12 nt, Homo sapiens
ucuuaauuccca

SEQ ID NO: 1669988 - RNA, 17 nt, Homo sapiens
ucuuacuguugcauaac

SEQ ID NO: 1669989 - RNA, 13 nt, Homo sapiens
ucuuagauucucu

SEQ ID NO: 1669990 - RNA, 14 nt, Homo sapiens
ucuuauacagauaa

SEQ ID NO: 1669991 - RNA, 16 nt, Homo sapiens
ucuuaucccagugauc

SEQ ID NO: 1669992 - RNA, 18 nt, Homo sapiens
ucuuaucccagugaucac

SEQ ID NO: 1669993 - RNA, 16 nt, Homo sapiens
ucuuauuuauauauga

SEQ ID NO: 1669994 - RNA, 14 nt, Homo sapiens
ucuucaaacaguuc

SEQ ID NO: 1669995 - RNA, 14 nt, Homo sapiens
ucuucaacaugguu

SEQ ID NO: 1669996 - RNA, 15 nt, Homo sapiens
ucuucaauccccaua

SEQ ID NO: 1669997 - RNA, 18 nt, Homo sapiens
ucuucacugucuuacuca

SEQ ID NO: 1669998 - RNA, 22 nt, Homo sapiens
ucuucagaagaaaggacagcuc

SEQ ID NO: 1669999 - RNA, 20 nt, Homo sapiens
ucuucaucucccggugccuu

SEQ ID NO: 1670000 - RNA, 16 nt, Homo sapiens
ucuucaugaugguggu

SEQ ID NO: 1670001 - RNA, 17 nt, Homo sapiens
ucuuccaacaugugaug

SEQ ID NO: 1670002 - RNA, 16 nt, Homo sapiens
ucuuccauaugcucuu

SEQ ID NO: 1670003 - RNA, 14 nt, Homo sapiens
ucuucgcugugaug

SEQ ID NO: 1670004 - RNA, 22 nt, Homo sapiens
ucuucgguggccuugagucucu

SEQ ID NO: 1670005 - RNA, 19 nt, Homo sapiens
ucuucuaucaaagcacaua

SEQ ID NO: 1670006 - RNA, 17 nt, Homo sapiens
ucuucucaaagauuuga

SEQ ID NO: 1670007 - RNA, 22 nt, Homo sapiens
ucuucucagcuccacucugaag

SEQ ID NO: 1670008 - RNA, 13 nt, Homo sapiens
ucuugaauguuga

SEQ ID NO: 1670009 - RNA, 22 nt, Homo sapiens
ucuugccucauuuugcuuccca

SEQ ID NO: 1670010 - RNA, 18 nt, Homo sapiens
ucuugcggcaccgcccac

SEQ ID NO: 1670011 - RNA, 15 nt, Homo sapiens
ucuugggaagcaguu

SEQ ID NO: 1670012 - RNA, 23 nt, Homo sapiens
ucuuguaaaacugugacauucca

SEQ ID NO: 1670013 - RNA, 18 nt, Homo sapiens
ucuuguuguuauucagaa

SEQ ID NO: 1670014 - RNA, 14 nt, Homo sapiens
ucuuuaccuugcau

SEQ ID NO: 1670015 - RNA, 24 nt, Homo sapiens
ucuuuaccuugcauuuuagcuaau

SEQ ID NO: 1670016 - RNA, 18 nt, Homo sapiens
ucuuuagcuauuacugga

SEQ ID NO: 1670017 - RNA, 16 nt, Homo sapiens
ucuuuaguugauuuaa

SEQ ID NO: 1670018 - RNA, 15 nt, Homo sapiens
ucuuuauaauggcuc

SEQ ID NO: 1670019 - RNA, 20 nt, Homo sapiens
ucuuucacuggggaagccag

SEQ ID NO: 1670020 - RNA, 14 nt, Homo sapiens
ucuuuccagcaucc

SEQ ID NO: 1670021 - RNA, 14 nt, Homo sapiens
ucuuuccuccucau

SEQ ID NO: 1670022 - RNA, 18 nt, Homo sapiens
ucuuucggaaaugauuga

SEQ ID NO: 1670023 - RNA, 14 nt, Homo sapiens
ucuuucucucugug

SEQ ID NO: 1670024 - RNA, 18 nt, Homo sapiens
ucuuugagggacugccuc

SEQ ID NO: 1670025 - RNA, 18 nt, Homo sapiens
ucuuuggcuucagaauug

SEQ ID NO: 1670026 - RNA, 21 nt, Homo sapiens
ucuuugguagggagaggggcu

SEQ ID NO: 1670027 - RNA, 14 nt, Homo sapiens
ucuuugguuccuca

SEQ ID NO: 1670028 - RNA, 17 nt, Homo sapiens
ucuuugucaaugcucua

SEQ ID NO: 1670029 - RNA, 18 nt, Homo sapiens
ucuuuguguuuuguccaa

SEQ ID NO: 1670030 - RNA, 14 nt, Homo sapiens
ucuuuucaaugugu

SEQ ID NO: 1670031 - RNA, 22 nt, Homo sapiens
ucuuuucuucuccgccaguaug

SEQ ID NO: 1670032 - RNA, 15 nt, Homo sapiens
ucuuuuuucaaugua

SEQ ID NO: 1670033 - RNA, 18 nt, Homo sapiens
ucuuuuuucaauguacug

SEQ ID NO: 1670034 - RNA, 23 nt, Homo sapiens
ucuuuuuucaauguacuguauug

SEQ ID NO: 1670035 - RNA, 21 nt, Homo sapiens
ugaaaaaucugaauuucuaaa

SEQ ID NO: 1670036 - RNA, 20 nt, Homo sapiens
ugaaaaccacccuaucauca

SEQ ID NO: 1670037 - RNA, 14 nt, Homo sapiens
ugaaaaccaucugg

SEQ ID NO: 1670038 - RNA, 12 nt, Homo sapiens
ugaaaaggugau

SEQ ID NO: 1670039 - RNA, 13 nt, Homo sapiens
ugaaaaguuuuca

SEQ ID NO: 1670040 - RNA, 12 nt, Homo sapiens
ugaaaauggaga

SEQ ID NO: 1670041 - RNA, 14 nt, Homo sapiens
ugaaaauggagaaa

SEQ ID NO: 1670042 - RNA, 15 nt, Homo sapiens
ugaaaauggagaaag

SEQ ID NO: 1670043 - RNA, 22 nt, Homo sapiens
ugaaaauggcugaagaaacaca

SEQ ID NO: 1670044 - RNA, 15 nt, Homo sapiens
ugaaaauucuugaua

SEQ ID NO: 1670045 - RNA, 16 nt, Homo sapiens
ugaaaauucuugauaa

SEQ ID NO: 1670046 - RNA, 19 nt, Homo sapiens
ugaaacacacagugaccaa

SEQ ID NO: 1670047 - RNA, 14 nt, Homo sapiens
ugaaauaacagccu

SEQ ID NO: 1670048 - RNA, 17 nt, Homo sapiens
ugaaauauaaacuguga

SEQ ID NO: 1670049 - RNA, 15 nt, Homo sapiens
ugaaauccaaaauag

SEQ ID NO: 1670050 - RNA, 15 nt, Homo sapiens
ugaaauuauaucugu

SEQ ID NO: 1670051 - RNA, 16 nt, Homo sapiens
ugaaauuuucuguaca

SEQ ID NO: 1670052 - RNA, 20 nt, Homo sapiens
ugaacaacucgaaucacuca

SEQ ID NO: 1670053 - RNA, 15 nt, Homo sapiens
ugaacacaaagccug

SEQ ID NO: 1670054 - RNA, 23 nt, Homo sapiens
ugaacaccacuuugucucugaga

SEQ ID NO: 1670055 - RNA, 13 nt, Homo sapiens
ugaacagaacaaa

SEQ ID NO: 1670056 - RNA, 16 nt, Homo sapiens
ugaaccgucaauguga

SEQ ID NO: 1670057 - RNA, 14 nt, Homo sapiens
ugaacuaacugcca

SEQ ID NO: 1670058 - RNA, 13 nt, Homo sapiens
ugaacuaaugaca

SEQ ID NO: 1670059 - RNA, 21 nt, Homo sapiens
ugaacuauuucuacacagugg

SEQ ID NO: 1670060 - RNA, 13 nt, Homo sapiens
ugaacucagggag

SEQ ID NO: 1670061 - RNA, 16 nt, Homo sapiens
ugaagaauauuguuaa

SEQ ID NO: 1670062 - RNA, 16 nt, Homo sapiens
ugaagaauuaaugaca

SEQ ID NO: 1670063 - RNA, 19 nt, Homo sapiens
ugaagacagagcagaucag

SEQ ID NO: 1670064 - RNA, 20 nt, Homo sapiens
ugaagacagagcuacacagg

SEQ ID NO: 1670065 - RNA, 16 nt, Homo sapiens
ugaagaguccaagaag

SEQ ID NO: 1670066 - RNA, 11 nt, Homo sapiens
ugaagauuuca

SEQ ID NO: 1670067 - RNA, 16 nt, Homo sapiens
ugaagauuucauggac

SEQ ID NO: 1670068 - RNA, 19 nt, Homo sapiens
ugaagauuucauggacacu

SEQ ID NO: 1670069 - RNA, 21 nt, Homo sapiens
ugaagauuucauggacacuga

SEQ ID NO: 1670070 - RNA, 18 nt, Homo sapiens
ugaagauuucauggacau

SEQ ID NO: 1670071 - RNA, 20 nt, Homo sapiens
ugaaggaaccagcaaugaga

SEQ ID NO: 1670072 - RNA, 15 nt, Homo sapiens
ugaaggacuacaggu

SEQ ID NO: 1670073 - RNA, 14 nt, Homo sapiens
ugaaggauugugaa

SEQ ID NO: 1670074 - RNA, 22 nt, Homo sapiens
ugaaggcaaaaccaacucucua

SEQ ID NO: 1670075 - RNA, 12 nt, Homo sapiens
ugaaggggccag

SEQ ID NO: 1670076 - RNA, 17 nt, Homo sapiens
ugaaggggcugguggag

SEQ ID NO: 1670077 - RNA, 14 nt, Homo sapiens
uucaaccaguuuga

SEQ ID NO: 1670078 - RNA, 22 nt, Homo sapiens
uucaaccaguuugaaccaagaa

SEQ ID NO: 1670079 - RNA, 20 nt, Homo sapiens
uucaaccugguggcaccaga

SEQ ID NO: 1670080 - RNA, 15 nt, Homo sapiens
uucaagaaugcagua

SEQ ID NO: 1670081 - RNA, 22 nt, Homo sapiens
uucaagcaggcgccaagugcua

SEQ ID NO: 1670082 - RNA, 23 nt, Homo sapiens
uucaagcaggcgccaagugcuau

SEQ ID NO: 1670083 - RNA, 23 nt, Homo sapiens
uucaagugcuucuccagccucag

SEQ ID NO: 1670084 - RNA, 18 nt, Homo sapiens
uucaauguuaaaucuaca

SEQ ID NO: 1670085 - RNA, 22 nt, Homo sapiens
uucacaaguaaucuguugacag

SEQ ID NO: 1670086 - RNA, 18 nt, Homo sapiens
uucacacaacuguggaua

SEQ ID NO: 1670087 - RNA, 15 nt, Homo sapiens
uucacagauggaauc

SEQ ID NO: 1670088 - RNA, 15 nt, Homo sapiens
uucacagccaugauu

SEQ ID NO: 1670089 - RNA, 11 nt, Homo sapiens
uucacaguauc

SEQ ID NO: 1670090 - RNA, 15 nt, Homo sapiens
uucaccgcauuccag

SEQ ID NO: 1670091 - RNA, 18 nt, Homo sapiens
uucaccuccauuaaccaa

SEQ ID NO: 1670092 - RNA, 16 nt, Homo sapiens
uucaccucuucccaca

SEQ ID NO: 1670093 - RNA, 15 nt, Homo sapiens
uucacuauaauguga

SEQ ID NO: 1670094 - RNA, 16 nt, Homo sapiens
uucagaaacaaagcau

SEQ ID NO: 1670095 - RNA, 14 nt, Homo sapiens
uucagaaagggcag

SEQ ID NO: 1670096 - RNA, 19 nt, Homo sapiens
uucagugccaaaaacaaca

SEQ ID NO: 1670097 - RNA, 18 nt, Homo sapiens
uucauaccuucugaugaa

SEQ ID NO: 1670098 - RNA, 22 nt, Homo sapiens
uucauccaacgugaagauacca

SEQ ID NO: 1670099 - RNA, 17 nt, Homo sapiens
uucauggcaucacaucu

SEQ ID NO: 1670100 - RNA, 16 nt, Homo sapiens
uucauguuuucacuua

SEQ ID NO: 1670101 - RNA, 15 nt, Homo sapiens
uucauuaaaacaaga

SEQ ID NO: 1670102 - RNA, 15 nt, Homo sapiens
uucauucaagcuuca

SEQ ID NO: 1670103 - RNA, 17 nt, Homo sapiens
uucauucacaguuugau

SEQ ID NO: 1670104 - RNA, 14 nt, Homo sapiens
uucauucaccuaac

SEQ ID NO: 1670105 - RNA, 23 nt, Homo sapiens
uucauuuaggugaggaagcaaaa

SEQ ID NO: 1670106 - RNA, 18 nt, Homo sapiens
uuccaaguuuauugcccu

SEQ ID NO: 1670107 - RNA, 18 nt, Homo sapiens
uuccaaugcuuugauccc

SEQ ID NO: 1670108 - RNA, 19 nt, Homo sapiens
uuccacccugcccuggccu

SEQ ID NO: 1670109 - RNA, 19 nt, Homo sapiens
uuccacgugggguggaauu

SEQ ID NO: 1670110 - RNA, 13 nt, Homo sapiens
uuccagugcugcu

SEQ ID NO: 1670111 - RNA, 14 nt, Homo sapiens
uuccauaugcucuu

SEQ ID NO: 1670112 - RNA, 12 nt, Homo sapiens
uuccaugguggu

SEQ ID NO: 1670113 - RNA, 23 nt, Homo sapiens
uuccaugucugaaguuugcccca

SEQ ID NO: 1670114 - RNA, 15 nt, Homo sapiens
uuccauuugcaacag

SEQ ID NO: 1670115 - RNA, 15 nt, Homo sapiens
uuccauuuuggaaaa

SEQ ID NO: 1670116 - RNA, 17 nt, Homo sapiens
uucccaaaucucaaaag

SEQ ID NO: 1670117 - RNA, 14 nt, Homo sapiens
uucccaaucccauu

SEQ ID NO: 1670118 - RNA, 22 nt, Homo sapiens
uucccacacugugaacuaauga

SEQ ID NO: 1670119 - RNA, 21 nt, Homo sapiens
uucccaucuuaaauuucuaaa

SEQ ID NO: 1670120 - RNA, 18 nt, Homo sapiens
uuccccaaucaauacccu

SEQ ID NO: 1670121 - RNA, 13 nt, Homo sapiens
uuccccacucccg

SEQ ID NO: 1670122 - RNA, 20 nt, Homo sapiens
uucccccagaacauggaaau

SEQ ID NO: 1670123 - RNA, 15 nt, Homo sapiens
uucccccagcacaaa

SEQ ID NO: 1670124 - RNA, 14 nt, Homo sapiens
uucccgccuaauaa

SEQ ID NO: 1670125 - RNA, 15 nt, Homo sapiens
uucccgccuaauaaa

SEQ ID NO: 1670126 - RNA, 14 nt, Homo sapiens
uucccucuuuccau

SEQ ID NO: 1670127 - RNA, 19 nt, Homo sapiens
uucccugaacacucauccc

SEQ ID NO: 1670128 - RNA, 16 nt, Homo sapiens
uucccuggugaugguc

SEQ ID NO: 1670129 - RNA, 16 nt, Homo sapiens
uucccuuccacugccu

SEQ ID NO: 1670130 - RNA, 17 nt, Homo sapiens
uuccucuuaauucccaa

SEQ ID NO: 1670131 - RNA, 23 nt, Homo sapiens
uuccucuuaauucccaaucccau

SEQ ID NO: 1670132 - RNA, 18 nt, Homo sapiens
uuccucuuucacuucuua

SEQ ID NO: 1670133 - RNA, 15 nt, Homo sapiens
uuccugacuguucuc

SEQ ID NO: 1670134 - RNA, 23 nt, Homo sapiens
uuccugccuuugauguggaugaa

SEQ ID NO: 1670135 - RNA, 20 nt, Homo sapiens
uucguccuuagaauacugua

SEQ ID NO: 1670136 - RNA, 14 nt, Homo sapiens
uucguuaaucuugc

SEQ ID NO: 1670137 - RNA, 22 nt, Homo sapiens
uucuaaaggggacagaucuuga

SEQ ID NO: 1670138 - RNA, 17 nt, Homo sapiens
uucuaaaugccuuugac

SEQ ID NO: 1670139 - RNA, 19 nt, Homo sapiens
uucuaaggagcacuagaau

SEQ ID NO: 1670140 - RNA, 23 nt, Homo sapiens
uucuaccuuccugcaacaccuug

SEQ ID NO: 1670141 - RNA, 21 nt, Homo sapiens
uucuaggcaguucaaagcagg

SEQ ID NO: 1670142 - RNA, 14 nt, Homo sapiens
uucuauauuuacug

SEQ ID NO: 1670143 - RNA, 12 nt, Homo sapiens
uucuauggauuc

SEQ ID NO: 1670144 - RNA, 16 nt, Homo sapiens
uucuauggauucacuu

SEQ ID NO: 1670145 - RNA, 21 nt, Homo sapiens
uucuauuagcuuacugauuaa

SEQ ID NO: 1670146 - RNA, 21 nt, Homo sapiens
uucucaagcgcuauccacaga

SEQ ID NO: 1670147 - RNA, 11 nt, Homo sapiens
uucucaucucc

SEQ ID NO: 1670148 - RNA, 21 nt, Homo sapiens
uucucauuuagcauugaaaua

SEQ ID NO: 1670149 - RNA, 20 nt, Homo sapiens
uucuccacuuucuagccaga

SEQ ID NO: 1670150 - RNA, 21 nt, Homo sapiens
uucuccagggguuuacaguga

SEQ ID NO: 1670151 - RNA, 12 nt, Homo sapiens
uucucuagacau

SEQ ID NO: 1670152 - RNA, 23 nt, Homo sapiens
uucucucuguguggcaaacauuu

SEQ ID NO: 1670153 - RNA, 20 nt, Homo sapiens
uucucuguauaacuugugau

SEQ ID NO: 1670154 - RNA, 15 nt, Homo sapiens
uucugaaauucacaa

SEQ ID NO: 1670155 - RNA, 16 nt, Homo sapiens
uucugacagcauuuca

SEQ ID NO: 1670156 - RNA, 13 nt, Homo sapiens
uucugaguagcau

SEQ ID NO: 1670157 - RNA, 22 nt, Homo sapiens
uucugccucacaucagcccugu

SEQ ID NO: 1670158 - RNA, 20 nt, Homo sapiens
uucuguaauauuuacaaugu

SEQ ID NO: 1670159 - RNA, 20 nt, Homo sapiens
uucugugagaagugcaacug

SEQ ID NO: 1670160 - RNA, 23 nt, Homo sapiens
uucuguuauacacaguuccacaa

SEQ ID NO: 1670161 - RNA, 12 nt, Homo sapiens
uucuuacuguau

SEQ ID NO: 1670162 - RNA, 13 nt, Homo sapiens
uucuuagauucuc

SEQ ID NO: 1670163 - RNA, 22 nt, Homo sapiens
uucuuagugaaaggucaucuca

SEQ ID NO: 1670164 - RNA, 15 nt, Homo sapiens
uucuucaugauggug

SEQ ID NO: 1670165 - RNA, 18 nt, Homo sapiens
uucuuccaacaugugaug

SEQ ID NO: 1670166 - RNA, 12 nt, Homo sapiens
uucuuccuuccu

SEQ ID NO: 1670167 - RNA, 18 nt, Homo sapiens
uucuugaacaaacuggaa

SEQ ID NO: 1670168 - RNA, 21 nt, Homo sapiens
uucuugauaaagaagauucug

SEQ ID NO: 1670169 - RNA, 15 nt, Homo sapiens
uucuugaugauggug

SEQ ID NO: 1670170 - RNA, 11 nt, Homo sapiens
uucuugcaaua

SEQ ID NO: 1670171 - RNA, 13 nt, Homo sapiens
uucuugcacugua

SEQ ID NO: 1670172 - RNA, 18 nt, Homo sapiens
uucuuguaaaacugugac

SEQ ID NO: 1670173 - RNA, 14 nt, Homo sapiens
uucuuguaucugga

SEQ ID NO: 1670174 - RNA, 19 nt, Homo sapiens
uucuuguugcugcaucucc

SEQ ID NO: 1670175 - RNA, 17 nt, Homo sapiens
uucuuguuuaccaaaga

SEQ ID NO: 1670176 - RNA, 15 nt, Homo sapiens
uucuuuauaauggcu

SEQ ID NO: 1670177 - RNA, 21 nt, Homo sapiens
uucuuuccucaaagaagcaug

SEQ ID NO: 1670178 - RNA, 13 nt, Homo sapiens
uucuuuccuuccu

SEQ ID NO: 1670179 - RNA, 16 nt, Homo sapiens
uucuuucugcaugacu

SEQ ID NO: 1670180 - RNA, 17 nt, Homo sapiens
uugaaaaaagcugaauu

SEQ ID NO: 1670181 - RNA, 20 nt, Homo sapiens
uugaaaagagguggauucau

SEQ ID NO: 1670182 - RNA, 19 nt, Homo sapiens
uugaaauuauaucuguggu

SEQ ID NO: 1670183 - RNA, 14 nt, Homo sapiens
uugaacucagggag

SEQ ID NO: 1670184 - RNA, 19 nt, Homo sapiens
uugaagaaugaaaggcaau

SEQ ID NO: 1670185 - RNA, 13 nt, Homo sapiens
uugaaugaugcca

SEQ ID NO: 1670186 - RNA, 22 nt, Homo sapiens
uugacacuuuucauaucauuuc

SEQ ID NO: 1670187 - RNA, 15 nt, Homo sapiens
uugaccuacccugga

SEQ ID NO: 1670188 - RNA, 11 nt, Homo sapiens
uugacuugcca

SEQ ID NO: 1670189 - RNA, 18 nt, Homo sapiens
uugagaaauaaagcacau

SEQ ID NO: 1670190 - RNA, 13 nt, Homo sapiens
uugagauggaguc

SEQ ID NO: 1670191 - RNA, 23 nt, Homo sapiens
uugagcagaacccagacccugag

SEQ ID NO: 1670192 - RNA, 16 nt, Homo sapiens
uugagcccuggacuca

SEQ ID NO: 1670193 - RNA, 13 nt, Homo sapiens
uugagcugaccca

SEQ ID NO: 1670194 - RNA, 21 nt, Homo sapiens
uugaggacauuuaugaugcag

SEQ ID NO: 1670195 - RNA, 19 nt, Homo sapiens
uugaggcuaaguaaccuga

SEQ ID NO: 1670196 - RNA, 13 nt, Homo sapiens
uugagucuggaua

SEQ ID NO: 1670197 - RNA, 14 nt, Homo sapiens
uugauagcacacau

SEQ ID NO: 1670198 - RNA, 13 nt, Homo sapiens
uugauguccuucc

SEQ ID NO: 1670199 - RNA, 17 nt, Homo sapiens
aaaaaaaugauugucua

SEQ ID NO: 1670200 - RNA, 11 nt, Homo sapiens
aaaaaacugga

SEQ ID NO: 1670201 - RNA, 22 nt, Homo sapiens
aaaaaauguucauucuaugaca

SEQ ID NO: 1670202 - RNA, 17 nt, Homo sapiens
aaguucauccaacguga

SEQ ID NO: 1670203 - RNA, 19 nt, Homo sapiens
aaguugucuuacacuucuc

SEQ ID NO: 1670204 - RNA, 13 nt, Homo sapiens
aaguuuugauacu

SEQ ID NO: 1670205 - RNA, 19 nt, Homo sapiens
aaguuuugccuauccuaag

SEQ ID NO: 1670206 - RNA, 16 nt, Homo sapiens
aauaaaaaucauucua

SEQ ID NO: 1670207 - RNA, 14 nt, Homo sapiens
aauaaaagaaucau

SEQ ID NO: 1670208 - RNA, 15 nt, Homo sapiens
aauaaaggcauuuca

SEQ ID NO: 1670209 - RNA, 18 nt, Homo sapiens
aauaaauaugaauggagu

SEQ ID NO: 1670210 - RNA, 19 nt, Homo sapiens
aauaacacuguacugcaau

SEQ ID NO: 1670211 - RNA, 17 nt, Homo sapiens
aauaacccugaaucaga

SEQ ID NO: 1670212 - RNA, 19 nt, Homo sapiens
aauaacuagaucuccugua

SEQ ID NO: 1670213 - RNA, 17 nt, Homo sapiens
aauaacugagcacuuug

SEQ ID NO: 1670214 - RNA, 16 nt, Homo sapiens
aauaagcaacuguaaa

SEQ ID NO: 1670215 - RNA, 16 nt, Homo sapiens
aauaaggauuuauucu

SEQ ID NO: 1670216 - RNA, 17 nt, Homo sapiens
aauacauaaaaaaggga

SEQ ID NO: 1670217 - RNA, 18 nt, Homo sapiens
aauacaugaugauuucag

SEQ ID NO: 1670218 - RNA, 20 nt, Homo sapiens
aauacauuauuggacuucca

SEQ ID NO: 1670219 - RNA, 23 nt, Homo sapiens
aauacccacugccagacaugcca

SEQ ID NO: 1670220 - RNA, 23 nt, Homo sapiens
aauacucuuccaaaagccugcau

SEQ ID NO: 1670221 - RNA, 16 nt, Homo sapiens
aauaggaacagcugaa

SEQ ID NO: 1670222 - RNA, 12 nt, Homo sapiens
aauaggucugga

SEQ ID NO: 1670223 - RNA, 23 nt, Homo sapiens
aauaguaaaggaaagcaguguug

SEQ ID NO: 1670224 - RNA, 22 nt, Homo sapiens
aauagucucauugccaaggcau

SEQ ID NO: 1670225 - RNA, 17 nt, Homo sapiens
aauaguguguccaugca

SEQ ID NO: 1670226 - RNA, 16 nt, Homo sapiens
aauauaaacugugaga

SEQ ID NO: 1670227 - RNA, 20 nt, Homo sapiens
aauaucugugaaauaucauc

SEQ ID NO: 1670228 - RNA, 13 nt, Homo sapiens
aauaucugugaag

SEQ ID NO: 1670229 - RNA, 13 nt, Homo sapiens
aauauuaagcaca

SEQ ID NO: 1670230 - RNA, 17 nt, Homo sapiens
aauauuacaaauucuaa

SEQ ID NO: 1670231 - RNA, 19 nt, Homo sapiens
aauauugccauauucugua

SEQ ID NO: 1670232 - RNA, 12 nt, Homo sapiens
aauauuucacuu

SEQ ID NO: 1670233 - RNA, 12 nt, Homo sapiens
aauauuuugcug

SEQ ID NO: 1670234 - RNA, 17 nt, Homo sapiens
aauauuuugcugcugaa

SEQ ID NO: 1670235 - RNA, 15 nt, Homo sapiens
aaucaaacagggaca

SEQ ID NO: 1670236 - RNA, 12 nt, Homo sapiens
aaucaacaguga

SEQ ID NO: 1670237 - RNA, 23 nt, Homo sapiens
aaucaagucugugaaagucuccu

SEQ ID NO: 1670238 - RNA, 23 nt, Homo sapiens
aaucacacucucuucuuacugua

SEQ ID NO: 1670239 - RNA, 18 nt, Homo sapiens
aaucacuauugcuuccua

SEQ ID NO: 1670240 - RNA, 19 nt, Homo sapiens
aaucacucauuuauuucca

SEQ ID NO: 1670241 - RNA, 12 nt, Homo sapiens
aaucagacugaa

SEQ ID NO: 1670242 - RNA, 22 nt, Homo sapiens
aaucagugagaagaauagcuua

SEQ ID NO: 1670243 - RNA, 15 nt, Homo sapiens
aaucauaaauacugc

SEQ ID NO: 1670244 - RNA, 21 nt, Homo sapiens
aaucauugcuuaugacaugau

SEQ ID NO: 1670245 - RNA, 23 nt, Homo sapiens
aaucauuuauuuacaugugauug

SEQ ID NO: 1670246 - RNA, 21 nt, Homo sapiens
aaucauuuugauguauuauua

SEQ ID NO: 1670247 - RNA, 20 nt, Homo sapiens
aauccaagcugcucauuuca

SEQ ID NO: 1670248 - RNA, 12 nt, Homo sapiens
aauccacucugc

SEQ ID NO: 1670249 - RNA, 23 nt, Homo sapiens
aauccaugugcugcuguggcauc

SEQ ID NO: 1670250 - RNA, 15 nt, Homo sapiens
aaucccauacucuca

SEQ ID NO: 1670251 - RNA, 14 nt, Homo sapiens
aauccccagcugag

SEQ ID NO: 1670252 - RNA, 18 nt, Homo sapiens
aaucccucuuccuccaaa

SEQ ID NO: 1670253 - RNA, 22 nt, Homo sapiens
aauccuaacauuauauucccaa

SEQ ID NO: 1670254 - RNA, 15 nt, Homo sapiens
aauccucucugcaag

SEQ ID NO: 1670255 - RNA, 17 nt, Homo sapiens
aauccugacaaaaggga

SEQ ID NO: 1670256 - RNA, 14 nt, Homo sapiens
aauccuuguagauc

SEQ ID NO: 1670257 - RNA, 17 nt, Homo sapiens
aauccuuguagaucuuu

SEQ ID NO: 1670258 - RNA, 17 nt, Homo sapiens
aaucgaccucacuguca

SEQ ID NO: 1670259 - RNA, 14 nt, Homo sapiens
aaucguagguguug

SEQ ID NO: 1670260 - RNA, 14 nt, Homo sapiens
aaucuacaacauaa

SEQ ID NO: 1670261 - RNA, 21 nt, Homo sapiens
aaucuacucuuaaauauacaa

SEQ ID NO: 1670262 - RNA, 20 nt, Homo sapiens
aguacaucuugugcaugcaa

SEQ ID NO: 1670263 - RNA, 14 nt, Homo sapiens
aguacucaguaaau

SEQ ID NO: 1670264 - RNA, 24 nt, Homo sapiens
aguacucaguaaggcagugcagua

SEQ ID NO: 1670265 - RNA, 15 nt, Homo sapiens
aguacucaguacuau

SEQ ID NO: 1670266 - RNA, 14 nt, Homo sapiens
aguagaaucucagc

SEQ ID NO: 1670267 - RNA, 18 nt, Homo sapiens
aguagacaaagagccaga

SEQ ID NO: 1670268 - RNA, 19 nt, Homo sapiens
aguagagacgagguuucac

SEQ ID NO: 1670269 - RNA, 21 nt, Homo sapiens
aguagagucacuggaacacua

SEQ ID NO: 1670270 - RNA, 16 nt, Homo sapiens
aguagauaagugcuca

SEQ ID NO: 1670271 - RNA, 12 nt, Homo sapiens
aguagcuccuug

SEQ ID NO: 1670272 - RNA, 20 nt, Homo sapiens
aguaggucugcacacauaac

SEQ ID NO: 1670273 - RNA, 13 nt, Homo sapiens
aguaggugaucuu

SEQ ID NO: 1670274 - RNA, 17 nt, Homo sapiens
aguaguacuucuucugu

SEQ ID NO: 1670275 - RNA, 14 nt, Homo sapiens
aguagugcuaucuc

SEQ ID NO: 1670276 - RNA, 18 nt, Homo sapiens
aguauauugggggaggaa

SEQ ID NO: 1670277 - RNA, 12 nt, Homo sapiens
aguaucugagaa

SEQ ID NO: 1670278 - RNA, 19 nt, Homo sapiens
aguaugcacuaaucaauac

SEQ ID NO: 1670279 - RNA, 20 nt, Homo sapiens
aguauggugcuggguccuua

SEQ ID NO: 1670280 - RNA, 15 nt, Homo sapiens
aguauuacacaucag

SEQ ID NO: 1670281 - RNA, 16 nt, Homo sapiens
aguauuacacaucaga

SEQ ID NO: 1670282 - RNA, 13 nt, Homo sapiens
aguauugagacac

SEQ ID NO: 1670283 - RNA, 15 nt, Homo sapiens
agucaaacagugugg

SEQ ID NO: 1670284 - RNA, 12 nt, Homo sapiens
agucaagggcau

SEQ ID NO: 1670285 - RNA, 12 nt, Homo sapiens
agucacauauca

SEQ ID NO: 1670286 - RNA, 13 nt, Homo sapiens
agucaccuuccag

SEQ ID NO: 1670287 - RNA, 16 nt, Homo sapiens
agucacguagcacaga

SEQ ID NO: 1670288 - RNA, 12 nt, Homo sapiens
agucagcacaga

SEQ ID NO: 1670289 - RNA, 13 nt, Homo sapiens
agucaucaucuca

SEQ ID NO: 1670290 - RNA, 23 nt, Homo sapiens
aguccaaaggguuuuaagccagg

SEQ ID NO: 1670291 - RNA, 17 nt, Homo sapiens
aguccagaugugccuag

SEQ ID NO: 1670292 - RNA, 12 nt, Homo sapiens
aguccaguguga

SEQ ID NO: 1670293 - RNA, 12 nt, Homo sapiens
aguccaucucaa

SEQ ID NO: 1670294 - RNA, 20 nt, Homo sapiens
aguccaucucaagugccaua

SEQ ID NO: 1670295 - RNA, 16 nt, Homo sapiens
aguccaucuucuuuau

SEQ ID NO: 1670296 - RNA, 20 nt, Homo sapiens
aguccccagccugcucccua

SEQ ID NO: 1670297 - RNA, 17 nt, Homo sapiens
aguccggugccuuccac

SEQ ID NO: 1670298 - RNA, 22 nt, Homo sapiens
aguccuagaauguuucauuugc

SEQ ID NO: 1670299 - RNA, 20 nt, Homo sapiens
aguccucagugguuggcaau

SEQ ID NO: 1670300 - RNA, 23 nt, Homo sapiens
agucucaccuccugccauagggu

SEQ ID NO: 1670301 - RNA, 19 nt, Homo sapiens
agucucauugccaaggcau

SEQ ID NO: 1670302 - RNA, 18 nt, Homo sapiens
agucucccgaguagcugg

SEQ ID NO: 1670303 - RNA, 14 nt, Homo sapiens
agucucguugcuca

SEQ ID NO: 1670304 - RNA, 17 nt, Homo sapiens
agucuuuguacagacaa

SEQ ID NO: 1670305 - RNA, 20 nt, Homo sapiens
agugaaaauuuuauugaaua

SEQ ID NO: 1670306 - RNA, 23 nt, Homo sapiens
agugauuccuucuugcucagucc

SEQ ID NO: 1670307 - RNA, 16 nt, Homo sapiens
agugcaaugauaguca

SEQ ID NO: 1670308 - RNA, 21 nt, Homo sapiens
agugcaauggugcgaucucag

SEQ ID NO: 1670309 - RNA, 22 nt, Homo sapiens
agugcaguggcgcgaucucagc

SEQ ID NO: 1670310 - RNA, 20 nt, Homo sapiens
agugcaguggcgugaucuca

SEQ ID NO: 1670311 - RNA, 15 nt, Homo sapiens
agugcaguggcucaa

SEQ ID NO: 1670312 - RNA, 18 nt, Homo sapiens
agugccaaaaacaacaac

SEQ ID NO: 1670313 - RNA, 23 nt, Homo sapiens
agugccauggccaggaguggguu

SEQ ID NO: 1670314 - RNA, 18 nt, Homo sapiens
agugcgugugaaacagcg

SEQ ID NO: 1670315 - RNA, 15 nt, Homo sapiens
agugcuucuccagcc

SEQ ID NO: 1670316 - RNA, 22 nt, Homo sapiens
aguggaggaggggguacagucc

SEQ ID NO: 1670317 - RNA, 22 nt, Homo sapiens
aguggcagcuccccaaaccagg

SEQ ID NO: 1670318 - RNA, 14 nt, Homo sapiens
aguggccugagaag

SEQ ID NO: 1670319 - RNA, 15 nt, Homo sapiens
aguggcgugaucuca

SEQ ID NO: 1670320 - RNA, 14 nt, Homo sapiens
aguggcucaugccu

SEQ ID NO: 1670321 - RNA, 22 nt, Homo sapiens
aguggcucguguuucacagugg

SEQ ID NO: 1670322 - RNA, 16 nt, Homo sapiens
aguggcuucuucauga

SEQ ID NO: 1670323 - RNA, 23 nt, Homo sapiens
aguggugggcccugaugcugcca

SEQ ID NO: 1670324 - RNA, 14 nt, Homo sapiens
agugguggugaaca

SEQ ID NO: 1670325 - RNA, 22 nt, Homo sapiens
agugguggugaacagaacaaaa

SEQ ID NO: 1670326 - RNA, 17 nt, Homo sapiens
aguguagaucaacucau

SEQ ID NO: 1670327 - RNA, 14 nt, Homo sapiens
aguguauguauaca

SEQ ID NO: 1670328 - RNA, 15 nt, Homo sapiens
agugugacugaucuc

SEQ ID NO: 1670329 - RNA, 11 nt, Homo sapiens
agugugcuugg

SEQ ID NO: 1670330 - RNA, 17 nt, Homo sapiens
aguguggggaaugggaa

SEQ ID NO: 1670331 - RNA, 15 nt, Homo sapiens
aguguguacuucuuc

SEQ ID NO: 1670332 - RNA, 17 nt, Homo sapiens
aguguuuaugugcuauu

SEQ ID NO: 1670333 - RNA, 16 nt, Homo sapiens
aguuaaauuggcuugu

SEQ ID NO: 1670334 - RNA, 13 nt, Homo sapiens
aguuagacucaaa

SEQ ID NO: 1670335 - RNA, 17 nt, Homo sapiens
aguuaggugugccaaac

SEQ ID NO: 1670336 - RNA, 17 nt, Homo sapiens
aguuccagcuaacuggg

SEQ ID NO: 1670337 - RNA, 16 nt, Homo sapiens
aguuccuuucaucccu

SEQ ID NO: 1670338 - RNA, 11 nt, Homo sapiens
aguucuugcaa

SEQ ID NO: 1670339 - RNA, 21 nt, Homo sapiens
aguugaugaccaaucucugug

SEQ ID NO: 1670340 - RNA, 21 nt, Homo sapiens
aguugcaaauuuuagcguuaa

SEQ ID NO: 1670341 - RNA, 12 nt, Homo sapiens
aguugcaauaaa

SEQ ID NO: 1670342 - RNA, 12 nt, Homo sapiens
agagaagccaua

SEQ ID NO: 1670343 - RNA, 20 nt, Homo sapiens
agagacggguuucaccaugu

SEQ ID NO: 1670344 - RNA, 16 nt, Homo sapiens
agagacuuuguguuua

SEQ ID NO: 1670345 - RNA, 16 nt, Homo sapiens
agagagauauaucuga

SEQ ID NO: 1670346 - RNA, 13 nt, Homo sapiens
agagagcaaagau

SEQ ID NO: 1670347 - RNA, 15 nt, Homo sapiens
agagaguauggugcu

SEQ ID NO: 1670348 - RNA, 14 nt, Homo sapiens
agagaguggaagaa

SEQ ID NO: 1670349 - RNA, 15 nt, Homo sapiens
agagauauaucugaa

SEQ ID NO: 1670350 - RNA, 16 nt, Homo sapiens
agagauucccaagcca

SEQ ID NO: 1670351 - RNA, 17 nt, Homo sapiens
agagcaagaccccaucu

SEQ ID NO: 1670352 - RNA, 19 nt, Homo sapiens
agagcaagaccccaucuca

SEQ ID NO: 1670353 - RNA, 20 nt, Homo sapiens
agagcacgggcguuauguaa

SEQ ID NO: 1670354 - RNA, 19 nt, Homo sapiens
agagcacuagaagcacagg

SEQ ID NO: 1670355 - RNA, 15 nt, Homo sapiens
agagcacugcuccag

SEQ ID NO: 1670356 - RNA, 13 nt, Homo sapiens
agagcagaaccaa

SEQ ID NO: 1670357 - RNA, 15 nt, Homo sapiens
agagccaauggugca

SEQ ID NO: 1670358 - RNA, 17 nt, Homo sapiens
agagccuagaggcucac

SEQ ID NO: 1670359 - RNA, 19 nt, Homo sapiens
agagcgagacuccaucuca

SEQ ID NO: 1670360 - RNA, 14 nt, Homo sapiens
agagcuacuuugag

SEQ ID NO: 1670361 - RNA, 17 nt, Homo sapiens
agagcuauuauuuacuc

SEQ ID NO: 1670362 - RNA, 14 nt, Homo sapiens
agagcucaggagaa

SEQ ID NO: 1670363 - RNA, 11 nt, Homo sapiens
agagcugccac

SEQ ID NO: 1670364 - RNA, 19 nt, Homo sapiens
agagcuuuacagugccacg

SEQ ID NO: 1670365 - RNA, 15 nt, Homo sapiens
agaggaaaaggcuug

SEQ ID NO: 1670366 - RNA, 17 nt, Homo sapiens
agaggacaguuuaggac

SEQ ID NO: 1670367 - RNA, 20 nt, Homo sapiens
agaggaccccauucugggac

SEQ ID NO: 1670368 - RNA, 15 nt, Homo sapiens
agaggauuucugcuu

SEQ ID NO: 1670369 - RNA, 19 nt, Homo sapiens
agaggcagggaagcucuac

SEQ ID NO: 1670370 - RNA, 20 nt, Homo sapiens
agaggcaggugguaggccau

SEQ ID NO: 1670371 - RNA, 15 nt, Homo sapiens
agagggaacuaagca

SEQ ID NO: 1670372 - RNA, 16 nt, Homo sapiens
agagggcugcugacca

SEQ ID NO: 1670373 - RNA, 19 nt, Homo sapiens
agaggucuugaucuuugga

SEQ ID NO: 1670374 - RNA, 23 nt, Homo sapiens
agagguggggugcuggggcugca

SEQ ID NO: 1670375 - RNA, 15 nt, Homo sapiens
agaguauacaagugu

SEQ ID NO: 1670376 - RNA, 13 nt, Homo sapiens
agaguaugucagu

SEQ ID NO: 1670377 - RNA, 12 nt, Homo sapiens
agagucaucuca

SEQ ID NO: 1670378 - RNA, 19 nt, Homo sapiens
agagugcuuggcugcugua

SEQ ID NO: 1670379 - RNA, 14 nt, Homo sapiens
agauaccugugagg

SEQ ID NO: 1670380 - RNA, 18 nt, Homo sapiens
agauagccaaggccaaag

SEQ ID NO: 1670381 - RNA, 22 nt, Homo sapiens
agauagguauggaaaaagcaua

SEQ ID NO: 1670382 - RNA, 23 nt, Homo sapiens
agaucaugucauugaugaacugc

SEQ ID NO: 1670383 - RNA, 23 nt, Homo sapiens
agauccucugacagcuguccuga

SEQ ID NO: 1670384 - RNA, 19 nt, Homo sapiens
agaucugaggaaggccgua

SEQ ID NO: 1670385 - RNA, 20 nt, Homo sapiens
agaugaggcuccuuaguuua

SEQ ID NO: 1670386 - RNA, 15 nt, Homo sapiens
agaugcaaccucacu

SEQ ID NO: 1670387 - RNA, 13 nt, Homo sapiens
agaugcacugaag

SEQ ID NO: 1670388 - RNA, 15 nt, Homo sapiens
agaugcauccaugua

SEQ ID NO: 1670389 - RNA, 21 nt, Homo sapiens
agauggauuugacacacucac

SEQ ID NO: 1670390 - RNA, 15 nt, Homo sapiens
agaugugccuagaca

SEQ ID NO: 1670391 - RNA, 21 nt, Homo sapiens
agauguuguuaaaaacaugug

SEQ ID NO: 1670392 - RNA, 12 nt, Homo sapiens
agauucaccucc

SEQ ID NO: 1670393 - RNA, 11 nt, Homo sapiens
agauucaccug

SEQ ID NO: 1670394 - RNA, 17 nt, Homo sapiens
agauuccaccuagagcu

SEQ ID NO: 1670395 - RNA, 17 nt, Homo sapiens
agauuccauuuuggaaa

SEQ ID NO: 1670396 - RNA, 15 nt, Homo sapiens
agauucccaagccaa

SEQ ID NO: 1670397 - RNA, 23 nt, Homo sapiens
agauugcucuggggcuugcuauu

SEQ ID NO: 1670398 - RNA, 20 nt, Homo sapiens
agauuuucauguucuugcag

SEQ ID NO: 1670399 - RNA, 22 nt, Homo sapiens
agauuuuccugagaugacugag

SEQ ID NO: 1670400 - RNA, 17 nt, Homo sapiens
agauuuuucucaucucc

SEQ ID NO: 1670401 - RNA, 17 nt, Homo sapiens
agcaaaaaauaaugaca

SEQ ID NO: 1670402 - RNA, 21 nt, Homo sapiens
agcaaauuccaauacauuauu

SEQ ID NO: 1670403 - RNA, 19 nt, Homo sapiens
agcaagcucacuugcuuua

SEQ ID NO: 1670404 - RNA, 13 nt, Homo sapiens
agcaaugugguag

SEQ ID NO: 1670405 - RNA, 22 nt, Homo sapiens
agcaauuuuuccaaaagccagu

SEQ ID NO: 1670406 - RNA, 18 nt, Homo sapiens
agcacacugcuugugaaa

SEQ ID NO: 1670407 - RNA, 16 nt, Homo sapiens
agcacagcuacucaga

SEQ ID NO: 1670408 - RNA, 20 nt, Homo sapiens
agcacauaguguuuaaagac

SEQ ID NO: 1670409 - RNA, 20 nt, Homo sapiens
agcacaugccucucucaggc

SEQ ID NO: 1670410 - RNA, 15 nt, Homo sapiens
agcacccguugaguc

SEQ ID NO: 1670411 - RNA, 17 nt, Homo sapiens
agcacuagaagcacagg

SEQ ID NO: 1670412 - RNA, 18 nt, Homo sapiens
agcacugccucccuuaau

SEQ ID NO: 1670413 - RNA, 16 nt, Homo sapiens
agcacugcuccagugg

SEQ ID NO: 1670414 - RNA, 10 nt, Homo sapiens
agcacuucaa

SEQ ID NO: 1670415 - RNA, 14 nt, Homo sapiens
agcagaacccagac

SEQ ID NO: 1670416 - RNA, 18 nt, Homo sapiens
agcagaagcugguaaaaa

SEQ ID NO: 1670417 - RNA, 20 nt, Homo sapiens
agcagacacuccaguuugcc

SEQ ID NO: 1670418 - RNA, 16 nt, Homo sapiens
agcagcagcagcagca

SEQ ID NO: 1670419 - RNA, 21 nt, Homo sapiens
agcaggaaagaucccaaguca

SEQ ID NO: 1670420 - RNA, 17 nt, Homo sapiens
agcaggugucccugaga

SEQ ID NO: 1670421 - RNA, 15 nt, Homo sapiens
agcagucucagcuca

SEQ ID NO: 1670422 - RNA, 21 nt, Homo sapiens
agcagugaaauaugauaauaa

SEQ ID NO: 1670423 - RNA, 18 nt, Homo sapiens
agcaguggugucucugaa

SEQ ID NO: 1670424 - RNA, 13 nt, Homo sapiens
agcagugugauug

SEQ ID NO: 1670425 - RNA, 23 nt, Homo sapiens
agcaguguuggggguagcggcau

SEQ ID NO: 1670426 - RNA, 14 nt, Homo sapiens
agcaguucagcucc

SEQ ID NO: 1670427 - RNA, 20 nt, Homo sapiens
agcaguucagcuccuuccac

SEQ ID NO: 1670428 - RNA, 14 nt, Homo sapiens
agcaguuuacucua

SEQ ID NO: 1670429 - RNA, 23 nt, Homo sapiens
agcaguuuacucuagacuaaaga

SEQ ID NO: 1670430 - RNA, 13 nt, Homo sapiens
agcauaacacagc

SEQ ID NO: 1670431 - RNA, 19 nt, Homo sapiens
agcauaccaguucuugcaa

SEQ ID NO: 1670432 - RNA, 16 nt, Homo sapiens
agcauccacucucccu

SEQ ID NO: 1670433 - RNA, 19 nt, Homo sapiens
agcaucccaagguucaaua

SEQ ID NO: 1670434 - RNA, 19 nt, Homo sapiens
agcaugaagauaaauccaa

SEQ ID NO: 1670435 - RNA, 14 nt, Homo sapiens
agcauggcugccaa

SEQ ID NO: 1670436 - RNA, 12 nt, Homo sapiens
agcauguaauau

SEQ ID NO: 1670437 - RNA, 21 nt, Homo sapiens
agcauugggaggaagcucaga

SEQ ID NO: 1670438 - RNA, 21 nt, Homo sapiens
agcauugggugcaaauauuca

SEQ ID NO: 1670439 - RNA, 23 nt, Homo sapiens
agcauuuaggaaagcagugcagu

SEQ ID NO: 1670440 - RNA, 23 nt, Homo sapiens
agccaagaauucuuaaauaugug

SEQ ID NO: 1670441 - RNA, 16 nt, Homo sapiens
agccaaggccaaagga

SEQ ID NO: 1670442 - RNA, 17 nt, Homo sapiens
agccaaggucugaaccc

SEQ ID NO: 1670443 - RNA, 13 nt, Homo sapiens
agccaagugcagg

SEQ ID NO: 1670444 - RNA, 20 nt, Homo sapiens
agccaaguucacaccacugc

SEQ ID NO: 1670445 - RNA, 12 nt, Homo sapiens
agccaauggugc

SEQ ID NO: 1670446 - RNA, 19 nt, Homo sapiens
agccacuuauuuccaugga

SEQ ID NO: 1670447 - RNA, 15 nt, Homo sapiens
agccagaggcucuaa

SEQ ID NO: 1670448 - RNA, 19 nt, Homo sapiens
agccagaggcucuaaugua

SEQ ID NO: 1670449 - RNA, 23 nt, Homo sapiens
agccagcagggcgggccaggaga

SEQ ID NO: 1670450 - RNA, 16 nt, Homo sapiens
agccaggaacugugug

SEQ ID NO: 1670451 - RNA, 18 nt, Homo sapiens
agccaggguuccagacag

SEQ ID NO: 1670452 - RNA, 18 nt, Homo sapiens
agccaguuuccacaggca

SEQ ID NO: 1670453 - RNA, 20 nt, Homo sapiens
agccauaacguuagacugca

SEQ ID NO: 1670454 - RNA, 13 nt, Homo sapiens
agccaucgcauca

SEQ ID NO: 1670455 - RNA, 20 nt, Homo sapiens
agccauuauucucugaugca

SEQ ID NO: 1670456 - RNA, 14 nt, Homo sapiens
agcccaaccgggaa

SEQ ID NO: 1670457 - RNA, 22 nt, Homo sapiens
agcccaagaguuagaacaguug

SEQ ID NO: 1670458 - RNA, 21 nt, Homo sapiens
agccccagggcccugcucagg

SEQ ID NO: 1670459 - RNA, 23 nt, Homo sapiens
agccccauuauucauucucccuu

SEQ ID NO: 1670460 - RNA, 17 nt, Homo sapiens
agcccccugcacccacc

SEQ ID NO: 1670461 - RNA, 15 nt, Homo sapiens
agccccuugcuucua

SEQ ID NO: 1670462 - RNA, 21 nt, Homo sapiens
agcccucucccucaguccuuu

SEQ ID NO: 1670463 - RNA, 22 nt, Homo sapiens
agcccucuuucucucugugugg

SEQ ID NO: 1670464 - RNA, 14 nt, Homo sapiens
agccgcaaauccau

SEQ ID NO: 1670465 - RNA, 23 nt, Homo sapiens
cucuuccuugcuuucucuucuaa

SEQ ID NO: 1670466 - RNA, 15 nt, Homo sapiens
cucuugucauucuca

SEQ ID NO: 1670467 - RNA, 21 nt, Homo sapiens
cucuuuaccauagcuuaagaa

SEQ ID NO: 1670468 - RNA, 11 nt, Homo sapiens
cucuuucacaa

SEQ ID NO: 1670469 - RNA, 16 nt, Homo sapiens
cucuuucacccugcca

SEQ ID NO: 1670470 - RNA, 17 nt, Homo sapiens
cucuuuccuccucauga

SEQ ID NO: 1670471 - RNA, 14 nt, Homo sapiens
cucuuuucaaugug

SEQ ID NO: 1670472 - RNA, 23 nt, Homo sapiens
cugaaaaaguguuuuuacauaua

SEQ ID NO: 1670473 - RNA, 15 nt, Homo sapiens
cugaaauacauauga

SEQ ID NO: 1670474 - RNA, 19 nt, Homo sapiens
cugaaauuaguguuuucau

SEQ ID NO: 1670475 - RNA, 17 nt, Homo sapiens
cugaaauuggaagacuu

SEQ ID NO: 1670476 - RNA, 16 nt, Homo sapiens
cugggugccaguccau

SEQ ID NO: 1670477 - RNA, 15 nt, Homo sapiens
cugggugcugucaug

SEQ ID NO: 1670478 - RNA, 16 nt, Homo sapiens
cuggguggaucggccu

SEQ ID NO: 1670479 - RNA, 16 nt, Homo sapiens
cuggguuaacaguaaa

SEQ ID NO: 1670480 - RNA, 19 nt, Homo sapiens
cuggguuugggcaguggag

SEQ ID NO: 1670481 - RNA, 13 nt, Homo sapiens
cuggucugugcau

SEQ ID NO: 1670482 - RNA, 14 nt, Homo sapiens
cuggugaugguccc

SEQ ID NO: 1670483 - RNA, 19 nt, Homo sapiens
cuggugucuaauaaacaca

SEQ ID NO: 1670484 - RNA, 15 nt, Homo sapiens
cuguaagauaauguu

SEQ ID NO: 1670485 - RNA, 22 nt, Homo sapiens
cuguaauagccucaccuucccu

SEQ ID NO: 1670486 - RNA, 16 nt, Homo sapiens
cuguagccuggucugu

SEQ ID NO: 1670487 - RNA, 14 nt, Homo sapiens
cuguagcugagcac

SEQ ID NO: 1670488 - RNA, 15 nt, Homo sapiens
cuguauaucagcucu

SEQ ID NO: 1670489 - RNA, 15 nt, Homo sapiens
cugucauaugcagaa

SEQ ID NO: 1670490 - RNA, 13 nt, Homo sapiens
cuguccagacaag

SEQ ID NO: 1670491 - RNA, 18 nt, Homo sapiens
cuguccucucagaacucc

SEQ ID NO: 1670492 - RNA, 18 nt, Homo sapiens
cugucuaaaaaugauucu

SEQ ID NO: 1670493 - RNA, 13 nt, Homo sapiens
cugucugguuguu

SEQ ID NO: 1670494 - RNA, 19 nt, Homo sapiens
cugucugucaccagcuauc

SEQ ID NO: 1670495 - RNA, 17 nt, Homo sapiens
cugucuuagaucaggag

SEQ ID NO: 1670496 - RNA, 21 nt, Homo sapiens
cugucuuagucauaccaucca

SEQ ID NO: 1670497 - RNA, 17 nt, Homo sapiens
cugucuugcugagggag

SEQ ID NO: 1670498 - RNA, 15 nt, Homo sapiens
cugugaaaugacugc

SEQ ID NO: 1670499 - RNA, 17 nt, Homo sapiens
cugugaauaaagccaca

SEQ ID NO: 1670500 - RNA, 19 nt, Homo sapiens
cugugaucuauaccaccuu

SEQ ID NO: 1670501 - RNA, 17 nt, Homo sapiens
cugugaugcaugagcuc

SEQ ID NO: 1670502 - RNA, 13 nt, Homo sapiens
cugugcaucuggc

SEQ ID NO: 1670503 - RNA, 15 nt, Homo sapiens
cugugccuaacagca

SEQ ID NO: 1670504 - RNA, 23 nt, Homo sapiens
cuguggguuucuaaagcugccag

SEQ ID NO: 1670505 - RNA, 19 nt, Homo sapiens
cuguggucugugugugaca

SEQ ID NO: 1670506 - RNA, 11 nt, Homo sapiens
cuguguauaca

SEQ ID NO: 1670507 - RNA, 14 nt, Homo sapiens
cuguguauacauau

SEQ ID NO: 1670508 - RNA, 13 nt, Homo sapiens
cuguguguggaag

SEQ ID NO: 1670509 - RNA, 16 nt, Homo sapiens
cuguuagacaaaagug

SEQ ID NO: 1670510 - RNA, 12 nt, Homo sapiens
cuguuccaagug

SEQ ID NO: 1670511 - RNA, 19 nt, Homo sapiens
cuguuccacuucucuagag

SEQ ID NO: 1670512 - RNA, 13 nt, Homo sapiens
cuguucccaugag

SEQ ID NO: 1670513 - RNA, 14 nt, Homo sapiens
cuguucccaugaga

SEQ ID NO: 1670514 - RNA, 23 nt, Homo sapiens
cuguugaaggacuacagguauuu

SEQ ID NO: 1670515 - RNA, 13 nt, Homo sapiens
cuguugggaacca

SEQ ID NO: 1670516 - RNA, 16 nt, Homo sapiens
cuguugggaaccagag

SEQ ID NO: 1670517 - RNA, 17 nt, Homo sapiens
cuguugggaaccagaga

SEQ ID NO: 1670518 - RNA, 16 nt, Homo sapiens
cuguuuccaaugccaa

SEQ ID NO: 1670519 - RNA, 17 nt, Homo sapiens
cuguuucugcagccacu

SEQ ID NO: 1670520 - RNA, 19 nt, Homo sapiens
cuguuucugcagccacuau

SEQ ID NO: 1670521 - RNA, 19 nt, Homo sapiens
cuguuugauacaguauuau

SEQ ID NO: 1670522 - RNA, 20 nt, Homo sapiens
cuguuuugcauggaguauua

SEQ ID NO: 1670523 - RNA, 21 nt, Homo sapiens
cuguuuugcauggaguauuau

SEQ ID NO: 1670524 - RNA, 13 nt, Homo sapiens
cuuaaaaauuuau

SEQ ID NO: 1670525 - RNA, 19 nt, Homo sapiens
cuuaaaccugugcuuucau

SEQ ID NO: 1670526 - RNA, 14 nt, Homo sapiens
cuuaaacuuuguca

SEQ ID NO: 1670527 - RNA, 21 nt, Homo sapiens
cuuaagagauuggaucaagua

SEQ ID NO: 1670528 - RNA, 22 nt, Homo sapiens
cuuaagaugcaaaucaacucuc

SEQ ID NO: 1670529 - RNA, 15 nt, Homo sapiens
cuuaaggacaguguu

SEQ ID NO: 1670530 - RNA, 21 nt, Homo sapiens
cuuaaggggacccacaaguau

SEQ ID NO: 1670531 - RNA, 23 nt, Homo sapiens
cuuaaggggacccacaaguauug

SEQ ID NO: 1670532 - RNA, 20 nt, Homo sapiens
cuuaaucuagagcuaugcac

SEQ ID NO: 1670533 - RNA, 19 nt, Homo sapiens
cuuaaugacuuacuuagaa

SEQ ID NO: 1670534 - RNA, 20 nt, Homo sapiens
cuuaauuauaagcuauguca

SEQ ID NO: 1670535 - RNA, 17 nt, Homo sapiens
cuuaauucccaauccca

SEQ ID NO: 1670536 - RNA, 23 nt, Homo sapiens
cuuaauucuuaccucauuugcau

SEQ ID NO: 1670537 - RNA, 17 nt, Homo sapiens
cuuaauuugaaauaaca

SEQ ID NO: 1670538 - RNA, 14 nt, Homo sapiens
cuuaccugacacaa

SEQ ID NO: 1670539 - RNA, 11 nt, Homo sapiens
cuuaccugcca

SEQ ID NO: 1670540 - RNA, 15 nt, Homo sapiens
cuuaccugccaggaa

SEQ ID NO: 1670541 - RNA, 19 nt, Homo sapiens
cuuacuuaaccugaagcua

SEQ ID NO: 1670542 - RNA, 20 nt, Homo sapiens
cuuacuuuaccucucuguca

SEQ ID NO: 1670543 - RNA, 16 nt, Homo sapiens
cuuagaagaaauauga

SEQ ID NO: 1670544 - RNA, 15 nt, Homo sapiens
cuuagaauacuguau

SEQ ID NO: 1670545 - RNA, 21 nt, Homo sapiens
cuuagagcacuagaagcacag

SEQ ID NO: 1670546 - RNA, 22 nt, Homo sapiens
cuuagaucaggagaaacucggg

SEQ ID NO: 1670547 - RNA, 16 nt, Homo sapiens
cuuaguaauagaucac

SEQ ID NO: 1670548 - RNA, 20 nt, Homo sapiens
cuuauauuauuuucuguaau

SEQ ID NO: 1670549 - RNA, 16 nt, Homo sapiens
cuuaucauaaauucaa

SEQ ID NO: 1670550 - RNA, 23 nt, Homo sapiens
cuuaucuuaggauuuaccaaaua

SEQ ID NO: 1670551 - RNA, 17 nt, Homo sapiens
cuuaugccugucuuuac

SEQ ID NO: 1670552 - RNA, 15 nt, Homo sapiens
cuuauggaacugagu

SEQ ID NO: 1670553 - RNA, 22 nt, Homo sapiens
cuuauuaaaauauuuucuuaau

SEQ ID NO: 1670554 - RNA, 15 nt, Homo sapiens
cuucaaaauauugag

SEQ ID NO: 1670555 - RNA, 21 nt, Homo sapiens
cuucaaagucucaaugaaaua

SEQ ID NO: 1670556 - RNA, 19 nt, Homo sapiens
cuucaacaugguuaccucu

SEQ ID NO: 1670557 - RNA, 16 nt, Homo sapiens
cuucaaccccaugaga

SEQ ID NO: 1670558 - RNA, 12 nt, Homo sapiens
cuucaacuaauu

SEQ ID NO: 1670559 - RNA, 13 nt, Homo sapiens
cuucaauguuaaa

SEQ ID NO: 1670560 - RNA, 19 nt, Homo sapiens
cuucaccgugacauuccag

SEQ ID NO: 1670561 - RNA, 17 nt, Homo sapiens
cuucacugucuuacuca

SEQ ID NO: 1670562 - RNA, 20 nt, Homo sapiens
cuucagaauauggacaaaga

SEQ ID NO: 1670563 - RNA, 17 nt, Homo sapiens
cuucaucuggauuccag

SEQ ID NO: 1670564 - RNA, 18 nt, Homo sapiens
cuucauggaacucagcug

SEQ ID NO: 1670565 - RNA, 16 nt, Homo sapiens
cuucauguaaauugac

SEQ ID NO: 1670566 - RNA, 14 nt, Homo sapiens
cuucauuaaaacaa

SEQ ID NO: 1670567 - RNA, 13 nt, Homo sapiens
cuuccaugguggu

SEQ ID NO: 1670568 - RNA, 21 nt, Homo sapiens
cuucccaaucagcacugaaaa

SEQ ID NO: 1670569 - RNA, 21 nt, Homo sapiens
cuuccccauugccuucugggg

SEQ ID NO: 1670570 - RNA, 15 nt, Homo sapiens
cuucccugacucuuc

SEQ ID NO: 1670571 - RNA, 18 nt, Homo sapiens
cuucccugacucuucaag

SEQ ID NO: 1670572 - RNA, 15 nt, Homo sapiens
cuuccuaccaaauau

SEQ ID NO: 1670573 - RNA, 20 nt, Homo sapiens
cuuccugaacucccagucau

SEQ ID NO: 1670574 - RNA, 20 nt, Homo sapiens
cuuccugggcagcccagaga

SEQ ID NO: 1670575 - RNA, 15 nt, Homo sapiens
cuuccuuacccaaac

SEQ ID NO: 1670576 - RNA, 18 nt, Homo sapiens
cuuccuuuuguauccucc

SEQ ID NO: 1670577 - RNA, 18 nt, Homo sapiens
cuucuaguggguuuaaug

SEQ ID NO: 1670578 - RNA, 23 nt, Homo sapiens
cuucucaguagaaaggaacagaa

SEQ ID NO: 1670579 - RNA, 23 nt, Homo sapiens
cuucuccacaaccuccuccucca

SEQ ID NO: 1670580 - RNA, 17 nt, Homo sapiens
cuucuccccuccaagug

SEQ ID NO: 1670581 - RNA, 17 nt, Homo sapiens
cuucuccccuccagacc

SEQ ID NO: 1670582 - RNA, 13 nt, Homo sapiens
cuucucuuucaca

SEQ ID NO: 1670583 - RNA, 18 nt, Homo sapiens
cuucugcagucagacuga

SEQ ID NO: 1670584 - RNA, 15 nt, Homo sapiens
cuucugcugcccuga

SEQ ID NO: 1670585 - RNA, 15 nt, Homo sapiens
cuucuggcugucagu

SEQ ID NO: 1670586 - RNA, 14 nt, Homo sapiens
cuucugggggugua

SEQ ID NO: 1670587 - RNA, 22 nt, Homo sapiens
cuucuguucucaaaugcuaaau

SEQ ID NO: 1670588 - RNA, 18 nt, Homo sapiens
cuucuucaugaugguggu

SEQ ID NO: 1670589 - RNA, 20 nt, Homo sapiens
cuucuuuauacaaugaccac

SEQ ID NO: 1670590 - RNA, 18 nt, Homo sapiens
cuugaaaacucucaguca

SEQ ID NO: 1670591 - RNA, 18 nt, Homo sapiens
caaaggcguaucaguuca

SEQ ID NO: 1670592 - RNA, 19 nt, Homo sapiens
caaaggguuuuaagccagg

SEQ ID NO: 1670593 - RNA, 14 nt, Homo sapiens
caaaguauguuuca

SEQ ID NO: 1670594 - RNA, 15 nt, Homo sapiens
caaauaaauaucauc

SEQ ID NO: 1670595 - RNA, 14 nt, Homo sapiens
caaauacaugccuu

SEQ ID NO: 1670596 - RNA, 16 nt, Homo sapiens
caaauauugcuauugu

SEQ ID NO: 1670597 - RNA, 15 nt, Homo sapiens
caaauauuucacuua

SEQ ID NO: 1670598 - RNA, 23 nt, Homo sapiens
caaauccauacccccugccccag

SEQ ID NO: 1670599 - RNA, 21 nt, Homo sapiens
caaaucguccaaagaucucaa

SEQ ID NO: 1670600 - RNA, 21 nt, Homo sapiens
caaaucucagucccugacuaa

SEQ ID NO: 1670601 - RNA, 17 nt, Homo sapiens
caaaugacaugcacuga

SEQ ID NO: 1670602 - RNA, 18 nt, Homo sapiens
caaaugacaugcacugac

SEQ ID NO: 1670603 - RNA, 20 nt, Homo sapiens
caaaugacaugcacugaccc

SEQ ID NO: 1670604 - RNA, 19 nt, Homo sapiens
caaaugccuuucuagcaau

SEQ ID NO: 1670605 - RNA, 17 nt, Homo sapiens
caaaugggccugccaaa

SEQ ID NO: 1670606 - RNA, 13 nt, Homo sapiens
caaauguccaagc

SEQ ID NO: 1670607 - RNA, 11 nt, Homo sapiens
caaauguguaa

SEQ ID NO: 1670608 - RNA, 23 nt, Homo sapiens
caaauucaaugaaucaaauccaa

SEQ ID NO: 1670609 - RNA, 13 nt, Homo sapiens
caaauugcugaga

SEQ ID NO: 1670610 - RNA, 15 nt, Homo sapiens
caacaaauaagucaa

SEQ ID NO: 1670611 - RNA, 15 nt, Homo sapiens
caacagcgaagccag

SEQ ID NO: 1670612 - RNA, 21 nt, Homo sapiens
caacaggcuguucugcacuga

SEQ ID NO: 1670613 - RNA, 12 nt, Homo sapiens
caacaugcacau

SEQ ID NO: 1670614 - RNA, 19 nt, Homo sapiens
caaccaguuugaaccaaga

SEQ ID NO: 1670615 - RNA, 20 nt, Homo sapiens
caacccaaaugguggccauu

SEQ ID NO: 1670616 - RNA, 13 nt, Homo sapiens
caaccccaugaga

SEQ ID NO: 1670617 - RNA, 23 nt, Homo sapiens
caacccugugaucuauaccaccu

SEQ ID NO: 1670618 - RNA, 22 nt, Homo sapiens
caaccuacuaauccucucugca

SEQ ID NO: 1670619 - RNA, 22 nt, Homo sapiens
caaccuccccugguccugcacu

SEQ ID NO: 1670620 - RNA, 23 nt, Homo sapiens
caaccuccccugguccugcacug

SEQ ID NO: 1670621 - RNA, 20 nt, Homo sapiens
caaccugccacaaugugaua

SEQ ID NO: 1670622 - RNA, 23 nt, Homo sapiens
caacgaacauggcaugugaaaag

SEQ ID NO: 1670623 - RNA, 12 nt, Homo sapiens
caacuagccauc

SEQ ID NO: 1670624 - RNA, 19 nt, Homo sapiens
caacuauuucuuucaucag

SEQ ID NO: 1670625 - RNA, 14 nt, Homo sapiens
caacuccaaggcaa

SEQ ID NO: 1670626 - RNA, 21 nt, Homo sapiens
caacuccaaggcaaaugucca

SEQ ID NO: 1670627 - RNA, 21 nt, Homo sapiens
caacuccauuuucugugagaa

SEQ ID NO: 1670628 - RNA, 13 nt, Homo sapiens
caacuuacauaug

SEQ ID NO: 1670629 - RNA, 21 nt, Homo sapiens
caacuugaaauuauaucugug

SEQ ID NO: 1670630 - RNA, 12 nt, Homo sapiens
caagaagccagc

SEQ ID NO: 1670631 - RNA, 21 nt, Homo sapiens
caagaagugggauucaggaau

SEQ ID NO: 1670632 - RNA, 22 nt, Homo sapiens
caagacuggcauggacaucagc

SEQ ID NO: 1670633 - RNA, 15 nt, Homo sapiens
caagagaccacuucc

SEQ ID NO: 1670634 - RNA, 19 nt, Homo sapiens
caagagguuucagcauucc

SEQ ID NO: 1670635 - RNA, 14 nt, Homo sapiens
caagaguuagaaca

SEQ ID NO: 1670636 - RNA, 14 nt, Homo sapiens
caagauaccuucau

SEQ ID NO: 1670637 - RNA, 22 nt, Homo sapiens
caagauaccuucaugguguuca

SEQ ID NO: 1670638 - RNA, 16 nt, Homo sapiens
caagaucaaacuucca

SEQ ID NO: 1670639 - RNA, 16 nt, Homo sapiens
caagcaaaaugcaaac

SEQ ID NO: 1670640 - RNA, 17 nt, Homo sapiens
caagcaccugggauuac

SEQ ID NO: 1670641 - RNA, 13 nt, Homo sapiens
caagcacuucaaa

SEQ ID NO: 1670642 - RNA, 15 nt, Homo sapiens
caagcauuuguggac

SEQ ID NO: 1670643 - RNA, 23 nt, Homo sapiens
caagccaaaaaccuuagcucccu

SEQ ID NO: 1670644 - RNA, 17 nt, Homo sapiens
caagccacguugcagaa

SEQ ID NO: 1670645 - RNA, 17 nt, Homo sapiens
caagcccagccuaucuc

SEQ ID NO: 1670646 - RNA, 19 nt, Homo sapiens
caagcgauugucugaggaa

SEQ ID NO: 1670647 - RNA, 22 nt, Homo sapiens
caagcucuguccaaucagguag

SEQ ID NO: 1670648 - RNA, 14 nt, Homo sapiens
caaggaaaauggac

SEQ ID NO: 1670649 - RNA, 16 nt, Homo sapiens
caaggaaaauggacau

SEQ ID NO: 1670650 - RNA, 17 nt, Homo sapiens
caaggaucacuugagcc

SEQ ID NO: 1670651 - RNA, 16 nt, Homo sapiens
caaggcaaggcuguca

SEQ ID NO: 1670652 - RNA, 17 nt, Homo sapiens
caaggcauccccagugc

SEQ ID NO: 1670653 - RNA, 15 nt, Homo sapiens
caaggcugcagugag

SEQ ID NO: 1670654 - RNA, 23 nt, Homo sapiens
caaggcugcgggagaagaaguuu

SEQ ID NO: 1670655 - RNA, 16 nt, Homo sapiens
caagguccaugucacc

SEQ ID NO: 1670656 - RNA, 18 nt, Homo sapiens
caaggucugaacccuucc

SEQ ID NO: 1670657 - RNA, 17 nt, Homo sapiens
caaggugaacaccacuu

SEQ ID NO: 1670658 - RNA, 22 nt, Homo sapiens
caagguuuugaaauuuucugua

SEQ ID NO: 1670659 - RNA, 22 nt, Homo sapiens
caaguccucagugguuggcaau

SEQ ID NO: 1670660 - RNA, 13 nt, Homo sapiens
caagucugugaaa

SEQ ID NO: 1670661 - RNA, 19 nt, Homo sapiens
caaguucauucauacucaa

SEQ ID NO: 1670662 - RNA, 17 nt, Homo sapiens
caaguuuaacauauaca

SEQ ID NO: 1670663 - RNA, 22 nt, Homo sapiens
caauaaaaucagugugcuugcc

SEQ ID NO: 1670664 - RNA, 13 nt, Homo sapiens
caauaaagcaaug

SEQ ID NO: 1670665 - RNA, 17 nt, Homo sapiens
caauaaagcaauguggu

SEQ ID NO: 1670666 - RNA, 19 nt, Homo sapiens
caauaaagcaaugugguag

SEQ ID NO: 1670667 - RNA, 16 nt, Homo sapiens
caauaaagugugagga

SEQ ID NO: 1670668 - RNA, 18 nt, Homo sapiens
caaucaauacccuuguga

SEQ ID NO: 1670669 - RNA, 14 nt, Homo sapiens
caaucccauuccug

SEQ ID NO: 1670670 - RNA, 14 nt, Homo sapiens
caaucuguccagac

SEQ ID NO: 1670671 - RNA, 20 nt, Homo sapiens
caaugacaauggugcccgaa

SEQ ID NO: 1670672 - RNA, 13 nt, Homo sapiens
caaugagaaggcc

SEQ ID NO: 1670673 - RNA, 16 nt, Homo sapiens
caaugccauuuugcua

SEQ ID NO: 1670674 - RNA, 15 nt, Homo sapiens
caaugccugccugaa

SEQ ID NO: 1670675 - RNA, 16 nt, Homo sapiens
caaugccuuguuguau

SEQ ID NO: 1670676 - RNA, 19 nt, Homo sapiens
caaugccuuguuguauucc

SEQ ID NO: 1670677 - RNA, 15 nt, Homo sapiens
caaugcuauggacug

SEQ ID NO: 1670678 - RNA, 22 nt, Homo sapiens
caaugcucaguaacacagugca

SEQ ID NO: 1670679 - RNA, 20 nt, Homo sapiens
caaugcugacuggacugugu

SEQ ID NO: 1670680 - RNA, 14 nt, Homo sapiens
caauggcuggguuu

SEQ ID NO: 1670681 - RNA, 13 nt, Homo sapiens
caauggugcgauc

SEQ ID NO: 1670682 - RNA, 16 nt, Homo sapiens
caauguaguacucagu

SEQ ID NO: 1670683 - RNA, 14 nt, Homo sapiens
caauguaugaauua

SEQ ID NO: 1670684 - RNA, 14 nt, Homo sapiens
caaugugcuccuuc

SEQ ID NO: 1670685 - RNA, 22 nt, Homo sapiens
caauuaacuccguuuccaaaua

SEQ ID NO: 1670686 - RNA, 19 nt, Homo sapiens
caauuacaggaaguacugg

SEQ ID NO: 1670687 - RNA, 12 nt, Homo sapiens
caauuacuguga

SEQ ID NO: 1670688 - RNA, 23 nt, Homo sapiens
caauuauuucagucaucaucuca

SEQ ID NO: 1670689 - RNA, 13 nt, Homo sapiens
caauuccaugaau

SEQ ID NO: 1670690 - RNA, 22 nt, Homo sapiens
caauucugaaggggaaaaccuc

SEQ ID NO: 1670691 - RNA, 23 nt, Homo sapiens
caauucugaaggggaaaaccuca

SEQ ID NO: 1670692 - RNA, 15 nt, Homo sapiens
caauuggacaauuau

SEQ ID NO: 1670693 - RNA, 20 nt, Homo sapiens
caauugugagaauuacuguu

SEQ ID NO: 1670694 - RNA, 18 nt, Homo sapiens
caauuuguugaaucucag

SEQ ID NO: 1670695 - RNA, 15 nt, Homo sapiens
caauuuuguugcauc

SEQ ID NO: 1670696 - RNA, 23 nt, Homo sapiens
cacaaaaggcuggaugugcuuuc

SEQ ID NO: 1670697 - RNA, 22 nt, Homo sapiens
cacaaaagucucaauguuccau

SEQ ID NO: 1670698 - RNA, 18 nt, Homo sapiens
cacaaacucauccauuaa

SEQ ID NO: 1670699 - RNA, 21 nt, Homo sapiens
cacaaauugugaagauuucau

SEQ ID NO: 1670700 - RNA, 20 nt, Homo sapiens
cacaaccuccuccuccaguu

SEQ ID NO: 1670701 - RNA, 18 nt, Homo sapiens
cacaagaacucccuucuc

SEQ ID NO: 1670702 - RNA, 18 nt, Homo sapiens
cacaauacagugguauaa

SEQ ID NO: 1670703 - RNA, 12 nt, Homo sapiens
cacacaauggca

SEQ ID NO: 1670704 - RNA, 13 nt, Homo sapiens
cacacacagcagc

SEQ ID NO: 1670705 - RNA, 20 nt, Homo sapiens
cacaccuugcccaugcacaa

SEQ ID NO: 1670706 - RNA, 18 nt, Homo sapiens
cacacggggcacccagcc

SEQ ID NO: 1670707 - RNA, 17 nt, Homo sapiens
cacacugaguuugaaca

SEQ ID NO: 1670708 - RNA, 18 nt, Homo sapiens
cacacugugcguuuuaga

SEQ ID NO: 1670709 - RNA, 17 nt, Homo sapiens
cacacuugguccaucca

SEQ ID NO: 1670710 - RNA, 19 nt, Homo sapiens
cacagaaaauggaagacag

SEQ ID NO: 1670711 - RNA, 22 nt, Homo sapiens
cacagaaccuuugucaacuuca

SEQ ID NO: 1670712 - RNA, 21 nt, Homo sapiens
cacagaggauggcuuccccau

SEQ ID NO: 1670713 - RNA, 15 nt, Homo sapiens
auggccaggccucag

SEQ ID NO: 1670714 - RNA, 18 nt, Homo sapiens
auggcggucagccccuuc

SEQ ID NO: 1670715 - RNA, 16 nt, Homo sapiens
auggcucggccaggca

SEQ ID NO: 1670716 - RNA, 19 nt, Homo sapiens
auggcuuaagccuguguau

SEQ ID NO: 1670717 - RNA, 18 nt, Homo sapiens
auggcuuccccauugccu

SEQ ID NO: 1670718 - RNA, 18 nt, Homo sapiens
auggcuuuccacaucccc

SEQ ID NO: 1670719 - RNA, 20 nt, Homo sapiens
augggagauuaaaaccagag

SEQ ID NO: 1670720 - RNA, 17 nt, Homo sapiens
augggcaucacacccuc

SEQ ID NO: 1670721 - RNA, 15 nt, Homo sapiens
augggccaagccagg

SEQ ID NO: 1670722 - RNA, 14 nt, Homo sapiens
augguaacugcaca

SEQ ID NO: 1670723 - RNA, 15 nt, Homo sapiens
augguagacugugac

SEQ ID NO: 1670724 - RNA, 16 nt, Homo sapiens
augguagacugugaca

SEQ ID NO: 1670725 - RNA, 23 nt, Homo sapiens
augguccccugcccugucuuucc

SEQ ID NO: 1670726 - RNA, 14 nt, Homo sapiens
augguguagcuguc

SEQ ID NO: 1670727 - RNA, 12 nt, Homo sapiens
auguaaauacca

SEQ ID NO: 1670728 - RNA, 17 nt, Homo sapiens
auguaacggaugaccau

SEQ ID NO: 1670729 - RNA, 23 nt, Homo sapiens
auguacaauaaagcaauguggua

SEQ ID NO: 1670730 - RNA, 16 nt, Homo sapiens
auguacaggcugagac

SEQ ID NO: 1670731 - RNA, 20 nt, Homo sapiens
auguaccguugauguugaua

SEQ ID NO: 1670732 - RNA, 16 nt, Homo sapiens
auguacuacauuugca

SEQ ID NO: 1670733 - RNA, 21 nt, Homo sapiens
auguauuuuacaguacauguu

SEQ ID NO: 1670734 - RNA, 20 nt, Homo sapiens
augucaaauggauguaauau

SEQ ID NO: 1670735 - RNA, 16 nt, Homo sapiens
augucagugugacuga

SEQ ID NO: 1670736 - RNA, 14 nt, Homo sapiens
augucaguuauaau

SEQ ID NO: 1670737 - RNA, 14 nt, Homo sapiens
augucauuugcuaa

SEQ ID NO: 1670738 - RNA, 17 nt, Homo sapiens
auguccaaacuuaacag

SEQ ID NO: 1670739 - RNA, 13 nt, Homo sapiens
augucccaugacc

SEQ ID NO: 1670740 - RNA, 21 nt, Homo sapiens
augugacuugagcccagagug

SEQ ID NO: 1670741 - RNA, 19 nt, Homo sapiens
augugccgucuuugguucc

SEQ ID NO: 1670742 - RNA, 14 nt, Homo sapiens
augugccuagacac

SEQ ID NO: 1670743 - RNA, 20 nt, Homo sapiens
auguggaccucuacuuucca

SEQ ID NO: 1670744 - RNA, 14 nt, Homo sapiens
auguggaugcucuu

SEQ ID NO: 1670745 - RNA, 20 nt, Homo sapiens
augugucccaugcauaacac

SEQ ID NO: 1670746 - RNA, 21 nt, Homo sapiens
auguguccccucacucuguca

SEQ ID NO: 1670747 - RNA, 13 nt, Homo sapiens
augugucuuacca

SEQ ID NO: 1670748 - RNA, 17 nt, Homo sapiens
augugucuuaccagauc

SEQ ID NO: 1670749 - RNA, 22 nt, Homo sapiens
augugucuuaccagaucuaaua

SEQ ID NO: 1670750 - RNA, 22 nt, Homo sapiens
augugugaagcaaauuucuaga

SEQ ID NO: 1670751 - RNA, 21 nt, Homo sapiens
augugugaguguauguauaca

SEQ ID NO: 1670752 - RNA, 21 nt, Homo sapiens
auguguguuucuguccuguaa

SEQ ID NO: 1670753 - RNA, 15 nt, Homo sapiens
auguucugacagcau

SEQ ID NO: 1670754 - RNA, 13 nt, Homo sapiens
auguucuguguca

SEQ ID NO: 1670755 - RNA, 17 nt, Homo sapiens
auguucuuucacccuuu

SEQ ID NO: 1670756 - RNA, 23 nt, Homo sapiens
auguugaagaacucaugugauuu

SEQ ID NO: 1670757 - RNA, 23 nt, Homo sapiens
auguugcuuucuuaucccaguga

SEQ ID NO: 1670758 - RNA, 16 nt, Homo sapiens
auguuucccagggcaa

SEQ ID NO: 1670759 - RNA, 16 nt, Homo sapiens
auguuuucaaguugca

SEQ ID NO: 1670760 - RNA, 17 nt, Homo sapiens
auuaaaaucacaaacuc

SEQ ID NO: 1670761 - RNA, 19 nt, Homo sapiens
auuaaacuucuacugagca

SEQ ID NO: 1670762 - RNA, 13 nt, Homo sapiens
auuaaagucuaca

SEQ ID NO: 1670763 - RNA, 19 nt, Homo sapiens
auuaaagucuacacugccu

SEQ ID NO: 1670764 - RNA, 15 nt, Homo sapiens
auuaacaugucacaa

SEQ ID NO: 1670765 - RNA, 22 nt, Homo sapiens
auuaaccuuaucauaaauucaa

SEQ ID NO: 1670766 - RNA, 13 nt, Homo sapiens
auuaacucugcau

SEQ ID NO: 1670767 - RNA, 17 nt, Homo sapiens
auuaaguguuguacaau

SEQ ID NO: 1670768 - RNA, 18 nt, Homo sapiens
auuaaguguuguacaauu

SEQ ID NO: 1670769 - RNA, 18 nt, Homo sapiens
auuacacgccacaacucc

SEQ ID NO: 1670770 - RNA, 12 nt, Homo sapiens
auuacauaacag

SEQ ID NO: 1670771 - RNA, 14 nt, Homo sapiens
auuacuaaauugac

SEQ ID NO: 1670772 - RNA, 15 nt, Homo sapiens
auuacugcaaagggu

SEQ ID NO: 1670773 - RNA, 13 nt, Homo sapiens
auuagaaggcaga

SEQ ID NO: 1670774 - RNA, 20 nt, Homo sapiens
auuagaaggcagacuuucua

SEQ ID NO: 1670775 - RNA, 23 nt, Homo sapiens
auuagacaauguggaauuacaua

SEQ ID NO: 1670776 - RNA, 14 nt, Homo sapiens
auuagacacacaua

SEQ ID NO: 1670777 - RNA, 21 nt, Homo sapiens
auuagauuuuaaaacuucauc

SEQ ID NO: 1670778 - RNA, 16 nt, Homo sapiens
auuagcccacugccug

SEQ ID NO: 1670779 - RNA, 12 nt, Homo sapiens
auuagcugugau

SEQ ID NO: 1670780 - RNA, 18 nt, Homo sapiens
auuauaaagaacagcuga

SEQ ID NO: 1670781 - RNA, 23 nt, Homo sapiens
auuauauucccaaaucucaaaag

SEQ ID NO: 1670782 - RNA, 20 nt, Homo sapiens
auuaucuaguaggucugcac

SEQ ID NO: 1670783 - RNA, 13 nt, Homo sapiens
auuaucuguccaa

SEQ ID NO: 1670784 - RNA, 13 nt, Homo sapiens
auuaugaaccgca

SEQ ID NO: 1670785 - RNA, 13 nt, Homo sapiens
auuauguccugug

SEQ ID NO: 1670786 - RNA, 16 nt, Homo sapiens
auuauuggacagucuc

SEQ ID NO: 1670787 - RNA, 17 nt, Homo sapiens
auuauuggacagucuca

SEQ ID NO: 1670788 - RNA, 23 nt, Homo sapiens
auuauuuacugacauauaucuau

SEQ ID NO: 1670789 - RNA, 21 nt, Homo sapiens
auuauuucagucaucaucuca

SEQ ID NO: 1670790 - RNA, 23 nt, Homo sapiens
auuauuugguauguguuuugcuu

SEQ ID NO: 1670791 - RNA, 23 nt, Homo sapiens
auucaaauaacccugaaucagag

SEQ ID NO: 1670792 - RNA, 15 nt, Homo sapiens
auucaaucauuuugg

SEQ ID NO: 1670793 - RNA, 13 nt, Homo sapiens
auucacaguaucu

SEQ ID NO: 1670794 - RNA, 20 nt, Homo sapiens
auucaccuguaaaacuuuau

SEQ ID NO: 1670795 - RNA, 15 nt, Homo sapiens
auucagaaugugcaa

SEQ ID NO: 1670796 - RNA, 16 nt, Homo sapiens
auucagaccagggaac

SEQ ID NO: 1670797 - RNA, 17 nt, Homo sapiens
auucaggaaauguucac

SEQ ID NO: 1670798 - RNA, 19 nt, Homo sapiens
aacauuugggagacugagc

SEQ ID NO: 1670799 - RNA, 20 nt, Homo sapiens
aaccaauuuguucugugcaa

SEQ ID NO: 1670800 - RNA, 20 nt, Homo sapiens
aaccaggccuccaagccagg

SEQ ID NO: 1670801 - RNA, 17 nt, Homo sapiens
aacccagacccugaguc

SEQ ID NO: 1670802 - RNA, 18 nt, Homo sapiens
aacccagacccugagucc

SEQ ID NO: 1670803 - RNA, 15 nt, Homo sapiens
aacccagauugaagc

SEQ ID NO: 1670804 - RNA, 18 nt, Homo sapiens
aaccccaacgcacaggaa

SEQ ID NO: 1670805 - RNA, 18 nt, Homo sapiens
aacccggcugacucagug

SEQ ID NO: 1670806 - RNA, 17 nt, Homo sapiens
aacccugcccugcaccu

SEQ ID NO: 1670807 - RNA, 15 nt, Homo sapiens
aacccugugaucuau

SEQ ID NO: 1670808 - RNA, 16 nt, Homo sapiens
aacccuuuuacaguca

SEQ ID NO: 1670809 - RNA, 18 nt, Homo sapiens
aaccugaauuaaagucua

SEQ ID NO: 1670810 - RNA, 22 nt, Homo sapiens
aaccugaauuaaagucuacacu

SEQ ID NO: 1670811 - RNA, 17 nt, Homo sapiens
aaccuggaggcuggacc

SEQ ID NO: 1670812 - RNA, 19 nt, Homo sapiens
aaccuggguuguugcagag

SEQ ID NO: 1670813 - RNA, 17 nt, Homo sapiens
aaccugguggcaccaga

SEQ ID NO: 1670814 - RNA, 17 nt, Homo sapiens
aaccugugcuuucaugu

SEQ ID NO: 1670815 - RNA, 22 nt, Homo sapiens
aacuaagguacggugagacucu

SEQ ID NO: 1670816 - RNA, 17 nt, Homo sapiens
aacuaaguucucuaucu

SEQ ID NO: 1670817 - RNA, 18 nt, Homo sapiens
aacuaauaaaacuuugac

SEQ ID NO: 1670818 - RNA, 15 nt, Homo sapiens
aacuaauguaaauau

SEQ ID NO: 1670819 - RNA, 20 nt, Homo sapiens
aacuaaugucagcacauguu

SEQ ID NO: 1670820 - RNA, 15 nt, Homo sapiens
aacuagcaaaaggau

SEQ ID NO: 1670821 - RNA, 14 nt, Homo sapiens
aacuaucaccaaaa

SEQ ID NO: 1670822 - RNA, 16 nt, Homo sapiens
aacuaucaccaaaaga

SEQ ID NO: 1670823 - RNA, 19 nt, Homo sapiens
aacuauuucuacacagugg

SEQ ID NO: 1670824 - RNA, 11 nt, Homo sapiens
aacucauaaag

SEQ ID NO: 1670825 - RNA, 18 nt, Homo sapiens
aacuccaggaaaacuguu

SEQ ID NO: 1670826 - RNA, 13 nt, Homo sapiens
aacuccaguguuc

SEQ ID NO: 1670827 - RNA, 13 nt, Homo sapiens
aacucccuuccuu

SEQ ID NO: 1670828 - RNA, 23 nt, Homo sapiens
aacuccuuguuucagaugauucu

SEQ ID NO: 1670829 - RNA, 13 nt, Homo sapiens
aacuccuuucuaa

SEQ ID NO: 1670830 - RNA, 16 nt, Homo sapiens
aacucgggcacucccu

SEQ ID NO: 1670831 - RNA, 18 nt, Homo sapiens
aacucugacaagggcuga

SEQ ID NO: 1670832 - RNA, 14 nt, Homo sapiens
aacucugacuguaa

SEQ ID NO: 1670833 - RNA, 17 nt, Homo sapiens
aacugaaaagcaguuua

SEQ ID NO: 1670834 - RNA, 15 nt, Homo sapiens
aacugcuugugcacu

SEQ ID NO: 1670835 - RNA, 16 nt, Homo sapiens
aacugcuugugcacug

SEQ ID NO: 1670836 - RNA, 22 nt, Homo sapiens
aacuggaaaguacguuaugaua

SEQ ID NO: 1670837 - RNA, 21 nt, Homo sapiens
aacuggaaugcuguuacuuug

SEQ ID NO: 1670838 - RNA, 14 nt, Homo sapiens
aacuguacaguuuc

SEQ ID NO: 1670839 - RNA, 19 nt, Homo sapiens
aacuguacaguuucuuccc

SEQ ID NO: 1670840 - RNA, 23 nt, Homo sapiens
aacuguacaguuucuuccccaag

SEQ ID NO: 1670841 - RNA, 15 nt, Homo sapiens
aacugucuuagucau

SEQ ID NO: 1670842 - RNA, 21 nt, Homo sapiens
aacuguuaagggaagcugaua

SEQ ID NO: 1670843 - RNA, 22 nt, Homo sapiens
aacuguuuuugaagaagggaaa

SEQ ID NO: 1670844 - RNA, 15 nt, Homo sapiens
aacuuaauuaccuaa

SEQ ID NO: 1670845 - RNA, 20 nt, Homo sapiens
aacuuaauuauaagcuaugu

SEQ ID NO: 1670846 - RNA, 20 nt, Homo sapiens
aacuuccauagcuucaucca

SEQ ID NO: 1670847 - RNA, 17 nt, Homo sapiens
aacuucuuaacuggcaa

SEQ ID NO: 1670848 - RNA, 23 nt, Homo sapiens
aacuugaauuaauccacacauca

SEQ ID NO: 1670849 - RNA, 17 nt, Homo sapiens
aacuugaggucugacuu

SEQ ID NO: 1670850 - RNA, 21 nt, Homo sapiens
aacuugauagccugacagcag

SEQ ID NO: 1670851 - RNA, 14 nt, Homo sapiens
aacuuggugccuaa

SEQ ID NO: 1670852 - RNA, 20 nt, Homo sapiens
aacuuuauuggucuugcccu

SEQ ID NO: 1670853 - RNA, 19 nt, Homo sapiens
aacuuucccuccaccagug

SEQ ID NO: 1670854 - RNA, 23 nt, Homo sapiens
aacuuugacgagucaccuuccag

SEQ ID NO: 1670855 - RNA, 15 nt, Homo sapiens
aacuuugucacuucu

SEQ ID NO: 1670856 - RNA, 20 nt, Homo sapiens
aacuuuugguaucuacuucu

SEQ ID NO: 1670857 - RNA, 13 nt, Homo sapiens
gaaauaccuauuc

SEQ ID NO: 1670858 - RNA, 15 nt, Homo sapiens
gaaauacucuuccaa

SEQ ID NO: 1670859 - RNA, 22 nt, Homo sapiens
gaaauacuugaaaacuucucau

SEQ ID NO: 1670860 - RNA, 14 nt, Homo sapiens
gaaauacuugacaa

SEQ ID NO: 1670861 - RNA, 20 nt, Homo sapiens
gaaauccaacuccaggguua

SEQ ID NO: 1670862 - RNA, 14 nt, Homo sapiens
gaaaucuaaucucu

SEQ ID NO: 1670863 - RNA, 11 nt, Homo sapiens
gaaaugccaag

SEQ ID NO: 1670864 - RNA, 12 nt, Homo sapiens
gaaaugcugauu

SEQ ID NO: 1670865 - RNA, 16 nt, Homo sapiens
gaaaugugcugcaaag

SEQ ID NO: 1670866 - RNA, 16 nt, Homo sapiens
gaaauuaguguuuuca

SEQ ID NO: 1670867 - RNA, 17 nt, Homo sapiens
gaaauuauaucuguggu

SEQ ID NO: 1670868 - RNA, 14 nt, Homo sapiens
gaaauucacaaagu

SEQ ID NO: 1670869 - RNA, 16 nt, Homo sapiens
gaaauuggaagacuug

SEQ ID NO: 1670870 - RNA, 16 nt, Homo sapiens
gaaauuuaagcacaaa

SEQ ID NO: 1670871 - RNA, 17 nt, Homo sapiens
gaacagcauaugcaaag

SEQ ID NO: 1670872 - RNA, 19 nt, Homo sapiens
gaacagcuuggcuguucca

SEQ ID NO: 1670873 - RNA, 22 nt, Homo sapiens
gaacagggaugcuaucucgcua

SEQ ID NO: 1670874 - RNA, 16 nt, Homo sapiens
gaaccaaccaaugaaa

SEQ ID NO: 1670875 - RNA, 17 nt, Homo sapiens
gaaccagagagaaucaa

SEQ ID NO: 1670876 - RNA, 14 nt, Homo sapiens
gaaccagcaaugag

SEQ ID NO: 1670877 - RNA, 23 nt, Homo sapiens
gaaccagcaaugagaaggccagg

SEQ ID NO: 1670878 - RNA, 12 nt, Homo sapiens
gaacccaucacu

SEQ ID NO: 1670879 - RNA, 18 nt, Homo sapiens
gaacucacagacugcugu

SEQ ID NO: 1670880 - RNA, 19 nt, Homo sapiens
gaacucagcugucuguggc

SEQ ID NO: 1670881 - RNA, 14 nt, Homo sapiens
gaacugcaacacug

SEQ ID NO: 1670882 - RNA, 13 nt, Homo sapiens
gaacugcuugugc

SEQ ID NO: 1670883 - RNA, 19 nt, Homo sapiens
gaacugcuugugcacugga

SEQ ID NO: 1670884 - RNA, 21 nt, Homo sapiens
gaacugcuugugcacuggaug

SEQ ID NO: 1670885 - RNA, 23 nt, Homo sapiens
gaacuuaauuaccuaagagccac

SEQ ID NO: 1670886 - RNA, 20 nt, Homo sapiens
gaagaaaauggaugacaaag

SEQ ID NO: 1670887 - RNA, 21 nt, Homo sapiens
gaagaaccgauacacuuggca

SEQ ID NO: 1670888 - RNA, 14 nt, Homo sapiens
gaagaacugcaaaa

SEQ ID NO: 1670889 - RNA, 15 nt, Homo sapiens
gaagaaggcaaccca

SEQ ID NO: 1670890 - RNA, 22 nt, Homo sapiens
gaagacacguucuugccagcuu

SEQ ID NO: 1670891 - RNA, 12 nt, Homo sapiens
gaagaccccagg

SEQ ID NO: 1670892 - RNA, 20 nt, Homo sapiens
gaagacccuaucucccacaa

SEQ ID NO: 1670893 - RNA, 16 nt, Homo sapiens
gaagagcuccuugaua

SEQ ID NO: 1670894 - RNA, 18 nt, Homo sapiens
gaagauguaagaagcuaa

SEQ ID NO: 1670895 - RNA, 17 nt, Homo sapiens
gaagauuucauggacac

SEQ ID NO: 1670896 - RNA, 17 nt, Homo sapiens
gaagauuucauggacau

SEQ ID NO: 1670897 - RNA, 13 nt, Homo sapiens
gaagcaccaugaa

SEQ ID NO: 1670898 - RNA, 20 nt, Homo sapiens
gaagcaucgcuccucuccag

SEQ ID NO: 1670899 - RNA, 21 nt, Homo sapiens
gaagcuaaaauaaaccagacu

SEQ ID NO: 1670900 - RNA, 16 nt, Homo sapiens
gaagcucagaucucua

SEQ ID NO: 1670901 - RNA, 18 nt, Homo sapiens
gaaggaaccagcaaugag

SEQ ID NO: 1670902 - RNA, 14 nt, Homo sapiens
gaaggacacaguca

SEQ ID NO: 1670903 - RNA, 16 nt, Homo sapiens
gaaggggaaaaccuca

SEQ ID NO: 1670904 - RNA, 21 nt, Homo sapiens
gaaggggccugggcugugagg

SEQ ID NO: 1670905 - RNA, 14 nt, Homo sapiens
gaaggugagccaga

SEQ ID NO: 1670906 - RNA, 17 nt, Homo sapiens
gaaguaaauuauuuuau

SEQ ID NO: 1670907 - RNA, 18 nt, Homo sapiens
gaaguaauuuucuucuca

SEQ ID NO: 1670908 - RNA, 18 nt, Homo sapiens
gaagucuuuguacagaca

SEQ ID NO: 1670909 - RNA, 15 nt, Homo sapiens
gaagugcauguuaaa

SEQ ID NO: 1670910 - RNA, 18 nt, Homo sapiens
gaaguuacuucuuguaaa

SEQ ID NO: 1670911 - RNA, 20 nt, Homo sapiens
gaaguuuauuuucuauuuua

SEQ ID NO: 1670912 - RNA, 17 nt, Homo sapiens
gaauaaaaugcagugaa

SEQ ID NO: 1670913 - RNA, 13 nt, Homo sapiens
gaauaaagccaca

SEQ ID NO: 1670914 - RNA, 15 nt, Homo sapiens
gaauaaagucuuucc

SEQ ID NO: 1670915 - RNA, 17 nt, Homo sapiens
gaauauuaagcacauua

SEQ ID NO: 1670916 - RNA, 13 nt, Homo sapiens
gaauauuguuaaa

SEQ ID NO: 1670917 - RNA, 16 nt, Homo sapiens
gaaucaagucugugaa

SEQ ID NO: 1670918 - RNA, 11 nt, Homo sapiens
gaaucauuugc

SEQ ID NO: 1670919 - RNA, 12 nt, Homo sapiens
gaauccauauca

SEQ ID NO: 1670920 - RNA, 23 nt, Homo sapiens
gaaucuuguuaauuucauuccaa

SEQ ID NO: 1670921 - RNA, 22 nt, Homo sapiens
gaaugaaugucagugugacuga

SEQ ID NO: 1670922 - RNA, 17 nt, Homo sapiens
gaaugaguuuccagcua

SEQ ID NO: 1670923 - RNA, 21 nt, Homo sapiens
gaaugauuaauuaaaacacaa

SEQ ID NO: 1670924 - RNA, 20 nt, Homo sapiens
gaaugcacagugaaggguga

SEQ ID NO: 1670925 - RNA, 17 nt, Homo sapiens
gaaugcagcacaguacu

SEQ ID NO: 1670926 - RNA, 20 nt, Homo sapiens
gaaugcagcaguaaauccaa

SEQ ID NO: 1670927 - RNA, 15 nt, Homo sapiens
gaaugcuuaaaugau

SEQ ID NO: 1670928 - RNA, 21 nt, Homo sapiens
gaauuaaagucuacacugccu

SEQ ID NO: 1670929 - RNA, 15 nt, Homo sapiens
gaauucuccaaaaca

SEQ ID NO: 1670930 - RNA, 20 nt, Homo sapiens
gaauuguuauguaaacauca

SEQ ID NO: 1670931 - RNA, 21 nt, Homo sapiens
gaauuucccaaagcagugcau

SEQ ID NO: 1670932 - RNA, 12 nt, Homo sapiens
gaauuucucaca

SEQ ID NO: 1670933 - RNA, 17 nt, Homo sapiens
gaauuucucacaaagga

SEQ ID NO: 1670934 - RNA, 21 nt, Homo sapiens
gaauuuuaaaaaagauggauu

SEQ ID NO: 1670935 - RNA, 15 nt, Homo sapiens
gacaagcauguugau

SEQ ID NO: 1670936 - RNA, 16 nt, Homo sapiens
gacaagggcugaccug

SEQ ID NO: 1670937 - RNA, 19 nt, Homo sapiens
gacaagugacuuauuugcu

SEQ ID NO: 1670938 - RNA, 14 nt, Homo sapiens
gacacacucaccau

SEQ ID NO: 1670939 - RNA, 21 nt, Homo sapiens
gacacagaggacggcuucccc

SEQ ID NO: 1670940 - RNA, 12 nt, Homo sapiens
gacacaguauug

SEQ ID NO: 1670941 - RNA, 16 nt, Homo sapiens
gacacaguauugacuu

SEQ ID NO: 1670942 - RNA, 15 nt, Homo sapiens
gacacauaguguuug

SEQ ID NO: 1670943 - RNA, 15 nt, Homo sapiens
gacaccaccacugug

SEQ ID NO: 1670944 - RNA, 18 nt, Homo sapiens
gacaccaccacugugucc

SEQ ID NO: 1670945 - RNA, 18 nt, Homo sapiens
gacaccuagacucuaaaa

SEQ ID NO: 1670946 - RNA, 19 nt, Homo sapiens
gacagaauguggucuguca

SEQ ID NO: 1670947 - RNA, 22 nt, Homo sapiens
gacagagcaagaccccaucuca

SEQ ID NO: 1670948 - RNA, 23 nt, Homo sapiens
gacagagcaagaccccaucucaa

SEQ ID NO: 1670949 - RNA, 22 nt, Homo sapiens
gacagagcgagacuccaucuca

SEQ ID NO: 1670950 - RNA, 22 nt, Homo sapiens
gacagcauuacacgccacaacu

SEQ ID NO: 1670951 - RNA, 15 nt, Homo sapiens
gacagcucagaaaau

SEQ ID NO: 1670952 - RNA, 17 nt, Homo sapiens
gacaggaacccaucacu

SEQ ID NO: 1670953 - RNA, 23 nt, Homo sapiens
gacaggauaugaguacauacuca

SEQ ID NO: 1670954 - RNA, 13 nt, Homo sapiens
gacaggggagaaa

SEQ ID NO: 1670955 - RNA, 21 nt, Homo sapiens
gacagucucaccuccugccau

SEQ ID NO: 1670956 - RNA, 12 nt, Homo sapiens
gacauaccucuc

SEQ ID NO: 1670957 - RNA, 13 nt, Homo sapiens
gacauauaucuau

SEQ ID NO: 1670958 - RNA, 24 nt, Homo sapiens
gacaugaucgcuuucuacacugua

SEQ ID NO: 1670959 - RNA, 15 nt, Homo sapiens
gacaugcacugaccc

SEQ ID NO: 1670960 - RNA, 20 nt, Homo sapiens
gacaugcuaaccucucugaa

SEQ ID NO: 1670961 - RNA, 16 nt, Homo sapiens
gacauucacacagaga

SEQ ID NO: 1670962 - RNA, 22 nt, Homo sapiens
gacauucaccaacaacagucag

SEQ ID NO: 1670963 - RNA, 17 nt, Homo sapiens
gacauuccagcauuguc

SEQ ID NO: 1670964 - RNA, 14 nt, Homo sapiens
gaccacccugccaa

SEQ ID NO: 1670965 - RNA, 19 nt, Homo sapiens
gaccaggugucucugagaa

SEQ ID NO: 1670966 - RNA, 14 nt, Homo sapiens
gacccaaaugcaaa

SEQ ID NO: 1670967 - RNA, 12 nt, Homo sapiens
gaccccaaguga

SEQ ID NO: 1670968 - RNA, 16 nt, Homo sapiens
gacccgacacucucac

SEQ ID NO: 1670969 - RNA, 17 nt, Homo sapiens
gacccucccacuggugc

SEQ ID NO: 1670970 - RNA, 16 nt, Homo sapiens
gaccucaagugaucug

SEQ ID NO: 1670971 - RNA, 18 nt, Homo sapiens
gaccucagcuugcacaaa

SEQ ID NO: 1670972 - RNA, 20 nt, Homo sapiens
gaccuccucccaagcacuuc

SEQ ID NO: 1670973 - RNA, 17 nt, Homo sapiens
gaccucgugaucugccc

SEQ ID NO: 1670974 - RNA, 19 nt, Homo sapiens
gaccucucucaaagugcug

SEQ ID NO: 1670975 - RNA, 14 nt, Homo sapiens
ccuagaccuggacc

SEQ ID NO: 1670976 - RNA, 15 nt, Homo sapiens
ccuagagcuagaugu

SEQ ID NO: 1670977 - RNA, 17 nt, Homo sapiens
ccuagccugcauaucau

SEQ ID NO: 1670978 - RNA, 22 nt, Homo sapiens
ccuaggaucuucacugucuuac

SEQ ID NO: 1670979 - RNA, 14 nt, Homo sapiens
ccuauggaaagggu

SEQ ID NO: 1670980 - RNA, 16 nt, Homo sapiens
ccuauggaaagggugu

SEQ ID NO: 1670981 - RNA, 15 nt, Homo sapiens
ccuaugguuuugcug

SEQ ID NO: 1670982 - RNA, 22 nt, Homo sapiens
ccuauuauaauugucaugacuu

SEQ ID NO: 1670983 - RNA, 19 nt, Homo sapiens
ccucaaaaaucaucaaagu

SEQ ID NO: 1670984 - RNA, 14 nt, Homo sapiens
ccucaacaagaaga

SEQ ID NO: 1670985 - RNA, 18 nt, Homo sapiens
ccucaagccaggagaccc

SEQ ID NO: 1670986 - RNA, 16 nt, Homo sapiens
ccucacccagagucag

SEQ ID NO: 1670987 - RNA, 20 nt, Homo sapiens
ccucaccuggcuucccagga

SEQ ID NO: 1670988 - RNA, 12 nt, Homo sapiens
ccucagauucca

SEQ ID NO: 1670989 - RNA, 12 nt, Homo sapiens
ccucagucuccc

SEQ ID NO: 1670990 - RNA, 19 nt, Homo sapiens
ccucauccacuaggugccc

SEQ ID NO: 1670991 - RNA, 17 nt, Homo sapiens
ccucauccuccacugaa

SEQ ID NO: 1670992 - RNA, 20 nt, Homo sapiens
ccucauccugagaaggccag

SEQ ID NO: 1670993 - RNA, 12 nt, Homo sapiens
ccucauuugcau

SEQ ID NO: 1670994 - RNA, 22 nt, Homo sapiens
ccuccaagggaucugcuugaua

SEQ ID NO: 1670995 - RNA, 13 nt, Homo sapiens
ccuccacauuucc

SEQ ID NO: 1670996 - RNA, 21 nt, Homo sapiens
ccuccaccccaguccccggga

SEQ ID NO: 1670997 - RNA, 13 nt, Homo sapiens
ccuccacugcugc

SEQ ID NO: 1670998 - RNA, 16 nt, Homo sapiens
ccuccauuaaccaaga

SEQ ID NO: 1670999 - RNA, 14 nt, Homo sapiens
ccucccacugcccc

SEQ ID NO: 1671000 - RNA, 22 nt, Homo sapiens
ccucccagcuguaccggccacu

SEQ ID NO: 1671001 - RNA, 13 nt, Homo sapiens
ccucccccgcaga

SEQ ID NO: 1671002 - RNA, 13 nt, Homo sapiens
ccuccucaugaaa

SEQ ID NO: 1671003 - RNA, 18 nt, Homo sapiens
ccucuaagaucuugccuc

SEQ ID NO: 1671004 - RNA, 21 nt, Homo sapiens
ccucucagauuguaccauuga

SEQ ID NO: 1671005 - RNA, 16 nt, Homo sapiens
ccucucaucacugaaa

SEQ ID NO: 1671006 - RNA, 17 nt, Homo sapiens
ccucuccuuccuuaccc

SEQ ID NO: 1671007 - RNA, 14 nt, Homo sapiens
ccucugcagccuga

SEQ ID NO: 1671008 - RNA, 17 nt, Homo sapiens
ccucugcgccccagcga

SEQ ID NO: 1671009 - RNA, 17 nt, Homo sapiens
ccucuggcccccugaag

SEQ ID NO: 1671010 - RNA, 16 nt, Homo sapiens
ccucugggugacaaaa

SEQ ID NO: 1671011 - RNA, 14 nt, Homo sapiens
ccucugugcugcac

SEQ ID NO: 1671012 - RNA, 17 nt, Homo sapiens
ccucuuuccccacugaa

SEQ ID NO: 1671013 - RNA, 19 nt, Homo sapiens
ccucuuuccuccucaugaa

SEQ ID NO: 1671014 - RNA, 16 nt, Homo sapiens
ccucuuucucucugug

SEQ ID NO: 1671015 - RNA, 17 nt, Homo sapiens
ccucuuugagugaagcu

SEQ ID NO: 1671016 - RNA, 20 nt, Homo sapiens
ccucuuuuaaugucaucucu

SEQ ID NO: 1671017 - RNA, 12 nt, Homo sapiens
ccugaagugaug

SEQ ID NO: 1671018 - RNA, 22 nt, Homo sapiens
ccugaauuaaagucuacacugc

SEQ ID NO: 1671019 - RNA, 23 nt, Homo sapiens
ccugaauuaaagucuacacugcc

SEQ ID NO: 1671020 - RNA, 15 nt, Homo sapiens
ccugaccaugcauuu

SEQ ID NO: 1671021 - RNA, 17 nt, Homo sapiens
ccugacuaacagccuca

SEQ ID NO: 1671022 - RNA, 15 nt, Homo sapiens
ccugagaacccaaac

SEQ ID NO: 1671023 - RNA, 20 nt, Homo sapiens
ccugagcgugcuuuccaaaa

SEQ ID NO: 1671024 - RNA, 17 nt, Homo sapiens
ccugaugcgucuaccca

SEQ ID NO: 1671025 - RNA, 16 nt, Homo sapiens
ccugcaauaagggagg

SEQ ID NO: 1671026 - RNA, 19 nt, Homo sapiens
ccugcacucuuauuucacu

SEQ ID NO: 1671027 - RNA, 13 nt, Homo sapiens
ccugcagagccaa

SEQ ID NO: 1671028 - RNA, 16 nt, Homo sapiens
ccugccacaaugugau

SEQ ID NO: 1671029 - RNA, 23 nt, Homo sapiens
ccugcccagaguaugggcacuca

SEQ ID NO: 1671030 - RNA, 13 nt, Homo sapiens
ccugccccagaga

SEQ ID NO: 1671031 - RNA, 15 nt, Homo sapiens
ccugcccucccccac

SEQ ID NO: 1671032 - RNA, 22 nt, Homo sapiens
ccugcccuuaccugccaggaag

SEQ ID NO: 1671033 - RNA, 17 nt, Homo sapiens
ccugcgucuccugccca

SEQ ID NO: 1671034 - RNA, 17 nt, Homo sapiens
ccugcucccuagccaga

SEQ ID NO: 1671035 - RNA, 15 nt, Homo sapiens
ccugcuccuccagua

SEQ ID NO: 1671036 - RNA, 23 nt, Homo sapiens
ccugcugcaucuucccacagugg

SEQ ID NO: 1671037 - RNA, 12 nt, Homo sapiens
ccugcugccauc

SEQ ID NO: 1671038 - RNA, 19 nt, Homo sapiens
ccuggagauugugcucugc

SEQ ID NO: 1671039 - RNA, 17 nt, Homo sapiens
ccuggaggaacugcuug

SEQ ID NO: 1671040 - RNA, 16 nt, Homo sapiens
ccuggccccagugacc

SEQ ID NO: 1671041 - RNA, 15 nt, Homo sapiens
ccuggccuaccacag

SEQ ID NO: 1671042 - RNA, 12 nt, Homo sapiens
ccuggcuucugg

SEQ ID NO: 1671043 - RNA, 18 nt, Homo sapiens
ccugggagaugcagcugg

SEQ ID NO: 1671044 - RNA, 18 nt, Homo sapiens
ccugggcaacagagugag

SEQ ID NO: 1671045 - RNA, 17 nt, Homo sapiens
ccugggcagaaaugugc

SEQ ID NO: 1671046 - RNA, 14 nt, Homo sapiens
ccugggcugugagg

SEQ ID NO: 1671047 - RNA, 20 nt, Homo sapiens
ccuggggguggcaggcacac

SEQ ID NO: 1671048 - RNA, 22 nt, Homo sapiens
ccugggucaccuuccugggcag

SEQ ID NO: 1671049 - RNA, 19 nt, Homo sapiens
ccuggucaauaaaccacug

SEQ ID NO: 1671050 - RNA, 14 nt, Homo sapiens
ccuggucugugcau

SEQ ID NO: 1671051 - RNA, 15 nt, Homo sapiens
ccuggucugugcauu

SEQ ID NO: 1671052 - RNA, 16 nt, Homo sapiens
ccuggucugugcauug

SEQ ID NO: 1671053 - RNA, 19 nt, Homo sapiens
ccuggucugugcauugugg

SEQ ID NO: 1671054 - RNA, 20 nt, Homo sapiens
ccugguggaacagagucaua

SEQ ID NO: 1671055 - RNA, 15 nt, Homo sapiens
ccuguaaaacuuuau

SEQ ID NO: 1671056 - RNA, 15 nt, Homo sapiens
ccuguaccacacaua

SEQ ID NO: 1671057 - RNA, 14 nt, Homo sapiens
ccugucaaccugaa

SEQ ID NO: 1671058 - RNA, 17 nt, Homo sapiens
ccugucaaccugaauua

SEQ ID NO: 1671059 - RNA, 15 nt, Homo sapiens
ccugucucuacaaaa

SEQ ID NO: 1671060 - RNA, 22 nt, Homo sapiens
ccugugaggacugguugucucu

SEQ ID NO: 1671061 - RNA, 18 nt, Homo sapiens
ccugugaucuauaccacc

SEQ ID NO: 1671062 - RNA, 23 nt, Homo sapiens
ccugugaucuauaccaccuucaa

SEQ ID NO: 1671063 - RNA, 12 nt, Homo sapiens
ccugugaucucg

SEQ ID NO: 1671064 - RNA, 17 nt, Homo sapiens
ccugugucaucugucag

SEQ ID NO: 1671065 - RNA, 15 nt, Homo sapiens
ccuguguuccuguga

SEQ ID NO: 1671066 - RNA, 20 nt, Homo sapiens
ccuguguuccugugaucucg

SEQ ID NO: 1671067 - RNA, 22 nt, Homo sapiens
ccuguguuucauguucuguguc

SEQ ID NO: 1671068 - RNA, 23 nt, Homo sapiens
ccuguguuucauguucuguguca

SEQ ID NO: 1671069 - RNA, 15 nt, Homo sapiens
ccuguuaaggcaucc

SEQ ID NO: 1671070 - RNA, 16 nt, Homo sapiens
ccuuaaaaauguaugu

SEQ ID NO: 1671071 - RNA, 20 nt, Homo sapiens
ccuuaaauuaaacaauuuau

SEQ ID NO: 1671072 - RNA, 18 nt, Homo sapiens
ccuuauuuaacaagcaag

SEQ ID NO: 1671073 - RNA, 21 nt, Homo sapiens
ccuucacaccacuugugagcu

SEQ ID NO: 1671074 - RNA, 22 nt, Homo sapiens
ccuucagugccaaaaacaacaa

SEQ ID NO: 1671075 - RNA, 12 nt, Homo sapiens
ccuucaugcuuu

SEQ ID NO: 1671076 - RNA, 14 nt, Homo sapiens
ccuuccacugccuc

SEQ ID NO: 1671077 - RNA, 22 nt, Homo sapiens
ccuucccgcagcaccagccuga

SEQ ID NO: 1671078 - RNA, 20 nt, Homo sapiens
ccuucccugacacugucugc

SEQ ID NO: 1671079 - RNA, 13 nt, Homo sapiens
ccuucccuuccac

SEQ ID NO: 1671080 - RNA, 12 nt, Homo sapiens
aaauaacuguga

SEQ ID NO: 1671081 - RNA, 17 nt, Homo sapiens
aaauaaucauacacaga

SEQ ID NO: 1671082 - RNA, 13 nt, Homo sapiens
aaauaaugcuuaa

SEQ ID NO: 1671083 - RNA, 23 nt, Homo sapiens
aaauacuauuggacagacacaga

SEQ ID NO: 1671084 - RNA, 20 nt, Homo sapiens
aaauacuugaaaacuucuca

SEQ ID NO: 1671085 - RNA, 23 nt, Homo sapiens
aaauagcaucugcucuucucuua

SEQ ID NO: 1671086 - RNA, 14 nt, Homo sapiens
aaauaggcauauca

SEQ ID NO: 1671087 - RNA, 15 nt, Homo sapiens
aaauauaaacuguga

SEQ ID NO: 1671088 - RNA, 19 nt, Homo sapiens
aaauauaaacugugagaua

SEQ ID NO: 1671089 - RNA, 15 nt, Homo sapiens
aaauauaaacuugug

SEQ ID NO: 1671090 - RNA, 17 nt, Homo sapiens
aaauauacaaacaugug

SEQ ID NO: 1671091 - RNA, 21 nt, Homo sapiens
aaauauauguaauauauacau

SEQ ID NO: 1671092 - RNA, 12 nt, Homo sapiens
aaauaugcucuc

SEQ ID NO: 1671093 - RNA, 15 nt, Homo sapiens
aaauauuauuugcua

SEQ ID NO: 1671094 - RNA, 16 nt, Homo sapiens
aaauauugacaaguuu

SEQ ID NO: 1671095 - RNA, 12 nt, Homo sapiens
aaauauugcuau

SEQ ID NO: 1671096 - RNA, 16 nt, Homo sapiens
aaaucaacucucuccu

SEQ ID NO: 1671097 - RNA, 13 nt, Homo sapiens
aaaucagugcagu

SEQ ID NO: 1671098 - RNA, 13 nt, Homo sapiens
aaaucaucaaagu

SEQ ID NO: 1671099 - RNA, 14 nt, Homo sapiens
aaauccacagugag

SEQ ID NO: 1671100 - RNA, 19 nt, Homo sapiens
aaauccugacaaaagggac

SEQ ID NO: 1671101 - RNA, 12 nt, Homo sapiens
aaaucuagaaga

SEQ ID NO: 1671102 - RNA, 22 nt, Homo sapiens
aaaucuccccacuccagaagca

SEQ ID NO: 1671103 - RNA, 20 nt, Homo sapiens
aaaucucgcacuacaucuga

SEQ ID NO: 1671104 - RNA, 20 nt, Homo sapiens
aaaucuguauugcuaagaua

SEQ ID NO: 1671105 - RNA, 16 nt, Homo sapiens
aaaucuucagcaugau

SEQ ID NO: 1671106 - RNA, 11 nt, Homo sapiens
aaaucuugcca

SEQ ID NO: 1671107 - RNA, 23 nt, Homo sapiens
aaaugaagacaccagaguguaug

SEQ ID NO: 1671108 - RNA, 19 nt, Homo sapiens
aaaugaauauucaacagcu

SEQ ID NO: 1671109 - RNA, 14 nt, Homo sapiens
aaaugacaugcacu

SEQ ID NO: 1671110 - RNA, 17 nt, Homo sapiens
aaaugacaugcacugac

SEQ ID NO: 1671111 - RNA, 14 nt, Homo sapiens
aaaugauucucuaa

SEQ ID NO: 1671112 - RNA, 16 nt, Homo sapiens
aaaugcaaacacugug

SEQ ID NO: 1671113 - RNA, 23 nt, Homo sapiens
aaaugcaaggugaacaccacuuu

SEQ ID NO: 1671114 - RNA, 16 nt, Homo sapiens
aaaugccaguggugga

SEQ ID NO: 1671115 - RNA, 21 nt, Homo sapiens
aaaugccgggcacaggccagg

SEQ ID NO: 1671116 - RNA, 15 nt, Homo sapiens
aaaugcuguucucaa

SEQ ID NO: 1671117 - RNA, 13 nt, Homo sapiens
aaauggaugacaa

SEQ ID NO: 1671118 - RNA, 16 nt, Homo sapiens
aaauggaugacaaaga

SEQ ID NO: 1671119 - RNA, 16 nt, Homo sapiens
aaauggauguaauaua

SEQ ID NO: 1671120 - RNA, 20 nt, Homo sapiens
aaauggcuuuccacaucccc

SEQ ID NO: 1671121 - RNA, 24 nt, Homo sapiens
aaauguaaaacacaagacugucau

SEQ ID NO: 1671122 - RNA, 17 nt, Homo sapiens
aaauguacuacauuugc

SEQ ID NO: 1671123 - RNA, 19 nt, Homo sapiens
aaauguacuacauuugcau

SEQ ID NO: 1671124 - RNA, 10 nt, Homo sapiens
aaaugucucc

SEQ ID NO: 1671125 - RNA, 18 nt, Homo sapiens
aaaugucuucauguugau

SEQ ID NO: 1671126 - RNA, 12 nt, Homo sapiens
aaauguuugaua

SEQ ID NO: 1671127 - RNA, 18 nt, Homo sapiens
aaauguuuggccaugcuu

SEQ ID NO: 1671128 - RNA, 16 nt, Homo sapiens
aaauuaacaugucaca

SEQ ID NO: 1671129 - RNA, 23 nt, Homo sapiens
aaauuaauugaaauaccuauuca

SEQ ID NO: 1671130 - RNA, 15 nt, Homo sapiens
aaauuacaugcauga

SEQ ID NO: 1671131 - RNA, 21 nt, Homo sapiens
aaauuagggcucuaauuuccu

SEQ ID NO: 1671132 - RNA, 18 nt, Homo sapiens
aaauuauauuuugaacaa

SEQ ID NO: 1671133 - RNA, 16 nt, Homo sapiens
aaauuaucugauccuu

SEQ ID NO: 1671134 - RNA, 23 nt, Homo sapiens
aaauugagucauuuuauauauga

SEQ ID NO: 1671135 - RNA, 24 nt, Homo sapiens
aaauugucuuuugucauguggcua

SEQ ID NO: 1671136 - RNA, 23 nt, Homo sapiens
aaauuuccaggggccucccaagg

SEQ ID NO: 1671137 - RNA, 23 nt, Homo sapiens
aaauuuuuacucaggcuuucuau

SEQ ID NO: 1671138 - RNA, 23 nt, Homo sapiens
aacaaaucguccaaagaucucaa

SEQ ID NO: 1671139 - RNA, 15 nt, Homo sapiens
aacaagguccaguaa

SEQ ID NO: 1671140 - RNA, 17 nt, Homo sapiens
aacaaguagcacacuga

SEQ ID NO: 1671141 - RNA, 21 nt, Homo sapiens
aacaaguucuuguugacucag

SEQ ID NO: 1671142 - RNA, 13 nt, Homo sapiens
aacaauucaagca

SEQ ID NO: 1671143 - RNA, 22 nt, Homo sapiens
aacacaaaccacaacugacaca

SEQ ID NO: 1671144 - RNA, 20 nt, Homo sapiens
aacacagcaugcauuuagca

SEQ ID NO: 1671145 - RNA, 11 nt, Homo sapiens
aacacaguaag

SEQ ID NO: 1671146 - RNA, 12 nt, Homo sapiens
aacacagugaaa

SEQ ID NO: 1671147 - RNA, 13 nt, Homo sapiens
aacacagugcagu

SEQ ID NO: 1671148 - RNA, 22 nt, Homo sapiens
aacacauugaaacuguauuuac

SEQ ID NO: 1671149 - RNA, 22 nt, Homo sapiens
aacaccacuuugucucugagaa

SEQ ID NO: 1671150 - RNA, 23 nt, Homo sapiens
aacaccacuuugucucugagaac

SEQ ID NO: 1671151 - RNA, 15 nt, Homo sapiens
aacacuguacugcaa

SEQ ID NO: 1671152 - RNA, 14 nt, Homo sapiens
aacacuuuggccac

SEQ ID NO: 1671153 - RNA, 16 nt, Homo sapiens
aacagaaaaaugaaau

SEQ ID NO: 1671154 - RNA, 22 nt, Homo sapiens
aacagaccagcauaguucugca

SEQ ID NO: 1671155 - RNA, 19 nt, Homo sapiens
aacagauuuguucauuccg

SEQ ID NO: 1671156 - RNA, 13 nt, Homo sapiens
aacagcauaugca

SEQ ID NO: 1671157 - RNA, 19 nt, Homo sapiens
aacagcuguauuaucuuaa

SEQ ID NO: 1671158 - RNA, 19 nt, Homo sapiens
aacagcuuggcuguuccac

SEQ ID NO: 1671159 - RNA, 20 nt, Homo sapiens
aacaggcuguucugcacuga

SEQ ID NO: 1671160 - RNA, 19 nt, Homo sapiens
aacagguuuuccugaagaa

SEQ ID NO: 1671161 - RNA, 12 nt, Homo sapiens
aacagugcagua

SEQ ID NO: 1671162 - RNA, 13 nt, Homo sapiens
aacaguggugugg

SEQ ID NO: 1671163 - RNA, 17 nt, Homo sapiens
aacauauuaaagguucu

SEQ ID NO: 1671164 - RNA, 20 nt, Homo sapiens
aacaucaacuuuuuucuuuc

SEQ ID NO: 1671165 - RNA, 16 nt, Homo sapiens
aacaucugauuucuga

SEQ ID NO: 1671166 - RNA, 18 nt, Homo sapiens
aacaugacacugaccuug

SEQ ID NO: 1671167 - RNA, 14 nt, Homo sapiens
aacaugcugucuua

SEQ ID NO: 1671168 - RNA, 19 nt, Homo sapiens
aacaugguuaccucugcau

SEQ ID NO: 1671169 - RNA, 18 nt, Homo sapiens
aacauuaacaaaagcaau

SEQ ID NO: 1671170 - RNA, 13 nt, Homo sapiens
aacauuuucucaa

SEQ ID NO: 1671171 - RNA, 14 nt, Homo sapiens
aaccaagaacauaa

SEQ ID NO: 1671172 - RNA, 17 nt, Homo sapiens
aaccaccaccaaccacu

SEQ ID NO: 1671173 - RNA, 17 nt, Homo sapiens
aaccaccgacucucauu

SEQ ID NO: 1671174 - RNA, 13 nt, Homo sapiens
aaccacugggauc

SEQ ID NO: 1671175 - RNA, 21 nt, Homo sapiens
aaccagaaaucuaaucucugu

SEQ ID NO: 1671176 - RNA, 16 nt, Homo sapiens
aaccaggccuccaagc

SEQ ID NO: 1671177 - RNA, 19 nt, Homo sapiens
aaccauuguuuacagagcu

SEQ ID NO: 1671178 - RNA, 15 nt, Homo sapiens
aacccaaacuuccca

SEQ ID NO: 1671179 - RNA, 15 nt, Homo sapiens
aacccaucacugugu

SEQ ID NO: 1671180 - RNA, 17 nt, Homo sapiens
aaccccgggcaagacuu

SEQ ID NO: 1671181 - RNA, 17 nt, Homo sapiens
aacccgggcgcugccug

SEQ ID NO: 1671182 - RNA, 21 nt, Homo sapiens
aacccugagaggcagguggua

SEQ ID NO: 1671183 - RNA, 12 nt, Homo sapiens
aacccugugauc

SEQ ID NO: 1671184 - RNA, 14 nt, Homo sapiens
aacccugugaucua

SEQ ID NO: 1671185 - RNA, 23 nt, Homo sapiens
aacccugugaucuauaccaccuu

SEQ ID NO: 1671186 - RNA, 21 nt, Homo sapiens
aacccuuuuacagucacauuc

SEQ ID NO: 1671187 - RNA, 22 nt, Homo sapiens
aacccuuuuacagucacauuca

SEQ ID NO: 1671188 - RNA, 22 nt, Homo sapiens
aaccguccagcaagugucauca

SEQ ID NO: 1671189 - RNA, 10 nt, Homo sapiens
aaccuaccuc

SEQ ID NO: 1671190 - RNA, 23 nt, Homo sapiens
aaccuaccuuauagagcacaaua

SEQ ID NO: 1671191 - RNA, 14 nt, Homo sapiens
aaccuccgccuccc

SEQ ID NO: 1671192 - RNA, 17 nt, Homo sapiens
aaccuccuccuccaguu

SEQ ID NO: 1671193 - RNA, 15 nt, Homo sapiens
aaccucucagcacua

SEQ ID NO: 1671194 - RNA, 13 nt, Homo sapiens
aaccucugaggac

SEQ ID NO: 1671195 - RNA, 22 nt, Homo sapiens
aaccugggguuuugacuugcca

SEQ ID NO: 1671196 - RNA, 20 nt, Homo sapiens
aaccugugcuuucauguuua

SEQ ID NO: 1671197 - RNA, 15 nt, Homo sapiens
aaccuguuccugacu

SEQ ID NO: 1671198 - RNA, 19 nt, Homo sapiens
aaccuguuccugacuguuc

SEQ ID NO: 1671199 - RNA, 18 nt, Homo sapiens
aaccuuuugagugccuua

SEQ ID NO: 1671200 - RNA, 13 nt, Homo sapiens
aacgcaugcaggg

SEQ ID NO: 1671201 - RNA, 22 nt, Homo sapiens
aacggagggugaagagcauagu

SEQ ID NO: 1671202 - RNA, 13 nt, Homo sapiens
acagaucuucaac

SEQ ID NO: 1671203 - RNA, 19 nt, Homo sapiens
acagaugggcaaggccuuu

SEQ ID NO: 1671204 - RNA, 21 nt, Homo sapiens
acagaugguguccugcaugua

SEQ ID NO: 1671205 - RNA, 23 nt, Homo sapiens
acagaugguguccugcauguaug

SEQ ID NO: 1671206 - RNA, 15 nt, Homo sapiens
acagauuuguucauu

SEQ ID NO: 1671207 - RNA, 17 nt, Homo sapiens
acagauuuguucauucc

SEQ ID NO: 1671208 - RNA, 21 nt, Homo sapiens
acagcaaaaccauugcuucac

SEQ ID NO: 1671209 - RNA, 16 nt, Homo sapiens
acagcaaauguuauag

SEQ ID NO: 1671210 - RNA, 17 nt, Homo sapiens
acagcauaugcaaaggc

SEQ ID NO: 1671211 - RNA, 12 nt, Homo sapiens
acagcaugcauu

SEQ ID NO: 1671212 - RNA, 11 nt, Homo sapiens
acagcauuuca

SEQ ID NO: 1671213 - RNA, 14 nt, Homo sapiens
acagccuuaaaucc

SEQ ID NO: 1671214 - RNA, 17 nt, Homo sapiens
acagcgaagccagucca

SEQ ID NO: 1671215 - RNA, 19 nt, Homo sapiens
acagcggcuccacuaaaga

SEQ ID NO: 1671216 - RNA, 19 nt, Homo sapiens
acagcgucccuagcaguga

SEQ ID NO: 1671217 - RNA, 21 nt, Homo sapiens
acagcucaccaacuacagaaa

SEQ ID NO: 1671218 - RNA, 19 nt, Homo sapiens
acagcucagaaaaucaaag

SEQ ID NO: 1671219 - RNA, 19 nt, Homo sapiens
acagcugggguggggaccu

SEQ ID NO: 1671220 - RNA, 20 nt, Homo sapiens
acaggaaguacuggagaaaa

SEQ ID NO: 1671221 - RNA, 17 nt, Homo sapiens
acaggagcguguacuac

SEQ ID NO: 1671222 - RNA, 20 nt, Homo sapiens
acaggaggcaagcaagcucu

SEQ ID NO: 1671223 - RNA, 15 nt, Homo sapiens
acaggccaggacaaa

SEQ ID NO: 1671224 - RNA, 20 nt, Homo sapiens
acaggccugauaacucugua

SEQ ID NO: 1671225 - RNA, 15 nt, Homo sapiens
acaggcucugaccag

SEQ ID NO: 1671226 - RNA, 15 nt, Homo sapiens
acaggcugcugucca

SEQ ID NO: 1671227 - RNA, 19 nt, Homo sapiens
acaggcuguucugcacuga

SEQ ID NO: 1671228 - RNA, 21 nt, Homo sapiens
acaggcuguucugcacugaaa

SEQ ID NO: 1671229 - RNA, 15 nt, Homo sapiens
acaggugugagccac

SEQ ID NO: 1671230 - RNA, 12 nt, Homo sapiens
acaguaauguca

SEQ ID NO: 1671231 - RNA, 19 nt, Homo sapiens
acaguacucaggcagugca

SEQ ID NO: 1671232 - RNA, 23 nt, Homo sapiens
acaguacucaguuaggcagugca

SEQ ID NO: 1671233 - RNA, 20 nt, Homo sapiens
acaguagcauacugaugaga

SEQ ID NO: 1671234 - RNA, 19 nt, Homo sapiens
acaguauagauaaauccaa

SEQ ID NO: 1671235 - RNA, 18 nt, Homo sapiens
acagucagccaguggcuu

SEQ ID NO: 1671236 - RNA, 15 nt, Homo sapiens
acaguggcaguauug

SEQ ID NO: 1671237 - RNA, 17 nt, Homo sapiens
acaguguaguacucagu

SEQ ID NO: 1671238 - RNA, 16 nt, Homo sapiens
acaguguuuccaguga

SEQ ID NO: 1671239 - RNA, 16 nt, Homo sapiens
acaguucuacagaaaa

SEQ ID NO: 1671240 - RNA, 17 nt, Homo sapiens
acaguuggaacaguaau

SEQ ID NO: 1671241 - RNA, 23 nt, Homo sapiens
acaguugguuuugcaugucugca

SEQ ID NO: 1671242 - RNA, 18 nt, Homo sapiens
acauaaaaucgcuuucaa

SEQ ID NO: 1671243 - RNA, 18 nt, Homo sapiens
acauaacacacaucaguc

SEQ ID NO: 1671244 - RNA, 18 nt, Homo sapiens
acauaacaggcauugcac

SEQ ID NO: 1671245 - RNA, 19 nt, Homo sapiens
acauacgaaacacaaacca

SEQ ID NO: 1671246 - RNA, 23 nt, Homo sapiens
acauagcuuuagagaagccauaa

SEQ ID NO: 1671247 - RNA, 14 nt, Homo sapiens
acauaucauucaga

SEQ ID NO: 1671248 - RNA, 23 nt, Homo sapiens
acauaucauucagaaugugcaaa

SEQ ID NO: 1671249 - RNA, 23 nt, Homo sapiens
acauauucccaugguagacugug

SEQ ID NO: 1671250 - RNA, 16 nt, Homo sapiens
acaucagcacugccaa

SEQ ID NO: 1671251 - RNA, 22 nt, Homo sapiens
acaucauaaacaaagaguagaa

SEQ ID NO: 1671252 - RNA, 19 nt, Homo sapiens
acaucuguauaucagcucu

SEQ ID NO: 1671253 - RNA, 23 nt, Homo sapiens
acaugaacguuuucucuucaccg

SEQ ID NO: 1671254 - RNA, 17 nt, Homo sapiens
acaugccucucucaggc

SEQ ID NO: 1671255 - RNA, 19 nt, Homo sapiens
acaugccuugaaaccagaa

SEQ ID NO: 1671256 - RNA, 22 nt, Homo sapiens
acaugcucaucccaaaagcuag

SEQ ID NO: 1671257 - RNA, 14 nt, Homo sapiens
acauggaaggugau

SEQ ID NO: 1671258 - RNA, 22 nt, Homo sapiens
acauggacuacacacaauacag

SEQ ID NO: 1671259 - RNA, 15 nt, Homo sapiens
acaugguuaccucug

SEQ ID NO: 1671260 - RNA, 15 nt, Homo sapiens
acaugugauugugau

SEQ ID NO: 1671261 - RNA, 18 nt, Homo sapiens
acauuaacaaaagcaauu

SEQ ID NO: 1671262 - RNA, 19 nt, Homo sapiens
acauuaauugaggcuuaca

SEQ ID NO: 1671263 - RNA, 13 nt, Homo sapiens
acauuagugccau

SEQ ID NO: 1671264 - RNA, 15 nt, Homo sapiens
acauucacacagaga

SEQ ID NO: 1671265 - RNA, 17 nt, Homo sapiens
acauucacuacugcaaa

SEQ ID NO: 1671266 - RNA, 17 nt, Homo sapiens
acauuucccugcugagu

SEQ ID NO: 1671267 - RNA, 17 nt, Homo sapiens
accaaaccauuauucau

SEQ ID NO: 1671268 - RNA, 16 nt, Homo sapiens
accaaaugacaaguca

SEQ ID NO: 1671269 - RNA, 22 nt, Homo sapiens
accaaaugccuuucuagcaauu

SEQ ID NO: 1671270 - RNA, 14 nt, Homo sapiens
accaaccaaugaaa

SEQ ID NO: 1671271 - RNA, 14 nt, Homo sapiens
accaaccacugcga

SEQ ID NO: 1671272 - RNA, 15 nt, Homo sapiens
accaacuacagaaag

SEQ ID NO: 1671273 - RNA, 23 nt, Homo sapiens
accaagaauucuccaaaacaauu

SEQ ID NO: 1671274 - RNA, 19 nt, Homo sapiens
accaagcaggcaaggcaag

SEQ ID NO: 1671275 - RNA, 14 nt, Homo sapiens
accaagcucugucc

SEQ ID NO: 1671276 - RNA, 15 nt, Homo sapiens
accaagcucugucca

SEQ ID NO: 1671277 - RNA, 16 nt, Homo sapiens
accaagcucuguccaa

SEQ ID NO: 1671278 - RNA, 17 nt, Homo sapiens
accacaacccuguugcu

SEQ ID NO: 1671279 - RNA, 20 nt, Homo sapiens
accacaacccuguugcuaca

SEQ ID NO: 1671280 - RNA, 20 nt, Homo sapiens
accacaacugacacaggaaa

SEQ ID NO: 1671281 - RNA, 21 nt, Homo sapiens
accacaacugacacaggaaac

SEQ ID NO: 1671282 - RNA, 16 nt, Homo sapiens
accacaaggggcucca

SEQ ID NO: 1671283 - RNA, 21 nt, Homo sapiens
accacacacacccuuccccac

SEQ ID NO: 1671284 - RNA, 21 nt, Homo sapiens
accaccuggauggaucugcuc

SEQ ID NO: 1671285 - RNA, 20 nt, Homo sapiens
accacugugucccagugucu

SEQ ID NO: 1671286 - RNA, 19 nt, Homo sapiens
accacuuccuuaacagcug

SEQ ID NO: 1671287 - RNA, 12 nt, Homo sapiens
accagagauuuu

SEQ ID NO: 1671288 - RNA, 19 nt, Homo sapiens
accagagcugccaccugcc

SEQ ID NO: 1671289 - RNA, 14 nt, Homo sapiens
accagaguguaugc

SEQ ID NO: 1671290 - RNA, 15 nt, Homo sapiens
accagcaacauuaua

SEQ ID NO: 1671291 - RNA, 21 nt, Homo sapiens
accagcuaucugucaucucuc

SEQ ID NO: 1671292 - RNA, 19 nt, Homo sapiens
accaggccuccaagccagg

SEQ ID NO: 1671293 - RNA, 19 nt, Homo sapiens
accagggacugcagcugca

SEQ ID NO: 1671294 - RNA, 11 nt, Homo sapiens
accagggaugg

SEQ ID NO: 1671295 - RNA, 18 nt, Homo sapiens
accagucugaaguuucau

SEQ ID NO: 1671296 - RNA, 22 nt, Homo sapiens
accauagcgcccaagcucagcu

SEQ ID NO: 1671297 - RNA, 14 nt, Homo sapiens
accauccaguacuu

SEQ ID NO: 1671298 - RNA, 22 nt, Homo sapiens
accaucugcacuggcaucuagu

SEQ ID NO: 1671299 - RNA, 16 nt, Homo sapiens
accaugcucaaugaaa

SEQ ID NO: 1671300 - RNA, 20 nt, Homo sapiens
accaugugauaauugcguua

SEQ ID NO: 1671301 - RNA, 18 nt, Homo sapiens
accauuuagcacacugcu

SEQ ID NO: 1671302 - RNA, 17 nt, Homo sapiens
acccaacuccucuccuc

SEQ ID NO: 1671303 - RNA, 17 nt, Homo sapiens
acccaagagaguggaag

SEQ ID NO: 1671304 - RNA, 19 nt, Homo sapiens
acccaaguuggagugcagu

SEQ ID NO: 1671305 - RNA, 18 nt, Homo sapiens
acccacuucccugcaagg

SEQ ID NO: 1671306 - RNA, 16 nt, Homo sapiens
acccagacguggugcu

SEQ ID NO: 1671307 - RNA, 20 nt, Homo sapiens
acccagccccagguucaaug

SEQ ID NO: 1671308 - RNA, 18 nt, Homo sapiens
acccaucacugugucuca

SEQ ID NO: 1671309 - RNA, 21 nt, Homo sapiens
acccaugagcguccaggugau

SEQ ID NO: 1671310 - RNA, 17 nt, Homo sapiens
accccaagcgacagagu

SEQ ID NO: 1671311 - RNA, 14 nt, Homo sapiens
accccagagcagug

SEQ ID NO: 1671312 - RNA, 20 nt, Homo sapiens
accccaggacgcaugcaggg

SEQ ID NO: 1671313 - RNA, 16 nt, Homo sapiens
accccauccgcaucuc

SEQ ID NO: 1671314 - RNA, 21 nt, Homo sapiens
acccccugaauuucucacaaa

SEQ ID NO: 1671315 - RNA, 18 nt, Homo sapiens
accccgggcaagacuuuu

SEQ ID NO: 1671316 - RNA, 12 nt, Homo sapiens
accccuacagcc

SEQ ID NO: 1671317 - RNA, 19 nt, Homo sapiens
accccuacagccugcacac

SEQ ID NO: 1671318 - RNA, 16 nt, Homo sapiens
acccggaucuccaggc

SEQ ID NO: 1671319 - RNA, 17 nt, Homo sapiens
acccuacgaaagcacag

SEQ ID NO: 1671320 - RNA, 15 nt, Homo sapiens
acccuaucaucaguu

SEQ ID NO: 1671321 - RNA, 15 nt, Homo sapiens
acccucacucugcca

SEQ ID NO: 1671322 - RNA, 16 nt, Homo sapiens
acccucacucugccag

SEQ ID NO: 1671323 - RNA, 23 nt, Homo sapiens
agccacuauuguuagucucuuga

SEQ ID NO: 1671324 - RNA, 18 nt, Homo sapiens
agccagaggcucuaaugu

SEQ ID NO: 1671325 - RNA, 23 nt, Homo sapiens
agccagaggcucuaauguacaau

SEQ ID NO: 1671326 - RNA, 17 nt, Homo sapiens
agccaucgcaucauguu

SEQ ID NO: 1671327 - RNA, 22 nt, Homo sapiens
agccaucgcuuuugacccaaau

SEQ ID NO: 1671328 - RNA, 21 nt, Homo sapiens
agccauuuccacuacagugag

SEQ ID NO: 1671329 - RNA, 22 nt, Homo sapiens
agcccacccgccccagagacug

SEQ ID NO: 1671330 - RNA, 19 nt, Homo sapiens
agcccacugccuggaaagc

SEQ ID NO: 1671331 - RNA, 16 nt, Homo sapiens
agcccaugucaaucaa

SEQ ID NO: 1671332 - RNA, 13 nt, Homo sapiens
agccccccaugua

SEQ ID NO: 1671333 - RNA, 16 nt, Homo sapiens
agcccccuacugagaa

SEQ ID NO: 1671334 - RNA, 13 nt, Homo sapiens
agcccucacagcu

SEQ ID NO: 1671335 - RNA, 16 nt, Homo sapiens
agcccucuuucucucu

SEQ ID NO: 1671336 - RNA, 13 nt, Homo sapiens
agcccugcagcua

SEQ ID NO: 1671337 - RNA, 12 nt, Homo sapiens
agcccugcauuu

SEQ ID NO: 1671338 - RNA, 23 nt, Homo sapiens
agccuccacuuuggaucaggaaa

SEQ ID NO: 1671339 - RNA, 14 nt, Homo sapiens
agccucugugcugc

SEQ ID NO: 1671340 - RNA, 15 nt, Homo sapiens
agccucugugcugca

SEQ ID NO: 1671341 - RNA, 15 nt, Homo sapiens
agccugagucagggc

SEQ ID NO: 1671342 - RNA, 14 nt, Homo sapiens
agccugcaauaagg

SEQ ID NO: 1671343 - RNA, 19 nt, Homo sapiens
agccugcacacaccugccu

SEQ ID NO: 1671344 - RNA, 12 nt, Homo sapiens
agccugccuccc

SEQ ID NO: 1671345 - RNA, 14 nt, Homo sapiens
agccugcucccuag

SEQ ID NO: 1671346 - RNA, 20 nt, Homo sapiens
agccugcucccuagccagag

SEQ ID NO: 1671347 - RNA, 16 nt, Homo sapiens
agccuggucugugcau

SEQ ID NO: 1671348 - RNA, 19 nt, Homo sapiens
agccuguuuuaaaaaauac

SEQ ID NO: 1671349 - RNA, 19 nt, Homo sapiens
agccuuaaauccuuuacaa

SEQ ID NO: 1671350 - RNA, 19 nt, Homo sapiens
agccuuaagucuuacuguu

SEQ ID NO: 1671351 - RNA, 21 nt, Homo sapiens
agccuucuucccccagggucc

SEQ ID NO: 1671352 - RNA, 18 nt, Homo sapiens
agcgaauucccugagaua

SEQ ID NO: 1671353 - RNA, 18 nt, Homo sapiens
agcgagacuccaucucaa

SEQ ID NO: 1671354 - RNA, 14 nt, Homo sapiens
agcggcuuccccau

SEQ ID NO: 1671355 - RNA, 21 nt, Homo sapiens
agcgugcaguagagagcaaag

SEQ ID NO: 1671356 - RNA, 13 nt, Homo sapiens
agcguggggcuaa

SEQ ID NO: 1671357 - RNA, 16 nt, Homo sapiens
agcguguacuacccca

SEQ ID NO: 1671358 - RNA, 17 nt, Homo sapiens
agcguguacuaccccag

SEQ ID NO: 1671359 - RNA, 19 nt, Homo sapiens
agcuaacacuaaaagucac

SEQ ID NO: 1671360 - RNA, 21 nt, Homo sapiens
agcuaauuugugaaaguggca

SEQ ID NO: 1671361 - RNA, 19 nt, Homo sapiens
agcuaccaacuaaguugua

SEQ ID NO: 1671362 - RNA, 17 nt, Homo sapiens
agcuaguguuaauccag

SEQ ID NO: 1671363 - RNA, 18 nt, Homo sapiens
agcuaucccgggcaucca

SEQ ID NO: 1671364 - RNA, 16 nt, Homo sapiens
agcuaucugucaucuc

SEQ ID NO: 1671365 - RNA, 17 nt, Homo sapiens
agcucaccaacuacaga

SEQ ID NO: 1671366 - RNA, 19 nt, Homo sapiens
agcucagaaaaucaaagag

SEQ ID NO: 1671367 - RNA, 18 nt, Homo sapiens
agcucagggacuggcaca

SEQ ID NO: 1671368 - RNA, 15 nt, Homo sapiens
agcuccagugcuuua

SEQ ID NO: 1671369 - RNA, 21 nt, Homo sapiens
agcuccgaguggcucccgugu

SEQ ID NO: 1671370 - RNA, 22 nt, Homo sapiens
agcucguggugggugcucaaga

SEQ ID NO: 1671371 - RNA, 17 nt, Homo sapiens
agcucuaaagcagagau

SEQ ID NO: 1671372 - RNA, 17 nt, Homo sapiens
agcucugugggagacca

SEQ ID NO: 1671373 - RNA, 16 nt, Homo sapiens
agcugaaagauugauu

SEQ ID NO: 1671374 - RNA, 20 nt, Homo sapiens
agcugaagcguuacuacagc

SEQ ID NO: 1671375 - RNA, 22 nt, Homo sapiens
agcugacccccaggaacagcuu

SEQ ID NO: 1671376 - RNA, 21 nt, Homo sapiens
agcugauugggcaccugacca

SEQ ID NO: 1671377 - RNA, 23 nt, Homo sapiens
agcugauugggcaccugaccaca

SEQ ID NO: 1671378 - RNA, 17 nt, Homo sapiens
agcugcacuccaugagu

SEQ ID NO: 1671379 - RNA, 14 nt, Homo sapiens
agcugccaccugcc

SEQ ID NO: 1671380 - RNA, 16 nt, Homo sapiens
agcugcuguuuuuaga

SEQ ID NO: 1671381 - RNA, 15 nt, Homo sapiens
agcuggagaucuuaa

SEQ ID NO: 1671382 - RNA, 15 nt, Homo sapiens
agcuggagugcagug

SEQ ID NO: 1671383 - RNA, 18 nt, Homo sapiens
agcuggcaaacugugaau

SEQ ID NO: 1671384 - RNA, 16 nt, Homo sapiens
agcuggggauguuuag

SEQ ID NO: 1671385 - RNA, 20 nt, Homo sapiens
agcuggggggcuguccugag

SEQ ID NO: 1671386 - RNA, 22 nt, Homo sapiens
agcugggguggggaccucaggc

SEQ ID NO: 1671387 - RNA, 21 nt, Homo sapiens
agcuguaccggccacugcaac

SEQ ID NO: 1671388 - RNA, 10 nt, Homo sapiens
agcugugaaa

SEQ ID NO: 1671389 - RNA, 22 nt, Homo sapiens
agcugugugugcccguggugag

SEQ ID NO: 1671390 - RNA, 13 nt, Homo sapiens
agcuuaaugucuu

SEQ ID NO: 1671391 - RNA, 13 nt, Homo sapiens
agcuuaccugaca

SEQ ID NO: 1671392 - RNA, 15 nt, Homo sapiens
agcuuaccugacaca

SEQ ID NO: 1671393 - RNA, 21 nt, Homo sapiens
agcuucacuuaaaaucaaauu

SEQ ID NO: 1671394 - RNA, 21 nt, Homo sapiens
agcuugcagugagccgagaua

SEQ ID NO: 1671395 - RNA, 15 nt, Homo sapiens
agcuuggagugccac

SEQ ID NO: 1671396 - RNA, 17 nt, Homo sapiens
agcuuucugauacuuau

SEQ ID NO: 1671397 - RNA, 12 nt, Homo sapiens
agcuuuucugca

SEQ ID NO: 1671398 - RNA, 17 nt, Homo sapiens
agcuuuugguguuugag

SEQ ID NO: 1671399 - RNA, 19 nt, Homo sapiens
aggaaaaaaagcauguaug

SEQ ID NO: 1671400 - RNA, 16 nt, Homo sapiens
aggaaaauauugacaa

SEQ ID NO: 1671401 - RNA, 20 nt, Homo sapiens
aggaaaauauugacaaguuu

SEQ ID NO: 1671402 - RNA, 13 nt, Homo sapiens
aggaacaaagaca

SEQ ID NO: 1671403 - RNA, 23 nt, Homo sapiens
aggaacaaagacaaccacuggga

SEQ ID NO: 1671404 - RNA, 13 nt, Homo sapiens
aggaacacuggag

SEQ ID NO: 1671405 - RNA, 18 nt, Homo sapiens
aggaacauuggagccugc

SEQ ID NO: 1671406 - RNA, 18 nt, Homo sapiens
aggaacccaucacugugu

SEQ ID NO: 1671407 - RNA, 13 nt, Homo sapiens
aggaacugcuugu

SEQ ID NO: 1671408 - RNA, 16 nt, Homo sapiens
aggaacugcuugugca

SEQ ID NO: 1671409 - RNA, 21 nt, Homo sapiens
aggaacugcuugugcacugga

SEQ ID NO: 1671410 - RNA, 12 nt, Homo sapiens
aggaagaaggcc

SEQ ID NO: 1671411 - RNA, 12 nt, Homo sapiens
aggaagcacaga

SEQ ID NO: 1671412 - RNA, 20 nt, Homo sapiens
aggaagggaagagcauguaa

SEQ ID NO: 1671413 - RNA, 20 nt, Homo sapiens
aggaagggaccccacuggaa

SEQ ID NO: 1671414 - RNA, 15 nt, Homo sapiens
aggaaggguguugca

SEQ ID NO: 1671415 - RNA, 18 nt, Homo sapiens
aggaauaagaauggagca

SEQ ID NO: 1671416 - RNA, 13 nt, Homo sapiens
aggaaucaaagua

SEQ ID NO: 1671417 - RNA, 15 nt, Homo sapiens
aggacaaaaugcaaa

SEQ ID NO: 1671418 - RNA, 19 nt, Homo sapiens
aggacagcucagaaaauca

SEQ ID NO: 1671419 - RNA, 16 nt, Homo sapiens
aggagcuaaacaugcu

SEQ ID NO: 1671420 - RNA, 22 nt, Homo sapiens
aggaggaccuggggggggcaag

SEQ ID NO: 1671421 - RNA, 21 nt, Homo sapiens
aggaguuugggguaugggaga

SEQ ID NO: 1671422 - RNA, 16 nt, Homo sapiens
aggaugacuacagaca

SEQ ID NO: 1671423 - RNA, 14 nt, Homo sapiens
aggaugcaugcagg

SEQ ID NO: 1671424 - RNA, 14 nt, Homo sapiens
aggauguucuagca

SEQ ID NO: 1671425 - RNA, 24 nt, Homo sapiens
aggauucagcucaggaguaaggga

SEQ ID NO: 1671426 - RNA, 16 nt, Homo sapiens
aggcaaggaagggugu

SEQ ID NO: 1671427 - RNA, 13 nt, Homo sapiens
aggcaccaugcug

SEQ ID NO: 1671428 - RNA, 23 nt, Homo sapiens
aggcacccgcccuuuccuugccu

SEQ ID NO: 1671429 - RNA, 20 nt, Homo sapiens
aggcaccgccagaguguccu

SEQ ID NO: 1671430 - RNA, 12 nt, Homo sapiens
aggcacugagcg

SEQ ID NO: 1671431 - RNA, 11 nt, Homo sapiens
aggcagcacuu

SEQ ID NO: 1671432 - RNA, 15 nt, Homo sapiens
aggcaggaacacugg

SEQ ID NO: 1671433 - RNA, 17 nt, Homo sapiens
aggcaggaacacuggag

SEQ ID NO: 1671434 - RNA, 18 nt, Homo sapiens
aggcagggcaaaugacau

SEQ ID NO: 1671435 - RNA, 13 nt, Homo sapiens
aggcagugcagug

SEQ ID NO: 1671436 - RNA, 15 nt, Homo sapiens
aggcauccacuucac

SEQ ID NO: 1671437 - RNA, 18 nt, Homo sapiens
aggcauccaguaucuuga

SEQ ID NO: 1671438 - RNA, 21 nt, Homo sapiens
aggcaucuaagacauucacca

SEQ ID NO: 1671439 - RNA, 18 nt, Homo sapiens
aggcauugagacuucaag

SEQ ID NO: 1671440 - RNA, 13 nt, Homo sapiens
aggcccacucugu

SEQ ID NO: 1671441 - RNA, 13 nt, Homo sapiens
aggccucagggac

SEQ ID NO: 1671442 - RNA, 22 nt, Homo sapiens
aggccugggaccucccacugcc

SEQ ID NO: 1671443 - RNA, 19 nt, Homo sapiens
aggccuugcucacagcuga

SEQ ID NO: 1671444 - RNA, 19 nt, Homo sapiens
aggcggcaaagauccagcg

SEQ ID NO: 1671445 - RNA, 19 nt, Homo sapiens
cguaucuccuugauuacau

SEQ ID NO: 1671446 - RNA, 11 nt, Homo sapiens
cgucauguccu

SEQ ID NO: 1671447 - RNA, 18 nt, Homo sapiens
cgucccgggcacugucau

SEQ ID NO: 1671448 - RNA, 19 nt, Homo sapiens
cgucugggguggcucugca

SEQ ID NO: 1671449 - RNA, 13 nt, Homo sapiens
cgugcccccagcg

SEQ ID NO: 1671450 - RNA, 14 nt, Homo sapiens
cguggcaacugugg

SEQ ID NO: 1671451 - RNA, 15 nt, Homo sapiens
cguggccgcugccca

SEQ ID NO: 1671452 - RNA, 20 nt, Homo sapiens
cguggugagguugugcugcc

SEQ ID NO: 1671453 - RNA, 15 nt, Homo sapiens
cguguuucacagugg

SEQ ID NO: 1671454 - RNA, 15 nt, Homo sapiens
cguucuugccagcuu

SEQ ID NO: 1671455 - RNA, 15 nt, Homo sapiens
cguucuuucaaugcu

SEQ ID NO: 1671456 - RNA, 13 nt, Homo sapiens
cguuuuaugauuu

SEQ ID NO: 1671457 - RNA, 16 nt, Homo sapiens
cuaaaagugaugugau

SEQ ID NO: 1671458 - RNA, 20 nt, Homo sapiens
cuaaagaaaaacuaauguca

SEQ ID NO: 1671459 - RNA, 19 nt, Homo sapiens
cuaaauaucuagugcuaaa

SEQ ID NO: 1671460 - RNA, 15 nt, Homo sapiens
cuaaaugccuuugac

SEQ ID NO: 1671461 - RNA, 23 nt, Homo sapiens
cuaaguaaauuuucuuuaaguca

SEQ ID NO: 1671462 - RNA, 13 nt, Homo sapiens
cuaauccaugugc

SEQ ID NO: 1671463 - RNA, 17 nt, Homo sapiens
cuaaugcucguaucucc

SEQ ID NO: 1671464 - RNA, 21 nt, Homo sapiens
cuacaauacaacacauugaaa

SEQ ID NO: 1671465 - RNA, 13 nt, Homo sapiens
cuacacuguauua

SEQ ID NO: 1671466 - RNA, 20 nt, Homo sapiens
cuacagcaaagccuagccug

SEQ ID NO: 1671467 - RNA, 17 nt, Homo sapiens
cuacauuugcaugccuu

SEQ ID NO: 1671468 - RNA, 23 nt, Homo sapiens
cuacccagacucagagaccguga

SEQ ID NO: 1671469 - RNA, 18 nt, Homo sapiens
cuaccuauaaauggacuu

SEQ ID NO: 1671470 - RNA, 18 nt, Homo sapiens
cuaccuuauagagcacaa

SEQ ID NO: 1671471 - RNA, 14 nt, Homo sapiens
cuaccuuccaguca

SEQ ID NO: 1671472 - RNA, 18 nt, Homo sapiens
cuacuaauccucucugca

SEQ ID NO: 1671473 - RNA, 17 nt, Homo sapiens
cuacucgaguuacagac

SEQ ID NO: 1671474 - RNA, 18 nt, Homo sapiens
cuacucgaguuacagaca

SEQ ID NO: 1671475 - RNA, 21 nt, Homo sapiens
cuacugaacaguccaucuucu

SEQ ID NO: 1671476 - RNA, 17 nt, Homo sapiens
cuacuggagauaccaga

SEQ ID NO: 1671477 - RNA, 15 nt, Homo sapiens
cuagaagaauuucaa

SEQ ID NO: 1671478 - RNA, 18 nt, Homo sapiens
cuagagcuagaugugucu

SEQ ID NO: 1671479 - RNA, 16 nt, Homo sapiens
cuagagcuaugcacac

SEQ ID NO: 1671480 - RNA, 14 nt, Homo sapiens
cuagcaacaacuua

SEQ ID NO: 1671481 - RNA, 13 nt, Homo sapiens
cuagccaaucaga

SEQ ID NO: 1671482 - RNA, 17 nt, Homo sapiens
cuagccagaggcucuaa

SEQ ID NO: 1671483 - RNA, 14 nt, Homo sapiens
cuaggaggucucua

SEQ ID NO: 1671484 - RNA, 21 nt, Homo sapiens
cuagggcucuccaagcacuag

SEQ ID NO: 1671485 - RNA, 18 nt, Homo sapiens
cuaggugcccagucuuga

SEQ ID NO: 1671486 - RNA, 20 nt, Homo sapiens
cuagguugaaaauguuauag

SEQ ID NO: 1671487 - RNA, 14 nt, Homo sapiens
cuagguugcaaggu

SEQ ID NO: 1671488 - RNA, 22 nt, Homo sapiens
cuaguaccuuuuuuuagaaaca

SEQ ID NO: 1671489 - RNA, 16 nt, Homo sapiens
cuaguacucaguacua

SEQ ID NO: 1671490 - RNA, 14 nt, Homo sapiens
cuaguuccauccac

SEQ ID NO: 1671491 - RNA, 19 nt, Homo sapiens
cuauaccaccuucaauauc

SEQ ID NO: 1671492 - RNA, 18 nt, Homo sapiens
cuauagaauaaagccucu

SEQ ID NO: 1671493 - RNA, 12 nt, Homo sapiens
cuauauuuacug

SEQ ID NO: 1671494 - RNA, 21 nt, Homo sapiens
cuauauuuggauucacagccu

SEQ ID NO: 1671495 - RNA, 15 nt, Homo sapiens
cuaucaaagcacaua

SEQ ID NO: 1671496 - RNA, 12 nt, Homo sapiens
cuaucaguaaua

SEQ ID NO: 1671497 - RNA, 13 nt, Homo sapiens
cuaucaguaauag

SEQ ID NO: 1671498 - RNA, 21 nt, Homo sapiens
cuauccacagaaccuuuguca

SEQ ID NO: 1671499 - RNA, 19 nt, Homo sapiens
cuauccagccgcaaaucca

SEQ ID NO: 1671500 - RNA, 21 nt, Homo sapiens
cuaucccuggacgcaugcagg

SEQ ID NO: 1671501 - RNA, 16 nt, Homo sapiens
cuaucugguauuaaau

SEQ ID NO: 1671502 - RNA, 22 nt, Homo sapiens
cuaugcacaccaaauugcugag

SEQ ID NO: 1671503 - RNA, 21 nt, Homo sapiens
cuaugggagauuaaaaccaga

SEQ ID NO: 1671504 - RNA, 20 nt, Homo sapiens
cuaugguaaauaacugugac

SEQ ID NO: 1671505 - RNA, 21 nt, Homo sapiens
cuauggucgagacuguaggga

SEQ ID NO: 1671506 - RNA, 14 nt, Homo sapiens
cuaugugagcacaa

SEQ ID NO: 1671507 - RNA, 15 nt, Homo sapiens
cuauuaucuggguuu

SEQ ID NO: 1671508 - RNA, 16 nt, Homo sapiens
cuauuccuucuggccu

SEQ ID NO: 1671509 - RNA, 17 nt, Homo sapiens
cuauuuaaguggacugu

SEQ ID NO: 1671510 - RNA, 21 nt, Homo sapiens
cuauuucaccauguugccaau

SEQ ID NO: 1671511 - RNA, 13 nt, Homo sapiens
cucaaaaugcaaa

SEQ ID NO: 1671512 - RNA, 18 nt, Homo sapiens
cucaacauaacauaagcu

SEQ ID NO: 1671513 - RNA, 16 nt, Homo sapiens
cucaacuuacauaugu

SEQ ID NO: 1671514 - RNA, 22 nt, Homo sapiens
cucaacuuacauaugucuucaa

SEQ ID NO: 1671515 - RNA, 15 nt, Homo sapiens
cucaaugugcuguug

SEQ ID NO: 1671516 - RNA, 18 nt, Homo sapiens
cucaaugugcuguugauu

SEQ ID NO: 1671517 - RNA, 20 nt, Homo sapiens
cucacaugccacuggaaaca

SEQ ID NO: 1671518 - RNA, 14 nt, Homo sapiens
cucacccagccugg

SEQ ID NO: 1671519 - RNA, 16 nt, Homo sapiens
cucaccugaauaaggg

SEQ ID NO: 1671520 - RNA, 14 nt, Homo sapiens
cucaccugccccuc

SEQ ID NO: 1671521 - RNA, 20 nt, Homo sapiens
cucaccuucccuaguucuuu

SEQ ID NO: 1671522 - RNA, 14 nt, Homo sapiens
cucacgauuccagu

SEQ ID NO: 1671523 - RNA, 21 nt, Homo sapiens
cucacgauuccagugcaguag

SEQ ID NO: 1671524 - RNA, 13 nt, Homo sapiens
cucacugauauau

SEQ ID NO: 1671525 - RNA, 20 nt, Homo sapiens
cucacugccacuaaaaucca

SEQ ID NO: 1671526 - RNA, 12 nt, Homo sapiens
cucacuggagau

SEQ ID NO: 1671527 - RNA, 17 nt, Homo sapiens
cucagaacaauccgauu

SEQ ID NO: 1671528 - RNA, 19 nt, Homo sapiens
cucagaagucaguugcaaa

SEQ ID NO: 1671529 - RNA, 21 nt, Homo sapiens
cucagaauauuaagcacauua

SEQ ID NO: 1671530 - RNA, 16 nt, Homo sapiens
cucagauuccaccuag

SEQ ID NO: 1671531 - RNA, 18 nt, Homo sapiens
cucagcaaggaacauccc

SEQ ID NO: 1671532 - RNA, 13 nt, Homo sapiens
cucagcacauccg

SEQ ID NO: 1671533 - RNA, 18 nt, Homo sapiens
cucagcaggggaggguag

SEQ ID NO: 1671534 - RNA, 16 nt, Homo sapiens
cucagcucacugcaac

SEQ ID NO: 1671535 - RNA, 19 nt, Homo sapiens
cucaggaccacccugccaa

SEQ ID NO: 1671536 - RNA, 11 nt, Homo sapiens
cucaggaccau

SEQ ID NO: 1671537 - RNA, 22 nt, Homo sapiens
cucaggacccagggaaugccag

SEQ ID NO: 1671538 - RNA, 19 nt, Homo sapiens
cucaggagcacagccauag

SEQ ID NO: 1671539 - RNA, 13 nt, Homo sapiens
cucaggcaccugc

SEQ ID NO: 1671540 - RNA, 16 nt, Homo sapiens
cucaggcagugcagua

SEQ ID NO: 1671541 - RNA, 17 nt, Homo sapiens
cucaggcagugcaguac

SEQ ID NO: 1671542 - RNA, 21 nt, Homo sapiens
cucaguaaaucagugcaguac

SEQ ID NO: 1671543 - RNA, 17 nt, Homo sapiens
cucaguaacacagugca

SEQ ID NO: 1671544 - RNA, 19 nt, Homo sapiens
cucaguaacacagugcagu

SEQ ID NO: 1671545 - RNA, 17 nt, Homo sapiens
cucaguaacagugcagu

SEQ ID NO: 1671546 - RNA, 19 nt, Homo sapiens
cucaguaacagugcaguac

SEQ ID NO: 1671547 - RNA, 21 nt, Homo sapiens
cucaguaacagugcaguacuc

SEQ ID NO: 1671548 - RNA, 18 nt, Homo sapiens
cucaguaaccaugcaaaa

SEQ ID NO: 1671549 - RNA, 21 nt, Homo sapiens
cucaguaaggcagugcaguac

SEQ ID NO: 1671550 - RNA, 23 nt, Homo sapiens
cucaguaaggcagugcaguacuc

SEQ ID NO: 1671551 - RNA, 22 nt, Homo sapiens
cucaguaauacaauacaguacu

SEQ ID NO: 1671552 - RNA, 22 nt, Homo sapiens
cucaguaauacaguacaguacu

SEQ ID NO: 1671553 - RNA, 16 nt, Homo sapiens
cucagucagcccagug

SEQ ID NO: 1671554 - RNA, 24 nt, Homo sapiens
cucaguccacugcugaggacacuc

SEQ ID NO: 1671555 - RNA, 15 nt, Homo sapiens
cucaguggaucacac

SEQ ID NO: 1671556 - RNA, 22 nt, Homo sapiens
cucaguggaucacacacaugga

SEQ ID NO: 1671557 - RNA, 19 nt, Homo sapiens
cucaguuaggcagugcagu

SEQ ID NO: 1671558 - RNA, 14 nt, Homo sapiens
cucaguuggugcug

SEQ ID NO: 1671559 - RNA, 13 nt, Homo sapiens
cucauaacuagag

SEQ ID NO: 1671560 - RNA, 21 nt, Homo sapiens
cucauacagucucuauuugau

SEQ ID NO: 1671561 - RNA, 22 nt, Homo sapiens
cucaucaacaaagaaauauuau

SEQ ID NO: 1671562 - RNA, 16 nt, Homo sapiens
cucauccuccacugaa

SEQ ID NO: 1671563 - RNA, 22 nt, Homo sapiens
cucauggaucugcauaaccgca

SEQ ID NO: 1671564 - RNA, 18 nt, Homo sapiens
cucauuauuaccacuuag

SEQ ID NO: 1671565 - RNA, 12 nt, Homo sapiens
cucauucuugcc

SEQ ID NO: 1671566 - RNA, 19 nt, Homo sapiens
cucauuuauuuccauauua

SEQ ID NO: 1671567 - RNA, 14 nt, Homo sapiens
gaauaaaaugauua

SEQ ID NO: 1671568 - RNA, 12 nt, Homo sapiens
gaauaaagccuc

SEQ ID NO: 1671569 - RNA, 21 nt, Homo sapiens
gaauaaauaaguaaauacauu

SEQ ID NO: 1671570 - RNA, 13 nt, Homo sapiens
gaauaagaagcaa

SEQ ID NO: 1671571 - RNA, 16 nt, Homo sapiens
gaauaagaauggagca

SEQ ID NO: 1671572 - RNA, 12 nt, Homo sapiens
gaauaaugcugu

SEQ ID NO: 1671573 - RNA, 23 nt, Homo sapiens
gaauacuaauaaaauacauacua

SEQ ID NO: 1671574 - RNA, 15 nt, Homo sapiens
gaauauuauacuucu

SEQ ID NO: 1671575 - RNA, 20 nt, Homo sapiens
gaaucaacagaucaaugaca

SEQ ID NO: 1671576 - RNA, 20 nt, Homo sapiens
gaaucacucauuuauuucca

SEQ ID NO: 1671577 - RNA, 10 nt, Homo sapiens
gaaucauuug

SEQ ID NO: 1671578 - RNA, 20 nt, Homo sapiens
gaauccccgugcucacagua

SEQ ID NO: 1671579 - RNA, 19 nt, Homo sapiens
gaaugaaaggcaaugacaa

SEQ ID NO: 1671580 - RNA, 19 nt, Homo sapiens
gaaugaaugucagugugac

SEQ ID NO: 1671581 - RNA, 15 nt, Homo sapiens
gaaugacauugaacu

SEQ ID NO: 1671582 - RNA, 22 nt, Homo sapiens
gaaugaguuuccagcuaagccu

SEQ ID NO: 1671583 - RNA, 16 nt, Homo sapiens
gaaugaugugauacaa

SEQ ID NO: 1671584 - RNA, 14 nt, Homo sapiens
gaaugcacagugaa

SEQ ID NO: 1671585 - RNA, 23 nt, Homo sapiens
gaauggaauccuucccuggugau

SEQ ID NO: 1671586 - RNA, 21 nt, Homo sapiens
gaaugugugggcccaaggccc

SEQ ID NO: 1671587 - RNA, 19 nt, Homo sapiens
gaauguuguccugugucau

SEQ ID NO: 1671588 - RNA, 15 nt, Homo sapiens
gaauuaaaggugcca

SEQ ID NO: 1671589 - RNA, 13 nt, Homo sapiens
gaauuaaagucua

SEQ ID NO: 1671590 - RNA, 15 nt, Homo sapiens
gaauuaaagucuaca

SEQ ID NO: 1671591 - RNA, 17 nt, Homo sapiens
gaauuacauaacaggca

SEQ ID NO: 1671592 - RNA, 15 nt, Homo sapiens
gaauuagguaaugga

SEQ ID NO: 1671593 - RNA, 18 nt, Homo sapiens
gaauugugcaaccaucac

SEQ ID NO: 1671594 - RNA, 20 nt, Homo sapiens
gaauuguuuuuugcucuuuu

SEQ ID NO: 1671595 - RNA, 16 nt, Homo sapiens
gaauuuuaaaagcaua

SEQ ID NO: 1671596 - RNA, 23 nt, Homo sapiens
gaauuuuuuuuuuuaagcucaaa

SEQ ID NO: 1671597 - RNA, 14 nt, Homo sapiens
gacaaagagccaga

SEQ ID NO: 1671598 - RNA, 22 nt, Homo sapiens
gacaaagcgugguggacaugca

SEQ ID NO: 1671599 - RNA, 20 nt, Homo sapiens
gacaacauuuuucauagaua

SEQ ID NO: 1671600 - RNA, 22 nt, Homo sapiens
gacaagccaggcccucucugca

SEQ ID NO: 1671601 - RNA, 22 nt, Homo sapiens
gacaagugacuuauuugcucau

SEQ ID NO: 1671602 - RNA, 22 nt, Homo sapiens
gacaaguuuaaaggcuguguca

SEQ ID NO: 1671603 - RNA, 22 nt, Homo sapiens
gacaauaaaauggaaagguccu

SEQ ID NO: 1671604 - RNA, 19 nt, Homo sapiens
gacaauaaauuuuaucuca

SEQ ID NO: 1671605 - RNA, 17 nt, Homo sapiens
gacacacauauacauua

SEQ ID NO: 1671606 - RNA, 22 nt, Homo sapiens
gacacagcgucccuagcaguga

SEQ ID NO: 1671607 - RNA, 20 nt, Homo sapiens
gacacaggccgggacaaaac

SEQ ID NO: 1671608 - RNA, 15 nt, Homo sapiens
gacaccaccaaggcu

SEQ ID NO: 1671609 - RNA, 14 nt, Homo sapiens
gacacguucuugcc

SEQ ID NO: 1671610 - RNA, 21 nt, Homo sapiens
gacagccaagggcagaucaca

SEQ ID NO: 1671611 - RNA, 22 nt, Homo sapiens
gacagcucagaaaaucaaagag

SEQ ID NO: 1671612 - RNA, 12 nt, Homo sapiens
gacagcuucccc

SEQ ID NO: 1671613 - RNA, 22 nt, Homo sapiens
gacaggaggauucagcucagga

SEQ ID NO: 1671614 - RNA, 15 nt, Homo sapiens
gacaguaaagaccau

SEQ ID NO: 1671615 - RNA, 15 nt, Homo sapiens
gacagugaccccagu

SEQ ID NO: 1671616 - RNA, 16 nt, Homo sapiens
gacagugaccccaguc

SEQ ID NO: 1671617 - RNA, 21 nt, Homo sapiens
gacaguuaagagaaaugagcu

SEQ ID NO: 1671618 - RNA, 20 nt, Homo sapiens
gacaguuagagaugcugauu

SEQ ID NO: 1671619 - RNA, 14 nt, Homo sapiens
gacaugcacugacc

SEQ ID NO: 1671620 - RNA, 17 nt, Homo sapiens
gaccaggcaggcaaagg

SEQ ID NO: 1671621 - RNA, 19 nt, Homo sapiens
gaccaggcaggcaaaggcc

SEQ ID NO: 1671622 - RNA, 21 nt, Homo sapiens
gaccauaugcacaauuccaug

SEQ ID NO: 1671623 - RNA, 12 nt, Homo sapiens
gaccaugcauuc

SEQ ID NO: 1671624 - RNA, 14 nt, Homo sapiens
gaccauuuggucag

SEQ ID NO: 1671625 - RNA, 17 nt, Homo sapiens
gaccccaaguuauccac

SEQ ID NO: 1671626 - RNA, 15 nt, Homo sapiens
gaccgugaggccaga

SEQ ID NO: 1671627 - RNA, 16 nt, Homo sapiens
gaccucccacugcccc

SEQ ID NO: 1671628 - RNA, 15 nt, Homo sapiens
gacgagguuucacug

SEQ ID NO: 1671629 - RNA, 14 nt, Homo sapiens
gacggaaguggccu

SEQ ID NO: 1671630 - RNA, 22 nt, Homo sapiens
gacggcaguaaauccacaguga

SEQ ID NO: 1671631 - RNA, 15 nt, Homo sapiens
gacgugugaggaugu

SEQ ID NO: 1671632 - RNA, 17 nt, Homo sapiens
gacuacagaaguggaag

SEQ ID NO: 1671633 - RNA, 22 nt, Homo sapiens
gacuauaggcaugcgccaccau

SEQ ID NO: 1671634 - RNA, 12 nt, Homo sapiens
gacucagggcau

SEQ ID NO: 1671635 - RNA, 15 nt, Homo sapiens
gacugugacacagcu

SEQ ID NO: 1671636 - RNA, 13 nt, Homo sapiens
gacuuacuuagaa

SEQ ID NO: 1671637 - RNA, 13 nt, Homo sapiens
gacuucagacucu

SEQ ID NO: 1671638 - RNA, 15 nt, Homo sapiens
gacuucccaaggaaa

SEQ ID NO: 1671639 - RNA, 21 nt, Homo sapiens
gacuucuuuacuaacacuggc

SEQ ID NO: 1671640 - RNA, 17 nt, Homo sapiens
gacuucuuuuuggcauu

SEQ ID NO: 1671641 - RNA, 11 nt, Homo sapiens
gacuugccacu

SEQ ID NO: 1671642 - RNA, 14 nt, Homo sapiens
gacuuggaaauggg

SEQ ID NO: 1671643 - RNA, 18 nt, Homo sapiens
gagaaaaagcccucuuca

SEQ ID NO: 1671644 - RNA, 21 nt, Homo sapiens
gagaaaacaggcucacagaga

SEQ ID NO: 1671645 - RNA, 12 nt, Homo sapiens
gagaaaugagcu

SEQ ID NO: 1671646 - RNA, 13 nt, Homo sapiens
gagaaaugagcug

SEQ ID NO: 1671647 - RNA, 16 nt, Homo sapiens
gagaacagaaauccac

SEQ ID NO: 1671648 - RNA, 14 nt, Homo sapiens
gagaaccaaccaag

SEQ ID NO: 1671649 - RNA, 12 nt, Homo sapiens
gagaacugcuga

SEQ ID NO: 1671650 - RNA, 15 nt, Homo sapiens
gagaagaaacagcag

SEQ ID NO: 1671651 - RNA, 18 nt, Homo sapiens
gagaagagaaugcacaaa

SEQ ID NO: 1671652 - RNA, 11 nt, Homo sapiens
gagacacaucu

SEQ ID NO: 1671653 - RNA, 14 nt, Homo sapiens
gagacagaaucuca

SEQ ID NO: 1671654 - RNA, 19 nt, Homo sapiens
gagacagaaucucagucug

SEQ ID NO: 1671655 - RNA, 18 nt, Homo sapiens
gagacaguugguuuugca

SEQ ID NO: 1671656 - RNA, 21 nt, Homo sapiens
gagaccaacuacgacuggcau

SEQ ID NO: 1671657 - RNA, 16 nt, Homo sapiens
gagaccacuuccuuaa

SEQ ID NO: 1671658 - RNA, 20 nt, Homo sapiens
gagacggguuucaccauguu

SEQ ID NO: 1671659 - RNA, 14 nt, Homo sapiens
gagacuauguguca

SEQ ID NO: 1671660 - RNA, 14 nt, Homo sapiens
gagagaacagggau

SEQ ID NO: 1671661 - RNA, 19 nt, Homo sapiens
gagagaaucaacagaucaa

SEQ ID NO: 1671662 - RNA, 15 nt, Homo sapiens
gagagauaugccugg

SEQ ID NO: 1671663 - RNA, 22 nt, Homo sapiens
gagagcaaucuugcugugaaac

SEQ ID NO: 1671664 - RNA, 14 nt, Homo sapiens
gagagcagccucuu

SEQ ID NO: 1671665 - RNA, 23 nt, Homo sapiens
gagagcugcccacaacuugccaa

SEQ ID NO: 1671666 - RNA, 13 nt, Homo sapiens
gagaggacuggag

SEQ ID NO: 1671667 - RNA, 12 nt, Homo sapiens
gagagggcugcu

SEQ ID NO: 1671668 - RNA, 22 nt, Homo sapiens
gagagggugugggugcccuguu

SEQ ID NO: 1671669 - RNA, 16 nt, Homo sapiens
gagaguaucugagaac

SEQ ID NO: 1671670 - RNA, 23 nt, Homo sapiens
gagaguguggggaaugggaagaa

SEQ ID NO: 1671671 - RNA, 17 nt, Homo sapiens
gagauaacauuuccaaa

SEQ ID NO: 1671672 - RNA, 13 nt, Homo sapiens
gagaugacaggaa

SEQ ID NO: 1671673 - RNA, 24 nt, Homo sapiens
gagaugauaaucccauacucucaa

SEQ ID NO: 1671674 - RNA, 12 nt, Homo sapiens
gagaugcugauu

SEQ ID NO: 1671675 - RNA, 11 nt, Homo sapiens
gagauggacca

SEQ ID NO: 1671676 - RNA, 17 nt, Homo sapiens
gagauucccaucugaua

SEQ ID NO: 1671677 - RNA, 15 nt, Homo sapiens
gagcacagcagggga

SEQ ID NO: 1671678 - RNA, 15 nt, Homo sapiens
gagcacaucucuuca

SEQ ID NO: 1671679 - RNA, 13 nt, Homo sapiens
gagcaggcuucuu

SEQ ID NO: 1671680 - RNA, 11 nt, Homo sapiens
gagcagugggg

SEQ ID NO: 1671681 - RNA, 21 nt, Homo sapiens
gagcaugcucaguuggugcug

SEQ ID NO: 1671682 - RNA, 23 nt, Homo sapiens
gagcaugcucaguuggugcugcu

SEQ ID NO: 1671683 - RNA, 11 nt, Homo sapiens
gagccacagaa

SEQ ID NO: 1671684 - RNA, 20 nt, Homo sapiens
gagccaccgcgccuggccaa

SEQ ID NO: 1671685 - RNA, 13 nt, Homo sapiens
gagccaugcucuu

SEQ ID NO: 1671686 - RNA, 23 nt, Homo sapiens
gagccucccccucagaugaucuc

SEQ ID NO: 1671687 - RNA, 17 nt, Homo sapiens
gagccuccugcccuuac

SEQ ID NO: 1671688 - RNA, 16 nt, Homo sapiens
gagcuaugauaugugc

SEQ ID NO: 1671689 - RNA, 19 nt, Homo sapiens
gagcuaugauaugugcuug

SEQ ID NO: 1671690 - RNA, 17 nt, Homo sapiens
gcuuuggguagugccau

SEQ ID NO: 1671691 - RNA, 23 nt, Homo sapiens
gcuuugugcuuguucuuccucuu

SEQ ID NO: 1671692 - RNA, 15 nt, Homo sapiens
gcuuuuguacguuaa

SEQ ID NO: 1671693 - RNA, 22 nt, Homo sapiens
ggaaaaaaaaaaauaugagauu

SEQ ID NO: 1671694 - RNA, 18 nt, Homo sapiens
ggaaaaaggcuucuccac

SEQ ID NO: 1671695 - RNA, 14 nt, Homo sapiens
ggaaaaauguuucc

SEQ ID NO: 1671696 - RNA, 20 nt, Homo sapiens
ggaaaacaaauauuucacuu

SEQ ID NO: 1671697 - RNA, 11 nt, Homo sapiens
ggaaaacuguu

SEQ ID NO: 1671698 - RNA, 15 nt, Homo sapiens
ggaaacaaagcaaua

SEQ ID NO: 1671699 - RNA, 20 nt, Homo sapiens
ggaaacaaggaaggacauuu

SEQ ID NO: 1671700 - RNA, 21 nt, Homo sapiens
ggaaacacuuugaggacauuu

SEQ ID NO: 1671701 - RNA, 15 nt, Homo sapiens
ggaaagcagugcagu

SEQ ID NO: 1671702 - RNA, 16 nt, Homo sapiens
ggaaagcagugcagua

SEQ ID NO: 1671703 - RNA, 15 nt, Homo sapiens
ggaaagccucacuga

SEQ ID NO: 1671704 - RNA, 16 nt, Homo sapiens
ggaaagccuuccucaa

SEQ ID NO: 1671705 - RNA, 15 nt, Homo sapiens
ggaaauaucugugaa

SEQ ID NO: 1671706 - RNA, 14 nt, Homo sapiens
ggaacaaaucucuc

SEQ ID NO: 1671707 - RNA, 16 nt, Homo sapiens
ggaacagagucauauu

SEQ ID NO: 1671708 - RNA, 14 nt, Homo sapiens
ggaacugcuugugc

SEQ ID NO: 1671709 - RNA, 11 nt, Homo sapiens
ggaagaagcaa

SEQ ID NO: 1671710 - RNA, 20 nt, Homo sapiens
ggaagagcugcuguauuuga

SEQ ID NO: 1671711 - RNA, 16 nt, Homo sapiens
ggaagaggagaugaca

SEQ ID NO: 1671712 - RNA, 21 nt, Homo sapiens
ggaagcacaugccucucucag

SEQ ID NO: 1671713 - RNA, 21 nt, Homo sapiens
ggaaugauaauggaaacuguc

SEQ ID NO: 1671714 - RNA, 23 nt, Homo sapiens
ggaaugccagggacauuuucaag

SEQ ID NO: 1671715 - RNA, 20 nt, Homo sapiens
ggaaugggaagaagcaguuu

SEQ ID NO: 1671716 - RNA, 18 nt, Homo sapiens
ggaaugggccaagccagg

SEQ ID NO: 1671717 - RNA, 23 nt, Homo sapiens
ggaauugaagacacguucuugcc

SEQ ID NO: 1671718 - RNA, 19 nt, Homo sapiens
ggacacauaguguuuguaa

SEQ ID NO: 1671719 - RNA, 21 nt, Homo sapiens
ggacagccaagggcagaucac

SEQ ID NO: 1671720 - RNA, 16 nt, Homo sapiens
ggacaggcaccaugcu

SEQ ID NO: 1671721 - RNA, 16 nt, Homo sapiens
ggaccagagcugccac

SEQ ID NO: 1671722 - RNA, 18 nt, Homo sapiens
ggaccccagauaccugug

SEQ ID NO: 1671723 - RNA, 12 nt, Homo sapiens
ggacgcaugcag

SEQ ID NO: 1671724 - RNA, 22 nt, Homo sapiens
ggacuaaccccaacgcacagga

SEQ ID NO: 1671725 - RNA, 13 nt, Homo sapiens
ggacuuccauuug

SEQ ID NO: 1671726 - RNA, 13 nt, Homo sapiens
ggagaaaauggac

SEQ ID NO: 1671727 - RNA, 20 nt, Homo sapiens
ggagaaguguguucugauga

SEQ ID NO: 1671728 - RNA, 17 nt, Homo sapiens
ggagacuuggaugucau

SEQ ID NO: 1671729 - RNA, 19 nt, Homo sapiens
ggagcaaggcugcuaagug

SEQ ID NO: 1671730 - RNA, 23 nt, Homo sapiens
ggagccauaagggacaugucuuu

SEQ ID NO: 1671731 - RNA, 14 nt, Homo sapiens
ggagcccucaucuu

SEQ ID NO: 1671732 - RNA, 13 nt, Homo sapiens
ggagccugcaaua

SEQ ID NO: 1671733 - RNA, 14 nt, Homo sapiens
ggaggaacugcuug

SEQ ID NO: 1671734 - RNA, 20 nt, Homo sapiens
ggaggagcacacauccaaga

SEQ ID NO: 1671735 - RNA, 19 nt, Homo sapiens
ggagguggagcuugcagug

SEQ ID NO: 1671736 - RNA, 20 nt, Homo sapiens
ggagguggagcuugcaguga

SEQ ID NO: 1671737 - RNA, 11 nt, Homo sapiens
ggagugccacg

SEQ ID NO: 1671738 - RNA, 21 nt, Homo sapiens
ggaguuccucaucagugucau

SEQ ID NO: 1671739 - RNA, 17 nt, Homo sapiens
ggauaggagcuuccaga

SEQ ID NO: 1671740 - RNA, 12 nt, Homo sapiens
ggauaugagaug

SEQ ID NO: 1671741 - RNA, 16 nt, Homo sapiens
ggauccgaagugcaau

SEQ ID NO: 1671742 - RNA, 22 nt, Homo sapiens
ggaugaaaaaauaacacuguac

SEQ ID NO: 1671743 - RNA, 16 nt, Homo sapiens
ggaugaccauaugcac

SEQ ID NO: 1671744 - RNA, 18 nt, Homo sapiens
ggaugaccauaugcacaa

SEQ ID NO: 1671745 - RNA, 20 nt, Homo sapiens
ggauggagugcaguggcuca

SEQ ID NO: 1671746 - RNA, 21 nt, Homo sapiens
ggauguucaacuuaaugaaga

SEQ ID NO: 1671747 - RNA, 19 nt, Homo sapiens
ggauucacuucuauuuauu

SEQ ID NO: 1671748 - RNA, 22 nt, Homo sapiens
ggauuccucuaagaucuugccu

SEQ ID NO: 1671749 - RNA, 17 nt, Homo sapiens
ggauucuuauggacaau

SEQ ID NO: 1671750 - RNA, 19 nt, Homo sapiens
ggauugucugcugccucca

SEQ ID NO: 1671751 - RNA, 15 nt, Homo sapiens
ggauuuaccaaauag

SEQ ID NO: 1671752 - RNA, 22 nt, Homo sapiens
ggauuuucaaagauuguuggca

SEQ ID NO: 1671753 - RNA, 15 nt, Homo sapiens
ggcaaaugacaugca

SEQ ID NO: 1671754 - RNA, 18 nt, Homo sapiens
ggcaagacaccuucccag

SEQ ID NO: 1671755 - RNA, 14 nt, Homo sapiens
ggcaaucuugcccu

SEQ ID NO: 1671756 - RNA, 13 nt, Homo sapiens
ggcacagccagaa

SEQ ID NO: 1671757 - RNA, 12 nt, Homo sapiens
ggcacaggccag

SEQ ID NO: 1671758 - RNA, 21 nt, Homo sapiens
ggcacccagcccaaccgggaa

SEQ ID NO: 1671759 - RNA, 22 nt, Homo sapiens
ggcacucaggugugggccgaac

SEQ ID NO: 1671760 - RNA, 23 nt, Homo sapiens
ggcagaaaaccuaccacauucac

SEQ ID NO: 1671761 - RNA, 19 nt, Homo sapiens
ggcagaaaugccgggcaca

SEQ ID NO: 1671762 - RNA, 14 nt, Homo sapiens
ggcagaaccugaaa

SEQ ID NO: 1671763 - RNA, 23 nt, Homo sapiens
ggcagaauaaaccggauccuguu

SEQ ID NO: 1671764 - RNA, 16 nt, Homo sapiens
ggcagaauggugggcu

SEQ ID NO: 1671765 - RNA, 16 nt, Homo sapiens
ggcagaggccaugaag

SEQ ID NO: 1671766 - RNA, 22 nt, Homo sapiens
ggcagauaucuauggcagcaca

SEQ ID NO: 1671767 - RNA, 13 nt, Homo sapiens
ggcagcacaggaa

SEQ ID NO: 1671768 - RNA, 13 nt, Homo sapiens
ggcagcaucccaa

SEQ ID NO: 1671769 - RNA, 22 nt, Homo sapiens
ggcagccccuccccauggugca

SEQ ID NO: 1671770 - RNA, 21 nt, Homo sapiens
ggcagcuccccaaaccaggcc

SEQ ID NO: 1671771 - RNA, 12 nt, Homo sapiens
ggcaggcagcug

SEQ ID NO: 1671772 - RNA, 14 nt, Homo sapiens
ggcaggccucccaa

SEQ ID NO: 1671773 - RNA, 12 nt, Homo sapiens
ggcagugcagua

SEQ ID NO: 1671774 - RNA, 18 nt, Homo sapiens
ggcaucuaagacauucac

SEQ ID NO: 1671775 - RNA, 18 nt, Homo sapiens
ggcaugggaaugaauguc

SEQ ID NO: 1671776 - RNA, 17 nt, Homo sapiens
ggcauuauaaagaacag

SEQ ID NO: 1671777 - RNA, 13 nt, Homo sapiens
ggcauuucacaaa

SEQ ID NO: 1671778 - RNA, 18 nt, Homo sapiens
ggccacucuugaccugga

SEQ ID NO: 1671779 - RNA, 16 nt, Homo sapiens
ggccacugcaacccau

SEQ ID NO: 1671780 - RNA, 19 nt, Homo sapiens
ggccaggacaaaaugcaaa

SEQ ID NO: 1671781 - RNA, 19 nt, Homo sapiens
ggccaggacaaaaugcaga

SEQ ID NO: 1671782 - RNA, 12 nt, Homo sapiens
ggccauguauua

SEQ ID NO: 1671783 - RNA, 20 nt, Homo sapiens
ggccauguucccagaaccuu

SEQ ID NO: 1671784 - RNA, 19 nt, Homo sapiens
ggccauuugugauacuucc

SEQ ID NO: 1671785 - RNA, 21 nt, Homo sapiens
ggccccacccuuuccucuuaa

SEQ ID NO: 1671786 - RNA, 17 nt, Homo sapiens
ggcccccaucacacucg

SEQ ID NO: 1671787 - RNA, 13 nt, Homo sapiens
ggccucagggacc

SEQ ID NO: 1671788 - RNA, 14 nt, Homo sapiens
ggccucccaagcug

SEQ ID NO: 1671789 - RNA, 23 nt, Homo sapiens
ggccugggugugaccugacaccu

SEQ ID NO: 1671790 - RNA, 17 nt, Homo sapiens
ggccuucuccacaggga

SEQ ID NO: 1671791 - RNA, 18 nt, Homo sapiens
ggcgacugugaaacugga

SEQ ID NO: 1671792 - RNA, 18 nt, Homo sapiens
ggcuaagaggcugcugaa

SEQ ID NO: 1671793 - RNA, 14 nt, Homo sapiens
ggcucacaugccac

SEQ ID NO: 1671794 - RNA, 23 nt, Homo sapiens
ggcucaccuuugggcaaaggccc

SEQ ID NO: 1671795 - RNA, 18 nt, Homo sapiens
ggcucccacuucuuggga

SEQ ID NO: 1671796 - RNA, 17 nt, Homo sapiens
ggcucuaauguacaaua

SEQ ID NO: 1671797 - RNA, 12 nt, Homo sapiens
ggcucucaggcc

SEQ ID NO: 1671798 - RNA, 15 nt, Homo sapiens
ggcugacucagugca

SEQ ID NO: 1671799 - RNA, 13 nt, Homo sapiens
ggcugauuuacua

SEQ ID NO: 1671800 - RNA, 19 nt, Homo sapiens
ggcugcugaaaaccaucug

SEQ ID NO: 1671801 - RNA, 16 nt, Homo sapiens
ggcugcugcacugccc

SEQ ID NO: 1671802 - RNA, 14 nt, Homo sapiens
ggcuggagugcagu

SEQ ID NO: 1671803 - RNA, 15 nt, Homo sapiens
ggcuggaucucucga

SEQ ID NO: 1671804 - RNA, 20 nt, Homo sapiens
ggcugucagucguguugcuu

SEQ ID NO: 1671805 - RNA, 14 nt, Homo sapiens
ggcuucccaugucu

SEQ ID NO: 1671806 - RNA, 21 nt, Homo sapiens
ggcuuccugaugauggucauu

SEQ ID NO: 1671807 - RNA, 19 nt, Homo sapiens
ggcuucuauguccaacaga

SEQ ID NO: 1671808 - RNA, 21 nt, Homo sapiens
ggcuucuucaugauggugguu

SEQ ID NO: 1671809 - RNA, 16 nt, Homo sapiens
ggcuuggaagggcgcu

SEQ ID NO: 1671810 - RNA, 14 nt, Homo sapiens
ggcuuggggaccag

SEQ ID NO: 1671811 - RNA, 21 nt, Homo sapiens
ggcuugggguagagaggacag

SEQ ID NO: 1671812 - RNA, 21 nt, Homo sapiens
ugugaaaugacugcaucaugc

SEQ ID NO: 1671813 - RNA, 23 nt, Homo sapiens
ugugaaauuuuuauuuguauuag

SEQ ID NO: 1671814 - RNA, 13 nt, Homo sapiens
ugugaagauuuca

SEQ ID NO: 1671815 - RNA, 18 nt, Homo sapiens
ugugaagauuucauggac

SEQ ID NO: 1671816 - RNA, 21 nt, Homo sapiens
ugugacaccaccacugugucc

SEQ ID NO: 1671817 - RNA, 15 nt, Homo sapiens
ugugagcagucucag

SEQ ID NO: 1671818 - RNA, 16 nt, Homo sapiens
ugugagcagucucagc

SEQ ID NO: 1671819 - RNA, 18 nt, Homo sapiens
ugugaucuauaccaccuu

SEQ ID NO: 1671820 - RNA, 16 nt, Homo sapiens
ugugaugcaugagcuc

SEQ ID NO: 1671821 - RNA, 17 nt, Homo sapiens
ugugcacacauuaggca

SEQ ID NO: 1671822 - RNA, 14 nt, Homo sapiens
ugugcagauaucac

SEQ ID NO: 1671823 - RNA, 15 nt, Homo sapiens
ugugcagcuuuccag

SEQ ID NO: 1671824 - RNA, 10 nt, Homo sapiens
ugugccuaac

SEQ ID NO: 1671825 - RNA, 15 nt, Homo sapiens
ugugcugccuguggu

SEQ ID NO: 1671826 - RNA, 19 nt, Homo sapiens
ugugcuugggaucuucaau

SEQ ID NO: 1671827 - RNA, 17 nt, Homo sapiens
ugugcuuugccacugaa

SEQ ID NO: 1671828 - RNA, 17 nt, Homo sapiens
uguggaaaacucacaga

SEQ ID NO: 1671829 - RNA, 20 nt, Homo sapiens
uguggacaaugaguggaaua

SEQ ID NO: 1671830 - RNA, 18 nt, Homo sapiens
uguggcacacaacugugg

SEQ ID NO: 1671831 - RNA, 19 nt, Homo sapiens
uguggccccacccuuuccu

SEQ ID NO: 1671832 - RNA, 15 nt, Homo sapiens
uguggcuuaguaaua

SEQ ID NO: 1671833 - RNA, 14 nt, Homo sapiens
uguggggaauggga

SEQ ID NO: 1671834 - RNA, 15 nt, Homo sapiens
uguggggaaugggaa

SEQ ID NO: 1671835 - RNA, 23 nt, Homo sapiens
uguggucugugugugacaccacc

SEQ ID NO: 1671836 - RNA, 16 nt, Homo sapiens
uguguacaaaauaucc

SEQ ID NO: 1671837 - RNA, 15 nt, Homo sapiens
uguguacacauauga

SEQ ID NO: 1671838 - RNA, 23 nt, Homo sapiens
uguguacacauaugaacgcacaa

SEQ ID NO: 1671839 - RNA, 20 nt, Homo sapiens
uguguacuucuucauccaua

SEQ ID NO: 1671840 - RNA, 17 nt, Homo sapiens
uguguaggaaaucugaa

SEQ ID NO: 1671841 - RNA, 16 nt, Homo sapiens
uguguauacauaugua

SEQ ID NO: 1671842 - RNA, 19 nt, Homo sapiens
ugugucacgugacccugug

SEQ ID NO: 1671843 - RNA, 20 nt, Homo sapiens
ugugucacgugacccugugc

SEQ ID NO: 1671844 - RNA, 15 nt, Homo sapiens
ugugucaucugucag

SEQ ID NO: 1671845 - RNA, 21 nt, Homo sapiens
uguguccccccuguggucugu

SEQ ID NO: 1671846 - RNA, 20 nt, Homo sapiens
ugugugacaccaccacugug

SEQ ID NO: 1671847 - RNA, 14 nt, Homo sapiens
ugugugaugucucc

SEQ ID NO: 1671848 - RNA, 17 nt, Homo sapiens
uguguucaaucugugaa

SEQ ID NO: 1671849 - RNA, 20 nt, Homo sapiens
uguguucucaacacacagua

SEQ ID NO: 1671850 - RNA, 21 nt, Homo sapiens
uguguuuuguccaaaacugua

SEQ ID NO: 1671851 - RNA, 19 nt, Homo sapiens
uguuaagggaagcugauac

SEQ ID NO: 1671852 - RNA, 22 nt, Homo sapiens
uguuaaguaacacucaccauca

SEQ ID NO: 1671853 - RNA, 18 nt, Homo sapiens
uguuagccacgauggucu

SEQ ID NO: 1671854 - RNA, 12 nt, Homo sapiens
uguuaugacucc

SEQ ID NO: 1671855 - RNA, 14 nt, Homo sapiens
uguucagaaaagca

SEQ ID NO: 1671856 - RNA, 17 nt, Homo sapiens
uguucaugcacacuugc

SEQ ID NO: 1671857 - RNA, 14 nt, Homo sapiens
uguuccuacuggag

SEQ ID NO: 1671858 - RNA, 15 nt, Homo sapiens
uguuccugacuguuc

SEQ ID NO: 1671859 - RNA, 16 nt, Homo sapiens
uguucugaaggucugg

SEQ ID NO: 1671860 - RNA, 14 nt, Homo sapiens
uguucugugucacg

SEQ ID NO: 1671861 - RNA, 19 nt, Homo sapiens
uguugaagaacucauguga

SEQ ID NO: 1671862 - RNA, 15 nt, Homo sapiens
uguugacagugccaa

SEQ ID NO: 1671863 - RNA, 17 nt, Homo sapiens
uguugaugaagcacauu

SEQ ID NO: 1671864 - RNA, 20 nt, Homo sapiens
uguugauucuagguugaaaa

SEQ ID NO: 1671865 - RNA, 14 nt, Homo sapiens
uguugcugcaucuc

SEQ ID NO: 1671866 - RNA, 15 nt, Homo sapiens
uguugcugcaucucc

SEQ ID NO: 1671867 - RNA, 20 nt, Homo sapiens
uguuggcuagacuagucuca

SEQ ID NO: 1671868 - RNA, 14 nt, Homo sapiens
uguuguuauggcaa

SEQ ID NO: 1671869 - RNA, 19 nt, Homo sapiens
uguuguucauagucaauca

SEQ ID NO: 1671870 - RNA, 16 nt, Homo sapiens
uguuucugaaugacau

SEQ ID NO: 1671871 - RNA, 16 nt, Homo sapiens
uguuucugcaguauuc

SEQ ID NO: 1671872 - RNA, 22 nt, Homo sapiens
uguuucuggaauugauauugaa

SEQ ID NO: 1671873 - RNA, 21 nt, Homo sapiens
uguuuuggaugaaugcaguau

SEQ ID NO: 1671874 - RNA, 16 nt, Homo sapiens
uuaaaaaucaguuugu

SEQ ID NO: 1671875 - RNA, 13 nt, Homo sapiens
uuaaaggugccag

SEQ ID NO: 1671876 - RNA, 17 nt, Homo sapiens
uuaaagucaggauuuau

SEQ ID NO: 1671877 - RNA, 17 nt, Homo sapiens
uuaaagucuacacugcc

SEQ ID NO: 1671878 - RNA, 18 nt, Homo sapiens
uuaaagucuacacugccu

SEQ ID NO: 1671879 - RNA, 20 nt, Homo sapiens
uuaaaugucuauaaauggug

SEQ ID NO: 1671880 - RNA, 14 nt, Homo sapiens
uuaacaauugccag

SEQ ID NO: 1671881 - RNA, 12 nt, Homo sapiens
uuaacuaacuca

SEQ ID NO: 1671882 - RNA, 20 nt, Homo sapiens
uuaacuccguuuccaaauac

SEQ ID NO: 1671883 - RNA, 17 nt, Homo sapiens
uuaacuuuaccaugcuc

SEQ ID NO: 1671884 - RNA, 18 nt, Homo sapiens
uuaagacaacaggcauuu

SEQ ID NO: 1671885 - RNA, 22 nt, Homo sapiens
uuaagaugcaaaucaacucucu

SEQ ID NO: 1671886 - RNA, 21 nt, Homo sapiens
uuaagauuccauuuuggaaaa

SEQ ID NO: 1671887 - RNA, 12 nt, Homo sapiens
uuaagcucaaaa

SEQ ID NO: 1671888 - RNA, 16 nt, Homo sapiens
uuaaggucaccugcac

SEQ ID NO: 1671889 - RNA, 23 nt, Homo sapiens
uuaauauaaaucguaaccuauga

SEQ ID NO: 1671890 - RNA, 11 nt, Homo sapiens
uuaaugcagau

SEQ ID NO: 1671891 - RNA, 16 nt, Homo sapiens
uuaaugcagauggcaa

SEQ ID NO: 1671892 - RNA, 14 nt, Homo sapiens
uuaaugucaucucu

SEQ ID NO: 1671893 - RNA, 20 nt, Homo sapiens
uuaauuaagucaccuguaua

SEQ ID NO: 1671894 - RNA, 23 nt, Homo sapiens
uuaauuuuucuguuggucuuaac

SEQ ID NO: 1671895 - RNA, 21 nt, Homo sapiens
uuacacuugggauugucuuac

SEQ ID NO: 1671896 - RNA, 21 nt, Homo sapiens
uuacagacagaauauacauau

SEQ ID NO: 1671897 - RNA, 15 nt, Homo sapiens
uuacagucacauuca

SEQ ID NO: 1671898 - RNA, 17 nt, Homo sapiens
uuacaguggcaguauug

SEQ ID NO: 1671899 - RNA, 19 nt, Homo sapiens
uuacaugcaugagcaccuu

SEQ ID NO: 1671900 - RNA, 17 nt, Homo sapiens
uuacccauaggucuuaa

SEQ ID NO: 1671901 - RNA, 18 nt, Homo sapiens
uuacccuccacacacuuc

SEQ ID NO: 1671902 - RNA, 21 nt, Homo sapiens
uuacgauuauaguaccacugc

SEQ ID NO: 1671903 - RNA, 12 nt, Homo sapiens
uuacuaaagaca

SEQ ID NO: 1671904 - RNA, 15 nt, Homo sapiens
uuacugauuaacuca

SEQ ID NO: 1671905 - RNA, 13 nt, Homo sapiens
uuagaaacaguga

SEQ ID NO: 1671906 - RNA, 14 nt, Homo sapiens
uuagaggagcccac

SEQ ID NO: 1671907 - RNA, 22 nt, Homo sapiens
uuagauuaacccuauuaaucua

SEQ ID NO: 1671908 - RNA, 15 nt, Homo sapiens
uuagauucacuuuga

SEQ ID NO: 1671909 - RNA, 18 nt, Homo sapiens
uuagcaaagcaugccaau

SEQ ID NO: 1671910 - RNA, 23 nt, Homo sapiens
uuagcacagaggauggcuucccc

SEQ ID NO: 1671911 - RNA, 15 nt, Homo sapiens
uuagcccacugccug

SEQ ID NO: 1671912 - RNA, 17 nt, Homo sapiens
uuagccgggccccaugg

SEQ ID NO: 1671913 - RNA, 16 nt, Homo sapiens
uuagcuuacugauuaa

SEQ ID NO: 1671914 - RNA, 19 nt, Homo sapiens
uuaggaaagcagugcagua

SEQ ID NO: 1671915 - RNA, 23 nt, Homo sapiens
uuaggaaagcagugcaguacuca

SEQ ID NO: 1671916 - RNA, 18 nt, Homo sapiens
uuaggauuuaccaaauag

SEQ ID NO: 1671917 - RNA, 20 nt, Homo sapiens
uuagguuauuuaagggugca

SEQ ID NO: 1671918 - RNA, 21 nt, Homo sapiens
uuaguaaaauuaucuguucua

SEQ ID NO: 1671919 - RNA, 15 nt, Homo sapiens
uuaguacauccucac

SEQ ID NO: 1671920 - RNA, 13 nt, Homo sapiens
uuaguaucucauc

SEQ ID NO: 1671921 - RNA, 15 nt, Homo sapiens
uuaguaucucaucaa

SEQ ID NO: 1671922 - RNA, 23 nt, Homo sapiens
uuaguauuugcccggggggaaaa

SEQ ID NO: 1671923 - RNA, 19 nt, Homo sapiens
uuagucaguguacucugag

SEQ ID NO: 1671924 - RNA, 16 nt, Homo sapiens
uuagucauaccaucca

SEQ ID NO: 1671925 - RNA, 18 nt, Homo sapiens
uuagucauaccauccauc

SEQ ID NO: 1671926 - RNA, 21 nt, Homo sapiens
uuagugguaaaugucacauug

SEQ ID NO: 1671927 - RNA, 20 nt, Homo sapiens
uuauauacuggaaauaaccu

SEQ ID NO: 1671928 - RNA, 19 nt, Homo sapiens
uuauauaugaaaacuaagu

SEQ ID NO: 1671929 - RNA, 21 nt, Homo sapiens
uuauaucagcagacacuccag

SEQ ID NO: 1671930 - RNA, 18 nt, Homo sapiens
uuauaucuguggucuuca

SEQ ID NO: 1671931 - RNA, 16 nt, Homo sapiens
uuauauuucaaccaca

SEQ ID NO: 1671932 - RNA, 17 nt, Homo sapiens
uuaucaguacaauucuu

SEQ ID NO: 1671933 - RNA, 11 nt, Homo sapiens
uuaucaugugu

SEQ ID NO: 1671934 - RNA, 22 nt, Homo sapiens
agacauaccucucaacuuacau

SEQ ID NO: 1671935 - RNA, 19 nt, Homo sapiens
agacauacgaaacacaaac

SEQ ID NO: 1671936 - RNA, 16 nt, Homo sapiens
agacaucuagucucag

SEQ ID NO: 1671937 - RNA, 15 nt, Homo sapiens
agacaugaaauugag

SEQ ID NO: 1671938 - RNA, 23 nt, Homo sapiens
agacaugaaauugagucauuuua

SEQ ID NO: 1671939 - RNA, 18 nt, Homo sapiens
agaccaggaggcugcaag

SEQ ID NO: 1671940 - RNA, 16 nt, Homo sapiens
agaccagggaacggaa

SEQ ID NO: 1671941 - RNA, 21 nt, Homo sapiens
agaccccuacccuuucccaaa

SEQ ID NO: 1671942 - RNA, 22 nt, Homo sapiens
agaccccugggggaggcuucca

SEQ ID NO: 1671943 - RNA, 15 nt, Homo sapiens
agacccgcccuuaga

SEQ ID NO: 1671944 - RNA, 20 nt, Homo sapiens
agacccugccaacuuuccag

SEQ ID NO: 1671945 - RNA, 21 nt, Homo sapiens
agacgagguuucacuguguug

SEQ ID NO: 1671946 - RNA, 18 nt, Homo sapiens
agacgcaaggaucacuug

SEQ ID NO: 1671947 - RNA, 18 nt, Homo sapiens
agacucacuaaauccuuu

SEQ ID NO: 1671948 - RNA, 20 nt, Homo sapiens
agacucgauaguggugguga

SEQ ID NO: 1671949 - RNA, 20 nt, Homo sapiens
agacucuuuaguugauuuaa

SEQ ID NO: 1671950 - RNA, 20 nt, Homo sapiens
agacugucauuagaauugaa

SEQ ID NO: 1671951 - RNA, 12 nt, Homo sapiens
agagaaaggagg

SEQ ID NO: 1671952 - RNA, 14 nt, Homo sapiens
agagaaaugagcuu

SEQ ID NO: 1671953 - RNA, 20 nt, Homo sapiens
agagaaugcacaaacagagg

SEQ ID NO: 1671954 - RNA, 16 nt, Homo sapiens
agagaccacuuccuua

SEQ ID NO: 1671955 - RNA, 20 nt, Homo sapiens
agagaccugcuccagauccu

SEQ ID NO: 1671956 - RNA, 21 nt, Homo sapiens
agagagcaaucuugcugugaa

SEQ ID NO: 1671957 - RNA, 15 nt, Homo sapiens
agagaggacuggaga

SEQ ID NO: 1671958 - RNA, 13 nt, Homo sapiens
agagauuuucaag

SEQ ID NO: 1671959 - RNA, 16 nt, Homo sapiens
agagauuuuccucucc

SEQ ID NO: 1671960 - RNA, 20 nt, Homo sapiens
agagcaagaccccaucucaa

SEQ ID NO: 1671961 - RNA, 19 nt, Homo sapiens
agagcaaucuugcugugaa

SEQ ID NO: 1671962 - RNA, 18 nt, Homo sapiens
agagcacuagaagcacag

SEQ ID NO: 1671963 - RNA, 20 nt, Homo sapiens
agagcgagacuccaucucaa

SEQ ID NO: 1671964 - RNA, 18 nt, Homo sapiens
agagcgucauguccuugg

SEQ ID NO: 1671965 - RNA, 18 nt, Homo sapiens
agagcuacacaggggaaa

SEQ ID NO: 1671966 - RNA, 18 nt, Homo sapiens
agagcuuuacagugccac

SEQ ID NO: 1671967 - RNA, 22 nt, Homo sapiens
agaggaacuccuuggccuagcc

SEQ ID NO: 1671968 - RNA, 15 nt, Homo sapiens
agaggacagcuuccc

SEQ ID NO: 1671969 - RNA, 15 nt, Homo sapiens
agaggacggcuuccc

SEQ ID NO: 1671970 - RNA, 19 nt, Homo sapiens
agaggagcguguccuaucc

SEQ ID NO: 1671971 - RNA, 20 nt, Homo sapiens
agaggagcguguccuauccc

SEQ ID NO: 1671972 - RNA, 15 nt, Homo sapiens
agaggauggcuuccc

SEQ ID NO: 1671973 - RNA, 22 nt, Homo sapiens
agaggauugagauaacauuucc

SEQ ID NO: 1671974 - RNA, 20 nt, Homo sapiens
agaggcucuaauguacaaua

SEQ ID NO: 1671975 - RNA, 19 nt, Homo sapiens
agaggcugcugaaaaccau

SEQ ID NO: 1671976 - RNA, 20 nt, Homo sapiens
agagguggaacuuaauuacc

SEQ ID NO: 1671977 - RNA, 12 nt, Homo sapiens
agaguacuuugg

SEQ ID NO: 1671978 - RNA, 15 nt, Homo sapiens
agaguaucugagaac

SEQ ID NO: 1671979 - RNA, 13 nt, Homo sapiens
agaguauggauug

SEQ ID NO: 1671980 - RNA, 13 nt, Homo sapiens
agaguaugugaga

SEQ ID NO: 1671981 - RNA, 14 nt, Homo sapiens
agaguauguguaug

SEQ ID NO: 1671982 - RNA, 23 nt, Homo sapiens
agagucacuggaacacuaaugag

SEQ ID NO: 1671983 - RNA, 20 nt, Homo sapiens
agagucuuugauucaccaaa

SEQ ID NO: 1671984 - RNA, 13 nt, Homo sapiens
agagugaccagaa

SEQ ID NO: 1671985 - RNA, 17 nt, Homo sapiens
agaguggaaauggggaa

SEQ ID NO: 1671986 - RNA, 15 nt, Homo sapiens
agaguugaagacaga

SEQ ID NO: 1671987 - RNA, 20 nt, Homo sapiens
agaguugguggagaacagaa

SEQ ID NO: 1671988 - RNA, 16 nt, Homo sapiens
agauaaaaucuucaac

SEQ ID NO: 1671989 - RNA, 15 nt, Homo sapiens
agauaacauuuccaa

SEQ ID NO: 1671990 - RNA, 14 nt, Homo sapiens
agauaauguugcuu

SEQ ID NO: 1671991 - RNA, 19 nt, Homo sapiens
agauaccagagacucugaa

SEQ ID NO: 1671992 - RNA, 23 nt, Homo sapiens
agauaccuucaugguguucauga

SEQ ID NO: 1671993 - RNA, 20 nt, Homo sapiens
agauacuggacuaaguggaa

SEQ ID NO: 1671994 - RNA, 17 nt, Homo sapiens
agauagccaaggccaaa

SEQ ID NO: 1671995 - RNA, 19 nt, Homo sapiens
agcugcuguuagauguccu

SEQ ID NO: 1671996 - RNA, 14 nt, Homo sapiens
agcuggagugcagu

SEQ ID NO: 1671997 - RNA, 22 nt, Homo sapiens
agcuggauugaaaaaacaaaac

SEQ ID NO: 1671998 - RNA, 21 nt, Homo sapiens
agcuggggauguuuaguaaua

SEQ ID NO: 1671999 - RNA, 21 nt, Homo sapiens
agcuguaaccgauaugcacuu

SEQ ID NO: 1672000 - RNA, 20 nt, Homo sapiens
agcuguaauauauaguaaaa

SEQ ID NO: 1672001 - RNA, 17 nt, Homo sapiens
agcuguuccacuucucu

SEQ ID NO: 1672002 - RNA, 13 nt, Homo sapiens
agcuuaaugacuu

SEQ ID NO: 1672003 - RNA, 18 nt, Homo sapiens
agcuuaaugacuuacuua

SEQ ID NO: 1672004 - RNA, 13 nt, Homo sapiens
agcuuacugauua

SEQ ID NO: 1672005 - RNA, 23 nt, Homo sapiens
agcuuauuuguauuuuuccucuu

SEQ ID NO: 1672006 - RNA, 17 nt, Homo sapiens
agcuucauccacugaau

SEQ ID NO: 1672007 - RNA, 23 nt, Homo sapiens
agcuucccugaacacucaucccc

SEQ ID NO: 1672008 - RNA, 21 nt, Homo sapiens
agcuucccuuuucucccaaga

SEQ ID NO: 1672009 - RNA, 21 nt, Homo sapiens
agcuuccucuaaacuucucac

SEQ ID NO: 1672010 - RNA, 20 nt, Homo sapiens
agcuugaccgugaggccaga

SEQ ID NO: 1672011 - RNA, 14 nt, Homo sapiens
agcuugcacaaaga

SEQ ID NO: 1672012 - RNA, 15 nt, Homo sapiens
agcuuggagggaugg

SEQ ID NO: 1672013 - RNA, 15 nt, Homo sapiens
agcuugggugcauuu

SEQ ID NO: 1672014 - RNA, 15 nt, Homo sapiens
agcuuuacagugcca

SEQ ID NO: 1672015 - RNA, 18 nt, Homo sapiens
agcuuuagagaagccaua

SEQ ID NO: 1672016 - RNA, 12 nt, Homo sapiens
agcuuuucccaa

SEQ ID NO: 1672017 - RNA, 19 nt, Homo sapiens
aggaaaagaauucucagca

SEQ ID NO: 1672018 - RNA, 21 nt, Homo sapiens
aggaaaccaacacccaaagca

SEQ ID NO: 1672019 - RNA, 16 nt, Homo sapiens
aggaaacugcacuguu

SEQ ID NO: 1672020 - RNA, 13 nt, Homo sapiens
aggaaagauccca

SEQ ID NO: 1672021 - RNA, 16 nt, Homo sapiens
aggaaagcagugcagu

SEQ ID NO: 1672022 - RNA, 17 nt, Homo sapiens
aggaaauaucugugaag

SEQ ID NO: 1672023 - RNA, 14 nt, Homo sapiens
aggaacagaguaua

SEQ ID NO: 1672024 - RNA, 21 nt, Homo sapiens
aggaacccaucacugugucuc

SEQ ID NO: 1672025 - RNA, 19 nt, Homo sapiens
aggaaccucaaacugggua

SEQ ID NO: 1672026 - RNA, 12 nt, Homo sapiens
aggaacugcuug

SEQ ID NO: 1672027 - RNA, 20 nt, Homo sapiens
aggaacugcuugugcacugg

SEQ ID NO: 1672028 - RNA, 22 nt, Homo sapiens
aggaacugcuugugcacuggau

SEQ ID NO: 1672029 - RNA, 23 nt, Homo sapiens
aggaagcaaaagcaucuauguga

SEQ ID NO: 1672030 - RNA, 16 nt, Homo sapiens
aggaagcacccguuga

SEQ ID NO: 1672031 - RNA, 23 nt, Homo sapiens
aggaagccagcaggcucucaggc

SEQ ID NO: 1672032 - RNA, 13 nt, Homo sapiens
aggaaugcaauaa

SEQ ID NO: 1672033 - RNA, 12 nt, Homo sapiens
aggacagcauua

SEQ ID NO: 1672034 - RNA, 15 nt, Homo sapiens
aggacagugacccca

SEQ ID NO: 1672035 - RNA, 20 nt, Homo sapiens
aggaccaggugucucugaga

SEQ ID NO: 1672036 - RNA, 15 nt, Homo sapiens
aggacccucccaggu

SEQ ID NO: 1672037 - RNA, 20 nt, Homo sapiens
aggaccucagcuugcacaaa

SEQ ID NO: 1672038 - RNA, 13 nt, Homo sapiens
aggacgcaugcag

SEQ ID NO: 1672039 - RNA, 10 nt, Homo sapiens
aggagaagac

SEQ ID NO: 1672040 - RNA, 22 nt, Homo sapiens
aggagaaggcaggaacauugga

SEQ ID NO: 1672041 - RNA, 23 nt, Homo sapiens
aggagaauggcgugaaccuggga

SEQ ID NO: 1672042 - RNA, 16 nt, Homo sapiens
aggagagaacagggau

SEQ ID NO: 1672043 - RNA, 19 nt, Homo sapiens
aggagaggcugcugucacu

SEQ ID NO: 1672044 - RNA, 15 nt, Homo sapiens
aggagaugacaggaa

SEQ ID NO: 1672045 - RNA, 17 nt, Homo sapiens
aggagaugaggcuggau

SEQ ID NO: 1672046 - RNA, 18 nt, Homo sapiens
aggagcguguacuacccc

SEQ ID NO: 1672047 - RNA, 22 nt, Homo sapiens
aggagcuaguguuaauccagag

SEQ ID NO: 1672048 - RNA, 13 nt, Homo sapiens
aggaggacaggga

SEQ ID NO: 1672049 - RNA, 13 nt, Homo sapiens
aggaggcaagcaa

SEQ ID NO: 1672050 - RNA, 20 nt, Homo sapiens
aggaggcaagcaagcucucu

SEQ ID NO: 1672051 - RNA, 14 nt, Homo sapiens
aggaggggagcaag

SEQ ID NO: 1672052 - RNA, 16 nt, Homo sapiens
aggagucugauugcag

SEQ ID NO: 1672053 - RNA, 13 nt, Homo sapiens
aggauaaugagau

SEQ ID NO: 1672054 - RNA, 14 nt, Homo sapiens
aggauaaugagaug

SEQ ID NO: 1672055 - RNA, 23 nt, Homo sapiens
aggauacccgguggcuucuggca

SEQ ID NO: 1672056 - RNA, 20 nt, Homo sapiens
aggauaugaguacauacuca

SEQ ID NO: 1672057 - RNA, 20 nt, Homo sapiens
acccaugagcguccagguga

SEQ ID NO: 1672058 - RNA, 22 nt, Homo sapiens
acccauuuucgcuauaaauaaa

SEQ ID NO: 1672059 - RNA, 23 nt, Homo sapiens
accccagagauucccaagccaaa

SEQ ID NO: 1672060 - RNA, 21 nt, Homo sapiens
accccaggaggaaaagcccag

SEQ ID NO: 1672061 - RNA, 20 nt, Homo sapiens
accccaggaugcaugcaggg

SEQ ID NO: 1672062 - RNA, 21 nt, Homo sapiens
accccggcaggcccugcagug

SEQ ID NO: 1672063 - RNA, 15 nt, Homo sapiens
accccuagugucuuu

SEQ ID NO: 1672064 - RNA, 13 nt, Homo sapiens
accccugcccagg

SEQ ID NO: 1672065 - RNA, 15 nt, Homo sapiens
acccuaggucuccac

SEQ ID NO: 1672066 - RNA, 16 nt, Homo sapiens
acccuauaaaagugau

SEQ ID NO: 1672067 - RNA, 21 nt, Homo sapiens
acccuccuguaaaauacuauu

SEQ ID NO: 1672068 - RNA, 19 nt, Homo sapiens
acccucugcuaugucugug

SEQ ID NO: 1672069 - RNA, 22 nt, Homo sapiens
acccucugcuaugucugugaug

SEQ ID NO: 1672070 - RNA, 23 nt, Homo sapiens
acccugaaauauuuucuacuuua

SEQ ID NO: 1672071 - RNA, 15 nt, Homo sapiens
acccuggacagugcc

SEQ ID NO: 1672072 - RNA, 13 nt, Homo sapiens
acccugugccugu

SEQ ID NO: 1672073 - RNA, 17 nt, Homo sapiens
acccuuagccuccagca

SEQ ID NO: 1672074 - RNA, 20 nt, Homo sapiens
acccuuggcuccugugucug

SEQ ID NO: 1672075 - RNA, 15 nt, Homo sapiens
acccuuuccucuuaa

SEQ ID NO: 1672076 - RNA, 22 nt, Homo sapiens
acccuuuccucuuaauucccaa

SEQ ID NO: 1672077 - RNA, 22 nt, Homo sapiens
acccuuuuacagucacauucag

SEQ ID NO: 1672078 - RNA, 15 nt, Homo sapiens
accgaaaugcuuaaa

SEQ ID NO: 1672079 - RNA, 16 nt, Homo sapiens
accgcaauaugggagg

SEQ ID NO: 1672080 - RNA, 14 nt, Homo sapiens
accgcuguuuguau

SEQ ID NO: 1672081 - RNA, 15 nt, Homo sapiens
accggacgcaugcag

SEQ ID NO: 1672082 - RNA, 15 nt, Homo sapiens
accgggaaaggcauc

SEQ ID NO: 1672083 - RNA, 19 nt, Homo sapiens
accguccagcaagugucau

SEQ ID NO: 1672084 - RNA, 19 nt, Homo sapiens
accuaccgaugugugaugu

SEQ ID NO: 1672085 - RNA, 22 nt, Homo sapiens
accuacuaauccucucugcaag

SEQ ID NO: 1672086 - RNA, 19 nt, Homo sapiens
accuagagcuagauguguc

SEQ ID NO: 1672087 - RNA, 20 nt, Homo sapiens
accuaucuuugguauaugau

SEQ ID NO: 1672088 - RNA, 12 nt, Homo sapiens
accuauugcugu

SEQ ID NO: 1672089 - RNA, 24 nt, Homo sapiens
accucacuuuuaauuagugaugca

SEQ ID NO: 1672090 - RNA, 12 nt, Homo sapiens
accucauuugca

SEQ ID NO: 1672091 - RNA, 13 nt, Homo sapiens
accucauuugcau

SEQ ID NO: 1672092 - RNA, 14 nt, Homo sapiens
accuccaacuuucc

SEQ ID NO: 1672093 - RNA, 14 nt, Homo sapiens
accucccacugccc

SEQ ID NO: 1672094 - RNA, 19 nt, Homo sapiens
accuccccugguccugcac

SEQ ID NO: 1672095 - RNA, 22 nt, Homo sapiens
accuccuccuccaguucugaug

SEQ ID NO: 1672096 - RNA, 16 nt, Homo sapiens
accucgugaucugccc

SEQ ID NO: 1672097 - RNA, 13 nt, Homo sapiens
accucuacuuucc

SEQ ID NO: 1672098 - RNA, 21 nt, Homo sapiens
accucucugaacugcaacacu

SEQ ID NO: 1672099 - RNA, 16 nt, Homo sapiens
accucuuugucacagg

SEQ ID NO: 1672100 - RNA, 20 nt, Homo sapiens
accucuuuucauggaguaga

SEQ ID NO: 1672101 - RNA, 17 nt, Homo sapiens
accugaauuaaagucua

SEQ ID NO: 1672102 - RNA, 24 nt, Homo sapiens
accugaauuaaagucuacacugcc

SEQ ID NO: 1672103 - RNA, 17 nt, Homo sapiens
accugccacaaugugau

SEQ ID NO: 1672104 - RNA, 19 nt, Homo sapiens
accuggaggaacugcuugu

SEQ ID NO: 1672105 - RNA, 24 nt, Homo sapiens
accuggcccagugcaaucugucca

SEQ ID NO: 1672106 - RNA, 14 nt, Homo sapiens
accuguaaaacuuu

SEQ ID NO: 1672107 - RNA, 19 nt, Homo sapiens
accuguaggucuaugaugu

SEQ ID NO: 1672108 - RNA, 15 nt, Homo sapiens
accugucaaccugaa

SEQ ID NO: 1672109 - RNA, 14 nt, Homo sapiens
accugugcuuucau

SEQ ID NO: 1672110 - RNA, 13 nt, Homo sapiens
accuguuucugca

SEQ ID NO: 1672111 - RNA, 19 nt, Homo sapiens
accuuaaauuaaacaauuu

SEQ ID NO: 1672112 - RNA, 15 nt, Homo sapiens
accuucacaccacuu

SEQ ID NO: 1672113 - RNA, 21 nt, Homo sapiens
accuuccuugaaauuucucag

SEQ ID NO: 1672114 - RNA, 13 nt, Homo sapiens
accuucuaaucca

SEQ ID NO: 1672115 - RNA, 17 nt, Homo sapiens
accuucugaagaucuca

SEQ ID NO: 1672116 - RNA, 20 nt, Homo sapiens
accuuuaagagaaaugagcu

SEQ ID NO: 1672117 - RNA, 23 nt, Homo sapiens
accuuuugggaaaugcugauuua

SEQ ID NO: 1672118 - RNA, 20 nt, Homo sapiens
acuuugacgagucaccuucc

SEQ ID NO: 1672119 - RNA, 17 nt, Homo sapiens
acuuugaggacauuuau

SEQ ID NO: 1672120 - RNA, 15 nt, Homo sapiens
acuuuggaucaggaa

SEQ ID NO: 1672121 - RNA, 19 nt, Homo sapiens
acuuuguuauuguaccuaa

SEQ ID NO: 1672122 - RNA, 21 nt, Homo sapiens
acuuuguuauuguaccuaagu

SEQ ID NO: 1672123 - RNA, 19 nt, Homo sapiens
acuuuuccuggacacuuua

SEQ ID NO: 1672124 - RNA, 22 nt, Homo sapiens
acuuuuuuuuuuuucugagaca

SEQ ID NO: 1672125 - RNA, 15 nt, Homo sapiens
agaaaaaagugcaac

SEQ ID NO: 1672126 - RNA, 16 nt, Homo sapiens
agaaaaaucaaucauu

SEQ ID NO: 1672127 - RNA, 20 nt, Homo sapiens
agaaaacaggcucacagaga

SEQ ID NO: 1672128 - RNA, 20 nt, Homo sapiens
agaaaacccaacuccucucc

SEQ ID NO: 1672129 - RNA, 23 nt, Homo sapiens
agaaaaccuaccacauucacuac

SEQ ID NO: 1672130 - RNA, 20 nt, Homo sapiens
agaaaaugcuuucucaugca

SEQ ID NO: 1672131 - RNA, 17 nt, Homo sapiens
agaaaauggaagacagc

SEQ ID NO: 1672132 - RNA, 16 nt, Homo sapiens
agaaacaugacacuga

SEQ ID NO: 1672133 - RNA, 17 nt, Homo sapiens
agaaacaugacacugac

SEQ ID NO: 1672134 - RNA, 19 nt, Homo sapiens
agaaacaugacacugaccu

SEQ ID NO: 1672135 - RNA, 22 nt, Homo sapiens
agaaaccagacccuguaugaca

SEQ ID NO: 1672136 - RNA, 12 nt, Homo sapiens
agaaagaaggcu

SEQ ID NO: 1672137 - RNA, 16 nt, Homo sapiens
agaaagauucaauuaa

SEQ ID NO: 1672138 - RNA, 13 nt, Homo sapiens
agaaagccacaaa

SEQ ID NO: 1672139 - RNA, 17 nt, Homo sapiens
agaaaggacagcucaga

SEQ ID NO: 1672140 - RNA, 24 nt, Homo sapiens
agaaauaugagcaugcucccucau

SEQ ID NO: 1672141 - RNA, 19 nt, Homo sapiens
agaaaucagcuuuguuaaa

SEQ ID NO: 1672142 - RNA, 21 nt, Homo sapiens
agaaauccacgcucaaucuca

SEQ ID NO: 1672143 - RNA, 21 nt, Homo sapiens
agaaauuuuuuuccagaauug

SEQ ID NO: 1672144 - RNA, 23 nt, Homo sapiens
agaacaaaccucuauauguugcu

SEQ ID NO: 1672145 - RNA, 20 nt, Homo sapiens
agaacaguuggauacaggag

SEQ ID NO: 1672146 - RNA, 21 nt, Homo sapiens
agaacauggaaauaaccauug

SEQ ID NO: 1672147 - RNA, 20 nt, Homo sapiens
agaacauggacuacacacaa

SEQ ID NO: 1672148 - RNA, 15 nt, Homo sapiens
agaacauuaagagau

SEQ ID NO: 1672149 - RNA, 13 nt, Homo sapiens
agaacgcaugcag

SEQ ID NO: 1672150 - RNA, 23 nt, Homo sapiens
agaacggaagaagagaucaggaa

SEQ ID NO: 1672151 - RNA, 18 nt, Homo sapiens
agaacggugucauccugg

SEQ ID NO: 1672152 - RNA, 16 nt, Homo sapiens
agaacucaugugauuu

SEQ ID NO: 1672153 - RNA, 14 nt, Homo sapiens
agaacuuuccagga

SEQ ID NO: 1672154 - RNA, 16 nt, Homo sapiens
agaagcaguugcaaua

SEQ ID NO: 1672155 - RNA, 16 nt, Homo sapiens
agaagcugucagggac

SEQ ID NO: 1672156 - RNA, 13 nt, Homo sapiens
agaaggcaaccca

SEQ ID NO: 1672157 - RNA, 16 nt, Homo sapiens
agaaggcacaggugua

SEQ ID NO: 1672158 - RNA, 14 nt, Homo sapiens
agaaggccaggaaa

SEQ ID NO: 1672159 - RNA, 23 nt, Homo sapiens
agaaguaguuuacuuuggacuaa

SEQ ID NO: 1672160 - RNA, 16 nt, Homo sapiens
agaagucaguugcaaa

SEQ ID NO: 1672161 - RNA, 19 nt, Homo sapiens
agaauaaaaugcagugaaa

SEQ ID NO: 1672162 - RNA, 13 nt, Homo sapiens
agaauaaagccuc

SEQ ID NO: 1672163 - RNA, 22 nt, Homo sapiens
agaauaaagccucugugcugca

SEQ ID NO: 1672164 - RNA, 20 nt, Homo sapiens
agaauaaagccuugugauca

SEQ ID NO: 1672165 - RNA, 20 nt, Homo sapiens
agaauauuaaaaauuaauuc

SEQ ID NO: 1672166 - RNA, 14 nt, Homo sapiens
agaaucaagucugu

SEQ ID NO: 1672167 - RNA, 21 nt, Homo sapiens
agaaugagaacauccaucuac

SEQ ID NO: 1672168 - RNA, 19 nt, Homo sapiens
agaaugcugcgcuuaccuu

SEQ ID NO: 1672169 - RNA, 18 nt, Homo sapiens
agaaugucauuugcuaau

SEQ ID NO: 1672170 - RNA, 19 nt, Homo sapiens
agaauucacuuuaccuuca

SEQ ID NO: 1672171 - RNA, 16 nt, Homo sapiens
agaauugugccucucc

SEQ ID NO: 1672172 - RNA, 21 nt, Homo sapiens
agacaaaugggccugccaaac

SEQ ID NO: 1672173 - RNA, 19 nt, Homo sapiens
agacaaauguaacacacac

SEQ ID NO: 1672174 - RNA, 13 nt, Homo sapiens
agacaacacacac

SEQ ID NO: 1672175 - RNA, 15 nt, Homo sapiens
agacaaccacuggga

SEQ ID NO: 1672176 - RNA, 15 nt, Homo sapiens
agacacguucuugcc

SEQ ID NO: 1672177 - RNA, 20 nt, Homo sapiens
agacagagcagaucagucuu

SEQ ID NO: 1672178 - RNA, 19 nt, Homo sapiens
agacauaccucucaacuua

SEQ ID NO: 1672179 - RNA, 16 nt, Homo sapiens
aggggaagagacuugg

SEQ ID NO: 1672180 - RNA, 21 nt, Homo sapiens
aggggaagagugcucugcuac

SEQ ID NO: 1672181 - RNA, 18 nt, Homo sapiens
aggggagaguaacccugu

SEQ ID NO: 1672182 - RNA, 22 nt, Homo sapiens
aggggaucuaaaaggaggacag

SEQ ID NO: 1672183 - RNA, 15 nt, Homo sapiens
aggggcuguggcuga

SEQ ID NO: 1672184 - RNA, 23 nt, Homo sapiens
agggguuaaugcagauggcaagu

SEQ ID NO: 1672185 - RNA, 20 nt, Homo sapiens
aggguccucaguccacugcu

SEQ ID NO: 1672186 - RNA, 13 nt, Homo sapiens
agggugacggggg

SEQ ID NO: 1672187 - RNA, 19 nt, Homo sapiens
aggguguuggaagaugcau

SEQ ID NO: 1672188 - RNA, 19 nt, Homo sapiens
aggguuaaagaaaggcaga

SEQ ID NO: 1672189 - RNA, 19 nt, Homo sapiens
aggguucuauauuuacugu

SEQ ID NO: 1672190 - RNA, 15 nt, Homo sapiens
agguaauaaaacucu

SEQ ID NO: 1672191 - RNA, 20 nt, Homo sapiens
agguacgaaaagaggggaag

SEQ ID NO: 1672192 - RNA, 12 nt, Homo sapiens
agguaucugaug

SEQ ID NO: 1672193 - RNA, 21 nt, Homo sapiens
agguaugugucagccaugacc

SEQ ID NO: 1672194 - RNA, 15 nt, Homo sapiens
agguccugcugugga

SEQ ID NO: 1672195 - RNA, 20 nt, Homo sapiens
aggucuaccugaaaauucaa

SEQ ID NO: 1672196 - RNA, 23 nt, Homo sapiens
aggucuccaccccucaagccagg

SEQ ID NO: 1672197 - RNA, 21 nt, Homo sapiens
aggucuuaagaugcaaaucaa

SEQ ID NO: 1672198 - RNA, 17 nt, Homo sapiens
aggugaaugcacaguga

SEQ ID NO: 1672199 - RNA, 14 nt, Homo sapiens
aggugcucuucuca

SEQ ID NO: 1672200 - RNA, 19 nt, Homo sapiens
aggugggguuuucacuucc

SEQ ID NO: 1672201 - RNA, 19 nt, Homo sapiens
aggugguggugguggugaa

SEQ ID NO: 1672202 - RNA, 18 nt, Homo sapiens
aggugugaauaaaagcau

SEQ ID NO: 1672203 - RNA, 16 nt, Homo sapiens
aggugugccaaacuac

SEQ ID NO: 1672204 - RNA, 12 nt, Homo sapiens
agguuaccucac

SEQ ID NO: 1672205 - RNA, 14 nt, Homo sapiens
agguugaaaauguu

SEQ ID NO: 1672206 - RNA, 16 nt, Homo sapiens
agguugaaaauguuau

SEQ ID NO: 1672207 - RNA, 13 nt, Homo sapiens
aguaaaaccaaag

SEQ ID NO: 1672208 - RNA, 18 nt, Homo sapiens
aguaaaagagagcugccc

SEQ ID NO: 1672209 - RNA, 21 nt, Homo sapiens
aguaaaucagugcaguacuca

SEQ ID NO: 1672210 - RNA, 20 nt, Homo sapiens
aguaaaucuaucucuauaua

SEQ ID NO: 1672211 - RNA, 21 nt, Homo sapiens
aguaacacaguguagugcuca

SEQ ID NO: 1672212 - RNA, 19 nt, Homo sapiens
aguaacagugcaguacuca

SEQ ID NO: 1672213 - RNA, 19 nt, Homo sapiens
aguaacaguguaguacuca

SEQ ID NO: 1672214 - RNA, 23 nt, Homo sapiens
aguaaccguccagcaagugucau

SEQ ID NO: 1672215 - RNA, 23 nt, Homo sapiens
aguaagacagugcagugcucagu

SEQ ID NO: 1672216 - RNA, 19 nt, Homo sapiens
aguaauagcgccucuuuua

SEQ ID NO: 1672217 - RNA, 19 nt, Homo sapiens
aguaaucuguauaauacuu

SEQ ID NO: 1672218 - RNA, 15 nt, Homo sapiens
aguaauuuacaaacc

SEQ ID NO: 1672219 - RNA, 20 nt, Homo sapiens
aguacagggcagaaccaaga

SEQ ID NO: 1672220 - RNA, 15 nt, Homo sapiens
aguaccaaugcucuu

SEQ ID NO: 1672221 - RNA, 11 nt, Homo sapiens
aguaccacugc

SEQ ID NO: 1672222 - RNA, 21 nt, Homo sapiens
aguaccacugcacaucauguu

SEQ ID NO: 1672223 - RNA, 23 nt, Homo sapiens
aguacucaguaaaucagugcagu

SEQ ID NO: 1672224 - RNA, 24 nt, Homo sapiens
aguacucaguaacacagugcagua

SEQ ID NO: 1672225 - RNA, 17 nt, Homo sapiens
aguacugaaauacauau

SEQ ID NO: 1672226 - RNA, 22 nt, Homo sapiens
aguacuuugguuucugagcacc

SEQ ID NO: 1672227 - RNA, 19 nt, Homo sapiens
aguagacaaagagccagaa

SEQ ID NO: 1672228 - RNA, 12 nt, Homo sapiens
aguagcauauau

SEQ ID NO: 1672229 - RNA, 15 nt, Homo sapiens
aguagccaacagcga

SEQ ID NO: 1672230 - RNA, 14 nt, Homo sapiens
aguauacacaucau

SEQ ID NO: 1672231 - RNA, 19 nt, Homo sapiens
aguauauacagagccuguu

SEQ ID NO: 1672232 - RNA, 22 nt, Homo sapiens
aguaugcacuaaucaauacuuu

SEQ ID NO: 1672233 - RNA, 23 nt, Homo sapiens
aguauggauugaaggauugugaa

SEQ ID NO: 1672234 - RNA, 14 nt, Homo sapiens
aguauguguaugua

SEQ ID NO: 1672235 - RNA, 22 nt, Homo sapiens
aguauguguauguacuuacaug

SEQ ID NO: 1672236 - RNA, 22 nt, Homo sapiens
agucaagacggauccacaguaa

SEQ ID NO: 1672237 - RNA, 21 nt, Homo sapiens
agucaagucuaccugccuugc

SEQ ID NO: 1672238 - RNA, 18 nt, Homo sapiens
agucagaagcccauuaaa

SEQ ID NO: 1672239 - RNA, 16 nt, Homo sapiens
agucagaccucagcaa

SEQ ID NO: 1672240 - RNA, 12 nt, Homo sapiens
cagacucuuaaa

SEQ ID NO: 1672241 - RNA, 12 nt, Homo sapiens
cagacugaaaua

SEQ ID NO: 1672242 - RNA, 12 nt, Homo sapiens
cagagagaauca

SEQ ID NO: 1672243 - RNA, 20 nt, Homo sapiens
cagagagacaacuugcuccu

SEQ ID NO: 1672244 - RNA, 20 nt, Homo sapiens
cagagaguaugugagaacca

SEQ ID NO: 1672245 - RNA, 21 nt, Homo sapiens
cagagauuugguuaagcucac

SEQ ID NO: 1672246 - RNA, 13 nt, Homo sapiens
cagagcaaaagaa

SEQ ID NO: 1672247 - RNA, 20 nt, Homo sapiens
cagagcaagaccccaucuca

SEQ ID NO: 1672248 - RNA, 18 nt, Homo sapiens
cagagcaagcacuggacu

SEQ ID NO: 1672249 - RNA, 13 nt, Homo sapiens
cagagccauccac

SEQ ID NO: 1672250 - RNA, 20 nt, Homo sapiens
cagagcgagacuccaucuca

SEQ ID NO: 1672251 - RNA, 15 nt, Homo sapiens
cagagcuccaugcau

SEQ ID NO: 1672252 - RNA, 17 nt, Homo sapiens
cagagcuccaugcaugg

SEQ ID NO: 1672253 - RNA, 22 nt, Homo sapiens
cagagcugacccccugcugcca

SEQ ID NO: 1672254 - RNA, 19 nt, Homo sapiens
cagagcugauggagaagga

SEQ ID NO: 1672255 - RNA, 18 nt, Homo sapiens
cagagcugccaccugccu

SEQ ID NO: 1672256 - RNA, 23 nt, Homo sapiens
cagagcuuuacagugccacgaca

SEQ ID NO: 1672257 - RNA, 14 nt, Homo sapiens
cagaggcucuaaug

SEQ ID NO: 1672258 - RNA, 18 nt, Homo sapiens
cagaggcucuaauguaca

SEQ ID NO: 1672259 - RNA, 20 nt, Homo sapiens
cagaggcucuaauguacaau

SEQ ID NO: 1672260 - RNA, 17 nt, Homo sapiens
cagaggugaaugcacag

SEQ ID NO: 1672261 - RNA, 17 nt, Homo sapiens
cagagguggauacuggg

SEQ ID NO: 1672262 - RNA, 18 nt, Homo sapiens
cagagucucuaguuccau

SEQ ID NO: 1672263 - RNA, 20 nt, Homo sapiens
cagagugaacacucuuggua

SEQ ID NO: 1672264 - RNA, 16 nt, Homo sapiens
cagaguguaugcauac

SEQ ID NO: 1672265 - RNA, 14 nt, Homo sapiens
cagaugaucucucc

SEQ ID NO: 1672266 - RNA, 12 nt, Homo sapiens
cagaugcacuga

SEQ ID NO: 1672267 - RNA, 17 nt, Homo sapiens
cagauggcaagugcacc

SEQ ID NO: 1672268 - RNA, 21 nt, Homo sapiens
cagauguuuuucuucauuaac

SEQ ID NO: 1672269 - RNA, 19 nt, Homo sapiens
cagauuccaccuagagcua

SEQ ID NO: 1672270 - RNA, 22 nt, Homo sapiens
cagauugauuuucucagcacaa

SEQ ID NO: 1672271 - RNA, 14 nt, Homo sapiens
cagauuuguucauu

SEQ ID NO: 1672272 - RNA, 15 nt, Homo sapiens
cagcaaaagugcagu

SEQ ID NO: 1672273 - RNA, 22 nt, Homo sapiens
cagcaaggaacaucccugagaa

SEQ ID NO: 1672274 - RNA, 13 nt, Homo sapiens
cagcaagugucau

SEQ ID NO: 1672275 - RNA, 19 nt, Homo sapiens
cagcaauuuuuccaaaagc

SEQ ID NO: 1672276 - RNA, 23 nt, Homo sapiens
cagcaauuuuuccaaaagccagu

SEQ ID NO: 1672277 - RNA, 12 nt, Homo sapiens
cagcacaguacu

SEQ ID NO: 1672278 - RNA, 18 nt, Homo sapiens
cagcacaucucugagguu

SEQ ID NO: 1672279 - RNA, 15 nt, Homo sapiens
cagcaccagccugag

SEQ ID NO: 1672280 - RNA, 16 nt, Homo sapiens
cagcagguguuuuccu

SEQ ID NO: 1672281 - RNA, 22 nt, Homo sapiens
cagcagguugugugugugugca

SEQ ID NO: 1672282 - RNA, 12 nt, Homo sapiens
cagcauagagcu

SEQ ID NO: 1672283 - RNA, 17 nt, Homo sapiens
cagcaucugccaggaca

SEQ ID NO: 1672284 - RNA, 16 nt, Homo sapiens
cagcaugugcucagcc

SEQ ID NO: 1672285 - RNA, 22 nt, Homo sapiens
cagcauuacacgccacaacucc

SEQ ID NO: 1672286 - RNA, 20 nt, Homo sapiens
cagccaagggcagaucacag

SEQ ID NO: 1672287 - RNA, 20 nt, Homo sapiens
cagccacuuauuuccaugga

SEQ ID NO: 1672288 - RNA, 19 nt, Homo sapiens
cagcccugggcacauagca

SEQ ID NO: 1672289 - RNA, 19 nt, Homo sapiens
cagccucccaaguagcuga

SEQ ID NO: 1672290 - RNA, 12 nt, Homo sapiens
cagccugcacag

SEQ ID NO: 1672291 - RNA, 16 nt, Homo sapiens
cagcggagaggacccc

SEQ ID NO: 1672292 - RNA, 23 nt, Homo sapiens
cagcggcucuuccuggacaguga

SEQ ID NO: 1672293 - RNA, 21 nt, Homo sapiens
cagcgugggaccccaagugaa

SEQ ID NO: 1672294 - RNA, 22 nt, Homo sapiens
cagcuaacaaguagcacacuga

SEQ ID NO: 1672295 - RNA, 21 nt, Homo sapiens
cagcuaacauggaaguacuau

SEQ ID NO: 1672296 - RNA, 22 nt, Homo sapiens
cagcuaagcccccuacugagaa

SEQ ID NO: 1672297 - RNA, 16 nt, Homo sapiens
cagcuaagccugauga

SEQ ID NO: 1672298 - RNA, 11 nt, Homo sapiens
cagcuagacac

SEQ ID NO: 1672299 - RNA, 18 nt, Homo sapiens
cagcuaucugucaucucu

SEQ ID NO: 1672300 - RNA, 21 nt, Homo sapiens
ccugugagcuccccaauccaa

SEQ ID NO: 1672301 - RNA, 12 nt, Homo sapiens
ccugugaucgug

SEQ ID NO: 1672302 - RNA, 16 nt, Homo sapiens
ccugugccuaacagca

SEQ ID NO: 1672303 - RNA, 17 nt, Homo sapiens
ccugugccuaacagcau

SEQ ID NO: 1672304 - RNA, 14 nt, Homo sapiens
ccuguggucugugu

SEQ ID NO: 1672305 - RNA, 16 nt, Homo sapiens
ccuguguauaaagcca

SEQ ID NO: 1672306 - RNA, 23 nt, Homo sapiens
ccuguuaaggcauccacuucaca

SEQ ID NO: 1672307 - RNA, 13 nt, Homo sapiens
ccuguucccauga

SEQ ID NO: 1672308 - RNA, 17 nt, Homo sapiens
ccuguuccugacuguuc

SEQ ID NO: 1672309 - RNA, 22 nt, Homo sapiens
ccuguucgugcuuguaaugcuc

SEQ ID NO: 1672310 - RNA, 19 nt, Homo sapiens
ccuguucuuccuaccaaau

SEQ ID NO: 1672311 - RNA, 18 nt, Homo sapiens
ccuuaauucuuaccucau

SEQ ID NO: 1672312 - RNA, 17 nt, Homo sapiens
ccuuagaauacuguauu

SEQ ID NO: 1672313 - RNA, 20 nt, Homo sapiens
ccuuagcccaagacuuggag

SEQ ID NO: 1672314 - RNA, 20 nt, Homo sapiens
ccuuauagagcacaauauua

SEQ ID NO: 1672315 - RNA, 16 nt, Homo sapiens
ccuuaucauaaauuca

SEQ ID NO: 1672316 - RNA, 18 nt, Homo sapiens
ccuucaaugcaaaauaca

SEQ ID NO: 1672317 - RNA, 16 nt, Homo sapiens
ccuucacaccacuugu

SEQ ID NO: 1672318 - RNA, 20 nt, Homo sapiens
ccuucacucugacaguauua

SEQ ID NO: 1672319 - RNA, 20 nt, Homo sapiens
ccuucaugguguucaugaca

SEQ ID NO: 1672320 - RNA, 23 nt, Homo sapiens
ccuuccaagaauaaagucuuucc

SEQ ID NO: 1672321 - RNA, 17 nt, Homo sapiens
ccuuccaagaauggaau

SEQ ID NO: 1672322 - RNA, 19 nt, Homo sapiens
ccuucccaaucagcacuga

SEQ ID NO: 1672323 - RNA, 21 nt, Homo sapiens
ccuucccaaucagcacugaaa

SEQ ID NO: 1672324 - RNA, 23 nt, Homo sapiens
ccuucucacagcacaugcuggcc

SEQ ID NO: 1672325 - RNA, 19 nt, Homo sapiens
ccuucugacggcccugcaa

SEQ ID NO: 1672326 - RNA, 22 nt, Homo sapiens
ccuucuuacuuaaccugaagcu

SEQ ID NO: 1672327 - RNA, 13 nt, Homo sapiens
ccuucuuccccaa

SEQ ID NO: 1672328 - RNA, 11 nt, Homo sapiens
ccuugcugcua

SEQ ID NO: 1672329 - RNA, 14 nt, Homo sapiens
ccuuggcagaggca

SEQ ID NO: 1672330 - RNA, 13 nt, Homo sapiens
ccuuguaaugcca

SEQ ID NO: 1672331 - RNA, 16 nt, Homo sapiens
ccuuguuaaaauccaa

SEQ ID NO: 1672332 - RNA, 20 nt, Homo sapiens
ccuuguugaugaagcacauu

SEQ ID NO: 1672333 - RNA, 14 nt, Homo sapiens
ccuuguuguaacua

SEQ ID NO: 1672334 - RNA, 20 nt, Homo sapiens
ccuuuaggaagguauguguc

SEQ ID NO: 1672335 - RNA, 22 nt, Homo sapiens
ccuuuccugaucaaggugcucu

SEQ ID NO: 1672336 - RNA, 13 nt, Homo sapiens
ccuuucuuccuuc

SEQ ID NO: 1672337 - RNA, 16 nt, Homo sapiens
ccuuugggcaaaggcc

SEQ ID NO: 1672338 - RNA, 20 nt, Homo sapiens
ccuuuuacagucacauucag

SEQ ID NO: 1672339 - RNA, 16 nt, Homo sapiens
ccuuuugagugccuua

SEQ ID NO: 1672340 - RNA, 13 nt, Homo sapiens
cgaacuccugacc

SEQ ID NO: 1672341 - RNA, 18 nt, Homo sapiens
cgaacucgggauuacaga

SEQ ID NO: 1672342 - RNA, 17 nt, Homo sapiens
cgaauuaauuaccuggc

SEQ ID NO: 1672343 - RNA, 15 nt, Homo sapiens
cgaccaccccugugc

SEQ ID NO: 1672344 - RNA, 22 nt, Homo sapiens
cgagauagccaaggccaaagga

SEQ ID NO: 1672345 - RNA, 14 nt, Homo sapiens
cgaguuacagacaa

SEQ ID NO: 1672346 - RNA, 14 nt, Homo sapiens
cgauauaagccaua

SEQ ID NO: 1672347 - RNA, 18 nt, Homo sapiens
cgauccuuguagacgcac

SEQ ID NO: 1672348 - RNA, 13 nt, Homo sapiens
cgaucucagcuca

SEQ ID NO: 1672349 - RNA, 15 nt, Homo sapiens
cgaugggcaucacac

SEQ ID NO: 1672350 - RNA, 17 nt, Homo sapiens
cgcacacccucacucug

SEQ ID NO: 1672351 - RNA, 21 nt, Homo sapiens
cgcccaggaugaaggggccag

SEQ ID NO: 1672352 - RNA, 20 nt, Homo sapiens
cgcccaggauggagugcagu

SEQ ID NO: 1672353 - RNA, 15 nt, Homo sapiens
cgccccugccugaga

SEQ ID NO: 1672354 - RNA, 19 nt, Homo sapiens
cgcccugggcugucuguca

SEQ ID NO: 1672355 - RNA, 19 nt, Homo sapiens
cgccgugucuuguguugcu

SEQ ID NO: 1672356 - RNA, 15 nt, Homo sapiens
cgccuggccaaaaug

SEQ ID NO: 1672357 - RNA, 13 nt, Homo sapiens
cgcgcccagccuu

SEQ ID NO: 1672358 - RNA, 22 nt, Homo sapiens
cgcgccccuguccauccgucuc

SEQ ID NO: 1672359 - RNA, 15 nt, Homo sapiens
caguaacagugcagu

SEQ ID NO: 1672360 - RNA, 15 nt, Homo sapiens
caguaaccaugcaaa

SEQ ID NO: 1672361 - RNA, 17 nt, Homo sapiens
caguaagacagugcagu

SEQ ID NO: 1672362 - RNA, 18 nt, Homo sapiens
caguaagacagugcagug

SEQ ID NO: 1672363 - RNA, 14 nt, Homo sapiens
caguaagauagguu

SEQ ID NO: 1672364 - RNA, 23 nt, Homo sapiens
caguaagaucaagcuccaucuua

SEQ ID NO: 1672365 - RNA, 17 nt, Homo sapiens
caguaaggcagugcaau

SEQ ID NO: 1672366 - RNA, 22 nt, Homo sapiens
caguaaggcagugcaguacuca

SEQ ID NO: 1672367 - RNA, 15 nt, Homo sapiens
caguaauacaguaca

SEQ ID NO: 1672368 - RNA, 22 nt, Homo sapiens
caguaauacaguacaguacuca

SEQ ID NO: 1672369 - RNA, 21 nt, Homo sapiens
caguaaucuuucggucuccuu

SEQ ID NO: 1672370 - RNA, 19 nt, Homo sapiens
caguacaauaaauaaaaga

SEQ ID NO: 1672371 - RNA, 13 nt, Homo sapiens
caguacaguacuc

SEQ ID NO: 1672372 - RNA, 14 nt, Homo sapiens
caguacaguacuca

SEQ ID NO: 1672373 - RNA, 19 nt, Homo sapiens
caguacaugggaaaggagg

SEQ ID NO: 1672374 - RNA, 19 nt, Homo sapiens
caguacucaggcagugcag

SEQ ID NO: 1672375 - RNA, 13 nt, Homo sapiens
caguacucaguaa

SEQ ID NO: 1672376 - RNA, 15 nt, Homo sapiens
caguacucaguaaua

SEQ ID NO: 1672377 - RNA, 23 nt, Homo sapiens
caguagcauuuuaauaguuucua

SEQ ID NO: 1672378 - RNA, 19 nt, Homo sapiens
caguauaaaauguaaaaac

SEQ ID NO: 1672379 - RNA, 16 nt, Homo sapiens
caguauaaauuacaug

SEQ ID NO: 1672380 - RNA, 18 nt, Homo sapiens
caguaugguacucaguaa

SEQ ID NO: 1672381 - RNA, 20 nt, Homo sapiens
caguauuauuuaguaaaauu

SEQ ID NO: 1672382 - RNA, 13 nt, Homo sapiens
cagucagugcuaa

SEQ ID NO: 1672383 - RNA, 11 nt, Homo sapiens
caguccacugc

SEQ ID NO: 1672384 - RNA, 21 nt, Homo sapiens
cagucccagcuaacucugacc

SEQ ID NO: 1672385 - RNA, 21 nt, Homo sapiens
cagucucuauuugauuugcaa

SEQ ID NO: 1672386 - RNA, 20 nt, Homo sapiens
cagucuggugcccagacuca

SEQ ID NO: 1672387 - RNA, 18 nt, Homo sapiens
cagugaaaccccgucucu

SEQ ID NO: 1672388 - RNA, 15 nt, Homo sapiens
cagugaaauaugaua

SEQ ID NO: 1672389 - RNA, 14 nt, Homo sapiens
cagugaaguacuca

SEQ ID NO: 1672390 - RNA, 15 nt, Homo sapiens
cagugacacaacuca

SEQ ID NO: 1672391 - RNA, 17 nt, Homo sapiens
cagugcagcaaggagaa

SEQ ID NO: 1672392 - RNA, 18 nt, Homo sapiens
cagugcagugcucaguaa

SEQ ID NO: 1672393 - RNA, 20 nt, Homo sapiens
caguggcgcgaucucagcuc

SEQ ID NO: 1672394 - RNA, 16 nt, Homo sapiens
caguggcgugaucuca

SEQ ID NO: 1672395 - RNA, 21 nt, Homo sapiens
caguggcgugaucucagcuca

SEQ ID NO: 1672396 - RNA, 16 nt, Homo sapiens
cagugguuggcaauug

SEQ ID NO: 1672397 - RNA, 21 nt, Homo sapiens
cagugguuggcaauuguuuca

SEQ ID NO: 1672398 - RNA, 22 nt, Homo sapiens
cagugguuggcaauuguuucaa

SEQ ID NO: 1672399 - RNA, 19 nt, Homo sapiens
caguguaacccaagcauuu

SEQ ID NO: 1672400 - RNA, 16 nt, Homo sapiens
caguguguacuucuuc

SEQ ID NO: 1672401 - RNA, 15 nt, Homo sapiens
caguguuuccaguga

SEQ ID NO: 1672402 - RNA, 18 nt, Homo sapiens
caguguuuccagugacac

SEQ ID NO: 1672403 - RNA, 19 nt, Homo sapiens
caguuaaaucccccaccuc

SEQ ID NO: 1672404 - RNA, 21 nt, Homo sapiens
caguuaaaucccccaccucca

SEQ ID NO: 1672405 - RNA, 18 nt, Homo sapiens
caguuaagagaaaugagc

SEQ ID NO: 1672406 - RNA, 16 nt, Homo sapiens
caguuauacauaccuc

SEQ ID NO: 1672407 - RNA, 19 nt, Homo sapiens
caguucacacccugcaagg

SEQ ID NO: 1672408 - RNA, 15 nt, Homo sapiens
caguucagauucaua

SEQ ID NO: 1672409 - RNA, 14 nt, Homo sapiens
caguucuugcaaua

SEQ ID NO: 1672410 - RNA, 19 nt, Homo sapiens
caguugcuagcaacaacuu

SEQ ID NO: 1672411 - RNA, 13 nt, Homo sapiens
caguuggugcugc

SEQ ID NO: 1672412 - RNA, 15 nt, Homo sapiens
caguuggugcugcuu

SEQ ID NO: 1672413 - RNA, 14 nt, Homo sapiens
caguugguuuugca

SEQ ID NO: 1672414 - RNA, 22 nt, Homo sapiens
caguuguaacauucuauuucaa

SEQ ID NO: 1672415 - RNA, 17 nt, Homo sapiens
caguuugaaaagacaaa

SEQ ID NO: 1672416 - RNA, 15 nt, Homo sapiens
caguuugugaucugu

SEQ ID NO: 1672417 - RNA, 14 nt, Homo sapiens
cauaaaaaagggac

SEQ ID NO: 1672418 - RNA, 17 nt, Homo sapiens
cauaaaaucgcuuucaa

SEQ ID NO: 1672419 - RNA, 15 nt, Homo sapiens
cauaaacacuucucc

SEQ ID NO: 1672420 - RNA, 18 nt, Homo sapiens
ccaugguagacugugaca

SEQ ID NO: 1672421 - RNA, 14 nt, Homo sapiens
ccauggugaacuga

SEQ ID NO: 1672422 - RNA, 16 nt, Homo sapiens
ccauguaggcuaagaa

SEQ ID NO: 1672423 - RNA, 16 nt, Homo sapiens
ccaugugcugcugugg

SEQ ID NO: 1672424 - RNA, 13 nt, Homo sapiens
ccauuuguaaugu

SEQ ID NO: 1672425 - RNA, 16 nt, Homo sapiens
ccauuugugauacuuc

SEQ ID NO: 1672426 - RNA, 20 nt, Homo sapiens
ccauuuuccuucaccgugac

SEQ ID NO: 1672427 - RNA, 18 nt, Homo sapiens
ccauuuuuugucugugau

SEQ ID NO: 1672428 - RNA, 14 nt, Homo sapiens
cccaaaacaaagua

SEQ ID NO: 1672429 - RNA, 16 nt, Homo sapiens
cccaaacccuucagug

SEQ ID NO: 1672430 - RNA, 14 nt, Homo sapiens
cccaaagugcacug

SEQ ID NO: 1672431 - RNA, 13 nt, Homo sapiens
cccaaaugcaaac

SEQ ID NO: 1672432 - RNA, 22 nt, Homo sapiens
cccaauaaacucaccuacucau

SEQ ID NO: 1672433 - RNA, 22 nt, Homo sapiens
cccacaagaacucccuucuccc

SEQ ID NO: 1672434 - RNA, 23 nt, Homo sapiens
cccaccugucaaccugaauuaaa

SEQ ID NO: 1672435 - RNA, 21 nt, Homo sapiens
cccacgcuaguuccauccacg

SEQ ID NO: 1672436 - RNA, 19 nt, Homo sapiens
cccacgucccgggcacugu

SEQ ID NO: 1672437 - RNA, 20 nt, Homo sapiens
cccacgucccgggcacuguc

SEQ ID NO: 1672438 - RNA, 23 nt, Homo sapiens
cccacgugccugcuuaccugcca

SEQ ID NO: 1672439 - RNA, 20 nt, Homo sapiens
cccagacguggugcuucuca

SEQ ID NO: 1672440 - RNA, 13 nt, Homo sapiens
cccagagccacag

SEQ ID NO: 1672441 - RNA, 20 nt, Homo sapiens
cccagagcuuuacagugcca

SEQ ID NO: 1672442 - RNA, 17 nt, Homo sapiens
cccagauaccugugagg

SEQ ID NO: 1672443 - RNA, 21 nt, Homo sapiens
cccagcaggacagugacccca

SEQ ID NO: 1672444 - RNA, 13 nt, Homo sapiens
cccagcaggguga

SEQ ID NO: 1672445 - RNA, 16 nt, Homo sapiens
cccagccaggggaacu

SEQ ID NO: 1672446 - RNA, 19 nt, Homo sapiens
cccagcugaggagcaggug

SEQ ID NO: 1672447 - RNA, 21 nt, Homo sapiens
cccaggaaccgauuaucuaua

SEQ ID NO: 1672448 - RNA, 22 nt, Homo sapiens
cccaggaagucauccugcaaug

SEQ ID NO: 1672449 - RNA, 12 nt, Homo sapiens
cccaggaugcau

SEQ ID NO: 1672450 - RNA, 13 nt, Homo sapiens
cccaggaugcaug

SEQ ID NO: 1672451 - RNA, 18 nt, Homo sapiens
cccaggauggagugcagu

SEQ ID NO: 1672452 - RNA, 19 nt, Homo sapiens
cccaggccaucaccacagc

SEQ ID NO: 1672453 - RNA, 21 nt, Homo sapiens
cccagggcaacuugaggucug

SEQ ID NO: 1672454 - RNA, 19 nt, Homo sapiens
cccaggggcacuguguucu

SEQ ID NO: 1672455 - RNA, 13 nt, Homo sapiens
cccagggugcagg

SEQ ID NO: 1672456 - RNA, 13 nt, Homo sapiens
cccagguucaaug

SEQ ID NO: 1672457 - RNA, 18 nt, Homo sapiens
cccagguuggagugcagu

SEQ ID NO: 1672458 - RNA, 15 nt, Homo sapiens
cccagugaucaccug

SEQ ID NO: 1672459 - RNA, 18 nt, Homo sapiens
cccagugggaucuuaccc

SEQ ID NO: 1672460 - RNA, 17 nt, Homo sapiens
cccauagaaacaugaca

SEQ ID NO: 1672461 - RNA, 15 nt, Homo sapiens
cccaucgcuggaaaa

SEQ ID NO: 1672462 - RNA, 19 nt, Homo sapiens
cccauucuguuccaccacu

SEQ ID NO: 1672463 - RNA, 13 nt, Homo sapiens
cccauuucuguaa

SEQ ID NO: 1672464 - RNA, 16 nt, Homo sapiens
cccauuugggauuuuc

SEQ ID NO: 1672465 - RNA, 15 nt, Homo sapiens
ccccacaagaacucc

SEQ ID NO: 1672466 - RNA, 17 nt, Homo sapiens
ccccacaggagcauguc

SEQ ID NO: 1672467 - RNA, 18 nt, Homo sapiens
ccccagauaccugugagg

SEQ ID NO: 1672468 - RNA, 18 nt, Homo sapiens
ccccagcacaaagcacug

SEQ ID NO: 1672469 - RNA, 19 nt, Homo sapiens
ccccagcccccuggcaugu

SEQ ID NO: 1672470 - RNA, 22 nt, Homo sapiens
ccccagccugcucccuagccag

SEQ ID NO: 1672471 - RNA, 21 nt, Homo sapiens
cccccaaacagcaugugcuca

SEQ ID NO: 1672472 - RNA, 16 nt, Homo sapiens
cccccagagguggaua

SEQ ID NO: 1672473 - RNA, 17 nt, Homo sapiens
cccccucuguugcacau

SEQ ID NO: 1672474 - RNA, 22 nt, Homo sapiens
cccccuuuccaucuguuugaua

SEQ ID NO: 1672475 - RNA, 22 nt, Homo sapiens
ccccgcacugggcuuggggacc

SEQ ID NO: 1672476 - RNA, 16 nt, Homo sapiens
ccccucagaugaucuc

SEQ ID NO: 1672477 - RNA, 22 nt, Homo sapiens
ccccucagccaaugaaucaaug

SEQ ID NO: 1672478 - RNA, 21 nt, Homo sapiens
ccccuccuccagagccugggc

SEQ ID NO: 1672479 - RNA, 16 nt, Homo sapiens
ccccugccccagagaa

SEQ ID NO: 1672480 - RNA, 17 nt, Homo sapiens
ccccuggacauauuccc

SEQ ID NO: 1672481 - RNA, 15 nt, Homo sapiens
cccggaggacaggcu

SEQ ID NO: 1672482 - RNA, 16 nt, Homo sapiens
cccgggaauguuucag

SEQ ID NO: 1672483 - RNA, 18 nt, Homo sapiens
uaaugccacucauacuca

SEQ ID NO: 1672484 - RNA, 14 nt, Homo sapiens
uaauggaaacuguc

SEQ ID NO: 1672485 - RNA, 21 nt, Homo sapiens
uaauguacaauaaagcaaugu

SEQ ID NO: 1672486 - RNA, 18 nt, Homo sapiens
uaauguagauaaagcacu

SEQ ID NO: 1672487 - RNA, 16 nt, Homo sapiens
uaauguauaaugggaa

SEQ ID NO: 1672488 - RNA, 14 nt, Homo sapiens
uaaugugccaaaau

SEQ ID NO: 1672489 - RNA, 12 nt, Homo sapiens
uaauguugcuuu

SEQ ID NO: 1672490 - RNA, 14 nt, Homo sapiens
uaauuaaacugaug

SEQ ID NO: 1672491 - RNA, 10 nt, Homo sapiens
uaauucccaa

SEQ ID NO: 1672492 - RNA, 20 nt, Homo sapiens
uaauucuuaccucauuugca

SEQ ID NO: 1672493 - RNA, 17 nt, Homo sapiens
uaauuuccuaugccugu

SEQ ID NO: 1672494 - RNA, 17 nt, Homo sapiens
uacaaaauauccaagcc

SEQ ID NO: 1672495 - RNA, 15 nt, Homo sapiens
uacaauaaagcaaug

SEQ ID NO: 1672496 - RNA, 18 nt, Homo sapiens
uacaauaaagcaaugugg

SEQ ID NO: 1672497 - RNA, 21 nt, Homo sapiens
uacaauaaagcaaugugguag

SEQ ID NO: 1672498 - RNA, 21 nt, Homo sapiens
uacaauucuuuguugcuuaau

SEQ ID NO: 1672499 - RNA, 15 nt, Homo sapiens
uacacuucaccuccu

SEQ ID NO: 1672500 - RNA, 22 nt, Homo sapiens
uacagaaagagcgucauguccu

SEQ ID NO: 1672501 - RNA, 23 nt, Homo sapiens
uacagacaaagcgugguggacau

SEQ ID NO: 1672502 - RNA, 19 nt, Homo sapiens
uacagacaacaaaccuguu

SEQ ID NO: 1672503 - RNA, 16 nt, Homo sapiens
uacagacauuaaauaa

SEQ ID NO: 1672504 - RNA, 16 nt, Homo sapiens
uacagccugcacacac

SEQ ID NO: 1672505 - RNA, 17 nt, Homo sapiens
uacaggcgugagccauc

SEQ ID NO: 1672506 - RNA, 21 nt, Homo sapiens
uacaguauuauuuaguaaaau

SEQ ID NO: 1672507 - RNA, 14 nt, Homo sapiens
uacagucacauuca

SEQ ID NO: 1672508 - RNA, 16 nt, Homo sapiens
uacauaaaaaagggac

SEQ ID NO: 1672509 - RNA, 24 nt, Homo sapiens
uacauaauugccaauaauguguga

SEQ ID NO: 1672510 - RNA, 23 nt, Homo sapiens
uacauagcuuuagagaagccaua

SEQ ID NO: 1672511 - RNA, 16 nt, Homo sapiens
uacauauacacaaaga

SEQ ID NO: 1672512 - RNA, 15 nt, Homo sapiens
uacaucuguacauga

SEQ ID NO: 1672513 - RNA, 18 nt, Homo sapiens
uacaucuguacaugacug

SEQ ID NO: 1672514 - RNA, 20 nt, Homo sapiens
uacaugaugauuucagaaac

SEQ ID NO: 1672515 - RNA, 11 nt, Homo sapiens
uacaugugauu

SEQ ID NO: 1672516 - RNA, 16 nt, Homo sapiens
uacaugugauugugau

SEQ ID NO: 1672517 - RNA, 13 nt, Homo sapiens
uacauuagugcca

SEQ ID NO: 1672518 - RNA, 14 nt, Homo sapiens
uacauuagugccau

SEQ ID NO: 1672519 - RNA, 15 nt, Homo sapiens
uacauuagugccaua

SEQ ID NO: 1672520 - RNA, 12 nt, Homo sapiens
uaccacauucac

SEQ ID NO: 1672521 - RNA, 19 nt, Homo sapiens
uaccacccucgcugccacc

SEQ ID NO: 1672522 - RNA, 16 nt, Homo sapiens
uaccagguuaccucac

SEQ ID NO: 1672523 - RNA, 22 nt, Homo sapiens
uaccauaagcuuuuucucugaa

SEQ ID NO: 1672524 - RNA, 20 nt, Homo sapiens
uaccauagcuuaagaaguau

SEQ ID NO: 1672525 - RNA, 17 nt, Homo sapiens
uacccagccuaccagag

SEQ ID NO: 1672526 - RNA, 18 nt, Homo sapiens
uaccccagaacgcaugca

SEQ ID NO: 1672527 - RNA, 14 nt, Homo sapiens
uacccuugugauuu

SEQ ID NO: 1672528 - RNA, 14 nt, Homo sapiens
uaccuacugcugag

SEQ ID NO: 1672529 - RNA, 23 nt, Homo sapiens
uaccuaugugugugcuuugccac

SEQ ID NO: 1672530 - RNA, 13 nt, Homo sapiens
uaccucacuuuua

SEQ ID NO: 1672531 - RNA, 18 nt, Homo sapiens
uaccugaaaauucaacau

SEQ ID NO: 1672532 - RNA, 15 nt, Homo sapiens
uaccugccagauaac

SEQ ID NO: 1672533 - RNA, 22 nt, Homo sapiens
uaccugccagauaaccaaguga

SEQ ID NO: 1672534 - RNA, 17 nt, Homo sapiens
uaccuguaauagccuca

SEQ ID NO: 1672535 - RNA, 15 nt, Homo sapiens
uaccuucaacaugug

SEQ ID NO: 1672536 - RNA, 13 nt, Homo sapiens
uaccuugugaagu

SEQ ID NO: 1672537 - RNA, 14 nt, Homo sapiens
uaccuuugucucac

SEQ ID NO: 1672538 - RNA, 13 nt, Homo sapiens
uacgaaagcacag

SEQ ID NO: 1672539 - RNA, 13 nt, Homo sapiens
uacuaacacuggc

SEQ ID NO: 1672540 - RNA, 18 nt, Homo sapiens
uacuaaccaccauuuccc

SEQ ID NO: 1672541 - RNA, 13 nt, Homo sapiens
uacuacauuauua

SEQ ID NO: 1672542 - RNA, 20 nt, Homo sapiens
uacuaccccaggacgcaugc

SEQ ID NO: 1672543 - RNA, 17 nt, Homo sapiens
uacuagcaaaagucuua

SEQ ID NO: 1672544 - RNA, 18 nt, Homo sapiens
uacuauagauucuuuauu

SEQ ID NO: 1672545 - RNA, 16 nt, Homo sapiens
uacuauuaacucugca

SEQ ID NO: 1672546 - RNA, 23 nt, Homo sapiens
uucccacgucccucgagcucugu

SEQ ID NO: 1672547 - RNA, 22 nt, Homo sapiens
uucccagagaguaugugagaac

SEQ ID NO: 1672548 - RNA, 16 nt, Homo sapiens
uucccccuaauucuua

SEQ ID NO: 1672549 - RNA, 21 nt, Homo sapiens
uucccgcagcaccagccugag

SEQ ID NO: 1672550 - RNA, 21 nt, Homo sapiens
uucccguggcuuugugcuuau

SEQ ID NO: 1672551 - RNA, 19 nt, Homo sapiens
uucccuaaaagaaaaccaa

SEQ ID NO: 1672552 - RNA, 19 nt, Homo sapiens
uucccucuggcacuccaga

SEQ ID NO: 1672553 - RNA, 15 nt, Homo sapiens
uucccugacacuguc

SEQ ID NO: 1672554 - RNA, 21 nt, Homo sapiens
uucccugagucccaccauagc

SEQ ID NO: 1672555 - RNA, 14 nt, Homo sapiens
uucccuuccacugc

SEQ ID NO: 1672556 - RNA, 15 nt, Homo sapiens
uucccuuccacugcc

SEQ ID NO: 1672557 - RNA, 15 nt, Homo sapiens
uuccggaaagccuuc

SEQ ID NO: 1672558 - RNA, 15 nt, Homo sapiens
uuccgucaugaauuc

SEQ ID NO: 1672559 - RNA, 14 nt, Homo sapiens
uuccguucaucuga

SEQ ID NO: 1672560 - RNA, 19 nt, Homo sapiens
uuccucaugaaucucucaa

SEQ ID NO: 1672561 - RNA, 21 nt, Homo sapiens
uuccuccuaaauuuccagggg

SEQ ID NO: 1672562 - RNA, 14 nt, Homo sapiens
uuccuccucaugaa

SEQ ID NO: 1672563 - RNA, 15 nt, Homo sapiens
uuccucuuaauuccc

SEQ ID NO: 1672564 - RNA, 16 nt, Homo sapiens
uuccucuuaauuccca

SEQ ID NO: 1672565 - RNA, 13 nt, Homo sapiens
uuccucuuaccug

SEQ ID NO: 1672566 - RNA, 16 nt, Homo sapiens
uuccugaucacuaugc

SEQ ID NO: 1672567 - RNA, 18 nt, Homo sapiens
uuccugaucacuaugcau

SEQ ID NO: 1672568 - RNA, 15 nt, Homo sapiens
uuccugcuccuccag

SEQ ID NO: 1672569 - RNA, 11 nt, Homo sapiens
uuccuguaaag

SEQ ID NO: 1672570 - RNA, 14 nt, Homo sapiens
uuccugugaucucg

SEQ ID NO: 1672571 - RNA, 17 nt, Homo sapiens
uuccuguucccaugaga

SEQ ID NO: 1672572 - RNA, 15 nt, Homo sapiens
uuccuugaccuuccu

SEQ ID NO: 1672573 - RNA, 17 nt, Homo sapiens
uuccuuuacccuccaca

SEQ ID NO: 1672574 - RNA, 23 nt, Homo sapiens
uucgaagaauuggcagaagcagu

SEQ ID NO: 1672575 - RNA, 22 nt, Homo sapiens
uucuaaaaacaguuaagacaac

SEQ ID NO: 1672576 - RNA, 21 nt, Homo sapiens
uucuaaaucauaaucauccuu

SEQ ID NO: 1672577 - RNA, 20 nt, Homo sapiens
uucuaaccuuucuaacccac

SEQ ID NO: 1672578 - RNA, 16 nt, Homo sapiens
uucuaagaaauaucug

SEQ ID NO: 1672579 - RNA, 19 nt, Homo sapiens
uucuaagaaauaucuguga

SEQ ID NO: 1672580 - RNA, 19 nt, Homo sapiens
uucuacacuguauuacaua

SEQ ID NO: 1672581 - RNA, 20 nt, Homo sapiens
uucuacucgaguuacagaca

SEQ ID NO: 1672582 - RNA, 19 nt, Homo sapiens
uucuacucuucaaccucua

SEQ ID NO: 1672583 - RNA, 16 nt, Homo sapiens
uucuaggggcagguga

SEQ ID NO: 1672584 - RNA, 17 nt, Homo sapiens
uucuaguccuggaugac

SEQ ID NO: 1672585 - RNA, 20 nt, Homo sapiens
uucuauuagcuuacugauua

SEQ ID NO: 1672586 - RNA, 22 nt, Homo sapiens
uucuauuucaacuucaggaaag

SEQ ID NO: 1672587 - RNA, 21 nt, Homo sapiens
uucuccauuaaacuucuacug

SEQ ID NO: 1672588 - RNA, 12 nt, Homo sapiens
uucuccuuaacc

SEQ ID NO: 1672589 - RNA, 15 nt, Homo sapiens
uucuccuuguacuug

SEQ ID NO: 1672590 - RNA, 16 nt, Homo sapiens
uucuccuuguacuuga

SEQ ID NO: 1672591 - RNA, 14 nt, Homo sapiens
uucucugauggcac

SEQ ID NO: 1672592 - RNA, 11 nt, Homo sapiens
uucugcacuga

SEQ ID NO: 1672593 - RNA, 23 nt, Homo sapiens
uucuggagggaagcaccaugaau

SEQ ID NO: 1672594 - RNA, 16 nt, Homo sapiens
uucuguacauguggaa

SEQ ID NO: 1672595 - RNA, 21 nt, Homo sapiens
uucuguccuguaacuguuaca

SEQ ID NO: 1672596 - RNA, 23 nt, Homo sapiens
uucugugucacgugacccugugc

SEQ ID NO: 1672597 - RNA, 17 nt, Homo sapiens
uucuuaccucauuugca

SEQ ID NO: 1672598 - RNA, 15 nt, Homo sapiens
uucuucauccauaga

SEQ ID NO: 1672599 - RNA, 21 nt, Homo sapiens
uucuucaucccuuuccaguua

SEQ ID NO: 1672600 - RNA, 13 nt, Homo sapiens
uucuuccacaaga

SEQ ID NO: 1672601 - RNA, 17 nt, Homo sapiens
uucuugcagucaucaga

SEQ ID NO: 1672602 - RNA, 14 nt, Homo sapiens
uucuuguugcugca

SEQ ID NO: 1672603 - RNA, 17 nt, Homo sapiens
uucuuuaagucaguuca

SEQ ID NO: 1672604 - RNA, 14 nt, Homo sapiens
uucuuuaguauuau

SEQ ID NO: 1672605 - RNA, 19 nt, Homo sapiens
uucuuuccuucugaucuga

SEQ ID NO: 1672606 - RNA, 22 nt, Homo sapiens
uucuuuccuucugaucugagaa

SEQ ID NO: 1672607 - RNA, 20 nt, Homo sapiens
uguagccuggucugugcauu

SEQ ID NO: 1672608 - RNA, 16 nt, Homo sapiens
uguagcugagcacagc

SEQ ID NO: 1672609 - RNA, 22 nt, Homo sapiens
uguagucagaccucagcaauau

SEQ ID NO: 1672610 - RNA, 21 nt, Homo sapiens
uguagucccggaggccuuccc

SEQ ID NO: 1672611 - RNA, 18 nt, Homo sapiens
uguauaaagccauuauuc

SEQ ID NO: 1672612 - RNA, 16 nt, Homo sapiens
uguauacaaacaggug

SEQ ID NO: 1672613 - RNA, 13 nt, Homo sapiens
uguauccaaguua

SEQ ID NO: 1672614 - RNA, 11 nt, Homo sapiens
uguauccucca

SEQ ID NO: 1672615 - RNA, 22 nt, Homo sapiens
uguaugcggaauuccaccugga

SEQ ID NO: 1672616 - RNA, 13 nt, Homo sapiens
uguauguauacac

SEQ ID NO: 1672617 - RNA, 14 nt, Homo sapiens
uguauuaguaauaa

SEQ ID NO: 1672618 - RNA, 17 nt, Homo sapiens
uguauuaucauauaugc

SEQ ID NO: 1672619 - RNA, 18 nt, Homo sapiens
uguauuaucuguccaaaa

SEQ ID NO: 1672620 - RNA, 18 nt, Homo sapiens
ugucaagauuaaguuaua

SEQ ID NO: 1672621 - RNA, 21 nt, Homo sapiens
ugucacaaauaaacauaauaa

SEQ ID NO: 1672622 - RNA, 22 nt, Homo sapiens
ugucaccagcuaucugucaucu

SEQ ID NO: 1672623 - RNA, 23 nt, Homo sapiens
ugucacccaaguuggagugcagu

SEQ ID NO: 1672624 - RNA, 23 nt, Homo sapiens
ugucacccagguuggagugcagu

SEQ ID NO: 1672625 - RNA, 15 nt, Homo sapiens
ugucagccaugacca

SEQ ID NO: 1672626 - RNA, 21 nt, Homo sapiens
ugucagccauuccuguuccca

SEQ ID NO: 1672627 - RNA, 16 nt, Homo sapiens
ugucagugagucagag

SEQ ID NO: 1672628 - RNA, 17 nt, Homo sapiens
ugucaguguagaucaac

SEQ ID NO: 1672629 - RNA, 13 nt, Homo sapiens
ugucauaucuucu

SEQ ID NO: 1672630 - RNA, 12 nt, Homo sapiens
ugucauaugcag

SEQ ID NO: 1672631 - RNA, 18 nt, Homo sapiens
ugucauugguuacaaauu

SEQ ID NO: 1672632 - RNA, 14 nt, Homo sapiens
ugucauuugcuaau

SEQ ID NO: 1672633 - RNA, 17 nt, Homo sapiens
uguccaacaacuccagg

SEQ ID NO: 1672634 - RNA, 16 nt, Homo sapiens
uguccacagggacaca

SEQ ID NO: 1672635 - RNA, 14 nt, Homo sapiens
uguccagagucucu

SEQ ID NO: 1672636 - RNA, 19 nt, Homo sapiens
ugucccaguuaacuguuaa

SEQ ID NO: 1672637 - RNA, 13 nt, Homo sapiens
ugucccaugaccu

SEQ ID NO: 1672638 - RNA, 14 nt, Homo sapiens
uguccccccugugg

SEQ ID NO: 1672639 - RNA, 13 nt, Homo sapiens
uguccguccugcu

SEQ ID NO: 1672640 - RNA, 17 nt, Homo sapiens
uguccgucuguccugcg

SEQ ID NO: 1672641 - RNA, 19 nt, Homo sapiens
uguccuccugggggcauau

SEQ ID NO: 1672642 - RNA, 18 nt, Homo sapiens
ugucgccgcccaggauug

SEQ ID NO: 1672643 - RNA, 21 nt, Homo sapiens
ugucuccacccguguccagca

SEQ ID NO: 1672644 - RNA, 16 nt, Homo sapiens
ugucuccucugucagu

SEQ ID NO: 1672645 - RNA, 13 nt, Homo sapiens
ugucucucuuuug

SEQ ID NO: 1672646 - RNA, 13 nt, Homo sapiens
ugucucugagaac

SEQ ID NO: 1672647 - RNA, 23 nt, Homo sapiens
ugucucuuguuaaaugagcuuaa

SEQ ID NO: 1672648 - RNA, 12 nt, Homo sapiens
ugucugagacag

SEQ ID NO: 1672649 - RNA, 19 nt, Homo sapiens
ugucuggccacacuggaau

SEQ ID NO: 1672650 - RNA, 10 nt, Homo sapiens
ugucuggccc

SEQ ID NO: 1672651 - RNA, 14 nt, Homo sapiens
ugucuguguauaca

SEQ ID NO: 1672652 - RNA, 15 nt, Homo sapiens
ugucuguguauacau

SEQ ID NO: 1672653 - RNA, 16 nt, Homo sapiens
ugucuuagucauacca

SEQ ID NO: 1672654 - RNA, 16 nt, Homo sapiens
ugucuucauguugaug

SEQ ID NO: 1672655 - RNA, 12 nt, Homo sapiens
ugucuugcugag

SEQ ID NO: 1672656 - RNA, 20 nt, Homo sapiens
ugucuugucgccgcccagga

SEQ ID NO: 1672657 - RNA, 16 nt, Homo sapiens
ugugaaauaucaucac

SEQ ID NO: 1672658 - RNA, 14 nt, Homo sapiens
ugugaagauuucau

SEQ ID NO: 1672659 - RNA, 18 nt, Homo sapiens
ugugacaccaccacugug

SEQ ID NO: 1672660 - RNA, 22 nt, Homo sapiens
ugugacccacacccacacccua

SEQ ID NO: 1672661 - RNA, 14 nt, Homo sapiens
ugugagaacuguga

SEQ ID NO: 1672662 - RNA, 20 nt, Homo sapiens
ugugagcuuucugauacuua

SEQ ID NO: 1672663 - RNA, 19 nt, Homo sapiens
ugugaguguauguauacac

SEQ ID NO: 1672664 - RNA, 21 nt, Homo sapiens
ugugaucuauaccaccuucaa

SEQ ID NO: 1672665 - RNA, 20 nt, Homo sapiens
ugugaucuguuguaauauca

SEQ ID NO: 1672666 - RNA, 14 nt, Homo sapiens
ugugauugugauuc

SEQ ID NO: 1672667 - RNA, 17 nt, Homo sapiens
ugugcagugauguggug

SEQ ID NO: 1672668 - RNA, 23 nt, Homo sapiens
ugugcaugagaaugucauuugcu

SEQ ID NO: 1672669 - RNA, 23 nt, Homo sapiens
ugugccaaacuaccguucccaaa

SEQ ID NO: 1672670 - RNA, 12 nt, Homo sapiens
ugugccaaagau

SEQ ID NO: 1672671 - RNA, 18 nt, Homo sapiens
ugugccccuuccccaugc

SEQ ID NO: 1672672 - RNA, 21 nt, Homo sapiens
ugugcgacuucacaaaaugca

SEQ ID NO: 1672673 - RNA, 17 nt, Homo sapiens
ugugcuggugggggccu

SEQ ID NO: 1672674 - RNA, 12 nt, Homo sapiens
ugugcuuucauc

SEQ ID NO: 1672675 - RNA, 22 nt, Homo sapiens
ugugcuuuucgcuuucuuucug

SEQ ID NO: 1672676 - RNA, 16 nt, Homo sapiens
uguggaccaguucccu

SEQ ID NO: 1672677 - RNA, 20 nt, Homo sapiens
uguggaccucuacuuuccag

SEQ ID NO: 1672678 - RNA, 13 nt, Homo sapiens
uguggaugcucuu

SEQ ID NO: 1672679 - RNA, 17 nt, Homo sapiens
uguggcagcugcaacag

SEQ ID NO: 1672680 - RNA, 20 nt, Homo sapiens
uguggcagcugcaacagugg

SEQ ID NO: 1672681 - RNA, 18 nt, Homo sapiens
ugugggccagagauccuc

SEQ ID NO: 1672682 - RNA, 19 nt, Homo sapiens
uguggggaaugggaagaag

SEQ ID NO: 1672683 - RNA, 20 nt, Homo sapiens
uguggucugcugccucagga

SEQ ID NO: 1672684 - RNA, 17 nt, Homo sapiens
uguguaaguccuaauaa

SEQ ID NO: 1672685 - RNA, 17 nt, Homo sapiens
uguguacaaacccagau

SEQ ID NO: 1672686 - RNA, 16 nt, Homo sapiens
ugugucagccaugacc

SEQ ID NO: 1672687 - RNA, 22 nt, Homo sapiens
uguguccccucacucugucagc

SEQ ID NO: 1672688 - RNA, 19 nt, Homo sapiens
ugugucgcuuaugucuaua

SEQ ID NO: 1672689 - RNA, 14 nt, Homo sapiens
ugugugggcccaag

SEQ ID NO: 1672690 - RNA, 15 nt, Homo sapiens
uguguucaugcacac

SEQ ID NO: 1672691 - RNA, 20 nt, Homo sapiens
uguguucaugcacacuugca

SEQ ID NO: 1672692 - RNA, 21 nt, Homo sapiens
uguguuuauccuaaacugaga

SEQ ID NO: 1672693 - RNA, 12 nt, Homo sapiens
uguguuugcaaa

SEQ ID NO: 1672694 - RNA, 20 nt, Homo sapiens
uguuaaauaaggccucaucc

SEQ ID NO: 1672695 - RNA, 16 nt, Homo sapiens
uguuagucaguauucu

SEQ ID NO: 1672696 - RNA, 16 nt, Homo sapiens
uguuauuuauaguguu

SEQ ID NO: 1672697 - RNA, 22 nt, Homo sapiens
uguuauuuguugagacuaucaa

SEQ ID NO: 1672698 - RNA, 11 nt, Homo sapiens
uguucagggaa

SEQ ID NO: 1672699 - RNA, 22 nt, Homo sapiens
uguucccucucucccuccaggg

SEQ ID NO: 1672700 - RNA, 18 nt, Homo sapiens
uguuccugggacuggcag

SEQ ID NO: 1672701 - RNA, 14 nt, Homo sapiens
uguuccugugaucu

SEQ ID NO: 1672702 - RNA, 15 nt, Homo sapiens
uguuccugugaucuc

SEQ ID NO: 1672703 - RNA, 20 nt, Homo sapiens
uguuccuguucgugcuugua

SEQ ID NO: 1672704 - RNA, 22 nt, Homo sapiens
uguucucaaaugcuaaaugcaa

SEQ ID NO: 1672705 - RNA, 13 nt, Homo sapiens
uguucugcacuga

SEQ ID NO: 1672706 - RNA, 18 nt, Homo sapiens
uguucuuccucuuaccug

SEQ ID NO: 1672707 - RNA, 19 nt, Homo sapiens
uguugcgggaagucaggga

SEQ ID NO: 1672708 - RNA, 18 nt, Homo sapiens
uguugcuaagcuguaacc

SEQ ID NO: 1672709 - RNA, 14 nt, Homo sapiens
uguugcuauuuccu

SEQ ID NO: 1672710 - RNA, 15 nt, Homo sapiens
uguugggaaccagag

SEQ ID NO: 1672711 - RNA, 17 nt, Homo sapiens
uguuuaggugccucuac

SEQ ID NO: 1672712 - RNA, 20 nt, Homo sapiens
uguuuccagagugcuuauaa

SEQ ID NO: 1672713 - RNA, 17 nt, Homo sapiens
uguuucccgcuccaaga

SEQ ID NO: 1672714 - RNA, 17 nt, Homo sapiens
uguuugauacaguauua

SEQ ID NO: 1672715 - RNA, 14 nt, Homo sapiens
uguuugugcuucua

SEQ ID NO: 1672716 - RNA, 23 nt, Homo sapiens
uguuuucucuguauaacuuguga

SEQ ID NO: 1672717 - RNA, 18 nt, Homo sapiens
uguuuucuucguggauug

SEQ ID NO: 1672718 - RNA, 20 nt, Homo sapiens
uguuuugcagaaugagccag

SEQ ID NO: 1672719 - RNA, 17 nt, Homo sapiens
uguuuugcauggaguau

SEQ ID NO: 1672720 - RNA, 18 nt, Homo sapiens
uguuuuggcugcucucca

SEQ ID NO: 1672721 - RNA, 12 nt, Homo sapiens
uguuuuguggau

SEQ ID NO: 1672722 - RNA, 16 nt, Homo sapiens
uuaaaacuuacuaugg

SEQ ID NO: 1672723 - RNA, 15 nt, Homo sapiens
uuaaaauauaguguu

SEQ ID NO: 1672724 - RNA, 19 nt, Homo sapiens
uuaaacaaaaacuuuccau

SEQ ID NO: 1672725 - RNA, 14 nt, Homo sapiens
uuaaaccuguuccu

SEQ ID NO: 1672726 - RNA, 20 nt, Homo sapiens
uuaaaggaaaguucuauuau

SEQ ID NO: 1672727 - RNA, 20 nt, Homo sapiens
uuaaaguaaaaacaauucaa

SEQ ID NO: 1672728 - RNA, 12 nt, Homo sapiens
uuaaagucuaca

SEQ ID NO: 1672729 - RNA, 15 nt, Homo sapiens
uuaacaagacuucaa

SEQ ID NO: 1672730 - RNA, 14 nt, Homo sapiens
ugaaacugacuugc

SEQ ID NO: 1672731 - RNA, 20 nt, Homo sapiens
ugaaagauugauuaaugaac

SEQ ID NO: 1672732 - RNA, 23 nt, Homo sapiens
ugaaaggaaagaggcucuggcua

SEQ ID NO: 1672733 - RNA, 15 nt, Homo sapiens
ugaaaggucaucuca

SEQ ID NO: 1672734 - RNA, 16 nt, Homo sapiens
ugaaaggucaucucau

SEQ ID NO: 1672735 - RNA, 15 nt, Homo sapiens
ugaaauaaaccccag

SEQ ID NO: 1672736 - RNA, 15 nt, Homo sapiens
ugaaauacucuucca

SEQ ID NO: 1672737 - RNA, 20 nt, Homo sapiens
ugaaauauaaacugugagau

SEQ ID NO: 1672738 - RNA, 19 nt, Homo sapiens
ugaaauauuuucuacuuua

SEQ ID NO: 1672739 - RNA, 18 nt, Homo sapiens
ugaaauuggaagacuugg

SEQ ID NO: 1672740 - RNA, 16 nt, Homo sapiens
ugaacacaaagccugu

SEQ ID NO: 1672741 - RNA, 15 nt, Homo sapiens
ugaacaccacuuugu

SEQ ID NO: 1672742 - RNA, 13 nt, Homo sapiens
ugaaccaagcuau

SEQ ID NO: 1672743 - RNA, 19 nt, Homo sapiens
ugaacguuuucucuucacc

SEQ ID NO: 1672744 - RNA, 14 nt, Homo sapiens
ugaacuaaugacaa

SEQ ID NO: 1672745 - RNA, 13 nt, Homo sapiens
ugaacugccaaag

SEQ ID NO: 1672746 - RNA, 17 nt, Homo sapiens
ugaagaacucaugugau

SEQ ID NO: 1672747 - RNA, 20 nt, Homo sapiens
ugaagaacucaugugauuua

SEQ ID NO: 1672748 - RNA, 14 nt, Homo sapiens
ugaagagagauaua

SEQ ID NO: 1672749 - RNA, 12 nt, Homo sapiens
ugaagaucucag

SEQ ID NO: 1672750 - RNA, 22 nt, Homo sapiens
ugaagccagcugcaggaaucaa

SEQ ID NO: 1672751 - RNA, 16 nt, Homo sapiens
ugaaggaaugcaauaa

SEQ ID NO: 1672752 - RNA, 16 nt, Homo sapiens
ugaaggauugugaacu

SEQ ID NO: 1672753 - RNA, 18 nt, Homo sapiens
ugaagggcaggugguggg

SEQ ID NO: 1672754 - RNA, 23 nt, Homo sapiens
ugaagucuuucccuggugauggu

SEQ ID NO: 1672755 - RNA, 18 nt, Homo sapiens
ugaagugaugauggauga

SEQ ID NO: 1672756 - RNA, 18 nt, Homo sapiens
ugaauaaugcuguuuuau

SEQ ID NO: 1672757 - RNA, 16 nt, Homo sapiens
ugaauauuauacuucu

SEQ ID NO: 1672758 - RNA, 13 nt, Homo sapiens
ugaaucaaucugg

SEQ ID NO: 1672759 - RNA, 22 nt, Homo sapiens
ugaaugaaauauaaacugugag

SEQ ID NO: 1672760 - RNA, 23 nt, Homo sapiens
ugaaugaaauauaaacugugaga

SEQ ID NO: 1672761 - RNA, 15 nt, Homo sapiens
ugaaugacauugaac

SEQ ID NO: 1672762 - RNA, 15 nt, Homo sapiens
ugaaugcacagugaa

SEQ ID NO: 1672763 - RNA, 15 nt, Homo sapiens
ugaaugucaguguga

SEQ ID NO: 1672764 - RNA, 11 nt, Homo sapiens
ugaaugugauu

SEQ ID NO: 1672765 - RNA, 13 nt, Homo sapiens
ugaauucuuguuc

SEQ ID NO: 1672766 - RNA, 17 nt, Homo sapiens
ugaauuuuggcuguguc

SEQ ID NO: 1672767 - RNA, 14 nt, Homo sapiens
ugacaacaaaaggg

SEQ ID NO: 1672768 - RNA, 23 nt, Homo sapiens
ugacaacaacuaucaccaaaaga

SEQ ID NO: 1672769 - RNA, 20 nt, Homo sapiens
ugacaagugacuuauuugcu

SEQ ID NO: 1672770 - RNA, 18 nt, Homo sapiens
ugacacaacucauccaga

SEQ ID NO: 1672771 - RNA, 17 nt, Homo sapiens
ugacaccaccacugugu

SEQ ID NO: 1672772 - RNA, 14 nt, Homo sapiens
ugacacugucugcu

SEQ ID NO: 1672773 - RNA, 17 nt, Homo sapiens
ugacagagcgagacucc

SEQ ID NO: 1672774 - RNA, 17 nt, Homo sapiens
ugacaggaaaguggaug

SEQ ID NO: 1672775 - RNA, 21 nt, Homo sapiens
ugacaggaagcgacgccucug

SEQ ID NO: 1672776 - RNA, 14 nt, Homo sapiens
ugacagggaaaaga

SEQ ID NO: 1672777 - RNA, 21 nt, Homo sapiens
ugacaguagcauacugaugag

SEQ ID NO: 1672778 - RNA, 12 nt, Homo sapiens
ugacagugccaa

SEQ ID NO: 1672779 - RNA, 22 nt, Homo sapiens
ugacauaggauccgaagugcaa

SEQ ID NO: 1672780 - RNA, 23 nt, Homo sapiens
ugacauaggauccgaagugcaau

SEQ ID NO: 1672781 - RNA, 17 nt, Homo sapiens
ugacaucagcacugcca

SEQ ID NO: 1672782 - RNA, 19 nt, Homo sapiens
ugaccaagggaagugacca

SEQ ID NO: 1672783 - RNA, 15 nt, Homo sapiens
ugacccaaaugcaaa

SEQ ID NO: 1672784 - RNA, 22 nt, Homo sapiens
ugacccaggaaccgauuaucua

SEQ ID NO: 1672785 - RNA, 12 nt, Homo sapiens
ugaccccaguuc

SEQ ID NO: 1672786 - RNA, 16 nt, Homo sapiens
ugacccuuccagacau

SEQ ID NO: 1672787 - RNA, 20 nt, Homo sapiens
ugaccucaagugaucugccc

SEQ ID NO: 1672788 - RNA, 14 nt, Homo sapiens
ugaccucacaguga

SEQ ID NO: 1672789 - RNA, 15 nt, Homo sapiens
ugaccucacagugac

SEQ ID NO: 1672790 - RNA, 19 nt, Homo sapiens
ugaccuugaaugaugccau

SEQ ID NO: 1672791 - RNA, 17 nt, Homo sapiens
ugcagugcccugagcca

SEQ ID NO: 1672792 - RNA, 20 nt, Homo sapiens
ugcaguggcaucaucucagc

SEQ ID NO: 1672793 - RNA, 23 nt, Homo sapiens
ugcaguggcgcgaucucagcuca

SEQ ID NO: 1672794 - RNA, 20 nt, Homo sapiens
ugcaguggcgugaucucagc

SEQ ID NO: 1672795 - RNA, 18 nt, Homo sapiens
ugcaucaagaugugacau

SEQ ID NO: 1672796 - RNA, 16 nt, Homo sapiens
ugcaucauguugaaua

SEQ ID NO: 1672797 - RNA, 20 nt, Homo sapiens
ugcauccauguaaucuauuc

SEQ ID NO: 1672798 - RNA, 13 nt, Homo sapiens
ugcaugugcugca

SEQ ID NO: 1672799 - RNA, 22 nt, Homo sapiens
ugcauucauucauccucuuaua

SEQ ID NO: 1672800 - RNA, 15 nt, Homo sapiens
ugcauucguccuuag

SEQ ID NO: 1672801 - RNA, 18 nt, Homo sapiens
ugcauuguggcugucaaa

SEQ ID NO: 1672802 - RNA, 14 nt, Homo sapiens
ugccaaaaacaaca

SEQ ID NO: 1672803 - RNA, 15 nt, Homo sapiens
ugccaaaaacaacaa

SEQ ID NO: 1672804 - RNA, 15 nt, Homo sapiens
ugccacaagcacaau

SEQ ID NO: 1672805 - RNA, 18 nt, Homo sapiens
ugccacaaugugauaugu

SEQ ID NO: 1672806 - RNA, 13 nt, Homo sapiens
ugccacacucuga

SEQ ID NO: 1672807 - RNA, 15 nt, Homo sapiens
ugccacugacaggaa

SEQ ID NO: 1672808 - RNA, 16 nt, Homo sapiens
ugccaggaagccagca

SEQ ID NO: 1672809 - RNA, 16 nt, Homo sapiens
ugccaggcagugcagc

SEQ ID NO: 1672810 - RNA, 18 nt, Homo sapiens
ugccaggcuggagugcag

SEQ ID NO: 1672811 - RNA, 23 nt, Homo sapiens
ugccaguccaucucaagugccau

SEQ ID NO: 1672812 - RNA, 20 nt, Homo sapiens
ugccaucaagaaacauucag

SEQ ID NO: 1672813 - RNA, 18 nt, Homo sapiens
ugccaugggcaaagccau

SEQ ID NO: 1672814 - RNA, 16 nt, Homo sapiens
ugcccacaacuugcca

SEQ ID NO: 1672815 - RNA, 13 nt, Homo sapiens
ugcccacacuugg

SEQ ID NO: 1672816 - RNA, 14 nt, Homo sapiens
ugcccaccuuggcc

SEQ ID NO: 1672817 - RNA, 16 nt, Homo sapiens
ugcccacgucccgggc

SEQ ID NO: 1672818 - RNA, 23 nt, Homo sapiens
ugcccacgucccgggcacuguca

SEQ ID NO: 1672819 - RNA, 22 nt, Homo sapiens
ugcccagcuuggagugccacau

SEQ ID NO: 1672820 - RNA, 18 nt, Homo sapiens
ugcccaggcagucuuugc

SEQ ID NO: 1672821 - RNA, 14 nt, Homo sapiens
ugcccccuccacug

SEQ ID NO: 1672822 - RNA, 15 nt, Homo sapiens
ugcccccuccacugg

SEQ ID NO: 1672823 - RNA, 16 nt, Homo sapiens
ugcccgcacacccuca

SEQ ID NO: 1672824 - RNA, 13 nt, Homo sapiens
ugcccguggugag

SEQ ID NO: 1672825 - RNA, 22 nt, Homo sapiens
ugcccucuccuuccuuacccaa

SEQ ID NO: 1672826 - RNA, 15 nt, Homo sapiens
ugcccuggccuacca

SEQ ID NO: 1672827 - RNA, 13 nt, Homo sapiens
ugccgucuguccc

SEQ ID NO: 1672828 - RNA, 13 nt, Homo sapiens
ugccuaaguauuc

SEQ ID NO: 1672829 - RNA, 14 nt, Homo sapiens
ugccucagccuccc

SEQ ID NO: 1672830 - RNA, 12 nt, Homo sapiens
ugccucaggaau

SEQ ID NO: 1672831 - RNA, 17 nt, Homo sapiens
ugccuccagaaccuucc

SEQ ID NO: 1672832 - RNA, 18 nt, Homo sapiens
ugccuccccccacaagaa

SEQ ID NO: 1672833 - RNA, 22 nt, Homo sapiens
ugccucccuggcagcacaggaa

SEQ ID NO: 1672834 - RNA, 20 nt, Homo sapiens
ugccucccuuaaucugccag

SEQ ID NO: 1672835 - RNA, 13 nt, Homo sapiens
ugccucucucagg

SEQ ID NO: 1672836 - RNA, 19 nt, Homo sapiens
ugccuggagggaauccaua

SEQ ID NO: 1672837 - RNA, 21 nt, Homo sapiens
ugccuguggugagguccuguc

SEQ ID NO: 1672838 - RNA, 19 nt, Homo sapiens
ugccuuacagacagaauau

SEQ ID NO: 1672839 - RNA, 20 nt, Homo sapiens
ugccuucucuaaacauuuca

SEQ ID NO: 1672840 - RNA, 18 nt, Homo sapiens
ugccuuuccagugcugcu

SEQ ID NO: 1672841 - RNA, 23 nt, Homo sapiens
ugccuuuuccuauguaaauauua

SEQ ID NO: 1672842 - RNA, 21 nt, Homo sapiens
ugcgacuucacaaaaugcaag

SEQ ID NO: 1672843 - RNA, 13 nt, Homo sapiens
ugcgcucuggguu

SEQ ID NO: 1672844 - RNA, 13 nt, Homo sapiens
ugcguucuuucaa

SEQ ID NO: 1672845 - RNA, 15 nt, Homo sapiens
ugcuagcaacaacuu

SEQ ID NO: 1672846 - RNA, 15 nt, Homo sapiens
ugcuauaauguauaa

SEQ ID NO: 1672847 - RNA, 20 nt, Homo sapiens
ugcuaucucgcuagccauau

SEQ ID NO: 1672848 - RNA, 22 nt, Homo sapiens
ugcuaucucgcuagccauauau

SEQ ID NO: 1672849 - RNA, 20 nt, Homo sapiens
ugcucagccccagaccugcc

SEQ ID NO: 1672850 - RNA, 21 nt, Homo sapiens
ugcucagccuuccaugcugug

SEQ ID NO: 1672851 - RNA, 22 nt, Homo sapiens
ugcucaguaacacagugcagug

SEQ ID NO: 1672852 - RNA, 20 nt, Homo sapiens
ugcucaguaaggcagugaau

SEQ ID NO: 1672853 - RNA, 15 nt, Homo sapiens
guguggcaaacauuu

SEQ ID NO: 1672854 - RNA, 13 nt, Homo sapiens
guguguccaugca

SEQ ID NO: 1672855 - RNA, 13 nt, Homo sapiens
guguuccugugau

SEQ ID NO: 1672856 - RNA, 18 nt, Homo sapiens
guguucugaugaggcauu

SEQ ID NO: 1672857 - RNA, 23 nt, Homo sapiens
guguuucuguccuguaacuguua

SEQ ID NO: 1672858 - RNA, 17 nt, Homo sapiens
guuaaaucaguaaucug

SEQ ID NO: 1672859 - RNA, 14 nt, Homo sapiens
guuaaaugaacuug

SEQ ID NO: 1672860 - RNA, 18 nt, Homo sapiens
guuaagagaaaugagcuu

SEQ ID NO: 1672861 - RNA, 13 nt, Homo sapiens
guuaauucuugcc

SEQ ID NO: 1672862 - RNA, 17 nt, Homo sapiens
guuacaguggcaguauu

SEQ ID NO: 1672863 - RNA, 11 nt, Homo sapiens
guuacuaaagg

SEQ ID NO: 1672864 - RNA, 13 nt, Homo sapiens
guuagauguccuc

SEQ ID NO: 1672865 - RNA, 16 nt, Homo sapiens
guuagauucacuuuga

SEQ ID NO: 1672866 - RNA, 16 nt, Homo sapiens
guuaggugugccaaac

SEQ ID NO: 1672867 - RNA, 21 nt, Homo sapiens
guuaucaaccgugacugcaag

SEQ ID NO: 1672868 - RNA, 22 nt, Homo sapiens
guuaucuucuaucaaagcacau

SEQ ID NO: 1672869 - RNA, 18 nt, Homo sapiens
guuaugucccaugaccuu

SEQ ID NO: 1672870 - RNA, 16 nt, Homo sapiens
guuauguuguaauauu

SEQ ID NO: 1672871 - RNA, 23 nt, Homo sapiens
guuauuucccaacccaggauuca

SEQ ID NO: 1672872 - RNA, 20 nt, Homo sapiens
guuauuuuguacguguuauu

SEQ ID NO: 1672873 - RNA, 23 nt, Homo sapiens
guuauuuugucacccaaccuggc

SEQ ID NO: 1672874 - RNA, 22 nt, Homo sapiens
guucaaagaaccccccucccca

SEQ ID NO: 1672875 - RNA, 20 nt, Homo sapiens
guucagcuccuuccaccaca

SEQ ID NO: 1672876 - RNA, 21 nt, Homo sapiens
guucagcuccuuccaccacaa

SEQ ID NO: 1672877 - RNA, 16 nt, Homo sapiens
guucaugcacacuugc

SEQ ID NO: 1672878 - RNA, 11 nt, Homo sapiens
guuccaagugu

SEQ ID NO: 1672879 - RNA, 16 nt, Homo sapiens
guuccauccaccaccu

SEQ ID NO: 1672880 - RNA, 22 nt, Homo sapiens
guuccauccaccaccuugccaa

SEQ ID NO: 1672881 - RNA, 17 nt, Homo sapiens
guuccaugaagacaaau

SEQ ID NO: 1672882 - RNA, 14 nt, Homo sapiens
guuccaugucugaa

SEQ ID NO: 1672883 - RNA, 19 nt, Homo sapiens
guucccagcaaaguuuuca

SEQ ID NO: 1672884 - RNA, 12 nt, Homo sapiens
guucccauuugc

SEQ ID NO: 1672885 - RNA, 13 nt, Homo sapiens
guuccuacuggag

SEQ ID NO: 1672886 - RNA, 13 nt, Homo sapiens
guuccugacuguu

SEQ ID NO: 1672887 - RNA, 23 nt, Homo sapiens
guucucaauacccacugccagac

SEQ ID NO: 1672888 - RNA, 14 nt, Homo sapiens
guucucccaugauu

SEQ ID NO: 1672889 - RNA, 15 nt, Homo sapiens
guucucggaguccaa

SEQ ID NO: 1672890 - RNA, 21 nt, Homo sapiens
guucugccagguuuaagguca

SEQ ID NO: 1672891 - RNA, 15 nt, Homo sapiens
guucuuccuaccaaa

SEQ ID NO: 1672892 - RNA, 18 nt, Homo sapiens
guucuuccuaccaaauau

SEQ ID NO: 1672893 - RNA, 17 nt, Homo sapiens
guucuuccucuuaccug

SEQ ID NO: 1672894 - RNA, 23 nt, Homo sapiens
guucuuucaaugcugacuggacu

SEQ ID NO: 1672895 - RNA, 15 nt, Homo sapiens
guugauguugauaaa

SEQ ID NO: 1672896 - RNA, 19 nt, Homo sapiens
guugcaguuaauucuugcc

SEQ ID NO: 1672897 - RNA, 13 nt, Homo sapiens
guugcaucauguu

SEQ ID NO: 1672898 - RNA, 15 nt, Homo sapiens
guugcugaaacacac

SEQ ID NO: 1672899 - RNA, 15 nt, Homo sapiens
guugcugcaucuccc

SEQ ID NO: 1672900 - RNA, 15 nt, Homo sapiens
guugcuuuuuuucca

SEQ ID NO: 1672901 - RNA, 13 nt, Homo sapiens
guuggagugcagu

SEQ ID NO: 1672902 - RNA, 15 nt, Homo sapiens
guuggauacaggaga

SEQ ID NO: 1672903 - RNA, 20 nt, Homo sapiens
guuggccauguucauucaca

SEQ ID NO: 1672904 - RNA, 20 nt, Homo sapiens
guuggcuagacuagucucaa

SEQ ID NO: 1672905 - RNA, 15 nt, Homo sapiens
guugggaaccagaga

SEQ ID NO: 1672906 - RNA, 15 nt, Homo sapiens
guuggguuccagaca

SEQ ID NO: 1672907 - RNA, 15 nt, Homo sapiens
guuguccugugucau

SEQ ID NO: 1672908 - RNA, 14 nt, Homo sapiens
guuuaaacagucaa

SEQ ID NO: 1672909 - RNA, 18 nt, Homo sapiens
guuuaaaucuuuguuaaa

SEQ ID NO: 1672910 - RNA, 15 nt, Homo sapiens
guuuaagguucuugc

SEQ ID NO: 1672911 - RNA, 20 nt, Homo sapiens
guuuacaaccuugugagcaa

SEQ ID NO: 1672912 - RNA, 19 nt, Homo sapiens
guuuacuuuggacuaaaga

SEQ ID NO: 1672913 - RNA, 14 nt, Homo sapiens
guuuagcauuggga

SEQ ID NO: 1672914 - RNA, 17 nt, Homo sapiens
guuuauugaaugugauu

SEQ ID NO: 1672915 - RNA, 20 nt, Homo sapiens
guuucaaagaaaagguguca

SEQ ID NO: 1672916 - RNA, 22 nt, Homo sapiens
guuucaacuguaaaauacuucu

SEQ ID NO: 1672917 - RNA, 14 nt, Homo sapiens
guuucacuguucau

SEQ ID NO: 1672918 - RNA, 18 nt, Homo sapiens
guuucauguucuguguca

SEQ ID NO: 1672919 - RNA, 18 nt, Homo sapiens
guuuccaaguuuauugcc

SEQ ID NO: 1672920 - RNA, 23 nt, Homo sapiens
guuucccgcuccaagagaauuca

SEQ ID NO: 1672921 - RNA, 17 nt, Homo sapiens
guuuccuguguuaguca

SEQ ID NO: 1672922 - RNA, 14 nt, Homo sapiens
guuucuggaauuga

SEQ ID NO: 1672923 - RNA, 19 nt, Homo sapiens
guuucuguuugaauuuuca

SEQ ID NO: 1672924 - RNA, 19 nt, Homo sapiens
guuucuuguuuaccaaaga

SEQ ID NO: 1672925 - RNA, 16 nt, Homo sapiens
guuugcguauauguua

SEQ ID NO: 1672926 - RNA, 18 nt, Homo sapiens
guuuuagaguaugcaaga

SEQ ID NO: 1672927 - RNA, 12 nt, Homo sapiens
guuuucucugua

SEQ ID NO: 1672928 - RNA, 14 nt, Homo sapiens
guuuucugcuguaa

SEQ ID NO: 1672929 - RNA, 17 nt, Homo sapiens
guuuugcaugucugcau

SEQ ID NO: 1672930 - RNA, 23 nt, Homo sapiens
guuuuggaugaaugcaguauaaa

SEQ ID NO: 1672931 - RNA, 17 nt, Homo sapiens
guuuuuaaguacucacu

SEQ ID NO: 1672932 - RNA, 22 nt, Homo sapiens
guuuuugaagaagggaaauuca

SEQ ID NO: 1672933 - RNA, 17 nt, Homo sapiens
guuuuuguuuuuugcca

SEQ ID NO: 1672934 - RNA, 18 nt, Homo sapiens
guuuuuguuuuuugccau

SEQ ID NO: 1672935 - RNA, 12 nt, Homo sapiens
guuuuuugccau

SEQ ID NO: 1672936 - RNA, 18 nt, Homo sapiens
uaaaaaauagcagcuuua

SEQ ID NO: 1672937 - RNA, 21 nt, Homo sapiens
uaaaaacauaaaauauacaaa

SEQ ID NO: 1672938 - RNA, 16 nt, Homo sapiens
uaaaaagaccaugcau

SEQ ID NO: 1672939 - RNA, 22 nt, Homo sapiens
uaaaaagucaaacuuucaccuc

SEQ ID NO: 1672940 - RNA, 15 nt, Homo sapiens
uaaaaauuaugucca

SEQ ID NO: 1672941 - RNA, 21 nt, Homo sapiens
uaaaacaaaacaaacaaccug

SEQ ID NO: 1672942 - RNA, 20 nt, Homo sapiens
uaaaacaagagaccacuucc

SEQ ID NO: 1672943 - RNA, 14 nt, Homo sapiens
uaaaacaagcugau

SEQ ID NO: 1672944 - RNA, 12 nt, Homo sapiens
uaaaaccaaagg

SEQ ID NO: 1672945 - RNA, 16 nt, Homo sapiens
uaaaagaaucauuugc

SEQ ID NO: 1672946 - RNA, 19 nt, Homo sapiens
uaaaagacaugaaauugag

SEQ ID NO: 1672947 - RNA, 22 nt, Homo sapiens
uaaaagauaaguguguuugcaa

SEQ ID NO: 1672948 - RNA, 13 nt, Homo sapiens
uaaaagcuaucuu

SEQ ID NO: 1672949 - RNA, 20 nt, Homo sapiens
uaaaaggaagguauuggcug

SEQ ID NO: 1672950 - RNA, 15 nt, Homo sapiens
uaaaauauacaaaca

SEQ ID NO: 1672951 - RNA, 11 nt, Homo sapiens
uaaaaugcaag

SEQ ID NO: 1672952 - RNA, 16 nt, Homo sapiens
uaaaauggcauuuagc

SEQ ID NO: 1672953 - RNA, 18 nt, Homo sapiens
uaaaaugugaaguaauag

SEQ ID NO: 1672954 - RNA, 13 nt, Homo sapiens
uaaaauuccaugg

SEQ ID NO: 1672955 - RNA, 14 nt, Homo sapiens
uaaacaaaauuuau

SEQ ID NO: 1672956 - RNA, 13 nt, Homo sapiens
uaaacaaauuccu

SEQ ID NO: 1672957 - RNA, 19 nt, Homo sapiens
uaaacacaaauugugaaga

SEQ ID NO: 1672958 - RNA, 13 nt, Homo sapiens
uaaacacagauua

SEQ ID NO: 1672959 - RNA, 17 nt, Homo sapiens
uaaacacuucuccuuaa

SEQ ID NO: 1672960 - RNA, 19 nt, Homo sapiens
uaaacaguuugaaaagaca

SEQ ID NO: 1672961 - RNA, 16 nt, Homo sapiens
uaaacgugaugugcuc

SEQ ID NO: 1672962 - RNA, 22 nt, Homo sapiens
uaaacuaccacccucgcugcca

SEQ ID NO: 1672963 - RNA, 15 nt, Homo sapiens
uaaacuuguguauga

SEQ ID NO: 1672964 - RNA, 15 nt, Homo sapiens
uaaagaugcagguuu

SEQ ID NO: 1672965 - RNA, 14 nt, Homo sapiens
uaaaggcuguguca

SEQ ID NO: 1672966 - RNA, 17 nt, Homo sapiens
uaaagucuacacugccu

SEQ ID NO: 1672967 - RNA, 23 nt, Homo sapiens
uaaauaaacacauagauucaccu

SEQ ID NO: 1672968 - RNA, 20 nt, Homo sapiens
uaaauaucauccugccuuca

SEQ ID NO: 1672969 - RNA, 13 nt, Homo sapiens
uaaauauuacaaa

SEQ ID NO: 1672970 - RNA, 22 nt, Homo sapiens
uaaauauuagcaaagcaugcca

SEQ ID NO: 1672971 - RNA, 13 nt, Homo sapiens
uaaaucagugcag

SEQ ID NO: 1672972 - RNA, 15 nt, Homo sapiens
uaaaucuuccaaagu

SEQ ID NO: 1672973 - RNA, 11 nt, Homo sapiens
uaaaugaacuu

SEQ ID NO: 1672974 - RNA, 17 nt, Homo sapiens
uaaaugcaaacacugug

SEQ ID NO: 1672975 - RNA, 19 nt, Homo sapiens
uaaauguacuacauuugca

SEQ ID NO: 1672976 - RNA, 20 nt, Homo sapiens
uaaauguacuacauuugcau

SEQ ID NO: 1672977 - RNA, 22 nt, Homo sapiens
cuccucccagcuguaccggcca

SEQ ID NO: 1672978 - RNA, 14 nt, Homo sapiens
cuccucugcagcuc

SEQ ID NO: 1672979 - RNA, 18 nt, Homo sapiens
cuccuggcucacagccac

SEQ ID NO: 1672980 - RNA, 20 nt, Homo sapiens
cuccugggggcauaucucag

SEQ ID NO: 1672981 - RNA, 20 nt, Homo sapiens
cuccugucuccucugucagu

SEQ ID NO: 1672982 - RNA, 15 nt, Homo sapiens
cuccuuaaacuacca

SEQ ID NO: 1672983 - RNA, 16 nt, Homo sapiens
cuccuuaaacuaccac

SEQ ID NO: 1672984 - RNA, 16 nt, Homo sapiens
cuccuugaggucuuga

SEQ ID NO: 1672985 - RNA, 16 nt, Homo sapiens
cucgaaucagacugaa

SEQ ID NO: 1672986 - RNA, 18 nt, Homo sapiens
cucgaaugugugggccca

SEQ ID NO: 1672987 - RNA, 16 nt, Homo sapiens
cucgaguuacagacaa

SEQ ID NO: 1672988 - RNA, 21 nt, Homo sapiens
cucgggcacucccuaagucca

SEQ ID NO: 1672989 - RNA, 20 nt, Homo sapiens
cucgugguuagcaagauaca

SEQ ID NO: 1672990 - RNA, 21 nt, Homo sapiens
cucuaagaaauggcuuuccac

SEQ ID NO: 1672991 - RNA, 23 nt, Homo sapiens
cucuaauguacaauaaagcaaug

SEQ ID NO: 1672992 - RNA, 14 nt, Homo sapiens
cucuaccuccuagc

SEQ ID NO: 1672993 - RNA, 12 nt, Homo sapiens
cucuaguuccau

SEQ ID NO: 1672994 - RNA, 16 nt, Homo sapiens
cucuaguugacuucaa

SEQ ID NO: 1672995 - RNA, 15 nt, Homo sapiens
cucuauauauacaug

SEQ ID NO: 1672996 - RNA, 15 nt, Homo sapiens
cucucaggccaaacu

SEQ ID NO: 1672997 - RNA, 15 nt, Homo sapiens
cucucaucacugaaa

SEQ ID NO: 1672998 - RNA, 20 nt, Homo sapiens
cucuccuccccccaagcuca

SEQ ID NO: 1672999 - RNA, 20 nt, Homo sapiens
cucucgagggaagcagugug

SEQ ID NO: 1673000 - RNA, 14 nt, Homo sapiens
cucucucaaagugc

SEQ ID NO: 1673001 - RNA, 19 nt, Homo sapiens
cucucuccaucuaccuucc

SEQ ID NO: 1673002 - RNA, 15 nt, Homo sapiens
cucucugaacugcaa

SEQ ID NO: 1673003 - RNA, 23 nt, Homo sapiens
cucucugaauacccaaaacacac

SEQ ID NO: 1673004 - RNA, 14 nt, Homo sapiens
cucucuuuacauuu

SEQ ID NO: 1673005 - RNA, 19 nt, Homo sapiens
cucugaacugcaacacugg

SEQ ID NO: 1673006 - RNA, 18 nt, Homo sapiens
cucugacgcaaaaccacu

SEQ ID NO: 1673007 - RNA, 16 nt, Homo sapiens
cucugacuaacgccau

SEQ ID NO: 1673008 - RNA, 20 nt, Homo sapiens
cucugacuaacgccauccag

SEQ ID NO: 1673009 - RNA, 14 nt, Homo sapiens
cucugagaacagac

SEQ ID NO: 1673010 - RNA, 22 nt, Homo sapiens
cucugagaacagacguuaccaa

SEQ ID NO: 1673011 - RNA, 22 nt, Homo sapiens
cucugagauacuaauaggugug

SEQ ID NO: 1673012 - RNA, 16 nt, Homo sapiens
cucugauaugggacug

SEQ ID NO: 1673013 - RNA, 12 nt, Homo sapiens
cucugcauagac

SEQ ID NO: 1673014 - RNA, 22 nt, Homo sapiens
cucugccggucccccaugccac

SEQ ID NO: 1673015 - RNA, 17 nt, Homo sapiens
cucuggcaaucuugccc

SEQ ID NO: 1673016 - RNA, 13 nt, Homo sapiens
cucuggcugccaa

SEQ ID NO: 1673017 - RNA, 21 nt, Homo sapiens
cucugggucuggcauuauaaa

SEQ ID NO: 1673018 - RNA, 21 nt, Homo sapiens
cucuggguuuugggauuuggg

SEQ ID NO: 1673019 - RNA, 12 nt, Homo sapiens
cucugucagcca

SEQ ID NO: 1673020 - RNA, 12 nt, Homo sapiens
cucugugcugca

SEQ ID NO: 1673021 - RNA, 13 nt, Homo sapiens
cucugugcugcac

SEQ ID NO: 1673022 - RNA, 14 nt, Homo sapiens
cucuguugcacaug

SEQ ID NO: 1673023 - RNA, 23 nt, Homo sapiens
cucuguuuugcauggaguauuau

SEQ ID NO: 1673024 - RNA, 19 nt, Homo sapiens
cucuuaauucccaauccca

SEQ ID NO: 1673025 - RNA, 15 nt, Homo sapiens
cucuuaccuguaaua

SEQ ID NO: 1673026 - RNA, 13 nt, Homo sapiens
cucuucaaacagu

SEQ ID NO: 1673027 - RNA, 23 nt, Homo sapiens
cucuucccaccugucaaccugaa

SEQ ID NO: 1673028 - RNA, 20 nt, Homo sapiens
cucuuccgcagacuugguca

SEQ ID NO: 1673029 - RNA, 20 nt, Homo sapiens
cucuuccucucuuuugcuca

SEQ ID NO: 1673030 - RNA, 17 nt, Homo sapiens
cucuugaagaacugacu

SEQ ID NO: 1673031 - RNA, 22 nt, Homo sapiens
cucuugucauucucauccaaaa

SEQ ID NO: 1673032 - RNA, 18 nt, Homo sapiens
cucuuucaauucugugau

SEQ ID NO: 1673033 - RNA, 15 nt, Homo sapiens
cucuuuccuccucau

SEQ ID NO: 1673034 - RNA, 21 nt, Homo sapiens
cugaaagacaguaaagaccau

SEQ ID NO: 1673035 - RNA, 14 nt, Homo sapiens
cugaaauuaguguu

SEQ ID NO: 1673036 - RNA, 16 nt, Homo sapiens
aucaauacccuuguga

SEQ ID NO: 1673037 - RNA, 19 nt, Homo sapiens
aucaaucuggcuucugcau

SEQ ID NO: 1673038 - RNA, 16 nt, Homo sapiens
aucacaaacucaucca

SEQ ID NO: 1673039 - RNA, 22 nt, Homo sapiens
aucacacucucuucuuacugua

SEQ ID NO: 1673040 - RNA, 15 nt, Homo sapiens
aucacagauuuccaa

SEQ ID NO: 1673041 - RNA, 14 nt, Homo sapiens
aucacucauuuauu

SEQ ID NO: 1673042 - RNA, 15 nt, Homo sapiens
aucacuccucuguca

SEQ ID NO: 1673043 - RNA, 15 nt, Homo sapiens
aucacugugucucau

SEQ ID NO: 1673044 - RNA, 16 nt, Homo sapiens
aucacugugucucaug

SEQ ID NO: 1673045 - RNA, 13 nt, Homo sapiens
aucacuuaucagu

SEQ ID NO: 1673046 - RNA, 20 nt, Homo sapiens
aucagaaaauccugacaaaa

SEQ ID NO: 1673047 - RNA, 23 nt, Homo sapiens
aucagaggugaaugcacagugaa

SEQ ID NO: 1673048 - RNA, 20 nt, Homo sapiens
aucaggaaauaucugugaag

SEQ ID NO: 1673049 - RNA, 21 nt, Homo sapiens
aucaggaguucugccagguuu

SEQ ID NO: 1673050 - RNA, 14 nt, Homo sapiens
aucagugugauaag

SEQ ID NO: 1673051 - RNA, 22 nt, Homo sapiens
aucagugugauaaggacuuuag

SEQ ID NO: 1673052 - RNA, 20 nt, Homo sapiens
aucaguuugcuaacauauuu

SEQ ID NO: 1673053 - RNA, 18 nt, Homo sapiens
aucaguuuguuguucaga

SEQ ID NO: 1673054 - RNA, 11 nt, Homo sapiens
aucaucucagc

SEQ ID NO: 1673055 - RNA, 13 nt, Homo sapiens
aucaucucagcuc

SEQ ID NO: 1673056 - RNA, 14 nt, Homo sapiens
aucaugucauugau

SEQ ID NO: 1673057 - RNA, 18 nt, Homo sapiens
aucauguguuucugugua

SEQ ID NO: 1673058 - RNA, 23 nt, Homo sapiens
aucauucuccuuguaaaagccua

SEQ ID NO: 1673059 - RNA, 20 nt, Homo sapiens
aucauuucuugguaugauca

SEQ ID NO: 1673060 - RNA, 21 nt, Homo sapiens
auccacauuguagccuaauau

SEQ ID NO: 1673061 - RNA, 17 nt, Homo sapiens
auccaccaccuugccaa

SEQ ID NO: 1673062 - RNA, 19 nt, Homo sapiens
auccacgcucaaucucagg

SEQ ID NO: 1673063 - RNA, 19 nt, Homo sapiens
auccagaggguugugauuu

SEQ ID NO: 1673064 - RNA, 12 nt, Homo sapiens
auccaggacagc

SEQ ID NO: 1673065 - RNA, 20 nt, Homo sapiens
aucccaagucaaacagugug

SEQ ID NO: 1673066 - RNA, 12 nt, Homo sapiens
aucccagcauuu

SEQ ID NO: 1673067 - RNA, 18 nt, Homo sapiens
aucccauuccugggcuag

SEQ ID NO: 1673068 - RNA, 20 nt, Homo sapiens
aucccgccagggagugugau

SEQ ID NO: 1673069 - RNA, 19 nt, Homo sapiens
auccuaaggugcuuaccuc

SEQ ID NO: 1673070 - RNA, 21 nt, Homo sapiens
auccuccuucacucccuguca

SEQ ID NO: 1673071 - RNA, 23 nt, Homo sapiens
auccugaaaaggguguugcuaag

SEQ ID NO: 1673072 - RNA, 17 nt, Homo sapiens
auccuggcuaacacagu

SEQ ID NO: 1673073 - RNA, 19 nt, Homo sapiens
auccuuuacaagauggaga

SEQ ID NO: 1673074 - RNA, 22 nt, Homo sapiens
aucgcagacuuaagcguacaaa

SEQ ID NO: 1673075 - RNA, 15 nt, Homo sapiens
aucgcuccucuccag

SEQ ID NO: 1673076 - RNA, 16 nt, Homo sapiens
aucgcuggaaaacagc

SEQ ID NO: 1673077 - RNA, 15 nt, Homo sapiens
aucguaaccuaugaa

SEQ ID NO: 1673078 - RNA, 11 nt, Homo sapiens
aucguccaaag

SEQ ID NO: 1673079 - RNA, 16 nt, Homo sapiens
aucguuucacaucugu

SEQ ID NO: 1673080 - RNA, 19 nt, Homo sapiens
aucuaagacauucaccaac

SEQ ID NO: 1673081 - RNA, 13 nt, Homo sapiens
aucuaccuuccag

SEQ ID NO: 1673082 - RNA, 19 nt, Homo sapiens
aucuagaagagucuauugu

SEQ ID NO: 1673083 - RNA, 18 nt, Homo sapiens
aucuaucuauauauacau

SEQ ID NO: 1673084 - RNA, 12 nt, Homo sapiens
aucuauggauug

SEQ ID NO: 1673085 - RNA, 19 nt, Homo sapiens
aucucaagugccauauucu

SEQ ID NO: 1673086 - RNA, 21 nt, Homo sapiens
aucucagcaaucacaagccaa

SEQ ID NO: 1673087 - RNA, 19 nt, Homo sapiens
aucucauaccucugaccaa

SEQ ID NO: 1673088 - RNA, 16 nt, Homo sapiens
aucuccccucagauuc

SEQ ID NO: 1673089 - RNA, 18 nt, Homo sapiens
aucuccccucagauucca

SEQ ID NO: 1673090 - RNA, 16 nt, Homo sapiens
aucuccuugauuacau

SEQ ID NO: 1673091 - RNA, 18 nt, Homo sapiens
aucucuccccauauauaa

SEQ ID NO: 1673092 - RNA, 23 nt, Homo sapiens
aucucucgagcugucuugcugag

SEQ ID NO: 1673093 - RNA, 14 nt, Homo sapiens
aucucucuuuacau

SEQ ID NO: 1673094 - RNA, 16 nt, Homo sapiens
aucucugaggccucag

SEQ ID NO: 1673095 - RNA, 23 nt, Homo sapiens
aucucuguucuuucauacuacau

SEQ ID NO: 1673096 - RNA, 13 nt, Homo sapiens
aucugagcuuaaa

SEQ ID NO: 1673097 - RNA, 15 nt, Homo sapiens
aucugaggaguccaa

SEQ ID NO: 1673098 - RNA, 17 nt, Homo sapiens
aucuggauuccagagca

SEQ ID NO: 1673099 - RNA, 19 nt, Homo sapiens
aaucuagagcuaugcacac

SEQ ID NO: 1673100 - RNA, 22 nt, Homo sapiens
aaucuagagcuaugcacaccaa

SEQ ID NO: 1673101 - RNA, 14 nt, Homo sapiens
aaucucagcacuuu

SEQ ID NO: 1673102 - RNA, 16 nt, Homo sapiens
aaucucagucccugac

SEQ ID NO: 1673103 - RNA, 23 nt, Homo sapiens
aaucucuugucauucucauccaa

SEQ ID NO: 1673104 - RNA, 10 nt, Homo sapiens
aaucuugccc

SEQ ID NO: 1673105 - RNA, 15 nt, Homo sapiens
aaucuugcugcuuau

SEQ ID NO: 1673106 - RNA, 23 nt, Homo sapiens
aaucuugcugugaaacagugugg

SEQ ID NO: 1673107 - RNA, 22 nt, Homo sapiens
aaucuuguuaauuucauuccaa

SEQ ID NO: 1673108 - RNA, 16 nt, Homo sapiens
aaugaaauacuugaca

SEQ ID NO: 1673109 - RNA, 22 nt, Homo sapiens
aaugaauuuuaaaagcauauau

SEQ ID NO: 1673110 - RNA, 15 nt, Homo sapiens
aaugacaauggugcc

SEQ ID NO: 1673111 - RNA, 15 nt, Homo sapiens
aaugacaggaaccca

SEQ ID NO: 1673112 - RNA, 15 nt, Homo sapiens
aaugacaugcacuga

SEQ ID NO: 1673113 - RNA, 15 nt, Homo sapiens
aaugagaaggccagg

SEQ ID NO: 1673114 - RNA, 21 nt, Homo sapiens
aaugagcugcacuccaugagu

SEQ ID NO: 1673115 - RNA, 17 nt, Homo sapiens
aaugaggaaacugcacu

SEQ ID NO: 1673116 - RNA, 19 nt, Homo sapiens
aaugaggaaacugcacugu

SEQ ID NO: 1673117 - RNA, 20 nt, Homo sapiens
aaugaguucccuugauucaa

SEQ ID NO: 1673118 - RNA, 18 nt, Homo sapiens
aaugauaauagcucacag

SEQ ID NO: 1673119 - RNA, 13 nt, Homo sapiens
aaugaugugauac

SEQ ID NO: 1673120 - RNA, 22 nt, Homo sapiens
aaugcaaggugaacaccacuuu

SEQ ID NO: 1673121 - RNA, 20 nt, Homo sapiens
aaugcagcaguaaauccaag

SEQ ID NO: 1673122 - RNA, 13 nt, Homo sapiens
aaugcaugccagu

SEQ ID NO: 1673123 - RNA, 17 nt, Homo sapiens
aaugccaauucaucuca

SEQ ID NO: 1673124 - RNA, 23 nt, Homo sapiens
aaugccuuguugaugaagcacau

SEQ ID NO: 1673125 - RNA, 16 nt, Homo sapiens
aaugcugacuggacug

SEQ ID NO: 1673126 - RNA, 13 nt, Homo sapiens
aaugcugcgcuua

SEQ ID NO: 1673127 - RNA, 19 nt, Homo sapiens
aaugcuuguaauagucugu

SEQ ID NO: 1673128 - RNA, 15 nt, Homo sapiens
aaugcuuucucaugc

SEQ ID NO: 1673129 - RNA, 16 nt, Homo sapiens
aauggaauccuucccu

SEQ ID NO: 1673130 - RNA, 17 nt, Homo sapiens
aauggagaaaaccagag

SEQ ID NO: 1673131 - RNA, 22 nt, Homo sapiens
aauggcauuuagcacaguauuu

SEQ ID NO: 1673132 - RNA, 21 nt, Homo sapiens
aauggccaaguguacauuuga

SEQ ID NO: 1673133 - RNA, 20 nt, Homo sapiens
aauggccugguaggucugga

SEQ ID NO: 1673134 - RNA, 17 nt, Homo sapiens
aauggcgugaaccuggg

SEQ ID NO: 1673135 - RNA, 12 nt, Homo sapiens
aauggcuauuaa

SEQ ID NO: 1673136 - RNA, 11 nt, Homo sapiens
aaugggagaaa

SEQ ID NO: 1673137 - RNA, 14 nt, Homo sapiens
aauggggcuuccau

SEQ ID NO: 1673138 - RNA, 20 nt, Homo sapiens
aauggguuuuguguacugua

SEQ ID NO: 1673139 - RNA, 21 nt, Homo sapiens
aauguaaagauacugagaaua

SEQ ID NO: 1673140 - RNA, 23 nt, Homo sapiens
aauguaacacacacacacauaca

SEQ ID NO: 1673141 - RNA, 18 nt, Homo sapiens
aauguaauauucuuuugu

SEQ ID NO: 1673142 - RNA, 20 nt, Homo sapiens
aauguacaauaaagcaaugu

SEQ ID NO: 1673143 - RNA, 20 nt, Homo sapiens
aauguagcuucagucauuaa

SEQ ID NO: 1673144 - RNA, 15 nt, Homo sapiens
aauguauaaugggaa

SEQ ID NO: 1673145 - RNA, 23 nt, Homo sapiens
aauguauauugauguaacugugu

SEQ ID NO: 1673146 - RNA, 13 nt, Homo sapiens
aaugucagcacau

SEQ ID NO: 1673147 - RNA, 18 nt, Homo sapiens
aaugucagugugacugau

SEQ ID NO: 1673148 - RNA, 16 nt, Homo sapiens
aaugugaaauguaacu

SEQ ID NO: 1673149 - RNA, 22 nt, Homo sapiens
aaugugacuugagcccagagug

SEQ ID NO: 1673150 - RNA, 23 nt, Homo sapiens
aaugugcuccuucauaagccauu

SEQ ID NO: 1673151 - RNA, 16 nt, Homo sapiens
aauguucacugaauaa

SEQ ID NO: 1673152 - RNA, 21 nt, Homo sapiens
aauguuccauucagucugcag

SEQ ID NO: 1673153 - RNA, 18 nt, Homo sapiens
aauguuccguucaucuga

SEQ ID NO: 1673154 - RNA, 22 nt, Homo sapiens
aauguuggcuagucugugccuc

SEQ ID NO: 1673155 - RNA, 16 nt, Homo sapiens
aauguuucaggucugg

SEQ ID NO: 1673156 - RNA, 18 nt, Homo sapiens
aauuaaaaaauaguugca

SEQ ID NO: 1673157 - RNA, 19 nt, Homo sapiens
aauuaaaaaauaguugcaa

SEQ ID NO: 1673158 - RNA, 19 nt, Homo sapiens
aauuaaaaaguuaaucuuc

SEQ ID NO: 1673159 - RNA, 19 nt, Homo sapiens
aauuaaacaaauuccuucc

SEQ ID NO: 1673160 - RNA, 23 nt, Homo sapiens
aauuaaacuguuaacuuauucaa

SEQ ID NO: 1673161 - RNA, 22 nt, Homo sapiens
aaauaugauucuccucucccaa

SEQ ID NO: 1673162 - RNA, 21 nt, Homo sapiens
aaauauguguacacauaugaa

SEQ ID NO: 1673163 - RNA, 19 nt, Homo sapiens
aaauauuuucuacuuuaaa

SEQ ID NO: 1673164 - RNA, 15 nt, Homo sapiens
aaaucaguaaucugu

SEQ ID NO: 1673165 - RNA, 16 nt, Homo sapiens
aaaucauuuauuuaca

SEQ ID NO: 1673166 - RNA, 22 nt, Homo sapiens
aaauccauacccccugccccag

SEQ ID NO: 1673167 - RNA, 16 nt, Homo sapiens
aaaugaaagucaguuu

SEQ ID NO: 1673168 - RNA, 22 nt, Homo sapiens
aaaugaauauucaacagcucac

SEQ ID NO: 1673169 - RNA, 22 nt, Homo sapiens
aaaugagaaucugugcagucau

SEQ ID NO: 1673170 - RNA, 15 nt, Homo sapiens
aaaugcaaacacugu

SEQ ID NO: 1673171 - RNA, 17 nt, Homo sapiens
aaaugcaaagcacaccu

SEQ ID NO: 1673172 - RNA, 13 nt, Homo sapiens
aaaugcagugaaa

SEQ ID NO: 1673173 - RNA, 13 nt, Homo sapiens
aaaugcuacucag

SEQ ID NO: 1673174 - RNA, 14 nt, Homo sapiens
aaauggaagacagc

SEQ ID NO: 1673175 - RNA, 19 nt, Homo sapiens
aaauggcuuguucagucac

SEQ ID NO: 1673176 - RNA, 14 nt, Homo sapiens
aaauguauguuggu

SEQ ID NO: 1673177 - RNA, 17 nt, Homo sapiens
aaauguuauaggcacuu

SEQ ID NO: 1673178 - RNA, 15 nt, Homo sapiens
aaauguuucaaagac

SEQ ID NO: 1673179 - RNA, 14 nt, Homo sapiens
aaauuaacauguca

SEQ ID NO: 1673180 - RNA, 15 nt, Homo sapiens
aaauuaacaugucac

SEQ ID NO: 1673181 - RNA, 14 nt, Homo sapiens
aaauuaucuuuaaa

SEQ ID NO: 1673182 - RNA, 16 nt, Homo sapiens
aaauucaugcugcuua

SEQ ID NO: 1673183 - RNA, 12 nt, Homo sapiens
aaauuccagagc

SEQ ID NO: 1673184 - RNA, 18 nt, Homo sapiens
aaauucccgccuaauaaa

SEQ ID NO: 1673185 - RNA, 18 nt, Homo sapiens
aaauuccuguugucugac

SEQ ID NO: 1673186 - RNA, 23 nt, Homo sapiens
aaauucuguuuauguucuugcag

SEQ ID NO: 1673187 - RNA, 16 nt, Homo sapiens
aaauugcagcaguugc

SEQ ID NO: 1673188 - RNA, 16 nt, Homo sapiens
aaauugcuccauuccu

SEQ ID NO: 1673189 - RNA, 15 nt, Homo sapiens
aaauuguguauagca

SEQ ID NO: 1673190 - RNA, 17 nt, Homo sapiens
aaauuuacccaaugcag

SEQ ID NO: 1673191 - RNA, 14 nt, Homo sapiens
aaauuugacuguua

SEQ ID NO: 1673192 - RNA, 21 nt, Homo sapiens
aaauuuuagcguuaaagucag

SEQ ID NO: 1673193 - RNA, 18 nt, Homo sapiens
aaauuuucuuuaagucag

SEQ ID NO: 1673194 - RNA, 14 nt, Homo sapiens
aaauuuuuuuccag

SEQ ID NO: 1673195 - RNA, 19 nt, Homo sapiens
aacaaaaacuguugcuauu

SEQ ID NO: 1673196 - RNA, 12 nt, Homo sapiens
aacaaaacuugc

SEQ ID NO: 1673197 - RNA, 12 nt, Homo sapiens
aacaaaagggag

SEQ ID NO: 1673198 - RNA, 15 nt, Homo sapiens
aacaaagcaugcuca

SEQ ID NO: 1673199 - RNA, 15 nt, Homo sapiens
aacaaagcauuugac

SEQ ID NO: 1673200 - RNA, 21 nt, Homo sapiens
aacaaauggcuuguucaguca

SEQ ID NO: 1673201 - RNA, 22 nt, Homo sapiens
aacaacaauuuaggaaugcuca

SEQ ID NO: 1673202 - RNA, 19 nt, Homo sapiens
aacaacucgaaucacucau

SEQ ID NO: 1673203 - RNA, 21 nt, Homo sapiens
aacaagcaagcaaaaugcaaa

SEQ ID NO: 1673204 - RNA, 15 nt, Homo sapiens
aacaagcaaugagaa

SEQ ID NO: 1673205 - RNA, 12 nt, Homo sapiens
aacaagcugaua

SEQ ID NO: 1673206 - RNA, 21 nt, Homo sapiens
aacaaugccuuguuguauucc

SEQ ID NO: 1673207 - RNA, 22 nt, Homo sapiens
aacaaugccuuguuguauuccu

SEQ ID NO: 1673208 - RNA, 12 nt, Homo sapiens
aacacagugcag

SEQ ID NO: 1673209 - RNA, 18 nt, Homo sapiens
aacacaguguagugcuca

SEQ ID NO: 1673210 - RNA, 23 nt, Homo sapiens
aacacuggcuuuggguagugcca

SEQ ID NO: 1673211 - RNA, 16 nt, Homo sapiens
aacagaccagcauagu

SEQ ID NO: 1673212 - RNA, 13 nt, Homo sapiens
aacagagacugga

SEQ ID NO: 1673213 - RNA, 19 nt, Homo sapiens
aacagcaauuguucaggga

SEQ ID NO: 1673214 - RNA, 21 nt, Homo sapiens
aacagccuuaaauccuuuaca

SEQ ID NO: 1673215 - RNA, 20 nt, Homo sapiens
aacagcuaacaauaaagugu

SEQ ID NO: 1673216 - RNA, 12 nt, Homo sapiens
aacaguaaauau

SEQ ID NO: 1673217 - RNA, 17 nt, Homo sapiens
aacaguuuaacagaaaa

SEQ ID NO: 1673218 - RNA, 13 nt, Homo sapiens
aacauaucuugag

SEQ ID NO: 1673219 - RNA, 23 nt, Homo sapiens
aacauccuggagaguaucugaga

SEQ ID NO: 1673220 - RNA, 20 nt, Homo sapiens
aacaucuuuuucuacucgag

SEQ ID NO: 1673221 - RNA, 22 nt, Homo sapiens
aacaugcacauucauccucaca

SEQ ID NO: 1673222 - RNA, 16 nt, Homo sapiens
aacaugguuaccucug

SEQ ID NO: 1673223 - RNA, 21 nt, Homo sapiens
aacauguggcaaccuguucuu

SEQ ID NO: 1673224 - RNA, 21 nt, Homo sapiens
aacauucuauuucaacuucag

SEQ ID NO: 1673225 - RNA, 19 nt, Homo sapiens
aagcugcugccgccucacc

SEQ ID NO: 1673226 - RNA, 21 nt, Homo sapiens
aagcugggagaaccaaaaaga

SEQ ID NO: 1673227 - RNA, 23 nt, Homo sapiens
aagcuggggccccugcaaccucg

SEQ ID NO: 1673228 - RNA, 21 nt, Homo sapiens
aagcuguaagauaauguugcu

SEQ ID NO: 1673229 - RNA, 13 nt, Homo sapiens
aagcugucacuca

SEQ ID NO: 1673230 - RNA, 20 nt, Homo sapiens
aagcuuaaacauugccuuau

SEQ ID NO: 1673231 - RNA, 12 nt, Homo sapiens
aagcuucuugcu

SEQ ID NO: 1673232 - RNA, 17 nt, Homo sapiens
aaggaaagaggcucugg

SEQ ID NO: 1673233 - RNA, 17 nt, Homo sapiens
aaggaagacuucauccc

SEQ ID NO: 1673234 - RNA, 12 nt, Homo sapiens
aaggagaaggca

SEQ ID NO: 1673235 - RNA, 17 nt, Homo sapiens
aaggaggggaagcugca

SEQ ID NO: 1673236 - RNA, 13 nt, Homo sapiens
aaggcaaugacaa

SEQ ID NO: 1673237 - RNA, 13 nt, Homo sapiens
aaggcacaggugu

SEQ ID NO: 1673238 - RNA, 14 nt, Homo sapiens
aaggcacaggugua

SEQ ID NO: 1673239 - RNA, 21 nt, Homo sapiens
aaggcacauugaaauacuuga

SEQ ID NO: 1673240 - RNA, 21 nt, Homo sapiens
aaggcacccgcccuuuccuug

SEQ ID NO: 1673241 - RNA, 15 nt, Homo sapiens
aaggcagcuagacac

SEQ ID NO: 1673242 - RNA, 18 nt, Homo sapiens
aaggcaggaacacuggag

SEQ ID NO: 1673243 - RNA, 15 nt, Homo sapiens
aaggcaguaugccaa

SEQ ID NO: 1673244 - RNA, 13 nt, Homo sapiens
aaggcagugcagu

SEQ ID NO: 1673245 - RNA, 14 nt, Homo sapiens
aaggcaucuaagac

SEQ ID NO: 1673246 - RNA, 18 nt, Homo sapiens
aaggccagcccacacagc

SEQ ID NO: 1673247 - RNA, 18 nt, Homo sapiens
aaggccucauccuccacu

SEQ ID NO: 1673248 - RNA, 19 nt, Homo sapiens
aaggcgucucuucaaacag

SEQ ID NO: 1673249 - RNA, 16 nt, Homo sapiens
aaggcuuccaaugugg

SEQ ID NO: 1673250 - RNA, 21 nt, Homo sapiens
aaggcuucuccacaaccuccu

SEQ ID NO: 1673251 - RNA, 23 nt, Homo sapiens
aaggcuugguugguagauauuca

SEQ ID NO: 1673252 - RNA, 23 nt, Homo sapiens
aagggaaaacaaauauuucacuu

SEQ ID NO: 1673253 - RNA, 18 nt, Homo sapiens
aagggaagcccugacaac

SEQ ID NO: 1673254 - RNA, 13 nt, Homo sapiens
aagggaccccaga

SEQ ID NO: 1673255 - RNA, 15 nt, Homo sapiens
aagggaccccagaua

SEQ ID NO: 1673256 - RNA, 22 nt, Homo sapiens
aagggacuuuggaauucugcuu

SEQ ID NO: 1673257 - RNA, 16 nt, Homo sapiens
aagggugcccaccucu

SEQ ID NO: 1673258 - RNA, 15 nt, Homo sapiens
aaggguguugcagag

SEQ ID NO: 1673259 - RNA, 14 nt, Homo sapiens
aagguaacuguaca

SEQ ID NO: 1673260 - RNA, 13 nt, Homo sapiens
aagguaauacuuu

SEQ ID NO: 1673261 - RNA, 21 nt, Homo sapiens
aaggucuaccugaaaauucaa

SEQ ID NO: 1673262 - RNA, 11 nt, Homo sapiens
aaggucucauu

SEQ ID NO: 1673263 - RNA, 15 nt, Homo sapiens
aagguucuugcugcc

SEQ ID NO: 1673264 - RNA, 17 nt, Homo sapiens
aaguaaaucuaucucua

SEQ ID NO: 1673265 - RNA, 16 nt, Homo sapiens
aaguaaucuguugaca

SEQ ID NO: 1673266 - RNA, 17 nt, Homo sapiens
aaguaauuuucuucuca

SEQ ID NO: 1673267 - RNA, 19 nt, Homo sapiens
aaguacugaaauacauaug

SEQ ID NO: 1673268 - RNA, 17 nt, Homo sapiens
aaguacuguacuuuccc

SEQ ID NO: 1673269 - RNA, 23 nt, Homo sapiens
aaguaucagaggugaaugcacag

SEQ ID NO: 1673270 - RNA, 19 nt, Homo sapiens
aaguaugcacuaaucaaua

SEQ ID NO: 1673271 - RNA, 20 nt, Homo sapiens
aaguaugcuuucuccugaaa

SEQ ID NO: 1673272 - RNA, 18 nt, Homo sapiens
aagucaaacaguguggcu

SEQ ID NO: 1673273 - RNA, 17 nt, Homo sapiens
aagucacguagcacaga

SEQ ID NO: 1673274 - RNA, 13 nt, Homo sapiens
aaguccuaauaaa

SEQ ID NO: 1673275 - RNA, 14 nt, Homo sapiens
aagucuacacugcc

SEQ ID NO: 1673276 - RNA, 16 nt, Homo sapiens
aagucuccuguaucau

SEQ ID NO: 1673277 - RNA, 18 nt, Homo sapiens
aagucuuaguacauccuc

SEQ ID NO: 1673278 - RNA, 18 nt, Homo sapiens
aagugaagacgaggccaa

SEQ ID NO: 1673279 - RNA, 15 nt, Homo sapiens
aagugaugugauuua

SEQ ID NO: 1673280 - RNA, 23 nt, Homo sapiens
aagugcuggcauuacagguguga

SEQ ID NO: 1673281 - RNA, 20 nt, Homo sapiens
aagugcuucuccagccucag

SEQ ID NO: 1673282 - RNA, 18 nt, Homo sapiens
aagugguaggaaagccuc

SEQ ID NO: 1673283 - RNA, 14 nt, Homo sapiens
aaguguguuugcaa

SEQ ID NO: 1673284 - RNA, 15 nt, Homo sapiens
aaguuaaaaagucaa

SEQ ID NO: 1673285 - RNA, 14 nt, Homo sapiens
aaguuaauucucag

SEQ ID NO: 1673286 - RNA, 20 nt, Homo sapiens
aguugcaauaaacucaguca

SEQ ID NO: 1673287 - RNA, 20 nt, Homo sapiens
aguugccguggcaacugugg

SEQ ID NO: 1673288 - RNA, 13 nt, Homo sapiens
aguuggagugcaa

SEQ ID NO: 1673289 - RNA, 15 nt, Homo sapiens
aguuggugcugcuuu

SEQ ID NO: 1673290 - RNA, 21 nt, Homo sapiens
aguugguuaccuauugcugua

SEQ ID NO: 1673291 - RNA, 23 nt, Homo sapiens
aguugugaucuguuguaauauca

SEQ ID NO: 1673292 - RNA, 23 nt, Homo sapiens
aguuuccagcuaagccugaugau

SEQ ID NO: 1673293 - RNA, 20 nt, Homo sapiens
aguuucuauggauucacuuc

SEQ ID NO: 1673294 - RNA, 19 nt, Homo sapiens
aguuucucuuaagcugccc

SEQ ID NO: 1673295 - RNA, 14 nt, Homo sapiens
aguuugaccucaca

SEQ ID NO: 1673296 - RNA, 20 nt, Homo sapiens
aguuugggguaugggagaga

SEQ ID NO: 1673297 - RNA, 21 nt, Homo sapiens
aguuugugaucuguccuucca

SEQ ID NO: 1673298 - RNA, 22 nt, Homo sapiens
aguuuguuguucagaagaaaga

SEQ ID NO: 1673299 - RNA, 13 nt, Homo sapiens
auaaaaacauaaa

SEQ ID NO: 1673300 - RNA, 19 nt, Homo sapiens
auaaaacucccuuccuuau

SEQ ID NO: 1673301 - RNA, 13 nt, Homo sapiens
auaaaacucugca

SEQ ID NO: 1673302 - RNA, 16 nt, Homo sapiens
auaaaauacauacuau

SEQ ID NO: 1673303 - RNA, 11 nt, Homo sapiens
auaaacacaga

SEQ ID NO: 1673304 - RNA, 12 nt, Homo sapiens
auaaacugugag

SEQ ID NO: 1673305 - RNA, 19 nt, Homo sapiens
auaaacuuuuuauucucag

SEQ ID NO: 1673306 - RNA, 16 nt, Homo sapiens
auaaagacuaguuuac

SEQ ID NO: 1673307 - RNA, 20 nt, Homo sapiens
auaaaguuuuugacuuccuu

SEQ ID NO: 1673308 - RNA, 19 nt, Homo sapiens
auaaaucguaaccuaugaa

SEQ ID NO: 1673309 - RNA, 17 nt, Homo sapiens
auaaauguguaaaugug

SEQ ID NO: 1673310 - RNA, 18 nt, Homo sapiens
auaaauguguaaaugugg

SEQ ID NO: 1673311 - RNA, 11 nt, Homo sapiens
auaacacuggc

SEQ ID NO: 1673312 - RNA, 21 nt, Homo sapiens
auaacacuguacugcaauaag

SEQ ID NO: 1673313 - RNA, 15 nt, Homo sapiens
auaacaggcauugca

SEQ ID NO: 1673314 - RNA, 12 nt, Homo sapiens
auaaccaaguga

SEQ ID NO: 1673315 - RNA, 14 nt, Homo sapiens
auaacccugaauca

SEQ ID NO: 1673316 - RNA, 14 nt, Homo sapiens
auaacuagaucucc

SEQ ID NO: 1673317 - RNA, 20 nt, Homo sapiens
auaacuugugauuccagggc

SEQ ID NO: 1673318 - RNA, 21 nt, Homo sapiens
auaaggcagugcagugcucag

SEQ ID NO: 1673319 - RNA, 23 nt, Homo sapiens
auaaggccucauccuccacugaa

SEQ ID NO: 1673320 - RNA, 18 nt, Homo sapiens
auaaguaaaugagccuuu

SEQ ID NO: 1673321 - RNA, 17 nt, Homo sapiens
auaaguaaaugucuuca

SEQ ID NO: 1673322 - RNA, 17 nt, Homo sapiens
auaagugcucaguauug

SEQ ID NO: 1673323 - RNA, 18 nt, Homo sapiens
auaagugcucaguauuga

SEQ ID NO: 1673324 - RNA, 17 nt, Homo sapiens
auaauaaaauucauucc

SEQ ID NO: 1673325 - RNA, 19 nt, Homo sapiens
auaauaaaauucauuccau

SEQ ID NO: 1673326 - RNA, 20 nt, Homo sapiens
auaaucugaaaugacaggau

SEQ ID NO: 1673327 - RNA, 14 nt, Homo sapiens
auaaucuuuuaaca

SEQ ID NO: 1673328 - RNA, 11 nt, Homo sapiens
auaaugcuucu

SEQ ID NO: 1673329 - RNA, 20 nt, Homo sapiens
auaauguuaguagcacugag

SEQ ID NO: 1673330 - RNA, 20 nt, Homo sapiens
auaauuaaaugaaauacuug

SEQ ID NO: 1673331 - RNA, 12 nt, Homo sapiens
auaauuacuuuc

SEQ ID NO: 1673332 - RNA, 22 nt, Homo sapiens
auacaaaaauaccuacugcuga

SEQ ID NO: 1673333 - RNA, 20 nt, Homo sapiens
auacaaauugauagucaaua

SEQ ID NO: 1673334 - RNA, 18 nt, Homo sapiens
auacaauacaguacucag

SEQ ID NO: 1673335 - RNA, 13 nt, Homo sapiens
auacaauuugccc

SEQ ID NO: 1673336 - RNA, 14 nt, Homo sapiens
auacacacacacac

SEQ ID NO: 1673337 - RNA, 20 nt, Homo sapiens
auacagacagagauggccau

SEQ ID NO: 1673338 - RNA, 10 nt, Homo sapiens
auacaguacu

SEQ ID NO: 1673339 - RNA, 12 nt, Homo sapiens
auacaguauuau

SEQ ID NO: 1673340 - RNA, 16 nt, Homo sapiens
auacauauguaugugu

SEQ ID NO: 1673341 - RNA, 20 nt, Homo sapiens
auacaugccuuuccagugcu

SEQ ID NO: 1673342 - RNA, 15 nt, Homo sapiens
auacauuagugccau

SEQ ID NO: 1673343 - RNA, 17 nt, Homo sapiens
auaccagagacucugaa

SEQ ID NO: 1673344 - RNA, 14 nt, Homo sapiens
auaccauccauccc

SEQ ID NO: 1673345 - RNA, 18 nt, Homo sapiens
auacccacugccagacau

SEQ ID NO: 1673346 - RNA, 14 nt, Homo sapiens
auacccuugugauu

SEQ ID NO: 1673347 - RNA, 22 nt, Homo sapiens
auaccucucaacuuacauaugu

SEQ ID NO: 1673348 - RNA, 12 nt, Homo sapiens
auaccugugagg

SEQ ID NO: 1673349 - RNA, 17 nt, Homo sapiens
auacucauuuggauaua

SEQ ID NO: 1673350 - RNA, 21 nt, Homo sapiens
auacugacuccaaccauucaa

SEQ ID NO: 1673351 - RNA, 21 nt, Homo sapiens
auacuuucuaaaugccuuuga

SEQ ID NO: 1673352 - RNA, 17 nt, Homo sapiens
auagaaacaugacacug

SEQ ID NO: 1673353 - RNA, 16 nt, Homo sapiens
auagaugucuguguau

SEQ ID NO: 1673354 - RNA, 17 nt, Homo sapiens
auagauuaauggcacug

SEQ ID NO: 1673355 - RNA, 18 nt, Homo sapiens
auagauuaauggcacuga

SEQ ID NO: 1673356 - RNA, 19 nt, Homo sapiens
auagauuaauggcacugau

SEQ ID NO: 1673357 - RNA, 17 nt, Homo sapiens
auagccaaggccaaagg

SEQ ID NO: 1673358 - RNA, 22 nt, Homo sapiens
auagccgugugagcagucucag

SEQ ID NO: 1673359 - RNA, 15 nt, Homo sapiens
auagcuuaagaagua

SEQ ID NO: 1673360 - RNA, 13 nt, Homo sapiens
auaguuacaagca

SEQ ID NO: 1673361 - RNA, 18 nt, Homo sapiens
auaguuuuaucuggaaaa

SEQ ID NO: 1673362 - RNA, 15 nt, Homo sapiens
auauaaacugugaga

SEQ ID NO: 1673363 - RNA, 15 nt, Homo sapiens
auauaauauauguca

SEQ ID NO: 1673364 - RNA, 12 nt, Homo sapiens
auauacauaacu

SEQ ID NO: 1673365 - RNA, 13 nt, Homo sapiens
auauacauauaca

SEQ ID NO: 1673366 - RNA, 23 nt, Homo sapiens
auauacauauguuaauucuaguc

SEQ ID NO: 1673367 - RNA, 22 nt, Homo sapiens
auauacauuagacacacauaua

SEQ ID NO: 1673368 - RNA, 19 nt, Homo sapiens
auauagaugucuguguaua

SEQ ID NO: 1673369 - RNA, 16 nt, Homo sapiens
auauagugaugugcua

SEQ ID NO: 1673370 - RNA, 14 nt, Homo sapiens
auauauaagcucau

SEQ ID NO: 1673371 - RNA, 20 nt, Homo sapiens
auauauaauguggggugaaa

SEQ ID NO: 1673372 - RNA, 14 nt, Homo sapiens
auaucagaguaugu

SEQ ID NO: 1673373 - RNA, 11 nt, Homo sapiens
auaucagcucu

SEQ ID NO: 1673374 - RNA, 23 nt, Homo sapiens
auaucauucacccaaaacaaagu

SEQ ID NO: 1673375 - RNA, 17 nt, Homo sapiens
auaucuguggucuucaa

SEQ ID NO: 1673376 - RNA, 20 nt, Homo sapiens
auaucuugaagaauauuguu

SEQ ID NO: 1673377 - RNA, 17 nt, Homo sapiens
auaugaaaacuaaguuc

SEQ ID NO: 1673378 - RNA, 14 nt, Homo sapiens
auaugcacuugaaa

SEQ ID NO: 1673379 - RNA, 18 nt, Homo sapiens
auaugggaggaacaaaga

SEQ ID NO: 1673380 - RNA, 16 nt, Homo sapiens
auauguaauauauaca

SEQ ID NO: 1673381 - RNA, 14 nt, Homo sapiens
auauguaucuaguc

SEQ ID NO: 1673382 - RNA, 21 nt, Homo sapiens
auauguaugugugaguguaug

SEQ ID NO: 1673383 - RNA, 15 nt, Homo sapiens
auauguggaguucau

SEQ ID NO: 1673384 - RNA, 24 nt, Homo sapiens
auauuaaaaucacaaacucaucca

SEQ ID NO: 1673385 - RNA, 18 nt, Homo sapiens
auauuaaggcaguaugcc

SEQ ID NO: 1673386 - RNA, 16 nt, Homo sapiens
auauuaaggcuuacua

SEQ ID NO: 1673387 - RNA, 23 nt, Homo sapiens
auauuauauaaauaguauuucag

SEQ ID NO: 1673388 - RNA, 21 nt, Homo sapiens
auauucauaccuucugaugaa

SEQ ID NO: 1673389 - RNA, 20 nt, Homo sapiens
auauucaugcugccugccau

SEQ ID NO: 1673390 - RNA, 15 nt, Homo sapiens
auauuccagguuuaa

SEQ ID NO: 1673391 - RNA, 22 nt, Homo sapiens
auauugaaugaugugauacaaa

SEQ ID NO: 1673392 - RNA, 18 nt, Homo sapiens
auauugccauuucuucca

SEQ ID NO: 1673393 - RNA, 20 nt, Homo sapiens
auauuuaggcaugagcucuu

SEQ ID NO: 1673394 - RNA, 21 nt, Homo sapiens
auauuuaggcaugagcucuug

SEQ ID NO: 1673395 - RNA, 14 nt, Homo sapiens
auauuucaaccaca

SEQ ID NO: 1673396 - RNA, 20 nt, Homo sapiens
auauuuucgcccaccuaaag

SEQ ID NO: 1673397 - RNA, 17 nt, Homo sapiens
auauuuuuuuaacuuua

SEQ ID NO: 1673398 - RNA, 17 nt, Homo sapiens
aucaaacuagugcauga

SEQ ID NO: 1673399 - RNA, 12 nt, Homo sapiens
aucaaacuucca

SEQ ID NO: 1673400 - RNA, 12 nt, Homo sapiens
aucaaagcacau

SEQ ID NO: 1673401 - RNA, 13 nt, Homo sapiens
aucaacucugucu

SEQ ID NO: 1673402 - RNA, 21 nt, Homo sapiens
aucaagucccgaggcagcaac

SEQ ID NO: 1673403 - RNA, 22 nt, Homo sapiens
aucaagucugugaaagucuccu

SEQ ID NO: 1673404 - RNA, 23 nt, Homo sapiens
aucaauguucacgcaacuugaaa

SEQ ID NO: 1673405 - RNA, 19 nt, Homo sapiens
aucaccagaaaugauagcg

SEQ ID NO: 1673406 - RNA, 18 nt, Homo sapiens
aucaccgauucuuccuug

SEQ ID NO: 1673407 - RNA, 14 nt, Homo sapiens
aucacguugcaaug

SEQ ID NO: 1673408 - RNA, 20 nt, Homo sapiens
aucacugaaaucccucuacc

SEQ ID NO: 1673409 - RNA, 21 nt, Homo sapiens
agccgguaaguaaacagucag

SEQ ID NO: 1673410 - RNA, 17 nt, Homo sapiens
agccgucagccugugaa

SEQ ID NO: 1673411 - RNA, 23 nt, Homo sapiens
agccuaugaggggguuuggcacc

SEQ ID NO: 1673412 - RNA, 14 nt, Homo sapiens
agccucagccuccc

SEQ ID NO: 1673413 - RNA, 15 nt, Homo sapiens
agccugaugauggaa

SEQ ID NO: 1673414 - RNA, 14 nt, Homo sapiens
agccugcuucccac

SEQ ID NO: 1673415 - RNA, 13 nt, Homo sapiens
agccuugugauca

SEQ ID NO: 1673416 - RNA, 19 nt, Homo sapiens
agcggcuuccugaugaugg

SEQ ID NO: 1673417 - RNA, 14 nt, Homo sapiens
agcguccaggugau

SEQ ID NO: 1673418 - RNA, 16 nt, Homo sapiens
agcgucccuagcagug

SEQ ID NO: 1673419 - RNA, 18 nt, Homo sapiens
agcgucccuagcagugaa

SEQ ID NO: 1673420 - RNA, 15 nt, Homo sapiens
agcguguacuacccc

SEQ ID NO: 1673421 - RNA, 16 nt, Homo sapiens
agcuaaacaugcugcc

SEQ ID NO: 1673422 - RNA, 15 nt, Homo sapiens
agcuaagccugauga

SEQ ID NO: 1673423 - RNA, 12 nt, Homo sapiens
agcuaccaggaa

SEQ ID NO: 1673424 - RNA, 13 nt, Homo sapiens
agcuaccaggaag

SEQ ID NO: 1673425 - RNA, 16 nt, Homo sapiens
agcuagaugugucuua

SEQ ID NO: 1673426 - RNA, 15 nt, Homo sapiens
agcuaugauaugugc

SEQ ID NO: 1673427 - RNA, 19 nt, Homo sapiens
agcuaugauaugugcuugu

SEQ ID NO: 1673428 - RNA, 21 nt, Homo sapiens
agcuauuuaaguggacuguau

SEQ ID NO: 1673429 - RNA, 13 nt, Homo sapiens
agcucaaguuuca

SEQ ID NO: 1673430 - RNA, 22 nt, Homo sapiens
agcucacagcacauuuguuaau

SEQ ID NO: 1673431 - RNA, 17 nt, Homo sapiens
agcucacuacaaccucc

SEQ ID NO: 1673432 - RNA, 13 nt, Homo sapiens
agcucacugcaag

SEQ ID NO: 1673433 - RNA, 18 nt, Homo sapiens
agcucagaaaaucaaaga

SEQ ID NO: 1673434 - RNA, 12 nt, Homo sapiens
agcuccuuccac

SEQ ID NO: 1673435 - RNA, 16 nt, Homo sapiens
agcucucaucuaguuu

SEQ ID NO: 1673436 - RNA, 13 nt, Homo sapiens
agcugaagcguua

SEQ ID NO: 1673437 - RNA, 17 nt, Homo sapiens
agcugacccaacacuua

SEQ ID NO: 1673438 - RNA, 20 nt, Homo sapiens
agcugacccccugcugccau

SEQ ID NO: 1673439 - RNA, 13 nt, Homo sapiens
agcugagcacagc

SEQ ID NO: 1673440 - RNA, 19 nt, Homo sapiens
agcugcccacaacuugcca

SEQ ID NO: 1673441 - RNA, 13 nt, Homo sapiens
agcugcucauuuc

SEQ ID NO: 1673442 - RNA, 16 nt, Homo sapiens
agcugcucauuucacu

SEQ ID NO: 1673443 - RNA, 15 nt, Homo sapiens
agcugcucuccuuca

SEQ ID NO: 1673444 - RNA, 18 nt, Homo sapiens
agcugcuguuuuuagacu

SEQ ID NO: 1673445 - RNA, 20 nt, Homo sapiens
agcugcuugggcuucauccu

SEQ ID NO: 1673446 - RNA, 22 nt, Homo sapiens
agcuggggccccugcaaccucg

SEQ ID NO: 1673447 - RNA, 17 nt, Homo sapiens
agcugggguggggaccu

SEQ ID NO: 1673448 - RNA, 21 nt, Homo sapiens
agcuguaagauaauguugcuu

SEQ ID NO: 1673449 - RNA, 11 nt, Homo sapiens
agcugugauuu

SEQ ID NO: 1673450 - RNA, 23 nt, Homo sapiens
agcuguuuuggaugaaugcagua

SEQ ID NO: 1673451 - RNA, 15 nt, Homo sapiens
agcuuaaacauugcc

SEQ ID NO: 1673452 - RNA, 17 nt, Homo sapiens
agcuuaccugacacaag

SEQ ID NO: 1673453 - RNA, 22 nt, Homo sapiens
agcuuccucuaaacuucucacc

SEQ ID NO: 1673454 - RNA, 21 nt, Homo sapiens
agcuugaccgugaggccagag

SEQ ID NO: 1673455 - RNA, 13 nt, Homo sapiens
agcuugcagugag

SEQ ID NO: 1673456 - RNA, 21 nt, Homo sapiens
cugggccugcuagucugucag

SEQ ID NO: 1673457 - RNA, 13 nt, Homo sapiens
cugggcugugagg

SEQ ID NO: 1673458 - RNA, 13 nt, Homo sapiens
cuggggaagccag

SEQ ID NO: 1673459 - RNA, 21 nt, Homo sapiens
cuggggcuuuagcuagaagaa

SEQ ID NO: 1673460 - RNA, 21 nt, Homo sapiens
cugggguggggaccucaggcc

SEQ ID NO: 1673461 - RNA, 15 nt, Homo sapiens
cuggguccucccagc

SEQ ID NO: 1673462 - RNA, 13 nt, Homo sapiens
cuggguccuuaaa

SEQ ID NO: 1673463 - RNA, 12 nt, Homo sapiens
cugggugacaaa

SEQ ID NO: 1673464 - RNA, 16 nt, Homo sapiens
cuugacuguuaucucg

SEQ ID NO: 1673465 - RNA, 16 nt, Homo sapiens
cuugagcaaggcaaga

SEQ ID NO: 1673466 - RNA, 18 nt, Homo sapiens
cuugagcccagagugaac

SEQ ID NO: 1673467 - RNA, 16 nt, Homo sapiens
cuugaggccaaaugag

SEQ ID NO: 1673468 - RNA, 22 nt, Homo sapiens
cuugaggccaaaugaguucccu

SEQ ID NO: 1673469 - RNA, 21 nt, Homo sapiens
cuugaguaguuuuuaucugaa

SEQ ID NO: 1673470 - RNA, 19 nt, Homo sapiens
cuugaguggacagcagcug

SEQ ID NO: 1673471 - RNA, 19 nt, Homo sapiens
cuugaucaugaaucacugc

SEQ ID NO: 1673472 - RNA, 13 nt, Homo sapiens
cuugaugggguga

SEQ ID NO: 1673473 - RNA, 19 nt, Homo sapiens
cuugauucauaaugacuua

SEQ ID NO: 1673474 - RNA, 16 nt, Homo sapiens
cuugauucuaaagggg

SEQ ID NO: 1673475 - RNA, 16 nt, Homo sapiens
cuugcacuguauccaa

SEQ ID NO: 1673476 - RNA, 22 nt, Homo sapiens
cuugccaaaacagauauacucg

SEQ ID NO: 1673477 - RNA, 14 nt, Homo sapiens
cuugcccaugcaca

SEQ ID NO: 1673478 - RNA, 13 nt, Homo sapiens
cuugcccuauuau

SEQ ID NO: 1673479 - RNA, 21 nt, Homo sapiens
cuugcccuuugagaaacccaa

SEQ ID NO: 1673480 - RNA, 20 nt, Homo sapiens
cuugccuccaggaccuugcu

SEQ ID NO: 1673481 - RNA, 14 nt, Homo sapiens
cuuggaggaucccc

SEQ ID NO: 1673482 - RNA, 13 nt, Homo sapiens
cuuggcacauccg

SEQ ID NO: 1673483 - RNA, 19 nt, Homo sapiens
cuuggcuagucacauauca

SEQ ID NO: 1673484 - RNA, 14 nt, Homo sapiens
cuuggcuguuccac

SEQ ID NO: 1673485 - RNA, 20 nt, Homo sapiens
cuuggcuguuccaccagagc

SEQ ID NO: 1673486 - RNA, 15 nt, Homo sapiens
cuugggauugucuua

SEQ ID NO: 1673487 - RNA, 21 nt, Homo sapiens
cuuggggaccagagcugccac

SEQ ID NO: 1673488 - RNA, 15 nt, Homo sapiens
cuugggugcauuugc

SEQ ID NO: 1673489 - RNA, 22 nt, Homo sapiens
cuuggugguuaugucccaugac

SEQ ID NO: 1673490 - RNA, 18 nt, Homo sapiens
cuuguaaaacugugacau

SEQ ID NO: 1673491 - RNA, 20 nt, Homo sapiens
cuuguauuaucuguccaaaa

SEQ ID NO: 1673492 - RNA, 13 nt, Homo sapiens
cuugucauucuca

SEQ ID NO: 1673493 - RNA, 11 nt, Homo sapiens
cuugugcacug

SEQ ID NO: 1673494 - RNA, 16 nt, Homo sapiens
cuugugcacuggaugu

SEQ ID NO: 1673495 - RNA, 15 nt, Homo sapiens
cuugugcaugcaaaa

SEQ ID NO: 1673496 - RNA, 18 nt, Homo sapiens
cuuguguacaaacccaga

SEQ ID NO: 1673497 - RNA, 20 nt, Homo sapiens
cuuguuaauuucauuccaaa

SEQ ID NO: 1673498 - RNA, 18 nt, Homo sapiens
cuuguugaugaagcacau

SEQ ID NO: 1673499 - RNA, 17 nt, Homo sapiens
cuuuaacaagacuucaa

SEQ ID NO: 1673500 - RNA, 21 nt, Homo sapiens
cuuuacuuuaaucuccuaauc

SEQ ID NO: 1673501 - RNA, 21 nt, Homo sapiens
cuuuagcuagaagaauuucaa

SEQ ID NO: 1673502 - RNA, 16 nt, Homo sapiens
cuuuagguauuacaca

SEQ ID NO: 1673503 - RNA, 14 nt, Homo sapiens
cuuucaaagugcac

SEQ ID NO: 1673504 - RNA, 14 nt, Homo sapiens
cuuucaacaauggg

SEQ ID NO: 1673505 - RNA, 14 nt, Homo sapiens
cuuucaauccacag

SEQ ID NO: 1673506 - RNA, 13 nt, Homo sapiens
cuuucaaugcuga

SEQ ID NO: 1673507 - RNA, 14 nt, Homo sapiens
cuuucaaugcugac

SEQ ID NO: 1673508 - RNA, 18 nt, Homo sapiens
cuuucccacacugugaac

SEQ ID NO: 1673509 - RNA, 15 nt, Homo sapiens
cuuucccgaugcgug

SEQ ID NO: 1673510 - RNA, 14 nt, Homo sapiens
cuuuccugggucug

SEQ ID NO: 1673511 - RNA, 13 nt, Homo sapiens
cuuuccuguaaag

SEQ ID NO: 1673512 - RNA, 17 nt, Homo sapiens
cuuucggaauuccugca

SEQ ID NO: 1673513 - RNA, 15 nt, Homo sapiens
cuuucuaaagacagg

SEQ ID NO: 1673514 - RNA, 17 nt, Homo sapiens
cuuucuucaauuaaugg

SEQ ID NO: 1673515 - RNA, 14 nt, Homo sapiens
cuuucuuguugcug

SEQ ID NO: 1673516 - RNA, 16 nt, Homo sapiens
cuuugaacacaccucu

SEQ ID NO: 1673517 - RNA, 19 nt, Homo sapiens
cuuugaacacaccucucuc

SEQ ID NO: 1673518 - RNA, 21 nt, Homo sapiens
cuuugacugaucagugugaua

SEQ ID NO: 1673519 - RNA, 20 nt, Homo sapiens
cuuugcucuuuuaauaacaa

SEQ ID NO: 1673520 - RNA, 14 nt, Homo sapiens
cuuuggacuaaaga

SEQ ID NO: 1673521 - RNA, 16 nt, Homo sapiens
cuuuggcuuaauucca

SEQ ID NO: 1673522 - RNA, 19 nt, Homo sapiens
cuuugggaggcugagaugg

SEQ ID NO: 1673523 - RNA, 19 nt, Homo sapiens
cuuuguauacaaguacugg

SEQ ID NO: 1673524 - RNA, 19 nt, Homo sapiens
cuuugucucacgauuccag

SEQ ID NO: 1673525 - RNA, 15 nt, Homo sapiens
cuuugucucugagaa

SEQ ID NO: 1673526 - RNA, 11 nt, Homo sapiens
cuuuguuaaaa

SEQ ID NO: 1673527 - RNA, 15 nt, Homo sapiens
cuuuguuaaauccaa

SEQ ID NO: 1673528 - RNA, 22 nt, Homo sapiens
cuuuucaagacuuccucaugaa

SEQ ID NO: 1673529 - RNA, 22 nt, Homo sapiens
cuuuucccagaagagucuuuga

SEQ ID NO: 1673530 - RNA, 23 nt, Homo sapiens
cuuuucuuugaaggaugacuaca

SEQ ID NO: 1673531 - RNA, 19 nt, Homo sapiens
cuuuucuuuuuuuguccac

SEQ ID NO: 1673532 - RNA, 23 nt, Homo sapiens
cuuuugacugcuuucccaaaggc

SEQ ID NO: 1673533 - RNA, 17 nt, Homo sapiens
cuuuuguauaacuacua

SEQ ID NO: 1673534 - RNA, 17 nt, Homo sapiens
cuuuuuacaauguauca

SEQ ID NO: 1673535 - RNA, 19 nt, Homo sapiens
cuuuuuuaagacucaauca

SEQ ID NO: 1673536 - RNA, 13 nt, Homo sapiens
cuuuuuucucuga

SEQ ID NO: 1673537 - RNA, 13 nt, Homo sapiens
cuuuuuugcaaua

SEQ ID NO: 1673538 - RNA, 17 nt, Homo sapiens
cuuuuuuuaaguguucu

SEQ ID NO: 1673539 - RNA, 15 nt, Homo sapiens
cuuuuuuuccaauuu

SEQ ID NO: 1673540 - RNA, 19 nt, Homo sapiens
cuuuuuuuucuucaccuca

SEQ ID NO: 1673541 - RNA, 21 nt, Homo sapiens
gaaaaaaaaauguucauucua

SEQ ID NO: 1673542 - RNA, 13 nt, Homo sapiens
gaaaaaagugcaa

SEQ ID NO: 1673543 - RNA, 16 nt, Homo sapiens
gaaaaaauaacacugu

SEQ ID NO: 1673544 - RNA, 14 nt, Homo sapiens
gaaaaacaaaaagg

SEQ ID NO: 1673545 - RNA, 23 nt, Homo sapiens
gaaaaagauauuguauuaucaua

SEQ ID NO: 1673546 - RNA, 18 nt, Homo sapiens
gaaaaauaguguguccau

SEQ ID NO: 1673547 - RNA, 19 nt, Homo sapiens
gaaaaauccuuguagaucu

SEQ ID NO: 1673548 - RNA, 19 nt, Homo sapiens
gaaaaccuaccacauucac

SEQ ID NO: 1673549 - RNA, 22 nt, Homo sapiens
gaaaaccucuuucggaaaugau

SEQ ID NO: 1673550 - RNA, 23 nt, Homo sapiens
gaaaaccugaggccaaauauuga

SEQ ID NO: 1673551 - RNA, 20 nt, Homo sapiens
gaaaacugccacaagcacaa

SEQ ID NO: 1673552 - RNA, 22 nt, Homo sapiens
gaaaaggcuugagucuggauaa

SEQ ID NO: 1673553 - RNA, 21 nt, Homo sapiens
gaaaagguagcuuaccugaca

SEQ ID NO: 1673554 - RNA, 22 nt, Homo sapiens
gaaaagguagcuuaccugacac

SEQ ID NO: 1673555 - RNA, 16 nt, Homo sapiens
gaaaaggugauuguca

SEQ ID NO: 1673556 - RNA, 19 nt, Homo sapiens
gaaaagguucuucaucccu

SEQ ID NO: 1673557 - RNA, 12 nt, Homo sapiens
gaaaaguuuuca

SEQ ID NO: 1673558 - RNA, 17 nt, Homo sapiens
gaaaauaaauacauaaa

SEQ ID NO: 1673559 - RNA, 21 nt, Homo sapiens
gaaaauaauaaaagaaucauu

SEQ ID NO: 1673560 - RNA, 18 nt, Homo sapiens
gaaaaucaaagaggccaa

SEQ ID NO: 1673561 - RNA, 16 nt, Homo sapiens
gaaaaugcuuucucau

SEQ ID NO: 1673562 - RNA, 17 nt, Homo sapiens
gaaaauuccagagcuau

SEQ ID NO: 1673563 - RNA, 22 nt, Homo sapiens
gaaacagcggcuccacuaaaga

SEQ ID NO: 1673564 - RNA, 17 nt, Homo sapiens
gaaacagcuugaugcug

SEQ ID NO: 1673565 - RNA, 18 nt, Homo sapiens
gaaacaugacacugaccu

SEQ ID NO: 1673566 - RNA, 19 nt, Homo sapiens
gaaaccagccaacccaagu

SEQ ID NO: 1673567 - RNA, 12 nt, Homo sapiens
gaaacccgggga

SEQ ID NO: 1673568 - RNA, 16 nt, Homo sapiens
gaaacccuugacuguu

SEQ ID NO: 1673569 - RNA, 18 nt, Homo sapiens
gaaacccuuuuacaguca

SEQ ID NO: 1673570 - RNA, 19 nt, Homo sapiens
gaaaccuaaggcaacauuu

SEQ ID NO: 1673571 - RNA, 17 nt, Homo sapiens
gaaacgaaaaccacaaa

SEQ ID NO: 1673572 - RNA, 13 nt, Homo sapiens
gaaacugcacugu

SEQ ID NO: 1673573 - RNA, 22 nt, Homo sapiens
gaaacuuccuuugagaauugug

SEQ ID NO: 1673574 - RNA, 14 nt, Homo sapiens
gaaagaagcaguuu

SEQ ID NO: 1673575 - RNA, 19 nt, Homo sapiens
gaaagacaguaaagaccau

SEQ ID NO: 1673576 - RNA, 20 nt, Homo sapiens
gaaagagcugaaaauggaga

SEQ ID NO: 1673577 - RNA, 21 nt, Homo sapiens
gaaagaucccaagucaaacag

SEQ ID NO: 1673578 - RNA, 14 nt, Homo sapiens
gaaagccucacuga

SEQ ID NO: 1673579 - RNA, 22 nt, Homo sapiens
gaaagcguuuuguuaucuucua

SEQ ID NO: 1673580 - RNA, 18 nt, Homo sapiens
gaaaggcaucuaagacau

SEQ ID NO: 1673581 - RNA, 23 nt, Homo sapiens
gaaaggcaucuaagacauucacc

SEQ ID NO: 1673582 - RNA, 16 nt, Homo sapiens
gaaagggucagguuag

SEQ ID NO: 1673583 - RNA, 17 nt, Homo sapiens
gaaaguacguuaugaua

SEQ ID NO: 1673584 - RNA, 18 nt, Homo sapiens
gaaagucuccuguaucau

SEQ ID NO: 1673585 - RNA, 18 nt, Homo sapiens
gaaaguuuauaucuugau

SEQ ID NO: 1673586 - RNA, 21 nt, Homo sapiens
ccuuccugggcagcccagaga

SEQ ID NO: 1673587 - RNA, 22 nt, Homo sapiens
ccuuccugggcagcccagagag

SEQ ID NO: 1673588 - RNA, 16 nt, Homo sapiens
ccuucucaucuugccu

SEQ ID NO: 1673589 - RNA, 16 nt, Homo sapiens
ccuucugaagaucuca

SEQ ID NO: 1673590 - RNA, 24 nt, Homo sapiens
ccuucuggggguguaucacaguca

SEQ ID NO: 1673591 - RNA, 18 nt, Homo sapiens
ccuucugugcaucuggcc

SEQ ID NO: 1673592 - RNA, 21 nt, Homo sapiens
ccuucuuuuccugggugcuca

SEQ ID NO: 1673593 - RNA, 22 nt, Homo sapiens
ccuucuuuuccugggugcucag

SEQ ID NO: 1673594 - RNA, 15 nt, Homo sapiens
ccuugaaauuucuca

SEQ ID NO: 1673595 - RNA, 16 nt, Homo sapiens
ccuugcuuccuucuca

SEQ ID NO: 1673596 - RNA, 23 nt, Homo sapiens
ccuugcuuucucuucuaauggaa

SEQ ID NO: 1673597 - RNA, 20 nt, Homo sapiens
ccuuuaauaggcuuguguaa

SEQ ID NO: 1673598 - RNA, 22 nt, Homo sapiens
ccuuuaccacccagaaauccau

SEQ ID NO: 1673599 - RNA, 15 nt, Homo sapiens
ccuuuagcuuucuaa

SEQ ID NO: 1673600 - RNA, 23 nt, Homo sapiens
ccuuucaaauuuaggauggaaua

SEQ ID NO: 1673601 - RNA, 22 nt, Homo sapiens
cucaagcaugaagauaaacaca

SEQ ID NO: 1673602 - RNA, 19 nt, Homo sapiens
cucaaucucaggucuucac

SEQ ID NO: 1673603 - RNA, 13 nt, Homo sapiens
cucacagcacauu

SEQ ID NO: 1673604 - RNA, 18 nt, Homo sapiens
cucacccgccucuugccc

SEQ ID NO: 1673605 - RNA, 20 nt, Homo sapiens
cucacgauuccagugcagua

SEQ ID NO: 1673606 - RNA, 20 nt, Homo sapiens
cucacuucuuuccucaaaga

SEQ ID NO: 1673607 - RNA, 21 nt, Homo sapiens
cucacuugcuuuaguuguuaa

SEQ ID NO: 1673608 - RNA, 17 nt, Homo sapiens
cucagaaaaucaaagag

SEQ ID NO: 1673609 - RNA, 13 nt, Homo sapiens
cucagaacaccaa

SEQ ID NO: 1673610 - RNA, 21 nt, Homo sapiens
cucagaagagggaacuaagca

SEQ ID NO: 1673611 - RNA, 18 nt, Homo sapiens
cucagaagucaguugcaa

SEQ ID NO: 1673612 - RNA, 19 nt, Homo sapiens
cucagagaccgugagcgcc

SEQ ID NO: 1673613 - RNA, 23 nt, Homo sapiens
cucagauuccaccuagagcuaga

SEQ ID NO: 1673614 - RNA, 19 nt, Homo sapiens
cucagcaaucacaagccaa

SEQ ID NO: 1673615 - RNA, 14 nt, Homo sapiens
cucagcaauggcag

SEQ ID NO: 1673616 - RNA, 15 nt, Homo sapiens
cucagcauuguguac

SEQ ID NO: 1673617 - RNA, 14 nt, Homo sapiens
cucagcucacugca

SEQ ID NO: 1673618 - RNA, 16 nt, Homo sapiens
cucagcucacugcaag

SEQ ID NO: 1673619 - RNA, 17 nt, Homo sapiens
cucagcuugcacaaaga

SEQ ID NO: 1673620 - RNA, 17 nt, Homo sapiens
cucaggcugcccagcgg

SEQ ID NO: 1673621 - RNA, 21 nt, Homo sapiens
cucagggacuggcacacuggc

SEQ ID NO: 1673622 - RNA, 16 nt, Homo sapiens
cucaggugcgugccac

SEQ ID NO: 1673623 - RNA, 19 nt, Homo sapiens
cucaguaaaucagugcagu

SEQ ID NO: 1673624 - RNA, 23 nt, Homo sapiens
cucaguaaaucagugcaguacuc

SEQ ID NO: 1673625 - RNA, 21 nt, Homo sapiens
cucaguaacacagugcaguac

SEQ ID NO: 1673626 - RNA, 23 nt, Homo sapiens
cucaguaacacagugcaguacuc

SEQ ID NO: 1673627 - RNA, 20 nt, Homo sapiens
cucaguaacacagugcagug

SEQ ID NO: 1673628 - RNA, 15 nt, Homo sapiens
cucaguaacagugca

SEQ ID NO: 1673629 - RNA, 17 nt, Homo sapiens
cucaguaagacagugca

SEQ ID NO: 1673630 - RNA, 20 nt, Homo sapiens
cucaguaaggcagugcagua

SEQ ID NO: 1673631 - RNA, 14 nt, Homo sapiens
cucagucaaaugua

SEQ ID NO: 1673632 - RNA, 15 nt, Homo sapiens
cucaguccacugcug

SEQ ID NO: 1673633 - RNA, 17 nt, Homo sapiens
cucaguguuaggaacuu

SEQ ID NO: 1673634 - RNA, 20 nt, Homo sapiens
cucaguuaggcagugcagua

SEQ ID NO: 1673635 - RNA, 18 nt, Homo sapiens
cucaguuggugcugcuuu

SEQ ID NO: 1673636 - RNA, 20 nt, Homo sapiens
cucaguuggugcugcuuucu

SEQ ID NO: 1673637 - RNA, 21 nt, Homo sapiens
cucaguuggugcugcuuucuu

SEQ ID NO: 1673638 - RNA, 23 nt, Homo sapiens
cucauauauaguagacaaagagc

SEQ ID NO: 1673639 - RNA, 12 nt, Homo sapiens
cucaucagaaac

SEQ ID NO: 1673640 - RNA, 23 nt, Homo sapiens
cucaucccccaucagaugauggg

SEQ ID NO: 1673641 - RNA, 14 nt, Homo sapiens
cucaugauguauug

SEQ ID NO: 1673642 - RNA, 21 nt, Homo sapiens
cucaugcagauaguauacaca

SEQ ID NO: 1673643 - RNA, 18 nt, Homo sapiens
cucaugcauagacaagug

SEQ ID NO: 1673644 - RNA, 16 nt, Homo sapiens
cucauggaucugcaua

SEQ ID NO: 1673645 - RNA, 16 nt, Homo sapiens
cucauuagaauuacca

SEQ ID NO: 1673646 - RNA, 17 nt, Homo sapiens
cucauuauuuuucacug

SEQ ID NO: 1673647 - RNA, 21 nt, Homo sapiens
cucauuuauuuccauauuaaa

SEQ ID NO: 1673648 - RNA, 15 nt, Homo sapiens
cuccaaccuggaggc

SEQ ID NO: 1673649 - RNA, 17 nt, Homo sapiens
cuccaaggcaaaugucc

SEQ ID NO: 1673650 - RNA, 22 nt, Homo sapiens
cuccaaggcaaauguccaagca

SEQ ID NO: 1673651 - RNA, 12 nt, Homo sapiens
cuccacugcugc

SEQ ID NO: 1673652 - RNA, 21 nt, Homo sapiens
cuccacuggaggggucuccuc

SEQ ID NO: 1673653 - RNA, 16 nt, Homo sapiens
cuccagaacaaaccuc

SEQ ID NO: 1673654 - RNA, 22 nt, Homo sapiens
cuccagccugggugacagagcg

SEQ ID NO: 1673655 - RNA, 13 nt, Homo sapiens
cuccaguagcucc

SEQ ID NO: 1673656 - RNA, 22 nt, Homo sapiens
cuccaguauaaauuacaugcau

SEQ ID NO: 1673657 - RNA, 18 nt, Homo sapiens
cuccagucccccuauccu

SEQ ID NO: 1673658 - RNA, 15 nt, Homo sapiens
cuccaguucugauga

SEQ ID NO: 1673659 - RNA, 19 nt, Homo sapiens
cucccaaagugcugggauu

SEQ ID NO: 1673660 - RNA, 19 nt, Homo sapiens
cucccaaauaaacuccuua

SEQ ID NO: 1673661 - RNA, 19 nt, Homo sapiens
cucccaagcaccugggauu

SEQ ID NO: 1673662 - RNA, 17 nt, Homo sapiens
cucccacucucugcaag

SEQ ID NO: 1673663 - RNA, 13 nt, Homo sapiens
cucccagcuguac

SEQ ID NO: 1673664 - RNA, 14 nt, Homo sapiens
cucccaggguccug

SEQ ID NO: 1673665 - RNA, 13 nt, Homo sapiens
cucccccagggag

SEQ ID NO: 1673666 - RNA, 15 nt, Homo sapiens
cucccucgcuguaug

SEQ ID NO: 1673667 - RNA, 16 nt, Homo sapiens
cucccugcagagccaa

SEQ ID NO: 1673668 - RNA, 15 nt, Homo sapiens
cucccuuguccuccu

SEQ ID NO: 1673669 - RNA, 20 nt, Homo sapiens
cuccuaagcuggagugcagu

SEQ ID NO: 1673670 - RNA, 20 nt, Homo sapiens
cuccuagaagcccucugagc

SEQ ID NO: 1673671 - RNA, 19 nt, Homo sapiens
cuccucccaagcacuucaa

SEQ ID NO: 1673672 - RNA, 17 nt, Homo sapiens
cuccugagccacucaga

SEQ ID NO: 1673673 - RNA, 16 nt, Homo sapiens
cuccuuguacuugaau

SEQ ID NO: 1673674 - RNA, 16 nt, Homo sapiens
cucgcacuacaucuga

SEQ ID NO: 1673675 - RNA, 15 nt, Homo sapiens
cucgcuucauaggca

SEQ ID NO: 1673676 - RNA, 17 nt, Homo sapiens
cucgcuucauaggcaga

SEQ ID NO: 1673677 - RNA, 14 nt, Homo sapiens
cucggacaccaucu

SEQ ID NO: 1673678 - RNA, 14 nt, Homo sapiens
cucggucugagaag

SEQ ID NO: 1673679 - RNA, 14 nt, Homo sapiens
cucguguuucacag

SEQ ID NO: 1673680 - RNA, 14 nt, Homo sapiens
cucuaaacauuuca

SEQ ID NO: 1673681 - RNA, 15 nt, Homo sapiens
cucuaaacauuucau

SEQ ID NO: 1673682 - RNA, 16 nt, Homo sapiens
cucuaggaaucaaagu

SEQ ID NO: 1673683 - RNA, 13 nt, Homo sapiens
cucucaaaacccu

SEQ ID NO: 1673684 - RNA, 13 nt, Homo sapiens
cucuccaagcacu

SEQ ID NO: 1673685 - RNA, 13 nt, Homo sapiens
cucucccaaauaa

SEQ ID NO: 1673686 - RNA, 19 nt, Homo sapiens
cucuccuuccuuacccaaa

SEQ ID NO: 1673687 - RNA, 19 nt, Homo sapiens
cucucuacuagcaccauca

SEQ ID NO: 1673688 - RNA, 22 nt, Homo sapiens
cucucuggccucccaccaggaa

SEQ ID NO: 1673689 - RNA, 12 nt, Homo sapiens
cucucuuuacau

SEQ ID NO: 1673690 - RNA, 23 nt, Homo sapiens
cucugacgcaaaaccacuuuccu

SEQ ID NO: 1673691 - RNA, 21 nt, Homo sapiens
cucugagaguagagucacugg

SEQ ID NO: 1673692 - RNA, 21 nt, Homo sapiens
cucugagcacgccccacgcau

SEQ ID NO: 1673693 - RNA, 18 nt, Homo sapiens
cucugagcagacagggcg

SEQ ID NO: 1673694 - RNA, 15 nt, Homo sapiens
cucugauaugggacu

SEQ ID NO: 1673695 - RNA, 14 nt, Homo sapiens
cucugaugcacugu

SEQ ID NO: 1673696 - RNA, 23 nt, Homo sapiens
cucugauggcacuuuugagcucc

SEQ ID NO: 1673697 - RNA, 17 nt, Homo sapiens
cucugcagcucagggac

SEQ ID NO: 1673698 - RNA, 17 nt, Homo sapiens
cucugcucaucuacaca

SEQ ID NO: 1673699 - RNA, 15 nt, Homo sapiens
cucugcuggagguga

SEQ ID NO: 1673700 - RNA, 23 nt, Homo sapiens
cucuggaagagggaggggcccug

SEQ ID NO: 1673701 - RNA, 18 nt, Homo sapiens
cucuggcuaaauucaugc

SEQ ID NO: 1673702 - RNA, 17 nt, Homo sapiens
cucuguauaacuuguga

SEQ ID NO: 1673703 - RNA, 15 nt, Homo sapiens
cucuguccaaucagg

SEQ ID NO: 1673704 - RNA, 23 nt, Homo sapiens
cucuguccuucccccagcacaaa

SEQ ID NO: 1673705 - RNA, 23 nt, Homo sapiens
cucugucuugggcguuugaacuc

SEQ ID NO: 1673706 - RNA, 20 nt, Homo sapiens
cucuuaaguacugaaauaca

SEQ ID NO: 1673707 - RNA, 15 nt, Homo sapiens
cucuuauauugccau

SEQ ID NO: 1673708 - RNA, 20 nt, Homo sapiens
cucuucagagcaagcacugg

SEQ ID NO: 1673709 - RNA, 20 nt, Homo sapiens
cucuucaugcgcagucccca

SEQ ID NO: 1673710 - RNA, 16 nt, Homo sapiens
ccagugacacaacuca

SEQ ID NO: 1673711 - RNA, 16 nt, Homo sapiens
ccaguucagauucaua

SEQ ID NO: 1673712 - RNA, 19 nt, Homo sapiens
ccaguuuccacaggcagca

SEQ ID NO: 1673713 - RNA, 22 nt, Homo sapiens
ccauagaaacaugacacugacc

SEQ ID NO: 1673714 - RNA, 16 nt, Homo sapiens
ccaucacacauguuca

SEQ ID NO: 1673715 - RNA, 20 nt, Homo sapiens
ccauccacacacagcagcuc

SEQ ID NO: 1673716 - RNA, 13 nt, Homo sapiens
ccaucccacugau

SEQ ID NO: 1673717 - RNA, 22 nt, Homo sapiens
ccauccuaaggugcuuaccuca

SEQ ID NO: 1673718 - RNA, 15 nt, Homo sapiens
ccauccuucccgcag

SEQ ID NO: 1673719 - RNA, 22 nt, Homo sapiens
ccaucuccaggccccuuaccug

SEQ ID NO: 1673720 - RNA, 16 nt, Homo sapiens
ccaucuguuugauaca

SEQ ID NO: 1673721 - RNA, 16 nt, Homo sapiens
ccaugagaugaugcca

SEQ ID NO: 1673722 - RNA, 23 nt, Homo sapiens
ccaugauuuggggugauuucuca

SEQ ID NO: 1673723 - RNA, 18 nt, Homo sapiens
ccaugcccucccugcugc

SEQ ID NO: 1673724 - RNA, 20 nt, Homo sapiens
ccaugcccucccugcugcca

SEQ ID NO: 1673725 - RNA, 11 nt, Homo sapiens
ccaugcucaau

SEQ ID NO: 1673726 - RNA, 13 nt, Homo sapiens
ccauggccacaau

SEQ ID NO: 1673727 - RNA, 13 nt, Homo sapiens
ccauggugcagug

SEQ ID NO: 1673728 - RNA, 19 nt, Homo sapiens
ccauggugcagugaagaaa

SEQ ID NO: 1673729 - RNA, 16 nt, Homo sapiens
ccauggugguuucaga

SEQ ID NO: 1673730 - RNA, 23 nt, Homo sapiens
ccauguauguugcaugaauccau

SEQ ID NO: 1673731 - RNA, 20 nt, Homo sapiens
ccauugucauccuguaccac

SEQ ID NO: 1673732 - RNA, 14 nt, Homo sapiens
ccauuuaaucauuu

SEQ ID NO: 1673733 - RNA, 15 nt, Homo sapiens
ccauuuguauacuuu

SEQ ID NO: 1673734 - RNA, 23 nt, Homo sapiens
ccauuuucugugagaagugcaac

SEQ ID NO: 1673735 - RNA, 13 nt, Homo sapiens
ccauuuugaaaua

SEQ ID NO: 1673736 - RNA, 17 nt, Homo sapiens
cccaaaucucaaaagau

SEQ ID NO: 1673737 - RNA, 22 nt, Homo sapiens
cccaaccuccccugguccugca

SEQ ID NO: 1673738 - RNA, 14 nt, Homo sapiens
cccaagacuuggag

SEQ ID NO: 1673739 - RNA, 21 nt, Homo sapiens
cccaaggaaaauggacauauu

SEQ ID NO: 1673740 - RNA, 22 nt, Homo sapiens
cccaaggaaaauggacauauuc

SEQ ID NO: 1673741 - RNA, 18 nt, Homo sapiens
cccaaguuggagugcagu

SEQ ID NO: 1673742 - RNA, 20 nt, Homo sapiens
cccaaucaauacccuuguga

SEQ ID NO: 1673743 - RNA, 17 nt, Homo sapiens
cccaaucagcacugaaa

SEQ ID NO: 1673744 - RNA, 12 nt, Homo sapiens
cccaaucccauu

SEQ ID NO: 1673745 - RNA, 20 nt, Homo sapiens
cccacaggagcauguccuau

SEQ ID NO: 1673746 - RNA, 16 nt, Homo sapiens
cccacccugcugccuu

SEQ ID NO: 1673747 - RNA, 16 nt, Homo sapiens
cccaccuccaucaaac

SEQ ID NO: 1673748 - RNA, 19 nt, Homo sapiens
cccaccuccaucaaacgca

SEQ ID NO: 1673749 - RNA, 23 nt, Homo sapiens
cccaccucccgguguaugcagug

SEQ ID NO: 1673750 - RNA, 13 nt, Homo sapiens
cccaccugucaac

SEQ ID NO: 1673751 - RNA, 15 nt, Homo sapiens
cccacgcauggugca

SEQ ID NO: 1673752 - RNA, 18 nt, Homo sapiens
cccagaagagucuuugau

SEQ ID NO: 1673753 - RNA, 13 nt, Homo sapiens
cccagagauccug

SEQ ID NO: 1673754 - RNA, 17 nt, Homo sapiens
cccagagugaacacucu

SEQ ID NO: 1673755 - RNA, 18 nt, Homo sapiens
cccagcacaaagcacugg

SEQ ID NO: 1673756 - RNA, 23 nt, Homo sapiens
cccagcccaaccgggaaaggcau

SEQ ID NO: 1673757 - RNA, 22 nt, Homo sapiens
cccagccugcucccuagccaga

SEQ ID NO: 1673758 - RNA, 20 nt, Homo sapiens
cccagcucaggggcagcuca

SEQ ID NO: 1673759 - RNA, 16 nt, Homo sapiens
cccagcuccucuuccu

SEQ ID NO: 1673760 - RNA, 18 nt, Homo sapiens
cccagcuuggagugccac

SEQ ID NO: 1673761 - RNA, 17 nt, Homo sapiens
cccaggacgcaugcagg

SEQ ID NO: 1673762 - RNA, 18 nt, Homo sapiens
cccaggaggaaaagccca

SEQ ID NO: 1673763 - RNA, 14 nt, Homo sapiens
cccaggaggaccug

SEQ ID NO: 1673764 - RNA, 15 nt, Homo sapiens
cccaggaugaagggg

SEQ ID NO: 1673765 - RNA, 20 nt, Homo sapiens
cccaggauggagugcagugg

SEQ ID NO: 1673766 - RNA, 14 nt, Homo sapiens
cccagggaaugcca

SEQ ID NO: 1673767 - RNA, 13 nt, Homo sapiens
cccagguaucuga

SEQ ID NO: 1673768 - RNA, 19 nt, Homo sapiens
cccagguuggagugcagug

SEQ ID NO: 1673769 - RNA, 20 nt, Homo sapiens
cccagguuugauguccuucc

SEQ ID NO: 1673770 - RNA, 20 nt, Homo sapiens
cccaguuguugguuuggcca

SEQ ID NO: 1673771 - RNA, 17 nt, Homo sapiens
cccauaugccugggcag

SEQ ID NO: 1673772 - RNA, 14 nt, Homo sapiens
cccauccgcaucuc

SEQ ID NO: 1673773 - RNA, 19 nt, Homo sapiens
cccaugguagacugugaca

SEQ ID NO: 1673774 - RNA, 21 nt, Homo sapiens
cccaugguagacugugacaca

SEQ ID NO: 1673775 - RNA, 19 nt, Homo sapiens
cccauuaaaauaguuacaa

SEQ ID NO: 1673776 - RNA, 18 nt, Homo sapiens
cccauuagcccacugccu

SEQ ID NO: 1673777 - RNA, 21 nt, Homo sapiens
ccccaaucaauacccuuguga

SEQ ID NO: 1673778 - RNA, 18 nt, Homo sapiens
ccccacaggagcguguac

SEQ ID NO: 1673779 - RNA, 21 nt, Homo sapiens
ccccagccugcucccuagcca

SEQ ID NO: 1673780 - RNA, 11 nt, Homo sapiens
ccccaucacac

SEQ ID NO: 1673781 - RNA, 15 nt, Homo sapiens
cccccauuuuuguaa

SEQ ID NO: 1673782 - RNA, 13 nt, Homo sapiens
ccccccaguggac

SEQ ID NO: 1673783 - RNA, 15 nt, Homo sapiens
ccccucacucuguca

SEQ ID NO: 1673784 - RNA, 17 nt, Homo sapiens
ccccucauggaucugca

SEQ ID NO: 1673785 - RNA, 11 nt, Homo sapiens
ccccuccgggc

SEQ ID NO: 1673786 - RNA, 17 nt, Homo sapiens
ccccugcauggcugaga

SEQ ID NO: 1673787 - RNA, 15 nt, Homo sapiens
ccccuguucuggcag

SEQ ID NO: 1673788 - RNA, 23 nt, Homo sapiens
ccccuuagccaguuguauauuau

SEQ ID NO: 1673789 - RNA, 20 nt, Homo sapiens
ccccuucuaggggcagguga

SEQ ID NO: 1673790 - RNA, 12 nt, Homo sapiens
cccuaauucuua

SEQ ID NO: 1673791 - RNA, 13 nt, Homo sapiens
cccuaauucuuau

SEQ ID NO: 1673792 - RNA, 13 nt, Homo sapiens
cccuagcagugaa

SEQ ID NO: 1673793 - RNA, 23 nt, Homo sapiens
cccucacuucuuuccucaaagaa

SEQ ID NO: 1673794 - RNA, 21 nt, Homo sapiens
cccucagaauauuaagcacau

SEQ ID NO: 1673795 - RNA, 13 nt, Homo sapiens
cccucaucuugaa

SEQ ID NO: 1673796 - RNA, 14 nt, Homo sapiens
cccuccacauuucc

SEQ ID NO: 1673797 - RNA, 16 nt, Homo sapiens
cccuccaccagugugc

SEQ ID NO: 1673798 - RNA, 15 nt, Homo sapiens
cccuccgacuucucu

SEQ ID NO: 1673799 - RNA, 13 nt, Homo sapiens
cccuccugccuca

SEQ ID NO: 1673800 - RNA, 22 nt, Homo sapiens
cccucuccuuccuuacccaaac

SEQ ID NO: 1673801 - RNA, 17 nt, Homo sapiens
cccucugcugcuuucca

SEQ ID NO: 1673802 - RNA, 13 nt, Homo sapiens
cccugcuggacca

SEQ ID NO: 1673803 - RNA, 22 nt, Homo sapiens
cccugcuugaacacugaagggc

SEQ ID NO: 1673804 - RNA, 23 nt, Homo sapiens
cccuguuaaaugucaaccuagac

SEQ ID NO: 1673805 - RNA, 18 nt, Homo sapiens
cccuguuuccaaugccaa

SEQ ID NO: 1673806 - RNA, 21 nt, Homo sapiens
cccuuccacugccucugccuu

SEQ ID NO: 1673807 - RNA, 16 nt, Homo sapiens
cccuucccaaucagca

SEQ ID NO: 1673808 - RNA, 14 nt, Homo sapiens
cccuucccuuccac

SEQ ID NO: 1673809 - RNA, 14 nt, Homo sapiens
cccuuguaaugcca

SEQ ID NO: 1673810 - RNA, 20 nt, Homo sapiens
cccuuguaaugccacucaua

SEQ ID NO: 1673811 - RNA, 17 nt, Homo sapiens
cccuugugugagggcaa

SEQ ID NO: 1673812 - RNA, 16 nt, Homo sapiens
gaccucuugaucugcc

SEQ ID NO: 1673813 - RNA, 20 nt, Homo sapiens
gaccugcuuugagauuuccu

SEQ ID NO: 1673814 - RNA, 20 nt, Homo sapiens
gaccugggagcccucaggca

SEQ ID NO: 1673815 - RNA, 17 nt, Homo sapiens
gaccuugaaaagcagua

SEQ ID NO: 1673816 - RNA, 13 nt, Homo sapiens
gacgacccggggc

SEQ ID NO: 1673817 - RNA, 13 nt, Homo sapiens
gacgcaugcaggg

SEQ ID NO: 1673818 - RNA, 14 nt, Homo sapiens
gucuacccagacuc

SEQ ID NO: 1673819 - RNA, 15 nt, Homo sapiens
gucuaguggaaccaa

SEQ ID NO: 1673820 - RNA, 13 nt, Homo sapiens
gucuauguguaua

SEQ ID NO: 1673821 - RNA, 16 nt, Homo sapiens
gucuauguguauauau

SEQ ID NO: 1673822 - RNA, 22 nt, Homo sapiens
gucucaaagaccacgugacuuu

SEQ ID NO: 1673823 - RNA, 18 nt, Homo sapiens
gucucacuuuuauugaua

SEQ ID NO: 1673824 - RNA, 22 nt, Homo sapiens
gucuccuaagcuggagugcagu

SEQ ID NO: 1673825 - RNA, 15 nt, Homo sapiens
gucuccucugucagu

SEQ ID NO: 1673826 - RNA, 16 nt, Homo sapiens
gucucucuaagacaaa

SEQ ID NO: 1673827 - RNA, 16 nt, Homo sapiens
gucugagaagauucaa

SEQ ID NO: 1673828 - RNA, 16 nt, Homo sapiens
gucuguguauacauau

SEQ ID NO: 1673829 - RNA, 19 nt, Homo sapiens
gucuguguucucaacacac

SEQ ID NO: 1673830 - RNA, 15 nt, Homo sapiens
gucuuacuguugcau

SEQ ID NO: 1673831 - RNA, 22 nt, Homo sapiens
gucuuaguacauccucacuuuu

SEQ ID NO: 1673832 - RNA, 17 nt, Homo sapiens
gucuuagucauaccauc

SEQ ID NO: 1673833 - RNA, 22 nt, Homo sapiens
gucuucaacaugguuaccucug

SEQ ID NO: 1673834 - RNA, 21 nt, Homo sapiens
gucuuggauugguaccagagc

SEQ ID NO: 1673835 - RNA, 18 nt, Homo sapiens
gucuuuaccgcaaucucu

SEQ ID NO: 1673836 - RNA, 17 nt, Homo sapiens
gucuuucccuggugaug

SEQ ID NO: 1673837 - RNA, 15 nt, Homo sapiens
gugaaaggaaagagg

SEQ ID NO: 1673838 - RNA, 16 nt, Homo sapiens
gugaaaggucaucuca

SEQ ID NO: 1673839 - RNA, 17 nt, Homo sapiens
gugaacagaacaaaagg

SEQ ID NO: 1673840 - RNA, 15 nt, Homo sapiens
gugaacugaagcaga

SEQ ID NO: 1673841 - RNA, 22 nt, Homo sapiens
gugaagacgaggccaaggcuga

SEQ ID NO: 1673842 - RNA, 18 nt, Homo sapiens
gugaagauuucauggaca

SEQ ID NO: 1673843 - RNA, 12 nt, Homo sapiens
gugaagccuuua

SEQ ID NO: 1673844 - RNA, 17 nt, Homo sapiens
gugaauaaaagcaucag

SEQ ID NO: 1673845 - RNA, 12 nt, Homo sapiens
gugacaccacca

SEQ ID NO: 1673846 - RNA, 21 nt, Homo sapiens
gugacccuucccaaucagcac

SEQ ID NO: 1673847 - RNA, 16 nt, Homo sapiens
gugaccugacaccugc

SEQ ID NO: 1673848 - RNA, 20 nt, Homo sapiens
gugagccacagggcuagaag

SEQ ID NO: 1673849 - RNA, 24 nt, Homo sapiens
gugaggaccuuugcacuuugccau

SEQ ID NO: 1673850 - RNA, 23 nt, Homo sapiens
gugaucuguccuuccaaccuguu

SEQ ID NO: 1673851 - RNA, 18 nt, Homo sapiens
gugaugggcaaggggcca

SEQ ID NO: 1673852 - RNA, 18 nt, Homo sapiens
gugauguaugccucccac

SEQ ID NO: 1673853 - RNA, 17 nt, Homo sapiens
gugauugucaccaugau

SEQ ID NO: 1673854 - RNA, 18 nt, Homo sapiens
gugauuucuuaugccugu

SEQ ID NO: 1673855 - RNA, 18 nt, Homo sapiens
gugcaacaaacucaaaau

SEQ ID NO: 1673856 - RNA, 16 nt, Homo sapiens
gugcaaccaucaccag

SEQ ID NO: 1673857 - RNA, 19 nt, Homo sapiens
gugcaacugcuacugacca

SEQ ID NO: 1673858 - RNA, 21 nt, Homo sapiens
gugcaaugauagucacuucua

SEQ ID NO: 1673859 - RNA, 18 nt, Homo sapiens
gugcagauaucacagagg

SEQ ID NO: 1673860 - RNA, 20 nt, Homo sapiens
gugcaguggcaucaucucag

SEQ ID NO: 1673861 - RNA, 19 nt, Homo sapiens
gugcaguggcgugaucuca

SEQ ID NO: 1673862 - RNA, 14 nt, Homo sapiens
gugcaguggcucaa

SEQ ID NO: 1673863 - RNA, 21 nt, Homo sapiens
gugcaguugcuguuuacuuga

SEQ ID NO: 1673864 - RNA, 21 nt, Homo sapiens
gugccacguggccgcugccca

SEQ ID NO: 1673865 - RNA, 20 nt, Homo sapiens
gugccagagcuccaugcaug

SEQ ID NO: 1673866 - RNA, 15 nt, Homo sapiens
gugccagcuggugaa

SEQ ID NO: 1673867 - RNA, 17 nt, Homo sapiens
gugccaguccaucucaa

SEQ ID NO: 1673868 - RNA, 17 nt, Homo sapiens
gugccauauucugugau

SEQ ID NO: 1673869 - RNA, 15 nt, Homo sapiens
gugcccuguagcucc

SEQ ID NO: 1673870 - RNA, 16 nt, Homo sapiens
gugccuaauguuccau

SEQ ID NO: 1673871 - RNA, 22 nt, Homo sapiens
gugccucucccaaguccagugu

SEQ ID NO: 1673872 - RNA, 12 nt, Homo sapiens
gugccugugauc

SEQ ID NO: 1673873 - RNA, 16 nt, Homo sapiens
gugcucagccccagac

SEQ ID NO: 1673874 - RNA, 20 nt, Homo sapiens
gugcugagaauaaaaccagc

SEQ ID NO: 1673875 - RNA, 15 nt, Homo sapiens
gugcugcagguguaa

SEQ ID NO: 1673876 - RNA, 21 nt, Homo sapiens
gugcuucacacaaagugaaau

SEQ ID NO: 1673877 - RNA, 18 nt, Homo sapiens
gugcuucuccagccucag

SEQ ID NO: 1673878 - RNA, 22 nt, Homo sapiens
gugcuuggaaaauguucugaca

SEQ ID NO: 1673879 - RNA, 15 nt, Homo sapiens
gugcuuguucuuccu

SEQ ID NO: 1673880 - RNA, 23 nt, Homo sapiens
gugcuuguucuuccucuuaccug

SEQ ID NO: 1673881 - RNA, 23 nt, Homo sapiens
guggaagauuucuugacuauuuc

SEQ ID NO: 1673882 - RNA, 13 nt, Homo sapiens
guggacagcagcu

SEQ ID NO: 1673883 - RNA, 15 nt, Homo sapiens
guggagcuugcagug

SEQ ID NO: 1673884 - RNA, 14 nt, Homo sapiens
guggauacuggggg

SEQ ID NO: 1673885 - RNA, 15 nt, Homo sapiens
guggcacccaccacu

SEQ ID NO: 1673886 - RNA, 16 nt, Homo sapiens
guggcacccaccacuc

SEQ ID NO: 1673887 - RNA, 14 nt, Homo sapiens
guggcaucaggaaa

SEQ ID NO: 1673888 - RNA, 14 nt, Homo sapiens
guggcaucaucuca

SEQ ID NO: 1673889 - RNA, 14 nt, Homo sapiens
guggcgugaucuca

SEQ ID NO: 1673890 - RNA, 23 nt, Homo sapiens
guggcugauuuacuaacaguaac

SEQ ID NO: 1673891 - RNA, 17 nt, Homo sapiens
guggcugcuucauauga

SEQ ID NO: 1673892 - RNA, 13 nt, Homo sapiens
gugggaacucuga

SEQ ID NO: 1673893 - RNA, 12 nt, Homo sapiens
gugggaguccac

SEQ ID NO: 1673894 - RNA, 18 nt, Homo sapiens
gugggaguccacuuuccu

SEQ ID NO: 1673895 - RNA, 13 nt, Homo sapiens
gugggcucacacc

SEQ ID NO: 1673896 - RNA, 14 nt, Homo sapiens
guggggagucugag

SEQ ID NO: 1673897 - RNA, 11 nt, Homo sapiens
guggggccagc

SEQ ID NO: 1673898 - RNA, 19 nt, Homo sapiens
gugggggccucuuuaccau

SEQ ID NO: 1673899 - RNA, 15 nt, Homo sapiens
guggucuguguguga

SEQ ID NO: 1673900 - RNA, 12 nt, Homo sapiens
guggucuugggg

SEQ ID NO: 1673901 - RNA, 14 nt, Homo sapiens
gugguuuguuauca

SEQ ID NO: 1673902 - RNA, 22 nt, Homo sapiens
guguacacauaugaacgcacaa

SEQ ID NO: 1673903 - RNA, 17 nt, Homo sapiens
guguagcugagcacagc

SEQ ID NO: 1673904 - RNA, 20 nt, Homo sapiens
guguauauauuauauauaca

SEQ ID NO: 1673905 - RNA, 12 nt, Homo sapiens
guguaugcauac

SEQ ID NO: 1673906 - RNA, 13 nt, Homo sapiens
guguaugucuaug

SEQ ID NO: 1673907 - RNA, 18 nt, Homo sapiens
gugucaugauuucaauga

SEQ ID NO: 1673908 - RNA, 17 nt, Homo sapiens
guguccaugccuuccau

SEQ ID NO: 1673909 - RNA, 16 nt, Homo sapiens
gugucccagugucugg

SEQ ID NO: 1673910 - RNA, 21 nt, Homo sapiens
guguccuguuuuuauucccuu

SEQ ID NO: 1673911 - RNA, 15 nt, Homo sapiens
gugugaccugacacc

SEQ ID NO: 1673912 - RNA, 22 nt, Homo sapiens
guguggcuuggaacauuuggga

SEQ ID NO: 1673913 - RNA, 22 nt, Homo sapiens
guguguaugucuauguguauau

SEQ ID NO: 1673914 - RNA, 23 nt, Homo sapiens
gugugucgcuuaugucuauaacu

SEQ ID NO: 1673915 - RNA, 21 nt, Homo sapiens
guguucgcuuggcuccaugcu

SEQ ID NO: 1673916 - RNA, 22 nt, Homo sapiens
guguucucaacacacaguauag

SEQ ID NO: 1673917 - RNA, 20 nt, Homo sapiens
guguuuauauauaagccaaa

SEQ ID NO: 1673918 - RNA, 16 nt, Homo sapiens
guuaagggaagcugau

SEQ ID NO: 1673919 - RNA, 17 nt, Homo sapiens
guuaagggaagcugaua

SEQ ID NO: 1673920 - RNA, 14 nt, Homo sapiens
guuaaucacaggau

SEQ ID NO: 1673921 - RNA, 11 nt, Homo sapiens
guuaaugcaga

SEQ ID NO: 1673922 - RNA, 12 nt, Homo sapiens
guuaaugcagau

SEQ ID NO: 1673923 - RNA, 17 nt, Homo sapiens
guuaauuucauuccaaa

SEQ ID NO: 1673924 - RNA, 20 nt, Homo sapiens
guuacagacaaagcguggug

SEQ ID NO: 1673925 - RNA, 20 nt, Homo sapiens
guuacucuguaaaugaaaaa

SEQ ID NO: 1673926 - RNA, 17 nt, Homo sapiens
guuagauguccucagaa

SEQ ID NO: 1673927 - RNA, 13 nt, Homo sapiens
guuagcaggaaau

SEQ ID NO: 1673928 - RNA, 11 nt, Homo sapiens
guuaggcagug

SEQ ID NO: 1673929 - RNA, 15 nt, Homo sapiens
guuaggcagugcagu

SEQ ID NO: 1673930 - RNA, 21 nt, Homo sapiens
guuauaugacuucuuguucau

SEQ ID NO: 1673931 - RNA, 16 nt, Homo sapiens
guuauuauuauuauau

SEQ ID NO: 1673932 - RNA, 14 nt, Homo sapiens
guugcuaaugacag

SEQ ID NO: 1673933 - RNA, 15 nt, Homo sapiens
guugcuuucuuaucc

SEQ ID NO: 1673934 - RNA, 20 nt, Homo sapiens
guuggagugcaauggugcga

SEQ ID NO: 1673935 - RNA, 14 nt, Homo sapiens
guuggagugcagug

SEQ ID NO: 1673936 - RNA, 19 nt, Homo sapiens
guuggcuagacuagucuca

SEQ ID NO: 1673937 - RNA, 22 nt, Homo sapiens
guugguuuggccacucuugacc

SEQ ID NO: 1673938 - RNA, 21 nt, Homo sapiens
guugucuaaagcuaaacaaaa

SEQ ID NO: 1673939 - RNA, 23 nt, Homo sapiens
guugucucucuaaacccaaauaa

SEQ ID NO: 1673940 - RNA, 10 nt, Homo sapiens
guuguucaua

SEQ ID NO: 1673941 - RNA, 14 nt, Homo sapiens
guuuaaagaccaaa

SEQ ID NO: 1673942 - RNA, 16 nt, Homo sapiens
guuuaagaaaugagaa

SEQ ID NO: 1673943 - RNA, 14 nt, Homo sapiens
guuuaaugcaaaug

SEQ ID NO: 1673944 - RNA, 20 nt, Homo sapiens
guuuaauuguaggucaauga

SEQ ID NO: 1673945 - RNA, 21 nt, Homo sapiens
guuuagaaucaagucugugaa

SEQ ID NO: 1673946 - RNA, 21 nt, Homo sapiens
guuuagaugagguugagcuau

SEQ ID NO: 1673947 - RNA, 14 nt, Homo sapiens
guuuaggaaccgcu

SEQ ID NO: 1673948 - RNA, 13 nt, Homo sapiens
guuucacauucau

SEQ ID NO: 1673949 - RNA, 13 nt, Homo sapiens
guuucagcauucc

SEQ ID NO: 1673950 - RNA, 14 nt, Homo sapiens
guuuccaaugccaa

SEQ ID NO: 1673951 - RNA, 23 nt, Homo sapiens
guuuccaaugccaauucaucuca

SEQ ID NO: 1673952 - RNA, 22 nt, Homo sapiens
guuuccagcuaagccugaugau

SEQ ID NO: 1673953 - RNA, 16 nt, Homo sapiens
guuucucaagcgcuau

SEQ ID NO: 1673954 - RNA, 15 nt, Homo sapiens
guuugaacucaggga

SEQ ID NO: 1673955 - RNA, 14 nt, Homo sapiens
guuugaccaucacc

SEQ ID NO: 1673956 - RNA, 17 nt, Homo sapiens
guuugcaaaaaaaaaga

SEQ ID NO: 1673957 - RNA, 22 nt, Homo sapiens
guuuguaggguggaugggauac

SEQ ID NO: 1673958 - RNA, 13 nt, Homo sapiens
guuuuaagccagg

SEQ ID NO: 1673959 - RNA, 17 nt, Homo sapiens
guuuuauuguaaucaua

SEQ ID NO: 1673960 - RNA, 14 nt, Homo sapiens
guuuucaaguugca

SEQ ID NO: 1673961 - RNA, 14 nt, Homo sapiens
guuuucacauucuu

SEQ ID NO: 1673962 - RNA, 22 nt, Homo sapiens
guuuucucuguauaacuuguga

SEQ ID NO: 1673963 - RNA, 21 nt, Homo sapiens
guuuugacuugccacugccau

SEQ ID NO: 1673964 - RNA, 21 nt, Homo sapiens
guuuugugcggugugucucca

SEQ ID NO: 1673965 - RNA, 14 nt, Homo sapiens
uaaaaaaguuuaca

SEQ ID NO: 1673966 - RNA, 18 nt, Homo sapiens
uaaaaacuuuuaagccau

SEQ ID NO: 1673967 - RNA, 22 nt, Homo sapiens
uaaaaaucaguuuguuguucag

SEQ ID NO: 1673968 - RNA, 14 nt, Homo sapiens
uaaaacaaguacau

SEQ ID NO: 1673969 - RNA, 14 nt, Homo sapiens
uaaaacacaacauc

SEQ ID NO: 1673970 - RNA, 23 nt, Homo sapiens
uaaaacauuauagauuuucaugu

SEQ ID NO: 1673971 - RNA, 14 nt, Homo sapiens
uaaaaccuuacuua

SEQ ID NO: 1673972 - RNA, 16 nt, Homo sapiens
uaaaacucccuuccuu

SEQ ID NO: 1673973 - RNA, 12 nt, Homo sapiens
uaaaacugugac

SEQ ID NO: 1673974 - RNA, 14 nt, Homo sapiens
uaaaagaaucauuu

SEQ ID NO: 1673975 - RNA, 19 nt, Homo sapiens
uaaaagccuaugugccuuu

SEQ ID NO: 1673976 - RNA, 18 nt, Homo sapiens
uaaaauaaaccagacuca

SEQ ID NO: 1673977 - RNA, 20 nt, Homo sapiens
uaaaaucacaaacucaucca

SEQ ID NO: 1673978 - RNA, 22 nt, Homo sapiens
uaaaaucuguauugcuaagaua

SEQ ID NO: 1673979 - RNA, 12 nt, Homo sapiens
uaaaaugauuaa

SEQ ID NO: 1673980 - RNA, 15 nt, Homo sapiens
uaaaaugcuguucuc

SEQ ID NO: 1673981 - RNA, 23 nt, Homo sapiens
uaaaauguauuauguccugugag

SEQ ID NO: 1673982 - RNA, 13 nt, Homo sapiens
uaaaauuagugag

SEQ ID NO: 1673983 - RNA, 14 nt, Homo sapiens
uaaaauuccaugga

SEQ ID NO: 1673984 - RNA, 12 nt, Homo sapiens
uaaaauugucag

SEQ ID NO: 1673985 - RNA, 23 nt, Homo sapiens
uaaaauuugggaccugcuucauu

SEQ ID NO: 1673986 - RNA, 22 nt, Homo sapiens
uaaacaguuugaaaagacaaau

SEQ ID NO: 1673987 - RNA, 22 nt, Homo sapiens
uaaacccaaauaaauguguaaa

SEQ ID NO: 1673988 - RNA, 16 nt, Homo sapiens
uaaacuagauauagcu

SEQ ID NO: 1673989 - RNA, 14 nt, Homo sapiens
uaaacucugaccaa

SEQ ID NO: 1673990 - RNA, 13 nt, Homo sapiens
uaaacugaugcuu

SEQ ID NO: 1673991 - RNA, 13 nt, Homo sapiens
uaaacugugagau

SEQ ID NO: 1673992 - RNA, 14 nt, Homo sapiens
uaaagaaaggcaga

SEQ ID NO: 1673993 - RNA, 19 nt, Homo sapiens
uaaagaacagcugaggcug

SEQ ID NO: 1673994 - RNA, 20 nt, Homo sapiens
uaaagaaguccaugugauaa

SEQ ID NO: 1673995 - RNA, 22 nt, Homo sapiens
uaaagacuaguuuacaaaggag

SEQ ID NO: 1673996 - RNA, 15 nt, Homo sapiens
uaaagcaauguggua

SEQ ID NO: 1673997 - RNA, 17 nt, Homo sapiens
uaaagccucugugcugc

SEQ ID NO: 1673998 - RNA, 12 nt, Homo sapiens
uaaagcugccag

SEQ ID NO: 1673999 - RNA, 16 nt, Homo sapiens
uaaaggcauuucaaag

SEQ ID NO: 1674000 - RNA, 19 nt, Homo sapiens
uaaaggugaugaauuuacc

SEQ ID NO: 1674001 - RNA, 12 nt, Homo sapiens
uaaaguauucca

SEQ ID NO: 1674002 - RNA, 17 nt, Homo sapiens
uaaauaaacacauagau

SEQ ID NO: 1674003 - RNA, 14 nt, Homo sapiens
uaaauacugcugua

SEQ ID NO: 1674004 - RNA, 17 nt, Homo sapiens
uaaauaucuagugcuaa

SEQ ID NO: 1674005 - RNA, 14 nt, Homo sapiens
uaaauccuuuacaa

SEQ ID NO: 1674006 - RNA, 17 nt, Homo sapiens
uaaauccuuuacaagau

SEQ ID NO: 1674007 - RNA, 18 nt, Homo sapiens
uaaaucguaaccuaugaa

SEQ ID NO: 1674008 - RNA, 13 nt, Homo sapiens
uaaaugagcuuaa

SEQ ID NO: 1674009 - RNA, 14 nt, Homo sapiens
uaaaugucccaaau

SEQ ID NO: 1674010 - RNA, 17 nt, Homo sapiens
uaaauucaaaccuaagu

SEQ ID NO: 1674011 - RNA, 17 nt, Homo sapiens
uaacaaaucguccaaag

SEQ ID NO: 1674012 - RNA, 16 nt, Homo sapiens
uaacaaugccuauugu

SEQ ID NO: 1674013 - RNA, 21 nt, Homo sapiens
uaacaggcauugcacuaaaag

SEQ ID NO: 1674014 - RNA, 12 nt, Homo sapiens
uaacagugcagu

SEQ ID NO: 1674015 - RNA, 19 nt, Homo sapiens
uaaccucucugaacugcaa

SEQ ID NO: 1674016 - RNA, 22 nt, Homo sapiens
uaacggaugaccauaugcacaa

SEQ ID NO: 1674017 - RNA, 11 nt, Homo sapiens
uaacuaugauu

SEQ ID NO: 1674018 - RNA, 22 nt, Homo sapiens
uaacuaugguaaauaacuguga

SEQ ID NO: 1674019 - RNA, 16 nt, Homo sapiens
uaacuuccaguaucau

SEQ ID NO: 1674020 - RNA, 22 nt, Homo sapiens
uaacuuccaguaucauuuucca

SEQ ID NO: 1674021 - RNA, 22 nt, Homo sapiens
uaagaaacccccucauggaucu

SEQ ID NO: 1674022 - RNA, 17 nt, Homo sapiens
uaagaauucaguagcau

SEQ ID NO: 1674023 - RNA, 15 nt, Homo sapiens
uaagacaaaaaagau

SEQ ID NO: 1674024 - RNA, 12 nt, Homo sapiens
uaagacagugca

SEQ ID NO: 1674025 - RNA, 13 nt, Homo sapiens
uaagacagugcag

SEQ ID NO: 1674026 - RNA, 14 nt, Homo sapiens
uaagacagugcagu

SEQ ID NO: 1674027 - RNA, 16 nt, Homo sapiens
uaagacagugcagugc

SEQ ID NO: 1674028 - RNA, 17 nt, Homo sapiens
uaagacauucaccaaca

SEQ ID NO: 1674029 - RNA, 15 nt, Homo sapiens
uaagagaaaugagcu

SEQ ID NO: 1674030 - RNA, 16 nt, Homo sapiens
uaagagaaaugagcug

SEQ ID NO: 1674031 - RNA, 16 nt, Homo sapiens
uaagagauaugcucau

SEQ ID NO: 1674032 - RNA, 13 nt, Homo sapiens
uaagaucuugccu

SEQ ID NO: 1674033 - RNA, 19 nt, Homo sapiens
uaagcacaaccauguucuu

SEQ ID NO: 1674034 - RNA, 12 nt, Homo sapiens
uaagccaaaaaa

SEQ ID NO: 1674035 - RNA, 20 nt, Homo sapiens
uaagccauugcuucucccuc

SEQ ID NO: 1674036 - RNA, 19 nt, Homo sapiens
uaagcccccuacugagaaa

SEQ ID NO: 1674037 - RNA, 13 nt, Homo sapiens
uaagccugaugau

SEQ ID NO: 1674038 - RNA, 19 nt, Homo sapiens
uaagcuaugucacuacccu

SEQ ID NO: 1674039 - RNA, 18 nt, Homo sapiens
uaagcugccagccuuccc

SEQ ID NO: 1674040 - RNA, 16 nt, Homo sapiens
uaaggcagugcaguac

SEQ ID NO: 1674041 - RNA, 22 nt, Homo sapiens
uaaggcauccacuucacaguuc

SEQ ID NO: 1674042 - RNA, 14 nt, Homo sapiens
uaaggccuugccag

SEQ ID NO: 1674043 - RNA, 18 nt, Homo sapiens
uaaggggaauuaacaauu

SEQ ID NO: 1674044 - RNA, 19 nt, Homo sapiens
aucuacaacauaaugauac

SEQ ID NO: 1674045 - RNA, 14 nt, Homo sapiens
aucuaccuuccagu

SEQ ID NO: 1674046 - RNA, 21 nt, Homo sapiens
aucuacuagaaccuucuaauc

SEQ ID NO: 1674047 - RNA, 15 nt, Homo sapiens
aucuacuucuacauc

SEQ ID NO: 1674048 - RNA, 17 nt, Homo sapiens
aucuacuucuacaucca

SEQ ID NO: 1674049 - RNA, 18 nt, Homo sapiens
aucucaaaagaucuccug

SEQ ID NO: 1674050 - RNA, 14 nt, Homo sapiens
aucucaagugccau

SEQ ID NO: 1674051 - RNA, 19 nt, Homo sapiens
aucucagguggcauuugca

SEQ ID NO: 1674052 - RNA, 14 nt, Homo sapiens
aucucagucccuga

SEQ ID NO: 1674053 - RNA, 16 nt, Homo sapiens
aucucaucccuagucu

SEQ ID NO: 1674054 - RNA, 17 nt, Homo sapiens
aucuccacagcagcaaa

SEQ ID NO: 1674055 - RNA, 21 nt, Homo sapiens
aucuccagccaauuucaaaga

SEQ ID NO: 1674056 - RNA, 22 nt, Homo sapiens
aucuccaggccccuuaccugca

SEQ ID NO: 1674057 - RNA, 17 nt, Homo sapiens
aucuccccucagauucc

SEQ ID NO: 1674058 - RNA, 21 nt, Homo sapiens
aucuccccucagauuccaccu

SEQ ID NO: 1674059 - RNA, 22 nt, Homo sapiens
aucuccuugauuacauaauguu

SEQ ID NO: 1674060 - RNA, 21 nt, Homo sapiens
aucucgcccugccuccacuug

SEQ ID NO: 1674061 - RNA, 16 nt, Homo sapiens
aucucuaaaaugcugu

SEQ ID NO: 1674062 - RNA, 21 nt, Homo sapiens
aucucuaaaaugcuguucuca

SEQ ID NO: 1674063 - RNA, 17 nt, Homo sapiens
aucucugaggccucaga

SEQ ID NO: 1674064 - RNA, 17 nt, Homo sapiens
aucucuucuuauacaga

SEQ ID NO: 1674065 - RNA, 16 nt, Homo sapiens
aucugaggaguccaaa

SEQ ID NO: 1674066 - RNA, 20 nt, Homo sapiens
aucugccaggacacugccuu

SEQ ID NO: 1674067 - RNA, 18 nt, Homo sapiens
aucuguaaaauagucuca

SEQ ID NO: 1674068 - RNA, 20 nt, Homo sapiens
aucuguagaagguucuacca

SEQ ID NO: 1674069 - RNA, 16 nt, Homo sapiens
aucuguauaaauguga

SEQ ID NO: 1674070 - RNA, 18 nt, Homo sapiens
aucuguauaauacuuugu

SEQ ID NO: 1674071 - RNA, 22 nt, Homo sapiens
aucuguauuggcagcacagcua

SEQ ID NO: 1674072 - RNA, 14 nt, Homo sapiens
aucuguccaaaagg

SEQ ID NO: 1674073 - RNA, 20 nt, Homo sapiens
aucugucgcauuucaucaag

SEQ ID NO: 1674074 - RNA, 14 nt, Homo sapiens
aucugugaagccuu

SEQ ID NO: 1674075 - RNA, 18 nt, Homo sapiens
aucuguugacagugccaa

SEQ ID NO: 1674076 - RNA, 15 nt, Homo sapiens
aucuguugauggaga

SEQ ID NO: 1674077 - RNA, 12 nt, Homo sapiens
aucuuaauguau

SEQ ID NO: 1674078 - RNA, 24 nt, Homo sapiens
aucuuauuugucaguguagaucaa

SEQ ID NO: 1674079 - RNA, 14 nt, Homo sapiens
aucuuccuucucag

SEQ ID NO: 1674080 - RNA, 20 nt, Homo sapiens
aucuucuaucaaagcacaua

SEQ ID NO: 1674081 - RNA, 12 nt, Homo sapiens
aucuugccucau

SEQ ID NO: 1674082 - RNA, 19 nt, Homo sapiens
aucuuuccuaggcagauca

SEQ ID NO: 1674083 - RNA, 16 nt, Homo sapiens
augaaaacagucccau

SEQ ID NO: 1674084 - RNA, 20 nt, Homo sapiens
augaaaaccacccuaucauc

SEQ ID NO: 1674085 - RNA, 14 nt, Homo sapiens
augaaaauucuuga

SEQ ID NO: 1674086 - RNA, 23 nt, Homo sapiens
augaacgcacaacaugcacauuc

SEQ ID NO: 1674087 - RNA, 18 nt, Homo sapiens
augaacguuuucucuuca

SEQ ID NO: 1674088 - RNA, 14 nt, Homo sapiens
augaacugccaaag

SEQ ID NO: 1674089 - RNA, 18 nt, Homo sapiens
augaagacaccagagugu

SEQ ID NO: 1674090 - RNA, 16 nt, Homo sapiens
augaagacccuaucuc

SEQ ID NO: 1674091 - RNA, 15 nt, Homo sapiens
augaaggucuaccug

SEQ ID NO: 1674092 - RNA, 21 nt, Homo sapiens
augaagucccucuaugucguc

SEQ ID NO: 1674093 - RNA, 23 nt, Homo sapiens
augaaugaaauauaaacugugag

SEQ ID NO: 1674094 - RNA, 22 nt, Homo sapiens
augaauguacauuuucuaacaa

SEQ ID NO: 1674095 - RNA, 21 nt, Homo sapiens
augacaauaaauuuuaucuca

SEQ ID NO: 1674096 - RNA, 13 nt, Homo sapiens
augacacugaccu

SEQ ID NO: 1674097 - RNA, 13 nt, Homo sapiens
augacaugcacug

SEQ ID NO: 1674098 - RNA, 15 nt, Homo sapiens
augacaugcacugac

SEQ ID NO: 1674099 - RNA, 15 nt, Homo sapiens
augacauugaacuga

SEQ ID NO: 1674100 - RNA, 16 nt, Homo sapiens
augaccauaaaauuag

SEQ ID NO: 1674101 - RNA, 13 nt, Homo sapiens
augaccauaugca

SEQ ID NO: 1674102 - RNA, 20 nt, Homo sapiens
augacugcauuuuacuguac

SEQ ID NO: 1674103 - RNA, 16 nt, Homo sapiens
augagaaucaccccuc

SEQ ID NO: 1674104 - RNA, 18 nt, Homo sapiens
augagaaugucauuugcu

SEQ ID NO: 1674105 - RNA, 17 nt, Homo sapiens
augagagaagagaguau

SEQ ID NO: 1674106 - RNA, 21 nt, Homo sapiens
augaggcacgccugccuucuc

SEQ ID NO: 1674107 - RNA, 21 nt, Homo sapiens
augaggugagagaaagccaca

SEQ ID NO: 1674108 - RNA, 22 nt, Homo sapiens
augaggugagagaaagccacaa

SEQ ID NO: 1674109 - RNA, 17 nt, Homo sapiens
augaguacauacucaag

SEQ ID NO: 1674110 - RNA, 13 nt, Homo sapiens
augaguggaauac

SEQ ID NO: 1674111 - RNA, 17 nt, Homo sapiens
augauaauaaaggcauu

SEQ ID NO: 1674112 - RNA, 17 nt, Homo sapiens
augauacuugguccuua

SEQ ID NO: 1674113 - RNA, 19 nt, Homo sapiens
augauacuugguccuuaaa

SEQ ID NO: 1674114 - RNA, 15 nt, Homo sapiens
augauaugugcuugu

SEQ ID NO: 1674115 - RNA, 23 nt, Homo sapiens
augaugccaugaggaacaaggca

SEQ ID NO: 1674116 - RNA, 14 nt, Homo sapiens
augaugguggauca

SEQ ID NO: 1674117 - RNA, 20 nt, Homo sapiens
augauggugguggugguugu

SEQ ID NO: 1674118 - RNA, 16 nt, Homo sapiens
augauguauuguugcu

SEQ ID NO: 1674119 - RNA, 14 nt, Homo sapiens
augauuaagugcuu

SEQ ID NO: 1674120 - RNA, 22 nt, Homo sapiens
augauuaggcccgccaaacuuc

SEQ ID NO: 1674121 - RNA, 23 nt, Homo sapiens
augauugucuaaccaauugugag

SEQ ID NO: 1674122 - RNA, 16 nt, Homo sapiens
augauugugaccucca

SEQ ID NO: 1674123 - RNA, 13 nt, Homo sapiens
augcaagcccuuu

SEQ ID NO: 1674124 - RNA, 21 nt, Homo sapiens
augcacaccaaauugcugaga

SEQ ID NO: 1674125 - RNA, 18 nt, Homo sapiens
augcacagcuaacaugga

SEQ ID NO: 1674126 - RNA, 13 nt, Homo sapiens
augcacauguauu

SEQ ID NO: 1674127 - RNA, 19 nt, Homo sapiens
ucaaaggcuuccaaugugg

SEQ ID NO: 1674128 - RNA, 16 nt, Homo sapiens
ucaaaguaaccucuga

SEQ ID NO: 1674129 - RNA, 17 nt, Homo sapiens
ucaaaguacuacagcaa

SEQ ID NO: 1674130 - RNA, 12 nt, Homo sapiens
ucaaagugcugg

SEQ ID NO: 1674131 - RNA, 21 nt, Homo sapiens
ucaaauaaaucuaaaucuuca

SEQ ID NO: 1674132 - RNA, 14 nt, Homo sapiens
ucaacaaaagggag

SEQ ID NO: 1674133 - RNA, 16 nt, Homo sapiens
ucaacagaucaaugac

SEQ ID NO: 1674134 - RNA, 16 nt, Homo sapiens
ucaacccugugaucua

SEQ ID NO: 1674135 - RNA, 18 nt, Homo sapiens
ucaaccucucuacuagca

SEQ ID NO: 1674136 - RNA, 22 nt, Homo sapiens
ucaaccugguggcaccagaugc

SEQ ID NO: 1674137 - RNA, 22 nt, Homo sapiens
ucaacuuaaugaagaaauacag

SEQ ID NO: 1674138 - RNA, 20 nt, Homo sapiens
ucaagacauaaguaaaugag

SEQ ID NO: 1674139 - RNA, 13 nt, Homo sapiens
ucaagauacugga

SEQ ID NO: 1674140 - RNA, 14 nt, Homo sapiens
ucaagaugugacau

SEQ ID NO: 1674141 - RNA, 15 nt, Homo sapiens
ucaagaugugacaug

SEQ ID NO: 1674142 - RNA, 12 nt, Homo sapiens
ucaagccaggag

SEQ ID NO: 1674143 - RNA, 14 nt, Homo sapiens
ucaagccaggagac

SEQ ID NO: 1674144 - RNA, 22 nt, Homo sapiens
ucaaggaaaagaauucucagca

SEQ ID NO: 1674145 - RNA, 23 nt, Homo sapiens
ucaaguagcguuggagacauaca

SEQ ID NO: 1674146 - RNA, 18 nt, Homo sapiens
ucaauauuuguauuugug

SEQ ID NO: 1674147 - RNA, 20 nt, Homo sapiens
ucaaugcugacuggacugug

SEQ ID NO: 1674148 - RNA, 11 nt, Homo sapiens
ucaauggguaa

SEQ ID NO: 1674149 - RNA, 23 nt, Homo sapiens
ucaauuggguuuugaucucagca

SEQ ID NO: 1674150 - RNA, 16 nt, Homo sapiens
ucacaaacucauccau

SEQ ID NO: 1674151 - RNA, 22 nt, Homo sapiens
ucacaacuuugcuuuuagguug

SEQ ID NO: 1674152 - RNA, 19 nt, Homo sapiens
ucacaauaaaagaaacugu

SEQ ID NO: 1674153 - RNA, 21 nt, Homo sapiens
ucacaauuuguugaaucucag

SEQ ID NO: 1674154 - RNA, 20 nt, Homo sapiens
ucacacccugcaaggcccac

SEQ ID NO: 1674155 - RNA, 20 nt, Homo sapiens
ucacaccggcacugugcacu

SEQ ID NO: 1674156 - RNA, 13 nt, Homo sapiens
ucacagaugggca

SEQ ID NO: 1674157 - RNA, 21 nt, Homo sapiens
ucaccaacaacagucagccag

SEQ ID NO: 1674158 - RNA, 16 nt, Homo sapiens
ucaccaacuacagaaa

SEQ ID NO: 1674159 - RNA, 15 nt, Homo sapiens
ucaccacagcugcag

SEQ ID NO: 1674160 - RNA, 14 nt, Homo sapiens
ucaccauguuggcc

SEQ ID NO: 1674161 - RNA, 16 nt, Homo sapiens
ucaccccguuacagcu

SEQ ID NO: 1674162 - RNA, 14 nt, Homo sapiens
ucacccugucuuac

SEQ ID NO: 1674163 - RNA, 21 nt, Homo sapiens
ucaccgacccgacacucucac

SEQ ID NO: 1674164 - RNA, 15 nt, Homo sapiens
ucaccuaacuuucau

SEQ ID NO: 1674165 - RNA, 17 nt, Homo sapiens
ucaccuaacuuucauua

SEQ ID NO: 1674166 - RNA, 18 nt, Homo sapiens
ucaccuagcugcucucua

SEQ ID NO: 1674167 - RNA, 19 nt, Homo sapiens
ucaccugaauaagggacuu

SEQ ID NO: 1674168 - RNA, 18 nt, Homo sapiens
ucaccuggcuucccagga

SEQ ID NO: 1674169 - RNA, 16 nt, Homo sapiens
ucacgugacccugugc

SEQ ID NO: 1674170 - RNA, 14 nt, Homo sapiens
ucacuacaaccucc

SEQ ID NO: 1674171 - RNA, 14 nt, Homo sapiens
ucacuccacucccc

SEQ ID NO: 1674172 - RNA, 16 nt, Homo sapiens
ucacucugacaguauu

SEQ ID NO: 1674173 - RNA, 16 nt, Homo sapiens
ucacugcaaccuccac

SEQ ID NO: 1674174 - RNA, 21 nt, Homo sapiens
ucacugccccagacacagugc

SEQ ID NO: 1674175 - RNA, 15 nt, Homo sapiens
ucacugugucucaug

SEQ ID NO: 1674176 - RNA, 15 nt, Homo sapiens
ucacuuaaacuuugu

SEQ ID NO: 1674177 - RNA, 15 nt, Homo sapiens
ucacuucugcuguac

SEQ ID NO: 1674178 - RNA, 17 nt, Homo sapiens
ucacuucugcuguacag

SEQ ID NO: 1674179 - RNA, 15 nt, Homo sapiens
ucacuuuuauugaua

SEQ ID NO: 1674180 - RNA, 23 nt, Homo sapiens
ucagaaaagaugugcagauauca

SEQ ID NO: 1674181 - RNA, 21 nt, Homo sapiens
ucagaaacaaagcauuugacu

SEQ ID NO: 1674182 - RNA, 20 nt, Homo sapiens
ucagaagagggaacuaagca

SEQ ID NO: 1674183 - RNA, 18 nt, Homo sapiens
ucagaagucaguugcaaa

SEQ ID NO: 1674184 - RNA, 21 nt, Homo sapiens
ucagacaguggaugagacaca

SEQ ID NO: 1674185 - RNA, 18 nt, Homo sapiens
ucagagcaagcacuggac

SEQ ID NO: 1674186 - RNA, 14 nt, Homo sapiens
ucagaugauucuau

SEQ ID NO: 1674187 - RNA, 19 nt, Homo sapiens
ucagcacauccgacaccuc

SEQ ID NO: 1674188 - RNA, 23 nt, Homo sapiens
ucagcacugaaaauaccaucagg

SEQ ID NO: 1674189 - RNA, 18 nt, Homo sapiens
ucagcacuuuguuucaua

SEQ ID NO: 1674190 - RNA, 20 nt, Homo sapiens
ucagcaguucagcuccuucc

SEQ ID NO: 1674191 - RNA, 20 nt, Homo sapiens
ucagccccacuccacaguua

SEQ ID NO: 1674192 - RNA, 13 nt, Homo sapiens
ucagcccucagaa

SEQ ID NO: 1674193 - RNA, 13 nt, Homo sapiens
ucagcugcuucuc

SEQ ID NO: 1674194 - RNA, 13 nt, Homo sapiens
ucaggagaaggcc

SEQ ID NO: 1674195 - RNA, 15 nt, Homo sapiens
ucaggagcacagcca

SEQ ID NO: 1674196 - RNA, 17 nt, Homo sapiens
ucaggagcacagccaua

SEQ ID NO: 1674197 - RNA, 18 nt, Homo sapiens
ucaggagcacagccauag

SEQ ID NO: 1674198 - RNA, 16 nt, Homo sapiens
ucagggcaugcuuauu

SEQ ID NO: 1674199 - RNA, 18 nt, Homo sapiens
ucaggggaagauuuagaa

SEQ ID NO: 1674200 - RNA, 17 nt, Homo sapiens
ucaggucagagcccagg

SEQ ID NO: 1674201 - RNA, 17 nt, Homo sapiens
ucaguaaaucagugcag

SEQ ID NO: 1674202 - RNA, 21 nt, Homo sapiens
ucaguaacacaauacaguacu

SEQ ID NO: 1674203 - RNA, 23 nt, Homo sapiens
ucaguaacacaauacaguacuca

SEQ ID NO: 1674204 - RNA, 17 nt, Homo sapiens
ucaguaacacagugcag

SEQ ID NO: 1674205 - RNA, 15 nt, Homo sapiens
ucaguaacagugcag

SEQ ID NO: 1674206 - RNA, 17 nt, Homo sapiens
ucaguaacagugcagua

SEQ ID NO: 1674207 - RNA, 18 nt, Homo sapiens
ucaguaaggcagugcagu

SEQ ID NO: 1674208 - RNA, 21 nt, Homo sapiens
ucaguaauacaguacaguacu

SEQ ID NO: 1674209 - RNA, 23 nt, Homo sapiens
ucaguaauacaguacaguacuca

SEQ ID NO: 1674210 - RNA, 23 nt, Homo sapiens
ucaguagugcuaucucaugacaa

SEQ ID NO: 1674211 - RNA, 21 nt, Homo sapiens
ucaguauugagacacugucaa

SEQ ID NO: 1674212 - RNA, 16 nt, Homo sapiens
ucagucagcccagugg

SEQ ID NO: 1674213 - RNA, 17 nt, Homo sapiens
ucaguccaauaaauuau

SEQ ID NO: 1674214 - RNA, 22 nt, Homo sapiens
ucaguccacccccauugugaau

SEQ ID NO: 1674215 - RNA, 15 nt, Homo sapiens
ucaguccacugcuga

SEQ ID NO: 1674216 - RNA, 20 nt, Homo sapiens
ucaguguuauaaaaucugua

SEQ ID NO: 1674217 - RNA, 15 nt, Homo sapiens
ucaguuggugcugcu

SEQ ID NO: 1674218 - RNA, 23 nt, Homo sapiens
ucaguuguaacauucuauuucaa

SEQ ID NO: 1674219 - RNA, 22 nt, Homo sapiens
ucauaaugacuuaagcacacuu

SEQ ID NO: 1674220 - RNA, 12 nt, Homo sapiens
ucauacacuccc

SEQ ID NO: 1674221 - RNA, 18 nt, Homo sapiens
ucauacauuagugccaua

SEQ ID NO: 1674222 - RNA, 15 nt, Homo sapiens
ucauaggaagacaca

SEQ ID NO: 1674223 - RNA, 18 nt, Homo sapiens
ucaucagccaaaacgugg

SEQ ID NO: 1674224 - RNA, 20 nt, Homo sapiens
ucauccaggcucccaaaaga

SEQ ID NO: 1674225 - RNA, 19 nt, Homo sapiens
ucaucccccaucagaugau

SEQ ID NO: 1674226 - RNA, 19 nt, Homo sapiens
ucauccugccuucauggaa

SEQ ID NO: 1674227 - RNA, 18 nt, Homo sapiens
ucaucuccaaaucuugcc

SEQ ID NO: 1674228 - RNA, 19 nt, Homo sapiens
ucaucucccggugccuugg

SEQ ID NO: 1674229 - RNA, 19 nt, Homo sapiens
ucaucuugggaagggccau

SEQ ID NO: 1674230 - RNA, 14 nt, Homo sapiens
ucaugauugcccaa

SEQ ID NO: 1674231 - RNA, 23 nt, Homo sapiens
ucaugauuucaaugauuguuuaa

SEQ ID NO: 1674232 - RNA, 17 nt, Homo sapiens
ucaugcccagcuuggag

SEQ ID NO: 1674233 - RNA, 12 nt, Homo sapiens
ucauggaacuca

SEQ ID NO: 1674234 - RNA, 23 nt, Homo sapiens
ucauggccauagcuuuuauucau

SEQ ID NO: 1674235 - RNA, 21 nt, Homo sapiens
ucauguaaauaaauacauucu

SEQ ID NO: 1674236 - RNA, 23 nt, Homo sapiens
ucaugucauugaugaacugccaa

SEQ ID NO: 1674237 - RNA, 19 nt, Homo sapiens
ucauguuucugcaguauuc

SEQ ID NO: 1674238 - RNA, 15 nt, Homo sapiens
ucauuagaauugaau

SEQ ID NO: 1674239 - RNA, 16 nt, Homo sapiens
ucauuagcugugauuu

SEQ ID NO: 1674240 - RNA, 17 nt, Homo sapiens
ucauucauacucaaaga

SEQ ID NO: 1674241 - RNA, 17 nt, Homo sapiens
ucauucccaggcacucu

SEQ ID NO: 1674242 - RNA, 21 nt, Homo sapiens
ucauucuacugaacaguccau

SEQ ID NO: 1674243 - RNA, 22 nt, Homo sapiens
ucauuuaggugaggaagcaaaa

SEQ ID NO: 1674244 - RNA, 20 nt, Homo sapiens
ucauuuauuuacaugugauu

SEQ ID NO: 1674245 - RNA, 21 nt, Homo sapiens
ucauuucuucucucugugcug

SEQ ID NO: 1674246 - RNA, 15 nt, Homo sapiens
ucauuugcauccuau

SEQ ID NO: 1674247 - RNA, 21 nt, Homo sapiens
ucauuugcauccuaucgaucu

SEQ ID NO: 1674248 - RNA, 12 nt, Homo sapiens
uccaacauguga

SEQ ID NO: 1674249 - RNA, 14 nt, Homo sapiens
uagggacuuuggca

SEQ ID NO: 1674250 - RNA, 15 nt, Homo sapiens
uagggagugugccuu

SEQ ID NO: 1674251 - RNA, 14 nt, Homo sapiens
uaggggcaggugaa

SEQ ID NO: 1674252 - RNA, 16 nt, Homo sapiens
uagguagaugagaaaa

SEQ ID NO: 1674253 - RNA, 23 nt, Homo sapiens
uagguaguagaaucucagcacuu

SEQ ID NO: 1674254 - RNA, 17 nt, Homo sapiens
uaggugaggaagcaaaa

SEQ ID NO: 1674255 - RNA, 18 nt, Homo sapiens
uaguaacaguauuuccau

SEQ ID NO: 1674256 - RNA, 20 nt, Homo sapiens
uagucauaugugaagacaga

SEQ ID NO: 1674257 - RNA, 20 nt, Homo sapiens
uaguccccagccugcucccu

SEQ ID NO: 1674258 - RNA, 18 nt, Homo sapiens
uaguccggacccaccuca

SEQ ID NO: 1674259 - RNA, 18 nt, Homo sapiens
uagucuguuagauuuuau

SEQ ID NO: 1674260 - RNA, 19 nt, Homo sapiens
uagugaaguaugcacuaau

SEQ ID NO: 1674261 - RNA, 16 nt, Homo sapiens
uagugaugcaggcagu

SEQ ID NO: 1674262 - RNA, 21 nt, Homo sapiens
uagugcaugaauagauucucu

SEQ ID NO: 1674263 - RNA, 16 nt, Homo sapiens
uagugucccuuaccug

SEQ ID NO: 1674264 - RNA, 23 nt, Homo sapiens
uagugucuuuuuuuucuucaccu

SEQ ID NO: 1674265 - RNA, 12 nt, Homo sapiens
uaguuccccaaa

SEQ ID NO: 1674266 - RNA, 19 nt, Homo sapiens
uaguuugaccucacaguga

SEQ ID NO: 1674267 - RNA, 16 nt, Homo sapiens
uauaaaacguguuugu

SEQ ID NO: 1674268 - RNA, 20 nt, Homo sapiens
uauaaaucacagauuuccaa

SEQ ID NO: 1674269 - RNA, 15 nt, Homo sapiens
uauaaauguacuaca

SEQ ID NO: 1674270 - RNA, 16 nt, Homo sapiens
uauaaucucuucuuau

SEQ ID NO: 1674271 - RNA, 18 nt, Homo sapiens
uauaauuuuaaaauugca

SEQ ID NO: 1674272 - RNA, 19 nt, Homo sapiens
uauacauuagacacacaua

SEQ ID NO: 1674273 - RNA, 20 nt, Homo sapiens
uauaccggagcuccaguuuc

SEQ ID NO: 1674274 - RNA, 14 nt, Homo sapiens
uauagagcacaaua

SEQ ID NO: 1674275 - RNA, 16 nt, Homo sapiens
uauagaugucugugua

SEQ ID NO: 1674276 - RNA, 21 nt, Homo sapiens
uauagaugucuguguauacau

SEQ ID NO: 1674277 - RNA, 21 nt, Homo sapiens
uauaggaaaaguuauugugau

SEQ ID NO: 1674278 - RNA, 16 nt, Homo sapiens
uauaguaccacugcac

SEQ ID NO: 1674279 - RNA, 22 nt, Homo sapiens
uauaguagacaaagagccagaa

SEQ ID NO: 1674280 - RNA, 15 nt, Homo sapiens
uauauagcagcuuua

SEQ ID NO: 1674281 - RNA, 22 nt, Homo sapiens
uauauaggcaauguaguacuca

SEQ ID NO: 1674282 - RNA, 12 nt, Homo sapiens
uauaucuauuac

SEQ ID NO: 1674283 - RNA, 17 nt, Homo sapiens
uauaucuguggucuuca

SEQ ID NO: 1674284 - RNA, 18 nt, Homo sapiens
uauaugaauauuuugcaa

SEQ ID NO: 1674285 - RNA, 12 nt, Homo sapiens
uauaugucaaag

SEQ ID NO: 1674286 - RNA, 16 nt, Homo sapiens
uauauuccagguuuaa

SEQ ID NO: 1674287 - RNA, 22 nt, Homo sapiens
uauauuugugugaaaaugugac

SEQ ID NO: 1674288 - RNA, 19 nt, Homo sapiens
uaucaaacuagugcaugaa

SEQ ID NO: 1674289 - RNA, 18 nt, Homo sapiens
uaucagagucaugaugaa

SEQ ID NO: 1674290 - RNA, 19 nt, Homo sapiens
uaucaggaaauaucuguga

SEQ ID NO: 1674291 - RNA, 22 nt, Homo sapiens
uaucagugaauauaaauguacu

SEQ ID NO: 1674292 - RNA, 23 nt, Homo sapiens
uaucaguuacaguggcaguauug

SEQ ID NO: 1674293 - RNA, 22 nt, Homo sapiens
uaucauguguuucuguguagua

SEQ ID NO: 1674294 - RNA, 21 nt, Homo sapiens
uauccaugcaccaaacuaaua

SEQ ID NO: 1674295 - RNA, 16 nt, Homo sapiens
uauccccccaaaugga

SEQ ID NO: 1674296 - RNA, 21 nt, Homo sapiens
uaucccgccagggagugugau

SEQ ID NO: 1674297 - RNA, 15 nt, Homo sapiens
uaucuacuucuacau

SEQ ID NO: 1674298 - RNA, 22 nt, Homo sapiens
uaucuggguuuuagaaauucua

SEQ ID NO: 1674299 - RNA, 22 nt, Homo sapiens
uaucuuaggauuuaccaaauag

SEQ ID NO: 1674300 - RNA, 19 nt, Homo sapiens
uaugaaccgcaauauggga

SEQ ID NO: 1674301 - RNA, 15 nt, Homo sapiens
uaugaagucccucua

SEQ ID NO: 1674302 - RNA, 19 nt, Homo sapiens
uaugaagucccucuauguc

SEQ ID NO: 1674303 - RNA, 22 nt, Homo sapiens
uaugacaauaaauuuuaucuca

SEQ ID NO: 1674304 - RNA, 14 nt, Homo sapiens
uaugaccauaaaau

SEQ ID NO: 1674305 - RNA, 23 nt, Homo sapiens
uaugaccauaaaauuagacauac

SEQ ID NO: 1674306 - RNA, 22 nt, Homo sapiens
uaugagauguagcaaauuccaa

SEQ ID NO: 1674307 - RNA, 20 nt, Homo sapiens
uaugaugguggaucaagaca

SEQ ID NO: 1674308 - RNA, 19 nt, Homo sapiens
uaugcacaauuccaugaau

SEQ ID NO: 1674309 - RNA, 12 nt, Homo sapiens
uaugcacuaauc

SEQ ID NO: 1674310 - RNA, 11 nt, Homo sapiens
uaugcauuuau

SEQ ID NO: 1674311 - RNA, 22 nt, Homo sapiens
uaugccccaccuaucuuuggua

SEQ ID NO: 1674312 - RNA, 12 nt, Homo sapiens
uaugcuggccag

SEQ ID NO: 1674313 - RNA, 18 nt, Homo sapiens
uaugcuguucauugauga

SEQ ID NO: 1674314 - RNA, 17 nt, Homo sapiens
uauggauugaaggauug

SEQ ID NO: 1674315 - RNA, 20 nt, Homo sapiens
uauggauugaaggauuguga

SEQ ID NO: 1674316 - RNA, 15 nt, Homo sapiens
uaugguaacugauga

SEQ ID NO: 1674317 - RNA, 10 nt, Homo sapiens
uauguaaaaa

SEQ ID NO: 1674318 - RNA, 22 nt, Homo sapiens
uauguaccguugauguugauaa

SEQ ID NO: 1674319 - RNA, 12 nt, Homo sapiens
uauguauacaca

SEQ ID NO: 1674320 - RNA, 23 nt, Homo sapiens
uaugucaccucaggaccauguga

SEQ ID NO: 1674321 - RNA, 23 nt, Homo sapiens
uaugucaguuauaauaaccuggu

SEQ ID NO: 1674322 - RNA, 14 nt, Homo sapiens
uaugugagcacaaa

SEQ ID NO: 1674323 - RNA, 16 nt, Homo sapiens
uauguuuuauuguaau

SEQ ID NO: 1674324 - RNA, 18 nt, Homo sapiens
uauuaaagaugcagguuu

SEQ ID NO: 1674325 - RNA, 14 nt, Homo sapiens
uauuaaauuccucc

SEQ ID NO: 1674326 - RNA, 15 nt, Homo sapiens
uauuaguuaggugug

SEQ ID NO: 1674327 - RNA, 21 nt, Homo sapiens
uauuaguuaggugugccaaac

SEQ ID NO: 1674328 - RNA, 14 nt, Homo sapiens
uauuauguccugug

SEQ ID NO: 1674329 - RNA, 16 nt, Homo sapiens
uauuauuuggugggga

SEQ ID NO: 1674330 - RNA, 23 nt, Homo sapiens
uauucaaagagaaaacaucucau

SEQ ID NO: 1674331 - RNA, 22 nt, Homo sapiens
uauucaggaaauguucacugaa

SEQ ID NO: 1674332 - RNA, 23 nt, Homo sapiens
uauucauacacucccuccccuuu

SEQ ID NO: 1674333 - RNA, 15 nt, Homo sapiens
uauucaucauucauu

SEQ ID NO: 1674334 - RNA, 22 nt, Homo sapiens
uauucaucauucauucauucac

SEQ ID NO: 1674335 - RNA, 18 nt, Homo sapiens
uauucauuuauuggcuua

SEQ ID NO: 1674336 - RNA, 14 nt, Homo sapiens
uauucuauuaccuu

SEQ ID NO: 1674337 - RNA, 19 nt, Homo sapiens
uauucuguagccaacuuaa

SEQ ID NO: 1674338 - RNA, 17 nt, Homo sapiens
uauugagcagaauucau

SEQ ID NO: 1674339 - RNA, 15 nt, Homo sapiens
uauugcuuggacuac

SEQ ID NO: 1674340 - RNA, 14 nt, Homo sapiens
uauugguagguuac

SEQ ID NO: 1674341 - RNA, 15 nt, Homo sapiens
uauuguccauuccaa

SEQ ID NO: 1674342 - RNA, 18 nt, Homo sapiens
uauuuaaggggaauuaac

SEQ ID NO: 1674343 - RNA, 13 nt, Homo sapiens
uauuuaagggugc

SEQ ID NO: 1674344 - RNA, 15 nt, Homo sapiens
uauuuacaugugauu

SEQ ID NO: 1674345 - RNA, 20 nt, Homo sapiens
uauuuacggaggcguuguga

SEQ ID NO: 1674346 - RNA, 15 nt, Homo sapiens
uauuuggugaugaga

SEQ ID NO: 1674347 - RNA, 15 nt, Homo sapiens
uauuuguccucaugu

SEQ ID NO: 1674348 - RNA, 19 nt, Homo sapiens
uauuuguccucaugugaga

SEQ ID NO: 1674349 - RNA, 18 nt, Homo sapiens
uauuuuaguuaacuauga

SEQ ID NO: 1674350 - RNA, 20 nt, Homo sapiens
uauuuuauacucauggaaga

SEQ ID NO: 1674351 - RNA, 12 nt, Homo sapiens
uauuuucacugg

SEQ ID NO: 1674352 - RNA, 21 nt, Homo sapiens
uauuuugauuguuugaugaau

SEQ ID NO: 1674353 - RNA, 16 nt, Homo sapiens
uauuuuggacguguga

SEQ ID NO: 1674354 - RNA, 16 nt, Homo sapiens
uauuuuguacguguua

SEQ ID NO: 1674355 - RNA, 21 nt, Homo sapiens
uauuuugucacccaaccuggc

SEQ ID NO: 1674356 - RNA, 17 nt, Homo sapiens
uauuuuuccucuuucac

SEQ ID NO: 1674357 - RNA, 16 nt, Homo sapiens
ucaaaacccugucucc

SEQ ID NO: 1674358 - RNA, 19 nt, Homo sapiens
ucaaaaucugggaccaaaa

SEQ ID NO: 1674359 - RNA, 22 nt, Homo sapiens
ucaaacaacauuccaccccagc

SEQ ID NO: 1674360 - RNA, 19 nt, Homo sapiens
ucaaacagggacacuacaa

SEQ ID NO: 1674361 - RNA, 17 nt, Homo sapiens
ucaaacuagugcaugaa

SEQ ID NO: 1674362 - RNA, 23 nt, Homo sapiens
ucaaacuuccauagcuucaucca

SEQ ID NO: 1674363 - RNA, 18 nt, Homo sapiens
ucaaagagaaaacaucuc

SEQ ID NO: 1674364 - RNA, 17 nt, Homo sapiens
uaaucccauacucucaa

SEQ ID NO: 1674365 - RNA, 15 nt, Homo sapiens
uaaucuucauggcca

SEQ ID NO: 1674366 - RNA, 23 nt, Homo sapiens
uaaucuugcugcuuaugugccaa

SEQ ID NO: 1674367 - RNA, 18 nt, Homo sapiens
uaaucuuggcccuauuca

SEQ ID NO: 1674368 - RNA, 13 nt, Homo sapiens
uaaugaaugacau

SEQ ID NO: 1674369 - RNA, 15 nt, Homo sapiens
uaaugauucaaugug

SEQ ID NO: 1674370 - RNA, 16 nt, Homo sapiens
uaauggaaacugucaa

SEQ ID NO: 1674371 - RNA, 14 nt, Homo sapiens
uaauguacaauaaa

SEQ ID NO: 1674372 - RNA, 20 nt, Homo sapiens
uaauguacaauaaagcaaug

SEQ ID NO: 1674373 - RNA, 20 nt, Homo sapiens
uaauguagauaaagcacugu

SEQ ID NO: 1674374 - RNA, 16 nt, Homo sapiens
uaaugucagcacaugu

SEQ ID NO: 1674375 - RNA, 12 nt, Homo sapiens
uaaugugugaga

SEQ ID NO: 1674376 - RNA, 11 nt, Homo sapiens
uaauguuauag

SEQ ID NO: 1674377 - RNA, 22 nt, Homo sapiens
uaauguugcuuucuuaucccag

SEQ ID NO: 1674378 - RNA, 21 nt, Homo sapiens
uaauuaaaaaguuaaucuuca

SEQ ID NO: 1674379 - RNA, 15 nt, Homo sapiens
uaauuccccuuccau

SEQ ID NO: 1674380 - RNA, 21 nt, Homo sapiens
uaauucuuaccucauuugcau

SEQ ID NO: 1674381 - RNA, 12 nt, Homo sapiens
uaauucuuuauc

SEQ ID NO: 1674382 - RNA, 19 nt, Homo sapiens
uaauuguauaaaacagugu

SEQ ID NO: 1674383 - RNA, 16 nt, Homo sapiens
uaauuuauuucaucca

SEQ ID NO: 1674384 - RNA, 19 nt, Homo sapiens
uaauuuuggguggggagaa

SEQ ID NO: 1674385 - RNA, 22 nt, Homo sapiens
uaauuuuuacugacgcucagua

SEQ ID NO: 1674386 - RNA, 16 nt, Homo sapiens
uacaauaaagcaaugu

SEQ ID NO: 1674387 - RNA, 18 nt, Homo sapiens
uacaauacaacacauuga

SEQ ID NO: 1674388 - RNA, 18 nt, Homo sapiens
uacaauguaucaacauau

SEQ ID NO: 1674389 - RNA, 11 nt, Homo sapiens
uacacaggccu

SEQ ID NO: 1674390 - RNA, 22 nt, Homo sapiens
uacacucgucccccuccugccu

SEQ ID NO: 1674391 - RNA, 23 nt, Homo sapiens
uacagaaucauugcuuaugacau

SEQ ID NO: 1674392 - RNA, 21 nt, Homo sapiens
uacagaccacaaaauguaaua

SEQ ID NO: 1674393 - RNA, 14 nt, Homo sapiens
uacagagcugagca

SEQ ID NO: 1674394 - RNA, 19 nt, Homo sapiens
uacagauugcugcuucugc

SEQ ID NO: 1674395 - RNA, 17 nt, Homo sapiens
uacagcaaauguuauag

SEQ ID NO: 1674396 - RNA, 22 nt, Homo sapiens
uacagcgcauuuucuaccugaa

SEQ ID NO: 1674397 - RNA, 13 nt, Homo sapiens
uacaggaaguacu

SEQ ID NO: 1674398 - RNA, 14 nt, Homo sapiens
uacaggaaguacug

SEQ ID NO: 1674399 - RNA, 22 nt, Homo sapiens
uacaggagaagaaacagcagcu

SEQ ID NO: 1674400 - RNA, 14 nt, Homo sapiens
uacaggcugagaca

SEQ ID NO: 1674401 - RNA, 22 nt, Homo sapiens
uacaguacucaggcagugcagu

SEQ ID NO: 1674402 - RNA, 16 nt, Homo sapiens
uacagugccacgacau

SEQ ID NO: 1674403 - RNA, 12 nt, Homo sapiens
uacaguugauau

SEQ ID NO: 1674404 - RNA, 20 nt, Homo sapiens
uacauaacaggcauugcacu

SEQ ID NO: 1674405 - RNA, 20 nt, Homo sapiens
uacauaguggucauuuggug

SEQ ID NO: 1674406 - RNA, 20 nt, Homo sapiens
uacaugccuuuccagugcug

SEQ ID NO: 1674407 - RNA, 13 nt, Homo sapiens
uacauuagacaca

SEQ ID NO: 1674408 - RNA, 18 nt, Homo sapiens
uacauuauuggacuucca

SEQ ID NO: 1674409 - RNA, 19 nt, Homo sapiens
uacauuauuggacuuccau

SEQ ID NO: 1674410 - RNA, 10 nt, Homo sapiens
uaccaaauau

SEQ ID NO: 1674411 - RNA, 19 nt, Homo sapiens
uaccaagugcuuugcucua

SEQ ID NO: 1674412 - RNA, 22 nt, Homo sapiens
uaccaccaagaggaaaauauug

SEQ ID NO: 1674413 - RNA, 15 nt, Homo sapiens
uaccagaucuaauau

SEQ ID NO: 1674414 - RNA, 18 nt, Homo sapiens
uaccccaggaugcaugca

SEQ ID NO: 1674415 - RNA, 18 nt, Homo sapiens
uacccccugccccagaga

SEQ ID NO: 1674416 - RNA, 16 nt, Homo sapiens
uacccuugugauuucu

SEQ ID NO: 1674417 - RNA, 13 nt, Homo sapiens
uaccuacugcuga

SEQ ID NO: 1674418 - RNA, 14 nt, Homo sapiens
uaccuauugcugua

SEQ ID NO: 1674419 - RNA, 12 nt, Homo sapiens
uaccucccagca

SEQ ID NO: 1674420 - RNA, 15 nt, Homo sapiens
uaccugaaaauucaa

SEQ ID NO: 1674421 - RNA, 23 nt, Homo sapiens
uacgaaacacaaaccacaacuga

SEQ ID NO: 1674422 - RNA, 14 nt, Homo sapiens
uacgcucucugucu

SEQ ID NO: 1674423 - RNA, 18 nt, Homo sapiens
uacgugaguccuggcaug

SEQ ID NO: 1674424 - RNA, 21 nt, Homo sapiens
uacuaccccagaacgcaugca

SEQ ID NO: 1674425 - RNA, 15 nt, Homo sapiens
uacuauuaacucugc

SEQ ID NO: 1674426 - RNA, 13 nt, Homo sapiens
uacucaggcagug

SEQ ID NO: 1674427 - RNA, 18 nt, Homo sapiens
uacucaggcagugcagua

SEQ ID NO: 1674428 - RNA, 21 nt, Homo sapiens
uacucaguaaaucagugcagu

SEQ ID NO: 1674429 - RNA, 19 nt, Homo sapiens
uacucaguaacagugcagu

SEQ ID NO: 1674430 - RNA, 16 nt, Homo sapiens
uacucuagacuaaaga

SEQ ID NO: 1674431 - RNA, 15 nt, Homo sapiens
uacugaaauacauau

SEQ ID NO: 1674432 - RNA, 17 nt, Homo sapiens
uacugaaauacauauga

SEQ ID NO: 1674433 - RNA, 14 nt, Homo sapiens
uacugaacaguauu

SEQ ID NO: 1674434 - RNA, 19 nt, Homo sapiens
uacugacgcucaguaacca

SEQ ID NO: 1674435 - RNA, 16 nt, Homo sapiens
uacugagauagcuuag

SEQ ID NO: 1674436 - RNA, 14 nt, Homo sapiens
uacuuagacccagu

SEQ ID NO: 1674437 - RNA, 15 nt, Homo sapiens
uacuucucgugacac

SEQ ID NO: 1674438 - RNA, 16 nt, Homo sapiens
uacuucuugugcuuua

SEQ ID NO: 1674439 - RNA, 15 nt, Homo sapiens
uacuuggaauuugcu

SEQ ID NO: 1674440 - RNA, 22 nt, Homo sapiens
uacuuuagguaguagaaucuca

SEQ ID NO: 1674441 - RNA, 16 nt, Homo sapiens
uacuuuggacuaaaga

SEQ ID NO: 1674442 - RNA, 22 nt, Homo sapiens
uacuuuuauaauuuccuaugcc

SEQ ID NO: 1674443 - RNA, 17 nt, Homo sapiens
uagaaacaugacacuga

SEQ ID NO: 1674444 - RNA, 18 nt, Homo sapiens
uagaaauuuuaucucuuc

SEQ ID NO: 1674445 - RNA, 17 nt, Homo sapiens
uagaaucaagucuguga

SEQ ID NO: 1674446 - RNA, 18 nt, Homo sapiens
uagaaugagaacauccau

SEQ ID NO: 1674447 - RNA, 16 nt, Homo sapiens
uagaauggggcuucca

SEQ ID NO: 1674448 - RNA, 17 nt, Homo sapiens
uagaauuuugauuccuu

SEQ ID NO: 1674449 - RNA, 18 nt, Homo sapiens
uagacuguuagacaaaag

SEQ ID NO: 1674450 - RNA, 20 nt, Homo sapiens
uagacuguuagacaaaagug

SEQ ID NO: 1674451 - RNA, 13 nt, Homo sapiens
uagagaagccaua

SEQ ID NO: 1674452 - RNA, 16 nt, Homo sapiens
uagagagaaacagcuu

SEQ ID NO: 1674453 - RNA, 23 nt, Homo sapiens
uagagaugauaaucccauacucu

SEQ ID NO: 1674454 - RNA, 20 nt, Homo sapiens
uagagcuagaugugucuuac

SEQ ID NO: 1674455 - RNA, 19 nt, Homo sapiens
uagaggguccagucuucua

SEQ ID NO: 1674456 - RNA, 22 nt, Homo sapiens
uagaggucuugaucuuuggaau

SEQ ID NO: 1674457 - RNA, 14 nt, Homo sapiens
uagauaagugcuca

SEQ ID NO: 1674458 - RNA, 20 nt, Homo sapiens
uagauaagugcucaguauug

SEQ ID NO: 1674459 - RNA, 19 nt, Homo sapiens
uagaucaggagaaacucgg

SEQ ID NO: 1674460 - RNA, 21 nt, Homo sapiens
uagauguccucagaagucagu

SEQ ID NO: 1674461 - RNA, 17 nt, Homo sapiens
uagaugucuguguauac

SEQ ID NO: 1674462 - RNA, 20 nt, Homo sapiens
uagaugucuguguauacaua

SEQ ID NO: 1674463 - RNA, 13 nt, Homo sapiens
uagaugugucuua

SEQ ID NO: 1674464 - RNA, 14 nt, Homo sapiens
uagaugugucuuac

SEQ ID NO: 1674465 - RNA, 17 nt, Homo sapiens
uagaugugucuuaccag

SEQ ID NO: 1674466 - RNA, 18 nt, Homo sapiens
uagauuaauggcacugau

SEQ ID NO: 1674467 - RNA, 16 nt, Homo sapiens
uagauuaccaugaaga

SEQ ID NO: 1674468 - RNA, 18 nt, Homo sapiens
uagauuuuucucaucucc

SEQ ID NO: 1674469 - RNA, 14 nt, Homo sapiens
uagcagcuuuagcc

SEQ ID NO: 1674470 - RNA, 20 nt, Homo sapiens
uagcaguucugcaaauagaa

SEQ ID NO: 1674471 - RNA, 14 nt, Homo sapiens
uagccaagugcagg

SEQ ID NO: 1674472 - RNA, 16 nt, Homo sapiens
uagccacgauggucuc

SEQ ID NO: 1674473 - RNA, 17 nt, Homo sapiens
uagccagaggcucuaau

SEQ ID NO: 1674474 - RNA, 13 nt, Homo sapiens
uagcccacugccu

SEQ ID NO: 1674475 - RNA, 17 nt, Homo sapiens
uagccugaaaauccaaa

SEQ ID NO: 1674476 - RNA, 15 nt, Homo sapiens
uagcgccucuuuuau

SEQ ID NO: 1674477 - RNA, 14 nt, Homo sapiens
uagcucgugugcuu

SEQ ID NO: 1674478 - RNA, 17 nt, Homo sapiens
ugugcgacuucacaaaa

SEQ ID NO: 1674479 - RNA, 23 nt, Homo sapiens
ugugcugccuguggugagguccu

SEQ ID NO: 1674480 - RNA, 18 nt, Homo sapiens
ugugcuguugauucuuuc

SEQ ID NO: 1674481 - RNA, 18 nt, Homo sapiens
uguggaauuacauaacag

SEQ ID NO: 1674482 - RNA, 18 nt, Homo sapiens
ugugucacgugacccugu

SEQ ID NO: 1674483 - RNA, 16 nt, Homo sapiens
ugugucaucugucagc

SEQ ID NO: 1674484 - RNA, 21 nt, Homo sapiens
uguguccgugaaaguugugau

SEQ ID NO: 1674485 - RNA, 15 nt, Homo sapiens
ugugucgcuuauguc

SEQ ID NO: 1674486 - RNA, 18 nt, Homo sapiens
ugugucgcuuaugucuau

SEQ ID NO: 1674487 - RNA, 12 nt, Homo sapiens
ugugucuucaau

SEQ ID NO: 1674488 - RNA, 14 nt, Homo sapiens
ugugucuucaauuu

SEQ ID NO: 1674489 - RNA, 15 nt, Homo sapiens
ugugugaagcaaauu

SEQ ID NO: 1674490 - RNA, 14 nt, Homo sapiens
ugugugcagugaug

SEQ ID NO: 1674491 - RNA, 22 nt, Homo sapiens
ugugugcuuugccacugaagua

SEQ ID NO: 1674492 - RNA, 21 nt, Homo sapiens
uguguguucuggggcaaccua

SEQ ID NO: 1674493 - RNA, 16 nt, Homo sapiens
uguuaaaaacauguga

SEQ ID NO: 1674494 - RNA, 14 nt, Homo sapiens
uguuaauaucacuc

SEQ ID NO: 1674495 - RNA, 16 nt, Homo sapiens
uguuaaugauucuugu

SEQ ID NO: 1674496 - RNA, 15 nt, Homo sapiens
uguuacuauuccuuu

SEQ ID NO: 1674497 - RNA, 15 nt, Homo sapiens
uguuagucaguauuc

SEQ ID NO: 1674498 - RNA, 23 nt, Homo sapiens
uguuaucuucuaucaaagcacau

SEQ ID NO: 1674499 - RNA, 22 nt, Homo sapiens
uguucagaagaaagauugcuau

SEQ ID NO: 1674500 - RNA, 21 nt, Homo sapiens
uguucaugcacacuugcaccc

SEQ ID NO: 1674501 - RNA, 12 nt, Homo sapiens
uguucauucaca

SEQ ID NO: 1674502 - RNA, 18 nt, Homo sapiens
uguucauucucaucagug

SEQ ID NO: 1674503 - RNA, 13 nt, Homo sapiens
uguucccaugaga

SEQ ID NO: 1674504 - RNA, 14 nt, Homo sapiens
uguuccugacuguu

SEQ ID NO: 1674505 - RNA, 18 nt, Homo sapiens
uguucucaaaugcuaaau

SEQ ID NO: 1674506 - RNA, 22 nt, Homo sapiens
uguucucaaucauugucagaga

SEQ ID NO: 1674507 - RNA, 21 nt, Homo sapiens
uguucuguggcugauuuacua

SEQ ID NO: 1674508 - RNA, 13 nt, Homo sapiens
uguucugugucac

SEQ ID NO: 1674509 - RNA, 20 nt, Homo sapiens
uguucugugucacgugaccc

SEQ ID NO: 1674510 - RNA, 11 nt, Homo sapiens
uguucuugggg

SEQ ID NO: 1674511 - RNA, 14 nt, Homo sapiens
uguugaauaaugcu

SEQ ID NO: 1674512 - RNA, 14 nt, Homo sapiens
uguugacagugcca

SEQ ID NO: 1674513 - RNA, 13 nt, Homo sapiens
uguugcugcaucu

SEQ ID NO: 1674514 - RNA, 14 nt, Homo sapiens
uguuuaggugccuc

SEQ ID NO: 1674515 - RNA, 14 nt, Homo sapiens
uguuuccagugaca

SEQ ID NO: 1674516 - RNA, 19 nt, Homo sapiens
uguuucccuucccuuccac

SEQ ID NO: 1674517 - RNA, 19 nt, Homo sapiens
uguuucugcagccacuauu

SEQ ID NO: 1674518 - RNA, 20 nt, Homo sapiens
uguuucugcagccacuauug

SEQ ID NO: 1674519 - RNA, 18 nt, Homo sapiens
uguuugccuuuaggcagg

SEQ ID NO: 1674520 - RNA, 21 nt, Homo sapiens
uguuuuccccaauuauccucc

SEQ ID NO: 1674521 - RNA, 22 nt, Homo sapiens
uguuuuccccaauuauccuccu

SEQ ID NO: 1674522 - RNA, 23 nt, Homo sapiens
uguuuuuuuuuuuuuugagacag

SEQ ID NO: 1674523 - RNA, 20 nt, Homo sapiens
uuaaaacuuacuaugguaua

SEQ ID NO: 1674524 - RNA, 19 nt, Homo sapiens
uuaaaauaauuauaugaag

SEQ ID NO: 1674525 - RNA, 15 nt, Homo sapiens
uuaaaauaguuacaa

SEQ ID NO: 1674526 - RNA, 11 nt, Homo sapiens
uuaaaaucaca

SEQ ID NO: 1674527 - RNA, 16 nt, Homo sapiens
uuaaaauuagugagau

SEQ ID NO: 1674528 - RNA, 17 nt, Homo sapiens
uuaaacugggaaaugag

SEQ ID NO: 1674529 - RNA, 14 nt, Homo sapiens
uuaaacuuugucac

SEQ ID NO: 1674530 - RNA, 20 nt, Homo sapiens
uuaaagaaguccaugugaua

SEQ ID NO: 1674531 - RNA, 16 nt, Homo sapiens
uuaaaggucucccaca

SEQ ID NO: 1674532 - RNA, 20 nt, Homo sapiens
uuaaagucuacacugccuuu

SEQ ID NO: 1674533 - RNA, 22 nt, Homo sapiens
uuaaagucuacacugccuuugu

SEQ ID NO: 1674534 - RNA, 19 nt, Homo sapiens
uuaaaguuacauuaugugu

SEQ ID NO: 1674535 - RNA, 17 nt, Homo sapiens
uuaaauaaaaaaguuua

SEQ ID NO: 1674536 - RNA, 20 nt, Homo sapiens
uuaaaugaacuugauagcua

SEQ ID NO: 1674537 - RNA, 18 nt, Homo sapiens
uuaacagguaugaaccac

SEQ ID NO: 1674538 - RNA, 15 nt, Homo sapiens
uuaacaugucacaau

SEQ ID NO: 1674539 - RNA, 19 nt, Homo sapiens
uuaagacaacaggcauuuu

SEQ ID NO: 1674540 - RNA, 14 nt, Homo sapiens
uuaagaugggcaua

SEQ ID NO: 1674541 - RNA, 23 nt, Homo sapiens
uuaagcacaaccauguucuugag

SEQ ID NO: 1674542 - RNA, 13 nt, Homo sapiens
uuaagcacauuau

SEQ ID NO: 1674543 - RNA, 13 nt, Homo sapiens
uuaauaaagauuc

SEQ ID NO: 1674544 - RNA, 12 nt, Homo sapiens
uuaauaagcaac

SEQ ID NO: 1674545 - RNA, 23 nt, Homo sapiens
uuaauaagucacugacaucagca

SEQ ID NO: 1674546 - RNA, 20 nt, Homo sapiens
uuaaucacaggaucccacga

SEQ ID NO: 1674547 - RNA, 20 nt, Homo sapiens
uuaauugaaauaccuauuca

SEQ ID NO: 1674548 - RNA, 13 nt, Homo sapiens
uuacaaaccucuc

SEQ ID NO: 1674549 - RNA, 14 nt, Homo sapiens
uuacaaaccucuca

SEQ ID NO: 1674550 - RNA, 19 nt, Homo sapiens
uuacaacaagcaaacugaa

SEQ ID NO: 1674551 - RNA, 19 nt, Homo sapiens
uuacaauguaucaacauau

SEQ ID NO: 1674552 - RNA, 12 nt, Homo sapiens
uuacacaauggu

SEQ ID NO: 1674553 - RNA, 20 nt, Homo sapiens
uuacagaaaacaagguccag

SEQ ID NO: 1674554 - RNA, 12 nt, Homo sapiens
uuacagugccac

SEQ ID NO: 1674555 - RNA, 19 nt, Homo sapiens
uuacaguggcaguauugac

SEQ ID NO: 1674556 - RNA, 12 nt, Homo sapiens
uuacaugugauu

SEQ ID NO: 1674557 - RNA, 19 nt, Homo sapiens
uuaccaaagaagaguuuac

SEQ ID NO: 1674558 - RNA, 20 nt, Homo sapiens
uuaccagcauccacucuccc

SEQ ID NO: 1674559 - RNA, 14 nt, Homo sapiens
uuaccaugcucaau

SEQ ID NO: 1674560 - RNA, 14 nt, Homo sapiens
uuacccaaugcagu

SEQ ID NO: 1674561 - RNA, 14 nt, Homo sapiens
uuaccucauuugca

SEQ ID NO: 1674562 - RNA, 15 nt, Homo sapiens
uuaccucauuugcau

SEQ ID NO: 1674563 - RNA, 13 nt, Homo sapiens
uuaccugacacaa

SEQ ID NO: 1674564 - RNA, 13 nt, Homo sapiens
uuacuaacacugg

SEQ ID NO: 1674565 - RNA, 13 nt, Homo sapiens
uuacuaguaucac

SEQ ID NO: 1674566 - RNA, 23 nt, Homo sapiens
uuacuauagcaaaguaguacuuc

SEQ ID NO: 1674567 - RNA, 15 nt, Homo sapiens
uuacuuuaucugggc

SEQ ID NO: 1674568 - RNA, 19 nt, Homo sapiens
uuagaagaaaauggaugac

SEQ ID NO: 1674569 - RNA, 19 nt, Homo sapiens
uuagaaggcagacuuucua

SEQ ID NO: 1674570 - RNA, 21 nt, Homo sapiens
uuagaaguucgaaaacucagc

SEQ ID NO: 1674571 - RNA, 20 nt, Homo sapiens
uuagaaugucaguugaucag

SEQ ID NO: 1674572 - RNA, 19 nt, Homo sapiens
uuagacaagucuaguggaa

SEQ ID NO: 1674573 - RNA, 15 nt, Homo sapiens
uuagacaauguggaa

SEQ ID NO: 1674574 - RNA, 18 nt, Homo sapiens
uuaggaaagcagugcagu

SEQ ID NO: 1674575 - RNA, 23 nt, Homo sapiens
uuaggaugaguuucuauguugua

SEQ ID NO: 1674576 - RNA, 21 nt, Homo sapiens
uuaggcaauggugaacuguca

SEQ ID NO: 1674577 - RNA, 22 nt, Homo sapiens
uuaggcaauggugaacugucau

SEQ ID NO: 1674578 - RNA, 21 nt, Homo sapiens
uuaguagagacggguuucacc

SEQ ID NO: 1674579 - RNA, 13 nt, Homo sapiens
uuaguauuugccc

SEQ ID NO: 1674580 - RNA, 16 nt, Homo sapiens
uuagugugauugugaa

SEQ ID NO: 1674581 - RNA, 21 nt, Homo sapiens
uuaguuaacuaugauuccaau

SEQ ID NO: 1674582 - RNA, 21 nt, Homo sapiens
uuauaaagauugguaguuauc

SEQ ID NO: 1674583 - RNA, 17 nt, Homo sapiens
uuauaaaugaagaugca

SEQ ID NO: 1674584 - RNA, 15 nt, Homo sapiens
uuauaauaaccuggu

SEQ ID NO: 1674585 - RNA, 14 nt, Homo sapiens
uuauagagcacaau

SEQ ID NO: 1674586 - RNA, 23 nt, Homo sapiens
uuauaggaaaaguuauugugaua

SEQ ID NO: 1674587 - RNA, 22 nt, Homo sapiens
uuauaggcacuugcuacuucag

SEQ ID NO: 1674588 - RNA, 22 nt, Homo sapiens
uuauauaauaaaguauuccacc

SEQ ID NO: 1674589 - RNA, 19 nt, Homo sapiens
uuauauauaagccaaaaaa

SEQ ID NO: 1674590 - RNA, 19 nt, Homo sapiens
uuauaucagacugcuuuga

SEQ ID NO: 1674591 - RNA, 23 nt, Homo sapiens
uuauauucauuuauucaucauuc

SEQ ID NO: 1674592 - RNA, 22 nt, Homo sapiens
uuauauucccaaaucucaaaag

SEQ ID NO: 1674593 - RNA, 12 nt, Homo sapiens
uuauauugcuag

SEQ ID NO: 1674594 - RNA, 18 nt, Homo sapiens
uuaucccagugaucaccu

SEQ ID NO: 1674595 - RNA, 15 nt, Homo sapiens
uuaucgaaaguaaaa

SEQ ID NO: 1674596 - RNA, 22 nt, Homo sapiens
uuaugauauaauaaauauauau

SEQ ID NO: 1674597 - RNA, 23 nt, Homo sapiens
uuauucaauaacuauugcugcuu

SEQ ID NO: 1674598 - RNA, 22 nt, Homo sapiens
uuauucagaaaagaugugcaga

SEQ ID NO: 1674599 - RNA, 23 nt, Homo sapiens
uuauucuuauuuggacagccaag

SEQ ID NO: 1674600 - RNA, 13 nt, Homo sapiens
uccaacccaugca

SEQ ID NO: 1674601 - RNA, 12 nt, Homo sapiens
uccaaccuggag

SEQ ID NO: 1674602 - RNA, 12 nt, Homo sapiens
uccaacuuuccc

SEQ ID NO: 1674603 - RNA, 14 nt, Homo sapiens
uccaacuuuucauc

SEQ ID NO: 1674604 - RNA, 17 nt, Homo sapiens
uccaaggaacuucaugc

SEQ ID NO: 1674605 - RNA, 23 nt, Homo sapiens
uccaaggaacuucaugcuugauu

SEQ ID NO: 1674606 - RNA, 15 nt, Homo sapiens
uccaaggcaaauguc

SEQ ID NO: 1674607 - RNA, 19 nt, Homo sapiens
uccaagggaucugcuugau

SEQ ID NO: 1674608 - RNA, 14 nt, Homo sapiens
uccaagguggcaua

SEQ ID NO: 1674609 - RNA, 17 nt, Homo sapiens
uccaagucaugggagaa

SEQ ID NO: 1674610 - RNA, 22 nt, Homo sapiens
uccaagugaaugaguuuccagc

SEQ ID NO: 1674611 - RNA, 12 nt, Homo sapiens
uccaaugccaau

SEQ ID NO: 1674612 - RNA, 16 nt, Homo sapiens
uccaaugccaauucau

SEQ ID NO: 1674613 - RNA, 17 nt, Homo sapiens
uccaauuacuacuuugu

SEQ ID NO: 1674614 - RNA, 22 nt, Homo sapiens
uccacaaccuccuccuccaguu

SEQ ID NO: 1674615 - RNA, 13 nt, Homo sapiens
uccacaccagucc

SEQ ID NO: 1674616 - RNA, 16 nt, Homo sapiens
uccacagcagcaaagg

SEQ ID NO: 1674617 - RNA, 16 nt, Homo sapiens
uccacaguaaucuuuc

SEQ ID NO: 1674618 - RNA, 19 nt, Homo sapiens
uccacaguuaggccaagaa

SEQ ID NO: 1674619 - RNA, 21 nt, Homo sapiens
uccacaucaaaaaugcaucaa

SEQ ID NO: 1674620 - RNA, 14 nt, Homo sapiens
uccacccugcccug

SEQ ID NO: 1674621 - RNA, 20 nt, Homo sapiens
uccaccuagagcuagaugug

SEQ ID NO: 1674622 - RNA, 18 nt, Homo sapiens
uccacgugggguggaauu

SEQ ID NO: 1674623 - RNA, 13 nt, Homo sapiens
uccacuacaguga

SEQ ID NO: 1674624 - RNA, 11 nt, Homo sapiens
uccacugccuc

SEQ ID NO: 1674625 - RNA, 20 nt, Homo sapiens
uccacugcugaggacacuca

SEQ ID NO: 1674626 - RNA, 14 nt, Homo sapiens
uccacuucucuaga

SEQ ID NO: 1674627 - RNA, 16 nt, Homo sapiens
uccacuugccuuguga

SEQ ID NO: 1674628 - RNA, 19 nt, Homo sapiens
uccacuugccuugugauau

SEQ ID NO: 1674629 - RNA, 20 nt, Homo sapiens
uccacuugccuugugauauu

SEQ ID NO: 1674630 - RNA, 14 nt, Homo sapiens
uccagagagaagca

SEQ ID NO: 1674631 - RNA, 18 nt, Homo sapiens
uccagaggguugugauuu

SEQ ID NO: 1674632 - RNA, 23 nt, Homo sapiens
uccagaggugaugguaacugcac

SEQ ID NO: 1674633 - RNA, 23 nt, Homo sapiens
uccagauccucuuuccccacuga

SEQ ID NO: 1674634 - RNA, 22 nt, Homo sapiens
uccagaugugccuagacacgaa

SEQ ID NO: 1674635 - RNA, 17 nt, Homo sapiens
uccagcccugcagcuau

SEQ ID NO: 1674636 - RNA, 18 nt, Homo sapiens
uccagcuaagccugauga

SEQ ID NO: 1674637 - RNA, 17 nt, Homo sapiens
uccaggcagacacagcu

SEQ ID NO: 1674638 - RNA, 18 nt, Homo sapiens
uccaggguuaaagaaagg

SEQ ID NO: 1674639 - RNA, 21 nt, Homo sapiens
uccagugacacaacucaucca

SEQ ID NO: 1674640 - RNA, 14 nt, Homo sapiens
uccagugcuuuauc

SEQ ID NO: 1674641 - RNA, 15 nt, Homo sapiens
uccaguucugaugag

SEQ ID NO: 1674642 - RNA, 14 nt, Homo sapiens
uccaguuugcccac

SEQ ID NO: 1674643 - RNA, 19 nt, Homo sapiens
uccauagcuucauccacug

SEQ ID NO: 1674644 - RNA, 19 nt, Homo sapiens
uccauaucagcucugcaua

SEQ ID NO: 1674645 - RNA, 17 nt, Homo sapiens
uccaucucaagugccau

SEQ ID NO: 1674646 - RNA, 23 nt, Homo sapiens
uccaucucgcugccgucuguccc

SEQ ID NO: 1674647 - RNA, 17 nt, Homo sapiens
uccaugacugcauuuua

SEQ ID NO: 1674648 - RNA, 17 nt, Homo sapiens
uccaugaucaaaaugca

SEQ ID NO: 1674649 - RNA, 23 nt, Homo sapiens
uccaugcagaucuagccaggccu

SEQ ID NO: 1674650 - RNA, 14 nt, Homo sapiens
uccaugccuuccau

SEQ ID NO: 1674651 - RNA, 18 nt, Homo sapiens
uccaugcuccucacugcc

SEQ ID NO: 1674652 - RNA, 15 nt, Homo sapiens
uccaugucugaaguu

SEQ ID NO: 1674653 - RNA, 18 nt, Homo sapiens
uccauuaaacuucuacug

SEQ ID NO: 1674654 - RNA, 20 nt, Homo sapiens
uccauuaaacuucuacugag

SEQ ID NO: 1674655 - RNA, 14 nt, Homo sapiens
uccauuaaccaaga

SEQ ID NO: 1674656 - RNA, 16 nt, Homo sapiens
uccauuuucugugaga

SEQ ID NO: 1674657 - RNA, 16 nt, Homo sapiens
ucccaaagcagugcau

SEQ ID NO: 1674658 - RNA, 17 nt, Homo sapiens
ucccaaaguccugggau

SEQ ID NO: 1674659 - RNA, 20 nt, Homo sapiens
ucccaagcacuucaaaggaa

SEQ ID NO: 1674660 - RNA, 15 nt, Homo sapiens
ucccaagguucaaua

SEQ ID NO: 1674661 - RNA, 14 nt, Homo sapiens
ucccaagucaaaca

SEQ ID NO: 1674662 - RNA, 17 nt, Homo sapiens
ucccaaucagcacugaa

SEQ ID NO: 1674663 - RNA, 18 nt, Homo sapiens
ucccaaucagcacugaaa

SEQ ID NO: 1674664 - RNA, 14 nt, Homo sapiens
ucccaaucccauuc

SEQ ID NO: 1674665 - RNA, 16 nt, Homo sapiens
ucccaaucccauuccu

SEQ ID NO: 1674666 - RNA, 17 nt, Homo sapiens
ucccacaagaaauucau

SEQ ID NO: 1674667 - RNA, 15 nt, Homo sapiens
ucccacacugugaac

SEQ ID NO: 1674668 - RNA, 19 nt, Homo sapiens
ucccagccucccggagcuc

SEQ ID NO: 1674669 - RNA, 13 nt, Homo sapiens
ucccaggcacucu

SEQ ID NO: 1674670 - RNA, 19 nt, Homo sapiens
ucccaggggacaugaguaa

SEQ ID NO: 1674671 - RNA, 17 nt, Homo sapiens
ucccaugguagacugug

SEQ ID NO: 1674672 - RNA, 23 nt, Homo sapiens
uccccaaucaauacccuugugau

SEQ ID NO: 1674673 - RNA, 13 nt, Homo sapiens
uccccagccugcu

SEQ ID NO: 1674674 - RNA, 20 nt, Homo sapiens
uccccaguuaaugugccaaa

SEQ ID NO: 1674675 - RNA, 20 nt, Homo sapiens
uccccauuaguauccuguua

SEQ ID NO: 1674676 - RNA, 21 nt, Homo sapiens
ucccccacggccgucccugac

SEQ ID NO: 1674677 - RNA, 15 nt, Homo sapiens
ucccccuaaacugug

SEQ ID NO: 1674678 - RNA, 16 nt, Homo sapiens
ucccccuaaacuguga

SEQ ID NO: 1674679 - RNA, 13 nt, Homo sapiens
uccccguccacag

SEQ ID NO: 1674680 - RNA, 16 nt, Homo sapiens
uccccguccacagggc

SEQ ID NO: 1674681 - RNA, 17 nt, Homo sapiens
uccccucagccaaugaa

SEQ ID NO: 1674682 - RNA, 21 nt, Homo sapiens
uccccucauccacuaggugcc

SEQ ID NO: 1674683 - RNA, 13 nt, Homo sapiens
uccccuccagacc

SEQ ID NO: 1674684 - RNA, 17 nt, Homo sapiens
uccccuuccauucccaa

SEQ ID NO: 1674685 - RNA, 13 nt, Homo sapiens
ucccgcaggcuuc

SEQ ID NO: 1674686 - RNA, 16 nt, Homo sapiens
ucccgggcacugucau

SEQ ID NO: 1674687 - RNA, 18 nt, Homo sapiens
ucccgggcacugucaugc

SEQ ID NO: 1674688 - RNA, 19 nt, Homo sapiens
ucccgggcacugucaugcc

SEQ ID NO: 1674689 - RNA, 23 nt, Homo sapiens
ucccuagccagaggcucuaaugu

SEQ ID NO: 1674690 - RNA, 19 nt, Homo sapiens
ucccucagcccucauuaaa

SEQ ID NO: 1674691 - RNA, 14 nt, Homo sapiens
ucccuccacauuuc

SEQ ID NO: 1674692 - RNA, 18 nt, Homo sapiens
ucccuccaccagugugcu

SEQ ID NO: 1674693 - RNA, 11 nt, Homo sapiens
ucccuccacuc

SEQ ID NO: 1674694 - RNA, 15 nt, Homo sapiens
ucccugaacacucau

SEQ ID NO: 1674695 - RNA, 19 nt, Homo sapiens
ucccugaacacucaucccc

SEQ ID NO: 1674696 - RNA, 21 nt, Homo sapiens
ucccuggggcugcugugcgcu

SEQ ID NO: 1674697 - RNA, 23 nt, Homo sapiens
ucccuucacaaaauuuuguuuca

SEQ ID NO: 1674698 - RNA, 16 nt, Homo sapiens
ucccuuccacugccuc

SEQ ID NO: 1674699 - RNA, 22 nt, Homo sapiens
ucccuuccacugccucugccuu

SEQ ID NO: 1674700 - RNA, 14 nt, Homo sapiens
ucccuugauucaaa

SEQ ID NO: 1674701 - RNA, 16 nt, Homo sapiens
uccgaagugcaaugau

SEQ ID NO: 1674702 - RNA, 15 nt, Homo sapiens
uccgcgugucucauu

SEQ ID NO: 1674703 - RNA, 23 nt, Homo sapiens
uccggauggaaucacagccaaua

SEQ ID NO: 1674704 - RNA, 15 nt, Homo sapiens
uccggugccuuccac

SEQ ID NO: 1674705 - RNA, 16 nt, Homo sapiens
uccguuuccaaauaca

SEQ ID NO: 1674706 - RNA, 20 nt, Homo sapiens
uccuaagcuggagugcagug

SEQ ID NO: 1674707 - RNA, 16 nt, Homo sapiens
uccuacacuugagaug

SEQ ID NO: 1674708 - RNA, 21 nt, Homo sapiens
uccuaucccuggacgcaugca

SEQ ID NO: 1674709 - RNA, 17 nt, Homo sapiens
uccucaagauccugucu

SEQ ID NO: 1674710 - RNA, 21 nt, Homo sapiens
uccucagaagucaguugcaaa

SEQ ID NO: 1674711 - RNA, 15 nt, Homo sapiens
uccucaguccacugc

SEQ ID NO: 1674712 - RNA, 18 nt, Homo sapiens
uccuccaguucugaugag

SEQ ID NO: 1674713 - RNA, 20 nt, Homo sapiens
uccucggcccuguagcccug

SEQ ID NO: 1674714 - RNA, 19 nt, Homo sapiens
uccucucgagcccagaugg

SEQ ID NO: 1674715 - RNA, 15 nt, Homo sapiens
uccucuuaauuccca

SEQ ID NO: 1674716 - RNA, 23 nt, Homo sapiens
uccucuuaccuguaauagccuca

SEQ ID NO: 1674717 - RNA, 23 nt, Homo sapiens
uccugagaaggccagaauacugg

SEQ ID NO: 1674718 - RNA, 13 nt, Homo sapiens
uccugcacugucc

SEQ ID NO: 1674719 - RNA, 22 nt, Homo sapiens
uccugcgggcgggcgucugcug

SEQ ID NO: 1674720 - RNA, 22 nt, Homo sapiens
uccugcucacccgccucuugcc

SEQ ID NO: 1674721 - RNA, 23 nt, Homo sapiens
uccugcucacccgccucuugccc

SEQ ID NO: 1674722 - RNA, 23 nt, Homo sapiens
uccugcuugguuuagcugugcag

SEQ ID NO: 1674723 - RNA, 15 nt, Homo sapiens
uggaggaaaccacaa

SEQ ID NO: 1674724 - RNA, 20 nt, Homo sapiens
uggaggaacugcuugugcac

SEQ ID NO: 1674725 - RNA, 21 nt, Homo sapiens
uggaggaacugcuugugcacu

SEQ ID NO: 1674726 - RNA, 21 nt, Homo sapiens
uggaggaggggguacaguccu

SEQ ID NO: 1674727 - RNA, 20 nt, Homo sapiens
uggaggaucauuugagccca

SEQ ID NO: 1674728 - RNA, 19 nt, Homo sapiens
uggagucagggcugugcuu

SEQ ID NO: 1674729 - RNA, 18 nt, Homo sapiens
uggagugcaauggugcga

SEQ ID NO: 1674730 - RNA, 23 nt, Homo sapiens
uggagugucaccagcugccaaaa

SEQ ID NO: 1674731 - RNA, 20 nt, Homo sapiens
uggauaauaacuagaucucc

SEQ ID NO: 1674732 - RNA, 22 nt, Homo sapiens
uggauacaggagaagaaacagc

SEQ ID NO: 1674733 - RNA, 15 nt, Homo sapiens
uggaucacacacaug

SEQ ID NO: 1674734 - RNA, 18 nt, Homo sapiens
uggaucuguugggaacca

SEQ ID NO: 1674735 - RNA, 16 nt, Homo sapiens
uggaugucauaucuuc

SEQ ID NO: 1674736 - RNA, 12 nt, Homo sapiens
uggaugugcauc

SEQ ID NO: 1674737 - RNA, 15 nt, Homo sapiens
uggauguggccccac

SEQ ID NO: 1674738 - RNA, 19 nt, Homo sapiens
uggcacguaaggucucauu

SEQ ID NO: 1674739 - RNA, 19 nt, Homo sapiens
uggcaucaucucagcucac

SEQ ID NO: 1674740 - RNA, 23 nt, Homo sapiens
uggcauuacaggugugagccacg

SEQ ID NO: 1674741 - RNA, 12 nt, Homo sapiens
uggccaaugggg

SEQ ID NO: 1674742 - RNA, 14 nt, Homo sapiens
uggccagcacguuc

SEQ ID NO: 1674743 - RNA, 19 nt, Homo sapiens
uggcccauagaaacaugac

SEQ ID NO: 1674744 - RNA, 13 nt, Homo sapiens
uggccccagcucc

SEQ ID NO: 1674745 - RNA, 21 nt, Homo sapiens
uggcccccacccaguccugca

SEQ ID NO: 1674746 - RNA, 18 nt, Homo sapiens
uggcccugcccugaggaa

SEQ ID NO: 1674747 - RNA, 14 nt, Homo sapiens
uggccgcugcccac

SEQ ID NO: 1674748 - RNA, 17 nt, Homo sapiens
uggccgcugcugugaca

SEQ ID NO: 1674749 - RNA, 18 nt, Homo sapiens
uggccgucacgcuuucau

SEQ ID NO: 1674750 - RNA, 16 nt, Homo sapiens
uggccuaugacccugu

SEQ ID NO: 1674751 - RNA, 13 nt, Homo sapiens
uggccugacacaa

SEQ ID NO: 1674752 - RNA, 12 nt, Homo sapiens
uggccuugccuc

SEQ ID NO: 1674753 - RNA, 21 nt, Homo sapiens
uggcgaguccagacaccauca

SEQ ID NO: 1674754 - RNA, 15 nt, Homo sapiens
uggcgcgaucucagc

SEQ ID NO: 1674755 - RNA, 15 nt, Homo sapiens
uggcgugaucucagc

SEQ ID NO: 1674756 - RNA, 22 nt, Homo sapiens
uggcuagucugugccucaguga

SEQ ID NO: 1674757 - RNA, 17 nt, Homo sapiens
uggcugauuggaaaaua

SEQ ID NO: 1674758 - RNA, 17 nt, Homo sapiens
uggcuggaugugcaucu

SEQ ID NO: 1674759 - RNA, 21 nt, Homo sapiens
uggcuggguuugggcagugga

SEQ ID NO: 1674760 - RNA, 21 nt, Homo sapiens
ugggaaagacccuaggugcuc

SEQ ID NO: 1674761 - RNA, 14 nt, Homo sapiens
ugggaagaagcagu

SEQ ID NO: 1674762 - RNA, 20 nt, Homo sapiens
ugggaagaauaaaaugcagu

SEQ ID NO: 1674763 - RNA, 21 nt, Homo sapiens
ugggaagaauaaaaugcagug

SEQ ID NO: 1674764 - RNA, 13 nt, Homo sapiens
ugggacagaggag

SEQ ID NO: 1674765 - RNA, 22 nt, Homo sapiens
ugggcaacagagugagacccua

SEQ ID NO: 1674766 - RNA, 19 nt, Homo sapiens
ugggccgggguguggaauc

SEQ ID NO: 1674767 - RNA, 15 nt, Homo sapiens
ugggcucuucgccau

SEQ ID NO: 1674768 - RNA, 14 nt, Homo sapiens
ugggcugucuguca

SEQ ID NO: 1674769 - RNA, 12 nt, Homo sapiens
uggggaagccag

SEQ ID NO: 1674770 - RNA, 22 nt, Homo sapiens
uggggacagaggauuucugcuu

SEQ ID NO: 1674771 - RNA, 20 nt, Homo sapiens
uggggagccauaagggacau

SEQ ID NO: 1674772 - RNA, 21 nt, Homo sapiens
uggggcaguuccccuucuuac

SEQ ID NO: 1674773 - RNA, 16 nt, Homo sapiens
uggggcgacugugaaa

SEQ ID NO: 1674774 - RNA, 22 nt, Homo sapiens
uggggcuuccauggugguuuca

SEQ ID NO: 1674775 - RNA, 18 nt, Homo sapiens
uggggcuuuagcuagaag

SEQ ID NO: 1674776 - RNA, 14 nt, Homo sapiens
ugggggaugcuuca

SEQ ID NO: 1674777 - RNA, 18 nt, Homo sapiens
ugggggcugcugcacugc

SEQ ID NO: 1674778 - RNA, 22 nt, Homo sapiens
ugggguuuaaaagaacugucuc

SEQ ID NO: 1674779 - RNA, 12 nt, Homo sapiens
ugggucaacucc

SEQ ID NO: 1674780 - RNA, 16 nt, Homo sapiens
ugggucaauuccuuag

SEQ ID NO: 1674781 - RNA, 14 nt, Homo sapiens
ugggugcugucaug

SEQ ID NO: 1674782 - RNA, 15 nt, Homo sapiens
uggguuccagacaga

SEQ ID NO: 1674783 - RNA, 23 nt, Homo sapiens
uggguugugaaauacucuuccaa

SEQ ID NO: 1674784 - RNA, 16 nt, Homo sapiens
ugguaaauaacuguga

SEQ ID NO: 1674785 - RNA, 17 nt, Homo sapiens
ugguacuuguaccuccg

SEQ ID NO: 1674786 - RNA, 12 nt, Homo sapiens
ugguaucucuuu

SEQ ID NO: 1674787 - RNA, 15 nt, Homo sapiens
uggucacaaagcuau

SEQ ID NO: 1674788 - RNA, 23 nt, Homo sapiens
ugguccccugcccugucuuucca

SEQ ID NO: 1674789 - RNA, 15 nt, Homo sapiens
ugguccgacaugccu

SEQ ID NO: 1674790 - RNA, 19 nt, Homo sapiens
ugguccuacccgcuuccca

SEQ ID NO: 1674791 - RNA, 16 nt, Homo sapiens
ugguccugcacugucc

SEQ ID NO: 1674792 - RNA, 10 nt, Homo sapiens
uggucucuuu

SEQ ID NO: 1674793 - RNA, 17 nt, Homo sapiens
uggucugucagcuguga

SEQ ID NO: 1674794 - RNA, 12 nt, Homo sapiens
uggugacugucc

SEQ ID NO: 1674795 - RNA, 14 nt, Homo sapiens
uggugcuggguccu

SEQ ID NO: 1674796 - RNA, 21 nt, Homo sapiens
uggugugcuuuucuaagcauu

SEQ ID NO: 1674797 - RNA, 14 nt, Homo sapiens
ugguguucccaaga

SEQ ID NO: 1674798 - RNA, 22 nt, Homo sapiens
ugguguuuagaaugucaguuga

SEQ ID NO: 1674799 - RNA, 15 nt, Homo sapiens
ugguucccauuugcu

SEQ ID NO: 1674800 - RNA, 17 nt, Homo sapiens
ugguuuauugaauguga

SEQ ID NO: 1674801 - RNA, 18 nt, Homo sapiens
uguaaaaacccugcuaaa

SEQ ID NO: 1674802 - RNA, 13 nt, Homo sapiens
uguaaaacuguga

SEQ ID NO: 1674803 - RNA, 18 nt, Homo sapiens
uguaaauauacacuauuu

SEQ ID NO: 1674804 - RNA, 21 nt, Homo sapiens
uguaaauauuaugauggugga

SEQ ID NO: 1674805 - RNA, 20 nt, Homo sapiens
uguaacggaugaccauaugc

SEQ ID NO: 1674806 - RNA, 17 nt, Homo sapiens
uguaagauaauguugcu

SEQ ID NO: 1674807 - RNA, 18 nt, Homo sapiens
uguacaauaaagcaaugu

SEQ ID NO: 1674808 - RNA, 14 nt, Homo sapiens
uguacagcaaggua

SEQ ID NO: 1674809 - RNA, 21 nt, Homo sapiens
uguacauguggaaaacucaca

SEQ ID NO: 1674810 - RNA, 20 nt, Homo sapiens
uguacccuucuugucucucu

SEQ ID NO: 1674811 - RNA, 19 nt, Homo sapiens
uguaccuaaguaaauuuuc

SEQ ID NO: 1674812 - RNA, 22 nt, Homo sapiens
uguaccugggcuuggugcguuu

SEQ ID NO: 1674813 - RNA, 15 nt, Homo sapiens
uguacuacauuugca

SEQ ID NO: 1674814 - RNA, 14 nt, Homo sapiens
uguacuuacacuga

SEQ ID NO: 1674815 - RNA, 19 nt, Homo sapiens
uguagaauuauaacuaauu

SEQ ID NO: 1674816 - RNA, 23 nt, Homo sapiens
uguagccugaguguccacaggga

SEQ ID NO: 1674817 - RNA, 23 nt, Homo sapiens
uguauauauuuauuauuuucaua

SEQ ID NO: 1674818 - RNA, 20 nt, Homo sapiens
uguaucaauaaaauacuuug

SEQ ID NO: 1674819 - RNA, 17 nt, Homo sapiens
uguaugugugaguguau

SEQ ID NO: 1674820 - RNA, 19 nt, Homo sapiens
uguauuccucacauucaca

SEQ ID NO: 1674821 - RNA, 17 nt, Homo sapiens
uguauuuucacuggaga

SEQ ID NO: 1674822 - RNA, 18 nt, Homo sapiens
ugucaccagcugccaaaa

SEQ ID NO: 1674823 - RNA, 13 nt, Homo sapiens
ugucaucugucag

SEQ ID NO: 1674824 - RNA, 16 nt, Homo sapiens
ugucaugaauguugca

SEQ ID NO: 1674825 - RNA, 15 nt, Homo sapiens
ugucaugacuuucag

SEQ ID NO: 1674826 - RNA, 19 nt, Homo sapiens
ugucaugauuucaaugauu

SEQ ID NO: 1674827 - RNA, 15 nt, Homo sapiens
uguccaugccuucca

SEQ ID NO: 1674828 - RNA, 16 nt, Homo sapiens
uguccaugccuuccau

SEQ ID NO: 1674829 - RNA, 16 nt, Homo sapiens
uguccucaugugagaa

SEQ ID NO: 1674830 - RNA, 23 nt, Homo sapiens
uguccugucuaaaaaugauucuc

SEQ ID NO: 1674831 - RNA, 18 nt, Homo sapiens
ugucuacggaagccucug

SEQ ID NO: 1674832 - RNA, 18 nt, Homo sapiens
ugucucaaaauaaaacca

SEQ ID NO: 1674833 - RNA, 15 nt, Homo sapiens
ugucugucaccagcu

SEQ ID NO: 1674834 - RNA, 15 nt, Homo sapiens
ugucugugaugucag

SEQ ID NO: 1674835 - RNA, 13 nt, Homo sapiens
ugucuuucuccaa

SEQ ID NO: 1674836 - RNA, 22 nt, Homo sapiens
ugugaaauaaauaugaauggag

SEQ ID NO: 1674837 - RNA, 17 nt, Homo sapiens
ugugacaccaccacugu

SEQ ID NO: 1674838 - RNA, 17 nt, Homo sapiens
ugugagaacugugaaua

SEQ ID NO: 1674839 - RNA, 17 nt, Homo sapiens
ugugauauguguaauau

SEQ ID NO: 1674840 - RNA, 12 nt, Homo sapiens
ugugaucuauac

SEQ ID NO: 1674841 - RNA, 16 nt, Homo sapiens
ugugaucuauaccacc

SEQ ID NO: 1674842 - RNA, 15 nt, Homo sapiens
ugugaugcaugagcu

SEQ ID NO: 1674843 - RNA, 22 nt, Homo sapiens
ugugauuuuucugcacuaauau

SEQ ID NO: 1674844 - RNA, 20 nt, Homo sapiens
ugugccauggaugauucuuu

SEQ ID NO: 1674845 - RNA, 15 nt, Homo sapiens
ugugccuguguuuca

SEQ ID NO: 1674846 - RNA, 20 nt, Homo sapiens
uuugguauaugauagguuac

SEQ ID NO: 1674847 - RNA, 15 nt, Homo sapiens
uuuggugaauaaccu

SEQ ID NO: 1674848 - RNA, 18 nt, Homo sapiens
uuugguuacugugccaug

SEQ ID NO: 1674849 - RNA, 20 nt, Homo sapiens
uuuguaacaccguccaacau

SEQ ID NO: 1674850 - RNA, 23 nt, Homo sapiens
uuugucaguguagaucaacucau

SEQ ID NO: 1674851 - RNA, 15 nt, Homo sapiens
uuuguuucacauuca

SEQ ID NO: 1674852 - RNA, 23 nt, Homo sapiens
uuuuaaaaaagauggauuugaca

SEQ ID NO: 1674853 - RNA, 16 nt, Homo sapiens
uuuuaaaauugcagca

SEQ ID NO: 1674854 - RNA, 19 nt, Homo sapiens
uuuuaagaugugucuucaa

SEQ ID NO: 1674855 - RNA, 19 nt, Homo sapiens
uuuuacagucacauucaga

SEQ ID NO: 1674856 - RNA, 21 nt, Homo sapiens
uuuuaccaucacacauguuca

SEQ ID NO: 1674857 - RNA, 20 nt, Homo sapiens
uuuuaccuuucaugugccug

SEQ ID NO: 1674858 - RNA, 18 nt, Homo sapiens
uuuuaguauuugcccggg

SEQ ID NO: 1674859 - RNA, 19 nt, Homo sapiens
uuuuaucgccauuccaggg

SEQ ID NO: 1674860 - RNA, 22 nt, Homo sapiens
uuuucaaugugugugagguguu

SEQ ID NO: 1674861 - RNA, 22 nt, Homo sapiens
uuuucuacuuuaaauuguggau

SEQ ID NO: 1674862 - RNA, 19 nt, Homo sapiens
uuuugaaagucccuaauaa

SEQ ID NO: 1674863 - RNA, 18 nt, Homo sapiens
uuuugcccacacuuggga

SEQ ID NO: 1674864 - RNA, 10 nt, Homo sapiens
uuuugcucau

SEQ ID NO: 1674865 - RNA, 22 nt, Homo sapiens
uuuugucugcuuaguaucucau

SEQ ID NO: 1674866 - RNA, 22 nt, Homo sapiens
uuuuuaauccaggccccaucag

SEQ ID NO: 1674867 - RNA, 18 nt, Homo sapiens
uuuuuaucgccauuccag

SEQ ID NO: 1674868 - RNA, 16 nt, Homo sapiens
uuuuuccaaaagccag

SEQ ID NO: 1674869 - RNA, 11 nt, Homo sapiens
uuuuugccaug

SEQ ID NO: 1674870 - RNA, 19 nt, Homo sapiens
uuuuuuaaaaaauagcagc

SEQ ID NO: 1674871 - RNA, 13 nt, Homo sapiens
uuuuuucugauaa

SEQ ID NO: 1674872 - RNA, 19 nt, Homo sapiens
uugaagacacguucuugcc

SEQ ID NO: 1674873 - RNA, 22 nt, Homo sapiens
uugaagacuuuucuuucagcca

SEQ ID NO: 1674874 - RNA, 17 nt, Homo sapiens
uugaauauaauggccuc

SEQ ID NO: 1674875 - RNA, 18 nt, Homo sapiens
uugaaugcuuaaaugauc

SEQ ID NO: 1674876 - RNA, 12 nt, Homo sapiens
uugaaugugauu

SEQ ID NO: 1674877 - RNA, 20 nt, Homo sapiens
uugaauuuugucauguaauu

SEQ ID NO: 1674878 - RNA, 14 nt, Homo sapiens
uugacagugccaau

SEQ ID NO: 1674879 - RNA, 17 nt, Homo sapiens
uugaccucgugauccac

SEQ ID NO: 1674880 - RNA, 11 nt, Homo sapiens
uugagacagag

SEQ ID NO: 1674881 - RNA, 13 nt, Homo sapiens
uugagacagaguc

SEQ ID NO: 1674882 - RNA, 22 nt, Homo sapiens
uugauaaaauaaaaaucauucu

SEQ ID NO: 1674883 - RNA, 17 nt, Homo sapiens
uugaugcuguuucuaca

SEQ ID NO: 1674884 - RNA, 15 nt, Homo sapiens
uugauguaacugugu

SEQ ID NO: 1674885 - RNA, 20 nt, Homo sapiens
uugauucaaauaacccugaa

SEQ ID NO: 1674886 - RNA, 15 nt, Homo sapiens
uugcaaagcauuuga

SEQ ID NO: 1674887 - RNA, 21 nt, Homo sapiens
uugcaaccacugcaauaucuu

SEQ ID NO: 1674888 - RNA, 16 nt, Homo sapiens
uugcaaugcaagcccu

SEQ ID NO: 1674889 - RNA, 18 nt, Homo sapiens
uugcacaggucccacugc

SEQ ID NO: 1674890 - RNA, 17 nt, Homo sapiens
uugcagcuggacuucuc

SEQ ID NO: 1674891 - RNA, 13 nt, Homo sapiens
uugcaugugcugc

SEQ ID NO: 1674892 - RNA, 15 nt, Homo sapiens
uugcaugugcugcag

SEQ ID NO: 1674893 - RNA, 21 nt, Homo sapiens
uugcaugugcugcagguguaa

SEQ ID NO: 1674894 - RNA, 20 nt, Homo sapiens
uugccaggcuggagugcagu

SEQ ID NO: 1674895 - RNA, 21 nt, Homo sapiens
uugcccacacuugggagcaaa

SEQ ID NO: 1674896 - RNA, 22 nt, Homo sapiens
uugcccugcgucccuucucuuu

SEQ ID NO: 1674897 - RNA, 14 nt, Homo sapiens
uugccgcauauuau

SEQ ID NO: 1674898 - RNA, 20 nt, Homo sapiens
uugccuucuccacuuuggga

SEQ ID NO: 1674899 - RNA, 13 nt, Homo sapiens
uugcugcauuuca

SEQ ID NO: 1674900 - RNA, 19 nt, Homo sapiens
uugcuggagccugagucag

SEQ ID NO: 1674901 - RNA, 22 nt, Homo sapiens
uugcuuagccuuuaauaggcuu

SEQ ID NO: 1674902 - RNA, 17 nt, Homo sapiens
uugcuucauuaaaacaa

SEQ ID NO: 1674903 - RNA, 23 nt, Homo sapiens
uugcuuuuagguugaaggcaaaa

SEQ ID NO: 1674904 - RNA, 15 nt, Homo sapiens
uuggagagacacagc

SEQ ID NO: 1674905 - RNA, 12 nt, Homo sapiens
uuggagugcagu

SEQ ID NO: 1674906 - RNA, 18 nt, Homo sapiens
uugggaaaugcugauuua

SEQ ID NO: 1674907 - RNA, 16 nt, Homo sapiens
uugggaccugcuucau

SEQ ID NO: 1674908 - RNA, 23 nt, Homo sapiens
uugggauugucuuacuguugcau

SEQ ID NO: 1674909 - RNA, 19 nt, Homo sapiens
uuggguaagggacuccaga

SEQ ID NO: 1674910 - RNA, 14 nt, Homo sapiens
uuggguuccagaca

SEQ ID NO: 1674911 - RNA, 15 nt, Homo sapiens
uuggguuccagacag

SEQ ID NO: 1674912 - RNA, 15 nt, Homo sapiens
uugguagauauucag

SEQ ID NO: 1674913 - RNA, 19 nt, Homo sapiens
uuggucucuuucuuuccaa

SEQ ID NO: 1674914 - RNA, 16 nt, Homo sapiens
uuguaaauugucucaa

SEQ ID NO: 1674915 - RNA, 22 nt, Homo sapiens
uuguaacuagauagaacauuaa

SEQ ID NO: 1674916 - RNA, 21 nt, Homo sapiens
uuguaauauuuugcugcugaa

SEQ ID NO: 1674917 - RNA, 19 nt, Homo sapiens
uuguaauuuugcaaaacau

SEQ ID NO: 1674918 - RNA, 13 nt, Homo sapiens
uuguacuugaaua

SEQ ID NO: 1674919 - RNA, 22 nt, Homo sapiens
uuguauuuuaauaaagauucca

SEQ ID NO: 1674920 - RNA, 22 nt, Homo sapiens
uugucaacaguauacaaaagaa

SEQ ID NO: 1674921 - RNA, 13 nt, Homo sapiens
uugucaccaugau

SEQ ID NO: 1674922 - RNA, 22 nt, Homo sapiens
uugucaguguagaucaacucau

SEQ ID NO: 1674923 - RNA, 18 nt, Homo sapiens
uugucaugugaugggucc

SEQ ID NO: 1674924 - RNA, 16 nt, Homo sapiens
uugucggguucuccca

SEQ ID NO: 1674925 - RNA, 17 nt, Homo sapiens
uugucucuaguugacuu

SEQ ID NO: 1674926 - RNA, 22 nt, Homo sapiens
uugucucucuaaacccaaauaa

SEQ ID NO: 1674927 - RNA, 21 nt, Homo sapiens
uugucuguuaaaugaacuuga

SEQ ID NO: 1674928 - RNA, 17 nt, Homo sapiens
uugugcugccuguggug

SEQ ID NO: 1674929 - RNA, 17 nt, Homo sapiens
uuguguacaaaauaucc

SEQ ID NO: 1674930 - RNA, 18 nt, Homo sapiens
uuguguaggaaaucugaa

SEQ ID NO: 1674931 - RNA, 16 nt, Homo sapiens
uuguguuacaauaagu

SEQ ID NO: 1674932 - RNA, 15 nt, Homo sapiens
uuguguucaaucugu

SEQ ID NO: 1674933 - RNA, 15 nt, Homo sapiens
uuguuaauucuuccu

SEQ ID NO: 1674934 - RNA, 15 nt, Homo sapiens
uuguuauggcaaguu

SEQ ID NO: 1674935 - RNA, 21 nt, Homo sapiens
uuguugaagaaugaaaggcaa

SEQ ID NO: 1674936 - RNA, 12 nt, Homo sapiens
uuguuguucaga

SEQ ID NO: 1674937 - RNA, 18 nt, Homo sapiens
uuguuucaaccaguuuga

SEQ ID NO: 1674938 - RNA, 20 nt, Homo sapiens
uuguuuguccuuuauguauu

SEQ ID NO: 1674939 - RNA, 19 nt, Homo sapiens
uuguuuuggguuuucuucc

SEQ ID NO: 1674940 - RNA, 13 nt, Homo sapiens
uuguuuuuugcca

SEQ ID NO: 1674941 - RNA, 14 nt, Homo sapiens
uuguuuuuugccau

SEQ ID NO: 1674942 - RNA, 15 nt, Homo sapiens
uuuaaaacaugcugu

SEQ ID NO: 1674943 - RNA, 14 nt, Homo sapiens
uuuaaaacauucac

SEQ ID NO: 1674944 - RNA, 16 nt, Homo sapiens
uuuaaaacauucacac

SEQ ID NO: 1674945 - RNA, 21 nt, Homo sapiens
uuuaaauaaaaaaguuuacag

SEQ ID NO: 1674946 - RNA, 21 nt, Homo sapiens
uuuaaaugaucuguacuaucu

SEQ ID NO: 1674947 - RNA, 21 nt, Homo sapiens
uuuaagccaauauaaugggcu

SEQ ID NO: 1674948 - RNA, 13 nt, Homo sapiens
uuuaaguacucac

SEQ ID NO: 1674949 - RNA, 22 nt, Homo sapiens
uuuaauuauaaucucuucuuau

SEQ ID NO: 1674950 - RNA, 17 nt, Homo sapiens
uuuacagucacauucag

SEQ ID NO: 1674951 - RNA, 13 nt, Homo sapiens
uuuacauaugcuu

SEQ ID NO: 1674952 - RNA, 13 nt, Homo sapiens
uuuacgacaagga

SEQ ID NO: 1674953 - RNA, 13 nt, Homo sapiens
uuuacuaacacug

SEQ ID NO: 1674954 - RNA, 15 nt, Homo sapiens
uuuagaguaugcaag

SEQ ID NO: 1674955 - RNA, 16 nt, Homo sapiens
uuuagcuauuacugga

SEQ ID NO: 1674956 - RNA, 20 nt, Homo sapiens
uuuaggaaagcagugcagua

SEQ ID NO: 1674957 - RNA, 23 nt, Homo sapiens
uuuaggaugaguuucuauguugu

SEQ ID NO: 1674958 - RNA, 17 nt, Homo sapiens
uuuauaaaagacaugaa

SEQ ID NO: 1674959 - RNA, 18 nt, Homo sapiens
uuuauaagagggaacaaa

SEQ ID NO: 1674960 - RNA, 22 nt, Homo sapiens
uuuauaccagcuuaugagcuca

SEQ ID NO: 1674961 - RNA, 13 nt, Homo sapiens
uuuauauaugaag

SEQ ID NO: 1674962 - RNA, 20 nt, Homo sapiens
uuuauaugauuaaauuauca

SEQ ID NO: 1674963 - RNA, 23 nt, Homo sapiens
uuuauuaguuaggugugccaaac

SEQ ID NO: 1674964 - RNA, 17 nt, Homo sapiens
uuuauucacaguaucug

SEQ ID NO: 1674965 - RNA, 13 nt, Homo sapiens
uuuauuucucggg

SEQ ID NO: 1674966 - RNA, 19 nt, Homo sapiens
uuucaaugcugacuggacu

SEQ ID NO: 1674967 - RNA, 21 nt, Homo sapiens
uuucaccccaucccuccuuaa

SEQ ID NO: 1674968 - RNA, 16 nt, Homo sapiens
uuucacuauaauguga

SEQ ID NO: 1674969 - RNA, 19 nt, Homo sapiens
uuucagaugauucuauguc

SEQ ID NO: 1674970 - RNA, 18 nt, Homo sapiens
uuucauguucugugucac

SEQ ID NO: 1674971 - RNA, 18 nt, Homo sapiens
uuuccaacuuuucaucca

SEQ ID NO: 1674972 - RNA, 15 nt, Homo sapiens
uuuccaggcuagucc

SEQ ID NO: 1674973 - RNA, 18 nt, Homo sapiens
uuuccaggggccucccaa

SEQ ID NO: 1674974 - RNA, 13 nt, Homo sapiens
uuuccauccaaac

SEQ ID NO: 1674975 - RNA, 16 nt, Homo sapiens
uuuccugaggucaucu

SEQ ID NO: 1674976 - RNA, 18 nt, Homo sapiens
uuuccugaucacuaugca

SEQ ID NO: 1674977 - RNA, 15 nt, Homo sapiens
uuucggaauuccugc

SEQ ID NO: 1674978 - RNA, 15 nt, Homo sapiens
uuucucgggugcauu

SEQ ID NO: 1674979 - RNA, 15 nt, Homo sapiens
uuucugaacuaucag

SEQ ID NO: 1674980 - RNA, 18 nt, Homo sapiens
uuucugccucacaucagc

SEQ ID NO: 1674981 - RNA, 19 nt, Homo sapiens
uuucuugacuauuucacca

SEQ ID NO: 1674982 - RNA, 17 nt, Homo sapiens
uuucuugcaagcuccag

SEQ ID NO: 1674983 - RNA, 23 nt, Homo sapiens
uuugaaacacacagugaccaagg

SEQ ID NO: 1674984 - RNA, 11 nt, Homo sapiens
uuugaacacaa

SEQ ID NO: 1674985 - RNA, 22 nt, Homo sapiens
uuugaauuguguggagaagugu

SEQ ID NO: 1674986 - RNA, 13 nt, Homo sapiens
uuugacacacuca

SEQ ID NO: 1674987 - RNA, 17 nt, Homo sapiens
uuugacuugccacugcc

SEQ ID NO: 1674988 - RNA, 13 nt, Homo sapiens
uuugagacagagu

SEQ ID NO: 1674989 - RNA, 16 nt, Homo sapiens
uuugauacaguauuau

SEQ ID NO: 1674990 - RNA, 17 nt, Homo sapiens
uuugcaugucugcauga

SEQ ID NO: 1674991 - RNA, 22 nt, Homo sapiens
uuugccuucucuaaacauuuca

SEQ ID NO: 1674992 - RNA, 18 nt, Homo sapiens
uuugcuaagugaggauga

SEQ ID NO: 1674993 - RNA, 11 nt, Homo sapiens
uuugggagacu

SEQ ID NO: 1674994 - RNA, 23 nt, Homo sapiens
uuugggggugcuaauccaggaca

SEQ ID NO: 1674995 - RNA, 14 nt, Homo sapiens
uuauuggacuucca

SEQ ID NO: 1674996 - RNA, 13 nt, Homo sapiens
uuauuguaaucau

SEQ ID NO: 1674997 - RNA, 16 nt, Homo sapiens
uuauuuacaugugauu

SEQ ID NO: 1674998 - RNA, 14 nt, Homo sapiens
uuauuuccauggau

SEQ ID NO: 1674999 - RNA, 13 nt, Homo sapiens
uuauuugaucugg

SEQ ID NO: 1675000 - RNA, 22 nt, Homo sapiens
uuauuuugucacccaaccuggc

SEQ ID NO: 1675001 - RNA, 17 nt, Homo sapiens
uucaaacgaaauggcuc

SEQ ID NO: 1675002 - RNA, 21 nt, Homo sapiens
uucaaaggcuuccaauguggu

SEQ ID NO: 1675003 - RNA, 19 nt, Homo sapiens
uucaacaugguuaccucug

SEQ ID NO: 1675004 - RNA, 15 nt, Homo sapiens
uucaacuucaggaaa

SEQ ID NO: 1675005 - RNA, 16 nt, Homo sapiens
uucaagcauugcuaaa

SEQ ID NO: 1675006 - RNA, 13 nt, Homo sapiens
uucaagcuucaua

SEQ ID NO: 1675007 - RNA, 18 nt, Homo sapiens
uucaagugcuucuccagc

SEQ ID NO: 1675008 - RNA, 16 nt, Homo sapiens
uucaaugaacugugcu

SEQ ID NO: 1675009 - RNA, 20 nt, Homo sapiens
uucaaugaaucaaauccaau

SEQ ID NO: 1675010 - RNA, 23 nt, Homo sapiens
uucacaguucucuccuucuuccc

SEQ ID NO: 1675011 - RNA, 14 nt, Homo sapiens
uucaccaacaacag

SEQ ID NO: 1675012 - RNA, 16 nt, Homo sapiens
uucaccgcauuccagg

SEQ ID NO: 1675013 - RNA, 17 nt, Homo sapiens
uucaccuccuucugcag

SEQ ID NO: 1675014 - RNA, 20 nt, Homo sapiens
uucagaaaagaugugcagau

SEQ ID NO: 1675015 - RNA, 21 nt, Homo sapiens
uucagaccacaaggggcucca

SEQ ID NO: 1675016 - RNA, 14 nt, Homo sapiens
uucagacucucucc

SEQ ID NO: 1675017 - RNA, 17 nt, Homo sapiens
uucagagcaagcacugg

SEQ ID NO: 1675018 - RNA, 16 nt, Homo sapiens
uucagccaagaauucu

SEQ ID NO: 1675019 - RNA, 19 nt, Homo sapiens
uucagcuccuuccaccaca

SEQ ID NO: 1675020 - RNA, 18 nt, Homo sapiens
uucaggaaugggccaagc

SEQ ID NO: 1675021 - RNA, 22 nt, Homo sapiens
uucagucuaugcugugugcaga

SEQ ID NO: 1675022 - RNA, 16 nt, Homo sapiens
uucagugccaaaaaca

SEQ ID NO: 1675023 - RNA, 22 nt, Homo sapiens
uucaguuccuuucaucccuuca

SEQ ID NO: 1675024 - RNA, 13 nt, Homo sapiens
uucauacacuccc

SEQ ID NO: 1675025 - RNA, 20 nt, Homo sapiens
uucauauucucagaugggcu

SEQ ID NO: 1675026 - RNA, 16 nt, Homo sapiens
uucauccaacuggaag

SEQ ID NO: 1675027 - RNA, 22 nt, Homo sapiens
uucauccaguuuguucuccggg

SEQ ID NO: 1675028 - RNA, 18 nt, Homo sapiens
uucaugcagcaaauaugg

SEQ ID NO: 1675029 - RNA, 20 nt, Homo sapiens
uucauucaccuaacuuucau

SEQ ID NO: 1675030 - RNA, 14 nt, Homo sapiens
uucauucauacuca

SEQ ID NO: 1675031 - RNA, 15 nt, Homo sapiens
uucauuuucacauuu

SEQ ID NO: 1675032 - RNA, 17 nt, Homo sapiens
uuccaaaagccagucaa

SEQ ID NO: 1675033 - RNA, 18 nt, Homo sapiens
uuccaagugugugugcaa

SEQ ID NO: 1675034 - RNA, 16 nt, Homo sapiens
uuccaaguuuauugcc

SEQ ID NO: 1675035 - RNA, 13 nt, Homo sapiens
uuccaaugccaau

SEQ ID NO: 1675036 - RNA, 22 nt, Homo sapiens
uuccaaugugguggcaauaaau

SEQ ID NO: 1675037 - RNA, 17 nt, Homo sapiens
uuccaauuacuacuuug

SEQ ID NO: 1675038 - RNA, 17 nt, Homo sapiens
uuccaauuuuguugcau

SEQ ID NO: 1675039 - RNA, 18 nt, Homo sapiens
uuccaccuagagcuagau

SEQ ID NO: 1675040 - RNA, 19 nt, Homo sapiens
uuccacuucaggguucuaa

SEQ ID NO: 1675041 - RNA, 10 nt, Homo sapiens
uuccagacag

SEQ ID NO: 1675042 - RNA, 16 nt, Homo sapiens
uuccagcucaguccca

SEQ ID NO: 1675043 - RNA, 22 nt, Homo sapiens
uuccagugcaguagugccaaaa

SEQ ID NO: 1675044 - RNA, 18 nt, Homo sapiens
uuccaugucugaaguuug

SEQ ID NO: 1675045 - RNA, 14 nt, Homo sapiens
uuccauuugcaaca

SEQ ID NO: 1675046 - RNA, 20 nt, Homo sapiens
uucccaaucagcacugaaaa

SEQ ID NO: 1675047 - RNA, 13 nt, Homo sapiens
uucccaaucccau

SEQ ID NO: 1675048 - RNA, 13 nt, Homo sapiens
uucccaucgcugg

SEQ ID NO: 1675049 - RNA, 22 nt, Homo sapiens
uucccauuuccuugucuaaaga

SEQ ID NO: 1675050 - RNA, 19 nt, Homo sapiens
uuccccacaauaggcuuag

SEQ ID NO: 1675051 - RNA, 20 nt, Homo sapiens
uuccccauugccuucugggg

SEQ ID NO: 1675052 - RNA, 16 nt, Homo sapiens
uucccuccaccagugu

SEQ ID NO: 1675053 - RNA, 18 nt, Homo sapiens
uucccuccaccagugugc

SEQ ID NO: 1675054 - RNA, 15 nt, Homo sapiens
uucccugaacacuca

SEQ ID NO: 1675055 - RNA, 16 nt, Homo sapiens
uucccugaacacucau

SEQ ID NO: 1675056 - RNA, 20 nt, Homo sapiens
uucccugaacacucaucccc

SEQ ID NO: 1675057 - RNA, 19 nt, Homo sapiens
uucccuggguuuucugccc

SEQ ID NO: 1675058 - RNA, 19 nt, Homo sapiens
uucccuggugauggucucu

SEQ ID NO: 1675059 - RNA, 17 nt, Homo sapiens
uucccuuccacugccuc

SEQ ID NO: 1675060 - RNA, 19 nt, Homo sapiens
uucccuugugugagggcaa

SEQ ID NO: 1675061 - RNA, 17 nt, Homo sapiens
uuccggaaagccuuccu

SEQ ID NO: 1675062 - RNA, 22 nt, Homo sapiens
uuccucaagauccugucuugcu

SEQ ID NO: 1675063 - RNA, 12 nt, Homo sapiens
uuccucacauuc

SEQ ID NO: 1675064 - RNA, 16 nt, Homo sapiens
uuccucuuaccuguaa

SEQ ID NO: 1675065 - RNA, 16 nt, Homo sapiens
uuccugaacucccagu

SEQ ID NO: 1675066 - RNA, 17 nt, Homo sapiens
uuccugaucaaggugcu

SEQ ID NO: 1675067 - RNA, 18 nt, Homo sapiens
uuccugcuccuccaguac

SEQ ID NO: 1675068 - RNA, 16 nt, Homo sapiens
uuccuggacacuuuac

SEQ ID NO: 1675069 - RNA, 12 nt, Homo sapiens
uuccuuagcuua

SEQ ID NO: 1675070 - RNA, 17 nt, Homo sapiens
uuccuuuccugaucacu

SEQ ID NO: 1675071 - RNA, 17 nt, Homo sapiens
uucgugcagugcccuga

SEQ ID NO: 1675072 - RNA, 18 nt, Homo sapiens
uucuaaaacuacugccuu

SEQ ID NO: 1675073 - RNA, 23 nt, Homo sapiens
uucuaaacuaaaggaaacaaagc

SEQ ID NO: 1675074 - RNA, 15 nt, Homo sapiens
uucuaauccaugugc

SEQ ID NO: 1675075 - RNA, 21 nt, Homo sapiens
uucuacuccauggugaacuga

SEQ ID NO: 1675076 - RNA, 18 nt, Homo sapiens
uucuagcauggcugccaa

SEQ ID NO: 1675077 - RNA, 17 nt, Homo sapiens
uucuaggggcaggugaa

SEQ ID NO: 1675078 - RNA, 22 nt, Homo sapiens
uucuaguggguuuaauguuuag

SEQ ID NO: 1675079 - RNA, 16 nt, Homo sapiens
uucuaugacaauaaau

SEQ ID NO: 1675080 - RNA, 23 nt, Homo sapiens
uucuaugagaccucccccaggga

SEQ ID NO: 1675081 - RNA, 18 nt, Homo sapiens
uucuauggauucacuucu

SEQ ID NO: 1675082 - RNA, 15 nt, Homo sapiens
uucucaaagauuuga

SEQ ID NO: 1675083 - RNA, 17 nt, Homo sapiens
uucucaaagauuugaca

SEQ ID NO: 1675084 - RNA, 22 nt, Homo sapiens
uucucaaaugcuaaaugcaaac

SEQ ID NO: 1675085 - RNA, 16 nt, Homo sapiens
uucucaacacacagua

SEQ ID NO: 1675086 - RNA, 23 nt, Homo sapiens
uucucacacuggaggagcacaca

SEQ ID NO: 1675087 - RNA, 20 nt, Homo sapiens
uucucagcgcaacagcugug

SEQ ID NO: 1675088 - RNA, 22 nt, Homo sapiens
uucuccaaaacaauuuucugca

SEQ ID NO: 1675089 - RNA, 22 nt, Homo sapiens
uucuccagggguuuacagugaa

SEQ ID NO: 1675090 - RNA, 18 nt, Homo sapiens
uucucgugacaccaccaa

SEQ ID NO: 1675091 - RNA, 16 nt, Homo sapiens
uucucuaaacauuuca

SEQ ID NO: 1675092 - RNA, 14 nt, Homo sapiens
uucucuaggaauca

SEQ ID NO: 1675093 - RNA, 16 nt, Homo sapiens
uucucucugugcuggu

SEQ ID NO: 1675094 - RNA, 19 nt, Homo sapiens
uucucucuguguggcaaac

SEQ ID NO: 1675095 - RNA, 18 nt, Homo sapiens
uucucuucccaccuguca

SEQ ID NO: 1675096 - RNA, 16 nt, Homo sapiens
uucugacggcccugca

SEQ ID NO: 1675097 - RNA, 17 nt, Homo sapiens
uucugacggcccugcaa

SEQ ID NO: 1675098 - RNA, 11 nt, Homo sapiens
uucugagacag

SEQ ID NO: 1675099 - RNA, 12 nt, Homo sapiens
uucugcacugaa

SEQ ID NO: 1675100 - RNA, 14 nt, Homo sapiens
uucugcacugaaaa

SEQ ID NO: 1675101 - RNA, 14 nt, Homo sapiens
uucugcauuacuau

SEQ ID NO: 1675102 - RNA, 18 nt, Homo sapiens
uucuggagggaagcacca

SEQ ID NO: 1675103 - RNA, 18 nt, Homo sapiens
uucuuaccucauuugcau

SEQ ID NO: 1675104 - RNA, 13 nt, Homo sapiens
uucuuacuguauu

SEQ ID NO: 1675105 - RNA, 22 nt, Homo sapiens
uucuuccccccaaaacugauua

SEQ ID NO: 1675106 - RNA, 15 nt, Homo sapiens
uucuucccuagcuua

SEQ ID NO: 1675107 - RNA, 17 nt, Homo sapiens
uucuuccuaccaaauau

SEQ ID NO: 1675108 - RNA, 18 nt, Homo sapiens
uucuuccucuuaccugua

SEQ ID NO: 1675109 - RNA, 22 nt, Homo sapiens
uucuucuggagggaagcaccau

SEQ ID NO: 1675110 - RNA, 17 nt, Homo sapiens
uucuuggagucuuccaa

SEQ ID NO: 1675111 - RNA, 15 nt, Homo sapiens
uucuuguugcugcau

SEQ ID NO: 1675112 - RNA, 17 nt, Homo sapiens
uucuuugcauucguccu

SEQ ID NO: 1675113 - RNA, 24 nt, Homo sapiens
uucuuuucaaugcaaugcaucuga

SEQ ID NO: 1675114 - RNA, 16 nt, Homo sapiens
uugaaacugcauuugu

SEQ ID NO: 1675115 - RNA, 23 nt, Homo sapiens
uugaaaggagaaaaaaaaagcca

SEQ ID NO: 1675116 - RNA, 19 nt, Homo sapiens
uugaaccgucaaugugaaa

SEQ ID NO: 1675117 - RNA, 20 nt, Homo sapiens
uugaacuucuuuaguauuau

SEQ ID NO: 1675118 - RNA, 14 nt, Homo sapiens
acacaucaguccac

SEQ ID NO: 1675119 - RNA, 19 nt, Homo sapiens
acacaugguuuccaagggu

SEQ ID NO: 1675120 - RNA, 18 nt, Homo sapiens
acaccaaguaaaucuauc

SEQ ID NO: 1675121 - RNA, 16 nt, Homo sapiens
acaccacuuugucucu

SEQ ID NO: 1675122 - RNA, 12 nt, Homo sapiens
acacccugcaag

SEQ ID NO: 1675123 - RNA, 13 nt, Homo sapiens
acaccuagacucu

SEQ ID NO: 1675124 - RNA, 19 nt, Homo sapiens
acacgugagccacagggcu

SEQ ID NO: 1675125 - RNA, 14 nt, Homo sapiens
acacuaccaguuuc

SEQ ID NO: 1675126 - RNA, 21 nt, Homo sapiens
acacucaccauuuaaucauuu

SEQ ID NO: 1675127 - RNA, 21 nt, Homo sapiens
acacucaucagguaaacugau

SEQ ID NO: 1675128 - RNA, 16 nt, Homo sapiens
acacucuugguagaag

SEQ ID NO: 1675129 - RNA, 14 nt, Homo sapiens
acacuucuccuuaa

SEQ ID NO: 1675130 - RNA, 15 nt, Homo sapiens
acacuugcacccaug

SEQ ID NO: 1675131 - RNA, 16 nt, Homo sapiens
acagaaucucagucug

SEQ ID NO: 1675132 - RNA, 18 nt, Homo sapiens
acagacaacaaaccuguu

SEQ ID NO: 1675133 - RNA, 14 nt, Homo sapiens
acagaccagcauag

SEQ ID NO: 1675134 - RNA, 23 nt, Homo sapiens
acagagauuugguuaagcucaca

SEQ ID NO: 1675135 - RNA, 21 nt, Homo sapiens
acagagcgagacuccaucuca

SEQ ID NO: 1675136 - RNA, 22 nt, Homo sapiens
acagagcugagcauuggugaca

SEQ ID NO: 1675137 - RNA, 17 nt, Homo sapiens
acagaguauauauguac

SEQ ID NO: 1675138 - RNA, 17 nt, Homo sapiens
acagagucuugcucugu

SEQ ID NO: 1675139 - RNA, 15 nt, Homo sapiens
acagaguuacugcca

SEQ ID NO: 1675140 - RNA, 19 nt, Homo sapiens
acagauugcugcuucugcu

SEQ ID NO: 1675141 - RNA, 12 nt, Homo sapiens
acagcagcucca

SEQ ID NO: 1675142 - RNA, 15 nt, Homo sapiens
acagcauaauugccu

SEQ ID NO: 1675143 - RNA, 15 nt, Homo sapiens
acagcauaugcaaag

SEQ ID NO: 1675144 - RNA, 21 nt, Homo sapiens
acagccccaaacaagcgccac

SEQ ID NO: 1675145 - RNA, 17 nt, Homo sapiens
acagccucagcacaucc

SEQ ID NO: 1675146 - RNA, 16 nt, Homo sapiens
acagccugcacagugg

SEQ ID NO: 1675147 - RNA, 15 nt, Homo sapiens
acagcuaacauggaa

SEQ ID NO: 1675148 - RNA, 17 nt, Homo sapiens
acagcugaaagauugau

SEQ ID NO: 1675149 - RNA, 22 nt, Homo sapiens
acagcuucacuuaaaaucaaau

SEQ ID NO: 1675150 - RNA, 17 nt, Homo sapiens
acagcuuggcuguucca

SEQ ID NO: 1675151 - RNA, 15 nt, Homo sapiens
acaggaaaaugacuu

SEQ ID NO: 1675152 - RNA, 18 nt, Homo sapiens
acaggaagcgacgccucu

SEQ ID NO: 1675153 - RNA, 13 nt, Homo sapiens
acaggacugauuc

SEQ ID NO: 1675154 - RNA, 17 nt, Homo sapiens
acaggagaagaaacagc

SEQ ID NO: 1675155 - RNA, 15 nt, Homo sapiens
acaggagcauguccu

SEQ ID NO: 1675156 - RNA, 15 nt, Homo sapiens
acaggagcguguacu

SEQ ID NO: 1675157 - RNA, 22 nt, Homo sapiens
acaggagcguguacuaccccag

SEQ ID NO: 1675158 - RNA, 15 nt, Homo sapiens
acaggagcguguccu

SEQ ID NO: 1675159 - RNA, 13 nt, Homo sapiens
acaggcugagaca

SEQ ID NO: 1675160 - RNA, 16 nt, Homo sapiens
acaggcugcuguccag

SEQ ID NO: 1675161 - RNA, 22 nt, Homo sapiens
acaggcuguucugcacugaaaa

SEQ ID NO: 1675162 - RNA, 16 nt, Homo sapiens
acagggacacagucug

SEQ ID NO: 1675163 - RNA, 18 nt, Homo sapiens
acagggcuagaagcacag

SEQ ID NO: 1675164 - RNA, 22 nt, Homo sapiens
acaguaacugccauuuuuuguc

SEQ ID NO: 1675165 - RNA, 20 nt, Homo sapiens
acaguacucaggcagugcaa

SEQ ID NO: 1675166 - RNA, 12 nt, Homo sapiens
acaguauuucca

SEQ ID NO: 1675167 - RNA, 21 nt, Homo sapiens
acagucucuauuugauuugca

SEQ ID NO: 1675168 - RNA, 11 nt, Homo sapiens
acagugcagua

SEQ ID NO: 1675169 - RNA, 16 nt, Homo sapiens
acagugcagugcucag

SEQ ID NO: 1675170 - RNA, 19 nt, Homo sapiens
acagugccaauaaaugaua

SEQ ID NO: 1675171 - RNA, 18 nt, Homo sapiens
acagugggaacucugaca

SEQ ID NO: 1675172 - RNA, 20 nt, Homo sapiens
acaguuaagagaaaugagcu

SEQ ID NO: 1675173 - RNA, 17 nt, Homo sapiens
acaguugucaaauugau

SEQ ID NO: 1675174 - RNA, 14 nt, Homo sapiens
acauaaacacuucu

SEQ ID NO: 1675175 - RNA, 16 nt, Homo sapiens
acauaaacuuguacuu

SEQ ID NO: 1675176 - RNA, 21 nt, Homo sapiens
acauaacacacaucaguccac

SEQ ID NO: 1675177 - RNA, 14 nt, Homo sapiens
acauaacauaagcu

SEQ ID NO: 1675178 - RNA, 23 nt, Homo sapiens
acauaauguuaguagcacugaga

SEQ ID NO: 1675179 - RNA, 22 nt, Homo sapiens
acauaccucucucuauauauac

SEQ ID NO: 1675180 - RNA, 21 nt, Homo sapiens
aggauaugaguacauacucaa

SEQ ID NO: 1675181 - RNA, 12 nt, Homo sapiens
aggaucacuuga

SEQ ID NO: 1675182 - RNA, 17 nt, Homo sapiens
aggauccuggccugaga

SEQ ID NO: 1675183 - RNA, 16 nt, Homo sapiens
aggaugaaggggccag

SEQ ID NO: 1675184 - RNA, 13 nt, Homo sapiens
aggaugcaugcag

SEQ ID NO: 1675185 - RNA, 18 nt, Homo sapiens
aggauggucucgaucucc

SEQ ID NO: 1675186 - RNA, 23 nt, Homo sapiens
aggauugagauaacauuuccaaa

SEQ ID NO: 1675187 - RNA, 13 nt, Homo sapiens
aggauugucugcu

SEQ ID NO: 1675188 - RNA, 21 nt, Homo sapiens
aggauugucugcugccuccaa

SEQ ID NO: 1675189 - RNA, 14 nt, Homo sapiens
aggauuuauucuca

SEQ ID NO: 1675190 - RNA, 13 nt, Homo sapiens
aggcaauggugaa

SEQ ID NO: 1675191 - RNA, 20 nt, Homo sapiens
aggcaauggugaacugucau

SEQ ID NO: 1675192 - RNA, 15 nt, Homo sapiens
aggcagaaugguggg

SEQ ID NO: 1675193 - RNA, 17 nt, Homo sapiens
aggcagaauggugggcu

SEQ ID NO: 1675194 - RNA, 16 nt, Homo sapiens
aggcagggcccugaaa

SEQ ID NO: 1675195 - RNA, 12 nt, Homo sapiens
aggcagugcagu

SEQ ID NO: 1675196 - RNA, 22 nt, Homo sapiens
aggcauaucaagguuccugauu

SEQ ID NO: 1675197 - RNA, 21 nt, Homo sapiens
aggccaaaggaagcacaugcc

SEQ ID NO: 1675198 - RNA, 16 nt, Homo sapiens
aggccaacugcccaga

SEQ ID NO: 1675199 - RNA, 12 nt, Homo sapiens
aggccaagcccc

SEQ ID NO: 1675200 - RNA, 15 nt, Homo sapiens
aggccaucaccacag

SEQ ID NO: 1675201 - RNA, 17 nt, Homo sapiens
aggcccacaggaggcaa

SEQ ID NO: 1675202 - RNA, 20 nt, Homo sapiens
aggccccaucagcaucccac

SEQ ID NO: 1675203 - RNA, 14 nt, Homo sapiens
aggccccuuaccug

SEQ ID NO: 1675204 - RNA, 13 nt, Homo sapiens
aggccccuuccca

SEQ ID NO: 1675205 - RNA, 20 nt, Homo sapiens
aggccucagggaccaaggag

SEQ ID NO: 1675206 - RNA, 16 nt, Homo sapiens
aggccuccaagccagg

SEQ ID NO: 1675207 - RNA, 21 nt, Homo sapiens
aggccugcacucuuauuucac

SEQ ID NO: 1675208 - RNA, 21 nt, Homo sapiens
aggccugggaccucccacugc

SEQ ID NO: 1675209 - RNA, 17 nt, Homo sapiens
aggccuugcucacagcu

SEQ ID NO: 1675210 - RNA, 23 nt, Homo sapiens
aggcggccucgugccaugaucug

SEQ ID NO: 1675211 - RNA, 12 nt, Homo sapiens
aggcggugagca

SEQ ID NO: 1675212 - RNA, 15 nt, Homo sapiens
aggcgucucuucaaa

SEQ ID NO: 1675213 - RNA, 20 nt, Homo sapiens
aggcuaagaaagaaaugcua

SEQ ID NO: 1675214 - RNA, 23 nt, Homo sapiens
aggcuaguccggacccaccucac

SEQ ID NO: 1675215 - RNA, 13 nt, Homo sapiens
aggcuaugugagc

SEQ ID NO: 1675216 - RNA, 17 nt, Homo sapiens
aggcuaugugagcacaa

SEQ ID NO: 1675217 - RNA, 12 nt, Homo sapiens
aggcucuaaugu

SEQ ID NO: 1675218 - RNA, 14 nt, Homo sapiens
aggcucuaauguac

SEQ ID NO: 1675219 - RNA, 19 nt, Homo sapiens
aggcucuaauguacaauaa

SEQ ID NO: 1675220 - RNA, 22 nt, Homo sapiens
aggcucuaauguacaauaaagc

SEQ ID NO: 1675221 - RNA, 12 nt, Homo sapiens
aggcucucaggc

SEQ ID NO: 1675222 - RNA, 16 nt, Homo sapiens
aggcucucaggccagc

SEQ ID NO: 1675223 - RNA, 14 nt, Homo sapiens
aggcuggagugcag

SEQ ID NO: 1675224 - RNA, 16 nt, Homo sapiens
aggcuggagugcagug

SEQ ID NO: 1675225 - RNA, 19 nt, Homo sapiens
aggcugucaauuacaggaa

SEQ ID NO: 1675226 - RNA, 18 nt, Homo sapiens
aggcuguucugcacugaa

SEQ ID NO: 1675227 - RNA, 19 nt, Homo sapiens
aggcuuguggccacagugg

SEQ ID NO: 1675228 - RNA, 15 nt, Homo sapiens
agggaaaagauuucu

SEQ ID NO: 1675229 - RNA, 14 nt, Homo sapiens
agggaccccagaua

SEQ ID NO: 1675230 - RNA, 16 nt, Homo sapiens
agggagccaugcucuu

SEQ ID NO: 1675231 - RNA, 18 nt, Homo sapiens
agggagggaaacccgggg

SEQ ID NO: 1675232 - RNA, 22 nt, Homo sapiens
agggcaaaugacaugcacugac

SEQ ID NO: 1675233 - RNA, 16 nt, Homo sapiens
agggcagaauagcuga

SEQ ID NO: 1675234 - RNA, 15 nt, Homo sapiens
agggcagaggccaug

SEQ ID NO: 1675235 - RNA, 18 nt, Homo sapiens
agggcauaaugaguuccu

SEQ ID NO: 1675236 - RNA, 14 nt, Homo sapiens
agggcccugcucag

SEQ ID NO: 1675237 - RNA, 21 nt, Homo sapiens
agggccguaguaccucccagc

SEQ ID NO: 1675238 - RNA, 13 nt, Homo sapiens
agggccucuggac

SEQ ID NO: 1675239 - RNA, 20 nt, Homo sapiens
agggccuucuccacagggac

SEQ ID NO: 1675240 - RNA, 23 nt, Homo sapiens
agggcuccuguacccauucuguu

SEQ ID NO: 1675241 - RNA, 21 nt, Homo sapiens
acugaauaaauaaguaaauac

SEQ ID NO: 1675242 - RNA, 14 nt, Homo sapiens
acugacgcucagua

SEQ ID NO: 1675243 - RNA, 13 nt, Homo sapiens
acugagcacuuug

SEQ ID NO: 1675244 - RNA, 17 nt, Homo sapiens
acugaguauggagauua

SEQ ID NO: 1675245 - RNA, 15 nt, Homo sapiens
acugaucacuucccc

SEQ ID NO: 1675246 - RNA, 14 nt, Homo sapiens
acugcaacacugga

SEQ ID NO: 1675247 - RNA, 17 nt, Homo sapiens
acugcaacccaugagcg

SEQ ID NO: 1675248 - RNA, 12 nt, Homo sapiens
acugcaaccucu

SEQ ID NO: 1675249 - RNA, 15 nt, Homo sapiens
acugcaaccucugcc

SEQ ID NO: 1675250 - RNA, 18 nt, Homo sapiens
acugcagguuggacccca

SEQ ID NO: 1675251 - RNA, 20 nt, Homo sapiens
acugcaucaagaugugacau

SEQ ID NO: 1675252 - RNA, 16 nt, Homo sapiens
acugccacaagcacaa

SEQ ID NO: 1675253 - RNA, 18 nt, Homo sapiens
acugcccaccugccaggc

SEQ ID NO: 1675254 - RNA, 19 nt, Homo sapiens
acugcccgcacacccucac

SEQ ID NO: 1675255 - RNA, 13 nt, Homo sapiens
acugccucugcca

SEQ ID NO: 1675256 - RNA, 14 nt, Homo sapiens
acugccucugccac

SEQ ID NO: 1675257 - RNA, 22 nt, Homo sapiens
acugccucugccacacucugac

SEQ ID NO: 1675258 - RNA, 19 nt, Homo sapiens
acugccuuacagacagaau

SEQ ID NO: 1675259 - RNA, 17 nt, Homo sapiens
acugcuguauaagguaa

SEQ ID NO: 1675260 - RNA, 15 nt, Homo sapiens
acugcuugugcacug

SEQ ID NO: 1675261 - RNA, 20 nt, Homo sapiens
acugcuuuuuccuuagcuua

SEQ ID NO: 1675262 - RNA, 21 nt, Homo sapiens
acuggaauaagaagcaaauaa

SEQ ID NO: 1675263 - RNA, 16 nt, Homo sapiens
acuggacagaucugag

SEQ ID NO: 1675264 - RNA, 19 nt, Homo sapiens
acuggcacacuggccucca

SEQ ID NO: 1675265 - RNA, 15 nt, Homo sapiens
acuggcaucuaguca

SEQ ID NO: 1675266 - RNA, 12 nt, Homo sapiens
acugggggcaac

SEQ ID NO: 1675267 - RNA, 16 nt, Homo sapiens
acuguacaaaauaagu

SEQ ID NO: 1675268 - RNA, 21 nt, Homo sapiens
acuguacaguuucuuccccaa

SEQ ID NO: 1675269 - RNA, 22 nt, Homo sapiens
acuguagccugaguguccacag

SEQ ID NO: 1675270 - RNA, 14 nt, Homo sapiens
acugucaugcccag

SEQ ID NO: 1675271 - RNA, 13 nt, Homo sapiens
acugucuuaguca

SEQ ID NO: 1675272 - RNA, 20 nt, Homo sapiens
acugugccauguguuuaucc

SEQ ID NO: 1675273 - RNA, 13 nt, Homo sapiens
acuguucucuuac

SEQ ID NO: 1675274 - RNA, 10 nt, Homo sapiens
acuguugcau

SEQ ID NO: 1675275 - RNA, 22 nt, Homo sapiens
acuguuggcugauuggaaaaua

SEQ ID NO: 1675276 - RNA, 21 nt, Homo sapiens
acuuaaacaaaaacuuuccau

SEQ ID NO: 1675277 - RNA, 13 nt, Homo sapiens
acuuaauuaccua

SEQ ID NO: 1675278 - RNA, 15 nt, Homo sapiens
acuuaauuauaagcu

SEQ ID NO: 1675279 - RNA, 16 nt, Homo sapiens
acuuauggagugugcc

SEQ ID NO: 1675280 - RNA, 21 nt, Homo sapiens
acuuauuucagguuaaauuaa

SEQ ID NO: 1675281 - RNA, 17 nt, Homo sapiens
acuucaaauguuauuca

SEQ ID NO: 1675282 - RNA, 20 nt, Homo sapiens
acuucaguucucaucuugua

SEQ ID NO: 1675283 - RNA, 16 nt, Homo sapiens
acuuccucaugaaucu

SEQ ID NO: 1675284 - RNA, 13 nt, Homo sapiens
acuuccuuugaga

SEQ ID NO: 1675285 - RNA, 18 nt, Homo sapiens
acuucuacauccaaugua

SEQ ID NO: 1675286 - RNA, 14 nt, Homo sapiens
acuucuacugagca

SEQ ID NO: 1675287 - RNA, 22 nt, Homo sapiens
acuucucagccugguacuugua

SEQ ID NO: 1675288 - RNA, 14 nt, Homo sapiens
acuucucuagacau

SEQ ID NO: 1675289 - RNA, 13 nt, Homo sapiens
acuucucuagaga

SEQ ID NO: 1675290 - RNA, 17 nt, Homo sapiens
acuugacaucaacugca

SEQ ID NO: 1675291 - RNA, 23 nt, Homo sapiens
acuugagggacgacuuucuuuaa

SEQ ID NO: 1675292 - RNA, 22 nt, Homo sapiens
acuugcaguuagacucaaagaa

SEQ ID NO: 1675293 - RNA, 15 nt, Homo sapiens
acuugccaaaacaga

SEQ ID NO: 1675294 - RNA, 13 nt, Homo sapiens
acuugccacugcc

SEQ ID NO: 1675295 - RNA, 15 nt, Homo sapiens
acuugccacugccau

SEQ ID NO: 1675296 - RNA, 14 nt, Homo sapiens
acuugggagcaaaa

SEQ ID NO: 1675297 - RNA, 15 nt, Homo sapiens
acuugggcuggcacc

SEQ ID NO: 1675298 - RNA, 19 nt, Homo sapiens
acuuuaauucuuuucccag

SEQ ID NO: 1675299 - RNA, 15 nt, Homo sapiens
acuuuaccucucugu

SEQ ID NO: 1675300 - RNA, 15 nt, Homo sapiens
acuuuccaggcuagu

SEQ ID NO: 1675301 - RNA, 21 nt, Homo sapiens
acuuucucuaggaaucaaagu

SEQ ID NO: 1675302 - RNA, 17 nt, Homo sapiens
acuuucuuuaacauauc

SEQ ID NO: 1675303 - RNA, 14 nt, Homo sapiens
agauaucuauggca

SEQ ID NO: 1675304 - RNA, 16 nt, Homo sapiens
agaucacguugcaaug

SEQ ID NO: 1675305 - RNA, 19 nt, Homo sapiens
agaucaggagaaacucggg

SEQ ID NO: 1675306 - RNA, 15 nt, Homo sapiens
agauccugucuugcu

SEQ ID NO: 1675307 - RNA, 17 nt, Homo sapiens
agaucuuaagauuccau

SEQ ID NO: 1675308 - RNA, 18 nt, Homo sapiens
agaucuuggcccuguuaa

SEQ ID NO: 1675309 - RNA, 13 nt, Homo sapiens
agaugacaggaag

SEQ ID NO: 1675310 - RNA, 20 nt, Homo sapiens
agaugcaaaucaacucucuc

SEQ ID NO: 1675311 - RNA, 15 nt, Homo sapiens
agaugcaucuguggc

SEQ ID NO: 1675312 - RNA, 18 nt, Homo sapiens
agaugggaggaucacuug

SEQ ID NO: 1675313 - RNA, 21 nt, Homo sapiens
agaugggaggaucacuugagg

SEQ ID NO: 1675314 - RNA, 21 nt, Homo sapiens
agaugggggccucucuggaag

SEQ ID NO: 1675315 - RNA, 17 nt, Homo sapiens
agauguaauacaccaaa

SEQ ID NO: 1675316 - RNA, 17 nt, Homo sapiens
agauguaccauguuaaa

SEQ ID NO: 1675317 - RNA, 12 nt, Homo sapiens
agauguccucag

SEQ ID NO: 1675318 - RNA, 18 nt, Homo sapiens
agaugucuguguauacau

SEQ ID NO: 1675319 - RNA, 14 nt, Homo sapiens
agaugugucuuacc

SEQ ID NO: 1675320 - RNA, 15 nt, Homo sapiens
agaugugucuuacca

SEQ ID NO: 1675321 - RNA, 22 nt, Homo sapiens
agauuauauuuuauaagaggga

SEQ ID NO: 1675322 - RNA, 14 nt, Homo sapiens
agauucaccuccau

SEQ ID NO: 1675323 - RNA, 22 nt, Homo sapiens
agauucaccuccauuaaccaag

SEQ ID NO: 1675324 - RNA, 17 nt, Homo sapiens
agauugauuaaugaacu

SEQ ID NO: 1675325 - RNA, 17 nt, Homo sapiens
agauuuuaaaacuucau

SEQ ID NO: 1675326 - RNA, 23 nt, Homo sapiens
agauuuucauguucuugcaguca

SEQ ID NO: 1675327 - RNA, 14 nt, Homo sapiens
agauuuuccucucc

SEQ ID NO: 1675328 - RNA, 22 nt, Homo sapiens
agcaaaguuuucagauuguaaa

SEQ ID NO: 1675329 - RNA, 13 nt, Homo sapiens
agcaacaacaaca

SEQ ID NO: 1675330 - RNA, 12 nt, Homo sapiens
agcaacaacuua

SEQ ID NO: 1675331 - RNA, 20 nt, Homo sapiens
agcaacccuacaguauauaa

SEQ ID NO: 1675332 - RNA, 18 nt, Homo sapiens
agcaacuggugacugucc

SEQ ID NO: 1675333 - RNA, 20 nt, Homo sapiens
agcaauuguauuacuuccuc

SEQ ID NO: 1675334 - RNA, 14 nt, Homo sapiens
agcacaaagcacug

SEQ ID NO: 1675335 - RNA, 18 nt, Homo sapiens
agcacaaagguagcuuuu

SEQ ID NO: 1675336 - RNA, 20 nt, Homo sapiens
agcacaagaaguuucuucag

SEQ ID NO: 1675337 - RNA, 13 nt, Homo sapiens
agcacacugaguu

SEQ ID NO: 1675338 - RNA, 16 nt, Homo sapiens
agcacaucucuucaug

SEQ ID NO: 1675339 - RNA, 23 nt, Homo sapiens
agcacauguugcuaaugacagug

SEQ ID NO: 1675340 - RNA, 18 nt, Homo sapiens
agcacuaauuagugucca

SEQ ID NO: 1675341 - RNA, 17 nt, Homo sapiens
agcacuggccuugccuc

SEQ ID NO: 1675342 - RNA, 15 nt, Homo sapiens
agcacuucaaaggaa

SEQ ID NO: 1675343 - RNA, 13 nt, Homo sapiens
agcagaaccaaag

SEQ ID NO: 1675344 - RNA, 12 nt, Homo sapiens
agcagaacccag

SEQ ID NO: 1675345 - RNA, 13 nt, Homo sapiens
agcagaacccaga

SEQ ID NO: 1675346 - RNA, 13 nt, Homo sapiens
agcagaaugagau

SEQ ID NO: 1675347 - RNA, 20 nt, Homo sapiens
agcagaauucauucauacuu

SEQ ID NO: 1675348 - RNA, 21 nt, Homo sapiens
agcagaggaaaauaguggcag

SEQ ID NO: 1675349 - RNA, 12 nt, Homo sapiens
agcagagucaag

SEQ ID NO: 1675350 - RNA, 15 nt, Homo sapiens
agcagcagcagcagc

SEQ ID NO: 1675351 - RNA, 12 nt, Homo sapiens
agcagugcagua

SEQ ID NO: 1675352 - RNA, 11 nt, Homo sapiens
agcaguguccu

SEQ ID NO: 1675353 - RNA, 20 nt, Homo sapiens
agcaguguguacuucuucau

SEQ ID NO: 1675354 - RNA, 14 nt, Homo sapiens
agcaguguuuugca

SEQ ID NO: 1675355 - RNA, 13 nt, Homo sapiens
agcauaugcaaag

SEQ ID NO: 1675356 - RNA, 19 nt, Homo sapiens
agcauccaaggaacuucau

SEQ ID NO: 1675357 - RNA, 17 nt, Homo sapiens
agcaucuauagcacaua

SEQ ID NO: 1675358 - RNA, 16 nt, Homo sapiens
agcaucuaugugagac

SEQ ID NO: 1675359 - RNA, 22 nt, Homo sapiens
agcaucugccaggacacugccu

SEQ ID NO: 1675360 - RNA, 17 nt, Homo sapiens
agcaugaaagcaguuua

SEQ ID NO: 1675361 - RNA, 17 nt, Homo sapiens
agcaugaagauaaaucc

SEQ ID NO: 1675362 - RNA, 22 nt, Homo sapiens
agcaugcucaguuggugcugcu

SEQ ID NO: 1675363 - RNA, 16 nt, Homo sapiens
agcauguugauucuag

SEQ ID NO: 1675364 - RNA, 20 nt, Homo sapiens
agccaagaauucuuaaauau

SEQ ID NO: 1675365 - RNA, 22 nt, Homo sapiens
uuuccaaugccaauucaucuca

SEQ ID NO: 1675366 - RNA, 12 nt, Homo sapiens
uuuccaucuccc

SEQ ID NO: 1675367 - RNA, 18 nt, Homo sapiens
uuuccccauugacccuca

SEQ ID NO: 1675368 - RNA, 20 nt, Homo sapiens
uuuccccauugacccucacc

SEQ ID NO: 1675369 - RNA, 23 nt, Homo sapiens
uuucccuucccuuccacugccuc

SEQ ID NO: 1675370 - RNA, 16 nt, Homo sapiens
uuuccuaggcagauca

SEQ ID NO: 1675371 - RNA, 12 nt, Homo sapiens
uuuccucuccaa

SEQ ID NO: 1675372 - RNA, 15 nt, Homo sapiens
uuuccugacagggaa

SEQ ID NO: 1675373 - RNA, 19 nt, Homo sapiens
uuuccuuguacuugauccu

SEQ ID NO: 1675374 - RNA, 13 nt, Homo sapiens
uuucuacucgagu

SEQ ID NO: 1675375 - RNA, 18 nt, Homo sapiens
uuucucauuuagcauuga

SEQ ID NO: 1675376 - RNA, 21 nt, Homo sapiens
uuucuccuucccaaggcagcu

SEQ ID NO: 1675377 - RNA, 19 nt, Homo sapiens
uuucucuguggccauuugu

SEQ ID NO: 1675378 - RNA, 16 nt, Homo sapiens
uuucugaggaguaaaa

SEQ ID NO: 1675379 - RNA, 19 nt, Homo sapiens
uuucugcgggucauauuca

SEQ ID NO: 1675380 - RNA, 21 nt, Homo sapiens
uuucuuaauagaaagucagau

SEQ ID NO: 1675381 - RNA, 19 nt, Homo sapiens
uuucuuaucccagugauca

SEQ ID NO: 1675382 - RNA, 13 nt, Homo sapiens
uuucuuccaacau

SEQ ID NO: 1675383 - RNA, 16 nt, Homo sapiens
uuucuuguugcugcau

SEQ ID NO: 1675384 - RNA, 22 nt, Homo sapiens
uuugaacaacucgaaucacuca

SEQ ID NO: 1675385 - RNA, 17 nt, Homo sapiens
uuugacagcugugcugu

SEQ ID NO: 1675386 - RNA, 16 nt, Homo sapiens
uuugacauugucagaa

SEQ ID NO: 1675387 - RNA, 14 nt, Homo sapiens
uuugacccaggaac

SEQ ID NO: 1675388 - RNA, 14 nt, Homo sapiens
uuugacuguuucca

SEQ ID NO: 1675389 - RNA, 20 nt, Homo sapiens
uuugacuuucugucugugga

SEQ ID NO: 1675390 - RNA, 17 nt, Homo sapiens
uuugcauggaguauuau

SEQ ID NO: 1675391 - RNA, 14 nt, Homo sapiens
uuugccuucuccac

SEQ ID NO: 1675392 - RNA, 22 nt, Homo sapiens
uuugcucaguggaucacacaca

SEQ ID NO: 1675393 - RNA, 20 nt, Homo sapiens
uuugcucuagggaagcagug

SEQ ID NO: 1675394 - RNA, 17 nt, Homo sapiens
uuugcucucucauuccc

SEQ ID NO: 1675395 - RNA, 22 nt, Homo sapiens
uuugcuuguguacaaacccaga

SEQ ID NO: 1675396 - RNA, 15 nt, Homo sapiens
uuuggcagauuuucu

SEQ ID NO: 1675397 - RNA, 13 nt, Homo sapiens
uuugggaaauucu

SEQ ID NO: 1675398 - RNA, 15 nt, Homo sapiens
uuuggguagugccau

SEQ ID NO: 1675399 - RNA, 20 nt, Homo sapiens
uuugguggggagucugagaa

SEQ ID NO: 1675400 - RNA, 17 nt, Homo sapiens
uuuguaccuguaggucu

SEQ ID NO: 1675401 - RNA, 19 nt, Homo sapiens
uuuguaguguuauugccag

SEQ ID NO: 1675402 - RNA, 18 nt, Homo sapiens
uuugucacaaauaaacau

SEQ ID NO: 1675403 - RNA, 13 nt, Homo sapiens
uuugucacuucug

SEQ ID NO: 1675404 - RNA, 15 nt, Homo sapiens
uuuguccucauguga

SEQ ID NO: 1675405 - RNA, 16 nt, Homo sapiens
uuugugaagugauuga

SEQ ID NO: 1675406 - RNA, 17 nt, Homo sapiens
uuuuaaaaaguugcaca

SEQ ID NO: 1675407 - RNA, 14 nt, Homo sapiens
uuuuaacauagcag

SEQ ID NO: 1675408 - RNA, 12 nt, Homo sapiens
uuuuagaguaug

SEQ ID NO: 1675409 - RNA, 18 nt, Homo sapiens
uuuuagcaguucugcaaa

SEQ ID NO: 1675410 - RNA, 13 nt, Homo sapiens
uuuuaugucuaaa

SEQ ID NO: 1675411 - RNA, 15 nt, Homo sapiens
uuuucaagacuuccu

SEQ ID NO: 1675412 - RNA, 15 nt, Homo sapiens
uuuucacaccuuaca

SEQ ID NO: 1675413 - RNA, 23 nt, Homo sapiens
uuuucauccaggcucccaaaaga

SEQ ID NO: 1675414 - RNA, 12 nt, Homo sapiens
uuuuccacguua

SEQ ID NO: 1675415 - RNA, 18 nt, Homo sapiens
uuuuccuaugcaguguca

SEQ ID NO: 1675416 - RNA, 19 nt, Homo sapiens
uuuucuaauaccguggaug

SEQ ID NO: 1675417 - RNA, 15 nt, Homo sapiens
uuuucucuguauaac

SEQ ID NO: 1675418 - RNA, 13 nt, Homo sapiens
uuuuguguacugu

SEQ ID NO: 1675419 - RNA, 20 nt, Homo sapiens
uuuuuaaaagcccuuuccaa

SEQ ID NO: 1675420 - RNA, 14 nt, Homo sapiens
uuuuuaacuuaucu

SEQ ID NO: 1675421 - RNA, 20 nt, Homo sapiens
uuuuuaaguauuucagaugc

SEQ ID NO: 1675422 - RNA, 12 nt, Homo sapiens
uuuuuacauaua

SEQ ID NO: 1675423 - RNA, 13 nt, Homo sapiens
uuuuuacauauag

SEQ ID NO: 1675424 - RNA, 17 nt, Homo sapiens
uuuuuccaaaagccagu

SEQ ID NO: 1675425 - RNA, 17 nt, Homo sapiens
uuuuuggauggcuuaag

SEQ ID NO: 1675426 - RNA, 15 nt, Homo sapiens
gugacaggcaguguu

SEQ ID NO: 1675427 - RNA, 16 nt, Homo sapiens
gugacauuccacagag

SEQ ID NO: 1675428 - RNA, 14 nt, Homo sapiens
gugagaacugugaa

SEQ ID NO: 1675429 - RNA, 17 nt, Homo sapiens
gugagacacucugggaa

SEQ ID NO: 1675430 - RNA, 20 nt, Homo sapiens
gugagcaauccugcaagaac

SEQ ID NO: 1675431 - RNA, 18 nt, Homo sapiens
gugaggugggccuuugag

SEQ ID NO: 1675432 - RNA, 19 nt, Homo sapiens
gugaggugggccuuugaga

SEQ ID NO: 1675433 - RNA, 20 nt, Homo sapiens
gugaguuggggcgacuguga

SEQ ID NO: 1675434 - RNA, 14 nt, Homo sapiens
gugauaauuguaaa

SEQ ID NO: 1675435 - RNA, 20 nt, Homo sapiens
gugaucuauaccaccuucaa

SEQ ID NO: 1675436 - RNA, 15 nt, Homo sapiens
gugaucucagcucac

SEQ ID NO: 1675437 - RNA, 17 nt, Homo sapiens
gugaugauagcacuggu

SEQ ID NO: 1675438 - RNA, 14 nt, Homo sapiens
gugcaccaaggaga

SEQ ID NO: 1675439 - RNA, 13 nt, Homo sapiens
gugcagauaucac

SEQ ID NO: 1675440 - RNA, 23 nt, Homo sapiens
gugcagccaccagggcagaaaug

SEQ ID NO: 1675441 - RNA, 14 nt, Homo sapiens
gugcagcucuggag

SEQ ID NO: 1675442 - RNA, 20 nt, Homo sapiens
gugcagggccguaguaccuc

SEQ ID NO: 1675443 - RNA, 19 nt, Homo sapiens
gugcaguggcaucaucuca

SEQ ID NO: 1675444 - RNA, 12 nt, Homo sapiens
gugcaucuggcc

SEQ ID NO: 1675445 - RNA, 18 nt, Homo sapiens
gugcaugagaaugucauu

SEQ ID NO: 1675446 - RNA, 20 nt, Homo sapiens
gugcauucauucauccucuu

SEQ ID NO: 1675447 - RNA, 23 nt, Homo sapiens
gugccaagcagagguugggaggc

SEQ ID NO: 1675448 - RNA, 13 nt, Homo sapiens
gugccaugaucug

SEQ ID NO: 1675449 - RNA, 18 nt, Homo sapiens
gugccugcuuaccugcca

SEQ ID NO: 1675450 - RNA, 20 nt, Homo sapiens
gugcgugcuugcaugugcug

SEQ ID NO: 1675451 - RNA, 22 nt, Homo sapiens
gugcucaauaaggcagugcagu

SEQ ID NO: 1675452 - RNA, 19 nt, Homo sapiens
gugcuccugcugaccuucu

SEQ ID NO: 1675453 - RNA, 11 nt, Homo sapiens
gugcugggauu

SEQ ID NO: 1675454 - RNA, 11 nt, Homo sapiens
gugcugucaug

SEQ ID NO: 1675455 - RNA, 12 nt, Homo sapiens
gugcugucaugc

SEQ ID NO: 1675456 - RNA, 22 nt, Homo sapiens
gugcugucaugcccagcuugga

SEQ ID NO: 1675457 - RNA, 18 nt, Homo sapiens
guggaaaccuugcugcua

SEQ ID NO: 1675458 - RNA, 17 nt, Homo sapiens
guggaacagagucauau

SEQ ID NO: 1675459 - RNA, 14 nt, Homo sapiens
guggacagcagcug

SEQ ID NO: 1675460 - RNA, 21 nt, Homo sapiens
guggagaaauacaucauuugc

SEQ ID NO: 1675461 - RNA, 20 nt, Homo sapiens
guggagaacagaaauccacg

SEQ ID NO: 1675462 - RNA, 21 nt, Homo sapiens
guggagacuaacuuauuuuga

SEQ ID NO: 1675463 - RNA, 17 nt, Homo sapiens
guggagcuugcagugag

SEQ ID NO: 1675464 - RNA, 20 nt, Homo sapiens
guggauaaauuuuggaagaa

SEQ ID NO: 1675465 - RNA, 17 nt, Homo sapiens
guggaugccugcugcau

SEQ ID NO: 1675466 - RNA, 16 nt, Homo sapiens
guggcgaguccagaca

SEQ ID NO: 1675467 - RNA, 14 nt, Homo sapiens
guggcgcgaucuca

SEQ ID NO: 1675468 - RNA, 22 nt, Homo sapiens
guggcuucacagacccacaaga

SEQ ID NO: 1675469 - RNA, 21 nt, Homo sapiens
gugggccauggccaugguccc

SEQ ID NO: 1675470 - RNA, 19 nt, Homo sapiens
gugguaggaaagccucacu

SEQ ID NO: 1675471 - RNA, 18 nt, Homo sapiens
gugguaggccauggccac

SEQ ID NO: 1675472 - RNA, 20 nt, Homo sapiens
gugguaggccauggccacaa

SEQ ID NO: 1675473 - RNA, 19 nt, Homo sapiens
gugguauuuuaacauagca

SEQ ID NO: 1675474 - RNA, 15 nt, Homo sapiens
guggucuaaacaaaa

SEQ ID NO: 1675475 - RNA, 18 nt, Homo sapiens
guggugaacagaacaaaa

SEQ ID NO: 1675476 - RNA, 20 nt, Homo sapiens
gugguugggaaacucauuua

SEQ ID NO: 1675477 - RNA, 20 nt, Homo sapiens
gugguuuauugaaugugauu

SEQ ID NO: 1675478 - RNA, 20 nt, Homo sapiens
gugguuuccacaugcucuga

SEQ ID NO: 1675479 - RNA, 18 nt, Homo sapiens
guguaauaucauuucaua

SEQ ID NO: 1675480 - RNA, 20 nt, Homo sapiens
guguagcuguccucucagaa

SEQ ID NO: 1675481 - RNA, 12 nt, Homo sapiens
guguaugucuau

SEQ ID NO: 1675482 - RNA, 15 nt, Homo sapiens
gugucaucugucagc

SEQ ID NO: 1675483 - RNA, 17 nt, Homo sapiens
guguccaguugcagcug

SEQ ID NO: 1675484 - RNA, 19 nt, Homo sapiens
guguccccucacucuguca

SEQ ID NO: 1675485 - RNA, 13 nt, Homo sapiens
gugugacaggucc

SEQ ID NO: 1675486 - RNA, 13 nt, Homo sapiens
gugugaguguaug

SEQ ID NO: 1675487 - RNA, 14 nt, Homo sapiens
gugugcuucacaca

SEQ ID NO: 1675488 - RNA, 19 nt, Homo sapiens
uuaacaauugccagggaaa

SEQ ID NO: 1675489 - RNA, 20 nt, Homo sapiens
uuaacauaaacuuguacuua

SEQ ID NO: 1675490 - RNA, 15 nt, Homo sapiens
uuaacauaucauuca

SEQ ID NO: 1675491 - RNA, 13 nt, Homo sapiens
uuaacuacuguuu

SEQ ID NO: 1675492 - RNA, 16 nt, Homo sapiens
uuaacuaugauuccaa

SEQ ID NO: 1675493 - RNA, 13 nt, Homo sapiens
uuaacucugcaua

SEQ ID NO: 1675494 - RNA, 21 nt, Homo sapiens
uuaacugccuuacagacagaa

SEQ ID NO: 1675495 - RNA, 14 nt, Homo sapiens
uuaagagaaaugag

SEQ ID NO: 1675496 - RNA, 17 nt, Homo sapiens
uuaagagaaaugagcug

SEQ ID NO: 1675497 - RNA, 13 nt, Homo sapiens
uuaagcccagaga

SEQ ID NO: 1675498 - RNA, 21 nt, Homo sapiens
uuaaguauaacuaauuugcuc

SEQ ID NO: 1675499 - RNA, 16 nt, Homo sapiens
uuaagucaccuguaua

SEQ ID NO: 1675500 - RNA, 14 nt, Homo sapiens
uuaaucauuuccag

SEQ ID NO: 1675501 - RNA, 14 nt, Homo sapiens
uuaauggcacugau

SEQ ID NO: 1675502 - RNA, 18 nt, Homo sapiens
uuaauuaaacaaauuccu

SEQ ID NO: 1675503 - RNA, 14 nt, Homo sapiens
uuaauucccaaucc

SEQ ID NO: 1675504 - RNA, 15 nt, Homo sapiens
uuaauuuugauucag

SEQ ID NO: 1675505 - RNA, 22 nt, Homo sapiens
uuacagguguacuauggcugua

SEQ ID NO: 1675506 - RNA, 16 nt, Homo sapiens
uuacagucacauucag

SEQ ID NO: 1675507 - RNA, 17 nt, Homo sapiens
uuacagucacauucaga

SEQ ID NO: 1675508 - RNA, 21 nt, Homo sapiens
uuacauaacaggcauugcacu

SEQ ID NO: 1675509 - RNA, 17 nt, Homo sapiens
uuaccgcccacccagca

SEQ ID NO: 1675510 - RNA, 15 nt, Homo sapiens
uuaccuauugcugua

SEQ ID NO: 1675511 - RNA, 18 nt, Homo sapiens
uuaccucugcauaaauau

SEQ ID NO: 1675512 - RNA, 18 nt, Homo sapiens
uuacuaaagggugcaugu

SEQ ID NO: 1675513 - RNA, 23 nt, Homo sapiens
uuagaaauaaaccuuaauauuuc

SEQ ID NO: 1675514 - RNA, 16 nt, Homo sapiens
uuagaagaaaauggau

SEQ ID NO: 1675515 - RNA, 17 nt, Homo sapiens
uuagaauuaccauuugu

SEQ ID NO: 1675516 - RNA, 14 nt, Homo sapiens
uuagacauaccucu

SEQ ID NO: 1675517 - RNA, 15 nt, Homo sapiens
uuagacauaccucuc

SEQ ID NO: 1675518 - RNA, 12 nt, Homo sapiens
uuagauucucuu

SEQ ID NO: 1675519 - RNA, 16 nt, Homo sapiens
uuagcaguucugcaaa

SEQ ID NO: 1675520 - RNA, 19 nt, Homo sapiens
uuagcuagaagaauuucaa

SEQ ID NO: 1675521 - RNA, 16 nt, Homo sapiens
uuagcuuuucugcaau

SEQ ID NO: 1675522 - RNA, 22 nt, Homo sapiens
uuaggacaugcuaucaguaaua

SEQ ID NO: 1675523 - RNA, 14 nt, Homo sapiens
uuaggcagugcagu

SEQ ID NO: 1675524 - RNA, 15 nt, Homo sapiens
uuaggcagugcagua

SEQ ID NO: 1675525 - RNA, 18 nt, Homo sapiens
uuaggugugccaaacuac

SEQ ID NO: 1675526 - RNA, 22 nt, Homo sapiens
uuaguagagacgagguuucacu

SEQ ID NO: 1675527 - RNA, 22 nt, Homo sapiens
uuaguggagaugggguuucacc

SEQ ID NO: 1675528 - RNA, 16 nt, Homo sapiens
uuaguuuuauauugcu

SEQ ID NO: 1675529 - RNA, 18 nt, Homo sapiens
uuauaauaaacuguuuaa

SEQ ID NO: 1675530 - RNA, 19 nt, Homo sapiens
uuauaccagguuaccucac

SEQ ID NO: 1675531 - RNA, 15 nt, Homo sapiens
uuauacuucuuuauu

SEQ ID NO: 1675532 - RNA, 16 nt, Homo sapiens
uuauagucuguacuuc

SEQ ID NO: 1675533 - RNA, 18 nt, Homo sapiens
uuauauaugaaaacuaag

SEQ ID NO: 1675534 - RNA, 17 nt, Homo sapiens
uuauaucagacugcuuu

SEQ ID NO: 1675535 - RNA, 19 nt, Homo sapiens
uuauauucccaaaucucaa

SEQ ID NO: 1675536 - RNA, 22 nt, Homo sapiens
uuauauugccauuucuuccaca

SEQ ID NO: 1675537 - RNA, 15 nt, Homo sapiens
uuaucaaaaaacaga

SEQ ID NO: 1675538 - RNA, 20 nt, Homo sapiens
uuaucaaugacaauggugcc

SEQ ID NO: 1675539 - RNA, 15 nt, Homo sapiens
uuaucauaaauucaa

SEQ ID NO: 1675540 - RNA, 20 nt, Homo sapiens
uuaucauggguaucacauug

SEQ ID NO: 1675541 - RNA, 21 nt, Homo sapiens
uuauccagaggguugugauuu

SEQ ID NO: 1675542 - RNA, 19 nt, Homo sapiens
uuaucugauccuuguggca

SEQ ID NO: 1675543 - RNA, 17 nt, Homo sapiens
uuaucuguguugucucu

SEQ ID NO: 1675544 - RNA, 14 nt, Homo sapiens
uuauguaaacauca

SEQ ID NO: 1675545 - RNA, 21 nt, Homo sapiens
uuaugugccaauuuaguggaa

SEQ ID NO: 1675546 - RNA, 22 nt, Homo sapiens
uuauuaaauguagcuucaguca

SEQ ID NO: 1675547 - RNA, 16 nt, Homo sapiens
uuauuagcaccagcuu

SEQ ID NO: 1675548 - RNA, 14 nt, Homo sapiens
uuauuauguucaau

SEQ ID NO: 1675549 - RNA, 22 nt, Homo sapiens
uucuuucugcaugacuauugua

SEQ ID NO: 1675550 - RNA, 19 nt, Homo sapiens
uucuuuucccaucaccaga

SEQ ID NO: 1675551 - RNA, 19 nt, Homo sapiens
uucuuuugaaucaaucugg

SEQ ID NO: 1675552 - RNA, 16 nt, Homo sapiens
uugaacacaccucucu

SEQ ID NO: 1675553 - RNA, 16 nt, Homo sapiens
uugaacuucuuuagua

SEQ ID NO: 1675554 - RNA, 19 nt, Homo sapiens
uugaacuucuuuaguauua

SEQ ID NO: 1675555 - RNA, 13 nt, Homo sapiens
uugaagaacucau

SEQ ID NO: 1675556 - RNA, 23 nt, Homo sapiens
uugaagcuaaaauaaaccagacu

SEQ ID NO: 1675557 - RNA, 16 nt, Homo sapiens
uugaaggacuacaggu

SEQ ID NO: 1675558 - RNA, 20 nt, Homo sapiens
uugaaugauaauagcucaca

SEQ ID NO: 1675559 - RNA, 20 nt, Homo sapiens
uugaaugaugugauacaaau

SEQ ID NO: 1675560 - RNA, 20 nt, Homo sapiens
uugaauuaauccacacauca

SEQ ID NO: 1675561 - RNA, 22 nt, Homo sapiens
uugacagugccaauaaaugaua

SEQ ID NO: 1675562 - RNA, 17 nt, Homo sapiens
uugaccgugaggccaga

SEQ ID NO: 1675563 - RNA, 18 nt, Homo sapiens
uugacugaucagugugau

SEQ ID NO: 1675564 - RNA, 19 nt, Homo sapiens
uugagaaauaaagcacauu

SEQ ID NO: 1675565 - RNA, 14 nt, Homo sapiens
uugagcgacaucuc

SEQ ID NO: 1675566 - RNA, 15 nt, Homo sapiens
uugagggacugccuc

SEQ ID NO: 1675567 - RNA, 16 nt, Homo sapiens
uugaggguccucaguc

SEQ ID NO: 1675568 - RNA, 22 nt, Homo sapiens
uugaggguccucaguccacugc

SEQ ID NO: 1675569 - RNA, 21 nt, Homo sapiens
uugaucccuaaagaaaacaaa

SEQ ID NO: 1675570 - RNA, 17 nt, Homo sapiens
uugauccucacugagaa

SEQ ID NO: 1675571 - RNA, 13 nt, Homo sapiens
uugaucuuuggaa

SEQ ID NO: 1675572 - RNA, 14 nt, Homo sapiens
uugaugaagcacau

SEQ ID NO: 1675573 - RNA, 18 nt, Homo sapiens
uugaugcuguuucuacau

SEQ ID NO: 1675574 - RNA, 16 nt, Homo sapiens
uugauuaaguauaucu

SEQ ID NO: 1675575 - RNA, 11 nt, Homo sapiens
uugcaauaaga

SEQ ID NO: 1675576 - RNA, 22 nt, Homo sapiens
uugcacgugcucuucuguucuc

SEQ ID NO: 1675577 - RNA, 20 nt, Homo sapiens
uugcagcuggacuucuccac

SEQ ID NO: 1675578 - RNA, 14 nt, Homo sapiens
uugcaugugcugca

SEQ ID NO: 1675579 - RNA, 22 nt, Homo sapiens
uugccaagagccugagugacag

SEQ ID NO: 1675580 - RNA, 22 nt, Homo sapiens
uugccaucugaugucguaccuc

SEQ ID NO: 1675581 - RNA, 23 nt, Homo sapiens
uugcccaccacaacuaacaaugc

SEQ ID NO: 1675582 - RNA, 15 nt, Homo sapiens
uugccuuaauucuua

SEQ ID NO: 1675583 - RNA, 19 nt, Homo sapiens
uugccuuaauucuuaccuc

SEQ ID NO: 1675584 - RNA, 20 nt, Homo sapiens
uugccuuugguuccccgcga

SEQ ID NO: 1675585 - RNA, 12 nt, Homo sapiens
uugcuaacauau

SEQ ID NO: 1675586 - RNA, 16 nt, Homo sapiens
uugcuagcaacaacuu

SEQ ID NO: 1675587 - RNA, 15 nt, Homo sapiens
uugcucacagcugau

SEQ ID NO: 1675588 - RNA, 14 nt, Homo sapiens
uugcugaauaacaa

SEQ ID NO: 1675589 - RNA, 16 nt, Homo sapiens
uugcugucccuuuucc

SEQ ID NO: 1675590 - RNA, 21 nt, Homo sapiens
uugcugugaaaugacugcauc

SEQ ID NO: 1675591 - RNA, 15 nt, Homo sapiens
uugcuguuuacuuga

SEQ ID NO: 1675592 - RNA, 15 nt, Homo sapiens
uugcuuggacuaccu

SEQ ID NO: 1675593 - RNA, 21 nt, Homo sapiens
uugcuuguguacaaacccaga

SEQ ID NO: 1675594 - RNA, 22 nt, Homo sapiens
uuggaaaauaauaaaagaauca

SEQ ID NO: 1675595 - RNA, 23 nt, Homo sapiens
uuggaaugcaugccaguaaugua

SEQ ID NO: 1675596 - RNA, 20 nt, Homo sapiens
uuggagaggagguguggagu

SEQ ID NO: 1675597 - RNA, 18 nt, Homo sapiens
uuggagauucccaucuga

SEQ ID NO: 1675598 - RNA, 15 nt, Homo sapiens
uuggagccugcaaua

SEQ ID NO: 1675599 - RNA, 13 nt, Homo sapiens
uuggagugcagug

SEQ ID NO: 1675600 - RNA, 15 nt, Homo sapiens
uuggauacaggagaa

SEQ ID NO: 1675601 - RNA, 17 nt, Homo sapiens
uuggcagaagcaguugc

SEQ ID NO: 1675602 - RNA, 17 nt, Homo sapiens
uuggcauuaucucuuuc

SEQ ID NO: 1675603 - RNA, 19 nt, Homo sapiens
uuggccauguucauucaca

SEQ ID NO: 1675604 - RNA, 13 nt, Homo sapiens
uuggccucccaag

SEQ ID NO: 1675605 - RNA, 14 nt, Homo sapiens
uuggcuucccaaag

SEQ ID NO: 1675606 - RNA, 17 nt, Homo sapiens
uugggaggaagcacaga

SEQ ID NO: 1675607 - RNA, 16 nt, Homo sapiens
uugggaggccauuugu

SEQ ID NO: 1675608 - RNA, 16 nt, Homo sapiens
uugggcaccugaccac

SEQ ID NO: 1675609 - RNA, 21 nt, Homo sapiens
uuggguaagggacuccagaag

SEQ ID NO: 1675610 - RNA, 14 nt, Homo sapiens
uugggugcauuugc

SEQ ID NO: 1675611 - RNA, 21 nt, Homo sapiens
ugaguacauacucaagagcau

SEQ ID NO: 1675612 - RNA, 12 nt, Homo sapiens
ugagugccuuac

SEQ ID NO: 1675613 - RNA, 21 nt, Homo sapiens
ugagugcgaccaccacuugau

SEQ ID NO: 1675614 - RNA, 17 nt, Homo sapiens
ugaguguccacagggac

SEQ ID NO: 1675615 - RNA, 20 nt, Homo sapiens
ugaguuguuuaaacagucaa

SEQ ID NO: 1675616 - RNA, 22 nt, Homo sapiens
ugauaauagcucacagcacauu

SEQ ID NO: 1675617 - RNA, 17 nt, Homo sapiens
ugauaaucccauacucu

SEQ ID NO: 1675618 - RNA, 17 nt, Homo sapiens
ugauaauuacuuuccag

SEQ ID NO: 1675619 - RNA, 14 nt, Homo sapiens
ugauacaguauuau

SEQ ID NO: 1675620 - RNA, 12 nt, Homo sapiens
ugauaugacccc

SEQ ID NO: 1675621 - RNA, 19 nt, Homo sapiens
ugauaugagucacugccuu

SEQ ID NO: 1675622 - RNA, 16 nt, Homo sapiens
ugaucuauaccaccuu

SEQ ID NO: 1675623 - RNA, 12 nt, Homo sapiens
ugaucucagcuc

SEQ ID NO: 1675624 - RNA, 19 nt, Homo sapiens
ugaucuuugugacccacac

SEQ ID NO: 1675625 - RNA, 15 nt, Homo sapiens
ugaugaaaaccaccc

SEQ ID NO: 1675626 - RNA, 19 nt, Homo sapiens
ugaugaaguuguacaacac

SEQ ID NO: 1675627 - RNA, 21 nt, Homo sapiens
ugaugccaugggcccucucag

SEQ ID NO: 1675628 - RNA, 22 nt, Homo sapiens
ugaugcugccaggccugggacc

SEQ ID NO: 1675629 - RNA, 14 nt, Homo sapiens
ugauguaacugugu

SEQ ID NO: 1675630 - RNA, 19 nt, Homo sapiens
ugauguauuguugcuuuuu

SEQ ID NO: 1675631 - RNA, 16 nt, Homo sapiens
ugaugucuccccugga

SEQ ID NO: 1675632 - RNA, 18 nt, Homo sapiens
ugaugugcucaucagaaa

SEQ ID NO: 1675633 - RNA, 14 nt, Homo sapiens
ugauguggaugaaa

SEQ ID NO: 1675634 - RNA, 15 nt, Homo sapiens
ugauuaacucagucc

SEQ ID NO: 1675635 - RNA, 18 nt, Homo sapiens
ugauuaugaaaugccaga

SEQ ID NO: 1675636 - RNA, 20 nt, Homo sapiens
ugauucaaauaacccugaau

SEQ ID NO: 1675637 - RNA, 14 nt, Homo sapiens
ugauuccuucuugc

SEQ ID NO: 1675638 - RNA, 15 nt, Homo sapiens
ugauucuaaagggga

SEQ ID NO: 1675639 - RNA, 16 nt, Homo sapiens
ugauucuccucuccca

SEQ ID NO: 1675640 - RNA, 14 nt, Homo sapiens
ugauugucaccaug

SEQ ID NO: 1675641 - RNA, 15 nt, Homo sapiens
ugauugucaccauga

SEQ ID NO: 1675642 - RNA, 16 nt, Homo sapiens
ugauuuaaacucuuag

SEQ ID NO: 1675643 - RNA, 19 nt, Homo sapiens
ugauuuauucuggugucua

SEQ ID NO: 1675644 - RNA, 13 nt, Homo sapiens
ugauuugucuuac

SEQ ID NO: 1675645 - RNA, 15 nt, Homo sapiens
ugcaaagaguuauau

SEQ ID NO: 1675646 - RNA, 14 nt, Homo sapiens
ugcaaagcauuuga

SEQ ID NO: 1675647 - RNA, 15 nt, Homo sapiens
ugcaaagcauuugag

SEQ ID NO: 1675648 - RNA, 16 nt, Homo sapiens
ugcaaccaucaccaga

SEQ ID NO: 1675649 - RNA, 13 nt, Homo sapiens
ugcaaccucugcc

SEQ ID NO: 1675650 - RNA, 17 nt, Homo sapiens
ugcaaccucugccuccc

SEQ ID NO: 1675651 - RNA, 15 nt, Homo sapiens
ugcaaccuuguacuu

SEQ ID NO: 1675652 - RNA, 18 nt, Homo sapiens
ugcaagcaaacacacucu

SEQ ID NO: 1675653 - RNA, 18 nt, Homo sapiens
ugcaaggcccacaggagg

SEQ ID NO: 1675654 - RNA, 22 nt, Homo sapiens
ugcaaggugaacaccacuuugu

SEQ ID NO: 1675655 - RNA, 21 nt, Homo sapiens
ugcaauaaaacucccuuccuu

SEQ ID NO: 1675656 - RNA, 14 nt, Homo sapiens
ugcaauacucagua

SEQ ID NO: 1675657 - RNA, 21 nt, Homo sapiens
ugcaauccucccuaccguccu

SEQ ID NO: 1675658 - RNA, 17 nt, Homo sapiens
ugcaaugcaagcccuuu

SEQ ID NO: 1675659 - RNA, 20 nt, Homo sapiens
ugcaauguaucccuucucac

SEQ ID NO: 1675660 - RNA, 13 nt, Homo sapiens
ugcaauuguggac

SEQ ID NO: 1675661 - RNA, 12 nt, Homo sapiens
ugcacacaccug

SEQ ID NO: 1675662 - RNA, 19 nt, Homo sapiens
ugcacaggucccacugccc

SEQ ID NO: 1675663 - RNA, 22 nt, Homo sapiens
ugcacauugguuuaagcccaga

SEQ ID NO: 1675664 - RNA, 21 nt, Homo sapiens
ugcacugcccuccgcccuucc

SEQ ID NO: 1675665 - RNA, 16 nt, Homo sapiens
ugcacuguuugcccca

SEQ ID NO: 1675666 - RNA, 14 nt, Homo sapiens
ugcagauaucacag

SEQ ID NO: 1675667 - RNA, 15 nt, Homo sapiens
ugcagcagaaucucu

SEQ ID NO: 1675668 - RNA, 13 nt, Homo sapiens
ugcagcuauucac

SEQ ID NO: 1675669 - RNA, 15 nt, Homo sapiens
ugcaguagugccaaa

SEQ ID NO: 1675670 - RNA, 16 nt, Homo sapiens
ugcagucagugcuaau

SEQ ID NO: 1675671 - RNA, 19 nt, Homo sapiens
ugcaguccucggcagcucc

SEQ ID NO: 1675672 - RNA, 18 nt, Homo sapiens
uggcgcgaucucagcuca

SEQ ID NO: 1675673 - RNA, 15 nt, Homo sapiens
uggcgugaaccuggg

SEQ ID NO: 1675674 - RNA, 18 nt, Homo sapiens
uggcgugaucucagcuca

SEQ ID NO: 1675675 - RNA, 19 nt, Homo sapiens
uggcgugaucucagcucac

SEQ ID NO: 1675676 - RNA, 16 nt, Homo sapiens
uggcuaacacagugaa

SEQ ID NO: 1675677 - RNA, 16 nt, Homo sapiens
uggcuagucacauauc

SEQ ID NO: 1675678 - RNA, 17 nt, Homo sapiens
uggcuagucacauauca

SEQ ID NO: 1675679 - RNA, 18 nt, Homo sapiens
uggcucaaacaacauucc

SEQ ID NO: 1675680 - RNA, 23 nt, Homo sapiens
uggcucccccucgcccuaugcaa

SEQ ID NO: 1675681 - RNA, 19 nt, Homo sapiens
uggcuuuggguagugccau

SEQ ID NO: 1675682 - RNA, 14 nt, Homo sapiens
uggcuuugugcuua

SEQ ID NO: 1675683 - RNA, 19 nt, Homo sapiens
ugggaagaaagauucaauu

SEQ ID NO: 1675684 - RNA, 20 nt, Homo sapiens
ugggaagaaagauucaauua

SEQ ID NO: 1675685 - RNA, 22 nt, Homo sapiens
ugggaaguaugauuuguuccuu

SEQ ID NO: 1675686 - RNA, 15 nt, Homo sapiens
ugggagaaccaaaaa

SEQ ID NO: 1675687 - RNA, 22 nt, Homo sapiens
ugggaucuucaaugaacugugc

SEQ ID NO: 1675688 - RNA, 23 nt, Homo sapiens
ugggauuacaggugugagccacc

SEQ ID NO: 1675689 - RNA, 15 nt, Homo sapiens
ugggcaaggccuuug

SEQ ID NO: 1675690 - RNA, 18 nt, Homo sapiens
ugggccaagccaggguuc

SEQ ID NO: 1675691 - RNA, 20 nt, Homo sapiens
ugggccaagccaggguucca

SEQ ID NO: 1675692 - RNA, 13 nt, Homo sapiens
ugggccugccaaa

SEQ ID NO: 1675693 - RNA, 18 nt, Homo sapiens
ugggcugcaaaaugaaga

SEQ ID NO: 1675694 - RNA, 13 nt, Homo sapiens
uggggaagccagu

SEQ ID NO: 1675695 - RNA, 15 nt, Homo sapiens
uggggaggggugcuc

SEQ ID NO: 1675696 - RNA, 16 nt, Homo sapiens
uggggccccucucauc

SEQ ID NO: 1675697 - RNA, 15 nt, Homo sapiens
uggggggcacagcca

SEQ ID NO: 1675698 - RNA, 22 nt, Homo sapiens
ugggucgcgugaugcgcauguc

SEQ ID NO: 1675699 - RNA, 14 nt, Homo sapiens
ugggucuaugccuu

SEQ ID NO: 1675700 - RNA, 22 nt, Homo sapiens
ugggugugaccugacaccugcc

SEQ ID NO: 1675701 - RNA, 17 nt, Homo sapiens
uggguuccagacagagu

SEQ ID NO: 1675702 - RNA, 15 nt, Homo sapiens
uggguuuacucugug

SEQ ID NO: 1675703 - RNA, 21 nt, Homo sapiens
ugguaaauaacugugacugug

SEQ ID NO: 1675704 - RNA, 15 nt, Homo sapiens
ugguaauuauccuca

SEQ ID NO: 1675705 - RNA, 19 nt, Homo sapiens
ugguacaacacuugcacaa

SEQ ID NO: 1675706 - RNA, 12 nt, Homo sapiens
ugguacucagua

SEQ ID NO: 1675707 - RNA, 19 nt, Homo sapiens
ugguagauauucaggaaau

SEQ ID NO: 1675708 - RNA, 22 nt, Homo sapiens
ugguaugaaacaaauauacuca

SEQ ID NO: 1675709 - RNA, 20 nt, Homo sapiens
ugguaugcuggccagcaccc

SEQ ID NO: 1675710 - RNA, 12 nt, Homo sapiens
ugguauuuacug

SEQ ID NO: 1675711 - RNA, 17 nt, Homo sapiens
uggucaauaaaccacug

SEQ ID NO: 1675712 - RNA, 14 nt, Homo sapiens
ugguccugcacugu

SEQ ID NO: 1675713 - RNA, 13 nt, Homo sapiens
uggucugugcauu

SEQ ID NO: 1675714 - RNA, 13 nt, Homo sapiens
uggugauggucuc

SEQ ID NO: 1675715 - RNA, 19 nt, Homo sapiens
uggugcugcuuucuuguug

SEQ ID NO: 1675716 - RNA, 20 nt, Homo sapiens
ugguggacaugcacagcuaa

SEQ ID NO: 1675717 - RNA, 14 nt, Homo sapiens
ugguggcaccagau

SEQ ID NO: 1675718 - RNA, 18 nt, Homo sapiens
ugguggggagucugagaa

SEQ ID NO: 1675719 - RNA, 18 nt, Homo sapiens
uggugguuaugucccaug

SEQ ID NO: 1675720 - RNA, 17 nt, Homo sapiens
uggugguuggggugguu

SEQ ID NO: 1675721 - RNA, 21 nt, Homo sapiens
ugguguccugcauguaugcca

SEQ ID NO: 1675722 - RNA, 19 nt, Homo sapiens
uggugugaggcccccggag

SEQ ID NO: 1675723 - RNA, 20 nt, Homo sapiens
ugguuuauugaaugugauuu

SEQ ID NO: 1675724 - RNA, 22 nt, Homo sapiens
uguaaaauauuuauaaaugaag

SEQ ID NO: 1675725 - RNA, 12 nt, Homo sapiens
uguaaauaaaua

SEQ ID NO: 1675726 - RNA, 20 nt, Homo sapiens
uguaaauaccagacugcagg

SEQ ID NO: 1675727 - RNA, 21 nt, Homo sapiens
uguaacaucacuauccaugca

SEQ ID NO: 1675728 - RNA, 16 nt, Homo sapiens
uguaaccgauaugcac

SEQ ID NO: 1675729 - RNA, 13 nt, Homo sapiens
uguacaauaaagc

SEQ ID NO: 1675730 - RNA, 14 nt, Homo sapiens
uguacaauaaagca

SEQ ID NO: 1675731 - RNA, 17 nt, Homo sapiens
uguacaauuacugugag

SEQ ID NO: 1675732 - RNA, 16 nt, Homo sapiens
uguacaugacuguaua

SEQ ID NO: 1675733 - RNA, 13 nt, Homo sapiens
uguacauguggaa

SEQ ID NO: 1675734 - RNA, 15 nt, Homo sapiens
uguagaaacucagca

SEQ ID NO: 1675735 - RNA, 16 nt, Homo sapiens
uaaauguguaaaugug

SEQ ID NO: 1675736 - RNA, 19 nt, Homo sapiens
uaaauuaaugaguuuuauc

SEQ ID NO: 1675737 - RNA, 16 nt, Homo sapiens
uaaauugucucaaaga

SEQ ID NO: 1675738 - RNA, 23 nt, Homo sapiens
uaaauuuguuauuguguauuaug

SEQ ID NO: 1675739 - RNA, 15 nt, Homo sapiens
uaaauuuuaucucag

SEQ ID NO: 1675740 - RNA, 17 nt, Homo sapiens
uaacaaagugagaccuc

SEQ ID NO: 1675741 - RNA, 15 nt, Homo sapiens
uaacaagcaagcaaa

SEQ ID NO: 1675742 - RNA, 16 nt, Homo sapiens
uaacacagugcagugc

SEQ ID NO: 1675743 - RNA, 16 nt, Homo sapiens
uaacacucaccaucag

SEQ ID NO: 1675744 - RNA, 18 nt, Homo sapiens
uaacagccucagcacauc

SEQ ID NO: 1675745 - RNA, 18 nt, Homo sapiens
uaacaggcauugcacuaa

SEQ ID NO: 1675746 - RNA, 20 nt, Homo sapiens
uaacauaaacuuguacuuac

SEQ ID NO: 1675747 - RNA, 12 nt, Homo sapiens
uaacaugucaca

SEQ ID NO: 1675748 - RNA, 20 nt, Homo sapiens
uaaccccaacgcacaggaaa

SEQ ID NO: 1675749 - RNA, 13 nt, Homo sapiens
uaaccucugagga

SEQ ID NO: 1675750 - RNA, 16 nt, Homo sapiens
uaacgccauccaggcu

SEQ ID NO: 1675751 - RNA, 17 nt, Homo sapiens
uaacucauguucauuca

SEQ ID NO: 1675752 - RNA, 16 nt, Homo sapiens
uaacugaaaagcaguu

SEQ ID NO: 1675753 - RNA, 12 nt, Homo sapiens
uaacuuacauuc

SEQ ID NO: 1675754 - RNA, 13 nt, Homo sapiens
uaacuuuaccaug

SEQ ID NO: 1675755 - RNA, 19 nt, Homo sapiens
uaacuuuaccaugcucaau

SEQ ID NO: 1675756 - RNA, 20 nt, Homo sapiens
uaacuuuauuggucuugccc

SEQ ID NO: 1675757 - RNA, 18 nt, Homo sapiens
uaacuuuugguaucuacu

SEQ ID NO: 1675758 - RNA, 16 nt, Homo sapiens
uaagaaagaaaugcua

SEQ ID NO: 1675759 - RNA, 23 nt, Homo sapiens
uaagaauggagcaguacauggga

SEQ ID NO: 1675760 - RNA, 18 nt, Homo sapiens
uaagacaacaggcauuuu

SEQ ID NO: 1675761 - RNA, 20 nt, Homo sapiens
uaagacagugcagugcucag

SEQ ID NO: 1675762 - RNA, 18 nt, Homo sapiens
uaagagaaaugagcugca

SEQ ID NO: 1675763 - RNA, 17 nt, Homo sapiens
uaagagagauaaccuua

SEQ ID NO: 1675764 - RNA, 13 nt, Homo sapiens
uaagcaacuguaa

SEQ ID NO: 1675765 - RNA, 19 nt, Homo sapiens
uaagccaaaaaaugcuugc

SEQ ID NO: 1675766 - RNA, 14 nt, Homo sapiens
uaagccaaaaacaa

SEQ ID NO: 1675767 - RNA, 15 nt, Homo sapiens
uaagcuggagugcag

SEQ ID NO: 1675768 - RNA, 16 nt, Homo sapiens
uaagcuguaaccgaua

SEQ ID NO: 1675769 - RNA, 22 nt, Homo sapiens
uaagcuguaaccgauaugcacu

SEQ ID NO: 1675770 - RNA, 15 nt, Homo sapiens
uaaggaacaaaucuc

SEQ ID NO: 1675771 - RNA, 13 nt, Homo sapiens
uaaggacuacaga

SEQ ID NO: 1675772 - RNA, 16 nt, Homo sapiens
uaaggacuucugcagc

SEQ ID NO: 1675773 - RNA, 15 nt, Homo sapiens
uaaggcagugcagua

SEQ ID NO: 1675774 - RNA, 16 nt, Homo sapiens
uaaggcagugcagugc

SEQ ID NO: 1675775 - RNA, 23 nt, Homo sapiens
uaagggacuuuggaauucugcuu

SEQ ID NO: 1675776 - RNA, 22 nt, Homo sapiens
uaaggguuuuuuuuuuuagcuu

SEQ ID NO: 1675777 - RNA, 15 nt, Homo sapiens
uaaguaaacagucag

SEQ ID NO: 1675778 - RNA, 17 nt, Homo sapiens
uaaguaaaugagccuuu

SEQ ID NO: 1675779 - RNA, 18 nt, Homo sapiens
uaaguaaccucuacaggc

SEQ ID NO: 1675780 - RNA, 23 nt, Homo sapiens
uaaguaaccucuacaggcauuua

SEQ ID NO: 1675781 - RNA, 17 nt, Homo sapiens
uaaguauaucuaucuau

SEQ ID NO: 1675782 - RNA, 21 nt, Homo sapiens
uaaguccacucuaguugugga

SEQ ID NO: 1675783 - RNA, 16 nt, Homo sapiens
uaagugagauguuugg

SEQ ID NO: 1675784 - RNA, 23 nt, Homo sapiens
uaagugaggaugaaaaaauaaca

SEQ ID NO: 1675785 - RNA, 22 nt, Homo sapiens
uaaguguuguauguaccguuga

SEQ ID NO: 1675786 - RNA, 15 nt, Homo sapiens
uaauaaacacagauu

SEQ ID NO: 1675787 - RNA, 14 nt, Homo sapiens
uaauaggaggacag

SEQ ID NO: 1675788 - RNA, 18 nt, Homo sapiens
uaauauaaaugaaugaaa

SEQ ID NO: 1675789 - RNA, 13 nt, Homo sapiens
uaauauacauaac

SEQ ID NO: 1675790 - RNA, 21 nt, Homo sapiens
uaauauuucuucaaauaucuc

SEQ ID NO: 1675791 - RNA, 15 nt, Homo sapiens
uaauccccauaacuu

SEQ ID NO: 1675792 - RNA, 14 nt, Homo sapiens
uaauccuagcacuu

SEQ ID NO: 1675793 - RNA, 20 nt, Homo sapiens
uaaucuguugacagugccaa

SEQ ID NO: 1675794 - RNA, 15 nt, Homo sapiens
uaaugacaacaaaag

SEQ ID NO: 1675795 - RNA, 22 nt, Homo sapiens
uaaugacuuacuuagaauuuau

SEQ ID NO: 1675796 - RNA, 15 nt, Homo sapiens
ucuggccacacugga

SEQ ID NO: 1675797 - RNA, 23 nt, Homo sapiens
ucuguaaaauagucucauugcca

SEQ ID NO: 1675798 - RNA, 17 nt, Homo sapiens
ucuguagccuggucugu

SEQ ID NO: 1675799 - RNA, 12 nt, Homo sapiens
ucugucaccagc

SEQ ID NO: 1675800 - RNA, 14 nt, Homo sapiens
ucugucaccagcua

SEQ ID NO: 1675801 - RNA, 15 nt, Homo sapiens
ucugucgcauuucau

SEQ ID NO: 1675802 - RNA, 12 nt, Homo sapiens
ucugucuugggc

SEQ ID NO: 1675803 - RNA, 18 nt, Homo sapiens
ucugugcaacaaacucaa

SEQ ID NO: 1675804 - RNA, 12 nt, Homo sapiens
ucugugcugcac

SEQ ID NO: 1675805 - RNA, 23 nt, Homo sapiens
ucuguggguuucuaaagcugcca

SEQ ID NO: 1675806 - RNA, 20 nt, Homo sapiens
ucuguggucuaaacaaaaaa

SEQ ID NO: 1675807 - RNA, 22 nt, Homo sapiens
ucuguguaguagcucgugugcu

SEQ ID NO: 1675808 - RNA, 22 nt, Homo sapiens
ucuguuauuuguccucauguga

SEQ ID NO: 1675809 - RNA, 14 nt, Homo sapiens
ucuguuccaagugu

SEQ ID NO: 1675810 - RNA, 18 nt, Homo sapiens
ucuuaaacuaacaauuca

SEQ ID NO: 1675811 - RNA, 23 nt, Homo sapiens
ucuuaaguacugaaauacauaug

SEQ ID NO: 1675812 - RNA, 14 nt, Homo sapiens
ucuuaaugucucaa

SEQ ID NO: 1675813 - RNA, 13 nt, Homo sapiens
ucuuaauucccaa

SEQ ID NO: 1675814 - RNA, 22 nt, Homo sapiens
ucuuaauucccaaucccauucc

SEQ ID NO: 1675815 - RNA, 12 nt, Homo sapiens
ucuuacuguugc

SEQ ID NO: 1675816 - RNA, 14 nt, Homo sapiens
ucuuauauugccau

SEQ ID NO: 1675817 - RNA, 23 nt, Homo sapiens
ucuuauauugccauuucuuccac

SEQ ID NO: 1675818 - RNA, 21 nt, Homo sapiens
ucuuauccugucccuccucca

SEQ ID NO: 1675819 - RNA, 17 nt, Homo sapiens
ucuuaugccugucuuua

SEQ ID NO: 1675820 - RNA, 21 nt, Homo sapiens
ucuucagaauauggacaaaga

SEQ ID NO: 1675821 - RNA, 11 nt, Homo sapiens
ucuucauggcc

SEQ ID NO: 1675822 - RNA, 14 nt, Homo sapiens
ucuucauggccaua

SEQ ID NO: 1675823 - RNA, 18 nt, Homo sapiens
ucuuccaaaccaccuucc

SEQ ID NO: 1675824 - RNA, 18 nt, Homo sapiens
ucuuccaacaugugaugu

SEQ ID NO: 1675825 - RNA, 21 nt, Homo sapiens
ucuucccuggguuuucugccc

SEQ ID NO: 1675826 - RNA, 20 nt, Homo sapiens
ucuuccuaccaaauauaaac

SEQ ID NO: 1675827 - RNA, 19 nt, Homo sapiens
ucuuccuauuuuaaugaau

SEQ ID NO: 1675828 - RNA, 14 nt, Homo sapiens
ucuuccucuuaccu

SEQ ID NO: 1675829 - RNA, 22 nt, Homo sapiens
ucuucuggagggaagcaccaug

SEQ ID NO: 1675830 - RNA, 14 nt, Homo sapiens
ucuucuuacuguau

SEQ ID NO: 1675831 - RNA, 21 nt, Homo sapiens
ucuugaaugcuuaaaugauca

SEQ ID NO: 1675832 - RNA, 13 nt, Homo sapiens
ucuugaccuggag

SEQ ID NO: 1675833 - RNA, 14 nt, Homo sapiens
ucuugcacauggau

SEQ ID NO: 1675834 - RNA, 18 nt, Homo sapiens
ucuugcucugucgccaag

SEQ ID NO: 1675835 - RNA, 14 nt, Homo sapiens
ucuugcugccaggc

SEQ ID NO: 1675836 - RNA, 16 nt, Homo sapiens
ucuugguuuccaucaa

SEQ ID NO: 1675837 - RNA, 17 nt, Homo sapiens
ucuuguaaaacugugac

SEQ ID NO: 1675838 - RNA, 22 nt, Homo sapiens
ucuuguaccagcccaggcaaua

SEQ ID NO: 1675839 - RNA, 13 nt, Homo sapiens
ucuuguugcugca

SEQ ID NO: 1675840 - RNA, 15 nt, Homo sapiens
ucuuguugcugcauc

SEQ ID NO: 1675841 - RNA, 17 nt, Homo sapiens
ucuuguugcugcaucuc

SEQ ID NO: 1675842 - RNA, 21 nt, Homo sapiens
ucuuucagccaagaauucuua

SEQ ID NO: 1675843 - RNA, 15 nt, Homo sapiens
ucuuucauacuacau

SEQ ID NO: 1675844 - RNA, 17 nt, Homo sapiens
ucuuucggaaaugauug

SEQ ID NO: 1675845 - RNA, 18 nt, Homo sapiens
ucuuugaggguuccaugg

SEQ ID NO: 1675846 - RNA, 18 nt, Homo sapiens
ucuuuuaaugucaucucu

SEQ ID NO: 1675847 - RNA, 14 nt, Homo sapiens
ucuuuucaaugcaa

SEQ ID NO: 1675848 - RNA, 20 nt, Homo sapiens
ucuuuuggggucaucuuuga

SEQ ID NO: 1675849 - RNA, 12 nt, Homo sapiens
ucuuuuuacaau

SEQ ID NO: 1675850 - RNA, 21 nt, Homo sapiens
ugaaaaauucccucuuuccau

SEQ ID NO: 1675851 - RNA, 17 nt, Homo sapiens
ugaaaaccaucuggccu

SEQ ID NO: 1675852 - RNA, 17 nt, Homo sapiens
ugaaaagaguaguacuu

SEQ ID NO: 1675853 - RNA, 19 nt, Homo sapiens
ugaaaaggguguugcuaag

SEQ ID NO: 1675854 - RNA, 21 nt, Homo sapiens
ugaaaauggagaaagccacag

SEQ ID NO: 1675855 - RNA, 12 nt, Homo sapiens
ugaaaaugugac

SEQ ID NO: 1675856 - RNA, 13 nt, Homo sapiens
ugaaaauucuuga

SEQ ID NO: 1675857 - RNA, 22 nt, Homo sapiens
ugaaaccagaaaucuaaucucu

SEQ ID NO: 1675858 - RNA, 23 nt, Homo sapiens
ggugcugcuuucuuguugcugca

SEQ ID NO: 1675859 - RNA, 18 nt, Homo sapiens
ggugcuucucacacugga

SEQ ID NO: 1675860 - RNA, 19 nt, Homo sapiens
gguggccgucacgcuuuca

SEQ ID NO: 1675861 - RNA, 11 nt, Homo sapiens
gguggggaccu

SEQ ID NO: 1675862 - RNA, 11 nt, Homo sapiens
gguggggccag

SEQ ID NO: 1675863 - RNA, 15 nt, Homo sapiens
gguggggcuuggaag

SEQ ID NO: 1675864 - RNA, 22 nt, Homo sapiens
gguguagcuguccucucagaac

SEQ ID NO: 1675865 - RNA, 17 nt, Homo sapiens
ggugugaauaaaagcau

SEQ ID NO: 1675866 - RNA, 13 nt, Homo sapiens
gguuaacaguaaa

SEQ ID NO: 1675867 - RNA, 11 nt, Homo sapiens
gguuaccucug

SEQ ID NO: 1675868 - RNA, 13 nt, Homo sapiens
gguuagugcaugu

SEQ ID NO: 1675869 - RNA, 15 nt, Homo sapiens
gguuccagacagggu

SEQ ID NO: 1675870 - RNA, 15 nt, Homo sapiens
gguuggagugcagug

SEQ ID NO: 1675871 - RNA, 18 nt, Homo sapiens
gguuuauugaaugugauu

SEQ ID NO: 1675872 - RNA, 16 nt, Homo sapiens
gguuucuaaagcugcc

SEQ ID NO: 1675873 - RNA, 20 nt, Homo sapiens
gguuucuuguuuaccaaaga

SEQ ID NO: 1675874 - RNA, 13 nt, Homo sapiens
guaaaacugugac

SEQ ID NO: 1675875 - RNA, 13 nt, Homo sapiens
guaaaauguuuca

SEQ ID NO: 1675876 - RNA, 18 nt, Homo sapiens
guaaaauuaucuguucua

SEQ ID NO: 1675877 - RNA, 12 nt, Homo sapiens
guaaacaguuug

SEQ ID NO: 1675878 - RNA, 15 nt, Homo sapiens
guaaauaaauacauu

SEQ ID NO: 1675879 - RNA, 13 nt, Homo sapiens
guaacagugcagu

SEQ ID NO: 1675880 - RNA, 14 nt, Homo sapiens
guaacagugcagua

SEQ ID NO: 1675881 - RNA, 23 nt, Homo sapiens
guaacugcacacaugguuuccaa

SEQ ID NO: 1675882 - RNA, 21 nt, Homo sapiens
guaacuuuauuggucuugccc

SEQ ID NO: 1675883 - RNA, 22 nt, Homo sapiens
guaagaauuuuaauauugccau

SEQ ID NO: 1675884 - RNA, 15 nt, Homo sapiens
guaagacagugcagu

SEQ ID NO: 1675885 - RNA, 11 nt, Homo sapiens
guaaggcagua

SEQ ID NO: 1675886 - RNA, 15 nt, Homo sapiens
guaaggcagugcagu

SEQ ID NO: 1675887 - RNA, 16 nt, Homo sapiens
guaaguuacuggcuga

SEQ ID NO: 1675888 - RNA, 16 nt, Homo sapiens
guaauccgagcacuuu

SEQ ID NO: 1675889 - RNA, 19 nt, Homo sapiens
guaaucuguauaauacuuu

SEQ ID NO: 1675890 - RNA, 16 nt, Homo sapiens
guacaagcuacauaug

SEQ ID NO: 1675891 - RNA, 18 nt, Homo sapiens
guacaauaaagcaaugug

SEQ ID NO: 1675892 - RNA, 20 nt, Homo sapiens
guacauacucaagagcauaa

SEQ ID NO: 1675893 - RNA, 15 nt, Homo sapiens
guacauaguggucau

SEQ ID NO: 1675894 - RNA, 16 nt, Homo sapiens
guacgaggcuucucua

SEQ ID NO: 1675895 - RNA, 14 nt, Homo sapiens
guacgggaggguaa

SEQ ID NO: 1675896 - RNA, 20 nt, Homo sapiens
guacguuaauuaaacaaauu

SEQ ID NO: 1675897 - RNA, 12 nt, Homo sapiens
guacuaccccag

SEQ ID NO: 1675898 - RNA, 13 nt, Homo sapiens
guacuaccccaga

SEQ ID NO: 1675899 - RNA, 18 nt, Homo sapiens
guacucaggcagugcagu

SEQ ID NO: 1675900 - RNA, 22 nt, Homo sapiens
guacucaguaacacagugcagu

SEQ ID NO: 1675901 - RNA, 18 nt, Homo sapiens
guacucaguaacagugca

SEQ ID NO: 1675902 - RNA, 20 nt, Homo sapiens
guacucaguaacagugcagu

SEQ ID NO: 1675903 - RNA, 20 nt, Homo sapiens
guacucaguaagacagugca

SEQ ID NO: 1675904 - RNA, 23 nt, Homo sapiens
guacucaguaaggcagugcagua

SEQ ID NO: 1675905 - RNA, 13 nt, Homo sapiens
guacucugagucc

SEQ ID NO: 1675906 - RNA, 16 nt, Homo sapiens
guagaaacucagcaga

SEQ ID NO: 1675907 - RNA, 14 nt, Homo sapiens
guagcaaauuccaa

SEQ ID NO: 1675908 - RNA, 14 nt, Homo sapiens
guagcacacugagu

SEQ ID NO: 1675909 - RNA, 12 nt, Homo sapiens
guagcaucucug

SEQ ID NO: 1675910 - RNA, 23 nt, Homo sapiens
guagccuggucugugcauugugg

SEQ ID NO: 1675911 - RNA, 18 nt, Homo sapiens
guagcuccgcgugucuca

SEQ ID NO: 1675912 - RNA, 19 nt, Homo sapiens
guagcugagacuacaggca

SEQ ID NO: 1675913 - RNA, 17 nt, Homo sapiens
guagcuuaccugacaca

SEQ ID NO: 1675914 - RNA, 19 nt, Homo sapiens
guaggaaccgaucugcuau

SEQ ID NO: 1675915 - RNA, 15 nt, Homo sapiens
guagggugaggcgug

SEQ ID NO: 1675916 - RNA, 17 nt, Homo sapiens
guaguagcucgugugcu

SEQ ID NO: 1675917 - RNA, 15 nt, Homo sapiens
guagucauuuugccc

SEQ ID NO: 1675918 - RNA, 15 nt, Homo sapiens
guauaauacuuugua

SEQ ID NO: 1675919 - RNA, 11 nt, Homo sapiens
guauacuguua

SEQ ID NO: 1675920 - RNA, 18 nt, Homo sapiens
guauauagugaugugcua

SEQ ID NO: 1675921 - RNA, 11 nt, Homo sapiens
guauauucaaa

SEQ ID NO: 1675922 - RNA, 14 nt, Homo sapiens
gcucaagacuggca

SEQ ID NO: 1675923 - RNA, 15 nt, Homo sapiens
gcucaagacuggcau

SEQ ID NO: 1675924 - RNA, 22 nt, Homo sapiens
gcucaaucucggcucacugcaa

SEQ ID NO: 1675925 - RNA, 16 nt, Homo sapiens
gcucacugcaaccucc

SEQ ID NO: 1675926 - RNA, 16 nt, Homo sapiens
gcucacugcaaccucu

SEQ ID NO: 1675927 - RNA, 21 nt, Homo sapiens
gcucaguaaggcagugcaaua

SEQ ID NO: 1675928 - RNA, 20 nt, Homo sapiens
gcucaguuggugcugcuuuc

SEQ ID NO: 1675929 - RNA, 20 nt, Homo sapiens
gcucauuucacuauucuguu

SEQ ID NO: 1675930 - RNA, 14 nt, Homo sapiens
gcuccaagagaauu

SEQ ID NO: 1675931 - RNA, 16 nt, Homo sapiens
gcuccaucuccagugg

SEQ ID NO: 1675932 - RNA, 15 nt, Homo sapiens
gcucccggugugcag

SEQ ID NO: 1675933 - RNA, 20 nt, Homo sapiens
gcucccuagccagaggcucu

SEQ ID NO: 1675934 - RNA, 17 nt, Homo sapiens
gcucccugcccugaccu

SEQ ID NO: 1675935 - RNA, 14 nt, Homo sapiens
gcuccgggugcgug

SEQ ID NO: 1675936 - RNA, 14 nt, Homo sapiens
gcuccugcugaccu

SEQ ID NO: 1675937 - RNA, 12 nt, Homo sapiens
gcucgggacugu

SEQ ID NO: 1675938 - RNA, 16 nt, Homo sapiens
gcucgugugcuuagaa

SEQ ID NO: 1675939 - RNA, 18 nt, Homo sapiens
gcucguguuucacagugg

SEQ ID NO: 1675940 - RNA, 14 nt, Homo sapiens
gcucuaauguacaa

SEQ ID NO: 1675941 - RNA, 14 nt, Homo sapiens
gcucucaggccagc

SEQ ID NO: 1675942 - RNA, 20 nt, Homo sapiens
gcucuccgccccccggccug

SEQ ID NO: 1675943 - RNA, 19 nt, Homo sapiens
gcucuccuucacucugaca

SEQ ID NO: 1675944 - RNA, 18 nt, Homo sapiens
gcucucuggaccugacca

SEQ ID NO: 1675945 - RNA, 19 nt, Homo sapiens
gcucugagcaguuguuaua

SEQ ID NO: 1675946 - RNA, 20 nt, Homo sapiens
gcucugagcaguuguuauau

SEQ ID NO: 1675947 - RNA, 17 nt, Homo sapiens
gcucugcuggucacugg

SEQ ID NO: 1675948 - RNA, 16 nt, Homo sapiens
gcucuucaccaggaag

SEQ ID NO: 1675949 - RNA, 18 nt, Homo sapiens
gcucuuccuggacaguga

SEQ ID NO: 1675950 - RNA, 23 nt, Homo sapiens
gcucuuuagaauggaccacugag

SEQ ID NO: 1675951 - RNA, 17 nt, Homo sapiens
gcucuuuugagcauuua

SEQ ID NO: 1675952 - RNA, 19 nt, Homo sapiens
gcugaaaaccaucuggccu

SEQ ID NO: 1675953 - RNA, 18 nt, Homo sapiens
gcugaaauuaugucaaau

SEQ ID NO: 1675954 - RNA, 18 nt, Homo sapiens
gcugaugucuucuugggg

SEQ ID NO: 1675955 - RNA, 11 nt, Homo sapiens
gcugcacagua

SEQ ID NO: 1675956 - RNA, 15 nt, Homo sapiens
gcugcacuccaugag

SEQ ID NO: 1675957 - RNA, 17 nt, Homo sapiens
gcugcagucagcacaga

SEQ ID NO: 1675958 - RNA, 19 nt, Homo sapiens
gcugcaucuccccucagau

SEQ ID NO: 1675959 - RNA, 14 nt, Homo sapiens
gcugccaucuccag

SEQ ID NO: 1675960 - RNA, 16 nt, Homo sapiens
gcugccaucuccaggc

SEQ ID NO: 1675961 - RNA, 18 nt, Homo sapiens
gcugcccccacagaucca

SEQ ID NO: 1675962 - RNA, 18 nt, Homo sapiens
gcugccgccacccugcga

SEQ ID NO: 1675963 - RNA, 22 nt, Homo sapiens
gcugcguucuuucaaugcugac

SEQ ID NO: 1675964 - RNA, 19 nt, Homo sapiens
gcugcucccuuuaucaugu

SEQ ID NO: 1675965 - RNA, 17 nt, Homo sapiens
gcugcugaaaaccaucu

SEQ ID NO: 1675966 - RNA, 14 nt, Homo sapiens
gcugcugcacugcc

SEQ ID NO: 1675967 - RNA, 22 nt, Homo sapiens
gcugcugcagucagcacagaga

SEQ ID NO: 1675968 - RNA, 13 nt, Homo sapiens
gcuggagugcagu

SEQ ID NO: 1675969 - RNA, 14 nt, Homo sapiens
gcuggagugcagug

SEQ ID NO: 1675970 - RNA, 15 nt, Homo sapiens
gcuggagugcagugg

SEQ ID NO: 1675971 - RNA, 22 nt, Homo sapiens
gcuggauugagcagaacccaga

SEQ ID NO: 1675972 - RNA, 9 nt, Homo sapiens
gcuggccaa

SEQ ID NO: 1675973 - RNA, 17 nt, Homo sapiens
gcugggagaaaagccag

SEQ ID NO: 1675974 - RNA, 19 nt, Homo sapiens
gcugguaaaaacaugggga

SEQ ID NO: 1675975 - RNA, 13 nt, Homo sapiens
gcuggucuucaau

SEQ ID NO: 1675976 - RNA, 19 nt, Homo sapiens
gcuguaccggccacugcaa

SEQ ID NO: 1675977 - RNA, 15 nt, Homo sapiens
gcuguauacaaacag

SEQ ID NO: 1675978 - RNA, 21 nt, Homo sapiens
gcuguccucucagaacuccug

SEQ ID NO: 1675979 - RNA, 15 nt, Homo sapiens
gcugugaugcaugag

SEQ ID NO: 1675980 - RNA, 15 nt, Homo sapiens
gcuguuccacuucuc

SEQ ID NO: 1675981 - RNA, 13 nt, Homo sapiens
gcuuaccugacac

SEQ ID NO: 1675982 - RNA, 15 nt, Homo sapiens
gcuuagaauggggcu

SEQ ID NO: 1675983 - RNA, 16 nt, Homo sapiens
gcuucauccacugaau

SEQ ID NO: 1675984 - RNA, 19 nt, Homo sapiens
gcaucuccccucagauucc

SEQ ID NO: 1675985 - RNA, 15 nt, Homo sapiens
gcaucugccaggaca

SEQ ID NO: 1675986 - RNA, 21 nt, Homo sapiens
gcaucugccaggacacugccu

SEQ ID NO: 1675987 - RNA, 15 nt, Homo sapiens
gcaugaaagcaguuu

SEQ ID NO: 1675988 - RNA, 13 nt, Homo sapiens
gcaugaagcacau

SEQ ID NO: 1675989 - RNA, 21 nt, Homo sapiens
gcaugcagggcccccacagga

SEQ ID NO: 1675990 - RNA, 12 nt, Homo sapiens
gcaugugcugca

SEQ ID NO: 1675991 - RNA, 20 nt, Homo sapiens
gcauuacacgccacaacucc

SEQ ID NO: 1675992 - RNA, 23 nt, Homo sapiens
gcauuacauuuguuccugggacu

SEQ ID NO: 1675993 - RNA, 14 nt, Homo sapiens
gcauuuaacugccu

SEQ ID NO: 1675994 - RNA, 16 nt, Homo sapiens
gcauuucuacauguuu

SEQ ID NO: 1675995 - RNA, 18 nt, Homo sapiens
gcauuuuucuacugcucu

SEQ ID NO: 1675996 - RNA, 17 nt, Homo sapiens
gccaaacuguacaguuu

SEQ ID NO: 1675997 - RNA, 20 nt, Homo sapiens
gccaagcagagguugggagg

SEQ ID NO: 1675998 - RNA, 17 nt, Homo sapiens
gccaagggcagaucaca

SEQ ID NO: 1675999 - RNA, 18 nt, Homo sapiens
gccaaguuggagugcaau

SEQ ID NO: 1676000 - RNA, 16 nt, Homo sapiens
gccaaugggagcucau

SEQ ID NO: 1676001 - RNA, 19 nt, Homo sapiens
gccacaagggcaguggaag

SEQ ID NO: 1676002 - RNA, 17 nt, Homo sapiens
gccacacuggaauccag

SEQ ID NO: 1676003 - RNA, 22 nt, Homo sapiens
gccaccaagcugcucuccuuca

SEQ ID NO: 1676004 - RNA, 14 nt, Homo sapiens
gccacguggccgcu

SEQ ID NO: 1676005 - RNA, 20 nt, Homo sapiens
gccacuagugggguccugag

SEQ ID NO: 1676006 - RNA, 13 nt, Homo sapiens
gccagacaugcca

SEQ ID NO: 1676007 - RNA, 21 nt, Homo sapiens
gccagagcuccaugcauggaa

SEQ ID NO: 1676008 - RNA, 17 nt, Homo sapiens
gccaggacacugccuug

SEQ ID NO: 1676009 - RNA, 15 nt, Homo sapiens
gccaggcagugcagc

SEQ ID NO: 1676010 - RNA, 18 nt, Homo sapiens
gccaggcuggagugcagu

SEQ ID NO: 1676011 - RNA, 15 nt, Homo sapiens
gccagucaagggcau

SEQ ID NO: 1676012 - RNA, 17 nt, Homo sapiens
gccauauucugugauca

SEQ ID NO: 1676013 - RNA, 17 nt, Homo sapiens
gccaugaagaagugcuu

SEQ ID NO: 1676014 - RNA, 19 nt, Homo sapiens
gccaugggagguccuggcu

SEQ ID NO: 1676015 - RNA, 14 nt, Homo sapiens
gccaugggcaaagc

SEQ ID NO: 1676016 - RNA, 20 nt, Homo sapiens
gccauguauguugcaugaau

SEQ ID NO: 1676017 - RNA, 22 nt, Homo sapiens
gccaugugugagucacuucuac

SEQ ID NO: 1676018 - RNA, 17 nt, Homo sapiens
gccauguuauuuauagu

SEQ ID NO: 1676019 - RNA, 13 nt, Homo sapiens
gccauuggccuua

SEQ ID NO: 1676020 - RNA, 20 nt, Homo sapiens
gccauuuccacuacagugag

SEQ ID NO: 1676021 - RNA, 19 nt, Homo sapiens
gccauuuuuugucugugau

SEQ ID NO: 1676022 - RNA, 22 nt, Homo sapiens
gcccaauuucacagaguacaaa

SEQ ID NO: 1676023 - RNA, 22 nt, Homo sapiens
gcccacgucccgggcacuguca

SEQ ID NO: 1676024 - RNA, 16 nt, Homo sapiens
gcccagcagcggccca

SEQ ID NO: 1676025 - RNA, 18 nt, Homo sapiens
gcccagccagcagguucu

SEQ ID NO: 1676026 - RNA, 19 nt, Homo sapiens
gcccagccuaucucucuuc

SEQ ID NO: 1676027 - RNA, 18 nt, Homo sapiens
gcccagcuuggagugcca

SEQ ID NO: 1676028 - RNA, 19 nt, Homo sapiens
gcccagcuuggagugccac

SEQ ID NO: 1676029 - RNA, 15 nt, Homo sapiens
gcccaggccaucacc

SEQ ID NO: 1676030 - RNA, 16 nt, Homo sapiens
gcccaggccaucacca

SEQ ID NO: 1676031 - RNA, 18 nt, Homo sapiens
gcccaggccaucaccaca

SEQ ID NO: 1676032 - RNA, 21 nt, Homo sapiens
gcccaggccggccagccucac

SEQ ID NO: 1676033 - RNA, 20 nt, Homo sapiens
gcccaggcggucacugccca

SEQ ID NO: 1676034 - RNA, 21 nt, Homo sapiens
gccccacccuuuccucuuaau

SEQ ID NO: 1676035 - RNA, 18 nt, Homo sapiens
gccccaggggcacugugu

SEQ ID NO: 1676036 - RNA, 18 nt, Homo sapiens
gccccauuauucauucuc

SEQ ID NO: 1676037 - RNA, 20 nt, Homo sapiens
gcccccacagauccauccuu

SEQ ID NO: 1676038 - RNA, 22 nt, Homo sapiens
gcccccaggacccccccagucc

SEQ ID NO: 1676039 - RNA, 19 nt, Homo sapiens
gcccccaucacacucggcc

SEQ ID NO: 1676040 - RNA, 13 nt, Homo sapiens
gccccccggccug

SEQ ID NO: 1676041 - RNA, 20 nt, Homo sapiens
gccccgcccccaccccuaca

SEQ ID NO: 1676042 - RNA, 17 nt, Homo sapiens
gccccuucauggaagaa

SEQ ID NO: 1676043 - RNA, 22 nt, Homo sapiens
gccccuucuaggggcaggugaa

SEQ ID NO: 1676044 - RNA, 21 nt, Homo sapiens
gcccgcacacccucacucugc

SEQ ID NO: 1676045 - RNA, 17 nt, Homo sapiens
cucacaacuguuuuuga

SEQ ID NO: 1676046 - RNA, 19 nt, Homo sapiens
cucacagccccggcccccu

SEQ ID NO: 1676047 - RNA, 12 nt, Homo sapiens
cucacauucaca

SEQ ID NO: 1676048 - RNA, 13 nt, Homo sapiens
cucaccugaauaa

SEQ ID NO: 1676049 - RNA, 19 nt, Homo sapiens
cucaccuuugggcaaaggc

SEQ ID NO: 1676050 - RNA, 12 nt, Homo sapiens
cucacgauucca

SEQ ID NO: 1676051 - RNA, 20 nt, Homo sapiens
cucacugguuuucaauacca

SEQ ID NO: 1676052 - RNA, 17 nt, Homo sapiens
cucacuuuuauugauaa

SEQ ID NO: 1676053 - RNA, 16 nt, Homo sapiens
cucagaaaaucaaaga

SEQ ID NO: 1676054 - RNA, 18 nt, Homo sapiens
cucagaaaaucaaagagg

SEQ ID NO: 1676055 - RNA, 19 nt, Homo sapiens
cucagaauauuaagcacau

SEQ ID NO: 1676056 - RNA, 18 nt, Homo sapiens
cucagacaccuagacucu

SEQ ID NO: 1676057 - RNA, 13 nt, Homo sapiens
cucagaugaucuc

SEQ ID NO: 1676058 - RNA, 11 nt, Homo sapiens
cucagcucacu

SEQ ID NO: 1676059 - RNA, 16 nt, Homo sapiens
cucaggagaaggccug

SEQ ID NO: 1676060 - RNA, 16 nt, Homo sapiens
cucaggcagugcaaua

SEQ ID NO: 1676061 - RNA, 15 nt, Homo sapiens
cucaggcagugcagu

SEQ ID NO: 1676062 - RNA, 12 nt, Homo sapiens
cucagggaccaa

SEQ ID NO: 1676063 - RNA, 22 nt, Homo sapiens
cucagggcauaaugaguuccug

SEQ ID NO: 1676064 - RNA, 21 nt, Homo sapiens
cucagguccuacuggggaaac

SEQ ID NO: 1676065 - RNA, 21 nt, Homo sapiens
cucaguuaggcagugcaguac

SEQ ID NO: 1676066 - RNA, 16 nt, Homo sapiens
cucaguuggugcugcu

SEQ ID NO: 1676067 - RNA, 12 nt, Homo sapiens
cucauacauaaa

SEQ ID NO: 1676068 - RNA, 14 nt, Homo sapiens
cucaucccaaaagc

SEQ ID NO: 1676069 - RNA, 13 nt, Homo sapiens
cucaucuugccuc

SEQ ID NO: 1676070 - RNA, 14 nt, Homo sapiens
cucaugguagaaaa

SEQ ID NO: 1676071 - RNA, 13 nt, Homo sapiens
cucauuauuacca

SEQ ID NO: 1676072 - RNA, 16 nt, Homo sapiens
cucauuguucagaaaa

SEQ ID NO: 1676073 - RNA, 17 nt, Homo sapiens
cucauuuuuauauucau

SEQ ID NO: 1676074 - RNA, 16 nt, Homo sapiens
cucauuuuuuccugag

SEQ ID NO: 1676075 - RNA, 21 nt, Homo sapiens
cuccaaaacaauuuucugcag

SEQ ID NO: 1676076 - RNA, 14 nt, Homo sapiens
cuccaaaucuugcc

SEQ ID NO: 1676077 - RNA, 15 nt, Homo sapiens
cuccaaaucuugcca

SEQ ID NO: 1676078 - RNA, 19 nt, Homo sapiens
cuccaaggcaaauguccaa

SEQ ID NO: 1676079 - RNA, 18 nt, Homo sapiens
cuccacacacuucuucca

SEQ ID NO: 1676080 - RNA, 14 nt, Homo sapiens
cuccacagcagcaa

SEQ ID NO: 1676081 - RNA, 18 nt, Homo sapiens
cuccacuugccuugugau

SEQ ID NO: 1676082 - RNA, 17 nt, Homo sapiens
cuccacuuucuagccag

SEQ ID NO: 1676083 - RNA, 21 nt, Homo sapiens
cuccacuuucuagccagagga

SEQ ID NO: 1676084 - RNA, 20 nt, Homo sapiens
cuccagaagggcagcuccac

SEQ ID NO: 1676085 - RNA, 14 nt, Homo sapiens
cuccagaauaugga

SEQ ID NO: 1676086 - RNA, 18 nt, Homo sapiens
cuccagaauauggaaaca

SEQ ID NO: 1676087 - RNA, 17 nt, Homo sapiens
cuccagcccugcagcua

SEQ ID NO: 1676088 - RNA, 17 nt, Homo sapiens
cuccagguuacuaaagg

SEQ ID NO: 1676089 - RNA, 16 nt, Homo sapiens
cuccaguucugaugag

SEQ ID NO: 1676090 - RNA, 12 nt, Homo sapiens
cuccaugcacag

SEQ ID NO: 1676091 - RNA, 15 nt, Homo sapiens
cuccauuaaccaaga

SEQ ID NO: 1676092 - RNA, 21 nt, Homo sapiens
cuccauuaaccaagaaaacca

SEQ ID NO: 1676093 - RNA, 15 nt, Homo sapiens
cuccauuacuaaaga

SEQ ID NO: 1676094 - RNA, 13 nt, Homo sapiens
cuccauuccugag

SEQ ID NO: 1676095 - RNA, 13 nt, Homo sapiens
cucccaagcacuu

SEQ ID NO: 1676096 - RNA, 14 nt, Homo sapiens
cucccaagcacuuc

SEQ ID NO: 1676097 - RNA, 19 nt, Homo sapiens
cucccaaguagcugagacu

SEQ ID NO: 1676098 - RNA, 17 nt, Homo sapiens
cucccaaguccagugug

SEQ ID NO: 1676099 - RNA, 13 nt, Homo sapiens
cuccccacuccag

SEQ ID NO: 1676100 - RNA, 16 nt, Homo sapiens
cuccccacuccagaag

SEQ ID NO: 1676101 - RNA, 12 nt, Homo sapiens
cucccucagucc

SEQ ID NO: 1676102 - RNA, 17 nt, Homo sapiens
cucccuggccccaguga

SEQ ID NO: 1676103 - RNA, 15 nt, Homo sapiens
cucccuuuuugaauu

SEQ ID NO: 1676104 - RNA, 16 nt, Homo sapiens
cuccgcgugucucauu

SEQ ID NO: 1676105 - RNA, 21 nt, Homo sapiens
cuccgcgugucucauuugcca

SEQ ID NO: 1676106 - RNA, 14 nt, Homo sapiens
cuccuaaauuucca

SEQ ID NO: 1676107 - RNA, 13 nt, Homo sapiens
cuccucacugcca

SEQ ID NO: 1676108 - RNA, 14 nt, Homo sapiens
cuccuccagagccu

SEQ ID NO: 1676109 - RNA, 20 nt, Homo sapiens
cuccucccaagcacuucaaa

SEQ ID NO: 1676110 - RNA, 16 nt, Homo sapiens
ccagaagcagcagcua

SEQ ID NO: 1676111 - RNA, 12 nt, Homo sapiens
ccagaauuuccc

SEQ ID NO: 1676112 - RNA, 16 nt, Homo sapiens
ccagacaccaucacca

SEQ ID NO: 1676113 - RNA, 22 nt, Homo sapiens
ccagagagaaucaacagaucaa

SEQ ID NO: 1676114 - RNA, 13 nt, Homo sapiens
ccagagcugccac

SEQ ID NO: 1676115 - RNA, 23 nt, Homo sapiens
ccagagcuuuacagugccacgac

SEQ ID NO: 1676116 - RNA, 14 nt, Homo sapiens
ccagaggcucuaau

SEQ ID NO: 1676117 - RNA, 21 nt, Homo sapiens
ccagaggcucuaauguacaau

SEQ ID NO: 1676118 - RNA, 12 nt, Homo sapiens
ccagaggggugc

SEQ ID NO: 1676119 - RNA, 23 nt, Homo sapiens
ccagaggggugcgcagagcugac

SEQ ID NO: 1676120 - RNA, 18 nt, Homo sapiens
ccagcaggcucucaggcc

SEQ ID NO: 1676121 - RNA, 13 nt, Homo sapiens
ccagcagggugaa

SEQ ID NO: 1676122 - RNA, 18 nt, Homo sapiens
ccagcauaguucugcaau

SEQ ID NO: 1676123 - RNA, 16 nt, Homo sapiens
ccagcaugacgguguc

SEQ ID NO: 1676124 - RNA, 21 nt, Homo sapiens
ccagcauugucugacugugag

SEQ ID NO: 1676125 - RNA, 23 nt, Homo sapiens
ccagccacggggacucagcccuu

SEQ ID NO: 1676126 - RNA, 16 nt, Homo sapiens
ccagccuguucucuga

SEQ ID NO: 1676127 - RNA, 16 nt, Homo sapiens
ccagcggggcuucugg

SEQ ID NO: 1676128 - RNA, 19 nt, Homo sapiens
ccagcugcaggaaucaaaa

SEQ ID NO: 1676129 - RNA, 17 nt, Homo sapiens
ccaggacaaaaugcaaa

SEQ ID NO: 1676130 - RNA, 13 nt, Homo sapiens
ccaggacagcauu

SEQ ID NO: 1676131 - RNA, 16 nt, Homo sapiens
ccaggacgcaugcagg

SEQ ID NO: 1676132 - RNA, 13 nt, Homo sapiens
ccaggaggcugca

SEQ ID NO: 1676133 - RNA, 12 nt, Homo sapiens
ccaggaugcaug

SEQ ID NO: 1676134 - RNA, 14 nt, Homo sapiens
ccaggaugcaugca

SEQ ID NO: 1676135 - RNA, 18 nt, Homo sapiens
ccaggauggagugcagug

SEQ ID NO: 1676136 - RNA, 16 nt, Homo sapiens
ccaggcagcugcaguu

SEQ ID NO: 1676137 - RNA, 15 nt, Homo sapiens
ccaggccaucaccac

SEQ ID NO: 1676138 - RNA, 19 nt, Homo sapiens
ccaggcuaguccggaccca

SEQ ID NO: 1676139 - RNA, 17 nt, Homo sapiens
ccaggcuggagugcagu

SEQ ID NO: 1676140 - RNA, 23 nt, Homo sapiens
ccagggaugggggaugggccagg

SEQ ID NO: 1676141 - RNA, 17 nt, Homo sapiens
ccagggcacaaccagaa

SEQ ID NO: 1676142 - RNA, 20 nt, Homo sapiens
ccagguagagagaccacaag

SEQ ID NO: 1676143 - RNA, 17 nt, Homo sapiens
ccagguuacuaaagggu

SEQ ID NO: 1676144 - RNA, 22 nt, Homo sapiens
ccagguuacuaaagggugcaug

SEQ ID NO: 1676145 - RNA, 15 nt, Homo sapiens
ccagguuccucaaaa

SEQ ID NO: 1676146 - RNA, 23 nt, Homo sapiens
ccaguccaucucaagugccauau

SEQ ID NO: 1676147 - RNA, 19 nt, Homo sapiens
ccagucccagcuaacucug

SEQ ID NO: 1676148 - RNA, 17 nt, Homo sapiens
ccagugcaaucugucca

SEQ ID NO: 1676149 - RNA, 22 nt, Homo sapiens
ccagugcuacacguuggaguau

SEQ ID NO: 1676150 - RNA, 12 nt, Homo sapiens
ccaguuaacugu

SEQ ID NO: 1676151 - RNA, 15 nt, Homo sapiens
ccaguuaacuguuaa

SEQ ID NO: 1676152 - RNA, 13 nt, Homo sapiens
ccaguucuugcaa

SEQ ID NO: 1676153 - RNA, 16 nt, Homo sapiens
ccaguucuugcaauaa

SEQ ID NO: 1676154 - RNA, 12 nt, Homo sapiens
ccaucauuucau

SEQ ID NO: 1676155 - RNA, 18 nt, Homo sapiens
ccauccgcaucucaacaa

SEQ ID NO: 1676156 - RNA, 23 nt, Homo sapiens
ccauccuggcuaacacagugaaa

SEQ ID NO: 1676157 - RNA, 23 nt, Homo sapiens
ccaucuguuugauacaguauuau

SEQ ID NO: 1676158 - RNA, 17 nt, Homo sapiens
ccaucuuaaauuucuaa

SEQ ID NO: 1676159 - RNA, 15 nt, Homo sapiens
ccaucuucuuuauac

SEQ ID NO: 1676160 - RNA, 16 nt, Homo sapiens
ccaugaagaagugcuu

SEQ ID NO: 1676161 - RNA, 20 nt, Homo sapiens
ccaugcaggcagccugcaga

SEQ ID NO: 1676162 - RNA, 13 nt, Homo sapiens
ccaugcucaauga

SEQ ID NO: 1676163 - RNA, 19 nt, Homo sapiens
ccaugcucagcucagcauu

SEQ ID NO: 1676164 - RNA, 10 nt, Homo sapiens
ccaugcucuu

SEQ ID NO: 1676165 - RNA, 16 nt, Homo sapiens
ccauggccacaauccc

SEQ ID NO: 1676166 - RNA, 20 nt, Homo sapiens
ccauggcuccucaccaccga

SEQ ID NO: 1676167 - RNA, 22 nt, Homo sapiens
ccauggcuccucaccaccgaga

SEQ ID NO: 1676168 - RNA, 19 nt, Homo sapiens
ccauggcuggaugugcauc

SEQ ID NO: 1676169 - RNA, 15 nt, Homo sapiens
ccaugguaauguaac

SEQ ID NO: 1676170 - RNA, 14 nt, Homo sapiens
ccucccaccaggaa

SEQ ID NO: 1676171 - RNA, 21 nt, Homo sapiens
ccucccuguccccugagguua

SEQ ID NO: 1676172 - RNA, 13 nt, Homo sapiens
ccuccugaugucu

SEQ ID NO: 1676173 - RNA, 19 nt, Homo sapiens
ccuccugcaaggggcucaa

SEQ ID NO: 1676174 - RNA, 24 nt, Homo sapiens
ccuccugggggcauaucucaguca

SEQ ID NO: 1676175 - RNA, 20 nt, Homo sapiens
ccucgcggcucuccagggcu

SEQ ID NO: 1676176 - RNA, 21 nt, Homo sapiens
ccucuagguaaacuagcaaaa

SEQ ID NO: 1676177 - RNA, 16 nt, Homo sapiens
ccucucagcacuaauu

SEQ ID NO: 1676178 - RNA, 19 nt, Homo sapiens
ccucucaucacugaaaucc

SEQ ID NO: 1676179 - RNA, 15 nt, Homo sapiens
ccucucccucagucc

SEQ ID NO: 1676180 - RNA, 13 nt, Homo sapiens
ccucucucaggcc

SEQ ID NO: 1676181 - RNA, 12 nt, Homo sapiens
ccucucucuaua

SEQ ID NO: 1676182 - RNA, 19 nt, Homo sapiens
ccucucucucccuccacuc

SEQ ID NO: 1676183 - RNA, 17 nt, Homo sapiens
ccucugcauaaauauua

SEQ ID NO: 1676184 - RNA, 22 nt, Homo sapiens
ccucugccggucccccaugcca

SEQ ID NO: 1676185 - RNA, 20 nt, Homo sapiens
ccucugucauaugcagaauu

SEQ ID NO: 1676186 - RNA, 19 nt, Homo sapiens
ccucuuaaugucucaaaau

SEQ ID NO: 1676187 - RNA, 15 nt, Homo sapiens
ccucuuaauucccaa

SEQ ID NO: 1676188 - RNA, 19 nt, Homo sapiens
ccucuuagaagaaauauga

SEQ ID NO: 1676189 - RNA, 13 nt, Homo sapiens
ccucuuaggcaga

SEQ ID NO: 1676190 - RNA, 17 nt, Homo sapiens
ccucuucuugcggcacc

SEQ ID NO: 1676191 - RNA, 22 nt, Homo sapiens
ccugaaaacuuuagcauugggu

SEQ ID NO: 1676192 - RNA, 19 nt, Homo sapiens
ccugaaaaggguguugcua

SEQ ID NO: 1676193 - RNA, 13 nt, Homo sapiens
ccugaacacucau

SEQ ID NO: 1676194 - RNA, 23 nt, Homo sapiens
ccugaagaaacaaggcauugaau

SEQ ID NO: 1676195 - RNA, 19 nt, Homo sapiens
ccugaauguuucagaccac

SEQ ID NO: 1676196 - RNA, 15 nt, Homo sapiens
ccugacaaaagggac

SEQ ID NO: 1676197 - RNA, 19 nt, Homo sapiens
ccugagaggagcguguccu

SEQ ID NO: 1676198 - RNA, 14 nt, Homo sapiens
ccugaggccaagaa

SEQ ID NO: 1676199 - RNA, 16 nt, Homo sapiens
ccugagggaagcccac

SEQ ID NO: 1676200 - RNA, 17 nt, Homo sapiens
ccugaucacuaugcauu

SEQ ID NO: 1676201 - RNA, 22 nt, Homo sapiens
ccugaugucuugguuuccauca

SEQ ID NO: 1676202 - RNA, 20 nt, Homo sapiens
ccugauuuccauuugcaaca

SEQ ID NO: 1676203 - RNA, 14 nt, Homo sapiens
ccugcacacuuggu

SEQ ID NO: 1676204 - RNA, 20 nt, Homo sapiens
ccugcagagccaauggugca

SEQ ID NO: 1676205 - RNA, 23 nt, Homo sapiens
ccugccaaaugaauaagacaaca

SEQ ID NO: 1676206 - RNA, 14 nt, Homo sapiens
ccugccccagagaa

SEQ ID NO: 1676207 - RNA, 22 nt, Homo sapiens
ccugccucucucauggcuuggg

SEQ ID NO: 1676208 - RNA, 22 nt, Homo sapiens
ccugcuuagugucccuuaccug

SEQ ID NO: 1676209 - RNA, 22 nt, Homo sapiens
ccugcuucauucaagcuucaua

SEQ ID NO: 1676210 - RNA, 22 nt, Homo sapiens
ccuggaaauaacugagcacuuu

SEQ ID NO: 1676211 - RNA, 18 nt, Homo sapiens
ccuggacucaucuuggga

SEQ ID NO: 1676212 - RNA, 16 nt, Homo sapiens
ccuggagaaggguuca

SEQ ID NO: 1676213 - RNA, 17 nt, Homo sapiens
ccuggagauugugcucu

SEQ ID NO: 1676214 - RNA, 23 nt, Homo sapiens
ccuggaggaacugcuugugcacu

SEQ ID NO: 1676215 - RNA, 16 nt, Homo sapiens
ccuggcacaggacuga

SEQ ID NO: 1676216 - RNA, 17 nt, Homo sapiens
ccuggccaaaaugcaga

SEQ ID NO: 1676217 - RNA, 21 nt, Homo sapiens
ccuggcgggcagccccugcug

SEQ ID NO: 1676218 - RNA, 15 nt, Homo sapiens
ccuggcucacagcca

SEQ ID NO: 1676219 - RNA, 23 nt, Homo sapiens
ccuggcuuagcguucuguuucac

SEQ ID NO: 1676220 - RNA, 20 nt, Homo sapiens
ccuggcuucaccgcauucca

SEQ ID NO: 1676221 - RNA, 16 nt, Homo sapiens
ccugggacagccacug

SEQ ID NO: 1676222 - RNA, 20 nt, Homo sapiens
ccugggggcugcugcacugc

SEQ ID NO: 1676223 - RNA, 15 nt, Homo sapiens
ccuggggguggcagg

SEQ ID NO: 1676224 - RNA, 15 nt, Homo sapiens
ccugggugccagucc

SEQ ID NO: 1676225 - RNA, 23 nt, Homo sapiens
ccuggucaauaaaccacuguucc

SEQ ID NO: 1676226 - RNA, 17 nt, Homo sapiens
ccugguccugcacuguc

SEQ ID NO: 1676227 - RNA, 23 nt, Homo sapiens
ccuguaauccgagcacuuuggga

SEQ ID NO: 1676228 - RNA, 15 nt, Homo sapiens
ccuguaccugggcuu

SEQ ID NO: 1676229 - RNA, 17 nt, Homo sapiens
ccugucuccucugucag

SEQ ID NO: 1676230 - RNA, 22 nt, Homo sapiens
ccugucucuugggaagcaguuu

SEQ ID NO: 1676231 - RNA, 12 nt, Homo sapiens
ccugucuuuacu

SEQ ID NO: 1676232 - RNA, 16 nt, Homo sapiens
ccugucuuuacuuuaa

SEQ ID NO: 1676233 - RNA, 13 nt, Homo sapiens
agucaggauuuau

SEQ ID NO: 1676234 - RNA, 12 nt, Homo sapiens
agucaguugcaa

SEQ ID NO: 1676235 - RNA, 19 nt, Homo sapiens
agucaguugcaaauuuuag

SEQ ID NO: 1676236 - RNA, 14 nt, Homo sapiens
agucaucaucucau

SEQ ID NO: 1676237 - RNA, 14 nt, Homo sapiens
agucaugaugaauc

SEQ ID NO: 1676238 - RNA, 19 nt, Homo sapiens
aguccacccccauugugaa

SEQ ID NO: 1676239 - RNA, 12 nt, Homo sapiens
aguccacugcug

SEQ ID NO: 1676240 - RNA, 18 nt, Homo sapiens
aguccacugcugaggaca

SEQ ID NO: 1676241 - RNA, 20 nt, Homo sapiens
aguccacuuuccucucucuc

SEQ ID NO: 1676242 - RNA, 12 nt, Homo sapiens
aguccagaagag

SEQ ID NO: 1676243 - RNA, 15 nt, Homo sapiens
aguccagugugacuu

SEQ ID NO: 1676244 - RNA, 21 nt, Homo sapiens
agucccugacuaacagccuca

SEQ ID NO: 1676245 - RNA, 22 nt, Homo sapiens
agucccuucucucuuccuugcu

SEQ ID NO: 1676246 - RNA, 12 nt, Homo sapiens
aguccugggauu

SEQ ID NO: 1676247 - RNA, 15 nt, Homo sapiens
aguccuuuauugucc

SEQ ID NO: 1676248 - RNA, 23 nt, Homo sapiens
agucuauugucuccuugguuaua

SEQ ID NO: 1676249 - RNA, 21 nt, Homo sapiens
agucucacuuuuauugauaaa

SEQ ID NO: 1676250 - RNA, 15 nt, Homo sapiens
agucucuugauucau

SEQ ID NO: 1676251 - RNA, 20 nt, Homo sapiens
agucuguacuucaguucuca

SEQ ID NO: 1676252 - RNA, 20 nt, Homo sapiens
agucugugaauaaagccaca

SEQ ID NO: 1676253 - RNA, 23 nt, Homo sapiens
agucuuccuccucagucuucuca

SEQ ID NO: 1676254 - RNA, 23 nt, Homo sapiens
agucuucuuucuuagauucucuu

SEQ ID NO: 1676255 - RNA, 20 nt, Homo sapiens
agucuugggucuaugccuug

SEQ ID NO: 1676256 - RNA, 23 nt, Homo sapiens
agucuuucccuggugauggucuc

SEQ ID NO: 1676257 - RNA, 17 nt, Homo sapiens
agugaaaggucaucuca

SEQ ID NO: 1676258 - RNA, 16 nt, Homo sapiens
agugaagcugggagaa

SEQ ID NO: 1676259 - RNA, 17 nt, Homo sapiens
agugagaaaacugugac

SEQ ID NO: 1676260 - RNA, 19 nt, Homo sapiens
agugaugcaggcaguguaa

SEQ ID NO: 1676261 - RNA, 15 nt, Homo sapiens
agugcaauaaaacuc

SEQ ID NO: 1676262 - RNA, 18 nt, Homo sapiens
agugcaguggcaucaucu

SEQ ID NO: 1676263 - RNA, 20 nt, Homo sapiens
agugcaguggcaucaucuca

SEQ ID NO: 1676264 - RNA, 21 nt, Homo sapiens
agugcaguggcaucaucucag

SEQ ID NO: 1676265 - RNA, 23 nt, Homo sapiens
agugcaguggcgcgaucucagcu

SEQ ID NO: 1676266 - RNA, 13 nt, Homo sapiens
agugcaguggcuc

SEQ ID NO: 1676267 - RNA, 20 nt, Homo sapiens
agugccauauucugugauca

SEQ ID NO: 1676268 - RNA, 23 nt, Homo sapiens
agugccccuauuauuaacaauuc

SEQ ID NO: 1676269 - RNA, 13 nt, Homo sapiens
agugccugugauc

SEQ ID NO: 1676270 - RNA, 14 nt, Homo sapiens
aguggaauacuaaa

SEQ ID NO: 1676271 - RNA, 20 nt, Homo sapiens
aguggagaugggguuucacc

SEQ ID NO: 1676272 - RNA, 17 nt, Homo sapiens
aguggaugccugcugca

SEQ ID NO: 1676273 - RNA, 21 nt, Homo sapiens
aguggcaagcucuucauugca

SEQ ID NO: 1676274 - RNA, 18 nt, Homo sapiens
aguggcaucaucucagcu

SEQ ID NO: 1676275 - RNA, 16 nt, Homo sapiens
aguggcgugaucucag

SEQ ID NO: 1676276 - RNA, 17 nt, Homo sapiens
agugggaacucugacaa

SEQ ID NO: 1676277 - RNA, 17 nt, Homo sapiens
aguguacuggauuuaac

SEQ ID NO: 1676278 - RNA, 14 nt, Homo sapiens
aguguagugcucag

SEQ ID NO: 1676279 - RNA, 22 nt, Homo sapiens
agugucacuuuuuuccugucaa

SEQ ID NO: 1676280 - RNA, 19 nt, Homo sapiens
aguguccugcuaccuuugu

SEQ ID NO: 1676281 - RNA, 21 nt, Homo sapiens
agugucuuuuuuuucuucacc

SEQ ID NO: 1676282 - RNA, 16 nt, Homo sapiens
agugugauugugaacu

SEQ ID NO: 1676283 - RNA, 20 nt, Homo sapiens
aguguugaggaggggagcaa

SEQ ID NO: 1676284 - RNA, 15 nt, Homo sapiens
aguguuguguuacaa

SEQ ID NO: 1676285 - RNA, 14 nt, Homo sapiens
aguguuuccaguga

SEQ ID NO: 1676286 - RNA, 14 nt, Homo sapiens
aguuaaaaagucaa

SEQ ID NO: 1676287 - RNA, 13 nt, Homo sapiens
aguuaacuaugau

SEQ ID NO: 1676288 - RNA, 13 nt, Homo sapiens
aguuaaucuucau

SEQ ID NO: 1676289 - RNA, 15 nt, Homo sapiens
aguuaaugugccaaa

SEQ ID NO: 1676290 - RNA, 14 nt, Homo sapiens
aguuacuucuugua

SEQ ID NO: 1676291 - RNA, 20 nt, Homo sapiens
aguuauuaaaguaauuuaca

SEQ ID NO: 1676292 - RNA, 14 nt, Homo sapiens
aguucagcuccuuc

SEQ ID NO: 1676293 - RNA, 17 nt, Homo sapiens
cauaaauuauuucuaaa

SEQ ID NO: 1676294 - RNA, 18 nt, Homo sapiens
cauaaauuauuucuaaaa

SEQ ID NO: 1676295 - RNA, 18 nt, Homo sapiens
cauaaccgcacagacauu

SEQ ID NO: 1676296 - RNA, 17 nt, Homo sapiens
cauaacuagaguaugug

SEQ ID NO: 1676297 - RNA, 20 nt, Homo sapiens
cauaagcuuuuucucugaac

SEQ ID NO: 1676298 - RNA, 17 nt, Homo sapiens
cauaaugaguuccugag

SEQ ID NO: 1676299 - RNA, 11 nt, Homo sapiens
cauacauaaaa

SEQ ID NO: 1676300 - RNA, 16 nt, Homo sapiens
cauacauuagugccau

SEQ ID NO: 1676301 - RNA, 22 nt, Homo sapiens
cauacucucaauugaguuaaau

SEQ ID NO: 1676302 - RNA, 17 nt, Homo sapiens
cauagaaacaugacacu

SEQ ID NO: 1676303 - RNA, 16 nt, Homo sapiens
cauagauucaccugua

SEQ ID NO: 1676304 - RNA, 17 nt, Homo sapiens
cauagcuugcaguuuca

SEQ ID NO: 1676305 - RNA, 23 nt, Homo sapiens
cauaggauccgaagugcaaugau

SEQ ID NO: 1676306 - RNA, 21 nt, Homo sapiens
cauaggguccugaauguuuca

SEQ ID NO: 1676307 - RNA, 21 nt, Homo sapiens
cauaguuugaauucaugccuc

SEQ ID NO: 1676308 - RNA, 17 nt, Homo sapiens
cauauaaacacaguaag

SEQ ID NO: 1676309 - RNA, 17 nt, Homo sapiens
cauauaaauggaauuac

SEQ ID NO: 1676310 - RNA, 14 nt, Homo sapiens
cauauaauuugcca

SEQ ID NO: 1676311 - RNA, 13 nt, Homo sapiens
cauauaucuauua

SEQ ID NO: 1676312 - RNA, 19 nt, Homo sapiens
cauaucagcucugcauaag

SEQ ID NO: 1676313 - RNA, 16 nt, Homo sapiens
cauauuuaaagucuug

SEQ ID NO: 1676314 - RNA, 13 nt, Homo sapiens
caucaaagcccuc

SEQ ID NO: 1676315 - RNA, 14 nt, Homo sapiens
caucaaaguguuua

SEQ ID NO: 1676316 - RNA, 14 nt, Homo sapiens
caucaagaugugac

SEQ ID NO: 1676317 - RNA, 18 nt, Homo sapiens
caucaauuggguuuugau

SEQ ID NO: 1676318 - RNA, 15 nt, Homo sapiens
caucacacauguuca

SEQ ID NO: 1676319 - RNA, 12 nt, Homo sapiens
caucaccacagc

SEQ ID NO: 1676320 - RNA, 16 nt, Homo sapiens
caucaugaugcucaug

SEQ ID NO: 1676321 - RNA, 12 nt, Homo sapiens
caucauguugaa

SEQ ID NO: 1676322 - RNA, 13 nt, Homo sapiens
cauccaauguaug

SEQ ID NO: 1676323 - RNA, 19 nt, Homo sapiens
cauccacacacagcagcuc

SEQ ID NO: 1676324 - RNA, 22 nt, Homo sapiens
cauccaccaccuugccaauggu

SEQ ID NO: 1676325 - RNA, 19 nt, Homo sapiens
cauccaccuucacaccacu

SEQ ID NO: 1676326 - RNA, 16 nt, Homo sapiens
cauccaguaucuugaa

SEQ ID NO: 1676327 - RNA, 15 nt, Homo sapiens
cauccauagacacag

SEQ ID NO: 1676328 - RNA, 14 nt, Homo sapiens
cauccguaucuuuu

SEQ ID NO: 1676329 - RNA, 22 nt, Homo sapiens
cauccuucccgcagcaccagcc

SEQ ID NO: 1676330 - RNA, 23 nt, Homo sapiens
caucguugcaaccacugcaauau

SEQ ID NO: 1676331 - RNA, 12 nt, Homo sapiens
caucuaccuucc

SEQ ID NO: 1676332 - RNA, 16 nt, Homo sapiens
caucuagucucagugc

SEQ ID NO: 1676333 - RNA, 22 nt, Homo sapiens
caucuaugugagaccauuuagc

SEQ ID NO: 1676334 - RNA, 15 nt, Homo sapiens
caucucaucaugucu

SEQ ID NO: 1676335 - RNA, 20 nt, Homo sapiens
caucuccaaaucuugccauu

SEQ ID NO: 1676336 - RNA, 20 nt, Homo sapiens
caucuccccucagauuccac

SEQ ID NO: 1676337 - RNA, 12 nt, Homo sapiens
caucucgcugcc

SEQ ID NO: 1676338 - RNA, 15 nt, Homo sapiens
caucucuguaaaaag

SEQ ID NO: 1676339 - RNA, 16 nt, Homo sapiens
caucugcauuucuaca

SEQ ID NO: 1676340 - RNA, 20 nt, Homo sapiens
caucuggagcugaagcguua

SEQ ID NO: 1676341 - RNA, 13 nt, Homo sapiens
caucuguaaaaua

SEQ ID NO: 1676342 - RNA, 20 nt, Homo sapiens
caucuguaaaauagucucau

SEQ ID NO: 1676343 - RNA, 22 nt, Homo sapiens
caucugucagcuucccaacaau

SEQ ID NO: 1676344 - RNA, 24 nt, Homo sapiens
caucuuauuugucaguguagauca

SEQ ID NO: 1676345 - RNA, 11 nt, Homo sapiens
caucuuccuag

SEQ ID NO: 1676346 - RNA, 17 nt, Homo sapiens
caucuugggaagggcca

SEQ ID NO: 1676347 - RNA, 16 nt, Homo sapiens
caugaaaaguuuucaa

SEQ ID NO: 1676348 - RNA, 18 nt, Homo sapiens
caugacacugaccuugga

SEQ ID NO: 1676349 - RNA, 21 nt, Homo sapiens
caugaccacugggccugcuag

SEQ ID NO: 1676350 - RNA, 18 nt, Homo sapiens
caugacgguguccaugcc

SEQ ID NO: 1676351 - RNA, 14 nt, Homo sapiens
caugagaugaugcc

SEQ ID NO: 1676352 - RNA, 21 nt, Homo sapiens
caugaggugagagaaagccac

SEQ ID NO: 1676353 - RNA, 17 nt, Homo sapiens
caugauguauuguugcu

SEQ ID NO: 1676354 - RNA, 20 nt, Homo sapiens
caugcaaaucuggcuuagua

SEQ ID NO: 1676355 - RNA, 18 nt, Homo sapiens
caugcagacccucagacc

SEQ ID NO: 1676356 - RNA, 22 nt, Homo sapiens
caugcagauaguauacacauca

SEQ ID NO: 1676357 - RNA, 12 nt, Homo sapiens
caugcauaacac

SEQ ID NO: 1676358 - RNA, 13 nt, Homo sapiens
caugcaugagcac

SEQ ID NO: 1676359 - RNA, 22 nt, Homo sapiens
caugcccagcuuggagugccac

SEQ ID NO: 1676360 - RNA, 17 nt, Homo sapiens
caugccucucucaggcc

SEQ ID NO: 1676361 - RNA, 20 nt, Homo sapiens
caugccucucucaggccaaa

SEQ ID NO: 1676362 - RNA, 18 nt, Homo sapiens
caugcugccugccaugug

SEQ ID NO: 1676363 - RNA, 22 nt, Homo sapiens
cauggaacucagcugucugugg

SEQ ID NO: 1676364 - RNA, 14 nt, Homo sapiens
cauggaaguacuau

SEQ ID NO: 1676365 - RNA, 22 nt, Homo sapiens
cauggaaguacuauaauuuacc

SEQ ID NO: 1676366 - RNA, 16 nt, Homo sapiens
cauggccaauagucau

SEQ ID NO: 1676367 - RNA, 14 nt, Homo sapiens
cauggccauggucc

SEQ ID NO: 1676368 - RNA, 15 nt, Homo sapiens
cauggccaugguccc

SEQ ID NO: 1676369 - RNA, 14 nt, Homo sapiens
cauggccgcugccc

SEQ ID NO: 1676370 - RNA, 22 nt, Homo sapiens
cauggcuuuaaaacaugcuguc

SEQ ID NO: 1676371 - RNA, 14 nt, Homo sapiens
caugguagacugug

SEQ ID NO: 1676372 - RNA, 16 nt, Homo sapiens
caugguagacugugac

SEQ ID NO: 1676373 - RNA, 13 nt, Homo sapiens
caugguaucucuu

SEQ ID NO: 1676374 - RNA, 21 nt, Homo sapiens
cauguagaauuauaacuaauu

SEQ ID NO: 1676375 - RNA, 19 nt, Homo sapiens
caugugcucagccccagac

SEQ ID NO: 1676376 - RNA, 11 nt, Homo sapiens
caugugcugca

SEQ ID NO: 1676377 - RNA, 12 nt, Homo sapiens
caugugcugcag

SEQ ID NO: 1676378 - RNA, 15 nt, Homo sapiens
cauguggaaaacuca

SEQ ID NO: 1676379 - RNA, 22 nt, Homo sapiens
cauguggcuaaaugccuaauaa

SEQ ID NO: 1676380 - RNA, 18 nt, Homo sapiens
cauguguccccccugugg

SEQ ID NO: 1676381 - RNA, 19 nt, Homo sapiens
cauguguuucuguguagua

SEQ ID NO: 1676382 - RNA, 22 nt, Homo sapiens
cauguucaagcgauucuccugc

SEQ ID NO: 1676383 - RNA, 19 nt, Homo sapiens
cauguuuauuauguucaau

SEQ ID NO: 1676384 - RNA, 22 nt, Homo sapiens
cauuaaaacaagagaccacuuc

SEQ ID NO: 1676385 - RNA, 17 nt, Homo sapiens
cauuaaaauaguuacaa

SEQ ID NO: 1676386 - RNA, 23 nt, Homo sapiens
cauuaaacuaauuaaacugaugg

SEQ ID NO: 1676387 - RNA, 19 nt, Homo sapiens
cauuaauuuaaaugauuua

SEQ ID NO: 1676388 - RNA, 20 nt, Homo sapiens
cauuauucucugaugcacug

SEQ ID NO: 1676389 - RNA, 21 nt, Homo sapiens
cauuauuucuguauauagaug

SEQ ID NO: 1676390 - RNA, 17 nt, Homo sapiens
cauucaagcuucauaua

SEQ ID NO: 1676391 - RNA, 12 nt, Homo sapiens
cauuccauuugc

SEQ ID NO: 1676392 - RNA, 14 nt, Homo sapiens
cauuccugggcuag

SEQ ID NO: 1676393 - RNA, 18 nt, Homo sapiens
cauuccuguucccaugag

SEQ ID NO: 1676394 - RNA, 20 nt, Homo sapiens
cauuccuguucccaugagau

SEQ ID NO: 1676395 - RNA, 23 nt, Homo sapiens
cauucguccuuagaauacuguau

SEQ ID NO: 1676396 - RNA, 14 nt, Homo sapiens
cauucuacugaaca

SEQ ID NO: 1676397 - RNA, 21 nt, Homo sapiens
cauucuccuuguaaaagccua

SEQ ID NO: 1676398 - RNA, 14 nt, Homo sapiens
cauugaaacuguau

SEQ ID NO: 1676399 - RNA, 18 nt, Homo sapiens
cauugaacuucuuuagua

SEQ ID NO: 1676400 - RNA, 17 nt, Homo sapiens
cauugcacuaaaaguga

SEQ ID NO: 1676401 - RNA, 21 nt, Homo sapiens
cauugcuaaagucaggccauu

SEQ ID NO: 1676402 - RNA, 17 nt, Homo sapiens
cauugcuucacuaccca

SEQ ID NO: 1676403 - RNA, 21 nt, Homo sapiens
cauugcuucauuaaaacaaga

SEQ ID NO: 1676404 - RNA, 20 nt, Homo sapiens
cauuuaaaacaagcugauag

SEQ ID NO: 1676405 - RNA, 23 nt, Homo sapiens
cauuuaggaaagcagugcaguac

SEQ ID NO: 1676406 - RNA, 12 nt, Homo sapiens
cauuuauagaau

SEQ ID NO: 1676407 - RNA, 13 nt, Homo sapiens
cauuuauguguga

SEQ ID NO: 1676408 - RNA, 15 nt, Homo sapiens
cauuucacauuccug

SEQ ID NO: 1676409 - RNA, 12 nt, Homo sapiens
cauuucaugucc

SEQ ID NO: 1676410 - RNA, 21 nt, Homo sapiens
cauuuccccugugguuuguua

SEQ ID NO: 1676411 - RNA, 13 nt, Homo sapiens
cauuugcccucau

SEQ ID NO: 1676412 - RNA, 16 nt, Homo sapiens
cauuuguguagcugag

SEQ ID NO: 1676413 - RNA, 16 nt, Homo sapiens
cauuuucaagacacag

SEQ ID NO: 1676414 - RNA, 17 nt, Homo sapiens
cauuuugcauuccugca

SEQ ID NO: 1676415 - RNA, 14 nt, Homo sapiens
aaaaaauauaugua

SEQ ID NO: 1676416 - RNA, 13 nt, Homo sapiens
aaaaaauguucau

SEQ ID NO: 1676417 - RNA, 18 nt, Homo sapiens
aaaaaccucuuagcuuuu

SEQ ID NO: 1676418 - RNA, 12 nt, Homo sapiens
aaaaagguuuaa

SEQ ID NO: 1676419 - RNA, 15 nt, Homo sapiens
aaaaagucaaacuuu

SEQ ID NO: 1676420 - RNA, 12 nt, Homo sapiens
aaaaauaugugu

SEQ ID NO: 1676421 - RNA, 22 nt, Homo sapiens
aaaaaucaaucauuuucuagcc

SEQ ID NO: 1676422 - RNA, 19 nt, Homo sapiens
aaaaaucccauuuaugcaa

SEQ ID NO: 1676423 - RNA, 18 nt, Homo sapiens
aaaacaagagaccacuuc

SEQ ID NO: 1676424 - RNA, 13 nt, Homo sapiens
aaaacaagcugau

SEQ ID NO: 1676425 - RNA, 14 nt, Homo sapiens
aaaacagacccucc

SEQ ID NO: 1676426 - RNA, 17 nt, Homo sapiens
aaaacagacccucccac

SEQ ID NO: 1676427 - RNA, 14 nt, Homo sapiens
aaaacaguguuucc

SEQ ID NO: 1676428 - RNA, 11 nt, Homo sapiens
aaaaccaggcu

SEQ ID NO: 1676429 - RNA, 14 nt, Homo sapiens
aaaacucucaguca

SEQ ID NO: 1676430 - RNA, 18 nt, Homo sapiens
aaaacugccacaagcaca

SEQ ID NO: 1676431 - RNA, 22 nt, Homo sapiens
aaaacuguuaagggaagcugau

SEQ ID NO: 1676432 - RNA, 19 nt, Homo sapiens
aaaagaauugugccucucc

SEQ ID NO: 1676433 - RNA, 15 nt, Homo sapiens
aaaagaugugcagau

SEQ ID NO: 1676434 - RNA, 18 nt, Homo sapiens
aaaagcaaaucuguauaa

SEQ ID NO: 1676435 - RNA, 14 nt, Homo sapiens
aaaagcaccucuug

SEQ ID NO: 1676436 - RNA, 19 nt, Homo sapiens
aaaagcaucuaugugagac

SEQ ID NO: 1676437 - RNA, 23 nt, Homo sapiens
aaaaggaagccucuucaucuccc

SEQ ID NO: 1676438 - RNA, 21 nt, Homo sapiens
aaaaggcuugagucuggauaa

SEQ ID NO: 1676439 - RNA, 20 nt, Homo sapiens
aaaagggagaacauggccaa

SEQ ID NO: 1676440 - RNA, 22 nt, Homo sapiens
aaaagguagcuuaccugacaca

SEQ ID NO: 1676441 - RNA, 11 nt, Homo sapiens
aaaaguaucag

SEQ ID NO: 1676442 - RNA, 11 nt, Homo sapiens
aaaagugcaac

SEQ ID NO: 1676443 - RNA, 18 nt, Homo sapiens
aaaauaauaaaagaauca

SEQ ID NO: 1676444 - RNA, 19 nt, Homo sapiens
aaaauacaugguaucucuu

SEQ ID NO: 1676445 - RNA, 21 nt, Homo sapiens
aaaauauaguguuguguuaca

SEQ ID NO: 1676446 - RNA, 17 nt, Homo sapiens
aaaauccaaaaugcaug

SEQ ID NO: 1676447 - RNA, 22 nt, Homo sapiens
aaaauccaagcugcucauuuca

SEQ ID NO: 1676448 - RNA, 20 nt, Homo sapiens
aaaaugagaaucugugcagu

SEQ ID NO: 1676449 - RNA, 10 nt, Homo sapiens
aaaaugagau

SEQ ID NO: 1676450 - RNA, 11 nt, Homo sapiens
aaaauggacau

SEQ ID NO: 1676451 - RNA, 21 nt, Homo sapiens
aaaauggacguguuaugacuc

SEQ ID NO: 1676452 - RNA, 16 nt, Homo sapiens
aaaaugggaacuggag

SEQ ID NO: 1676453 - RNA, 22 nt, Homo sapiens
aaaauguaaaaacccugcuaaa

SEQ ID NO: 1676454 - RNA, 22 nt, Homo sapiens
aaaauguucugacagcauuuca

SEQ ID NO: 1676455 - RNA, 14 nt, Homo sapiens
aaaauguuguccuu

SEQ ID NO: 1676456 - RNA, 16 nt, Homo sapiens
aaacaaaaaggaaaug

SEQ ID NO: 1676457 - RNA, 15 nt, Homo sapiens
aaacaaagaguagaa

SEQ ID NO: 1676458 - RNA, 15 nt, Homo sapiens
aaacaaauauacuca

SEQ ID NO: 1676459 - RNA, 14 nt, Homo sapiens
aaacaauucaaaga

SEQ ID NO: 1676460 - RNA, 16 nt, Homo sapiens
aaacacaaauugugaa

SEQ ID NO: 1676461 - RNA, 23 nt, Homo sapiens
aaacacagcugcuuucuucuuac

SEQ ID NO: 1676462 - RNA, 16 nt, Homo sapiens
aaacacucgugugcau

SEQ ID NO: 1676463 - RNA, 16 nt, Homo sapiens
aaacagagcaaaagaa

SEQ ID NO: 1676464 - RNA, 14 nt, Homo sapiens
aaacagauauacuc

SEQ ID NO: 1676465 - RNA, 14 nt, Homo sapiens
aaacagcagguugu

SEQ ID NO: 1676466 - RNA, 22 nt, Homo sapiens
aaacaguguggcuuaaacauuu

SEQ ID NO: 1676467 - RNA, 21 nt, Homo sapiens
aaacaguuaagacaacaggca

SEQ ID NO: 1676468 - RNA, 21 nt, Homo sapiens
aaacaucggggcuaacagaga

SEQ ID NO: 1676469 - RNA, 15 nt, Homo sapiens
aaacauuucccugcu

SEQ ID NO: 1676470 - RNA, 23 nt, Homo sapiens
aaaccaauuuguucugugcaaca

SEQ ID NO: 1676471 - RNA, 14 nt, Homo sapiens
aaaccacaaaaaga

SEQ ID NO: 1676472 - RNA, 14 nt, Homo sapiens
aaaccaccuucccu

SEQ ID NO: 1676473 - RNA, 18 nt, Homo sapiens
aaaccagaaaucuaaucu

SEQ ID NO: 1676474 - RNA, 12 nt, Homo sapiens
aaaccuccacug

SEQ ID NO: 1676475 - RNA, 12 nt, Homo sapiens
aaaccuuacuua

SEQ ID NO: 1676476 - RNA, 16 nt, Homo sapiens
aaacuaacaauucaag

SEQ ID NO: 1676477 - RNA, 17 nt, Homo sapiens
aaacuacugccuuucaa

SEQ ID NO: 1676478 - RNA, 13 nt, Homo sapiens
aaacucaccugcc

SEQ ID NO: 1676479 - RNA, 14 nt, Homo sapiens
aaacucaccugccc

SEQ ID NO: 1676480 - RNA, 12 nt, Homo sapiens
aaacucauccau

SEQ ID NO: 1676481 - RNA, 15 nt, Homo sapiens
aaacucugcaccuaa

SEQ ID NO: 1676482 - RNA, 13 nt, Homo sapiens
aaacugaagccca

SEQ ID NO: 1676483 - RNA, 22 nt, Homo sapiens
aaacugauuacaacugcuacag

SEQ ID NO: 1676484 - RNA, 15 nt, Homo sapiens
aaacuguauuuacuu

SEQ ID NO: 1676485 - RNA, 12 nt, Homo sapiens
aaacugugagau

SEQ ID NO: 1676486 - RNA, 13 nt, Homo sapiens
aaacuucuacuga

SEQ ID NO: 1676487 - RNA, 22 nt, Homo sapiens
aaacuuguguucaaucugugaa

SEQ ID NO: 1676488 - RNA, 19 nt, Homo sapiens
aaacuuuugggaacucucc

SEQ ID NO: 1676489 - RNA, 23 nt, Homo sapiens
aaagaacagcugaggcugucauu

SEQ ID NO: 1676490 - RNA, 20 nt, Homo sapiens
aaagaaguacuguacuuucc

SEQ ID NO: 1676491 - RNA, 13 nt, Homo sapiens
aaagaaucauuug

SEQ ID NO: 1676492 - RNA, 16 nt, Homo sapiens
aaagaauucucagcag

SEQ ID NO: 1676493 - RNA, 23 nt, Homo sapiens
aaagaauucucagcagagcucaa

SEQ ID NO: 1676494 - RNA, 17 nt, Homo sapiens
aaagacaguaaagacca

SEQ ID NO: 1676495 - RNA, 13 nt, Homo sapiens
aaagaccuugaaa

SEQ ID NO: 1676496 - RNA, 22 nt, Homo sapiens
aaagaguugcaguaaaguucca

SEQ ID NO: 1676497 - RNA, 19 nt, Homo sapiens
aaagauuugacaugcucca

SEQ ID NO: 1676498 - RNA, 18 nt, Homo sapiens
aaagcagugcaguacuca

SEQ ID NO: 1676499 - RNA, 22 nt, Homo sapiens
aaagcaugcucaguauugagac

SEQ ID NO: 1676500 - RNA, 11 nt, Homo sapiens
aaagccaguca

SEQ ID NO: 1676501 - RNA, 16 nt, Homo sapiens
aaagccauuauucucu

SEQ ID NO: 1676502 - RNA, 14 nt, Homo sapiens
aaagccuuccucaa

SEQ ID NO: 1676503 - RNA, 19 nt, Homo sapiens
aaagcgugguggacaugca

SEQ ID NO: 1676504 - RNA, 21 nt, Homo sapiens
aaagcgugguggacaugcaca

SEQ ID NO: 1676505 - RNA, 18 nt, Homo sapiens
aaagcuaucuucauguaa

SEQ ID NO: 1676506 - RNA, 11 nt, Homo sapiens
aaagcugccag

SEQ ID NO: 1676507 - RNA, 17 nt, Homo sapiens
aaaggcccccaucacac

SEQ ID NO: 1676508 - RNA, 21 nt, Homo sapiens
aaaggguuuuaagccagggca

SEQ ID NO: 1676509 - RNA, 21 nt, Homo sapiens
aaagguagcuuuucccaaacu

SEQ ID NO: 1676510 - RNA, 13 nt, Homo sapiens
aaaggucaucuca

SEQ ID NO: 1676511 - RNA, 19 nt, Homo sapiens
aaaggugccagagcuccau

SEQ ID NO: 1676512 - RNA, 23 nt, Homo sapiens
aaagguuguacauaguggucauu

SEQ ID NO: 1676513 - RNA, 22 nt, Homo sapiens
aaaguaauuaaaaagacacuuu

SEQ ID NO: 1676514 - RNA, 17 nt, Homo sapiens
aaaguauuccaccuuaa

SEQ ID NO: 1676515 - RNA, 20 nt, Homo sapiens
aaagucaaacuuucaccuca

SEQ ID NO: 1676516 - RNA, 20 nt, Homo sapiens
aaagucagugccuggagaag

SEQ ID NO: 1676517 - RNA, 17 nt, Homo sapiens
aaagucuacacugccuu

SEQ ID NO: 1676518 - RNA, 15 nt, Homo sapiens
aaagugaaauuagua

SEQ ID NO: 1676519 - RNA, 23 nt, Homo sapiens
aaaguuuauggaacugaguguua

SEQ ID NO: 1676520 - RNA, 18 nt, Homo sapiens
aauguacaauaaagcaau

SEQ ID NO: 1676521 - RNA, 18 nt, Homo sapiens
aauguacccagccuacca

SEQ ID NO: 1676522 - RNA, 13 nt, Homo sapiens
aauguacuacauu

SEQ ID NO: 1676523 - RNA, 20 nt, Homo sapiens
aauguaucuacauaccuaca

SEQ ID NO: 1676524 - RNA, 23 nt, Homo sapiens
aauguaucuuauuuauauaugaa

SEQ ID NO: 1676525 - RNA, 16 nt, Homo sapiens
aaugucagcacauguu

SEQ ID NO: 1676526 - RNA, 12 nt, Homo sapiens
aaugucaucucu

SEQ ID NO: 1676527 - RNA, 18 nt, Homo sapiens
aauguccaagcaucagca

SEQ ID NO: 1676528 - RNA, 11 nt, Homo sapiens
aauguccuccg

SEQ ID NO: 1676529 - RNA, 19 nt, Homo sapiens
aaugugaaacugagaccaa

SEQ ID NO: 1676530 - RNA, 22 nt, Homo sapiens
aaugugaaauaaagaguucucc

SEQ ID NO: 1676531 - RNA, 18 nt, Homo sapiens
aaugugauauguguaaua

SEQ ID NO: 1676532 - RNA, 11 nt, Homo sapiens
aaugugccaaa

SEQ ID NO: 1676533 - RNA, 20 nt, Homo sapiens
aauguucauucuaugacaau

SEQ ID NO: 1676534 - RNA, 15 nt, Homo sapiens
aauguuggcuagucu

SEQ ID NO: 1676535 - RNA, 16 nt, Homo sapiens
aauguuuguaagcaau

SEQ ID NO: 1676536 - RNA, 20 nt, Homo sapiens
aauguuuuaaagaaguccau

SEQ ID NO: 1676537 - RNA, 16 nt, Homo sapiens
aauuaaaggugccaga

SEQ ID NO: 1676538 - RNA, 18 nt, Homo sapiens
aauuaaagucuacacugc

SEQ ID NO: 1676539 - RNA, 20 nt, Homo sapiens
aauuaaagucuacacugccu

SEQ ID NO: 1676540 - RNA, 21 nt, Homo sapiens
aauuaaagucuacacugccuu

SEQ ID NO: 1676541 - RNA, 16 nt, Homo sapiens
aauuaacaugucacaa

SEQ ID NO: 1676542 - RNA, 16 nt, Homo sapiens
aauuacaggaaguacu

SEQ ID NO: 1676543 - RNA, 22 nt, Homo sapiens
aauuacuguuugaaacuuuuca

SEQ ID NO: 1676544 - RNA, 18 nt, Homo sapiens
aauuauuuaacuaauuaa

SEQ ID NO: 1676545 - RNA, 15 nt, Homo sapiens
aauuccaaucauugu

SEQ ID NO: 1676546 - RNA, 12 nt, Homo sapiens
aauuccaugaau

SEQ ID NO: 1676547 - RNA, 13 nt, Homo sapiens
aauucccaauccc

SEQ ID NO: 1676548 - RNA, 20 nt, Homo sapiens
aauucuaugauuaaacuggg

SEQ ID NO: 1676549 - RNA, 19 nt, Homo sapiens
aauucuuaccucauuugca

SEQ ID NO: 1676550 - RNA, 21 nt, Homo sapiens
aauucuucucaaagauuugac

SEQ ID NO: 1676551 - RNA, 23 nt, Homo sapiens
aauugaagagagauauaucugaa

SEQ ID NO: 1676552 - RNA, 21 nt, Homo sapiens
aauugaccuuuagguauuaca

SEQ ID NO: 1676553 - RNA, 19 nt, Homo sapiens
aauugcuccauuccugagu

SEQ ID NO: 1676554 - RNA, 14 nt, Homo sapiens
aauuggacaauuau

SEQ ID NO: 1676555 - RNA, 20 nt, Homo sapiens
aauuguacccuucuugucuc

SEQ ID NO: 1676556 - RNA, 16 nt, Homo sapiens
aauuguauuacuuccu

SEQ ID NO: 1676557 - RNA, 17 nt, Homo sapiens
aauugugaagauuucau

SEQ ID NO: 1676558 - RNA, 15 nt, Homo sapiens
aauuuacaaaccucu

SEQ ID NO: 1676559 - RNA, 18 nt, Homo sapiens
aauuuaccaucaaacaaa

SEQ ID NO: 1676560 - RNA, 22 nt, Homo sapiens
aauuuaccaucaaacaaaucau

SEQ ID NO: 1676561 - RNA, 17 nt, Homo sapiens
aauuuaggaaugcucaa

SEQ ID NO: 1676562 - RNA, 20 nt, Homo sapiens
aauuuaggauggaauacuuc

SEQ ID NO: 1676563 - RNA, 16 nt, Homo sapiens
aauuuaugaagauagu

SEQ ID NO: 1676564 - RNA, 21 nt, Homo sapiens
aauuuccuuaaagcaagcuca

SEQ ID NO: 1676565 - RNA, 20 nt, Homo sapiens
aauuuuaauguuuacaacaa

SEQ ID NO: 1676566 - RNA, 13 nt, Homo sapiens
aauuuuaucucuu

SEQ ID NO: 1676567 - RNA, 18 nt, Homo sapiens
aauuuucacagccaugau

SEQ ID NO: 1676568 - RNA, 12 nt, Homo sapiens
aauuuugauuca

SEQ ID NO: 1676569 - RNA, 14 nt, Homo sapiens
aauuuugcuuuaau

SEQ ID NO: 1676570 - RNA, 21 nt, Homo sapiens
aauuuuguaguaguugaugac

SEQ ID NO: 1676571 - RNA, 18 nt, Homo sapiens
acaaaauauccaagccca

SEQ ID NO: 1676572 - RNA, 17 nt, Homo sapiens
acaaacaggugcuaaca

SEQ ID NO: 1676573 - RNA, 18 nt, Homo sapiens
acaaaccacaacugacac

SEQ ID NO: 1676574 - RNA, 13 nt, Homo sapiens
acaaacucaucca

SEQ ID NO: 1676575 - RNA, 22 nt, Homo sapiens
acaaacuucccugacucuucaa

SEQ ID NO: 1676576 - RNA, 14 nt, Homo sapiens
acaaagaaauauua

SEQ ID NO: 1676577 - RNA, 21 nt, Homo sapiens
acaaagcacuggccuugccuc

SEQ ID NO: 1676578 - RNA, 13 nt, Homo sapiens
acaaaucguccaa

SEQ ID NO: 1676579 - RNA, 22 nt, Homo sapiens
acaaaucguccaaagaucucaa

SEQ ID NO: 1676580 - RNA, 20 nt, Homo sapiens
acaaaugauuucgugacugu

SEQ ID NO: 1676581 - RNA, 18 nt, Homo sapiens
acaaaugggccugccaaa

SEQ ID NO: 1676582 - RNA, 17 nt, Homo sapiens
acaacagucagccagcu

SEQ ID NO: 1676583 - RNA, 15 nt, Homo sapiens
acaacaugcacauuc

SEQ ID NO: 1676584 - RNA, 20 nt, Homo sapiens
acaacgaacauggcauguga

SEQ ID NO: 1676585 - RNA, 17 nt, Homo sapiens
acaacuguuuuugaaga

SEQ ID NO: 1676586 - RNA, 21 nt, Homo sapiens
acaacuuucacuauaauguga

SEQ ID NO: 1676587 - RNA, 13 nt, Homo sapiens
acaagacuucaaa

SEQ ID NO: 1676588 - RNA, 13 nt, Homo sapiens
acaagauuguaaa

SEQ ID NO: 1676589 - RNA, 15 nt, Homo sapiens
acaagggcugaccug

SEQ ID NO: 1676590 - RNA, 21 nt, Homo sapiens
acaaguacaucuguacaugac

SEQ ID NO: 1676591 - RNA, 14 nt, Homo sapiens
acaaguucuuguug

SEQ ID NO: 1676592 - RNA, 21 nt, Homo sapiens
acaauaaaagaaacugugguc

SEQ ID NO: 1676593 - RNA, 13 nt, Homo sapiens
acaauaaagcaau

SEQ ID NO: 1676594 - RNA, 17 nt, Homo sapiens
acaauaaagcaaugugg

SEQ ID NO: 1676595 - RNA, 13 nt, Homo sapiens
acaauaagccacu

SEQ ID NO: 1676596 - RNA, 11 nt, Homo sapiens
acaaugugaua

SEQ ID NO: 1676597 - RNA, 14 nt, Homo sapiens
acacaaaacaaauc

SEQ ID NO: 1676598 - RNA, 12 nt, Homo sapiens
acacaaagugaa

SEQ ID NO: 1676599 - RNA, 14 nt, Homo sapiens
acacaacucaucca

SEQ ID NO: 1676600 - RNA, 18 nt, Homo sapiens
acacaauuggaagucuaa

SEQ ID NO: 1676601 - RNA, 17 nt, Homo sapiens
acacacaaauauugcuu

SEQ ID NO: 1676602 - RNA, 15 nt, Homo sapiens
acacacacacuuuug

SEQ ID NO: 1676603 - RNA, 14 nt, Homo sapiens
acacacauauacau

SEQ ID NO: 1676604 - RNA, 14 nt, Homo sapiens
acacaggaaaccaa

SEQ ID NO: 1676605 - RNA, 23 nt, Homo sapiens
acacaggaaaccaacacccaaag

SEQ ID NO: 1676606 - RNA, 18 nt, Homo sapiens
acacagugaccaagggaa

SEQ ID NO: 1676607 - RNA, 13 nt, Homo sapiens
acacagugcagua

SEQ ID NO: 1676608 - RNA, 18 nt, Homo sapiens
acacagugcaguacucag

SEQ ID NO: 1676609 - RNA, 18 nt, Homo sapiens
acacaguuuugucuucgu

SEQ ID NO: 1676610 - RNA, 13 nt, Homo sapiens
acacauaauaaag

SEQ ID NO: 1676611 - RNA, 13 nt, Homo sapiens
acacauacacaca

SEQ ID NO: 1676612 - RNA, 18 nt, Homo sapiens
acacauaguguuuguaac

SEQ ID NO: 1676613 - RNA, 20 nt, Homo sapiens
acacauaguguuuguaacac

SEQ ID NO: 1676614 - RNA, 18 nt, Homo sapiens
acacaugcucaucccaaa

SEQ ID NO: 1676615 - RNA, 21 nt, Homo sapiens
acaccaccacugugucccagu

SEQ ID NO: 1676616 - RNA, 17 nt, Homo sapiens
acaccacuugugagcug

SEQ ID NO: 1676617 - RNA, 23 nt, Homo sapiens
acaccacuuucccacacugugaa

SEQ ID NO: 1676618 - RNA, 18 nt, Homo sapiens
acaccagaguguaugcau

SEQ ID NO: 1676619 - RNA, 15 nt, Homo sapiens
acacccuuagccucc

SEQ ID NO: 1676620 - RNA, 23 nt, Homo sapiens
acacgcccccacaggcucugacc

SEQ ID NO: 1676621 - RNA, 15 nt, Homo sapiens
acacgggcucaagga

SEQ ID NO: 1676622 - RNA, 18 nt, Homo sapiens
acacuauuuuugauagca

SEQ ID NO: 1676623 - RNA, 13 nt, Homo sapiens
acacucaccauuu

SEQ ID NO: 1676624 - RNA, 20 nt, Homo sapiens
acacucaucccccaucagau

SEQ ID NO: 1676625 - RNA, 17 nt, Homo sapiens
acacuccaguuugccca

SEQ ID NO: 1676626 - RNA, 20 nt, Homo sapiens
acacucucuucuuacuguau

SEQ ID NO: 1676627 - RNA, 15 nt, Homo sapiens
acacucuugguagaa

SEQ ID NO: 1676628 - RNA, 18 nt, Homo sapiens
acacugaguuugaacaca

SEQ ID NO: 1676629 - RNA, 13 nt, Homo sapiens
acacugcuuguga

SEQ ID NO: 1676630 - RNA, 23 nt, Homo sapiens
acacuggcuuuggguagugccau

SEQ ID NO: 1676631 - RNA, 11 nt, Homo sapiens
acacugugaac

SEQ ID NO: 1676632 - RNA, 14 nt, Homo sapiens
acacuuagggaaaa

SEQ ID NO: 1676633 - RNA, 22 nt, Homo sapiens
acacuuaucugucucuucuaca

SEQ ID NO: 1676634 - RNA, 16 nt, Homo sapiens
acacuugggagcaaaa

SEQ ID NO: 1676635 - RNA, 23 nt, Homo sapiens
acacuugggauugucuuacuguu

SEQ ID NO: 1676636 - RNA, 23 nt, Homo sapiens
acagaaauccacgcucaaucuca

SEQ ID NO: 1676637 - RNA, 21 nt, Homo sapiens
acagaacaacaacaaagcaug

SEQ ID NO: 1676638 - RNA, 12 nt, Homo sapiens
acagacaaagcg

SEQ ID NO: 1676639 - RNA, 15 nt, Homo sapiens
acagaccuccagauu

SEQ ID NO: 1676640 - RNA, 20 nt, Homo sapiens
acagaggacggcuuccccau

SEQ ID NO: 1676641 - RNA, 17 nt, Homo sapiens
acagaguggaucuggag

SEQ ID NO: 1676642 - RNA, 21 nt, Homo sapiens
agacgggguuucacuguguua

SEQ ID NO: 1676643 - RNA, 12 nt, Homo sapiens
agacguggugcu

SEQ ID NO: 1676644 - RNA, 21 nt, Homo sapiens
agacuaugugucaugauuuca

SEQ ID NO: 1676645 - RNA, 17 nt, Homo sapiens
agacucacgcugacugc

SEQ ID NO: 1676646 - RNA, 15 nt, Homo sapiens
agacugguauucucu

SEQ ID NO: 1676647 - RNA, 22 nt, Homo sapiens
agacuuaagcguacaaagugau

SEQ ID NO: 1676648 - RNA, 18 nt, Homo sapiens
agagaaauaaaacuccuu

SEQ ID NO: 1676649 - RNA, 14 nt, Homo sapiens
agagaaaugagcug

SEQ ID NO: 1676650 - RNA, 13 nt, Homo sapiens
agagaagcugaug

SEQ ID NO: 1676651 - RNA, 14 nt, Homo sapiens
agagaccacaagca

SEQ ID NO: 1676652 - RNA, 17 nt, Homo sapiens
agagaccuccugauguc

SEQ ID NO: 1676653 - RNA, 17 nt, Homo sapiens
agagacgaagaccccag

SEQ ID NO: 1676654 - RNA, 15 nt, Homo sapiens
agagacuauggagcc

SEQ ID NO: 1676655 - RNA, 14 nt, Homo sapiens
agagagaaacagcu

SEQ ID NO: 1676656 - RNA, 21 nt, Homo sapiens
agagagggaggcacguaggaa

SEQ ID NO: 1676657 - RNA, 21 nt, Homo sapiens
agagauggcagagccauccac

SEQ ID NO: 1676658 - RNA, 23 nt, Homo sapiens
agagcaaucuugcugugaaacag

SEQ ID NO: 1676659 - RNA, 13 nt, Homo sapiens
agagcaggaaaug

SEQ ID NO: 1676660 - RNA, 21 nt, Homo sapiens
agagcauucugggguggggcu

SEQ ID NO: 1676661 - RNA, 12 nt, Homo sapiens
agagccacagaa

SEQ ID NO: 1676662 - RNA, 20 nt, Homo sapiens
agagccuauggaaagggugu

SEQ ID NO: 1676663 - RNA, 21 nt, Homo sapiens
agagcggcuuccccauugccu

SEQ ID NO: 1676664 - RNA, 14 nt, Homo sapiens
agagcuagaugugu

SEQ ID NO: 1676665 - RNA, 14 nt, Homo sapiens
agagcuaugcacac

SEQ ID NO: 1676666 - RNA, 17 nt, Homo sapiens
agagcugaaaauggaga

SEQ ID NO: 1676667 - RNA, 15 nt, Homo sapiens
agagcugucuugucg

SEQ ID NO: 1676668 - RNA, 20 nt, Homo sapiens
agaggaaaaaggcuucucca

SEQ ID NO: 1676669 - RNA, 19 nt, Homo sapiens
agaggaauaagaauggagc

SEQ ID NO: 1676670 - RNA, 13 nt, Homo sapiens
agaggccaugaag

SEQ ID NO: 1676671 - RNA, 19 nt, Homo sapiens
agaggcucuaauguacaau

SEQ ID NO: 1676672 - RNA, 11 nt, Homo sapiens
agagggacaac

SEQ ID NO: 1676673 - RNA, 20 nt, Homo sapiens
agagguuucagcauucccaa

SEQ ID NO: 1676674 - RNA, 15 nt, Homo sapiens
agaguaaaucccacg

SEQ ID NO: 1676675 - RNA, 14 nt, Homo sapiens
agaguaucugagaa

SEQ ID NO: 1676676 - RNA, 15 nt, Homo sapiens
agaguaugugagaac

SEQ ID NO: 1676677 - RNA, 15 nt, Homo sapiens
agagucauuguuaca

SEQ ID NO: 1676678 - RNA, 18 nt, Homo sapiens
agaguccaagaagccagc

SEQ ID NO: 1676679 - RNA, 18 nt, Homo sapiens
agagucuuugauucacca

SEQ ID NO: 1676680 - RNA, 22 nt, Homo sapiens
agaguguggggaaugggaagaa

SEQ ID NO: 1676681 - RNA, 15 nt, Homo sapiens
agaguguuuaacuga

SEQ ID NO: 1676682 - RNA, 22 nt, Homo sapiens
agaguuauuuuguguccuuuaa

SEQ ID NO: 1676683 - RNA, 21 nt, Homo sapiens
agaguucuccuuguacuugaa

SEQ ID NO: 1676684 - RNA, 15 nt, Homo sapiens
agaguuuacagacaa

SEQ ID NO: 1676685 - RNA, 12 nt, Homo sapiens
agauaaauccaa

SEQ ID NO: 1676686 - RNA, 12 nt, Homo sapiens
agauaaccaagu

SEQ ID NO: 1676687 - RNA, 19 nt, Homo sapiens
agauaagugcucaguauug

SEQ ID NO: 1676688 - RNA, 13 nt, Homo sapiens
agauaauguugcu

SEQ ID NO: 1676689 - RNA, 19 nt, Homo sapiens
agauagccaaggccaaagg

SEQ ID NO: 1676690 - RNA, 20 nt, Homo sapiens
agauagccaaggccaaagga

SEQ ID NO: 1676691 - RNA, 17 nt, Homo sapiens
agauagcuuagugucuc

SEQ ID NO: 1676692 - RNA, 18 nt, Homo sapiens
agaucaacagaccuaaga

SEQ ID NO: 1676693 - RNA, 14 nt, Homo sapiens
agaucaacucuguc

SEQ ID NO: 1676694 - RNA, 17 nt, Homo sapiens
agaucaguagugcuauc

SEQ ID NO: 1676695 - RNA, 21 nt, Homo sapiens
agaucaucuccaaaucuugcc

SEQ ID NO: 1676696 - RNA, 20 nt, Homo sapiens
agauccauuuaaaacaagcu

SEQ ID NO: 1676697 - RNA, 19 nt, Homo sapiens
agauccccccacaaagugg

SEQ ID NO: 1676698 - RNA, 21 nt, Homo sapiens
agauccugucuugcugaggga

SEQ ID NO: 1676699 - RNA, 15 nt, Homo sapiens
agaucugaaguagug

SEQ ID NO: 1676700 - RNA, 19 nt, Homo sapiens
agaugacuggaaacaagga

SEQ ID NO: 1676701 - RNA, 20 nt, Homo sapiens
agaugagaaaacaggcucac

SEQ ID NO: 1676702 - RNA, 22 nt, Homo sapiens
agaugagaaaacaggcucacag

SEQ ID NO: 1676703 - RNA, 23 nt, Homo sapiens
agaugauaaucccauacucucaa

SEQ ID NO: 1676704 - RNA, 13 nt, Homo sapiens
agaugccuuccag

SEQ ID NO: 1676705 - RNA, 13 nt, Homo sapiens
agauggccaugua

SEQ ID NO: 1676706 - RNA, 12 nt, Homo sapiens
agaugggggccu

SEQ ID NO: 1676707 - RNA, 21 nt, Homo sapiens
agauguagcaaauuccaauac

SEQ ID NO: 1676708 - RNA, 19 nt, Homo sapiens
agauguccucagaagucag

SEQ ID NO: 1676709 - RNA, 16 nt, Homo sapiens
agaugugccuagacac

SEQ ID NO: 1676710 - RNA, 12 nt, Homo sapiens
agauuccaccua

SEQ ID NO: 1676711 - RNA, 19 nt, Homo sapiens
agauugguaguuaucugag

SEQ ID NO: 1676712 - RNA, 19 nt, Homo sapiens
agauuuucauguucuugca

SEQ ID NO: 1676713 - RNA, 21 nt, Homo sapiens
agcaaaagugcaguaguguca

SEQ ID NO: 1676714 - RNA, 20 nt, Homo sapiens
agcaaagcaugccaauuucu

SEQ ID NO: 1676715 - RNA, 14 nt, Homo sapiens
agcaaaggucacca

SEQ ID NO: 1676716 - RNA, 15 nt, Homo sapiens
agcaaaguaguacuu

SEQ ID NO: 1676717 - RNA, 17 nt, Homo sapiens
agcaaaugggagaaaua

SEQ ID NO: 1676718 - RNA, 15 nt, Homo sapiens
agcaaauuccaauac

SEQ ID NO: 1676719 - RNA, 22 nt, Homo sapiens
agcaacuggugacugucccuuc

SEQ ID NO: 1676720 - RNA, 18 nt, Homo sapiens
agcaagaccccaucucaa

SEQ ID NO: 1676721 - RNA, 13 nt, Homo sapiens
agcaagcaaaaug

SEQ ID NO: 1676722 - RNA, 15 nt, Homo sapiens
agcaagcucacuugc

SEQ ID NO: 1676723 - RNA, 15 nt, Homo sapiens
agcaaggagaaggca

SEQ ID NO: 1676724 - RNA, 13 nt, Homo sapiens
agcaaggcugcua

SEQ ID NO: 1676725 - RNA, 17 nt, Homo sapiens
agcaagucuuaguacau

SEQ ID NO: 1676726 - RNA, 23 nt, Homo sapiens
agcaagucuuaguacauccucac

SEQ ID NO: 1676727 - RNA, 21 nt, Homo sapiens
agcaauuuuuccaaaagccag

SEQ ID NO: 1676728 - RNA, 15 nt, Homo sapiens
agcacacauccaaga

SEQ ID NO: 1676729 - RNA, 17 nt, Homo sapiens
agcacacuugacaucaa

SEQ ID NO: 1676730 - RNA, 23 nt, Homo sapiens
agcacagaggauggcuuccccau

SEQ ID NO: 1676731 - RNA, 16 nt, Homo sapiens
agcacagaucucuaga

SEQ ID NO: 1676732 - RNA, 15 nt, Homo sapiens
agcacagcuuuccug

SEQ ID NO: 1676733 - RNA, 14 nt, Homo sapiens
agcacaguauuuaa

SEQ ID NO: 1676734 - RNA, 15 nt, Homo sapiens
agcacaucucuucau

SEQ ID NO: 1676735 - RNA, 14 nt, Homo sapiens
agcaccagccugag

SEQ ID NO: 1676736 - RNA, 19 nt, Homo sapiens
agcacccguugaguccuuu

SEQ ID NO: 1676737 - RNA, 14 nt, Homo sapiens
agcaccucuugaag

SEQ ID NO: 1676738 - RNA, 15 nt, Homo sapiens
agcacugcuccagug

SEQ ID NO: 1676739 - RNA, 22 nt, Homo sapiens
agcacuucaaaggaacuggaau

SEQ ID NO: 1676740 - RNA, 23 nt, Homo sapiens
agcagagcugauggagaaggaag

SEQ ID NO: 1676741 - RNA, 14 nt, Homo sapiens
agcagagguuggga

SEQ ID NO: 1676742 - RNA, 21 nt, Homo sapiens
agcagcaaaggucaccaggcu

SEQ ID NO: 1676743 - RNA, 16 nt, Homo sapiens
agcagcaccucagcca

SEQ ID NO: 1676744 - RNA, 16 nt, Homo sapiens
agcagcuggguuggua

SEQ ID NO: 1676745 - RNA, 15 nt, Homo sapiens
agcaggcucucaggc

SEQ ID NO: 1676746 - RNA, 18 nt, Homo sapiens
agcaggcucucaggccag

SEQ ID NO: 1676747 - RNA, 18 nt, Homo sapiens
agcagggugaagagucca

SEQ ID NO: 1676748 - RNA, 22 nt, Homo sapiens
agcagggugaagaguccaagaa

SEQ ID NO: 1676749 - RNA, 21 nt, Homo sapiens
agcagguguuuuccuucacaa

SEQ ID NO: 1676750 - RNA, 21 nt, Homo sapiens
agcaguguccugugcuuucug

SEQ ID NO: 1676751 - RNA, 17 nt, Homo sapiens
agcauaguucugcaaua

SEQ ID NO: 1676752 - RNA, 21 nt, Homo sapiens
agcauccacucucccuugucc

SEQ ID NO: 1676753 - RNA, 14 nt, Homo sapiens
agcaugauugugac

SEQ ID NO: 1676754 - RNA, 23 nt, Homo sapiens
agcaugcucaguuggugcugcuu

SEQ ID NO: 1676755 - RNA, 21 nt, Homo sapiens
agcauggccgcaacuucccag

SEQ ID NO: 1676756 - RNA, 22 nt, Homo sapiens
agcauguguuaaucuuaaugua

SEQ ID NO: 1676757 - RNA, 21 nt, Homo sapiens
agcauugggaggaagcacaga

SEQ ID NO: 1676758 - RNA, 15 nt, Homo sapiens
agcauuuagacucuc

SEQ ID NO: 1676759 - RNA, 23 nt, Homo sapiens
agccaaguucacaccacugccau

SEQ ID NO: 1676760 - RNA, 16 nt, Homo sapiens
agccaauauaaugggc

SEQ ID NO: 1676761 - RNA, 17 nt, Homo sapiens
agccaauggugcacauu

SEQ ID NO: 1676762 - RNA, 17 nt, Homo sapiens
agccacaauaagccacu

SEQ ID NO: 1676763 - RNA, 21 nt, Homo sapiens
agccacaguggggcccauggc

SEQ ID NO: 1676764 - RNA, 10 nt, Homo sapiens
ccuccagacc

SEQ ID NO: 1676765 - RNA, 14 nt, Homo sapiens
ccuccccauggugc

SEQ ID NO: 1676766 - RNA, 22 nt, Homo sapiens
ccuccccccacaagaacucccu

SEQ ID NO: 1676767 - RNA, 17 nt, Homo sapiens
ccucccugcagcuuuga

SEQ ID NO: 1676768 - RNA, 15 nt, Homo sapiens
ccuccuaaauuucca

SEQ ID NO: 1676769 - RNA, 14 nt, Homo sapiens
ccuccuccaugcug

SEQ ID NO: 1676770 - RNA, 18 nt, Homo sapiens
ccuccuggcucacagcca

SEQ ID NO: 1676771 - RNA, 18 nt, Homo sapiens
ccuccugggugccagucc

SEQ ID NO: 1676772 - RNA, 14 nt, Homo sapiens
ccucuacaggcauu

SEQ ID NO: 1676773 - RNA, 17 nt, Homo sapiens
ccucuacaggcauuuaa

SEQ ID NO: 1676774 - RNA, 14 nt, Homo sapiens
ccucuacuugggag

SEQ ID NO: 1676775 - RNA, 20 nt, Homo sapiens
ccucucccaaguccagugug

SEQ ID NO: 1676776 - RNA, 21 nt, Homo sapiens
ccucucuggcacuuugaguua

SEQ ID NO: 1676777 - RNA, 17 nt, Homo sapiens
ccucucuguuuacccuc

SEQ ID NO: 1676778 - RNA, 13 nt, Homo sapiens
ccucuuaccugua

SEQ ID NO: 1676779 - RNA, 12 nt, Homo sapiens
ccucuuaggcag

SEQ ID NO: 1676780 - RNA, 16 nt, Homo sapiens
ccugaaaacuuuagca

SEQ ID NO: 1676781 - RNA, 18 nt, Homo sapiens
ccugaaaaggguguugcu

SEQ ID NO: 1676782 - RNA, 22 nt, Homo sapiens
ccugaagucuuuguacagacaa

SEQ ID NO: 1676783 - RNA, 17 nt, Homo sapiens
ccugaaucagaggcaga

SEQ ID NO: 1676784 - RNA, 19 nt, Homo sapiens
ccugaauuaaagucuacac

SEQ ID NO: 1676785 - RNA, 19 nt, Homo sapiens
ccugacauucacacagaga

SEQ ID NO: 1676786 - RNA, 22 nt, Homo sapiens
ccugacuguccuacaauaucau

SEQ ID NO: 1676787 - RNA, 15 nt, Homo sapiens
ccugagaagagucga

SEQ ID NO: 1676788 - RNA, 16 nt, Homo sapiens
ccugagccugucucuc

SEQ ID NO: 1676789 - RNA, 21 nt, Homo sapiens
ccugagcgaugggcaucacac

SEQ ID NO: 1676790 - RNA, 12 nt, Homo sapiens
ccugagugucca

SEQ ID NO: 1676791 - RNA, 23 nt, Homo sapiens
ccugaucaaggugcucuucucau

SEQ ID NO: 1676792 - RNA, 12 nt, Homo sapiens
ccugauggccag

SEQ ID NO: 1676793 - RNA, 22 nt, Homo sapiens
ccugcaaccucggggagugcca

SEQ ID NO: 1676794 - RNA, 22 nt, Homo sapiens
ccugcagagccaauggugcaca

SEQ ID NO: 1676795 - RNA, 17 nt, Homo sapiens
ccugcagggaucauagc

SEQ ID NO: 1676796 - RNA, 16 nt, Homo sapiens
ccugcaucaucuugaa

SEQ ID NO: 1676797 - RNA, 15 nt, Homo sapiens
ccugccaggaagcca

SEQ ID NO: 1676798 - RNA, 15 nt, Homo sapiens
ccugcccaugugucc

SEQ ID NO: 1676799 - RNA, 14 nt, Homo sapiens
ccugcccuccccca

SEQ ID NO: 1676800 - RNA, 21 nt, Homo sapiens
ccugcccuuaccugccaggaa

SEQ ID NO: 1676801 - RNA, 20 nt, Homo sapiens
ccugcuagucugucagggcc

SEQ ID NO: 1676802 - RNA, 21 nt, Homo sapiens
ccugcucacccgccucuugcc

SEQ ID NO: 1676803 - RNA, 16 nt, Homo sapiens
ccugcucccuagccag

SEQ ID NO: 1676804 - RNA, 22 nt, Homo sapiens
ccugcuugcuggaaaacugcca

SEQ ID NO: 1676805 - RNA, 14 nt, Homo sapiens
ccuggaaggcagcu

SEQ ID NO: 1676806 - RNA, 22 nt, Homo sapiens
ccuggagaguaucugagaacca

SEQ ID NO: 1676807 - RNA, 14 nt, Homo sapiens
ccuggauguuauau

SEQ ID NO: 1676808 - RNA, 13 nt, Homo sapiens
ccuggcaaucugu

SEQ ID NO: 1676809 - RNA, 16 nt, Homo sapiens
ccuggccaaaaugcag

SEQ ID NO: 1676810 - RNA, 13 nt, Homo sapiens
ccuggcccagugc

SEQ ID NO: 1676811 - RNA, 17 nt, Homo sapiens
ccuggcccagugcaauc

SEQ ID NO: 1676812 - RNA, 22 nt, Homo sapiens
ccuggcugagugcgaccaccac

SEQ ID NO: 1676813 - RNA, 15 nt, Homo sapiens
ccuggcuucugggac

SEQ ID NO: 1676814 - RNA, 23 nt, Homo sapiens
ccugggcugucugucaccagcua

SEQ ID NO: 1676815 - RNA, 22 nt, Homo sapiens
ccugggcuuggugcguuucaaa

SEQ ID NO: 1676816 - RNA, 17 nt, Homo sapiens
ccugggggcugcugcac

SEQ ID NO: 1676817 - RNA, 18 nt, Homo sapiens
ccuggguaacaaagugag

SEQ ID NO: 1676818 - RNA, 18 nt, Homo sapiens
ccugggugcugucaugcc

SEQ ID NO: 1676819 - RNA, 15 nt, Homo sapiens
ccuggugaaagagua

SEQ ID NO: 1676820 - RNA, 18 nt, Homo sapiens
ccuguaggucuaugaugu

SEQ ID NO: 1676821 - RNA, 20 nt, Homo sapiens
ccuguaggucuaugaugucc

SEQ ID NO: 1676822 - RNA, 21 nt, Homo sapiens
ccugugggaguccacuuuccu

SEQ ID NO: 1676823 - RNA, 17 nt, Homo sapiens
ccugugucugguccaca

SEQ ID NO: 1676824 - RNA, 20 nt, Homo sapiens
ccuguuaggggaaaauagua

SEQ ID NO: 1676825 - RNA, 22 nt, Homo sapiens
ccuguucauuguaagcacuuuu

SEQ ID NO: 1676826 - RNA, 16 nt, Homo sapiens
ccuguuccugacuguu

SEQ ID NO: 1676827 - RNA, 24 nt, Homo sapiens
ccuguuuuaaaaaauacaguauua

SEQ ID NO: 1676828 - RNA, 20 nt, Homo sapiens
ccuuaacuggcccucgggcc

SEQ ID NO: 1676829 - RNA, 18 nt, Homo sapiens
ccuuaaguauaacuaauu

SEQ ID NO: 1676830 - RNA, 15 nt, Homo sapiens
ccuuaccaagggaag

SEQ ID NO: 1676831 - RNA, 12 nt, Homo sapiens
ccuuacccaaac

SEQ ID NO: 1676832 - RNA, 16 nt, Homo sapiens
ccuuagaauacuguau

SEQ ID NO: 1676833 - RNA, 17 nt, Homo sapiens
ccuuagcuuaaugacuu

SEQ ID NO: 1676834 - RNA, 23 nt, Homo sapiens
ccuuccccacaauaggcuuagug

SEQ ID NO: 1676835 - RNA, 22 nt, Homo sapiens
ccuucucagccuugguuccuga

SEQ ID NO: 1676836 - RNA, 19 nt, Homo sapiens
ccuucuccccucagccaau

SEQ ID NO: 1676837 - RNA, 15 nt, Homo sapiens
ccuucuccugcauug

SEQ ID NO: 1676838 - RNA, 21 nt, Homo sapiens
ccuucuggccgcugcagucag

SEQ ID NO: 1676839 - RNA, 16 nt, Homo sapiens
ccuucuugcucagucc

SEQ ID NO: 1676840 - RNA, 12 nt, Homo sapiens
ccuugaccuucc

SEQ ID NO: 1676841 - RNA, 15 nt, Homo sapiens
ccuugcuuucucuuc

SEQ ID NO: 1676842 - RNA, 22 nt, Homo sapiens
ccuugggcgggccauuucacau

SEQ ID NO: 1676843 - RNA, 15 nt, Homo sapiens
ccuuguaaaagccua

SEQ ID NO: 1676844 - RNA, 14 nt, Homo sapiens
ccuuguaaugccac

SEQ ID NO: 1676845 - RNA, 20 nt, Homo sapiens
ccuugugaaguaggugaucu

SEQ ID NO: 1676846 - RNA, 19 nt, Homo sapiens
ccuuguugaugaagcacau

SEQ ID NO: 1676847 - RNA, 14 nt, Homo sapiens
ccuuguuguauucc

SEQ ID NO: 1676848 - RNA, 14 nt, Homo sapiens
ccuuuagaauauua

SEQ ID NO: 1676849 - RNA, 16 nt, Homo sapiens
ccuuuccccucucaua

SEQ ID NO: 1676850 - RNA, 23 nt, Homo sapiens
ccuuucugaggaguaaaaagacu

SEQ ID NO: 1676851 - RNA, 23 nt, Homo sapiens
ccuuugagugucaggcucugaau

SEQ ID NO: 1676852 - RNA, 15 nt, Homo sapiens
ccuuugcaaugcaag

SEQ ID NO: 1676853 - RNA, 15 nt, Homo sapiens
ccuuuguacugauga

SEQ ID NO: 1676854 - RNA, 20 nt, Homo sapiens
ccuuuugacagcugugcugu

SEQ ID NO: 1676855 - RNA, 19 nt, Homo sapiens
ccuuuuggguuugccuuaa

SEQ ID NO: 1676856 - RNA, 17 nt, Homo sapiens
cgaaaaccacaaaaaga

SEQ ID NO: 1676857 - RNA, 22 nt, Homo sapiens
cgaaaguaauggggaagauuag

SEQ ID NO: 1676858 - RNA, 21 nt, Homo sapiens
cgaacgcugcuccaugcacag

SEQ ID NO: 1676859 - RNA, 17 nt, Homo sapiens
cgaagccaguccagaag

SEQ ID NO: 1676860 - RNA, 15 nt, Homo sapiens
cgacuuucucagcag

SEQ ID NO: 1676861 - RNA, 20 nt, Homo sapiens
cgacuuucuuuaacauauca

SEQ ID NO: 1676862 - RNA, 21 nt, Homo sapiens
cgaggcggcaaagauccagcg

SEQ ID NO: 1676863 - RNA, 17 nt, Homo sapiens
cgaguuccggaaagccu

SEQ ID NO: 1676864 - RNA, 19 nt, Homo sapiens
cgaguuccggaaagccuuc

SEQ ID NO: 1676865 - RNA, 15 nt, Homo sapiens
cgauauaagccauag

SEQ ID NO: 1676866 - RNA, 20 nt, Homo sapiens
cgaucucagcucacugcaag

SEQ ID NO: 1676867 - RNA, 20 nt, Homo sapiens
cgcaaauacaugccuuucca

SEQ ID NO: 1676868 - RNA, 14 nt, Homo sapiens
cgcagacgcaagag

SEQ ID NO: 1676869 - RNA, 19 nt, Homo sapiens
cgccaaguuggagugcaau

SEQ ID NO: 1676870 - RNA, 16 nt, Homo sapiens
cgcccccccuaucucu

SEQ ID NO: 1676871 - RNA, 15 nt, Homo sapiens
cgccccggacugccu

SEQ ID NO: 1676872 - RNA, 13 nt, Homo sapiens
cgccucuugcccc

SEQ ID NO: 1676873 - RNA, 16 nt, Homo sapiens
cgccuggguccuccca

SEQ ID NO: 1676874 - RNA, 11 nt, Homo sapiens
cgcgaucucag

SEQ ID NO: 1676875 - RNA, 18 nt, Homo sapiens
cgcugggagaaaagccag

SEQ ID NO: 1676876 - RNA, 13 nt, Homo sapiens
cggccucagucuc

SEQ ID NO: 1676877 - RNA, 13 nt, Homo sapiens
cggcuccacuaca

SEQ ID NO: 1676878 - RNA, 21 nt, Homo sapiens
cgggagaagaaguuugaccau

SEQ ID NO: 1676879 - RNA, 14 nt, Homo sapiens
cgggccuccccggg

SEQ ID NO: 1676880 - RNA, 20 nt, Homo sapiens
cgggcuuggggcuggccaau

SEQ ID NO: 1676881 - RNA, 14 nt, Homo sapiens
cgggguguggaauc

SEQ ID NO: 1676882 - RNA, 17 nt, Homo sapiens
cggguucucccaugauu

SEQ ID NO: 1676883 - RNA, 21 nt, Homo sapiens
cgguccuguguuccugugauc

SEQ ID NO: 1676884 - RNA, 23 nt, Homo sapiens
cggucugagaagauucaauuuaa

SEQ ID NO: 1676885 - RNA, 18 nt, Homo sapiens
cgguugguaccaugcuaa

SEQ ID NO: 1676886 - RNA, 15 nt, Homo sapiens
cuuaagaugcaaauc

SEQ ID NO: 1676887 - RNA, 21 nt, Homo sapiens
cuuaagcacacuugacaucaa

SEQ ID NO: 1676888 - RNA, 11 nt, Homo sapiens
cuuaauuaccu

SEQ ID NO: 1676889 - RNA, 20 nt, Homo sapiens
cuuaauuaccuaagagccac

SEQ ID NO: 1676890 - RNA, 19 nt, Homo sapiens
cuuaauucccaaucccauu

SEQ ID NO: 1676891 - RNA, 22 nt, Homo sapiens
cuuaauucccaaucccauuccu

SEQ ID NO: 1676892 - RNA, 22 nt, Homo sapiens
cuuaauucuuaccucauuugca

SEQ ID NO: 1676893 - RNA, 21 nt, Homo sapiens
cuuaccagaucuaauauugac

SEQ ID NO: 1676894 - RNA, 13 nt, Homo sapiens
cuuacccuucaau

SEQ ID NO: 1676895 - RNA, 16 nt, Homo sapiens
cuuaccugccagauaa

SEQ ID NO: 1676896 - RNA, 21 nt, Homo sapiens
cuuaccugccaggaagccagc

SEQ ID NO: 1676897 - RNA, 22 nt, Homo sapiens
cuuagagcacuagaagcacagg

SEQ ID NO: 1676898 - RNA, 16 nt, Homo sapiens
cuuagaucaggagaaa

SEQ ID NO: 1676899 - RNA, 21 nt, Homo sapiens
cuuagccaucagaugaggcuc

SEQ ID NO: 1676900 - RNA, 21 nt, Homo sapiens
cuuagccccagggcacucaga

SEQ ID NO: 1676901 - RNA, 20 nt, Homo sapiens
cuuagcguucuguuucacca

SEQ ID NO: 1676902 - RNA, 22 nt, Homo sapiens
cuuagcuuuucugcaauucaac

SEQ ID NO: 1676903 - RNA, 14 nt, Homo sapiens
cuuagucauaccau

SEQ ID NO: 1676904 - RNA, 18 nt, Homo sapiens
cuuauaauauacauaacu

SEQ ID NO: 1676905 - RNA, 14 nt, Homo sapiens
cuuauagagcacaa

SEQ ID NO: 1676906 - RNA, 17 nt, Homo sapiens
cuuauauacuaauauca

SEQ ID NO: 1676907 - RNA, 18 nt, Homo sapiens
cuuaugagauacuuugca

SEQ ID NO: 1676908 - RNA, 14 nt, Homo sapiens
cuuauggaacugag

SEQ ID NO: 1676909 - RNA, 21 nt, Homo sapiens
cuuauuuaacaagcaagcaaa

SEQ ID NO: 1676910 - RNA, 18 nt, Homo sapiens
cuuauuucagauucaccu

SEQ ID NO: 1676911 - RNA, 14 nt, Homo sapiens
cuuauuuccaugga

SEQ ID NO: 1676912 - RNA, 23 nt, Homo sapiens
cuuauuuugauuguuugaugaau

SEQ ID NO: 1676913 - RNA, 15 nt, Homo sapiens
cuucaaacgaaaugg

SEQ ID NO: 1676914 - RNA, 18 nt, Homo sapiens
cuucaaaguuuucugcug

SEQ ID NO: 1676915 - RNA, 22 nt, Homo sapiens
cuucaaaguuuucugcuguaaa

SEQ ID NO: 1676916 - RNA, 17 nt, Homo sapiens
cuucaaccccaugagac

SEQ ID NO: 1676917 - RNA, 18 nt, Homo sapiens
cuucaccuccuucugcag

SEQ ID NO: 1676918 - RNA, 14 nt, Homo sapiens
cuucauauaugcuu

SEQ ID NO: 1676919 - RNA, 13 nt, Homo sapiens
cuucauccacuga

SEQ ID NO: 1676920 - RNA, 14 nt, Homo sapiens
cuucaucuggaguc

SEQ ID NO: 1676921 - RNA, 22 nt, Homo sapiens
cuucaugcgcaguccccaggua

SEQ ID NO: 1676922 - RNA, 13 nt, Homo sapiens
cuuccaaaagccu

SEQ ID NO: 1676923 - RNA, 14 nt, Homo sapiens
cuuccaacauguga

SEQ ID NO: 1676924 - RNA, 13 nt, Homo sapiens
cuuccacugccuc

SEQ ID NO: 1676925 - RNA, 12 nt, Homo sapiens
cuuccauggugg

SEQ ID NO: 1676926 - RNA, 20 nt, Homo sapiens
cuucccaaaguccugggauu

SEQ ID NO: 1676927 - RNA, 21 nt, Homo sapiens
cuucccaaaguccugggauua

SEQ ID NO: 1676928 - RNA, 13 nt, Homo sapiens
cuucccacagugg

SEQ ID NO: 1676929 - RNA, 21 nt, Homo sapiens
cuuccccaucgccuucugggg

SEQ ID NO: 1676930 - RNA, 14 nt, Homo sapiens
cuucccuaguucuu

SEQ ID NO: 1676931 - RNA, 15 nt, Homo sapiens
cuucccugacacugu

SEQ ID NO: 1676932 - RNA, 18 nt, Homo sapiens
cuucccuggugauggucu

SEQ ID NO: 1676933 - RNA, 13 nt, Homo sapiens
cuuccgugagaca

SEQ ID NO: 1676934 - RNA, 16 nt, Homo sapiens
cuuccgugagacacaa

SEQ ID NO: 1676935 - RNA, 13 nt, Homo sapiens
cuuccuaccaaau

SEQ ID NO: 1676936 - RNA, 14 nt, Homo sapiens
cuuccuaccaaaua

SEQ ID NO: 1676937 - RNA, 14 nt, Homo sapiens
cuuccucaugaauc

SEQ ID NO: 1676938 - RNA, 19 nt, Homo sapiens
cuuccucuaaacuucucac

SEQ ID NO: 1676939 - RNA, 23 nt, Homo sapiens
cuuccucucuuuugcucauccac

SEQ ID NO: 1676940 - RNA, 17 nt, Homo sapiens
cuuccuucucaucuugc

SEQ ID NO: 1676941 - RNA, 16 nt, Homo sapiens
cuucuacaauuguggu

SEQ ID NO: 1676942 - RNA, 14 nt, Homo sapiens
cuucuaccagagau

SEQ ID NO: 1676943 - RNA, 17 nt, Homo sapiens
cuucuaccuuccugcaa

SEQ ID NO: 1676944 - RNA, 15 nt, Homo sapiens
cuucuaguggguuua

SEQ ID NO: 1676945 - RNA, 20 nt, Homo sapiens
cuucuauuuauuuauuauua

SEQ ID NO: 1676946 - RNA, 13 nt, Homo sapiens
cuucucacacugg

SEQ ID NO: 1676947 - RNA, 16 nt, Homo sapiens
cuucucacacuggagg

SEQ ID NO: 1676948 - RNA, 14 nt, Homo sapiens
cuucuccacaggga

SEQ ID NO: 1676949 - RNA, 20 nt, Homo sapiens
cuucucccccucagcucucc

SEQ ID NO: 1676950 - RNA, 18 nt, Homo sapiens
cuucucccgccauuggcc

SEQ ID NO: 1676951 - RNA, 17 nt, Homo sapiens
cuucucugggucuggca

SEQ ID NO: 1676952 - RNA, 20 nt, Homo sapiens
cuucuuaaggacaguguuca

SEQ ID NO: 1676953 - RNA, 17 nt, Homo sapiens
cuucuucauccauagac

SEQ ID NO: 1676954 - RNA, 22 nt, Homo sapiens
cuucuuccccccaaaacugauu

SEQ ID NO: 1676955 - RNA, 19 nt, Homo sapiens
cuucuuccccccgcuguca

SEQ ID NO: 1676956 - RNA, 17 nt, Homo sapiens
cuucuugagcugaccca

SEQ ID NO: 1676957 - RNA, 18 nt, Homo sapiens
cuucuugaugaugguggu

SEQ ID NO: 1676958 - RNA, 15 nt, Homo sapiens
cuucuugcucagucc

SEQ ID NO: 1676959 - RNA, 18 nt, Homo sapiens
cuucuugggggcagacca

SEQ ID NO: 1676960 - RNA, 19 nt, Homo sapiens
cuucuuuacuaacacuggc

SEQ ID NO: 1676961 - RNA, 16 nt, Homo sapiens
cuugaaauuauaucug

SEQ ID NO: 1676962 - RNA, 15 nt, Homo sapiens
cuugaaauuucucag

SEQ ID NO: 1676963 - RNA, 13 nt, Homo sapiens
cuugaacccugag

SEQ ID NO: 1676964 - RNA, 16 nt, Homo sapiens
cuugaaugaugccaug

SEQ ID NO: 1676965 - RNA, 17 nt, Homo sapiens
cuugaaugaugccauga

SEQ ID NO: 1676966 - RNA, 18 nt, Homo sapiens
cuugaccgugaggccaga

SEQ ID NO: 1676967 - RNA, 18 nt, Homo sapiens
cuugaccucgugauccac

SEQ ID NO: 1676968 - RNA, 23 nt, Homo sapiens
cuugagcacuauucuaaggagca

SEQ ID NO: 1676969 - RNA, 23 nt, Homo sapiens
cuugaggucugacuuuuggcucc

SEQ ID NO: 1676970 - RNA, 23 nt, Homo sapiens
cuugaguuguuuaaacagucaaa

SEQ ID NO: 1676971 - RNA, 22 nt, Homo sapiens
cuugauagccugacagcagaga

SEQ ID NO: 1676972 - RNA, 14 nt, Homo sapiens
cuugcacuguaucc

SEQ ID NO: 1676973 - RNA, 15 nt, Homo sapiens
cuugcaugugcugca

SEQ ID NO: 1676974 - RNA, 12 nt, Homo sapiens
cuugccaauggu

SEQ ID NO: 1676975 - RNA, 14 nt, Homo sapiens
cuugccacaaucac

SEQ ID NO: 1676976 - RNA, 13 nt, Homo sapiens
cuugccaugcuaa

SEQ ID NO: 1676977 - RNA, 18 nt, Homo sapiens
cuugccccaccuccauca

SEQ ID NO: 1676978 - RNA, 14 nt, Homo sapiens
cuuggagugccacg

SEQ ID NO: 1676979 - RNA, 19 nt, Homo sapiens
cuuggaugucauaucuucu

SEQ ID NO: 1676980 - RNA, 13 nt, Homo sapiens
cuuggcaccaaag

SEQ ID NO: 1676981 - RNA, 22 nt, Homo sapiens
cuuggcgagauuugggggugcu

SEQ ID NO: 1676982 - RNA, 16 nt, Homo sapiens
cuuggcucagacaccu

SEQ ID NO: 1676983 - RNA, 15 nt, Homo sapiens
cuugggcgggccauu

SEQ ID NO: 1676984 - RNA, 23 nt, Homo sapiens
cuugggcguuugaacucagggag

SEQ ID NO: 1676985 - RNA, 17 nt, Homo sapiens
cuuggggaaggggccug

SEQ ID NO: 1676986 - RNA, 15 nt, Homo sapiens
cuuggguaauuaaaa

SEQ ID NO: 1676987 - RNA, 18 nt, Homo sapiens
cuuggguccaguauuuac

SEQ ID NO: 1676988 - RNA, 19 nt, Homo sapiens
cuuggucucuuucuuucca

SEQ ID NO: 1676989 - RNA, 19 nt, Homo sapiens
cuugguguuguuauggcaa

SEQ ID NO: 1676990 - RNA, 16 nt, Homo sapiens
cuugguucccauuugc

SEQ ID NO: 1676991 - RNA, 18 nt, Homo sapiens
cuugguuuccaucaaagc

SEQ ID NO: 1676992 - RNA, 23 nt, Homo sapiens
cuuguaaaaacuuuuaagccauu

SEQ ID NO: 1676993 - RNA, 16 nt, Homo sapiens
cuugucauucugcuaa

SEQ ID NO: 1676994 - RNA, 20 nt, Homo sapiens
cuugugaaguaggugaucuu

SEQ ID NO: 1676995 - RNA, 19 nt, Homo sapiens
cuugugaggcaucacggaa

SEQ ID NO: 1676996 - RNA, 22 nt, Homo sapiens
cuugugauuucuuaugccuguc

SEQ ID NO: 1676997 - RNA, 12 nt, Homo sapiens
cuugugcacugg

SEQ ID NO: 1676998 - RNA, 18 nt, Homo sapiens
cuugugcacuggaugugg

SEQ ID NO: 1676999 - RNA, 22 nt, Homo sapiens
cuuguucuuccucuuaccugua

SEQ ID NO: 1677000 - RNA, 16 nt, Homo sapiens
cuuguugcugcaucuc

SEQ ID NO: 1677001 - RNA, 17 nt, Homo sapiens
cuuguugcugcaucucc

SEQ ID NO: 1677002 - RNA, 15 nt, Homo sapiens
cuuguuuaccaaaga

SEQ ID NO: 1677003 - RNA, 23 nt, Homo sapiens
cuuguuuguguuugaauugauuu

SEQ ID NO: 1677004 - RNA, 22 nt, Homo sapiens
cuuuaaauuaugacgugcacaa

SEQ ID NO: 1677005 - RNA, 22 nt, Homo sapiens
cuuuaacaagacuucaaaguuu

SEQ ID NO: 1677006 - RNA, 12 nt, Homo sapiens
cuuuaccaugcu

SEQ ID NO: 1677007 - RNA, 16 nt, Homo sapiens
cuuuaccaugcucaau

SEQ ID NO: 1677008 - RNA, 18 nt, Homo sapiens
gcacaacaugcacauuca

SEQ ID NO: 1677009 - RNA, 12 nt, Homo sapiens
gcacaaguauua

SEQ ID NO: 1677010 - RNA, 14 nt, Homo sapiens
gcacacaacugugg

SEQ ID NO: 1677011 - RNA, 12 nt, Homo sapiens
gcacacauaaca

SEQ ID NO: 1677012 - RNA, 17 nt, Homo sapiens
gcacacaugguuuccaa

SEQ ID NO: 1677013 - RNA, 15 nt, Homo sapiens
gcacacccauucaca

SEQ ID NO: 1677014 - RNA, 19 nt, Homo sapiens
gcacagagagcggcuuccc

SEQ ID NO: 1677015 - RNA, 20 nt, Homo sapiens
gcacagaggauggcuucccc

SEQ ID NO: 1677016 - RNA, 17 nt, Homo sapiens
gcacagcuaacauggaa

SEQ ID NO: 1677017 - RNA, 16 nt, Homo sapiens
gcacaugccucucuca

SEQ ID NO: 1677018 - RNA, 19 nt, Homo sapiens
gcacaugccucucucaggc

SEQ ID NO: 1677019 - RNA, 22 nt, Homo sapiens
gcacaugccucucucaggccaa

SEQ ID NO: 1677020 - RNA, 21 nt, Homo sapiens
gcaccaaggagaaggcaggaa

SEQ ID NO: 1677021 - RNA, 23 nt, Homo sapiens
gcaccaccccauccgcaucucaa

SEQ ID NO: 1677022 - RNA, 17 nt, Homo sapiens
gcacccaccacucucag

SEQ ID NO: 1677023 - RNA, 19 nt, Homo sapiens
gcacccaccacucucagga

SEQ ID NO: 1677024 - RNA, 12 nt, Homo sapiens
gcaccugggauu

SEQ ID NO: 1677025 - RNA, 15 nt, Homo sapiens
gcacuagaagcacag

SEQ ID NO: 1677026 - RNA, 20 nt, Homo sapiens
gcacucaggagcacagccau

SEQ ID NO: 1677027 - RNA, 17 nt, Homo sapiens
gcacucccagccaagug

SEQ ID NO: 1677028 - RNA, 13 nt, Homo sapiens
gcacugcccuccg

SEQ ID NO: 1677029 - RNA, 21 nt, Homo sapiens
gcagaaaaccuaccacauuca

SEQ ID NO: 1677030 - RNA, 14 nt, Homo sapiens
gcagaaauugaccu

SEQ ID NO: 1677031 - RNA, 15 nt, Homo sapiens
gcagaaugagccaga

SEQ ID NO: 1677032 - RNA, 23 nt, Homo sapiens
gcagacuuaagcguacaaaguga

SEQ ID NO: 1677033 - RNA, 17 nt, Homo sapiens
gcagaggccaugaagaa

SEQ ID NO: 1677034 - RNA, 23 nt, Homo sapiens
gcagaucaucuccaaaucuugcc

SEQ ID NO: 1677035 - RNA, 16 nt, Homo sapiens
gcagauuuucuucuag

SEQ ID NO: 1677036 - RNA, 12 nt, Homo sapiens
gcagcaccucag

SEQ ID NO: 1677037 - RNA, 13 nt, Homo sapiens
gcagcagagccau

SEQ ID NO: 1677038 - RNA, 15 nt, Homo sapiens
gcagcagcagcagca

SEQ ID NO: 1677039 - RNA, 12 nt, Homo sapiens
gcagcuagacac

SEQ ID NO: 1677040 - RNA, 21 nt, Homo sapiens
gcagcuuuagccaagugcagg

SEQ ID NO: 1677041 - RNA, 15 nt, Homo sapiens
gcaggaacacuggag

SEQ ID NO: 1677042 - RNA, 14 nt, Homo sapiens
gcaggcaaggcaag

SEQ ID NO: 1677043 - RNA, 19 nt, Homo sapiens
gcagggaagcucuaccgca

SEQ ID NO: 1677044 - RNA, 19 nt, Homo sapiens
gcagggcaaaugacaugca

SEQ ID NO: 1677045 - RNA, 21 nt, Homo sapiens
gcaguaacuccccaacucccu

SEQ ID NO: 1677046 - RNA, 19 nt, Homo sapiens
gcagucccuccacauuucc

SEQ ID NO: 1677047 - RNA, 22 nt, Homo sapiens
gcagucuccgcucccgcagcgg

SEQ ID NO: 1677048 - RNA, 14 nt, Homo sapiens
gcagucuuugcuca

SEQ ID NO: 1677049 - RNA, 17 nt, Homo sapiens
gcagugcaguacucagg

SEQ ID NO: 1677050 - RNA, 17 nt, Homo sapiens
gcaguggcaucaucuca

SEQ ID NO: 1677051 - RNA, 21 nt, Homo sapiens
gcaguggcgugaucucagcuc

SEQ ID NO: 1677052 - RNA, 20 nt, Homo sapiens
gcaguggggagcgggggcua

SEQ ID NO: 1677053 - RNA, 16 nt, Homo sapiens
gcaguuaauucuugcc

SEQ ID NO: 1677054 - RNA, 19 nt, Homo sapiens
gcaguucagcuccuuccac

SEQ ID NO: 1677055 - RNA, 23 nt, Homo sapiens
gcaguucagcuccuuccaccaca

SEQ ID NO: 1677056 - RNA, 14 nt, Homo sapiens
gcaguuuacuuuag

SEQ ID NO: 1677057 - RNA, 15 nt, Homo sapiens
gcauaaccgcacaga

SEQ ID NO: 1677058 - RNA, 21 nt, Homo sapiens
gcauaccaguucuugcaauaa

SEQ ID NO: 1677059 - RNA, 14 nt, Homo sapiens
gcauagacaagugu

SEQ ID NO: 1677060 - RNA, 13 nt, Homo sapiens
gcauagccauuca

SEQ ID NO: 1677061 - RNA, 16 nt, Homo sapiens
gcaucaagaugugaca

SEQ ID NO: 1677062 - RNA, 18 nt, Homo sapiens
gcaucaucucagcucacu

SEQ ID NO: 1677063 - RNA, 22 nt, Homo sapiens
gcauccacuucacaguucugaa

SEQ ID NO: 1677064 - RNA, 17 nt, Homo sapiens
gcaucgcuccucuccag

SEQ ID NO: 1677065 - RNA, 23 nt, Homo sapiens
gcaucuaagacauucaccaacaa

SEQ ID NO: 1677066 - RNA, 17 nt, Homo sapiens
gcaucuucccacagugg

SEQ ID NO: 1677067 - RNA, 15 nt, Homo sapiens
gcaugagaaugucau

SEQ ID NO: 1677068 - RNA, 19 nt, Homo sapiens
gcaugauuagugcaauaaa

SEQ ID NO: 1677069 - RNA, 22 nt, Homo sapiens
gcauguuucaccacaacccugu

SEQ ID NO: 1677070 - RNA, 13 nt, Homo sapiens
gcauuacauuugu

SEQ ID NO: 1677071 - RNA, 18 nt, Homo sapiens
gcauucauucauccucuu

SEQ ID NO: 1677072 - RNA, 20 nt, Homo sapiens
gcauucugggguggggcuug

SEQ ID NO: 1677073 - RNA, 15 nt, Homo sapiens
gcauuuagcacagua

SEQ ID NO: 1677074 - RNA, 13 nt, Homo sapiens
gcauuucaucaag

SEQ ID NO: 1677075 - RNA, 18 nt, Homo sapiens
gcauuuuacuaugccugu

SEQ ID NO: 1677076 - RNA, 14 nt, Homo sapiens
gccaaaaugcagac

SEQ ID NO: 1677077 - RNA, 17 nt, Homo sapiens
gccaaccccauccucac

SEQ ID NO: 1677078 - RNA, 20 nt, Homo sapiens
gccaacugcccagagccaca

SEQ ID NO: 1677079 - RNA, 18 nt, Homo sapiens
gccaagacucuaugcucu

SEQ ID NO: 1677080 - RNA, 20 nt, Homo sapiens
gccaagagccugagugacag

SEQ ID NO: 1677081 - RNA, 23 nt, Homo sapiens
gccaagguuuggggaagaacgaa

SEQ ID NO: 1677082 - RNA, 19 nt, Homo sapiens
gccaaguuggagugcaaug

SEQ ID NO: 1677083 - RNA, 15 nt, Homo sapiens
gccaauagucauaug

SEQ ID NO: 1677084 - RNA, 18 nt, Homo sapiens
gccacauggccgcugccc

SEQ ID NO: 1677085 - RNA, 20 nt, Homo sapiens
gccaccccuaaucacuauug

SEQ ID NO: 1677086 - RNA, 23 nt, Homo sapiens
gccaccuggaggaacugcuugug

SEQ ID NO: 1677087 - RNA, 19 nt, Homo sapiens
gccagaaaauuaacugaaa

SEQ ID NO: 1677088 - RNA, 13 nt, Homo sapiens
gccagagccucug

SEQ ID NO: 1677089 - RNA, 22 nt, Homo sapiens
gccagaggcucuaauguacaau

SEQ ID NO: 1677090 - RNA, 17 nt, Homo sapiens
gccagcaauaauugaca

SEQ ID NO: 1677091 - RNA, 13 nt, Homo sapiens
gccagcccacaca

SEQ ID NO: 1677092 - RNA, 22 nt, Homo sapiens
gccaggaacuguguguguugca

SEQ ID NO: 1677093 - RNA, 22 nt, Homo sapiens
gccaggauggucucgaucuccu

SEQ ID NO: 1677094 - RNA, 15 nt, Homo sapiens
gccaggccucaggga

SEQ ID NO: 1677095 - RNA, 22 nt, Homo sapiens
gccaggccucagggaccaagga

SEQ ID NO: 1677096 - RNA, 14 nt, Homo sapiens
gccaggcugcaggg

SEQ ID NO: 1677097 - RNA, 18 nt, Homo sapiens
gccagggcagugcuagug

SEQ ID NO: 1677098 - RNA, 14 nt, Homo sapiens
gccaggggaacucg

SEQ ID NO: 1677099 - RNA, 15 nt, Homo sapiens
gccaguccaucucaa

SEQ ID NO: 1677100 - RNA, 19 nt, Homo sapiens
gccaguggcuucuucauga

SEQ ID NO: 1677101 - RNA, 12 nt, Homo sapiens
gccaucaagaaa

SEQ ID NO: 1677102 - RNA, 13 nt, Homo sapiens
gccaucauuucau

SEQ ID NO: 1677103 - RNA, 18 nt, Homo sapiens
gccaugaggaacaaggca

SEQ ID NO: 1677104 - RNA, 16 nt, Homo sapiens
gccauugaacacugca

SEQ ID NO: 1677105 - RNA, 19 nt, Homo sapiens
gccauuuccacuacaguga

SEQ ID NO: 1677106 - RNA, 13 nt, Homo sapiens
gccauuugugaua

SEQ ID NO: 1677107 - RNA, 18 nt, Homo sapiens
gcccaagguaaacaguuu

SEQ ID NO: 1677108 - RNA, 18 nt, Homo sapiens
gcccacaacuugccaaaa

SEQ ID NO: 1677109 - RNA, 19 nt, Homo sapiens
gcccacgucccgggcacug

SEQ ID NO: 1677110 - RNA, 17 nt, Homo sapiens
gcccaguuagcccggcc

SEQ ID NO: 1677111 - RNA, 16 nt, Homo sapiens
gcccauagaaacauga

SEQ ID NO: 1677112 - RNA, 13 nt, Homo sapiens
gccccagugaccg

SEQ ID NO: 1677113 - RNA, 16 nt, Homo sapiens
gccccccguguucaca

SEQ ID NO: 1677114 - RNA, 17 nt, Homo sapiens
gcccccucucuuacccc

SEQ ID NO: 1677115 - RNA, 22 nt, Homo sapiens
gccccuccccauggugcaguga

SEQ ID NO: 1677116 - RNA, 20 nt, Homo sapiens
gccccucucuguuuacccuc

SEQ ID NO: 1677117 - RNA, 14 nt, Homo sapiens
gccccuucuagggg

SEQ ID NO: 1677118 - RNA, 14 nt, Homo sapiens
gcccgagccaggaa

SEQ ID NO: 1677119 - RNA, 17 nt, Homo sapiens
gcccuaugcaagcaaac

SEQ ID NO: 1677120 - RNA, 14 nt, Homo sapiens
gcccugaccaugca

SEQ ID NO: 1677121 - RNA, 19 nt, Homo sapiens
gcccugaugcgucuaccca

SEQ ID NO: 1677122 - RNA, 22 nt, Homo sapiens
gcccuggcuaauuccccuucca

SEQ ID NO: 1677123 - RNA, 22 nt, Homo sapiens
gcccuggggucucugagcagug

SEQ ID NO: 1677124 - RNA, 15 nt, Homo sapiens
gcccugucuuuccag

SEQ ID NO: 1677125 - RNA, 16 nt, Homo sapiens
gcccuucccugacacu

SEQ ID NO: 1677126 - RNA, 12 nt, Homo sapiens
gccgcugcuuga

SEQ ID NO: 1677127 - RNA, 20 nt, Homo sapiens
gccgcugcuugaguggacag

SEQ ID NO: 1677128 - RNA, 22 nt, Homo sapiens
gccgcugggagaaaagccagau

SEQ ID NO: 1677129 - RNA, 16 nt, Homo sapiens
gccgggagaccagugu

SEQ ID NO: 1677130 - RNA, 23 nt, Homo sapiens
ggcuuuacauggguucaauugga

SEQ ID NO: 1677131 - RNA, 11 nt, Homo sapiens
gggaaccagag

SEQ ID NO: 1677132 - RNA, 23 nt, Homo sapiens
gggaagcaguguguacuucuuca

SEQ ID NO: 1677133 - RNA, 16 nt, Homo sapiens
gggaccccaagugaag

SEQ ID NO: 1677134 - RNA, 15 nt, Homo sapiens
gggacgggggcugcu

SEQ ID NO: 1677135 - RNA, 13 nt, Homo sapiens
gggacuacaggca

SEQ ID NO: 1677136 - RNA, 13 nt, Homo sapiens
gggacugagccug

SEQ ID NO: 1677137 - RNA, 18 nt, Homo sapiens
gggacuuuggcauuucca

SEQ ID NO: 1677138 - RNA, 13 nt, Homo sapiens
gggaucuuaccca

SEQ ID NO: 1677139 - RNA, 13 nt, Homo sapiens
gggauuacaggcg

SEQ ID NO: 1677140 - RNA, 22 nt, Homo sapiens
gggcaaaugacaugcacugacc

SEQ ID NO: 1677141 - RNA, 17 nt, Homo sapiens
gggcacugucaugccca

SEQ ID NO: 1677142 - RNA, 18 nt, Homo sapiens
gggcacugucaugcccag

SEQ ID NO: 1677143 - RNA, 18 nt, Homo sapiens
gggcagaucacagguuau

SEQ ID NO: 1677144 - RNA, 15 nt, Homo sapiens
gggcagcucauagag

SEQ ID NO: 1677145 - RNA, 13 nt, Homo sapiens
gggcaggguucua

SEQ ID NO: 1677146 - RNA, 12 nt, Homo sapiens
gggcauguuucu

SEQ ID NO: 1677147 - RNA, 20 nt, Homo sapiens
gggcauugcuggacugaugg

SEQ ID NO: 1677148 - RNA, 16 nt, Homo sapiens
gggccagcucuuggcu

SEQ ID NO: 1677149 - RNA, 17 nt, Homo sapiens
gggccccauggucacag

SEQ ID NO: 1677150 - RNA, 15 nt, Homo sapiens
gggccuucauugucu

SEQ ID NO: 1677151 - RNA, 17 nt, Homo sapiens
gggcucuccaagcacua

SEQ ID NO: 1677152 - RNA, 22 nt, Homo sapiens
gggcucuucgccaugggggucu

SEQ ID NO: 1677153 - RNA, 20 nt, Homo sapiens
gggcugagccccuccucucc

SEQ ID NO: 1677154 - RNA, 22 nt, Homo sapiens
gggcuguccugagcccccugca

SEQ ID NO: 1677155 - RNA, 14 nt, Homo sapiens
ggggaaugggaaga

SEQ ID NO: 1677156 - RNA, 13 nt, Homo sapiens
ggggagaauggcu

SEQ ID NO: 1677157 - RNA, 14 nt, Homo sapiens
ggggcacagccaga

SEQ ID NO: 1677158 - RNA, 14 nt, Homo sapiens
ggggcaugggugga

SEQ ID NO: 1677159 - RNA, 13 nt, Homo sapiens
gggggcaagagcu

SEQ ID NO: 1677160 - RNA, 20 nt, Homo sapiens
ggggguuacagcuguucuga

SEQ ID NO: 1677161 - RNA, 17 nt, Homo sapiens
ggggguuuuuaaucuuu

SEQ ID NO: 1677162 - RNA, 16 nt, Homo sapiens
ggggucagaugcacug

SEQ ID NO: 1677163 - RNA, 19 nt, Homo sapiens
gggguccugguaugucuca

SEQ ID NO: 1677164 - RNA, 18 nt, Homo sapiens
gggguuggguuccagaca

SEQ ID NO: 1677165 - RNA, 12 nt, Homo sapiens
gggucugugaug

SEQ ID NO: 1677166 - RNA, 22 nt, Homo sapiens
gggugcuaauccaggacagcau

SEQ ID NO: 1677167 - RNA, 11 nt, Homo sapiens
ggguguugcua

SEQ ID NO: 1677168 - RNA, 21 nt, Homo sapiens
ggguucacaccauucuccggc

SEQ ID NO: 1677169 - RNA, 14 nt, Homo sapiens
ggguuccagacagg

SEQ ID NO: 1677170 - RNA, 16 nt, Homo sapiens
ggguuuugacuugcca

SEQ ID NO: 1677171 - RNA, 21 nt, Homo sapiens
gguaaauaaucauacacagaa

SEQ ID NO: 1677172 - RNA, 23 nt, Homo sapiens
gguaagagauaugcucauuauua

SEQ ID NO: 1677173 - RNA, 17 nt, Homo sapiens
gguaagggacuccagaa

SEQ ID NO: 1677174 - RNA, 20 nt, Homo sapiens
gguaaugaugauucaaucau

SEQ ID NO: 1677175 - RNA, 13 nt, Homo sapiens
gguagaagcccuu

SEQ ID NO: 1677176 - RNA, 12 nt, Homo sapiens
gguauuuacugc

SEQ ID NO: 1677177 - RNA, 15 nt, Homo sapiens
ggucagagcccagga

SEQ ID NO: 1677178 - RNA, 10 nt, Homo sapiens
ggucaucuca

SEQ ID NO: 1677179 - RNA, 16 nt, Homo sapiens
gguccaguaauagcaa

SEQ ID NO: 1677180 - RNA, 17 nt, Homo sapiens
gguccuuugagugucag

SEQ ID NO: 1677181 - RNA, 13 nt, Homo sapiens
ggucuaugauguc

SEQ ID NO: 1677182 - RNA, 22 nt, Homo sapiens
ggucuccaccccucaagccagg

SEQ ID NO: 1677183 - RNA, 23 nt, Homo sapiens
ggugaaacccuacgaaagcacag

SEQ ID NO: 1677184 - RNA, 13 nt, Homo sapiens
ggugaacagaaca

SEQ ID NO: 1677185 - RNA, 19 nt, Homo sapiens
ggugccaucacgcuuguga

SEQ ID NO: 1677186 - RNA, 15 nt, Homo sapiens
ggugcccagucuuga

SEQ ID NO: 1677187 - RNA, 12 nt, Homo sapiens
gguggacaugca

SEQ ID NO: 1677188 - RNA, 17 nt, Homo sapiens
gguggagcuugcaguga

SEQ ID NO: 1677189 - RNA, 23 nt, Homo sapiens
gguggagucagggcugugcuuuc

SEQ ID NO: 1677190 - RNA, 12 nt, Homo sapiens
gguggggccagc

SEQ ID NO: 1677191 - RNA, 11 nt, Homo sapiens
gguggggcuua

SEQ ID NO: 1677192 - RNA, 23 nt, Homo sapiens
gguguaguggcucaugccuguaa

SEQ ID NO: 1677193 - RNA, 13 nt, Homo sapiens
gguguggccucag

SEQ ID NO: 1677194 - RNA, 12 nt, Homo sapiens
gguuaaugcaga

SEQ ID NO: 1677195 - RNA, 13 nt, Homo sapiens
gguucaagugcuu

SEQ ID NO: 1677196 - RNA, 19 nt, Homo sapiens
gguuccuaauccucuagga

SEQ ID NO: 1677197 - RNA, 14 nt, Homo sapiens
gguuggagugcagu

SEQ ID NO: 1677198 - RNA, 14 nt, Homo sapiens
gguuggguuccaga

SEQ ID NO: 1677199 - RNA, 14 nt, Homo sapiens
gguugucaugugau

SEQ ID NO: 1677200 - RNA, 17 nt, Homo sapiens
gguuguugcaguucaga

SEQ ID NO: 1677201 - RNA, 15 nt, Homo sapiens
gguuucacuguguua

SEQ ID NO: 1677202 - RNA, 14 nt, Homo sapiens
gguuuuaagccagg

SEQ ID NO: 1677203 - RNA, 19 nt, Homo sapiens
guaaaacagauuuguucau

SEQ ID NO: 1677204 - RNA, 22 nt, Homo sapiens
guaaaacagauuuguucauucc

SEQ ID NO: 1677205 - RNA, 19 nt, Homo sapiens
guaaaacuuguauuggaag

SEQ ID NO: 1677206 - RNA, 22 nt, Homo sapiens
guaaacaguuugaaaagacaaa

SEQ ID NO: 1677207 - RNA, 19 nt, Homo sapiens
guaaagaauuuagcuguau

SEQ ID NO: 1677208 - RNA, 16 nt, Homo sapiens
guaaaucagugcagua

SEQ ID NO: 1677209 - RNA, 19 nt, Homo sapiens
guaaaucagugcaguacuc

SEQ ID NO: 1677210 - RNA, 15 nt, Homo sapiens
guaaaugagccuuuc

SEQ ID NO: 1677211 - RNA, 21 nt, Homo sapiens
guaaauuuucuuuaagucaga

SEQ ID NO: 1677212 - RNA, 20 nt, Homo sapiens
guaacacaguguagugcuca

SEQ ID NO: 1677213 - RNA, 18 nt, Homo sapiens
guaacaguguaguacuca

SEQ ID NO: 1677214 - RNA, 16 nt, Homo sapiens
guaaccacaacuuuca

SEQ ID NO: 1677215 - RNA, 14 nt, Homo sapiens
guaaccaugcaaaa

SEQ ID NO: 1677216 - RNA, 16 nt, Homo sapiens
guaaccucuacaggca

SEQ ID NO: 1677217 - RNA, 11 nt, Homo sapiens
guaacuguccu

SEQ ID NO: 1677218 - RNA, 16 nt, Homo sapiens
guaagagucuguguua

SEQ ID NO: 1677219 - RNA, 16 nt, Homo sapiens
guaaggcagugcagua

SEQ ID NO: 1677220 - RNA, 18 nt, Homo sapiens
guaaguucugugcaguuu

SEQ ID NO: 1677221 - RNA, 19 nt, Homo sapiens
guaauacaauacaguacuc

SEQ ID NO: 1677222 - RNA, 19 nt, Homo sapiens
guaauacaguacaguacuc

SEQ ID NO: 1677223 - RNA, 20 nt, Homo sapiens
guaauaucaguuacaguggc

SEQ ID NO: 1677224 - RNA, 21 nt, Homo sapiens
guaaucuguugacagugccaa

SEQ ID NO: 1677225 - RNA, 16 nt, Homo sapiens
guacagauugcugcuu

SEQ ID NO: 1677226 - RNA, 12 nt, Homo sapiens
guacaguacuca

SEQ ID NO: 1677227 - RNA, 12 nt, Homo sapiens
guacaugacugu

SEQ ID NO: 1677228 - RNA, 19 nt, Homo sapiens
guacauguggaaaacucac

SEQ ID NO: 1677229 - RNA, 13 nt, Homo sapiens
guacuaccccagg

SEQ ID NO: 1677230 - RNA, 17 nt, Homo sapiens
guacuaucuagugucua

SEQ ID NO: 1677231 - RNA, 23 nt, Homo sapiens
guacucaguaaaucagugcagua

SEQ ID NO: 1677232 - RNA, 15 nt, Homo sapiens
guacuucaguucuca

SEQ ID NO: 1677233 - RNA, 23 nt, Homo sapiens
guagacaugcacacccauucaca

SEQ ID NO: 1677234 - RNA, 21 nt, Homo sapiens
guagacucacgcugacugcag

SEQ ID NO: 1677235 - RNA, 15 nt, Homo sapiens
guagauaagugcuca

SEQ ID NO: 1677236 - RNA, 16 nt, Homo sapiens
guagcaacccaggugu

SEQ ID NO: 1677237 - RNA, 12 nt, Homo sapiens
guagcacacuga

SEQ ID NO: 1677238 - RNA, 18 nt, Homo sapiens
guagcagagucauuguua

SEQ ID NO: 1677239 - RNA, 16 nt, Homo sapiens
guagccuggucugugc

SEQ ID NO: 1677240 - RNA, 19 nt, Homo sapiens
guagcuccgcgugucucau

SEQ ID NO: 1677241 - RNA, 19 nt, Homo sapiens
guagcugggacuacaggca

SEQ ID NO: 1677242 - RNA, 14 nt, Homo sapiens
guaguaccucccag

SEQ ID NO: 1677243 - RNA, 21 nt, Homo sapiens
guaguagaaucucagcacuuu

SEQ ID NO: 1677244 - RNA, 22 nt, Homo sapiens
guagucaggugccucaagagaa

SEQ ID NO: 1677245 - RNA, 23 nt, Homo sapiens
guauaaaaugguguuuucaugua

SEQ ID NO: 1677246 - RNA, 14 nt, Homo sapiens
guauaaagccauua

SEQ ID NO: 1677247 - RNA, 13 nt, Homo sapiens
guauagcauuaau

SEQ ID NO: 1677248 - RNA, 20 nt, Homo sapiens
guauauagaugucuguguau

SEQ ID NO: 1677249 - RNA, 13 nt, Homo sapiens
guauaucagcucu

SEQ ID NO: 1677250 - RNA, 13 nt, Homo sapiens
guaucacagucag

SEQ ID NO: 1677251 - RNA, 23 nt, Homo sapiens
guaugccucauuuuauucuguca

SEQ ID NO: 1677252 - RNA, 18 nt, Homo sapiens
guaugcuggccagcaccc

SEQ ID NO: 1677253 - RNA, 13 nt, Homo sapiens
uggagugcagugg

SEQ ID NO: 1677254 - RNA, 15 nt, Homo sapiens
uggauacaggagaag

SEQ ID NO: 1677255 - RNA, 16 nt, Homo sapiens
uggauacuggggggca

SEQ ID NO: 1677256 - RNA, 16 nt, Homo sapiens
uggaucagcaacucca

SEQ ID NO: 1677257 - RNA, 20 nt, Homo sapiens
uggaucuguugggaaccaga

SEQ ID NO: 1677258 - RNA, 21 nt, Homo sapiens
uggaucuguugggaaccagag

SEQ ID NO: 1677259 - RNA, 21 nt, Homo sapiens
uggauuuagacucauggaaua

SEQ ID NO: 1677260 - RNA, 15 nt, Homo sapiens
uggcaaccuguucuu

SEQ ID NO: 1677261 - RNA, 20 nt, Homo sapiens
uggcaauauaaggggaugag

SEQ ID NO: 1677262 - RNA, 15 nt, Homo sapiens
uggcaccagaugcaa

SEQ ID NO: 1677263 - RNA, 16 nt, Homo sapiens
uggcaucaucucagcu

SEQ ID NO: 1677264 - RNA, 14 nt, Homo sapiens
uggcauuugcugaa

SEQ ID NO: 1677265 - RNA, 20 nt, Homo sapiens
uggccacacuggaauccagu

SEQ ID NO: 1677266 - RNA, 14 nt, Homo sapiens
uggccccaaauguu

SEQ ID NO: 1677267 - RNA, 20 nt, Homo sapiens
uggccccacccuuuccucuu

SEQ ID NO: 1677268 - RNA, 19 nt, Homo sapiens
uggccuaauccaccuggug

SEQ ID NO: 1677269 - RNA, 21 nt, Homo sapiens
uggccuauuuuggacguguga

SEQ ID NO: 1677270 - RNA, 19 nt, Homo sapiens
uggcgcgaucucagcucac

SEQ ID NO: 1677271 - RNA, 15 nt, Homo sapiens
uggcuaacacaguga

SEQ ID NO: 1677272 - RNA, 19 nt, Homo sapiens
uggcuaauuccccuuccau

SEQ ID NO: 1677273 - RNA, 22 nt, Homo sapiens
uggcucacaaaagguuaaugga

SEQ ID NO: 1677274 - RNA, 11 nt, Homo sapiens
uggcugaagaa

SEQ ID NO: 1677275 - RNA, 18 nt, Homo sapiens
uggcugauuuacuaacag

SEQ ID NO: 1677276 - RNA, 15 nt, Homo sapiens
uggcuggaugugcau

SEQ ID NO: 1677277 - RNA, 17 nt, Homo sapiens
uggcuuaagccugugua

SEQ ID NO: 1677278 - RNA, 16 nt, Homo sapiens
uggcuuugugcuuguu

SEQ ID NO: 1677279 - RNA, 15 nt, Homo sapiens
ugggaaauucuugca

SEQ ID NO: 1677280 - RNA, 17 nt, Homo sapiens
ugggaagaagcaguuua

SEQ ID NO: 1677281 - RNA, 22 nt, Homo sapiens
ugggaauggggugggagccaca

SEQ ID NO: 1677282 - RNA, 19 nt, Homo sapiens
ugggaccugcuucauucaa

SEQ ID NO: 1677283 - RNA, 17 nt, Homo sapiens
ugggaggaacaaagaca

SEQ ID NO: 1677284 - RNA, 16 nt, Homo sapiens
ugggaggaucacuuga

SEQ ID NO: 1677285 - RNA, 15 nt, Homo sapiens
ugggaggccauuugu

SEQ ID NO: 1677286 - RNA, 12 nt, Homo sapiens
ugggcagaggaa

SEQ ID NO: 1677287 - RNA, 15 nt, Homo sapiens
ugggccucaguucaa

SEQ ID NO: 1677288 - RNA, 14 nt, Homo sapiens
ugggccuggcuccc

SEQ ID NO: 1677289 - RNA, 15 nt, Homo sapiens
ugggcugucugucac

SEQ ID NO: 1677290 - RNA, 19 nt, Homo sapiens
uggggaccagagcugccac

SEQ ID NO: 1677291 - RNA, 15 nt, Homo sapiens
uggggaccucaggcc

SEQ ID NO: 1677292 - RNA, 21 nt, Homo sapiens
uggggacgggggcugcuucuc

SEQ ID NO: 1677293 - RNA, 16 nt, Homo sapiens
uggggagggacacaga

SEQ ID NO: 1677294 - RNA, 17 nt, Homo sapiens
uggggagucugagaaag

SEQ ID NO: 1677295 - RNA, 15 nt, Homo sapiens
uggggccccucucau

SEQ ID NO: 1677296 - RNA, 23 nt, Homo sapiens
ugggggccucuuuaccauagcuu

SEQ ID NO: 1677297 - RNA, 14 nt, Homo sapiens
ugggguaugggaga

SEQ ID NO: 1677298 - RNA, 12 nt, Homo sapiens
ugggguggaauu

SEQ ID NO: 1677299 - RNA, 17 nt, Homo sapiens
uggguaucaugcuucua

SEQ ID NO: 1677300 - RNA, 19 nt, Homo sapiens
ugggucaccuuccugggca

SEQ ID NO: 1677301 - RNA, 17 nt, Homo sapiens
ugggugcugucaugccc

SEQ ID NO: 1677302 - RNA, 12 nt, Homo sapiens
uggguguucaag

SEQ ID NO: 1677303 - RNA, 15 nt, Homo sapiens
ugguagacugugaca

SEQ ID NO: 1677304 - RNA, 17 nt, Homo sapiens
ugguaguucgaagaauu

SEQ ID NO: 1677305 - RNA, 23 nt, Homo sapiens
uggucaggauuccuguugccuuu

SEQ ID NO: 1677306 - RNA, 21 nt, Homo sapiens
uggucauuugguggcucuaac

SEQ ID NO: 1677307 - RNA, 16 nt, Homo sapiens
uggucgcuuugccauc

SEQ ID NO: 1677308 - RNA, 16 nt, Homo sapiens
uggucucuauacuaca

SEQ ID NO: 1677309 - RNA, 17 nt, Homo sapiens
uggucugugugugacac

SEQ ID NO: 1677310 - RNA, 21 nt, Homo sapiens
uggucugugugugacaccacc

SEQ ID NO: 1677311 - RNA, 19 nt, Homo sapiens
uggugagguugugcugccu

SEQ ID NO: 1677312 - RNA, 12 nt, Homo sapiens
uggugcagugaa

SEQ ID NO: 1677313 - RNA, 16 nt, Homo sapiens
ugguggacaugcacag

SEQ ID NO: 1677314 - RNA, 18 nt, Homo sapiens
ugguguaugacaguuaga

SEQ ID NO: 1677315 - RNA, 19 nt, Homo sapiens
ugguuaaugaaaaaucuga

SEQ ID NO: 1677316 - RNA, 20 nt, Homo sapiens
ugguucaggccaagccccuu

SEQ ID NO: 1677317 - RNA, 11 nt, Homo sapiens
ugguugcaauu

SEQ ID NO: 1677318 - RNA, 12 nt, Homo sapiens
ugguugcaauug

SEQ ID NO: 1677319 - RNA, 19 nt, Homo sapiens
ugguuuuuaaguacucacu

SEQ ID NO: 1677320 - RNA, 20 nt, Homo sapiens
uguaaaaacuuuuaagccau

SEQ ID NO: 1677321 - RNA, 22 nt, Homo sapiens
uguaaaacugugacauuccaca

SEQ ID NO: 1677322 - RNA, 19 nt, Homo sapiens
uguaaaauacuauuggaca

SEQ ID NO: 1677323 - RNA, 17 nt, Homo sapiens
uguaaaauagucucauu

SEQ ID NO: 1677324 - RNA, 14 nt, Homo sapiens
uguaaagauauugu

SEQ ID NO: 1677325 - RNA, 21 nt, Homo sapiens
uguaaauaaugcuuaacauaa

SEQ ID NO: 1677326 - RNA, 17 nt, Homo sapiens
uguaacuguuacaguaa

SEQ ID NO: 1677327 - RNA, 22 nt, Homo sapiens
uguaacuuuauuggucuugccc

SEQ ID NO: 1677328 - RNA, 14 nt, Homo sapiens
uguaauauaagaca

SEQ ID NO: 1677329 - RNA, 19 nt, Homo sapiens
uguaauauuuacaauguau

SEQ ID NO: 1677330 - RNA, 19 nt, Homo sapiens
uguaauccuagcacuuugg

SEQ ID NO: 1677331 - RNA, 20 nt, Homo sapiens
uguaaugccacucauacuca

SEQ ID NO: 1677332 - RNA, 22 nt, Homo sapiens
uguaauuccucuagcuaccauu

SEQ ID NO: 1677333 - RNA, 14 nt, Homo sapiens
uguacaaaauaucc

SEQ ID NO: 1677334 - RNA, 20 nt, Homo sapiens
uguacaauaaagcaaugugg

SEQ ID NO: 1677335 - RNA, 16 nt, Homo sapiens
uguacaauuacuguga

SEQ ID NO: 1677336 - RNA, 15 nt, Homo sapiens
uguacagacaacaaa

SEQ ID NO: 1677337 - RNA, 21 nt, Homo sapiens
uguacaggcugagacacagcc

SEQ ID NO: 1677338 - RNA, 19 nt, Homo sapiens
uguagaaacucagcagaag

SEQ ID NO: 1677339 - RNA, 15 nt, Homo sapiens
uguagauaaagcacu

SEQ ID NO: 1677340 - RNA, 18 nt, Homo sapiens
uguagauaguaugcacua

SEQ ID NO: 1677341 - RNA, 18 nt, Homo sapiens
uguagcucugaaugcuau

SEQ ID NO: 1677342 - RNA, 18 nt, Homo sapiens
uguauaagaugcugcuga

SEQ ID NO: 1677343 - RNA, 20 nt, Homo sapiens
uguauaauuggaguagauau

SEQ ID NO: 1677344 - RNA, 17 nt, Homo sapiens
uguauacaaacaggugc

SEQ ID NO: 1677345 - RNA, 19 nt, Homo sapiens
uguauacuuuugguggaga

SEQ ID NO: 1677346 - RNA, 21 nt, Homo sapiens
uguauauugauguaacugugu

SEQ ID NO: 1677347 - RNA, 17 nt, Homo sapiens
uguaucaaacuagugca

SEQ ID NO: 1677348 - RNA, 16 nt, Homo sapiens
uguaucccuucucaca

SEQ ID NO: 1677349 - RNA, 14 nt, Homo sapiens
uguauguauacaca

SEQ ID NO: 1677350 - RNA, 18 nt, Homo sapiens
uguauuccugccuuugau

SEQ ID NO: 1677351 - RNA, 20 nt, Homo sapiens
ugucaacaguauacaaaaga

SEQ ID NO: 1677352 - RNA, 14 nt, Homo sapiens
ugucaaccugaauu

SEQ ID NO: 1677353 - RNA, 16 nt, Homo sapiens
ugucaacuucaguuga

SEQ ID NO: 1677354 - RNA, 22 nt, Homo sapiens
ugucaaugcuauggacugcaca

SEQ ID NO: 1677355 - RNA, 15 nt, Homo sapiens
ugucaccaugaucac

SEQ ID NO: 1677356 - RNA, 19 nt, Homo sapiens
ugucacgugacccugugcc

SEQ ID NO: 1677357 - RNA, 14 nt, Homo sapiens
ugucacucacaaaa

SEQ ID NO: 1677358 - RNA, 17 nt, Homo sapiens
ugucagucguguugcuu

SEQ ID NO: 1677359 - RNA, 15 nt, Homo sapiens
ugucaucacuuuuac

SEQ ID NO: 1677360 - RNA, 21 nt, Homo sapiens
ugucauuuucuguuauacaca

SEQ ID NO: 1677361 - RNA, 16 nt, Homo sapiens
uguccagagucucuuu

SEQ ID NO: 1677362 - RNA, 15 nt, Homo sapiens
uguccaguugcagcu

SEQ ID NO: 1677363 - RNA, 23 nt, Homo sapiens
ugucccacccccagcagcucacc

SEQ ID NO: 1677364 - RNA, 15 nt, Homo sapiens
uguccuaaaugcaaa

SEQ ID NO: 1677365 - RNA, 16 nt, Homo sapiens
uguccuacaauaucau

SEQ ID NO: 1677366 - RNA, 21 nt, Homo sapiens
ugucucaaaauaaaaccagaa

SEQ ID NO: 1677367 - RNA, 17 nt, Homo sapiens
ugucugucaccagcuau

SEQ ID NO: 1677368 - RNA, 23 nt, Homo sapiens
ugucugucccaguuaacuguuaa

SEQ ID NO: 1677369 - RNA, 21 nt, Homo sapiens
ugucuguguauacauauguau

SEQ ID NO: 1677370 - RNA, 18 nt, Homo sapiens
ugucuguuaaaugaacuu

SEQ ID NO: 1677371 - RNA, 12 nt, Homo sapiens
ugucuuaccaga

SEQ ID NO: 1677372 - RNA, 13 nt, Homo sapiens
ugucuucuugggg

SEQ ID NO: 1677373 - RNA, 20 nt, Homo sapiens
ugucuugagguuuuguucau

SEQ ID NO: 1677374 - RNA, 15 nt, Homo sapiens
ugucuuuggcuucag

SEQ ID NO: 1677375 - RNA, 13 nt, Homo sapiens
uucuuuuugacug

SEQ ID NO: 1677376 - RNA, 19 nt, Homo sapiens
uugaaaagcaaaucuguau

SEQ ID NO: 1677377 - RNA, 19 nt, Homo sapiens
uugaaaagcaguaacuugg

SEQ ID NO: 1677378 - RNA, 16 nt, Homo sapiens
uugaaacuguauuuac

SEQ ID NO: 1677379 - RNA, 21 nt, Homo sapiens
uugaaaugaugguaaguuaau

SEQ ID NO: 1677380 - RNA, 13 nt, Homo sapiens
uugaacaaacugg

SEQ ID NO: 1677381 - RNA, 22 nt, Homo sapiens
uugaacaacucgaaucacucau

SEQ ID NO: 1677382 - RNA, 21 nt, Homo sapiens
uugaagacagagcuacacagg

SEQ ID NO: 1677383 - RNA, 23 nt, Homo sapiens
uugaagacuuuucuuucagccaa

SEQ ID NO: 1677384 - RNA, 20 nt, Homo sapiens
uugaaggacuacagguauuu

SEQ ID NO: 1677385 - RNA, 17 nt, Homo sapiens
uugaccaaccccagcaa

SEQ ID NO: 1677386 - RNA, 14 nt, Homo sapiens
uugaccacugacag

SEQ ID NO: 1677387 - RNA, 22 nt, Homo sapiens
uugacugauuguuuuaaacaac

SEQ ID NO: 1677388 - RNA, 15 nt, Homo sapiens
uugacuguuaucucg

SEQ ID NO: 1677389 - RNA, 13 nt, Homo sapiens
uugacuugccacu

SEQ ID NO: 1677390 - RNA, 14 nt, Homo sapiens
uugagaaacccaag

SEQ ID NO: 1677391 - RNA, 9 nt, Homo sapiens
uugagacag

SEQ ID NO: 1677392 - RNA, 13 nt, Homo sapiens
uugagaucauguc

SEQ ID NO: 1677393 - RNA, 16 nt, Homo sapiens
uugaguggacagcagc

SEQ ID NO: 1677394 - RNA, 17 nt, Homo sapiens
uugaguuaaaucaguaa

SEQ ID NO: 1677395 - RNA, 12 nt, Homo sapiens
uugauagucaau

SEQ ID NO: 1677396 - RNA, 16 nt, Homo sapiens
uugaugaacugccaaa

SEQ ID NO: 1677397 - RNA, 15 nt, Homo sapiens
uugauguucuuucac

SEQ ID NO: 1677398 - RNA, 11 nt, Homo sapiens
uugcaauaagg

SEQ ID NO: 1677399 - RNA, 17 nt, Homo sapiens
uugcacuaaaagugaug

SEQ ID NO: 1677400 - RNA, 17 nt, Homo sapiens
uugcaugugcugcaggu

SEQ ID NO: 1677401 - RNA, 19 nt, Homo sapiens
uugccaggcuggagugcag

SEQ ID NO: 1677402 - RNA, 14 nt, Homo sapiens
uugccucuuuccuc

SEQ ID NO: 1677403 - RNA, 13 nt, Homo sapiens
uugccuucuccac

SEQ ID NO: 1677404 - RNA, 22 nt, Homo sapiens
uugcuauaauguauaaugggaa

SEQ ID NO: 1677405 - RNA, 14 nt, Homo sapiens
uugcucacagcuga

SEQ ID NO: 1677406 - RNA, 17 nt, Homo sapiens
uugcucuuuucaaugug

SEQ ID NO: 1677407 - RNA, 23 nt, Homo sapiens
uugcugcccuggcuauggucaca

SEQ ID NO: 1677408 - RNA, 23 nt, Homo sapiens
uugcuuucucuucuaauggaaua

SEQ ID NO: 1677409 - RNA, 12 nt, Homo sapiens
uuggaaagcagc

SEQ ID NO: 1677410 - RNA, 13 nt, Homo sapiens
uuggaagucuaag

SEQ ID NO: 1677411 - RNA, 16 nt, Homo sapiens
uuggacuuccauuugg

SEQ ID NO: 1677412 - RNA, 14 nt, Homo sapiens
uuggauuuuaaaca

SEQ ID NO: 1677413 - RNA, 20 nt, Homo sapiens
uuggccuagcccacccugcu

SEQ ID NO: 1677414 - RNA, 22 nt, Homo sapiens
uuggcuccaugcuccucacugc

SEQ ID NO: 1677415 - RNA, 20 nt, Homo sapiens
uuggcugauuggaaaauaau

SEQ ID NO: 1677416 - RNA, 11 nt, Homo sapiens
uuggggcuccu

SEQ ID NO: 1677417 - RNA, 14 nt, Homo sapiens
uugguauacuguua

SEQ ID NO: 1677418 - RNA, 23 nt, Homo sapiens
uugguaucuacuucuacauccaa

SEQ ID NO: 1677419 - RNA, 17 nt, Homo sapiens
uuggugacagggucuga

SEQ ID NO: 1677420 - RNA, 18 nt, Homo sapiens
uugguuaccuauugcugu

SEQ ID NO: 1677421 - RNA, 21 nt, Homo sapiens
uugguugguagauauucagga

SEQ ID NO: 1677422 - RNA, 15 nt, Homo sapiens
uuguaaucauaaaua

SEQ ID NO: 1677423 - RNA, 17 nt, Homo sapiens
uuguaaucauaaauacu

SEQ ID NO: 1677424 - RNA, 16 nt, Homo sapiens
uuguacagacaacaaa

SEQ ID NO: 1677425 - RNA, 15 nt, Homo sapiens
uuguacauauggaaa

SEQ ID NO: 1677426 - RNA, 14 nt, Homo sapiens
uuguauauguaauu

SEQ ID NO: 1677427 - RNA, 19 nt, Homo sapiens
uuguaugaaauauauguga

SEQ ID NO: 1677428 - RNA, 20 nt, Homo sapiens
uuguauuccucacauucaca

SEQ ID NO: 1677429 - RNA, 23 nt, Homo sapiens
uugucucucuaaacccaaauaaa

SEQ ID NO: 1677430 - RNA, 14 nt, Homo sapiens
uugucuggcugugg

SEQ ID NO: 1677431 - RNA, 22 nt, Homo sapiens
uugucuguuaaaugaacuugau

SEQ ID NO: 1677432 - RNA, 14 nt, Homo sapiens
uugugaagaaacau

SEQ ID NO: 1677433 - RNA, 20 nt, Homo sapiens
uugugacaggaaagcccucc

SEQ ID NO: 1677434 - RNA, 15 nt, Homo sapiens
uugugaugauagcac

SEQ ID NO: 1677435 - RNA, 10 nt, Homo sapiens
uugugcacug

SEQ ID NO: 1677436 - RNA, 17 nt, Homo sapiens
uuguggacuuuucccca

SEQ ID NO: 1677437 - RNA, 20 nt, Homo sapiens
uugugguuuauugaauguga

SEQ ID NO: 1677438 - RNA, 20 nt, Homo sapiens
uuguuacagguguacuaugg

SEQ ID NO: 1677439 - RNA, 16 nt, Homo sapiens
uuguuaucaguacaau

SEQ ID NO: 1677440 - RNA, 18 nt, Homo sapiens
uuguugaugaagcacauu

SEQ ID NO: 1677441 - RNA, 14 nt, Homo sapiens
uuguugcaguucag

SEQ ID NO: 1677442 - RNA, 19 nt, Homo sapiens
uuguugcaguucagacaaa

SEQ ID NO: 1677443 - RNA, 23 nt, Homo sapiens
uuguugguuuggccacucuugac

SEQ ID NO: 1677444 - RNA, 13 nt, Homo sapiens
uuguuuuguggau

SEQ ID NO: 1677445 - RNA, 16 nt, Homo sapiens
uuuaaaacaagcugau

SEQ ID NO: 1677446 - RNA, 18 nt, Homo sapiens
uuuaaaacaagcugauag

SEQ ID NO: 1677447 - RNA, 15 nt, Homo sapiens
uuuaagaauugccag

SEQ ID NO: 1677448 - RNA, 11 nt, Homo sapiens
uuuaagcucaa

SEQ ID NO: 1677449 - RNA, 17 nt, Homo sapiens
uuuaauauacuccuuaa

SEQ ID NO: 1677450 - RNA, 15 nt, Homo sapiens
uuuaaucauuuccag

SEQ ID NO: 1677451 - RNA, 17 nt, Homo sapiens
uuuaauguuuacaacaa

SEQ ID NO: 1677452 - RNA, 19 nt, Homo sapiens
uuuacaaagaaacaaaaua

SEQ ID NO: 1677453 - RNA, 17 nt, Homo sapiens
uuuacaaaggagaaaga

SEQ ID NO: 1677454 - RNA, 16 nt, Homo sapiens
uuuacauggguucaau

SEQ ID NO: 1677455 - RNA, 13 nt, Homo sapiens
uuuacaugugauu

SEQ ID NO: 1677456 - RNA, 16 nt, Homo sapiens
uuuagaaugacaggaa

SEQ ID NO: 1677457 - RNA, 15 nt, Homo sapiens
uuuagcacaguauuu

SEQ ID NO: 1677458 - RNA, 13 nt, Homo sapiens
uuuaggcucagaa

SEQ ID NO: 1677459 - RNA, 14 nt, Homo sapiens
uuuauaaauggagg

SEQ ID NO: 1677460 - RNA, 12 nt, Homo sapiens
uuuauauaugaa

SEQ ID NO: 1677461 - RNA, 23 nt, Homo sapiens
uuuaucagagucaugaugaauca

SEQ ID NO: 1677462 - RNA, 15 nt, Homo sapiens
uuuauuucaauguaa

SEQ ID NO: 1677463 - RNA, 19 nt, Homo sapiens
uuucaagaucaaacuucca

SEQ ID NO: 1677464 - RNA, 22 nt, Homo sapiens
uuucaaggaaaagaauucucag

SEQ ID NO: 1677465 - RNA, 23 nt, Homo sapiens
uuucaaguggaaaccuugcugcu

SEQ ID NO: 1677466 - RNA, 18 nt, Homo sapiens
uuucacaccuuacaaagc

SEQ ID NO: 1677467 - RNA, 15 nt, Homo sapiens
uuucacauucaugca

SEQ ID NO: 1677468 - RNA, 13 nt, Homo sapiens
uuucaccucagau

SEQ ID NO: 1677469 - RNA, 15 nt, Homo sapiens
uuucacuguucauga

SEQ ID NO: 1677470 - RNA, 15 nt, Homo sapiens
uuucagauaaaucau

SEQ ID NO: 1677471 - RNA, 21 nt, Homo sapiens
uuucagcauucccaauuauca

SEQ ID NO: 1677472 - RNA, 16 nt, Homo sapiens
uuucagcuuccucuaa

SEQ ID NO: 1677473 - RNA, 21 nt, Homo sapiens
uuucaugauuagacaaugugg

SEQ ID NO: 1677474 - RNA, 19 nt, Homo sapiens
uuuccaaaaguacuagcaa

SEQ ID NO: 1677475 - RNA, 21 nt, Homo sapiens
uuuccaaaccuccacugcugc

SEQ ID NO: 1677476 - RNA, 19 nt, Homo sapiens
uuuccagugacacaacuca

SEQ ID NO: 1677477 - RNA, 22 nt, Homo sapiens
uuuccccugugguuuguuauca

SEQ ID NO: 1677478 - RNA, 18 nt, Homo sapiens
uuucccgcuccaagagaa

SEQ ID NO: 1677479 - RNA, 20 nt, Homo sapiens
uuuccgugagagucaucuca

SEQ ID NO: 1677480 - RNA, 18 nt, Homo sapiens
uuuccuaugacacucauc

SEQ ID NO: 1677481 - RNA, 13 nt, Homo sapiens
uuuccucaaagaa

SEQ ID NO: 1677482 - RNA, 22 nt, Homo sapiens
uuuccucauuuuuauauucauu

SEQ ID NO: 1677483 - RNA, 22 nt, Homo sapiens
uuuccucuuaaugucucaaaau

SEQ ID NO: 1677484 - RNA, 13 nt, Homo sapiens
uuuccugacaggg

SEQ ID NO: 1677485 - RNA, 17 nt, Homo sapiens
uuuccugcuccuccagu

SEQ ID NO: 1677486 - RNA, 19 nt, Homo sapiens
uuuccugcuccuccaguac

SEQ ID NO: 1677487 - RNA, 15 nt, Homo sapiens
uuucggaaaugauug

SEQ ID NO: 1677488 - RNA, 14 nt, Homo sapiens
uuucuaagaauuua

SEQ ID NO: 1677489 - RNA, 21 nt, Homo sapiens
uuucuacuuuaaauuguggau

SEQ ID NO: 1677490 - RNA, 19 nt, Homo sapiens
uuucuauauuauugcccau

SEQ ID NO: 1677491 - RNA, 19 nt, Homo sapiens
uuucucucuguguggcaaa

SEQ ID NO: 1677492 - RNA, 12 nt, Homo sapiens
uuucuguucccu

SEQ ID NO: 1677493 - RNA, 19 nt, Homo sapiens
uuucuuuaacauaucauuc

SEQ ID NO: 1677494 - RNA, 18 nt, Homo sapiens
uuucuuuaagucaguuca

SEQ ID NO: 1677495 - RNA, 15 nt, Homo sapiens
uuucuuuagucuuua

SEQ ID NO: 1677496 - RNA, 15 nt, Homo sapiens
uuugaaacuuuucaa

SEQ ID NO: 1677497 - RNA, 20 nt, Homo sapiens
uuugaacaacucgaaucacu

SEQ ID NO: 1677498 - RNA, 13 nt, Homo sapiens
aaagaaagagcug

SEQ ID NO: 1677499 - RNA, 12 nt, Homo sapiens
aaagaacaggau

SEQ ID NO: 1677500 - RNA, 19 nt, Homo sapiens
aaagaaccccccuccccaa

SEQ ID NO: 1677501 - RNA, 14 nt, Homo sapiens
aaagaagaguuuac

SEQ ID NO: 1677502 - RNA, 16 nt, Homo sapiens
aaagaagauucugugg

SEQ ID NO: 1677503 - RNA, 13 nt, Homo sapiens
aaagaagcaguuu

SEQ ID NO: 1677504 - RNA, 21 nt, Homo sapiens
aaagaaggcacagguguaaau

SEQ ID NO: 1677505 - RNA, 19 nt, Homo sapiens
aaagaaucaacagugaaca

SEQ ID NO: 1677506 - RNA, 20 nt, Homo sapiens
aaagaauugugccucuccca

SEQ ID NO: 1677507 - RNA, 17 nt, Homo sapiens
aaagagaaaaagcccuc

SEQ ID NO: 1677508 - RNA, 20 nt, Homo sapiens
aaagagcgucauguccuugg

SEQ ID NO: 1677509 - RNA, 19 nt, Homo sapiens
aaagaggaggagaguugaa

SEQ ID NO: 1677510 - RNA, 16 nt, Homo sapiens
aaagauauuguaucuc

SEQ ID NO: 1677511 - RNA, 15 nt, Homo sapiens
aaagauggaagugua

SEQ ID NO: 1677512 - RNA, 20 nt, Homo sapiens
aaagaugugcagauaucaca

SEQ ID NO: 1677513 - RNA, 21 nt, Homo sapiens
aaagauugcuauaauguauaa

SEQ ID NO: 1677514 - RNA, 14 nt, Homo sapiens
aaagauuguuggca

SEQ ID NO: 1677515 - RNA, 17 nt, Homo sapiens
aaagcaaaucuguauaa

SEQ ID NO: 1677516 - RNA, 15 nt, Homo sapiens
aaagcaaaugggaga

SEQ ID NO: 1677517 - RNA, 18 nt, Homo sapiens
aaagcacuggccuugccu

SEQ ID NO: 1677518 - RNA, 20 nt, Homo sapiens
aaagcacuggccuugccucc

SEQ ID NO: 1677519 - RNA, 12 nt, Homo sapiens
aaagcagugcau

SEQ ID NO: 1677520 - RNA, 13 nt, Homo sapiens
aaagcagugcaug

SEQ ID NO: 1677521 - RNA, 14 nt, Homo sapiens
aaagcaugccaauu

SEQ ID NO: 1677522 - RNA, 20 nt, Homo sapiens
aaagcauggacuaaccccaa

SEQ ID NO: 1677523 - RNA, 13 nt, Homo sapiens
aaagcauguaugu

SEQ ID NO: 1677524 - RNA, 15 nt, Homo sapiens
aaagccacaaaguca

SEQ ID NO: 1677525 - RNA, 17 nt, Homo sapiens
aaagcucagucguccca

SEQ ID NO: 1677526 - RNA, 14 nt, Homo sapiens
aaaggaaaguucua

SEQ ID NO: 1677527 - RNA, 13 nt, Homo sapiens
aaaggaagaugua

SEQ ID NO: 1677528 - RNA, 17 nt, Homo sapiens
aaaggacagcucagaaa

SEQ ID NO: 1677529 - RNA, 16 nt, Homo sapiens
aaaggaggcaugccuc

SEQ ID NO: 1677530 - RNA, 18 nt, Homo sapiens
aaaggauuuuggagauuc

SEQ ID NO: 1677531 - RNA, 19 nt, Homo sapiens
aaaggggacagaucuugag

SEQ ID NO: 1677532 - RNA, 12 nt, Homo sapiens
aaagggugcaug

SEQ ID NO: 1677533 - RNA, 18 nt, Homo sapiens
aaaggguuuuaagccagg

SEQ ID NO: 1677534 - RNA, 13 nt, Homo sapiens
aaagguaggugca

SEQ ID NO: 1677535 - RNA, 13 nt, Homo sapiens
aaaguauauacag

SEQ ID NO: 1677536 - RNA, 23 nt, Homo sapiens
aaaguaucagaggugaaugcaca

SEQ ID NO: 1677537 - RNA, 11 nt, Homo sapiens
aaaguauucca

SEQ ID NO: 1677538 - RNA, 14 nt, Homo sapiens
aaagucuacacugc

SEQ ID NO: 1677539 - RNA, 15 nt, Homo sapiens
aaagucuacacugcc

SEQ ID NO: 1677540 - RNA, 19 nt, Homo sapiens
aaagugcaguagugucacu

SEQ ID NO: 1677541 - RNA, 23 nt, Homo sapiens
aaaguuaccuggaaucaaauaaa

SEQ ID NO: 1677542 - RNA, 14 nt, Homo sapiens
aaaguuauugugau

SEQ ID NO: 1677543 - RNA, 15 nt, Homo sapiens
aaaguuauugugaua

SEQ ID NO: 1677544 - RNA, 23 nt, Homo sapiens
aaaguugguuuuguaaaauucca

SEQ ID NO: 1677545 - RNA, 20 nt, Homo sapiens
aaaguugugaucuguuguaa

SEQ ID NO: 1677546 - RNA, 22 nt, Homo sapiens
aaaguuuuauuuguuuacuuua

SEQ ID NO: 1677547 - RNA, 18 nt, Homo sapiens
aaaguuuucugcuguaaa

SEQ ID NO: 1677548 - RNA, 23 nt, Homo sapiens
aaauaaaaaucauucuacugaac

SEQ ID NO: 1677549 - RNA, 12 nt, Homo sapiens
aaauaacacugu

SEQ ID NO: 1677550 - RNA, 15 nt, Homo sapiens
aaauaacagccuuaa

SEQ ID NO: 1677551 - RNA, 23 nt, Homo sapiens
aaauaaggccucauccuccacug

SEQ ID NO: 1677552 - RNA, 21 nt, Homo sapiens
aaauaagucaaaauaaucuga

SEQ ID NO: 1677553 - RNA, 12 nt, Homo sapiens
aaauaaugauuu

SEQ ID NO: 1677554 - RNA, 14 nt, Homo sapiens
aaauacauacuaua

SEQ ID NO: 1677555 - RNA, 16 nt, Homo sapiens
aaauacugcuguauaa

SEQ ID NO: 1677556 - RNA, 11 nt, Homo sapiens
aaauacuucua

SEQ ID NO: 1677557 - RNA, 14 nt, Homo sapiens
aaauagcaucugcu

SEQ ID NO: 1677558 - RNA, 15 nt, Homo sapiens
aaauaggcauaucaa

SEQ ID NO: 1677559 - RNA, 15 nt, Homo sapiens
aaauaguguguccau

SEQ ID NO: 1677560 - RNA, 19 nt, Homo sapiens
aaauaguuacaagcauuga

SEQ ID NO: 1677561 - RNA, 16 nt, Homo sapiens
aaauauaaacuugugu

SEQ ID NO: 1677562 - RNA, 14 nt, Homo sapiens
aaauauacaaacau

SEQ ID NO: 1677563 - RNA, 21 nt, Homo sapiens
aaauaucauuauagcauguaa

SEQ ID NO: 1677564 - RNA, 21 nt, Homo sapiens
aaauauugcuuggacuaccua

SEQ ID NO: 1677565 - RNA, 12 nt, Homo sapiens
aaaucagugcag

SEQ ID NO: 1677566 - RNA, 20 nt, Homo sapiens
aaaucauauuuaccugugaa

SEQ ID NO: 1677567 - RNA, 15 nt, Homo sapiens
aaaucccagccaggg

SEQ ID NO: 1677568 - RNA, 15 nt, Homo sapiens
aaaucccccaccucc

SEQ ID NO: 1677569 - RNA, 16 nt, Homo sapiens
aaaucuaaaucuucag

SEQ ID NO: 1677570 - RNA, 20 nt, Homo sapiens
aaaucuccccacuccagaag

SEQ ID NO: 1677571 - RNA, 15 nt, Homo sapiens
aaaucuggcuuagua

SEQ ID NO: 1677572 - RNA, 16 nt, Homo sapiens
aaaugaaauacuugac

SEQ ID NO: 1677573 - RNA, 16 nt, Homo sapiens
aaaugaauaaugccuu

SEQ ID NO: 1677574 - RNA, 20 nt, Homo sapiens
aaaugagccuuucugccuca

SEQ ID NO: 1677575 - RNA, 16 nt, Homo sapiens
aaaugaguucccuuga

SEQ ID NO: 1677576 - RNA, 20 nt, Homo sapiens
aaaugaucuguacuaucuag

SEQ ID NO: 1677577 - RNA, 18 nt, Homo sapiens
aaaugauuaagugcuuga

SEQ ID NO: 1677578 - RNA, 14 nt, Homo sapiens
aaaugauucacuuu

SEQ ID NO: 1677579 - RNA, 18 nt, Homo sapiens
aaaugcaaacacugugua

SEQ ID NO: 1677580 - RNA, 13 nt, Homo sapiens
aaaugcaagguga

SEQ ID NO: 1677581 - RNA, 18 nt, Homo sapiens
aaaugccaagacucuaug

SEQ ID NO: 1677582 - RNA, 16 nt, Homo sapiens
aaaugccuuugaccca

SEQ ID NO: 1677583 - RNA, 12 nt, Homo sapiens
aaaugcuuucuc

SEQ ID NO: 1677584 - RNA, 17 nt, Homo sapiens
aaauggcuuguucaguc

SEQ ID NO: 1677585 - RNA, 22 nt, Homo sapiens
aaaugggaacuggagagugugg

SEQ ID NO: 1677586 - RNA, 18 nt, Homo sapiens
aaauguacuacauuugca

SEQ ID NO: 1677587 - RNA, 12 nt, Homo sapiens
aaaugucccaaa

SEQ ID NO: 1677588 - RNA, 13 nt, Homo sapiens
aaauguucacuga

SEQ ID NO: 1677589 - RNA, 22 nt, Homo sapiens
aaauuaugucaaauggauguaa

SEQ ID NO: 1677590 - RNA, 17 nt, Homo sapiens
aaauucaguggacauuu

SEQ ID NO: 1677591 - RNA, 19 nt, Homo sapiens
aaauucaguggacauuugu

SEQ ID NO: 1677592 - RNA, 23 nt, Homo sapiens
aaauucuucuccacuuucuagcc

SEQ ID NO: 1677593 - RNA, 20 nt, Homo sapiens
aaauugaguucuuccuguaa

SEQ ID NO: 1677594 - RNA, 12 nt, Homo sapiens
aaauuggaagac

SEQ ID NO: 1677595 - RNA, 17 nt, Homo sapiens
aaauuucagaccaguuc

SEQ ID NO: 1677596 - RNA, 14 nt, Homo sapiens
aaauuuucuguaca

SEQ ID NO: 1677597 - RNA, 13 nt, Homo sapiens
aaauuuuuacuca

SEQ ID NO: 1677598 - RNA, 23 nt, Homo sapiens
aacaaaauuuaugucauuuucag

SEQ ID NO: 1677599 - RNA, 16 nt, Homo sapiens
aacaaagcaugcucag

SEQ ID NO: 1677600 - RNA, 16 nt, Homo sapiens
aacaaauauuucacuu

SEQ ID NO: 1677601 - RNA, 20 nt, Homo sapiens
aacaaaucauuuugauguau

SEQ ID NO: 1677602 - RNA, 18 nt, Homo sapiens
aacaagccacguugcaga

SEQ ID NO: 1677603 - RNA, 16 nt, Homo sapiens
aacaaggaaggacauu

SEQ ID NO: 1677604 - RNA, 16 nt, Homo sapiens
aacaauuucugugucc

SEQ ID NO: 1677605 - RNA, 13 nt, Homo sapiens
aacacaaauccaa

SEQ ID NO: 1677606 - RNA, 23 nt, Homo sapiens
aacacaaauugugaagauuucau

SEQ ID NO: 1677607 - RNA, 13 nt, Homo sapiens
aacacaacaucuu

SEQ ID NO: 1677608 - RNA, 16 nt, Homo sapiens
aacacaauacaguacu

SEQ ID NO: 1677609 - RNA, 20 nt, Homo sapiens
aacacacacacacacaaaac

SEQ ID NO: 1677610 - RNA, 19 nt, Homo sapiens
aacacacuuaucugucucu

SEQ ID NO: 1677611 - RNA, 17 nt, Homo sapiens
aacacagcaugcauuua

SEQ ID NO: 1677612 - RNA, 18 nt, Homo sapiens
aacacagugcagugcuca

SEQ ID NO: 1677613 - RNA, 13 nt, Homo sapiens
aacacuauucucc

SEQ ID NO: 1677614 - RNA, 10 nt, Homo sapiens
aacacuggag

SEQ ID NO: 1677615 - RNA, 18 nt, Homo sapiens
aacagacguuaccaauua

SEQ ID NO: 1677616 - RNA, 14 nt, Homo sapiens
aacagccucagcac

SEQ ID NO: 1677617 - RNA, 15 nt, Homo sapiens
aacagccuuaaaucc

SEQ ID NO: 1677618 - RNA, 22 nt, Homo sapiens
aacagcugaggcugucauucca

SEQ ID NO: 1677619 - RNA, 18 nt, Homo sapiens
aacagggaugcuaucucg

SEQ ID NO: 1677620 - RNA, 18 nt, Homo sapiens
aacaguuggauacaggag

SEQ ID NO: 1677621 - RNA, 15 nt, Homo sapiens
augccuuuccagugc

SEQ ID NO: 1677622 - RNA, 23 nt, Homo sapiens
augcuaucucgcuagccauauau

SEQ ID NO: 1677623 - RNA, 21 nt, Homo sapiens
augcucaaugaaaaggugauu

SEQ ID NO: 1677624 - RNA, 22 nt, Homo sapiens
augcucaguaacacagugcagu

SEQ ID NO: 1677625 - RNA, 18 nt, Homo sapiens
augcucuuuucacagcua

SEQ ID NO: 1677626 - RNA, 15 nt, Homo sapiens
augcugccaaccagc

SEQ ID NO: 1677627 - RNA, 22 nt, Homo sapiens
augcugcugagcacaucucuuc

SEQ ID NO: 1677628 - RNA, 17 nt, Homo sapiens
augcuuuuuugcaauaa

SEQ ID NO: 1677629 - RNA, 15 nt, Homo sapiens
auggaaaacuguuaa

SEQ ID NO: 1677630 - RNA, 14 nt, Homo sapiens
auggaacucgcuca

SEQ ID NO: 1677631 - RNA, 19 nt, Homo sapiens
auggcaagugcaccaagga

SEQ ID NO: 1677632 - RNA, 12 nt, Homo sapiens
auggcacuuuug

SEQ ID NO: 1677633 - RNA, 18 nt, Homo sapiens
auggccaggccucaggga

SEQ ID NO: 1677634 - RNA, 15 nt, Homo sapiens
auggccuaggaucuu

SEQ ID NO: 1677635 - RNA, 19 nt, Homo sapiens
augggagaguuucuuuaca

SEQ ID NO: 1677636 - RNA, 18 nt, Homo sapiens
auggggaacucccccaga

SEQ ID NO: 1677637 - RNA, 14 nt, Homo sapiens
augguaacugauga

SEQ ID NO: 1677638 - RNA, 16 nt, Homo sapiens
auggucacagagagac

SEQ ID NO: 1677639 - RNA, 15 nt, Homo sapiens
auggugaacugucau

SEQ ID NO: 1677640 - RNA, 15 nt, Homo sapiens
auggugcgaucucag

SEQ ID NO: 1677641 - RNA, 18 nt, Homo sapiens
auggugcuggguccuuaa

SEQ ID NO: 1677642 - RNA, 18 nt, Homo sapiens
augguguguguucagcuc

SEQ ID NO: 1677643 - RNA, 18 nt, Homo sapiens
augguugguuagugcaug

SEQ ID NO: 1677644 - RNA, 23 nt, Homo sapiens
auguaacuuaauuauaagcuaug

SEQ ID NO: 1677645 - RNA, 17 nt, Homo sapiens
auguacaggcugagaca

SEQ ID NO: 1677646 - RNA, 19 nt, Homo sapiens
auguacauuuucuaacaaa

SEQ ID NO: 1677647 - RNA, 22 nt, Homo sapiens
auguacccagccuaccagagau

SEQ ID NO: 1677648 - RNA, 17 nt, Homo sapiens
auguagauaaagcacug

SEQ ID NO: 1677649 - RNA, 23 nt, Homo sapiens
auguagcaaauuccaauacauua

SEQ ID NO: 1677650 - RNA, 12 nt, Homo sapiens
auguauacacac

SEQ ID NO: 1677651 - RNA, 16 nt, Homo sapiens
auguaugucaccucag

SEQ ID NO: 1677652 - RNA, 20 nt, Homo sapiens
augucauugaugaacugcca

SEQ ID NO: 1677653 - RNA, 23 nt, Homo sapiens
augucauuuucagauccuuccaa

SEQ ID NO: 1677654 - RNA, 19 nt, Homo sapiens
auguccccugcuugaacac

SEQ ID NO: 1677655 - RNA, 16 nt, Homo sapiens
augucuauaacuccuu

SEQ ID NO: 1677656 - RNA, 20 nt, Homo sapiens
augucugaggauaccuucca

SEQ ID NO: 1677657 - RNA, 20 nt, Homo sapiens
augucuguguauacauaugu

SEQ ID NO: 1677658 - RNA, 14 nt, Homo sapiens
augucuuuaaaaug

SEQ ID NO: 1677659 - RNA, 23 nt, Homo sapiens
augugagaccauuuagcacacug

SEQ ID NO: 1677660 - RNA, 20 nt, Homo sapiens
augugcaaagcaguauguac

SEQ ID NO: 1677661 - RNA, 17 nt, Homo sapiens
augugcagauaucacag

SEQ ID NO: 1677662 - RNA, 12 nt, Homo sapiens
augugcuauuaa

SEQ ID NO: 1677663 - RNA, 15 nt, Homo sapiens
auguggaaaacucac

SEQ ID NO: 1677664 - RNA, 13 nt, Homo sapiens
auguggucuguca

SEQ ID NO: 1677665 - RNA, 18 nt, Homo sapiens
auguggugggagcacagc

SEQ ID NO: 1677666 - RNA, 18 nt, Homo sapiens
auguguccccucacucug

SEQ ID NO: 1677667 - RNA, 22 nt, Homo sapiens
augugugagucacuucuacgca

SEQ ID NO: 1677668 - RNA, 14 nt, Homo sapiens
augugugucagccc

SEQ ID NO: 1677669 - RNA, 16 nt, Homo sapiens
auguguguucaugcac

SEQ ID NO: 1677670 - RNA, 17 nt, Homo sapiens
auguuauaggcacuugc

SEQ ID NO: 1677671 - RNA, 10 nt, Homo sapiens
auguucaagc

SEQ ID NO: 1677672 - RNA, 17 nt, Homo sapiens
auguuccguucaucuga

SEQ ID NO: 1677673 - RNA, 19 nt, Homo sapiens
auguugauguguccgugaa

SEQ ID NO: 1677674 - RNA, 22 nt, Homo sapiens
auguugauucuagguugaaaau

SEQ ID NO: 1677675 - RNA, 21 nt, Homo sapiens
auguuggcuagacuagucuca

SEQ ID NO: 1677676 - RNA, 23 nt, Homo sapiens
auguugguacccuggacagugcc

SEQ ID NO: 1677677 - RNA, 13 nt, Homo sapiens
auguuucagacca

SEQ ID NO: 1677678 - RNA, 22 nt, Homo sapiens
auguuuucacuuaaaaguauca

SEQ ID NO: 1677679 - RNA, 14 nt, Homo sapiens
auguuuuucuucau

SEQ ID NO: 1677680 - RNA, 20 nt, Homo sapiens
auuaaacugggaaaugagau

SEQ ID NO: 1677681 - RNA, 18 nt, Homo sapiens
auuaaagucuacacugcc

SEQ ID NO: 1677682 - RNA, 17 nt, Homo sapiens
auuaacucugcauagac

SEQ ID NO: 1677683 - RNA, 20 nt, Homo sapiens
auuaacugaaaagcaguuua

SEQ ID NO: 1677684 - RNA, 16 nt, Homo sapiens
auuaauccacacauca

SEQ ID NO: 1677685 - RNA, 15 nt, Homo sapiens
auuaauggcacugau

SEQ ID NO: 1677686 - RNA, 21 nt, Homo sapiens
auuacaacugcuacagagcag

SEQ ID NO: 1677687 - RNA, 17 nt, Homo sapiens
auuacaaguuguacuaa

SEQ ID NO: 1677688 - RNA, 19 nt, Homo sapiens
auuacaggaaguacuggag

SEQ ID NO: 1677689 - RNA, 19 nt, Homo sapiens
auuacuccauuacuaaaga

SEQ ID NO: 1677690 - RNA, 15 nt, Homo sapiens
auuacuggaucucuu

SEQ ID NO: 1677691 - RNA, 21 nt, Homo sapiens
auuacuguuugaaacuuuuca

SEQ ID NO: 1677692 - RNA, 23 nt, Homo sapiens
auuagaagaaaauggaugacaaa

SEQ ID NO: 1677693 - RNA, 16 nt, Homo sapiens
auuagacauaccucuc

SEQ ID NO: 1677694 - RNA, 17 nt, Homo sapiens
auuagcaccagcuugcu

SEQ ID NO: 1677695 - RNA, 20 nt, Homo sapiens
auuagcaugaaagcaguuua

SEQ ID NO: 1677696 - RNA, 21 nt, Homo sapiens
auuagcccacugccuggaaag

SEQ ID NO: 1677697 - RNA, 14 nt, Homo sapiens
auuaguauccuguu

SEQ ID NO: 1677698 - RNA, 19 nt, Homo sapiens
auuauaagcuaugucacua

SEQ ID NO: 1677699 - RNA, 20 nt, Homo sapiens
auuauaguaccacugcacau

SEQ ID NO: 1677700 - RNA, 14 nt, Homo sapiens
auuauagucuguac

SEQ ID NO: 1677701 - RNA, 23 nt, Homo sapiens
auuauauuugugugaaaauguga

SEQ ID NO: 1677702 - RNA, 18 nt, Homo sapiens
auuauggagugucaccag

SEQ ID NO: 1677703 - RNA, 15 nt, Homo sapiens
auuauuuacugacau

SEQ ID NO: 1677704 - RNA, 14 nt, Homo sapiens
auuauuuaucacau

SEQ ID NO: 1677705 - RNA, 18 nt, Homo sapiens
auuauuuuucacugcccc

SEQ ID NO: 1677706 - RNA, 19 nt, Homo sapiens
auuauuuuucacugcccca

SEQ ID NO: 1677707 - RNA, 16 nt, Homo sapiens
auuauuuuugagacag

SEQ ID NO: 1677708 - RNA, 21 nt, Homo sapiens
auuauuuuugcucugcucugu

SEQ ID NO: 1677709 - RNA, 22 nt, Homo sapiens
auucaaaccuaaguugcuggac

SEQ ID NO: 1677710 - RNA, 17 nt, Homo sapiens
auucaaagaaucaccua

SEQ ID NO: 1677711 - RNA, 23 nt, Homo sapiens
auucaacagguuuuccugaagaa

SEQ ID NO: 1677712 - RNA, 13 nt, Homo sapiens
auucaagcuucau

SEQ ID NO: 1677713 - RNA, 16 nt, Homo sapiens
auucaccuaacuuuca

SEQ ID NO: 1677714 - RNA, 14 nt, Homo sapiens
auucaccuguaaaa

SEQ ID NO: 1677715 - RNA, 20 nt, Homo sapiens
auucagaaaagaugugcaga

SEQ ID NO: 1677716 - RNA, 20 nt, Homo sapiens
auucaggaaauguucacuga

SEQ ID NO: 1677717 - RNA, 15 nt, Homo sapiens
auucaguaaggcagu

SEQ ID NO: 1677718 - RNA, 20 nt, Homo sapiens
auucaguuucuaaaauugag

SEQ ID NO: 1677719 - RNA, 12 nt, Homo sapiens
auucaugcagca

SEQ ID NO: 1677720 - RNA, 23 nt, Homo sapiens
auucaugcagcaaauaugggcug

SEQ ID NO: 1677721 - RNA, 13 nt, Homo sapiens
auucaugcugcuu

SEQ ID NO: 1677722 - RNA, 22 nt, Homo sapiens
auucaugcugcuuagaugacau

SEQ ID NO: 1677723 - RNA, 16 nt, Homo sapiens
auucauuagcugugau

SEQ ID NO: 1677724 - RNA, 18 nt, Homo sapiens
auucauuagcugugauuu

SEQ ID NO: 1677725 - RNA, 20 nt, Homo sapiens
auucauuuauucaucauuca

SEQ ID NO: 1677726 - RNA, 23 nt, Homo sapiens
auuccaccccagcaggacaguga

SEQ ID NO: 1677727 - RNA, 17 nt, Homo sapiens
auuccaccuagagcuag

SEQ ID NO: 1677728 - RNA, 18 nt, Homo sapiens
auuccagcauugucugac

SEQ ID NO: 1677729 - RNA, 14 nt, Homo sapiens
auuccagugcagua

SEQ ID NO: 1677730 - RNA, 20 nt, Homo sapiens
auuccagugcaguagugcca

SEQ ID NO: 1677731 - RNA, 22 nt, Homo sapiens
auuccagugcaguagugccaaa

SEQ ID NO: 1677732 - RNA, 19 nt, Homo sapiens
auucccaagccaaaaaccu

SEQ ID NO: 1677733 - RNA, 14 nt, Homo sapiens
auucccaaucccau

SEQ ID NO: 1677734 - RNA, 22 nt, Homo sapiens
auucccaugguagacugugaca

SEQ ID NO: 1677735 - RNA, 16 nt, Homo sapiens
auuccucuaagaucuu

SEQ ID NO: 1677736 - RNA, 14 nt, Homo sapiens
auuccuucuggccu

SEQ ID NO: 1677737 - RNA, 15 nt, Homo sapiens
auucuaaaagauaag

SEQ ID NO: 1677738 - RNA, 14 nt, Homo sapiens
auucuauaagagac

SEQ ID NO: 1677739 - RNA, 15 nt, Homo sapiens
auucucaguuuaaaa

SEQ ID NO: 1677740 - RNA, 13 nt, Homo sapiens
auucucccuuuau

SEQ ID NO: 1677741 - RNA, 15 nt, Homo sapiens
auucuccggccucag

SEQ ID NO: 1677742 - RNA, 18 nt, Homo sapiens
caguucccucagcccuca

SEQ ID NO: 1677743 - RNA, 12 nt, Homo sapiens
caguucugauga

SEQ ID NO: 1677744 - RNA, 17 nt, Homo sapiens
caguugcaauaaacuca

SEQ ID NO: 1677745 - RNA, 15 nt, Homo sapiens
caguuguuauauuca

SEQ ID NO: 1677746 - RNA, 12 nt, Homo sapiens
caguuucuugca

SEQ ID NO: 1677747 - RNA, 19 nt, Homo sapiens
cauaaaaaucccucuuccu

SEQ ID NO: 1677748 - RNA, 13 nt, Homo sapiens
cauaaacacuucu

SEQ ID NO: 1677749 - RNA, 20 nt, Homo sapiens
cauaaacacuucuccuuaac

SEQ ID NO: 1677750 - RNA, 14 nt, Homo sapiens
cauaaccgcacaga

SEQ ID NO: 1677751 - RNA, 13 nt, Homo sapiens
cauaacuagagua

SEQ ID NO: 1677752 - RNA, 18 nt, Homo sapiens
cauaaugacuuaagcaca

SEQ ID NO: 1677753 - RNA, 19 nt, Homo sapiens
cauaaugacuuaagcacac

SEQ ID NO: 1677754 - RNA, 16 nt, Homo sapiens
cauaccuucugaugaa

SEQ ID NO: 1677755 - RNA, 18 nt, Homo sapiens
cauagccauucauuuaca

SEQ ID NO: 1677756 - RNA, 18 nt, Homo sapiens
cauagcuugcaguuucau

SEQ ID NO: 1677757 - RNA, 17 nt, Homo sapiens
cauaguucugcaauaac

SEQ ID NO: 1677758 - RNA, 22 nt, Homo sapiens
cauauauaaauuauuacuuuaa

SEQ ID NO: 1677759 - RNA, 16 nt, Homo sapiens
cauauaucuauuacac

SEQ ID NO: 1677760 - RNA, 12 nt, Homo sapiens
cauaucagcucu

SEQ ID NO: 1677761 - RNA, 12 nt, Homo sapiens
cauaucauucag

SEQ ID NO: 1677762 - RNA, 23 nt, Homo sapiens
cauaugauaaauuugacuguuau

SEQ ID NO: 1677763 - RNA, 16 nt, Homo sapiens
cauaugcuuuaagaau

SEQ ID NO: 1677764 - RNA, 16 nt, Homo sapiens
cauauguaucuauaca

SEQ ID NO: 1677765 - RNA, 12 nt, Homo sapiens
cauauguaugug

SEQ ID NO: 1677766 - RNA, 15 nt, Homo sapiens
cauauguauguguga

SEQ ID NO: 1677767 - RNA, 11 nt, Homo sapiens
cauauguuaau

SEQ ID NO: 1677768 - RNA, 12 nt, Homo sapiens
caucaaagcccu

SEQ ID NO: 1677769 - RNA, 17 nt, Homo sapiens
caucaagaaacauucag

SEQ ID NO: 1677770 - RNA, 16 nt, Homo sapiens
caucaauaaaacacaa

SEQ ID NO: 1677771 - RNA, 18 nt, Homo sapiens
caucacugaaaucccucu

SEQ ID NO: 1677772 - RNA, 18 nt, Homo sapiens
caucaggccuaaucucau

SEQ ID NO: 1677773 - RNA, 11 nt, Homo sapiens
caucaucucag

SEQ ID NO: 1677774 - RNA, 19 nt, Homo sapiens
cauccacaugcacauguau

SEQ ID NO: 1677775 - RNA, 13 nt, Homo sapiens
cauccaguaucuu

SEQ ID NO: 1677776 - RNA, 20 nt, Homo sapiens
cauccauagacacaguauug

SEQ ID NO: 1677777 - RNA, 21 nt, Homo sapiens
caucccucuggggcuguucac

SEQ ID NO: 1677778 - RNA, 13 nt, Homo sapiens
cauccucacuuuu

SEQ ID NO: 1677779 - RNA, 22 nt, Homo sapiens
cauccugaaaaggguguugcua

SEQ ID NO: 1677780 - RNA, 20 nt, Homo sapiens
cauccuggcuaacacaguga

SEQ ID NO: 1677781 - RNA, 13 nt, Homo sapiens
cauccuucaucug

SEQ ID NO: 1677782 - RNA, 11 nt, Homo sapiens
caucuaagaca

SEQ ID NO: 1677783 - RNA, 14 nt, Homo sapiens
caucuaagacauuc

SEQ ID NO: 1677784 - RNA, 13 nt, Homo sapiens
caucuaccuucca

SEQ ID NO: 1677785 - RNA, 11 nt, Homo sapiens
caucuauguga

SEQ ID NO: 1677786 - RNA, 14 nt, Homo sapiens
caucucaagugcca

SEQ ID NO: 1677787 - RNA, 15 nt, Homo sapiens
caucucaagugccau

SEQ ID NO: 1677788 - RNA, 20 nt, Homo sapiens
caucucaagugccauauucu

SEQ ID NO: 1677789 - RNA, 23 nt, Homo sapiens
caucucagcaaucacaagccaag

SEQ ID NO: 1677790 - RNA, 21 nt, Homo sapiens
caucucagguggcauuugcag

SEQ ID NO: 1677791 - RNA, 17 nt, Homo sapiens
caucucccggugccuug

SEQ ID NO: 1677792 - RNA, 20 nt, Homo sapiens
caucucgcugccgucugucc

SEQ ID NO: 1677793 - RNA, 15 nt, Homo sapiens
caucugaggagucca

SEQ ID NO: 1677794 - RNA, 16 nt, Homo sapiens
caucugauaugacccc

SEQ ID NO: 1677795 - RNA, 13 nt, Homo sapiens
caucugcauuucu

SEQ ID NO: 1677796 - RNA, 15 nt, Homo sapiens
caucugucagugagu

SEQ ID NO: 1677797 - RNA, 15 nt, Homo sapiens
caugaaaaguuuuca

SEQ ID NO: 1677798 - RNA, 12 nt, Homo sapiens
caugaagcacau

SEQ ID NO: 1677799 - RNA, 14 nt, Homo sapiens
caugaaucucucaa

SEQ ID NO: 1677800 - RNA, 15 nt, Homo sapiens
caugaauucuucuca

SEQ ID NO: 1677801 - RNA, 11 nt, Homo sapiens
caugacacuga

SEQ ID NO: 1677802 - RNA, 13 nt, Homo sapiens
caugacacugacc

SEQ ID NO: 1677803 - RNA, 20 nt, Homo sapiens
caugacugcauuuuacugua

SEQ ID NO: 1677804 - RNA, 22 nt, Homo sapiens
caugaggugagagaaagccaca

SEQ ID NO: 1677805 - RNA, 22 nt, Homo sapiens
caugaucgcuuucuacacugua

SEQ ID NO: 1677806 - RNA, 16 nt, Homo sapiens
caugauuagugcaaua

SEQ ID NO: 1677807 - RNA, 17 nt, Homo sapiens
caugauugugaccucca

SEQ ID NO: 1677808 - RNA, 15 nt, Homo sapiens
caugauuugggguga

SEQ ID NO: 1677809 - RNA, 19 nt, Homo sapiens
caugcacagcuaacaugga

SEQ ID NO: 1677810 - RNA, 15 nt, Homo sapiens
caugcccagcuugga

SEQ ID NO: 1677811 - RNA, 16 nt, Homo sapiens
caugccuuuccagugc

SEQ ID NO: 1677812 - RNA, 14 nt, Homo sapiens
caugcucaguauug

SEQ ID NO: 1677813 - RNA, 18 nt, Homo sapiens
caugcucaguuggugcug

SEQ ID NO: 1677814 - RNA, 13 nt, Homo sapiens
cauggaaguacua

SEQ ID NO: 1677815 - RNA, 17 nt, Homo sapiens
cauggacaucagcauca

SEQ ID NO: 1677816 - RNA, 15 nt, Homo sapiens
cauggaucugcauaa

SEQ ID NO: 1677817 - RNA, 18 nt, Homo sapiens
cauggcuggaugugcauc

SEQ ID NO: 1677818 - RNA, 19 nt, Homo sapiens
cauggguggagggucccua

SEQ ID NO: 1677819 - RNA, 17 nt, Homo sapiens
cauggguucaauuggac

SEQ ID NO: 1677820 - RNA, 17 nt, Homo sapiens
caugguauuaucuagua

SEQ ID NO: 1677821 - RNA, 14 nt, Homo sapiens
cauggucagucuac

SEQ ID NO: 1677822 - RNA, 12 nt, Homo sapiens
cauggugcagug

SEQ ID NO: 1677823 - RNA, 15 nt, Homo sapiens
cauggugcagugaag

SEQ ID NO: 1677824 - RNA, 14 nt, Homo sapiens
cauguagcauauaa

SEQ ID NO: 1677825 - RNA, 20 nt, Homo sapiens
cauguauguuuuuuacuguu

SEQ ID NO: 1677826 - RNA, 18 nt, Homo sapiens
cauguccccugcuugaac

SEQ ID NO: 1677827 - RNA, 18 nt, Homo sapiens
caugugcugcuguggcau

SEQ ID NO: 1677828 - RNA, 19 nt, Homo sapiens
cauguggaaaacucacaga

SEQ ID NO: 1677829 - RNA, 20 nt, Homo sapiens
cauguggaaaacucacagau

SEQ ID NO: 1677830 - RNA, 22 nt, Homo sapiens
cauguggcacguaaggucucau

SEQ ID NO: 1677831 - RNA, 20 nt, Homo sapiens
cauguguccccccugugguc

SEQ ID NO: 1677832 - RNA, 20 nt, Homo sapiens
caugugugucagcccauguc

SEQ ID NO: 1677833 - RNA, 22 nt, Homo sapiens
cauguguguucaugcacacuug

SEQ ID NO: 1677834 - RNA, 18 nt, Homo sapiens
cauguuauuuauaguguu

SEQ ID NO: 1677835 - RNA, 14 nt, Homo sapiens
cauguucauucaca

SEQ ID NO: 1677836 - RNA, 13 nt, Homo sapiens
cauguucauucag

SEQ ID NO: 1677837 - RNA, 23 nt, Homo sapiens
cauguuucccgcuccaagagaau

SEQ ID NO: 1677838 - RNA, 14 nt, Homo sapiens
cauguuuugcuaau

SEQ ID NO: 1677839 - RNA, 20 nt, Homo sapiens
cauuaaacuucuacugagca

SEQ ID NO: 1677840 - RNA, 17 nt, Homo sapiens
cauuaacaaaagcaauu

SEQ ID NO: 1677841 - RNA, 15 nt, Homo sapiens
cauuacaggugugag

SEQ ID NO: 1677842 - RNA, 12 nt, Homo sapiens
cauuagugccau

SEQ ID NO: 1677843 - RNA, 15 nt, Homo sapiens
cauuauucuuucuaa

SEQ ID NO: 1677844 - RNA, 22 nt, Homo sapiens
cauucagucugcagcuauucac

SEQ ID NO: 1677845 - RNA, 19 nt, Homo sapiens
cauuccaugagucuucaga

SEQ ID NO: 1677846 - RNA, 23 nt, Homo sapiens
cauuccgaaaaaaaaauguucau

SEQ ID NO: 1677847 - RNA, 22 nt, Homo sapiens
cauucguccuuagaauacugua

SEQ ID NO: 1677848 - RNA, 13 nt, Homo sapiens
cauucuaugacaa

SEQ ID NO: 1677849 - RNA, 17 nt, Homo sapiens
cauugacccucaccuga

SEQ ID NO: 1677850 - RNA, 19 nt, Homo sapiens
cauugacgagcaugagcug

SEQ ID NO: 1677851 - RNA, 23 nt, Homo sapiens
cauugaugacaugggauugaguu

SEQ ID NO: 1677852 - RNA, 12 nt, Homo sapiens
cauugauuggua

SEQ ID NO: 1677853 - RNA, 22 nt, Homo sapiens
cauugauugguaguucgaagaa

SEQ ID NO: 1677854 - RNA, 22 nt, Homo sapiens
cauugcacuaaaagugauguga

SEQ ID NO: 1677855 - RNA, 15 nt, Homo sapiens
cauugcuuaugacau

SEQ ID NO: 1677856 - RNA, 20 nt, Homo sapiens
cauugcuucauuaaaacaag

SEQ ID NO: 1677857 - RNA, 14 nt, Homo sapiens
cauugguaucugau

SEQ ID NO: 1677858 - RNA, 20 nt, Homo sapiens
cauuguagccuaauauucau

SEQ ID NO: 1677859 - RNA, 19 nt, Homo sapiens
cauuguaucuucauacaaa

SEQ ID NO: 1677860 - RNA, 16 nt, Homo sapiens
cauugucugacuguga

SEQ ID NO: 1677861 - RNA, 20 nt, Homo sapiens
cauuguuacagguguacuau

SEQ ID NO: 1677862 - RNA, 22 nt, Homo sapiens
cauuguucagaaaagcaccucu

SEQ ID NO: 1677863 - RNA, 15 nt, Homo sapiens
cauuuacaacuucca

SEQ ID NO: 1677864 - RNA, 21 nt, Homo sapiens
cauuucauaaaaaucccucuu

SEQ ID NO: 1677865 - RNA, 17 nt, Homo sapiens
ccuuugauguggaugaa

SEQ ID NO: 1677866 - RNA, 21 nt, Homo sapiens
ccuuuguaaccacaacuuuca

SEQ ID NO: 1677867 - RNA, 21 nt, Homo sapiens
ccuuuucuauuccuucuggcc

SEQ ID NO: 1677868 - RNA, 20 nt, Homo sapiens
ccuuuugucuacggaagccu

SEQ ID NO: 1677869 - RNA, 13 nt, Homo sapiens
ccuuuuuaaucca

SEQ ID NO: 1677870 - RNA, 18 nt, Homo sapiens
ccuuuuuuccuuuccuga

SEQ ID NO: 1677871 - RNA, 19 nt, Homo sapiens
cgaaaagaggggaagagac

SEQ ID NO: 1677872 - RNA, 23 nt, Homo sapiens
cgaauuuucacagccaugauucu

SEQ ID NO: 1677873 - RNA, 14 nt, Homo sapiens
cgagccaggaacug

SEQ ID NO: 1677874 - RNA, 20 nt, Homo sapiens
cgagcuaauuaacuaacuca

SEQ ID NO: 1677875 - RNA, 11 nt, Homo sapiens
cgaguuacaga

SEQ ID NO: 1677876 - RNA, 15 nt, Homo sapiens
cgaguuacagacaaa

SEQ ID NO: 1677877 - RNA, 18 nt, Homo sapiens
cgaguuccggaaagccuu

SEQ ID NO: 1677878 - RNA, 17 nt, Homo sapiens
cgauagugguggugaac

SEQ ID NO: 1677879 - RNA, 13 nt, Homo sapiens
cgauccccaugga

SEQ ID NO: 1677880 - RNA, 15 nt, Homo sapiens
cgauguggaccucua

SEQ ID NO: 1677881 - RNA, 21 nt, Homo sapiens
cgcaaccaccaccaaccacug

SEQ ID NO: 1677882 - RNA, 21 nt, Homo sapiens
cgcaaggaucacuugagccca

SEQ ID NO: 1677883 - RNA, 11 nt, Homo sapiens
cgcacaguauu

SEQ ID NO: 1677884 - RNA, 15 nt, Homo sapiens
cgcagagcugacccc

SEQ ID NO: 1677885 - RNA, 20 nt, Homo sapiens
cgcaucucaacaaaucucag

SEQ ID NO: 1677886 - RNA, 12 nt, Homo sapiens
cgccaccugccc

SEQ ID NO: 1677887 - RNA, 22 nt, Homo sapiens
cgccaugggggucuuugaacac

SEQ ID NO: 1677888 - RNA, 20 nt, Homo sapiens
cgccugggaaucaggauucc

SEQ ID NO: 1677889 - RNA, 23 nt, Homo sapiens
cgccugguucuguacauguggaa

SEQ ID NO: 1677890 - RNA, 13 nt, Homo sapiens
cgcgcaccgccca

SEQ ID NO: 1677891 - RNA, 13 nt, Homo sapiens
cgcggcucuccag

SEQ ID NO: 1677892 - RNA, 17 nt, Homo sapiens
cgcugagggcaggguuc

SEQ ID NO: 1677893 - RNA, 19 nt, Homo sapiens
cgcugcccacgucccgggc

SEQ ID NO: 1677894 - RNA, 19 nt, Homo sapiens
cgcugggagaaaagccaga

SEQ ID NO: 1677895 - RNA, 14 nt, Homo sapiens
cgcuucauaggcag

SEQ ID NO: 1677896 - RNA, 12 nt, Homo sapiens
cgcuuuuguacg

SEQ ID NO: 1677897 - RNA, 17 nt, Homo sapiens
cggaaagccuuccucaa

SEQ ID NO: 1677898 - RNA, 20 nt, Homo sapiens
cggaagccucugggugacaa

SEQ ID NO: 1677899 - RNA, 15 nt, Homo sapiens
cggaccugcuuugag

SEQ ID NO: 1677900 - RNA, 16 nt, Homo sapiens
cggacgccccccggcc

SEQ ID NO: 1677901 - RNA, 16 nt, Homo sapiens
cggaugaccauaugca

SEQ ID NO: 1677902 - RNA, 23 nt, Homo sapiens
cggccuccuagccucuccgccca

SEQ ID NO: 1677903 - RNA, 14 nt, Homo sapiens
cggccugauggcca

SEQ ID NO: 1677904 - RNA, 12 nt, Homo sapiens
cgggcacuguca

SEQ ID NO: 1677905 - RNA, 17 nt, Homo sapiens
cggggcacccagcccaa

SEQ ID NO: 1677906 - RNA, 19 nt, Homo sapiens
cgguccuguguuccuguga

SEQ ID NO: 1677907 - RNA, 14 nt, Homo sapiens
cguaaggucucauu

SEQ ID NO: 1677908 - RNA, 20 nt, Homo sapiens
cguacccuuugcacacaggg

SEQ ID NO: 1677909 - RNA, 20 nt, Homo sapiens
cguccagcaagugucaucac

SEQ ID NO: 1677910 - RNA, 19 nt, Homo sapiens
cguccuuagaauacuguau

SEQ ID NO: 1677911 - RNA, 9 nt, Homo sapiens
cgucuuccc

SEQ ID NO: 1677912 - RNA, 19 nt, Homo sapiens
cgugaaaguugugaucugu

SEQ ID NO: 1677913 - RNA, 14 nt, Homo sapiens
cgugcccauuucac

SEQ ID NO: 1677914 - RNA, 13 nt, Homo sapiens
cguggauugugaa

SEQ ID NO: 1677915 - RNA, 17 nt, Homo sapiens
cguggccgcugcuguga

SEQ ID NO: 1677916 - RNA, 17 nt, Homo sapiens
cguggugggugcucaag

SEQ ID NO: 1677917 - RNA, 15 nt, Homo sapiens
cgugugagcagucuc

SEQ ID NO: 1677918 - RNA, 19 nt, Homo sapiens
cguguguagauaguaugca

SEQ ID NO: 1677919 - RNA, 14 nt, Homo sapiens
cguguuaugacucc

SEQ ID NO: 1677920 - RNA, 20 nt, Homo sapiens
cguguucacacacacacaau

SEQ ID NO: 1677921 - RNA, 15 nt, Homo sapiens
cguucucuaccuuca

SEQ ID NO: 1677922 - RNA, 14 nt, Homo sapiens
cuaaacccaaauaa

SEQ ID NO: 1677923 - RNA, 12 nt, Homo sapiens
cuaaagacagaa

SEQ ID NO: 1677924 - RNA, 15 nt, Homo sapiens
cuaaaucuucagcau

SEQ ID NO: 1677925 - RNA, 11 nt, Homo sapiens
cuaaauuucca

SEQ ID NO: 1677926 - RNA, 22 nt, Homo sapiens
cuaacaaguagcacacugaguu

SEQ ID NO: 1677927 - RNA, 12 nt, Homo sapiens
cuaacagcauaa

SEQ ID NO: 1677928 - RNA, 14 nt, Homo sapiens
cuaacagccagcuu

SEQ ID NO: 1677929 - RNA, 17 nt, Homo sapiens
cuaacagccucagcaca

SEQ ID NO: 1677930 - RNA, 18 nt, Homo sapiens
cuaacagccucagcacau

SEQ ID NO: 1677931 - RNA, 21 nt, Homo sapiens
cuaaccuggguuguugcagag

SEQ ID NO: 1677932 - RNA, 14 nt, Homo sapiens
cuaacgccauccag

SEQ ID NO: 1677933 - RNA, 20 nt, Homo sapiens
cuaacugggcggcugaggca

SEQ ID NO: 1677934 - RNA, 11 nt, Homo sapiens
cuaacuuucau

SEQ ID NO: 1677935 - RNA, 21 nt, Homo sapiens
cuaagaaauggcuuuccacau

SEQ ID NO: 1677936 - RNA, 13 nt, Homo sapiens
cuaagaucuugcc

SEQ ID NO: 1677937 - RNA, 15 nt, Homo sapiens
cuaagguacggugag

SEQ ID NO: 1677938 - RNA, 20 nt, Homo sapiens
cuaaguaaccugauuacaag

SEQ ID NO: 1677939 - RNA, 23 nt, Homo sapiens
cuaagugaggaugaaaaaauaac

SEQ ID NO: 1677940 - RNA, 18 nt, Homo sapiens
cuaauaaaauacauacua

SEQ ID NO: 1677941 - RNA, 15 nt, Homo sapiens
cuaauguacaauaaa

SEQ ID NO: 1677942 - RNA, 20 nt, Homo sapiens
cuaauguacaauaaagcaau

SEQ ID NO: 1677943 - RNA, 22 nt, Homo sapiens
cuaauguacaauaaagcaaugu

SEQ ID NO: 1677944 - RNA, 14 nt, Homo sapiens
cuaaugucagcaca

SEQ ID NO: 1677945 - RNA, 17 nt, Homo sapiens
cuaaugucagcacaugu

SEQ ID NO: 1677946 - RNA, 22 nt, Homo sapiens
cuaauuaaaaaguuaaucuuca

SEQ ID NO: 1677947 - RNA, 23 nt, Homo sapiens
cuaauuaaaaaguuaaucuucau

SEQ ID NO: 1677948 - RNA, 19 nt, Homo sapiens
cuaauucauguuuucacuu

SEQ ID NO: 1677949 - RNA, 17 nt, Homo sapiens
cuaauucuaugauuaaa

SEQ ID NO: 1677950 - RNA, 23 nt, Homo sapiens
cuaauuguacccuucuugucucu

SEQ ID NO: 1677951 - RNA, 13 nt, Homo sapiens
cuaauuugugaaa

SEQ ID NO: 1677952 - RNA, 12 nt, Homo sapiens
cuacacugccuu

SEQ ID NO: 1677953 - RNA, 19 nt, Homo sapiens
cuacagagcagacaguuaa

SEQ ID NO: 1677954 - RNA, 13 nt, Homo sapiens
cuacaguauauaa

SEQ ID NO: 1677955 - RNA, 22 nt, Homo sapiens
cuacauugacgagcaugagcug

SEQ ID NO: 1677956 - RNA, 12 nt, Homo sapiens
cuacauuugcau

SEQ ID NO: 1677957 - RNA, 21 nt, Homo sapiens
cuaccaaagggaguguugaaa

SEQ ID NO: 1677958 - RNA, 13 nt, Homo sapiens
cuaccacauucac

SEQ ID NO: 1677959 - RNA, 16 nt, Homo sapiens
cuaccgcaaggaccug

SEQ ID NO: 1677960 - RNA, 13 nt, Homo sapiens
cuaccucuguccc

SEQ ID NO: 1677961 - RNA, 14 nt, Homo sapiens
cuacgaaagcacag

SEQ ID NO: 1677962 - RNA, 20 nt, Homo sapiens
cuacucuuaaauauacaacu

SEQ ID NO: 1677963 - RNA, 17 nt, Homo sapiens
cuagaacacaaauccaa

SEQ ID NO: 1677964 - RNA, 14 nt, Homo sapiens
cuagaagaauuuca

SEQ ID NO: 1677965 - RNA, 12 nt, Homo sapiens
cuagaagcacag

SEQ ID NO: 1677966 - RNA, 15 nt, Homo sapiens
cuagaugugucuuac

SEQ ID NO: 1677967 - RNA, 20 nt, Homo sapiens
cuagauuaccaugaagaaca

SEQ ID NO: 1677968 - RNA, 16 nt, Homo sapiens
cuagcauggcugccaa

SEQ ID NO: 1677969 - RNA, 19 nt, Homo sapiens
cuagccagaggcucuaaug

SEQ ID NO: 1677970 - RNA, 23 nt, Homo sapiens
cuaggcagaucacguugcaaugg

SEQ ID NO: 1677971 - RNA, 21 nt, Homo sapiens
cuaggccuugccccaccucca

SEQ ID NO: 1677972 - RNA, 23 nt, Homo sapiens
cuaggccuugccccaccuccauc

SEQ ID NO: 1677973 - RNA, 15 nt, Homo sapiens
cuaggcugagucuag

SEQ ID NO: 1677974 - RNA, 22 nt, Homo sapiens
cuaguaggucugcacacauaac

SEQ ID NO: 1677975 - RNA, 23 nt, Homo sapiens
cuaguaggucugcacacauaaca

SEQ ID NO: 1677976 - RNA, 23 nt, Homo sapiens
cuaguccccagccugcucccuag

SEQ ID NO: 1677977 - RNA, 18 nt, Homo sapiens
cuagucugugccucagug

SEQ ID NO: 1677978 - RNA, 23 nt, Homo sapiens
cuagugucuuuuuuuucuucacc

SEQ ID NO: 1677979 - RNA, 15 nt, Homo sapiens
cuaguuagcucacaa

SEQ ID NO: 1677980 - RNA, 23 nt, Homo sapiens
cuaguugccguggcaacugugga

SEQ ID NO: 1677981 - RNA, 17 nt, Homo sapiens
cuauaaauggugucaua

SEQ ID NO: 1677982 - RNA, 14 nt, Homo sapiens
cuauacuacauuau

SEQ ID NO: 1677983 - RNA, 19 nt, Homo sapiens
cuauacuuaggcauagucu

SEQ ID NO: 1677984 - RNA, 15 nt, Homo sapiens
cuauauguugcugaa

SEQ ID NO: 1677985 - RNA, 21 nt, Homo sapiens
cuauccccggacgcaugcagg

SEQ ID NO: 1677986 - RNA, 17 nt, Homo sapiens
cuaucccgggcauccag

SEQ ID NO: 1677987 - RNA, 11 nt, Homo sapiens
guccacagggc

SEQ ID NO: 1677988 - RNA, 17 nt, Homo sapiens
guccagacaccaucacc

SEQ ID NO: 1677989 - RNA, 17 nt, Homo sapiens
guccaucucaagugcca

SEQ ID NO: 1677990 - RNA, 22 nt, Homo sapiens
guccaucucaagugccauauuc

SEQ ID NO: 1677991 - RNA, 23 nt, Homo sapiens
guccaucuucuuuauacaaugac

SEQ ID NO: 1677992 - RNA, 14 nt, Homo sapiens
gucccaugcauaac

SEQ ID NO: 1677993 - RNA, 15 nt, Homo sapiens
guccccagagcuuua

SEQ ID NO: 1677994 - RNA, 20 nt, Homo sapiens
guccccagccugcucccuag

SEQ ID NO: 1677995 - RNA, 16 nt, Homo sapiens
gucccuccacauuucc

SEQ ID NO: 1677996 - RNA, 16 nt, Homo sapiens
gucccucgagcucugu

SEQ ID NO: 1677997 - RNA, 13 nt, Homo sapiens
gucccuuaccugg

SEQ ID NO: 1677998 - RNA, 16 nt, Homo sapiens
guccucaguccacugc

SEQ ID NO: 1677999 - RNA, 23 nt, Homo sapiens
guccucgccccccgcccggccuc

SEQ ID NO: 1678000 - RNA, 15 nt, Homo sapiens
guccugcuguggaaa

SEQ ID NO: 1678001 - RNA, 19 nt, Homo sapiens
guccugggauuacaggugu

SEQ ID NO: 1678002 - RNA, 21 nt, Homo sapiens
guccugggugcugucaugccc

SEQ ID NO: 1678003 - RNA, 24 nt, Homo sapiens
guccuuuuucuucccuuaggcaau

SEQ ID NO: 1678004 - RNA, 13 nt, Homo sapiens
gucuaaagcuaaa

SEQ ID NO: 1678005 - RNA, 17 nt, Homo sapiens
gucuacacugccuuugu

SEQ ID NO: 1678006 - RNA, 18 nt, Homo sapiens
gucuacccagacucagag

SEQ ID NO: 1678007 - RNA, 20 nt, Homo sapiens
gucuacccagacucagagac

SEQ ID NO: 1678008 - RNA, 20 nt, Homo sapiens
gucucaaaauaaaaccagaa

SEQ ID NO: 1678009 - RNA, 19 nt, Homo sapiens
gucucccuggccccaguga

SEQ ID NO: 1678010 - RNA, 13 nt, Homo sapiens
gucuccucuguca

SEQ ID NO: 1678011 - RNA, 14 nt, Homo sapiens
gucucguugcucau

SEQ ID NO: 1678012 - RNA, 15 nt, Homo sapiens
gucucucccuacccu

SEQ ID NO: 1678013 - RNA, 23 nt, Homo sapiens
gucucugagaauccaaacauccu

SEQ ID NO: 1678014 - RNA, 22 nt, Homo sapiens
gucugaaggagaggagugcgcu

SEQ ID NO: 1678015 - RNA, 23 nt, Homo sapiens
gucugcacacauaacacacauca

SEQ ID NO: 1678016 - RNA, 23 nt, Homo sapiens
gucugccacaagggcaguggaag

SEQ ID NO: 1678017 - RNA, 17 nt, Homo sapiens
gucugcuuaguaucuca

SEQ ID NO: 1678018 - RNA, 20 nt, Homo sapiens
gucugcuuaguaucucauca

SEQ ID NO: 1678019 - RNA, 19 nt, Homo sapiens
gucuggaaggucacgcuga

SEQ ID NO: 1678020 - RNA, 15 nt, Homo sapiens
gucuguccuuuccca

SEQ ID NO: 1678021 - RNA, 14 nt, Homo sapiens
gucugucucucuuu

SEQ ID NO: 1678022 - RNA, 13 nt, Homo sapiens
gucuuaagaugca

SEQ ID NO: 1678023 - RNA, 21 nt, Homo sapiens
gucuuacuguugcauaacuau

SEQ ID NO: 1678024 - RNA, 23 nt, Homo sapiens
gucuuaguacauccucacuuuua

SEQ ID NO: 1678025 - RNA, 22 nt, Homo sapiens
gucuuccuccucagucuucuca

SEQ ID NO: 1678026 - RNA, 19 nt, Homo sapiens
gucuuuacuuuaaucuccu

SEQ ID NO: 1678027 - RNA, 22 nt, Homo sapiens
gucuuucagaacacgacagaaa

SEQ ID NO: 1678028 - RNA, 14 nt, Homo sapiens
gucuuugaacacac

SEQ ID NO: 1678029 - RNA, 22 nt, Homo sapiens
gugaaacccuacgaaagcacag

SEQ ID NO: 1678030 - RNA, 21 nt, Homo sapiens
gugaaagaguaaaaccaaagg

SEQ ID NO: 1678031 - RNA, 18 nt, Homo sapiens
gugaaauuaguauuuuga

SEQ ID NO: 1678032 - RNA, 12 nt, Homo sapiens
gugaagauuuca

SEQ ID NO: 1678033 - RNA, 19 nt, Homo sapiens
gugaagauuucauggacau

SEQ ID NO: 1678034 - RNA, 21 nt, Homo sapiens
gugaauccuuuguacugauga

SEQ ID NO: 1678035 - RNA, 14 nt, Homo sapiens
gugaaugcacagug

SEQ ID NO: 1678036 - RNA, 16 nt, Homo sapiens
gugaaugcacagugaa

SEQ ID NO: 1678037 - RNA, 19 nt, Homo sapiens
gugacacaacucauccaga

SEQ ID NO: 1678038 - RNA, 22 nt, Homo sapiens
gugacugucccuucgacacgga

SEQ ID NO: 1678039 - RNA, 14 nt, Homo sapiens
gugagacacucugg

SEQ ID NO: 1678040 - RNA, 23 nt, Homo sapiens
gugagcaauccugcaagaacaag

SEQ ID NO: 1678041 - RNA, 21 nt, Homo sapiens
gugagggaacagagagguuaa

SEQ ID NO: 1678042 - RNA, 16 nt, Homo sapiens
gugaugauagcacugg

SEQ ID NO: 1678043 - RNA, 15 nt, Homo sapiens
gugaugcaugagcuc

SEQ ID NO: 1678044 - RNA, 20 nt, Homo sapiens
gugauguggugggagcacag

SEQ ID NO: 1678045 - RNA, 23 nt, Homo sapiens
gugauuuuucugcacuaauauaa

SEQ ID NO: 1678046 - RNA, 22 nt, Homo sapiens
gugcaauguuccguucaucuga

SEQ ID NO: 1678047 - RNA, 22 nt, Homo sapiens
gugcacauugguuuaagcccag

SEQ ID NO: 1678048 - RNA, 17 nt, Homo sapiens
gugcaugucacaugaca

SEQ ID NO: 1678049 - RNA, 13 nt, Homo sapiens
gugcauguuaaaa

SEQ ID NO: 1678050 - RNA, 12 nt, Homo sapiens
gugccauauucu

SEQ ID NO: 1678051 - RNA, 23 nt, Homo sapiens
gugccucuuuuaaugucaucucu

SEQ ID NO: 1678052 - RNA, 14 nt, Homo sapiens
gugccuuacacaau

SEQ ID NO: 1678053 - RNA, 22 nt, Homo sapiens
gugcuaauccaggacagcauua

SEQ ID NO: 1678054 - RNA, 18 nt, Homo sapiens
gugcuggcauuacaggug

SEQ ID NO: 1678055 - RNA, 20 nt, Homo sapiens
gugcuugggaucuucaauga

SEQ ID NO: 1678056 - RNA, 18 nt, Homo sapiens
guggaccucuacuuucca

SEQ ID NO: 1678057 - RNA, 12 nt, Homo sapiens
guggagggguca

SEQ ID NO: 1678058 - RNA, 15 nt, Homo sapiens
guggauucaugucca

SEQ ID NO: 1678059 - RNA, 20 nt, Homo sapiens
guggcaucaucucagcucac

SEQ ID NO: 1678060 - RNA, 21 nt, Homo sapiens
guggccccacccuuuccucuu

SEQ ID NO: 1678061 - RNA, 19 nt, Homo sapiens
guggccucagcccucagaa

SEQ ID NO: 1678062 - RNA, 17 nt, Homo sapiens
guggcuaaaugccuaau

SEQ ID NO: 1678063 - RNA, 15 nt, Homo sapiens
guggcuucacagacc

SEQ ID NO: 1678064 - RNA, 19 nt, Homo sapiens
gugggagcacagcuuuccu

SEQ ID NO: 1678065 - RNA, 14 nt, Homo sapiens
guggggaauggaaa

SEQ ID NO: 1678066 - RNA, 18 nt, Homo sapiens
guggucugcugccucagg

SEQ ID NO: 1678067 - RNA, 17 nt, Homo sapiens
guggugaacagaacaaa

SEQ ID NO: 1678068 - RNA, 20 nt, Homo sapiens
guggugaacagaacaaaagg

SEQ ID NO: 1678069 - RNA, 16 nt, Homo sapiens
gugguuugauaguguu

SEQ ID NO: 1678070 - RNA, 22 nt, Homo sapiens
guguacuaccccaggaugcaug

SEQ ID NO: 1678071 - RNA, 23 nt, Homo sapiens
guguacuucuucauccauagaca

SEQ ID NO: 1678072 - RNA, 16 nt, Homo sapiens
gugucaucaaguagua

SEQ ID NO: 1678073 - RNA, 13 nt, Homo sapiens
gugucaucuguca

SEQ ID NO: 1678074 - RNA, 21 nt, Homo sapiens
gugucaugaauguugcaugac

SEQ ID NO: 1678075 - RNA, 11 nt, Homo sapiens
guguccaugcc

SEQ ID NO: 1678076 - RNA, 18 nt, Homo sapiens
gugucccagugucuggcc

SEQ ID NO: 1678077 - RNA, 18 nt, Homo sapiens
gugucucugaggacguca

SEQ ID NO: 1678078 - RNA, 17 nt, Homo sapiens
gugugacaccaccacug

SEQ ID NO: 1678079 - RNA, 20 nt, Homo sapiens
gugugacaccaccacugugu

SEQ ID NO: 1678080 - RNA, 21 nt, Homo sapiens
gugugcccacccguguucucc

SEQ ID NO: 1678081 - RNA, 13 nt, Homo sapiens
guguggccugggu

SEQ ID NO: 1678082 - RNA, 14 nt, Homo sapiens
guguggcuuggaac

SEQ ID NO: 1678083 - RNA, 17 nt, Homo sapiens
guguguagaaacacagc

SEQ ID NO: 1678084 - RNA, 20 nt, Homo sapiens
guguguaugucuauguguau

SEQ ID NO: 1678085 - RNA, 16 nt, Homo sapiens
gugugugugcaauguu

SEQ ID NO: 1678086 - RNA, 21 nt, Homo sapiens
guguucccucucucccuccag

SEQ ID NO: 1678087 - RNA, 17 nt, Homo sapiens
guguuccugugaucucg

SEQ ID NO: 1678088 - RNA, 22 nt, Homo sapiens
guguuguaaacuuaguugcacu

SEQ ID NO: 1678089 - RNA, 15 nt, Homo sapiens
guguuuauugucaaa

SEQ ID NO: 1678090 - RNA, 18 nt, Homo sapiens
guguuucguuaagcagua

SEQ ID NO: 1678091 - RNA, 23 nt, Homo sapiens
guguuugaauugauuuuuaaaca

SEQ ID NO: 1678092 - RNA, 16 nt, Homo sapiens
guguuuugucuucaac

SEQ ID NO: 1678093 - RNA, 12 nt, Homo sapiens
guuaacaguaaa

SEQ ID NO: 1678094 - RNA, 18 nt, Homo sapiens
guuaauaagcaacuguaa

SEQ ID NO: 1678095 - RNA, 14 nt, Homo sapiens
guuaauucuugcca

SEQ ID NO: 1678096 - RNA, 16 nt, Homo sapiens
guuacagcuguucuga

SEQ ID NO: 1678097 - RNA, 22 nt, Homo sapiens
guuagaauuagguaauggauau

SEQ ID NO: 1678098 - RNA, 17 nt, Homo sapiens
guuagacaaaagugcuc

SEQ ID NO: 1678099 - RNA, 23 nt, Homo sapiens
guuagcacagaggauggcuuccc

SEQ ID NO: 1678100 - RNA, 20 nt, Homo sapiens
guuagguaucaaaauguugu

SEQ ID NO: 1678101 - RNA, 18 nt, Homo sapiens
guucaaaaccuugcacag

SEQ ID NO: 1678102 - RNA, 19 nt, Homo sapiens
guucacgugacuccucaau

SEQ ID NO: 1678103 - RNA, 22 nt, Homo sapiens
guucagaaaagcaccucuugaa

SEQ ID NO: 1678104 - RNA, 23 nt, Homo sapiens
guucagaagaaagauugcuauaa

SEQ ID NO: 1678105 - RNA, 22 nt, Homo sapiens
guucaugcccccuuugacugau

SEQ ID NO: 1678106 - RNA, 21 nt, Homo sapiens
guuccauccaccaccuugcca

SEQ ID NO: 1678107 - RNA, 12 nt, Homo sapiens
ucauagcacaug

SEQ ID NO: 1678108 - RNA, 22 nt, Homo sapiens
ucauauuuggugaugagacuua

SEQ ID NO: 1678109 - RNA, 13 nt, Homo sapiens
ucaucaaguagua

SEQ ID NO: 1678110 - RNA, 23 nt, Homo sapiens
ucaucagggggcaugaagcacau

SEQ ID NO: 1678111 - RNA, 13 nt, Homo sapiens
ucauccaacguga

SEQ ID NO: 1678112 - RNA, 15 nt, Homo sapiens
ucauccaacuggaag

SEQ ID NO: 1678113 - RNA, 15 nt, Homo sapiens
ucauccaccuucaca

SEQ ID NO: 1678114 - RNA, 19 nt, Homo sapiens
ucaucccuuuccaguuaag

SEQ ID NO: 1678115 - RNA, 19 nt, Homo sapiens
ucaucucaaacacugcuua

SEQ ID NO: 1678116 - RNA, 17 nt, Homo sapiens
ucaucucagcaaucaca

SEQ ID NO: 1678117 - RNA, 18 nt, Homo sapiens
ucaucucagcaaucacaa

SEQ ID NO: 1678118 - RNA, 12 nt, Homo sapiens
ucaucucagcuc

SEQ ID NO: 1678119 - RNA, 15 nt, Homo sapiens
ucaucucagcucacu

SEQ ID NO: 1678120 - RNA, 19 nt, Homo sapiens
ucaucugucugucccaguu

SEQ ID NO: 1678121 - RNA, 21 nt, Homo sapiens
ucaucuugggaagggccaugg

SEQ ID NO: 1678122 - RNA, 20 nt, Homo sapiens
ucaugaaagcagcacacauu

SEQ ID NO: 1678123 - RNA, 19 nt, Homo sapiens
ucaugaauucuucucaaag

SEQ ID NO: 1678124 - RNA, 17 nt, Homo sapiens
ucaugguguucaugaca

SEQ ID NO: 1678125 - RNA, 21 nt, Homo sapiens
ucaugguguucaugacaagug

SEQ ID NO: 1678126 - RNA, 13 nt, Homo sapiens
ucauguucuugca

SEQ ID NO: 1678127 - RNA, 21 nt, Homo sapiens
ucauguugauguguccgugaa

SEQ ID NO: 1678128 - RNA, 13 nt, Homo sapiens
ucauuagcuguga

SEQ ID NO: 1678129 - RNA, 14 nt, Homo sapiens
ucauuagcugugau

SEQ ID NO: 1678130 - RNA, 16 nt, Homo sapiens
ucauuauuaccacuua

SEQ ID NO: 1678131 - RNA, 17 nt, Homo sapiens
ucauucagaaugugcaa

SEQ ID NO: 1678132 - RNA, 17 nt, Homo sapiens
ucauucauucauucacc

SEQ ID NO: 1678133 - RNA, 21 nt, Homo sapiens
ucauucccaggcacucucuuu

SEQ ID NO: 1678134 - RNA, 11 nt, Homo sapiens
ucauucuugcc

SEQ ID NO: 1678135 - RNA, 21 nt, Homo sapiens
ucauugagaaauaaagcacau

SEQ ID NO: 1678136 - RNA, 15 nt, Homo sapiens
ucauugcacugcagu

SEQ ID NO: 1678137 - RNA, 18 nt, Homo sapiens
ucauugggccauguuuaa

SEQ ID NO: 1678138 - RNA, 21 nt, Homo sapiens
ucauuguucagaaaagcaccu

SEQ ID NO: 1678139 - RNA, 21 nt, Homo sapiens
ucauuuuuuuuuuaucagagu

SEQ ID NO: 1678140 - RNA, 18 nt, Homo sapiens
uccaaaauaucgagugaa

SEQ ID NO: 1678141 - RNA, 19 nt, Homo sapiens
uccaaaauaucgagugaau

SEQ ID NO: 1678142 - RNA, 16 nt, Homo sapiens
uccaaaccaccuuccc

SEQ ID NO: 1678143 - RNA, 16 nt, Homo sapiens
uccaaaccuccacugc

SEQ ID NO: 1678144 - RNA, 19 nt, Homo sapiens
uccaaagguuucaacugua

SEQ ID NO: 1678145 - RNA, 22 nt, Homo sapiens
uccaacuauuucuuucaucaga

SEQ ID NO: 1678146 - RNA, 18 nt, Homo sapiens
uccaacucugacuguaaa

SEQ ID NO: 1678147 - RNA, 16 nt, Homo sapiens
uccaacuuuucaucca

SEQ ID NO: 1678148 - RNA, 14 nt, Homo sapiens
uccaagaagccagc

SEQ ID NO: 1678149 - RNA, 20 nt, Homo sapiens
uccaagaauaaagucuuucc

SEQ ID NO: 1678150 - RNA, 19 nt, Homo sapiens
uccaagcugcucauuucac

SEQ ID NO: 1678151 - RNA, 21 nt, Homo sapiens
uccaagugggucaauuccuua

SEQ ID NO: 1678152 - RNA, 22 nt, Homo sapiens
uccaagugggucaauuccuuag

SEQ ID NO: 1678153 - RNA, 18 nt, Homo sapiens
uccaagugugugugcaau

SEQ ID NO: 1678154 - RNA, 20 nt, Homo sapiens
uccaauacauugaacacauu

SEQ ID NO: 1678155 - RNA, 15 nt, Homo sapiens
uccacaaauguccuc

SEQ ID NO: 1678156 - RNA, 18 nt, Homo sapiens
uccacaaauguccucaga

SEQ ID NO: 1678157 - RNA, 19 nt, Homo sapiens
uccacagggacacacguga

SEQ ID NO: 1678158 - RNA, 15 nt, Homo sapiens
uccacauacacugca

SEQ ID NO: 1678159 - RNA, 19 nt, Homo sapiens
uccacaugcacauguauuc

SEQ ID NO: 1678160 - RNA, 21 nt, Homo sapiens
uccaccuagagcuagaugugu

SEQ ID NO: 1678161 - RNA, 20 nt, Homo sapiens
uccaccucgcagguucaagc

SEQ ID NO: 1678162 - RNA, 13 nt, Homo sapiens
uccacguaucuuu

SEQ ID NO: 1678163 - RNA, 13 nt, Homo sapiens
uccacuccuccca

SEQ ID NO: 1678164 - RNA, 15 nt, Homo sapiens
uccagaacugucuua

SEQ ID NO: 1678165 - RNA, 19 nt, Homo sapiens
uccagaacugucuuaguca

SEQ ID NO: 1678166 - RNA, 16 nt, Homo sapiens
uccagaccccuacccu

SEQ ID NO: 1678167 - RNA, 16 nt, Homo sapiens
uccagaggugauggua

SEQ ID NO: 1678168 - RNA, 19 nt, Homo sapiens
uccagaguaggugggucuu

SEQ ID NO: 1678169 - RNA, 23 nt, Homo sapiens
uccagcagguguuuuccuucaca

SEQ ID NO: 1678170 - RNA, 17 nt, Homo sapiens
uccagccacuuauuucc

SEQ ID NO: 1678171 - RNA, 17 nt, Homo sapiens
uccaggccccaucagca

SEQ ID NO: 1678172 - RNA, 22 nt, Homo sapiens
uccagguuccauccaccaccuu

SEQ ID NO: 1678173 - RNA, 18 nt, Homo sapiens
uccagugcaguagugcca

SEQ ID NO: 1678174 - RNA, 19 nt, Homo sapiens
uccagugcaguagugccaa

SEQ ID NO: 1678175 - RNA, 14 nt, Homo sapiens
uccaguucugauga

SEQ ID NO: 1678176 - RNA, 16 nt, Homo sapiens
uccauagcuucaucca

SEQ ID NO: 1678177 - RNA, 13 nt, Homo sapiens
uccauaucagcuc

SEQ ID NO: 1678178 - RNA, 13 nt, Homo sapiens
uccauaugcucuu

SEQ ID NO: 1678179 - RNA, 21 nt, Homo sapiens
uccaucauacauuagugccau

SEQ ID NO: 1678180 - RNA, 20 nt, Homo sapiens
uccauccacacacagcagcu

SEQ ID NO: 1678181 - RNA, 23 nt, Homo sapiens
uccauccacacacagcagcucca

SEQ ID NO: 1678182 - RNA, 19 nt, Homo sapiens
uccaucucaagugccauau

SEQ ID NO: 1678183 - RNA, 21 nt, Homo sapiens
uccaugacaguagcauacuga

SEQ ID NO: 1678184 - RNA, 16 nt, Homo sapiens
uccauucucuuucaau

SEQ ID NO: 1678185 - RNA, 20 nt, Homo sapiens
ucccaaagugcugggauuaa

SEQ ID NO: 1678186 - RNA, 23 nt, Homo sapiens
ucccaaccuccccugguccugca

SEQ ID NO: 1678187 - RNA, 15 nt, Homo sapiens
ucccaaguccagugu

SEQ ID NO: 1678188 - RNA, 13 nt, Homo sapiens
ucccaaucccauu

SEQ ID NO: 1678189 - RNA, 19 nt, Homo sapiens
ucccaccugucaaccugaa

SEQ ID NO: 1678190 - RNA, 22 nt, Homo sapiens
ucccagccaggggaacucgcca

SEQ ID NO: 1678191 - RNA, 22 nt, Homo sapiens
ucccagcccugcccagaguaug

SEQ ID NO: 1678192 - RNA, 18 nt, Homo sapiens
ucccagguucaagugcuu

SEQ ID NO: 1678193 - RNA, 16 nt, Homo sapiens
ucccagugucuggccc

SEQ ID NO: 1678194 - RNA, 11 nt, Homo sapiens
ucccauacucu

SEQ ID NO: 1678195 - RNA, 21 nt, Homo sapiens
ucccauggaaugcagcaguaa

SEQ ID NO: 1678196 - RNA, 21 nt, Homo sapiens
ucccaugguagacugugacac

SEQ ID NO: 1678197 - RNA, 16 nt, Homo sapiens
uccccaagcaguguga

SEQ ID NO: 1678198 - RNA, 14 nt, Homo sapiens
uccccaauuauccu

SEQ ID NO: 1678199 - RNA, 19 nt, Homo sapiens
uccccagccugcucccuag

SEQ ID NO: 1678200 - RNA, 13 nt, Homo sapiens
uccccauggugca

SEQ ID NO: 1678201 - RNA, 16 nt, Homo sapiens
uccccauugacccuca

SEQ ID NO: 1678202 - RNA, 22 nt, Homo sapiens
ucccccaaacagcaugugcuca

SEQ ID NO: 1678203 - RNA, 17 nt, Homo sapiens
ucccccagagguggaua

SEQ ID NO: 1678204 - RNA, 18 nt, Homo sapiens
ucccccuauccuuggcac

SEQ ID NO: 1678205 - RNA, 19 nt, Homo sapiens
ucccccucgcccuaugcaa

SEQ ID NO: 1678206 - RNA, 14 nt, Homo sapiens
uccccucacucugu

SEQ ID NO: 1678207 - RNA, 15 nt, Homo sapiens
uccccucagauucca

SEQ ID NO: 1678208 - RNA, 16 nt, Homo sapiens
uccccucagauuccac

SEQ ID NO: 1678209 - RNA, 19 nt, Homo sapiens
uccccugcccugucuuucc

SEQ ID NO: 1678210 - RNA, 18 nt, Homo sapiens
ucccggggguguaucuga

SEQ ID NO: 1678211 - RNA, 15 nt, Homo sapiens
ucccggugugcagcg

SEQ ID NO: 1678212 - RNA, 13 nt, Homo sapiens
ucccuaaguccac

SEQ ID NO: 1678213 - RNA, 22 nt, Homo sapiens
ucccuaauucucuucgcuguga

SEQ ID NO: 1678214 - RNA, 13 nt, Homo sapiens
ucccucuaugucg

SEQ ID NO: 1678215 - RNA, 11 nt, Homo sapiens
ucccugaacac

SEQ ID NO: 1678216 - RNA, 16 nt, Homo sapiens
ucccugaacacucauc

SEQ ID NO: 1678217 - RNA, 17 nt, Homo sapiens
ucccuuuaucauguguu

SEQ ID NO: 1678218 - RNA, 20 nt, Homo sapiens
ucccuuuaucauguguuucu

SEQ ID NO: 1678219 - RNA, 15 nt, Homo sapiens
ucccuuuuugaauug

SEQ ID NO: 1678220 - RNA, 23 nt, Homo sapiens
uccgaacgcugcuccaugcacag

SEQ ID NO: 1678221 - RNA, 15 nt, Homo sapiens
uccgaagaaugaagu

SEQ ID NO: 1678222 - RNA, 13 nt, Homo sapiens
uccgcccgcccac

SEQ ID NO: 1678223 - RNA, 19 nt, Homo sapiens
uccggaaagccuuccucaa

SEQ ID NO: 1678224 - RNA, 14 nt, Homo sapiens
uccggugccuucca

SEQ ID NO: 1678225 - RNA, 11 nt, Homo sapiens
uccgugcuuuu

SEQ ID NO: 1678226 - RNA, 19 nt, Homo sapiens
uccuaagcuggagugcagu

SEQ ID NO: 1678227 - RNA, 23 nt, Homo sapiens
uccuaagcuggagugcaguggca

SEQ ID NO: 1678228 - RNA, 18 nt, Homo sapiens
uccuauaccggagcucca

SEQ ID NO: 1678229 - RNA, 23 nt, Homo sapiens
ugaaucaaucuggcuucugcauu

SEQ ID NO: 1678230 - RNA, 23 nt, Homo sapiens
ugaaucaguccuagaauguuuca

SEQ ID NO: 1678231 - RNA, 13 nt, Homo sapiens
ugaaucucucaaa

SEQ ID NO: 1678232 - RNA, 21 nt, Homo sapiens
ugaaugaaauauaaacuguga

SEQ ID NO: 1678233 - RNA, 18 nt, Homo sapiens
ugaaugaugccaugagga

SEQ ID NO: 1678234 - RNA, 21 nt, Homo sapiens
ugaauguuuuauggaauugaa

SEQ ID NO: 1678235 - RNA, 13 nt, Homo sapiens
ugaauuaaagucu

SEQ ID NO: 1678236 - RNA, 22 nt, Homo sapiens
ugaauuaaagucuacacugccu

SEQ ID NO: 1678237 - RNA, 15 nt, Homo sapiens
ugaauuaaaucuguu

SEQ ID NO: 1678238 - RNA, 20 nt, Homo sapiens
ugaauuagagcuacuuugag

SEQ ID NO: 1678239 - RNA, 18 nt, Homo sapiens
ugaauuauuaaugaaugc

SEQ ID NO: 1678240 - RNA, 17 nt, Homo sapiens
ugaauuguaaggaauga

SEQ ID NO: 1678241 - RNA, 16 nt, Homo sapiens
ugacaagggcugaccu

SEQ ID NO: 1678242 - RNA, 14 nt, Homo sapiens
ugacacaacucauc

SEQ ID NO: 1678243 - RNA, 21 nt, Homo sapiens
ugacacagcugagcuggccua

SEQ ID NO: 1678244 - RNA, 16 nt, Homo sapiens
ugacaggaaagcccuc

SEQ ID NO: 1678245 - RNA, 18 nt, Homo sapiens
ugacaggaacccaucacu

SEQ ID NO: 1678246 - RNA, 17 nt, Homo sapiens
ugacaggccuuccuccu

SEQ ID NO: 1678247 - RNA, 22 nt, Homo sapiens
ugacaggccuuccuccucucaa

SEQ ID NO: 1678248 - RNA, 11 nt, Homo sapiens
ugacaguauua

SEQ ID NO: 1678249 - RNA, 15 nt, Homo sapiens
ugacauaggauccga

SEQ ID NO: 1678250 - RNA, 18 nt, Homo sapiens
ugacauauaucuauuaca

SEQ ID NO: 1678251 - RNA, 13 nt, Homo sapiens
ugacaugcacuga

SEQ ID NO: 1678252 - RNA, 14 nt, Homo sapiens
ugacaugcacugac

SEQ ID NO: 1678253 - RNA, 15 nt, Homo sapiens
ugacaugcacugacc

SEQ ID NO: 1678254 - RNA, 14 nt, Homo sapiens
ugacauuccagcau

SEQ ID NO: 1678255 - RNA, 18 nt, Homo sapiens
ugaccauaugcacaauuc

SEQ ID NO: 1678256 - RNA, 14 nt, Homo sapiens
ugacccaaaugcaa

SEQ ID NO: 1678257 - RNA, 15 nt, Homo sapiens
ugacccucaccugaa

SEQ ID NO: 1678258 - RNA, 19 nt, Homo sapiens
ugaccugauuuccauuugc

SEQ ID NO: 1678259 - RNA, 15 nt, Homo sapiens
ugacgagcaugagcu

SEQ ID NO: 1678260 - RNA, 15 nt, Homo sapiens
ugacggcccugcaau

SEQ ID NO: 1678261 - RNA, 12 nt, Homo sapiens
ugacggugucca

SEQ ID NO: 1678262 - RNA, 17 nt, Homo sapiens
ugacgguguccaugccu

SEQ ID NO: 1678263 - RNA, 13 nt, Homo sapiens
ugacuaacagccu

SEQ ID NO: 1678264 - RNA, 13 nt, Homo sapiens
ugacuaacgccau

SEQ ID NO: 1678265 - RNA, 17 nt, Homo sapiens
ugacuaacgccauccag

SEQ ID NO: 1678266 - RNA, 13 nt, Homo sapiens
ugacuauggggaa

SEQ ID NO: 1678267 - RNA, 21 nt, Homo sapiens
ugacugccucugccugucgca

SEQ ID NO: 1678268 - RNA, 19 nt, Homo sapiens
ugacuguccuacaauauca

SEQ ID NO: 1678269 - RNA, 22 nt, Homo sapiens
ugacugugaggugggccuuuga

SEQ ID NO: 1678270 - RNA, 21 nt, Homo sapiens
ugacuucuuuacuaacacugg

SEQ ID NO: 1678271 - RNA, 22 nt, Homo sapiens
ugacuucuuuacuaacacuggc

SEQ ID NO: 1678272 - RNA, 23 nt, Homo sapiens
ugacuucuuuacuaacacuggcu

SEQ ID NO: 1678273 - RNA, 17 nt, Homo sapiens
ugagaaauaaagcacau

SEQ ID NO: 1678274 - RNA, 16 nt, Homo sapiens
ugagaaggccaggaaa

SEQ ID NO: 1678275 - RNA, 20 nt, Homo sapiens
ugagaaucgaccucacuguc

SEQ ID NO: 1678276 - RNA, 17 nt, Homo sapiens
ugagaaugucauuugcu

SEQ ID NO: 1678277 - RNA, 13 nt, Homo sapiens
ugagacacaagau

SEQ ID NO: 1678278 - RNA, 15 nt, Homo sapiens
ugagaccaagucucu

SEQ ID NO: 1678279 - RNA, 18 nt, Homo sapiens
ugagagaaagccacaaag

SEQ ID NO: 1678280 - RNA, 18 nt, Homo sapiens
ugagaggagcguguccua

SEQ ID NO: 1678281 - RNA, 17 nt, Homo sapiens
ugagauaacauuuccaa

SEQ ID NO: 1678282 - RNA, 13 nt, Homo sapiens
ugagaucauguca

SEQ ID NO: 1678283 - RNA, 13 nt, Homo sapiens
ugagauccuguga

SEQ ID NO: 1678284 - RNA, 12 nt, Homo sapiens
ugagauggaguc

SEQ ID NO: 1678285 - RNA, 18 nt, Homo sapiens
ugagcaauaugucaguca

SEQ ID NO: 1678286 - RNA, 19 nt, Homo sapiens
ugagcaguuguuauauuca

SEQ ID NO: 1678287 - RNA, 17 nt, Homo sapiens
ugagcguccaggugauc

SEQ ID NO: 1678288 - RNA, 16 nt, Homo sapiens
ugagcucaaaguacua

SEQ ID NO: 1678289 - RNA, 19 nt, Homo sapiens
ugaggcuccuuaguuuauu

SEQ ID NO: 1678290 - RNA, 14 nt, Homo sapiens
ugaguacauacuca

SEQ ID NO: 1678291 - RNA, 15 nt, Homo sapiens
ugaguccuggcaugg

SEQ ID NO: 1678292 - RNA, 14 nt, Homo sapiens
ugagugcccugugu

SEQ ID NO: 1678293 - RNA, 15 nt, Homo sapiens
ugaguggacagcagc

SEQ ID NO: 1678294 - RNA, 13 nt, Homo sapiens
ugauaacucugua

SEQ ID NO: 1678295 - RNA, 12 nt, Homo sapiens
ugauacuugguc

SEQ ID NO: 1678296 - RNA, 16 nt, Homo sapiens
ugaucaccugccaaau

SEQ ID NO: 1678297 - RNA, 18 nt, Homo sapiens
ugaucccuucuuacuuaa

SEQ ID NO: 1678298 - RNA, 17 nt, Homo sapiens
ugauccucacugagaag

SEQ ID NO: 1678299 - RNA, 11 nt, Homo sapiens
ugaucucagcu

SEQ ID NO: 1678300 - RNA, 13 nt, Homo sapiens
ugaucucagcuca

SEQ ID NO: 1678301 - RNA, 15 nt, Homo sapiens
ugaugcuaguucuua

SEQ ID NO: 1678302 - RNA, 19 nt, Homo sapiens
ugaugguaacugcacacau

SEQ ID NO: 1678303 - RNA, 19 nt, Homo sapiens
ugauggucauugggguggu

SEQ ID NO: 1678304 - RNA, 23 nt, Homo sapiens
ugauguccaaacuuaacagauca

SEQ ID NO: 1678305 - RNA, 16 nt, Homo sapiens
ugaugucugaggauac

SEQ ID NO: 1678306 - RNA, 20 nt, Homo sapiens
ugaugugauacaaauugaua

SEQ ID NO: 1678307 - RNA, 21 nt, Homo sapiens
ugauguuauuuuguacguguu

SEQ ID NO: 1678308 - RNA, 19 nt, Homo sapiens
ugauuaugaaaugccagac

SEQ ID NO: 1678309 - RNA, 12 nt, Homo sapiens
ugauucuauguc

SEQ ID NO: 1678310 - RNA, 21 nt, Homo sapiens
ugauucuuuugcccacacuug

SEQ ID NO: 1678311 - RNA, 21 nt, Homo sapiens
ugauugagagcagccucuuga

SEQ ID NO: 1678312 - RNA, 12 nt, Homo sapiens
ugauugugaacu

SEQ ID NO: 1678313 - RNA, 15 nt, Homo sapiens
ugauuuccauuugca

SEQ ID NO: 1678314 - RNA, 14 nt, Homo sapiens
ugcaaaacauaucu

SEQ ID NO: 1678315 - RNA, 17 nt, Homo sapiens
ugcaaaacauaucuuga

SEQ ID NO: 1678316 - RNA, 13 nt, Homo sapiens
ugcaaacaaacaa

SEQ ID NO: 1678317 - RNA, 19 nt, Homo sapiens
ugcaacaggaagacacugg

SEQ ID NO: 1678318 - RNA, 19 nt, Homo sapiens
ugcaacugcuacugaccau

SEQ ID NO: 1678319 - RNA, 14 nt, Homo sapiens
ugcaaggggcucaa

SEQ ID NO: 1678320 - RNA, 22 nt, Homo sapiens
ugcaauaaaacucccuuccuua

SEQ ID NO: 1678321 - RNA, 18 nt, Homo sapiens
ugcaauaaacucagucaa

SEQ ID NO: 1678322 - RNA, 16 nt, Homo sapiens
ugcaauccucccuacc

SEQ ID NO: 1678323 - RNA, 14 nt, Homo sapiens
ugcaaucuguccag

SEQ ID NO: 1678324 - RNA, 14 nt, Homo sapiens
ugcaauuuacuugg

SEQ ID NO: 1678325 - RNA, 14 nt, Homo sapiens
ugcacaaacagagg

SEQ ID NO: 1678326 - RNA, 14 nt, Homo sapiens
ugcacacauaacac

SEQ ID NO: 1678327 - RNA, 20 nt, Homo sapiens
ugcacagugguccagggucc

SEQ ID NO: 1678328 - RNA, 13 nt, Homo sapiens
ugcacccaugugu

SEQ ID NO: 1678329 - RNA, 15 nt, Homo sapiens
ugcacccguguuugu

SEQ ID NO: 1678330 - RNA, 16 nt, Homo sapiens
ugcacuccagccuggg

SEQ ID NO: 1678331 - RNA, 13 nt, Homo sapiens
ugcacuggaugug

SEQ ID NO: 1678332 - RNA, 16 nt, Homo sapiens
ugcacuggauguggcc

SEQ ID NO: 1678333 - RNA, 14 nt, Homo sapiens
ugcacuucaguucc

SEQ ID NO: 1678334 - RNA, 20 nt, Homo sapiens
ugcagaauuguuuuuugcuc

SEQ ID NO: 1678335 - RNA, 21 nt, Homo sapiens
ugcagacauuuuauuaggggg

SEQ ID NO: 1678336 - RNA, 17 nt, Homo sapiens
ugcagagcaggaaauga

SEQ ID NO: 1678337 - RNA, 21 nt, Homo sapiens
ugcagagccaauggugcacau

SEQ ID NO: 1678338 - RNA, 16 nt, Homo sapiens
ugcagaugacuggaaa

SEQ ID NO: 1678339 - RNA, 14 nt, Homo sapiens
ugcagauggcagug

SEQ ID NO: 1678340 - RNA, 17 nt, Homo sapiens
ugcagauggcagugcag

SEQ ID NO: 1678341 - RNA, 23 nt, Homo sapiens
ugcagcacaguacucaggcagug

SEQ ID NO: 1678342 - RNA, 12 nt, Homo sapiens
ugcagcaguacc

SEQ ID NO: 1678343 - RNA, 14 nt, Homo sapiens
ugcagcaguaccau

SEQ ID NO: 1678344 - RNA, 14 nt, Homo sapiens
ugcagcuauucaca

SEQ ID NO: 1678345 - RNA, 14 nt, Homo sapiens
ugcagcucagggac

SEQ ID NO: 1678346 - RNA, 23 nt, Homo sapiens
ugcagcucuggagguacgaaaag

SEQ ID NO: 1678347 - RNA, 21 nt, Homo sapiens
ugcaggaaccagcaaugagaa

SEQ ID NO: 1678348 - RNA, 17 nt, Homo sapiens
ugcaggcagaaccugaa

SEQ ID NO: 1678349 - RNA, 21 nt, Homo sapiens
ugcaguaaaguuccaugaaga

SEQ ID NO: 1678350 - RNA, 11 nt, Homo sapiens
ugcaguacuca

SEQ ID NO: 1678351 - RNA, 14 nt, Homo sapiens
ugcaguacucagua

SEQ ID NO: 1678352 - RNA, 17 nt, Homo sapiens
ugugcucggacacaguu

SEQ ID NO: 1678353 - RNA, 12 nt, Homo sapiens
ugugcuuucaug

SEQ ID NO: 1678354 - RNA, 14 nt, Homo sapiens
ugugcuuucauguu

SEQ ID NO: 1678355 - RNA, 15 nt, Homo sapiens
uguggaaaacucaca

SEQ ID NO: 1678356 - RNA, 16 nt, Homo sapiens
uguggcuaaaugccua

SEQ ID NO: 1678357 - RNA, 18 nt, Homo sapiens
uguggcuucccaugucuu

SEQ ID NO: 1678358 - RNA, 13 nt, Homo sapiens
uguggguuucuaa

SEQ ID NO: 1678359 - RNA, 20 nt, Homo sapiens
uguguauaaagccauuauuc

SEQ ID NO: 1678360 - RNA, 23 nt, Homo sapiens
uguguaucaguguuuaugugcua

SEQ ID NO: 1678361 - RNA, 22 nt, Homo sapiens
uguguccuaaaugcaaagcaca

SEQ ID NO: 1678362 - RNA, 15 nt, Homo sapiens
ugugugaaaauguga

SEQ ID NO: 1678363 - RNA, 17 nt, Homo sapiens
ugugugacaccaccacu

SEQ ID NO: 1678364 - RNA, 14 nt, Homo sapiens
ugugugcaauguuc

SEQ ID NO: 1678365 - RNA, 15 nt, Homo sapiens
ugugugugcaauguu

SEQ ID NO: 1678366 - RNA, 12 nt, Homo sapiens
uguguuacugau

SEQ ID NO: 1678367 - RNA, 17 nt, Homo sapiens
uguguuccugugaucuc

SEQ ID NO: 1678368 - RNA, 18 nt, Homo sapiens
uguuagauguccucagaa

SEQ ID NO: 1678369 - RNA, 21 nt, Homo sapiens
uguuagggacuuuggcauuuc

SEQ ID NO: 1678370 - RNA, 22 nt, Homo sapiens
uguuaucaaugacaauggugcc

SEQ ID NO: 1678371 - RNA, 15 nt, Homo sapiens
uguuauccacuacag

SEQ ID NO: 1678372 - RNA, 22 nt, Homo sapiens
uguuauuuuguauaaaugggaa

SEQ ID NO: 1678373 - RNA, 17 nt, Homo sapiens
uguucaacuuaaugaag

SEQ ID NO: 1678374 - RNA, 20 nt, Homo sapiens
uguucaauauuuguauuugu

SEQ ID NO: 1678375 - RNA, 16 nt, Homo sapiens
uguucaugcacacuug

SEQ ID NO: 1678376 - RNA, 14 nt, Homo sapiens
uguucauuccgaaa

SEQ ID NO: 1678377 - RNA, 16 nt, Homo sapiens
uguucauuccgaaaaa

SEQ ID NO: 1678378 - RNA, 19 nt, Homo sapiens
uguucuccggguguggccu

SEQ ID NO: 1678379 - RNA, 14 nt, Homo sapiens
uguucugcacugaa

SEQ ID NO: 1678380 - RNA, 19 nt, Homo sapiens
uguucuugcagucaucaga

SEQ ID NO: 1678381 - RNA, 19 nt, Homo sapiens
uguucuuguaaaacuguga

SEQ ID NO: 1678382 - RNA, 16 nt, Homo sapiens
uguugaggguccucag

SEQ ID NO: 1678383 - RNA, 23 nt, Homo sapiens
uguugcugcaucuccccucagau

SEQ ID NO: 1678384 - RNA, 15 nt, Homo sapiens
uguuggccaggcuug

SEQ ID NO: 1678385 - RNA, 18 nt, Homo sapiens
uguuggguggaggaugga

SEQ ID NO: 1678386 - RNA, 15 nt, Homo sapiens
uguuguuauucagaa

SEQ ID NO: 1678387 - RNA, 19 nt, Homo sapiens
uguuuagaaugucaguuga

SEQ ID NO: 1678388 - RNA, 13 nt, Homo sapiens
uguuucacagugg

SEQ ID NO: 1678389 - RNA, 12 nt, Homo sapiens
uguuuccaguga

SEQ ID NO: 1678390 - RNA, 16 nt, Homo sapiens
uguuugauacaguauu

SEQ ID NO: 1678391 - RNA, 14 nt, Homo sapiens
uguuugcccgggaa

SEQ ID NO: 1678392 - RNA, 17 nt, Homo sapiens
uguuuuauuguaaucau

SEQ ID NO: 1678393 - RNA, 12 nt, Homo sapiens
uguuuuuugcca

SEQ ID NO: 1678394 - RNA, 23 nt, Homo sapiens
uuaaaaagaccaugcauucagau

SEQ ID NO: 1678395 - RNA, 12 nt, Homo sapiens
uuaaaaagucaa

SEQ ID NO: 1678396 - RNA, 16 nt, Homo sapiens
uuaaaaauguauguug

SEQ ID NO: 1678397 - RNA, 21 nt, Homo sapiens
uuaaaaucacaaacucaucca

SEQ ID NO: 1678398 - RNA, 13 nt, Homo sapiens
uuaaacauugccu

SEQ ID NO: 1678399 - RNA, 13 nt, Homo sapiens
uuaaaccuguucc

SEQ ID NO: 1678400 - RNA, 16 nt, Homo sapiens
uuaaacuaacaauuca

SEQ ID NO: 1678401 - RNA, 17 nt, Homo sapiens
uuaaacuaacaauucaa

SEQ ID NO: 1678402 - RNA, 19 nt, Homo sapiens
uuaaacuucuuaacuggca

SEQ ID NO: 1678403 - RNA, 16 nt, Homo sapiens
uuaaagcaaucuuggc

SEQ ID NO: 1678404 - RNA, 16 nt, Homo sapiens
uuaaagucuacacugc

SEQ ID NO: 1678405 - RNA, 19 nt, Homo sapiens
uuaaagucuacacugccuu

SEQ ID NO: 1678406 - RNA, 20 nt, Homo sapiens
uuaaaguuacauuaugugua

SEQ ID NO: 1678407 - RNA, 16 nt, Homo sapiens
uuaaaugaacuugaua

SEQ ID NO: 1678408 - RNA, 17 nt, Homo sapiens
uuaacauaucauucaga

SEQ ID NO: 1678409 - RNA, 15 nt, Homo sapiens
uuaacaucaaagacu

SEQ ID NO: 1678410 - RNA, 18 nt, Homo sapiens
uuaaccagucugaaguuu

SEQ ID NO: 1678411 - RNA, 16 nt, Homo sapiens
uuaacuuuaccaugcu

SEQ ID NO: 1678412 - RNA, 22 nt, Homo sapiens
uuaacuuuaccaugcucaauga

SEQ ID NO: 1678413 - RNA, 17 nt, Homo sapiens
uuaagagaaaugagcuu

SEQ ID NO: 1678414 - RNA, 17 nt, Homo sapiens
uuaagcacacuugacau

SEQ ID NO: 1678415 - RNA, 20 nt, Homo sapiens
uuaagcacacuugacaucaa

SEQ ID NO: 1678416 - RNA, 22 nt, Homo sapiens
uuaagccagggcacaaccagaa

SEQ ID NO: 1678417 - RNA, 19 nt, Homo sapiens
uuaagcguacaaagugauc

SEQ ID NO: 1678418 - RNA, 15 nt, Homo sapiens
uuaagggaagcugau

SEQ ID NO: 1678419 - RNA, 20 nt, Homo sapiens
uuaaguacugaaauacauau

SEQ ID NO: 1678420 - RNA, 18 nt, Homo sapiens
uuaaguccuacuuuacau

SEQ ID NO: 1678421 - RNA, 16 nt, Homo sapiens
uuaauaguuucuaaac

SEQ ID NO: 1678422 - RNA, 23 nt, Homo sapiens
uuaauggguuuuguguacuguaa

SEQ ID NO: 1678423 - RNA, 12 nt, Homo sapiens
uuaauucccaau

SEQ ID NO: 1678424 - RNA, 17 nt, Homo sapiens
uuaauugaggcuuacag

SEQ ID NO: 1678425 - RNA, 14 nt, Homo sapiens
uuaauuuugauuca

SEQ ID NO: 1678426 - RNA, 21 nt, Homo sapiens
uuacaagauggagaaacaaca

SEQ ID NO: 1678427 - RNA, 23 nt, Homo sapiens
uuacaagcauugaacuucuuuag

SEQ ID NO: 1678428 - RNA, 15 nt, Homo sapiens
uuacauaauugccaa

SEQ ID NO: 1678429 - RNA, 17 nt, Homo sapiens
uuacaugugauugugau

SEQ ID NO: 1678430 - RNA, 16 nt, Homo sapiens
uuacauuuuggucucu

SEQ ID NO: 1678431 - RNA, 17 nt, Homo sapiens
uuaccaugcucaaugaa

SEQ ID NO: 1678432 - RNA, 13 nt, Homo sapiens
uuaccucacacgc

SEQ ID NO: 1678433 - RNA, 21 nt, Homo sapiens
uuaccugccaggaagccagca

SEQ ID NO: 1678434 - RNA, 22 nt, Homo sapiens
uuaccuguaauagccucaccuu

SEQ ID NO: 1678435 - RNA, 16 nt, Homo sapiens
uuacuaaaucuacucu

SEQ ID NO: 1678436 - RNA, 16 nt, Homo sapiens
uuacuuacacaccuga

SEQ ID NO: 1678437 - RNA, 18 nt, Homo sapiens
uuagaagaaaauggauga

SEQ ID NO: 1678438 - RNA, 17 nt, Homo sapiens
uuagaauggggcuucca

SEQ ID NO: 1678439 - RNA, 19 nt, Homo sapiens
uuagaauguugaaacugac

SEQ ID NO: 1678440 - RNA, 18 nt, Homo sapiens
uuagaccaggcaggcaaa

SEQ ID NO: 1678441 - RNA, 19 nt, Homo sapiens
uuagauuuuaaaacuucau

SEQ ID NO: 1678442 - RNA, 19 nt, Homo sapiens
uuagauuuuucucaucucc

SEQ ID NO: 1678443 - RNA, 12 nt, Homo sapiens
uuagcaaagcau

SEQ ID NO: 1678444 - RNA, 22 nt, Homo sapiens
uuagcagucccuccacauuucc

SEQ ID NO: 1678445 - RNA, 18 nt, Homo sapiens
uuagcauugggugcaaau

SEQ ID NO: 1678446 - RNA, 12 nt, Homo sapiens
uuagcuauuacu

SEQ ID NO: 1678447 - RNA, 12 nt, Homo sapiens
uuaggcacuugg

SEQ ID NO: 1678448 - RNA, 17 nt, Homo sapiens
uuagguggggacagagg

SEQ ID NO: 1678449 - RNA, 17 nt, Homo sapiens
uuaguaagauacuguuu

SEQ ID NO: 1678450 - RNA, 14 nt, Homo sapiens
uuaguccucaccuu

SEQ ID NO: 1678451 - RNA, 14 nt, Homo sapiens
uuagugcaugucac

SEQ ID NO: 1678452 - RNA, 14 nt, Homo sapiens
uuauaccagcaaaa

SEQ ID NO: 1678453 - RNA, 22 nt, Homo sapiens
uuauauacaaagcugucacuca

SEQ ID NO: 1678454 - RNA, 21 nt, Homo sapiens
uuauauauguauaucugugua

SEQ ID NO: 1678455 - RNA, 15 nt, Homo sapiens
uuauaucagaguaug

SEQ ID NO: 1678456 - RNA, 22 nt, Homo sapiens
uuaucaaaaaacagaaaaacaa

SEQ ID NO: 1678457 - RNA, 23 nt, Homo sapiens
uuaucagugaauauaaauguacu

SEQ ID NO: 1678458 - RNA, 18 nt, Homo sapiens
uuaucuaaccuguuccau

SEQ ID NO: 1678459 - RNA, 13 nt, Homo sapiens
uuaucugucuuua

SEQ ID NO: 1678460 - RNA, 13 nt, Homo sapiens
uuaucuguucuau

SEQ ID NO: 1678461 - RNA, 21 nt, Homo sapiens
uuaugaaccgcaauaugggag

SEQ ID NO: 1678462 - RNA, 13 nt, Homo sapiens
uuaugacuccaga

SEQ ID NO: 1678463 - RNA, 17 nt, Homo sapiens
uuaugacuccagaauuu

SEQ ID NO: 1678464 - RNA, 11 nt, Homo sapiens
uuaugccuguc

SEQ ID NO: 1678465 - RNA, 14 nt, Homo sapiens
uuauggagugugcc

SEQ ID NO: 1678466 - RNA, 18 nt, Homo sapiens
uuauucuuccaaguucau

SEQ ID NO: 1678467 - RNA, 16 nt, Homo sapiens
uuauuggucuugcccu

SEQ ID NO: 1678468 - RNA, 15 nt, Homo sapiens
uuauuguaccuaagu

SEQ ID NO: 1678469 - RNA, 13 nt, Homo sapiens
uuauuguauauau

SEQ ID NO: 1678470 - RNA, 14 nt, Homo sapiens
uuauuucagauuca

SEQ ID NO: 1678471 - RNA, 23 nt, Homo sapiens
uucaaaaauuauauuuugaacaa

SEQ ID NO: 1678472 - RNA, 23 nt, Homo sapiens
uucaaaauagguuuuuauuguug

SEQ ID NO: 1678473 - RNA, 23 nt, Homo sapiens
uucaacagcucaccaacuacaga

SEQ ID NO: 1678474 - RNA, 17 nt, Homo sapiens
uuugguuacugugccau

SEQ ID NO: 1678475 - RNA, 13 nt, Homo sapiens
uuugguugcaauu

SEQ ID NO: 1678476 - RNA, 17 nt, Homo sapiens
uuuguaauauaagacaa

SEQ ID NO: 1678477 - RNA, 14 nt, Homo sapiens
uuugucaacuucag

SEQ ID NO: 1678478 - RNA, 12 nt, Homo sapiens
uuugucacuucu

SEQ ID NO: 1678479 - RNA, 12 nt, Homo sapiens
uuugucugugau

SEQ ID NO: 1678480 - RNA, 12 nt, Homo sapiens
uuugugaucugu

SEQ ID NO: 1678481 - RNA, 13 nt, Homo sapiens
uuuguguuuacau

SEQ ID NO: 1678482 - RNA, 14 nt, Homo sapiens
uuuuaaaacauuca

SEQ ID NO: 1678483 - RNA, 15 nt, Homo sapiens
uuuuacugacgcuca

SEQ ID NO: 1678484 - RNA, 13 nt, Homo sapiens
uuuuagauuccua

SEQ ID NO: 1678485 - RNA, 12 nt, Homo sapiens
uuuuaggcucug

SEQ ID NO: 1678486 - RNA, 23 nt, Homo sapiens
uuuuauggaucuguugggaacca

SEQ ID NO: 1678487 - RNA, 18 nt, Homo sapiens
uuuuccaugacugcauuu

SEQ ID NO: 1678488 - RNA, 19 nt, Homo sapiens
uuuuccuucacaaugguuu

SEQ ID NO: 1678489 - RNA, 13 nt, Homo sapiens
uuuucucaucucc

SEQ ID NO: 1678490 - RNA, 13 nt, Homo sapiens
uuuucugcuguaa

SEQ ID NO: 1678491 - RNA, 20 nt, Homo sapiens
uuuugaaagucccuaauaaa

SEQ ID NO: 1678492 - RNA, 13 nt, Homo sapiens
uuuugacuugcca

SEQ ID NO: 1678493 - RNA, 15 nt, Homo sapiens
uuuugacuugccacu

SEQ ID NO: 1678494 - RNA, 13 nt, Homo sapiens
uuuugauggcuau

SEQ ID NO: 1678495 - RNA, 17 nt, Homo sapiens
uuuugcaaaacauaucu

SEQ ID NO: 1678496 - RNA, 18 nt, Homo sapiens
uuuugccagccuguucuc

SEQ ID NO: 1678497 - RNA, 15 nt, Homo sapiens
uuuuggaagaauuca

SEQ ID NO: 1678498 - RNA, 21 nt, Homo sapiens
uuuuguaugaaauauauguga

SEQ ID NO: 1678499 - RNA, 18 nt, Homo sapiens
uuuuuaacuuuaccaugc

SEQ ID NO: 1678500 - RNA, 21 nt, Homo sapiens
uuuuuagacuguuagacaaaa

SEQ ID NO: 1678501 - RNA, 11 nt, Homo sapiens
uuuuuccuuag

SEQ ID NO: 1678502 - RNA, 20 nt, Homo sapiens
gcauuugcugaauaacaaca

SEQ ID NO: 1678503 - RNA, 16 nt, Homo sapiens
gcauuugcugcauuuc

SEQ ID NO: 1678504 - RNA, 18 nt, Homo sapiens
gcauuugcugcauuucaa

SEQ ID NO: 1678505 - RNA, 17 nt, Homo sapiens
gcauuuguguagcugag

SEQ ID NO: 1678506 - RNA, 16 nt, Homo sapiens
gccaagggcagaucac

SEQ ID NO: 1678507 - RNA, 15 nt, Homo sapiens
gccaauucaucucag

SEQ ID NO: 1678508 - RNA, 19 nt, Homo sapiens
gccacaauaagccacuggu

SEQ ID NO: 1678509 - RNA, 12 nt, Homo sapiens
gccacaauguga

SEQ ID NO: 1678510 - RNA, 14 nt, Homo sapiens
gccacauggccgcu

SEQ ID NO: 1678511 - RNA, 19 nt, Homo sapiens
gccacguggccgcugccca

SEQ ID NO: 1678512 - RNA, 17 nt, Homo sapiens
gcucagaaaaucaaaga

SEQ ID NO: 1678513 - RNA, 20 nt, Homo sapiens
gcucagccccagaccugccg

SEQ ID NO: 1678514 - RNA, 21 nt, Homo sapiens
gcucaguaaccaugcaaaauu

SEQ ID NO: 1678515 - RNA, 17 nt, Homo sapiens
gcucaguuggugcugcu

SEQ ID NO: 1678516 - RNA, 14 nt, Homo sapiens
gcucauagcacaug

SEQ ID NO: 1678517 - RNA, 21 nt, Homo sapiens
gcucauuauuaccacuuagaa

SEQ ID NO: 1678518 - RNA, 12 nt, Homo sapiens
gcuccacucuga

SEQ ID NO: 1678519 - RNA, 23 nt, Homo sapiens
gcuccaguauaaauuacaugcau

SEQ ID NO: 1678520 - RNA, 23 nt, Homo sapiens
gcuccccaauccaacccaugcau

SEQ ID NO: 1678521 - RNA, 18 nt, Homo sapiens
gcucccugcgccugacau

SEQ ID NO: 1678522 - RNA, 18 nt, Homo sapiens
gcuccucugcagccugag

SEQ ID NO: 1678523 - RNA, 17 nt, Homo sapiens
gcucuagggaagcagug

SEQ ID NO: 1678524 - RNA, 16 nt, Homo sapiens
gcucucuaagaauuca

SEQ ID NO: 1678525 - RNA, 23 nt, Homo sapiens
gcucugcagcgagccccccaugu

SEQ ID NO: 1678526 - RNA, 19 nt, Homo sapiens
gcucuuccuggacagugag

SEQ ID NO: 1678527 - RNA, 21 nt, Homo sapiens
gcucuucucauuuuuuccuga

SEQ ID NO: 1678528 - RNA, 13 nt, Homo sapiens
gcugaaaauggag

SEQ ID NO: 1678529 - RNA, 22 nt, Homo sapiens
gcugaauuauuggacagucuca

SEQ ID NO: 1678530 - RNA, 14 nt, Homo sapiens
gcugagcacagcag

SEQ ID NO: 1678531 - RNA, 16 nt, Homo sapiens
gcugaggacacucagu

SEQ ID NO: 1678532 - RNA, 19 nt, Homo sapiens
gcugauuuacuaacaguaa

SEQ ID NO: 1678533 - RNA, 19 nt, Homo sapiens
gcugauuuuuuuucugaua

SEQ ID NO: 1678534 - RNA, 13 nt, Homo sapiens
gcugcaacagugg

SEQ ID NO: 1678535 - RNA, 18 nt, Homo sapiens
gcugcagaugacuggaaa

SEQ ID NO: 1678536 - RNA, 16 nt, Homo sapiens
gcugcaggaaucaaaa

SEQ ID NO: 1678537 - RNA, 11 nt, Homo sapiens
gcugcaucucc

SEQ ID NO: 1678538 - RNA, 21 nt, Homo sapiens
gcugcccacaacuugccaaaa

SEQ ID NO: 1678539 - RNA, 22 nt, Homo sapiens
gcugccucaggaaucuccugac

SEQ ID NO: 1678540 - RNA, 14 nt, Homo sapiens
gcugccugccaugu

SEQ ID NO: 1678541 - RNA, 13 nt, Homo sapiens
gcugccuguggug

SEQ ID NO: 1678542 - RNA, 23 nt, Homo sapiens
gcugcuaaguggaagacagagau

SEQ ID NO: 1678543 - RNA, 15 nt, Homo sapiens
gcugcugcacugccc

SEQ ID NO: 1678544 - RNA, 16 nt, Homo sapiens
gcugcuggaaaggccc

SEQ ID NO: 1678545 - RNA, 19 nt, Homo sapiens
gcugcuguagcaacagagc

SEQ ID NO: 1678546 - RNA, 13 nt, Homo sapiens
gcugcugugacag

SEQ ID NO: 1678547 - RNA, 20 nt, Homo sapiens
gcugcuuucuuguugcugca

SEQ ID NO: 1678548 - RNA, 17 nt, Homo sapiens
gcuggcaaacugugaau

SEQ ID NO: 1678549 - RNA, 20 nt, Homo sapiens
gcugggcagaggaaagcaaa

SEQ ID NO: 1678550 - RNA, 19 nt, Homo sapiens
gcuggggaggccugccugg

SEQ ID NO: 1678551 - RNA, 21 nt, Homo sapiens
gcuggguuugggcaguggaga

SEQ ID NO: 1678552 - RNA, 18 nt, Homo sapiens
gcugugagcuuucugaua

SEQ ID NO: 1678553 - RNA, 18 nt, Homo sapiens
gcugugaugcaugagcuc

SEQ ID NO: 1678554 - RNA, 20 nt, Homo sapiens
gcuguuuuggaugaaugcag

SEQ ID NO: 1678555 - RNA, 14 nt, Homo sapiens
gcuuaaaugaucaa

SEQ ID NO: 1678556 - RNA, 20 nt, Homo sapiens
gcuuacuaguaucacugcuu

SEQ ID NO: 1678557 - RNA, 19 nt, Homo sapiens
gcuuauaccagguuaccuc

SEQ ID NO: 1678558 - RNA, 21 nt, Homo sapiens
gcuuauaccagguuaccucac

SEQ ID NO: 1678559 - RNA, 15 nt, Homo sapiens
gcuuauuagcagcug

SEQ ID NO: 1678560 - RNA, 12 nt, Homo sapiens
gcuucacuuaaa

SEQ ID NO: 1678561 - RNA, 12 nt, Homo sapiens
gcuucauucaag

SEQ ID NO: 1678562 - RNA, 21 nt, Homo sapiens
gcuuccaaugugguggcaaua

SEQ ID NO: 1678563 - RNA, 20 nt, Homo sapiens
gcuucccaugucuuucucca

SEQ ID NO: 1678564 - RNA, 21 nt, Homo sapiens
gcuuccuccugguguggaaga

SEQ ID NO: 1678565 - RNA, 14 nt, Homo sapiens
gcuucuaccagaga

SEQ ID NO: 1678566 - RNA, 18 nt, Homo sapiens
gcuucuacuccaugguga

SEQ ID NO: 1678567 - RNA, 23 nt, Homo sapiens
gcuucucugccgguggggccagc

SEQ ID NO: 1678568 - RNA, 15 nt, Homo sapiens
gcuucucuugccuaa

SEQ ID NO: 1678569 - RNA, 18 nt, Homo sapiens
gcuugaguggacagcagc

SEQ ID NO: 1678570 - RNA, 15 nt, Homo sapiens
gcuugcaugugcugc

SEQ ID NO: 1678571 - RNA, 20 nt, Homo sapiens
gcuugcuggaaaacugccac

SEQ ID NO: 1678572 - RNA, 14 nt, Homo sapiens
gcuuggagugccac

SEQ ID NO: 1678573 - RNA, 16 nt, Homo sapiens
gcuugggcuggagugg

SEQ ID NO: 1678574 - RNA, 15 nt, Homo sapiens
gcuugggcuucaucc

SEQ ID NO: 1678575 - RNA, 16 nt, Homo sapiens
gcuugggcuucauccu

SEQ ID NO: 1678576 - RNA, 21 nt, Homo sapiens
gcuuggugguuaugucccaug

SEQ ID NO: 1678577 - RNA, 19 nt, Homo sapiens
gcuuguaaugcucacuuau

SEQ ID NO: 1678578 - RNA, 23 nt, Homo sapiens
gcuuguauuaucuguccaaaagg

SEQ ID NO: 1678579 - RNA, 22 nt, Homo sapiens
gcuuguguguaugucuaugugu

SEQ ID NO: 1678580 - RNA, 21 nt, Homo sapiens
gcuuguucuuccucuuaccug

SEQ ID NO: 1678581 - RNA, 20 nt, Homo sapiens
gcuuguuuaagguucuugcu

SEQ ID NO: 1678582 - RNA, 18 nt, Homo sapiens
gcuuuacagugccacgac

SEQ ID NO: 1678583 - RNA, 17 nt, Homo sapiens
gcuuuacucugaauuuc

SEQ ID NO: 1678584 - RNA, 18 nt, Homo sapiens
gcuuuauaauaaacuguu

SEQ ID NO: 1678585 - RNA, 18 nt, Homo sapiens
gcuuucuuaucccaguga

SEQ ID NO: 1678586 - RNA, 15 nt, Homo sapiens
gcuuucuuguugcug

SEQ ID NO: 1678587 - RNA, 17 nt, Homo sapiens
gcuuugccacugaagua

SEQ ID NO: 1678588 - RNA, 17 nt, Homo sapiens
gcuuuucucaugguauu

SEQ ID NO: 1678589 - RNA, 17 nt, Homo sapiens
ggaaaaaauuagacaag

SEQ ID NO: 1678590 - RNA, 13 nt, Homo sapiens
ggaaaaauggggu

SEQ ID NO: 1678591 - RNA, 23 nt, Homo sapiens
ggaaaacugccacaagcacaauu

SEQ ID NO: 1678592 - RNA, 16 nt, Homo sapiens
ggaaaagaaagagcug

SEQ ID NO: 1678593 - RNA, 20 nt, Homo sapiens
ggaaaagaauucucagcaga

SEQ ID NO: 1678594 - RNA, 17 nt, Homo sapiens
ggaaaagagaaacacua

SEQ ID NO: 1678595 - RNA, 15 nt, Homo sapiens
ggaaacugcacuguu

SEQ ID NO: 1678596 - RNA, 19 nt, Homo sapiens
ggaaagccucacugauaua

SEQ ID NO: 1678597 - RNA, 23 nt, Homo sapiens
ggaaaggcaucuaagacauucac

SEQ ID NO: 1678598 - RNA, 13 nt, Homo sapiens
ggaaagguccugc

SEQ ID NO: 1678599 - RNA, 18 nt, Homo sapiens
ggaaauaggcauaucaag

SEQ ID NO: 1678600 - RNA, 19 nt, Homo sapiens
ggaaaugauugagagcagc

SEQ ID NO: 1678601 - RNA, 13 nt, Homo sapiens
ggaaaugggagac

SEQ ID NO: 1678602 - RNA, 22 nt, Homo sapiens
ggaacaaagacaaccacuggga

SEQ ID NO: 1678603 - RNA, 15 nt, Homo sapiens
ggaacagcauaugca

SEQ ID NO: 1678604 - RNA, 16 nt, Homo sapiens
ggaacagcauaugcaa

SEQ ID NO: 1678605 - RNA, 22 nt, Homo sapiens
ggaacagcccugcacgcccagg

SEQ ID NO: 1678606 - RNA, 18 nt, Homo sapiens
ggaacccaucacuguguc

SEQ ID NO: 1678607 - RNA, 18 nt, Homo sapiens
ggaacugcuugugcacug

SEQ ID NO: 1678608 - RNA, 19 nt, Homo sapiens
ggaacugcuugugcacugg

SEQ ID NO: 1678609 - RNA, 20 nt, Homo sapiens
ggaacugcuugugcacugga

SEQ ID NO: 1678610 - RNA, 21 nt, Homo sapiens
ggaacugcuugugcacuggau

SEQ ID NO: 1678611 - RNA, 23 nt, Homo sapiens
ggaagagagggaggcacguagga

SEQ ID NO: 1678612 - RNA, 15 nt, Homo sapiens
ggaagcaccaugaau

SEQ ID NO: 1678613 - RNA, 18 nt, Homo sapiens
ggaagggaccccacugga

SEQ ID NO: 1678614 - RNA, 13 nt, Homo sapiens
ggaaugcaauaaa

SEQ ID NO: 1678615 - RNA, 20 nt, Homo sapiens
ggaauggggugggagccaca

SEQ ID NO: 1678616 - RNA, 14 nt, Homo sapiens
ggaauuacauaaca

SEQ ID NO: 1678617 - RNA, 17 nt, Homo sapiens
ggacaacgaacauggca

SEQ ID NO: 1678618 - RNA, 15 nt, Homo sapiens
ggaccagagcugcca

SEQ ID NO: 1678619 - RNA, 20 nt, Homo sapiens
ggaccugcuuugagauuucc

SEQ ID NO: 1678620 - RNA, 19 nt, Homo sapiens
ggacuacaggcaccugcca

SEQ ID NO: 1678621 - RNA, 12 nt, Homo sapiens
ggacuccaagcc

SEQ ID NO: 1678622 - RNA, 14 nt, Homo sapiens
ugaaugaugugaua

SEQ ID NO: 1678623 - RNA, 21 nt, Homo sapiens
ugaaugccaguccagaugugc

SEQ ID NO: 1678624 - RNA, 22 nt, Homo sapiens
ugaaugccaguccagaugugcc

SEQ ID NO: 1678625 - RNA, 16 nt, Homo sapiens
ugaauuaaagucuaca

SEQ ID NO: 1678626 - RNA, 18 nt, Homo sapiens
ugaauuuggggcuacuua

SEQ ID NO: 1678627 - RNA, 22 nt, Homo sapiens
uccugggggcauaucucaguca

SEQ ID NO: 1678628 - RNA, 13 nt, Homo sapiens
uccugggugccag

SEQ ID NO: 1678629 - RNA, 22 nt, Homo sapiens
uccugggugcugucaugcccag

SEQ ID NO: 1678630 - RNA, 21 nt, Homo sapiens
uccugucuaaaaaugauucuc

SEQ ID NO: 1678631 - RNA, 19 nt, Homo sapiens
uccugucuccucugucagu

SEQ ID NO: 1678632 - RNA, 16 nt, Homo sapiens
uccuguucccaugaga

SEQ ID NO: 1678633 - RNA, 16 nt, Homo sapiens
uccuuaaaaauguaug

SEQ ID NO: 1678634 - RNA, 17 nt, Homo sapiens
uccuuagaauacuguau

SEQ ID NO: 1678635 - RNA, 21 nt, Homo sapiens
uccuucacucugacaguauua

SEQ ID NO: 1678636 - RNA, 19 nt, Homo sapiens
uccuucaugcuuuucucau

SEQ ID NO: 1678637 - RNA, 14 nt, Homo sapiens
uccuuccacuucag

SEQ ID NO: 1678638 - RNA, 22 nt, Homo sapiens
uccuugaggucuugaguuucau

SEQ ID NO: 1678639 - RNA, 14 nt, Homo sapiens
uccuugauuacaua

SEQ ID NO: 1678640 - RNA, 15 nt, Homo sapiens
uccuuggcagaggca

SEQ ID NO: 1678641 - RNA, 20 nt, Homo sapiens
uccuugguuuugccucuuua

SEQ ID NO: 1678642 - RNA, 11 nt, Homo sapiens
uccuuguacuu

SEQ ID NO: 1678643 - RNA, 14 nt, Homo sapiens
uccuuguacuugau

SEQ ID NO: 1678644 - RNA, 18 nt, Homo sapiens
uccuuguagaucuuugug

SEQ ID NO: 1678645 - RNA, 22 nt, Homo sapiens
uccuuuagacuaagggcaggaa

SEQ ID NO: 1678646 - RNA, 15 nt, Homo sapiens
uccuuucauccucag

SEQ ID NO: 1678647 - RNA, 18 nt, Homo sapiens
uccuuuccaucagcuuua

SEQ ID NO: 1678648 - RNA, 15 nt, Homo sapiens
uccuuucccacccac

SEQ ID NO: 1678649 - RNA, 20 nt, Homo sapiens
uccuuuugcuucaucuggag

SEQ ID NO: 1678650 - RNA, 16 nt, Homo sapiens
uccuuuuguauccucc

SEQ ID NO: 1678651 - RNA, 17 nt, Homo sapiens
uccuuuuuuauugaaua

SEQ ID NO: 1678652 - RNA, 21 nt, Homo sapiens
ucgcagacuuaagcguacaaa

SEQ ID NO: 1678653 - RNA, 20 nt, Homo sapiens
ucgccaaguuggagugcaau

SEQ ID NO: 1678654 - RNA, 22 nt, Homo sapiens
ucgccaugggggucuuugaaca

SEQ ID NO: 1678655 - RNA, 21 nt, Homo sapiens
ucgcggcucuccagggcuccc

SEQ ID NO: 1678656 - RNA, 12 nt, Homo sapiens
ucgcuuugccau

SEQ ID NO: 1678657 - RNA, 17 nt, Homo sapiens
ucggacaccaucuuggg

SEQ ID NO: 1678658 - RNA, 16 nt, Homo sapiens
ucggacuuugcaggag

SEQ ID NO: 1678659 - RNA, 19 nt, Homo sapiens
ucgggggcggcucugggaa

SEQ ID NO: 1678660 - RNA, 16 nt, Homo sapiens
ucgguggcauuugcug

SEQ ID NO: 1678661 - RNA, 18 nt, Homo sapiens
ucguaaguucugugcagu

SEQ ID NO: 1678662 - RNA, 14 nt, Homo sapiens
ucguauacccugga

SEQ ID NO: 1678663 - RNA, 14 nt, Homo sapiens
ucgucugggcuccc

SEQ ID NO: 1678664 - RNA, 18 nt, Homo sapiens
ucgugaauucuuguucau

SEQ ID NO: 1678665 - RNA, 18 nt, Homo sapiens
ucgugcgacaggcauuua

SEQ ID NO: 1678666 - RNA, 21 nt, Homo sapiens
ucguggugggugcucaagacu

SEQ ID NO: 1678667 - RNA, 22 nt, Homo sapiens
ucuaaaaacaguuaagacaaca

SEQ ID NO: 1678668 - RNA, 13 nt, Homo sapiens
ucuaaacauuuca

SEQ ID NO: 1678669 - RNA, 22 nt, Homo sapiens
ucuaaacuuucccuauacuuag

SEQ ID NO: 1678670 - RNA, 12 nt, Homo sapiens
ucuaaagcugcc

SEQ ID NO: 1678671 - RNA, 13 nt, Homo sapiens
ucuaaagcugcca

SEQ ID NO: 1678672 - RNA, 16 nt, Homo sapiens
ucuaaaucauaaucau

SEQ ID NO: 1678673 - RNA, 15 nt, Homo sapiens
ucuaagacauucacc

SEQ ID NO: 1678674 - RNA, 23 nt, Homo sapiens
ucuaaugaaaccugugucucuga

SEQ ID NO: 1678675 - RNA, 14 nt, Homo sapiens
ucuaauguacaaua

SEQ ID NO: 1678676 - RNA, 21 nt, Homo sapiens
ucuaauugcccacccaguaug

SEQ ID NO: 1678677 - RNA, 23 nt, Homo sapiens
ucuacacagugggaacucugaca

SEQ ID NO: 1678678 - RNA, 14 nt, Homo sapiens
ucuacacugccuuu

SEQ ID NO: 1678679 - RNA, 15 nt, Homo sapiens
ucuacaggcauuuaa

SEQ ID NO: 1678680 - RNA, 16 nt, Homo sapiens
ucuacauccaauguau

SEQ ID NO: 1678681 - RNA, 22 nt, Homo sapiens
ucuacucuuaaauauacaacuu

SEQ ID NO: 1678682 - RNA, 16 nt, Homo sapiens
ucuacuucuugugcuu

SEQ ID NO: 1678683 - RNA, 15 nt, Homo sapiens
ucuagaauacuaaua

SEQ ID NO: 1678684 - RNA, 15 nt, Homo sapiens
ucuagagaacaugcc

SEQ ID NO: 1678685 - RNA, 18 nt, Homo sapiens
ucuagcauggcugccaau

SEQ ID NO: 1678686 - RNA, 21 nt, Homo sapiens
ucuagucaagcgauugucuga

SEQ ID NO: 1678687 - RNA, 21 nt, Homo sapiens
ucuauauuauauaaauaguau

SEQ ID NO: 1678688 - RNA, 22 nt, Homo sapiens
ucuauggaccaaauguaaaaua

SEQ ID NO: 1678689 - RNA, 17 nt, Homo sapiens
ucuauggcauauugaua

SEQ ID NO: 1678690 - RNA, 20 nt, Homo sapiens
ucuauuuuaguuaacuauga

SEQ ID NO: 1678691 - RNA, 16 nt, Homo sapiens
ucuauuuucaaguaca

SEQ ID NO: 1678692 - RNA, 23 nt, Homo sapiens
ucucaaaauaaaaccagaaagag

SEQ ID NO: 1678693 - RNA, 14 nt, Homo sapiens
ucucaaacacugcu

SEQ ID NO: 1678694 - RNA, 17 nt, Homo sapiens
ucucaaacacugcuuaa

SEQ ID NO: 1678695 - RNA, 16 nt, Homo sapiens
ucucaacaaaucucag

SEQ ID NO: 1678696 - RNA, 19 nt, Homo sapiens
ucucaauacccacugccag

SEQ ID NO: 1678697 - RNA, 13 nt, Homo sapiens
ucucacacacaua

SEQ ID NO: 1678698 - RNA, 22 nt, Homo sapiens
ucucagcucacuacaaccuccg

SEQ ID NO: 1678699 - RNA, 21 nt, Homo sapiens
ucucagcucacugcaaccucc

SEQ ID NO: 1678700 - RNA, 12 nt, Homo sapiens
ucucaggccagc

SEQ ID NO: 1678701 - RNA, 14 nt, Homo sapiens
ucucaggucuucac

SEQ ID NO: 1678702 - RNA, 17 nt, Homo sapiens
ucucagugcuagcuuau

SEQ ID NO: 1678703 - RNA, 23 nt, Homo sapiens
ucucaucaacaaagaaauauuau

SEQ ID NO: 1678704 - RNA, 13 nt, Homo sapiens
ucucaucacugaa

SEQ ID NO: 1678705 - RNA, 10 nt, Homo sapiens
ucucaucucc

SEQ ID NO: 1678706 - RNA, 22 nt, Homo sapiens
ucucaucuguaaaaccaggcug

SEQ ID NO: 1678707 - RNA, 17 nt, Homo sapiens
ucucauuagcucucauc

SEQ ID NO: 1678708 - RNA, 16 nt, Homo sapiens
ucucauucccaggcac

SEQ ID NO: 1678709 - RNA, 13 nt, Homo sapiens
ucucauucuugcc

SEQ ID NO: 1678710 - RNA, 15 nt, Homo sapiens
ucucauuugccagga

SEQ ID NO: 1678711 - RNA, 16 nt, Homo sapiens
ucucauuugccaggaa

SEQ ID NO: 1678712 - RNA, 21 nt, Homo sapiens
ucuccaagcacuagccuuccc

SEQ ID NO: 1678713 - RNA, 19 nt, Homo sapiens
ucuccaauuggguugugaa

SEQ ID NO: 1678714 - RNA, 21 nt, Homo sapiens
ucuccagccaauuucaaagaa

SEQ ID NO: 1678715 - RNA, 21 nt, Homo sapiens
ucuccagggguuuacagugaa

SEQ ID NO: 1678716 - RNA, 19 nt, Homo sapiens
ucuccccucagccaaugaa

SEQ ID NO: 1678717 - RNA, 23 nt, Homo sapiens
ucucccuacuuagacccagucau

SEQ ID NO: 1678718 - RNA, 12 nt, Homo sapiens
ucucccuuuaug

SEQ ID NO: 1678719 - RNA, 20 nt, Homo sapiens
ucuccuaagcuggagugcag

SEQ ID NO: 1678720 - RNA, 14 nt, Homo sapiens
ucuccucugcagcu

SEQ ID NO: 1678721 - RNA, 16 nt, Homo sapiens
ucuccugauuauuuau

SEQ ID NO: 1678722 - RNA, 18 nt, Homo sapiens
ucuccugugcaccugacu

SEQ ID NO: 1678723 - RNA, 16 nt, Homo sapiens
ucuccuuaaacuacca

SEQ ID NO: 1678724 - RNA, 22 nt, Homo sapiens
ucuccuuauccccccaaaugga

SEQ ID NO: 1678725 - RNA, 17 nt, Homo sapiens
ucucgagcccagaugga

SEQ ID NO: 1678726 - RNA, 15 nt, Homo sapiens
ucucggaguccaaag

SEQ ID NO: 1678727 - RNA, 16 nt, Homo sapiens
ucucgggugcauuuga

SEQ ID NO: 1678728 - RNA, 18 nt, Homo sapiens
ucucuaaaacagcacuau

SEQ ID NO: 1678729 - RNA, 20 nt, Homo sapiens
ucucuaccuucaacaugugc

SEQ ID NO: 1678730 - RNA, 19 nt, Homo sapiens
ucucuacuagcaccaucac

SEQ ID NO: 1678731 - RNA, 13 nt, Homo sapiens
ucucuagugcagg

SEQ ID NO: 1678732 - RNA, 12 nt, Homo sapiens
ucucuaucuuag

SEQ ID NO: 1678733 - RNA, 21 nt, Homo sapiens
ucucuccacgguagcacuuga

SEQ ID NO: 1678734 - RNA, 18 nt, Homo sapiens
ucucugagaacagacguu

SEQ ID NO: 1678735 - RNA, 19 nt, Homo sapiens
ucucuguauaacuugugau

SEQ ID NO: 1678736 - RNA, 20 nt, Homo sapiens
ucucugucaugugcagauga

SEQ ID NO: 1678737 - RNA, 12 nt, Homo sapiens
ucucugugcugg

SEQ ID NO: 1678738 - RNA, 21 nt, Homo sapiens
ucucuguggccauuugugaua

SEQ ID NO: 1678739 - RNA, 15 nt, Homo sapiens
ucucuuaagcugccc

SEQ ID NO: 1678740 - RNA, 17 nt, Homo sapiens
ucucuucccaccuguca

SEQ ID NO: 1678741 - RNA, 12 nt, Homo sapiens
ucucuucuaaug

SEQ ID NO: 1678742 - RNA, 19 nt, Homo sapiens
ucucuucuacaauuguggu

SEQ ID NO: 1678743 - RNA, 19 nt, Homo sapiens
ucucuuguuaaaugagcuu

SEQ ID NO: 1678744 - RNA, 15 nt, Homo sapiens
ucucuuucuuuccaa

SEQ ID NO: 1678745 - RNA, 19 nt, Homo sapiens
ucugaaaucuacaacauaa

SEQ ID NO: 1678746 - RNA, 21 nt, Homo sapiens
ucugaaauuuacccacaguga

SEQ ID NO: 1678747 - RNA, 17 nt, Homo sapiens
ucugaauuacugcaaag

SEQ ID NO: 1678748 - RNA, 22 nt, Homo sapiens
ucugacgcaaaaccacuuuccu

SEQ ID NO: 1678749 - RNA, 23 nt, Homo sapiens
ucugacuguaaaauacaugguau

SEQ ID NO: 1678750 - RNA, 16 nt, Homo sapiens
caguaugauuuguaca

SEQ ID NO: 1678751 - RNA, 23 nt, Homo sapiens
caguaugguucucggaguccaaa

SEQ ID NO: 1678752 - RNA, 17 nt, Homo sapiens
caguauugagacacugu

SEQ ID NO: 1678753 - RNA, 23 nt, Homo sapiens
caguauuguucuuguaaaacugu

SEQ ID NO: 1678754 - RNA, 19 nt, Homo sapiens
cagucaaaauguuugauau

SEQ ID NO: 1678755 - RNA, 14 nt, Homo sapiens
cagucaucaucuca

SEQ ID NO: 1678756 - RNA, 15 nt, Homo sapiens
caguccaucucaagu

SEQ ID NO: 1678757 - RNA, 22 nt, Homo sapiens
cagucccagcuaacucugaccu

SEQ ID NO: 1678758 - RNA, 19 nt, Homo sapiens
cagucccucccuccuggcu

SEQ ID NO: 1678759 - RNA, 11 nt, Homo sapiens
cagucuacauu

SEQ ID NO: 1678760 - RNA, 14 nt, Homo sapiens
cagucuuugcucag

SEQ ID NO: 1678761 - RNA, 13 nt, Homo sapiens
cagugcaguacuc

SEQ ID NO: 1678762 - RNA, 16 nt, Homo sapiens
caguggcaucaucuca

SEQ ID NO: 1678763 - RNA, 17 nt, Homo sapiens
caguggcgcgaucucag

SEQ ID NO: 1678764 - RNA, 17 nt, Homo sapiens
caguggcgugaucucag

SEQ ID NO: 1678765 - RNA, 20 nt, Homo sapiens
caguguacucugaguccuca

SEQ ID NO: 1678766 - RNA, 17 nt, Homo sapiens
caguguagaucaacuca

SEQ ID NO: 1678767 - RNA, 19 nt, Homo sapiens
caguguauuuaauguuugu

SEQ ID NO: 1678768 - RNA, 18 nt, Homo sapiens
cagugucaugaauguugc

SEQ ID NO: 1678769 - RNA, 19 nt, Homo sapiens
caguguccugugcuuucug

SEQ ID NO: 1678770 - RNA, 18 nt, Homo sapiens
cagugugauaaggacuuu

SEQ ID NO: 1678771 - RNA, 16 nt, Homo sapiens
caguguuuccagugac

SEQ ID NO: 1678772 - RNA, 17 nt, Homo sapiens
caguguuuccagugaca

SEQ ID NO: 1678773 - RNA, 20 nt, Homo sapiens
caguuaagacaacaggcauu

SEQ ID NO: 1678774 - RNA, 22 nt, Homo sapiens
caguuaagacaacaggcauuuu

SEQ ID NO: 1678775 - RNA, 15 nt, Homo sapiens
caguuaaugugccaa

SEQ ID NO: 1678776 - RNA, 21 nt, Homo sapiens
caguuaauuuauuauuuuguu

SEQ ID NO: 1678777 - RNA, 16 nt, Homo sapiens
caguucaaagcaggau

SEQ ID NO: 1678778 - RNA, 14 nt, Homo sapiens
caguucagcuccuu

SEQ ID NO: 1678779 - RNA, 15 nt, Homo sapiens
caguucauggcauca

SEQ ID NO: 1678780 - RNA, 18 nt, Homo sapiens
caguucuuugggcugggu

SEQ ID NO: 1678781 - RNA, 17 nt, Homo sapiens
caguugggcccccaucc

SEQ ID NO: 1678782 - RNA, 15 nt, Homo sapiens
caguugguuuugcau

SEQ ID NO: 1678783 - RNA, 21 nt, Homo sapiens
caguuuccacaggcagcaucc

SEQ ID NO: 1678784 - RNA, 13 nt, Homo sapiens
caguuucuugcaa

SEQ ID NO: 1678785 - RNA, 22 nt, Homo sapiens
caguuugugaucuguccuucca

SEQ ID NO: 1678786 - RNA, 22 nt, Homo sapiens
cauaacaggcauugcacuaaaa

SEQ ID NO: 1678787 - RNA, 14 nt, Homo sapiens
cauaacuagaguau

SEQ ID NO: 1678788 - RNA, 16 nt, Homo sapiens
cauaagauuauauaca

SEQ ID NO: 1678789 - RNA, 23 nt, Homo sapiens
cauaagccauugcuucucccuca

SEQ ID NO: 1678790 - RNA, 21 nt, Homo sapiens
cauaauaaaaggaguucagau

SEQ ID NO: 1678791 - RNA, 13 nt, Homo sapiens
cauaaugaguucc

SEQ ID NO: 1678792 - RNA, 20 nt, Homo sapiens
cauacauacacugcauccug

SEQ ID NO: 1678793 - RNA, 17 nt, Homo sapiens
cauaccuacaccuaucu

SEQ ID NO: 1678794 - RNA, 13 nt, Homo sapiens
cauaccucugacc

SEQ ID NO: 1678795 - RNA, 15 nt, Homo sapiens
cauaccucugaccaa

SEQ ID NO: 1678796 - RNA, 17 nt, Homo sapiens
cauaccucugaccaaca

SEQ ID NO: 1678797 - RNA, 21 nt, Homo sapiens
cauacggcucuaacagauuag

SEQ ID NO: 1678798 - RNA, 19 nt, Homo sapiens
cauacuuaaaaauuuauua

SEQ ID NO: 1678799 - RNA, 19 nt, Homo sapiens
cauagaaacaugacacuga

SEQ ID NO: 1678800 - RNA, 23 nt, Homo sapiens
cauagaaguuaaagguuacuguu

SEQ ID NO: 1678801 - RNA, 17 nt, Homo sapiens
cauagauuaauggcacu

SEQ ID NO: 1678802 - RNA, 17 nt, Homo sapiens
cauaggacucuuugguc

SEQ ID NO: 1678803 - RNA, 19 nt, Homo sapiens
cauaggauccgaagugcaa

SEQ ID NO: 1678804 - RNA, 17 nt, Homo sapiens
cauagugguauuuuaac

SEQ ID NO: 1678805 - RNA, 18 nt, Homo sapiens
cauauauauacauauaua

SEQ ID NO: 1678806 - RNA, 22 nt, Homo sapiens
cauaucauucagaaugugcaaa

SEQ ID NO: 1678807 - RNA, 17 nt, Homo sapiens
cauaucuguaugccuca

SEQ ID NO: 1678808 - RNA, 22 nt, Homo sapiens
cauauguaugugugaguguaug

SEQ ID NO: 1678809 - RNA, 15 nt, Homo sapiens
cauauuagcaucaug

SEQ ID NO: 1678810 - RNA, 21 nt, Homo sapiens
caucaacaaagaaauauuauu

SEQ ID NO: 1678811 - RNA, 17 nt, Homo sapiens
caucaagaugugacaug

SEQ ID NO: 1678812 - RNA, 16 nt, Homo sapiens
caucaagauuaauuaa

SEQ ID NO: 1678813 - RNA, 16 nt, Homo sapiens
caucacguauguuaua

SEQ ID NO: 1678814 - RNA, 22 nt, Homo sapiens
caucagggggcaugaagcacau

SEQ ID NO: 1678815 - RNA, 15 nt, Homo sapiens
caucauguugaauaa

SEQ ID NO: 1678816 - RNA, 22 nt, Homo sapiens
cauccaagagggacuccaagcc

SEQ ID NO: 1678817 - RNA, 17 nt, Homo sapiens
cauccacuucacaguuc

SEQ ID NO: 1678818 - RNA, 16 nt, Homo sapiens
cauccaggcucccaaa

SEQ ID NO: 1678819 - RNA, 16 nt, Homo sapiens
cauccucugcuuguca

SEQ ID NO: 1678820 - RNA, 20 nt, Homo sapiens
cauccuggagaguaucugag

SEQ ID NO: 1678821 - RNA, 22 nt, Homo sapiens
cauccuggagaguaucugagaa

SEQ ID NO: 1678822 - RNA, 18 nt, Homo sapiens
caucuccccucagauucc

SEQ ID NO: 1678823 - RNA, 19 nt, Homo sapiens
caucuccccucagauucca

SEQ ID NO: 1678824 - RNA, 13 nt, Homo sapiens
caucucuguaaaa

SEQ ID NO: 1678825 - RNA, 17 nt, Homo sapiens
caucucuuguaccagcc

SEQ ID NO: 1678826 - RNA, 22 nt, Homo sapiens
caucugaagaguggaaaugggg

SEQ ID NO: 1678827 - RNA, 22 nt, Homo sapiens
caucuggagcugaagcguuacu

SEQ ID NO: 1678828 - RNA, 18 nt, Homo sapiens
caucugucugucccaguu

SEQ ID NO: 1678829 - RNA, 19 nt, Homo sapiens
caucuguuugauacaguau

SEQ ID NO: 1678830 - RNA, 16 nt, Homo sapiens
caucuucccacagugg

SEQ ID NO: 1678831 - RNA, 16 nt, Homo sapiens
caucuugaauuguaag

SEQ ID NO: 1678832 - RNA, 23 nt, Homo sapiens
caucuugccucauuuugcuuccc

SEQ ID NO: 1678833 - RNA, 19 nt, Homo sapiens
caucuugggaagggccaug

SEQ ID NO: 1678834 - RNA, 15 nt, Homo sapiens
caugaaagcagcaca

SEQ ID NO: 1678835 - RNA, 17 nt, Homo sapiens
caugaaucucucaauua

SEQ ID NO: 1678836 - RNA, 18 nt, Homo sapiens
caugaauuaaaggugcca

SEQ ID NO: 1678837 - RNA, 14 nt, Homo sapiens
caugacacugaccu

SEQ ID NO: 1678838 - RNA, 22 nt, Homo sapiens
caugacagugguuauauuucaa

SEQ ID NO: 1678839 - RNA, 14 nt, Homo sapiens
caugagaaugucau

SEQ ID NO: 1678840 - RNA, 20 nt, Homo sapiens
caugagaaugucauuugcua

SEQ ID NO: 1678841 - RNA, 13 nt, Homo sapiens
caugagcaccuuu

SEQ ID NO: 1678842 - RNA, 16 nt, Homo sapiens
caugaguucugcacau

SEQ ID NO: 1678843 - RNA, 19 nt, Homo sapiens
caugaguucugcacauaca

SEQ ID NO: 1678844 - RNA, 17 nt, Homo sapiens
caugaguuuaugggaau

SEQ ID NO: 1678845 - RNA, 24 nt, Homo sapiens
caugaugcuaguucuuacgcuuga

SEQ ID NO: 1678846 - RNA, 18 nt, Homo sapiens
caugauguauuguugcuu

SEQ ID NO: 1678847 - RNA, 12 nt, Homo sapiens
caugcacauuca

SEQ ID NO: 1678848 - RNA, 15 nt, Homo sapiens
caugcagaaauugac

SEQ ID NO: 1678849 - RNA, 18 nt, Homo sapiens
caugcaugagcaccuuuc

SEQ ID NO: 1678850 - RNA, 16 nt, Homo sapiens
caugcauuuagcauga

SEQ ID NO: 1678851 - RNA, 21 nt, Homo sapiens
caugcauuuuaccaucacaca

SEQ ID NO: 1678852 - RNA, 13 nt, Homo sapiens
caugcucccucau

SEQ ID NO: 1678853 - RNA, 13 nt, Homo sapiens
cauggaaccaugg

SEQ ID NO: 1678854 - RNA, 17 nt, Homo sapiens
cauggaguagagucagg

SEQ ID NO: 1678855 - RNA, 15 nt, Homo sapiens
cauggccaauaguca

SEQ ID NO: 1678856 - RNA, 15 nt, Homo sapiens
cauggccacaauccc

SEQ ID NO: 1678857 - RNA, 15 nt, Homo sapiens
cauggccgcugccca

SEQ ID NO: 1678858 - RNA, 19 nt, Homo sapiens
cauggcuccucaccaccga

SEQ ID NO: 1678859 - RNA, 17 nt, Homo sapiens
cauggcuggaugugcau

SEQ ID NO: 1678860 - RNA, 17 nt, Homo sapiens
caugggaaugaauguca

SEQ ID NO: 1678861 - RNA, 21 nt, Homo sapiens
caugggaaugaaugucagugu

SEQ ID NO: 1678862 - RNA, 18 nt, Homo sapiens
cauggggccccucucauc

SEQ ID NO: 1678863 - RNA, 20 nt, Homo sapiens
cauggguguuuugaucucug

SEQ ID NO: 1678864 - RNA, 15 nt, Homo sapiens
cauguauuaccugaa

SEQ ID NO: 1678865 - RNA, 15 nt, Homo sapiens
caugugauugugauu

SEQ ID NO: 1678866 - RNA, 17 nt, Homo sapiens
cauguggcuaaaugccu

SEQ ID NO: 1678867 - RNA, 19 nt, Homo sapiens
cauguggcuaaaugccuaa

SEQ ID NO: 1678868 - RNA, 18 nt, Homo sapiens
cauguuuuugcaaauacu

SEQ ID NO: 1678869 - RNA, 21 nt, Homo sapiens
cauuaaauagcugcaccaucc

SEQ ID NO: 1678870 - RNA, 13 nt, Homo sapiens
cauuaaccaagaa

SEQ ID NO: 1678871 - RNA, 19 nt, Homo sapiens
cauuaauccacauguuuca

SEQ ID NO: 1678872 - RNA, 15 nt, Homo sapiens
cagcaacuggugacu

SEQ ID NO: 1678873 - RNA, 21 nt, Homo sapiens
cagcacuucccaaagugcacu

SEQ ID NO: 1678874 - RNA, 21 nt, Homo sapiens
cagcagcaggggaaagauuau

SEQ ID NO: 1678875 - RNA, 17 nt, Homo sapiens
cagcaugcauuuagcau

SEQ ID NO: 1678876 - RNA, 15 nt, Homo sapiens
cagcaugugcucagc

SEQ ID NO: 1678877 - RNA, 17 nt, Homo sapiens
cagcauuucagcuguga

SEQ ID NO: 1678878 - RNA, 21 nt, Homo sapiens
cagccccauccuucccgcagc

SEQ ID NO: 1678879 - RNA, 13 nt, Homo sapiens
cagcccccugcuu

SEQ ID NO: 1678880 - RNA, 19 nt, Homo sapiens
cagcccuggcaacugcuaa

SEQ ID NO: 1678881 - RNA, 14 nt, Homo sapiens
cagccuaccagaga

SEQ ID NO: 1678882 - RNA, 24 nt, Homo sapiens
cagccuccaccuugagcacuauuc

SEQ ID NO: 1678883 - RNA, 23 nt, Homo sapiens
cagccugcucccuagccagaggc

SEQ ID NO: 1678884 - RNA, 19 nt, Homo sapiens
cagccugcuucccaccucc

SEQ ID NO: 1678885 - RNA, 23 nt, Homo sapiens
cagccuuaaauccuuuacaagau

SEQ ID NO: 1678886 - RNA, 15 nt, Homo sapiens
cagccuugguuccug

SEQ ID NO: 1678887 - RNA, 18 nt, Homo sapiens
cagcgucccuagcaguga

SEQ ID NO: 1678888 - RNA, 12 nt, Homo sapiens
cagcuaacaugg

SEQ ID NO: 1678889 - RNA, 21 nt, Homo sapiens
cagcuaagcccccuacugaga

SEQ ID NO: 1678890 - RNA, 17 nt, Homo sapiens
cagcuaagccugaugau

SEQ ID NO: 1678891 - RNA, 23 nt, Homo sapiens
cagcuagaaagagaaaaagcccu

SEQ ID NO: 1678892 - RNA, 20 nt, Homo sapiens
cagcuaucugucaucucucu

SEQ ID NO: 1678893 - RNA, 14 nt, Homo sapiens
cagcucacugcaag

SEQ ID NO: 1678894 - RNA, 12 nt, Homo sapiens
cagcucagggac

SEQ ID NO: 1678895 - RNA, 19 nt, Homo sapiens
cagcucagggacuggcaca

SEQ ID NO: 1678896 - RNA, 23 nt, Homo sapiens
cagcucuuggcuaagaccaggag

SEQ ID NO: 1678897 - RNA, 14 nt, Homo sapiens
cagcugaggaccag

SEQ ID NO: 1678898 - RNA, 19 nt, Homo sapiens
cagcugauugggcaccuga

SEQ ID NO: 1678899 - RNA, 21 nt, Homo sapiens
cagcugcuugggcuucauccu

SEQ ID NO: 1678900 - RNA, 16 nt, Homo sapiens
cagcuuggagugccac

SEQ ID NO: 1678901 - RNA, 21 nt, Homo sapiens
cagcuuggugguuauguccca

SEQ ID NO: 1678902 - RNA, 17 nt, Homo sapiens
cagcuuuguuaaaucca

SEQ ID NO: 1678903 - RNA, 20 nt, Homo sapiens
caggaaaccaacacccaaag

SEQ ID NO: 1678904 - RNA, 14 nt, Homo sapiens
caggaaauaguguu

SEQ ID NO: 1678905 - RNA, 18 nt, Homo sapiens
caggaagacuuccagcuu

SEQ ID NO: 1678906 - RNA, 21 nt, Homo sapiens
caggaaguaauuuucuucuca

SEQ ID NO: 1678907 - RNA, 16 nt, Homo sapiens
caggacaaaaugcaaa

SEQ ID NO: 1678908 - RNA, 17 nt, Homo sapiens
caggacaaaaugcaaac

SEQ ID NO: 1678909 - RNA, 16 nt, Homo sapiens
caggacaaaaugcaga

SEQ ID NO: 1678910 - RNA, 14 nt, Homo sapiens
caggaccaggagcc

SEQ ID NO: 1678911 - RNA, 15 nt, Homo sapiens
caggacccagggaau

SEQ ID NO: 1678912 - RNA, 14 nt, Homo sapiens
caggagaagaaaca

SEQ ID NO: 1678913 - RNA, 18 nt, Homo sapiens
caggagcauguccuaucc

SEQ ID NO: 1678914 - RNA, 19 nt, Homo sapiens
caggagcguguacuacccc

SEQ ID NO: 1678915 - RNA, 21 nt, Homo sapiens
caggagcguguacuaccccag

SEQ ID NO: 1678916 - RNA, 18 nt, Homo sapiens
caggagcguguccuaucc

SEQ ID NO: 1678917 - RNA, 13 nt, Homo sapiens
caggaggcugcaa

SEQ ID NO: 1678918 - RNA, 14 nt, Homo sapiens
caggagugacucug

SEQ ID NO: 1678919 - RNA, 16 nt, Homo sapiens
caggagugacucuggc

SEQ ID NO: 1678920 - RNA, 18 nt, Homo sapiens
caggaugauuguacagaa

SEQ ID NO: 1678921 - RNA, 21 nt, Homo sapiens
caggauguucaacuuaaugaa

SEQ ID NO: 1678922 - RNA, 16 nt, Homo sapiens
caggauucucuucuca

SEQ ID NO: 1678923 - RNA, 21 nt, Homo sapiens
caggcaaaggcccccaucaca

SEQ ID NO: 1678924 - RNA, 15 nt, Homo sapiens
caggcagacacagcu

SEQ ID NO: 1678925 - RNA, 20 nt, Homo sapiens
caggcagucuuugcucagug

SEQ ID NO: 1678926 - RNA, 12 nt, Homo sapiens
caggcagugcag

SEQ ID NO: 1678927 - RNA, 14 nt, Homo sapiens
caggcagugcagua

SEQ ID NO: 1678928 - RNA, 14 nt, Homo sapiens
caggcccuggugag

SEQ ID NO: 1678929 - RNA, 13 nt, Homo sapiens
caggccucaggga

SEQ ID NO: 1678930 - RNA, 17 nt, Homo sapiens
caggccuccaagccagg

SEQ ID NO: 1678931 - RNA, 16 nt, Homo sapiens
caggcucacagagauu

SEQ ID NO: 1678932 - RNA, 17 nt, Homo sapiens
caggcucaggcugccca

SEQ ID NO: 1678933 - RNA, 17 nt, Homo sapiens
caggcuggagugcagug

SEQ ID NO: 1678934 - RNA, 19 nt, Homo sapiens
caggcuguucugcacugaa

SEQ ID NO: 1678935 - RNA, 22 nt, Homo sapiens
cagggaaggugagccagacaca

SEQ ID NO: 1678936 - RNA, 13 nt, Homo sapiens
cagggaaugccag

SEQ ID NO: 1678937 - RNA, 16 nt, Homo sapiens
cagggaccaaggagau

SEQ ID NO: 1678938 - RNA, 22 nt, Homo sapiens
cagggcaaaugacaugcacuga

SEQ ID NO: 1678939 - RNA, 23 nt, Homo sapiens
cagggcaaaugacaugcacugac

SEQ ID NO: 1678940 - RNA, 15 nt, Homo sapiens
cagggcaaucaucua

SEQ ID NO: 1678941 - RNA, 22 nt, Homo sapiens
cagggcagcggucuucuccauc

SEQ ID NO: 1678942 - RNA, 14 nt, Homo sapiens
cagggccacugagu

SEQ ID NO: 1678943 - RNA, 18 nt, Homo sapiens
cagggcccccacaggagc

SEQ ID NO: 1678944 - RNA, 22 nt, Homo sapiens
cagggccuguaaucccagcauu

SEQ ID NO: 1678945 - RNA, 12 nt, Homo sapiens
cagggcucccug

SEQ ID NO: 1678946 - RNA, 17 nt, Homo sapiens
caggggcugcauccuca

SEQ ID NO: 1678947 - RNA, 22 nt, Homo sapiens
cagggggaagaugccaagggca

SEQ ID NO: 1678948 - RNA, 17 nt, Homo sapiens
caggguggggggccaug

SEQ ID NO: 1678949 - RNA, 20 nt, Homo sapiens
caggguucuaaccuuucuaa

SEQ ID NO: 1678950 - RNA, 23 nt, Homo sapiens
caggguuuacccagugggacaga

SEQ ID NO: 1678951 - RNA, 13 nt, Homo sapiens
caggucagagccc

SEQ ID NO: 1678952 - RNA, 17 nt, Homo sapiens
caggucagagcccagga

SEQ ID NO: 1678953 - RNA, 17 nt, Homo sapiens
caggugcgugccacauc

SEQ ID NO: 1678954 - RNA, 20 nt, Homo sapiens
caggugugagccacggugcc

SEQ ID NO: 1678955 - RNA, 15 nt, Homo sapiens
cagguuaccucacuu

SEQ ID NO: 1678956 - RNA, 19 nt, Homo sapiens
cagguucucuccugugagc

SEQ ID NO: 1678957 - RNA, 22 nt, Homo sapiens
cagguugugugugugugcagug

SEQ ID NO: 1678958 - RNA, 15 nt, Homo sapiens
caguaaagcaaugca

SEQ ID NO: 1678959 - RNA, 15 nt, Homo sapiens
caguaaaucagugca

SEQ ID NO: 1678960 - RNA, 22 nt, Homo sapiens
caguaacacagugcagugcuca

SEQ ID NO: 1678961 - RNA, 20 nt, Homo sapiens
caguaacagugcaguacuca

SEQ ID NO: 1678962 - RNA, 20 nt, Homo sapiens
caguaacaguguaguacuca

SEQ ID NO: 1678963 - RNA, 17 nt, Homo sapiens
caguaaggcagugcagu

SEQ ID NO: 1678964 - RNA, 22 nt, Homo sapiens
caguacuauaaguacugaguac

SEQ ID NO: 1678965 - RNA, 21 nt, Homo sapiens
caguagcuccgcgugucucau

SEQ ID NO: 1678966 - RNA, 12 nt, Homo sapiens
caguagcuccuu

SEQ ID NO: 1678967 - RNA, 12 nt, Homo sapiens
agaaacuuccuu

SEQ ID NO: 1678968 - RNA, 12 nt, Homo sapiens
agaaagaauuag

SEQ ID NO: 1678969 - RNA, 17 nt, Homo sapiens
agaaagcagaucaucuc

SEQ ID NO: 1678970 - RNA, 12 nt, Homo sapiens
agaaagccacaa

SEQ ID NO: 1678971 - RNA, 14 nt, Homo sapiens
agaaauccauuuga

SEQ ID NO: 1678972 - RNA, 16 nt, Homo sapiens
agaacauggacuacac

SEQ ID NO: 1678973 - RNA, 15 nt, Homo sapiens
agaaccaaaaagagg

SEQ ID NO: 1678974 - RNA, 23 nt, Homo sapiens
agaaccaaaaagaggcuauguga

SEQ ID NO: 1678975 - RNA, 23 nt, Homo sapiens
agaaccaaccaaugaaaacaguc

SEQ ID NO: 1678976 - RNA, 15 nt, Homo sapiens
agaaccaagaacaua

SEQ ID NO: 1678977 - RNA, 14 nt, Homo sapiens
agaaccaccauuca

SEQ ID NO: 1678978 - RNA, 20 nt, Homo sapiens
agaacuccuguguguggaag

SEQ ID NO: 1678979 - RNA, 21 nt, Homo sapiens
agaacuuucuaggcugagucu

SEQ ID NO: 1678980 - RNA, 21 nt, Homo sapiens
agaagagucuuugauucacca

SEQ ID NO: 1678981 - RNA, 21 nt, Homo sapiens
agaagcagaagggcagaagau

SEQ ID NO: 1678982 - RNA, 11 nt, Homo sapiens
agaagcucucg

SEQ ID NO: 1678983 - RNA, 20 nt, Homo sapiens
agaagcuuguauuaucagug

SEQ ID NO: 1678984 - RNA, 18 nt, Homo sapiens
agaaggaaggcuccaucu

SEQ ID NO: 1678985 - RNA, 20 nt, Homo sapiens
agaaggcaggaacacuggag

SEQ ID NO: 1678986 - RNA, 18 nt, Homo sapiens
agaaggccagaauacugg

SEQ ID NO: 1678987 - RNA, 15 nt, Homo sapiens
agaaggccaggaaaa

SEQ ID NO: 1678988 - RNA, 22 nt, Homo sapiens
agaagggcagcuccacagggca

SEQ ID NO: 1678989 - RNA, 18 nt, Homo sapiens
agaagguucuaccauuac

SEQ ID NO: 1678990 - RNA, 20 nt, Homo sapiens
agaagugcaacugcuacuga

SEQ ID NO: 1678991 - RNA, 17 nt, Homo sapiens
agaauaaaaugcaguga

SEQ ID NO: 1678992 - RNA, 23 nt, Homo sapiens
agaauaaagccucugugcugcac

SEQ ID NO: 1678993 - RNA, 22 nt, Homo sapiens
agaauauggaaacagagcaaaa

SEQ ID NO: 1678994 - RNA, 12 nt, Homo sapiens
agaaucaagucu

SEQ ID NO: 1678995 - RNA, 21 nt, Homo sapiens
agaaucaccuaauuaauuuca

SEQ ID NO: 1678996 - RNA, 15 nt, Homo sapiens
agaaucucagcacuu

SEQ ID NO: 1678997 - RNA, 23 nt, Homo sapiens
agaaugaagucuuucccugguga

SEQ ID NO: 1678998 - RNA, 12 nt, Homo sapiens
agaaugagccag

SEQ ID NO: 1678999 - RNA, 14 nt, Homo sapiens
agaaugucauuugc

SEQ ID NO: 1679000 - RNA, 15 nt, Homo sapiens
agaaugucauuugcu

SEQ ID NO: 1679001 - RNA, 23 nt, Homo sapiens
agaauuaccauuuguuaauauca

SEQ ID NO: 1679002 - RNA, 23 nt, Homo sapiens
agaauuagauuuuaaaacuucau

SEQ ID NO: 1679003 - RNA, 16 nt, Homo sapiens
agaauuuauccuuuau

SEQ ID NO: 1679004 - RNA, 18 nt, Homo sapiens
agaauuuuaauauugcca

SEQ ID NO: 1679005 - RNA, 13 nt, Homo sapiens
agacaacuugcuc

SEQ ID NO: 1679006 - RNA, 16 nt, Homo sapiens
agacaagucugaguag

SEQ ID NO: 1679007 - RNA, 21 nt, Homo sapiens
agacacaguauugacuucuuu

SEQ ID NO: 1679008 - RNA, 14 nt, Homo sapiens
agacacgaaauugg

SEQ ID NO: 1679009 - RNA, 14 nt, Homo sapiens
agacacuauguagu

SEQ ID NO: 1679010 - RNA, 16 nt, Homo sapiens
agacagagcagaucag

SEQ ID NO: 1679011 - RNA, 15 nt, Homo sapiens
agacaggguggggcu

SEQ ID NO: 1679012 - RNA, 13 nt, Homo sapiens
agacagugcagug

SEQ ID NO: 1679013 - RNA, 15 nt, Homo sapiens
agacaguuucuugca

SEQ ID NO: 1679014 - RNA, 13 nt, Homo sapiens
agacauaccucuc

SEQ ID NO: 1679015 - RNA, 16 nt, Homo sapiens
agacauugacaagcac

SEQ ID NO: 1679016 - RNA, 20 nt, Homo sapiens
agaccccuacccuuucccaa

SEQ ID NO: 1679017 - RNA, 17 nt, Homo sapiens
agacccugaguccuugg

SEQ ID NO: 1679018 - RNA, 22 nt, Homo sapiens
agacccugaguccuugggccag

SEQ ID NO: 1679019 - RNA, 13 nt, Homo sapiens
agacccugccagg

SEQ ID NO: 1679020 - RNA, 14 nt, Homo sapiens
agacccugccaggg

SEQ ID NO: 1679021 - RNA, 15 nt, Homo sapiens
agacgagguuucacu

SEQ ID NO: 1679022 - RNA, 19 nt, Homo sapiens
agacgggguuucacugugu

SEQ ID NO: 1679023 - RNA, 17 nt, Homo sapiens
agacguggugcuucuca

SEQ ID NO: 1679024 - RNA, 13 nt, Homo sapiens
agacuagucucaa

SEQ ID NO: 1679025 - RNA, 13 nt, Homo sapiens
agacuaguuuaca

SEQ ID NO: 1679026 - RNA, 14 nt, Homo sapiens
agacuaucaaagac

SEQ ID NO: 1679027 - RNA, 13 nt, Homo sapiens
agacuauggagcc

SEQ ID NO: 1679028 - RNA, 20 nt, Homo sapiens
agacuauggagccuggcaca

SEQ ID NO: 1679029 - RNA, 17 nt, Homo sapiens
agacucgagagggcuga

SEQ ID NO: 1679030 - RNA, 22 nt, Homo sapiens
agacucgauagugguggugaac

SEQ ID NO: 1679031 - RNA, 21 nt, Homo sapiens
agacuggcauggacaucagca

SEQ ID NO: 1679032 - RNA, 15 nt, Homo sapiens
agacuguuagacaaa

SEQ ID NO: 1679033 - RNA, 14 nt, Homo sapiens
agacuucaucccuc

SEQ ID NO: 1679034 - RNA, 22 nt, Homo sapiens
agacuuccucaugaaucucuca

SEQ ID NO: 1679035 - RNA, 23 nt, Homo sapiens
agacuuuguguuuacaucugcau

SEQ ID NO: 1679036 - RNA, 20 nt, Homo sapiens
agagaaaaagcccucuucaa

SEQ ID NO: 1679037 - RNA, 21 nt, Homo sapiens
agagaaaaagcccucuucaau

SEQ ID NO: 1679038 - RNA, 19 nt, Homo sapiens
agagaacuugauagccuga

SEQ ID NO: 1679039 - RNA, 18 nt, Homo sapiens
acucaaggccuccagcca

SEQ ID NO: 1679040 - RNA, 22 nt, Homo sapiens
acucaccauuuaaucauuucca

SEQ ID NO: 1679041 - RNA, 18 nt, Homo sapiens
acucaggcagugcaguac

SEQ ID NO: 1679042 - RNA, 21 nt, Homo sapiens
acucaguaaaucagugcagua

SEQ ID NO: 1679043 - RNA, 22 nt, Homo sapiens
acucaguaaaucagugcaguac

SEQ ID NO: 1679044 - RNA, 20 nt, Homo sapiens
acucaguaacagugcaguac

SEQ ID NO: 1679045 - RNA, 15 nt, Homo sapiens
acucaguaaggcagu

SEQ ID NO: 1679046 - RNA, 20 nt, Homo sapiens
acucaguaaggcagugcagu

SEQ ID NO: 1679047 - RNA, 22 nt, Homo sapiens
acucaguaaggcagugcaguac

SEQ ID NO: 1679048 - RNA, 16 nt, Homo sapiens
acucaugugauuuacc

SEQ ID NO: 1679049 - RNA, 19 nt, Homo sapiens
acuccacuccccucaucca

SEQ ID NO: 1679050 - RNA, 18 nt, Homo sapiens
acucccugucauaguuac

SEQ ID NO: 1679051 - RNA, 12 nt, Homo sapiens
acuccucagacg

SEQ ID NO: 1679052 - RNA, 16 nt, Homo sapiens
acuccuguguguggaa

SEQ ID NO: 1679053 - RNA, 22 nt, Homo sapiens
acuccuuacagaagggagugaa

SEQ ID NO: 1679054 - RNA, 23 nt, Homo sapiens
acucgucccccuccugccucauc

SEQ ID NO: 1679055 - RNA, 19 nt, Homo sapiens
acucuaaaacuaucagcag

SEQ ID NO: 1679056 - RNA, 23 nt, Homo sapiens
acucucaggaccacccugccaag

SEQ ID NO: 1679057 - RNA, 20 nt, Homo sapiens
acucucagucagugucauga

SEQ ID NO: 1679058 - RNA, 18 nt, Homo sapiens
acucucuucuuacuguau

SEQ ID NO: 1679059 - RNA, 14 nt, Homo sapiens
acucugacaguauu

SEQ ID NO: 1679060 - RNA, 15 nt, Homo sapiens
acucugaguccucau

SEQ ID NO: 1679061 - RNA, 16 nt, Homo sapiens
acucuggcugccaaga

SEQ ID NO: 1679062 - RNA, 22 nt, Homo sapiens
acucuguuccuacuggagauac

SEQ ID NO: 1679063 - RNA, 20 nt, Homo sapiens
acucuuaaacuaacaauuca

SEQ ID NO: 1679064 - RNA, 18 nt, Homo sapiens
acucuuacuaaccaccau

SEQ ID NO: 1679065 - RNA, 22 nt, Homo sapiens
acucuucaaggucugcuuuuca

SEQ ID NO: 1679066 - RNA, 13 nt, Homo sapiens
acucuuugguccu

SEQ ID NO: 1679067 - RNA, 15 nt, Homo sapiens
acugaagaaaauccu

SEQ ID NO: 1679068 - RNA, 20 nt, Homo sapiens
acugaauuuuuugucuguua

SEQ ID NO: 1679069 - RNA, 12 nt, Homo sapiens
acugacacagga

SEQ ID NO: 1679070 - RNA, 20 nt, Homo sapiens
acugacauauaucuauuaca

SEQ ID NO: 1679071 - RNA, 14 nt, Homo sapiens
acugcaaaacaaga

SEQ ID NO: 1679072 - RNA, 16 nt, Homo sapiens
acugcaaccucugccu

SEQ ID NO: 1679073 - RNA, 14 nt, Homo sapiens
acugcacaucaugu

SEQ ID NO: 1679074 - RNA, 16 nt, Homo sapiens
acugcacaucauguuu

SEQ ID NO: 1679075 - RNA, 20 nt, Homo sapiens
acugcacuccagccugggug

SEQ ID NO: 1679076 - RNA, 17 nt, Homo sapiens
acugcaguuauuuacca

SEQ ID NO: 1679077 - RNA, 17 nt, Homo sapiens
acugcauuuuacuguac

SEQ ID NO: 1679078 - RNA, 19 nt, Homo sapiens
acugccccagacacagugc

SEQ ID NO: 1679079 - RNA, 23 nt, Homo sapiens
acugcguaggagagaacagggau

SEQ ID NO: 1679080 - RNA, 14 nt, Homo sapiens
acugcuacugacca

SEQ ID NO: 1679081 - RNA, 13 nt, Homo sapiens
acugcuugugcac

SEQ ID NO: 1679082 - RNA, 16 nt, Homo sapiens
acugcuugugcacugg

SEQ ID NO: 1679083 - RNA, 17 nt, Homo sapiens
acugcuuucccaaaggc

SEQ ID NO: 1679084 - RNA, 20 nt, Homo sapiens
acuggaaauaaccugugaau

SEQ ID NO: 1679085 - RNA, 21 nt, Homo sapiens
acuggaacacuaaugaggaaa

SEQ ID NO: 1679086 - RNA, 21 nt, Homo sapiens
acuggagcguguacuacccca

SEQ ID NO: 1679087 - RNA, 16 nt, Homo sapiens
acuggcaacaguugga

SEQ ID NO: 1679088 - RNA, 17 nt, Homo sapiens
acuggcaucuagucaag

SEQ ID NO: 1679089 - RNA, 14 nt, Homo sapiens
acuggccuugccuc

SEQ ID NO: 1679090 - RNA, 23 nt, Homo sapiens
acuggggaagccaguuuccacag

SEQ ID NO: 1679091 - RNA, 13 nt, Homo sapiens
acuguaaagaauu

SEQ ID NO: 1679092 - RNA, 21 nt, Homo sapiens
acuguauauuuguaugauauu

SEQ ID NO: 1679093 - RNA, 17 nt, Homo sapiens
acuguauuuacuuguua

SEQ ID NO: 1679094 - RNA, 13 nt, Homo sapiens
acugucauuagaa

SEQ ID NO: 1679095 - RNA, 15 nt, Homo sapiens
acugugacauuccac

SEQ ID NO: 1679096 - RNA, 14 nt, Homo sapiens
acugugcugagaaa

SEQ ID NO: 1679097 - RNA, 22 nt, Homo sapiens
acuguggucccagcuacagggg

SEQ ID NO: 1679098 - RNA, 16 nt, Homo sapiens
acuguuagcugggaag

SEQ ID NO: 1679099 - RNA, 13 nt, Homo sapiens
acuguucaugaau

SEQ ID NO: 1679100 - RNA, 16 nt, Homo sapiens
acuguuggauacagga

SEQ ID NO: 1679101 - RNA, 18 nt, Homo sapiens
acuguuugaaacuuuuca

SEQ ID NO: 1679102 - RNA, 16 nt, Homo sapiens
acuuaaaccugugcuu

SEQ ID NO: 1679103 - RNA, 19 nt, Homo sapiens
acuuaaaccugugcuuuca

SEQ ID NO: 1679104 - RNA, 13 nt, Homo sapiens
acuuaagcacacu

SEQ ID NO: 1679105 - RNA, 19 nt, Homo sapiens
acuuacaggccuugcucac

SEQ ID NO: 1679106 - RNA, 23 nt, Homo sapiens
acuuacauggguguuuugaucuc

SEQ ID NO: 1679107 - RNA, 14 nt, Homo sapiens
acuuagucaugagg

SEQ ID NO: 1679108 - RNA, 20 nt, Homo sapiens
acaauggcuggguuugggca

SEQ ID NO: 1679109 - RNA, 22 nt, Homo sapiens
acaaugguagcucugaagggag

SEQ ID NO: 1679110 - RNA, 21 nt, Homo sapiens
acaaugguuuuguuucuuucc

SEQ ID NO: 1679111 - RNA, 22 nt, Homo sapiens
acaauguggaauuacauaacag

SEQ ID NO: 1679112 - RNA, 18 nt, Homo sapiens
acacaaguagaugccuga

SEQ ID NO: 1679113 - RNA, 18 nt, Homo sapiens
acacaauacaguacucag

SEQ ID NO: 1679114 - RNA, 13 nt, Homo sapiens
acacacacuuuug

SEQ ID NO: 1679115 - RNA, 12 nt, Homo sapiens
acacacagcagc

SEQ ID NO: 1679116 - RNA, 14 nt, Homo sapiens
acacaccuugccca

SEQ ID NO: 1679117 - RNA, 20 nt, Homo sapiens
acacacgcguccacauacac

SEQ ID NO: 1679118 - RNA, 12 nt, Homo sapiens
acacagugcagu

SEQ ID NO: 1679119 - RNA, 14 nt, Homo sapiens
acacauagauucac

SEQ ID NO: 1679120 - RNA, 17 nt, Homo sapiens
acacauugaaacuguau

SEQ ID NO: 1679121 - RNA, 14 nt, Homo sapiens
acacgccacaacuc

SEQ ID NO: 1679122 - RNA, 18 nt, Homo sapiens
acacgcguccacauacac

SEQ ID NO: 1679123 - RNA, 23 nt, Homo sapiens
acacugagcaaguuuucaccuau

SEQ ID NO: 1679124 - RNA, 20 nt, Homo sapiens
acacugccuuggguggacca

SEQ ID NO: 1679125 - RNA, 17 nt, Homo sapiens
acacuguacugcaauaa

SEQ ID NO: 1679126 - RNA, 11 nt, Homo sapiens
acacugucaag

SEQ ID NO: 1679127 - RNA, 21 nt, Homo sapiens
acacugugaacuaaugacaag

SEQ ID NO: 1679128 - RNA, 23 nt, Homo sapiens
acacuugguccauccauuuccaa

SEQ ID NO: 1679129 - RNA, 16 nt, Homo sapiens
acagaaaagaaauuag

SEQ ID NO: 1679130 - RNA, 13 nt, Homo sapiens
acagaaaauggaa

SEQ ID NO: 1679131 - RNA, 22 nt, Homo sapiens
acagaaauccacgcucaaucuc

SEQ ID NO: 1679132 - RNA, 22 nt, Homo sapiens
acagacaaagcgugguggacau

SEQ ID NO: 1679133 - RNA, 17 nt, Homo sapiens
acagaccucggcugugu

SEQ ID NO: 1679134 - RNA, 20 nt, Homo sapiens
acagagagcggcuuccccau

SEQ ID NO: 1679135 - RNA, 18 nt, Homo sapiens
acagagcagaucagucuu

SEQ ID NO: 1679136 - RNA, 20 nt, Homo sapiens
acagaggauggcuuccccau

SEQ ID NO: 1679137 - RNA, 20 nt, Homo sapiens
acagagucuuccucugucuc

SEQ ID NO: 1679138 - RNA, 20 nt, Homo sapiens
acagauauacucgaaucaga

SEQ ID NO: 1679139 - RNA, 14 nt, Homo sapiens
acagaucaaugaca

SEQ ID NO: 1679140 - RNA, 19 nt, Homo sapiens
acagcacauuuguuaauga

SEQ ID NO: 1679141 - RNA, 12 nt, Homo sapiens
acagcauaugca

SEQ ID NO: 1679142 - RNA, 14 nt, Homo sapiens
acagcauaugcaaa

SEQ ID NO: 1679143 - RNA, 23 nt, Homo sapiens
acagcaucugccaggacacugcc

SEQ ID NO: 1679144 - RNA, 23 nt, Homo sapiens
acagcauuacacgccacaacucc

SEQ ID NO: 1679145 - RNA, 13 nt, Homo sapiens
acagccagcuccu

SEQ ID NO: 1679146 - RNA, 21 nt, Homo sapiens
acagccuuaaauccuuuacaa

SEQ ID NO: 1679147 - RNA, 22 nt, Homo sapiens
acagcggcccggcccacgcaga

SEQ ID NO: 1679148 - RNA, 17 nt, Homo sapiens
acagcuaacaaguagca

SEQ ID NO: 1679149 - RNA, 14 nt, Homo sapiens
acagcuaacaugga

SEQ ID NO: 1679150 - RNA, 17 nt, Homo sapiens
acagcuguccugagcua

SEQ ID NO: 1679151 - RNA, 13 nt, Homo sapiens
acagcuuccccau

SEQ ID NO: 1679152 - RNA, 21 nt, Homo sapiens
acaggaaaagggcauuuugua

SEQ ID NO: 1679153 - RNA, 18 nt, Homo sapiens
acaggagaagaaacagcg

SEQ ID NO: 1679154 - RNA, 16 nt, Homo sapiens
acaggagcguguccua

SEQ ID NO: 1679155 - RNA, 17 nt, Homo sapiens
acaggauucucuucuca

SEQ ID NO: 1679156 - RNA, 14 nt, Homo sapiens
acaggcaguguucu

SEQ ID NO: 1679157 - RNA, 21 nt, Homo sapiens
acaggcgccuaccaccaugcc

SEQ ID NO: 1679158 - RNA, 14 nt, Homo sapiens
acaggcucugacca

SEQ ID NO: 1679159 - RNA, 17 nt, Homo sapiens
acaggucccacugcccu

SEQ ID NO: 1679160 - RNA, 12 nt, Homo sapiens
acagguguaaau

SEQ ID NO: 1679161 - RNA, 17 nt, Homo sapiens
acaguacaguacucagu

SEQ ID NO: 1679162 - RNA, 18 nt, Homo sapiens
acaguauuaacaucaaag

SEQ ID NO: 1679163 - RNA, 18 nt, Homo sapiens
acagucaaaauguuugau

SEQ ID NO: 1679164 - RNA, 20 nt, Homo sapiens
acagucaaaauguuugauau

SEQ ID NO: 1679165 - RNA, 21 nt, Homo sapiens
acagucaagacggauccacag

SEQ ID NO: 1679166 - RNA, 14 nt, Homo sapiens
acagucacauucag

SEQ ID NO: 1679167 - RNA, 19 nt, Homo sapiens
acagugccacgacauggcu

SEQ ID NO: 1679168 - RNA, 20 nt, Homo sapiens
acaguggcaguauugacaau

SEQ ID NO: 1679169 - RNA, 15 nt, Homo sapiens
acaguguaguacuca

SEQ ID NO: 1679170 - RNA, 15 nt, Homo sapiens
acaguguagugcuca

SEQ ID NO: 1679171 - RNA, 16 nt, Homo sapiens
acaguuaagacaacag

SEQ ID NO: 1679172 - RNA, 18 nt, Homo sapiens
acaguuauacauaccucu

SEQ ID NO: 1679173 - RNA, 14 nt, Homo sapiens
aucuucacugucuu

SEQ ID NO: 1679174 - RNA, 19 nt, Homo sapiens
aucuucuaucaaagcacau

SEQ ID NO: 1679175 - RNA, 22 nt, Homo sapiens
aucuuucuuaauagaaagucag

SEQ ID NO: 1679176 - RNA, 14 nt, Homo sapiens
aucuuugugacagg

SEQ ID NO: 1679177 - RNA, 18 nt, Homo sapiens
augaaaaaauaacacugu

SEQ ID NO: 1679178 - RNA, 19 nt, Homo sapiens
augaaaugccaagacucua

SEQ ID NO: 1679179 - RNA, 20 nt, Homo sapiens
augaaauugagucauuuuau

SEQ ID NO: 1679180 - RNA, 22 nt, Homo sapiens
augaacgaauuaauuaccuggc

SEQ ID NO: 1679181 - RNA, 13 nt, Homo sapiens
augaacugccaaa

SEQ ID NO: 1679182 - RNA, 17 nt, Homo sapiens
augaagcaaacacacag

SEQ ID NO: 1679183 - RNA, 11 nt, Homo sapiens
augaagcacau

SEQ ID NO: 1679184 - RNA, 12 nt, Homo sapiens
augaaucacugc

SEQ ID NO: 1679185 - RNA, 19 nt, Homo sapiens
augacaacaaaagggaaaa

SEQ ID NO: 1679186 - RNA, 16 nt, Homo sapiens
augacauccacaugca

SEQ ID NO: 1679187 - RNA, 14 nt, Homo sapiens
augacaugcacuga

SEQ ID NO: 1679188 - RNA, 16 nt, Homo sapiens
augaccauaugcacaa

SEQ ID NO: 1679189 - RNA, 21 nt, Homo sapiens
augaccuugaaugaugccaug

SEQ ID NO: 1679190 - RNA, 23 nt, Homo sapiens
augacgguguccaugccuuccau

SEQ ID NO: 1679191 - RNA, 15 nt, Homo sapiens
augacugcauuuuac

SEQ ID NO: 1679192 - RNA, 22 nt, Homo sapiens
augacuucuuuacuaacacugg

SEQ ID NO: 1679193 - RNA, 22 nt, Homo sapiens
augagaaucaccccucucagug

SEQ ID NO: 1679194 - RNA, 24 nt, Homo sapiens
augagaaucaccccucucagugca

SEQ ID NO: 1679195 - RNA, 14 nt, Homo sapiens
augagcauucugca

SEQ ID NO: 1679196 - RNA, 16 nt, Homo sapiens
augagcucccucgcug

SEQ ID NO: 1679197 - RNA, 14 nt, Homo sapiens
augaguuccugaga

SEQ ID NO: 1679198 - RNA, 20 nt, Homo sapiens
augauaaauuugacuguuau

SEQ ID NO: 1679199 - RNA, 21 nt, Homo sapiens
augauaugugcuuguguguau

SEQ ID NO: 1679200 - RNA, 13 nt, Homo sapiens
augauuagugcaa

SEQ ID NO: 1679201 - RNA, 20 nt, Homo sapiens
augcaaaccaaaccauuauu

SEQ ID NO: 1679202 - RNA, 22 nt, Homo sapiens
augcaaaccaaaccauuauuca

SEQ ID NO: 1679203 - RNA, 21 nt, Homo sapiens
augcaaaggcguaucaguuca

SEQ ID NO: 1679204 - RNA, 17 nt, Homo sapiens
augcacaauuccaugaa

SEQ ID NO: 1679205 - RNA, 12 nt, Homo sapiens
augcacagugaa

SEQ ID NO: 1679206 - RNA, 16 nt, Homo sapiens
augcagaaauguggau

SEQ ID NO: 1679207 - RNA, 21 nt, Homo sapiens
augcagcagcuuuugacuguu

SEQ ID NO: 1679208 - RNA, 13 nt, Homo sapiens
augcaguauaaaa

SEQ ID NO: 1679209 - RNA, 23 nt, Homo sapiens
augcaugagaacuaaauagauuu

SEQ ID NO: 1679210 - RNA, 15 nt, Homo sapiens
augcaugagcaccuu

SEQ ID NO: 1679211 - RNA, 23 nt, Homo sapiens
augccaauuucucuuaaguacug

SEQ ID NO: 1679212 - RNA, 20 nt, Homo sapiens
augccaugaggaacaaggca

SEQ ID NO: 1679213 - RNA, 18 nt, Homo sapiens
augccauguauguugcau

SEQ ID NO: 1679214 - RNA, 17 nt, Homo sapiens
augcccccuccugcaag

SEQ ID NO: 1679215 - RNA, 22 nt, Homo sapiens
augccuaauaaacaauucaagu

SEQ ID NO: 1679216 - RNA, 16 nt, Homo sapiens
augccuugaaaccaga

SEQ ID NO: 1679217 - RNA, 17 nt, Homo sapiens
augcuaagggcagcccu

SEQ ID NO: 1679218 - RNA, 19 nt, Homo sapiens
augcucaguauugagacac

SEQ ID NO: 1679219 - RNA, 21 nt, Homo sapiens
augcucaguuggugcugcuuu

SEQ ID NO: 1679220 - RNA, 23 nt, Homo sapiens
augcucaguuggugcugcuuucu

SEQ ID NO: 1679221 - RNA, 21 nt, Homo sapiens
augcugccugccaugugugag

SEQ ID NO: 1679222 - RNA, 17 nt, Homo sapiens
augcugucuuagaucag

SEQ ID NO: 1679223 - RNA, 22 nt, Homo sapiens
augcuguucucaaucauuguca

SEQ ID NO: 1679224 - RNA, 13 nt, Homo sapiens
augcuuaacauaa

SEQ ID NO: 1679225 - RNA, 15 nt, Homo sapiens
augcuugacccugaa

SEQ ID NO: 1679226 - RNA, 22 nt, Homo sapiens
auggacuaaccccaacgcacag

SEQ ID NO: 1679227 - RNA, 19 nt, Homo sapiens
auggagaggcggccucgug

SEQ ID NO: 1679228 - RNA, 23 nt, Homo sapiens
auggagugcaguggcucaaucuc

SEQ ID NO: 1679229 - RNA, 15 nt, Homo sapiens
auggaucugcuccau

SEQ ID NO: 1679230 - RNA, 12 nt, Homo sapiens
auggauucacuu

SEQ ID NO: 1679231 - RNA, 11 nt, Homo sapiens
auggcacuuuu

SEQ ID NO: 1679232 - RNA, 19 nt, Homo sapiens
auggcacuuuugagcuccu

SEQ ID NO: 1679233 - RNA, 22 nt, Homo sapiens
auggccauagcuuuuauucauu

SEQ ID NO: 1679234 - RNA, 23 nt, Homo sapiens
auggcugccaaugggagcucaug

SEQ ID NO: 1679235 - RNA, 21 nt, Homo sapiens
auggcuuccgugagacacaag

SEQ ID NO: 1679236 - RNA, 17 nt, Homo sapiens
auggcuuguucagucac

SEQ ID NO: 1679237 - RNA, 14 nt, Homo sapiens
augggaccagggau

SEQ ID NO: 1679238 - RNA, 16 nt, Homo sapiens
augggaggaucacuug

SEQ ID NO: 1679239 - RNA, 15 nt, Homo sapiens
augggccugccaaac

SEQ ID NO: 1679240 - RNA, 18 nt, Homo sapiens
auggggcacugacagaga

SEQ ID NO: 1679241 - RNA, 19 nt, Homo sapiens
auggggcacugacagagaa

SEQ ID NO: 1679242 - RNA, 18 nt, Homo sapiens
augguauauauuuugaaa

SEQ ID NO: 1679243 - RNA, 23 nt, Homo sapiens
auggucucucgcucugucuuucc

SEQ ID NO: 1679244 - RNA, 21 nt, Homo sapiens
augguuuccaagggucuuccu

SEQ ID NO: 1679245 - RNA, 18 nt, Homo sapiens
auguacaauaaagcaaug

SEQ ID NO: 1679246 - RNA, 17 nt, Homo sapiens
auguacuacauuugcau

SEQ ID NO: 1679247 - RNA, 19 nt, Homo sapiens
auguacuacauuugcaugc

SEQ ID NO: 1679248 - RNA, 16 nt, Homo sapiens
auguagauaaagcacu

SEQ ID NO: 1679249 - RNA, 19 nt, Homo sapiens
auguauaaugggaaauguu

SEQ ID NO: 1679250 - RNA, 12 nt, Homo sapiens
augucaaaggcu

SEQ ID NO: 1679251 - RNA, 12 nt, Homo sapiens
augucaaaugga

SEQ ID NO: 1679252 - RNA, 19 nt, Homo sapiens
augucaauuuuuaacuuau

SEQ ID NO: 1679253 - RNA, 20 nt, Homo sapiens
augucacaugacauccacau

SEQ ID NO: 1679254 - RNA, 19 nt, Homo sapiens
augucaccucaggaccaug

SEQ ID NO: 1679255 - RNA, 14 nt, Homo sapiens
augucagucacuaa

SEQ ID NO: 1679256 - RNA, 15 nt, Homo sapiens
augucauaaagugag

SEQ ID NO: 1679257 - RNA, 12 nt, Homo sapiens
augucccaugac

SEQ ID NO: 1679258 - RNA, 20 nt, Homo sapiens
auguccuuccaagaauggaa

SEQ ID NO: 1679259 - RNA, 22 nt, Homo sapiens
augucucuuguuaaaugagcuu

SEQ ID NO: 1679260 - RNA, 15 nt, Homo sapiens
augucuguguauaca

SEQ ID NO: 1679261 - RNA, 19 nt, Homo sapiens
augucuuuguguuuugucc

SEQ ID NO: 1679262 - RNA, 20 nt, Homo sapiens
augugagaccauuuagcaca

SEQ ID NO: 1679263 - RNA, 16 nt, Homo sapiens
augugauuuuucugca

SEQ ID NO: 1679264 - RNA, 13 nt, Homo sapiens
augugcagauauc

SEQ ID NO: 1679265 - RNA, 15 nt, Homo sapiens
augugcaucuggccu

SEQ ID NO: 1679266 - RNA, 15 nt, Homo sapiens
augugcugcaaagag

SEQ ID NO: 1679267 - RNA, 22 nt, Homo sapiens
auguguccccucacucugucag

SEQ ID NO: 1679268 - RNA, 17 nt, Homo sapiens
augugugaguguaugua

SEQ ID NO: 1679269 - RNA, 13 nt, Homo sapiens
auguguguucaug

SEQ ID NO: 1679270 - RNA, 15 nt, Homo sapiens
auguguguucaugca

SEQ ID NO: 1679271 - RNA, 19 nt, Homo sapiens
auguguuauuugucacaaa

SEQ ID NO: 1679272 - RNA, 20 nt, Homo sapiens
auguguuauuugucacaaau

SEQ ID NO: 1679273 - RNA, 16 nt, Homo sapiens
auguuaguagcacuga

SEQ ID NO: 1679274 - RNA, 22 nt, Homo sapiens
auguucucaauacccacugcca

SEQ ID NO: 1679275 - RNA, 13 nt, Homo sapiens
auguucugacagc

SEQ ID NO: 1679276 - RNA, 20 nt, Homo sapiens
auguugcuuucuuaucccag

SEQ ID NO: 1679277 - RNA, 12 nt, Homo sapiens
auguuguaauau

SEQ ID NO: 1679278 - RNA, 18 nt, Homo sapiens
auguuuaagaaaugagaa

SEQ ID NO: 1679279 - RNA, 15 nt, Homo sapiens
auguuucagagcuca

SEQ ID NO: 1679280 - RNA, 20 nt, Homo sapiens
auguuucagagcucaccagg

SEQ ID NO: 1679281 - RNA, 20 nt, Homo sapiens
auguuucuaucuuguauguc

SEQ ID NO: 1679282 - RNA, 22 nt, Homo sapiens
auuaaaacaagagaccacuucc

SEQ ID NO: 1679283 - RNA, 14 nt, Homo sapiens
auuaaaaccagaga

SEQ ID NO: 1679284 - RNA, 20 nt, Homo sapiens
auuaaaccaaggagucugau

SEQ ID NO: 1679285 - RNA, 17 nt, Homo sapiens
auuaaagucuacacugc

SEQ ID NO: 1679286 - RNA, 20 nt, Homo sapiens
auuaaagucuacacugccuu

SEQ ID NO: 1679287 - RNA, 12 nt, Homo sapiens
auuaacaauuaa

SEQ ID NO: 1679288 - RNA, 14 nt, Homo sapiens
auuaacaucaaaga

SEQ ID NO: 1679289 - RNA, 14 nt, Homo sapiens
auuaacccuauuaa

SEQ ID NO: 1679290 - RNA, 18 nt, Homo sapiens
auuaacucugcauagaca

SEQ ID NO: 1679291 - RNA, 21 nt, Homo sapiens
auuaagaaacccccucaugga

SEQ ID NO: 1679292 - RNA, 17 nt, Homo sapiens
auuaaguccuacuuuac

SEQ ID NO: 1679293 - RNA, 19 nt, Homo sapiens
auuaauauuuguuuaguuc

SEQ ID NO: 1679294 - RNA, 17 nt, Homo sapiens
caaaaagaggcuaugug

SEQ ID NO: 1679295 - RNA, 21 nt, Homo sapiens
caaaacaacagcaacaacaac

SEQ ID NO: 1679296 - RNA, 22 nt, Homo sapiens
caaaacagauauacucgaauca

SEQ ID NO: 1679297 - RNA, 15 nt, Homo sapiens
caaaagauucuacaa

SEQ ID NO: 1679298 - RNA, 17 nt, Homo sapiens
caaaaugcaaaccaaac

SEQ ID NO: 1679299 - RNA, 20 nt, Homo sapiens
caaaauguuguccuuucccc

SEQ ID NO: 1679300 - RNA, 17 nt, Homo sapiens
caaaauuuaugucauuu

SEQ ID NO: 1679301 - RNA, 15 nt, Homo sapiens
caaacaaaaacuguu

SEQ ID NO: 1679302 - RNA, 15 nt, Homo sapiens
caaacaaacaaaaac

SEQ ID NO: 1679303 - RNA, 13 nt, Homo sapiens
caaacacugugua

SEQ ID NO: 1679304 - RNA, 21 nt, Homo sapiens
caaacaguguggcuuaaacau

SEQ ID NO: 1679305 - RNA, 17 nt, Homo sapiens
caaaccauuauucauuu

SEQ ID NO: 1679306 - RNA, 17 nt, Homo sapiens
caaaccuccacugcugc

SEQ ID NO: 1679307 - RNA, 19 nt, Homo sapiens
caaacuccauucuccaggg

SEQ ID NO: 1679308 - RNA, 21 nt, Homo sapiens
caaacuucccugacucuucaa

SEQ ID NO: 1679309 - RNA, 17 nt, Homo sapiens
caaagaaucaacaguga

SEQ ID NO: 1679310 - RNA, 18 nt, Homo sapiens
caaagaggccaguacuuu

SEQ ID NO: 1679311 - RNA, 18 nt, Homo sapiens
caaagaguuauaugacuu

SEQ ID NO: 1679312 - RNA, 15 nt, Homo sapiens
caaagauauuauuua

SEQ ID NO: 1679313 - RNA, 18 nt, Homo sapiens
caaagaugagauaaaaca

SEQ ID NO: 1679314 - RNA, 22 nt, Homo sapiens
caaagcaugccaauuucucuua

SEQ ID NO: 1679315 - RNA, 15 nt, Homo sapiens
caaaggucaccaggc

SEQ ID NO: 1679316 - RNA, 23 nt, Homo sapiens
caaaguuaaacgugaugugcuca

SEQ ID NO: 1679317 - RNA, 16 nt, Homo sapiens
caaauauugaucugua

SEQ ID NO: 1679318 - RNA, 19 nt, Homo sapiens
caaauauuggguugggcac

SEQ ID NO: 1679319 - RNA, 14 nt, Homo sapiens
caaaucgcccccuu

SEQ ID NO: 1679320 - RNA, 22 nt, Homo sapiens
caaaugccuuucuagcaauugc

SEQ ID NO: 1679321 - RNA, 16 nt, Homo sapiens
caaaugcuaaaugcaa

SEQ ID NO: 1679322 - RNA, 15 nt, Homo sapiens
caaauggauguaaua

SEQ ID NO: 1679323 - RNA, 13 nt, Homo sapiens
caaauguaaaaua

SEQ ID NO: 1679324 - RNA, 16 nt, Homo sapiens
caaauugauagucaau

SEQ ID NO: 1679325 - RNA, 22 nt, Homo sapiens
caaauugugaagauuucaugga

SEQ ID NO: 1679326 - RNA, 21 nt, Homo sapiens
caacaaagcagaagacuccuc

SEQ ID NO: 1679327 - RNA, 17 nt, Homo sapiens
caacaaagcaugcucag

SEQ ID NO: 1679328 - RNA, 14 nt, Homo sapiens
caacaaaucucagu

SEQ ID NO: 1679329 - RNA, 15 nt, Homo sapiens
caacaagcaaacuga

SEQ ID NO: 1679330 - RNA, 12 nt, Homo sapiens
caacacccaaag

SEQ ID NO: 1679331 - RNA, 19 nt, Homo sapiens
caacacuugcacaaucacg

SEQ ID NO: 1679332 - RNA, 20 nt, Homo sapiens
caacagaccuaagaaauagc

SEQ ID NO: 1679333 - RNA, 14 nt, Homo sapiens
caacagaucaauga

SEQ ID NO: 1679334 - RNA, 17 nt, Homo sapiens
caacagcugugugugcc

SEQ ID NO: 1679335 - RNA, 16 nt, Homo sapiens
caacaguauacaaaag

SEQ ID NO: 1679336 - RNA, 21 nt, Homo sapiens
caacauuacuccauuacuaaa

SEQ ID NO: 1679337 - RNA, 17 nt, Homo sapiens
caacauucccccaacau

SEQ ID NO: 1679338 - RNA, 18 nt, Homo sapiens
caacauuccuuguuugua

SEQ ID NO: 1679339 - RNA, 20 nt, Homo sapiens
caaccaaugaaaacaguccc

SEQ ID NO: 1679340 - RNA, 22 nt, Homo sapiens
caaccacugcgaccacaagaag

SEQ ID NO: 1679341 - RNA, 14 nt, Homo sapiens
caacccugugaucu

SEQ ID NO: 1679342 - RNA, 21 nt, Homo sapiens
caaccgggaaaggcaucuaag

SEQ ID NO: 1679343 - RNA, 16 nt, Homo sapiens
caaccgugacugcaag

SEQ ID NO: 1679344 - RNA, 20 nt, Homo sapiens
caaccuggguaacaaaguga

SEQ ID NO: 1679345 - RNA, 21 nt, Homo sapiens
caaccuguucacgugacuccu

SEQ ID NO: 1679346 - RNA, 21 nt, Homo sapiens
caaccuguucuuccuaccaaa

SEQ ID NO: 1679347 - RNA, 23 nt, Homo sapiens
caaccuguucuuccuaccaaaua

SEQ ID NO: 1679348 - RNA, 20 nt, Homo sapiens
caacgaacauggcaugugaa

SEQ ID NO: 1679349 - RNA, 12 nt, Homo sapiens
caacugacacag

SEQ ID NO: 1679350 - RNA, 18 nt, Homo sapiens
caacuugcuccuuuccau

SEQ ID NO: 1679351 - RNA, 23 nt, Homo sapiens
caagaaauucaugauugcccaau

SEQ ID NO: 1679352 - RNA, 16 nt, Homo sapiens
caagaagccagcacca

SEQ ID NO: 1679353 - RNA, 13 nt, Homo sapiens
caagaaugcagua

SEQ ID NO: 1679354 - RNA, 23 nt, Homo sapiens
caagacuggcauggacaucagca

SEQ ID NO: 1679355 - RNA, 14 nt, Homo sapiens
caagacuuccucau

SEQ ID NO: 1679356 - RNA, 22 nt, Homo sapiens
caagauacacucaagcaugaag

SEQ ID NO: 1679357 - RNA, 17 nt, Homo sapiens
caagauccugucuugcu

SEQ ID NO: 1679358 - RNA, 21 nt, Homo sapiens
caagauccugucuugcugagg

SEQ ID NO: 1679359 - RNA, 14 nt, Homo sapiens
caagaugugacaug

SEQ ID NO: 1679360 - RNA, 22 nt, Homo sapiens
caagcaaugagaagaccaggaa

SEQ ID NO: 1679361 - RNA, 17 nt, Homo sapiens
caagcacuagccuuccc

SEQ ID NO: 1679362 - RNA, 22 nt, Homo sapiens
caagcacuggacuacaagggca

SEQ ID NO: 1679363 - RNA, 21 nt, Homo sapiens
caagcaggcgccaagugcuau

SEQ ID NO: 1679364 - RNA, 20 nt, Homo sapiens
caagcagugaaauaugauaa

SEQ ID NO: 1679365 - RNA, 14 nt, Homo sapiens
caagccaggugcca

SEQ ID NO: 1679366 - RNA, 12 nt, Homo sapiens
caagcuucauau

SEQ ID NO: 1679367 - RNA, 20 nt, Homo sapiens
caaggaaggguguugcagag

SEQ ID NO: 1679368 - RNA, 14 nt, Homo sapiens
caaggcauccccag

SEQ ID NO: 1679369 - RNA, 14 nt, Homo sapiens
caaggcugcaguga

SEQ ID NO: 1679370 - RNA, 17 nt, Homo sapiens
caaggcugcagugagcc

SEQ ID NO: 1679371 - RNA, 21 nt, Homo sapiens
caaggggaccgccccaggcac

SEQ ID NO: 1679372 - RNA, 21 nt, Homo sapiens
caaggucugaacccuuccacc

SEQ ID NO: 1679373 - RNA, 24 nt, Homo sapiens
caaguaaucuguugacagugccaa

SEQ ID NO: 1679374 - RNA, 14 nt, Homo sapiens
caagucuaguggaa

SEQ ID NO: 1679375 - RNA, 16 nt, Homo sapiens
caagucucucuaagac

SEQ ID NO: 1679376 - RNA, 21 nt, Homo sapiens
caagucuuaguacauccucac

SEQ ID NO: 1679377 - RNA, 15 nt, Homo sapiens
caagugucaucacuu

SEQ ID NO: 1679378 - RNA, 12 nt, Homo sapiens
caaguucauuca

SEQ ID NO: 1679379 - RNA, 16 nt, Homo sapiens
caaguugccacauugc

SEQ ID NO: 1679380 - RNA, 19 nt, Homo sapiens
caaguuggagugcaauggu

SEQ ID NO: 1679381 - RNA, 16 nt, Homo sapiens
caaguuggagugcagu

SEQ ID NO: 1679382 - RNA, 20 nt, Homo sapiens
caaguuuaaaggcuguguca

SEQ ID NO: 1679383 - RNA, 16 nt, Homo sapiens
caauaaaagaaacugu

SEQ ID NO: 1679384 - RNA, 20 nt, Homo sapiens
caauaaaagaaacugugguc

SEQ ID NO: 1679385 - RNA, 18 nt, Homo sapiens
caauaaaauacuuugguu

SEQ ID NO: 1679386 - RNA, 15 nt, Homo sapiens
caauaaagaguaaau

SEQ ID NO: 1679387 - RNA, 18 nt, Homo sapiens
caauaaagcaauguggua

SEQ ID NO: 1679388 - RNA, 22 nt, Homo sapiens
caauaaggcagugcagugcuca

SEQ ID NO: 1679389 - RNA, 16 nt, Homo sapiens
caauacccacugccag

SEQ ID NO: 1679390 - RNA, 15 nt, Homo sapiens
caaucaagaugggug

SEQ ID NO: 1679391 - RNA, 13 nt, Homo sapiens
caaucagcacuga

SEQ ID NO: 1679392 - RNA, 14 nt, Homo sapiens
caaucagcacugaa

SEQ ID NO: 1679393 - RNA, 15 nt, Homo sapiens
caaucagcacugaaa

SEQ ID NO: 1679394 - RNA, 17 nt, Homo sapiens
caaucaucuauugagug

SEQ ID NO: 1679395 - RNA, 12 nt, Homo sapiens
caaucccauucc

SEQ ID NO: 1679396 - RNA, 11 nt, Homo sapiens
caaucuugccc

SEQ ID NO: 1679397 - RNA, 14 nt, Homo sapiens
caaucuugcuguga

SEQ ID NO: 1679398 - RNA, 19 nt, Homo sapiens
caaugaaaacagucccauc

SEQ ID NO: 1679399 - RNA, 18 nt, Homo sapiens
caaugaccacauccugaa

SEQ ID NO: 1679400 - RNA, 19 nt, Homo sapiens
caaugaccacauccugaaa

SEQ ID NO: 1679401 - RNA, 16 nt, Homo sapiens
caaugcaaugcaucug

SEQ ID NO: 1679402 - RNA, 18 nt, Homo sapiens
caaugccaggcagugcag

SEQ ID NO: 1679403 - RNA, 18 nt, Homo sapiens
caaugccugccugaacaa

SEQ ID NO: 1679404 - RNA, 16 nt, Homo sapiens
caaugcuuugaucccu

SEQ ID NO: 1679405 - RNA, 23 nt, Homo sapiens
caaugugcuccuucauaagccau

SEQ ID NO: 1679406 - RNA, 10 nt, Homo sapiens
caauguuuca

SEQ ID NO: 1679407 - RNA, 20 nt, Homo sapiens
caauuccuuaguauaauauu

SEQ ID NO: 1679408 - RNA, 16 nt, Homo sapiens
caauucuuuguugcuu

SEQ ID NO: 1679409 - RNA, 22 nt, Homo sapiens
caauugugagaauuacuguuug

SEQ ID NO: 1679410 - RNA, 14 nt, Homo sapiens
caauuguucaggga

SEQ ID NO: 1679411 - RNA, 23 nt, Homo sapiens
caauuguugcgggaagucaggga

SEQ ID NO: 1679412 - RNA, 23 nt, Homo sapiens
caauuuagauuuuucucaucucc

SEQ ID NO: 1679413 - RNA, 21 nt, Homo sapiens
caauuugguuuagaaugcugc

SEQ ID NO: 1679414 - RNA, 12 nt, Homo sapiens
cacaaaccacaa

SEQ ID NO: 1679415 - RNA, 22 nt, Homo sapiens
caguaaaucagugcaguacuca

SEQ ID NO: 1679416 - RNA, 21 nt, Homo sapiens
caguaaauguauauugaugua

SEQ ID NO: 1679417 - RNA, 15 nt, Homo sapiens
caguaacacagugca

SEQ ID NO: 1679418 - RNA, 16 nt, Homo sapiens
caguaacagugcagua

SEQ ID NO: 1679419 - RNA, 17 nt, Homo sapiens
caguaacuccccaacuc

SEQ ID NO: 1679420 - RNA, 15 nt, Homo sapiens
caguaagacagugca

SEQ ID NO: 1679421 - RNA, 16 nt, Homo sapiens
caguaaggcagugcag

SEQ ID NO: 1679422 - RNA, 21 nt, Homo sapiens
caguaauacaguacaguacuc

SEQ ID NO: 1679423 - RNA, 18 nt, Homo sapiens
caguaauagcaagucuua

SEQ ID NO: 1679424 - RNA, 19 nt, Homo sapiens
caguaaucaguuugcuaac

SEQ ID NO: 1679425 - RNA, 20 nt, Homo sapiens
caguaauguauucuaucucu

SEQ ID NO: 1679426 - RNA, 13 nt, Homo sapiens
caguacaugggaa

SEQ ID NO: 1679427 - RNA, 19 nt, Homo sapiens
caguacucaggcagugcaa

SEQ ID NO: 1679428 - RNA, 21 nt, Homo sapiens
caguacucaggcagugcagua

SEQ ID NO: 1679429 - RNA, 23 nt, Homo sapiens
caguacucaguaacagugcagua

SEQ ID NO: 1679430 - RNA, 17 nt, Homo sapiens
caguagaggguccaguc

SEQ ID NO: 1679431 - RNA, 20 nt, Homo sapiens
caguagcuccgcgugucuca

SEQ ID NO: 1679432 - RNA, 22 nt, Homo sapiens
caguagcuccgcgugucucauu

SEQ ID NO: 1679433 - RNA, 16 nt, Homo sapiens
caguagugcuaucuca

SEQ ID NO: 1679434 - RNA, 17 nt, Homo sapiens
caguagugcuaucucau

SEQ ID NO: 1679435 - RNA, 19 nt, Homo sapiens
caguauaaauuacaugcau

SEQ ID NO: 1679436 - RNA, 18 nt, Homo sapiens
caguauuaacaucaaaga

SEQ ID NO: 1679437 - RNA, 16 nt, Homo sapiens
caguauugacuucuuu

SEQ ID NO: 1679438 - RNA, 13 nt, Homo sapiens
cagucaagggcau

SEQ ID NO: 1679439 - RNA, 23 nt, Homo sapiens
cagucacauucagagucgcugcu

SEQ ID NO: 1679440 - RNA, 21 nt, Homo sapiens
caguccccagguaucugauga

SEQ ID NO: 1679441 - RNA, 23 nt, Homo sapiens
cagucgucccagcagcaccucag

SEQ ID NO: 1679442 - RNA, 19 nt, Homo sapiens
cagucucccgaguagcugg

SEQ ID NO: 1679443 - RNA, 15 nt, Homo sapiens
cagucuggugcccag

SEQ ID NO: 1679444 - RNA, 11 nt, Homo sapiens
cagucuucuca

SEQ ID NO: 1679445 - RNA, 17 nt, Homo sapiens
cagucuuuuguccugca

SEQ ID NO: 1679446 - RNA, 18 nt, Homo sapiens
cagugaaguacucaguaa

SEQ ID NO: 1679447 - RNA, 19 nt, Homo sapiens
cagugacacaacucaucca

SEQ ID NO: 1679448 - RNA, 19 nt, Homo sapiens
cagugagucagaggcagaa

SEQ ID NO: 1679449 - RNA, 22 nt, Homo sapiens
cagugaguuggggcgacuguga

SEQ ID NO: 1679450 - RNA, 23 nt, Homo sapiens
cagugaguuggggcgacugugaa

SEQ ID NO: 1679451 - RNA, 18 nt, Homo sapiens
cagugcaauacucaguaa

SEQ ID NO: 1679452 - RNA, 16 nt, Homo sapiens
cagugccaaaaacaac

SEQ ID NO: 1679453 - RNA, 19 nt, Homo sapiens
cagugccaaaaacaacaac

SEQ ID NO: 1679454 - RNA, 18 nt, Homo sapiens
cagugccacgacauggcu

SEQ ID NO: 1679455 - RNA, 15 nt, Homo sapiens
caguggcaucaucuc

SEQ ID NO: 1679456 - RNA, 17 nt, Homo sapiens
caguggcaucaucucag

SEQ ID NO: 1679457 - RNA, 23 nt, Homo sapiens
caguggccuacaaaucaguaauu

SEQ ID NO: 1679458 - RNA, 21 nt, Homo sapiens
caguggcgcgaucucagcuca

SEQ ID NO: 1679459 - RNA, 17 nt, Homo sapiens
caguggcuucuugauga

SEQ ID NO: 1679460 - RNA, 18 nt, Homo sapiens
cagugugacuuuaucuuc

SEQ ID NO: 1679461 - RNA, 21 nt, Homo sapiens
cagugugcuugggaucuucaa

SEQ ID NO: 1679462 - RNA, 20 nt, Homo sapiens
caguguuuccagugacacaa

SEQ ID NO: 1679463 - RNA, 15 nt, Homo sapiens
caguguuuugcagaa

SEQ ID NO: 1679464 - RNA, 15 nt, Homo sapiens
caguuaauucuugcc

SEQ ID NO: 1679465 - RNA, 20 nt, Homo sapiens
caguuagaacuguuggauac

SEQ ID NO: 1679466 - RNA, 22 nt, Homo sapiens
caguuagcccggccaaggacac

SEQ ID NO: 1679467 - RNA, 16 nt, Homo sapiens
caguuaggcagugcag

SEQ ID NO: 1679468 - RNA, 19 nt, Homo sapiens
caguucccucagcccucau

SEQ ID NO: 1679469 - RNA, 13 nt, Homo sapiens
caguucugaugag

SEQ ID NO: 1679470 - RNA, 14 nt, Homo sapiens
caguuggugcugcu

SEQ ID NO: 1679471 - RNA, 12 nt, Homo sapiens
cauaaacacuuc

SEQ ID NO: 1679472 - RNA, 14 nt, Homo sapiens
cauaaacacuucuc

SEQ ID NO: 1679473 - RNA, 16 nt, Homo sapiens
cauaaaggagcauaua

SEQ ID NO: 1679474 - RNA, 14 nt, Homo sapiens
cauaaaucuuccaa

SEQ ID NO: 1679475 - RNA, 14 nt, Homo sapiens
cauaaauguuauau

SEQ ID NO: 1679476 - RNA, 15 nt, Homo sapiens
cauaacacacuacug

SEQ ID NO: 1679477 - RNA, 16 nt, Homo sapiens
cauaauaaaaggaguu

SEQ ID NO: 1679478 - RNA, 18 nt, Homo sapiens
cauaaugaguuccugaga

SEQ ID NO: 1679479 - RNA, 17 nt, Homo sapiens
cauacauuagugccaua

SEQ ID NO: 1679480 - RNA, 15 nt, Homo sapiens
cauaccaagugcuuu

SEQ ID NO: 1679481 - RNA, 14 nt, Homo sapiens
cauaccucugacca

SEQ ID NO: 1679482 - RNA, 18 nt, Homo sapiens
cauaccucugaccaacag

SEQ ID NO: 1679483 - RNA, 16 nt, Homo sapiens
cauacguucuuuucaa

SEQ ID NO: 1679484 - RNA, 16 nt, Homo sapiens
cauacucagagcauua

SEQ ID NO: 1679485 - RNA, 23 nt, Homo sapiens
cauacuuucuaaaugccuuugac

SEQ ID NO: 1679486 - RNA, 16 nt, Homo sapiens
cauagaaacaugacac

SEQ ID NO: 1679487 - RNA, 22 nt, Homo sapiens
cauagacaaaggccuuaacaaa

SEQ ID NO: 1679488 - RNA, 14 nt, Homo sapiens
cauagaguuuagua

SEQ ID NO: 1679489 - RNA, 19 nt, Homo sapiens
cauagauuaauggcacuga

SEQ ID NO: 1679490 - RNA, 22 nt, Homo sapiens
cauagauucaccuguaaaacuu

SEQ ID NO: 1679491 - RNA, 24 nt, Homo sapiens
cauauaggggcaaaaauuugacau

SEQ ID NO: 1679492 - RNA, 24 nt, Homo sapiens
cauauauaauuuuauugcuggaau

SEQ ID NO: 1679493 - RNA, 21 nt, Homo sapiens
cauauauauauagcagcuuua

SEQ ID NO: 1679494 - RNA, 21 nt, Homo sapiens
cauaucaagguuccugauuca

SEQ ID NO: 1679495 - RNA, 22 nt, Homo sapiens
cauaucaagguuccugauucag

SEQ ID NO: 1679496 - RNA, 21 nt, Homo sapiens
cauaugcacaauuccaugaau

SEQ ID NO: 1679497 - RNA, 13 nt, Homo sapiens
cauauggaaaucc

SEQ ID NO: 1679498 - RNA, 23 nt, Homo sapiens
cauauguaugugugaguguaugu

SEQ ID NO: 1679499 - RNA, 13 nt, Homo sapiens
cauaugucuucaa

SEQ ID NO: 1679500 - RNA, 16 nt, Homo sapiens
cauaugugaagacaga

SEQ ID NO: 1679501 - RNA, 20 nt, Homo sapiens
cauauuauaucagacugcuu

SEQ ID NO: 1679502 - RNA, 18 nt, Homo sapiens
caucacuccucugucaua

SEQ ID NO: 1679503 - RNA, 23 nt, Homo sapiens
caucacuccucugucauaugcag

SEQ ID NO: 1679504 - RNA, 17 nt, Homo sapiens
caucacugugucucaug

SEQ ID NO: 1679505 - RNA, 16 nt, Homo sapiens
caucaguuaggauuag

SEQ ID NO: 1679506 - RNA, 23 nt, Homo sapiens
caucaucccuuaauuaaauauca

SEQ ID NO: 1679507 - RNA, 16 nt, Homo sapiens
caucauucauucauuc

SEQ ID NO: 1679508 - RNA, 15 nt, Homo sapiens
caucauuugcauaug

SEQ ID NO: 1679509 - RNA, 21 nt, Homo sapiens
cauccacgcucaagacccgcc

SEQ ID NO: 1679510 - RNA, 20 nt, Homo sapiens
cauccaucccuggugaaaga

SEQ ID NO: 1679511 - RNA, 14 nt, Homo sapiens
cauccucacacaga

SEQ ID NO: 1679512 - RNA, 16 nt, Homo sapiens
cauccuucaucuggau

SEQ ID NO: 1679513 - RNA, 16 nt, Homo sapiens
caucgcuuuugaccca

SEQ ID NO: 1679514 - RNA, 18 nt, Homo sapiens
caucgggaauacaaagau

SEQ ID NO: 1679515 - RNA, 16 nt, Homo sapiens
caucgguuuauacuau

SEQ ID NO: 1679516 - RNA, 16 nt, Homo sapiens
caucuaagacauucac

SEQ ID NO: 1679517 - RNA, 17 nt, Homo sapiens
caucuaagacauucacc

SEQ ID NO: 1679518 - RNA, 14 nt, Homo sapiens
caucuaucugguga

SEQ ID NO: 1679519 - RNA, 13 nt, Homo sapiens
caucuaugugaga

SEQ ID NO: 1679520 - RNA, 19 nt, Homo sapiens
caucucaaacacugcuuaa

SEQ ID NO: 1679521 - RNA, 22 nt, Homo sapiens
caucucagcaaucacaagccaa

SEQ ID NO: 1679522 - RNA, 12 nt, Homo sapiens
caucuccagugg

SEQ ID NO: 1679523 - RNA, 21 nt, Homo sapiens
caucuccccucagauuccacc

SEQ ID NO: 1679524 - RNA, 18 nt, Homo sapiens
caucucuccccauauaua

SEQ ID NO: 1679525 - RNA, 17 nt, Homo sapiens
caucucuccugcucacc

SEQ ID NO: 1679526 - RNA, 17 nt, Homo sapiens
caucugaggaguccaaa

SEQ ID NO: 1679527 - RNA, 19 nt, Homo sapiens
caucuguaaaauagucuca

SEQ ID NO: 1679528 - RNA, 17 nt, Homo sapiens
caucuucccacaguggc

SEQ ID NO: 1679529 - RNA, 18 nt, Homo sapiens
caucuucccacaguggcu

SEQ ID NO: 1679530 - RNA, 11 nt, Homo sapiens
caucuugccuc

SEQ ID NO: 1679531 - RNA, 22 nt, Homo sapiens
caucuuguaaauaaugcuuaac

SEQ ID NO: 1679532 - RNA, 11 nt, Homo sapiens
caucuuucuaa

SEQ ID NO: 1679533 - RNA, 14 nt, Homo sapiens
caugaaaaguuuuc

SEQ ID NO: 1679534 - RNA, 15 nt, Homo sapiens
caugaaagcaguuua

SEQ ID NO: 1679535 - RNA, 14 nt, Homo sapiens
caugaacguuuucu

SEQ ID NO: 1679536 - RNA, 15 nt, Homo sapiens
uaccacauucacuac

SEQ ID NO: 1679537 - RNA, 12 nt, Homo sapiens
uaccacccagaa

SEQ ID NO: 1679538 - RNA, 19 nt, Homo sapiens
uaccagagauuuuccucuc

SEQ ID NO: 1679539 - RNA, 14 nt, Homo sapiens
uaccaguucuugca

SEQ ID NO: 1679540 - RNA, 17 nt, Homo sapiens
uacccaaugcaguuugg

SEQ ID NO: 1679541 - RNA, 16 nt, Homo sapiens
uacccagugggacaga

SEQ ID NO: 1679542 - RNA, 20 nt, Homo sapiens
uaccugggcuuggugcguuu

SEQ ID NO: 1679543 - RNA, 17 nt, Homo sapiens
uacgaggcuucucuaac

SEQ ID NO: 1679544 - RNA, 17 nt, Homo sapiens
uacgauuauaguaccac

SEQ ID NO: 1679545 - RNA, 13 nt, Homo sapiens
uacgggaggguaa

SEQ ID NO: 1679546 - RNA, 20 nt, Homo sapiens
uacguuaugauaguguccca

SEQ ID NO: 1679547 - RNA, 19 nt, Homo sapiens
uacuaacaguaacugccau

SEQ ID NO: 1679548 - RNA, 22 nt, Homo sapiens
uacuaccccagaacgcaugcag

SEQ ID NO: 1679549 - RNA, 12 nt, Homo sapiens
uacuaccccagg

SEQ ID NO: 1679550 - RNA, 21 nt, Homo sapiens
uacuaccccaggacgcaugca

SEQ ID NO: 1679551 - RNA, 22 nt, Homo sapiens
uacuaccccaggacgcaugcag

SEQ ID NO: 1679552 - RNA, 16 nt, Homo sapiens
uacucaggcagugcaa

SEQ ID NO: 1679553 - RNA, 11 nt, Homo sapiens
uacucagucag

SEQ ID NO: 1679554 - RNA, 17 nt, Homo sapiens
uacucagucagcccagu

SEQ ID NO: 1679555 - RNA, 18 nt, Homo sapiens
uacuccuuaaaaauguau

SEQ ID NO: 1679556 - RNA, 18 nt, Homo sapiens
uacucgaguuacagacaa

SEQ ID NO: 1679557 - RNA, 19 nt, Homo sapiens
uacucgaguuacagacaaa

SEQ ID NO: 1679558 - RNA, 21 nt, Homo sapiens
uacucgaguuacagacaaagc

SEQ ID NO: 1679559 - RNA, 15 nt, Homo sapiens
uacucugugccuuua

SEQ ID NO: 1679560 - RNA, 11 nt, Homo sapiens
uacucuuccaa

SEQ ID NO: 1679561 - RNA, 12 nt, Homo sapiens
uacugacauaua

SEQ ID NO: 1679562 - RNA, 22 nt, Homo sapiens
uacuguaaagaauuuagcugua

SEQ ID NO: 1679563 - RNA, 15 nt, Homo sapiens
uacuguauuguuaca

SEQ ID NO: 1679564 - RNA, 15 nt, Homo sapiens
uacugugagaacugu

SEQ ID NO: 1679565 - RNA, 19 nt, Homo sapiens
uacuuaggaaauacucagc

SEQ ID NO: 1679566 - RNA, 22 nt, Homo sapiens
uacuucuacauccaauguauga

SEQ ID NO: 1679567 - RNA, 21 nt, Homo sapiens
uagaaaaauuagaugacugaa

SEQ ID NO: 1679568 - RNA, 12 nt, Homo sapiens
uagaaacaguga

SEQ ID NO: 1679569 - RNA, 13 nt, Homo sapiens
uagaaacaugaca

SEQ ID NO: 1679570 - RNA, 16 nt, Homo sapiens
uagaagagucuauugu

SEQ ID NO: 1679571 - RNA, 19 nt, Homo sapiens
uagaauaaugugggaagaa

SEQ ID NO: 1679572 - RNA, 18 nt, Homo sapiens
uagaaucaagucugugaa

SEQ ID NO: 1679573 - RNA, 23 nt, Homo sapiens
uagaauggggcuuccaugguggu

SEQ ID NO: 1679574 - RNA, 14 nt, Homo sapiens
uagacagagacaau

SEQ ID NO: 1679575 - RNA, 16 nt, Homo sapiens
uagacagagacaauuu

SEQ ID NO: 1679576 - RNA, 18 nt, Homo sapiens
uagaccuggauguuauau

SEQ ID NO: 1679577 - RNA, 15 nt, Homo sapiens
uagagagaaacagcu

SEQ ID NO: 1679578 - RNA, 17 nt, Homo sapiens
uagagaugauaauccca

SEQ ID NO: 1679579 - RNA, 19 nt, Homo sapiens
uagagcacuagaagcacag

SEQ ID NO: 1679580 - RNA, 19 nt, Homo sapiens
uagagcuagaugugucuua

SEQ ID NO: 1679581 - RNA, 20 nt, Homo sapiens
uagaggauuaguaagaucuc

SEQ ID NO: 1679582 - RNA, 22 nt, Homo sapiens
uagagugcccuuaaaauaauga

SEQ ID NO: 1679583 - RNA, 14 nt, Homo sapiens
uagauaaagcacug

SEQ ID NO: 1679584 - RNA, 22 nt, Homo sapiens
uagauaaagcacuguuuggaua

SEQ ID NO: 1679585 - RNA, 16 nt, Homo sapiens
uagauauccuuggcac

SEQ ID NO: 1679586 - RNA, 23 nt, Homo sapiens
uagaugagguugagcuaugauau

SEQ ID NO: 1679587 - RNA, 13 nt, Homo sapiens
uagauucaccugu

SEQ ID NO: 1679588 - RNA, 20 nt, Homo sapiens
uagauuuuuagauuccuacu

SEQ ID NO: 1679589 - RNA, 18 nt, Homo sapiens
uagcacuuuauaagccaa

SEQ ID NO: 1679590 - RNA, 20 nt, Homo sapiens
uagccaaccaggcuacaguu

SEQ ID NO: 1679591 - RNA, 14 nt, Homo sapiens
uagccaaggccaaa

SEQ ID NO: 1679592 - RNA, 23 nt, Homo sapiens
uagccaagugcagggccuguaau

SEQ ID NO: 1679593 - RNA, 23 nt, Homo sapiens
uagccagaggcucuaauguacaa

SEQ ID NO: 1679594 - RNA, 21 nt, Homo sapiens
uagcccucuuucucucugugu

SEQ ID NO: 1679595 - RNA, 13 nt, Homo sapiens
uagcccugcauuu

SEQ ID NO: 1679596 - RNA, 20 nt, Homo sapiens
uagcccuggcccggucccag

SEQ ID NO: 1679597 - RNA, 22 nt, Homo sapiens
uagccgguaaguaaacagucag

SEQ ID NO: 1679598 - RNA, 22 nt, Homo sapiens
uagccuaauauucaugcugccu

SEQ ID NO: 1679599 - RNA, 14 nt, Homo sapiens
uagccucaccuucc

SEQ ID NO: 1679600 - RNA, 14 nt, Homo sapiens
uagccucuccgccc

SEQ ID NO: 1679601 - RNA, 23 nt, Homo sapiens
uagccugaguguccacagggaca

SEQ ID NO: 1679602 - RNA, 18 nt, Homo sapiens
uagccugcauaucauuca

SEQ ID NO: 1679603 - RNA, 16 nt, Homo sapiens
uagcucacagcacauu

SEQ ID NO: 1679604 - RNA, 16 nt, Homo sapiens
uagcucugaaugcuau

SEQ ID NO: 1679605 - RNA, 13 nt, Homo sapiens
uagcuuaccugac

SEQ ID NO: 1679606 - RNA, 15 nt, Homo sapiens
uaggacucuuugguc

SEQ ID NO: 1679607 - RNA, 17 nt, Homo sapiens
uaggauuuaccaaauag

SEQ ID NO: 1679608 - RNA, 18 nt, Homo sapiens
uaggcaauguaguacuca

SEQ ID NO: 1679609 - RNA, 12 nt, Homo sapiens
uaggcauacucu

SEQ ID NO: 1679610 - RNA, 16 nt, Homo sapiens
uagggcucuaauuucc

SEQ ID NO: 1679611 - RNA, 19 nt, Homo sapiens
uagggcucuccaagcacua

SEQ ID NO: 1679612 - RNA, 22 nt, Homo sapiens
uaggucuuaagaugcaaaucaa

SEQ ID NO: 1679613 - RNA, 14 nt, Homo sapiens
uaggugugccaaac

SEQ ID NO: 1679614 - RNA, 20 nt, Homo sapiens
uagguuaauaggaggacaga

SEQ ID NO: 1679615 - RNA, 17 nt, Homo sapiens
uaguaaagcuugcacau

SEQ ID NO: 1679616 - RNA, 16 nt, Homo sapiens
uaguaacaguauuucc

SEQ ID NO: 1679617 - RNA, 13 nt, Homo sapiens
uagucacauauca

SEQ ID NO: 1679618 - RNA, 14 nt, Homo sapiens
uagucacauaucaa

SEQ ID NO: 1679619 - RNA, 17 nt, Homo sapiens
uagucucuugauucaua

SEQ ID NO: 1679620 - RNA, 13 nt, Homo sapiens
uagucugucaggg

SEQ ID NO: 1679621 - RNA, 18 nt, Homo sapiens
uagugaaaggucaucuca

SEQ ID NO: 1679622 - RNA, 22 nt, Homo sapiens
uagugcaauaaaacucccuucc

SEQ ID NO: 1679623 - RNA, 15 nt, Homo sapiens
uaguggucauuuggu

SEQ ID NO: 1679624 - RNA, 13 nt, Homo sapiens
uaguuaacuauga

SEQ ID NO: 1679625 - RNA, 21 nt, Homo sapiens
uaguuccccaaauuaauacuu

SEQ ID NO: 1679626 - RNA, 11 nt, Homo sapiens
uaguugcaaag

SEQ ID NO: 1679627 - RNA, 21 nt, Homo sapiens
uaguugccguggcaacugugg

SEQ ID NO: 1679628 - RNA, 23 nt, Homo sapiens
uaguugccguggcaacuguggaa

SEQ ID NO: 1679629 - RNA, 13 nt, Homo sapiens
uauaaaacagugu

SEQ ID NO: 1679630 - RNA, 13 nt, Homo sapiens
uauaaacacagua

SEQ ID NO: 1679631 - RNA, 16 nt, Homo sapiens
uauaaauggacuugcu

SEQ ID NO: 1679632 - RNA, 13 nt, Homo sapiens
uauaacaauugau

SEQ ID NO: 1679633 - RNA, 13 nt, Homo sapiens
uauaagccaaaaa

SEQ ID NO: 1679634 - RNA, 22 nt, Homo sapiens
uauaagcuuuuuucucaauaaa

SEQ ID NO: 1679635 - RNA, 20 nt, Homo sapiens
uauacauauguaugugugag

SEQ ID NO: 1679636 - RNA, 11 nt, Homo sapiens
uauacauauuc

SEQ ID NO: 1679637 - RNA, 17 nt, Homo sapiens
uauacauguauagugag

SEQ ID NO: 1679638 - RNA, 18 nt, Homo sapiens
uauacauguauagugagu

SEQ ID NO: 1679639 - RNA, 16 nt, Homo sapiens
uauacuugaauauuau

SEQ ID NO: 1679640 - RNA, 13 nt, Homo sapiens
uauagaauuuuga

SEQ ID NO: 1679641 - RNA, 16 nt, Homo sapiens
uauauaagccaaaaaa

SEQ ID NO: 1679642 - RNA, 16 nt, Homo sapiens
uauaugaaaacuaagu

SEQ ID NO: 1679643 - RNA, 18 nt, Homo sapiens
uauauguagaguguuuua

SEQ ID NO: 1679644 - RNA, 23 nt, Homo sapiens
uauauuguuuucaggugcucaaa

SEQ ID NO: 1679645 - RNA, 15 nt, Homo sapiens
uauauuucaugaaua

SEQ ID NO: 1679646 - RNA, 18 nt, Homo sapiens
uaucaaaaugaaugccag

SEQ ID NO: 1679647 - RNA, 19 nt, Homo sapiens
uaucaauaaaauacuuugg

SEQ ID NO: 1679648 - RNA, 18 nt, Homo sapiens
uaucagaacuccuuucua

SEQ ID NO: 1679649 - RNA, 15 nt, Homo sapiens
uaucagaguauguca

SEQ ID NO: 1679650 - RNA, 22 nt, Homo sapiens
uaucagcagacacuccaguuug

SEQ ID NO: 1679651 - RNA, 23 nt, Homo sapiens
uaucagcagacacuccaguuugc

SEQ ID NO: 1679652 - RNA, 20 nt, Homo sapiens
uaucaggaaauaucugugaa

SEQ ID NO: 1679653 - RNA, 19 nt, Homo sapiens
uaucaugcuucuacuccau

SEQ ID NO: 1679654 - RNA, 18 nt, Homo sapiens
uaucauuauagcauguaa

SEQ ID NO: 1679655 - RNA, 19 nt, Homo sapiens
uauccacagaaccuuuguc

SEQ ID NO: 1679656 - RNA, 19 nt, Homo sapiens
uauccuuggcaccaaagau

SEQ ID NO: 1679657 - RNA, 21 nt, Homo sapiens
uaucgaguuccggaaagccuu

SEQ ID NO: 1679658 - RNA, 14 nt, Homo sapiens
ucccauuugcuccu

SEQ ID NO: 1679659 - RNA, 22 nt, Homo sapiens
ucccauuuguaauguaucuuau

SEQ ID NO: 1679660 - RNA, 13 nt, Homo sapiens
uccccauugccuu

SEQ ID NO: 1679661 - RNA, 13 nt, Homo sapiens
uccccccacaaga

SEQ ID NO: 1679662 - RNA, 13 nt, Homo sapiens
ucccccgcuguaa

SEQ ID NO: 1679663 - RNA, 22 nt, Homo sapiens
uccccggaccggacgcaugcag

SEQ ID NO: 1679664 - RNA, 18 nt, Homo sapiens
uccccugcccugucuuuc

SEQ ID NO: 1679665 - RNA, 15 nt, Homo sapiens
uccccugguccugca

SEQ ID NO: 1679666 - RNA, 21 nt, Homo sapiens
ucccgcaggcuucguuugccu

SEQ ID NO: 1679667 - RNA, 13 nt, Homo sapiens
ucccgggcacugu

SEQ ID NO: 1679668 - RNA, 20 nt, Homo sapiens
ucccgggcacugucaugccc

SEQ ID NO: 1679669 - RNA, 22 nt, Homo sapiens
ucccguuguguggguuuacucu

SEQ ID NO: 1679670 - RNA, 18 nt, Homo sapiens
ucccuauacuuaggcaua

SEQ ID NO: 1679671 - RNA, 15 nt, Homo sapiens
ucccuccaccagugu

SEQ ID NO: 1679672 - RNA, 13 nt, Homo sapiens
ucccugcugccag

SEQ ID NO: 1679673 - RNA, 19 nt, Homo sapiens
ucccuggaaauaacugagc

SEQ ID NO: 1679674 - RNA, 15 nt, Homo sapiens
ucccuucccuuccac

SEQ ID NO: 1679675 - RNA, 15 nt, Homo sapiens
ucccuucuuacuuaa

SEQ ID NO: 1679676 - RNA, 22 nt, Homo sapiens
uccgacaugccuugaaaccaga

SEQ ID NO: 1679677 - RNA, 12 nt, Homo sapiens
uccgcagacuug

SEQ ID NO: 1679678 - RNA, 20 nt, Homo sapiens
uccgccucccauguucaagc

SEQ ID NO: 1679679 - RNA, 20 nt, Homo sapiens
uccggaaagccuuccucaag

SEQ ID NO: 1679680 - RNA, 19 nt, Homo sapiens
uccgugagagucaucucaa

SEQ ID NO: 1679681 - RNA, 18 nt, Homo sapiens
uccguggccgacagucug

SEQ ID NO: 1679682 - RNA, 14 nt, Homo sapiens
uccuaaauuuccag

SEQ ID NO: 1679683 - RNA, 16 nt, Homo sapiens
uccuacccgcuuccca

SEQ ID NO: 1679684 - RNA, 15 nt, Homo sapiens
uccuacuuuacauau

SEQ ID NO: 1679685 - RNA, 20 nt, Homo sapiens
uccuauccccggacgcaugc

SEQ ID NO: 1679686 - RNA, 20 nt, Homo sapiens
uccuaucccuggacgcaugc

SEQ ID NO: 1679687 - RNA, 21 nt, Homo sapiens
uccuaugagagaagagaguau

SEQ ID NO: 1679688 - RNA, 15 nt, Homo sapiens
uccucaaaacaggcc

SEQ ID NO: 1679689 - RNA, 22 nt, Homo sapiens
uccucaagauccugucuugcug

SEQ ID NO: 1679690 - RNA, 13 nt, Homo sapiens
uccucacugccac

SEQ ID NO: 1679691 - RNA, 23 nt, Homo sapiens
uccucaugaaagcagcacacauu

SEQ ID NO: 1679692 - RNA, 18 nt, Homo sapiens
uccucccuguuaaauguc

SEQ ID NO: 1679693 - RNA, 12 nt, Homo sapiens
uccucggcagcu

SEQ ID NO: 1679694 - RNA, 18 nt, Homo sapiens
uccucuccucguccggcc

SEQ ID NO: 1679695 - RNA, 13 nt, Homo sapiens
uccucucugcaag

SEQ ID NO: 1679696 - RNA, 15 nt, Homo sapiens
uccucugcagccuga

SEQ ID NO: 1679697 - RNA, 19 nt, Homo sapiens
uccucugcagcucagggac

SEQ ID NO: 1679698 - RNA, 23 nt, Homo sapiens
uccucugcuugucauucugcuaa

SEQ ID NO: 1679699 - RNA, 17 nt, Homo sapiens
uccucuuaauucccaau

SEQ ID NO: 1679700 - RNA, 14 nt, Homo sapiens
uccucuuccugccu

SEQ ID NO: 1679701 - RNA, 17 nt, Homo sapiens
uccugaacucccaguca

SEQ ID NO: 1679702 - RNA, 13 nt, Homo sapiens
uccugcaucccuc

SEQ ID NO: 1679703 - RNA, 14 nt, Homo sapiens
uccuggacagugag

SEQ ID NO: 1679704 - RNA, 19 nt, Homo sapiens
uccuggcuaacacagugaa

SEQ ID NO: 1679705 - RNA, 20 nt, Homo sapiens
uccugggggcugcugcacug

SEQ ID NO: 1679706 - RNA, 21 nt, Homo sapiens
uccugggggcugcugcacugc

SEQ ID NO: 1679707 - RNA, 15 nt, Homo sapiens
uccugggugcuguca

SEQ ID NO: 1679708 - RNA, 20 nt, Homo sapiens
uccugggugcugucaugccc

SEQ ID NO: 1679709 - RNA, 13 nt, Homo sapiens
uccugugaucucg

SEQ ID NO: 1679710 - RNA, 22 nt, Homo sapiens
uccugugugucgcuuaugucua

SEQ ID NO: 1679711 - RNA, 17 nt, Homo sapiens
uccuguguuccugugau

SEQ ID NO: 1679712 - RNA, 13 nt, Homo sapiens
uccuguuacuuaa

SEQ ID NO: 1679713 - RNA, 23 nt, Homo sapiens
uccuguugccuuuauauccaaaa

SEQ ID NO: 1679714 - RNA, 17 nt, Homo sapiens
uccuuaaaaaauaugcu

SEQ ID NO: 1679715 - RNA, 18 nt, Homo sapiens
uccuuagaauacuguauu

SEQ ID NO: 1679716 - RNA, 22 nt, Homo sapiens
uccuucaccgugacauuccagc

SEQ ID NO: 1679717 - RNA, 19 nt, Homo sapiens
uccuucacucccugucaua

SEQ ID NO: 1679718 - RNA, 20 nt, Homo sapiens
uccuucacucugacaguauu

SEQ ID NO: 1679719 - RNA, 20 nt, Homo sapiens
uccuucccccagcacaaagc

SEQ ID NO: 1679720 - RNA, 13 nt, Homo sapiens
uccuucuggccuu

SEQ ID NO: 1679721 - RNA, 19 nt, Homo sapiens
uccuugaguaguuuuuauc

SEQ ID NO: 1679722 - RNA, 16 nt, Homo sapiens
uccuuuccaucagcuu

SEQ ID NO: 1679723 - RNA, 14 nt, Homo sapiens
uccuuucccaccca

SEQ ID NO: 1679724 - RNA, 12 nt, Homo sapiens
ucgaaucacuca

SEQ ID NO: 1679725 - RNA, 15 nt, Homo sapiens
ucgcacuacaucuga

SEQ ID NO: 1679726 - RNA, 14 nt, Homo sapiens
ucgcgugaugcgca

SEQ ID NO: 1679727 - RNA, 23 nt, Homo sapiens
ucgcucagaagagggaacuaagc

SEQ ID NO: 1679728 - RNA, 23 nt, Homo sapiens
ucggcaccuuccccugaggaccu

SEQ ID NO: 1679729 - RNA, 18 nt, Homo sapiens
ucgggcacucccuaaguc

SEQ ID NO: 1679730 - RNA, 22 nt, Homo sapiens
ucggggcuaacagagacuggag

SEQ ID NO: 1679731 - RNA, 13 nt, Homo sapiens
ucgguguguuugc

SEQ ID NO: 1679732 - RNA, 14 nt, Homo sapiens
ucuaaacccaaaua

SEQ ID NO: 1679733 - RNA, 14 nt, Homo sapiens
ucuaaagcugccag

SEQ ID NO: 1679734 - RNA, 17 nt, Homo sapiens
ucuaaaggggacagauc

SEQ ID NO: 1679735 - RNA, 13 nt, Homo sapiens
ucuaaaucauaua

SEQ ID NO: 1679736 - RNA, 16 nt, Homo sapiens
ucuaaaugccuuugac

SEQ ID NO: 1679737 - RNA, 20 nt, Homo sapiens
ucuaagaaauggcuuuccac

SEQ ID NO: 1679738 - RNA, 14 nt, Homo sapiens
ucuaagacauucac

SEQ ID NO: 1679739 - RNA, 15 nt, Homo sapiens
ucuaagaucuugccu

SEQ ID NO: 1679740 - RNA, 14 nt, Homo sapiens
ucuaauccaugugc

SEQ ID NO: 1679741 - RNA, 13 nt, Homo sapiens
ucuaauguacaau

SEQ ID NO: 1679742 - RNA, 21 nt, Homo sapiens
ucuaauguacaauaaagcaau

SEQ ID NO: 1679743 - RNA, 20 nt, Homo sapiens
ucuacaacauaaugauacug

SEQ ID NO: 1679744 - RNA, 21 nt, Homo sapiens
ucuacacauauaaacacagua

SEQ ID NO: 1679745 - RNA, 12 nt, Homo sapiens
ucuacacuguau

SEQ ID NO: 1679746 - RNA, 17 nt, Homo sapiens
ucuacacuguauuacau

SEQ ID NO: 1679747 - RNA, 14 nt, Homo sapiens
ucuacaggcauuua

SEQ ID NO: 1679748 - RNA, 17 nt, Homo sapiens
ucuacauguuuuagaca

SEQ ID NO: 1679749 - RNA, 15 nt, Homo sapiens
ucuacgcauaaacua

SEQ ID NO: 1679750 - RNA, 15 nt, Homo sapiens
ucuacuuuccaggcu

SEQ ID NO: 1679751 - RNA, 13 nt, Homo sapiens
ucuaggcaguuca

SEQ ID NO: 1679752 - RNA, 21 nt, Homo sapiens
ucuaguugacuucaaaugugu

SEQ ID NO: 1679753 - RNA, 13 nt, Homo sapiens
ucuauaccaccuu

SEQ ID NO: 1679754 - RNA, 13 nt, Homo sapiens
ucuauagcacaua

SEQ ID NO: 1679755 - RNA, 17 nt, Homo sapiens
ucuauauuaaggcagua

SEQ ID NO: 1679756 - RNA, 18 nt, Homo sapiens
ucuauauuuggauucaca

SEQ ID NO: 1679757 - RNA, 23 nt, Homo sapiens
ucuaucucucuuuacauuuuggu

SEQ ID NO: 1679758 - RNA, 11 nt, Homo sapiens
ucuauguccaa

SEQ ID NO: 1679759 - RNA, 13 nt, Homo sapiens
ucuauucauuuga

SEQ ID NO: 1679760 - RNA, 14 nt, Homo sapiens
ucuauucauuugau

SEQ ID NO: 1679761 - RNA, 20 nt, Homo sapiens
ucuauucccaucgcuggaaa

SEQ ID NO: 1679762 - RNA, 16 nt, Homo sapiens
ucuauuucaacuucag

SEQ ID NO: 1679763 - RNA, 20 nt, Homo sapiens
ucucaagcgcuauccacaga

SEQ ID NO: 1679764 - RNA, 17 nt, Homo sapiens
ucucaauguuccauuca

SEQ ID NO: 1679765 - RNA, 12 nt, Homo sapiens
ucucacacugga

SEQ ID NO: 1679766 - RNA, 16 nt, Homo sapiens
ucucacagcacaugcu

SEQ ID NO: 1679767 - RNA, 20 nt, Homo sapiens
ucucacgauuccagugcagu

SEQ ID NO: 1679768 - RNA, 21 nt, Homo sapiens
ucucacgauuccagugcagua

SEQ ID NO: 1679769 - RNA, 18 nt, Homo sapiens
ucucacuuuuauugauaa

SEQ ID NO: 1679770 - RNA, 20 nt, Homo sapiens
ucucagaacaccaaguaaau

SEQ ID NO: 1679771 - RNA, 12 nt, Homo sapiens
ucucagcucacu

SEQ ID NO: 1679772 - RNA, 20 nt, Homo sapiens
ucucagcucacugcaaccuc

SEQ ID NO: 1679773 - RNA, 22 nt, Homo sapiens
ucucagcucacugcaaccucug

SEQ ID NO: 1679774 - RNA, 13 nt, Homo sapiens
ucucaggccaaac

SEQ ID NO: 1679775 - RNA, 18 nt, Homo sapiens
ucucaggugcgugccaca

SEQ ID NO: 1679776 - RNA, 15 nt, Homo sapiens
ucucaugcuccuuaa

SEQ ID NO: 1679777 - RNA, 11 nt, Homo sapiens
ucucauuccca

SEQ ID NO: 1679778 - RNA, 22 nt, Homo sapiens
ucucauucuucuaaaacuacug

SEQ ID NO: 1679779 - RNA, 14 nt, Homo sapiens
ucucauucuugccc

SEQ ID NO: 1679780 - RNA, 12 nt, Homo sapiens
ucucauuugcca

SEQ ID NO: 1679781 - RNA, 14 nt, Homo sapiens
ugcagagcaggaaa

SEQ ID NO: 1679782 - RNA, 19 nt, Homo sapiens
ugcagauggcaagugcacc

SEQ ID NO: 1679783 - RNA, 24 nt, Homo sapiens
ugcagcccccugcuucucccgcca

SEQ ID NO: 1679784 - RNA, 13 nt, Homo sapiens
ugcaggaagggaa

SEQ ID NO: 1679785 - RNA, 23 nt, Homo sapiens
ugcagggaggugcggacucuccu

SEQ ID NO: 1679786 - RNA, 17 nt, Homo sapiens
ugcaguacucaguaaua

SEQ ID NO: 1679787 - RNA, 19 nt, Homo sapiens
ugcaguagagagcaaagau

SEQ ID NO: 1679788 - RNA, 14 nt, Homo sapiens
ugcaguagugucac

SEQ ID NO: 1679789 - RNA, 18 nt, Homo sapiens
ugcaguggcaucaucuca

SEQ ID NO: 1679790 - RNA, 19 nt, Homo sapiens
ugcaguggcgcgaucucag

SEQ ID NO: 1679791 - RNA, 22 nt, Homo sapiens
ugcaguggcgcgaucucagcuc

SEQ ID NO: 1679792 - RNA, 23 nt, Homo sapiens
ugcaucacaauuuguugaaucuc

SEQ ID NO: 1679793 - RNA, 21 nt, Homo sapiens
ugcauccuaucgaucuggaaa

SEQ ID NO: 1679794 - RNA, 16 nt, Homo sapiens
ugcaucuccccucaga

SEQ ID NO: 1679795 - RNA, 23 nt, Homo sapiens
ugcaucuccccucagauuccacc

SEQ ID NO: 1679796 - RNA, 12 nt, Homo sapiens
ugcaucuggccu

SEQ ID NO: 1679797 - RNA, 15 nt, Homo sapiens
ugcaugagaauguca

SEQ ID NO: 1679798 - RNA, 19 nt, Homo sapiens
ugcaugauuagugcaauaa

SEQ ID NO: 1679799 - RNA, 16 nt, Homo sapiens
ugcaugccaguaaugu

SEQ ID NO: 1679800 - RNA, 15 nt, Homo sapiens
ugcauggaguauuau

SEQ ID NO: 1679801 - RNA, 17 nt, Homo sapiens
ugcauguaauccuagca

SEQ ID NO: 1679802 - RNA, 21 nt, Homo sapiens
ugcauuugugcguaugcagug

SEQ ID NO: 1679803 - RNA, 22 nt, Homo sapiens
ugccaaaugaauaagacaacaa

SEQ ID NO: 1679804 - RNA, 21 nt, Homo sapiens
ugccacguggccgcugcccac

SEQ ID NO: 1679805 - RNA, 18 nt, Homo sapiens
ugccagagcuccaugcau

SEQ ID NO: 1679806 - RNA, 18 nt, Homo sapiens
ugccagauaaccaaguga

SEQ ID NO: 1679807 - RNA, 16 nt, Homo sapiens
ugccaggacacugccu

SEQ ID NO: 1679808 - RNA, 18 nt, Homo sapiens
ugccagguuuaaggucac

SEQ ID NO: 1679809 - RNA, 20 nt, Homo sapiens
ugccauuuuuugucugugau

SEQ ID NO: 1679810 - RNA, 23 nt, Homo sapiens
ugcccaauuucacagaguacaaa

SEQ ID NO: 1679811 - RNA, 21 nt, Homo sapiens
ugcccacgucccgggcacugu

SEQ ID NO: 1679812 - RNA, 20 nt, Homo sapiens
ugcccagacucaaggccucc

SEQ ID NO: 1679813 - RNA, 15 nt, Homo sapiens
ugcccagagccacag

SEQ ID NO: 1679814 - RNA, 21 nt, Homo sapiens
ugcccaggccggccagccuca

SEQ ID NO: 1679815 - RNA, 19 nt, Homo sapiens
ugcccauauuaaaaagcca

SEQ ID NO: 1679816 - RNA, 24 nt, Homo sapiens
ugcccauuagcccacugccuggaa

SEQ ID NO: 1679817 - RNA, 17 nt, Homo sapiens
ugccccagacacagugc

SEQ ID NO: 1679818 - RNA, 15 nt, Homo sapiens
ugcccgcacagcagc

SEQ ID NO: 1679819 - RNA, 21 nt, Homo sapiens
ugcccgccucgaccucucuca

SEQ ID NO: 1679820 - RNA, 19 nt, Homo sapiens
ugcccuuaaaauaaugauu

SEQ ID NO: 1679821 - RNA, 19 nt, Homo sapiens
ugccgcuggaggccaccaa

SEQ ID NO: 1679822 - RNA, 18 nt, Homo sapiens
ugccggucccccaugcca

SEQ ID NO: 1679823 - RNA, 23 nt, Homo sapiens
ugccggucccccaugccaccacc

SEQ ID NO: 1679824 - RNA, 17 nt, Homo sapiens
ugccguggcaacugugg

SEQ ID NO: 1679825 - RNA, 23 nt, Homo sapiens
ugccuauuuaugaauaaauauua

SEQ ID NO: 1679826 - RNA, 22 nt, Homo sapiens
ugccucacaucagcccugugua

SEQ ID NO: 1679827 - RNA, 21 nt, Homo sapiens
ugccucagugagaucagucag

SEQ ID NO: 1679828 - RNA, 17 nt, Homo sapiens
ugccuccaggaccuugc

SEQ ID NO: 1679829 - RNA, 16 nt, Homo sapiens
ugccucugccacacuc

SEQ ID NO: 1679830 - RNA, 13 nt, Homo sapiens
ugccuguggugag

SEQ ID NO: 1679831 - RNA, 14 nt, Homo sapiens
ugccuguugaucua

SEQ ID NO: 1679832 - RNA, 12 nt, Homo sapiens
ugccuucugacg

SEQ ID NO: 1679833 - RNA, 18 nt, Homo sapiens
ugccuugggcgggccauu

SEQ ID NO: 1679834 - RNA, 19 nt, Homo sapiens
ugccuuggguggaccaggc

SEQ ID NO: 1679835 - RNA, 15 nt, Homo sapiens
ugccuuguuguauuc

SEQ ID NO: 1679836 - RNA, 19 nt, Homo sapiens
ugccuuucaaagugcacac

SEQ ID NO: 1679837 - RNA, 14 nt, Homo sapiens
ugccuuucacuuua

SEQ ID NO: 1679838 - RNA, 16 nt, Homo sapiens
ugccuuugauguggau

SEQ ID NO: 1679839 - RNA, 17 nt, Homo sapiens
ugccuuuuccuauguaa

SEQ ID NO: 1679840 - RNA, 15 nt, Homo sapiens
ugcgacaggcauuua

SEQ ID NO: 1679841 - RNA, 23 nt, Homo sapiens
ugcgccugacauucacacagaga

SEQ ID NO: 1679842 - RNA, 19 nt, Homo sapiens
ugcggaauuccaccuggaa

SEQ ID NO: 1679843 - RNA, 19 nt, Homo sapiens
ugcggugugagauggugcc

SEQ ID NO: 1679844 - RNA, 21 nt, Homo sapiens
ugcguuuuagaguaugcaaga

SEQ ID NO: 1679845 - RNA, 16 nt, Homo sapiens
ugcuaaguggaagaca

SEQ ID NO: 1679846 - RNA, 24 nt, Homo sapiens
ugcuaauuaaaaaguuaaucuuca

SEQ ID NO: 1679847 - RNA, 16 nt, Homo sapiens
ugcuaccuuugucuca

SEQ ID NO: 1679848 - RNA, 22 nt, Homo sapiens
ugcuacuucaguaaugucuaua

SEQ ID NO: 1679849 - RNA, 14 nt, Homo sapiens
ugcuaugacagagg

SEQ ID NO: 1679850 - RNA, 22 nt, Homo sapiens
ugcuaugacagaggugugaaua

SEQ ID NO: 1679851 - RNA, 22 nt, Homo sapiens
ugcuauucccuggggcugcugu

SEQ ID NO: 1679852 - RNA, 23 nt, Homo sapiens
ugcuauuuuuaauuuccugugag

SEQ ID NO: 1679853 - RNA, 21 nt, Homo sapiens
ugcucacccgccucuugcccc

SEQ ID NO: 1679854 - RNA, 19 nt, Homo sapiens
ugcucaguuggugcugcuu

SEQ ID NO: 1679855 - RNA, 20 nt, Homo sapiens
ugcucaguuggugcugcuuu

SEQ ID NO: 1679856 - RNA, 13 nt, Homo sapiens
ugcuccaugcaca

SEQ ID NO: 1679857 - RNA, 14 nt, Homo sapiens
ugcuccauuccuga

SEQ ID NO: 1679858 - RNA, 17 nt, Homo sapiens
ugcucccggguccugcu

SEQ ID NO: 1679859 - RNA, 21 nt, Homo sapiens
ugcucccuagccagaggcucu

SEQ ID NO: 1679860 - RNA, 16 nt, Homo sapiens
ugcucggacacaguuu

SEQ ID NO: 1679861 - RNA, 14 nt, Homo sapiens
ugcucuccaucucu

SEQ ID NO: 1679862 - RNA, 18 nt, Homo sapiens
ugcucuccuucacucuga

SEQ ID NO: 1679863 - RNA, 23 nt, Homo sapiens
ugcugauuuuuuuucugauaaau

SEQ ID NO: 1679864 - RNA, 15 nt, Homo sapiens
ugcugccaucuccag

SEQ ID NO: 1679865 - RNA, 17 nt, Homo sapiens
ugcugcguucuuucaau

SEQ ID NO: 1679866 - RNA, 18 nt, Homo sapiens
ugcugcuuucuuguugcu

SEQ ID NO: 1679867 - RNA, 14 nt, Homo sapiens
ugcugucaugccca

SEQ ID NO: 1679868 - RNA, 23 nt, Homo sapiens
ugcuguccagggcagaggccaug

SEQ ID NO: 1679869 - RNA, 14 nt, Homo sapiens
ugcuucccaccucc

SEQ ID NO: 1679870 - RNA, 16 nt, Homo sapiens
ugcuugcaugugcugc

SEQ ID NO: 1679871 - RNA, 21 nt, Homo sapiens
ugcuugcuggaaaacugccac

SEQ ID NO: 1679872 - RNA, 14 nt, Homo sapiens
ugcuuggcugcugu

SEQ ID NO: 1679873 - RNA, 13 nt, Homo sapiens
ugcuugugcacug

SEQ ID NO: 1679874 - RNA, 15 nt, Homo sapiens
ugcuugugcacugga

SEQ ID NO: 1679875 - RNA, 17 nt, Homo sapiens
ugcuuuagguaaaaagc

SEQ ID NO: 1679876 - RNA, 16 nt, Homo sapiens
ugcuuucagauccauc

SEQ ID NO: 1679877 - RNA, 12 nt, Homo sapiens
ugcuuuccaaca

SEQ ID NO: 1679878 - RNA, 19 nt, Homo sapiens
ugcuuucugauacaucugu

SEQ ID NO: 1679879 - RNA, 18 nt, Homo sapiens
ugcuuuggggcuuaucag

SEQ ID NO: 1679880 - RNA, 19 nt, Homo sapiens
ugcuuuuugcuuguguaca

SEQ ID NO: 1679881 - RNA, 13 nt, Homo sapiens
uggaaagguccug

SEQ ID NO: 1679882 - RNA, 14 nt, Homo sapiens
uggaacacuaauga

SEQ ID NO: 1679883 - RNA, 15 nt, Homo sapiens
uggaacagcccugca

SEQ ID NO: 1679884 - RNA, 18 nt, Homo sapiens
uggaacucagcugucugu

SEQ ID NO: 1679885 - RNA, 19 nt, Homo sapiens
uggaagagcuccuugauau

SEQ ID NO: 1679886 - RNA, 17 nt, Homo sapiens
uggaagauuucuugacu

SEQ ID NO: 1679887 - RNA, 20 nt, Homo sapiens
uggaaggucacgcugaauga

SEQ ID NO: 1679888 - RNA, 14 nt, Homo sapiens
uggaaucacagcca

SEQ ID NO: 1679889 - RNA, 17 nt, Homo sapiens
uggaaucauaugggaua

SEQ ID NO: 1679890 - RNA, 15 nt, Homo sapiens
uggacgcaugcaggg

SEQ ID NO: 1679891 - RNA, 20 nt, Homo sapiens
uggagaaaauggacguguua

SEQ ID NO: 1679892 - RNA, 15 nt, Homo sapiens
uggagaacugcugaa

SEQ ID NO: 1679893 - RNA, 17 nt, Homo sapiens
uggagaucuuaagauuc

SEQ ID NO: 1679894 - RNA, 13 nt, Homo sapiens
uggagauucccau

SEQ ID NO: 1679895 - RNA, 18 nt, Homo sapiens
uggagauucccaucugau

SEQ ID NO: 1679896 - RNA, 15 nt, Homo sapiens
uggagccugcaauaa

SEQ ID NO: 1679897 - RNA, 16 nt, Homo sapiens
uggagccugcaauaag

SEQ ID NO: 1679898 - RNA, 18 nt, Homo sapiens
uggagccuggcacaggac

SEQ ID NO: 1679899 - RNA, 19 nt, Homo sapiens
uggagggaagcaccaugaa

SEQ ID NO: 1679900 - RNA, 13 nt, Homo sapiens
uggaggugaugaa

SEQ ID NO: 1679901 - RNA, 18 nt, Homo sapiens
uggaguagauauuaauua

SEQ ID NO: 1679902 - RNA, 10 nt, Homo sapiens
aaagugcaac

SEQ ID NO: 1679903 - RNA, 21 nt, Homo sapiens
aaaguggugagaggcauccag

SEQ ID NO: 1679904 - RNA, 17 nt, Homo sapiens
aaaguguuuuuacauau

SEQ ID NO: 1679905 - RNA, 19 nt, Homo sapiens
aaaguuacauuauguguaa

SEQ ID NO: 1679906 - RNA, 12 nt, Homo sapiens
aaaguugugauc

SEQ ID NO: 1679907 - RNA, 14 nt, Homo sapiens
aaaguuuugccuau

SEQ ID NO: 1679908 - RNA, 19 nt, Homo sapiens
aaauaaacacauagauuca

SEQ ID NO: 1679909 - RNA, 15 nt, Homo sapiens
aaauaaaccagacuc

SEQ ID NO: 1679910 - RNA, 16 nt, Homo sapiens
aaauaaagaguucucc

SEQ ID NO: 1679911 - RNA, 15 nt, Homo sapiens
aaauaaauacauucu

SEQ ID NO: 1679912 - RNA, 19 nt, Homo sapiens
aaauaaauaugaauggagu

SEQ ID NO: 1679913 - RNA, 16 nt, Homo sapiens
aaauaaauguguaaau

SEQ ID NO: 1679914 - RNA, 13 nt, Homo sapiens
aaauaacacugua

SEQ ID NO: 1679915 - RNA, 15 nt, Homo sapiens
aaauaacacuguacu

SEQ ID NO: 1679916 - RNA, 18 nt, Homo sapiens
aaauaauaaaagaaucau

SEQ ID NO: 1679917 - RNA, 14 nt, Homo sapiens
aaauagcagcuuua

SEQ ID NO: 1679918 - RNA, 15 nt, Homo sapiens
aaauaguuacaagca

SEQ ID NO: 1679919 - RNA, 16 nt, Homo sapiens
aaauauaaacugugag

SEQ ID NO: 1679920 - RNA, 18 nt, Homo sapiens
aaauaugauucuccucuc

SEQ ID NO: 1679921 - RNA, 17 nt, Homo sapiens
aaauauguggaguucau

SEQ ID NO: 1679922 - RNA, 20 nt, Homo sapiens
aaauauguguacacauauga

SEQ ID NO: 1679923 - RNA, 22 nt, Homo sapiens
aaauauucugucauugguuaca

SEQ ID NO: 1679924 - RNA, 14 nt, Homo sapiens
aaaucagugcagua

SEQ ID NO: 1679925 - RNA, 12 nt, Homo sapiens
aaauccacagug

SEQ ID NO: 1679926 - RNA, 12 nt, Homo sapiens
aaauccaugugu

SEQ ID NO: 1679927 - RNA, 22 nt, Homo sapiens
aaauccauuugagucugcuccu

SEQ ID NO: 1679928 - RNA, 16 nt, Homo sapiens
aaauccuguuacuuaa

SEQ ID NO: 1679929 - RNA, 16 nt, Homo sapiens
aaauccuucagcaauc

SEQ ID NO: 1679930 - RNA, 19 nt, Homo sapiens
aaaucugggaccaaaacau

SEQ ID NO: 1679931 - RNA, 18 nt, Homo sapiens
aaaugaacuaacugccau

SEQ ID NO: 1679932 - RNA, 18 nt, Homo sapiens
aaaugaauccaucauaca

SEQ ID NO: 1679933 - RNA, 14 nt, Homo sapiens
aaaugagcuuaaug

SEQ ID NO: 1679934 - RNA, 15 nt, Homo sapiens
aaaugcaaauauugc

SEQ ID NO: 1679935 - RNA, 14 nt, Homo sapiens
aaaugcuguucuca

SEQ ID NO: 1679936 - RNA, 13 nt, Homo sapiens
aaaugcuuucuca

SEQ ID NO: 1679937 - RNA, 23 nt, Homo sapiens
aaauggacguguuaugacuccag

SEQ ID NO: 1679938 - RNA, 13 nt, Homo sapiens
aaauggacuugcu

SEQ ID NO: 1679939 - RNA, 21 nt, Homo sapiens
aaauggagaaagcccaagagu

SEQ ID NO: 1679940 - RNA, 10 nt, Homo sapiens
aaaugucaac

SEQ ID NO: 1679941 - RNA, 18 nt, Homo sapiens
aaauguuaacaaugccua

SEQ ID NO: 1679942 - RNA, 23 nt, Homo sapiens
aaauuaacaaauucaguggacau

SEQ ID NO: 1679943 - RNA, 13 nt, Homo sapiens
aaauucacaaagu

SEQ ID NO: 1679944 - RNA, 14 nt, Homo sapiens
aaauucaugcugcu

SEQ ID NO: 1679945 - RNA, 15 nt, Homo sapiens
aaauuccagagcuau

SEQ ID NO: 1679946 - RNA, 12 nt, Homo sapiens
aaauucuugaua

SEQ ID NO: 1679947 - RNA, 13 nt, Homo sapiens
aaauugaaccugg

SEQ ID NO: 1679948 - RNA, 13 nt, Homo sapiens
aaauugugccaaa

SEQ ID NO: 1679949 - RNA, 20 nt, Homo sapiens
aaauuugggaccugcuucau

SEQ ID NO: 1679950 - RNA, 23 nt, Homo sapiens
aacaaaaaaaaaaaaacaaaaga

SEQ ID NO: 1679951 - RNA, 15 nt, Homo sapiens
aacaaaaacuguugc

SEQ ID NO: 1679952 - RNA, 14 nt, Homo sapiens
aacaaagacaacca

SEQ ID NO: 1679953 - RNA, 12 nt, Homo sapiens
aacaaaguaaua

SEQ ID NO: 1679954 - RNA, 18 nt, Homo sapiens
aacaacaaagcaugcuca

SEQ ID NO: 1679955 - RNA, 19 nt, Homo sapiens
aacaacagucagccagcuu

SEQ ID NO: 1679956 - RNA, 16 nt, Homo sapiens
aacaacucgaaucacu

SEQ ID NO: 1679957 - RNA, 18 nt, Homo sapiens
aacaacucgaaucacuca

SEQ ID NO: 1679958 - RNA, 14 nt, Homo sapiens
aacaacuuacuaaa

SEQ ID NO: 1679959 - RNA, 21 nt, Homo sapiens
aacaaggcauugaaucucuaa

SEQ ID NO: 1679960 - RNA, 15 nt, Homo sapiens
aacaaguagcacacu

SEQ ID NO: 1679961 - RNA, 14 nt, Homo sapiens
aacaauucaaguga

SEQ ID NO: 1679962 - RNA, 16 nt, Homo sapiens
aacacaagacugucau

SEQ ID NO: 1679963 - RNA, 16 nt, Homo sapiens
aacacaccucucuccu

SEQ ID NO: 1679964 - RNA, 15 nt, Homo sapiens
aagauggagaaacaa

SEQ ID NO: 1679965 - RNA, 11 nt, Homo sapiens
aagauggauuu

SEQ ID NO: 1679966 - RNA, 22 nt, Homo sapiens
aagauguuguuaaaaacaugug

SEQ ID NO: 1679967 - RNA, 20 nt, Homo sapiens
aagauuauuuacugacauau

SEQ ID NO: 1679968 - RNA, 17 nt, Homo sapiens
aagauuuagaaacagug

SEQ ID NO: 1679969 - RNA, 16 nt, Homo sapiens
aagauuucauggacac

SEQ ID NO: 1679970 - RNA, 16 nt, Homo sapiens
aagauuucauggacau

SEQ ID NO: 1679971 - RNA, 17 nt, Homo sapiens
aagcaaaccugauacaa

SEQ ID NO: 1679972 - RNA, 12 nt, Homo sapiens
aagcaagcucac

SEQ ID NO: 1679973 - RNA, 13 nt, Homo sapiens
aagcaagcucucu

SEQ ID NO: 1679974 - RNA, 11 nt, Homo sapiens
aagcaaugugg

SEQ ID NO: 1679975 - RNA, 13 nt, Homo sapiens
aagcacacuugac

SEQ ID NO: 1679976 - RNA, 12 nt, Homo sapiens
aagcaccaugaa

SEQ ID NO: 1679977 - RNA, 19 nt, Homo sapiens
aagcaccuuuagaauauua

SEQ ID NO: 1679978 - RNA, 14 nt, Homo sapiens
aagcaguacaucuu

SEQ ID NO: 1679979 - RNA, 23 nt, Homo sapiens
aagcaguacaucuugugcaugca

SEQ ID NO: 1679980 - RNA, 12 nt, Homo sapiens
aagcagugcagu

SEQ ID NO: 1679981 - RNA, 22 nt, Homo sapiens
aagcagugcaugcugucccuua

SEQ ID NO: 1679982 - RNA, 10 nt, Homo sapiens
aagcaguuua

SEQ ID NO: 1679983 - RNA, 14 nt, Homo sapiens
aagcaguuuagaca

SEQ ID NO: 1679984 - RNA, 16 nt, Homo sapiens
aagcauggacuaaccc

SEQ ID NO: 1679985 - RNA, 17 nt, Homo sapiens
aagccaaaaacaaacga

SEQ ID NO: 1679986 - RNA, 12 nt, Homo sapiens
aagccaggguuc

SEQ ID NO: 1679987 - RNA, 18 nt, Homo sapiens
aagccaguuuccacaggc

SEQ ID NO: 1679988 - RNA, 23 nt, Homo sapiens
aagccaugguguguguucagcuc

SEQ ID NO: 1679989 - RNA, 13 nt, Homo sapiens
aagcccucuucaa

SEQ ID NO: 1679990 - RNA, 23 nt, Homo sapiens
aagccucuggcuaccucuguccc

SEQ ID NO: 1679991 - RNA, 16 nt, Homo sapiens
aagccucugugcugca

SEQ ID NO: 1679992 - RNA, 20 nt, Homo sapiens
aagccuguguauaaaaaaga

SEQ ID NO: 1679993 - RNA, 15 nt, Homo sapiens
aagcguacaaaguga

SEQ ID NO: 1679994 - RNA, 21 nt, Homo sapiens
aagcucaguuaaaucccccac

SEQ ID NO: 1679995 - RNA, 19 nt, Homo sapiens
aagcugcagcuugggagag

SEQ ID NO: 1679996 - RNA, 20 nt, Homo sapiens
aagcugcucuccuucacucu

SEQ ID NO: 1679997 - RNA, 14 nt, Homo sapiens
aagcuggagugcag

SEQ ID NO: 1679998 - RNA, 16 nt, Homo sapiens
aagcugggagaaccaa

SEQ ID NO: 1679999 - RNA, 17 nt, Homo sapiens
aagcuggggauguuuag

SEQ ID NO: 1680000 - RNA, 15 nt, Homo sapiens
aagcugucacucaca

SEQ ID NO: 1680001 - RNA, 14 nt, Homo sapiens
aagcugucagggac

SEQ ID NO: 1680002 - RNA, 14 nt, Homo sapiens
aaggaaacaaagca

SEQ ID NO: 1680003 - RNA, 19 nt, Homo sapiens
aaggaagauguaagaagcu

SEQ ID NO: 1680004 - RNA, 18 nt, Homo sapiens
aaggaaggcuccaucucc

SEQ ID NO: 1680005 - RNA, 22 nt, Homo sapiens
aaggaaggcuccaucuccagug

SEQ ID NO: 1680006 - RNA, 15 nt, Homo sapiens
aaggagaaggcagga

SEQ ID NO: 1680007 - RNA, 20 nt, Homo sapiens
aaggaggcaugccucugaua

SEQ ID NO: 1680008 - RNA, 12 nt, Homo sapiens
aaggaucacuug

SEQ ID NO: 1680009 - RNA, 22 nt, Homo sapiens
aaggcaacccaaaugguggcca

SEQ ID NO: 1680010 - RNA, 23 nt, Homo sapiens
aaggcacccgcccuuuccuugcc

SEQ ID NO: 1680011 - RNA, 12 nt, Homo sapiens
aaggcagugcag

SEQ ID NO: 1680012 - RNA, 18 nt, Homo sapiens
aaggcagugcaguacuca

SEQ ID NO: 1680013 - RNA, 18 nt, Homo sapiens
aaggcagugcagugcuca

SEQ ID NO: 1680014 - RNA, 22 nt, Homo sapiens
aaggccaggaaaagaaagagcu

SEQ ID NO: 1680015 - RNA, 15 nt, Homo sapiens
aaggcccuuacaccc

SEQ ID NO: 1680016 - RNA, 21 nt, Homo sapiens
aaggccuuguuaaaauccaag

SEQ ID NO: 1680017 - RNA, 13 nt, Homo sapiens
aaggcuccaucuc

SEQ ID NO: 1680018 - RNA, 20 nt, Homo sapiens
aaggcugcuaaguggaagac

SEQ ID NO: 1680019 - RNA, 18 nt, Homo sapiens
aagggaaaaaagcaacuu

SEQ ID NO: 1680020 - RNA, 17 nt, Homo sapiens
aagggaagagcauguaa

SEQ ID NO: 1680021 - RNA, 20 nt, Homo sapiens
aagggaagcccugacaacaa

SEQ ID NO: 1680022 - RNA, 18 nt, Homo sapiens
aagggaccccagauaccu

SEQ ID NO: 1680023 - RNA, 21 nt, Homo sapiens
aagggaccccagauaccugug

SEQ ID NO: 1680024 - RNA, 17 nt, Homo sapiens
aagggcaggagcucaca

SEQ ID NO: 1680025 - RNA, 19 nt, Homo sapiens
aagggcaggagcucacacc

SEQ ID NO: 1680026 - RNA, 12 nt, Homo sapiens
augccuuuccag

SEQ ID NO: 1680027 - RNA, 19 nt, Homo sapiens
augcggaauuccaccugga

SEQ ID NO: 1680028 - RNA, 18 nt, Homo sapiens
augcuauggacugcacaa

SEQ ID NO: 1680029 - RNA, 13 nt, Homo sapiens
augcucaguauug

SEQ ID NO: 1680030 - RNA, 14 nt, Homo sapiens
augcuccuaaaaga

SEQ ID NO: 1680031 - RNA, 20 nt, Homo sapiens
augcugauuuaaacuucuua

SEQ ID NO: 1680032 - RNA, 20 nt, Homo sapiens
augcugccaaccagcuuguc

SEQ ID NO: 1680033 - RNA, 16 nt, Homo sapiens
augcugcgcuuaccuu

SEQ ID NO: 1680034 - RNA, 19 nt, Homo sapiens
augcuguuuuauauguaga

SEQ ID NO: 1680035 - RNA, 17 nt, Homo sapiens
augcuugguuguugcag

SEQ ID NO: 1680036 - RNA, 16 nt, Homo sapiens
augcuuucuccugaaa

SEQ ID NO: 1680037 - RNA, 17 nt, Homo sapiens
auggaaagguccugcug

SEQ ID NO: 1680038 - RNA, 15 nt, Homo sapiens
auggaaggccagcuu

SEQ ID NO: 1680039 - RNA, 16 nt, Homo sapiens
auggaagggccuucuc

SEQ ID NO: 1680040 - RNA, 18 nt, Homo sapiens
auggaagggccuucucca

SEQ ID NO: 1680041 - RNA, 16 nt, Homo sapiens
auggacaucagcauca

SEQ ID NO: 1680042 - RNA, 17 nt, Homo sapiens
auggacugcacaaaagu

SEQ ID NO: 1680043 - RNA, 14 nt, Homo sapiens
auggauccuuguca

SEQ ID NO: 1680044 - RNA, 13 nt, Homo sapiens
auggaucugcaua

SEQ ID NO: 1680045 - RNA, 23 nt, Homo sapiens
auggauggggguuaccuagcccu

SEQ ID NO: 1680046 - RNA, 18 nt, Homo sapiens
auggcacaugauaugagu

SEQ ID NO: 1680047 - RNA, 19 nt, Homo sapiens
auggccaggccucagggac

SEQ ID NO: 1680048 - RNA, 22 nt, Homo sapiens
auggccaggccucagggaccaa

SEQ ID NO: 1680049 - RNA, 12 nt, Homo sapiens
auggcugaagaa

SEQ ID NO: 1680050 - RNA, 18 nt, Homo sapiens
auggcugccaaugggagc

SEQ ID NO: 1680051 - RNA, 13 nt, Homo sapiens
augggacugagcc

SEQ ID NO: 1680052 - RNA, 21 nt, Homo sapiens
augggccaagccaggguucca

SEQ ID NO: 1680053 - RNA, 14 nt, Homo sapiens
augggggaugcuuc

SEQ ID NO: 1680054 - RNA, 21 nt, Homo sapiens
augguaugcuggccagcaccc

SEQ ID NO: 1680055 - RNA, 14 nt, Homo sapiens
auggucucucaccc

SEQ ID NO: 1680056 - RNA, 14 nt, Homo sapiens
auggugcgaucuca

SEQ ID NO: 1680057 - RNA, 20 nt, Homo sapiens
augguggcgggcgccuguag

SEQ ID NO: 1680058 - RNA, 13 nt, Homo sapiens
auggugggcucca

SEQ ID NO: 1680059 - RNA, 22 nt, Homo sapiens
auguaaaacacaagacugucau

SEQ ID NO: 1680060 - RNA, 21 nt, Homo sapiens
auguaacuuaauuauaagcua

SEQ ID NO: 1680061 - RNA, 20 nt, Homo sapiens
auguaauauauacauauuca

SEQ ID NO: 1680062 - RNA, 17 nt, Homo sapiens
auguacaauaaagcaau

SEQ ID NO: 1680063 - RNA, 20 nt, Homo sapiens
auguacaauaaagcaaugug

SEQ ID NO: 1680064 - RNA, 20 nt, Homo sapiens
auguagaauuauaacuaauu

SEQ ID NO: 1680065 - RNA, 19 nt, Homo sapiens
auguagcuucagucauuaa

SEQ ID NO: 1680066 - RNA, 21 nt, Homo sapiens
auguauguugcaugaauccau

SEQ ID NO: 1680067 - RNA, 20 nt, Homo sapiens
auguauuggauacgcuccag

SEQ ID NO: 1680068 - RNA, 19 nt, Homo sapiens
auguauuuguaguguuauu

SEQ ID NO: 1680069 - RNA, 18 nt, Homo sapiens
augucacaugacauccac

SEQ ID NO: 1680070 - RNA, 13 nt, Homo sapiens
augucccaaauaa

SEQ ID NO: 1680071 - RNA, 18 nt, Homo sapiens
augucuaaaauugucagu

SEQ ID NO: 1680072 - RNA, 23 nt, Homo sapiens
augucucuuguuaaaugagcuua

SEQ ID NO: 1680073 - RNA, 20 nt, Homo sapiens
augucugaaguuugccccag

SEQ ID NO: 1680074 - RNA, 11 nt, Homo sapiens
augucugugau

SEQ ID NO: 1680075 - RNA, 19 nt, Homo sapiens
augucuuuaaaaugauuca

SEQ ID NO: 1680076 - RNA, 13 nt, Homo sapiens
augugauacaaau

SEQ ID NO: 1680077 - RNA, 14 nt, Homo sapiens
augugauacaaauu

SEQ ID NO: 1680078 - RNA, 15 nt, Homo sapiens
augugauauguguaa

SEQ ID NO: 1680079 - RNA, 17 nt, Homo sapiens
augugauuuaugcauuu

SEQ ID NO: 1680080 - RNA, 21 nt, Homo sapiens
augugcuguugauucuuucaa

SEQ ID NO: 1680081 - RNA, 15 nt, Homo sapiens
augugcuugugugua

SEQ ID NO: 1680082 - RNA, 19 nt, Homo sapiens
auguggaaaacucacagau

SEQ ID NO: 1680083 - RNA, 19 nt, Homo sapiens
auguggaauuacauaacag

SEQ ID NO: 1680084 - RNA, 21 nt, Homo sapiens
auguggcacguaaggucucau

SEQ ID NO: 1680085 - RNA, 12 nt, Homo sapiens
auguguauauau

SEQ ID NO: 1680086 - RNA, 12 nt, Homo sapiens
augugucagcca

SEQ ID NO: 1680087 - RNA, 21 nt, Homo sapiens
auguguccgugaaaguuguga

SEQ ID NO: 1680088 - RNA, 12 nt, Homo sapiens
augugucuucaa

SEQ ID NO: 1680089 - RNA, 18 nt, Homo sapiens
aauacauaaaaaagggac

SEQ ID NO: 1680090 - RNA, 19 nt, Homo sapiens
aauacauaaaaaagggaca

SEQ ID NO: 1680091 - RNA, 16 nt, Homo sapiens
aauacaugccuuucca

SEQ ID NO: 1680092 - RNA, 15 nt, Homo sapiens
aauaccuacugcuga

SEQ ID NO: 1680093 - RNA, 22 nt, Homo sapiens
aauacuauuggacagacacaga

SEQ ID NO: 1680094 - RNA, 19 nt, Homo sapiens
aauacuugaaaacuucuca

SEQ ID NO: 1680095 - RNA, 14 nt, Homo sapiens
aauacuuugaacac

SEQ ID NO: 1680096 - RNA, 15 nt, Homo sapiens
aauagcaaaagugau

SEQ ID NO: 1680097 - RNA, 20 nt, Homo sapiens
aauagcuuaucuuucaaggu

SEQ ID NO: 1680098 - RNA, 15 nt, Homo sapiens
aauagucauauguga

SEQ ID NO: 1680099 - RNA, 16 nt, Homo sapiens
aauaguuccauucuau

SEQ ID NO: 1680100 - RNA, 18 nt, Homo sapiens
aauauacacuuuacauuc

SEQ ID NO: 1680101 - RNA, 21 nt, Homo sapiens
aauauaggguuuguuugcugc

SEQ ID NO: 1680102 - RNA, 17 nt, Homo sapiens
aauaucaagcagugaaa

SEQ ID NO: 1680103 - RNA, 13 nt, Homo sapiens
aauaucauuucau

SEQ ID NO: 1680104 - RNA, 23 nt, Homo sapiens
aauaucugugaaggacuugguga

SEQ ID NO: 1680105 - RNA, 22 nt, Homo sapiens
aauaucuucauuucuaaauuga

SEQ ID NO: 1680106 - RNA, 17 nt, Homo sapiens
aauauggaaacagagca

SEQ ID NO: 1680107 - RNA, 11 nt, Homo sapiens
aauaugggagg

SEQ ID NO: 1680108 - RNA, 16 nt, Homo sapiens
aauaugggaggaacaa

SEQ ID NO: 1680109 - RNA, 16 nt, Homo sapiens
aauauguguacacaua

SEQ ID NO: 1680110 - RNA, 19 nt, Homo sapiens
aauauguguacacauauga

SEQ ID NO: 1680111 - RNA, 14 nt, Homo sapiens
aauauuaagcacau

SEQ ID NO: 1680112 - RNA, 16 nt, Homo sapiens
aauauuauacuucuuu

SEQ ID NO: 1680113 - RNA, 12 nt, Homo sapiens
aauauugaucug

SEQ ID NO: 1680114 - RNA, 10 nt, Homo sapiens
aauauugcca

SEQ ID NO: 1680115 - RNA, 23 nt, Homo sapiens
aaucaaucuggcuucugcauuac

SEQ ID NO: 1680116 - RNA, 18 nt, Homo sapiens
aaucacacucucuucuua

SEQ ID NO: 1680117 - RNA, 12 nt, Homo sapiens
aaucagcacuga

SEQ ID NO: 1680118 - RNA, 18 nt, Homo sapiens
aaucaggaguucugccag

SEQ ID NO: 1680119 - RNA, 20 nt, Homo sapiens
aaucaggauuccuucuuccc

SEQ ID NO: 1680120 - RNA, 20 nt, Homo sapiens
aaucauaaauacugcuguau

SEQ ID NO: 1680121 - RNA, 15 nt, Homo sapiens
aaucaugggcauugc

SEQ ID NO: 1680122 - RNA, 17 nt, Homo sapiens
aaucauucuacugaaca

SEQ ID NO: 1680123 - RNA, 16 nt, Homo sapiens
aaucauugucagagau

SEQ ID NO: 1680124 - RNA, 17 nt, Homo sapiens
aauccaagcugcucauu

SEQ ID NO: 1680125 - RNA, 20 nt, Homo sapiens
aauccacaguauuguucuug

SEQ ID NO: 1680126 - RNA, 15 nt, Homo sapiens
aauccacgcucaauc

SEQ ID NO: 1680127 - RNA, 21 nt, Homo sapiens
aauccacgcucaaucucaggu

SEQ ID NO: 1680128 - RNA, 17 nt, Homo sapiens
aauccaggacagcauua

SEQ ID NO: 1680129 - RNA, 15 nt, Homo sapiens
aauccaugugcugcu

SEQ ID NO: 1680130 - RNA, 21 nt, Homo sapiens
aauccaugugcugcuguggca

SEQ ID NO: 1680131 - RNA, 18 nt, Homo sapiens
aaucccauuccugggcua

SEQ ID NO: 1680132 - RNA, 13 nt, Homo sapiens
aaucccucuaccu

SEQ ID NO: 1680133 - RNA, 16 nt, Homo sapiens
aauccgagcacuuugg

SEQ ID NO: 1680134 - RNA, 19 nt, Homo sapiens
aauccucccacuucagccu

SEQ ID NO: 1680135 - RNA, 17 nt, Homo sapiens
aaucuacaaacuuuuau

SEQ ID NO: 1680136 - RNA, 16 nt, Homo sapiens
aaucugggaccaaaac

SEQ ID NO: 1680137 - RNA, 20 nt, Homo sapiens
aaucuuuguuacucuguaaa

SEQ ID NO: 1680138 - RNA, 13 nt, Homo sapiens
aaugaaaacaguc

SEQ ID NO: 1680139 - RNA, 15 nt, Homo sapiens
aaugaaauacuugac

SEQ ID NO: 1680140 - RNA, 19 nt, Homo sapiens
aaugaaauauaaacuguga

SEQ ID NO: 1680141 - RNA, 15 nt, Homo sapiens
aaugaacuaacugcc

SEQ ID NO: 1680142 - RNA, 15 nt, Homo sapiens
aaugaaugacauuga

SEQ ID NO: 1680143 - RNA, 19 nt, Homo sapiens
aaugaauuuuuuccuacca

SEQ ID NO: 1680144 - RNA, 17 nt, Homo sapiens
aaugacaugcacugacc

SEQ ID NO: 1680145 - RNA, 20 nt, Homo sapiens
aaugacuuaagcacacuuga

SEQ ID NO: 1680146 - RNA, 15 nt, Homo sapiens
aaugauaauagcuca

SEQ ID NO: 1680147 - RNA, 17 nt, Homo sapiens
aaugauaugucuuuaaa

SEQ ID NO: 1680148 - RNA, 14 nt, Homo sapiens
aaugcuauggacug

SEQ ID NO: 1680149 - RNA, 17 nt, Homo sapiens
aaugcuauggacugcac

SEQ ID NO: 1680150 - RNA, 22 nt, Homo sapiens
caacuccaggguuaaagaaagg

SEQ ID NO: 1680151 - RNA, 10 nt, Homo sapiens
caacugauga

SEQ ID NO: 1680152 - RNA, 19 nt, Homo sapiens
caacugcccagagccacag

SEQ ID NO: 1680153 - RNA, 17 nt, Homo sapiens
caacugcuacugaccau

SEQ ID NO: 1680154 - RNA, 22 nt, Homo sapiens
caacuugaaauuauaucugugg

SEQ ID NO: 1680155 - RNA, 14 nt, Homo sapiens
caacuuuccaacuu

SEQ ID NO: 1680156 - RNA, 13 nt, Homo sapiens
caagaacucccuu

SEQ ID NO: 1680157 - RNA, 20 nt, Homo sapiens
caagagaccacuuccuuaac

SEQ ID NO: 1680158 - RNA, 23 nt, Homo sapiens
caagagcguucgugcagugcccu

SEQ ID NO: 1680159 - RNA, 12 nt, Homo sapiens
caagauagcucc

SEQ ID NO: 1680160 - RNA, 16 nt, Homo sapiens
caagauuguagaaacu

SEQ ID NO: 1680161 - RNA, 15 nt, Homo sapiens
caagcaaaaugcaaa

SEQ ID NO: 1680162 - RNA, 13 nt, Homo sapiens
caagcaagcaaaa

SEQ ID NO: 1680163 - RNA, 22 nt, Homo sapiens
caagcacgcacacacacgcaaa

SEQ ID NO: 1680164 - RNA, 13 nt, Homo sapiens
caagcaucagcaa

SEQ ID NO: 1680165 - RNA, 14 nt, Homo sapiens
caagcucuucauug

SEQ ID NO: 1680166 - RNA, 15 nt, Homo sapiens
caaggaaaauggaca

SEQ ID NO: 1680167 - RNA, 22 nt, Homo sapiens
caaggaccuggagauugugcuc

SEQ ID NO: 1680168 - RNA, 16 nt, Homo sapiens
caaggcaaggaagggu

SEQ ID NO: 1680169 - RNA, 18 nt, Homo sapiens
caaggcauugaaucucua

SEQ ID NO: 1680170 - RNA, 20 nt, Homo sapiens
caaggccaaaggaagcacau

SEQ ID NO: 1680171 - RNA, 19 nt, Homo sapiens
caagguccaguaauagcaa

SEQ ID NO: 1680172 - RNA, 17 nt, Homo sapiens
caaguaaaucuaucucu

SEQ ID NO: 1680173 - RNA, 14 nt, Homo sapiens
caaguaagggcaca

SEQ ID NO: 1680174 - RNA, 16 nt, Homo sapiens
caaguacuuugucuug

SEQ ID NO: 1680175 - RNA, 15 nt, Homo sapiens
caaguagcacacuga

SEQ ID NO: 1680176 - RNA, 17 nt, Homo sapiens
caaguagcugagacuac

SEQ ID NO: 1680177 - RNA, 19 nt, Homo sapiens
caagucugaguaguuauga

SEQ ID NO: 1680178 - RNA, 23 nt, Homo sapiens
caagucuuaguacauccucacuu

SEQ ID NO: 1680179 - RNA, 20 nt, Homo sapiens
caagugggucaauuccuuag

SEQ ID NO: 1680180 - RNA, 17 nt, Homo sapiens
caagugucaucacuuuu

SEQ ID NO: 1680181 - RNA, 16 nt, Homo sapiens
caaguuggagugcaau

SEQ ID NO: 1680182 - RNA, 17 nt, Homo sapiens
caaguuggagugcagug

SEQ ID NO: 1680183 - RNA, 15 nt, Homo sapiens
caauaaagcaaugug

SEQ ID NO: 1680184 - RNA, 15 nt, Homo sapiens
caauaagaaacaguu

SEQ ID NO: 1680185 - RNA, 17 nt, Homo sapiens
caauaaggauuuauucu

SEQ ID NO: 1680186 - RNA, 16 nt, Homo sapiens
caauaaggcagugcag

SEQ ID NO: 1680187 - RNA, 15 nt, Homo sapiens
caauaaugugugaga

SEQ ID NO: 1680188 - RNA, 23 nt, Homo sapiens
caauacaaaaauaccuacugcug

SEQ ID NO: 1680189 - RNA, 13 nt, Homo sapiens
caauacaguacuc

SEQ ID NO: 1680190 - RNA, 22 nt, Homo sapiens
caauacauuauuggacuuccau

SEQ ID NO: 1680191 - RNA, 13 nt, Homo sapiens
caauacccacugc

SEQ ID NO: 1680192 - RNA, 14 nt, Homo sapiens
caauacccuuguga

SEQ ID NO: 1680193 - RNA, 20 nt, Homo sapiens
caaucacaaaaguauauuca

SEQ ID NO: 1680194 - RNA, 16 nt, Homo sapiens
caaucagaucaacucu

SEQ ID NO: 1680195 - RNA, 19 nt, Homo sapiens
caaucucggcucacugcaa

SEQ ID NO: 1680196 - RNA, 12 nt, Homo sapiens
caaucuugcccu

SEQ ID NO: 1680197 - RNA, 15 nt, Homo sapiens
caaugacaauggugc

SEQ ID NO: 1680198 - RNA, 23 nt, Homo sapiens
caaugcaucugaaaguuuugaua

SEQ ID NO: 1680199 - RNA, 20 nt, Homo sapiens
caaugccugccugaacaaag

SEQ ID NO: 1680200 - RNA, 23 nt, Homo sapiens
caaugcucaguaacacagugcag

SEQ ID NO: 1680201 - RNA, 16 nt, Homo sapiens
caauggugcgaucuca

SEQ ID NO: 1680202 - RNA, 16 nt, Homo sapiens
caaugugaaacugaga

SEQ ID NO: 1680203 - RNA, 23 nt, Homo sapiens
caaugugauauguguaauaucau

SEQ ID NO: 1680204 - RNA, 19 nt, Homo sapiens
caauguuccguucaucuga

SEQ ID NO: 1680205 - RNA, 18 nt, Homo sapiens
caauuaaguccuacuuua

SEQ ID NO: 1680206 - RNA, 21 nt, Homo sapiens
caauuaauggaaaacuguuaa

SEQ ID NO: 1680207 - RNA, 13 nt, Homo sapiens
caauuacugugag

SEQ ID NO: 1680208 - RNA, 16 nt, Homo sapiens
caauuaucaaaaaaca

SEQ ID NO: 1680209 - RNA, 23 nt, Homo sapiens
caauuauggagugucaccagcug

SEQ ID NO: 1680210 - RNA, 21 nt, Homo sapiens
caauucaucucagcaaucaca

SEQ ID NO: 1680211 - RNA, 14 nt, Homo sapiens
caauuuucuauuua

SEQ ID NO: 1680212 - RNA, 17 nt, Homo sapiens
cacaaaagucucaaugu

SEQ ID NO: 1680213 - RNA, 19 nt, Homo sapiens
cacaaaccacaacugacac

SEQ ID NO: 1680214 - RNA, 19 nt, Homo sapiens
ucuaguuguggacuuuucc

SEQ ID NO: 1680215 - RNA, 15 nt, Homo sapiens
ucuaucaaagcacau

SEQ ID NO: 1680216 - RNA, 16 nt, Homo sapiens
ucuauggauucacuuc

SEQ ID NO: 1680217 - RNA, 16 nt, Homo sapiens
ucuaugucucaugaug

SEQ ID NO: 1680218 - RNA, 18 nt, Homo sapiens
ucuauugaguguacauuu

SEQ ID NO: 1680219 - RNA, 15 nt, Homo sapiens
ucuauuucaacuuca

SEQ ID NO: 1680220 - RNA, 21 nt, Homo sapiens
ucuauuuuaguuaacuaugau

SEQ ID NO: 1680221 - RNA, 21 nt, Homo sapiens
ucucaaaauaaaaccagaaag

SEQ ID NO: 1680222 - RNA, 14 nt, Homo sapiens
ucucaaaccuggca

SEQ ID NO: 1680223 - RNA, 20 nt, Homo sapiens
ucucaaagauuugacaugcu

SEQ ID NO: 1680224 - RNA, 17 nt, Homo sapiens
ucucaaaguaaggguuu

SEQ ID NO: 1680225 - RNA, 16 nt, Homo sapiens
ucucaacuuacauaug

SEQ ID NO: 1680226 - RNA, 17 nt, Homo sapiens
ucucaacuuacauaugu

SEQ ID NO: 1680227 - RNA, 12 nt, Homo sapiens
ucucaagugcca

SEQ ID NO: 1680228 - RNA, 13 nt, Homo sapiens
ucucaagugccau

SEQ ID NO: 1680229 - RNA, 14 nt, Homo sapiens
ucucaagugccaua

SEQ ID NO: 1680230 - RNA, 18 nt, Homo sapiens
ucucacgauuccagugca

SEQ ID NO: 1680231 - RNA, 21 nt, Homo sapiens
ucucacugacuucucccgggu

SEQ ID NO: 1680232 - RNA, 17 nt, Homo sapiens
ucucagcaaggaacauc

SEQ ID NO: 1680233 - RNA, 15 nt, Homo sapiens
ucucagcaaucacaa

SEQ ID NO: 1680234 - RNA, 12 nt, Homo sapiens
ucucagcacuuu

SEQ ID NO: 1680235 - RNA, 18 nt, Homo sapiens
ucucagcgcaacagcugu

SEQ ID NO: 1680236 - RNA, 13 nt, Homo sapiens
ucucagcucacua

SEQ ID NO: 1680237 - RNA, 20 nt, Homo sapiens
ucucaggaccacccugccaa

SEQ ID NO: 1680238 - RNA, 21 nt, Homo sapiens
ucucaggaccacccugccaag

SEQ ID NO: 1680239 - RNA, 14 nt, Homo sapiens
ucucagucccugac

SEQ ID NO: 1680240 - RNA, 17 nt, Homo sapiens
ucucauaccucugacca

SEQ ID NO: 1680241 - RNA, 16 nt, Homo sapiens
ucucaucuaguuugau

SEQ ID NO: 1680242 - RNA, 21 nt, Homo sapiens
ucucaugguauuaucuaguag

SEQ ID NO: 1680243 - RNA, 17 nt, Homo sapiens
ucuccagcccugcagcu

SEQ ID NO: 1680244 - RNA, 13 nt, Homo sapiens
ucuccccucagcc

SEQ ID NO: 1680245 - RNA, 16 nt, Homo sapiens
ucuccccuccaaguga

SEQ ID NO: 1680246 - RNA, 14 nt, Homo sapiens
ucucccuucauccu

SEQ ID NO: 1680247 - RNA, 21 nt, Homo sapiens
ucuccuaagcuggagugcagu

SEQ ID NO: 1680248 - RNA, 20 nt, Homo sapiens
ucuccucugcagcucaggga

SEQ ID NO: 1680249 - RNA, 13 nt, Homo sapiens
ucuccucugucag

SEQ ID NO: 1680250 - RNA, 19 nt, Homo sapiens
ucuccuggucgcuuugcca

SEQ ID NO: 1680251 - RNA, 23 nt, Homo sapiens
ucucuccaucuaccuuccaguca

SEQ ID NO: 1680252 - RNA, 16 nt, Homo sapiens
ucucuccccauauaua

SEQ ID NO: 1680253 - RNA, 14 nt, Homo sapiens
ucucucccuacccu

SEQ ID NO: 1680254 - RNA, 14 nt, Homo sapiens
ucucucgugauuga

SEQ ID NO: 1680255 - RNA, 16 nt, Homo sapiens
ucucugaaccagagaa

SEQ ID NO: 1680256 - RNA, 20 nt, Homo sapiens
ucucugaacugcaacacugg

SEQ ID NO: 1680257 - RNA, 15 nt, Homo sapiens
ucucugaugcacugu

SEQ ID NO: 1680258 - RNA, 16 nt, Homo sapiens
ucucugucuggcugua

SEQ ID NO: 1680259 - RNA, 15 nt, Homo sapiens
ucugaaugacaucaa

SEQ ID NO: 1680260 - RNA, 16 nt, Homo sapiens
ucugacgcaaaaccac

SEQ ID NO: 1680261 - RNA, 12 nt, Homo sapiens
ucugagacagaa

SEQ ID NO: 1680262 - RNA, 16 nt, Homo sapiens
ucugauacaucuguca

SEQ ID NO: 1680263 - RNA, 13 nt, Homo sapiens
ucugcauaagauu

SEQ ID NO: 1680264 - RNA, 13 nt, Homo sapiens
ucugccauuucau

SEQ ID NO: 1680265 - RNA, 16 nt, Homo sapiens
ucugccccuccguccc

SEQ ID NO: 1680266 - RNA, 14 nt, Homo sapiens
ucugccucacauca

SEQ ID NO: 1680267 - RNA, 20 nt, Homo sapiens
ucugccucccagguucaagu

SEQ ID NO: 1680268 - RNA, 19 nt, Homo sapiens
ucugcgccgagccucagaa

SEQ ID NO: 1680269 - RNA, 17 nt, Homo sapiens
ucugcuaugucugugau

SEQ ID NO: 1680270 - RNA, 13 nt, Homo sapiens
ucugcuccaugca

SEQ ID NO: 1680271 - RNA, 18 nt, Homo sapiens
ucugcuucucuuucacaa

SEQ ID NO: 1680272 - RNA, 16 nt, Homo sapiens
ucuggacagaugggug

SEQ ID NO: 1680273 - RNA, 14 nt, Homo sapiens
ucuggagcugaagc

SEQ ID NO: 1680274 - RNA, 16 nt, Homo sapiens
ucuggcauuauaaaga

SEQ ID NO: 1680275 - RNA, 23 nt, Homo sapiens
ucuggcauuauaaagaacagcug

SEQ ID NO: 1680276 - RNA, 20 nt, Homo sapiens
ucagggcaagcucauagcac

SEQ ID NO: 1680277 - RNA, 20 nt, Homo sapiens
ucagggggcaugaagcacau

SEQ ID NO: 1680278 - RNA, 19 nt, Homo sapiens
ucagguuaaauuaaaccaa

SEQ ID NO: 1680279 - RNA, 20 nt, Homo sapiens
ucaguaaaauuauacugugu

SEQ ID NO: 1680280 - RNA, 15 nt, Homo sapiens
ucaguaacacagugc

SEQ ID NO: 1680281 - RNA, 18 nt, Homo sapiens
ucaguaacacagugcagu

SEQ ID NO: 1680282 - RNA, 13 nt, Homo sapiens
ucaguaaggcagu

SEQ ID NO: 1680283 - RNA, 17 nt, Homo sapiens
ucaguaaggcagugcag

SEQ ID NO: 1680284 - RNA, 19 nt, Homo sapiens
ucaguaaggcagugcagua

SEQ ID NO: 1680285 - RNA, 22 nt, Homo sapiens
ucaguaauuccgacuuucucag

SEQ ID NO: 1680286 - RNA, 16 nt, Homo sapiens
ucaguccacugcugag

SEQ ID NO: 1680287 - RNA, 17 nt, Homo sapiens
ucagugaagcccaggag

SEQ ID NO: 1680288 - RNA, 17 nt, Homo sapiens
ucaguuaggcagugcag

SEQ ID NO: 1680289 - RNA, 18 nt, Homo sapiens
ucaguuaggcagugcagu

SEQ ID NO: 1680290 - RNA, 17 nt, Homo sapiens
ucaguucauggcaucac

SEQ ID NO: 1680291 - RNA, 21 nt, Homo sapiens
ucaguucauggcaucacaucu

SEQ ID NO: 1680292 - RNA, 13 nt, Homo sapiens
ucaguuggugcug

SEQ ID NO: 1680293 - RNA, 12 nt, Homo sapiens
ucaguuugcuaa

SEQ ID NO: 1680294 - RNA, 22 nt, Homo sapiens
ucauaacuagaguauguguaug

SEQ ID NO: 1680295 - RNA, 14 nt, Homo sapiens
ucauaaugacuuaa

SEQ ID NO: 1680296 - RNA, 24 nt, Homo sapiens
ucauacaaaggacaguacacacuu

SEQ ID NO: 1680297 - RNA, 19 nt, Homo sapiens
ucauacauuagugccauag

SEQ ID NO: 1680298 - RNA, 23 nt, Homo sapiens
ucauaccauccaucccuggugaa

SEQ ID NO: 1680299 - RNA, 20 nt, Homo sapiens
ucauaccucugaccaacagg

SEQ ID NO: 1680300 - RNA, 17 nt, Homo sapiens
ucauaccuucugaugaa

SEQ ID NO: 1680301 - RNA, 17 nt, Homo sapiens
ucauaucuguaugccuc

SEQ ID NO: 1680302 - RNA, 15 nt, Homo sapiens
ucaucagaaacaauu

SEQ ID NO: 1680303 - RNA, 18 nt, Homo sapiens
ucauccauagacacagua

SEQ ID NO: 1680304 - RNA, 21 nt, Homo sapiens
ucauccauagacacaguauug

SEQ ID NO: 1680305 - RNA, 19 nt, Homo sapiens
ucauccucuuauaugugcc

SEQ ID NO: 1680306 - RNA, 16 nt, Homo sapiens
ucaucucccggugccu

SEQ ID NO: 1680307 - RNA, 12 nt, Homo sapiens
ucaucuugccuc

SEQ ID NO: 1680308 - RNA, 20 nt, Homo sapiens
ucaugauguauuguugcuuu

SEQ ID NO: 1680309 - RNA, 22 nt, Homo sapiens
ucaugcccagcuuggagugcca

SEQ ID NO: 1680310 - RNA, 13 nt, Homo sapiens
ucauggcaucaca

SEQ ID NO: 1680311 - RNA, 17 nt, Homo sapiens
ucaugugauuuacccuu

SEQ ID NO: 1680312 - RNA, 20 nt, Homo sapiens
ucauguucuugcagucauca

SEQ ID NO: 1680313 - RNA, 15 nt, Homo sapiens
ucauguuuugcuaau

SEQ ID NO: 1680314 - RNA, 19 nt, Homo sapiens
ucauuauuuuucacugccc

SEQ ID NO: 1680315 - RNA, 17 nt, Homo sapiens
ucauucuucuaaaacua

SEQ ID NO: 1680316 - RNA, 12 nt, Homo sapiens
ucauucuuuaua

SEQ ID NO: 1680317 - RNA, 23 nt, Homo sapiens
ucauuggggugguugucauguga

SEQ ID NO: 1680318 - RNA, 23 nt, Homo sapiens
ucauuuauuggcuuaaguaugcu

SEQ ID NO: 1680319 - RNA, 23 nt, Homo sapiens
ucauuuuugcuuuucaaaugaca

SEQ ID NO: 1680320 - RNA, 13 nt, Homo sapiens
uccaaaagccagu

SEQ ID NO: 1680321 - RNA, 23 nt, Homo sapiens
uccaaaauagucauguuucugca

SEQ ID NO: 1680322 - RNA, 19 nt, Homo sapiens
uccaacuggaaggcuuuau

SEQ ID NO: 1680323 - RNA, 16 nt, Homo sapiens
uccaacuuucccucca

SEQ ID NO: 1680324 - RNA, 19 nt, Homo sapiens
uccaagaagccagcaccac

SEQ ID NO: 1680325 - RNA, 17 nt, Homo sapiens
uccaagaauguaucaau

SEQ ID NO: 1680326 - RNA, 21 nt, Homo sapiens
uccaaggcaaauguccaagca

SEQ ID NO: 1680327 - RNA, 19 nt, Homo sapiens
uccaaguugccacauugcu

SEQ ID NO: 1680328 - RNA, 17 nt, Homo sapiens
uccaauacauugaacac

SEQ ID NO: 1680329 - RNA, 13 nt, Homo sapiens
uccaaucagguag

SEQ ID NO: 1680330 - RNA, 19 nt, Homo sapiens
uccaauuggguugugaaau

SEQ ID NO: 1680331 - RNA, 19 nt, Homo sapiens
uccaauuuuguugcaucau

SEQ ID NO: 1680332 - RNA, 14 nt, Homo sapiens
uccacacgccaagc

SEQ ID NO: 1680333 - RNA, 17 nt, Homo sapiens
uccacaguuaggccaag

SEQ ID NO: 1680334 - RNA, 16 nt, Homo sapiens
uccaccaccuugccaa

SEQ ID NO: 1680335 - RNA, 12 nt, Homo sapiens
uccugacuguuc

SEQ ID NO: 1680336 - RNA, 13 nt, Homo sapiens
uccugagaaggcc

SEQ ID NO: 1680337 - RNA, 15 nt, Homo sapiens
uccugaugggaacag

SEQ ID NO: 1680338 - RNA, 15 nt, Homo sapiens
uccugccuucaugga

SEQ ID NO: 1680339 - RNA, 16 nt, Homo sapiens
uccugccuucauggaa

SEQ ID NO: 1680340 - RNA, 23 nt, Homo sapiens
uccugcugcucgggaaggccuga

SEQ ID NO: 1680341 - RNA, 17 nt, Homo sapiens
uccuggagaguaucuga

SEQ ID NO: 1680342 - RNA, 21 nt, Homo sapiens
uccuggagaguaucugagaac

SEQ ID NO: 1680343 - RNA, 19 nt, Homo sapiens
uccugggauuacaggugug

SEQ ID NO: 1680344 - RNA, 19 nt, Homo sapiens
uccugggugcugucaugcc

SEQ ID NO: 1680345 - RNA, 18 nt, Homo sapiens
uccuguguguggaaggca

SEQ ID NO: 1680346 - RNA, 16 nt, Homo sapiens
uccuguguuccuguga

SEQ ID NO: 1680347 - RNA, 19 nt, Homo sapiens
uccuguguuccugugaucu

SEQ ID NO: 1680348 - RNA, 19 nt, Homo sapiens
uccuguucgugcuuguaau

SEQ ID NO: 1680349 - RNA, 22 nt, Homo sapiens
uccuguucgugcuuguaaugcu

SEQ ID NO: 1680350 - RNA, 17 nt, Homo sapiens
uccuuaacagcuguauu

SEQ ID NO: 1680351 - RNA, 18 nt, Homo sapiens
uccuuagcuaguuagcuc

SEQ ID NO: 1680352 - RNA, 11 nt, Homo sapiens
uccuucuuccc

SEQ ID NO: 1680353 - RNA, 15 nt, Homo sapiens
uccuugaaaccagcu

SEQ ID NO: 1680354 - RNA, 16 nt, Homo sapiens
uccuuggcaccaaaga

SEQ ID NO: 1680355 - RNA, 14 nt, Homo sapiens
uccuuuauugucca

SEQ ID NO: 1680356 - RNA, 15 nt, Homo sapiens
uccuuuauuguccau

SEQ ID NO: 1680357 - RNA, 21 nt, Homo sapiens
uccuuuccugaucacuaugca

SEQ ID NO: 1680358 - RNA, 19 nt, Homo sapiens
ucgccaaguuggagugcaa

SEQ ID NO: 1680359 - RNA, 15 nt, Homo sapiens
ucgccacugcacucc

SEQ ID NO: 1680360 - RNA, 18 nt, Homo sapiens
ucgccgggccauucugau

SEQ ID NO: 1680361 - RNA, 19 nt, Homo sapiens
ucgccuuuugacagcugug

SEQ ID NO: 1680362 - RNA, 15 nt, Homo sapiens
ucgcucugucuuucc

SEQ ID NO: 1680363 - RNA, 13 nt, Homo sapiens
ucgcuuugccauc

SEQ ID NO: 1680364 - RNA, 17 nt, Homo sapiens
ucggaauucccugaguc

SEQ ID NO: 1680365 - RNA, 12 nt, Homo sapiens
ucggaguccaaa

SEQ ID NO: 1680366 - RNA, 15 nt, Homo sapiens
ucggccuggcuucac

SEQ ID NO: 1680367 - RNA, 15 nt, Homo sapiens
ucgguggcauuugcu

SEQ ID NO: 1680368 - RNA, 21 nt, Homo sapiens
ucguagguugugaugauagca

SEQ ID NO: 1680369 - RNA, 20 nt, Homo sapiens
ucguccuuagaauacuguau

SEQ ID NO: 1680370 - RNA, 19 nt, Homo sapiens
ucgugcgacaggcauuuag

SEQ ID NO: 1680371 - RNA, 16 nt, Homo sapiens
ucguguuucacagugg

SEQ ID NO: 1680372 - RNA, 18 nt, Homo sapiens
ucguuucacaucuguaua

SEQ ID NO: 1680373 - RNA, 22 nt, Homo sapiens
ucuaaacaaaaaaaggcgguga

SEQ ID NO: 1680374 - RNA, 14 nt, Homo sapiens
ucuaaacuuucccu

SEQ ID NO: 1680375 - RNA, 21 nt, Homo sapiens
ucuaaagcagagauguauuau

SEQ ID NO: 1680376 - RNA, 15 nt, Homo sapiens
ucuaaccuuucuaac

SEQ ID NO: 1680377 - RNA, 14 nt, Homo sapiens
ucuaacuuggggaa

SEQ ID NO: 1680378 - RNA, 14 nt, Homo sapiens
ucuaagacaaaugc

SEQ ID NO: 1680379 - RNA, 15 nt, Homo sapiens
ucuaagacaaaugca

SEQ ID NO: 1680380 - RNA, 16 nt, Homo sapiens
ucuaagacaaaugcag

SEQ ID NO: 1680381 - RNA, 17 nt, Homo sapiens
ucuaauaaacacagauu

SEQ ID NO: 1680382 - RNA, 11 nt, Homo sapiens
ucuaauaaccu

SEQ ID NO: 1680383 - RNA, 16 nt, Homo sapiens
ucuaauccaugugcug

SEQ ID NO: 1680384 - RNA, 21 nt, Homo sapiens
ucuaauccaugugcugcugug

SEQ ID NO: 1680385 - RNA, 15 nt, Homo sapiens
ucuacaauacaacac

SEQ ID NO: 1680386 - RNA, 18 nt, Homo sapiens
ucuacacauauaaacaca

SEQ ID NO: 1680387 - RNA, 13 nt, Homo sapiens
ucuacacugccuu

SEQ ID NO: 1680388 - RNA, 16 nt, Homo sapiens
ucuacacugccuuugu

SEQ ID NO: 1680389 - RNA, 17 nt, Homo sapiens
ucuacauccaauguaug

SEQ ID NO: 1680390 - RNA, 13 nt, Homo sapiens
ucuacaugcaaau

SEQ ID NO: 1680391 - RNA, 23 nt, Homo sapiens
ucuacauguuuuagacagagaca

SEQ ID NO: 1680392 - RNA, 17 nt, Homo sapiens
ucuaccagagauuuucc

SEQ ID NO: 1680393 - RNA, 13 nt, Homo sapiens
ucuaccauuacca

SEQ ID NO: 1680394 - RNA, 22 nt, Homo sapiens
ucuacuagaaccuucuaaucca

SEQ ID NO: 1680395 - RNA, 18 nt, Homo sapiens
ucuacuuuaaauugugga

SEQ ID NO: 1680396 - RNA, 11 nt, Homo sapiens
ucuagugcagg

SEQ ID NO: 1680397 - RNA, 14 nt, Homo sapiens
ucuaguggccuuag

SEQ ID NO: 1680398 - RNA, 23 nt, Homo sapiens
gagccuccugcccuuaccugcca

SEQ ID NO: 1680399 - RNA, 15 nt, Homo sapiens
gagccuggcacagga

SEQ ID NO: 1680400 - RNA, 16 nt, Homo sapiens
gagccuggcacaggac

SEQ ID NO: 1680401 - RNA, 13 nt, Homo sapiens
gagcggcuucccc

SEQ ID NO: 1680402 - RNA, 14 nt, Homo sapiens
gagcguguacuacc

SEQ ID NO: 1680403 - RNA, 13 nt, Homo sapiens
gagcucacaccgc

SEQ ID NO: 1680404 - RNA, 11 nt, Homo sapiens
gagcucaccag

SEQ ID NO: 1680405 - RNA, 21 nt, Homo sapiens
gagcugacccccugcugccau

SEQ ID NO: 1680406 - RNA, 19 nt, Homo sapiens
gagcuugggugcauuugcc

SEQ ID NO: 1680407 - RNA, 17 nt, Homo sapiens
gaggaaaauaguggcag

SEQ ID NO: 1680408 - RNA, 13 nt, Homo sapiens
gaggaaccucaaa

SEQ ID NO: 1680409 - RNA, 15 nt, Homo sapiens
gaggacagaaccaac

SEQ ID NO: 1680410 - RNA, 22 nt, Homo sapiens
gaggaccaggugucucugagaa

SEQ ID NO: 1680411 - RNA, 13 nt, Homo sapiens
gaggacuggagag

SEQ ID NO: 1680412 - RNA, 17 nt, Homo sapiens
gaggacugguugucucu

SEQ ID NO: 1680413 - RNA, 17 nt, Homo sapiens
gaggacuguuggcugau

SEQ ID NO: 1680414 - RNA, 22 nt, Homo sapiens
gaggagcaggugucccugagaa

SEQ ID NO: 1680415 - RNA, 23 nt, Homo sapiens
gaggagcaggugucccugagaac

SEQ ID NO: 1680416 - RNA, 14 nt, Homo sapiens
gaggagcccucauc

SEQ ID NO: 1680417 - RNA, 14 nt, Homo sapiens
gaggauuucugcuu

SEQ ID NO: 1680418 - RNA, 15 nt, Homo sapiens
gaggcagaauggugg

SEQ ID NO: 1680419 - RNA, 16 nt, Homo sapiens
gaggcaggagaauggc

SEQ ID NO: 1680420 - RNA, 21 nt, Homo sapiens
gaggcucuaauguacaauaaa

SEQ ID NO: 1680421 - RNA, 17 nt, Homo sapiens
gaggcuggaccaacugc

SEQ ID NO: 1680422 - RNA, 20 nt, Homo sapiens
gaggcugggccccugggaug

SEQ ID NO: 1680423 - RNA, 23 nt, Homo sapiens
gaggcuuguggccacaguggcac

SEQ ID NO: 1680424 - RNA, 17 nt, Homo sapiens
gagggaagcaccaugaa

SEQ ID NO: 1680425 - RNA, 14 nt, Homo sapiens
gagggaagggcugg

SEQ ID NO: 1680426 - RNA, 20 nt, Homo sapiens
gagggacaacgaacauggca

SEQ ID NO: 1680427 - RNA, 13 nt, Homo sapiens
gagggacugccuc

SEQ ID NO: 1680428 - RNA, 23 nt, Homo sapiens
gagggauccaccgccacacuggc

SEQ ID NO: 1680429 - RNA, 19 nt, Homo sapiens
gagguggagcuugcaguga

SEQ ID NO: 1680430 - RNA, 23 nt, Homo sapiens
gaguauggauugaaggauuguga

SEQ ID NO: 1680431 - RNA, 22 nt, Homo sapiens
gaguauguguauguacuuacau

SEQ ID NO: 1680432 - RNA, 14 nt, Homo sapiens
gagucaccuuccag

SEQ ID NO: 1680433 - RNA, 13 nt, Homo sapiens
gagucaugaugaa

SEQ ID NO: 1680434 - RNA, 19 nt, Homo sapiens
gaguccagacaccaucacc

SEQ ID NO: 1680435 - RNA, 18 nt, Homo sapiens
gagucgaccccaagcgac

SEQ ID NO: 1680436 - RNA, 16 nt, Homo sapiens
gagucugagaaagccu

SEQ ID NO: 1680437 - RNA, 22 nt, Homo sapiens
gagucuuccaaaccaccuuccc

SEQ ID NO: 1680438 - RNA, 21 nt, Homo sapiens
gagucuuugauucaccaaaca

SEQ ID NO: 1680439 - RNA, 19 nt, Homo sapiens
gagugcaguggcgugaucu

SEQ ID NO: 1680440 - RNA, 19 nt, Homo sapiens
gaguuuaugggaaugccuu

SEQ ID NO: 1680441 - RNA, 19 nt, Homo sapiens
gauaaaaagaaaguuuaua

SEQ ID NO: 1680442 - RNA, 15 nt, Homo sapiens
gauaaauaauaaagg

SEQ ID NO: 1680443 - RNA, 16 nt, Homo sapiens
gauaaaucaugggcau

SEQ ID NO: 1680444 - RNA, 18 nt, Homo sapiens
gauaaauuugacuguuau

SEQ ID NO: 1680445 - RNA, 19 nt, Homo sapiens
gauaacucuguacgaggcu

SEQ ID NO: 1680446 - RNA, 21 nt, Homo sapiens
gauaaugcauaaauguuauau

SEQ ID NO: 1680447 - RNA, 13 nt, Homo sapiens
gauaauuacuuuc

SEQ ID NO: 1680448 - RNA, 14 nt, Homo sapiens
gauacccaucccau

SEQ ID NO: 1680449 - RNA, 20 nt, Homo sapiens
gauacccaucccauaugccu

SEQ ID NO: 1680450 - RNA, 17 nt, Homo sapiens
gauaccuuccaucucaa

SEQ ID NO: 1680451 - RNA, 23 nt, Homo sapiens
gauacuaauaggugugugaggcu

SEQ ID NO: 1680452 - RNA, 13 nt, Homo sapiens
gauauaagccaua

SEQ ID NO: 1680453 - RNA, 20 nt, Homo sapiens
gauauaauucuuaugccaua

SEQ ID NO: 1680454 - RNA, 16 nt, Homo sapiens
gauaucaggaaauauc

SEQ ID NO: 1680455 - RNA, 20 nt, Homo sapiens
gauaucgccacugcacucca

SEQ ID NO: 1680456 - RNA, 16 nt, Homo sapiens
gauaugggacugagcc

SEQ ID NO: 1680457 - RNA, 19 nt, Homo sapiens
gauauucuaagaaauaucu

SEQ ID NO: 1680458 - RNA, 15 nt, Homo sapiens
gaucacuaugcauuu

SEQ ID NO: 1680459 - RNA, 15 nt, Homo sapiens
gaucagaauguuuca

SEQ ID NO: 1680460 - RNA, 22 nt, Homo sapiens
gaaugaaauauaaacugugaga

SEQ ID NO: 1680461 - RNA, 13 nt, Homo sapiens
gaaugacauugaa

SEQ ID NO: 1680462 - RNA, 20 nt, Homo sapiens
gaaugauaauggaaacuguc

SEQ ID NO: 1680463 - RNA, 11 nt, Homo sapiens
gaaugugauuu

SEQ ID NO: 1680464 - RNA, 20 nt, Homo sapiens
gaauguguuauuugucacaa

SEQ ID NO: 1680465 - RNA, 22 nt, Homo sapiens
gaauuaaagucuacacugccuu

SEQ ID NO: 1680466 - RNA, 13 nt, Homo sapiens
gaauuacauaaca

SEQ ID NO: 1680467 - RNA, 20 nt, Homo sapiens
gaauucucagcagagcucaa

SEQ ID NO: 1680468 - RNA, 17 nt, Homo sapiens
gaauucugcccuggaca

SEQ ID NO: 1680469 - RNA, 19 nt, Homo sapiens
gaauucuuaaauaugugga

SEQ ID NO: 1680470 - RNA, 13 nt, Homo sapiens
gaauucuucucaa

SEQ ID NO: 1680471 - RNA, 20 nt, Homo sapiens
gaauugaaccgucaauguga

SEQ ID NO: 1680472 - RNA, 16 nt, Homo sapiens
gaauuuaucugugaau

SEQ ID NO: 1680473 - RNA, 21 nt, Homo sapiens
gaauuugaagaauuaaugaca

SEQ ID NO: 1680474 - RNA, 20 nt, Homo sapiens
gaauuugucggguucuccca

SEQ ID NO: 1680475 - RNA, 22 nt, Homo sapiens
gaauuuuuuuuuuuaagcucaa

SEQ ID NO: 1680476 - RNA, 13 nt, Homo sapiens
gacaaaaugcaaa

SEQ ID NO: 1680477 - RNA, 13 nt, Homo sapiens
gacaaaaugcaga

SEQ ID NO: 1680478 - RNA, 20 nt, Homo sapiens
gacaaaggccuuaacaaacg

SEQ ID NO: 1680479 - RNA, 20 nt, Homo sapiens
gacaaaugggccugccaaac

SEQ ID NO: 1680480 - RNA, 11 nt, Homo sapiens
gacaacaggca

SEQ ID NO: 1680481 - RNA, 16 nt, Homo sapiens
gacaagcauguugauu

SEQ ID NO: 1680482 - RNA, 18 nt, Homo sapiens
gacaaguggggucuuuca

SEQ ID NO: 1680483 - RNA, 15 nt, Homo sapiens
gacaauaaaauggaa

SEQ ID NO: 1680484 - RNA, 11 nt, Homo sapiens
gacacaacuca

SEQ ID NO: 1680485 - RNA, 20 nt, Homo sapiens
gacacagaggacggcuuccc

SEQ ID NO: 1680486 - RNA, 14 nt, Homo sapiens
gacacagugcccaa

SEQ ID NO: 1680487 - RNA, 13 nt, Homo sapiens
gacaccaccaagg

SEQ ID NO: 1680488 - RNA, 14 nt, Homo sapiens
gacaccaccacugu

SEQ ID NO: 1680489 - RNA, 17 nt, Homo sapiens
gacaccaccacuguguc

SEQ ID NO: 1680490 - RNA, 20 nt, Homo sapiens
gacaccagaguguaugcaua

SEQ ID NO: 1680491 - RNA, 16 nt, Homo sapiens
gacaccaucaccacgc

SEQ ID NO: 1680492 - RNA, 22 nt, Homo sapiens
gacacgugcaacagacugccuu

SEQ ID NO: 1680493 - RNA, 15 nt, Homo sapiens
gacacguucuugcca

SEQ ID NO: 1680494 - RNA, 22 nt, Homo sapiens
gacacuacacguuucaaccucu

SEQ ID NO: 1680495 - RNA, 14 nt, Homo sapiens
gacagaaacagggg

SEQ ID NO: 1680496 - RNA, 15 nt, Homo sapiens
gacagagauggcaga

SEQ ID NO: 1680497 - RNA, 18 nt, Homo sapiens
gacagaggauuucugcuu

SEQ ID NO: 1680498 - RNA, 12 nt, Homo sapiens
gacagcagagaa

SEQ ID NO: 1680499 - RNA, 14 nt, Homo sapiens
gacagccaagggca

SEQ ID NO: 1680500 - RNA, 20 nt, Homo sapiens
gacagccaagggcagaucac

SEQ ID NO: 1680501 - RNA, 17 nt, Homo sapiens
gacagccugcacagugg

SEQ ID NO: 1680502 - RNA, 12 nt, Homo sapiens
gacagcucuuau

SEQ ID NO: 1680503 - RNA, 15 nt, Homo sapiens
gacaggcaccaugcu

SEQ ID NO: 1680504 - RNA, 16 nt, Homo sapiens
gacaggcaccaugcug

SEQ ID NO: 1680505 - RNA, 21 nt, Homo sapiens
gacaggccuuccuccucucaa

SEQ ID NO: 1680506 - RNA, 11 nt, Homo sapiens
gacagugcagu

SEQ ID NO: 1680507 - RNA, 12 nt, Homo sapiens
gacagugcagug

SEQ ID NO: 1680508 - RNA, 16 nt, Homo sapiens
gacagugcagugcuca

SEQ ID NO: 1680509 - RNA, 19 nt, Homo sapiens
gacaguuaagagaaaugag

SEQ ID NO: 1680510 - RNA, 19 nt, Homo sapiens
gacauaaaucuuccaaagu

SEQ ID NO: 1680511 - RNA, 17 nt, Homo sapiens
gacauauaucuauuaca

SEQ ID NO: 1680512 - RNA, 16 nt, Homo sapiens
gacaucuagucucagu

SEQ ID NO: 1680513 - RNA, 16 nt, Homo sapiens
gacaucugucuaggaa

SEQ ID NO: 1680514 - RNA, 20 nt, Homo sapiens
gacaugccuugaaaccagaa

SEQ ID NO: 1680515 - RNA, 22 nt, Homo sapiens
gaccaagucucucuaagacaaa

SEQ ID NO: 1680516 - RNA, 20 nt, Homo sapiens
gaccacacgcccccacaggc

SEQ ID NO: 1680517 - RNA, 14 nt, Homo sapiens
gaccagagcugcca

SEQ ID NO: 1680518 - RNA, 23 nt, Homo sapiens
gacccacaaguauugcccuuuaa

SEQ ID NO: 1680519 - RNA, 21 nt, Homo sapiens
gacccaggaaccgauuaucua

SEQ ID NO: 1680520 - RNA, 17 nt, Homo sapiens
gacccagggaaugccag

SEQ ID NO: 1680521 - RNA, 17 nt, Homo sapiens
gacccauguucucaaua

SEQ ID NO: 1680522 - RNA, 20 nt, Homo sapiens
cuuuugaaagucccuaauaa

SEQ ID NO: 1680523 - RNA, 21 nt, Homo sapiens
cuuuugaaagucccuaauaaa

SEQ ID NO: 1680524 - RNA, 21 nt, Homo sapiens
cuuuugagugccuuacacaau

SEQ ID NO: 1680525 - RNA, 22 nt, Homo sapiens
cuuuugcccacacuugggagca

SEQ ID NO: 1680526 - RNA, 19 nt, Homo sapiens
cuuuugguaucuacuucua

SEQ ID NO: 1680527 - RNA, 19 nt, Homo sapiens
cuuuuuaucgccauuccag

SEQ ID NO: 1680528 - RNA, 22 nt, Homo sapiens
cuuuuuauuagguuaagucuca

SEQ ID NO: 1680529 - RNA, 17 nt, Homo sapiens
cuuuuuccuuagcuuaa

SEQ ID NO: 1680530 - RNA, 20 nt, Homo sapiens
cuuuuuuuucuucaccucac

SEQ ID NO: 1680531 - RNA, 14 nt, Homo sapiens
gaaaaaagcaacuu

SEQ ID NO: 1680532 - RNA, 18 nt, Homo sapiens
gaaaaaauaacacuguac

SEQ ID NO: 1680533 - RNA, 23 nt, Homo sapiens
gaaaaaauauuguuuaaugcaaa

SEQ ID NO: 1680534 - RNA, 20 nt, Homo sapiens
gaaaaacaaaaaggaaauga

SEQ ID NO: 1680535 - RNA, 15 nt, Homo sapiens
gaaaaagcccucuuc

SEQ ID NO: 1680536 - RNA, 14 nt, Homo sapiens
gaaaaaugccauca

SEQ ID NO: 1680537 - RNA, 17 nt, Homo sapiens
gaaaacaaaaaacaaaa

SEQ ID NO: 1680538 - RNA, 15 nt, Homo sapiens
gaaaacaaacaaaca

SEQ ID NO: 1680539 - RNA, 18 nt, Homo sapiens
gaaaacaaauauuucacu

SEQ ID NO: 1680540 - RNA, 12 nt, Homo sapiens
gaaaacaggcuc

SEQ ID NO: 1680541 - RNA, 23 nt, Homo sapiens
gaaaacccaacuccucuccuccc

SEQ ID NO: 1680542 - RNA, 13 nt, Homo sapiens
gaaaaccucuuuc

SEQ ID NO: 1680543 - RNA, 17 nt, Homo sapiens
gaaaaccugaggccaaa

SEQ ID NO: 1680544 - RNA, 17 nt, Homo sapiens
gaaaagauuucugucca

SEQ ID NO: 1680545 - RNA, 23 nt, Homo sapiens
gaaaagcaaaucuguauaaaugu

SEQ ID NO: 1680546 - RNA, 12 nt, Homo sapiens
gaaaagcaguuu

SEQ ID NO: 1680547 - RNA, 12 nt, Homo sapiens
gaaaagccagau

SEQ ID NO: 1680548 - RNA, 18 nt, Homo sapiens
gaaaauaccaucaggccu

SEQ ID NO: 1680549 - RNA, 22 nt, Homo sapiens
gaaaauccugacaaaagggaca

SEQ ID NO: 1680550 - RNA, 16 nt, Homo sapiens
gaaaauggaagacagc

SEQ ID NO: 1680551 - RNA, 18 nt, Homo sapiens
gaaaauggagaaaaccag

SEQ ID NO: 1680552 - RNA, 22 nt, Homo sapiens
gaaaauggaugacaaagaaaau

SEQ ID NO: 1680553 - RNA, 16 nt, Homo sapiens
gaaaauuagcaugaaa

SEQ ID NO: 1680554 - RNA, 15 nt, Homo sapiens
gaaacaaagcauuug

SEQ ID NO: 1680555 - RNA, 16 nt, Homo sapiens
gaaacaacaaauaagu

SEQ ID NO: 1680556 - RNA, 16 nt, Homo sapiens
gaaacaaggaaggaca

SEQ ID NO: 1680557 - RNA, 17 nt, Homo sapiens
gaaacaauuucuguguc

SEQ ID NO: 1680558 - RNA, 22 nt, Homo sapiens
gaaacacaaaccacaacugaca

SEQ ID NO: 1680559 - RNA, 19 nt, Homo sapiens
gaaacaugacacugaccuu

SEQ ID NO: 1680560 - RNA, 14 nt, Homo sapiens
gaaaccccugacac

SEQ ID NO: 1680561 - RNA, 18 nt, Homo sapiens
gaaaccccugacaccuuu

SEQ ID NO: 1680562 - RNA, 23 nt, Homo sapiens
gaaacuggaaugcuguuacuuug

SEQ ID NO: 1680563 - RNA, 20 nt, Homo sapiens
gaaagagaaugcaccccuga

SEQ ID NO: 1680564 - RNA, 15 nt, Homo sapiens
gaaagaguugcagua

SEQ ID NO: 1680565 - RNA, 14 nt, Homo sapiens
gaaagauugcuaua

SEQ ID NO: 1680566 - RNA, 19 nt, Homo sapiens
gaaagcagcacacauugug

SEQ ID NO: 1680567 - RNA, 14 nt, Homo sapiens
gaaagcagugcagu

SEQ ID NO: 1680568 - RNA, 15 nt, Homo sapiens
gaaagccuuccucaa

SEQ ID NO: 1680569 - RNA, 17 nt, Homo sapiens
gaaaggcaucuaagaca

SEQ ID NO: 1680570 - RNA, 22 nt, Homo sapiens
gaaaggcaucuaagacauucac

SEQ ID NO: 1680571 - RNA, 14 nt, Homo sapiens
gaaaggucaucuca

SEQ ID NO: 1680572 - RNA, 15 nt, Homo sapiens
gaaagucccuaauaa

SEQ ID NO: 1680573 - RNA, 17 nt, Homo sapiens
gaaauaaagaguucucc

SEQ ID NO: 1680574 - RNA, 14 nt, Homo sapiens
gaaauaaagcacau

SEQ ID NO: 1680575 - RNA, 14 nt, Homo sapiens
gaaauaucugugaa

SEQ ID NO: 1680576 - RNA, 20 nt, Homo sapiens
gaaauccacgcucaaucuca

SEQ ID NO: 1680577 - RNA, 17 nt, Homo sapiens
gaaaugaauccaucaua

SEQ ID NO: 1680578 - RNA, 14 nt, Homo sapiens
gaaaugccaguggu

SEQ ID NO: 1680579 - RNA, 24 nt, Homo sapiens
gaaaugggaguagggggguggaca

SEQ ID NO: 1680580 - RNA, 22 nt, Homo sapiens
gaaaugucuccacccgugucca

SEQ ID NO: 1680581 - RNA, 13 nt, Homo sapiens
gaaaugugcugca

SEQ ID NO: 1680582 - RNA, 15 nt, Homo sapiens
cuguacaugacugua

SEQ ID NO: 1680583 - RNA, 18 nt, Homo sapiens
cuguaccggccacugcaa

SEQ ID NO: 1680584 - RNA, 18 nt, Homo sapiens
cuguacgaggcuucucua

SEQ ID NO: 1680585 - RNA, 23 nt, Homo sapiens
cuguagcccuggcccggucccag

SEQ ID NO: 1680586 - RNA, 22 nt, Homo sapiens
cuguaguuuuuguucaccuucu

SEQ ID NO: 1680587 - RNA, 21 nt, Homo sapiens
cuguauaauacuuuguauaca

SEQ ID NO: 1680588 - RNA, 15 nt, Homo sapiens
cuguauacaaacagg

SEQ ID NO: 1680589 - RNA, 13 nt, Homo sapiens
cuguauccaaguu

SEQ ID NO: 1680590 - RNA, 13 nt, Homo sapiens
cuguauuacauaa

SEQ ID NO: 1680591 - RNA, 16 nt, Homo sapiens
cuguauuacauaaaua

SEQ ID NO: 1680592 - RNA, 15 nt, Homo sapiens
cugucagucguguug

SEQ ID NO: 1680593 - RNA, 21 nt, Homo sapiens
cugucauuccaugagucuuca

SEQ ID NO: 1680594 - RNA, 12 nt, Homo sapiens
cuguccaaaagg

SEQ ID NO: 1680595 - RNA, 22 nt, Homo sapiens
cugucccggagcucaggcccug

SEQ ID NO: 1680596 - RNA, 16 nt, Homo sapiens
cuguccgacagucaag

SEQ ID NO: 1680597 - RNA, 13 nt, Homo sapiens
cuguccgucuguc

SEQ ID NO: 1680598 - RNA, 17 nt, Homo sapiens
cuguccuacaauaucau

SEQ ID NO: 1680599 - RNA, 15 nt, Homo sapiens
cuguccucucagaac

SEQ ID NO: 1680600 - RNA, 20 nt, Homo sapiens
cugucgcaugagaacauuaa

SEQ ID NO: 1680601 - RNA, 16 nt, Homo sapiens
cugucugucaccagcu

SEQ ID NO: 1680602 - RNA, 23 nt, Homo sapiens
cugugaaacuguuuaggauuuuc

SEQ ID NO: 1680603 - RNA, 15 nt, Homo sapiens
cugugaaauaucauc

SEQ ID NO: 1680604 - RNA, 17 nt, Homo sapiens
cugugauaacagaguga

SEQ ID NO: 1680605 - RNA, 23 nt, Homo sapiens
cugugaugucaguagugccugug

SEQ ID NO: 1680606 - RNA, 18 nt, Homo sapiens
cugugcaacaaacucaaa

SEQ ID NO: 1680607 - RNA, 20 nt, Homo sapiens
cugugcaacaaacucaaaau

SEQ ID NO: 1680608 - RNA, 15 nt, Homo sapiens
cugugccucagugag

SEQ ID NO: 1680609 - RNA, 21 nt, Homo sapiens
cugugcguuuuagaguaugca

SEQ ID NO: 1680610 - RNA, 20 nt, Homo sapiens
cugugggguuuuuaaucucu

SEQ ID NO: 1680611 - RNA, 18 nt, Homo sapiens
cuguggugagguccuguc

SEQ ID NO: 1680612 - RNA, 13 nt, Homo sapiens
cuguguugucucu

SEQ ID NO: 1680613 - RNA, 15 nt, Homo sapiens
cuguuaaaugaacuu

SEQ ID NO: 1680614 - RNA, 20 nt, Homo sapiens
cuguuaagggaagcugauac

SEQ ID NO: 1680615 - RNA, 14 nt, Homo sapiens
cuguuacaguaaug

SEQ ID NO: 1680616 - RNA, 19 nt, Homo sapiens
cuguucauuguaagcacuu

SEQ ID NO: 1680617 - RNA, 20 nt, Homo sapiens
cuguucauuguaagcacuuu

SEQ ID NO: 1680618 - RNA, 16 nt, Homo sapiens
cuguuccaccagagca

SEQ ID NO: 1680619 - RNA, 19 nt, Homo sapiens
cuguucucaaaugcuaaau

SEQ ID NO: 1680620 - RNA, 19 nt, Homo sapiens
cuguucuuccuaccaaaua

SEQ ID NO: 1680621 - RNA, 18 nt, Homo sapiens
cuguucuuuuugacugau

SEQ ID NO: 1680622 - RNA, 16 nt, Homo sapiens
cuguugaggguccuca

SEQ ID NO: 1680623 - RNA, 16 nt, Homo sapiens
cuguuggcugauugga

SEQ ID NO: 1680624 - RNA, 21 nt, Homo sapiens
cuguuuccagagugcuuauaa

SEQ ID NO: 1680625 - RNA, 17 nt, Homo sapiens
cuguuuuaugugcacac

SEQ ID NO: 1680626 - RNA, 22 nt, Homo sapiens
cuguuuugggaaacacuuugag

SEQ ID NO: 1680627 - RNA, 19 nt, Homo sapiens
cuuaaaaagaccaugcauu

SEQ ID NO: 1680628 - RNA, 14 nt, Homo sapiens
cuuaaaaguaucag

SEQ ID NO: 1680629 - RNA, 18 nt, Homo sapiens
cuuaaacaaaaacuuucc

SEQ ID NO: 1680630 - RNA, 17 nt, Homo sapiens
cuuaaaccugugcuuuc

SEQ ID NO: 1680631 - RNA, 20 nt, Homo sapiens
cuuaaacuuugucacuucug

SEQ ID NO: 1680632 - RNA, 23 nt, Homo sapiens
cuuaaagcuuguuuguucuaguu

SEQ ID NO: 1680633 - RNA, 15 nt, Homo sapiens
cuuaacagcuguauu

SEQ ID NO: 1680634 - RNA, 14 nt, Homo sapiens
cuuaagaugcaaau

SEQ ID NO: 1680635 - RNA, 21 nt, Homo sapiens
cuuaagauuccauuuuggaaa

SEQ ID NO: 1680636 - RNA, 17 nt, Homo sapiens
cuuaauauaaaucguaa

SEQ ID NO: 1680637 - RNA, 19 nt, Homo sapiens
cuuaaucaggaguucugcc

SEQ ID NO: 1680638 - RNA, 18 nt, Homo sapiens
cuuaauucccaaucccau

SEQ ID NO: 1680639 - RNA, 22 nt, Homo sapiens
cuuacaguagaggguccagucu

SEQ ID NO: 1680640 - RNA, 16 nt, Homo sapiens
cuuaccucauuugcau

SEQ ID NO: 1680641 - RNA, 14 nt, Homo sapiens
cuuacuaguguuug

SEQ ID NO: 1680642 - RNA, 14 nt, Homo sapiens
cuuacuguugcaua

SEQ ID NO: 1680643 - RNA, 15 nt, Homo sapiens
cuuacuuaaccugaa

SEQ ID NO: 1680644 - RNA, 14 nt, Homo sapiens
ccugcucccacaga

SEQ ID NO: 1680645 - RNA, 21 nt, Homo sapiens
ccuuccuggucuuugaauaaa

SEQ ID NO: 1680646 - RNA, 18 nt, Homo sapiens
cuaaguccaacuacuaaa

SEQ ID NO: 1680647 - RNA, 14 nt, Homo sapiens
cuacuugggagcac

SEQ ID NO: 1680648 - RNA, 18 nt, Homo sapiens
cuauaguccagcuuuguu

SEQ ID NO: 1680649 - RNA, 19 nt, Homo sapiens
cuauuuuauaaaacaaaua

SEQ ID NO: 1680650 - RNA, 15 nt, Homo sapiens
cucaauaaguuuauu

SEQ ID NO: 1680651 - RNA, 14 nt, Homo sapiens
cucauacacagaaa

SEQ ID NO: 1680652 - RNA, 17 nt, Homo sapiens
cuccccuccuugcaccg

SEQ ID NO: 1680653 - RNA, 16 nt, Homo sapiens
cuccugcccgcugggc

SEQ ID NO: 1680654 - RNA, 19 nt, Homo sapiens
cugaaggcugaaagacagg

SEQ ID NO: 1680655 - RNA, 18 nt, Homo sapiens
cuguugaauuucccacau

SEQ ID NO: 1680656 - RNA, 16 nt, Homo sapiens
cuuccuggucuuugaa

SEQ ID NO: 1680657 - RNA, 14 nt, Homo sapiens
cuuuauucugcaag

SEQ ID NO: 1680658 - RNA, 22 nt, Homo sapiens
cuuuuccaugcacccucauaca

SEQ ID NO: 1680659 - RNA, 18 nt, Homo sapiens
cuuuuuuauacucaauca

SEQ ID NO: 1680660 - RNA, 16 nt, Homo sapiens
gauauuuuuccauuuu

SEQ ID NO: 1680661 - RNA, 16 nt, Homo sapiens
gaugcagagcuuucaa

SEQ ID NO: 1680662 - RNA, 16 nt, Homo sapiens
gcaagcaaucaaauaa

SEQ ID NO: 1680663 - RNA, 21 nt, Homo sapiens
gcccaugaugcagagcuuuca

SEQ ID NO: 1680664 - RNA, 17 nt, Homo sapiens
ggaauaaacuccauuua

SEQ ID NO: 1680665 - RNA, 21 nt, Homo sapiens
ggcuuuauucugcaagcaauc

SEQ ID NO: 1680666 - RNA, 23 nt, Homo sapiens
guauucagcuuuaguagauauua

SEQ ID NO: 1680667 - RNA, 15 nt, Homo sapiens
guuccgagaagaaca

SEQ ID NO: 1680668 - RNA, 23 nt, Homo sapiens
guugaauuucccacauacccucc

SEQ ID NO: 1680669 - RNA, 14 nt, Homo sapiens
uaaaaaacauuuau

SEQ ID NO: 1680670 - RNA, 18 nt, Homo sapiens
uaaacugggggauauuau

SEQ ID NO: 1680671 - RNA, 18 nt, Homo sapiens
uaagaagacccuauuucc

SEQ ID NO: 1680672 - RNA, 15 nt, Homo sapiens
uacauaacacauauc

SEQ ID NO: 1680673 - RNA, 12 nt, Homo sapiens
uaccaugcugaa

SEQ ID NO: 1680674 - RNA, 16 nt, Homo sapiens
uagaauagauauccac

SEQ ID NO: 1680675 - RNA, 23 nt, Homo sapiens
uaucuaaacuggauucacagcuc

SEQ ID NO: 1680676 - RNA, 23 nt, Homo sapiens
uaugaccucgcccuccacaaaug

SEQ ID NO: 1680677 - RNA, 12 nt, Homo sapiens
uauucugcaagc

SEQ ID NO: 1680678 - RNA, 13 nt, Homo sapiens
ucaaggauaggcu

SEQ ID NO: 1680679 - RNA, 20 nt, Homo sapiens
ucagcuuuaguagauauuac

SEQ ID NO: 1680680 - RNA, 15 nt, Homo sapiens
ucaggcaacgcacaa

SEQ ID NO: 1680681 - RNA, 21 nt, Homo sapiens
ucaugauuuugaaaccaugaa

SEQ ID NO: 1680682 - RNA, 18 nt, Homo sapiens
ucauucuuauuucaugaa

SEQ ID NO: 1680683 - RNA, 13 nt, Homo sapiens
ucccuaaguccaa

SEQ ID NO: 1680684 - RNA, 15 nt, Homo sapiens
uccugauuccuuuaa

SEQ ID NO: 1680685 - RNA, 16 nt, Homo sapiens
ucuuccugauuccuuu

SEQ ID NO: 1680686 - RNA, 15 nt, Homo sapiens
ugaaucucuaaucaa

SEQ ID NO: 1680687 - RNA, 16 nt, Homo sapiens
ugaauuucccacauac

SEQ ID NO: 1680688 - RNA, 17 nt, Homo sapiens
ugauuuugaaaccauga

SEQ ID NO: 1680689 - RNA, 15 nt, Homo sapiens
ugauuuugaaaucau

SEQ ID NO: 1680690 - RNA, 14 nt, Homo sapiens
ugcaagcaaucaaa

SEQ ID NO: 1680691 - RNA, 16 nt, Homo sapiens
ugcauagucauguaag

SEQ ID NO: 1680692 - RNA, 14 nt, Homo sapiens
ugcucccacagaac

SEQ ID NO: 1680693 - RNA, 10 nt, Homo sapiens
ugcuguccaa

SEQ ID NO: 1680694 - RNA, 16 nt, Homo sapiens
uggaagagcacaagag

SEQ ID NO: 1680695 - RNA, 14 nt, Homo sapiens
ugggaaaaccagac

SEQ ID NO: 1680696 - RNA, 22 nt, Homo sapiens
ugggaacacaaugccuacuuca

SEQ ID NO: 1680697 - RNA, 19 nt, Homo sapiens
uguacaaaaguuucauccu

SEQ ID NO: 1680698 - RNA, 21 nt, Homo sapiens
ugugucaaacaguacacuauc

SEQ ID NO: 1680699 - RNA, 19 nt, Homo sapiens
uguguuucagccauguauu

SEQ ID NO: 1680700 - RNA, 14 nt, Homo sapiens
uuaaaccauguaaa

SEQ ID NO: 1680701 - RNA, 19 nt, Homo sapiens
uuaaaugaauuuuucuucc

SEQ ID NO: 1680702 - RNA, 16 nt, Homo sapiens
uuaauacacacaguua

SEQ ID NO: 1680703 - RNA, 17 nt, Homo sapiens
uuaauauauacuaugag

SEQ ID NO: 1680704 - RNA, 14 nt, Homo sapiens
uuaauauuccucag

SEQ ID NO: 1680705 - RNA, 18 nt, Homo sapiens
uucaaggauaggcuuuau

SEQ ID NO: 1680706 - RNA, 21 nt, Homo sapiens
uucauucaggcaacgcacaaa

SEQ ID NO: 1680707 - RNA, 14 nt, Homo sapiens
uucccuaaguccaa

SEQ ID NO: 1680708 - RNA, 19 nt, Homo sapiens
uucucacacacauacauac

SEQ ID NO: 1680709 - RNA, 19 nt, Homo sapiens
uucugaacuugggaacaca

SEQ ID NO: 1680710 - RNA, 14 nt, Homo sapiens
uucugcaagcaauc

SEQ ID NO: 1680711 - RNA, 17 nt, Homo sapiens
uucugcuaagagaucac

SEQ ID NO: 1680712 - RNA, 20 nt, Homo sapiens
uuguaguuuuggcuaguccu

SEQ ID NO: 1680713 - RNA, 20 nt, Homo sapiens
uuuaaucuguauuuccccaa

SEQ ID NO: 1680714 - RNA, 16 nt, Homo sapiens
uuuacuuuaaaaagua

SEQ ID NO: 1680715 - RNA, 12 nt, Homo sapiens
uuuauucuuggu

SEQ ID NO: 1680716 - RNA, 14 nt, Homo sapiens
uuucacuaccuauc

SEQ ID NO: 1680717 - RNA, 18 nt, Homo sapiens
uuuccuuugguccuucaa

SEQ ID NO: 1680718 - RNA, 17 nt, Homo sapiens
uuucuuuuuuauacuca

SEQ ID NO: 1680719 - RNA, 22 nt, Homo sapiens
uuugugcagagauaaagaccuu

SEQ ID NO: 1680720 - RNA, 14 nt, Homo sapiens
aaacuggauucaca

SEQ ID NO: 1680721 - RNA, 21 nt, Homo sapiens
aaacugugacugcagugcugu

SEQ ID NO: 1680722 - RNA, 22 nt, Homo sapiens
aaagaccuuuuccaugcacccu

SEQ ID NO: 1680723 - RNA, 21 nt, Homo sapiens
aaaucaugaagauauuuuucc

SEQ ID NO: 1680724 - RNA, 13 nt, Homo sapiens
aacagauaauccc

SEQ ID NO: 1680725 - RNA, 19 nt, Homo sapiens
aacuuaacuguucuuugcc

SEQ ID NO: 1680726 - RNA, 14 nt, Homo sapiens
aagaaauuuuugcc

SEQ ID NO: 1680727 - RNA, 16 nt, Homo sapiens
aagauauuuuucauga

SEQ ID NO: 1680728 - RNA, 19 nt, Homo sapiens
aagcacagauguucuucaa

SEQ ID NO: 1680729 - RNA, 15 nt, Homo sapiens
aaucucaagcaaaca

SEQ ID NO: 1680730 - RNA, 15 nt, Homo sapiens
acaagacaccaaauu

SEQ ID NO: 1680731 - RNA, 14 nt, Homo sapiens
acaaugccuacuuc

SEQ ID NO: 1680732 - RNA, 20 nt, Homo sapiens
acacuacaaauuuauucuug

SEQ ID NO: 1680733 - RNA, 13 nt, Homo sapiens
acagcacuaugua

SEQ ID NO: 1680734 - RNA, 21 nt, Homo sapiens
acagcuucacaaauucucaca

SEQ ID NO: 1680735 - RNA, 20 nt, Homo sapiens
acagcuucucaauuucuaca

SEQ ID NO: 1680736 - RNA, 15 nt, Homo sapiens
acauccauguuccga

SEQ ID NO: 1680737 - RNA, 13 nt, Homo sapiens
accugaagacacc

SEQ ID NO: 1680738 - RNA, 19 nt, Homo sapiens
accugaagcugucaccucu

SEQ ID NO: 1680739 - RNA, 21 nt, Homo sapiens
acuaacuccuaggaaaauacu

SEQ ID NO: 1680740 - RNA, 14 nt, Homo sapiens
acucaaucauuucu

SEQ ID NO: 1680741 - RNA, 22 nt, Homo sapiens
acugcagugcuguaaacuuaac

SEQ ID NO: 1680742 - RNA, 20 nt, Homo sapiens
agcaucuggauucugccuaa

SEQ ID NO: 1680743 - RNA, 14 nt, Homo sapiens
agcuucucaauuuc

SEQ ID NO: 1680744 - RNA, 15 nt, Homo sapiens
aggauaggcuuuauu

SEQ ID NO: 1680745 - RNA, 22 nt, Homo sapiens
aggauaggcuuuauucugcaag

SEQ ID NO: 1680746 - RNA, 13 nt, Homo sapiens
aguuauuuuuaca

SEQ ID NO: 1680747 - RNA, 22 nt, Homo sapiens
auaaucauucuuauuucaugaa

SEQ ID NO: 1680748 - RNA, 11 nt, Homo sapiens
auaggcuuuau

SEQ ID NO: 1680749 - RNA, 24 nt, Homo sapiens
auccuuggaaauuggaagagcaca

SEQ ID NO: 1680750 - RNA, 17 nt, Homo sapiens
aucuggauucugccuaa

SEQ ID NO: 1680751 - RNA, 23 nt, Homo sapiens
augaaccugcccugcucccacag

SEQ ID NO: 1680752 - RNA, 21 nt, Homo sapiens
augaagguggaacaagcacag

SEQ ID NO: 1680753 - RNA, 19 nt, Homo sapiens
augcuuucgauaguguuaa

SEQ ID NO: 1680754 - RNA, 15 nt, Homo sapiens
auucugcuaagagau

SEQ ID NO: 1680755 - RNA, 17 nt, Homo sapiens
auuuacaacaaacaccu

SEQ ID NO: 1680756 - RNA, 20 nt, Homo sapiens
auuuauucuuggugaagaug

SEQ ID NO: 1680757 - RNA, 18 nt, Homo sapiens
auuuugaaaccaugaaga

SEQ ID NO: 1680758 - RNA, 13 nt, Homo sapiens
auuuuuccauuua

SEQ ID NO: 1680759 - RNA, 13 nt, Homo sapiens
auuuuuccauuuu

SEQ ID NO: 1680760 - RNA, 17 nt, Homo sapiens
caaaauuagugcuuuuu

SEQ ID NO: 1680761 - RNA, 14 nt, Homo sapiens
caaccugaagacac

SEQ ID NO: 1680762 - RNA, 17 nt, Homo sapiens
caaggccagaugcacau

SEQ ID NO: 1680763 - RNA, 14 nt, Homo sapiens
caauuucuauuaaa

SEQ ID NO: 1680764 - RNA, 20 nt, Homo sapiens
cacagaacacagcaauuccu

SEQ ID NO: 1680765 - RNA, 18 nt, Homo sapiens
cagaaauuaaaugaauuu

SEQ ID NO: 1680766 - RNA, 16 nt, Homo sapiens
cagugcuguaaacuua

SEQ ID NO: 1680767 - RNA, 24 nt, Homo sapiens
cauccauguuccgagaagaacaga

SEQ ID NO: 1680768 - RNA, 24 nt, Homo sapiens
cauccuuggaaauuggaagagcac

SEQ ID NO: 1680769 - RNA, 19 nt, Homo sapiens
cauucaggcaacgcacaaa

SEQ ID NO: 1680770 - RNA, 14 nt, Homo sapiens
ccaaauugaacuca

SEQ ID NO: 1680771 - RNA, 18 nt, Homo sapiens
ccaaauugaacucacugc

SEQ ID NO: 1680772 - RNA, 21 nt, Homo sapiens
ccacaaaugggaaaaccagac

SEQ ID NO: 1680773 - RNA, 20 nt, Homo sapiens
ccaucagcaaauauuauucu

SEQ ID NO: 1680774 - RNA, 16 nt, Homo sapiens
ccaugaugcagagcuu

SEQ ID NO: 1680775 - RNA, 19 nt, Homo sapiens
cccuuccuggucuuugaau

SEQ ID NO: 1680776 - RNA, 17 nt, Homo sapiens
ccgguucuuaaauccau

SEQ ID NO: 1680777 - RNA, 17 nt, Homo sapiens
ccuccccuccuugcacc

SEQ ID NO: 1680778 - RNA, 20 nt, Homo sapiens
ccuccuccccuccuugcacc

SEQ ID NO: 1680779 - RNA, 19 nt, Homo sapiens
ccugauuccuuuaaaugaa

SEQ ID NO: 1680780 - RNA, 22 nt, Homo sapiens
ccugauuccuuuaaaugaauau

SEQ ID NO: 1680781 - RNA, 21 nt, Homo sapiens
cuaagcgcucauucuauuuua

SEQ ID NO: 1680782 - RNA, 14 nt, Homo sapiens
cuacuaaacugggg

SEQ ID NO: 1680783 - RNA, 12 nt, Homo sapiens
cuauuaaagguu

SEQ ID NO: 1680784 - RNA, 13 nt, Homo sapiens
cucauacacagaa

SEQ ID NO: 1680785 - RNA, 15 nt, Homo sapiens
cuccuugcaccggcc

SEQ ID NO: 1680786 - RNA, 24 nt, Homo sapiens
cucuaugaccucgcccuccacaaa

SEQ ID NO: 1680787 - RNA, 15 nt, Homo sapiens
cugcuaagagaucac

SEQ ID NO: 1680788 - RNA, 14 nt, Homo sapiens
cuuaaauccauccu

SEQ ID NO: 1680789 - RNA, 17 nt, Homo sapiens
cuuccuggucuuugaau

SEQ ID NO: 1680790 - RNA, 21 nt, Homo sapiens
cuuggaaauuggaagagcaca

SEQ ID NO: 1680791 - RNA, 17 nt, Homo sapiens
cuuugaauaaagucuga

SEQ ID NO: 1680792 - RNA, 14 nt, Homo sapiens
cuuuuuuauacuca

SEQ ID NO: 1680793 - RNA, 23 nt, Homo sapiens
gaaauacacagugcugaccagac

SEQ ID NO: 1680794 - RNA, 15 nt, Homo sapiens
gaaauuuuuacuuua

SEQ ID NO: 1680795 - RNA, 22 nt, Homo sapiens
gaagaacagauaaucccuguau

SEQ ID NO: 1680796 - RNA, 15 nt, Homo sapiens
gaagaugauaccuga

SEQ ID NO: 1680797 - RNA, 16 nt, Homo sapiens
gaauuuuucuuccuga

SEQ ID NO: 1680798 - RNA, 17 nt, Homo sapiens
gacugcagugcuguaaa

SEQ ID NO: 1680799 - RNA, 15 nt, Homo sapiens
gauauuuuucaugau

SEQ ID NO: 1680800 - RNA, 15 nt, Homo sapiens
gaugcagagcuuuca

SEQ ID NO: 1680801 - RNA, 23 nt, Homo sapiens
gcaucuggaaauuuuuacuuuaa

SEQ ID NO: 1680802 - RNA, 18 nt, Homo sapiens
gcgcucauucuauuuuau

SEQ ID NO: 1680803 - RNA, 14 nt, Homo sapiens
gcucccacagaaca

SEQ ID NO: 1680804 - RNA, 20 nt, Homo sapiens
gcuuucaaggauaggcuuua

SEQ ID NO: 1680805 - RNA, 14 nt, Homo sapiens
ggauaggcuuuauu

SEQ ID NO: 1680806 - RNA, 19 nt, Homo sapiens
ggauuuauuuuuccauuua

SEQ ID NO: 1680807 - RNA, 15 nt, Homo sapiens
guagaauagauaucc

SEQ ID NO: 1680808 - RNA, 15 nt, Homo sapiens
aaagaccauuuuucc

SEQ ID NO: 1680809 - RNA, 23 nt, Homo sapiens
aaacugggggauauuaugaaggg

SEQ ID NO: 1680810 - RNA, 19 nt, Homo sapiens
aaagaauguucagcucaac

SEQ ID NO: 1680811 - RNA, 23 nt, Homo sapiens
aaauacacagugcugaccagaca

SEQ ID NO: 1680812 - RNA, 21 nt, Homo sapiens
aaauccugaugagguuucuac

SEQ ID NO: 1680813 - RNA, 16 nt, Homo sapiens
aagagauuuuucauga

SEQ ID NO: 1680814 - RNA, 19 nt, Homo sapiens
aagguggaacaagcacaga

SEQ ID NO: 1680815 - RNA, 15 nt, Homo sapiens
aaguccaacuacuaa

SEQ ID NO: 1680816 - RNA, 16 nt, Homo sapiens
aaucuauucugcuaag

SEQ ID NO: 1680817 - RNA, 22 nt, Homo sapiens
aaugaauaugaaacacuacaaa

SEQ ID NO: 1680818 - RNA, 15 nt, Homo sapiens
aaugggaaaaccaga

SEQ ID NO: 1680819 - RNA, 18 nt, Homo sapiens
acaaaugggaaaaccaga

SEQ ID NO: 1680820 - RNA, 17 nt, Homo sapiens
acacaaugccuacuuca

SEQ ID NO: 1680821 - RNA, 20 nt, Homo sapiens
accaaauugaacucacugcu

SEQ ID NO: 1680822 - RNA, 18 nt, Homo sapiens
accaccagaucagguaua

SEQ ID NO: 1680823 - RNA, 23 nt, Homo sapiens
accguucauucaggcaacgcaca

SEQ ID NO: 1680824 - RNA, 17 nt, Homo sapiens
acuccuccuaguacuaa

SEQ ID NO: 1680825 - RNA, 17 nt, Homo sapiens
acuguucuuugccagaa

SEQ ID NO: 1680826 - RNA, 19 nt, Homo sapiens
acuuuaaaaaguaaccaga

SEQ ID NO: 1680827 - RNA, 23 nt, Homo sapiens
agaaacagcuucucaauuucuac

SEQ ID NO: 1680828 - RNA, 22 nt, Homo sapiens
agagcuuucaaggauaggcuuu

SEQ ID NO: 1680829 - RNA, 21 nt, Homo sapiens
agauauuuuucaugauuuuga

SEQ ID NO: 1680830 - RNA, 20 nt, Homo sapiens
aggauaggcuuuauucugca

SEQ ID NO: 1680831 - RNA, 15 nt, Homo sapiens
aggccagaugcacau

SEQ ID NO: 1680832 - RNA, 21 nt, Homo sapiens
aggccauugggauauucugaa

SEQ ID NO: 1680833 - RNA, 16 nt, Homo sapiens
aguaaccagaauccaa

SEQ ID NO: 1680834 - RNA, 15 nt, Homo sapiens
agucuuauuuauuca

SEQ ID NO: 1680835 - RNA, 21 nt, Homo sapiens
auaaauuauaucaauuuccuc

SEQ ID NO: 1680836 - RNA, 15 nt, Homo sapiens
auacacagugcugac

SEQ ID NO: 1680837 - RNA, 14 nt, Homo sapiens
auaccacagcuuuu

SEQ ID NO: 1680838 - RNA, 21 nt, Homo sapiens
auacccuccuuccaccaaguu

SEQ ID NO: 1680839 - RNA, 14 nt, Homo sapiens
auauacucacuuuc

SEQ ID NO: 1680840 - RNA, 20 nt, Homo sapiens
aucaauguucaucauguauc

SEQ ID NO: 1680841 - RNA, 15 nt, Homo sapiens
aucccuggaaggaca

SEQ ID NO: 1680842 - RNA, 20 nt, Homo sapiens
augaaccugcccugcuccca

SEQ ID NO: 1680843 - RNA, 17 nt, Homo sapiens
auggcuucugccuaaua

SEQ ID NO: 1680844 - RNA, 19 nt, Homo sapiens
auggugcacuaauuucacu

SEQ ID NO: 1680845 - RNA, 15 nt, Homo sapiens
auguauucagcuuua

SEQ ID NO: 1680846 - RNA, 18 nt, Homo sapiens
auuaauuaucuaguuuaa

SEQ ID NO: 1680847 - RNA, 22 nt, Homo sapiens
auucucacacacauacauaccu

SEQ ID NO: 1680848 - RNA, 20 nt, Homo sapiens
auucugcaagcaaucaaaua

SEQ ID NO: 1680849 - RNA, 17 nt, Homo sapiens
caaaacagaaaaugaag

SEQ ID NO: 1680850 - RNA, 12 nt, Homo sapiens
caagacaccaaa

SEQ ID NO: 1680851 - RNA, 17 nt, Homo sapiens
caaggauaggcuuuauu

SEQ ID NO: 1680852 - RNA, 23 nt, Homo sapiens
caaucaaauaauaaaucuauucu

SEQ ID NO: 1680853 - RNA, 12 nt, Homo sapiens
cacaaaacagaa

SEQ ID NO: 1680854 - RNA, 14 nt, Homo sapiens
cacagcuuuuuacc

SEQ ID NO: 1680855 - RNA, 17 nt, Homo sapiens
cacagugcugaccagac

SEQ ID NO: 1680856 - RNA, 17 nt, Homo sapiens
cacauugagucuaucaa

SEQ ID NO: 1680857 - RNA, 22 nt, Homo sapiens
caccucuugauuaucuaaacua

SEQ ID NO: 1680858 - RNA, 18 nt, Homo sapiens
cagaacacaagacaccaa

SEQ ID NO: 1680859 - RNA, 21 nt, Homo sapiens
cagugcuguaaacuuaacugu

SEQ ID NO: 1680860 - RNA, 15 nt, Homo sapiens
cauacacagaaacca

SEQ ID NO: 1680861 - RNA, 15 nt, Homo sapiens
caucccuggaaggac

SEQ ID NO: 1680862 - RNA, 23 nt, Homo sapiens
caugaugcagagcuuucaaggau

SEQ ID NO: 1680863 - RNA, 16 nt, Homo sapiens
ccaaccugaagacacc

SEQ ID NO: 1680864 - RNA, 14 nt, Homo sapiens
ccaagguauuuuua

SEQ ID NO: 1680865 - RNA, 23 nt, Homo sapiens
ccacagaacacagcaauuccuca

SEQ ID NO: 1680866 - RNA, 14 nt, Homo sapiens
ccagaucagguaua

SEQ ID NO: 1680867 - RNA, 23 nt, Homo sapiens
ccaugcacccucauacacagaaa

SEQ ID NO: 1680868 - RNA, 18 nt, Homo sapiens
cccuggaaggacauccau

SEQ ID NO: 1680869 - RNA, 18 nt, Homo sapiens
cccuuccuggucuuugaa

SEQ ID NO: 1680870 - RNA, 14 nt, Homo sapiens
ccucauacacagaa

SEQ ID NO: 1680871 - RNA, 16 nt, Homo sapiens
ccucgcccuccacaaa

SEQ ID NO: 1680872 - RNA, 14 nt, Homo sapiens
ccugugaaauacca

SEQ ID NO: 1680873 - RNA, 21 nt, Homo sapiens
ccuuaagaauuuuugaaguga

SEQ ID NO: 1680874 - RNA, 20 nt, Homo sapiens
ccuuuguucccuaaguccaa

SEQ ID NO: 1680875 - RNA, 13 nt, Homo sapiens
cgcccuccacaaa

SEQ ID NO: 1680876 - RNA, 17 nt, Homo sapiens
cuagauacaugcuuuuu

SEQ ID NO: 1680877 - RNA, 21 nt, Homo sapiens
cuaguuuuugacuugcuccua

SEQ ID NO: 1680878 - RNA, 11 nt, Homo sapiens
cuauucugcua

SEQ ID NO: 1680879 - RNA, 20 nt, Homo sapiens
cuauucugcuaagagaucac

SEQ ID NO: 1680880 - RNA, 20 nt, Homo sapiens
cuccacaaaugggaaaacca

SEQ ID NO: 1680881 - RNA, 17 nt, Homo sapiens
cuccuccccuccuugca

SEQ ID NO: 1680882 - RNA, 23 nt, Homo sapiens
cuguaaacuuaacuguucuuugc

SEQ ID NO: 1680883 - RNA, 22 nt, Homo sapiens
cuguuucugggcugucuauucu

SEQ ID NO: 1680884 - RNA, 18 nt, Homo sapiens
cuuccugauuccuuuaaa

SEQ ID NO: 1680885 - RNA, 17 nt, Homo sapiens
cuugggagcaccgccug

SEQ ID NO: 1680886 - RNA, 21 nt, Homo sapiens
gaaccugcccugcucccacag

SEQ ID NO: 1680887 - RNA, 18 nt, Homo sapiens
gaagagauuuuucaugau

SEQ ID NO: 1680888 - RNA, 13 nt, Homo sapiens
gaauuucccacau

SEQ ID NO: 1680889 - RNA, 11 nt, Homo sapiens
gacaccaaauu

SEQ ID NO: 1680890 - RNA, 15 nt, Homo sapiens
gagauuuuucaugau

SEQ ID NO: 1680891 - RNA, 16 nt, Homo sapiens
gagcaccgccugugaa

SEQ ID NO: 1680892 - RNA, 14 nt, Homo sapiens
gaggcaucuggaaa

SEQ ID NO: 1680893 - RNA, 19 nt, Homo sapiens
gcaaucaaauaauaaaucu

SEQ ID NO: 1680894 - RNA, 19 nt, Homo sapiens
gcagagcuuucaaggauag

SEQ ID NO: 1680895 - RNA, 16 nt, Homo sapiens
gcaucuggauucugcc

SEQ ID NO: 1680896 - RNA, 22 nt, Homo sapiens
gcaucuggauucugccuaauaa

SEQ ID NO: 1680897 - RNA, 17 nt, Homo sapiens
ggccagaugcacauccc

SEQ ID NO: 1680898 - RNA, 13 nt, Homo sapiens
gggaaaaccagac

SEQ ID NO: 1680899 - RNA, 15 nt, Homo sapiens
gguggaacaagcaca

SEQ ID NO: 1680900 - RNA, 13 nt, Homo sapiens
guccaacuacuaa

SEQ ID NO: 1680901 - RNA, 18 nt, Homo sapiens
gugcuuguaaaaagucaa

SEQ ID NO: 1680902 - RNA, 16 nt, Homo sapiens
guggauguaaagugau

SEQ ID NO: 1680903 - RNA, 18 nt, Homo sapiens
guuaugccgcuagauaca

SEQ ID NO: 1680904 - RNA, 17 nt, Homo sapiens
guucuucuuaaagucaa

SEQ ID NO: 1680905 - RNA, 22 nt, Homo sapiens
uaaaacaaauaaauuagucucu

SEQ ID NO: 1680906 - RNA, 15 nt, Homo sapiens
uaaacauucuaucua

SEQ ID NO: 1680907 - RNA, 17 nt, Homo sapiens
uaaacucaauaaguuua

SEQ ID NO: 1680908 - RNA, 15 nt, Homo sapiens
uaaauaacaaaucuc

SEQ ID NO: 1680909 - RNA, 19 nt, Homo sapiens
uaaaucuauucugcuaaga

SEQ ID NO: 1680910 - RNA, 13 nt, Homo sapiens
uaaauuauaucaa

SEQ ID NO: 1680911 - RNA, 16 nt, Homo sapiens
uaaguccaacuacuaa

SEQ ID NO: 1680912 - RNA, 21 nt, Homo sapiens
uaauaaaucuauucugcuaag

SEQ ID NO: 1680913 - RNA, 17 nt, Homo sapiens
uaccaaccugaagacac

SEQ ID NO: 1680914 - RNA, 23 nt, Homo sapiens
uaggaaagaccauuuuuccucca

SEQ ID NO: 1680915 - RNA, 18 nt, Homo sapiens
uauucugcaagcaaucaa

SEQ ID NO: 1680916 - RNA, 24 nt, Homo sapiens
uauuuuaggucuuaauacacacag

SEQ ID NO: 1680917 - RNA, 16 nt, Homo sapiens
ucaaauaauaaaucua

SEQ ID NO: 1680918 - RNA, 16 nt, Homo sapiens
ucauauuuucuuucaa

SEQ ID NO: 1680919 - RNA, 13 nt, Homo sapiens
ucaugaagauauu

SEQ ID NO: 1680920 - RNA, 14 nt, Homo sapiens
ucaugaagauauuu

SEQ ID NO: 1680921 - RNA, 14 nt, Homo sapiens
ucaugucaugugua

SEQ ID NO: 1680922 - RNA, 16 nt, Homo sapiens
uccagggcaaggccau

SEQ ID NO: 1680923 - RNA, 15 nt, Homo sapiens
uccuacauuaauuau

SEQ ID NO: 1680924 - RNA, 17 nt, Homo sapiens
uccuuugguccuucaaa

SEQ ID NO: 1680925 - RNA, 22 nt, Homo sapiens
ucuuaauuauuguacauuuaua

SEQ ID NO: 1680926 - RNA, 14 nt, Homo sapiens
ucuugcuguccaau

SEQ ID NO: 1680927 - RNA, 19 nt, Homo sapiens
ucuuugaauaaagucugag

SEQ ID NO: 1680928 - RNA, 23 nt, Homo sapiens
ugaaauaccaaccugaagacacc

SEQ ID NO: 1680929 - RNA, 23 nt, Homo sapiens
ugaagaugauaccugaagcuguc

SEQ ID NO: 1680930 - RNA, 17 nt, Homo sapiens
ugaggaaagcauguauu

SEQ ID NO: 1680931 - RNA, 18 nt, Homo sapiens
ugauuuugaaaucaugaa

SEQ ID NO: 1680932 - RNA, 13 nt, Homo sapiens
ugcucccacagaa

SEQ ID NO: 1680933 - RNA, 13 nt, Homo sapiens
uggaacaagcaca

SEQ ID NO: 1680934 - RNA, 17 nt, Homo sapiens
uggaacaagcacagaug

SEQ ID NO: 1680935 - RNA, 15 nt, Homo sapiens
ugggagcaccgccug

SEQ ID NO: 1680936 - RNA, 20 nt, Homo sapiens
uguacacagaaauacaguua

SEQ ID NO: 1680937 - RNA, 19 nt, Homo sapiens
ugugaaauaccaaccugaa

SEQ ID NO: 1680938 - RNA, 18 nt, Homo sapiens
uuaauuauuguacauuua

SEQ ID NO: 1680939 - RNA, 18 nt, Homo sapiens
uuagaaacagcuucucaa

SEQ ID NO: 1680940 - RNA, 15 nt, Homo sapiens
uucauguaacuagaa

SEQ ID NO: 1680941 - RNA, 17 nt, Homo sapiens
uuccugauuccuuuaaa

SEQ ID NO: 1680942 - RNA, 16 nt, Homo sapiens
uuccuuuaaaugaaua

SEQ ID NO: 1680943 - RNA, 13 nt, Homo sapiens
uucugccuaauaa

SEQ ID NO: 1680944 - RNA, 20 nt, Homo sapiens
uugcuucuucccaauugcuu

SEQ ID NO: 1680945 - RNA, 16 nt, Homo sapiens
uugggauauucugaaa

SEQ ID NO: 1680946 - RNA, 20 nt, Homo sapiens
uuguucuuuggaaauacaca

SEQ ID NO: 1680947 - RNA, 15 nt, Homo sapiens
uuuagcuucccuuaa

SEQ ID NO: 1680948 - RNA, 12 nt, Homo sapiens
uuuaugcuccua

SEQ ID NO: 1680949 - RNA, 22 nt, Homo sapiens
uuuuuaaguuauuuuuacauuc

SEQ ID NO: 1680950 - RNA, 11 nt, Homo sapiens
uuuuucaugau

SEQ ID NO: 1680951 - RNA, 22 nt, Homo sapiens
gcccaugaugcagagcuuucaa

SEQ ID NO: 1680952 - RNA, 21 nt, Homo sapiens
gcccuccuccccuccuugcac

SEQ ID NO: 1680953 - RNA, 13 nt, Homo sapiens
gcuuuauucugca

SEQ ID NO: 1680954 - RNA, 20 nt, Homo sapiens
gcuuuauucugcaagcaauc

SEQ ID NO: 1680955 - RNA, 19 nt, Homo sapiens
ggauaggcuuuauucugca

SEQ ID NO: 1680956 - RNA, 23 nt, Homo sapiens
ggauuuuguauaugcauagucau

SEQ ID NO: 1680957 - RNA, 20 nt, Homo sapiens
guaaacuuaacuguucuuug

SEQ ID NO: 1680958 - RNA, 22 nt, Homo sapiens
guaaacuuaacuguucuuugcc

SEQ ID NO: 1680959 - RNA, 15 nt, Homo sapiens
guggaacaagcacag

SEQ ID NO: 1680960 - RNA, 16 nt, Homo sapiens
guguaguaaaguauca

SEQ ID NO: 1680961 - RNA, 13 nt, Homo sapiens
guuggaacauccu

SEQ ID NO: 1680962 - RNA, 16 nt, Homo sapiens
uaacuuucucuaugaa

SEQ ID NO: 1680963 - RNA, 15 nt, Homo sapiens
uaagacggauuuauu

SEQ ID NO: 1680964 - RNA, 15 nt, Homo sapiens
uaaguccaacuacua

SEQ ID NO: 1680965 - RNA, 22 nt, Homo sapiens
uaaguccaacuacuaaacuggg

SEQ ID NO: 1680966 - RNA, 22 nt, Homo sapiens
uaaugagauaaugugauauuau

SEQ ID NO: 1680967 - RNA, 14 nt, Homo sapiens
uaaugagauauuaa

SEQ ID NO: 1680968 - RNA, 20 nt, Homo sapiens
uauaucaauuuccucauauc

SEQ ID NO: 1680969 - RNA, 15 nt, Homo sapiens
uaucaauuuccucau

SEQ ID NO: 1680970 - RNA, 12 nt, Homo sapiens
uauucagcuuua

SEQ ID NO: 1680971 - RNA, 13 nt, Homo sapiens
uauuuuucaugau

SEQ ID NO: 1680972 - RNA, 18 nt, Homo sapiens
ucaaggauaggcuuuauu

SEQ ID NO: 1680973 - RNA, 13 nt, Homo sapiens
ucaauuucuacaa

SEQ ID NO: 1680974 - RNA, 18 nt, Homo sapiens
ucaguucauccauucuau

SEQ ID NO: 1680975 - RNA, 12 nt, Homo sapiens
ucaucauguauc

SEQ ID NO: 1680976 - RNA, 14 nt, Homo sapiens
ucauguaacuagaa

SEQ ID NO: 1680977 - RNA, 21 nt, Homo sapiens
ucauguaucgcuucauguaac

SEQ ID NO: 1680978 - RNA, 15 nt, Homo sapiens
uccucaguucaucca

SEQ ID NO: 1680979 - RNA, 23 nt, Homo sapiens
uccugauuccuuuaaaugaauau

SEQ ID NO: 1680980 - RNA, 16 nt, Homo sapiens
ucuagauuaagauaug

SEQ ID NO: 1680981 - RNA, 22 nt, Homo sapiens
ucuguauuuccccaacauguaa

SEQ ID NO: 1680982 - RNA, 23 nt, Homo sapiens
ucuguauuuccccaacauguaau

SEQ ID NO: 1680983 - RNA, 19 nt, Homo sapiens
ucugucacuuaauugcuac

SEQ ID NO: 1680984 - RNA, 20 nt, Homo sapiens
ucuguuuauaaacauuguau

SEQ ID NO: 1680985 - RNA, 21 nt, Homo sapiens
ucuguuuauaaacauuguaua

SEQ ID NO: 1680986 - RNA, 13 nt, Homo sapiens
ucuuggugaagau

SEQ ID NO: 1680987 - RNA, 19 nt, Homo sapiens
ugaagguggaacaagcaca

SEQ ID NO: 1680988 - RNA, 18 nt, Homo sapiens
ugacaucaccacaguuua

SEQ ID NO: 1680989 - RNA, 21 nt, Homo sapiens
ugaugcagagcuuucaaggau

SEQ ID NO: 1680990 - RNA, 13 nt, Homo sapiens
ugcagagcuuuca

SEQ ID NO: 1680991 - RNA, 18 nt, Homo sapiens
ugcagagcuuucaaggau

SEQ ID NO: 1680992 - RNA, 14 nt, Homo sapiens
uggaacaagcacag

SEQ ID NO: 1680993 - RNA, 12 nt, Homo sapiens
uggucuuugaau

SEQ ID NO: 1680994 - RNA, 16 nt, Homo sapiens
uguucccuaaguccaa

SEQ ID NO: 1680995 - RNA, 18 nt, Homo sapiens
uuauacauaacacauauc

SEQ ID NO: 1680996 - RNA, 19 nt, Homo sapiens
uuauuaauaaacauucuau

SEQ ID NO: 1680997 - RNA, 21 nt, Homo sapiens
uucccuaaguccaacuacuaa

SEQ ID NO: 1680998 - RNA, 16 nt, Homo sapiens
uuccuggucuuugaau

SEQ ID NO: 1680999 - RNA, 14 nt, Homo sapiens
uucuacaaaauccu

SEQ ID NO: 1681000 - RNA, 20 nt, Homo sapiens
uucucuuuuccuuugguccu

SEQ ID NO: 1681001 - RNA, 13 nt, Homo sapiens
uugucuacacucu

SEQ ID NO: 1681002 - RNA, 19 nt, Homo sapiens
uuucaaggauaggcuuuau

SEQ ID NO: 1681003 - RNA, 22 nt, Homo sapiens
uuugaugaacaaaauuuccuaa

SEQ ID NO: 1681004 - RNA, 20 nt, Homo sapiens
uuuucuauuguuguacacag

SEQ ID NO: 1681005 - RNA, 16 nt, Homo sapiens
guguguaguaaaguau

SEQ ID NO: 1681006 - RNA, 16 nt, Homo sapiens
guugaauuucccacau

SEQ ID NO: 1681007 - RNA, 23 nt, Homo sapiens
guuuucuuucuaaugagauauua

SEQ ID NO: 1681008 - RNA, 16 nt, Homo sapiens
uaaaucuauucugcua

SEQ ID NO: 1681009 - RNA, 19 nt, Homo sapiens
uaacuugcugcaguaugaa

SEQ ID NO: 1681010 - RNA, 19 nt, Homo sapiens
uaagaauuuuugaagugac

SEQ ID NO: 1681011 - RNA, 22 nt, Homo sapiens
uagccaauauuuuucuuacuga

SEQ ID NO: 1681012 - RNA, 16 nt, Homo sapiens
uagucaugcuaauuau

SEQ ID NO: 1681013 - RNA, 15 nt, Homo sapiens
uauaguccagcuuug

SEQ ID NO: 1681014 - RNA, 14 nt, Homo sapiens
uaucaggauacuau

SEQ ID NO: 1681015 - RNA, 14 nt, Homo sapiens
uaugaagggccuug

SEQ ID NO: 1681016 - RNA, 16 nt, Homo sapiens
uauucugcaagcaauc

SEQ ID NO: 1681017 - RNA, 19 nt, Homo sapiens
ucaacuguuuuugucuaca

SEQ ID NO: 1681018 - RNA, 23 nt, Homo sapiens
ucaaggauaggcuuuauucugca

SEQ ID NO: 1681019 - RNA, 12 nt, Homo sapiens
ucauaagauauu

SEQ ID NO: 1681020 - RNA, 13 nt, Homo sapiens
ucauaagauauuu

SEQ ID NO: 1681021 - RNA, 20 nt, Homo sapiens
ucccaaaaucauaagauauu

SEQ ID NO: 1681022 - RNA, 13 nt, Homo sapiens
uccuggucuuuga

SEQ ID NO: 1681023 - RNA, 15 nt, Homo sapiens
uccuuggaaauugga

SEQ ID NO: 1681024 - RNA, 23 nt, Homo sapiens
ucuaugaccucgcccuccacaaa

SEQ ID NO: 1681025 - RNA, 21 nt, Homo sapiens
ucuggaaauuuuuacuuuaaa

SEQ ID NO: 1681026 - RNA, 16 nt, Homo sapiens
ucuggauucugccuaa

SEQ ID NO: 1681027 - RNA, 19 nt, Homo sapiens
ucuuuaacuuaauugcuau

SEQ ID NO: 1681028 - RNA, 20 nt, Homo sapiens
ugaccucgcccuccacaaau

SEQ ID NO: 1681029 - RNA, 16 nt, Homo sapiens
ugcccaugaugcagag

SEQ ID NO: 1681030 - RNA, 18 nt, Homo sapiens
ugcugaccagacagccuc

SEQ ID NO: 1681031 - RNA, 16 nt, Homo sapiens
uggaacaagcacagau

SEQ ID NO: 1681032 - RNA, 15 nt, Homo sapiens
ugggaaaaccagacu

SEQ ID NO: 1681033 - RNA, 15 nt, Homo sapiens
ugggaacacaaugcc

SEQ ID NO: 1681034 - RNA, 18 nt, Homo sapiens
uguaaagugauauuuccc

SEQ ID NO: 1681035 - RNA, 21 nt, Homo sapiens
uguaacuauaguccagcuuug

SEQ ID NO: 1681036 - RNA, 16 nt, Homo sapiens
uguauuucaagaccuc

SEQ ID NO: 1681037 - RNA, 17 nt, Homo sapiens
uuaauaccacagcuuuu

SEQ ID NO: 1681038 - RNA, 18 nt, Homo sapiens
uucaggcaacgcacaaaa

SEQ ID NO: 1681039 - RNA, 14 nt, Homo sapiens
uuccuggucuuuga

SEQ ID NO: 1681040 - RNA, 21 nt, Homo sapiens
uucuauuuuauaaaacaaaua

SEQ ID NO: 1681041 - RNA, 14 nt, Homo sapiens
uugagcaucuggau

SEQ ID NO: 1681042 - RNA, 21 nt, Homo sapiens
uugggagcaccgccugugaaa

SEQ ID NO: 1681043 - RNA, 21 nt, Homo sapiens
uugggauauucugaaacuuga

SEQ ID NO: 1681044 - RNA, 11 nt, Homo sapiens
uuuacuuuaaa

SEQ ID NO: 1681045 - RNA, 22 nt, Homo sapiens
uuuccaugcacccucauacaca

SEQ ID NO: 1681046 - RNA, 18 nt, Homo sapiens
uuucuuuuuuauacucaa

SEQ ID NO: 1681047 - RNA, 15 nt, Homo sapiens
uuuugaaaccaugaa

SEQ ID NO: 1681048 - RNA, 21 nt, Homo sapiens
aaaaucuauuuuguaacuuuc

SEQ ID NO: 1681049 - RNA, 23 nt, Homo sapiens
aaaaugaagguggaacaagcaca

SEQ ID NO: 1681050 - RNA, 17 nt, Homo sapiens
aaaugggaaaaccagac

SEQ ID NO: 1681051 - RNA, 12 nt, Homo sapiens
aacgcacaaaac

SEQ ID NO: 1681052 - RNA, 19 nt, Homo sapiens
aagaauuuuugaagugacu

SEQ ID NO: 1681053 - RNA, 22 nt, Homo sapiens
aagacaccaaauugaacucacu

SEQ ID NO: 1681054 - RNA, 17 nt, Homo sapiens
aagcugccgguucuuaa

SEQ ID NO: 1681055 - RNA, 18 nt, Homo sapiens
aagcugucaccucuugau

SEQ ID NO: 1681056 - RNA, 18 nt, Homo sapiens
aauaaucauucuuauuuc

SEQ ID NO: 1681057 - RNA, 19 nt, Homo sapiens
aauauuuuguuuugugcag

SEQ ID NO: 1681058 - RNA, 15 nt, Homo sapiens
aaucuauucugcuaa

SEQ ID NO: 1681059 - RNA, 14 nt, Homo sapiens
aauuuauucuuggu

SEQ ID NO: 1681060 - RNA, 14 nt, Homo sapiens
aauuuuuacuuuaa

SEQ ID NO: 1681061 - RNA, 12 nt, Homo sapiens
aauuuuucuucc

SEQ ID NO: 1681062 - RNA, 15 nt, Homo sapiens
acauuuuuaguuuaa

SEQ ID NO: 1681063 - RNA, 14 nt, Homo sapiens
acccucauacacag

SEQ ID NO: 1681064 - RNA, 18 nt, Homo sapiens
acucacuuucuagauuaa

SEQ ID NO: 1681065 - RNA, 12 nt, Homo sapiens
agacaccaaauu

SEQ ID NO: 1681066 - RNA, 16 nt, Homo sapiens
agaccucugugcacuu

SEQ ID NO: 1681067 - RNA, 12 nt, Homo sapiens
agcuuucaagga

SEQ ID NO: 1681068 - RNA, 22 nt, Homo sapiens
agcuuucaaggauaggcuuuau

SEQ ID NO: 1681069 - RNA, 15 nt, Homo sapiens
aggcugaaagacagg

SEQ ID NO: 1681070 - RNA, 15 nt, Homo sapiens
agugcugaccagaca

SEQ ID NO: 1681071 - RNA, 15 nt, Homo sapiens
aguuuaauaccacag

SEQ ID NO: 1681072 - RNA, 18 nt, Homo sapiens
auaagaagacccuauuuc

SEQ ID NO: 1681073 - RNA, 22 nt, Homo sapiens
auaccaaccugaagacaccguu

SEQ ID NO: 1681074 - RNA, 19 nt, Homo sapiens
auaggcuuuauucugcaag

SEQ ID NO: 1681075 - RNA, 12 nt, Homo sapiens
auauacuaugag

SEQ ID NO: 1681076 - RNA, 18 nt, Homo sapiens
augaagguggaacaagca

SEQ ID NO: 1681077 - RNA, 15 nt, Homo sapiens
augaugcagagcuuu

SEQ ID NO: 1681078 - RNA, 14 nt, Homo sapiens
augcagagcuuuca

SEQ ID NO: 1681079 - RNA, 15 nt, Homo sapiens
auucugcaagcaauc

SEQ ID NO: 1681080 - RNA, 14 nt, Homo sapiens
auuggaagagcaca

SEQ ID NO: 1681081 - RNA, 13 nt, Homo sapiens
auuucaagaccuc

SEQ ID NO: 1681082 - RNA, 18 nt, Homo sapiens
auuuugaaaucaugaaga

SEQ ID NO: 1681083 - RNA, 17 nt, Homo sapiens
caaauauuauucuuaau

SEQ ID NO: 1681084 - RNA, 18 nt, Homo sapiens
caaaugggaaaaccagac

SEQ ID NO: 1681085 - RNA, 17 nt, Homo sapiens
caagacaccaaauugaa

SEQ ID NO: 1681086 - RNA, 18 nt, Homo sapiens
caagaccucugugcacuu

SEQ ID NO: 1681087 - RNA, 15 nt, Homo sapiens
caagcaaucaaauaa

SEQ ID NO: 1681088 - RNA, 23 nt, Homo sapiens
cacaucccuggaaggacauccau

SEQ ID NO: 1681089 - RNA, 21 nt, Homo sapiens
cagaacacagcaauuccucag

SEQ ID NO: 1681090 - RNA, 23 nt, Homo sapiens
cagcaaggccagaugcacauccc

SEQ ID NO: 1681091 - RNA, 14 nt, Homo sapiens
caggcaacgcacaa

SEQ ID NO: 1681092 - RNA, 20 nt, Homo sapiens
caggcaacgcacaaaacaga

SEQ ID NO: 1681093 - RNA, 23 nt, Homo sapiens
caggcccuccuugucuuuuuacu

SEQ ID NO: 1681094 - RNA, 18 nt, Homo sapiens
caugcacccucauacaca

SEQ ID NO: 1681095 - RNA, 15 nt, Homo sapiens
cauucuaucuauucc

SEQ ID NO: 1681096 - RNA, 12 nt, Homo sapiens
ccgagaagaaca

SEQ ID NO: 1681097 - RNA, 16 nt, Homo sapiens
ccuugcaccggcccuu

SEQ ID NO: 1681098 - RNA, 20 nt, Homo sapiens
cuaagcugccgguucuuaaa

SEQ ID NO: 1681099 - RNA, 14 nt, Homo sapiens
cuaauaguuuuauu

SEQ ID NO: 1681100 - RNA, 17 nt, Homo sapiens
cuaucuuuugcauccua

SEQ ID NO: 1681101 - RNA, 20 nt, Homo sapiens
cucacugcccaugaugcaga

SEQ ID NO: 1681102 - RNA, 23 nt, Homo sapiens
cucacuuucuagauuaagauaug

SEQ ID NO: 1681103 - RNA, 12 nt, Homo sapiens
cucccacagaac

SEQ ID NO: 1681104 - RNA, 17 nt, Homo sapiens
cugcaagcaaucaaaua

SEQ ID NO: 1681105 - RNA, 17 nt, Homo sapiens
cugcccugcucccacag

SEQ ID NO: 1681106 - RNA, 14 nt, Homo sapiens
cugcucccacagaa

SEQ ID NO: 1681107 - RNA, 17 nt, Homo sapiens
cuguauuucaagaccuc

SEQ ID NO: 1681108 - RNA, 19 nt, Homo sapiens
cuguuuuugucuacacucu

SEQ ID NO: 1681109 - RNA, 22 nt, Homo sapiens
cuuuauucugcaagcaaucaaa

SEQ ID NO: 1681110 - RNA, 19 nt, Homo sapiens
cuuucuugcuguccaauuu

SEQ ID NO: 1681111 - RNA, 16 nt, Homo sapiens
cuuuggaaauacacag

SEQ ID NO: 1681112 - RNA, 22 nt, Homo sapiens
cuuuguucccuaaguccaacua

SEQ ID NO: 1681113 - RNA, 18 nt, Homo sapiens
gaaccugcccugcuccca

SEQ ID NO: 1681114 - RNA, 14 nt, Homo sapiens
gaauuuuugaagug

SEQ ID NO: 1681115 - RNA, 13 nt, Homo sapiens
gauaggcuuuauu

SEQ ID NO: 1681116 - RNA, 20 nt, Homo sapiens
gaugcagagcuuucaaggau

SEQ ID NO: 1681117 - RNA, 17 nt, Homo sapiens
gcaagcaaucaaauaau

SEQ ID NO: 1681118 - RNA, 23 nt, Homo sapiens
gcccuccuccccuccuugcaccg

SEQ ID NO: 1681119 - RNA, 22 nt, Homo sapiens
gcucacugcccaugaugcagag

SEQ ID NO: 1681120 - RNA, 17 nt, Homo sapiens
ggaaggacauccauguu

SEQ ID NO: 1681121 - RNA, 16 nt, Homo sapiens
ggcaacgcacaaaaca

SEQ ID NO: 1681122 - RNA, 16 nt, Homo sapiens
aaagucaagauuucca

SEQ ID NO: 1681123 - RNA, 23 nt, Homo sapiens
aaauaagacggauuuauuuuucc

SEQ ID NO: 1681124 - RNA, 22 nt, Homo sapiens
aaauacacagugcugaccagac

SEQ ID NO: 1681125 - RNA, 12 nt, Homo sapiens
aaauauuuugcu

SEQ ID NO: 1681126 - RNA, 22 nt, Homo sapiens
aaaucuauuuuguaacuuucuc

SEQ ID NO: 1681127 - RNA, 18 nt, Homo sapiens
aaaugggaaaaccagacu

SEQ ID NO: 1681128 - RNA, 16 nt, Homo sapiens
aacacaaugccuacuu

SEQ ID NO: 1681129 - RNA, 22 nt, Homo sapiens
aacagauaaucccuguauuuca

SEQ ID NO: 1681130 - RNA, 19 nt, Homo sapiens
aacucuguuuucuuucuaa

SEQ ID NO: 1681131 - RNA, 22 nt, Homo sapiens
aacugugacugcagugcuguaa

SEQ ID NO: 1681132 - RNA, 17 nt, Homo sapiens
aagacaccguucauuca

SEQ ID NO: 1681133 - RNA, 22 nt, Homo sapiens
aagagauuuuucaugauuuuga

SEQ ID NO: 1681134 - RNA, 20 nt, Homo sapiens
aauaaaucuauucugcuaag

SEQ ID NO: 1681135 - RNA, 19 nt, Homo sapiens
acaagacaccaaauugaac

SEQ ID NO: 1681136 - RNA, 14 nt, Homo sapiens
acaccguucauuca

SEQ ID NO: 1681137 - RNA, 9 nt, Homo sapiens
accaugcug

SEQ ID NO: 1681138 - RNA, 24 nt, Homo sapiens
acuguucuuugccagaacacaaga

SEQ ID NO: 1681139 - RNA, 20 nt, Homo sapiens
acuugagacagcacuaugua

SEQ ID NO: 1681140 - RNA, 17 nt, Homo sapiens
acuugcugcaguaugaa

SEQ ID NO: 1681141 - RNA, 13 nt, Homo sapiens
agauaaagaccuu

SEQ ID NO: 1681142 - RNA, 14 nt, Homo sapiens
agaugauaccugaa

SEQ ID NO: 1681143 - RNA, 15 nt, Homo sapiens
aggaaagcauguauu

SEQ ID NO: 1681144 - RNA, 23 nt, Homo sapiens
aggggcuguugaauuucccacau

SEQ ID NO: 1681145 - RNA, 18 nt, Homo sapiens
agguggaacaagcacaga

SEQ ID NO: 1681146 - RNA, 15 nt, Homo sapiens
agucaagauuuccau

SEQ ID NO: 1681147 - RNA, 14 nt, Homo sapiens
aguccaacuacuaa

SEQ ID NO: 1681148 - RNA, 22 nt, Homo sapiens
agugacugggcaggcagcagaa

SEQ ID NO: 1681149 - RNA, 17 nt, Homo sapiens
auaaaucuauucugcua

SEQ ID NO: 1681150 - RNA, 18 nt, Homo sapiens
auaaaucuauucugcuaa

SEQ ID NO: 1681151 - RNA, 21 nt, Homo sapiens
auaaucauucuuauuucauga

SEQ ID NO: 1681152 - RNA, 18 nt, Homo sapiens
auacaugcuuuuuaauga

SEQ ID NO: 1681153 - RNA, 17 nt, Homo sapiens
auaccugaagcugucac

SEQ ID NO: 1681154 - RNA, 18 nt, Homo sapiens
auauuuuguuuugugcag

SEQ ID NO: 1681155 - RNA, 12 nt, Homo sapiens
aucuauucugcu

SEQ ID NO: 1681156 - RNA, 23 nt, Homo sapiens
augaucuagagccaguuacuuug

SEQ ID NO: 1681157 - RNA, 19 nt, Homo sapiens
auggaauaaacuccauuua

SEQ ID NO: 1681158 - RNA, 17 nt, Homo sapiens
auguuccgagaagaaca

SEQ ID NO: 1681159 - RNA, 13 nt, Homo sapiens
auuaccaguuuuc

SEQ ID NO: 1681160 - RNA, 17 nt, Homo sapiens
auucaggcaacgcacaa

SEQ ID NO: 1681161 - RNA, 22 nt, Homo sapiens
auucuauuuuauaaaacaaaua

SEQ ID NO: 1681162 - RNA, 17 nt, Homo sapiens
auucucacacacauaca

SEQ ID NO: 1681163 - RNA, 17 nt, Homo sapiens
auuuuauaaaacaaaua

SEQ ID NO: 1681164 - RNA, 19 nt, Homo sapiens
auuuuuaguuuaaaaaccu

SEQ ID NO: 1681165 - RNA, 16 nt, Homo sapiens
caagaccucugugcac

SEQ ID NO: 1681166 - RNA, 13 nt, Homo sapiens
caaucaaauaaua

SEQ ID NO: 1681167 - RNA, 23 nt, Homo sapiens
caauuuucuuuuuuauacucaau

SEQ ID NO: 1681168 - RNA, 15 nt, Homo sapiens
cagaaauuaaaugaa

SEQ ID NO: 1681169 - RNA, 16 nt, Homo sapiens
cagagauaaagaccuu

SEQ ID NO: 1681170 - RNA, 17 nt, Homo sapiens
cagcagaaauuaaauga

SEQ ID NO: 1681171 - RNA, 18 nt, Homo sapiens
cagcagaaauuaaaugaa

SEQ ID NO: 1681172 - RNA, 12 nt, Homo sapiens
cagccauguauu

SEQ ID NO: 1681173 - RNA, 15 nt, Homo sapiens
caggcaacgcacaaa

SEQ ID NO: 1681174 - RNA, 18 nt, Homo sapiens
caggcaacgcacaaaaca

SEQ ID NO: 1681175 - RNA, 18 nt, Homo sapiens
caucuggauucugccuaa

SEQ ID NO: 1681176 - RNA, 14 nt, Homo sapiens
cauugggauauucu

SEQ ID NO: 1681177 - RNA, 13 nt, Homo sapiens
cccugcucccaca

SEQ ID NO: 1681178 - RNA, 15 nt, Homo sapiens
ccucgcccuccacaa

SEQ ID NO: 1681179 - RNA, 12 nt, Homo sapiens
cuaaaagcuuuc

SEQ ID NO: 1681180 - RNA, 18 nt, Homo sapiens
cuaaaagcuuucaugucc

SEQ ID NO: 1681181 - RNA, 14 nt, Homo sapiens
cuaaaauguucuaa

SEQ ID NO: 1681182 - RNA, 20 nt, Homo sapiens
cuaaagccaggcucaggaga

SEQ ID NO: 1681183 - RNA, 23 nt, Homo sapiens
cuaaauuauuuacugcaaaaaga

SEQ ID NO: 1681184 - RNA, 13 nt, Homo sapiens
cuaacaucuccau

SEQ ID NO: 1681185 - RNA, 15 nt, Homo sapiens
cuaagauuuugugaa

SEQ ID NO: 1681186 - RNA, 12 nt, Homo sapiens
cuaagugcugcu

SEQ ID NO: 1681187 - RNA, 23 nt, Homo sapiens
cuaaugacaaguauuuucuacua

SEQ ID NO: 1681188 - RNA, 15 nt, Homo sapiens
cuacauguauugcac

SEQ ID NO: 1681189 - RNA, 18 nt, Homo sapiens
cuacauuccacccuguua

SEQ ID NO: 1681190 - RNA, 15 nt, Homo sapiens
cuaccaaagcccacu

SEQ ID NO: 1681191 - RNA, 12 nt, Homo sapiens
cuacugcuccug

SEQ ID NO: 1681192 - RNA, 16 nt, Homo sapiens
cuagaaagacagaagc

SEQ ID NO: 1681193 - RNA, 18 nt, Homo sapiens
cuagacuagacaucacaa

SEQ ID NO: 1681194 - RNA, 18 nt, Homo sapiens
cuagacugcuccugggca

SEQ ID NO: 1681195 - RNA, 18 nt, Homo sapiens
cuagagaaggcauuucau

SEQ ID NO: 1681196 - RNA, 12 nt, Homo sapiens
cuagcacuuugg

SEQ ID NO: 1681197 - RNA, 12 nt, Homo sapiens
cuagcaguacua

SEQ ID NO: 1681198 - RNA, 19 nt, Homo sapiens
cuaggcccugugagcacaa

SEQ ID NO: 1681199 - RNA, 16 nt, Homo sapiens
cuagggucuugggggu

SEQ ID NO: 1681200 - RNA, 12 nt, Homo sapiens
cuaguucagcug

SEQ ID NO: 1681201 - RNA, 11 nt, Homo sapiens
cuauacugugg

SEQ ID NO: 1681202 - RNA, 13 nt, Homo sapiens
cuauauagacuug

SEQ ID NO: 1681203 - RNA, 16 nt, Homo sapiens
cuaucuucuuuggacu

SEQ ID NO: 1681204 - RNA, 18 nt, Homo sapiens
cuauggagugcucacaaa

SEQ ID NO: 1681205 - RNA, 16 nt, Homo sapiens
cuauguacugccuuag

SEQ ID NO: 1681206 - RNA, 13 nt, Homo sapiens
cuauuaauauuca

SEQ ID NO: 1681207 - RNA, 21 nt, Homo sapiens
cucaaagcagcaggacugugg

SEQ ID NO: 1681208 - RNA, 19 nt, Homo sapiens
cucaaucccugaggacuga

SEQ ID NO: 1681209 - RNA, 22 nt, Homo sapiens
cucaaugcaguuagcugaagaa

SEQ ID NO: 1681210 - RNA, 12 nt, Homo sapiens
cucacacacaaa

SEQ ID NO: 1681211 - RNA, 23 nt, Homo sapiens
cucaccugucuaggucuccucag

SEQ ID NO: 1681212 - RNA, 11 nt, Homo sapiens
cucacuacuga

SEQ ID NO: 1681213 - RNA, 14 nt, Homo sapiens
cucagccucaggga

SEQ ID NO: 1681214 - RNA, 23 nt, Homo sapiens
cucagccugcuuuccugcagcag

SEQ ID NO: 1681215 - RNA, 23 nt, Homo sapiens
cucagcuucuucacaggcacucc

SEQ ID NO: 1681216 - RNA, 19 nt, Homo sapiens
cucaggccaagggaccagg

SEQ ID NO: 1681217 - RNA, 22 nt, Homo sapiens
cucagguuuguuuugugaauuu

SEQ ID NO: 1681218 - RNA, 14 nt, Homo sapiens
cucagugaccagug

SEQ ID NO: 1681219 - RNA, 21 nt, Homo sapiens
cucagugaccagugccuguga

SEQ ID NO: 1681220 - RNA, 13 nt, Homo sapiens
cucaucuugccuc

SEQ ID NO: 1681221 - RNA, 17 nt, Homo sapiens
cucaugccuguaaucuc

SEQ ID NO: 1681222 - RNA, 20 nt, Homo sapiens
cucaugucuucucacaagcc

SEQ ID NO: 1681223 - RNA, 20 nt, Homo sapiens
cucauuauucacaguaauua

SEQ ID NO: 1681224 - RNA, 20 nt, Homo sapiens
cuccaaugacugagcagcau

SEQ ID NO: 1681225 - RNA, 20 nt, Homo sapiens
cuccagauaguguagcugag

SEQ ID NO: 1681226 - RNA, 16 nt, Homo sapiens
cuccauucaggauucu

SEQ ID NO: 1681227 - RNA, 20 nt, Homo sapiens
cucccauaaacacugaauua

SEQ ID NO: 1681228 - RNA, 15 nt, Homo sapiens
cucccucagcucucu

SEQ ID NO: 1681229 - RNA, 20 nt, Homo sapiens
cuccucccaaggcauucucc

SEQ ID NO: 1681230 - RNA, 12 nt, Homo sapiens
cuccugccuuag

SEQ ID NO: 1681231 - RNA, 23 nt, Homo sapiens
cuccuuauagacacuugcuccca

SEQ ID NO: 1681232 - RNA, 13 nt, Homo sapiens
cuccuucgcuuaa

SEQ ID NO: 1681233 - RNA, 14 nt, Homo sapiens
cucgggagccaugu

SEQ ID NO: 1681234 - RNA, 14 nt, Homo sapiens
cucuaagugcugcu

SEQ ID NO: 1681235 - RNA, 17 nt, Homo sapiens
cucuaccugcacacugu

SEQ ID NO: 1681236 - RNA, 22 nt, Homo sapiens
cucuaggcccugugagcacaaa

SEQ ID NO: 1681237 - RNA, 21 nt, Homo sapiens
cucuagguacgaugacagugu

SEQ ID NO: 1681238 - RNA, 18 nt, Homo sapiens
cuuucccaaccccaggaa

SEQ ID NO: 1681239 - RNA, 22 nt, Homo sapiens
cuuucccagucccauuccucag

SEQ ID NO: 1681240 - RNA, 16 nt, Homo sapiens
cuuuccugcagcaguc

SEQ ID NO: 1681241 - RNA, 21 nt, Homo sapiens
cuuucuuugaccucuucucuc

SEQ ID NO: 1681242 - RNA, 13 nt, Homo sapiens
cuuugacaguguu

SEQ ID NO: 1681243 - RNA, 19 nt, Homo sapiens
cuuugcaguuggacucuca

SEQ ID NO: 1681244 - RNA, 18 nt, Homo sapiens
cuuugguuaauguugauu

SEQ ID NO: 1681245 - RNA, 14 nt, Homo sapiens
cuuugucaguguug

SEQ ID NO: 1681246 - RNA, 20 nt, Homo sapiens
cuuugucuaaguagggccag

SEQ ID NO: 1681247 - RNA, 11 nt, Homo sapiens
cuuugugacca

SEQ ID NO: 1681248 - RNA, 15 nt, Homo sapiens
cuuugugacuucaag

SEQ ID NO: 1681249 - RNA, 18 nt, Homo sapiens
cuuuuacagguuaagaca

SEQ ID NO: 1681250 - RNA, 14 nt, Homo sapiens
cuuuugaauugcac

SEQ ID NO: 1681251 - RNA, 16 nt, Homo sapiens
cuuuugcuugaauuua

SEQ ID NO: 1681252 - RNA, 21 nt, Homo sapiens
gaaaaaugcaagccaucucua

SEQ ID NO: 1681253 - RNA, 13 nt, Homo sapiens
gaaaacauuugcu

SEQ ID NO: 1681254 - RNA, 16 nt, Homo sapiens
gaaaauaaaagcacuu

SEQ ID NO: 1681255 - RNA, 17 nt, Homo sapiens
gaaaauaaaagcacuua

SEQ ID NO: 1681256 - RNA, 20 nt, Homo sapiens
gaaacacuauuugugacuuu

SEQ ID NO: 1681257 - RNA, 18 nt, Homo sapiens
gaaacaugggcugugauu

SEQ ID NO: 1681258 - RNA, 13 nt, Homo sapiens
gaaacccagagau

SEQ ID NO: 1681259 - RNA, 15 nt, Homo sapiens
gaaagaacacuuccc

SEQ ID NO: 1681260 - RNA, 19 nt, Homo sapiens
gaaagacuggcccucuagc

SEQ ID NO: 1681261 - RNA, 11 nt, Homo sapiens
gaaagcacaag

SEQ ID NO: 1681262 - RNA, 16 nt, Homo sapiens
gaaagguuuuccuuau

SEQ ID NO: 1681263 - RNA, 16 nt, Homo sapiens
gaaaguaacugugaga

SEQ ID NO: 1681264 - RNA, 16 nt, Homo sapiens
gaaauaaacugugcaa

SEQ ID NO: 1681265 - RNA, 16 nt, Homo sapiens
gaaauacucaugugca

SEQ ID NO: 1681266 - RNA, 16 nt, Homo sapiens
gaaaucuuaaaccuua

SEQ ID NO: 1681267 - RNA, 17 nt, Homo sapiens
gaaaugcauauuugcaa

SEQ ID NO: 1681268 - RNA, 18 nt, Homo sapiens
gaaaugccagugguggag

SEQ ID NO: 1681269 - RNA, 16 nt, Homo sapiens
gaaauuauuucucuca

SEQ ID NO: 1681270 - RNA, 15 nt, Homo sapiens
gaacauaacuucuca

SEQ ID NO: 1681271 - RNA, 17 nt, Homo sapiens
gaacauguuuaaugggu

SEQ ID NO: 1681272 - RNA, 16 nt, Homo sapiens
gaaccaauaccuucaa

SEQ ID NO: 1681273 - RNA, 12 nt, Homo sapiens
gaacuaggcucu

SEQ ID NO: 1681274 - RNA, 18 nt, Homo sapiens
gaacuguacacagaauug

SEQ ID NO: 1681275 - RNA, 13 nt, Homo sapiens
gaagcauuuugca

SEQ ID NO: 1681276 - RNA, 22 nt, Homo sapiens
gaagcugccguagcuucagcca

SEQ ID NO: 1681277 - RNA, 12 nt, Homo sapiens
gaaggacuauca

SEQ ID NO: 1681278 - RNA, 19 nt, Homo sapiens
gaaggagaaguaagaggcu

SEQ ID NO: 1681279 - RNA, 21 nt, Homo sapiens
gaaggggccugggcugugagg

SEQ ID NO: 1681280 - RNA, 15 nt, Homo sapiens
gaaggugaacuuugu

SEQ ID NO: 1681281 - RNA, 16 nt, Homo sapiens
gaaggugaacuuugug

SEQ ID NO: 1681282 - RNA, 14 nt, Homo sapiens
gaaguauguauauu

SEQ ID NO: 1681283 - RNA, 16 nt, Homo sapiens
gaagucuaaaugaagu

SEQ ID NO: 1681284 - RNA, 15 nt, Homo sapiens
gaagucugagggaaa

SEQ ID NO: 1681285 - RNA, 15 nt, Homo sapiens
gaagucuucuauuua

SEQ ID NO: 1681286 - RNA, 12 nt, Homo sapiens
gaaguguuucac

SEQ ID NO: 1681287 - RNA, 16 nt, Homo sapiens
gaauacugccaaaaca

SEQ ID NO: 1681288 - RNA, 20 nt, Homo sapiens
gaauguuuucaaauguucuc

SEQ ID NO: 1681289 - RNA, 16 nt, Homo sapiens
gaauuauaacuguaaa

SEQ ID NO: 1681290 - RNA, 21 nt, Homo sapiens
gaauucaaguggguauucugg

SEQ ID NO: 1681291 - RNA, 18 nt, Homo sapiens
gaauucuaacaagucaua

SEQ ID NO: 1681292 - RNA, 20 nt, Homo sapiens
gaauuuaauacagacaucua

SEQ ID NO: 1681293 - RNA, 20 nt, Homo sapiens
gaauuugucggguucuccca

SEQ ID NO: 1681294 - RNA, 19 nt, Homo sapiens
gacacaggauccuggccug

SEQ ID NO: 1681295 - RNA, 16 nt, Homo sapiens
gacaccauuaccaaaa

SEQ ID NO: 1681296 - RNA, 12 nt, Homo sapiens
gacagcaaguga

SEQ ID NO: 1681297 - RNA, 20 nt, Homo sapiens
gacagggcccuggagcucag

SEQ ID NO: 1681298 - RNA, 20 nt, Homo sapiens
gacaguucccagagugggcu

SEQ ID NO: 1681299 - RNA, 23 nt, Homo sapiens
gacaguugauggagccccagggu

SEQ ID NO: 1681300 - RNA, 21 nt, Homo sapiens
gacauuugggagacaugugac

SEQ ID NO: 1681301 - RNA, 18 nt, Homo sapiens
gcuacuguaaugcugccu

SEQ ID NO: 1681302 - RNA, 17 nt, Homo sapiens
gcuauaacuuacuucug

SEQ ID NO: 1681303 - RNA, 22 nt, Homo sapiens
gcucaacagaacauauguugca

SEQ ID NO: 1681304 - RNA, 20 nt, Homo sapiens
gcucacgccuguaauucuag

SEQ ID NO: 1681305 - RNA, 12 nt, Homo sapiens
gcucacuacuga

SEQ ID NO: 1681306 - RNA, 23 nt, Homo sapiens
gcucacuacugaacacaugugua

SEQ ID NO: 1681307 - RNA, 19 nt, Homo sapiens
gcucaugccuguaaucuca

SEQ ID NO: 1681308 - RNA, 17 nt, Homo sapiens
gcuccccuaaagccagg

SEQ ID NO: 1681309 - RNA, 15 nt, Homo sapiens
gcuccgggaucagca

SEQ ID NO: 1681310 - RNA, 22 nt, Homo sapiens
gcuccuccccuuccucuugucu

SEQ ID NO: 1681311 - RNA, 14 nt, Homo sapiens
gcucuauacugugg

SEQ ID NO: 1681312 - RNA, 23 nt, Homo sapiens
gcucugacagccuagaaguccaa

SEQ ID NO: 1681313 - RNA, 18 nt, Homo sapiens
gcucuuaugugugccuuu

SEQ ID NO: 1681314 - RNA, 22 nt, Homo sapiens
gcugaaauuuuagaaauauuca

SEQ ID NO: 1681315 - RNA, 14 nt, Homo sapiens
gcugcaacccaagu

SEQ ID NO: 1681316 - RNA, 16 nt, Homo sapiens
gcugcucggcuacugg

SEQ ID NO: 1681317 - RNA, 18 nt, Homo sapiens
gcugcuugaccuagcucu

SEQ ID NO: 1681318 - RNA, 12 nt, Homo sapiens
gcuggaauucua

SEQ ID NO: 1681319 - RNA, 15 nt, Homo sapiens
gcuggaggaaccaga

SEQ ID NO: 1681320 - RNA, 20 nt, Homo sapiens
gcuggagugcaauggcgcga

SEQ ID NO: 1681321 - RNA, 13 nt, Homo sapiens
gcuggcaccagaa

SEQ ID NO: 1681322 - RNA, 15 nt, Homo sapiens
gcugggucacaucca

SEQ ID NO: 1681323 - RNA, 19 nt, Homo sapiens
gcuggugggacagugguga

SEQ ID NO: 1681324 - RNA, 17 nt, Homo sapiens
gcuuaaaaucugugaag

SEQ ID NO: 1681325 - RNA, 21 nt, Homo sapiens
gcuuaauuauugauguuuuca

SEQ ID NO: 1681326 - RNA, 17 nt, Homo sapiens
gcuuaccuccucauggc

SEQ ID NO: 1681327 - RNA, 18 nt, Homo sapiens
gcuuaccugggcacaaac

SEQ ID NO: 1681328 - RNA, 21 nt, Homo sapiens
gcuucaaaaagccacagcaga

SEQ ID NO: 1681329 - RNA, 17 nt, Homo sapiens
gcuucaaggacauuggu

SEQ ID NO: 1681330 - RNA, 19 nt, Homo sapiens
gcuuccugaugcugggcaa

SEQ ID NO: 1681331 - RNA, 22 nt, Homo sapiens
gcuucucacacuggaggagcac

SEQ ID NO: 1681332 - RNA, 15 nt, Homo sapiens
gcuucuucacaggca

SEQ ID NO: 1681333 - RNA, 22 nt, Homo sapiens
gcuuuggguggcucacuacuga

SEQ ID NO: 1681334 - RNA, 22 nt, Homo sapiens
gcuuugguggccagggaggcag

SEQ ID NO: 1681335 - RNA, 21 nt, Homo sapiens
gcuuugucacuuuuccuuuuc

SEQ ID NO: 1681336 - RNA, 15 nt, Homo sapiens
ggaaagaaaaggaaa

SEQ ID NO: 1681337 - RNA, 16 nt, Homo sapiens
ggaagacuauggugcu

SEQ ID NO: 1681338 - RNA, 19 nt, Homo sapiens
ggaagaucagcacccuaag

SEQ ID NO: 1681339 - RNA, 15 nt, Homo sapiens
ggaagggaccccaga

SEQ ID NO: 1681340 - RNA, 12 nt, Homo sapiens
ggaaucuagccc

SEQ ID NO: 1681341 - RNA, 18 nt, Homo sapiens
ggaaucuuuguaccaaaa

SEQ ID NO: 1681342 - RNA, 11 nt, Homo sapiens
ggaauggugua

SEQ ID NO: 1681343 - RNA, 17 nt, Homo sapiens
ggacaccauuaccaaaa

SEQ ID NO: 1681344 - RNA, 17 nt, Homo sapiens
ggacauuugaacauguu

SEQ ID NO: 1681345 - RNA, 20 nt, Homo sapiens
ggaccugagccugguccugg

SEQ ID NO: 1681346 - RNA, 17 nt, Homo sapiens
ggaccugcccugggcca

SEQ ID NO: 1681347 - RNA, 23 nt, Homo sapiens
ggacuaucaacaccacuaggaau

SEQ ID NO: 1681348 - RNA, 12 nt, Homo sapiens
ggacuccaagcc

SEQ ID NO: 1681349 - RNA, 21 nt, Homo sapiens
ggagcaggaccuacuaggaga

SEQ ID NO: 1681350 - RNA, 22 nt, Homo sapiens
ggagcguucuaaauaugaauga

SEQ ID NO: 1681351 - RNA, 20 nt, Homo sapiens
ggagggcucgggguguguca

SEQ ID NO: 1681352 - RNA, 22 nt, Homo sapiens
ggaggugaaaucccugccucag

SEQ ID NO: 1681353 - RNA, 13 nt, Homo sapiens
ggaguaaaauuca

SEQ ID NO: 1681354 - RNA, 15 nt, Homo sapiens
ggagugaggaccugu

SEQ ID NO: 1681355 - RNA, 12 nt, Homo sapiens
ggagugcaaugg

SEQ ID NO: 1681356 - RNA, 17 nt, Homo sapiens
ggauauuuuuuacuuua

SEQ ID NO: 1681357 - RNA, 14 nt, Homo sapiens
ggauccucccucau

SEQ ID NO: 1681358 - RNA, 14 nt, Homo sapiens
ggaucgaguguagc

SEQ ID NO: 1681359 - RNA, 19 nt, Homo sapiens
uucuaguucagcugcccca

SEQ ID NO: 1681360 - RNA, 13 nt, Homo sapiens
uucucaaucuccu

SEQ ID NO: 1681361 - RNA, 14 nt, Homo sapiens
uucuccugccuuag

SEQ ID NO: 1681362 - RNA, 22 nt, Homo sapiens
uucucucccuuccucucuccuu

SEQ ID NO: 1681363 - RNA, 19 nt, Homo sapiens
uucucugguaauauugacu

SEQ ID NO: 1681364 - RNA, 15 nt, Homo sapiens
uucuggggccaucca

SEQ ID NO: 1681365 - RNA, 16 nt, Homo sapiens
uucuguaaaacagguu

SEQ ID NO: 1681366 - RNA, 17 nt, Homo sapiens
uucuuauuuuuguacuu

SEQ ID NO: 1681367 - RNA, 14 nt, Homo sapiens
uucuuugcauucca

SEQ ID NO: 1681368 - RNA, 18 nt, Homo sapiens
uugaaaguuaacauuaau

SEQ ID NO: 1681369 - RNA, 22 nt, Homo sapiens
uugagauguugaaauuacauua

SEQ ID NO: 1681370 - RNA, 21 nt, Homo sapiens
uugaguaccuacugugugcca

SEQ ID NO: 1681371 - RNA, 22 nt, Homo sapiens
uugauugggaaaacauuugcug

SEQ ID NO: 1681372 - RNA, 14 nt, Homo sapiens
uugcaacagacugu

SEQ ID NO: 1681373 - RNA, 23 nt, Homo sapiens
uugcaaccucuuugcucaacaga

SEQ ID NO: 1681374 - RNA, 13 nt, Homo sapiens
uugcaagauucca

SEQ ID NO: 1681375 - RNA, 21 nt, Homo sapiens
uugcaagauuccaaguucuca

SEQ ID NO: 1681376 - RNA, 22 nt, Homo sapiens
uugcaagauuccaaguucucac

SEQ ID NO: 1681377 - RNA, 20 nt, Homo sapiens
uugcagcggcuccugcaaaa

SEQ ID NO: 1681378 - RNA, 12 nt, Homo sapiens
uugcaugcaugc

SEQ ID NO: 1681379 - RNA, 17 nt, Homo sapiens
uugccaggacaugcaau

SEQ ID NO: 1681380 - RNA, 17 nt, Homo sapiens
uugcccagacuacaggg

SEQ ID NO: 1681381 - RNA, 22 nt, Homo sapiens
uugcccugcgucccuucucuuu

SEQ ID NO: 1681382 - RNA, 16 nt, Homo sapiens
uugccucuugcaaugc

SEQ ID NO: 1681383 - RNA, 20 nt, Homo sapiens
uugcucaacagaacauaugu

SEQ ID NO: 1681384 - RNA, 18 nt, Homo sapiens
uugcugauaccauaugaa

SEQ ID NO: 1681385 - RNA, 13 nt, Homo sapiens
uuggaacaaucac

SEQ ID NO: 1681386 - RNA, 19 nt, Homo sapiens
uuggaacaggguuggcauu

SEQ ID NO: 1681387 - RNA, 15 nt, Homo sapiens
uuggaagaugcagaa

SEQ ID NO: 1681388 - RNA, 13 nt, Homo sapiens
uuggaauggugua

SEQ ID NO: 1681389 - RNA, 18 nt, Homo sapiens
uuggauucuaaauacaug

SEQ ID NO: 1681390 - RNA, 18 nt, Homo sapiens
uuggcauucuuugcaaua

SEQ ID NO: 1681391 - RNA, 23 nt, Homo sapiens
uuggcugggaagacuauggugcu

SEQ ID NO: 1681392 - RNA, 20 nt, Homo sapiens
uuggggcuaauuuaacaaga

SEQ ID NO: 1681393 - RNA, 19 nt, Homo sapiens
uuggguggcucacuacuga

SEQ ID NO: 1681394 - RNA, 16 nt, Homo sapiens
uugguaaauucacaaa

SEQ ID NO: 1681395 - RNA, 18 nt, Homo sapiens
uugguuugcaaccucuuu

SEQ ID NO: 1681396 - RNA, 17 nt, Homo sapiens
uuguaucaaagugugau

SEQ ID NO: 1681397 - RNA, 12 nt, Homo sapiens
uugugacuucaa

SEQ ID NO: 1681398 - RNA, 17 nt, Homo sapiens
uuguuggaaaguaacug

SEQ ID NO: 1681399 - RNA, 15 nt, Homo sapiens
uuuaagcaugugaug

SEQ ID NO: 1681400 - RNA, 17 nt, Homo sapiens
uuuaagcuucaguugcu

SEQ ID NO: 1681401 - RNA, 23 nt, Homo sapiens
uuuaauccauuucaggacucucu

SEQ ID NO: 1681402 - RNA, 14 nt, Homo sapiens
uuuacagaagugaa

SEQ ID NO: 1681403 - RNA, 21 nt, Homo sapiens
uuuagaccuguguuacuaaaa

SEQ ID NO: 1681404 - RNA, 20 nt, Homo sapiens
uuuagaugaggcucagagag

SEQ ID NO: 1681405 - RNA, 16 nt, Homo sapiens
uuuaggagaaagugua

SEQ ID NO: 1681406 - RNA, 21 nt, Homo sapiens
uuuaucucacacacauuauga

SEQ ID NO: 1681407 - RNA, 17 nt, Homo sapiens
uuuauuaaaauauuuca

SEQ ID NO: 1681408 - RNA, 13 nt, Homo sapiens
uuuauugcaaugc

SEQ ID NO: 1681409 - RNA, 13 nt, Homo sapiens
uuucaaagugaua

SEQ ID NO: 1681410 - RNA, 15 nt, Homo sapiens
uuucagcggugccaa

SEQ ID NO: 1681411 - RNA, 22 nt, Homo sapiens
uuucauaaaaacacucaacaaa

SEQ ID NO: 1681412 - RNA, 15 nt, Homo sapiens
uuucauccauuccua

SEQ ID NO: 1681413 - RNA, 16 nt, Homo sapiens
uuuccuggcagucuca

SEQ ID NO: 1681414 - RNA, 21 nt, Homo sapiens
uuucuacaacugauugcaaca

SEQ ID NO: 1681415 - RNA, 15 nt, Homo sapiens
uuucuccauucagga

SEQ ID NO: 1681416 - RNA, 23 nt, Homo sapiens
uuucucuuuacuugaaauuuggc

SEQ ID NO: 1681417 - RNA, 19 nt, Homo sapiens
uuucugcucuauacugugg

SEQ ID NO: 1681418 - RNA, 15 nt, Homo sapiens
uuucuguagugugaa

SEQ ID NO: 1681419 - RNA, 20 nt, Homo sapiens
uuugaagugaaaaaguacau

SEQ ID NO: 1681420 - RNA, 17 nt, Homo sapiens
uuugcaugcaugcaaau

SEQ ID NO: 1681421 - RNA, 21 nt, Homo sapiens
uuugcauuuugauauugcugu

SEQ ID NO: 1681422 - RNA, 18 nt, Homo sapiens
uuugccaggacaugcaau

SEQ ID NO: 1681423 - RNA, 11 nt, Homo sapiens
uuugggguccc

SEQ ID NO: 1681424 - RNA, 17 nt, Homo sapiens
uuugucuuggauauaua

SEQ ID NO: 1681425 - RNA, 15 nt, Homo sapiens
uuuguucaacaucua

SEQ ID NO: 1681426 - RNA, 17 nt, Homo sapiens
uuuguuugccaggacau

SEQ ID NO: 1681427 - RNA, 18 nt, Homo sapiens
uuuuaaaagucucacaaa

SEQ ID NO: 1681428 - RNA, 22 nt, Homo sapiens
uuuuaaacgauuagugaugucc

SEQ ID NO: 1681429 - RNA, 14 nt, Homo sapiens
uuuuagugugugca

SEQ ID NO: 1681430 - RNA, 22 nt, Homo sapiens
uuuucccaacuccucaugucuu

SEQ ID NO: 1681431 - RNA, 16 nt, Homo sapiens
uuuucccagucuguga

SEQ ID NO: 1681432 - RNA, 14 nt, Homo sapiens
uuuuggaaagucag

SEQ ID NO: 1681433 - RNA, 18 nt, Homo sapiens
uuuugguugggaaugagg

SEQ ID NO: 1681434 - RNA, 20 nt, Homo sapiens
uuuuucuucaugccugauga

SEQ ID NO: 1681435 - RNA, 15 nt, Homo sapiens
uuuuuggaaagucag

SEQ ID NO: 1681436 - RNA, 15 nt, Homo sapiens
uguugggaaaguauu

SEQ ID NO: 1681437 - RNA, 23 nt, Homo sapiens
uguuuauuucaggcauuggauau

SEQ ID NO: 1681438 - RNA, 16 nt, Homo sapiens
uguuuggaaaagacag

SEQ ID NO: 1681439 - RNA, 18 nt, Homo sapiens
uuaaaacguguaaaugaa

SEQ ID NO: 1681440 - RNA, 14 nt, Homo sapiens
uuaaaaucugugaa

SEQ ID NO: 1681441 - RNA, 19 nt, Homo sapiens
uuaaacgauuagugauguc

SEQ ID NO: 1681442 - RNA, 21 nt, Homo sapiens
uuaaagacaggagacaaaaga

SEQ ID NO: 1681443 - RNA, 22 nt, Homo sapiens
uuaaauaaguaaaagcuacuau

SEQ ID NO: 1681444 - RNA, 13 nt, Homo sapiens
uuaaaugguaaua

SEQ ID NO: 1681445 - RNA, 18 nt, Homo sapiens
uuaagagucuacucucaa

SEQ ID NO: 1681446 - RNA, 21 nt, Homo sapiens
uuaagcagaggaauaacauca

SEQ ID NO: 1681447 - RNA, 23 nt, Homo sapiens
uuaaggauaaaucauaaagucag

SEQ ID NO: 1681448 - RNA, 23 nt, Homo sapiens
uuaauaaagaugaguugguucuc

SEQ ID NO: 1681449 - RNA, 15 nt, Homo sapiens
uuaauauuucugagg

SEQ ID NO: 1681450 - RNA, 20 nt, Homo sapiens
uuaauauuuuccuaguagau

SEQ ID NO: 1681451 - RNA, 20 nt, Homo sapiens
uuaaugccugcuuuuuggaa

SEQ ID NO: 1681452 - RNA, 21 nt, Homo sapiens
uuaauggcagcuagugccuuu

SEQ ID NO: 1681453 - RNA, 19 nt, Homo sapiens
uuacagaagugaaagugag

SEQ ID NO: 1681454 - RNA, 23 nt, Homo sapiens
uuacagcugugcuccacacucag

SEQ ID NO: 1681455 - RNA, 14 nt, Homo sapiens
uuacaugaagcaga

SEQ ID NO: 1681456 - RNA, 14 nt, Homo sapiens
uuaccuccauccau

SEQ ID NO: 1681457 - RNA, 15 nt, Homo sapiens
uuaccuccucauggc

SEQ ID NO: 1681458 - RNA, 17 nt, Homo sapiens
uuagaccuguguuacua

SEQ ID NO: 1681459 - RNA, 16 nt, Homo sapiens
uuagaguaaugaaaug

SEQ ID NO: 1681460 - RNA, 19 nt, Homo sapiens
uuagaguaaugaaauggag

SEQ ID NO: 1681461 - RNA, 13 nt, Homo sapiens
uuagcaaggcaga

SEQ ID NO: 1681462 - RNA, 18 nt, Homo sapiens
uuagguauuauaaguaau

SEQ ID NO: 1681463 - RNA, 16 nt, Homo sapiens
uuaguccuaauucaau

SEQ ID NO: 1681464 - RNA, 13 nt, Homo sapiens
uuauaacaguguu

SEQ ID NO: 1681465 - RNA, 17 nt, Homo sapiens
uuauuaagcaguacaaa

SEQ ID NO: 1681466 - RNA, 15 nt, Homo sapiens
uucaaauguucucca

SEQ ID NO: 1681467 - RNA, 19 nt, Homo sapiens
uucaacagccaagcuggca

SEQ ID NO: 1681468 - RNA, 21 nt, Homo sapiens
uucaacagccaagcuggcaca

SEQ ID NO: 1681469 - RNA, 17 nt, Homo sapiens
uucaaggaggugcuuag

SEQ ID NO: 1681470 - RNA, 14 nt, Homo sapiens
uucaauccuacuuu

SEQ ID NO: 1681471 - RNA, 15 nt, Homo sapiens
uucacaaauacauaa

SEQ ID NO: 1681472 - RNA, 16 nt, Homo sapiens
uucacuguacugcaug

SEQ ID NO: 1681473 - RNA, 19 nt, Homo sapiens
uucacuguacugcauguga

SEQ ID NO: 1681474 - RNA, 20 nt, Homo sapiens
uucacuguacugcaugugac

SEQ ID NO: 1681475 - RNA, 23 nt, Homo sapiens
uucacuuuuggcaaugacucaaa

SEQ ID NO: 1681476 - RNA, 17 nt, Homo sapiens
uucagagugacuacaca

SEQ ID NO: 1681477 - RNA, 17 nt, Homo sapiens
uucagguuagugacauu

SEQ ID NO: 1681478 - RNA, 20 nt, Homo sapiens
uucagguuagugacauuuaa

SEQ ID NO: 1681479 - RNA, 12 nt, Homo sapiens
uucauacuguaa

SEQ ID NO: 1681480 - RNA, 21 nt, Homo sapiens
uuccauuuugcuaauauuuac

SEQ ID NO: 1681481 - RNA, 21 nt, Homo sapiens
uucccaacuccucaugucuuc

SEQ ID NO: 1681482 - RNA, 13 nt, Homo sapiens
uucccacuccagc

SEQ ID NO: 1681483 - RNA, 16 nt, Homo sapiens
uucccagguugacuaa

SEQ ID NO: 1681484 - RNA, 15 nt, Homo sapiens
uucccccagcacaaa

SEQ ID NO: 1681485 - RNA, 15 nt, Homo sapiens
uuccgauacaaagug

SEQ ID NO: 1681486 - RNA, 22 nt, Homo sapiens
uuccugaugccccugacaucau

SEQ ID NO: 1681487 - RNA, 21 nt, Homo sapiens
uuccuuauuaauacaaacaca

SEQ ID NO: 1681488 - RNA, 19 nt, Homo sapiens
uuccuuuauacacagugga

SEQ ID NO: 1681489 - RNA, 14 nt, Homo sapiens
uucgacuacugcuc

SEQ ID NO: 1681490 - RNA, 22 nt, Homo sapiens
uucuaacagugaaguuuuacug

SEQ ID NO: 1681491 - RNA, 15 nt, Homo sapiens
uucuacaguguccua

SEQ ID NO: 1681492 - RNA, 19 nt, Homo sapiens
aggugcacuccagacucug

SEQ ID NO: 1681493 - RNA, 17 nt, Homo sapiens
aggugcucaugcugcuc

SEQ ID NO: 1681494 - RNA, 20 nt, Homo sapiens
agguuguggggccucaggcu

SEQ ID NO: 1681495 - RNA, 18 nt, Homo sapiens
agguuucuuugacuucaa

SEQ ID NO: 1681496 - RNA, 17 nt, Homo sapiens
aguaaaagcuacuaugu

SEQ ID NO: 1681497 - RNA, 14 nt, Homo sapiens
aguaagaauaccac

SEQ ID NO: 1681498 - RNA, 16 nt, Homo sapiens
aguaagaauaccacau

SEQ ID NO: 1681499 - RNA, 16 nt, Homo sapiens
aguaauuucaguguaa

SEQ ID NO: 1681500 - RNA, 21 nt, Homo sapiens
aguacaaauguuuuucaucca

SEQ ID NO: 1681501 - RNA, 20 nt, Homo sapiens
aguacagggcagaaccaaga

SEQ ID NO: 1681502 - RNA, 16 nt, Homo sapiens
aguacaggucaucugc

SEQ ID NO: 1681503 - RNA, 18 nt, Homo sapiens
aguaccuacugugugcca

SEQ ID NO: 1681504 - RNA, 12 nt, Homo sapiens
aguacuaaucau

SEQ ID NO: 1681505 - RNA, 15 nt, Homo sapiens
aguagauccauuucc

SEQ ID NO: 1681506 - RNA, 11 nt, Homo sapiens
aguagggccag

SEQ ID NO: 1681507 - RNA, 17 nt, Homo sapiens
aguauauugauaaccuu

SEQ ID NO: 1681508 - RNA, 14 nt, Homo sapiens
agucacaggucaca

SEQ ID NO: 1681509 - RNA, 16 nt, Homo sapiens
agucagcaguccuagc

SEQ ID NO: 1681510 - RNA, 22 nt, Homo sapiens
agucaggcuuacuaaugcugcc

SEQ ID NO: 1681511 - RNA, 18 nt, Homo sapiens
agucaguucucauuauuc

SEQ ID NO: 1681512 - RNA, 16 nt, Homo sapiens
agucauuaaagacagg

SEQ ID NO: 1681513 - RNA, 22 nt, Homo sapiens
agucccagacaauuccauucaa

SEQ ID NO: 1681514 - RNA, 15 nt, Homo sapiens
agucccuuugugacu

SEQ ID NO: 1681515 - RNA, 18 nt, Homo sapiens
aguccuuaggcuacugua

SEQ ID NO: 1681516 - RNA, 15 nt, Homo sapiens
agucucauagguuaa

SEQ ID NO: 1681517 - RNA, 23 nt, Homo sapiens
agucugguaauaaaugugacuca

SEQ ID NO: 1681518 - RNA, 16 nt, Homo sapiens
agucuucaucuguccg

SEQ ID NO: 1681519 - RNA, 22 nt, Homo sapiens
agugaaacuauauguauucaca

SEQ ID NO: 1681520 - RNA, 16 nt, Homo sapiens
agugacuccaggguga

SEQ ID NO: 1681521 - RNA, 18 nt, Homo sapiens
agugacuccagggugaca

SEQ ID NO: 1681522 - RNA, 17 nt, Homo sapiens
agugagugacaaagccu

SEQ ID NO: 1681523 - RNA, 19 nt, Homo sapiens
agugauaaaauguuuguua

SEQ ID NO: 1681524 - RNA, 18 nt, Homo sapiens
agugauagaaaagugugg

SEQ ID NO: 1681525 - RNA, 18 nt, Homo sapiens
agugcuugcaagauucca

SEQ ID NO: 1681526 - RNA, 18 nt, Homo sapiens
agugggaagggagcauug

SEQ ID NO: 1681527 - RNA, 22 nt, Homo sapiens
agugggauuuccagaaccacac

SEQ ID NO: 1681528 - RNA, 15 nt, Homo sapiens
aguggugacauaguc

SEQ ID NO: 1681529 - RNA, 17 nt, Homo sapiens
aguguccuaagugcuaa

SEQ ID NO: 1681530 - RNA, 23 nt, Homo sapiens
agugugaaacagcugcccugugu

SEQ ID NO: 1681531 - RNA, 16 nt, Homo sapiens
agugugagauacugug

SEQ ID NO: 1681532 - RNA, 19 nt, Homo sapiens
aguuaagagguuuguauau

SEQ ID NO: 1681533 - RNA, 13 nt, Homo sapiens
aguuagacucaaa

SEQ ID NO: 1681534 - RNA, 20 nt, Homo sapiens
aguuagagcuggcaccagaa

SEQ ID NO: 1681535 - RNA, 21 nt, Homo sapiens
aguucuguucacguccauugc

SEQ ID NO: 1681536 - RNA, 22 nt, Homo sapiens
aguugcauagagauuuguauug

SEQ ID NO: 1681537 - RNA, 18 nt, Homo sapiens
aguuucacuguacugcau

SEQ ID NO: 1681538 - RNA, 22 nt, Homo sapiens
aguuugauuuguuaauccuuuc

SEQ ID NO: 1681539 - RNA, 16 nt, Homo sapiens
aguuuucggaaacacu

SEQ ID NO: 1681540 - RNA, 17 nt, Homo sapiens
auaaaaggaaucuuccu

SEQ ID NO: 1681541 - RNA, 21 nt, Homo sapiens
auaaauauuucucaacugagg

SEQ ID NO: 1681542 - RNA, 23 nt, Homo sapiens
auaaauguaccagagagaguugu

SEQ ID NO: 1681543 - RNA, 19 nt, Homo sapiens
auaaauguugcaaugcaug

SEQ ID NO: 1681544 - RNA, 22 nt, Homo sapiens
auaaauuuaaacuuacaaacuu

SEQ ID NO: 1681545 - RNA, 17 nt, Homo sapiens
auaacaccagugggaau

SEQ ID NO: 1681546 - RNA, 20 nt, Homo sapiens
auaacagaaagccuggguga

SEQ ID NO: 1681547 - RNA, 19 nt, Homo sapiens
auaacuuggggaggcaaga

SEQ ID NO: 1681548 - RNA, 14 nt, Homo sapiens
auaagacuacugaa

SEQ ID NO: 1681549 - RNA, 16 nt, Homo sapiens
auaagucaguguuaaa

SEQ ID NO: 1681550 - RNA, 22 nt, Homo sapiens
auaaguguuauguuuguagaua

SEQ ID NO: 1681551 - RNA, 19 nt, Homo sapiens
auaauucagcacuuaacua

SEQ ID NO: 1681552 - RNA, 21 nt, Homo sapiens
auacaaaguguaccaacauaa

SEQ ID NO: 1681553 - RNA, 17 nt, Homo sapiens
auacauauuaucucauu

SEQ ID NO: 1681554 - RNA, 18 nt, Homo sapiens
auaccauucuauucucca

SEQ ID NO: 1681555 - RNA, 12 nt, Homo sapiens
auacuccuugcu

SEQ ID NO: 1681556 - RNA, 19 nt, Homo sapiens
auacugccaaaacauuuau

SEQ ID NO: 1681557 - RNA, 18 nt, Homo sapiens
auacuugccuucugauag

SEQ ID NO: 1681558 - RNA, 16 nt, Homo sapiens
auagaaaaugcuaaag

SEQ ID NO: 1681559 - RNA, 22 nt, Homo sapiens
auagaugaguguuaaacuagau

SEQ ID NO: 1681560 - RNA, 14 nt, Homo sapiens
auagauguguuauu

SEQ ID NO: 1681561 - RNA, 19 nt, Homo sapiens
auagcaaacuucaggacuu

SEQ ID NO: 1681562 - RNA, 22 nt, Homo sapiens
auagccuccaaacauguuccca

SEQ ID NO: 1681563 - RNA, 14 nt, Homo sapiens
auaguccuuuacaa

SEQ ID NO: 1681564 - RNA, 18 nt, Homo sapiens
auagucucugcccucaua

SEQ ID NO: 1681565 - RNA, 16 nt, Homo sapiens
auagugcaacaucucu

SEQ ID NO: 1681566 - RNA, 13 nt, Homo sapiens
auagugcaauagu

SEQ ID NO: 1681567 - RNA, 13 nt, Homo sapiens
auaucaugaguga

SEQ ID NO: 1681568 - RNA, 15 nt, Homo sapiens
auaucugcauguguc

SEQ ID NO: 1681569 - RNA, 17 nt, Homo sapiens
auaugaaggauuacucu

SEQ ID NO: 1681570 - RNA, 12 nt, Homo sapiens
auaugacugcau

SEQ ID NO: 1681571 - RNA, 17 nt, Homo sapiens
auauuacugacauuucu

SEQ ID NO: 1681572 - RNA, 16 nt, Homo sapiens
auauucaggacuugaa

SEQ ID NO: 1681573 - RNA, 14 nt, Homo sapiens
auauugacuuguau

SEQ ID NO: 1681574 - RNA, 15 nt, Homo sapiens
auauuuuguuuacaa

SEQ ID NO: 1681575 - RNA, 22 nt, Homo sapiens
aucaaauaagcuaauauacagu

SEQ ID NO: 1681576 - RNA, 20 nt, Homo sapiens
aucaagaacaugucagcaau

SEQ ID NO: 1681577 - RNA, 22 nt, Homo sapiens
aucacagggaauggccacaaac

SEQ ID NO: 1681578 - RNA, 21 nt, Homo sapiens
aucagggaaaaggaguaggga

SEQ ID NO: 1681579 - RNA, 18 nt, Homo sapiens
aucaggugaggugugcuc

SEQ ID NO: 1681580 - RNA, 18 nt, Homo sapiens
aucauaaaggaucagaga

SEQ ID NO: 1681581 - RNA, 13 nt, Homo sapiens
aucauaaagucag

SEQ ID NO: 1681582 - RNA, 16 nt, Homo sapiens
aucaucucuuccucac

SEQ ID NO: 1681583 - RNA, 23 nt, Homo sapiens
aucauguauggugauagguaucu

SEQ ID NO: 1681584 - RNA, 21 nt, Homo sapiens
auccagugugagauacugugu

SEQ ID NO: 1681585 - RNA, 19 nt, Homo sapiens
auccaucccuccauucauc

SEQ ID NO: 1681586 - RNA, 18 nt, Homo sapiens
auccauuaccuccaucca

SEQ ID NO: 1681587 - RNA, 22 nt, Homo sapiens
auccauuucaggacucucucca

SEQ ID NO: 1681588 - RNA, 14 nt, Homo sapiens
aucccgucuuccag

SEQ ID NO: 1681589 - RNA, 13 nt, Homo sapiens
aucccuacaugua

SEQ ID NO: 1681590 - RNA, 20 nt, Homo sapiens
aucccuacauguauugcaca

SEQ ID NO: 1681591 - RNA, 14 nt, Homo sapiens
aucccucaccugua

SEQ ID NO: 1681592 - RNA, 14 nt, Homo sapiens
aucccuccauucau

SEQ ID NO: 1681593 - RNA, 22 nt, Homo sapiens
aucccuccauucauccuuccau

SEQ ID NO: 1681594 - RNA, 16 nt, Homo sapiens
auccuagacugcuccu

SEQ ID NO: 1681595 - RNA, 14 nt, Homo sapiens
auccuagcaaauuc

SEQ ID NO: 1681596 - RNA, 22 nt, Homo sapiens
auccuucuuucuaguucagcug

SEQ ID NO: 1681597 - RNA, 17 nt, Homo sapiens
aucuagagaaggcauuu

SEQ ID NO: 1681598 - RNA, 13 nt, Homo sapiens
aucucagcacuuu

SEQ ID NO: 1681599 - RNA, 14 nt, Homo sapiens
aucucagcacuuug

SEQ ID NO: 1681600 - RNA, 22 nt, Homo sapiens
aucucauugcuuacaagccuaa

SEQ ID NO: 1681601 - RNA, 18 nt, Homo sapiens
aucucauuuuacacaaag

SEQ ID NO: 1681602 - RNA, 12 nt, Homo sapiens
aucuccacagga

SEQ ID NO: 1681603 - RNA, 14 nt, Homo sapiens
aucucuuccucaca

SEQ ID NO: 1681604 - RNA, 21 nt, Homo sapiens
aucucuuguuuacgauuucac

SEQ ID NO: 1681605 - RNA, 15 nt, Homo sapiens
aucuuagguaagaca

SEQ ID NO: 1681606 - RNA, 11 nt, Homo sapiens
aucuugccuca

SEQ ID NO: 1681607 - RNA, 12 nt, Homo sapiens
aucuugccucau

SEQ ID NO: 1681608 - RNA, 22 nt, Homo sapiens
aucuuguuuugaaaauaaccua

SEQ ID NO: 1681609 - RNA, 17 nt, Homo sapiens
aucuuuagagaaguaua

SEQ ID NO: 1681610 - RNA, 21 nt, Homo sapiens
augaccuugaguuaacaggac

SEQ ID NO: 1681611 - RNA, 16 nt, Homo sapiens
augacucucauuuuau

SEQ ID NO: 1681612 - RNA, 23 nt, Homo sapiens
ccuuucuuuuaaugaugccaugg

SEQ ID NO: 1681613 - RNA, 18 nt, Homo sapiens
ccuuuuccccagucccag

SEQ ID NO: 1681614 - RNA, 17 nt, Homo sapiens
cgaaccuacaguuuuaa

SEQ ID NO: 1681615 - RNA, 19 nt, Homo sapiens
cgaagcccaccacuggcca

SEQ ID NO: 1681616 - RNA, 22 nt, Homo sapiens
cgaccuccccacccgcucccac

SEQ ID NO: 1681617 - RNA, 19 nt, Homo sapiens
cgaggacauuugugggcaa

SEQ ID NO: 1681618 - RNA, 13 nt, Homo sapiens
cgaugacaguguu

SEQ ID NO: 1681619 - RNA, 23 nt, Homo sapiens
cgaugauguacagauucuuucag

SEQ ID NO: 1681620 - RNA, 12 nt, Homo sapiens
cgaugcauuuaa

SEQ ID NO: 1681621 - RNA, 18 nt, Homo sapiens
cgccauuuuugugcuuuu

SEQ ID NO: 1681622 - RNA, 15 nt, Homo sapiens
cgccgccggagucca

SEQ ID NO: 1681623 - RNA, 11 nt, Homo sapiens
cgccuguaauu

SEQ ID NO: 1681624 - RNA, 16 nt, Homo sapiens
cgcuagcaguacuaau

SEQ ID NO: 1681625 - RNA, 15 nt, Homo sapiens
cggcuccugcaaaag

SEQ ID NO: 1681626 - RNA, 16 nt, Homo sapiens
cggcuuguaaauguga

SEQ ID NO: 1681627 - RNA, 15 nt, Homo sapiens
cggcuuuaagugugc

SEQ ID NO: 1681628 - RNA, 16 nt, Homo sapiens
cgggguuucuccaugu

SEQ ID NO: 1681629 - RNA, 11 nt, Homo sapiens
cgucacagccu

SEQ ID NO: 1681630 - RNA, 14 nt, Homo sapiens
cgucacagccucaa

SEQ ID NO: 1681631 - RNA, 15 nt, Homo sapiens
cguccaucucccuua

SEQ ID NO: 1681632 - RNA, 21 nt, Homo sapiens
cguccauugccggcaauggau

SEQ ID NO: 1681633 - RNA, 12 nt, Homo sapiens
cgucccuaagca

SEQ ID NO: 1681634 - RNA, 18 nt, Homo sapiens
cuaaaaaugagcuugauu

SEQ ID NO: 1681635 - RNA, 13 nt, Homo sapiens
cuaaaaguucuca

SEQ ID NO: 1681636 - RNA, 17 nt, Homo sapiens
cuaaaaguucucaaugu

SEQ ID NO: 1681637 - RNA, 20 nt, Homo sapiens
cuaaacuucaccuacauuau

SEQ ID NO: 1681638 - RNA, 21 nt, Homo sapiens
cuaacaagucaccaaaagaca

SEQ ID NO: 1681639 - RNA, 16 nt, Homo sapiens
cuaacaucuaaaaaua

SEQ ID NO: 1681640 - RNA, 15 nt, Homo sapiens
cuaacuagcauugua

SEQ ID NO: 1681641 - RNA, 13 nt, Homo sapiens
cuaagugcuuauu

SEQ ID NO: 1681642 - RNA, 20 nt, Homo sapiens
cuaagugggagaaggacuau

SEQ ID NO: 1681643 - RNA, 14 nt, Homo sapiens
cuaaugacagccuu

SEQ ID NO: 1681644 - RNA, 14 nt, Homo sapiens
cuacacacaguacg

SEQ ID NO: 1681645 - RNA, 16 nt, Homo sapiens
cuacagaacacuuugc

SEQ ID NO: 1681646 - RNA, 17 nt, Homo sapiens
cuacagaacacuuugcu

SEQ ID NO: 1681647 - RNA, 17 nt, Homo sapiens
cuacagggcuuaggacu

SEQ ID NO: 1681648 - RNA, 21 nt, Homo sapiens
cuaccaacuuguauccaggcc

SEQ ID NO: 1681649 - RNA, 20 nt, Homo sapiens
cuaccuaaaaguugguuaaa

SEQ ID NO: 1681650 - RNA, 14 nt, Homo sapiens
cuacuauguacugc

SEQ ID NO: 1681651 - RNA, 19 nt, Homo sapiens
cuacuauguacugccuuag

SEQ ID NO: 1681652 - RNA, 23 nt, Homo sapiens
cuacuuacaacccagggugugaa

SEQ ID NO: 1681653 - RNA, 20 nt, Homo sapiens
cuagauuuauuaguccuaau

SEQ ID NO: 1681654 - RNA, 12 nt, Homo sapiens
cuagcuucuacc

SEQ ID NO: 1681655 - RNA, 13 nt, Homo sapiens
cuaggcccuguga

SEQ ID NO: 1681656 - RNA, 22 nt, Homo sapiens
cuagggucuugggggucagggg

SEQ ID NO: 1681657 - RNA, 17 nt, Homo sapiens
cuaggucuccucagggu

SEQ ID NO: 1681658 - RNA, 22 nt, Homo sapiens
cuaguauuuauggguggauuua

SEQ ID NO: 1681659 - RNA, 12 nt, Homo sapiens
cuagugccuuua

SEQ ID NO: 1681660 - RNA, 19 nt, Homo sapiens
cuauaaaacucugcaugua

SEQ ID NO: 1681661 - RNA, 16 nt, Homo sapiens
cuauaacuuacuucug

SEQ ID NO: 1681662 - RNA, 13 nt, Homo sapiens
cuauacacacaca

SEQ ID NO: 1681663 - RNA, 15 nt, Homo sapiens
cuauacacacacaca

SEQ ID NO: 1681664 - RNA, 11 nt, Homo sapiens
cuauagcucuu

SEQ ID NO: 1681665 - RNA, 20 nt, Homo sapiens
cuaucaacaccacuaggaau

SEQ ID NO: 1681666 - RNA, 20 nt, Homo sapiens
cuaucauaauucagcacuua

SEQ ID NO: 1681667 - RNA, 15 nt, Homo sapiens
cuaucccucuccuaa

SEQ ID NO: 1681668 - RNA, 14 nt, Homo sapiens
cuaugagccaggca

SEQ ID NO: 1681669 - RNA, 14 nt, Homo sapiens
cuauguacugccuu

SEQ ID NO: 1681670 - RNA, 14 nt, Homo sapiens
cuaugucuggcaga

SEQ ID NO: 1681671 - RNA, 13 nt, Homo sapiens
cuauuauauucau

SEQ ID NO: 1681672 - RNA, 14 nt, Homo sapiens
cuauuauauucauu

SEQ ID NO: 1681673 - RNA, 15 nt, Homo sapiens
cuauuauauucauuc

SEQ ID NO: 1681674 - RNA, 13 nt, Homo sapiens
cuauuuaucugau

SEQ ID NO: 1681675 - RNA, 20 nt, Homo sapiens
cucaaagcagcaggacugug

SEQ ID NO: 1681676 - RNA, 19 nt, Homo sapiens
cucaauccauccauguacu

SEQ ID NO: 1681677 - RNA, 13 nt, Homo sapiens
cucacaccacuaa

SEQ ID NO: 1681678 - RNA, 21 nt, Homo sapiens
cucacugcugcaaauacugua

SEQ ID NO: 1681679 - RNA, 23 nt, Homo sapiens
cucacugcugcaaauacuguaua

SEQ ID NO: 1681680 - RNA, 15 nt, Homo sapiens
cucagcucucuggga

SEQ ID NO: 1681681 - RNA, 15 nt, Homo sapiens
cucagcuuuccuuaa

SEQ ID NO: 1681682 - RNA, 15 nt, Homo sapiens
cucaggcucuugacu

SEQ ID NO: 1681683 - RNA, 16 nt, Homo sapiens
cucaggugaucugccc

SEQ ID NO: 1681684 - RNA, 21 nt, Homo sapiens
cucauaauagucguaagugga

SEQ ID NO: 1681685 - RNA, 12 nt, Homo sapiens
cucauacauaaa

SEQ ID NO: 1681686 - RNA, 14 nt, Homo sapiens
cucaucacuggacu

SEQ ID NO: 1681687 - RNA, 12 nt, Homo sapiens
cucaugcugcuc

SEQ ID NO: 1681688 - RNA, 13 nt, Homo sapiens
cucauuauucaca

SEQ ID NO: 1681689 - RNA, 18 nt, Homo sapiens
cuccacaggagagacugg

SEQ ID NO: 1681690 - RNA, 16 nt, Homo sapiens
cuccagcugacagcca

SEQ ID NO: 1681691 - RNA, 13 nt, Homo sapiens
cuccagggcuuug

SEQ ID NO: 1681692 - RNA, 21 nt, Homo sapiens
cuccagggcuuugcuccagaa

SEQ ID NO: 1681693 - RNA, 22 nt, Homo sapiens
cuccauaucccuuccucucagg

SEQ ID NO: 1681694 - RNA, 21 nt, Homo sapiens
cuccaugcuccucaccugucu

SEQ ID NO: 1681695 - RNA, 22 nt, Homo sapiens
cuccauucauccuuccauccau

SEQ ID NO: 1681696 - RNA, 23 nt, Homo sapiens
cucccaagcugauggacaugaga

SEQ ID NO: 1681697 - RNA, 16 nt, Homo sapiens
cucccacaggggccau

SEQ ID NO: 1681698 - RNA, 13 nt, Homo sapiens
cucccagugcuug

SEQ ID NO: 1681699 - RNA, 20 nt, Homo sapiens
cuccugaguagcugggauua

SEQ ID NO: 1681700 - RNA, 23 nt, Homo sapiens
cuccugggcauuagcaaggcaga

SEQ ID NO: 1681701 - RNA, 21 nt, Homo sapiens
cuccuguggucucugaccagg

SEQ ID NO: 1681702 - RNA, 18 nt, Homo sapiens
cuccuuuggaauggugua

SEQ ID NO: 1681703 - RNA, 18 nt, Homo sapiens
cucuaaugugucucucac

SEQ ID NO: 1681704 - RNA, 12 nt, Homo sapiens
cucuagacuuga

SEQ ID NO: 1681705 - RNA, 13 nt, Homo sapiens
cucuauacugugg

SEQ ID NO: 1681706 - RNA, 19 nt, Homo sapiens
cucucauauaagacaaaua

SEQ ID NO: 1681707 - RNA, 14 nt, Homo sapiens
cucuccaagcacua

SEQ ID NO: 1681708 - RNA, 14 nt, Homo sapiens
cucucccuuguaca

SEQ ID NO: 1681709 - RNA, 21 nt, Homo sapiens
cucuccuuauagacacuugcu

SEQ ID NO: 1681710 - RNA, 15 nt, Homo sapiens
cucugcaaaccaaca

SEQ ID NO: 1681711 - RNA, 17 nt, Homo sapiens
cucugcaaaccaacagg

SEQ ID NO: 1681712 - RNA, 15 nt, Homo sapiens
cucugcaggccacuu

SEQ ID NO: 1681713 - RNA, 23 nt, Homo sapiens
cucuggaagagggaggggcccug

SEQ ID NO: 1681714 - RNA, 20 nt, Homo sapiens
cucuggcuucaaaaagccac

SEQ ID NO: 1681715 - RNA, 15 nt, Homo sapiens
cucugguaauauuga

SEQ ID NO: 1681716 - RNA, 22 nt, Homo sapiens
cucuguauuccgauacaaagug

SEQ ID NO: 1681717 - RNA, 11 nt, Homo sapiens
cucuuccucac

SEQ ID NO: 1681718 - RNA, 20 nt, Homo sapiens
cucuuuacuugaaauuuggc

SEQ ID NO: 1681719 - RNA, 16 nt, Homo sapiens
cugaacaggaaagagc

SEQ ID NO: 1681720 - RNA, 15 nt, Homo sapiens
cugaccugaccccau

SEQ ID NO: 1681721 - RNA, 22 nt, Homo sapiens
cugacuaauuuuguaguuuuag

SEQ ID NO: 1681722 - RNA, 13 nt, Homo sapiens
cugagaaacacua

SEQ ID NO: 1681723 - RNA, 13 nt, Homo sapiens
cugaguguuguuu

SEQ ID NO: 1681724 - RNA, 17 nt, Homo sapiens
cugaguuugauuuguua

SEQ ID NO: 1681725 - RNA, 14 nt, Homo sapiens
cugauacuagacua

SEQ ID NO: 1681726 - RNA, 18 nt, Homo sapiens
cugaucaagaacauguca

SEQ ID NO: 1681727 - RNA, 18 nt, Homo sapiens
cugaugccccugacauca

SEQ ID NO: 1681728 - RNA, 18 nt, Homo sapiens
cugaugccuguguacugc

SEQ ID NO: 1681729 - RNA, 22 nt, Homo sapiens
cugauuucuuaggggaaggaga

SEQ ID NO: 1681730 - RNA, 14 nt, Homo sapiens
cugcaaaaggaggu

SEQ ID NO: 1681731 - RNA, 16 nt, Homo sapiens
cugcaagcuucuugcu

SEQ ID NO: 1681732 - RNA, 16 nt, Homo sapiens
cugcaaucacugugcu

SEQ ID NO: 1681733 - RNA, 23 nt, Homo sapiens
ucacaagugguguuuauugcaau

SEQ ID NO: 1681734 - RNA, 13 nt, Homo sapiens
ucacacccauuua

SEQ ID NO: 1681735 - RNA, 19 nt, Homo sapiens
ucacagccucaagucacuc

SEQ ID NO: 1681736 - RNA, 14 nt, Homo sapiens
ucacaugacucuca

SEQ ID NO: 1681737 - RNA, 15 nt, Homo sapiens
ucacccauuccgggu

SEQ ID NO: 1681738 - RNA, 22 nt, Homo sapiens
ucacccauuuacacauauccac

SEQ ID NO: 1681739 - RNA, 17 nt, Homo sapiens
ucaccuacauuaucuca

SEQ ID NO: 1681740 - RNA, 20 nt, Homo sapiens
ucacugcugcaaauacugua

SEQ ID NO: 1681741 - RNA, 11 nt, Homo sapiens
ucacuugccca

SEQ ID NO: 1681742 - RNA, 15 nt, Homo sapiens
ucagagagguagcac

SEQ ID NO: 1681743 - RNA, 23 nt, Homo sapiens
ucagagugacuacacacaguacg

SEQ ID NO: 1681744 - RNA, 23 nt, Homo sapiens
ucagaugcuugcggcaaaaggaa

SEQ ID NO: 1681745 - RNA, 15 nt, Homo sapiens
ucagcaguccuagcc

SEQ ID NO: 1681746 - RNA, 17 nt, Homo sapiens
ucagcucucugggaccu

SEQ ID NO: 1681747 - RNA, 21 nt, Homo sapiens
ucagguuuucgaaccuugacc

SEQ ID NO: 1681748 - RNA, 14 nt, Homo sapiens
ucaguaagucucau

SEQ ID NO: 1681749 - RNA, 20 nt, Homo sapiens
ucaguguugccucuugcaau

SEQ ID NO: 1681750 - RNA, 21 nt, Homo sapiens
ucaguguugccucuugcaaug

SEQ ID NO: 1681751 - RNA, 16 nt, Homo sapiens
ucaguucucaaaugug

SEQ ID NO: 1681752 - RNA, 12 nt, Homo sapiens
ucauacuguaac

SEQ ID NO: 1681753 - RNA, 23 nt, Homo sapiens
ucauaguaagugcgaagacugag

SEQ ID NO: 1681754 - RNA, 13 nt, Homo sapiens
ucaucacuuugac

SEQ ID NO: 1681755 - RNA, 14 nt, Homo sapiens
ucauccuagcaaau

SEQ ID NO: 1681756 - RNA, 12 nt, Homo sapiens
ucauccuuccau

SEQ ID NO: 1681757 - RNA, 18 nt, Homo sapiens
ucaucuguccgacaaguu

SEQ ID NO: 1681758 - RNA, 23 nt, Homo sapiens
ucaugccuguaaucucagcacuu

SEQ ID NO: 1681759 - RNA, 18 nt, Homo sapiens
ucaugugaccacucuguc

SEQ ID NO: 1681760 - RNA, 20 nt, Homo sapiens
ucauuggcauucuuugcaau

SEQ ID NO: 1681761 - RNA, 17 nt, Homo sapiens
ucauugucuuuccugaa

SEQ ID NO: 1681762 - RNA, 14 nt, Homo sapiens
ucauuucucuauga

SEQ ID NO: 1681763 - RNA, 19 nt, Homo sapiens
ucauuuuacacaaagggaa

SEQ ID NO: 1681764 - RNA, 17 nt, Homo sapiens
ucauuuuugaagugaaa

SEQ ID NO: 1681765 - RNA, 15 nt, Homo sapiens
uccaaaacaaaaaga

SEQ ID NO: 1681766 - RNA, 14 nt, Homo sapiens
uccaaacagacaaa

SEQ ID NO: 1681767 - RNA, 16 nt, Homo sapiens
uccaaagcuguuccau

SEQ ID NO: 1681768 - RNA, 20 nt, Homo sapiens
uccagccuggggaacagagc

SEQ ID NO: 1681769 - RNA, 15 nt, Homo sapiens
uccagcugacagcca

SEQ ID NO: 1681770 - RNA, 19 nt, Homo sapiens
uccaguuccucuuuugugc

SEQ ID NO: 1681771 - RNA, 13 nt, Homo sapiens
uccaucaauaaau

SEQ ID NO: 1681772 - RNA, 16 nt, Homo sapiens
uccauccauccuucca

SEQ ID NO: 1681773 - RNA, 17 nt, Homo sapiens
uccauccauuaccucca

SEQ ID NO: 1681774 - RNA, 14 nt, Homo sapiens
uccaugcuccucac

SEQ ID NO: 1681775 - RNA, 19 nt, Homo sapiens
uccauuacaccacagcauu

SEQ ID NO: 1681776 - RNA, 18 nt, Homo sapiens
uccauuaccuccauccau

SEQ ID NO: 1681777 - RNA, 16 nt, Homo sapiens
uccauucauccuucca

SEQ ID NO: 1681778 - RNA, 19 nt, Homo sapiens
ucccaaauccuagacugcu

SEQ ID NO: 1681779 - RNA, 20 nt, Homo sapiens
ucccaagguccucucaguuc

SEQ ID NO: 1681780 - RNA, 20 nt, Homo sapiens
ucccaggggagccagcugcu

SEQ ID NO: 1681781 - RNA, 17 nt, Homo sapiens
ucccccagagguggaua

SEQ ID NO: 1681782 - RNA, 19 nt, Homo sapiens
uccccccgagucuccggga

SEQ ID NO: 1681783 - RNA, 14 nt, Homo sapiens
ucccccucuuugca

SEQ ID NO: 1681784 - RNA, 23 nt, Homo sapiens
uccccugcccuuccuccugaugg

SEQ ID NO: 1681785 - RNA, 17 nt, Homo sapiens
uccccuuaccccaguca

SEQ ID NO: 1681786 - RNA, 22 nt, Homo sapiens
ucccggcuccccucccagggga

SEQ ID NO: 1681787 - RNA, 13 nt, Homo sapiens
ucccugaaguauu

SEQ ID NO: 1681788 - RNA, 15 nt, Homo sapiens
ucccuuucacuaaaa

SEQ ID NO: 1681789 - RNA, 18 nt, Homo sapiens
uccgcuagcaguacuaau

SEQ ID NO: 1681790 - RNA, 16 nt, Homo sapiens
uccuagccccaaacca

SEQ ID NO: 1681791 - RNA, 13 nt, Homo sapiens
uccugaaaguguu

SEQ ID NO: 1681792 - RNA, 21 nt, Homo sapiens
uccugaaauuugagagacaaa

SEQ ID NO: 1681793 - RNA, 21 nt, Homo sapiens
uccugcugggcgugugugaca

SEQ ID NO: 1681794 - RNA, 17 nt, Homo sapiens
uccuggcagucucaguc

SEQ ID NO: 1681795 - RNA, 19 nt, Homo sapiens
uccuggcagucucagucca

SEQ ID NO: 1681796 - RNA, 16 nt, Homo sapiens
ucgcuuaagccagcac

SEQ ID NO: 1681797 - RNA, 21 nt, Homo sapiens
ucggcugccaggggcucugug

SEQ ID NO: 1681798 - RNA, 16 nt, Homo sapiens
ucuaaaauucuauuau

SEQ ID NO: 1681799 - RNA, 12 nt, Homo sapiens
ucuaaaugaagc

SEQ ID NO: 1681800 - RNA, 12 nt, Homo sapiens
ucuaaaugaagu

SEQ ID NO: 1681801 - RNA, 22 nt, Homo sapiens
ucuaacugugcagaaaggcaga

SEQ ID NO: 1681802 - RNA, 20 nt, Homo sapiens
ucuagcccaaccuacauucc

SEQ ID NO: 1681803 - RNA, 22 nt, Homo sapiens
ucuaggcccugugagcacaaag

SEQ ID NO: 1681804 - RNA, 20 nt, Homo sapiens
ucucaaacuccugaccucag

SEQ ID NO: 1681805 - RNA, 12 nt, Homo sapiens
ucucacacugga

SEQ ID NO: 1681806 - RNA, 20 nt, Homo sapiens
ucucacggcuuguaaaugug

SEQ ID NO: 1681807 - RNA, 22 nt, Homo sapiens
ucucaggaccgugcccucguca

SEQ ID NO: 1681808 - RNA, 21 nt, Homo sapiens
ucucaggcucuugacuacuug

SEQ ID NO: 1681809 - RNA, 16 nt, Homo sapiens
ucucauugacuuuuau

SEQ ID NO: 1681810 - RNA, 15 nt, Homo sapiens
ucucccaggucccag

SEQ ID NO: 1681811 - RNA, 13 nt, Homo sapiens
ucuccgacucugc

SEQ ID NO: 1681812 - RNA, 14 nt, Homo sapiens
ucuccgacucugca

SEQ ID NO: 1681813 - RNA, 17 nt, Homo sapiens
ucucucacggcuuguaa

SEQ ID NO: 1681814 - RNA, 23 nt, Homo sapiens
ucucucccaggucccagccccuu

SEQ ID NO: 1681815 - RNA, 17 nt, Homo sapiens
ucucugcaaaccaacag

SEQ ID NO: 1681816 - RNA, 14 nt, Homo sapiens
ucucuuugugcucu

SEQ ID NO: 1681817 - RNA, 16 nt, Homo sapiens
ucucuuugugcucuaa

SEQ ID NO: 1681818 - RNA, 18 nt, Homo sapiens
ucugaccucuuggccaca

SEQ ID NO: 1681819 - RNA, 23 nt, Homo sapiens
ucugacuuaagcugccucaagga

SEQ ID NO: 1681820 - RNA, 16 nt, Homo sapiens
ucugagagacagaauu

SEQ ID NO: 1681821 - RNA, 17 nt, Homo sapiens
ucugagagacagaauuc

SEQ ID NO: 1681822 - RNA, 19 nt, Homo sapiens
ucugaucaagaacauguca

SEQ ID NO: 1681823 - RNA, 20 nt, Homo sapiens
ucugccaaaggaugugauau

SEQ ID NO: 1681824 - RNA, 14 nt, Homo sapiens
ucugcccucauaga

SEQ ID NO: 1681825 - RNA, 20 nt, Homo sapiens
ucugcugucuaaccugugac

SEQ ID NO: 1681826 - RNA, 15 nt, Homo sapiens
ucuggaccccaaaga

SEQ ID NO: 1681827 - RNA, 20 nt, Homo sapiens
ucuggacuggaaagcacaag

SEQ ID NO: 1681828 - RNA, 14 nt, Homo sapiens
ucuggaugguggug

SEQ ID NO: 1681829 - RNA, 20 nt, Homo sapiens
ucuggauuucauacuguaac

SEQ ID NO: 1681830 - RNA, 16 nt, Homo sapiens
ucuggcuucaaaaagc

SEQ ID NO: 1681831 - RNA, 22 nt, Homo sapiens
ucugguaauaaaugugacucag

SEQ ID NO: 1681832 - RNA, 16 nt, Homo sapiens
ucugguaauauugacu

SEQ ID NO: 1681833 - RNA, 15 nt, Homo sapiens
ucuguagugugaaac

SEQ ID NO: 1681834 - RNA, 14 nt, Homo sapiens
ucugucucuuggcu

SEQ ID NO: 1681835 - RNA, 15 nt, Homo sapiens
ucugugacauacaua

SEQ ID NO: 1681836 - RNA, 13 nt, Homo sapiens
ucuguggcuuuca

SEQ ID NO: 1681837 - RNA, 16 nt, Homo sapiens
ucuuaugugugccuuu

SEQ ID NO: 1681838 - RNA, 20 nt, Homo sapiens
ucuucaugaguagugggcua

SEQ ID NO: 1681839 - RNA, 14 nt, Homo sapiens
ucuucccaugcauu

SEQ ID NO: 1681840 - RNA, 13 nt, Homo sapiens
ucuugcaugucua

SEQ ID NO: 1681841 - RNA, 18 nt, Homo sapiens
ucuuuagaaacaucaguu

SEQ ID NO: 1681842 - RNA, 15 nt, Homo sapiens
ucuuugcucaacaga

SEQ ID NO: 1681843 - RNA, 24 nt, Homo sapiens
ucuuugcucaacagaacauauguu

SEQ ID NO: 1681844 - RNA, 17 nt, Homo sapiens
ucuuuggaggcuuuuaa

SEQ ID NO: 1681845 - RNA, 15 nt, Homo sapiens
ugaaaauuaaggaaa

SEQ ID NO: 1681846 - RNA, 12 nt, Homo sapiens
ugaaaugcauau

SEQ ID NO: 1681847 - RNA, 22 nt, Homo sapiens
ugaaauggaggaucucuaaaga

SEQ ID NO: 1681848 - RNA, 18 nt, Homo sapiens
ugaaauuauuucucucac

SEQ ID NO: 1681849 - RNA, 19 nt, Homo sapiens
ugaaauugcauacuuugua

SEQ ID NO: 1681850 - RNA, 17 nt, Homo sapiens
ugaacaccuauugcacu

SEQ ID NO: 1681851 - RNA, 16 nt, Homo sapiens
ugaacauaacuucuca

SEQ ID NO: 1681852 - RNA, 17 nt, Homo sapiens
ugaaggggcugguggag

SEQ ID NO: 1681853 - RNA, 17 nt, Homo sapiens
ugaaguuuuacugucua

SEQ ID NO: 1681854 - RNA, 22 nt, Homo sapiens
ugaauagguuccccaauccauc

SEQ ID NO: 1681855 - RNA, 12 nt, Homo sapiens
ugaaucuaugaa

SEQ ID NO: 1681856 - RNA, 22 nt, Homo sapiens
ugaaugagcuugucaaugugau

SEQ ID NO: 1681857 - RNA, 22 nt, Homo sapiens
ugaaugugcuggugaacacugu

SEQ ID NO: 1681858 - RNA, 15 nt, Homo sapiens
ugaauugguugaaua

SEQ ID NO: 1681859 - RNA, 19 nt, Homo sapiens
ugacaaccugaauuaucua

SEQ ID NO: 1681860 - RNA, 22 nt, Homo sapiens
ugacaacucauuuucauauugu

SEQ ID NO: 1681861 - RNA, 20 nt, Homo sapiens
ugacaaguauuuucuacuaa

SEQ ID NO: 1681862 - RNA, 22 nt, Homo sapiens
ugacagagcucuggguugugca

SEQ ID NO: 1681863 - RNA, 17 nt, Homo sapiens
ugacaggccuuccuccu

SEQ ID NO: 1681864 - RNA, 13 nt, Homo sapiens
ugacauacauauu

SEQ ID NO: 1681865 - RNA, 19 nt, Homo sapiens
ugacauacauauuaucuca

SEQ ID NO: 1681866 - RNA, 22 nt, Homo sapiens
ugacaucaugaggccggaugaa

SEQ ID NO: 1681867 - RNA, 23 nt, Homo sapiens
ugaccccaagggggcugcugcuc

SEQ ID NO: 1681868 - RNA, 14 nt, Homo sapiens
ugaccuaaauuauu

SEQ ID NO: 1681869 - RNA, 15 nt, Homo sapiens
ugacucagugaccag

SEQ ID NO: 1681870 - RNA, 13 nt, Homo sapiens
ugacuuauggcau

SEQ ID NO: 1681871 - RNA, 18 nt, Homo sapiens
ugagaguuccggggagaa

SEQ ID NO: 1681872 - RNA, 19 nt, Homo sapiens
ugagauaaaugagugauuc

SEQ ID NO: 1681873 - RNA, 18 nt, Homo sapiens
ugagcagagauguacugc

SEQ ID NO: 1681874 - RNA, 15 nt, Homo sapiens
ugagcauggggccag

SEQ ID NO: 1681875 - RNA, 18 nt, Homo sapiens
ugaggauagagacuugca

SEQ ID NO: 1681876 - RNA, 18 nt, Homo sapiens
ugaggcagauagcacugg

SEQ ID NO: 1681877 - RNA, 20 nt, Homo sapiens
ugaggcagauagcacugggu

SEQ ID NO: 1681878 - RNA, 14 nt, Homo sapiens
ugagggaagcaaua

SEQ ID NO: 1681879 - RNA, 16 nt, Homo sapiens
ugaggugaacuccagg

SEQ ID NO: 1681880 - RNA, 20 nt, Homo sapiens
ugagguguauugguguugca

SEQ ID NO: 1681881 - RNA, 16 nt, Homo sapiens
ugaguaccuacugugu

SEQ ID NO: 1681882 - RNA, 15 nt, Homo sapiens
ugagucaaagacuua

SEQ ID NO: 1681883 - RNA, 15 nt, Homo sapiens
ugaguggccugcuaa

SEQ ID NO: 1681884 - RNA, 16 nt, Homo sapiens
ugaguguauguguuua

SEQ ID NO: 1681885 - RNA, 14 nt, Homo sapiens
ugauaacaccagug

SEQ ID NO: 1681886 - RNA, 13 nt, Homo sapiens
ugauauaccaaau

SEQ ID NO: 1681887 - RNA, 19 nt, Homo sapiens
ugauauaucaugagugaau

SEQ ID NO: 1681888 - RNA, 17 nt, Homo sapiens
ugaucaagaacauguca

SEQ ID NO: 1681889 - RNA, 17 nt, Homo sapiens
ugaugagggaagcaaua

SEQ ID NO: 1681890 - RNA, 13 nt, Homo sapiens
ugaugauacuucc

SEQ ID NO: 1681891 - RNA, 15 nt, Homo sapiens
ugaugauccuucaga

SEQ ID NO: 1681892 - RNA, 20 nt, Homo sapiens
ugaugccuguguacugccuu

SEQ ID NO: 1681893 - RNA, 22 nt, Homo sapiens
ugaugccuguguacugccuuaa

SEQ ID NO: 1681894 - RNA, 20 nt, Homo sapiens
ugauguacagauucuuucag

SEQ ID NO: 1681895 - RNA, 13 nt, Homo sapiens
ugauuaaaguaag

SEQ ID NO: 1681896 - RNA, 21 nt, Homo sapiens
ugauuaggaaucuaaaugaag

SEQ ID NO: 1681897 - RNA, 21 nt, Homo sapiens
ugauugggaaaacauuugcug

SEQ ID NO: 1681898 - RNA, 17 nt, Homo sapiens
ugcaaaguguauuagga

SEQ ID NO: 1681899 - RNA, 19 nt, Homo sapiens
ugcaaauacuguauauuca

SEQ ID NO: 1681900 - RNA, 21 nt, Homo sapiens
ugcaaccucuuugcucaacag

SEQ ID NO: 1681901 - RNA, 19 nt, Homo sapiens
ugcaagagcccagaucacc

SEQ ID NO: 1681902 - RNA, 19 nt, Homo sapiens
ugcaagccaucucuaauaa

SEQ ID NO: 1681903 - RNA, 14 nt, Homo sapiens
ugcaauacugcuua

SEQ ID NO: 1681904 - RNA, 20 nt, Homo sapiens
ugcaauagugcaacaucucu

SEQ ID NO: 1681905 - RNA, 21 nt, Homo sapiens
ugcacaggcagauguuugccu

SEQ ID NO: 1681906 - RNA, 19 nt, Homo sapiens
gaacugagaccuccagaaa

SEQ ID NO: 1681907 - RNA, 16 nt, Homo sapiens
gaagaaggccagagag

SEQ ID NO: 1681908 - RNA, 17 nt, Homo sapiens
gaagaagugagcagugu

SEQ ID NO: 1681909 - RNA, 20 nt, Homo sapiens
gaagaaucuuccuggcacaa

SEQ ID NO: 1681910 - RNA, 15 nt, Homo sapiens
gaagauucuauguua

SEQ ID NO: 1681911 - RNA, 13 nt, Homo sapiens
gaagcaguauuuu

SEQ ID NO: 1681912 - RNA, 20 nt, Homo sapiens
gaagccaccgggagauuucu

SEQ ID NO: 1681913 - RNA, 17 nt, Homo sapiens
gaagcccaccacuggcc

SEQ ID NO: 1681914 - RNA, 15 nt, Homo sapiens
gaauguaugugcaca

SEQ ID NO: 1681915 - RNA, 18 nt, Homo sapiens
gaauuaagaaauacucau

SEQ ID NO: 1681916 - RNA, 15 nt, Homo sapiens
gaauuaucuauuuca

SEQ ID NO: 1681917 - RNA, 14 nt, Homo sapiens
gaauuauuacaauu

SEQ ID NO: 1681918 - RNA, 16 nt, Homo sapiens
gaauuggagugauaau

SEQ ID NO: 1681919 - RNA, 17 nt, Homo sapiens
gaauuguuccaguacua

SEQ ID NO: 1681920 - RNA, 24 nt, Homo sapiens
gacaacucauuuucauauuguaau

SEQ ID NO: 1681921 - RNA, 21 nt, Homo sapiens
gacauagcugugcuaugaggu

SEQ ID NO: 1681922 - RNA, 14 nt, Homo sapiens
gacaucugacccca

SEQ ID NO: 1681923 - RNA, 22 nt, Homo sapiens
gacaugcugaaauuauuucucu

SEQ ID NO: 1681924 - RNA, 13 nt, Homo sapiens
gacaugugacauu

SEQ ID NO: 1681925 - RNA, 13 nt, Homo sapiens
gacauuucuuugg

SEQ ID NO: 1681926 - RNA, 18 nt, Homo sapiens
gacauuuuaugucuuucu

SEQ ID NO: 1681927 - RNA, 17 nt, Homo sapiens
gaccccaauauauguau

SEQ ID NO: 1681928 - RNA, 23 nt, Homo sapiens
gaccccgucacagccucaaguca

SEQ ID NO: 1681929 - RNA, 22 nt, Homo sapiens
gacccuuuuaagcaugugaugu

SEQ ID NO: 1681930 - RNA, 18 nt, Homo sapiens
gaccucuuggccacagag

SEQ ID NO: 1681931 - RNA, 22 nt, Homo sapiens
gaccugcucccacaggggccau

SEQ ID NO: 1681932 - RNA, 19 nt, Homo sapiens
gacuacuuggaacuaggcu

SEQ ID NO: 1681933 - RNA, 14 nt, Homo sapiens
gacucacuugccca

SEQ ID NO: 1681934 - RNA, 12 nt, Homo sapiens
gacucucaggga

SEQ ID NO: 1681935 - RNA, 16 nt, Homo sapiens
gacuggaaagcacaag

SEQ ID NO: 1681936 - RNA, 22 nt, Homo sapiens
gacuuauacuugccuucugaua

SEQ ID NO: 1681937 - RNA, 22 nt, Homo sapiens
gacuuuccagaaugaccuugag

SEQ ID NO: 1681938 - RNA, 20 nt, Homo sapiens
gacuuugauacuaccagggu

SEQ ID NO: 1681939 - RNA, 17 nt, Homo sapiens
gacuuuuauaacauuuu

SEQ ID NO: 1681940 - RNA, 15 nt, Homo sapiens
gagaaguacagguca

SEQ ID NO: 1681941 - RNA, 13 nt, Homo sapiens
gagaaguauacau

SEQ ID NO: 1681942 - RNA, 22 nt, Homo sapiens
gagaaugaucaaggaucuggac

SEQ ID NO: 1681943 - RNA, 13 nt, Homo sapiens
gagacaugugaca

SEQ ID NO: 1681944 - RNA, 17 nt, Homo sapiens
gagacgggguuucucca

SEQ ID NO: 1681945 - RNA, 20 nt, Homo sapiens
gagacugggagccacuucuc

SEQ ID NO: 1681946 - RNA, 22 nt, Homo sapiens
gagacugggagccacuucuccc

SEQ ID NO: 1681947 - RNA, 13 nt, Homo sapiens
gagauaaagaaua

SEQ ID NO: 1681948 - RNA, 18 nt, Homo sapiens
gagauacucuucugccuc

SEQ ID NO: 1681949 - RNA, 13 nt, Homo sapiens
gagcagagaagua

SEQ ID NO: 1681950 - RNA, 13 nt, Homo sapiens
gagccaugucaug

SEQ ID NO: 1681951 - RNA, 17 nt, Homo sapiens
gagcccuauugcugcua

SEQ ID NO: 1681952 - RNA, 12 nt, Homo sapiens
gagccuggccag

SEQ ID NO: 1681953 - RNA, 20 nt, Homo sapiens
gagccuggccaggcagggag

SEQ ID NO: 1681954 - RNA, 20 nt, Homo sapiens
gagcucuggguugugcacau

SEQ ID NO: 1681955 - RNA, 16 nt, Homo sapiens
gagcugucugaacuca

SEQ ID NO: 1681956 - RNA, 13 nt, Homo sapiens
gagcuugauuaaa

SEQ ID NO: 1681957 - RNA, 14 nt, Homo sapiens
gaggaaaccuagca

SEQ ID NO: 1681958 - RNA, 21 nt, Homo sapiens
gaggaauaacaucaccacugu

SEQ ID NO: 1681959 - RNA, 17 nt, Homo sapiens
gaggacugguugucucu

SEQ ID NO: 1681960 - RNA, 20 nt, Homo sapiens
gaggagauucccaccuucca

SEQ ID NO: 1681961 - RNA, 19 nt, Homo sapiens
gaggagcacacauccaaga

SEQ ID NO: 1681962 - RNA, 22 nt, Homo sapiens
gaggauggacuaaaugaucucu

SEQ ID NO: 1681963 - RNA, 22 nt, Homo sapiens
gaggcugaggcagaaggauuac

SEQ ID NO: 1681964 - RNA, 16 nt, Homo sapiens
gagggccccugcgugg

SEQ ID NO: 1681965 - RNA, 22 nt, Homo sapiens
gagggcgaccccgucacagccu

SEQ ID NO: 1681966 - RNA, 22 nt, Homo sapiens
gaggguuauaaauuuuagcaag

SEQ ID NO: 1681967 - RNA, 17 nt, Homo sapiens
gaggucaucacuuugac

SEQ ID NO: 1681968 - RNA, 16 nt, Homo sapiens
gaguauaaauuuacuu

SEQ ID NO: 1681969 - RNA, 17 nt, Homo sapiens
gagucagugccaggucc

SEQ ID NO: 1681970 - RNA, 20 nt, Homo sapiens
gagugacuacacacaguacg

SEQ ID NO: 1681971 - RNA, 22 nt, Homo sapiens
gagugcaacccagucacacugu

SEQ ID NO: 1681972 - RNA, 22 nt, Homo sapiens
gaguucuggaugucuggcucaa

SEQ ID NO: 1681973 - RNA, 21 nt, Homo sapiens
gaguugcauagagauuuguau

SEQ ID NO: 1681974 - RNA, 14 nt, Homo sapiens
gauaaacaaacaag

SEQ ID NO: 1681975 - RNA, 23 nt, Homo sapiens
gauaccauucuauucuccagaca

SEQ ID NO: 1681976 - RNA, 23 nt, Homo sapiens
gauacuuacauguucccaaaaca

SEQ ID NO: 1681977 - RNA, 11 nt, Homo sapiens
gauacuuugac

SEQ ID NO: 1681978 - RNA, 15 nt, Homo sapiens
gauacuuuuacaggu

SEQ ID NO: 1681979 - RNA, 15 nt, Homo sapiens
gauaugaaggauuac

SEQ ID NO: 1681980 - RNA, 13 nt, Homo sapiens
gaucauugugaag

SEQ ID NO: 1681981 - RNA, 21 nt, Homo sapiens
gaucccguucagaaaaccacu

SEQ ID NO: 1681982 - RNA, 14 nt, Homo sapiens
gaugaaacuucuca

SEQ ID NO: 1681983 - RNA, 14 nt, Homo sapiens
gaugaccuccagaa

SEQ ID NO: 1681984 - RNA, 17 nt, Homo sapiens
gaugaggcuggccaagc

SEQ ID NO: 1681985 - RNA, 13 nt, Homo sapiens
gaugaguuugaca

SEQ ID NO: 1681986 - RNA, 11 nt, Homo sapiens
gaugcauuuaa

SEQ ID NO: 1681987 - RNA, 12 nt, Homo sapiens
gaugccucuugc

SEQ ID NO: 1681988 - RNA, 17 nt, Homo sapiens
gaugccuguguacugcc

SEQ ID NO: 1681989 - RNA, 21 nt, Homo sapiens
gaugccuguguacugccuuaa

SEQ ID NO: 1681990 - RNA, 19 nt, Homo sapiens
gaugguggugcauccguga

SEQ ID NO: 1681991 - RNA, 16 nt, Homo sapiens
gauuacucuccauauc

SEQ ID NO: 1681992 - RNA, 21 nt, Homo sapiens
gauucagccaaaugcagggag

SEQ ID NO: 1681993 - RNA, 18 nt, Homo sapiens
gauucuauaucaugacca

SEQ ID NO: 1681994 - RNA, 17 nt, Homo sapiens
gauugcauccacuagcu

SEQ ID NO: 1681995 - RNA, 12 nt, Homo sapiens
gcaacagacugu

SEQ ID NO: 1681996 - RNA, 18 nt, Homo sapiens
gcaacagcaaacaggugc

SEQ ID NO: 1681997 - RNA, 21 nt, Homo sapiens
gcaacaugccagccacuguga

SEQ ID NO: 1681998 - RNA, 16 nt, Homo sapiens
gcaaccucuuugcuca

SEQ ID NO: 1681999 - RNA, 20 nt, Homo sapiens
gcaagagcccagaucaccca

SEQ ID NO: 1682000 - RNA, 19 nt, Homo sapiens
gcaagauuccaaguucuca

SEQ ID NO: 1682001 - RNA, 15 nt, Homo sapiens
gcaagcaccaaccuc

SEQ ID NO: 1682002 - RNA, 16 nt, Homo sapiens
gcaaugacucaaaguc

SEQ ID NO: 1682003 - RNA, 11 nt, Homo sapiens
gcacacuuugc

SEQ ID NO: 1682004 - RNA, 22 nt, Homo sapiens
gcacaggcagauguuugccuca

SEQ ID NO: 1682005 - RNA, 19 nt, Homo sapiens
gcacaguguaauccagggg

SEQ ID NO: 1682006 - RNA, 17 nt, Homo sapiens
gcaccaaccuccagacu

SEQ ID NO: 1682007 - RNA, 23 nt, Homo sapiens
gcacuaaaaugaggauccagggc

SEQ ID NO: 1682008 - RNA, 17 nt, Homo sapiens
gcacucagggagcauuu

SEQ ID NO: 1682009 - RNA, 21 nt, Homo sapiens
gcacugcggcugucuccuuga

SEQ ID NO: 1682010 - RNA, 15 nt, Homo sapiens
gcacuuauugaauau

SEQ ID NO: 1682011 - RNA, 21 nt, Homo sapiens
gcagaagccuccccagcucac

SEQ ID NO: 1682012 - RNA, 23 nt, Homo sapiens
gcagagaccagcccaccccugug

SEQ ID NO: 1682013 - RNA, 21 nt, Homo sapiens
gcagauaucugcaugugucau

SEQ ID NO: 1682014 - RNA, 19 nt, Homo sapiens
gcagcggcuccugcaaaag

SEQ ID NO: 1682015 - RNA, 14 nt, Homo sapiens
gcagcucuggaggg

SEQ ID NO: 1682016 - RNA, 20 nt, Homo sapiens
gcagcugaaauucaccaaga

SEQ ID NO: 1682017 - RNA, 18 nt, Homo sapiens
gcaggaagccuacuauuu

SEQ ID NO: 1682018 - RNA, 14 nt, Homo sapiens
gcagucuaauuaca

SEQ ID NO: 1682019 - RNA, 21 nt, Homo sapiens
gcagucuaauuacauuucacu

SEQ ID NO: 1682020 - RNA, 19 nt, Homo sapiens
gcaucaucucuuccucaca

SEQ ID NO: 1682021 - RNA, 14 nt, Homo sapiens
gcauccacuagcuu

SEQ ID NO: 1682022 - RNA, 14 nt, Homo sapiens
gcauggacauuuag

SEQ ID NO: 1682023 - RNA, 18 nt, Homo sapiens
gcauguucugugacugaa

SEQ ID NO: 1682024 - RNA, 22 nt, Homo sapiens
gccaaacauuaaaauuagcacu

SEQ ID NO: 1682025 - RNA, 14 nt, Homo sapiens
gccaagguccugcu

SEQ ID NO: 1682026 - RNA, 20 nt, Homo sapiens
ugacauuuauauauugaauu

SEQ ID NO: 1682027 - RNA, 20 nt, Homo sapiens
ugaccaaaaucagcuuugua

SEQ ID NO: 1682028 - RNA, 23 nt, Homo sapiens
ugaccuaaauuauuuacugcaaa

SEQ ID NO: 1682029 - RNA, 20 nt, Homo sapiens
ugaccucaggugaucugccc

SEQ ID NO: 1682030 - RNA, 22 nt, Homo sapiens
ugacuggccuauuuaucugauc

SEQ ID NO: 1682031 - RNA, 12 nt, Homo sapiens
ugagauggaguu

SEQ ID NO: 1682032 - RNA, 20 nt, Homo sapiens
ugagcagagauguacugcaa

SEQ ID NO: 1682033 - RNA, 19 nt, Homo sapiens
ugagcagcauccaccccac

SEQ ID NO: 1682034 - RNA, 19 nt, Homo sapiens
ugagcaggaaagacuggcc

SEQ ID NO: 1682035 - RNA, 22 nt, Homo sapiens
ugagcaguguuggagugaggac

SEQ ID NO: 1682036 - RNA, 13 nt, Homo sapiens
ugagcaugugaug

SEQ ID NO: 1682037 - RNA, 18 nt, Homo sapiens
ugagcuugauuaaaucaa

SEQ ID NO: 1682038 - RNA, 16 nt, Homo sapiens
ugagguucuugggaua

SEQ ID NO: 1682039 - RNA, 22 nt, Homo sapiens
ugaguugcacuuauugaccauu

SEQ ID NO: 1682040 - RNA, 13 nt, Homo sapiens
ugauacaugucag

SEQ ID NO: 1682041 - RNA, 16 nt, Homo sapiens
ugauagaaaagugugg

SEQ ID NO: 1682042 - RNA, 22 nt, Homo sapiens
ugaucagaguuccuccuacuua

SEQ ID NO: 1682043 - RNA, 20 nt, Homo sapiens
ugauguugucuuagcauggu

SEQ ID NO: 1682044 - RNA, 24 nt, Homo sapiens
ugauuagaaauuaccuguggauau

SEQ ID NO: 1682045 - RNA, 18 nt, Homo sapiens
ugauugcauccacuagcu

SEQ ID NO: 1682046 - RNA, 15 nt, Homo sapiens
ugauuucacagugug

SEQ ID NO: 1682047 - RNA, 13 nt, Homo sapiens
ugcaaaccaacag

SEQ ID NO: 1682048 - RNA, 14 nt, Homo sapiens
ugcaaauacuguau

SEQ ID NO: 1682049 - RNA, 15 nt, Homo sapiens
ugcaacagacuugaa

SEQ ID NO: 1682050 - RNA, 23 nt, Homo sapiens
ugcaacaugccagccacugugau

SEQ ID NO: 1682051 - RNA, 19 nt, Homo sapiens
ugcaacccagucacacugu

SEQ ID NO: 1682052 - RNA, 12 nt, Homo sapiens
ugcaagauucca

SEQ ID NO: 1682053 - RNA, 14 nt, Homo sapiens
ugcaaugcaugaua

SEQ ID NO: 1682054 - RNA, 11 nt, Homo sapiens
ugcacauugua

SEQ ID NO: 1682055 - RNA, 11 nt, Homo sapiens
ugcacuccaga

SEQ ID NO: 1682056 - RNA, 12 nt, Homo sapiens
ugcagccuucau

SEQ ID NO: 1682057 - RNA, 15 nt, Homo sapiens
ugcagcugugccaua

SEQ ID NO: 1682058 - RNA, 12 nt, Homo sapiens
ugcagggguccc

SEQ ID NO: 1682059 - RNA, 22 nt, Homo sapiens
ugcauaauguuucuggauuuca

SEQ ID NO: 1682060 - RNA, 19 nt, Homo sapiens
ugcaucaucucuuccucac

SEQ ID NO: 1682061 - RNA, 21 nt, Homo sapiens
ugcauuuuuauuaaagcauuu

SEQ ID NO: 1682062 - RNA, 17 nt, Homo sapiens
ugccagagguaauguua

SEQ ID NO: 1682063 - RNA, 16 nt, Homo sapiens
ugccagccacugugau

SEQ ID NO: 1682064 - RNA, 14 nt, Homo sapiens
ugccuguaaucuca

SEQ ID NO: 1682065 - RNA, 20 nt, Homo sapiens
ugccuguaaucucagcacuu

SEQ ID NO: 1682066 - RNA, 12 nt, Homo sapiens
ugccugugaaau

SEQ ID NO: 1682067 - RNA, 17 nt, Homo sapiens
ugccugugagcaugggg

SEQ ID NO: 1682068 - RNA, 21 nt, Homo sapiens
ugccuguguacugccuuaaau

SEQ ID NO: 1682069 - RNA, 22 nt, Homo sapiens
ugccuuuuuuucucugcauuua

SEQ ID NO: 1682070 - RNA, 22 nt, Homo sapiens
ugcgccgccgccggaguccacu

SEQ ID NO: 1682071 - RNA, 20 nt, Homo sapiens
ugcuaggcgcuggggagacu

SEQ ID NO: 1682072 - RNA, 14 nt, Homo sapiens
ugcucaugcugcuc

SEQ ID NO: 1682073 - RNA, 14 nt, Homo sapiens
ugcuccagggcuuu

SEQ ID NO: 1682074 - RNA, 18 nt, Homo sapiens
ugcucuauacuguggccu

SEQ ID NO: 1682075 - RNA, 17 nt, Homo sapiens
ugcugauaccauaugaa

SEQ ID NO: 1682076 - RNA, 20 nt, Homo sapiens
ugcugcuccucucuugggua

SEQ ID NO: 1682077 - RNA, 16 nt, Homo sapiens
ugcuggggaacuggcg

SEQ ID NO: 1682078 - RNA, 22 nt, Homo sapiens
ugcuguuuuuguucuacucuag

SEQ ID NO: 1682079 - RNA, 14 nt, Homo sapiens
ugcuucgacuacug

SEQ ID NO: 1682080 - RNA, 15 nt, Homo sapiens
ugcuuggcccuucaa

SEQ ID NO: 1682081 - RNA, 18 nt, Homo sapiens
ugcuuuguaggugucuca

SEQ ID NO: 1682082 - RNA, 18 nt, Homo sapiens
ugcuuuuuggaaagucag

SEQ ID NO: 1682083 - RNA, 18 nt, Homo sapiens
uggaaagaaucuuuacaa

SEQ ID NO: 1682084 - RNA, 18 nt, Homo sapiens
uggaaaucugaacauucu

SEQ ID NO: 1682085 - RNA, 18 nt, Homo sapiens
uggaagaagugagcagug

SEQ ID NO: 1682086 - RNA, 20 nt, Homo sapiens
uggaauauuaaaaaacuuca

SEQ ID NO: 1682087 - RNA, 21 nt, Homo sapiens
uggacaagugcuguugggaua

SEQ ID NO: 1682088 - RNA, 13 nt, Homo sapiens
uggacgggaugac

SEQ ID NO: 1682089 - RNA, 22 nt, Homo sapiens
uggagaaaauggguuuauucac

SEQ ID NO: 1682090 - RNA, 16 nt, Homo sapiens
uggauacuggggggca

SEQ ID NO: 1682091 - RNA, 18 nt, Homo sapiens
uggauauuuuuuacuuua

SEQ ID NO: 1682092 - RNA, 19 nt, Homo sapiens
uggaucucacaagcacuuu

SEQ ID NO: 1682093 - RNA, 22 nt, Homo sapiens
uggauuuaaaagccugcucaau

SEQ ID NO: 1682094 - RNA, 17 nt, Homo sapiens
uggauuucauacuguaa

SEQ ID NO: 1682095 - RNA, 19 nt, Homo sapiens
uggcaaaugccugacucag

SEQ ID NO: 1682096 - RNA, 17 nt, Homo sapiens
uggcacuaccccaaacc

SEQ ID NO: 1682097 - RNA, 13 nt, Homo sapiens
uggccaaugagau

SEQ ID NO: 1682098 - RNA, 19 nt, Homo sapiens
uggccacagaggacucacu

SEQ ID NO: 1682099 - RNA, 17 nt, Homo sapiens
uggccaggugguugucu

SEQ ID NO: 1682100 - RNA, 14 nt, Homo sapiens
uggccggagucagu

SEQ ID NO: 1682101 - RNA, 13 nt, Homo sapiens
uggcucacuacug

SEQ ID NO: 1682102 - RNA, 23 nt, Homo sapiens
uggcugcuguugcuuaaaccacu

SEQ ID NO: 1682103 - RNA, 15 nt, Homo sapiens
ugggaagacuauggu

SEQ ID NO: 1682104 - RNA, 11 nt, Homo sapiens
ugggcacaaac

SEQ ID NO: 1682105 - RNA, 12 nt, Homo sapiens
ugggcacugggg

SEQ ID NO: 1682106 - RNA, 13 nt, Homo sapiens
ugggcaugacauc

SEQ ID NO: 1682107 - RNA, 14 nt, Homo sapiens
ugggccacagccau

SEQ ID NO: 1682108 - RNA, 17 nt, Homo sapiens
ugggcgugugugacacu

SEQ ID NO: 1682109 - RNA, 18 nt, Homo sapiens
uggggaacagagcaagac

SEQ ID NO: 1682110 - RNA, 13 nt, Homo sapiens
ugggggucagggg

SEQ ID NO: 1682111 - RNA, 20 nt, Homo sapiens
ugguaauauugacuuguaua

SEQ ID NO: 1682112 - RNA, 21 nt, Homo sapiens
uggugcauccgugaaugcgcu

SEQ ID NO: 1682113 - RNA, 14 nt, Homo sapiens
ugguucaacaucua

SEQ ID NO: 1682114 - RNA, 22 nt, Homo sapiens
ugguugaauaguucuauacaaa

SEQ ID NO: 1682115 - RNA, 20 nt, Homo sapiens
ugguuuguuauaucagggaa

SEQ ID NO: 1682116 - RNA, 19 nt, Homo sapiens
uguaacuguuuucaaggag

SEQ ID NO: 1682117 - RNA, 13 nt, Homo sapiens
uguacacagaauu

SEQ ID NO: 1682118 - RNA, 15 nt, Homo sapiens
uguacacagaauugu

SEQ ID NO: 1682119 - RNA, 17 nt, Homo sapiens
uguacagauucuuucag

SEQ ID NO: 1682120 - RNA, 23 nt, Homo sapiens
uguacugcaaagucgccagucac

SEQ ID NO: 1682121 - RNA, 19 nt, Homo sapiens
uguacugccuuaaauguac

SEQ ID NO: 1682122 - RNA, 16 nt, Homo sapiens
uguacugccuuagugc

SEQ ID NO: 1682123 - RNA, 18 nt, Homo sapiens
uguacugugucucaugga

SEQ ID NO: 1682124 - RNA, 16 nt, Homo sapiens
uguagacaaaguacau

SEQ ID NO: 1682125 - RNA, 20 nt, Homo sapiens
uguagaugggggaacuguga

SEQ ID NO: 1682126 - RNA, 16 nt, Homo sapiens
uguauacuguaggcac

SEQ ID NO: 1682127 - RNA, 11 nt, Homo sapiens
uguauguuaaa

SEQ ID NO: 1682128 - RNA, 22 nt, Homo sapiens
uguauuuuuaacaccagaaaga

SEQ ID NO: 1682129 - RNA, 13 nt, Homo sapiens
ugucaaagcuuug

SEQ ID NO: 1682130 - RNA, 14 nt, Homo sapiens
ugucaaugugauuu

SEQ ID NO: 1682131 - RNA, 16 nt, Homo sapiens
ugucacucugugccuu

SEQ ID NO: 1682132 - RNA, 21 nt, Homo sapiens
ugucaguuccaaacagacaaa

SEQ ID NO: 1682133 - RNA, 12 nt, Homo sapiens
ugucaugaagaa

SEQ ID NO: 1682134 - RNA, 16 nt, Homo sapiens
ugugaagcaaacucua

SEQ ID NO: 1682135 - RNA, 12 nt, Homo sapiens
ugugacauacau

SEQ ID NO: 1682136 - RNA, 11 nt, Homo sapiens
ugugacauuua

SEQ ID NO: 1682137 - RNA, 20 nt, Homo sapiens
ugugaccagucugacccuua

SEQ ID NO: 1682138 - RNA, 15 nt, Homo sapiens
ugugagauacugugu

SEQ ID NO: 1682139 - RNA, 15 nt, Homo sapiens
ugugagcauggggcc

SEQ ID NO: 1682140 - RNA, 16 nt, Homo sapiens
ugugauauacaaagug

SEQ ID NO: 1682141 - RNA, 15 nt, Homo sapiens
ugugcagaaaggcag

SEQ ID NO: 1682142 - RNA, 18 nt, Homo sapiens
ugugccuucccuuucuaa

SEQ ID NO: 1682143 - RNA, 18 nt, Homo sapiens
ugugcucuaaaauucuau

SEQ ID NO: 1682144 - RNA, 20 nt, Homo sapiens
ugugcuggugaacacuguga

SEQ ID NO: 1682145 - RNA, 22 nt, Homo sapiens
uguggccuuuauguucuuucac

SEQ ID NO: 1682146 - RNA, 18 nt, Homo sapiens
agcuucuugcugaucaga

SEQ ID NO: 1682147 - RNA, 19 nt, Homo sapiens
aggaauaacaucaccacug

SEQ ID NO: 1682148 - RNA, 21 nt, Homo sapiens
aggacugguucugaggccaga

SEQ ID NO: 1682149 - RNA, 19 nt, Homo sapiens
aggagcauccuuggcagug

SEQ ID NO: 1682150 - RNA, 23 nt, Homo sapiens
aggauccagggcagcaggccaga

SEQ ID NO: 1682151 - RNA, 11 nt, Homo sapiens
aggaugugaua

SEQ ID NO: 1682152 - RNA, 12 nt, Homo sapiens
aggaugugauau

SEQ ID NO: 1682153 - RNA, 13 nt, Homo sapiens
aggaugugauaua

SEQ ID NO: 1682154 - RNA, 14 nt, Homo sapiens
aggauucuauauca

SEQ ID NO: 1682155 - RNA, 16 nt, Homo sapiens
aggcacugagcaggga

SEQ ID NO: 1682156 - RNA, 16 nt, Homo sapiens
aggcagauagcacugg

SEQ ID NO: 1682157 - RNA, 16 nt, Homo sapiens
aggcagauguuugccu

SEQ ID NO: 1682158 - RNA, 20 nt, Homo sapiens
aggcaucauacuaaacuuca

SEQ ID NO: 1682159 - RNA, 21 nt, Homo sapiens
aggcaucauacuaaacuucac

SEQ ID NO: 1682160 - RNA, 13 nt, Homo sapiens
aggcauggcagaa

SEQ ID NO: 1682161 - RNA, 13 nt, Homo sapiens
aggcauguacaaa

SEQ ID NO: 1682162 - RNA, 23 nt, Homo sapiens
aggcauucucccagcucuagccu

SEQ ID NO: 1682163 - RNA, 20 nt, Homo sapiens
aggccacccccuauccucug

SEQ ID NO: 1682164 - RNA, 15 nt, Homo sapiens
aggcccuuagaggga

SEQ ID NO: 1682165 - RNA, 24 nt, Homo sapiens
aggcucagagagguagcacucuca

SEQ ID NO: 1682166 - RNA, 15 nt, Homo sapiens
aggcucuucuuccuc

SEQ ID NO: 1682167 - RNA, 10 nt, Homo sapiens
aggcugcaaa

SEQ ID NO: 1682168 - RNA, 18 nt, Homo sapiens
aggcugcucggcuacugg

SEQ ID NO: 1682169 - RNA, 15 nt, Homo sapiens
aggcuggagugcaau

SEQ ID NO: 1682170 - RNA, 15 nt, Homo sapiens
aggcuuacuaaugcu

SEQ ID NO: 1682171 - RNA, 18 nt, Homo sapiens
aggcuuacuaaugcugcc

SEQ ID NO: 1682172 - RNA, 20 nt, Homo sapiens
agggaacucuggcauuccuu

SEQ ID NO: 1682173 - RNA, 21 nt, Homo sapiens
agggaagaugaccugccccaa

SEQ ID NO: 1682174 - RNA, 14 nt, Homo sapiens
agggaccccagaua

SEQ ID NO: 1682175 - RNA, 14 nt, Homo sapiens
agggagguggugau

SEQ ID NO: 1682176 - RNA, 20 nt, Homo sapiens
agggauauuuuuuucuauua

SEQ ID NO: 1682177 - RNA, 22 nt, Homo sapiens
agggcagaaccaagaacauaaa

SEQ ID NO: 1682178 - RNA, 20 nt, Homo sapiens
aggggcucuguggcaaaaag

SEQ ID NO: 1682179 - RNA, 14 nt, Homo sapiens
agguccaaauucac

SEQ ID NO: 1682180 - RNA, 16 nt, Homo sapiens
aggugcucaugcugcu

SEQ ID NO: 1682181 - RNA, 15 nt, Homo sapiens
agguggccucugccu

SEQ ID NO: 1682182 - RNA, 19 nt, Homo sapiens
aggugguggugguggugaa

SEQ ID NO: 1682183 - RNA, 11 nt, Homo sapiens
aggugugaugg

SEQ ID NO: 1682184 - RNA, 23 nt, Homo sapiens
aguaacugugagaacccaguuuc

SEQ ID NO: 1682185 - RNA, 14 nt, Homo sapiens
aguaagauaucuca

SEQ ID NO: 1682186 - RNA, 20 nt, Homo sapiens
aguaagcaguguuacuugca

SEQ ID NO: 1682187 - RNA, 17 nt, Homo sapiens
aguacgaaccuacaguu

SEQ ID NO: 1682188 - RNA, 22 nt, Homo sapiens
aguaguauuugccuauuucccc

SEQ ID NO: 1682189 - RNA, 15 nt, Homo sapiens
aguauaaauuuacuu

SEQ ID NO: 1682190 - RNA, 17 nt, Homo sapiens
aguauaauguuuauuaa

SEQ ID NO: 1682191 - RNA, 23 nt, Homo sapiens
aguauuccuuuauacacagugga

SEQ ID NO: 1682192 - RNA, 17 nt, Homo sapiens
agucaagaaucacuugc

SEQ ID NO: 1682193 - RNA, 12 nt, Homo sapiens
agucaccaaaua

SEQ ID NO: 1682194 - RNA, 17 nt, Homo sapiens
agucacucccaagcccc

SEQ ID NO: 1682195 - RNA, 13 nt, Homo sapiens
agucagacugaaa

SEQ ID NO: 1682196 - RNA, 14 nt, Homo sapiens
agucagaugaggca

SEQ ID NO: 1682197 - RNA, 21 nt, Homo sapiens
agucaguucucauuauucaca

SEQ ID NO: 1682198 - RNA, 20 nt, Homo sapiens
agucccggaggccuucccuu

SEQ ID NO: 1682199 - RNA, 17 nt, Homo sapiens
aguccuaaaaguucuca

SEQ ID NO: 1682200 - RNA, 20 nt, Homo sapiens
agucgccagucacugcugca

SEQ ID NO: 1682201 - RNA, 22 nt, Homo sapiens
agucugucucuuggcuuuguca

SEQ ID NO: 1682202 - RNA, 14 nt, Homo sapiens
agugaccagugccu

SEQ ID NO: 1682203 - RNA, 15 nt, Homo sapiens
agugcaacaucucug

SEQ ID NO: 1682204 - RNA, 18 nt, Homo sapiens
agugcaacaucucugaau

SEQ ID NO: 1682205 - RNA, 21 nt, Homo sapiens
agugcaacccagucacacugu

SEQ ID NO: 1682206 - RNA, 16 nt, Homo sapiens
agugcucacaaaggau

SEQ ID NO: 1682207 - RNA, 15 nt, Homo sapiens
agugcugcuguggag

SEQ ID NO: 1682208 - RNA, 19 nt, Homo sapiens
accuuaauuuaacuuucca

SEQ ID NO: 1682209 - RNA, 19 nt, Homo sapiens
acgacucugaccucuuggc

SEQ ID NO: 1682210 - RNA, 16 nt, Homo sapiens
acguauuggaccugcc

SEQ ID NO: 1682211 - RNA, 16 nt, Homo sapiens
acuaaaaaaaagauga

SEQ ID NO: 1682212 - RNA, 17 nt, Homo sapiens
acuaaaacacacaggug

SEQ ID NO: 1682213 - RNA, 18 nt, Homo sapiens
acuaaaaguugcauuuua

SEQ ID NO: 1682214 - RNA, 14 nt, Homo sapiens
acuaaaauguucua

SEQ ID NO: 1682215 - RNA, 14 nt, Homo sapiens
acuaaacaguaaga

SEQ ID NO: 1682216 - RNA, 19 nt, Homo sapiens
acuaccuacugguguaauc

SEQ ID NO: 1682217 - RNA, 18 nt, Homo sapiens
acuacuagugugacuccu

SEQ ID NO: 1682218 - RNA, 13 nt, Homo sapiens
acuaucugugcca

SEQ ID NO: 1682219 - RNA, 17 nt, Homo sapiens
acuauggagugcucaca

SEQ ID NO: 1682220 - RNA, 17 nt, Homo sapiens
acucaccugcacuaaca

SEQ ID NO: 1682221 - RNA, 17 nt, Homo sapiens
acucagggagcauuuaa

SEQ ID NO: 1682222 - RNA, 16 nt, Homo sapiens
acuccagaaccgcaga

SEQ ID NO: 1682223 - RNA, 18 nt, Homo sapiens
acuccugggacacuccgu

SEQ ID NO: 1682224 - RNA, 22 nt, Homo sapiens
acucuggcuucaaaaagccaca

SEQ ID NO: 1682225 - RNA, 12 nt, Homo sapiens
acucugucuugu

SEQ ID NO: 1682226 - RNA, 22 nt, Homo sapiens
acucuuucauaaaaacacucaa

SEQ ID NO: 1682227 - RNA, 18 nt, Homo sapiens
acugagcagggaucugcc

SEQ ID NO: 1682228 - RNA, 16 nt, Homo sapiens
acugagcuauaacuua

SEQ ID NO: 1682229 - RNA, 20 nt, Homo sapiens
acugaugagagaauguggaa

SEQ ID NO: 1682230 - RNA, 19 nt, Homo sapiens
acugcugcaaauacuguau

SEQ ID NO: 1682231 - RNA, 13 nt, Homo sapiens
acuggggccucag

SEQ ID NO: 1682232 - RNA, 21 nt, Homo sapiens
acuguacacagaauuguucca

SEQ ID NO: 1682233 - RNA, 23 nt, Homo sapiens
acugucaagaagaggaaagggag

SEQ ID NO: 1682234 - RNA, 15 nt, Homo sapiens
acugucuagaacuua

SEQ ID NO: 1682235 - RNA, 15 nt, Homo sapiens
acugugucucaugga

SEQ ID NO: 1682236 - RNA, 19 nt, Homo sapiens
acuguuugauauaccaaau

SEQ ID NO: 1682237 - RNA, 18 nt, Homo sapiens
acuuauggcaugacucuu

SEQ ID NO: 1682238 - RNA, 23 nt, Homo sapiens
acuucaauguauugagcauguga

SEQ ID NO: 1682239 - RNA, 20 nt, Homo sapiens
acuucaccuacauuaucuca

SEQ ID NO: 1682240 - RNA, 17 nt, Homo sapiens
acuucucaccagcaguc

SEQ ID NO: 1682241 - RNA, 18 nt, Homo sapiens
acuugaguuuuggcaagg

SEQ ID NO: 1682242 - RNA, 15 nt, Homo sapiens
acuuggaacuaggcu

SEQ ID NO: 1682243 - RNA, 21 nt, Homo sapiens
acuugggcuucaacagccaag

SEQ ID NO: 1682244 - RNA, 22 nt, Homo sapiens
acuugggucacaugacucucau

SEQ ID NO: 1682245 - RNA, 22 nt, Homo sapiens
acuugguuuguuauaucaggga

SEQ ID NO: 1682246 - RNA, 18 nt, Homo sapiens
acuuguauagcaugaaau

SEQ ID NO: 1682247 - RNA, 18 nt, Homo sapiens
acuuuaguagacauuuau

SEQ ID NO: 1682248 - RNA, 19 nt, Homo sapiens
acuuucuucucuuucccaa

SEQ ID NO: 1682249 - RNA, 17 nt, Homo sapiens
agaaaauaaaagcacuu

SEQ ID NO: 1682250 - RNA, 17 nt, Homo sapiens
agaaauuaccuguggau

SEQ ID NO: 1682251 - RNA, 19 nt, Homo sapiens
agaacauauguugcaagac

SEQ ID NO: 1682252 - RNA, 16 nt, Homo sapiens
agaaccacacuugaaa

SEQ ID NO: 1682253 - RNA, 17 nt, Homo sapiens
agaagaaaauuugccaa

SEQ ID NO: 1682254 - RNA, 16 nt, Homo sapiens
agaagaggaaagggag

SEQ ID NO: 1682255 - RNA, 20 nt, Homo sapiens
agaaggggcuuugugaccag

SEQ ID NO: 1682256 - RNA, 20 nt, Homo sapiens
agaaguacaggucaucugcu

SEQ ID NO: 1682257 - RNA, 18 nt, Homo sapiens
agaauaguaguaacuguu

SEQ ID NO: 1682258 - RNA, 18 nt, Homo sapiens
agaauauaaaaauaaagc

SEQ ID NO: 1682259 - RNA, 20 nt, Homo sapiens
agaauauucucccauaaaca

SEQ ID NO: 1682260 - RNA, 21 nt, Homo sapiens
agaauauucucccauaaacac

SEQ ID NO: 1682261 - RNA, 18 nt, Homo sapiens
agaaucuuccuggcacaa

SEQ ID NO: 1682262 - RNA, 13 nt, Homo sapiens
agaauguuuucaa

SEQ ID NO: 1682263 - RNA, 21 nt, Homo sapiens
agaauuguuccaguacuaugg

SEQ ID NO: 1682264 - RNA, 14 nt, Homo sapiens
agacagaagcuuaa

SEQ ID NO: 1682265 - RNA, 18 nt, Homo sapiens
agacagcaggaagccaua

SEQ ID NO: 1682266 - RNA, 23 nt, Homo sapiens
agacccuugacaccugcugagaa

SEQ ID NO: 1682267 - RNA, 21 nt, Homo sapiens
agaccuccagaaaucuauucc

SEQ ID NO: 1682268 - RNA, 12 nt, Homo sapiens
agacguggugcu

SEQ ID NO: 1682269 - RNA, 17 nt, Homo sapiens
agacguggugcuucuca

SEQ ID NO: 1682270 - RNA, 19 nt, Homo sapiens
uggaagaugcagaagcaau

SEQ ID NO: 1682271 - RNA, 20 nt, Homo sapiens
uggaagaugcagaagcaaua

SEQ ID NO: 1682272 - RNA, 19 nt, Homo sapiens
uggaaucuuuguaccaaaa

SEQ ID NO: 1682273 - RNA, 13 nt, Homo sapiens
uggaauuacaggc

SEQ ID NO: 1682274 - RNA, 20 nt, Homo sapiens
uggaauucuaacaagucaua

SEQ ID NO: 1682275 - RNA, 15 nt, Homo sapiens
uggacucucagggau

SEQ ID NO: 1682276 - RNA, 23 nt, Homo sapiens
uggagccuaccucugucugagac

SEQ ID NO: 1682277 - RNA, 15 nt, Homo sapiens
uggagugcucacaaa

SEQ ID NO: 1682278 - RNA, 17 nt, Homo sapiens
uggauaagggaauaaua

SEQ ID NO: 1682279 - RNA, 20 nt, Homo sapiens
uggauucuuuaaacgcucua

SEQ ID NO: 1682280 - RNA, 14 nt, Homo sapiens
uggcaaagugacaa

SEQ ID NO: 1682281 - RNA, 17 nt, Homo sapiens
uggcaaagugacaaagc

SEQ ID NO: 1682282 - RNA, 18 nt, Homo sapiens
uggcaaaugccugacuca

SEQ ID NO: 1682283 - RNA, 19 nt, Homo sapiens
uggcacucagggagcauuu

SEQ ID NO: 1682284 - RNA, 21 nt, Homo sapiens
uggcauucuuugcaauacugc

SEQ ID NO: 1682285 - RNA, 20 nt, Homo sapiens
uggccacgggggcaguguga

SEQ ID NO: 1682286 - RNA, 23 nt, Homo sapiens
uggccgucccuaagcaugugucc

SEQ ID NO: 1682287 - RNA, 18 nt, Homo sapiens
uggcugcaagagcccaga

SEQ ID NO: 1682288 - RNA, 23 nt, Homo sapiens
uggcuucagguuagugacauuua

SEQ ID NO: 1682289 - RNA, 16 nt, Homo sapiens
ugggaaaacauuugcu

SEQ ID NO: 1682290 - RNA, 12 nt, Homo sapiens
ugggaaggccag

SEQ ID NO: 1682291 - RNA, 18 nt, Homo sapiens
ugggaauguucuuucugc

SEQ ID NO: 1682292 - RNA, 18 nt, Homo sapiens
ugggagaaggacuaucaa

SEQ ID NO: 1682293 - RNA, 15 nt, Homo sapiens
ugggagacaugugac

SEQ ID NO: 1682294 - RNA, 13 nt, Homo sapiens
ugggauacagauc

SEQ ID NO: 1682295 - RNA, 14 nt, Homo sapiens
ugggauggggacau

SEQ ID NO: 1682296 - RNA, 15 nt, Homo sapiens
ugggcggcacagccu

SEQ ID NO: 1682297 - RNA, 14 nt, Homo sapiens
uggggccucaggcu

SEQ ID NO: 1682298 - RNA, 19 nt, Homo sapiens
uggggggcaggccucccaa

SEQ ID NO: 1682299 - RNA, 16 nt, Homo sapiens
ugggguggagugggaa

SEQ ID NO: 1682300 - RNA, 14 nt, Homo sapiens
uggguaaaaugaag

SEQ ID NO: 1682301 - RNA, 16 nt, Homo sapiens
ugggucacauccaucc

SEQ ID NO: 1682302 - RNA, 21 nt, Homo sapiens
uggguuuucuccauucaggau

SEQ ID NO: 1682303 - RNA, 21 nt, Homo sapiens
ugguaauaaaugugacucagc

SEQ ID NO: 1682304 - RNA, 21 nt, Homo sapiens
ugguaguuuuacaguguuucu

SEQ ID NO: 1682305 - RNA, 22 nt, Homo sapiens
uggucugucaaugagagcauaa

SEQ ID NO: 1682306 - RNA, 17 nt, Homo sapiens
uggugggucuauguucc

SEQ ID NO: 1682307 - RNA, 17 nt, Homo sapiens
uguaaucucaaugcaag

SEQ ID NO: 1682308 - RNA, 12 nt, Homo sapiens
uguaaucucagc

SEQ ID NO: 1682309 - RNA, 16 nt, Homo sapiens
uguaaucucagcacuu

SEQ ID NO: 1682310 - RNA, 17 nt, Homo sapiens
uguaccuauggcaauuu

SEQ ID NO: 1682311 - RNA, 13 nt, Homo sapiens
uguacugccuuag

SEQ ID NO: 1682312 - RNA, 22 nt, Homo sapiens
uguagaugggggaacugugaau

SEQ ID NO: 1682313 - RNA, 13 nt, Homo sapiens
uguauauaagcaa

SEQ ID NO: 1682314 - RNA, 15 nt, Homo sapiens
uguauugguguugca

SEQ ID NO: 1682315 - RNA, 16 nt, Homo sapiens
uguccagagucucuuu

SEQ ID NO: 1682316 - RNA, 18 nt, Homo sapiens
ugucccaccuugaccaaa

SEQ ID NO: 1682317 - RNA, 21 nt, Homo sapiens
ugucuguaauaauagacugua

SEQ ID NO: 1682318 - RNA, 18 nt, Homo sapiens
ugucuuuguggugaugau

SEQ ID NO: 1682319 - RNA, 20 nt, Homo sapiens
ugugaaggcaggggaaugua

SEQ ID NO: 1682320 - RNA, 19 nt, Homo sapiens
ugugaggauagagacuugc

SEQ ID NO: 1682321 - RNA, 23 nt, Homo sapiens
ugugauuacugcaaucacugugc

SEQ ID NO: 1682322 - RNA, 23 nt, Homo sapiens
ugugcacuuucuucucuuuccca

SEQ ID NO: 1682323 - RNA, 17 nt, Homo sapiens
ugugcuauacacacaca

SEQ ID NO: 1682324 - RNA, 16 nt, Homo sapiens
ugugcuggugaacacu

SEQ ID NO: 1682325 - RNA, 17 nt, Homo sapiens
uguggaaauagaugugc

SEQ ID NO: 1682326 - RNA, 22 nt, Homo sapiens
uguggcauaaauugcaucacug

SEQ ID NO: 1682327 - RNA, 23 nt, Homo sapiens
uguggggccucaggcuccgggca

SEQ ID NO: 1682328 - RNA, 19 nt, Homo sapiens
uguguggucaacauuucuc

SEQ ID NO: 1682329 - RNA, 14 nt, Homo sapiens
uguguugaaugaag

SEQ ID NO: 1682330 - RNA, 21 nt, Homo sapiens
uguuaguaaauccaugguguu

SEQ ID NO: 1682331 - RNA, 12 nt, Homo sapiens
uguucgacucag

SEQ ID NO: 1682332 - RNA, 18 nt, Homo sapiens
uguucuccuauauccucc

SEQ ID NO: 1682333 - RNA, 18 nt, Homo sapiens
uguugcaaugcaugauac

SEQ ID NO: 1682334 - RNA, 23 nt, Homo sapiens
ucuaggcccugugagcacaaaga

SEQ ID NO: 1682335 - RNA, 16 nt, Homo sapiens
ucuaguucagcugccc

SEQ ID NO: 1682336 - RNA, 19 nt, Homo sapiens
ucuauacuccuucccuuaa

SEQ ID NO: 1682337 - RNA, 20 nt, Homo sapiens
ucuauauuagaucaaauagu

SEQ ID NO: 1682338 - RNA, 12 nt, Homo sapiens
ucucaacugagg

SEQ ID NO: 1682339 - RNA, 17 nt, Homo sapiens
ucucaaugaaccauaaa

SEQ ID NO: 1682340 - RNA, 14 nt, Homo sapiens
ucucacaagcacuu

SEQ ID NO: 1682341 - RNA, 18 nt, Homo sapiens
ucucauauaagacaaaua

SEQ ID NO: 1682342 - RNA, 18 nt, Homo sapiens
ucucuccaggagggcucg

SEQ ID NO: 1682343 - RNA, 16 nt, Homo sapiens
ucucucccagguccca

SEQ ID NO: 1682344 - RNA, 16 nt, Homo sapiens
ucucugaacaauacaa

SEQ ID NO: 1682345 - RNA, 22 nt, Homo sapiens
ucucugggcuucgggcuaugca

SEQ ID NO: 1682346 - RNA, 13 nt, Homo sapiens
ucugaauccuuuu

SEQ ID NO: 1682347 - RNA, 14 nt, Homo sapiens
ucugagagacagaa

SEQ ID NO: 1682348 - RNA, 14 nt, Homo sapiens
ucugcaaaccaaca

SEQ ID NO: 1682349 - RNA, 19 nt, Homo sapiens
ucugccaaaggaugugaua

SEQ ID NO: 1682350 - RNA, 16 nt, Homo sapiens
ucugcucucauauaag

SEQ ID NO: 1682351 - RNA, 12 nt, Homo sapiens
ucuggauuucau

SEQ ID NO: 1682352 - RNA, 23 nt, Homo sapiens
ucugugacauacauauuaucuca

SEQ ID NO: 1682353 - RNA, 19 nt, Homo sapiens
ucugugcuucgacuacugc

SEQ ID NO: 1682354 - RNA, 21 nt, Homo sapiens
ucuuaaacuaaaugugcaaua

SEQ ID NO: 1682355 - RNA, 22 nt, Homo sapiens
ucuuaaacuaaaugugcaauag

SEQ ID NO: 1682356 - RNA, 22 nt, Homo sapiens
ucuuagcccucaccacagccuu

SEQ ID NO: 1682357 - RNA, 18 nt, Homo sapiens
ucuucacaggcacuccug

SEQ ID NO: 1682358 - RNA, 15 nt, Homo sapiens
ucuuccuccucccaa

SEQ ID NO: 1682359 - RNA, 20 nt, Homo sapiens
ucuuggcucaccauaaccuc

SEQ ID NO: 1682360 - RNA, 17 nt, Homo sapiens
ucuugguaauccccuaa

SEQ ID NO: 1682361 - RNA, 20 nt, Homo sapiens
ucuugucauuauucucugaa

SEQ ID NO: 1682362 - RNA, 18 nt, Homo sapiens
ucuuucauaaaaacacuc

SEQ ID NO: 1682363 - RNA, 19 nt, Homo sapiens
ucuuucauaaaaacacuca

SEQ ID NO: 1682364 - RNA, 19 nt, Homo sapiens
ucuuuuguucuccuauauc

SEQ ID NO: 1682365 - RNA, 14 nt, Homo sapiens
ugaaaaaucuaagu

SEQ ID NO: 1682366 - RNA, 19 nt, Homo sapiens
ugaaagaugcaucaucucu

SEQ ID NO: 1682367 - RNA, 15 nt, Homo sapiens
ugaaaguuaacauua

SEQ ID NO: 1682368 - RNA, 20 nt, Homo sapiens
ugaaaucccugccucaggcc

SEQ ID NO: 1682369 - RNA, 14 nt, Homo sapiens
ugaaaugaacuuug

SEQ ID NO: 1682370 - RNA, 13 nt, Homo sapiens
ugaaauucuuccu

SEQ ID NO: 1682371 - RNA, 20 nt, Homo sapiens
ugaagaagaugagccuugca

SEQ ID NO: 1682372 - RNA, 17 nt, Homo sapiens
ugaagaguggaaauggg

SEQ ID NO: 1682373 - RNA, 17 nt, Homo sapiens
ugaagcuuuaaguuaag

SEQ ID NO: 1682374 - RNA, 16 nt, Homo sapiens
ugaaggauuacucucc

SEQ ID NO: 1682375 - RNA, 19 nt, Homo sapiens
ugaaggggcugguggagau

SEQ ID NO: 1682376 - RNA, 13 nt, Homo sapiens
ugaauauguagua

SEQ ID NO: 1682377 - RNA, 16 nt, Homo sapiens
ugaaugagcuugucaa

SEQ ID NO: 1682378 - RNA, 13 nt, Homo sapiens
ugaauuuaauaca

SEQ ID NO: 1682379 - RNA, 22 nt, Homo sapiens
ugacagguuuuccaaaaguaaa

SEQ ID NO: 1682380 - RNA, 11 nt, Homo sapiens
ugacaguuccc

SEQ ID NO: 1682381 - RNA, 18 nt, Homo sapiens
ugacauuuauauauugaa

SEQ ID NO: 1682382 - RNA, 21 nt, Homo sapiens
ugaccccauuccugaucccau

SEQ ID NO: 1682383 - RNA, 14 nt, Homo sapiens
ugaccgacaugaac

SEQ ID NO: 1682384 - RNA, 14 nt, Homo sapiens
ugacucagugacca

SEQ ID NO: 1682385 - RNA, 12 nt, Homo sapiens
ugagaagugaua

SEQ ID NO: 1682386 - RNA, 23 nt, Homo sapiens
ugagaauguaaauaaaugugucu

SEQ ID NO: 1682387 - RNA, 17 nt, Homo sapiens
ugagacuacuuaagaua

SEQ ID NO: 1682388 - RNA, 17 nt, Homo sapiens
ugagcagagauguacug

SEQ ID NO: 1682389 - RNA, 12 nt, Homo sapiens
ugagcaugugau

SEQ ID NO: 1682390 - RNA, 16 nt, Homo sapiens
ugagcuauaacuuacu

SEQ ID NO: 1682391 - RNA, 16 nt, Homo sapiens
ugaggaaaauucuuaa

SEQ ID NO: 1682392 - RNA, 15 nt, Homo sapiens
ugaggacugauuuca

SEQ ID NO: 1682393 - RNA, 22 nt, Homo sapiens
ugaggagauucccaccuuccau

SEQ ID NO: 1682394 - RNA, 21 nt, Homo sapiens
ugagguuucuuugacuucaau

SEQ ID NO: 1682395 - RNA, 21 nt, Homo sapiens
ugaguagcugggauuacaggc

SEQ ID NO: 1682396 - RNA, 19 nt, Homo sapiens
ugauaauaguccuuuacaa

SEQ ID NO: 1682397 - RNA, 14 nt, Homo sapiens
ugauacuaucugug

SEQ ID NO: 1682398 - RNA, 12 nt, Homo sapiens
ugauacuuugac

SEQ ID NO: 1682399 - RNA, 17 nt, Homo sapiens
ugauacuuugacagugu

SEQ ID NO: 1682400 - RNA, 19 nt, Homo sapiens
uaucauaauucagcacuua

SEQ ID NO: 1682401 - RNA, 20 nt, Homo sapiens
uaucauaauucagcacuuaa

SEQ ID NO: 1682402 - RNA, 22 nt, Homo sapiens
uauccacaaaugacugcaaaag

SEQ ID NO: 1682403 - RNA, 21 nt, Homo sapiens
uaucugaaaggccagcagcug

SEQ ID NO: 1682404 - RNA, 17 nt, Homo sapiens
uaugauaaauauaacau

SEQ ID NO: 1682405 - RNA, 20 nt, Homo sapiens
uaugauaaauauaacaucua

SEQ ID NO: 1682406 - RNA, 23 nt, Homo sapiens
uaugauaaauauaacaucuauga

SEQ ID NO: 1682407 - RNA, 17 nt, Homo sapiens
uaugcauucacauuuag

SEQ ID NO: 1682408 - RNA, 21 nt, Homo sapiens
uaugggggagauugaacuuuc

SEQ ID NO: 1682409 - RNA, 21 nt, Homo sapiens
uauguacugccuuagugcuga

SEQ ID NO: 1682410 - RNA, 13 nt, Homo sapiens
uauguauucacag

SEQ ID NO: 1682411 - RNA, 16 nt, Homo sapiens
uaugucaaagcuuuga

SEQ ID NO: 1682412 - RNA, 15 nt, Homo sapiens
uaugugcacaucugu

SEQ ID NO: 1682413 - RNA, 15 nt, Homo sapiens
uaugugggauauuga

SEQ ID NO: 1682414 - RNA, 15 nt, Homo sapiens
uauuacagcauuuga

SEQ ID NO: 1682415 - RNA, 20 nt, Homo sapiens
uauuccgauacaaaguguug

SEQ ID NO: 1682416 - RNA, 20 nt, Homo sapiens
uauucuauaaaacucugcau

SEQ ID NO: 1682417 - RNA, 22 nt, Homo sapiens
uauugaaaugauuucacagugu

SEQ ID NO: 1682418 - RNA, 17 nt, Homo sapiens
uauugcaaggugugaug

SEQ ID NO: 1682419 - RNA, 11 nt, Homo sapiens
uauugcugcua

SEQ ID NO: 1682420 - RNA, 13 nt, Homo sapiens
uauugguguugca

SEQ ID NO: 1682421 - RNA, 14 nt, Homo sapiens
uauuuaaguucaua

SEQ ID NO: 1682422 - RNA, 20 nt, Homo sapiens
uauuuuuugaaucuaugaac

SEQ ID NO: 1682423 - RNA, 13 nt, Homo sapiens
ucaaagccuucuc

SEQ ID NO: 1682424 - RNA, 16 nt, Homo sapiens
ucaaagucauuaaaga

SEQ ID NO: 1682425 - RNA, 22 nt, Homo sapiens
ucaaauaggcuauuaaaaaagu

SEQ ID NO: 1682426 - RNA, 12 nt, Homo sapiens
ucaaauguucuc

SEQ ID NO: 1682427 - RNA, 18 nt, Homo sapiens
ucaaauguucuccaguca

SEQ ID NO: 1682428 - RNA, 18 nt, Homo sapiens
ucaacaucuaaaaaucaa

SEQ ID NO: 1682429 - RNA, 12 nt, Homo sapiens
ucaacauugcau

SEQ ID NO: 1682430 - RNA, 14 nt, Homo sapiens
ucaagaaucacuug

SEQ ID NO: 1682431 - RNA, 20 nt, Homo sapiens
ucaagcuggaagaagugagc

SEQ ID NO: 1682432 - RNA, 21 nt, Homo sapiens
ucaaucuuuggaggcuuuuaa

SEQ ID NO: 1682433 - RNA, 13 nt, Homo sapiens
ucaaugcuauucu

SEQ ID NO: 1682434 - RNA, 13 nt, Homo sapiens
ucaauuucuagua

SEQ ID NO: 1682435 - RNA, 10 nt, Homo sapiens
ucacaaagug

SEQ ID NO: 1682436 - RNA, 18 nt, Homo sapiens
ucacacagacacuaacga

SEQ ID NO: 1682437 - RNA, 16 nt, Homo sapiens
ucacacauuacaaagu

SEQ ID NO: 1682438 - RNA, 17 nt, Homo sapiens
ucacaguugauacauag

SEQ ID NO: 1682439 - RNA, 13 nt, Homo sapiens
ucacauccauccc

SEQ ID NO: 1682440 - RNA, 19 nt, Homo sapiens
ucacauccaucccuccauu

SEQ ID NO: 1682441 - RNA, 21 nt, Homo sapiens
ucaccaaaagacacugcagaa

SEQ ID NO: 1682442 - RNA, 22 nt, Homo sapiens
ucacccuguaauaaauaugugu

SEQ ID NO: 1682443 - RNA, 18 nt, Homo sapiens
ucaccuacauuaucucac

SEQ ID NO: 1682444 - RNA, 12 nt, Homo sapiens
ucacuacaggug

SEQ ID NO: 1682445 - RNA, 23 nt, Homo sapiens
ucacucuggcuucaaaaagccac

SEQ ID NO: 1682446 - RNA, 18 nt, Homo sapiens
ucacuggcaugggagacc

SEQ ID NO: 1682447 - RNA, 12 nt, Homo sapiens
ucacuguacugc

SEQ ID NO: 1682448 - RNA, 23 nt, Homo sapiens
ucagaaaaccacuuuauugcaau

SEQ ID NO: 1682449 - RNA, 14 nt, Homo sapiens
ucagccucccaaag

SEQ ID NO: 1682450 - RNA, 21 nt, Homo sapiens
ucagccugcuuuccugcagca

SEQ ID NO: 1682451 - RNA, 20 nt, Homo sapiens
ucagcugcuguugaacuuuu

SEQ ID NO: 1682452 - RNA, 14 nt, Homo sapiens
ucagggaacucugg

SEQ ID NO: 1682453 - RNA, 12 nt, Homo sapiens
ucaucuugccuc

SEQ ID NO: 1682454 - RNA, 21 nt, Homo sapiens
ucaugaagaauguuucuggaa

SEQ ID NO: 1682455 - RNA, 14 nt, Homo sapiens
ucaugagugaauaa

SEQ ID NO: 1682456 - RNA, 16 nt, Homo sapiens
ucauucauaguaguua

SEQ ID NO: 1682457 - RNA, 20 nt, Homo sapiens
ucauuguauuuuuaacacca

SEQ ID NO: 1682458 - RNA, 23 nt, Homo sapiens
ucauuguauuuuuaacaccagaa

SEQ ID NO: 1682459 - RNA, 17 nt, Homo sapiens
ucauuuagucaugugac

SEQ ID NO: 1682460 - RNA, 18 nt, Homo sapiens
ucauuuucauauuguaau

SEQ ID NO: 1682461 - RNA, 20 nt, Homo sapiens
uccaaaaguguugacugugu

SEQ ID NO: 1682462 - RNA, 15 nt, Homo sapiens
uccaaguaacauuuu

SEQ ID NO: 1682463 - RNA, 21 nt, Homo sapiens
uccaaugacugagcagcaucc

SEQ ID NO: 1682464 - RNA, 22 nt, Homo sapiens
uccaauuucucuuuacuugaaa

SEQ ID NO: 1682465 - RNA, 11 nt, Homo sapiens
guugguucuga

SEQ ID NO: 1682466 - RNA, 21 nt, Homo sapiens
guuuaagccgcagaccuggag

SEQ ID NO: 1682467 - RNA, 19 nt, Homo sapiens
guuuaauggguaugcucag

SEQ ID NO: 1682468 - RNA, 22 nt, Homo sapiens
guuuauguaacuuccuguggau

SEQ ID NO: 1682469 - RNA, 21 nt, Homo sapiens
guuucccaucagacugucaag

SEQ ID NO: 1682470 - RNA, 23 nt, Homo sapiens
guuucuggauuucauacuguaac

SEQ ID NO: 1682471 - RNA, 20 nt, Homo sapiens
guuucuuugacuucaaugua

SEQ ID NO: 1682472 - RNA, 14 nt, Homo sapiens
guuuuaaaguucau

SEQ ID NO: 1682473 - RNA, 13 nt, Homo sapiens
uaaaaaauugacu

SEQ ID NO: 1682474 - RNA, 13 nt, Homo sapiens
uaaaaaguaauaa

SEQ ID NO: 1682475 - RNA, 18 nt, Homo sapiens
uaaaaaucacuuucauaa

SEQ ID NO: 1682476 - RNA, 16 nt, Homo sapiens
uaaaaaugucaucuca

SEQ ID NO: 1682477 - RNA, 21 nt, Homo sapiens
uaaaacagguuauaacagugu

SEQ ID NO: 1682478 - RNA, 11 nt, Homo sapiens
uaaaagcacuu

SEQ ID NO: 1682479 - RNA, 20 nt, Homo sapiens
uaaaagcuacuauguacugc

SEQ ID NO: 1682480 - RNA, 22 nt, Homo sapiens
uaaaagcuacuauguacugccu

SEQ ID NO: 1682481 - RNA, 19 nt, Homo sapiens
uaaaauauuuaaugugaca

SEQ ID NO: 1682482 - RNA, 12 nt, Homo sapiens
uaaaaucaggaa

SEQ ID NO: 1682483 - RNA, 20 nt, Homo sapiens
uaaaauguuuguuaaagcua

SEQ ID NO: 1682484 - RNA, 23 nt, Homo sapiens
uaaaauuagaaucugaguauaaa

SEQ ID NO: 1682485 - RNA, 23 nt, Homo sapiens
uaaagagucuggccuggacccug

SEQ ID NO: 1682486 - RNA, 17 nt, Homo sapiens
uaaagauguuuauuuca

SEQ ID NO: 1682487 - RNA, 17 nt, Homo sapiens
uaaaguaaauacaugca

SEQ ID NO: 1682488 - RNA, 21 nt, Homo sapiens
uaaauaaguaaaagcuacuau

SEQ ID NO: 1682489 - RNA, 13 nt, Homo sapiens
uaaaucauaaagu

SEQ ID NO: 1682490 - RNA, 18 nt, Homo sapiens
uaaaucuaauaauuauuc

SEQ ID NO: 1682491 - RNA, 15 nt, Homo sapiens
uaaaugaguucaaca

SEQ ID NO: 1682492 - RNA, 21 nt, Homo sapiens
uaaauuuucaugaaugugcug

SEQ ID NO: 1682493 - RNA, 15 nt, Homo sapiens
uaacaucaccacugu

SEQ ID NO: 1682494 - RNA, 12 nt, Homo sapiens
uaacaucuccau

SEQ ID NO: 1682495 - RNA, 23 nt, Homo sapiens
uaacauuaaugccugcuuuuugg

SEQ ID NO: 1682496 - RNA, 16 nt, Homo sapiens
uaacgcagucuaauua

SEQ ID NO: 1682497 - RNA, 23 nt, Homo sapiens
uaacgcagucuaauuacauuuca

SEQ ID NO: 1682498 - RNA, 18 nt, Homo sapiens
uaacucuaccugcacacu

SEQ ID NO: 1682499 - RNA, 13 nt, Homo sapiens
uaagaaauacuca

SEQ ID NO: 1682500 - RNA, 14 nt, Homo sapiens
uaagaauaguagau

SEQ ID NO: 1682501 - RNA, 22 nt, Homo sapiens
uaagacaaauauuccuuugcau

SEQ ID NO: 1682502 - RNA, 15 nt, Homo sapiens
uaagauuuugugaau

SEQ ID NO: 1682503 - RNA, 15 nt, Homo sapiens
uaagcaaauguuaaa

SEQ ID NO: 1682504 - RNA, 14 nt, Homo sapiens
uaagcagaggaaua

SEQ ID NO: 1682505 - RNA, 14 nt, Homo sapiens
uaagcaugugaugu

SEQ ID NO: 1682506 - RNA, 19 nt, Homo sapiens
uaaguaaaagcuacuaugu

SEQ ID NO: 1682507 - RNA, 14 nt, Homo sapiens
uaagucaguguuaa

SEQ ID NO: 1682508 - RNA, 20 nt, Homo sapiens
uaagugauauaaaucagauu

SEQ ID NO: 1682509 - RNA, 21 nt, Homo sapiens
uaaguuaagugcauugaucau

SEQ ID NO: 1682510 - RNA, 18 nt, Homo sapiens
uaaguuugaucugucagc

SEQ ID NO: 1682511 - RNA, 16 nt, Homo sapiens
uaauaaaugaguucaa

SEQ ID NO: 1682512 - RNA, 14 nt, Homo sapiens
uaauaauuauucau

SEQ ID NO: 1682513 - RNA, 15 nt, Homo sapiens
uaauacagacaucua

SEQ ID NO: 1682514 - RNA, 16 nt, Homo sapiens
uaauauugacuuguau

SEQ ID NO: 1682515 - RNA, 14 nt, Homo sapiens
uaaucucagcacuu

SEQ ID NO: 1682516 - RNA, 15 nt, Homo sapiens
uaaugaaauggagga

SEQ ID NO: 1682517 - RNA, 14 nt, Homo sapiens
uaaugcuaaaugug

SEQ ID NO: 1682518 - RNA, 14 nt, Homo sapiens
uaauucagcacuua

SEQ ID NO: 1682519 - RNA, 18 nt, Homo sapiens
uaauugggaacugaaauc

SEQ ID NO: 1682520 - RNA, 15 nt, Homo sapiens
uaauuguguggauuc

SEQ ID NO: 1682521 - RNA, 14 nt, Homo sapiens
uaauuugaacuuug

SEQ ID NO: 1682522 - RNA, 24 nt, Homo sapiens
uaauuuuagaugccugugaaauag

SEQ ID NO: 1682523 - RNA, 15 nt, Homo sapiens
uacacauauccacaa

SEQ ID NO: 1682524 - RNA, 15 nt, Homo sapiens
uacacuucaccuccu

SEQ ID NO: 1682525 - RNA, 14 nt, Homo sapiens
uacagaagugaaag

SEQ ID NO: 1682526 - RNA, 21 nt, Homo sapiens
uacagacuuuuuucuugucau

SEQ ID NO: 1682527 - RNA, 20 nt, Homo sapiens
uacagauacauaucugugua

SEQ ID NO: 1682528 - RNA, 15 nt, Homo sapiens
uacauaguuguauau

SEQ ID NO: 1682529 - RNA, 16 nt, Homo sapiens
ggcuggagugcaaugg

SEQ ID NO: 1682530 - RNA, 18 nt, Homo sapiens
gggaaaaggcaggugcuu

SEQ ID NO: 1682531 - RNA, 19 nt, Homo sapiens
gggaaacaaauaauuugaa

SEQ ID NO: 1682532 - RNA, 13 nt, Homo sapiens
gggaauccugcua

SEQ ID NO: 1682533 - RNA, 16 nt, Homo sapiens
gggacagcaagugagc

SEQ ID NO: 1682534 - RNA, 14 nt, Homo sapiens
gggagaaacccaga

SEQ ID NO: 1682535 - RNA, 19 nt, Homo sapiens
gggaucugcuugauauccc

SEQ ID NO: 1682536 - RNA, 23 nt, Homo sapiens
gggaugucuccgucucugucuca

SEQ ID NO: 1682537 - RNA, 23 nt, Homo sapiens
gggcccuggagcucaggguccuu

SEQ ID NO: 1682538 - RNA, 15 nt, Homo sapiens
gggccugaugugugu

SEQ ID NO: 1682539 - RNA, 17 nt, Homo sapiens
gggcucuccaagcacua

SEQ ID NO: 1682540 - RNA, 21 nt, Homo sapiens
gggcugugauuacugcaauca

SEQ ID NO: 1682541 - RNA, 15 nt, Homo sapiens
ggggagaaacccaga

SEQ ID NO: 1682542 - RNA, 17 nt, Homo sapiens
ggggaggccucacccca

SEQ ID NO: 1682543 - RNA, 12 nt, Homo sapiens
ggggugggccac

SEQ ID NO: 1682544 - RNA, 18 nt, Homo sapiens
gggucacugggaugccuc

SEQ ID NO: 1682545 - RNA, 16 nt, Homo sapiens
gggugacagugccuuc

SEQ ID NO: 1682546 - RNA, 17 nt, Homo sapiens
gggugugaacauguucu

SEQ ID NO: 1682547 - RNA, 17 nt, Homo sapiens
ggguugugcacauuucu

SEQ ID NO: 1682548 - RNA, 21 nt, Homo sapiens
gguaauauugacuuguauauu

SEQ ID NO: 1682549 - RNA, 12 nt, Homo sapiens
ggucugccaauc

SEQ ID NO: 1682550 - RNA, 15 nt, Homo sapiens
ggugcacuccagacu

SEQ ID NO: 1682551 - RNA, 14 nt, Homo sapiens
ggugcuagauccag

SEQ ID NO: 1682552 - RNA, 20 nt, Homo sapiens
gguguuauuuucugagagac

SEQ ID NO: 1682553 - RNA, 15 nt, Homo sapiens
gguuaagacaaaggg

SEQ ID NO: 1682554 - RNA, 14 nt, Homo sapiens
gguucaacaucuaa

SEQ ID NO: 1682555 - RNA, 19 nt, Homo sapiens
gguuuguuauaucagggaa

SEQ ID NO: 1682556 - RNA, 20 nt, Homo sapiens
guaaagauccuauagcucuu

SEQ ID NO: 1682557 - RNA, 16 nt, Homo sapiens
guaaauccaugguguu

SEQ ID NO: 1682558 - RNA, 16 nt, Homo sapiens
guaaguuaucuuugaa

SEQ ID NO: 1682559 - RNA, 13 nt, Homo sapiens
guaauuccagcua

SEQ ID NO: 1682560 - RNA, 19 nt, Homo sapiens
guacaaaaauuaugcaauu

SEQ ID NO: 1682561 - RNA, 15 nt, Homo sapiens
guaccugcugggugu

SEQ ID NO: 1682562 - RNA, 15 nt, Homo sapiens
guacgaugacagugu

SEQ ID NO: 1682563 - RNA, 13 nt, Homo sapiens
guacuaacccagu

SEQ ID NO: 1682564 - RNA, 21 nt, Homo sapiens
guacucccauuaaauucagug

SEQ ID NO: 1682565 - RNA, 16 nt, Homo sapiens
guagcacucucagagu

SEQ ID NO: 1682566 - RNA, 15 nt, Homo sapiens
guaggacccucgaga

SEQ ID NO: 1682567 - RNA, 16 nt, Homo sapiens
guaucagaaguguuaa

SEQ ID NO: 1682568 - RNA, 18 nt, Homo sapiens
guaugcauucacauuuag

SEQ ID NO: 1682569 - RNA, 18 nt, Homo sapiens
guauggaagccaccggga

SEQ ID NO: 1682570 - RNA, 13 nt, Homo sapiens
guauucacaguug

SEQ ID NO: 1682571 - RNA, 21 nt, Homo sapiens
guauuccuuuauacacagugg

SEQ ID NO: 1682572 - RNA, 16 nt, Homo sapiens
guauuuuuaaaggcau

SEQ ID NO: 1682573 - RNA, 18 nt, Homo sapiens
guauuuuuaacaccagaa

SEQ ID NO: 1682574 - RNA, 19 nt, Homo sapiens
gucacagccucaagucacu

SEQ ID NO: 1682575 - RNA, 17 nt, Homo sapiens
gucaccaaaagacacug

SEQ ID NO: 1682576 - RNA, 23 nt, Homo sapiens
gucagaacagagugcaacccagu

SEQ ID NO: 1682577 - RNA, 14 nt, Homo sapiens
gucauuauguuaau

SEQ ID NO: 1682578 - RNA, 20 nt, Homo sapiens
gucccacccccuccuucuag

SEQ ID NO: 1682579 - RNA, 16 nt, Homo sapiens
gucccaggagcaggac

SEQ ID NO: 1682580 - RNA, 21 nt, Homo sapiens
guccccccucaagaguacaga

SEQ ID NO: 1682581 - RNA, 16 nt, Homo sapiens
guccuuaggcuacugu

SEQ ID NO: 1682582 - RNA, 11 nt, Homo sapiens
guccuuuacaa

SEQ ID NO: 1682583 - RNA, 18 nt, Homo sapiens
guccuuuacaaacauaca

SEQ ID NO: 1682584 - RNA, 23 nt, Homo sapiens
guccuuugucuaaguagggccag

SEQ ID NO: 1682585 - RNA, 19 nt, Homo sapiens
gucggguucucccaugauu

SEQ ID NO: 1682586 - RNA, 18 nt, Homo sapiens
gucuagagagaaccaaua

SEQ ID NO: 1682587 - RNA, 19 nt, Homo sapiens
gucuaggucuccucagggu

SEQ ID NO: 1682588 - RNA, 22 nt, Homo sapiens
gucuggggacgaaggguuggac

SEQ ID NO: 1682589 - RNA, 22 nt, Homo sapiens
gucugguaauaaaugugacuca

SEQ ID NO: 1682590 - RNA, 21 nt, Homo sapiens
gugaaacccugucucuacuaa

SEQ ID NO: 1682591 - RNA, 23 nt, Homo sapiens
gugaagucucuggguggaagugu

SEQ ID NO: 1682592 - RNA, 14 nt, Homo sapiens
gugacaaagcaauu

SEQ ID NO: 1682593 - RNA, 15 nt, Homo sapiens
gugacauuugggaga

SEQ ID NO: 1682594 - RNA, 20 nt, Homo sapiens
gugagcagagauguacugca

SEQ ID NO: 1682595 - RNA, 12 nt, Homo sapiens
gugagugacaaa

SEQ ID NO: 1682596 - RNA, 20 nt, Homo sapiens
gugagugacaaagccucuga

SEQ ID NO: 1682597 - RNA, 19 nt, Homo sapiens
gugaguuuaccuuguauac

SEQ ID NO: 1682598 - RNA, 16 nt, Homo sapiens
gugcaacccagucaca

SEQ ID NO: 1682599 - RNA, 20 nt, Homo sapiens
gugcauccgggggcagcucu

SEQ ID NO: 1682600 - RNA, 17 nt, Homo sapiens
gugcccuuugggguccc

SEQ ID NO: 1682601 - RNA, 18 nt, Homo sapiens
gugccugccaccuucaag

SEQ ID NO: 1682602 - RNA, 18 nt, Homo sapiens
gugcuggaauuacaggcg

SEQ ID NO: 1682603 - RNA, 19 nt, Homo sapiens
gugcuggaauuacaggcgu

SEQ ID NO: 1682604 - RNA, 15 nt, Homo sapiens
gugcuguugggauau

SEQ ID NO: 1682605 - RNA, 18 nt, Homo sapiens
gugcuguuuuuguucuac

SEQ ID NO: 1682606 - RNA, 18 nt, Homo sapiens
guggaaaaaacauuuuaa

SEQ ID NO: 1682607 - RNA, 19 nt, Homo sapiens
guggaaagucacaggucac

SEQ ID NO: 1682608 - RNA, 17 nt, Homo sapiens
guggaaauagaugugca

SEQ ID NO: 1682609 - RNA, 14 nt, Homo sapiens
guggcucacuacug

SEQ ID NO: 1682610 - RNA, 15 nt, Homo sapiens
guggcucacuacuga

SEQ ID NO: 1682611 - RNA, 15 nt, Homo sapiens
gugggagaaggacua

SEQ ID NO: 1682612 - RNA, 21 nt, Homo sapiens
gugggauauugaauguuaaag

SEQ ID NO: 1682613 - RNA, 20 nt, Homo sapiens
guggggggugacagugccuu

SEQ ID NO: 1682614 - RNA, 18 nt, Homo sapiens
gugguugucuuauugcac

SEQ ID NO: 1682615 - RNA, 12 nt, Homo sapiens
guguacugccuu

SEQ ID NO: 1682616 - RNA, 23 nt, Homo sapiens
gugucaccccucacugugacuga

SEQ ID NO: 1682617 - RNA, 19 nt, Homo sapiens
gugucagagcugaaauuca

SEQ ID NO: 1682618 - RNA, 15 nt, Homo sapiens
gugugacccugggca

SEQ ID NO: 1682619 - RNA, 17 nt, Homo sapiens
gugugugacacugauga

SEQ ID NO: 1682620 - RNA, 22 nt, Homo sapiens
guguuguaucaaagugugauau

SEQ ID NO: 1682621 - RNA, 14 nt, Homo sapiens
guguuuucagcaaa

SEQ ID NO: 1682622 - RNA, 19 nt, Homo sapiens
guuauacuuauuuguauau

SEQ ID NO: 1682623 - RNA, 16 nt, Homo sapiens
guucaacaucuaaaaa

SEQ ID NO: 1682624 - RNA, 21 nt, Homo sapiens
guucaaucuggauucauauuu

SEQ ID NO: 1682625 - RNA, 18 nt, Homo sapiens
guucacucggcacuacuu

SEQ ID NO: 1682626 - RNA, 19 nt, Homo sapiens
guucccuugcagggguccc

SEQ ID NO: 1682627 - RNA, 20 nt, Homo sapiens
guuccggggagaaacccaga

SEQ ID NO: 1682628 - RNA, 17 nt, Homo sapiens
guucuaaauaugaauga

SEQ ID NO: 1682629 - RNA, 21 nt, Homo sapiens
guucuccagucauuauguuaa

SEQ ID NO: 1682630 - RNA, 14 nt, Homo sapiens
guucugaggccaga

SEQ ID NO: 1682631 - RNA, 12 nt, Homo sapiens
guucuugggaua

SEQ ID NO: 1682632 - RNA, 21 nt, Homo sapiens
guugaguuaugauaacaccag

SEQ ID NO: 1682633 - RNA, 18 nt, Homo sapiens
guuggagugcucuuccca

SEQ ID NO: 1682634 - RNA, 13 nt, Homo sapiens
guugguaucugca

SEQ ID NO: 1682635 - RNA, 18 nt, Homo sapiens
guuuaauggguaugcuca

SEQ ID NO: 1682636 - RNA, 22 nt, Homo sapiens
guuuauuucaggcauuggauau

SEQ ID NO: 1682637 - RNA, 21 nt, Homo sapiens
guuucacuguacugcauguga

SEQ ID NO: 1682638 - RNA, 16 nt, Homo sapiens
guuucccuuucacugg

SEQ ID NO: 1682639 - RNA, 19 nt, Homo sapiens
guuuccuagcugugugaau

SEQ ID NO: 1682640 - RNA, 16 nt, Homo sapiens
guuugauauaccaaau

SEQ ID NO: 1682641 - RNA, 23 nt, Homo sapiens
uaaaaaaaaauuguaucucauua

SEQ ID NO: 1682642 - RNA, 15 nt, Homo sapiens
uaaaaaaagcuaaaa

SEQ ID NO: 1682643 - RNA, 16 nt, Homo sapiens
uaaaaaacuucaugua

SEQ ID NO: 1682644 - RNA, 14 nt, Homo sapiens
uaaaaaagagacau

SEQ ID NO: 1682645 - RNA, 12 nt, Homo sapiens
uaaaagcacuua

SEQ ID NO: 1682646 - RNA, 16 nt, Homo sapiens
uaaaagcuacuaugua

SEQ ID NO: 1682647 - RNA, 22 nt, Homo sapiens
uaaaauaacaguaugugggaua

SEQ ID NO: 1682648 - RNA, 20 nt, Homo sapiens
uaaaaugaaggguguggggu

SEQ ID NO: 1682649 - RNA, 16 nt, Homo sapiens
ucugcucuauacugug

SEQ ID NO: 1682650 - RNA, 12 nt, Homo sapiens
ucugcugucuaa

SEQ ID NO: 1682651 - RNA, 14 nt, Homo sapiens
ucuggaccccaaag

SEQ ID NO: 1682652 - RNA, 19 nt, Homo sapiens
ucuggacuggaaagcacaa

SEQ ID NO: 1682653 - RNA, 21 nt, Homo sapiens
ucuggauggccaaacccaaga

SEQ ID NO: 1682654 - RNA, 22 nt, Homo sapiens
ucuggguggaagugugugccaa

SEQ ID NO: 1682655 - RNA, 23 nt, Homo sapiens
ucuguauuaaaauuagaaucuga

SEQ ID NO: 1682656 - RNA, 18 nt, Homo sapiens
ucuguccccaaaugucca

SEQ ID NO: 1682657 - RNA, 19 nt, Homo sapiens
ucugugaagaaagagguua

SEQ ID NO: 1682658 - RNA, 15 nt, Homo sapiens
ucuguggcaaaaaga

SEQ ID NO: 1682659 - RNA, 14 nt, Homo sapiens
ucuguucacgucca

SEQ ID NO: 1682660 - RNA, 15 nt, Homo sapiens
ucuuauuuucucaau

SEQ ID NO: 1682661 - RNA, 17 nt, Homo sapiens
ucuucaugccugaugaa

SEQ ID NO: 1682662 - RNA, 15 nt, Homo sapiens
ucuucccacuccagc

SEQ ID NO: 1682663 - RNA, 12 nt, Homo sapiens
ucuucuuccuca

SEQ ID NO: 1682664 - RNA, 21 nt, Homo sapiens
ucuucuuucuuccacccacaa

SEQ ID NO: 1682665 - RNA, 22 nt, Homo sapiens
ucuugccucauuuugcuuccca

SEQ ID NO: 1682666 - RNA, 16 nt, Homo sapiens
ucuuggguucccaaau

SEQ ID NO: 1682667 - RNA, 14 nt, Homo sapiens
ucuuugcauuccag

SEQ ID NO: 1682668 - RNA, 14 nt, Homo sapiens
ucuuuguaccaaaa

SEQ ID NO: 1682669 - RNA, 16 nt, Homo sapiens
ugaaaaaaaacagugg

SEQ ID NO: 1682670 - RNA, 18 nt, Homo sapiens
ugaaaaaucuaagugaua

SEQ ID NO: 1682671 - RNA, 19 nt, Homo sapiens
ugaaacagcugcccugugu

SEQ ID NO: 1682672 - RNA, 15 nt, Homo sapiens
ugaaaugaacuuugu

SEQ ID NO: 1682673 - RNA, 18 nt, Homo sapiens
ugaaauuucuuguucaua

SEQ ID NO: 1682674 - RNA, 19 nt, Homo sapiens
ugaaauuuggcuaauaaca

SEQ ID NO: 1682675 - RNA, 20 nt, Homo sapiens
ugaacaccuauugcacuugg

SEQ ID NO: 1682676 - RNA, 19 nt, Homo sapiens
ugaagguagaauguuuuca

SEQ ID NO: 1682677 - RNA, 12 nt, Homo sapiens
ugacacugauga

SEQ ID NO: 1682678 - RNA, 20 nt, Homo sapiens
ugacaguuuuugacauuuau

SEQ ID NO: 1682679 - RNA, 22 nt, Homo sapiens
ugacauuugggagacaugugac

SEQ ID NO: 1682680 - RNA, 13 nt, Homo sapiens
ugaccccauuccu

SEQ ID NO: 1682681 - RNA, 18 nt, Homo sapiens
ugacccugauacaggcau

SEQ ID NO: 1682682 - RNA, 18 nt, Homo sapiens
ugacugagcagcauccac

SEQ ID NO: 1682683 - RNA, 15 nt, Homo sapiens
ugacuuaagcugccu

SEQ ID NO: 1682684 - RNA, 20 nt, Homo sapiens
ugacuuucuaacugugcaga

SEQ ID NO: 1682685 - RNA, 23 nt, Homo sapiens
ugagaauugaggggagguggcca

SEQ ID NO: 1682686 - RNA, 16 nt, Homo sapiens
ugagacauugugaaaa

SEQ ID NO: 1682687 - RNA, 15 nt, Homo sapiens
ugagaucauugugaa

SEQ ID NO: 1682688 - RNA, 15 nt, Homo sapiens
ugagaugaugauuag

SEQ ID NO: 1682689 - RNA, 17 nt, Homo sapiens
ugagcagggaucugccc

SEQ ID NO: 1682690 - RNA, 14 nt, Homo sapiens
ugagcauaaaucaa

SEQ ID NO: 1682691 - RNA, 22 nt, Homo sapiens
ugagcauagagaacaaaguaaa

SEQ ID NO: 1682692 - RNA, 23 nt, Homo sapiens
ugagcauggggccaggaaagucu

SEQ ID NO: 1682693 - RNA, 17 nt, Homo sapiens
ugagccaagauugcacc

SEQ ID NO: 1682694 - RNA, 18 nt, Homo sapiens
ugaggugaacuccaggca

SEQ ID NO: 1682695 - RNA, 16 nt, Homo sapiens
ugaguauaaauuuacu

SEQ ID NO: 1682696 - RNA, 19 nt, Homo sapiens
ugauacauuuuuguacuaa

SEQ ID NO: 1682697 - RNA, 17 nt, Homo sapiens
ugauaccauaugaauga

SEQ ID NO: 1682698 - RNA, 19 nt, Homo sapiens
ugauaccauaugaaugaaa

SEQ ID NO: 1682699 - RNA, 18 nt, Homo sapiens
ugauacuuugacaguguu

SEQ ID NO: 1682700 - RNA, 17 nt, Homo sapiens
ugaucagaguuccuccu

SEQ ID NO: 1682701 - RNA, 12 nt, Homo sapiens
ugaucugucagc

SEQ ID NO: 1682702 - RNA, 19 nt, Homo sapiens
ugaugccuguguacugccu

SEQ ID NO: 1682703 - RNA, 22 nt, Homo sapiens
ugcaacccagucacacuguggc

SEQ ID NO: 1682704 - RNA, 15 nt, Homo sapiens
ugcaaggugugaugg

SEQ ID NO: 1682705 - RNA, 23 nt, Homo sapiens
ugcacaggcagauguuugccuca

SEQ ID NO: 1682706 - RNA, 14 nt, Homo sapiens
ugcaccacugcucu

SEQ ID NO: 1682707 - RNA, 14 nt, Homo sapiens
ugcacuaacagagu

SEQ ID NO: 1682708 - RNA, 16 nt, Homo sapiens
ugcagaggcaccucaa

SEQ ID NO: 1682709 - RNA, 13 nt, Homo sapiens
ugcagcagucgcc

SEQ ID NO: 1682710 - RNA, 19 nt, Homo sapiens
ugcagggguccccccucaa

SEQ ID NO: 1682711 - RNA, 22 nt, Homo sapiens
ugcauauuauaaaggauaaaga

SEQ ID NO: 1682712 - RNA, 15 nt, Homo sapiens
ugcauccacuagcuu

SEQ ID NO: 1682713 - RNA, 19 nt, Homo sapiens
ugccaaaggaugugauaua

SEQ ID NO: 1682714 - RNA, 15 nt, Homo sapiens
ugccaccuucaaguu

SEQ ID NO: 1682715 - RNA, 17 nt, Homo sapiens
ugccauccagccagaac

SEQ ID NO: 1682716 - RNA, 15 nt, Homo sapiens
ugcccuuuccuggca

SEQ ID NO: 1682717 - RNA, 14 nt, Homo sapiens
ugcccuuugggguc

SEQ ID NO: 1682718 - RNA, 15 nt, Homo sapiens
ugccucuguccgugc

SEQ ID NO: 1682719 - RNA, 15 nt, Homo sapiens
ugccucuugcagggu

SEQ ID NO: 1682720 - RNA, 20 nt, Homo sapiens
ugccugugaaauaguacugc

SEQ ID NO: 1682721 - RNA, 19 nt, Homo sapiens
ugccuuucuacaacugauu

SEQ ID NO: 1682722 - RNA, 20 nt, Homo sapiens
ugcuaacaagucaccaaaag

SEQ ID NO: 1682723 - RNA, 17 nt, Homo sapiens
ugcuaaggcuccuccuu

SEQ ID NO: 1682724 - RNA, 20 nt, Homo sapiens
ugcuaaugacagccuugcaa

SEQ ID NO: 1682725 - RNA, 17 nt, Homo sapiens
ugcuauacacacacaca

SEQ ID NO: 1682726 - RNA, 16 nt, Homo sapiens
ugcucacaaaggauac

SEQ ID NO: 1682727 - RNA, 22 nt, Homo sapiens
ugcucacgucaaaugcauacaa

SEQ ID NO: 1682728 - RNA, 15 nt, Homo sapiens
ugcucagagacacug

SEQ ID NO: 1682729 - RNA, 14 nt, Homo sapiens
ugcucccacagggg

SEQ ID NO: 1682730 - RNA, 18 nt, Homo sapiens
ugcuccccuaaagccagg

SEQ ID NO: 1682731 - RNA, 13 nt, Homo sapiens
ugcuccugggcau

SEQ ID NO: 1682732 - RNA, 16 nt, Homo sapiens
ugcuggugccugccac

SEQ ID NO: 1682733 - RNA, 14 nt, Homo sapiens
ugcuguacaaaagc

SEQ ID NO: 1682734 - RNA, 19 nt, Homo sapiens
ugcuguggaaugugcauuc

SEQ ID NO: 1682735 - RNA, 14 nt, Homo sapiens
ugcuuaauugcuga

SEQ ID NO: 1682736 - RNA, 13 nt, Homo sapiens
ugcuuuuggcaga

SEQ ID NO: 1682737 - RNA, 21 nt, Homo sapiens
uggaaaacagcgaacagccuu

SEQ ID NO: 1682738 - RNA, 19 nt, Homo sapiens
uggaaaaugccaugaauua

SEQ ID NO: 1682739 - RNA, 15 nt, Homo sapiens
uggaaagcacaagac

SEQ ID NO: 1682740 - RNA, 13 nt, Homo sapiens
uggaaagucacag

SEQ ID NO: 1682741 - RNA, 15 nt, Homo sapiens
uggaaauagaugugc

SEQ ID NO: 1682742 - RNA, 20 nt, Homo sapiens
uggaaauuugggagagccau

SEQ ID NO: 1682743 - RNA, 20 nt, Homo sapiens
uggaagugugugccaagagc

SEQ ID NO: 1682744 - RNA, 18 nt, Homo sapiens
uggaauucuucacuugcu

SEQ ID NO: 1682745 - RNA, 17 nt, Homo sapiens
uggaauuuggacaagug

SEQ ID NO: 1682746 - RNA, 14 nt, Homo sapiens
uggacucucaggga

SEQ ID NO: 1682747 - RNA, 15 nt, Homo sapiens
uggagaauacugcca

SEQ ID NO: 1682748 - RNA, 16 nt, Homo sapiens
uggagcacaaaauuca

SEQ ID NO: 1682749 - RNA, 19 nt, Homo sapiens
uggaggcuggaugugcauu

SEQ ID NO: 1682750 - RNA, 19 nt, Homo sapiens
uggagggaagaccugaaag

SEQ ID NO: 1682751 - RNA, 13 nt, Homo sapiens
uggaggggaugau

SEQ ID NO: 1682752 - RNA, 22 nt, Homo sapiens
uggauaauuuucauagcugccu

SEQ ID NO: 1682753 - RNA, 18 nt, Homo sapiens
uggaucucacaagcacuu

SEQ ID NO: 1682754 - RNA, 19 nt, Homo sapiens
uggaugucuuuguggugau

SEQ ID NO: 1682755 - RNA, 23 nt, Homo sapiens
uggauugugccuaauguguuuga

SEQ ID NO: 1682756 - RNA, 15 nt, Homo sapiens
uggcagucucagucc

SEQ ID NO: 1682757 - RNA, 17 nt, Homo sapiens
uggcagucucaguccaa

SEQ ID NO: 1682758 - RNA, 21 nt, Homo sapiens
uggccaaugagaucauuguga

SEQ ID NO: 1682759 - RNA, 18 nt, Homo sapiens
uggccaucuucuuucuuc

SEQ ID NO: 1682760 - RNA, 12 nt, Homo sapiens
uggccuugccuc

SEQ ID NO: 1682761 - RNA, 12 nt, Homo sapiens
uggccuuugaau

SEQ ID NO: 1682762 - RNA, 20 nt, Homo sapiens
uggcucacuacugaacacau

SEQ ID NO: 1682763 - RNA, 21 nt, Homo sapiens
uggcucaugccuguaaucuca

SEQ ID NO: 1682764 - RNA, 22 nt, Homo sapiens
ugggccucuccugcccucugcu

SEQ ID NO: 1682765 - RNA, 21 nt, Homo sapiens
ugggcgugugugacacugaug

SEQ ID NO: 1682766 - RNA, 22 nt, Homo sapiens
ugggcugugauuacugcaauca

SEQ ID NO: 1682767 - RNA, 22 nt, Homo sapiens
uggggagaagaaauacagucaa

SEQ ID NO: 1682768 - RNA, 23 nt, Homo sapiens
ugggggcuaagguuuccagucag

SEQ ID NO: 1682769 - RNA, 13 nt, Homo sapiens
agucuucuauuua

SEQ ID NO: 1682770 - RNA, 14 nt, Homo sapiens
agucuucuauuuau

SEQ ID NO: 1682771 - RNA, 18 nt, Homo sapiens
agugaucuguguucaaaa

SEQ ID NO: 1682772 - RNA, 13 nt, Homo sapiens
agugcaacccagu

SEQ ID NO: 1682773 - RNA, 17 nt, Homo sapiens
agugcaacccagucaca

SEQ ID NO: 1682774 - RNA, 14 nt, Homo sapiens
agugcauugaucau

SEQ ID NO: 1682775 - RNA, 15 nt, Homo sapiens
agugcugaugccugu

SEQ ID NO: 1682776 - RNA, 20 nt, Homo sapiens
aguguacauaugugcuggaa

SEQ ID NO: 1682777 - RNA, 23 nt, Homo sapiens
agugucaccccucacugugacug

SEQ ID NO: 1682778 - RNA, 19 nt, Homo sapiens
agugugagauacuguguau

SEQ ID NO: 1682779 - RNA, 16 nt, Homo sapiens
agugugauauacaaag

SEQ ID NO: 1682780 - RNA, 13 nt, Homo sapiens
agugugcugggca

SEQ ID NO: 1682781 - RNA, 24 nt, Homo sapiens
agugugugccaagagcuacuccca

SEQ ID NO: 1682782 - RNA, 20 nt, Homo sapiens
aguguuccccgauaccaugc

SEQ ID NO: 1682783 - RNA, 23 nt, Homo sapiens
aguucagcugccccacaggugug

SEQ ID NO: 1682784 - RNA, 23 nt, Homo sapiens
aguuccaguugaaguuaguggaa

SEQ ID NO: 1682785 - RNA, 19 nt, Homo sapiens
aguugaagcucuucauuca

SEQ ID NO: 1682786 - RNA, 17 nt, Homo sapiens
aguuucacuguacugca

SEQ ID NO: 1682787 - RNA, 18 nt, Homo sapiens
auaaaacucugcauguag

SEQ ID NO: 1682788 - RNA, 14 nt, Homo sapiens
auaaagcauguuca

SEQ ID NO: 1682789 - RNA, 12 nt, Homo sapiens
auaaagcauuua

SEQ ID NO: 1682790 - RNA, 12 nt, Homo sapiens
auaaagugccuc

SEQ ID NO: 1682791 - RNA, 17 nt, Homo sapiens
auaaaucuaauaauuau

SEQ ID NO: 1682792 - RNA, 15 nt, Homo sapiens
auaaaugaguucaac

SEQ ID NO: 1682793 - RNA, 16 nt, Homo sapiens
auaaauguugcaaugc

SEQ ID NO: 1682794 - RNA, 15 nt, Homo sapiens
auaacaucaccacug

SEQ ID NO: 1682795 - RNA, 19 nt, Homo sapiens
auaacgcagucuaauuaca

SEQ ID NO: 1682796 - RNA, 21 nt, Homo sapiens
auaagacuacugaaucugcua

SEQ ID NO: 1682797 - RNA, 14 nt, Homo sapiens
auaauucagcacuu

SEQ ID NO: 1682798 - RNA, 22 nt, Homo sapiens
auaauucagcacuuaacuauga

SEQ ID NO: 1682799 - RNA, 13 nt, Homo sapiens
auacacacacaca

SEQ ID NO: 1682800 - RNA, 22 nt, Homo sapiens
ugcagccuaagaagaaggccag

SEQ ID NO: 1682801 - RNA, 13 nt, Homo sapiens
ugcaggggucccc

SEQ ID NO: 1682802 - RNA, 16 nt, Homo sapiens
ugcaguuggacucuca

SEQ ID NO: 1682803 - RNA, 14 nt, Homo sapiens
ugcauauuugcaaa

SEQ ID NO: 1682804 - RNA, 14 nt, Homo sapiens
ugcaucuuauucga

SEQ ID NO: 1682805 - RNA, 17 nt, Homo sapiens
ugccaaucuguacaaaa

SEQ ID NO: 1682806 - RNA, 17 nt, Homo sapiens
ugccagguccuugcccu

SEQ ID NO: 1682807 - RNA, 17 nt, Homo sapiens
ugcccagacuacagggc

SEQ ID NO: 1682808 - RNA, 20 nt, Homo sapiens
ugcccagccccugguggugg

SEQ ID NO: 1682809 - RNA, 20 nt, Homo sapiens
ugcccaggcuggagugcaau

SEQ ID NO: 1682810 - RNA, 16 nt, Homo sapiens
ugcccaguacauuuaa

SEQ ID NO: 1682811 - RNA, 17 nt, Homo sapiens
ugccccacuacaggccc

SEQ ID NO: 1682812 - RNA, 22 nt, Homo sapiens
ugcccucacugccucuuugcag

SEQ ID NO: 1682813 - RNA, 21 nt, Homo sapiens
ugcccucugaaauaaugggau

SEQ ID NO: 1682814 - RNA, 17 nt, Homo sapiens
ugccuccaggaccuugc

SEQ ID NO: 1682815 - RNA, 18 nt, Homo sapiens
ugccucccaagguccucu

SEQ ID NO: 1682816 - RNA, 17 nt, Homo sapiens
ugccugacucagugacc

SEQ ID NO: 1682817 - RNA, 22 nt, Homo sapiens
ugccuggaucucacaagcacuu

SEQ ID NO: 1682818 - RNA, 13 nt, Homo sapiens
ugccugggcucag

SEQ ID NO: 1682819 - RNA, 22 nt, Homo sapiens
ugccuguaaucucagcacuuug

SEQ ID NO: 1682820 - RNA, 18 nt, Homo sapiens
ugccuguguacugccuua

SEQ ID NO: 1682821 - RNA, 22 nt, Homo sapiens
ugccuucucuguucccuugcag

SEQ ID NO: 1682822 - RNA, 16 nt, Homo sapiens
ugccuugcuucuguau

SEQ ID NO: 1682823 - RNA, 17 nt, Homo sapiens
ugcuaccaaaacaguua

SEQ ID NO: 1682824 - RNA, 23 nt, Homo sapiens
ugcuagugggcccucucucuggg

SEQ ID NO: 1682825 - RNA, 18 nt, Homo sapiens
ugcuaucuuuuuuagugu

SEQ ID NO: 1682826 - RNA, 23 nt, Homo sapiens
ugcuauuuuuaauuuccugugag

SEQ ID NO: 1682827 - RNA, 21 nt, Homo sapiens
ugcucacaaaggauacuuuua

SEQ ID NO: 1682828 - RNA, 16 nt, Homo sapiens
ugcucaccgcccugcu

SEQ ID NO: 1682829 - RNA, 21 nt, Homo sapiens
ugcucaguuuuucuguguuuc

SEQ ID NO: 1682830 - RNA, 13 nt, Homo sapiens
ugcucaugcugcu

SEQ ID NO: 1682831 - RNA, 17 nt, Homo sapiens
ugcucccaacccauuca

SEQ ID NO: 1682832 - RNA, 15 nt, Homo sapiens
ugcucuauacugugg

SEQ ID NO: 1682833 - RNA, 16 nt, Homo sapiens
ugcugcccucacugcc

SEQ ID NO: 1682834 - RNA, 19 nt, Homo sapiens
ugcuggaauuacaggcgug

SEQ ID NO: 1682835 - RNA, 18 nt, Homo sapiens
ugcugggccccaucucca

SEQ ID NO: 1682836 - RNA, 17 nt, Homo sapiens
ugcuggugaacacugug

SEQ ID NO: 1682837 - RNA, 19 nt, Homo sapiens
ugcuguugggauauaguca

SEQ ID NO: 1682838 - RNA, 21 nt, Homo sapiens
ugcuuuuggcagagaccauaa

SEQ ID NO: 1682839 - RNA, 16 nt, Homo sapiens
uggaaaguaacuguga

SEQ ID NO: 1682840 - RNA, 21 nt, Homo sapiens
uggaagugugugccaagagcu

SEQ ID NO: 1682841 - RNA, 18 nt, Homo sapiens
uggacaguuuuaagcaga

SEQ ID NO: 1682842 - RNA, 21 nt, Homo sapiens
uggaccugcccugggccacac

SEQ ID NO: 1682843 - RNA, 16 nt, Homo sapiens
uggaccugggcaugac

SEQ ID NO: 1682844 - RNA, 23 nt, Homo sapiens
uggacuaaaugaucucugaaagu

SEQ ID NO: 1682845 - RNA, 18 nt, Homo sapiens
uggagaaguaguauuugc

SEQ ID NO: 1682846 - RNA, 20 nt, Homo sapiens
uggagaauacugccaaaaca

SEQ ID NO: 1682847 - RNA, 22 nt, Homo sapiens
uggagcaggcccaaugcugcuu

SEQ ID NO: 1682848 - RNA, 21 nt, Homo sapiens
uggaucgaguguagcugugaa

SEQ ID NO: 1682849 - RNA, 18 nt, Homo sapiens
uggauuuuucuuuaacug

SEQ ID NO: 1682850 - RNA, 20 nt, Homo sapiens
uggcaaaugccugacucagu

SEQ ID NO: 1682851 - RNA, 17 nt, Homo sapiens
uggcagcuagugccuuu

SEQ ID NO: 1682852 - RNA, 20 nt, Homo sapiens
uggccuauuuaucugaucaa

SEQ ID NO: 1682853 - RNA, 23 nt, Homo sapiens
uggcgccaucgccgggacuccag

SEQ ID NO: 1682854 - RNA, 14 nt, Homo sapiens
uggcucacuacuga

SEQ ID NO: 1682855 - RNA, 22 nt, Homo sapiens
uggcucaugccuguaaucucag

SEQ ID NO: 1682856 - RNA, 22 nt, Homo sapiens
uggcugggaagacuauggugcu

SEQ ID NO: 1682857 - RNA, 18 nt, Homo sapiens
uggcuucaaaaagccaca

SEQ ID NO: 1682858 - RNA, 20 nt, Homo sapiens
ugggaaacaaauaauuugaa

SEQ ID NO: 1682859 - RNA, 18 nt, Homo sapiens
ugggaagacuauggugcu

SEQ ID NO: 1682860 - RNA, 22 nt, Homo sapiens
ugggacacuccgucugcuccaa

SEQ ID NO: 1682861 - RNA, 13 nt, Homo sapiens
ugggacccacaga

SEQ ID NO: 1682862 - RNA, 14 nt, Homo sapiens
ugauauacaaagug

SEQ ID NO: 1682863 - RNA, 17 nt, Homo sapiens
ugaugccuguguacugc

SEQ ID NO: 1682864 - RNA, 20 nt, Homo sapiens
ugaugucagcugcuguugaa

SEQ ID NO: 1682865 - RNA, 21 nt, Homo sapiens
ugauucagccaaaugcaggga

SEQ ID NO: 1682866 - RNA, 20 nt, Homo sapiens
ugauugggaaaacauuugcu

SEQ ID NO: 1682867 - RNA, 16 nt, Homo sapiens
ugcaaaacuccaggca

SEQ ID NO: 1682868 - RNA, 21 nt, Homo sapiens
ugcaaaagaagugaaacuaua

SEQ ID NO: 1682869 - RNA, 13 nt, Homo sapiens
ugcaacagacugu

SEQ ID NO: 1682870 - RNA, 14 nt, Homo sapiens
ugcaagccaucucu

SEQ ID NO: 1682871 - RNA, 15 nt, Homo sapiens
ugcaagccaucucua

SEQ ID NO: 1682872 - RNA, 21 nt, Homo sapiens
ugcacauuucuuugcauucca

SEQ ID NO: 1682873 - RNA, 13 nt, Homo sapiens
ugcacuuacauaa

SEQ ID NO: 1682874 - RNA, 16 nt, Homo sapiens
ugcagaagaaaucaua

SEQ ID NO: 1682875 - RNA, 12 nt, Homo sapiens
ugcagccuaaga

SEQ ID NO: 1682876 - RNA, 23 nt, Homo sapiens
ugcagccuaagaagaaggccaga

SEQ ID NO: 1682877 - RNA, 20 nt, Homo sapiens
ugcagcggcuccugcaaaag

SEQ ID NO: 1682878 - RNA, 18 nt, Homo sapiens
ugcaguuggacucucagg

SEQ ID NO: 1682879 - RNA, 18 nt, Homo sapiens
ugcaucaucucuuccuca

SEQ ID NO: 1682880 - RNA, 16 nt, Homo sapiens
ugcaugauacuaucug

SEQ ID NO: 1682881 - RNA, 14 nt, Homo sapiens
ugcauuuuuauuaa

SEQ ID NO: 1682882 - RNA, 18 nt, Homo sapiens
ugccaaaggaugugauau

SEQ ID NO: 1682883 - RNA, 21 nt, Homo sapiens
ugccaguuacuugggcuucaa

SEQ ID NO: 1682884 - RNA, 15 nt, Homo sapiens
ugcccagacuacagg

SEQ ID NO: 1682885 - RNA, 21 nt, Homo sapiens
ugcccaggcuggagugcaaug

SEQ ID NO: 1682886 - RNA, 15 nt, Homo sapiens
ugcccucugcucugc

SEQ ID NO: 1682887 - RNA, 22 nt, Homo sapiens
ugcccuuuguggaaagucacag

SEQ ID NO: 1682888 - RNA, 20 nt, Homo sapiens
ugccggccgggugugguggc

SEQ ID NO: 1682889 - RNA, 13 nt, Homo sapiens
ugccuaaccuggg

SEQ ID NO: 1682890 - RNA, 16 nt, Homo sapiens
ugccuaaccugggacc

SEQ ID NO: 1682891 - RNA, 20 nt, Homo sapiens
ugccucaggccaagggacca

SEQ ID NO: 1682892 - RNA, 18 nt, Homo sapiens
ugccuccaggaccuugcu

SEQ ID NO: 1682893 - RNA, 22 nt, Homo sapiens
ugccucccaagguccucucagu

SEQ ID NO: 1682894 - RNA, 17 nt, Homo sapiens
ugccucuugcagggucu

SEQ ID NO: 1682895 - RNA, 15 nt, Homo sapiens
ugccugccaccuuca

SEQ ID NO: 1682896 - RNA, 22 nt, Homo sapiens
ugcggcaaaaggaaagcugugu

SEQ ID NO: 1682897 - RNA, 13 nt, Homo sapiens
ugcgugggggcca

SEQ ID NO: 1682898 - RNA, 16 nt, Homo sapiens
ugcuaaagaauccaua

SEQ ID NO: 1682899 - RNA, 16 nt, Homo sapiens
ugcuaacaagucacca

SEQ ID NO: 1682900 - RNA, 18 nt, Homo sapiens
ugcuaagugcuuauuaca

SEQ ID NO: 1682901 - RNA, 16 nt, Homo sapiens
ugcuaaugacagccuu

SEQ ID NO: 1682902 - RNA, 20 nt, Homo sapiens
ugcuauucuaacuaaugaca

SEQ ID NO: 1682903 - RNA, 18 nt, Homo sapiens
ugcucaaucccugaggac

SEQ ID NO: 1682904 - RNA, 22 nt, Homo sapiens
ugcugacaaccauuaaagucag

SEQ ID NO: 1682905 - RNA, 17 nt, Homo sapiens
ugcugcaaauacuguau

SEQ ID NO: 1682906 - RNA, 15 nt, Homo sapiens
ugcugccagcucuca

SEQ ID NO: 1682907 - RNA, 20 nt, Homo sapiens
ugcugcuccccuaaagccag

SEQ ID NO: 1682908 - RNA, 21 nt, Homo sapiens
ugcugcuccccuaaagccagg

SEQ ID NO: 1682909 - RNA, 17 nt, Homo sapiens
ugcuggccggagcaaac

SEQ ID NO: 1682910 - RNA, 19 nt, Homo sapiens
ugcugggccccaucuccac

SEQ ID NO: 1682911 - RNA, 14 nt, Homo sapiens
ugcuguugggauau

SEQ ID NO: 1682912 - RNA, 22 nt, Homo sapiens
ugcuuccuucucaucuugccuc

SEQ ID NO: 1682913 - RNA, 13 nt, Homo sapiens
ugcuuggcacuua

SEQ ID NO: 1682914 - RNA, 21 nt, Homo sapiens
uggaaagacaaacugcacagg

SEQ ID NO: 1682915 - RNA, 17 nt, Homo sapiens
uggaaauaaacugugca

SEQ ID NO: 1682916 - RNA, 21 nt, Homo sapiens
uggaaauuccuguacuguguc

SEQ ID NO: 1682917 - RNA, 21 nt, Homo sapiens
uccaccucaucacuggacugc

SEQ ID NO: 1682918 - RNA, 19 nt, Homo sapiens
uccagacucagcagaguga

SEQ ID NO: 1682919 - RNA, 14 nt, Homo sapiens
uccagcaaccuaua

SEQ ID NO: 1682920 - RNA, 19 nt, Homo sapiens
uccagccacuggcugcuaa

SEQ ID NO: 1682921 - RNA, 19 nt, Homo sapiens
uccagucagaugaggcaaa

SEQ ID NO: 1682922 - RNA, 13 nt, Homo sapiens
uccagugugagau

SEQ ID NO: 1682923 - RNA, 23 nt, Homo sapiens
uccauaucccuuccucucaggcu

SEQ ID NO: 1682924 - RNA, 16 nt, Homo sapiens
uccauccuuccaacau

SEQ ID NO: 1682925 - RNA, 17 nt, Homo sapiens
uccaucuuuccauccau

SEQ ID NO: 1682926 - RNA, 18 nt, Homo sapiens
uccauuuauuaagcagua

SEQ ID NO: 1682927 - RNA, 13 nt, Homo sapiens
ucccaacccauuc

SEQ ID NO: 1682928 - RNA, 22 nt, Homo sapiens
ucccaacccauucacuacaggu

SEQ ID NO: 1682929 - RNA, 23 nt, Homo sapiens
ucccaacuccucaugucuucuca

SEQ ID NO: 1682930 - RNA, 19 nt, Homo sapiens
ucccaaggccccacuuuca

SEQ ID NO: 1682931 - RNA, 20 nt, Homo sapiens
ucccacugcucccccaacac

SEQ ID NO: 1682932 - RNA, 15 nt, Homo sapiens
ucccagaaccuugau

SEQ ID NO: 1682933 - RNA, 22 nt, Homo sapiens
ucccagcucuagccucuggacu

SEQ ID NO: 1682934 - RNA, 12 nt, Homo sapiens
ucccagucccau

SEQ ID NO: 1682935 - RNA, 13 nt, Homo sapiens
ucccagucuguga

SEQ ID NO: 1682936 - RNA, 15 nt, Homo sapiens
ucccaucccacugcu

SEQ ID NO: 1682937 - RNA, 21 nt, Homo sapiens
uccccucacacacaaauugac

SEQ ID NO: 1682938 - RNA, 13 nt, Homo sapiens
ucccuacauguau

SEQ ID NO: 1682939 - RNA, 14 nt, Homo sapiens
ucccuccggccaua

SEQ ID NO: 1682940 - RNA, 13 nt, Homo sapiens
ucccugggggccu

SEQ ID NO: 1682941 - RNA, 14 nt, Homo sapiens
ucccuguugguucu

SEQ ID NO: 1682942 - RNA, 13 nt, Homo sapiens
ucccuuggacauu

SEQ ID NO: 1682943 - RNA, 20 nt, Homo sapiens
ucccuuucuaagcaaccaca

SEQ ID NO: 1682944 - RNA, 19 nt, Homo sapiens
uccguauugaacauguaca

SEQ ID NO: 1682945 - RNA, 18 nt, Homo sapiens
uccuaaugucagaacaga

SEQ ID NO: 1682946 - RNA, 14 nt, Homo sapiens
uccuaccagcaaag

SEQ ID NO: 1682947 - RNA, 16 nt, Homo sapiens
uccucacacccauuua

SEQ ID NO: 1682948 - RNA, 19 nt, Homo sapiens
uccucaguucucaaaugug

SEQ ID NO: 1682949 - RNA, 12 nt, Homo sapiens
uccuccugaugg

SEQ ID NO: 1682950 - RNA, 17 nt, Homo sapiens
uccugaagagcauuugg

SEQ ID NO: 1682951 - RNA, 20 nt, Homo sapiens
uccugaguagcugggauuac

SEQ ID NO: 1682952 - RNA, 17 nt, Homo sapiens
uccugcauguucuguga

SEQ ID NO: 1682953 - RNA, 15 nt, Homo sapiens
uccuguggucucuga

SEQ ID NO: 1682954 - RNA, 18 nt, Homo sapiens
uccuguggucucugacca

SEQ ID NO: 1682955 - RNA, 21 nt, Homo sapiens
uccuuauuuugugugcuuucc

SEQ ID NO: 1682956 - RNA, 22 nt, Homo sapiens
uccuucaggcagcugaaauuca

SEQ ID NO: 1682957 - RNA, 17 nt, Homo sapiens
uccuucuccuguuccau

SEQ ID NO: 1682958 - RNA, 20 nt, Homo sapiens
uccuucuuucuaguucagcu

SEQ ID NO: 1682959 - RNA, 20 nt, Homo sapiens
ucgaaccuugaccgacauga

SEQ ID NO: 1682960 - RNA, 17 nt, Homo sapiens
ucgccagucacugcugc

SEQ ID NO: 1682961 - RNA, 23 nt, Homo sapiens
ucggccaguuuucggaaacacug

SEQ ID NO: 1682962 - RNA, 21 nt, Homo sapiens
ucggcuacugguuaccuggag

SEQ ID NO: 1682963 - RNA, 13 nt, Homo sapiens
ucuaaaagcuuuc

SEQ ID NO: 1682964 - RNA, 16 nt, Homo sapiens
ucuaaagagcaucuga

SEQ ID NO: 1682965 - RNA, 16 nt, Homo sapiens
ucuaaauaugaaugaa

SEQ ID NO: 1682966 - RNA, 12 nt, Homo sapiens
ucuaagcugugu

SEQ ID NO: 1682967 - RNA, 13 nt, Homo sapiens
ucuaagugauaua

SEQ ID NO: 1682968 - RNA, 13 nt, Homo sapiens
ucuaagugcugcu

SEQ ID NO: 1682969 - RNA, 16 nt, Homo sapiens
ucuaauaauaagucag

SEQ ID NO: 1682970 - RNA, 12 nt, Homo sapiens
ucuacaacugau

SEQ ID NO: 1682971 - RNA, 16 nt, Homo sapiens
ucuaccccugcuccca

SEQ ID NO: 1682972 - RNA, 19 nt, Homo sapiens
ucuagaacuuaaguuugau

SEQ ID NO: 1682973 - RNA, 14 nt, Homo sapiens
uacauguauugcac

SEQ ID NO: 1682974 - RNA, 12 nt, Homo sapiens
uaccaaagccca

SEQ ID NO: 1682975 - RNA, 13 nt, Homo sapiens
uaccccagucacu

SEQ ID NO: 1682976 - RNA, 12 nt, Homo sapiens
uaccuacuggug

SEQ ID NO: 1682977 - RNA, 14 nt, Homo sapiens
uaccuccauccauc

SEQ ID NO: 1682978 - RNA, 21 nt, Homo sapiens
uacgaauugaaaauuaaggaa

SEQ ID NO: 1682979 - RNA, 15 nt, Homo sapiens
uacgaugacaguguu

SEQ ID NO: 1682980 - RNA, 19 nt, Homo sapiens
uacuaaaaaguauaaaaua

SEQ ID NO: 1682981 - RNA, 15 nt, Homo sapiens
uacuaaagacgguau

SEQ ID NO: 1682982 - RNA, 14 nt, Homo sapiens
uacuacacagaauu

SEQ ID NO: 1682983 - RNA, 17 nt, Homo sapiens
uacuagauugugauccc

SEQ ID NO: 1682984 - RNA, 20 nt, Homo sapiens
uacuagcuuuauaaauuaca

SEQ ID NO: 1682985 - RNA, 19 nt, Homo sapiens
uacuauggagugcucacaa

SEQ ID NO: 1682986 - RNA, 14 nt, Homo sapiens
uacuauguacugcc

SEQ ID NO: 1682987 - RNA, 17 nt, Homo sapiens
uacuauguacugccuua

SEQ ID NO: 1682988 - RNA, 17 nt, Homo sapiens
uacucccauuaaauuca

SEQ ID NO: 1682989 - RNA, 20 nt, Homo sapiens
uacucuaggcagugacagug

SEQ ID NO: 1682990 - RNA, 18 nt, Homo sapiens
uacugaacacauguguau

SEQ ID NO: 1682991 - RNA, 13 nt, Homo sapiens
uacugaguuugau

SEQ ID NO: 1682992 - RNA, 11 nt, Homo sapiens
uacugccuuaa

SEQ ID NO: 1682993 - RNA, 21 nt, Homo sapiens
uacuguaggcacacuuugcac

SEQ ID NO: 1682994 - RNA, 16 nt, Homo sapiens
uacuucauggugauag

SEQ ID NO: 1682995 - RNA, 13 nt, Homo sapiens
uacuugggucaca

SEQ ID NO: 1682996 - RNA, 14 nt, Homo sapiens
uacuuugacagugu

SEQ ID NO: 1682997 - RNA, 19 nt, Homo sapiens
uagacucaaagaaguacug

SEQ ID NO: 1682998 - RNA, 18 nt, Homo sapiens
uagagggcgagggaugau

SEQ ID NO: 1682999 - RNA, 14 nt, Homo sapiens
uagaugaaugucag

SEQ ID NO: 1683000 - RNA, 19 nt, Homo sapiens
uagauguguuauuacuucc

SEQ ID NO: 1683001 - RNA, 22 nt, Homo sapiens
uagauucccaucauacacuucc

SEQ ID NO: 1683002 - RNA, 17 nt, Homo sapiens
uagcaucuuccuugaua

SEQ ID NO: 1683003 - RNA, 18 nt, Homo sapiens
uagccagcugugcacuuu

SEQ ID NO: 1683004 - RNA, 19 nt, Homo sapiens
uagccagcugugcacuuuc

SEQ ID NO: 1683005 - RNA, 19 nt, Homo sapiens
uagcccaaccuacauucca

SEQ ID NO: 1683006 - RNA, 16 nt, Homo sapiens
uagcccucaccacagc

SEQ ID NO: 1683007 - RNA, 16 nt, Homo sapiens
uagccuaugucuggca

SEQ ID NO: 1683008 - RNA, 19 nt, Homo sapiens
uaggaccauuucucugcag

SEQ ID NO: 1683009 - RNA, 23 nt, Homo sapiens
uaggaccauuucucugcaggcca

SEQ ID NO: 1683010 - RNA, 12 nt, Homo sapiens
uaggaucuccac

SEQ ID NO: 1683011 - RNA, 23 nt, Homo sapiens
uaggccacagaaggugaacuuug

SEQ ID NO: 1683012 - RNA, 14 nt, Homo sapiens
uaggcuacuguaau

SEQ ID NO: 1683013 - RNA, 21 nt, Homo sapiens
uaggcucuuaugugugccuuu

SEQ ID NO: 1683014 - RNA, 19 nt, Homo sapiens
uagggcucuccaagcacua

SEQ ID NO: 1683015 - RNA, 14 nt, Homo sapiens
uagggggaagacag

SEQ ID NO: 1683016 - RNA, 23 nt, Homo sapiens
uagguuuuuuuccuucugaagug

SEQ ID NO: 1683017 - RNA, 22 nt, Homo sapiens
uaguaauuuuaaaagucucaca

SEQ ID NO: 1683018 - RNA, 13 nt, Homo sapiens
uagugacauuuaa

SEQ ID NO: 1683019 - RNA, 19 nt, Homo sapiens
uagugcaacaucucugaau

SEQ ID NO: 1683020 - RNA, 23 nt, Homo sapiens
uagugcugaugccuguguacugc

SEQ ID NO: 1683021 - RNA, 21 nt, Homo sapiens
uagugugaaauauauuacuua

SEQ ID NO: 1683022 - RNA, 14 nt, Homo sapiens
uaguucagcugccc

SEQ ID NO: 1683023 - RNA, 23 nt, Homo sapiens
uauaaaauaguaugaaaauggaa

SEQ ID NO: 1683024 - RNA, 23 nt, Homo sapiens
uauaaacuauaaccucuccuuca

SEQ ID NO: 1683025 - RNA, 17 nt, Homo sapiens
uauaaauguaccagaga

SEQ ID NO: 1683026 - RNA, 11 nt, Homo sapiens
uauaacagugu

SEQ ID NO: 1683027 - RNA, 13 nt, Homo sapiens
uauaacaguguuu

SEQ ID NO: 1683028 - RNA, 11 nt, Homo sapiens
uauagugcaau

SEQ ID NO: 1683029 - RNA, 18 nt, Homo sapiens
uauauuguaaagauccua

SEQ ID NO: 1683030 - RNA, 16 nt, Homo sapiens
guauaaauuuacuuuu

SEQ ID NO: 1683031 - RNA, 22 nt, Homo sapiens
guauacuuuaguagacauuuau

SEQ ID NO: 1683032 - RNA, 14 nt, Homo sapiens
guauaugacugcau

SEQ ID NO: 1683033 - RNA, 21 nt, Homo sapiens
guauuaaaaaacaauuaacug

SEQ ID NO: 1683034 - RNA, 14 nt, Homo sapiens
guauuauacaugug

SEQ ID NO: 1683035 - RNA, 21 nt, Homo sapiens
guauuuucaugaaaauaccau

SEQ ID NO: 1683036 - RNA, 22 nt, Homo sapiens
gucacugaacaccuauugcacu

SEQ ID NO: 1683037 - RNA, 23 nt, Homo sapiens
gucagaucuauuguuuguugcac

SEQ ID NO: 1683038 - RNA, 15 nt, Homo sapiens
gucagaugaggcaaa

SEQ ID NO: 1683039 - RNA, 14 nt, Homo sapiens
gucaguacuauuca

SEQ ID NO: 1683040 - RNA, 22 nt, Homo sapiens
gucaguguugccucuugcaaug

SEQ ID NO: 1683041 - RNA, 14 nt, Homo sapiens
gucaucacuuugac

SEQ ID NO: 1683042 - RNA, 23 nt, Homo sapiens
gucauuauucucugaacaauaca

SEQ ID NO: 1683043 - RNA, 12 nt, Homo sapiens
guccacucccag

SEQ ID NO: 1683044 - RNA, 15 nt, Homo sapiens
gucccagacaauucc

SEQ ID NO: 1683045 - RNA, 14 nt, Homo sapiens
gucccauuccucag

SEQ ID NO: 1683046 - RNA, 19 nt, Homo sapiens
gucucuacuaaaaguacaa

SEQ ID NO: 1683047 - RNA, 19 nt, Homo sapiens
gucucuuggcuuugucacu

SEQ ID NO: 1683048 - RNA, 16 nt, Homo sapiens
gucugugaagucaaga

SEQ ID NO: 1683049 - RNA, 21 nt, Homo sapiens
gucuuaaacuaaaugugcaau

SEQ ID NO: 1683050 - RNA, 12 nt, Homo sapiens
gucuucaucugu

SEQ ID NO: 1683051 - RNA, 22 nt, Homo sapiens
gucuucaucuguccgacaaguu

SEQ ID NO: 1683052 - RNA, 16 nt, Homo sapiens
gucuucucacaagcca

SEQ ID NO: 1683053 - RNA, 18 nt, Homo sapiens
gucuucuuucuccaugga

SEQ ID NO: 1683054 - RNA, 17 nt, Homo sapiens
gucuugggggucagggg

SEQ ID NO: 1683055 - RNA, 23 nt, Homo sapiens
gugaacacugugaccaggcuuuu

SEQ ID NO: 1683056 - RNA, 12 nt, Homo sapiens
gugaauuugcca

SEQ ID NO: 1683057 - RNA, 21 nt, Homo sapiens
gugacauuugggagacaugug

SEQ ID NO: 1683058 - RNA, 19 nt, Homo sapiens
gugacucagcaucacccac

SEQ ID NO: 1683059 - RNA, 14 nt, Homo sapiens
gugacuccagggug

SEQ ID NO: 1683060 - RNA, 18 nt, Homo sapiens
gugagccaagauugcacc

SEQ ID NO: 1683061 - RNA, 18 nt, Homo sapiens
gugaggacugguugucuc

SEQ ID NO: 1683062 - RNA, 22 nt, Homo sapiens
gugauauuguguggucugguuc

SEQ ID NO: 1683063 - RNA, 23 nt, Homo sapiens
gugcacauuucuuugcauuccag

SEQ ID NO: 1683064 - RNA, 21 nt, Homo sapiens
gugcuaauuuguuuuggauau

SEQ ID NO: 1683065 - RNA, 19 nt, Homo sapiens
gugcuggugaacacuguga

SEQ ID NO: 1683066 - RNA, 17 nt, Homo sapiens
gugcuucgacuacugcu

SEQ ID NO: 1683067 - RNA, 22 nt, Homo sapiens
gugcuuucccagucccauuccu

SEQ ID NO: 1683068 - RNA, 16 nt, Homo sapiens
guggcaggaggcuuug

SEQ ID NO: 1683069 - RNA, 23 nt, Homo sapiens
gugggauggggacauuugaacau

SEQ ID NO: 1683070 - RNA, 15 nt, Homo sapiens
gugggccacagccau

SEQ ID NO: 1683071 - RNA, 19 nt, Homo sapiens
guguaggaaaaaugcaagc

SEQ ID NO: 1683072 - RNA, 18 nt, Homo sapiens
guguugccucuugcaaug

SEQ ID NO: 1683073 - RNA, 17 nt, Homo sapiens
guguuuccacagccugc

SEQ ID NO: 1683074 - RNA, 19 nt, Homo sapiens
guuagagcuggcaccagaa

SEQ ID NO: 1683075 - RNA, 15 nt, Homo sapiens
guuagugacauuuaa

SEQ ID NO: 1683076 - RNA, 16 nt, Homo sapiens
guuauacaucaauaug

SEQ ID NO: 1683077 - RNA, 22 nt, Homo sapiens
guuaucaguaaugcuaaaugug

SEQ ID NO: 1683078 - RNA, 17 nt, Homo sapiens
guuauuuaugcacugug

SEQ ID NO: 1683079 - RNA, 19 nt, Homo sapiens
guuauuuauuccccaguga

SEQ ID NO: 1683080 - RNA, 13 nt, Homo sapiens
guucaacaucuaa

SEQ ID NO: 1683081 - RNA, 18 nt, Homo sapiens
guuccccgauaccaugcu

SEQ ID NO: 1683082 - RNA, 14 nt, Homo sapiens
guuccuccuacuua

SEQ ID NO: 1683083 - RNA, 21 nt, Homo sapiens
guuccugugugacccugggca

SEQ ID NO: 1683084 - RNA, 14 nt, Homo sapiens
guucuaacagugaa

SEQ ID NO: 1683085 - RNA, 16 nt, Homo sapiens
guucuguagagccaau

SEQ ID NO: 1683086 - RNA, 12 nt, Homo sapiens
guuggugugaau

SEQ ID NO: 1683087 - RNA, 11 nt, Homo sapiens
agacuacaggg

SEQ ID NO: 1683088 - RNA, 17 nt, Homo sapiens
agacuuugauccaugua

SEQ ID NO: 1683089 - RNA, 16 nt, Homo sapiens
agagaaguacagguca

SEQ ID NO: 1683090 - RNA, 13 nt, Homo sapiens
agagacagaauuc

SEQ ID NO: 1683091 - RNA, 23 nt, Homo sapiens
agagaccauaagagaaaccugcc

SEQ ID NO: 1683092 - RNA, 21 nt, Homo sapiens
agagacgggguuucuccaugu

SEQ ID NO: 1683093 - RNA, 17 nt, Homo sapiens
agagaugggacuaggac

SEQ ID NO: 1683094 - RNA, 16 nt, Homo sapiens
agagauugauggguua

SEQ ID NO: 1683095 - RNA, 18 nt, Homo sapiens
agagcaagacugucucaa

SEQ ID NO: 1683096 - RNA, 20 nt, Homo sapiens
agagccaauuagacuugaaa

SEQ ID NO: 1683097 - RNA, 21 nt, Homo sapiens
agagcgggguccccucugugc

SEQ ID NO: 1683098 - RNA, 15 nt, Homo sapiens
agagcuaggaacccu

SEQ ID NO: 1683099 - RNA, 20 nt, Homo sapiens
agaggaaccaauaccuucaa

SEQ ID NO: 1683100 - RNA, 15 nt, Homo sapiens
agagucuccaguuua

SEQ ID NO: 1683101 - RNA, 15 nt, Homo sapiens
agagucuucaucugu

SEQ ID NO: 1683102 - RNA, 15 nt, Homo sapiens
agaguuaaaucucaa

SEQ ID NO: 1683103 - RNA, 20 nt, Homo sapiens
agauaaaaugauguuauaca

SEQ ID NO: 1683104 - RNA, 17 nt, Homo sapiens
agauaaacaaacaagcc

SEQ ID NO: 1683105 - RNA, 20 nt, Homo sapiens
agauaaagaauaauaauuaa

SEQ ID NO: 1683106 - RNA, 15 nt, Homo sapiens
agauagagugaaaua

SEQ ID NO: 1683107 - RNA, 21 nt, Homo sapiens
agauagggggaagacagauau

SEQ ID NO: 1683108 - RNA, 17 nt, Homo sapiens
agauauugauuacuauc

SEQ ID NO: 1683109 - RNA, 22 nt, Homo sapiens
agauauuguugaaauaauugaa

SEQ ID NO: 1683110 - RNA, 13 nt, Homo sapiens
agaugaaugucag

SEQ ID NO: 1683111 - RNA, 12 nt, Homo sapiens
agaugggggccu

SEQ ID NO: 1683112 - RNA, 21 nt, Homo sapiens
agaugggggccucucuggaag

SEQ ID NO: 1683113 - RNA, 13 nt, Homo sapiens
agauguacugcaa

SEQ ID NO: 1683114 - RNA, 14 nt, Homo sapiens
agauguacugcaaa

SEQ ID NO: 1683115 - RNA, 20 nt, Homo sapiens
agauuauuaaaagaugucuc

SEQ ID NO: 1683116 - RNA, 16 nt, Homo sapiens
agcaaaaagacuggau

SEQ ID NO: 1683117 - RNA, 22 nt, Homo sapiens
agcaaguccuuaggcuacugua

SEQ ID NO: 1683118 - RNA, 16 nt, Homo sapiens
agcaagugugcacucc

SEQ ID NO: 1683119 - RNA, 14 nt, Homo sapiens
agcacaaagcacug

SEQ ID NO: 1683120 - RNA, 21 nt, Homo sapiens
agcagaaauauagugcaauag

SEQ ID NO: 1683121 - RNA, 15 nt, Homo sapiens
agcauagaaaccacu

SEQ ID NO: 1683122 - RNA, 14 nt, Homo sapiens
agcaugaggcaaaa

SEQ ID NO: 1683123 - RNA, 13 nt, Homo sapiens
agccaaugcuguc

SEQ ID NO: 1683124 - RNA, 16 nt, Homo sapiens
agccagccaagcuuua

SEQ ID NO: 1683125 - RNA, 18 nt, Homo sapiens
agccagcugugcacuuuc

SEQ ID NO: 1683126 - RNA, 19 nt, Homo sapiens
agccagugucuaggcacug

SEQ ID NO: 1683127 - RNA, 13 nt, Homo sapiens
agcccacaccuaa

SEQ ID NO: 1683128 - RNA, 20 nt, Homo sapiens
agccccaggguuuacaugaa

SEQ ID NO: 1683129 - RNA, 14 nt, Homo sapiens
agcccugucugcua

SEQ ID NO: 1683130 - RNA, 18 nt, Homo sapiens
agccuaccucugucugag

SEQ ID NO: 1683131 - RNA, 18 nt, Homo sapiens
agccucuccgacucugca

SEQ ID NO: 1683132 - RNA, 16 nt, Homo sapiens
agccugccucccaagg

SEQ ID NO: 1683133 - RNA, 21 nt, Homo sapiens
agccuggauccucaguucuca

SEQ ID NO: 1683134 - RNA, 17 nt, Homo sapiens
agccugguuucugggug

SEQ ID NO: 1683135 - RNA, 21 nt, Homo sapiens
agccuuacuucaaagugccug

SEQ ID NO: 1683136 - RNA, 21 nt, Homo sapiens
agcgacguuuauuucaucucu

SEQ ID NO: 1683137 - RNA, 22 nt, Homo sapiens
agcgacguuuauuucaucucuu

SEQ ID NO: 1683138 - RNA, 20 nt, Homo sapiens
agcguucuaaauaugaauga

SEQ ID NO: 1683139 - RNA, 15 nt, Homo sapiens
agcucuggguugugc

SEQ ID NO: 1683140 - RNA, 23 nt, Homo sapiens
agcugaaauuuuagaaauauuca

SEQ ID NO: 1683141 - RNA, 18 nt, Homo sapiens
agcugccccacaggugug

SEQ ID NO: 1683142 - RNA, 16 nt, Homo sapiens
agcugccguagcuuca

SEQ ID NO: 1683143 - RNA, 16 nt, Homo sapiens
agcugucccacaucac

SEQ ID NO: 1683144 - RNA, 19 nt, Homo sapiens
agcuuaaugcuacauguga

SEQ ID NO: 1683145 - RNA, 20 nt, Homo sapiens
acacgaugcauuuaauaaag

SEQ ID NO: 1683146 - RNA, 23 nt, Homo sapiens
acacucaccugcacuaacagagu

SEQ ID NO: 1683147 - RNA, 21 nt, Homo sapiens
acacugaaaaaucuaagugau

SEQ ID NO: 1683148 - RNA, 15 nt, Homo sapiens
acacuucccaacuua

SEQ ID NO: 1683149 - RNA, 24 nt, Homo sapiens
acacuugcucccaacccauucacu

SEQ ID NO: 1683150 - RNA, 15 nt, Homo sapiens
acacuuuugcuugaa

SEQ ID NO: 1683151 - RNA, 21 nt, Homo sapiens
acagaaagccugggugacauu

SEQ ID NO: 1683152 - RNA, 18 nt, Homo sapiens
acagaacauauguugcaa

SEQ ID NO: 1683153 - RNA, 20 nt, Homo sapiens
acagaacuuguggccuuuau

SEQ ID NO: 1683154 - RNA, 22 nt, Homo sapiens
acagaagcuuuagcaagugugc

SEQ ID NO: 1683155 - RNA, 19 nt, Homo sapiens
acagaaggugaacuuugug

SEQ ID NO: 1683156 - RNA, 15 nt, Homo sapiens
acagaauuguuccag

SEQ ID NO: 1683157 - RNA, 18 nt, Homo sapiens
acagagcaagacugucuc

SEQ ID NO: 1683158 - RNA, 16 nt, Homo sapiens
acagauugucuuauua

SEQ ID NO: 1683159 - RNA, 17 nt, Homo sapiens
acagccuugcaacccaa

SEQ ID NO: 1683160 - RNA, 15 nt, Homo sapiens
acaggagacaaaaga

SEQ ID NO: 1683161 - RNA, 15 nt, Homo sapiens
acaggcgugagccac

SEQ ID NO: 1683162 - RNA, 19 nt, Homo sapiens
acaggggccauguccucuc

SEQ ID NO: 1683163 - RNA, 20 nt, Homo sapiens
acaggugcaacagacuugaa

SEQ ID NO: 1683164 - RNA, 15 nt, Homo sapiens
acagguucugagaua

SEQ ID NO: 1683165 - RNA, 20 nt, Homo sapiens
acagugaaguuuuacugucu

SEQ ID NO: 1683166 - RNA, 14 nt, Homo sapiens
acagugcccagggc

SEQ ID NO: 1683167 - RNA, 15 nt, Homo sapiens
acaguguuucuggcu

SEQ ID NO: 1683168 - RNA, 17 nt, Homo sapiens
acaguuuuaacugugga

SEQ ID NO: 1683169 - RNA, 18 nt, Homo sapiens
acauacauauuaucucau

SEQ ID NO: 1683170 - RNA, 23 nt, Homo sapiens
acauauccacaaaugacugcaaa

SEQ ID NO: 1683171 - RNA, 13 nt, Homo sapiens
acauauuaucuca

SEQ ID NO: 1683172 - RNA, 22 nt, Homo sapiens
acauccuuucuuuuaaugaugc

SEQ ID NO: 1683173 - RNA, 16 nt, Homo sapiens
acaucuuuauugaaau

SEQ ID NO: 1683174 - RNA, 23 nt, Homo sapiens
acaugggcugugauuacugcaau

SEQ ID NO: 1683175 - RNA, 18 nt, Homo sapiens
acauggugaaacccuguc

SEQ ID NO: 1683176 - RNA, 17 nt, Homo sapiens
acauguauugcacauug

SEQ ID NO: 1683177 - RNA, 13 nt, Homo sapiens
acauugugaaaag

SEQ ID NO: 1683178 - RNA, 18 nt, Homo sapiens
acauugugaaaaggcaaa

SEQ ID NO: 1683179 - RNA, 21 nt, Homo sapiens
acauuugugggcaagcagaug

SEQ ID NO: 1683180 - RNA, 13 nt, Homo sapiens
acauuuugacaca

SEQ ID NO: 1683181 - RNA, 15 nt, Homo sapiens
acauuuugacacaaa

SEQ ID NO: 1683182 - RNA, 16 nt, Homo sapiens
acauuuugacacaaaa

SEQ ID NO: 1683183 - RNA, 13 nt, Homo sapiens
accaaaaucagcu

SEQ ID NO: 1683184 - RNA, 23 nt, Homo sapiens
accaaggggugggccacagccau

SEQ ID NO: 1683185 - RNA, 15 nt, Homo sapiens
accagaaagcuucau

SEQ ID NO: 1683186 - RNA, 19 nt, Homo sapiens
accagaaagcuucauccac

SEQ ID NO: 1683187 - RNA, 21 nt, Homo sapiens
accauaccuuagagacuuuga

SEQ ID NO: 1683188 - RNA, 21 nt, Homo sapiens
acccaauggaaaauauaauga

SEQ ID NO: 1683189 - RNA, 13 nt, Homo sapiens
acccacaaacucc

SEQ ID NO: 1683190 - RNA, 19 nt, Homo sapiens
acccaccccguagauuccc

SEQ ID NO: 1683191 - RNA, 23 nt, Homo sapiens
acccagacguggugcuucucaca

SEQ ID NO: 1683192 - RNA, 22 nt, Homo sapiens
acccagggugugaacauguucu

SEQ ID NO: 1683193 - RNA, 23 nt, Homo sapiens
acccauaauaagagaauguuccu

SEQ ID NO: 1683194 - RNA, 16 nt, Homo sapiens
acccauucacuacagg

SEQ ID NO: 1683195 - RNA, 18 nt, Homo sapiens
acccauucacuacaggug

SEQ ID NO: 1683196 - RNA, 17 nt, Homo sapiens
accccucacugugacug

SEQ ID NO: 1683197 - RNA, 15 nt, Homo sapiens
accgcaggugcucau

SEQ ID NO: 1683198 - RNA, 19 nt, Homo sapiens
accgcaggugcucaugcug

SEQ ID NO: 1683199 - RNA, 13 nt, Homo sapiens
accguugcuaaga

SEQ ID NO: 1683200 - RNA, 21 nt, Homo sapiens
accucuuaaagaaaacccacc

SEQ ID NO: 1683201 - RNA, 23 nt, Homo sapiens
accugcugagaaaacaugccucu

SEQ ID NO: 1683202 - RNA, 16 nt, Homo sapiens
accugugcugaacaua

SEQ ID NO: 1683203 - RNA, 13 nt, Homo sapiens
uaaaauuauuuca

SEQ ID NO: 1683204 - RNA, 21 nt, Homo sapiens
uaaaauucuauuauacuacaa

SEQ ID NO: 1683205 - RNA, 19 nt, Homo sapiens
uaaacauuuugacacaaaa

SEQ ID NO: 1683206 - RNA, 23 nt, Homo sapiens
uaaacuucaccuacauuaucuca

SEQ ID NO: 1683207 - RNA, 17 nt, Homo sapiens
uaaagaagugcaugaaa

SEQ ID NO: 1683208 - RNA, 22 nt, Homo sapiens
uaaagacuuguauagcaugaaa

SEQ ID NO: 1683209 - RNA, 15 nt, Homo sapiens
uaaagccaggcucag

SEQ ID NO: 1683210 - RNA, 23 nt, Homo sapiens
uaaagugucaccccucacuguga

SEQ ID NO: 1683211 - RNA, 13 nt, Homo sapiens
uaaauaacauguu

SEQ ID NO: 1683212 - RNA, 15 nt, Homo sapiens
uaaauacaugcauau

SEQ ID NO: 1683213 - RNA, 17 nt, Homo sapiens
uaaauaggaaucauuca

SEQ ID NO: 1683214 - RNA, 12 nt, Homo sapiens
uaaaugaucucu

SEQ ID NO: 1683215 - RNA, 15 nt, Homo sapiens
uaaauguucuaauaa

SEQ ID NO: 1683216 - RNA, 18 nt, Homo sapiens
uaaauguugcaaugcaug

SEQ ID NO: 1683217 - RNA, 12 nt, Homo sapiens
uaaauugcauca

SEQ ID NO: 1683218 - RNA, 16 nt, Homo sapiens
uaaauuuuagcaaguu

SEQ ID NO: 1683219 - RNA, 20 nt, Homo sapiens
uaaauuuuuuauaaaagugu

SEQ ID NO: 1683220 - RNA, 15 nt, Homo sapiens
uaacaaacuagucag

SEQ ID NO: 1683221 - RNA, 20 nt, Homo sapiens
uaacauuccagccacuggcu

SEQ ID NO: 1683222 - RNA, 17 nt, Homo sapiens
uaaccagcucaguguuu

SEQ ID NO: 1683223 - RNA, 15 nt, Homo sapiens
uaacuuccuguggau

SEQ ID NO: 1683224 - RNA, 19 nt, Homo sapiens
uaagaaauacucaugugca

SEQ ID NO: 1683225 - RNA, 16 nt, Homo sapiens
uaagaagaaggccaga

SEQ ID NO: 1683226 - RNA, 13 nt, Homo sapiens
uaagaauaccaca

SEQ ID NO: 1683227 - RNA, 14 nt, Homo sapiens
uaagagaugggacu

SEQ ID NO: 1683228 - RNA, 19 nt, Homo sapiens
uaagcaaauugcuuuuuuc

SEQ ID NO: 1683229 - RNA, 20 nt, Homo sapiens
uaagcaguauauuaguauua

SEQ ID NO: 1683230 - RNA, 18 nt, Homo sapiens
uaagcaugugucccagga

SEQ ID NO: 1683231 - RNA, 16 nt, Homo sapiens
uaagguuuccagucag

SEQ ID NO: 1683232 - RNA, 17 nt, Homo sapiens
uaagugcuaagugcuua

SEQ ID NO: 1683233 - RNA, 12 nt, Homo sapiens
uaagugcugcug

SEQ ID NO: 1683234 - RNA, 14 nt, Homo sapiens
uaauaacuuaucua

SEQ ID NO: 1683235 - RNA, 17 nt, Homo sapiens
uaauagcuacagugcau

SEQ ID NO: 1683236 - RNA, 16 nt, Homo sapiens
uaaugacagccuugca

SEQ ID NO: 1683237 - RNA, 13 nt, Homo sapiens
uaaugaugccaug

SEQ ID NO: 1683238 - RNA, 18 nt, Homo sapiens
uaauuaaaggagaagauu

SEQ ID NO: 1683239 - RNA, 19 nt, Homo sapiens
uaauucauccuagcaaauu

SEQ ID NO: 1683240 - RNA, 15 nt, Homo sapiens
uaauuuccugugagg

SEQ ID NO: 1683241 - RNA, 18 nt, Homo sapiens
uacaacugauugcaacag

SEQ ID NO: 1683242 - RNA, 17 nt, Homo sapiens
uacagaacacuuugcua

SEQ ID NO: 1683243 - RNA, 13 nt, Homo sapiens
uacagauacauau

SEQ ID NO: 1683244 - RNA, 21 nt, Homo sapiens
uacagauacauaucuguguau

SEQ ID NO: 1683245 - RNA, 15 nt, Homo sapiens
uacaggaggaugugu

SEQ ID NO: 1683246 - RNA, 15 nt, Homo sapiens
uacagguuaagacaa

SEQ ID NO: 1683247 - RNA, 23 nt, Homo sapiens
uacauaucuguguauuaucucaa

SEQ ID NO: 1683248 - RNA, 13 nt, Homo sapiens
uacauauuaucuc

SEQ ID NO: 1683249 - RNA, 14 nt, Homo sapiens
uacauauuaucuca

SEQ ID NO: 1683250 - RNA, 15 nt, Homo sapiens
uacauauuaucucau

SEQ ID NO: 1683251 - RNA, 16 nt, Homo sapiens
uacauauuaucucauu

SEQ ID NO: 1683252 - RNA, 13 nt, Homo sapiens
uacauuaucucac

SEQ ID NO: 1683253 - RNA, 17 nt, Homo sapiens
uaccaacauaaguguug

SEQ ID NO: 1683254 - RNA, 15 nt, Homo sapiens
uaccagggucucuca

SEQ ID NO: 1683255 - RNA, 15 nt, Homo sapiens
uaccauauuuaauaa

SEQ ID NO: 1683256 - RNA, 15 nt, Homo sapiens
uaccccaaacccauc

SEQ ID NO: 1683257 - RNA, 19 nt, Homo sapiens
uaccccugcucccauuccu

SEQ ID NO: 1683258 - RNA, 23 nt, Homo sapiens
uacccuugugagagcccauuccc

SEQ ID NO: 1683259 - RNA, 14 nt, Homo sapiens
uaccugcacacugu

SEQ ID NO: 1683260 - RNA, 17 nt, Homo sapiens
uaccuggaggaaugauu

SEQ ID NO: 1683261 - RNA, 19 nt, Homo sapiens
uacuaaacuucaccuacau

SEQ ID NO: 1683262 - RNA, 14 nt, Homo sapiens
uacuaaucauguga

SEQ ID NO: 1683263 - RNA, 15 nt, Homo sapiens
uacuaucauaauuca

SEQ ID NO: 1683264 - RNA, 13 nt, Homo sapiens
uacuauguacugc

SEQ ID NO: 1683265 - RNA, 16 nt, Homo sapiens
uacugcaaucacugug

SEQ ID NO: 1683266 - RNA, 23 nt, Homo sapiens
uacuguaggcacacuuugcacug

SEQ ID NO: 1683267 - RNA, 13 nt, Homo sapiens
uacuuaaauuccc

SEQ ID NO: 1683268 - RNA, 15 nt, Homo sapiens
uacuucccacuguau

SEQ ID NO: 1683269 - RNA, 18 nt, Homo sapiens
uacuucuauucagcauug

SEQ ID NO: 1683270 - RNA, 16 nt, Homo sapiens
uacuuggaacuaggcu

SEQ ID NO: 1683271 - RNA, 22 nt, Homo sapiens
uacuugggucacaugacucuca

SEQ ID NO: 1683272 - RNA, 15 nt, Homo sapiens
uagaaaagugaauug

SEQ ID NO: 1683273 - RNA, 16 nt, Homo sapiens
uagaauaagucauugu

SEQ ID NO: 1683274 - RNA, 17 nt, Homo sapiens
uagaaucugaguauaaa

SEQ ID NO: 1683275 - RNA, 18 nt, Homo sapiens
uagaauuauaacuguaaa

SEQ ID NO: 1683276 - RNA, 14 nt, Homo sapiens
uagacaaaguacau

SEQ ID NO: 1683277 - RNA, 17 nt, Homo sapiens
uagagcucuuguguuca

SEQ ID NO: 1683278 - RNA, 18 nt, Homo sapiens
uagaggcauaaaccugug

SEQ ID NO: 1683279 - RNA, 18 nt, Homo sapiens
uagauguggccuuugaau

SEQ ID NO: 1683280 - RNA, 17 nt, Homo sapiens
uagcaaacugaauccag

SEQ ID NO: 1683281 - RNA, 16 nt, Homo sapiens
uagcaguacuaaucau

SEQ ID NO: 1683282 - RNA, 22 nt, Homo sapiens
uagcaugaaauaaaauauaucu

SEQ ID NO: 1683283 - RNA, 14 nt, Homo sapiens
uagccacagcaguu

SEQ ID NO: 1683284 - RNA, 17 nt, Homo sapiens
uagccagcugugcacuu

SEQ ID NO: 1683285 - RNA, 13 nt, Homo sapiens
uagcuucagccag

SEQ ID NO: 1683286 - RNA, 24 nt, Homo sapiens
uaggaaucccagaggugggauccu

SEQ ID NO: 1683287 - RNA, 22 nt, Homo sapiens
uagggcagccgaguggaggaaa

SEQ ID NO: 1683288 - RNA, 18 nt, Homo sapiens
uagguuaaaaaaaaaagu

SEQ ID NO: 1683289 - RNA, 17 nt, Homo sapiens
uaguaguuacugucagc

SEQ ID NO: 1683290 - RNA, 19 nt, Homo sapiens
uagucccggaggccuuccc

SEQ ID NO: 1683291 - RNA, 22 nt, Homo sapiens
uagucuuggaagcuguuuggaa

SEQ ID NO: 1683292 - RNA, 21 nt, Homo sapiens
uagugacauuuaaugccaucu

SEQ ID NO: 1683293 - RNA, 14 nt, Homo sapiens
uaguuacugucagc

SEQ ID NO: 1683294 - RNA, 19 nt, Homo sapiens
uaguucagguccaaauuca

SEQ ID NO: 1683295 - RNA, 13 nt, Homo sapiens
uauaaaggauaaa

SEQ ID NO: 1683296 - RNA, 12 nt, Homo sapiens
uauaacaguguu

SEQ ID NO: 1683297 - RNA, 15 nt, Homo sapiens
uauaacgcagucuaa

SEQ ID NO: 1683298 - RNA, 12 nt, Homo sapiens
uauaacuguaaa

SEQ ID NO: 1683299 - RNA, 12 nt, Homo sapiens
uauacaaagugu

SEQ ID NO: 1683300 - RNA, 15 nt, Homo sapiens
uauacuguaggcaca

SEQ ID NO: 1683301 - RNA, 12 nt, Homo sapiens
uauauauugaau

SEQ ID NO: 1683302 - RNA, 19 nt, Homo sapiens
uauaucuuagguaagacau

SEQ ID NO: 1683303 - RNA, 20 nt, Homo sapiens
uauaucuuagguaagacaua

SEQ ID NO: 1683304 - RNA, 13 nt, Homo sapiens
uauauugcaaggu

SEQ ID NO: 1683305 - RNA, 11 nt, Homo sapiens
uaucaaagugu

SEQ ID NO: 1683306 - RNA, 21 nt, Homo sapiens
uaucaaagugugauauacaaa

SEQ ID NO: 1683307 - RNA, 12 nt, Homo sapiens
uaucaggagaaa

SEQ ID NO: 1683308 - RNA, 14 nt, Homo sapiens
uaucccuacaugua

SEQ ID NO: 1683309 - RNA, 14 nt, Homo sapiens
uaucucauuacuua

SEQ ID NO: 1683310 - RNA, 13 nt, Homo sapiens
uaugagggccacg

SEQ ID NO: 1683311 - RNA, 22 nt, Homo sapiens
uaugagggccacgggucugugu

SEQ ID NO: 1683312 - RNA, 20 nt, Homo sapiens
uaugguuauuuaugcacugu

SEQ ID NO: 1683313 - RNA, 18 nt, Homo sapiens
uauguaacuuccugugga

SEQ ID NO: 1683314 - RNA, 14 nt, Homo sapiens
uauguacugccuua

SEQ ID NO: 1683315 - RNA, 11 nt, Homo sapiens
uauuagcaaac

SEQ ID NO: 1683316 - RNA, 12 nt, Homo sapiens
uauucagaugua

SEQ ID NO: 1683317 - RNA, 18 nt, Homo sapiens
uauuccuuugcauauuau

SEQ ID NO: 1683318 - RNA, 17 nt, Homo sapiens
uauugcaccauacuccu

SEQ ID NO: 1683319 - RNA, 19 nt, Homo sapiens
uauuuacagcugugcucca

SEQ ID NO: 1683320 - RNA, 22 nt, Homo sapiens
uauuuuccuucuuuguuucccc

SEQ ID NO: 1683321 - RNA, 22 nt, Homo sapiens
uauuuuuggaagcauacaauuu

SEQ ID NO: 1683322 - RNA, 22 nt, Homo sapiens
ucaaaagguauuauacauguga

SEQ ID NO: 1683323 - RNA, 20 nt, Homo sapiens
ucaaaauagucuaaggccau

SEQ ID NO: 1683324 - RNA, 15 nt, Homo sapiens
ugggucacauccauc

SEQ ID NO: 1683325 - RNA, 14 nt, Homo sapiens
ugggucuauguucc

SEQ ID NO: 1683326 - RNA, 18 nt, Homo sapiens
ugguaauauugacuugua

SEQ ID NO: 1683327 - RNA, 19 nt, Homo sapiens
uggugauauuguguggucu

SEQ ID NO: 1683328 - RNA, 19 nt, Homo sapiens
ugguggcucacgccuguaa

SEQ ID NO: 1683329 - RNA, 16 nt, Homo sapiens
uggugggcgccuguaa

SEQ ID NO: 1683330 - RNA, 15 nt, Homo sapiens
uguaaaauuauuuca

SEQ ID NO: 1683331 - RNA, 19 nt, Homo sapiens
uguaaagauguuuauuuca

SEQ ID NO: 1683332 - RNA, 14 nt, Homo sapiens
uguaauuccagcua

SEQ ID NO: 1683333 - RNA, 22 nt, Homo sapiens
uguacuaacccagucuuucuuc

SEQ ID NO: 1683334 - RNA, 10 nt, Homo sapiens
uguacugcaa

SEQ ID NO: 1683335 - RNA, 14 nt, Homo sapiens
uguacugccuuagu

SEQ ID NO: 1683336 - RNA, 19 nt, Homo sapiens
uguagagccccuacugugg

SEQ ID NO: 1683337 - RNA, 19 nt, Homo sapiens
uguauauucaggacuugaa

SEQ ID NO: 1683338 - RNA, 16 nt, Homo sapiens
ugucagcugcuguuga

SEQ ID NO: 1683339 - RNA, 17 nt, Homo sapiens
ugucagcugcuguugaa

SEQ ID NO: 1683340 - RNA, 19 nt, Homo sapiens
ugucucuuugugcucuaaa

SEQ ID NO: 1683341 - RNA, 18 nt, Homo sapiens
ugucuuguguuuccacag

SEQ ID NO: 1683342 - RNA, 13 nt, Homo sapiens
ugugacauacaua

SEQ ID NO: 1683343 - RNA, 22 nt, Homo sapiens
ugugacauacauauuaucucau

SEQ ID NO: 1683344 - RNA, 13 nt, Homo sapiens
ugugagcacaaag

SEQ ID NO: 1683345 - RNA, 15 nt, Homo sapiens
ugugagcacaaagaa

SEQ ID NO: 1683346 - RNA, 17 nt, Homo sapiens
ugugaugggcuguuuaa

SEQ ID NO: 1683347 - RNA, 21 nt, Homo sapiens
ugugccaagagcuacucccac

SEQ ID NO: 1683348 - RNA, 16 nt, Homo sapiens
uguggagcagagcucu

SEQ ID NO: 1683349 - RNA, 21 nt, Homo sapiens
uguggcacucagggagcauuu

SEQ ID NO: 1683350 - RNA, 14 nt, Homo sapiens
ugugggacugagug

SEQ ID NO: 1683351 - RNA, 11 nt, Homo sapiens
ugugugccuuu

SEQ ID NO: 1683352 - RNA, 19 nt, Homo sapiens
ugugugccuuuguuuccca

SEQ ID NO: 1683353 - RNA, 15 nt, Homo sapiens
uguguucgacucagc

SEQ ID NO: 1683354 - RNA, 15 nt, Homo sapiens
uguguugaaugaaga

SEQ ID NO: 1683355 - RNA, 15 nt, Homo sapiens
uguguuuucagcaaa

SEQ ID NO: 1683356 - RNA, 11 nt, Homo sapiens
uguugcaaugc

SEQ ID NO: 1683357 - RNA, 20 nt, Homo sapiens
uguugcaaugcaugauacua

SEQ ID NO: 1683358 - RNA, 21 nt, Homo sapiens
uguuguacuuaaaugguaaua

SEQ ID NO: 1683359 - RNA, 15 nt, Homo sapiens
uguuuacgauuucac

SEQ ID NO: 1683360 - RNA, 23 nt, Homo sapiens
uguuugccaggacaugcaauaaa

SEQ ID NO: 1683361 - RNA, 16 nt, Homo sapiens
uuaaaaucugugaaga

SEQ ID NO: 1683362 - RNA, 18 nt, Homo sapiens
uuaaaccuuaagauacua

SEQ ID NO: 1683363 - RNA, 18 nt, Homo sapiens
uuaaauccugaagagcau

SEQ ID NO: 1683364 - RNA, 17 nt, Homo sapiens
uuaaauuuuaacuaaau

SEQ ID NO: 1683365 - RNA, 12 nt, Homo sapiens
uuaacaccagaa

SEQ ID NO: 1683366 - RNA, 12 nt, Homo sapiens
uuaagacuaaaa

SEQ ID NO: 1683367 - RNA, 19 nt, Homo sapiens
uuaagacuaaaaguugcau

SEQ ID NO: 1683368 - RNA, 17 nt, Homo sapiens
uuaaguuuuacugauaa

SEQ ID NO: 1683369 - RNA, 17 nt, Homo sapiens
uuaauggguaugcucag

SEQ ID NO: 1683370 - RNA, 21 nt, Homo sapiens
uuacaaacuuuguuugucaca

SEQ ID NO: 1683371 - RNA, 14 nt, Homo sapiens
uuacacaaagggaa

SEQ ID NO: 1683372 - RNA, 23 nt, Homo sapiens
uuacagugagccaagauugcacc

SEQ ID NO: 1683373 - RNA, 21 nt, Homo sapiens
uuaccuccauccauccuucca

SEQ ID NO: 1683374 - RNA, 23 nt, Homo sapiens
uuacucuauacauucaacagaga

SEQ ID NO: 1683375 - RNA, 18 nt, Homo sapiens
uuagaaucugaguauaaa

SEQ ID NO: 1683376 - RNA, 20 nt, Homo sapiens
uuagagcuggcaccagaacu

SEQ ID NO: 1683377 - RNA, 19 nt, Homo sapiens
uuagaucaaauaguugcau

SEQ ID NO: 1683378 - RNA, 15 nt, Homo sapiens
uuagaugaaugucag

SEQ ID NO: 1683379 - RNA, 18 nt, Homo sapiens
uuagaugggaggaugaau

SEQ ID NO: 1683380 - RNA, 16 nt, Homo sapiens
uuagguaagacauaua

SEQ ID NO: 1683381 - RNA, 13 nt, Homo sapiens
uuauaacuguaaa

SEQ ID NO: 1683382 - RNA, 15 nt, Homo sapiens
uuauacuacaauaau

SEQ ID NO: 1683383 - RNA, 19 nt, Homo sapiens
uuauauguagccuuuacug

SEQ ID NO: 1683384 - RNA, 14 nt, Homo sapiens
uuauauucauucuu

SEQ ID NO: 1683385 - RNA, 22 nt, Homo sapiens
uuauuaaaagaugucucugcaa

SEQ ID NO: 1683386 - RNA, 18 nt, Homo sapiens
uuauuaagcuuuuuggaa

SEQ ID NO: 1683387 - RNA, 12 nt, Homo sapiens
uuauugcaaugc

SEQ ID NO: 1683388 - RNA, 12 nt, Homo sapiens
uucaaagugaua

SEQ ID NO: 1683389 - RNA, 23 nt, Homo sapiens
uucaaccccgaggucccuguugu

SEQ ID NO: 1683390 - RNA, 18 nt, Homo sapiens
uucaaggcucaaugcuau

SEQ ID NO: 1683391 - RNA, 17 nt, Homo sapiens
uucaagggucaggguga

SEQ ID NO: 1683392 - RNA, 16 nt, Homo sapiens
uucaccuacauuaucu

SEQ ID NO: 1683393 - RNA, 15 nt, Homo sapiens
uucacuguacugcau

SEQ ID NO: 1683394 - RNA, 12 nt, Homo sapiens
uucagaguauau

SEQ ID NO: 1683395 - RNA, 16 nt, Homo sapiens
uucagcagagcugaaa

SEQ ID NO: 1683396 - RNA, 18 nt, Homo sapiens
uucauccuuccauccauc

SEQ ID NO: 1683397 - RNA, 23 nt, Homo sapiens
uucaucucuuguuuacgauuuca

SEQ ID NO: 1683398 - RNA, 22 nt, Homo sapiens
uucauucucccuuucacuaaaa

SEQ ID NO: 1683399 - RNA, 18 nt, Homo sapiens
uucauuuagucaugugac

SEQ ID NO: 1683400 - RNA, 14 nt, Homo sapiens
uuccacccacaaac

SEQ ID NO: 1683401 - RNA, 14 nt, Homo sapiens
uuccaguacuaugg

SEQ ID NO: 1683402 - RNA, 21 nt, Homo sapiens
uucccacaacuacuaguguga

SEQ ID NO: 1683403 - RNA, 22 nt, Homo sapiens
uuccccagugacuccaggguga

SEQ ID NO: 1683404 - RNA, 16 nt, Homo sapiens
uuccgauacaaagugu

SEQ ID NO: 1683405 - RNA, 19 nt, Homo sapiens
uuccggggagaaacccaga

SEQ ID NO: 1683406 - RNA, 22 nt, Homo sapiens
uuccggggagaaacccagagau

SEQ ID NO: 1683407 - RNA, 20 nt, Homo sapiens
uuccuggcagucucagucca

SEQ ID NO: 1683408 - RNA, 10 nt, Homo sapiens
uucggcucua

SEQ ID NO: 1683409 - RNA, 21 nt, Homo sapiens
uucuaaagacuuguauagcau

SEQ ID NO: 1683410 - RNA, 22 nt, Homo sapiens
uucuacaacugauugcaacaga

SEQ ID NO: 1683411 - RNA, 16 nt, Homo sapiens
uucuauauuccuccag

SEQ ID NO: 1683412 - RNA, 14 nt, Homo sapiens
uucucugguaauau

SEQ ID NO: 1683413 - RNA, 21 nt, Homo sapiens
uucuuaauucauccuagcaaa

SEQ ID NO: 1683414 - RNA, 17 nt, Homo sapiens
uucuuagucacaaaaua

SEQ ID NO: 1683415 - RNA, 23 nt, Homo sapiens
uucuuccacccacaaacuccagg

SEQ ID NO: 1683416 - RNA, 21 nt, Homo sapiens
uucuuccuaaugucagaacag

SEQ ID NO: 1683417 - RNA, 15 nt, Homo sapiens
uucuuguaaggcaua

SEQ ID NO: 1683418 - RNA, 13 nt, Homo sapiens
uucuuucuuccac

SEQ ID NO: 1683419 - RNA, 17 nt, Homo sapiens
uucuuuuaaugaugcca

SEQ ID NO: 1683420 - RNA, 15 nt, Homo sapiens
uucuuuucuuuacaa

SEQ ID NO: 1683421 - RNA, 18 nt, Homo sapiens
uucuuuuugaaaugucaa

SEQ ID NO: 1683422 - RNA, 20 nt, Homo sapiens
uugaaaaaaaacaguggauc

SEQ ID NO: 1683423 - RNA, 16 nt, Homo sapiens
uugaaaccugauguca

SEQ ID NO: 1683424 - RNA, 21 nt, Homo sapiens
uugaaacuuugggaaaacaug

SEQ ID NO: 1683425 - RNA, 12 nt, Homo sapiens
uugaaaugucaa

SEQ ID NO: 1683426 - RNA, 19 nt, Homo sapiens
uugaauaguucuauacaaa

SEQ ID NO: 1683427 - RNA, 20 nt, Homo sapiens
uugaauaguucuauacaaau

SEQ ID NO: 1683428 - RNA, 22 nt, Homo sapiens
uugaauuaauaucccuacaugu

SEQ ID NO: 1683429 - RNA, 15 nt, Homo sapiens
uugacuuuccagaau

SEQ ID NO: 1683430 - RNA, 13 nt, Homo sapiens
uugagcaugugau

SEQ ID NO: 1683431 - RNA, 15 nt, Homo sapiens
uugauggagccccag

SEQ ID NO: 1683432 - RNA, 12 nt, Homo sapiens
uugcaccacugc

SEQ ID NO: 1683433 - RNA, 18 nt, Homo sapiens
uugcauuuugauauugcu

SEQ ID NO: 1683434 - RNA, 23 nt, Homo sapiens
uugcugacaaccauuaaagucag

SEQ ID NO: 1683435 - RNA, 16 nt, Homo sapiens
uuggcucaccauaacc

SEQ ID NO: 1683436 - RNA, 11 nt, Homo sapiens
uuggggcuccu

SEQ ID NO: 1683437 - RNA, 15 nt, Homo sapiens
uugguucaacaucua

SEQ ID NO: 1683438 - RNA, 18 nt, Homo sapiens
uugguuuuccuguggcau

SEQ ID NO: 1683439 - RNA, 17 nt, Homo sapiens
uuguaaaauuauuucau

SEQ ID NO: 1683440 - RNA, 15 nt, Homo sapiens
uuguaaagauccuau

SEQ ID NO: 1683441 - RNA, 19 nt, Homo sapiens
uuguacaaaauuaagcaaa

SEQ ID NO: 1683442 - RNA, 18 nt, Homo sapiens
uugucaguuccaaacaga

SEQ ID NO: 1683443 - RNA, 12 nt, Homo sapiens
uuguucuacucu

SEQ ID NO: 1683444 - RNA, 13 nt, Homo sapiens
uuaggguauuuag

SEQ ID NO: 1683445 - RNA, 20 nt, Homo sapiens
uuagguuucagcagagcuga

SEQ ID NO: 1683446 - RNA, 20 nt, Homo sapiens
uuauaaaggauaaagaagga

SEQ ID NO: 1683447 - RNA, 15 nt, Homo sapiens
uuauacacaguggau

SEQ ID NO: 1683448 - RNA, 14 nt, Homo sapiens
uuaugugugccuuu

SEQ ID NO: 1683449 - RNA, 22 nt, Homo sapiens
uuauuaaagcauuuccuaccag

SEQ ID NO: 1683450 - RNA, 20 nt, Homo sapiens
uuauugcaauaaaguauaau

SEQ ID NO: 1683451 - RNA, 16 nt, Homo sapiens
uuauuuauuuauucau

SEQ ID NO: 1683452 - RNA, 19 nt, Homo sapiens
uucaacaaagaaacaaaga

SEQ ID NO: 1683453 - RNA, 15 nt, Homo sapiens
uucaacagagacuga

SEQ ID NO: 1683454 - RNA, 21 nt, Homo sapiens
uucaaggcucuucuuccucac

SEQ ID NO: 1683455 - RNA, 22 nt, Homo sapiens
uucaagguugguucaacaucua

SEQ ID NO: 1683456 - RNA, 22 nt, Homo sapiens
uucaagguuuguucaacaucua

SEQ ID NO: 1683457 - RNA, 16 nt, Homo sapiens
uucacaggcacuccug

SEQ ID NO: 1683458 - RNA, 23 nt, Homo sapiens
uucagaagaaucuuccuggcaca

SEQ ID NO: 1683459 - RNA, 18 nt, Homo sapiens
uucagcauuguacuugaa

SEQ ID NO: 1683460 - RNA, 15 nt, Homo sapiens
uucaguaagucucau

SEQ ID NO: 1683461 - RNA, 14 nt, Homo sapiens
uucauaguaguuac

SEQ ID NO: 1683462 - RNA, 17 nt, Homo sapiens
uucauuacuagauaaaa

SEQ ID NO: 1683463 - RNA, 12 nt, Homo sapiens
uucauuuguaug

SEQ ID NO: 1683464 - RNA, 12 nt, Homo sapiens
uuccaaauucau

SEQ ID NO: 1683465 - RNA, 18 nt, Homo sapiens
uuccaaguucucaccucu

SEQ ID NO: 1683466 - RNA, 20 nt, Homo sapiens
uuccacccacaaacuccagg

SEQ ID NO: 1683467 - RNA, 15 nt, Homo sapiens
uuccagaucuuucag

SEQ ID NO: 1683468 - RNA, 17 nt, Homo sapiens
uucccaaaucccucuca

SEQ ID NO: 1683469 - RNA, 18 nt, Homo sapiens
uuccccagugacuccagg

SEQ ID NO: 1683470 - RNA, 12 nt, Homo sapiens
uuccuagcugug

SEQ ID NO: 1683471 - RNA, 14 nt, Homo sapiens
uuccugcauguucu

SEQ ID NO: 1683472 - RNA, 14 nt, Homo sapiens
uucgaacaccaaaa

SEQ ID NO: 1683473 - RNA, 12 nt, Homo sapiens
uucgguuucaaa

SEQ ID NO: 1683474 - RNA, 17 nt, Homo sapiens
uucuacaacugauugca

SEQ ID NO: 1683475 - RNA, 20 nt, Homo sapiens
uucuacaacugauugcaaca

SEQ ID NO: 1683476 - RNA, 19 nt, Homo sapiens
uucuacagaauauucuccc

SEQ ID NO: 1683477 - RNA, 18 nt, Homo sapiens
uucuacuaaaccagaaau

SEQ ID NO: 1683478 - RNA, 21 nt, Homo sapiens
uucuaguaccugugacucuua

SEQ ID NO: 1683479 - RNA, 9 nt, Homo sapiens
uucucugcu

SEQ ID NO: 1683480 - RNA, 20 nt, Homo sapiens
uucuggauuucauacuguaa

SEQ ID NO: 1683481 - RNA, 16 nt, Homo sapiens
uucugugacugaagaa

SEQ ID NO: 1683482 - RNA, 16 nt, Homo sapiens
uucuuacuaaaaagua

SEQ ID NO: 1683483 - RNA, 20 nt, Homo sapiens
uucuuuagcuuaccugggca

SEQ ID NO: 1683484 - RNA, 17 nt, Homo sapiens
uugaaaugaacuuuguc

SEQ ID NO: 1683485 - RNA, 21 nt, Homo sapiens
uugaacauguuuaauggguau

SEQ ID NO: 1683486 - RNA, 13 nt, Homo sapiens
uugaagauucuau

SEQ ID NO: 1683487 - RNA, 15 nt, Homo sapiens
uugaauugcacugaa

SEQ ID NO: 1683488 - RNA, 11 nt, Homo sapiens
uugacaccugc

SEQ ID NO: 1683489 - RNA, 21 nt, Homo sapiens
uugacaguuuuugacauuuau

SEQ ID NO: 1683490 - RNA, 13 nt, Homo sapiens
uugagauggaguu

SEQ ID NO: 1683491 - RNA, 15 nt, Homo sapiens
uugauaaaauccaaa

SEQ ID NO: 1683492 - RNA, 19 nt, Homo sapiens
uugcaagacccucccaugg

SEQ ID NO: 1683493 - RNA, 13 nt, Homo sapiens
uugcaauacugcu

SEQ ID NO: 1683494 - RNA, 14 nt, Homo sapiens
uugcacagccaaau

SEQ ID NO: 1683495 - RNA, 18 nt, Homo sapiens
uugcacugaggauauuca

SEQ ID NO: 1683496 - RNA, 13 nt, Homo sapiens
uugcagggguccc

SEQ ID NO: 1683497 - RNA, 18 nt, Homo sapiens
uugcccagacuacagggc

SEQ ID NO: 1683498 - RNA, 17 nt, Homo sapiens
uugcuaaugacagccuu

SEQ ID NO: 1683499 - RNA, 16 nt, Homo sapiens
uugcuaggagauacuc

SEQ ID NO: 1683500 - RNA, 13 nt, Homo sapiens
uugggaaguuugc

SEQ ID NO: 1683501 - RNA, 18 nt, Homo sapiens
uuggggugauuucucacc

SEQ ID NO: 1683502 - RNA, 23 nt, Homo sapiens
uuggggugauuucucacccucug

SEQ ID NO: 1683503 - RNA, 15 nt, Homo sapiens
uugguaaauucacaa

SEQ ID NO: 1683504 - RNA, 22 nt, Homo sapiens
uugguguggguucauuggcauu

SEQ ID NO: 1683505 - RNA, 23 nt, Homo sapiens
cagagagggaagaugaccugccc

SEQ ID NO: 1683506 - RNA, 16 nt, Homo sapiens
cagagagguagcacuc

SEQ ID NO: 1683507 - RNA, 16 nt, Homo sapiens
cagagauguacugcaa

SEQ ID NO: 1683508 - RNA, 19 nt, Homo sapiens
cagagccuuuuuaccuggc

SEQ ID NO: 1683509 - RNA, 24 nt, Homo sapiens
cagagcugcugcacacacucaccu

SEQ ID NO: 1683510 - RNA, 17 nt, Homo sapiens
cagagguggauacuggg

SEQ ID NO: 1683511 - RNA, 19 nt, Homo sapiens
cagauacauaucuguguau

SEQ ID NO: 1683512 - RNA, 17 nt, Homo sapiens
cagaugaugcuuuggaa

SEQ ID NO: 1683513 - RNA, 15 nt, Homo sapiens
cagauguuugccuca

SEQ ID NO: 1683514 - RNA, 22 nt, Homo sapiens
cagcaaacaggugcuaauuugu

SEQ ID NO: 1683515 - RNA, 18 nt, Homo sapiens
cagcaggccucugggacc

SEQ ID NO: 1683516 - RNA, 21 nt, Homo sapiens
cagccauaguguguguuuaga

SEQ ID NO: 1683517 - RNA, 20 nt, Homo sapiens
cagcccuggcaaaugccuga

SEQ ID NO: 1683518 - RNA, 22 nt, Homo sapiens
cagccucagcugggaacaugug

SEQ ID NO: 1683519 - RNA, 21 nt, Homo sapiens
cagccuggccaacauggugaa

SEQ ID NO: 1683520 - RNA, 19 nt, Homo sapiens
cagccuggggaacagagca

SEQ ID NO: 1683521 - RNA, 21 nt, Homo sapiens
cagccugguuucugggugcua

SEQ ID NO: 1683522 - RNA, 14 nt, Homo sapiens
cagcgaacagccuu

SEQ ID NO: 1683523 - RNA, 15 nt, Homo sapiens
cagcgaacagccuua

SEQ ID NO: 1683524 - RNA, 14 nt, Homo sapiens
cagcuagugccuuu

SEQ ID NO: 1683525 - RNA, 15 nt, Homo sapiens
cagcugugcacuuuc

SEQ ID NO: 1683526 - RNA, 22 nt, Homo sapiens
cagcuugggaauccugcuaaag

SEQ ID NO: 1683527 - RNA, 23 nt, Homo sapiens
caggaaagacuggcccucuagcu

SEQ ID NO: 1683528 - RNA, 14 nt, Homo sapiens
caggagaagccagu

SEQ ID NO: 1683529 - RNA, 23 nt, Homo sapiens
caggagaagccagugucuaggca

SEQ ID NO: 1683530 - RNA, 18 nt, Homo sapiens
caggagccuggccaggca

SEQ ID NO: 1683531 - RNA, 18 nt, Homo sapiens
caggcaugaaauucuucc

SEQ ID NO: 1683532 - RNA, 12 nt, Homo sapiens
caggccagagaa

SEQ ID NO: 1683533 - RNA, 17 nt, Homo sapiens
caggcccaaugcugcuu

SEQ ID NO: 1683534 - RNA, 20 nt, Homo sapiens
caggcucuugacuacuugga

SEQ ID NO: 1683535 - RNA, 17 nt, Homo sapiens
caggcuggagugcaaug

SEQ ID NO: 1683536 - RNA, 18 nt, Homo sapiens
caggcuggagugcaaugg

SEQ ID NO: 1683537 - RNA, 18 nt, Homo sapiens
cagggaacucuggcauuc

SEQ ID NO: 1683538 - RNA, 12 nt, Homo sapiens
cagggagcauuu

SEQ ID NO: 1683539 - RNA, 16 nt, Homo sapiens
cagggcagaaccaaga

SEQ ID NO: 1683540 - RNA, 20 nt, Homo sapiens
cagggcucuaaugugucucu

SEQ ID NO: 1683541 - RNA, 19 nt, Homo sapiens
caggggccaaccucaggcu

SEQ ID NO: 1683542 - RNA, 23 nt, Homo sapiens
caggggccaaccucaggcuccua

SEQ ID NO: 1683543 - RNA, 15 nt, Homo sapiens
caggggccauguccu

SEQ ID NO: 1683544 - RNA, 17 nt, Homo sapiens
caggggcucuguggcaa

SEQ ID NO: 1683545 - RNA, 17 nt, Homo sapiens
cagguuauaacaguguu

SEQ ID NO: 1683546 - RNA, 19 nt, Homo sapiens
caguaaaauacuauugccu

SEQ ID NO: 1683547 - RNA, 23 nt, Homo sapiens
caguaauuauguucuacagaaua

SEQ ID NO: 1683548 - RNA, 15 nt, Homo sapiens
caguacuauggagug

SEQ ID NO: 1683549 - RNA, 12 nt, Homo sapiens
cagucucagucc

SEQ ID NO: 1683550 - RNA, 16 nt, Homo sapiens
cagugacagugcccag

SEQ ID NO: 1683551 - RNA, 15 nt, Homo sapiens
cagugacuccagggu

SEQ ID NO: 1683552 - RNA, 23 nt, Homo sapiens
caguggugugugaaguuuggaga

SEQ ID NO: 1683553 - RNA, 16 nt, Homo sapiens
caguguaauccagggg

SEQ ID NO: 1683554 - RNA, 20 nt, Homo sapiens
caguuagagucuucaucugu

SEQ ID NO: 1683555 - RNA, 16 nt, Homo sapiens
caguucucucccuucc

SEQ ID NO: 1683556 - RNA, 15 nt, Homo sapiens
cauaacuucucaugu

SEQ ID NO: 1683557 - RNA, 20 nt, Homo sapiens
cauaaguuuaggauaaaaua

SEQ ID NO: 1683558 - RNA, 20 nt, Homo sapiens
cauaauagcuacagugcaua

SEQ ID NO: 1683559 - RNA, 16 nt, Homo sapiens
cauaauucagcacuua

SEQ ID NO: 1683560 - RNA, 20 nt, Homo sapiens
cauaauucagcacuuaacua

SEQ ID NO: 1683561 - RNA, 15 nt, Homo sapiens
cauaauuuaaaaaua

SEQ ID NO: 1683562 - RNA, 15 nt, Homo sapiens
cauacauauuaucuc

SEQ ID NO: 1683563 - RNA, 16 nt, Homo sapiens
cauagcugugcuauga

SEQ ID NO: 1683564 - RNA, 21 nt, Homo sapiens
cauagcugugcuaugagguuu

SEQ ID NO: 1683565 - RNA, 21 nt, Homo sapiens
cauauagaauuauuacaauuu

SEQ ID NO: 1683566 - RNA, 21 nt, Homo sapiens
cauaucuguguauuaucucaa

SEQ ID NO: 1683567 - RNA, 14 nt, Homo sapiens
cauauguugcaaga

SEQ ID NO: 1683568 - RNA, 22 nt, Homo sapiens
cauccaagagggacuccaagcc

SEQ ID NO: 1683569 - RNA, 22 nt, Homo sapiens
cauccagugugagauacugugu

SEQ ID NO: 1683570 - RNA, 14 nt, Homo sapiens
cauccaucuuucca

SEQ ID NO: 1683571 - RNA, 24 nt, Homo sapiens
cauccaucuuuccauccauuaccu

SEQ ID NO: 1683572 - RNA, 14 nt, Homo sapiens
cauccauuaccucc

SEQ ID NO: 1683573 - RNA, 14 nt, Homo sapiens
caucccuccauuca

SEQ ID NO: 1683574 - RNA, 14 nt, Homo sapiens
caucccugccugga

SEQ ID NO: 1683575 - RNA, 14 nt, Homo sapiens
cauccugagccaaa

SEQ ID NO: 1683576 - RNA, 20 nt, Homo sapiens
cauccuucuuucuaguucag

SEQ ID NO: 1683577 - RNA, 23 nt, Homo sapiens
caucucccuuggguaaaaugaag

SEQ ID NO: 1683578 - RNA, 13 nt, Homo sapiens
caucucuaauaau

SEQ ID NO: 1683579 - RNA, 13 nt, Homo sapiens
caugaaaaaccau

SEQ ID NO: 1683580 - RNA, 14 nt, Homo sapiens
caugaaauaaaaua

SEQ ID NO: 1683581 - RNA, 12 nt, Homo sapiens
caugaacuguac

SEQ ID NO: 1683582 - RNA, 18 nt, Homo sapiens
caugagugaauaaauguc

SEQ ID NO: 1683583 - RNA, 15 nt, Homo sapiens
caugauuugggguga

SEQ ID NO: 1683584 - RNA, 22 nt, Homo sapiens
caugcccagccccugguggugg

SEQ ID NO: 1683585 - RNA, 13 nt, Homo sapiens
cauggacauuuag

SEQ ID NO: 1683586 - RNA, 23 nt, Homo sapiens
cauggccaucuucuuucuuccac

SEQ ID NO: 1683587 - RNA, 21 nt, Homo sapiens
cauguacaaaaauuaugcaau

SEQ ID NO: 1683588 - RNA, 14 nt, Homo sapiens
auacagacaucuaa

SEQ ID NO: 1683589 - RNA, 16 nt, Homo sapiens
auacagaucucagggc

SEQ ID NO: 1683590 - RNA, 19 nt, Homo sapiens
auacauaaaaucgcuuuca

SEQ ID NO: 1683591 - RNA, 17 nt, Homo sapiens
auacauaaguuuaggau

SEQ ID NO: 1683592 - RNA, 14 nt, Homo sapiens
auacauauuaucuc

SEQ ID NO: 1683593 - RNA, 13 nt, Homo sapiens
auacaugcauaua

SEQ ID NO: 1683594 - RNA, 14 nt, Homo sapiens
auacaugcauauaa

SEQ ID NO: 1683595 - RNA, 12 nt, Homo sapiens
auaccugugagg

SEQ ID NO: 1683596 - RNA, 16 nt, Homo sapiens
auacuacuacuguuau

SEQ ID NO: 1683597 - RNA, 16 nt, Homo sapiens
auacuauugccucaua

SEQ ID NO: 1683598 - RNA, 15 nt, Homo sapiens
auacugccuuugcag

SEQ ID NO: 1683599 - RNA, 22 nt, Homo sapiens
auacuguaggcacacuuugcac

SEQ ID NO: 1683600 - RNA, 18 nt, Homo sapiens
auacuguauauucaggac

SEQ ID NO: 1683601 - RNA, 19 nt, Homo sapiens
auagaacaggcugaaauuu

SEQ ID NO: 1683602 - RNA, 16 nt, Homo sapiens
auagacggugcucacu

SEQ ID NO: 1683603 - RNA, 20 nt, Homo sapiens
auagggggaagacagauaug

SEQ ID NO: 1683604 - RNA, 16 nt, Homo sapiens
auagguggcacuaccc

SEQ ID NO: 1683605 - RNA, 17 nt, Homo sapiens
auagugcaauagugcaa

SEQ ID NO: 1683606 - RNA, 19 nt, Homo sapiens
auauaaaaauaaagcacuu

SEQ ID NO: 1683607 - RNA, 11 nt, Homo sapiens
auauaccaaau

SEQ ID NO: 1683608 - RNA, 16 nt, Homo sapiens
auauagaauuauuaca

SEQ ID NO: 1683609 - RNA, 17 nt, Homo sapiens
auauauuuauaaggaaa

SEQ ID NO: 1683610 - RNA, 11 nt, Homo sapiens
auaucagggaa

SEQ ID NO: 1683611 - RNA, 18 nt, Homo sapiens
auaucccuuccucucagg

SEQ ID NO: 1683612 - RNA, 22 nt, Homo sapiens
auauccuccuucuccuguucca

SEQ ID NO: 1683613 - RNA, 19 nt, Homo sapiens
auaucuguguauuaucuca

SEQ ID NO: 1683614 - RNA, 16 nt, Homo sapiens
auauguauauauguau

SEQ ID NO: 1683615 - RNA, 17 nt, Homo sapiens
auauguauuucuauaua

SEQ ID NO: 1683616 - RNA, 23 nt, Homo sapiens
auauugauugggaaaacauuugc

SEQ ID NO: 1683617 - RNA, 16 nt, Homo sapiens
auauuuuuuuaacugu

SEQ ID NO: 1683618 - RNA, 21 nt, Homo sapiens
aucaauaaauguugcaaugca

SEQ ID NO: 1683619 - RNA, 17 nt, Homo sapiens
aucacaagaaaacuaua

SEQ ID NO: 1683620 - RNA, 11 nt, Homo sapiens
aucacuuugac

SEQ ID NO: 1683621 - RNA, 11 nt, Homo sapiens
aucagcuuugu

SEQ ID NO: 1683622 - RNA, 17 nt, Homo sapiens
aucauaauucagcacuu

SEQ ID NO: 1683623 - RNA, 17 nt, Homo sapiens
aucauauguauauguca

SEQ ID NO: 1683624 - RNA, 12 nt, Homo sapiens
aucaucuuguuc

SEQ ID NO: 1683625 - RNA, 15 nt, Homo sapiens
aucaugugaggaaau

SEQ ID NO: 1683626 - RNA, 13 nt, Homo sapiens
aucauuccauuuu

SEQ ID NO: 1683627 - RNA, 15 nt, Homo sapiens
auccagcaaccuaua

SEQ ID NO: 1683628 - RNA, 14 nt, Homo sapiens
auccagugugagau

SEQ ID NO: 1683629 - RNA, 14 nt, Homo sapiens
auccaguuauuaga

SEQ ID NO: 1683630 - RNA, 14 nt, Homo sapiens
auccauuaccucca

SEQ ID NO: 1683631 - RNA, 20 nt, Homo sapiens
auccauuaccuccauccauc

SEQ ID NO: 1683632 - RNA, 15 nt, Homo sapiens
auccauuucaggacu

SEQ ID NO: 1683633 - RNA, 15 nt, Homo sapiens
aucccucaccuguag

SEQ ID NO: 1683634 - RNA, 24 nt, Homo sapiens
aucccucucacaagaaugugcaga

SEQ ID NO: 1683635 - RNA, 20 nt, Homo sapiens
aucccuuccucucaggcucu

SEQ ID NO: 1683636 - RNA, 21 nt, Homo sapiens
auccuccuucuccuguuccau

SEQ ID NO: 1683637 - RNA, 13 nt, Homo sapiens
auccuuccaucca

SEQ ID NO: 1683638 - RNA, 18 nt, Homo sapiens
auccuucuuucuaguuca

SEQ ID NO: 1683639 - RNA, 18 nt, Homo sapiens
aucggccaucaagggaag

SEQ ID NO: 1683640 - RNA, 17 nt, Homo sapiens
aucuaauaauuauucau

SEQ ID NO: 1683641 - RNA, 14 nt, Homo sapiens
aucuagagaaggca

SEQ ID NO: 1683642 - RNA, 17 nt, Homo sapiens
aucucaaugaaccauaa

SEQ ID NO: 1683643 - RNA, 15 nt, Homo sapiens
aucucacaagcacuu

SEQ ID NO: 1683644 - RNA, 15 nt, Homo sapiens
aucucauugcuuaca

SEQ ID NO: 1683645 - RNA, 22 nt, Homo sapiens
aucucauuuuacacaaagggaa

SEQ ID NO: 1683646 - RNA, 21 nt, Homo sapiens
aucuccucucucuuuccucca

SEQ ID NO: 1683647 - RNA, 15 nt, Homo sapiens
aucucuaaagagcau

SEQ ID NO: 1683648 - RNA, 16 nt, Homo sapiens
aucugaaaggccagca

SEQ ID NO: 1683649 - RNA, 18 nt, Homo sapiens
aucugugccagagguaau

SEQ ID NO: 1683650 - RNA, 14 nt, Homo sapiens
aucuucaaagccuu

SEQ ID NO: 1683651 - RNA, 12 nt, Homo sapiens
aucuuuacaaac

SEQ ID NO: 1683652 - RNA, 18 nt, Homo sapiens
aucuuuagaaacaucagu

SEQ ID NO: 1683653 - RNA, 15 nt, Homo sapiens
aucuuuuguucuccu

SEQ ID NO: 1683654 - RNA, 19 nt, Homo sapiens
augaaauggaggaucucua

SEQ ID NO: 1683655 - RNA, 20 nt, Homo sapiens
augaaggauuacucuccaua

SEQ ID NO: 1683656 - RNA, 16 nt, Homo sapiens
augagauaauacucuu

SEQ ID NO: 1683657 - RNA, 22 nt, Homo sapiens
augagguuucuuugacuucaau

SEQ ID NO: 1683658 - RNA, 21 nt, Homo sapiens
augaguuucacuguacugcau

SEQ ID NO: 1683659 - RNA, 14 nt, Homo sapiens
augauacuucccac

SEQ ID NO: 1683660 - RNA, 15 nt, Homo sapiens
augaugccauggcaa

SEQ ID NO: 1683661 - RNA, 16 nt, Homo sapiens
augauuucacagugug

SEQ ID NO: 1683662 - RNA, 19 nt, Homo sapiens
augauuuggggugauuucu

SEQ ID NO: 1683663 - RNA, 19 nt, Homo sapiens
augcaaaugagcucugaaa

SEQ ID NO: 1683664 - RNA, 18 nt, Homo sapiens
augcaauuggcauuaaca

SEQ ID NO: 1683665 - RNA, 20 nt, Homo sapiens
augcacugugggauguguuc

SEQ ID NO: 1683666 - RNA, 14 nt, Homo sapiens
augcaugauacuau

SEQ ID NO: 1683667 - RNA, 19 nt, Homo sapiens
augccaauaaagugaucug

SEQ ID NO: 1683668 - RNA, 14 nt, Homo sapiens
augccugacucagu

SEQ ID NO: 1683669 - RNA, 15 nt, Homo sapiens
augccuguaaucuca

SEQ ID NO: 1683670 - RNA, 17 nt, Homo sapiens
augccuguaaucucagc

SEQ ID NO: 1683671 - RNA, 19 nt, Homo sapiens
augccuguguacugccuua

SEQ ID NO: 1683672 - RNA, 20 nt, Homo sapiens
auggaaagacaaacugcaca

SEQ ID NO: 1683673 - RNA, 20 nt, Homo sapiens
auggaagaaacacagaaagg

SEQ ID NO: 1683674 - RNA, 21 nt, Homo sapiens
auggaggaucucuaaagagca

SEQ ID NO: 1683675 - RNA, 16 nt, Homo sapiens
auggagugcucacaaa

SEQ ID NO: 1683676 - RNA, 17 nt, Homo sapiens
auggggaggcagcagag

SEQ ID NO: 1683677 - RNA, 16 nt, Homo sapiens
augguaauaagcacug

SEQ ID NO: 1683678 - RNA, 19 nt, Homo sapiens
augguaauagcuuuaguga

SEQ ID NO: 1683679 - RNA, 15 nt, Homo sapiens
auguacugccuuagu

SEQ ID NO: 1683680 - RNA, 12 nt, Homo sapiens
auguauauguca

SEQ ID NO: 1683681 - RNA, 13 nt, Homo sapiens
augucucugcaaa

SEQ ID NO: 1683682 - RNA, 21 nt, Homo sapiens
augucucuuugugcucuaaaa

SEQ ID NO: 1683683 - RNA, 18 nt, Homo sapiens
auguuaaagagaaugagu

SEQ ID NO: 1683684 - RNA, 13 nt, Homo sapiens
auguuaaagggau

SEQ ID NO: 1683685 - RNA, 16 nt, Homo sapiens
auguucugugacugaa

SEQ ID NO: 1683686 - RNA, 22 nt, Homo sapiens
auuaaaagaugucucugcaaac

SEQ ID NO: 1683687 - RNA, 18 nt, Homo sapiens
auuaaauucaguguaguu

SEQ ID NO: 1683688 - RNA, 14 nt, Homo sapiens
auuaauguuuucaa

SEQ ID NO: 1683689 - RNA, 17 nt, Homo sapiens
auuacauuucacuucaa

SEQ ID NO: 1683690 - RNA, 14 nt, Homo sapiens
auuaccuccaucca

SEQ ID NO: 1683691 - RNA, 16 nt, Homo sapiens
auuacuaucauaauuc

SEQ ID NO: 1683692 - RNA, 15 nt, Homo sapiens
auuagaaucugagua

SEQ ID NO: 1683693 - RNA, 16 nt, Homo sapiens
auuagguuucagcaga

SEQ ID NO: 1683694 - RNA, 16 nt, Homo sapiens
auuauaaauaaauaga

SEQ ID NO: 1683695 - RNA, 22 nt, Homo sapiens
auuauaaauaaauagauguguc

SEQ ID NO: 1683696 - RNA, 14 nt, Homo sapiens
auuauauucauucu

SEQ ID NO: 1683697 - RNA, 21 nt, Homo sapiens
auuaucucaaggaauguacaa

SEQ ID NO: 1683698 - RNA, 18 nt, Homo sapiens
auuauuaaaagaugucuc

SEQ ID NO: 1683699 - RNA, 21 nt, Homo sapiens
auucaaagcauggacauuuag

SEQ ID NO: 1683700 - RNA, 18 nt, Homo sapiens
auucaagguugguucaac

SEQ ID NO: 1683701 - RNA, 12 nt, Homo sapiens
auucagcacuua

SEQ ID NO: 1683702 - RNA, 14 nt, Homo sapiens
auucaggacuugaa

SEQ ID NO: 1683703 - RNA, 16 nt, Homo sapiens
auucagguaacacuag

SEQ ID NO: 1683704 - RNA, 22 nt, Homo sapiens
auucauccuuccauccaucuuu

SEQ ID NO: 1683705 - RNA, 20 nt, Homo sapiens
auucauucugaacccuccaa

SEQ ID NO: 1683706 - RNA, 23 nt, Homo sapiens
auucauucuuuuugaaaugucaa

SEQ ID NO: 1683707 - RNA, 16 nt, Homo sapiens
auuccagaucuuucag

SEQ ID NO: 1683708 - RNA, 23 nt, Homo sapiens
auuccagcugucacucugugccu

SEQ ID NO: 1683709 - RNA, 14 nt, Homo sapiens
auuccgauacaaag

SEQ ID NO: 1683710 - RNA, 23 nt, Homo sapiens
agagguggggugcuggggcugca

SEQ ID NO: 1683711 - RNA, 22 nt, Homo sapiens
agaguccuggagcuggcucuau

SEQ ID NO: 1683712 - RNA, 14 nt, Homo sapiens
agauaccugugagg

SEQ ID NO: 1683713 - RNA, 16 nt, Homo sapiens
agauccuauagcucuu

SEQ ID NO: 1683714 - RNA, 15 nt, Homo sapiens
agauguuugccucau

SEQ ID NO: 1683715 - RNA, 20 nt, Homo sapiens
agauugacuaacucaaauac

SEQ ID NO: 1683716 - RNA, 17 nt, Homo sapiens
agauugcaccacugcuc

SEQ ID NO: 1683717 - RNA, 21 nt, Homo sapiens
agcaaauguuaaaaguuuuau

SEQ ID NO: 1683718 - RNA, 16 nt, Homo sapiens
agcaaauguugggaaa

SEQ ID NO: 1683719 - RNA, 14 nt, Homo sapiens
agcaauucuccugc

SEQ ID NO: 1683720 - RNA, 17 nt, Homo sapiens
agcacuggccuugccuc

SEQ ID NO: 1683721 - RNA, 14 nt, Homo sapiens
agcacuggguguga

SEQ ID NO: 1683722 - RNA, 22 nt, Homo sapiens
agcacuuucccucuuggugccu

SEQ ID NO: 1683723 - RNA, 18 nt, Homo sapiens
agcagagauguacugcaa

SEQ ID NO: 1683724 - RNA, 20 nt, Homo sapiens
agcagaggaauaacaucacc

SEQ ID NO: 1683725 - RNA, 16 nt, Homo sapiens
agcagcauccacccca

SEQ ID NO: 1683726 - RNA, 15 nt, Homo sapiens
agcagcugaugcugu

SEQ ID NO: 1683727 - RNA, 18 nt, Homo sapiens
agcaggcccaaugcugcu

SEQ ID NO: 1683728 - RNA, 19 nt, Homo sapiens
agcaggccucugggaccca

SEQ ID NO: 1683729 - RNA, 20 nt, Homo sapiens
agcauagaaaccacuagaaa

SEQ ID NO: 1683730 - RNA, 22 nt, Homo sapiens
agcauaggcuggggacacagga

SEQ ID NO: 1683731 - RNA, 17 nt, Homo sapiens
agcauccagugugagau

SEQ ID NO: 1683732 - RNA, 15 nt, Homo sapiens
agcaucugcuccauc

SEQ ID NO: 1683733 - RNA, 15 nt, Homo sapiens
agcaugcagcuuugc

SEQ ID NO: 1683734 - RNA, 15 nt, Homo sapiens
agccaaaugcaggga

SEQ ID NO: 1683735 - RNA, 15 nt, Homo sapiens
agccaagauugcacc

SEQ ID NO: 1683736 - RNA, 17 nt, Homo sapiens
agccaagcuggcacaaa

SEQ ID NO: 1683737 - RNA, 18 nt, Homo sapiens
agccaagcuggcacaaaa

SEQ ID NO: 1683738 - RNA, 16 nt, Homo sapiens
agcccuauugcugcua

SEQ ID NO: 1683739 - RNA, 17 nt, Homo sapiens
agcccugccuccaucuc

SEQ ID NO: 1683740 - RNA, 15 nt, Homo sapiens
agcccugucugcuag

SEQ ID NO: 1683741 - RNA, 15 nt, Homo sapiens
agccgcagaccugga

SEQ ID NO: 1683742 - RNA, 15 nt, Homo sapiens
agccuaacaucucca

SEQ ID NO: 1683743 - RNA, 15 nt, Homo sapiens
agccucagggacgac

SEQ ID NO: 1683744 - RNA, 18 nt, Homo sapiens
agccugcucuaaggcagu

SEQ ID NO: 1683745 - RNA, 19 nt, Homo sapiens
agccuggggaacagagcaa

SEQ ID NO: 1683746 - RNA, 15 nt, Homo sapiens
agccuugcagauauc

SEQ ID NO: 1683747 - RNA, 14 nt, Homo sapiens
agcuagugccuuua

SEQ ID NO: 1683748 - RNA, 14 nt, Homo sapiens
agcucacccacccc

SEQ ID NO: 1683749 - RNA, 18 nt, Homo sapiens
agcugaggaggugcugca

SEQ ID NO: 1683750 - RNA, 14 nt, Homo sapiens
agcugauacuuuga

SEQ ID NO: 1683751 - RNA, 17 nt, Homo sapiens
agcugcuguugaacuuu

SEQ ID NO: 1683752 - RNA, 19 nt, Homo sapiens
agcugggauuacaggcgug

SEQ ID NO: 1683753 - RNA, 16 nt, Homo sapiens
agcuuaaaaucuguga

SEQ ID NO: 1683754 - RNA, 17 nt, Homo sapiens
agcuuaaaaucugugaa

SEQ ID NO: 1683755 - RNA, 12 nt, Homo sapiens
agcuuaccuggg

SEQ ID NO: 1683756 - RNA, 18 nt, Homo sapiens
agcuuaccugggcacaaa

SEQ ID NO: 1683757 - RNA, 14 nt, Homo sapiens
agcuucacaguacc

SEQ ID NO: 1683758 - RNA, 13 nt, Homo sapiens
agcuucuacccuu

SEQ ID NO: 1683759 - RNA, 17 nt, Homo sapiens
agcuucuucacaggcac

SEQ ID NO: 1683760 - RNA, 22 nt, Homo sapiens
agcuuuagugaauuaaauuuag

SEQ ID NO: 1683761 - RNA, 17 nt, Homo sapiens
aggaaaagguugaauaa

SEQ ID NO: 1683762 - RNA, 23 nt, Homo sapiens
aggaaaugaugagaaauauuaaa

SEQ ID NO: 1683763 - RNA, 17 nt, Homo sapiens
aggacaaggauguucac

SEQ ID NO: 1683764 - RNA, 13 nt, Homo sapiens
aggagaagccagu

SEQ ID NO: 1683765 - RNA, 16 nt, Homo sapiens
aggagcacacauccaa

SEQ ID NO: 1683766 - RNA, 18 nt, Homo sapiens
aggagcugauacuuugac

SEQ ID NO: 1683767 - RNA, 20 nt, Homo sapiens
aggcauacugccuuguuuaa

SEQ ID NO: 1683768 - RNA, 19 nt, Homo sapiens
aggccagcagcugaugcug

SEQ ID NO: 1683769 - RNA, 20 nt, Homo sapiens
aggcuaccaacuuguaucca

SEQ ID NO: 1683770 - RNA, 12 nt, Homo sapiens
agggaagcaaua

SEQ ID NO: 1683771 - RNA, 18 nt, Homo sapiens
agggaucugcuugauauc

SEQ ID NO: 1683772 - RNA, 16 nt, Homo sapiens
agggcagcaggccaga

SEQ ID NO: 1683773 - RNA, 21 nt, Homo sapiens
aggggcuguggccgucuccuc

SEQ ID NO: 1683774 - RNA, 15 nt, Homo sapiens
agggggcugcugcuc

SEQ ID NO: 1683775 - RNA, 15 nt, Homo sapiens
aggguuggagugcuc

SEQ ID NO: 1683776 - RNA, 17 nt, Homo sapiens
agguagcacucucagag

SEQ ID NO: 1683777 - RNA, 21 nt, Homo sapiens
agguagcauucuuuggaguua

SEQ ID NO: 1683778 - RNA, 15 nt, Homo sapiens
agguccuugcccuuu

SEQ ID NO: 1683779 - RNA, 16 nt, Homo sapiens
aggugccuaaccuggg

SEQ ID NO: 1683780 - RNA, 14 nt, Homo sapiens
agguggcacuaccc

SEQ ID NO: 1683781 - RNA, 16 nt, Homo sapiens
aggugguggugguggu

SEQ ID NO: 1683782 - RNA, 22 nt, Homo sapiens
aggugugaggagagaggaggaa

SEQ ID NO: 1683783 - RNA, 16 nt, Homo sapiens
agguguuuguggggcu

SEQ ID NO: 1683784 - RNA, 16 nt, Homo sapiens
agguuauggggagaag

SEQ ID NO: 1683785 - RNA, 15 nt, Homo sapiens
agguucuugggauac

SEQ ID NO: 1683786 - RNA, 22 nt, Homo sapiens
aguaaaauagaugaguguuaaa

SEQ ID NO: 1683787 - RNA, 12 nt, Homo sapiens
aguaaauccaug

SEQ ID NO: 1683788 - RNA, 15 nt, Homo sapiens
aguaagauaucucaa

SEQ ID NO: 1683789 - RNA, 17 nt, Homo sapiens
aguacaggucaucugcu

SEQ ID NO: 1683790 - RNA, 22 nt, Homo sapiens
aguagaucuauauuagaucaaa

SEQ ID NO: 1683791 - RNA, 12 nt, Homo sapiens
aguauauguuaa

SEQ ID NO: 1683792 - RNA, 19 nt, Homo sapiens
agucaccaaauagugugaa

SEQ ID NO: 1683793 - RNA, 15 nt, Homo sapiens
agucagaugaggcaa

SEQ ID NO: 1683794 - RNA, 17 nt, Homo sapiens
agucagcaguccuagcc

SEQ ID NO: 1683795 - RNA, 13 nt, Homo sapiens
agucauuggcaaa

SEQ ID NO: 1683796 - RNA, 19 nt, Homo sapiens
agucauuggcaaagugaca

SEQ ID NO: 1683797 - RNA, 13 nt, Homo sapiens
aguccacucccag

SEQ ID NO: 1683798 - RNA, 18 nt, Homo sapiens
agucccuuugugacuuca

SEQ ID NO: 1683799 - RNA, 21 nt, Homo sapiens
agucugacccuuacagccucu

SEQ ID NO: 1683800 - RNA, 17 nt, Homo sapiens
agucugaggcaggagaa

SEQ ID NO: 1683801 - RNA, 19 nt, Homo sapiens
ccuguaaucucagcacuuu

SEQ ID NO: 1683802 - RNA, 15 nt, Homo sapiens
ccuguaauuccagcu

SEQ ID NO: 1683803 - RNA, 18 nt, Homo sapiens
ccuguggucucugaccag

SEQ ID NO: 1683804 - RNA, 19 nt, Homo sapiens
ccuguuuuaccguugcuaa

SEQ ID NO: 1683805 - RNA, 20 nt, Homo sapiens
ccuuaaggauaucaguaaau

SEQ ID NO: 1683806 - RNA, 18 nt, Homo sapiens
ccuuaagggguaucaugu

SEQ ID NO: 1683807 - RNA, 11 nt, Homo sapiens
ccuucaggcag

SEQ ID NO: 1683808 - RNA, 16 nt, Homo sapiens
ccuugcuuccuucuca

SEQ ID NO: 1683809 - RNA, 17 nt, Homo sapiens
ccuugcuuccuucucau

SEQ ID NO: 1683810 - RNA, 24 nt, Homo sapiens
ccuuuagaggguaccgucuucucc

SEQ ID NO: 1683811 - RNA, 17 nt, Homo sapiens
ccuuucacuaaaacaca

SEQ ID NO: 1683812 - RNA, 16 nt, Homo sapiens
ccuuuccccucucaua

SEQ ID NO: 1683813 - RNA, 17 nt, Homo sapiens
ccuuuccugaugccccu

SEQ ID NO: 1683814 - RNA, 23 nt, Homo sapiens
ccuuucuacaacugauugcaaca

SEQ ID NO: 1683815 - RNA, 21 nt, Homo sapiens
ccuuugcaguuggacucucag

SEQ ID NO: 1683816 - RNA, 19 nt, Homo sapiens
ccuuuuggccuccugcaaa

SEQ ID NO: 1683817 - RNA, 18 nt, Homo sapiens
cgaagcccaccacuggcc

SEQ ID NO: 1683818 - RNA, 15 nt, Homo sapiens
cgacuacugcuccug

SEQ ID NO: 1683819 - RNA, 15 nt, Homo sapiens
cgauacaaaguguug

SEQ ID NO: 1683820 - RNA, 14 nt, Homo sapiens
cgcccccaccucca

SEQ ID NO: 1683821 - RNA, 14 nt, Homo sapiens
cgccgccgcugccc

SEQ ID NO: 1683822 - RNA, 22 nt, Homo sapiens
cggauugcucuggagcagccaa

SEQ ID NO: 1683823 - RNA, 14 nt, Homo sapiens
cggcuccugcaaaa

SEQ ID NO: 1683824 - RNA, 12 nt, Homo sapiens
cgguuuuagcuu

SEQ ID NO: 1683825 - RNA, 19 nt, Homo sapiens
cguauuaaaaaacaauuaa

SEQ ID NO: 1683826 - RNA, 19 nt, Homo sapiens
cgucugcuccaaugacuga

SEQ ID NO: 1683827 - RNA, 22 nt, Homo sapiens
cguuguuuugguuguacuuugg

SEQ ID NO: 1683828 - RNA, 18 nt, Homo sapiens
cuaaaaguucucaaugua

SEQ ID NO: 1683829 - RNA, 20 nt, Homo sapiens
cuaaauguguaauaauguaa

SEQ ID NO: 1683830 - RNA, 18 nt, Homo sapiens
cuaaccaaggcuguguuu

SEQ ID NO: 1683831 - RNA, 16 nt, Homo sapiens
cuaagaagaaggccag

SEQ ID NO: 1683832 - RNA, 14 nt, Homo sapiens
cuaaguuagagcug

SEQ ID NO: 1683833 - RNA, 23 nt, Homo sapiens
cuaaguuagagcuggcaccagaa

SEQ ID NO: 1683834 - RNA, 13 nt, Homo sapiens
cuaauaauuauuc

SEQ ID NO: 1683835 - RNA, 22 nt, Homo sapiens
cuaaugcugcccucacugccuc

SEQ ID NO: 1683836 - RNA, 17 nt, Homo sapiens
cuacaacugauugcaac

SEQ ID NO: 1683837 - RNA, 17 nt, Homo sapiens
cuacaguuuuaacugug

SEQ ID NO: 1683838 - RNA, 14 nt, Homo sapiens
cuacauguauugca

SEQ ID NO: 1683839 - RNA, 16 nt, Homo sapiens
cuacauguauugcaca

SEQ ID NO: 1683840 - RNA, 18 nt, Homo sapiens
cuacauguauugcacauu

SEQ ID NO: 1683841 - RNA, 23 nt, Homo sapiens
cuacucuaggcagugacagugcc

SEQ ID NO: 1683842 - RNA, 16 nt, Homo sapiens
cuagauccagcccaaa

SEQ ID NO: 1683843 - RNA, 16 nt, Homo sapiens
cuagugguauggggcu

SEQ ID NO: 1683844 - RNA, 20 nt, Homo sapiens
cuauaagcaaauugcuuuuu

SEQ ID NO: 1683845 - RNA, 12 nt, Homo sapiens
cuauaagccaau

SEQ ID NO: 1683846 - RNA, 14 nt, Homo sapiens
cuauaucuuaggua

SEQ ID NO: 1683847 - RNA, 19 nt, Homo sapiens
cuaucauaauucagcacuu

SEQ ID NO: 1683848 - RNA, 17 nt, Homo sapiens
cuauccugggcauccuu

SEQ ID NO: 1683849 - RNA, 22 nt, Homo sapiens
cuaugaaaagcccacaccuaac

SEQ ID NO: 1683850 - RNA, 16 nt, Homo sapiens
cuauggagugcucaca

SEQ ID NO: 1683851 - RNA, 11 nt, Homo sapiens
cuauguucccc

SEQ ID NO: 1683852 - RNA, 20 nt, Homo sapiens
cuauucuaacuaaugacaag

SEQ ID NO: 1683853 - RNA, 18 nt, Homo sapiens
cuauuuaucugaucaaga

SEQ ID NO: 1683854 - RNA, 22 nt, Homo sapiens
cuauuuauuuauuuauucauua

SEQ ID NO: 1683855 - RNA, 22 nt, Homo sapiens
cucaaacuccugaccucaggug

SEQ ID NO: 1683856 - RNA, 13 nt, Homo sapiens
cucacaagcacuu

SEQ ID NO: 1683857 - RNA, 14 nt, Homo sapiens
cucacaagcacuuu

SEQ ID NO: 1683858 - RNA, 15 nt, Homo sapiens
cucaccacagccuuc

SEQ ID NO: 1683859 - RNA, 21 nt, Homo sapiens
cucacgccuguaauucuagca

SEQ ID NO: 1683860 - RNA, 13 nt, Homo sapiens
cucacuacugaac

SEQ ID NO: 1683861 - RNA, 11 nt, Homo sapiens
cucagccucag

SEQ ID NO: 1683862 - RNA, 18 nt, Homo sapiens
cucagccucccaaagugc

SEQ ID NO: 1683863 - RNA, 21 nt, Homo sapiens
cucagcuuuccuuaaggauau

SEQ ID NO: 1683864 - RNA, 22 nt, Homo sapiens
cucaggcaaagaaaaugaaaug

SEQ ID NO: 1683865 - RNA, 14 nt, Homo sapiens
cucagggugggggg

SEQ ID NO: 1683866 - RNA, 15 nt, Homo sapiens
cucauauaagacaaa

SEQ ID NO: 1683867 - RNA, 12 nt, Homo sapiens
cucaugccugua

SEQ ID NO: 1683868 - RNA, 18 nt, Homo sapiens
cucaugccuguaaucuca

SEQ ID NO: 1683869 - RNA, 22 nt, Homo sapiens
cuccaguuuacccuucagguug

SEQ ID NO: 1683870 - RNA, 21 nt, Homo sapiens
cuccaucaauaaauguugcaa

SEQ ID NO: 1683871 - RNA, 13 nt, Homo sapiens
cuccauucauccu

SEQ ID NO: 1683872 - RNA, 12 nt, Homo sapiens
cuccauuuucaa

SEQ ID NO: 1683873 - RNA, 18 nt, Homo sapiens
cucccaaagugcuggaau

SEQ ID NO: 1683874 - RNA, 23 nt, Homo sapiens
cucccaagguccucucaguucuc

SEQ ID NO: 1683875 - RNA, 15 nt, Homo sapiens
cucccccaacacaaa

SEQ ID NO: 1683876 - RNA, 21 nt, Homo sapiens
cuccccuaaagccaggcucag

SEQ ID NO: 1683877 - RNA, 13 nt, Homo sapiens
cuccgacucugca

SEQ ID NO: 1683878 - RNA, 18 nt, Homo sapiens
cuccugauggagugugca

SEQ ID NO: 1683879 - RNA, 20 nt, Homo sapiens
cuccugauggagugugcaga

SEQ ID NO: 1683880 - RNA, 22 nt, Homo sapiens
cuccugcugggcgugugugaca

SEQ ID NO: 1683881 - RNA, 16 nt, Homo sapiens
cuccuguuccauuuca

SEQ ID NO: 1683882 - RNA, 16 nt, Homo sapiens
cuccuugaagguucuc

SEQ ID NO: 1683883 - RNA, 21 nt, Homo sapiens
cuccuugcccagacuacaggg

SEQ ID NO: 1683884 - RNA, 14 nt, Homo sapiens
cuccuugucugugc

SEQ ID NO: 1683885 - RNA, 17 nt, Homo sapiens
cucuaaccaaggcugug

SEQ ID NO: 1683886 - RNA, 15 nt, Homo sapiens
cucuaagugcugcug

SEQ ID NO: 1683887 - RNA, 17 nt, Homo sapiens
cucuaaugugucucuca

SEQ ID NO: 1683888 - RNA, 17 nt, Homo sapiens
cucuaccccugcuccca

SEQ ID NO: 1683889 - RNA, 16 nt, Homo sapiens
cucuaggucaguauua

SEQ ID NO: 1683890 - RNA, 13 nt, Homo sapiens
cucuccauauccc

SEQ ID NO: 1683891 - RNA, 18 nt, Homo sapiens
cucucuauagcaccaggg

SEQ ID NO: 1683892 - RNA, 12 nt, Homo sapiens
cucucuccuuau

SEQ ID NO: 1683893 - RNA, 20 nt, Homo sapiens
cucugccaaaggaugugaua

SEQ ID NO: 1683894 - RNA, 20 nt, Homo sapiens
cucuggacuggaaagcacaa

SEQ ID NO: 1683895 - RNA, 17 nt, Homo sapiens
cucuggagcagccaagg

SEQ ID NO: 1683896 - RNA, 16 nt, Homo sapiens
cucugggucugaguca

SEQ ID NO: 1683897 - RNA, 16 nt, Homo sapiens
cucuggguugugcaca

SEQ ID NO: 1683898 - RNA, 19 nt, Homo sapiens
cucuguauuccgauacaaa

SEQ ID NO: 1683899 - RNA, 16 nt, Homo sapiens
cucuuagcccucacca

SEQ ID NO: 1683900 - RNA, 17 nt, Homo sapiens
cucuuaugugugccuuu

SEQ ID NO: 1683901 - RNA, 15 nt, Homo sapiens
cucuucuuccucacc

SEQ ID NO: 1683902 - RNA, 14 nt, Homo sapiens
cucuugcagggucu

SEQ ID NO: 1683903 - RNA, 13 nt, Homo sapiens
cucuuggugccuc

SEQ ID NO: 1683904 - RNA, 17 nt, Homo sapiens
cucuuguuccugaaaug

SEQ ID NO: 1683905 - RNA, 14 nt, Homo sapiens
cugaagaagaugag

SEQ ID NO: 1683906 - RNA, 16 nt, Homo sapiens
cugaaucugcuaccaa

SEQ ID NO: 1683907 - RNA, 15 nt, Homo sapiens
cugaauuaaauaugg

SEQ ID NO: 1683908 - RNA, 18 nt, Homo sapiens
cugaauuaucuauuucau

SEQ ID NO: 1683909 - RNA, 21 nt, Homo sapiens
cugacauuucuucuagugaug

SEQ ID NO: 1683910 - RNA, 13 nt, Homo sapiens
cugaccucaggug

SEQ ID NO: 1683911 - RNA, 19 nt, Homo sapiens
cugacuuauggcaugacuc

SEQ ID NO: 1683912 - RNA, 16 nt, Homo sapiens
cugagacagugaauuu

SEQ ID NO: 1683913 - RNA, 19 nt, Homo sapiens
cugaggagccugcaacaug

SEQ ID NO: 1683914 - RNA, 19 nt, Homo sapiens
cugaggccagaaaggugug

SEQ ID NO: 1683915 - RNA, 21 nt, Homo sapiens
cugagguucuugggauacaga

SEQ ID NO: 1683916 - RNA, 22 nt, Homo sapiens
cugaucuugcaugucuacaauc

SEQ ID NO: 1683917 - RNA, 22 nt, Homo sapiens
cugaugaguuucacuguacugc

SEQ ID NO: 1683918 - RNA, 11 nt, Homo sapiens
cugauugcauc

SEQ ID NO: 1683919 - RNA, 14 nt, Homo sapiens
cugcaaauacugua

SEQ ID NO: 1683920 - RNA, 16 nt, Homo sapiens
cugcagagauuucuca

SEQ ID NO: 1683921 - RNA, 13 nt, Homo sapiens
uaauucagcacuu

SEQ ID NO: 1683922 - RNA, 15 nt, Homo sapiens
uaauucuagcacuuu

SEQ ID NO: 1683923 - RNA, 15 nt, Homo sapiens
uaauuuaacuuucca

SEQ ID NO: 1683924 - RNA, 19 nt, Homo sapiens
uaauuuuuugcacacuguu

SEQ ID NO: 1683925 - RNA, 17 nt, Homo sapiens
uacacagaauuguucca

SEQ ID NO: 1683926 - RNA, 15 nt, Homo sapiens
uacagacaucuaaug

SEQ ID NO: 1683927 - RNA, 22 nt, Homo sapiens
uacaggcgugcgccacuaugcc

SEQ ID NO: 1683928 - RNA, 18 nt, Homo sapiens
uacaggugaaggcucuca

SEQ ID NO: 1683929 - RNA, 19 nt, Homo sapiens
uacaggugaaggcucucac

SEQ ID NO: 1683930 - RNA, 22 nt, Homo sapiens
uacagugagccaagauugcacc

SEQ ID NO: 1683931 - RNA, 15 nt, Homo sapiens
uacauauauuuugca

SEQ ID NO: 1683932 - RNA, 13 nt, Homo sapiens
uacauaugugcug

SEQ ID NO: 1683933 - RNA, 18 nt, Homo sapiens
uacauauguuuaucucac

SEQ ID NO: 1683934 - RNA, 18 nt, Homo sapiens
uacaugugagugacgaug

SEQ ID NO: 1683935 - RNA, 16 nt, Homo sapiens
uacauuaucucacuua

SEQ ID NO: 1683936 - RNA, 15 nt, Homo sapiens
uacauucaacagaga

SEQ ID NO: 1683937 - RNA, 19 nt, Homo sapiens
uacauuuuauuaagcuuuu

SEQ ID NO: 1683938 - RNA, 18 nt, Homo sapiens
uaccauuuaguaagaaua

SEQ ID NO: 1683939 - RNA, 15 nt, Homo sapiens
uaccccugcucccau

SEQ ID NO: 1683940 - RNA, 15 nt, Homo sapiens
uaccugaggccagga

SEQ ID NO: 1683941 - RNA, 15 nt, Homo sapiens
uaccugugacucuua

SEQ ID NO: 1683942 - RNA, 15 nt, Homo sapiens
uaccuuuccugaugc

SEQ ID NO: 1683943 - RNA, 12 nt, Homo sapiens
uacgauuucacu

SEQ ID NO: 1683944 - RNA, 19 nt, Homo sapiens
uacuaggagaggggggcca

SEQ ID NO: 1683945 - RNA, 12 nt, Homo sapiens
uacuauggagug

SEQ ID NO: 1683946 - RNA, 16 nt, Homo sapiens
uacucaugugcaauag

SEQ ID NO: 1683947 - RNA, 21 nt, Homo sapiens
uacugcaaagucgccagucac

SEQ ID NO: 1683948 - RNA, 11 nt, Homo sapiens
uacugcugcug

SEQ ID NO: 1683949 - RNA, 20 nt, Homo sapiens
uacuguuugauauaccaaau

SEQ ID NO: 1683950 - RNA, 22 nt, Homo sapiens
uacuugaaauuuggcuaauaac

SEQ ID NO: 1683951 - RNA, 14 nt, Homo sapiens
uacuuuuacagguu

SEQ ID NO: 1683952 - RNA, 15 nt, Homo sapiens
uagaacacaguuugu

SEQ ID NO: 1683953 - RNA, 16 nt, Homo sapiens
uagacggugcucacuc

SEQ ID NO: 1683954 - RNA, 15 nt, Homo sapiens
uagacuuaaaucuca

SEQ ID NO: 1683955 - RNA, 21 nt, Homo sapiens
uagagauguacugaguuugau

SEQ ID NO: 1683956 - RNA, 18 nt, Homo sapiens
uagauguguuauuacuuc

SEQ ID NO: 1683957 - RNA, 21 nt, Homo sapiens
uagcaaguugguaaauucaca

SEQ ID NO: 1683958 - RNA, 19 nt, Homo sapiens
uagcacugggugugagaau

SEQ ID NO: 1683959 - RNA, 19 nt, Homo sapiens
uagcagaguuaaaucucaa

SEQ ID NO: 1683960 - RNA, 19 nt, Homo sapiens
uagcaucuuccuugauaau

SEQ ID NO: 1683961 - RNA, 12 nt, Homo sapiens
uagcccaaccua

SEQ ID NO: 1683962 - RNA, 18 nt, Homo sapiens
uagcucuuugggccucuc

SEQ ID NO: 1683963 - RNA, 17 nt, Homo sapiens
uagcugaggcugagaaa

SEQ ID NO: 1683964 - RNA, 17 nt, Homo sapiens
uagcuggaugugguggu

SEQ ID NO: 1683965 - RNA, 17 nt, Homo sapiens
uagcuuaccugggcaca

SEQ ID NO: 1683966 - RNA, 15 nt, Homo sapiens
uagggggaagacaga

SEQ ID NO: 1683967 - RNA, 16 nt, Homo sapiens
uagguuaggaauucaa

SEQ ID NO: 1683968 - RNA, 19 nt, Homo sapiens
uaguagauguggccuuuga

SEQ ID NO: 1683969 - RNA, 15 nt, Homo sapiens
uaguccuuuacaaac

SEQ ID NO: 1683970 - RNA, 19 nt, Homo sapiens
uagugacauuuaaugccau

SEQ ID NO: 1683971 - RNA, 21 nt, Homo sapiens
uaguggucagaaaaauacuua

SEQ ID NO: 1683972 - RNA, 19 nt, Homo sapiens
uaguucaaucuggauucau

SEQ ID NO: 1683973 - RNA, 15 nt, Homo sapiens
uauaaauauauacag

SEQ ID NO: 1683974 - RNA, 18 nt, Homo sapiens
uauaaauauauacagaua

SEQ ID NO: 1683975 - RNA, 14 nt, Homo sapiens
uauaagcaacuuca

SEQ ID NO: 1683976 - RNA, 22 nt, Homo sapiens
uauaaggcagccuugaguugca

SEQ ID NO: 1683977 - RNA, 17 nt, Homo sapiens
uauacuuuaguagacau

SEQ ID NO: 1683978 - RNA, 21 nt, Homo sapiens
uauacuuuaguagacauuuau

SEQ ID NO: 1683979 - RNA, 14 nt, Homo sapiens
uauagcauuuugcu

SEQ ID NO: 1683980 - RNA, 11 nt, Homo sapiens
uauauaaacua

SEQ ID NO: 1683981 - RNA, 15 nt, Homo sapiens
uauauacauacugca

SEQ ID NO: 1683982 - RNA, 12 nt, Homo sapiens
uauaucagggaa

SEQ ID NO: 1683983 - RNA, 21 nt, Homo sapiens
uauauuuugugugaaauugca

SEQ ID NO: 1683984 - RNA, 22 nt, Homo sapiens
uaucaaaauagucuaaggccau

SEQ ID NO: 1683985 - RNA, 12 nt, Homo sapiens
uaucaaagucau

SEQ ID NO: 1683986 - RNA, 17 nt, Homo sapiens
uaucauguauggugaua

SEQ ID NO: 1683987 - RNA, 21 nt, Homo sapiens
uaucccuacauguauugcaca

SEQ ID NO: 1683988 - RNA, 21 nt, Homo sapiens
uaugaaggauuacucuccaua

SEQ ID NO: 1683989 - RNA, 21 nt, Homo sapiens
uaugagguuucuuugacuuca

SEQ ID NO: 1683990 - RNA, 21 nt, Homo sapiens
uaugccauugggguaguugug

SEQ ID NO: 1683991 - RNA, 19 nt, Homo sapiens
uaugccugacuaauuuugu

SEQ ID NO: 1683992 - RNA, 16 nt, Homo sapiens
uauguacugccuuagu

SEQ ID NO: 1683993 - RNA, 13 nt, Homo sapiens
uaugugugccuuu

SEQ ID NO: 1683994 - RNA, 12 nt, Homo sapiens
uauguugcaaga

SEQ ID NO: 1683995 - RNA, 16 nt, Homo sapiens
uauuaagcaguacaaa

SEQ ID NO: 1683996 - RNA, 21 nt, Homo sapiens
uauuagaucaaauaguugcau

SEQ ID NO: 1683997 - RNA, 21 nt, Homo sapiens
uauucccaaaaauuacuuugg

SEQ ID NO: 1683998 - RNA, 14 nt, Homo sapiens
uauugaauguuaaa

SEQ ID NO: 1683999 - RNA, 17 nt, Homo sapiens
uauuguaaagauccuau

SEQ ID NO: 1684000 - RNA, 19 nt, Homo sapiens
uauuuaauuaaaauauaca

SEQ ID NO: 1684001 - RNA, 21 nt, Homo sapiens
uauuuaugcacugugggaugu

SEQ ID NO: 1684002 - RNA, 18 nt, Homo sapiens
uauuuuuggaagcauaca

SEQ ID NO: 1684003 - RNA, 21 nt, Homo sapiens
uauuuuuuaagaaaaaaagcu

SEQ ID NO: 1684004 - RNA, 20 nt, Homo sapiens
ucaaagcuuugacucuauaa

SEQ ID NO: 1684005 - RNA, 16 nt, Homo sapiens
ucaaagcuuuuugcua

SEQ ID NO: 1684006 - RNA, 21 nt, Homo sapiens
ucaaauacacauuugcuacug

SEQ ID NO: 1684007 - RNA, 18 nt, Homo sapiens
ucaaauaguugcauagca

SEQ ID NO: 1684008 - RNA, 19 nt, Homo sapiens
ucaaauaguugcauagcag

SEQ ID NO: 1684009 - RNA, 16 nt, Homo sapiens
ucaacaccacuaggaa

SEQ ID NO: 1684010 - RNA, 14 nt, Homo sapiens
ucaagucacuccca

SEQ ID NO: 1684011 - RNA, 15 nt, Homo sapiens
ucaaguggguauucu

SEQ ID NO: 1684012 - RNA, 17 nt, Homo sapiens
ucaaucuggauucauau

SEQ ID NO: 1684013 - RNA, 22 nt, Homo sapiens
ucaauuucuaguaccugugacu

SEQ ID NO: 1684014 - RNA, 16 nt, Homo sapiens
ucacaagaaaacuaua

SEQ ID NO: 1684015 - RNA, 17 nt, Homo sapiens
ucacaagaaaacuauaa

SEQ ID NO: 1684016 - RNA, 17 nt, Homo sapiens
ucacacauuacaaaguu

SEQ ID NO: 1684017 - RNA, 12 nt, Homo sapiens
ucacagccucaa

SEQ ID NO: 1684018 - RNA, 19 nt, Homo sapiens
ucacauuuagaaaagugaa

SEQ ID NO: 1684019 - RNA, 17 nt, Homo sapiens
ucaccccucacugugac

SEQ ID NO: 1684020 - RNA, 20 nt, Homo sapiens
ucacuaaaacacacaggugc

SEQ ID NO: 1684021 - RNA, 10 nt, Homo sapiens
ucacuacuga

SEQ ID NO: 1684022 - RNA, 18 nt, Homo sapiens
ucacuacugaacacaugu

SEQ ID NO: 1684023 - RNA, 20 nt, Homo sapiens
ucacuacugaacacaugugu

SEQ ID NO: 1684024 - RNA, 16 nt, Homo sapiens
ucacugccucuuugca

SEQ ID NO: 1684025 - RNA, 21 nt, Homo sapiens
ucacugcugcaaauacuguau

SEQ ID NO: 1684026 - RNA, 14 nt, Homo sapiens
ucacuggacugcau

SEQ ID NO: 1684027 - RNA, 22 nt, Homo sapiens
ucacugugcuaucggcagauga

SEQ ID NO: 1684028 - RNA, 18 nt, Homo sapiens
ucacuugcuuuugaauug

SEQ ID NO: 1684029 - RNA, 22 nt, Homo sapiens
ucagccugcuuuccugcagcag

SEQ ID NO: 1684030 - RNA, 13 nt, Homo sapiens
ucaggauucuguu

SEQ ID NO: 1684031 - RNA, 19 nt, Homo sapiens
ucaggauucuguuccuuag

SEQ ID NO: 1684032 - RNA, 14 nt, Homo sapiens
ucaggucaacugac

SEQ ID NO: 1684033 - RNA, 15 nt, Homo sapiens
ucaguaagucucaua

SEQ ID NO: 1684034 - RNA, 23 nt, Homo sapiens
ucaguuguuauuuauugaaauga

SEQ ID NO: 1684035 - RNA, 21 nt, Homo sapiens
ucauaagauuaugaaaccaca

SEQ ID NO: 1684036 - RNA, 20 nt, Homo sapiens
ucauaauucagcacuuaacu

SEQ ID NO: 1684037 - RNA, 18 nt, Homo sapiens
ucauauuguaaucuaugu

SEQ ID NO: 1684038 - RNA, 16 nt, Homo sapiens
ucaucgggaaaggcaa

SEQ ID NO: 1684039 - RNA, 17 nt, Homo sapiens
ucaugaggccggaugaa

SEQ ID NO: 1684040 - RNA, 17 nt, Homo sapiens
ucaugccuguaaucuca

SEQ ID NO: 1684041 - RNA, 16 nt, Homo sapiens
acaaaauauauuuugu

SEQ ID NO: 1684042 - RNA, 14 nt, Homo sapiens
acaaaccauuuugu

SEQ ID NO: 1684043 - RNA, 12 nt, Homo sapiens
acaaacugcaca

SEQ ID NO: 1684044 - RNA, 19 nt, Homo sapiens
acaaacuuuguuugucaca

SEQ ID NO: 1684045 - RNA, 14 nt, Homo sapiens
acaaagccaugcca

SEQ ID NO: 1684046 - RNA, 21 nt, Homo sapiens
acaaaggauacuuuuacaggu

SEQ ID NO: 1684047 - RNA, 22 nt, Homo sapiens
acaagaacucuuuauguagcau

SEQ ID NO: 1684048 - RNA, 20 nt, Homo sapiens
acaaggaaaaauacugaauu

SEQ ID NO: 1684049 - RNA, 23 nt, Homo sapiens
acaagucaccaaaagacacugca

SEQ ID NO: 1684050 - RNA, 14 nt, Homo sapiens
acacacacgaugca

SEQ ID NO: 1684051 - RNA, 16 nt, Homo sapiens
acacacacgaugcauu

SEQ ID NO: 1684052 - RNA, 19 nt, Homo sapiens
acacacacgaugcauuuaa

SEQ ID NO: 1684053 - RNA, 12 nt, Homo sapiens
acacacaguacg

SEQ ID NO: 1684054 - RNA, 19 nt, Homo sapiens
acaccugagacaugcugaa

SEQ ID NO: 1684055 - RNA, 14 nt, Homo sapiens
acaccugcugagaa

SEQ ID NO: 1684056 - RNA, 15 nt, Homo sapiens
acacgaugcauuuaa

SEQ ID NO: 1684057 - RNA, 22 nt, Homo sapiens
acacuaacgaaauaucaaaguc

SEQ ID NO: 1684058 - RNA, 20 nt, Homo sapiens
acagaaagccugggugacau

SEQ ID NO: 1684059 - RNA, 17 nt, Homo sapiens
acagaacauauguugca

SEQ ID NO: 1684060 - RNA, 22 nt, Homo sapiens
acagaagcuuaaaaucugugaa

SEQ ID NO: 1684061 - RNA, 14 nt, Homo sapiens
acagacacaauuua

SEQ ID NO: 1684062 - RNA, 18 nt, Homo sapiens
acagacaucuaauguucu

SEQ ID NO: 1684063 - RNA, 23 nt, Homo sapiens
acagacuuccucuuucuaagauu

SEQ ID NO: 1684064 - RNA, 16 nt, Homo sapiens
acagacuugaaugcua

SEQ ID NO: 1684065 - RNA, 14 nt, Homo sapiens
acagauucuuucag

SEQ ID NO: 1684066 - RNA, 19 nt, Homo sapiens
acagauugucuuauuacag

SEQ ID NO: 1684067 - RNA, 14 nt, Homo sapiens
acagcaaacaggug

SEQ ID NO: 1684068 - RNA, 22 nt, Homo sapiens
acagcauuugauaaaauccaaa

SEQ ID NO: 1684069 - RNA, 17 nt, Homo sapiens
acagccauagugugugu

SEQ ID NO: 1684070 - RNA, 15 nt, Homo sapiens
acagccuuagagcuc

SEQ ID NO: 1684071 - RNA, 19 nt, Homo sapiens
acagccuucuaaauuccca

SEQ ID NO: 1684072 - RNA, 22 nt, Homo sapiens
acagccuucuaaauucccaaau

SEQ ID NO: 1684073 - RNA, 16 nt, Homo sapiens
acagccuugcaaccca

SEQ ID NO: 1684074 - RNA, 23 nt, Homo sapiens
acagcuugggaauccugcuaaag

SEQ ID NO: 1684075 - RNA, 22 nt, Homo sapiens
acaggcagauguuugccucaua

SEQ ID NO: 1684076 - RNA, 21 nt, Homo sapiens
acaggcugaaauuucuuguuc

SEQ ID NO: 1684077 - RNA, 18 nt, Homo sapiens
acaguacccaaacugcuu

SEQ ID NO: 1684078 - RNA, 14 nt, Homo sapiens
acagucugcuccuc

SEQ ID NO: 1684079 - RNA, 14 nt, Homo sapiens
acaguuuuaacugu

SEQ ID NO: 1684080 - RNA, 18 nt, Homo sapiens
acaguuuuaacuguggau

SEQ ID NO: 1684081 - RNA, 18 nt, Homo sapiens
acauaaaaucgcuuucaa

SEQ ID NO: 1684082 - RNA, 22 nt, Homo sapiens
acauaaguguugguagcacuua

SEQ ID NO: 1684083 - RNA, 22 nt, Homo sapiens
acauauaacgcagucuaauuac

SEQ ID NO: 1684084 - RNA, 21 nt, Homo sapiens
acauaucuguguauuaucuca

SEQ ID NO: 1684085 - RNA, 16 nt, Homo sapiens
acauauguuuaucuca

SEQ ID NO: 1684086 - RNA, 15 nt, Homo sapiens
acauccaucccucca

SEQ ID NO: 1684087 - RNA, 12 nt, Homo sapiens
acaucuccaugg

SEQ ID NO: 1684088 - RNA, 15 nt, Homo sapiens
acaucuguauacccu

SEQ ID NO: 1684089 - RNA, 18 nt, Homo sapiens
acaugcccuguucagcua

SEQ ID NO: 1684090 - RNA, 17 nt, Homo sapiens
acauggugaaacccugu

SEQ ID NO: 1684091 - RNA, 12 nt, Homo sapiens
acauguauugca

SEQ ID NO: 1684092 - RNA, 15 nt, Homo sapiens
acauguauugcacau

SEQ ID NO: 1684093 - RNA, 18 nt, Homo sapiens
acauguauugcacauugu

SEQ ID NO: 1684094 - RNA, 12 nt, Homo sapiens
acaugugacauu

SEQ ID NO: 1684095 - RNA, 10 nt, Homo sapiens
acauguuaau

SEQ ID NO: 1684096 - RNA, 21 nt, Homo sapiens
acauguuaaugacaauauucc

SEQ ID NO: 1684097 - RNA, 14 nt, Homo sapiens
acauuucuuuggaa

SEQ ID NO: 1684098 - RNA, 13 nt, Homo sapiens
acauuugggagac

SEQ ID NO: 1684099 - RNA, 19 nt, Homo sapiens
acauuugggagacauguga

SEQ ID NO: 1684100 - RNA, 16 nt, Homo sapiens
acauuuuuguacuaac

SEQ ID NO: 1684101 - RNA, 15 nt, Homo sapiens
accaaaaaugaugcg

SEQ ID NO: 1684102 - RNA, 16 nt, Homo sapiens
accacagcggauguug

SEQ ID NO: 1684103 - RNA, 23 nt, Homo sapiens
accacuagaaagugggcuuaaug

SEQ ID NO: 1684104 - RNA, 12 nt, Homo sapiens
accacucugucu

SEQ ID NO: 1684105 - RNA, 17 nt, Homo sapiens
accagucugacccuuac

SEQ ID NO: 1684106 - RNA, 13 nt, Homo sapiens
accauaugaauga

SEQ ID NO: 1684107 - RNA, 14 nt, Homo sapiens
accauaugaaugaa

SEQ ID NO: 1684108 - RNA, 14 nt, Homo sapiens
accauuucucugca

SEQ ID NO: 1684109 - RNA, 21 nt, Homo sapiens
accauuuuguuauugacuaac

SEQ ID NO: 1684110 - RNA, 19 nt, Homo sapiens
acccaccccacaauuccuc

SEQ ID NO: 1684111 - RNA, 16 nt, Homo sapiens
acccagacguggugcu

SEQ ID NO: 1684112 - RNA, 14 nt, Homo sapiens
accccauuccugau

SEQ ID NO: 1684113 - RNA, 18 nt, Homo sapiens
accccucacugugacuga

SEQ ID NO: 1684114 - RNA, 16 nt, Homo sapiens
acccugucucuacuaa

SEQ ID NO: 1684115 - RNA, 17 nt, Homo sapiens
acccuugacaccugcug

SEQ ID NO: 1684116 - RNA, 21 nt, Homo sapiens
acccuugacaccugcugagaa

SEQ ID NO: 1684117 - RNA, 22 nt, Homo sapiens
acccuugugagagcccauuccc

SEQ ID NO: 1684118 - RNA, 14 nt, Homo sapiens
accuacauuaucuc

SEQ ID NO: 1684119 - RNA, 22 nt, Homo sapiens
accuccuuagcccugucugcua

SEQ ID NO: 1684120 - RNA, 22 nt, Homo sapiens
accucuccuucaugacagccuc

SEQ ID NO: 1684121 - RNA, 13 nt, Homo sapiens
accucuuugcuca

SEQ ID NO: 1684122 - RNA, 16 nt, Homo sapiens
accugaccccauuccu

SEQ ID NO: 1684123 - RNA, 16 nt, Homo sapiens
accugcccugggccac

SEQ ID NO: 1684124 - RNA, 15 nt, Homo sapiens
accugggcaugacau

SEQ ID NO: 1684125 - RNA, 18 nt, Homo sapiens
accugucuaggucuccuc

SEQ ID NO: 1684126 - RNA, 16 nt, Homo sapiens
accuuccauagccucc

SEQ ID NO: 1684127 - RNA, 22 nt, Homo sapiens
accuugaccgacaugaacugua

SEQ ID NO: 1684128 - RNA, 22 nt, Homo sapiens
accuugucccuugucaguucca

SEQ ID NO: 1684129 - RNA, 14 nt, Homo sapiens
accuuuccugaugc

SEQ ID NO: 1684130 - RNA, 14 nt, Homo sapiens
acgacucugaccuc

SEQ ID NO: 1684131 - RNA, 14 nt, Homo sapiens
acgaugacaguguu

SEQ ID NO: 1684132 - RNA, 17 nt, Homo sapiens
acgauuucacuaggacu

SEQ ID NO: 1684133 - RNA, 13 nt, Homo sapiens
acguuaggccagg

SEQ ID NO: 1684134 - RNA, 18 nt, Homo sapiens
acuacaggccccacaccu

SEQ ID NO: 1684135 - RNA, 13 nt, Homo sapiens
acuacugcuccug

SEQ ID NO: 1684136 - RNA, 14 nt, Homo sapiens
acuacuucuauuca

SEQ ID NO: 1684137 - RNA, 16 nt, Homo sapiens
acuagugugacuccuu

SEQ ID NO: 1684138 - RNA, 20 nt, Homo sapiens
acuaucugugccagagguaa

SEQ ID NO: 1684139 - RNA, 23 nt, Homo sapiens
acuaugagccaggcaucauacua

SEQ ID NO: 1684140 - RNA, 23 nt, Homo sapiens
acucacugcugcaaauacuguau

SEQ ID NO: 1684141 - RNA, 16 nt, Homo sapiens
acucagggagcauuua

SEQ ID NO: 1684142 - RNA, 23 nt, Homo sapiens
acucccagugcuugcaagauucc

SEQ ID NO: 1684143 - RNA, 20 nt, Homo sapiens
acucucccuuguacagccuu

SEQ ID NO: 1684144 - RNA, 20 nt, Homo sapiens
acugaaaaaucuaagugaua

SEQ ID NO: 1684145 - RNA, 17 nt, Homo sapiens
acugaagaagaugagcc

SEQ ID NO: 1684146 - RNA, 22 nt, Homo sapiens
acugaauagauaugaaagcuga

SEQ ID NO: 1684147 - RNA, 19 nt, Homo sapiens
acugaaucugcuaccaaaa

SEQ ID NO: 1684148 - RNA, 22 nt, Homo sapiens
acugaauuuggaggcuggagua

SEQ ID NO: 1684149 - RNA, 13 nt, Homo sapiens
acugcacuuacau

SEQ ID NO: 1684150 - RNA, 16 nt, Homo sapiens
acugcagaaacccuga

SEQ ID NO: 1684151 - RNA, 17 nt, Homo sapiens
acugccaaaacauuuau

SEQ ID NO: 1684152 - RNA, 13 nt, Homo sapiens
acugccuuugcag

SEQ ID NO: 1684153 - RNA, 20 nt, Homo sapiens
acugcuucccuuacuuugcu

SEQ ID NO: 1684154 - RNA, 21 nt, Homo sapiens
acuggauggaaagacaaacug

SEQ ID NO: 1684155 - RNA, 14 nt, Homo sapiens
acuggccuugccuc

SEQ ID NO: 1684156 - RNA, 15 nt, Homo sapiens
acugguuaccuggag

SEQ ID NO: 1684157 - RNA, 18 nt, Homo sapiens
acugguucugaggccaga

SEQ ID NO: 1684158 - RNA, 16 nt, Homo sapiens
acuguaaacuucugca

SEQ ID NO: 1684159 - RNA, 13 nt, Homo sapiens
acuguaaugcugc

SEQ ID NO: 1684160 - RNA, 22 nt, Homo sapiens
acuguacacagaauuguuccag

SEQ ID NO: 1684161 - RNA, 16 nt, Homo sapiens
ccaaaguacagaauuu

SEQ ID NO: 1684162 - RNA, 20 nt, Homo sapiens
ccaaauccuagacugcuccu

SEQ ID NO: 1684163 - RNA, 15 nt, Homo sapiens
ccaaauucaccuucc

SEQ ID NO: 1684164 - RNA, 13 nt, Homo sapiens
ccaaccucaggcu

SEQ ID NO: 1684165 - RNA, 15 nt, Homo sapiens
ccaacuuuuucauag

SEQ ID NO: 1684166 - RNA, 17 nt, Homo sapiens
ccaagauugcaccacug

SEQ ID NO: 1684167 - RNA, 21 nt, Homo sapiens
ccaagcugaggaggugcugca

SEQ ID NO: 1684168 - RNA, 11 nt, Homo sapiens
ccaagguccug

SEQ ID NO: 1684169 - RNA, 12 nt, Homo sapiens
ccaaugcugcuu

SEQ ID NO: 1684170 - RNA, 20 nt, Homo sapiens
ccaauuaaaaacgaaaaccu

SEQ ID NO: 1684171 - RNA, 19 nt, Homo sapiens
ccacaacucccuugcacgu

SEQ ID NO: 1684172 - RNA, 22 nt, Homo sapiens
ccacagaggacucacuugccca

SEQ ID NO: 1684173 - RNA, 17 nt, Homo sapiens
ccacaggagagacuggu

SEQ ID NO: 1684174 - RNA, 20 nt, Homo sapiens
ccacccauaauaagagaaug

SEQ ID NO: 1684175 - RNA, 17 nt, Homo sapiens
ccacccuccaugcuccu

SEQ ID NO: 1684176 - RNA, 16 nt, Homo sapiens
ccaccuugaccaaaau

SEQ ID NO: 1684177 - RNA, 13 nt, Homo sapiens
ccacuaugccuga

SEQ ID NO: 1684178 - RNA, 15 nt, Homo sapiens
ccacuccagcuccuu

SEQ ID NO: 1684179 - RNA, 18 nt, Homo sapiens
ccacucccagugcuugca

SEQ ID NO: 1684180 - RNA, 19 nt, Homo sapiens
ccagaaagcuucauccaca

SEQ ID NO: 1684181 - RNA, 21 nt, Homo sapiens
ccagaaccucuaagugcugcu

SEQ ID NO: 1684182 - RNA, 20 nt, Homo sapiens
ccagacguggugcuucucac

SEQ ID NO: 1684183 - RNA, 21 nt, Homo sapiens
ccagagguaauguuaguaaau

SEQ ID NO: 1684184 - RNA, 20 nt, Homo sapiens
ccagaucacccauuccgggu

SEQ ID NO: 1684185 - RNA, 17 nt, Homo sapiens
ccagcacucacaccacu

SEQ ID NO: 1684186 - RNA, 14 nt, Homo sapiens
ccagccaagcuuua

SEQ ID NO: 1684187 - RNA, 15 nt, Homo sapiens
ccagcguguggagca

SEQ ID NO: 1684188 - RNA, 17 nt, Homo sapiens
ccagcuccaugcuccag

SEQ ID NO: 1684189 - RNA, 12 nt, Homo sapiens
ccagcugucacu

SEQ ID NO: 1684190 - RNA, 20 nt, Homo sapiens
ccaggccugggaauggauua

SEQ ID NO: 1684191 - RNA, 19 nt, Homo sapiens
ccaggcuggagugcaaugg

SEQ ID NO: 1684192 - RNA, 21 nt, Homo sapiens
ccagggcagcaggccagagaa

SEQ ID NO: 1684193 - RNA, 18 nt, Homo sapiens
ccagggcucuaauguguc

SEQ ID NO: 1684194 - RNA, 18 nt, Homo sapiens
ccaguauaagacuacuga

SEQ ID NO: 1684195 - RNA, 15 nt, Homo sapiens
ccagucacugcugca

SEQ ID NO: 1684196 - RNA, 21 nt, Homo sapiens
ccagucacugcugcaaggugg

SEQ ID NO: 1684197 - RNA, 17 nt, Homo sapiens
ccagucauuauguuaau

SEQ ID NO: 1684198 - RNA, 16 nt, Homo sapiens
ccagugccugugagca

SEQ ID NO: 1684199 - RNA, 20 nt, Homo sapiens
ccauaauaagagaauguucc

SEQ ID NO: 1684200 - RNA, 12 nt, Homo sapiens
ccaucagacugu

SEQ ID NO: 1684201 - RNA, 17 nt, Homo sapiens
ccauccauuaccuccau

SEQ ID NO: 1684202 - RNA, 21 nt, Homo sapiens
ccauccuuccaacauauauuu

SEQ ID NO: 1684203 - RNA, 21 nt, Homo sapiens
ccaucuuuagaaacaucaguu

SEQ ID NO: 1684204 - RNA, 21 nt, Homo sapiens
ccauguacuucccucuugaaa

SEQ ID NO: 1684205 - RNA, 12 nt, Homo sapiens
ccauuaccaaaa

SEQ ID NO: 1684206 - RNA, 19 nt, Homo sapiens
ccauucauccuuccaucca

SEQ ID NO: 1684207 - RNA, 22 nt, Homo sapiens
cccaacacaaacccccacucca

SEQ ID NO: 1684208 - RNA, 23 nt, Homo sapiens
cccaaggccccacuuucaagaau

SEQ ID NO: 1684209 - RNA, 19 nt, Homo sapiens
cccaagggacagcaaguga

SEQ ID NO: 1684210 - RNA, 15 nt, Homo sapiens
cccaaucaccuuucc

SEQ ID NO: 1684211 - RNA, 13 nt, Homo sapiens
cccaaugcugcuu

SEQ ID NO: 1684212 - RNA, 17 nt, Homo sapiens
cccacaaccuuccagcu

SEQ ID NO: 1684213 - RNA, 16 nt, Homo sapiens
cccaccccacaauucc

SEQ ID NO: 1684214 - RNA, 14 nt, Homo sapiens
cccacccgcuccca

SEQ ID NO: 1684215 - RNA, 15 nt, Homo sapiens
cccaccuuccauagc

SEQ ID NO: 1684216 - RNA, 22 nt, Homo sapiens
cccagaaccucuaagugcugcu

SEQ ID NO: 1684217 - RNA, 19 nt, Homo sapiens
cccagcucuagccucugga

SEQ ID NO: 1684218 - RNA, 17 nt, Homo sapiens
cccaggcuggagugcaa

SEQ ID NO: 1684219 - RNA, 18 nt, Homo sapiens
cccaggcuggagugcaau

SEQ ID NO: 1684220 - RNA, 19 nt, Homo sapiens
cccaggcuggagugcaaug

SEQ ID NO: 1684221 - RNA, 18 nt, Homo sapiens
cccagggugaagccuuca

SEQ ID NO: 1684222 - RNA, 13 nt, Homo sapiens
cccagugcuugca

SEQ ID NO: 1684223 - RNA, 14 nt, Homo sapiens
cccagugcuugcaa

SEQ ID NO: 1684224 - RNA, 20 nt, Homo sapiens
cccaucagacugucaagaag

SEQ ID NO: 1684225 - RNA, 17 nt, Homo sapiens
ccccaagggggcugcug

SEQ ID NO: 1684226 - RNA, 12 nt, Homo sapiens
ccccagcucacc

SEQ ID NO: 1684227 - RNA, 21 nt, Homo sapiens
ccccuccccucgcugcugggc

SEQ ID NO: 1684228 - RNA, 15 nt, Homo sapiens
ccccuccugcugggc

SEQ ID NO: 1684229 - RNA, 23 nt, Homo sapiens
cccguuucauuuagucaugugac

SEQ ID NO: 1684230 - RNA, 21 nt, Homo sapiens
cccuaaagccaggcucaggag

SEQ ID NO: 1684231 - RNA, 16 nt, Homo sapiens
cccuagggcucuccaa

SEQ ID NO: 1684232 - RNA, 20 nt, Homo sapiens
cccuccaaaggaacucuaga

SEQ ID NO: 1684233 - RNA, 14 nt, Homo sapiens
cccucucucugggc

SEQ ID NO: 1684234 - RNA, 18 nt, Homo sapiens
cccugacaucaucauucu

SEQ ID NO: 1684235 - RNA, 22 nt, Homo sapiens
cccuggcaaaugccugacucag

SEQ ID NO: 1684236 - RNA, 22 nt, Homo sapiens
cccuguagccuauacaguuuag

SEQ ID NO: 1684237 - RNA, 21 nt, Homo sapiens
cccuuacagccucugacuuaa

SEQ ID NO: 1684238 - RNA, 21 nt, Homo sapiens
cccuucuucacacagacacua

SEQ ID NO: 1684239 - RNA, 23 nt, Homo sapiens
cccuuugagcuacagaacacuuu

SEQ ID NO: 1684240 - RNA, 13 nt, Homo sapiens
ccgucacagccuc

SEQ ID NO: 1684241 - RNA, 22 nt, Homo sapiens
ccgucuguggcuuucagccucu

SEQ ID NO: 1684242 - RNA, 11 nt, Homo sapiens
ccgucuucucc

SEQ ID NO: 1684243 - RNA, 13 nt, Homo sapiens
ccguuuucugggc

SEQ ID NO: 1684244 - RNA, 14 nt, Homo sapiens
ccuaacaucuccau

SEQ ID NO: 1684245 - RNA, 17 nt, Homo sapiens
ccuaagcauguguccca

SEQ ID NO: 1684246 - RNA, 13 nt, Homo sapiens
ccuacauuaucuc

SEQ ID NO: 1684247 - RNA, 13 nt, Homo sapiens
ccuagccuauguc

SEQ ID NO: 1684248 - RNA, 15 nt, Homo sapiens
ccuauaucuuaggua

SEQ ID NO: 1684249 - RNA, 13 nt, Homo sapiens
ccuauugcugcua

SEQ ID NO: 1684250 - RNA, 17 nt, Homo sapiens
ccucagcuucuucacag

SEQ ID NO: 1684251 - RNA, 9 nt, Homo sapiens
ccucaggcu

SEQ ID NO: 1684252 - RNA, 21 nt, Homo sapiens
ccucaguuuccugaccuauga

SEQ ID NO: 1684253 - RNA, 18 nt, Homo sapiens
ccucauggcucuggcaca

SEQ ID NO: 1684254 - RNA, 22 nt, Homo sapiens
ccucaugucuucucacaagcca

SEQ ID NO: 1684255 - RNA, 14 nt, Homo sapiens
ccucccaagguccu

SEQ ID NO: 1684256 - RNA, 13 nt, Homo sapiens
ccuccccaaguca

SEQ ID NO: 1684257 - RNA, 23 nt, Homo sapiens
ccucugccaaaggaugugauaua

SEQ ID NO: 1684258 - RNA, 19 nt, Homo sapiens
ccugaauuaucuauuucau

SEQ ID NO: 1684259 - RNA, 22 nt, Homo sapiens
ccugagcaggaaagacuggccc

SEQ ID NO: 1684260 - RNA, 10 nt, Homo sapiens
ccugcaaaac

SEQ ID NO: 1684261 - RNA, 13 nt, Homo sapiens
ccugccucaggcc

SEQ ID NO: 1684262 - RNA, 17 nt, Homo sapiens
ccugcuuuccugcagca

SEQ ID NO: 1684263 - RNA, 19 nt, Homo sapiens
ccuggauccucaguucuca

SEQ ID NO: 1684264 - RNA, 20 nt, Homo sapiens
ccuggaucucacaagcacuu

SEQ ID NO: 1684265 - RNA, 21 nt, Homo sapiens
ccuggcaaaugccugacucag

SEQ ID NO: 1684266 - RNA, 13 nt, Homo sapiens
ccugggcacaaac

SEQ ID NO: 1684267 - RNA, 18 nt, Homo sapiens
ccugguuucugggugcua

SEQ ID NO: 1684268 - RNA, 17 nt, Homo sapiens
ccuguaaucucagcacu

SEQ ID NO: 1684269 - RNA, 17 nt, Homo sapiens
ccuguagcagccagucc

SEQ ID NO: 1684270 - RNA, 12 nt, Homo sapiens
ccugugugaccc

SEQ ID NO: 1684271 - RNA, 12 nt, Homo sapiens
ccuguuccagaa

SEQ ID NO: 1684272 - RNA, 22 nt, Homo sapiens
ccuuacuggcuuaccuccucau

SEQ ID NO: 1684273 - RNA, 15 nt, Homo sapiens
ccuuccuccucucaa

SEQ ID NO: 1684274 - RNA, 15 nt, Homo sapiens
ccuuccugcugcugc

SEQ ID NO: 1684275 - RNA, 16 nt, Homo sapiens
ccuucucaucuugccu

SEQ ID NO: 1684276 - RNA, 22 nt, Homo sapiens
ccuucuccacuggccggaguca

SEQ ID NO: 1684277 - RNA, 20 nt, Homo sapiens
ccuugcagauaucugcaugu

SEQ ID NO: 1684278 - RNA, 23 nt, Homo sapiens
ccuugcagcggcuccugcaaaag

SEQ ID NO: 1684279 - RNA, 20 nt, Homo sapiens
ccuugcccagacuacagggc

SEQ ID NO: 1684280 - RNA, 14 nt, Homo sapiens
ccuugcuuccugau

SEQ ID NO: 1684281 - RNA, 14 nt, Homo sapiens
auuccccagugacu

SEQ ID NO: 1684282 - RNA, 16 nt, Homo sapiens
auuccugaucccaugg

SEQ ID NO: 1684283 - RNA, 16 nt, Homo sapiens
auucuaacaagucaua

SEQ ID NO: 1684284 - RNA, 16 nt, Homo sapiens
auucuaacuaaugaca

SEQ ID NO: 1684285 - RNA, 18 nt, Homo sapiens
auucuaccugaggccagg

SEQ ID NO: 1684286 - RNA, 17 nt, Homo sapiens
auucuauucuccagaca

SEQ ID NO: 1684287 - RNA, 20 nt, Homo sapiens
auucucccauaaacacugaa

SEQ ID NO: 1684288 - RNA, 17 nt, Homo sapiens
auucucccuuucacuaa

SEQ ID NO: 1684289 - RNA, 21 nt, Homo sapiens
auucugauuauugaguuccag

SEQ ID NO: 1684290 - RNA, 14 nt, Homo sapiens
auucuucacuugcu

SEQ ID NO: 1684291 - RNA, 19 nt, Homo sapiens
auucuuugcaauacugcuu

SEQ ID NO: 1684292 - RNA, 16 nt, Homo sapiens
auucuuuucucagugu

SEQ ID NO: 1684293 - RNA, 21 nt, Homo sapiens
auugcaccauacuccuugcuu

SEQ ID NO: 1684294 - RNA, 13 nt, Homo sapiens
auugcauccacua

SEQ ID NO: 1684295 - RNA, 13 nt, Homo sapiens
auugccucugaaa

SEQ ID NO: 1684296 - RNA, 15 nt, Homo sapiens
auugggaaaacucca

SEQ ID NO: 1684297 - RNA, 22 nt, Homo sapiens
auugucuagugaggaagacaag

SEQ ID NO: 1684298 - RNA, 18 nt, Homo sapiens
auugugaaaaggcaaauu

SEQ ID NO: 1684299 - RNA, 12 nt, Homo sapiens
auuuaacuuucc

SEQ ID NO: 1684300 - RNA, 13 nt, Homo sapiens
auuuaacuuucca

SEQ ID NO: 1684301 - RNA, 13 nt, Homo sapiens
auuuacuggaccc

SEQ ID NO: 1684302 - RNA, 15 nt, Homo sapiens
auuuaucugaucaag

SEQ ID NO: 1684303 - RNA, 22 nt, Homo sapiens
auuucaaaguuuuguuguacuu

SEQ ID NO: 1684304 - RNA, 14 nt, Homo sapiens
auuucauagcugua

SEQ ID NO: 1684305 - RNA, 13 nt, Homo sapiens
auuuccugugagg

SEQ ID NO: 1684306 - RNA, 14 nt, Homo sapiens
auuucucacccucu

SEQ ID NO: 1684307 - RNA, 19 nt, Homo sapiens
auuucucauugacuuuuau

SEQ ID NO: 1684308 - RNA, 18 nt, Homo sapiens
auuugggagacaugugac

SEQ ID NO: 1684309 - RNA, 16 nt, Homo sapiens
auuuguauaugacugc

SEQ ID NO: 1684310 - RNA, 17 nt, Homo sapiens
auuuuacacaaagggaa

SEQ ID NO: 1684311 - RNA, 17 nt, Homo sapiens
auuuugaaaugaacuuu

SEQ ID NO: 1684312 - RNA, 11 nt, Homo sapiens
caaaaagccac

SEQ ID NO: 1684313 - RNA, 21 nt, Homo sapiens
caaaaggaggugaaaucccug

SEQ ID NO: 1684314 - RNA, 16 nt, Homo sapiens
caaaccccugcagaua

SEQ ID NO: 1684315 - RNA, 18 nt, Homo sapiens
caaacucuaaaauuauaa

SEQ ID NO: 1684316 - RNA, 16 nt, Homo sapiens
caaacuuuguuuguca

SEQ ID NO: 1684317 - RNA, 17 nt, Homo sapiens
caaacuuuguuugucac

SEQ ID NO: 1684318 - RNA, 15 nt, Homo sapiens
caaagaaguacugua

SEQ ID NO: 1684319 - RNA, 23 nt, Homo sapiens
caaagauguuaugguguuuagau

SEQ ID NO: 1684320 - RNA, 14 nt, Homo sapiens
caaagccaugccaa

SEQ ID NO: 1684321 - RNA, 19 nt, Homo sapiens
caaagugcuggaauuacag

SEQ ID NO: 1684322 - RNA, 17 nt, Homo sapiens
caaauaauuugaacuuu

SEQ ID NO: 1684323 - RNA, 17 nt, Homo sapiens
caaauacacauuugcua

SEQ ID NO: 1684324 - RNA, 21 nt, Homo sapiens
caaauacuguauauucaggac

SEQ ID NO: 1684325 - RNA, 15 nt, Homo sapiens
caaaugaaauguaug

SEQ ID NO: 1684326 - RNA, 21 nt, Homo sapiens
caaauguuuuucauccauucc

SEQ ID NO: 1684327 - RNA, 23 nt, Homo sapiens
caaauuuuucacccauuuacaca

SEQ ID NO: 1684328 - RNA, 18 nt, Homo sapiens
caacaaacuuaggaauaa

SEQ ID NO: 1684329 - RNA, 13 nt, Homo sapiens
caacagacuugaa

SEQ ID NO: 1684330 - RNA, 23 nt, Homo sapiens
caacagccaagcuggcacaaaag

SEQ ID NO: 1684331 - RNA, 18 nt, Homo sapiens
caacaucuaaaaaucaaa

SEQ ID NO: 1684332 - RNA, 18 nt, Homo sapiens
caacaugccagccacugu

SEQ ID NO: 1684333 - RNA, 19 nt, Homo sapiens
caacaugccagccacugug

SEQ ID NO: 1684334 - RNA, 14 nt, Homo sapiens
caacccaaggugag

SEQ ID NO: 1684335 - RNA, 18 nt, Homo sapiens
caacccauucacuacagg

SEQ ID NO: 1684336 - RNA, 18 nt, Homo sapiens
caacccuuccugcugcug

SEQ ID NO: 1684337 - RNA, 22 nt, Homo sapiens
caacccuuccugcugcugcuac

SEQ ID NO: 1684338 - RNA, 14 nt, Homo sapiens
caaccuuccagcuc

SEQ ID NO: 1684339 - RNA, 20 nt, Homo sapiens
caacuacuagugugacuccu

SEQ ID NO: 1684340 - RNA, 15 nt, Homo sapiens
cauaguguguguuua

SEQ ID NO: 1684341 - RNA, 20 nt, Homo sapiens
cauauaacgcagucuaauua

SEQ ID NO: 1684342 - RNA, 17 nt, Homo sapiens
cauaucccuuccucuca

SEQ ID NO: 1684343 - RNA, 13 nt, Homo sapiens
cauauuaucucau

SEQ ID NO: 1684344 - RNA, 16 nt, Homo sapiens
caucacguuagcuguc

SEQ ID NO: 1684345 - RNA, 17 nt, Homo sapiens
caucacuggacugcaug

SEQ ID NO: 1684346 - RNA, 21 nt, Homo sapiens
caucaggugaggugugcucca

SEQ ID NO: 1684347 - RNA, 19 nt, Homo sapiens
cauccaucccuccauucau

SEQ ID NO: 1684348 - RNA, 17 nt, Homo sapiens
cauccaucuuuccaucc

SEQ ID NO: 1684349 - RNA, 20 nt, Homo sapiens
cauccauuaccuccauccau

SEQ ID NO: 1684350 - RNA, 23 nt, Homo sapiens
cauccuuaaaacaauucugugac

SEQ ID NO: 1684351 - RNA, 15 nt, Homo sapiens
cauccuuucuuuuaa

SEQ ID NO: 1684352 - RNA, 17 nt, Homo sapiens
caucgccgggacuccag

SEQ ID NO: 1684353 - RNA, 18 nt, Homo sapiens
caucuaauguauuaugag

SEQ ID NO: 1684354 - RNA, 12 nt, Homo sapiens
caucugcuccau

SEQ ID NO: 1684355 - RNA, 23 nt, Homo sapiens
caucuugccucauuuugcuuccc

SEQ ID NO: 1684356 - RNA, 15 nt, Homo sapiens
caugaaaauaccauu

SEQ ID NO: 1684357 - RNA, 16 nt, Homo sapiens
caugaaauucuuccua

SEQ ID NO: 1684358 - RNA, 13 nt, Homo sapiens
caugcccuguuca

SEQ ID NO: 1684359 - RNA, 16 nt, Homo sapiens
caugccugaugaaagc

SEQ ID NO: 1684360 - RNA, 22 nt, Homo sapiens
caugcucaccgcccugcuucac

SEQ ID NO: 1684361 - RNA, 22 nt, Homo sapiens
caugcugcuccccuaaagccag

SEQ ID NO: 1684362 - RNA, 14 nt, Homo sapiens
cauguauugcacau

SEQ ID NO: 1684363 - RNA, 15 nt, Homo sapiens
cauguauugcacauu

SEQ ID NO: 1684364 - RNA, 13 nt, Homo sapiens
caugugacauuua

SEQ ID NO: 1684365 - RNA, 21 nt, Homo sapiens
caugugacauuuauauauuga

SEQ ID NO: 1684366 - RNA, 16 nt, Homo sapiens
caugugucaugaagaa

SEQ ID NO: 1684367 - RNA, 13 nt, Homo sapiens
cauguucugugac

SEQ ID NO: 1684368 - RNA, 19 nt, Homo sapiens
cauguucugugacugaaga

SEQ ID NO: 1684369 - RNA, 11 nt, Homo sapiens
cauuaaauuca

SEQ ID NO: 1684370 - RNA, 15 nt, Homo sapiens
cauuaccuccaucca

SEQ ID NO: 1684371 - RNA, 18 nt, Homo sapiens
cauucaacagagacugaa

SEQ ID NO: 1684372 - RNA, 20 nt, Homo sapiens
cauucauccuuccauccauc

SEQ ID NO: 1684373 - RNA, 14 nt, Homo sapiens
cauuccugauccca

SEQ ID NO: 1684374 - RNA, 18 nt, Homo sapiens
cauucucugaguguuguu

SEQ ID NO: 1684375 - RNA, 14 nt, Homo sapiens
cauucuuugcaaua

SEQ ID NO: 1684376 - RNA, 18 nt, Homo sapiens
cauugcacauaagcuucc

SEQ ID NO: 1684377 - RNA, 14 nt, Homo sapiens
cauugccggcaaug

SEQ ID NO: 1684378 - RNA, 13 nt, Homo sapiens
cauuguguggaau

SEQ ID NO: 1684379 - RNA, 17 nt, Homo sapiens
cauuuaauaaagaugag

SEQ ID NO: 1684380 - RNA, 20 nt, Homo sapiens
cauuuacacauauccacaaa

SEQ ID NO: 1684381 - RNA, 14 nt, Homo sapiens
cauuuaugacaagc

SEQ ID NO: 1684382 - RNA, 18 nt, Homo sapiens
cauuucuuugcauuccag

SEQ ID NO: 1684383 - RNA, 14 nt, Homo sapiens
cauuugaacauguu

SEQ ID NO: 1684384 - RNA, 20 nt, Homo sapiens
cauuugggagacaugugaca

SEQ ID NO: 1684385 - RNA, 14 nt, Homo sapiens
ccaaaacaguuaau

SEQ ID NO: 1684386 - RNA, 22 nt, Homo sapiens
ccaaaugcagggaggggaggca

SEQ ID NO: 1684387 - RNA, 16 nt, Homo sapiens
ccaacuccucaugucu

SEQ ID NO: 1684388 - RNA, 15 nt, Homo sapiens
ccaagcuggcacaaa

SEQ ID NO: 1684389 - RNA, 22 nt, Homo sapiens
ccaaggaaaggcauguacaaaa

SEQ ID NO: 1684390 - RNA, 17 nt, Homo sapiens
ccaaggccccacuuuca

SEQ ID NO: 1684391 - RNA, 14 nt, Homo sapiens
ccaaguaacauuuu

SEQ ID NO: 1684392 - RNA, 19 nt, Homo sapiens
ccaauaaagugaucugugu

SEQ ID NO: 1684393 - RNA, 19 nt, Homo sapiens
ccaaugagaucauugugaa

SEQ ID NO: 1684394 - RNA, 20 nt, Homo sapiens
ccaaugagaucauugugaag

SEQ ID NO: 1684395 - RNA, 22 nt, Homo sapiens
ccaaugcugucugguugcgcca

SEQ ID NO: 1684396 - RNA, 14 nt, Homo sapiens
ccacaaacuccagg

SEQ ID NO: 1684397 - RNA, 20 nt, Homo sapiens
ccacaaccuuccagcuccau

SEQ ID NO: 1684398 - RNA, 22 nt, Homo sapiens
ccacaauuccuccucuggccac

SEQ ID NO: 1684399 - RNA, 12 nt, Homo sapiens
ccacagccaugg

SEQ ID NO: 1684400 - RNA, 19 nt, Homo sapiens
ccacagccugcaagucagu

SEQ ID NO: 1684401 - RNA, 14 nt, Homo sapiens
ccacaggggccaug

SEQ ID NO: 1684402 - RNA, 17 nt, Homo sapiens
ccacgggggcaguguga

SEQ ID NO: 1684403 - RNA, 22 nt, Homo sapiens
ccacucugaaguaagagcaaug

SEQ ID NO: 1684404 - RNA, 17 nt, Homo sapiens
ccagccacuggcugcua

SEQ ID NO: 1684405 - RNA, 14 nt, Homo sapiens
ccagccacugugau

SEQ ID NO: 1684406 - RNA, 20 nt, Homo sapiens
ccagccuggggaacagagca

SEQ ID NO: 1684407 - RNA, 16 nt, Homo sapiens
ccagcugugcacuuuc

SEQ ID NO: 1684408 - RNA, 23 nt, Homo sapiens
ccaggagcaggaccuacuaggag

SEQ ID NO: 1684409 - RNA, 18 nt, Homo sapiens
ccaggccugggaauggau

SEQ ID NO: 1684410 - RNA, 16 nt, Homo sapiens
ccaggcuggagugcaa

SEQ ID NO: 1684411 - RNA, 17 nt, Homo sapiens
ccaggcuggagugcaau

SEQ ID NO: 1684412 - RNA, 23 nt, Homo sapiens
ccagggcucuaaugugucucuca

SEQ ID NO: 1684413 - RNA, 17 nt, Homo sapiens
ccagggcuuugcuccag

SEQ ID NO: 1684414 - RNA, 21 nt, Homo sapiens
ccagucccagacaauuccauu

SEQ ID NO: 1684415 - RNA, 20 nt, Homo sapiens
ccauccaucuuuccauccau

SEQ ID NO: 1684416 - RNA, 10 nt, Homo sapiens
ccaugaauua

SEQ ID NO: 1684417 - RNA, 23 nt, Homo sapiens
ccaugauuuggggugauuucuca

SEQ ID NO: 1684418 - RNA, 15 nt, Homo sapiens
ccauucagagcuaug

SEQ ID NO: 1684419 - RNA, 20 nt, Homo sapiens
ccauucagagcuauggugcu

SEQ ID NO: 1684420 - RNA, 18 nt, Homo sapiens
ccauucuauucuccagac

SEQ ID NO: 1684421 - RNA, 21 nt, Homo sapiens
ccauuuauuaagcaguacaaa

SEQ ID NO: 1684422 - RNA, 16 nt, Homo sapiens
ccauuucaggacucuc

SEQ ID NO: 1684423 - RNA, 20 nt, Homo sapiens
cccaaaccagcccagagcag

SEQ ID NO: 1684424 - RNA, 23 nt, Homo sapiens
cccaagauuauuaaaagaugucu

SEQ ID NO: 1684425 - RNA, 12 nt, Homo sapiens
cccaaugaauua

SEQ ID NO: 1684426 - RNA, 14 nt, Homo sapiens
cccacaaacuccag

SEQ ID NO: 1684427 - RNA, 16 nt, Homo sapiens
cccagaaccuugaugg

SEQ ID NO: 1684428 - RNA, 14 nt, Homo sapiens
cccagauaacuuuc

SEQ ID NO: 1684429 - RNA, 21 nt, Homo sapiens
cccaggaaagguuuuccuuau

SEQ ID NO: 1684430 - RNA, 15 nt, Homo sapiens
cccagggugugaaca

SEQ ID NO: 1684431 - RNA, 16 nt, Homo sapiens
cccaucauacacuucc

SEQ ID NO: 1684432 - RNA, 18 nt, Homo sapiens
cccaucuuuuguucuccu

SEQ ID NO: 1684433 - RNA, 22 nt, Homo sapiens
cccaugcuuuguaggugucuca

SEQ ID NO: 1684434 - RNA, 18 nt, Homo sapiens
cccaugggggcacuugag

SEQ ID NO: 1684435 - RNA, 12 nt, Homo sapiens
cccauuaaauuc

SEQ ID NO: 1684436 - RNA, 16 nt, Homo sapiens
ccccacuccagcuccu

SEQ ID NO: 1684437 - RNA, 18 nt, Homo sapiens
ccccagauaccugugagg

SEQ ID NO: 1684438 - RNA, 18 nt, Homo sapiens
ccccagcacaaagcacug

SEQ ID NO: 1684439 - RNA, 12 nt, Homo sapiens
ccccagucccag

SEQ ID NO: 1684440 - RNA, 20 nt, Homo sapiens
ccccagugacuccaggguga

SEQ ID NO: 1684441 - RNA, 16 nt, Homo sapiens
cccccagagguggaua

SEQ ID NO: 1684442 - RNA, 18 nt, Homo sapiens
ccccuacugugggcaaag

SEQ ID NO: 1684443 - RNA, 21 nt, Homo sapiens
ccccucuuugcacagcaugag

SEQ ID NO: 1684444 - RNA, 22 nt, Homo sapiens
cccgaggacgcucccugcucca

SEQ ID NO: 1684445 - RNA, 16 nt, Homo sapiens
cccuacagacagcuua

SEQ ID NO: 1684446 - RNA, 14 nt, Homo sapiens
cccuauugcugcua

SEQ ID NO: 1684447 - RNA, 22 nt, Homo sapiens
cccuccauucauccuuccaucc

SEQ ID NO: 1684448 - RNA, 17 nt, Homo sapiens
cccugauacaggcaugg

SEQ ID NO: 1684449 - RNA, 11 nt, Homo sapiens
cccugcaaaac

SEQ ID NO: 1684450 - RNA, 14 nt, Homo sapiens
cccugcaauuacuu

SEQ ID NO: 1684451 - RNA, 16 nt, Homo sapiens
cccugcucccauuccu

SEQ ID NO: 1684452 - RNA, 16 nt, Homo sapiens
cccugugagcacaaag

SEQ ID NO: 1684453 - RNA, 21 nt, Homo sapiens
cccuugugagagcccauuccc

SEQ ID NO: 1684454 - RNA, 23 nt, Homo sapiens
cccuuuccuggcagucucagucc

SEQ ID NO: 1684455 - RNA, 18 nt, Homo sapiens
ccgaagagaguucuggau

SEQ ID NO: 1684456 - RNA, 22 nt, Homo sapiens
ccgcuagcaguacuaaucaugu

SEQ ID NO: 1684457 - RNA, 12 nt, Homo sapiens
ccguagauuccc

SEQ ID NO: 1684458 - RNA, 18 nt, Homo sapiens
ccguccucucggcugcca

SEQ ID NO: 1684459 - RNA, 16 nt, Homo sapiens
ccguucagaaaaccac

SEQ ID NO: 1684460 - RNA, 14 nt, Homo sapiens
ccuaaaaguucuca

SEQ ID NO: 1684461 - RNA, 23 nt, Homo sapiens
gaugccucuugcagggucuugcu

SEQ ID NO: 1684462 - RNA, 16 nt, Homo sapiens
gauggggacauuugaa

SEQ ID NO: 1684463 - RNA, 17 nt, Homo sapiens
gauguugguaucugcag

SEQ ID NO: 1684464 - RNA, 15 nt, Homo sapiens
gauucccaccuucca

SEQ ID NO: 1684465 - RNA, 13 nt, Homo sapiens
gauucuauguuaa

SEQ ID NO: 1684466 - RNA, 13 nt, Homo sapiens
gauugaacuuucc

SEQ ID NO: 1684467 - RNA, 24 nt, Homo sapiens
gauugagaaauguguagcugcaaa

SEQ ID NO: 1684468 - RNA, 16 nt, Homo sapiens
gauuuaauccaguuau

SEQ ID NO: 1684469 - RNA, 22 nt, Homo sapiens
gauuugauugggaugaaugcca

SEQ ID NO: 1684470 - RNA, 22 nt, Homo sapiens
gauuuuuuuuaauuaccaugcu

SEQ ID NO: 1684471 - RNA, 20 nt, Homo sapiens
gcaacaugccagccacugug

SEQ ID NO: 1684472 - RNA, 18 nt, Homo sapiens
gcaacccagucacacugu

SEQ ID NO: 1684473 - RNA, 14 nt, Homo sapiens
gcaaccucuuugcu

SEQ ID NO: 1684474 - RNA, 13 nt, Homo sapiens
gcaagacugucuc

SEQ ID NO: 1684475 - RNA, 23 nt, Homo sapiens
gcaagauuccaaguucucaccuc

SEQ ID NO: 1684476 - RNA, 18 nt, Homo sapiens
gcaaguaaguaugaagga

SEQ ID NO: 1684477 - RNA, 14 nt, Homo sapiens
gcaccagggcucac

SEQ ID NO: 1684478 - RNA, 16 nt, Homo sapiens
gcagagaccauaagag

SEQ ID NO: 1684479 - RNA, 19 nt, Homo sapiens
gcagauaucugcauguguc

SEQ ID NO: 1684480 - RNA, 14 nt, Homo sapiens
gcagcugaugcugu

SEQ ID NO: 1684481 - RNA, 13 nt, Homo sapiens
gcaggacuguggg

SEQ ID NO: 1684482 - RNA, 16 nt, Homo sapiens
gcaggagucucugcca

SEQ ID NO: 1684483 - RNA, 13 nt, Homo sapiens
gcaggccagagaa

SEQ ID NO: 1684484 - RNA, 19 nt, Homo sapiens
gcaggccagagaaagcaaa

SEQ ID NO: 1684485 - RNA, 14 nt, Homo sapiens
gcagucucagucca

SEQ ID NO: 1684486 - RNA, 14 nt, Homo sapiens
gcaguuggacucuc

SEQ ID NO: 1684487 - RNA, 17 nt, Homo sapiens
gcaguuggacucucagg

SEQ ID NO: 1684488 - RNA, 23 nt, Homo sapiens
gcauaaaguaaauacaugcauau

SEQ ID NO: 1684489 - RNA, 21 nt, Homo sapiens
gcauaauguuucuggauuuca

SEQ ID NO: 1684490 - RNA, 23 nt, Homo sapiens
gcauccagugugagauacugugu

SEQ ID NO: 1684491 - RNA, 20 nt, Homo sapiens
gcaugacucuucaaccccga

SEQ ID NO: 1684492 - RNA, 17 nt, Homo sapiens
gcauuccagcugucacu

SEQ ID NO: 1684493 - RNA, 15 nt, Homo sapiens
gcauucuuugcaaua

SEQ ID NO: 1684494 - RNA, 21 nt, Homo sapiens
gcauucuuugcaauacugcuu

SEQ ID NO: 1684495 - RNA, 14 nt, Homo sapiens
gccaaaacauuuau

SEQ ID NO: 1684496 - RNA, 16 nt, Homo sapiens
gccaaauuucuuuugc

SEQ ID NO: 1684497 - RNA, 21 nt, Homo sapiens
gccaagauugcaccacugcuc

SEQ ID NO: 1684498 - RNA, 16 nt, Homo sapiens
gccaaucuguacaaaa

SEQ ID NO: 1684499 - RNA, 23 nt, Homo sapiens
gccagaacguggcucugcuggcc

SEQ ID NO: 1684500 - RNA, 16 nt, Homo sapiens
gccagcugugcacuuu

SEQ ID NO: 1684501 - RNA, 16 nt, Homo sapiens
gccagucacugcugca

SEQ ID NO: 1684502 - RNA, 16 nt, Homo sapiens
gccauccaauuucucu

SEQ ID NO: 1684503 - RNA, 16 nt, Homo sapiens
gccauuuuugugcuuu

SEQ ID NO: 1684504 - RNA, 21 nt, Homo sapiens
gccccaggguuuacaugaagc

SEQ ID NO: 1684505 - RNA, 13 nt, Homo sapiens
gccccuacugugg

SEQ ID NO: 1684506 - RNA, 14 nt, Homo sapiens
gcccuauugcugcu

SEQ ID NO: 1684507 - RNA, 14 nt, Homo sapiens
gcccucuagcuucu

SEQ ID NO: 1684508 - RNA, 15 nt, Homo sapiens
gcccucucucugggc

SEQ ID NO: 1684509 - RNA, 17 nt, Homo sapiens
gcccugcuucacugccc

SEQ ID NO: 1684510 - RNA, 16 nt, Homo sapiens
gcccuguucagcuacu

SEQ ID NO: 1684511 - RNA, 18 nt, Homo sapiens
gccgccggaguccacucc

SEQ ID NO: 1684512 - RNA, 17 nt, Homo sapiens
gccggaguccacuccca

SEQ ID NO: 1684513 - RNA, 19 nt, Homo sapiens
gccuaagaagaaggccaga

SEQ ID NO: 1684514 - RNA, 23 nt, Homo sapiens
gccucagccucccaaagugcugg

SEQ ID NO: 1684515 - RNA, 21 nt, Homo sapiens
gccucagggacgacucugacc

SEQ ID NO: 1684516 - RNA, 15 nt, Homo sapiens
gccuccccagcucac

SEQ ID NO: 1684517 - RNA, 13 nt, Homo sapiens
gccucuugcaaug

SEQ ID NO: 1684518 - RNA, 14 nt, Homo sapiens
gccuggaggcuccu

SEQ ID NO: 1684519 - RNA, 16 nt, Homo sapiens
gccugucugaagccaa

SEQ ID NO: 1684520 - RNA, 11 nt, Homo sapiens
gcuaccaacuu

SEQ ID NO: 1684521 - RNA, 18 nt, Homo sapiens
gcuaccaacuuguaucca

SEQ ID NO: 1684522 - RNA, 16 nt, Homo sapiens
gcuacuauguacugcc

SEQ ID NO: 1684523 - RNA, 16 nt, Homo sapiens
gcuacugguuaccugg

SEQ ID NO: 1684524 - RNA, 14 nt, Homo sapiens
cagagucugucucu

SEQ ID NO: 1684525 - RNA, 15 nt, Homo sapiens
cagauaccugugagg

SEQ ID NO: 1684526 - RNA, 20 nt, Homo sapiens
cagauagcacugggugugag

SEQ ID NO: 1684527 - RNA, 21 nt, Homo sapiens
cagauagcacugggugugaga

SEQ ID NO: 1684528 - RNA, 12 nt, Homo sapiens
cagaucuuucag

SEQ ID NO: 1684529 - RNA, 18 nt, Homo sapiens
cagauucuucucucucaa

SEQ ID NO: 1684530 - RNA, 16 nt, Homo sapiens
cagcagccccaggaga

SEQ ID NO: 1684531 - RNA, 16 nt, Homo sapiens
cagcaggaagccauag

SEQ ID NO: 1684532 - RNA, 18 nt, Homo sapiens
cagcaggaagccauagau

SEQ ID NO: 1684533 - RNA, 15 nt, Homo sapiens
cagcaggccagagaa

SEQ ID NO: 1684534 - RNA, 16 nt, Homo sapiens
cagcaucugcuccauc

SEQ ID NO: 1684535 - RNA, 16 nt, Homo sapiens
cagccaaaugcaggga

SEQ ID NO: 1684536 - RNA, 17 nt, Homo sapiens
cagccacuggcugcuaa

SEQ ID NO: 1684537 - RNA, 15 nt, Homo sapiens
cagccaggcaagaaa

SEQ ID NO: 1684538 - RNA, 20 nt, Homo sapiens
cagcccaccccugugcccac

SEQ ID NO: 1684539 - RNA, 19 nt, Homo sapiens
cagcccccuaaaagcacuc

SEQ ID NO: 1684540 - RNA, 19 nt, Homo sapiens
cagcccugggcacauagca

SEQ ID NO: 1684541 - RNA, 12 nt, Homo sapiens
cagccuagccua

SEQ ID NO: 1684542 - RNA, 13 nt, Homo sapiens
cagccucaaguca

SEQ ID NO: 1684543 - RNA, 17 nt, Homo sapiens
cagccucagggacgacu

SEQ ID NO: 1684544 - RNA, 20 nt, Homo sapiens
cagccucugggucugaguca

SEQ ID NO: 1684545 - RNA, 17 nt, Homo sapiens
cagccugcuucccacaa

SEQ ID NO: 1684546 - RNA, 15 nt, Homo sapiens
cagcuagugccuuua

SEQ ID NO: 1684547 - RNA, 18 nt, Homo sapiens
cagcuggccccggagcca

SEQ ID NO: 1684548 - RNA, 19 nt, Homo sapiens
cagcuggcggaggcugcuc

SEQ ID NO: 1684549 - RNA, 14 nt, Homo sapiens
cagcugugcacuuu

SEQ ID NO: 1684550 - RNA, 21 nt, Homo sapiens
cagcugugcacuuucuucucu

SEQ ID NO: 1684551 - RNA, 17 nt, Homo sapiens
cagcuucuucacaggca

SEQ ID NO: 1684552 - RNA, 15 nt, Homo sapiens
caggaaagacuggcc

SEQ ID NO: 1684553 - RNA, 15 nt, Homo sapiens
caggaccuacuagga

SEQ ID NO: 1684554 - RNA, 13 nt, Homo sapiens
caggagaaucgcu

SEQ ID NO: 1684555 - RNA, 12 nt, Homo sapiens
caggauggucau

SEQ ID NO: 1684556 - RNA, 15 nt, Homo sapiens
caggcagcugaaauu

SEQ ID NO: 1684557 - RNA, 22 nt, Homo sapiens
caggccucugggacccacagaa

SEQ ID NO: 1684558 - RNA, 19 nt, Homo sapiens
caggcuggaaguacuuggc

SEQ ID NO: 1684559 - RNA, 22 nt, Homo sapiens
cagggcucuaaugugucucuca

SEQ ID NO: 1684560 - RNA, 18 nt, Homo sapiens
caggggccaaccucaggc

SEQ ID NO: 1684561 - RNA, 23 nt, Homo sapiens
caggguggggggccauguuccca

SEQ ID NO: 1684562 - RNA, 18 nt, Homo sapiens
caggugcucaugcugcuc

SEQ ID NO: 1684563 - RNA, 23 nt, Homo sapiens
caguacaaauguuuuucauccau

SEQ ID NO: 1684564 - RNA, 20 nt, Homo sapiens
cagucacugcugcaaggugg

SEQ ID NO: 1684565 - RNA, 16 nt, Homo sapiens
cagucagaugaggcaa

SEQ ID NO: 1684566 - RNA, 17 nt, Homo sapiens
cagucccagacaauucc

SEQ ID NO: 1684567 - RNA, 18 nt, Homo sapiens
cagucuaauuacauuuca

SEQ ID NO: 1684568 - RNA, 20 nt, Homo sapiens
cagugcuugcaagauuccaa

SEQ ID NO: 1684569 - RNA, 18 nt, Homo sapiens
caguggauugauuauaaa

SEQ ID NO: 1684570 - RNA, 18 nt, Homo sapiens
cagugugagauacugugu

SEQ ID NO: 1684571 - RNA, 20 nt, Homo sapiens
caguguugccucuugcaaug

SEQ ID NO: 1684572 - RNA, 21 nt, Homo sapiens
caguuuucggaaacacugacu

SEQ ID NO: 1684573 - RNA, 22 nt, Homo sapiens
caguuuucggaaacacugacuu

SEQ ID NO: 1684574 - RNA, 20 nt, Homo sapiens
cauaaaaaguaauaaaugag

SEQ ID NO: 1684575 - RNA, 14 nt, Homo sapiens
cauaaaccugugcu

SEQ ID NO: 1684576 - RNA, 21 nt, Homo sapiens
cauaaagauauucuuuagugg

SEQ ID NO: 1684577 - RNA, 19 nt, Homo sapiens
cauaaccuugaauaaugag

SEQ ID NO: 1684578 - RNA, 21 nt, Homo sapiens
cauaauguuucuggauuucau

SEQ ID NO: 1684579 - RNA, 22 nt, Homo sapiens
cauaauuuuagaugccugugaa

SEQ ID NO: 1684580 - RNA, 14 nt, Homo sapiens
cauacaaguuucau

SEQ ID NO: 1684581 - RNA, 17 nt, Homo sapiens
cauacauauuaucucau

SEQ ID NO: 1684582 - RNA, 22 nt, Homo sapiens
cucuagguacgaugacaguguu

SEQ ID NO: 1684583 - RNA, 13 nt, Homo sapiens
cucuccaagcacu

SEQ ID NO: 1684584 - RNA, 22 nt, Homo sapiens
cucucuaaaggggacuugaggg

SEQ ID NO: 1684585 - RNA, 18 nt, Homo sapiens
cucugacuuaagcugccu

SEQ ID NO: 1684586 - RNA, 15 nt, Homo sapiens
cucuggcacagugua

SEQ ID NO: 1684587 - RNA, 12 nt, Homo sapiens
cucuguauuccg

SEQ ID NO: 1684588 - RNA, 21 nt, Homo sapiens
cucuguccuucccccagcaca

SEQ ID NO: 1684589 - RNA, 18 nt, Homo sapiens
cucuuaugugugccuuug

SEQ ID NO: 1684590 - RNA, 12 nt, Homo sapiens
cucuugacuacu

SEQ ID NO: 1684591 - RNA, 13 nt, Homo sapiens
cucuuuacuugaa

SEQ ID NO: 1684592 - RNA, 17 nt, Homo sapiens
cucuuuuaguccauuga

SEQ ID NO: 1684593 - RNA, 16 nt, Homo sapiens
cugaaaggccagcagc

SEQ ID NO: 1684594 - RNA, 19 nt, Homo sapiens
cugaacccuccaaaggaac

SEQ ID NO: 1684595 - RNA, 19 nt, Homo sapiens
cugacagccacaccguggc

SEQ ID NO: 1684596 - RNA, 14 nt, Homo sapiens
cugaccccauuccu

SEQ ID NO: 1684597 - RNA, 15 nt, Homo sapiens
cugagagacagaauu

SEQ ID NO: 1684598 - RNA, 13 nt, Homo sapiens
cugagcagcaucc

SEQ ID NO: 1684599 - RNA, 22 nt, Homo sapiens
cugaggagccugcaacaugcca

SEQ ID NO: 1684600 - RNA, 15 nt, Homo sapiens
cugaguauaaauuua

SEQ ID NO: 1684601 - RNA, 18 nt, Homo sapiens
cugaguauaaauuuacuu

SEQ ID NO: 1684602 - RNA, 14 nt, Homo sapiens
cugauaccauucua

SEQ ID NO: 1684603 - RNA, 15 nt, Homo sapiens
cugauaccauucuau

SEQ ID NO: 1684604 - RNA, 18 nt, Homo sapiens
cugauacuagacuagaca

SEQ ID NO: 1684605 - RNA, 18 nt, Homo sapiens
cugauacuuugacagugu

SEQ ID NO: 1684606 - RNA, 14 nt, Homo sapiens
cugauaguauuccu

SEQ ID NO: 1684607 - RNA, 15 nt, Homo sapiens
cugaugcugggcaau

SEQ ID NO: 1684608 - RNA, 21 nt, Homo sapiens
cugauucuggcuuuaagccuu

SEQ ID NO: 1684609 - RNA, 19 nt, Homo sapiens
cugauugcauccacuagcu

SEQ ID NO: 1684610 - RNA, 19 nt, Homo sapiens
cugcaaagucgccagucac

SEQ ID NO: 1684611 - RNA, 15 nt, Homo sapiens
cugcaaauacuguau

SEQ ID NO: 1684612 - RNA, 23 nt, Homo sapiens
cugcaacaugccagccacuguga

SEQ ID NO: 1684613 - RNA, 21 nt, Homo sapiens
cugcacacuguccuauuauau

SEQ ID NO: 1684614 - RNA, 17 nt, Homo sapiens
cugcaggccacuuaccu

SEQ ID NO: 1684615 - RNA, 21 nt, Homo sapiens
cugccauuacagagguauuaa

SEQ ID NO: 1684616 - RNA, 17 nt, Homo sapiens
cugccugucugaagcca

SEQ ID NO: 1684617 - RNA, 14 nt, Homo sapiens
cugcgacagaacuu

SEQ ID NO: 1684618 - RNA, 15 nt, Homo sapiens
cugcuaacaagucac

SEQ ID NO: 1684619 - RNA, 20 nt, Homo sapiens
cugcuaacaagucaccaaaa

SEQ ID NO: 1684620 - RNA, 21 nt, Homo sapiens
cugcuaacaagucaccaaaag

SEQ ID NO: 1684621 - RNA, 20 nt, Homo sapiens
cugcuaaggcuccuccuugc

SEQ ID NO: 1684622 - RNA, 20 nt, Homo sapiens
cugcuaagucauuggcaaag

SEQ ID NO: 1684623 - RNA, 16 nt, Homo sapiens
cugcucuauacugugg

SEQ ID NO: 1684624 - RNA, 16 nt, Homo sapiens
cugcugcacacacuca

SEQ ID NO: 1684625 - RNA, 21 nt, Homo sapiens
cugcugcacacacucaccucu

SEQ ID NO: 1684626 - RNA, 15 nt, Homo sapiens
cugcugcugcugcug

SEQ ID NO: 1684627 - RNA, 13 nt, Homo sapiens
cugcuucccuuac

SEQ ID NO: 1684628 - RNA, 22 nt, Homo sapiens
cuggaagaucagcacccuaaga

SEQ ID NO: 1684629 - RNA, 18 nt, Homo sapiens
cuggaaggaccugcuccc

SEQ ID NO: 1684630 - RNA, 20 nt, Homo sapiens
cuggagugcaauggcgcgau

SEQ ID NO: 1684631 - RNA, 19 nt, Homo sapiens
cuggcacaauguuggagca

SEQ ID NO: 1684632 - RNA, 18 nt, Homo sapiens
cuggccugagaauugagg

SEQ ID NO: 1684633 - RNA, 14 nt, Homo sapiens
cuggcugcuaacaa

SEQ ID NO: 1684634 - RNA, 18 nt, Homo sapiens
cugggacaccauuaccaa

SEQ ID NO: 1684635 - RNA, 22 nt, Homo sapiens
cugggacacuccgucugcucca

SEQ ID NO: 1684636 - RNA, 20 nt, Homo sapiens
cugggcaggguucuccaagg

SEQ ID NO: 1684637 - RNA, 13 nt, Homo sapiens
cugggccccaucu

SEQ ID NO: 1684638 - RNA, 22 nt, Homo sapiens
cugggguggagugggaagggag

SEQ ID NO: 1684639 - RNA, 16 nt, Homo sapiens
cuggguggaagugugu

SEQ ID NO: 1684640 - RNA, 16 nt, Homo sapiens
cuguaaaacagguuau

SEQ ID NO: 1684641 - RNA, 20 nt, Homo sapiens
cuguaaggcaggcccauuca

SEQ ID NO: 1684642 - RNA, 15 nt, Homo sapiens
cuguaauuccagcua

SEQ ID NO: 1684643 - RNA, 17 nt, Homo sapiens
cuguaauucuagcacuu

SEQ ID NO: 1684644 - RNA, 15 nt, Homo sapiens
ggaugaccuccagaa

SEQ ID NO: 1684645 - RNA, 22 nt, Homo sapiens
ggauggaaagacaaacugcaca

SEQ ID NO: 1684646 - RNA, 20 nt, Homo sapiens
ggauggggugggcuuagggg

SEQ ID NO: 1684647 - RNA, 15 nt, Homo sapiens
ggauguguguaaauu

SEQ ID NO: 1684648 - RNA, 20 nt, Homo sapiens
ggcaaagugacaaagcaauu

SEQ ID NO: 1684649 - RNA, 13 nt, Homo sapiens
ggcaaaugccuga

SEQ ID NO: 1684650 - RNA, 20 nt, Homo sapiens
ggcacagccuucuccacugg

SEQ ID NO: 1684651 - RNA, 20 nt, Homo sapiens
ggcacuccuggagauaugaa

SEQ ID NO: 1684652 - RNA, 18 nt, Homo sapiens
ggcaggcccauucagagc

SEQ ID NO: 1684653 - RNA, 14 nt, Homo sapiens
ggcaggccucccaa

SEQ ID NO: 1684654 - RNA, 12 nt, Homo sapiens
ggcaugggagac

SEQ ID NO: 1684655 - RNA, 21 nt, Homo sapiens
ggccaaagagucuccaguuua

SEQ ID NO: 1684656 - RNA, 23 nt, Homo sapiens
ggccaggugguugucuuauugca

SEQ ID NO: 1684657 - RNA, 20 nt, Homo sapiens
ggccauguucccagaaccuu

SEQ ID NO: 1684658 - RNA, 13 nt, Homo sapiens
ggccccaucucca

SEQ ID NO: 1684659 - RNA, 18 nt, Homo sapiens
ggccccaucuccacagga

SEQ ID NO: 1684660 - RNA, 16 nt, Homo sapiens
ggcccugugagcacaa

SEQ ID NO: 1684661 - RNA, 16 nt, Homo sapiens
ggccucaccccaggga

SEQ ID NO: 1684662 - RNA, 14 nt, Homo sapiens
ggccucccaagcug

SEQ ID NO: 1684663 - RNA, 17 nt, Homo sapiens
ggccuuccuccucucaa

SEQ ID NO: 1684664 - RNA, 21 nt, Homo sapiens
ggcuccgggcaccaggggcca

SEQ ID NO: 1684665 - RNA, 13 nt, Homo sapiens
ggcucuagggccu

SEQ ID NO: 1684666 - RNA, 19 nt, Homo sapiens
ggcucuuaugugugccuuu

SEQ ID NO: 1684667 - RNA, 20 nt, Homo sapiens
ggcucuuaugugugccuuug

SEQ ID NO: 1684668 - RNA, 22 nt, Homo sapiens
ggcugcuaacaagucaccaaaa

SEQ ID NO: 1684669 - RNA, 16 nt, Homo sapiens
ggcuuuguugugagaa

SEQ ID NO: 1684670 - RNA, 12 nt, Homo sapiens
gggacuaggacc

SEQ ID NO: 1684671 - RNA, 15 nt, Homo sapiens
gggacuaggaccuga

SEQ ID NO: 1684672 - RNA, 13 nt, Homo sapiens
gggauggguccuc

SEQ ID NO: 1684673 - RNA, 13 nt, Homo sapiens
gggauuacaggcg

SEQ ID NO: 1684674 - RNA, 15 nt, Homo sapiens
gggcaggccucccaa

SEQ ID NO: 1684675 - RNA, 15 nt, Homo sapiens
gggccaaccucaggc

SEQ ID NO: 1684676 - RNA, 17 nt, Homo sapiens
gggcccccacaggggau

SEQ ID NO: 1684677 - RNA, 18 nt, Homo sapiens
gggcucuaaugugucucu

SEQ ID NO: 1684678 - RNA, 15 nt, Homo sapiens
ggggcucuguggcaa

SEQ ID NO: 1684679 - RNA, 22 nt, Homo sapiens
gggucuugcuuucuuugaccuc

SEQ ID NO: 1684680 - RNA, 15 nt, Homo sapiens
gguaaaggucugugg

SEQ ID NO: 1684681 - RNA, 13 nt, Homo sapiens
gguaaauguuucu

SEQ ID NO: 1684682 - RNA, 20 nt, Homo sapiens
gguaauaaaugugacucagc

SEQ ID NO: 1684683 - RNA, 20 nt, Homo sapiens
gguaauguuaguaaauccau

SEQ ID NO: 1684684 - RNA, 12 nt, Homo sapiens
gguaugauuaac

SEQ ID NO: 1684685 - RNA, 13 nt, Homo sapiens
ggucagggugaga

SEQ ID NO: 1684686 - RNA, 19 nt, Homo sapiens
ggucuguguucgacucagc

SEQ ID NO: 1684687 - RNA, 14 nt, Homo sapiens
ggugaaaucccugc

SEQ ID NO: 1684688 - RNA, 16 nt, Homo sapiens
ggugacaguucccaga

SEQ ID NO: 1684689 - RNA, 12 nt, Homo sapiens
ggugcucacucc

SEQ ID NO: 1684690 - RNA, 21 nt, Homo sapiens
gguggaggcagaggugacagu

SEQ ID NO: 1684691 - RNA, 13 nt, Homo sapiens
ggugucagagcug

SEQ ID NO: 1684692 - RNA, 14 nt, Homo sapiens
gguucugaggccag

SEQ ID NO: 1684693 - RNA, 14 nt, Homo sapiens
gguuucugauugca

SEQ ID NO: 1684694 - RNA, 14 nt, Homo sapiens
guaaaauuauuuca

SEQ ID NO: 1684695 - RNA, 20 nt, Homo sapiens
guaaacuucugcaacaagca

SEQ ID NO: 1684696 - RNA, 16 nt, Homo sapiens
guaaucucagcacuuu

SEQ ID NO: 1684697 - RNA, 20 nt, Homo sapiens
guaauguuaguaaauccaug

SEQ ID NO: 1684698 - RNA, 15 nt, Homo sapiens
guacaggucaucugc

SEQ ID NO: 1684699 - RNA, 20 nt, Homo sapiens
guacuaacuagcauuguaaa

SEQ ID NO: 1684700 - RNA, 17 nt, Homo sapiens
guacugugucucaugga

SEQ ID NO: 1684701 - RNA, 21 nt, Homo sapiens
guagaaacugaggcccagaga

SEQ ID NO: 1684702 - RNA, 18 nt, Homo sapiens
guagauguggccuuugaa

SEQ ID NO: 1684703 - RNA, 10 nt, Homo sapiens
guagauuccc

SEQ ID NO: 1684704 - RNA, 20 nt, Homo sapiens
guagcugggauuacaggcgu

SEQ ID NO: 1684705 - RNA, 21 nt, Homo sapiens
guagcugugaaauccauauau

SEQ ID NO: 1684706 - RNA, 19 nt, Homo sapiens
guaggaaccgaucugcuau

SEQ ID NO: 1684707 - RNA, 13 nt, Homo sapiens
guaggugucucau

SEQ ID NO: 1684708 - RNA, 13 nt, Homo sapiens
aaaaaacuuugac

SEQ ID NO: 1684709 - RNA, 21 nt, Homo sapiens
aaaaacacccgacgucaugua

SEQ ID NO: 1684710 - RNA, 21 nt, Homo sapiens
aaaacaaugguguggugaaug

SEQ ID NO: 1684711 - RNA, 17 nt, Homo sapiens
aaaacaauucugugaca

SEQ ID NO: 1684712 - RNA, 13 nt, Homo sapiens
aaaacauguuaau

SEQ ID NO: 1684713 - RNA, 12 nt, Homo sapiens
aaaacauuugcu

SEQ ID NO: 1684714 - RNA, 15 nt, Homo sapiens
aaaagacacugcaga

SEQ ID NO: 1684715 - RNA, 20 nt, Homo sapiens
aaaaggaaagcuguguuuau

SEQ ID NO: 1684716 - RNA, 17 nt, Homo sapiens
aaaauacuauugccuca

SEQ ID NO: 1684717 - RNA, 20 nt, Homo sapiens
aaaaugcaagccaucucuaa

SEQ ID NO: 1684718 - RNA, 14 nt, Homo sapiens
aaaaugucaucuca

SEQ ID NO: 1684719 - RNA, 16 nt, Homo sapiens
aaaauguuuguuaaag

SEQ ID NO: 1684720 - RNA, 17 nt, Homo sapiens
aaaauuccaaauucaug

SEQ ID NO: 1684721 - RNA, 21 nt, Homo sapiens
aaacacccgacgucauguauu

SEQ ID NO: 1684722 - RNA, 13 nt, Homo sapiens
aaacacuauuugu

SEQ ID NO: 1684723 - RNA, 13 nt, Homo sapiens
aaacacugaauua

SEQ ID NO: 1684724 - RNA, 18 nt, Homo sapiens
aaacaugggcugugauua

SEQ ID NO: 1684725 - RNA, 19 nt, Homo sapiens
aaacauguuaaugacaaua

SEQ ID NO: 1684726 - RNA, 17 nt, Homo sapiens
aaacccccacuccagcu

SEQ ID NO: 1684727 - RNA, 19 nt, Homo sapiens
aaacuauaagccaauauuc

SEQ ID NO: 1684728 - RNA, 23 nt, Homo sapiens
aaacugcuucccuuacuuugcug

SEQ ID NO: 1684729 - RNA, 21 nt, Homo sapiens
aaacuucaccuacauuaucuc

SEQ ID NO: 1684730 - RNA, 23 nt, Homo sapiens
aaacuucaccuacauuaucucac

SEQ ID NO: 1684731 - RNA, 20 nt, Homo sapiens
aaagaaguacuguacuuucc

SEQ ID NO: 1684732 - RNA, 13 nt, Homo sapiens
aaagacacugcag

SEQ ID NO: 1684733 - RNA, 17 nt, Homo sapiens
aaagacuggauuugcag

SEQ ID NO: 1684734 - RNA, 19 nt, Homo sapiens
aaagagccuaacaucucca

SEQ ID NO: 1684735 - RNA, 17 nt, Homo sapiens
aaagccagccaagcuuu

SEQ ID NO: 1684736 - RNA, 19 nt, Homo sapiens
aaagccucuuuuaguccau

SEQ ID NO: 1684737 - RNA, 16 nt, Homo sapiens
aaagcuucacaguacc

SEQ ID NO: 1684738 - RNA, 15 nt, Homo sapiens
aaaggaugugauaua

SEQ ID NO: 1684739 - RNA, 23 nt, Homo sapiens
aaaggauucuauaucaugaccaa

SEQ ID NO: 1684740 - RNA, 14 nt, Homo sapiens
aaagguuuuccuua

SEQ ID NO: 1684741 - RNA, 18 nt, Homo sapiens
aaaguacauauauuuugc

SEQ ID NO: 1684742 - RNA, 13 nt, Homo sapiens
aaaguacuugacu

SEQ ID NO: 1684743 - RNA, 15 nt, Homo sapiens
aaagucgccagucac

SEQ ID NO: 1684744 - RNA, 17 nt, Homo sapiens
aaagugagacauuguga

SEQ ID NO: 1684745 - RNA, 17 nt, Homo sapiens
aaaguguaccaacauaa

SEQ ID NO: 1684746 - RNA, 22 nt, Homo sapiens
aaagugucaccccucacuguga

SEQ ID NO: 1684747 - RNA, 13 nt, Homo sapiens
aaagugugugauu

SEQ ID NO: 1684748 - RNA, 13 nt, Homo sapiens
aaauacugaauua

SEQ ID NO: 1684749 - RNA, 18 nt, Homo sapiens
aaaucaugccaguauuuu

SEQ ID NO: 1684750 - RNA, 14 nt, Homo sapiens
aaaucccucucaca

SEQ ID NO: 1684751 - RNA, 23 nt, Homo sapiens
aaaugcaagccaucucuaauaau

SEQ ID NO: 1684752 - RNA, 11 nt, Homo sapiens
aaaugucuugc

SEQ ID NO: 1684753 - RNA, 13 nt, Homo sapiens
aaaugugacucag

SEQ ID NO: 1684754 - RNA, 18 nt, Homo sapiens
aaaugugacucagcauca

SEQ ID NO: 1684755 - RNA, 12 nt, Homo sapiens
aaauguguaaua

SEQ ID NO: 1684756 - RNA, 15 nt, Homo sapiens
aaauucaacuuugua

SEQ ID NO: 1684757 - RNA, 17 nt, Homo sapiens
aaauugggaaaacucca

SEQ ID NO: 1684758 - RNA, 14 nt, Homo sapiens
aaauuuaauaccag

SEQ ID NO: 1684759 - RNA, 14 nt, Homo sapiens
aacaaagacuuuga

SEQ ID NO: 1684760 - RNA, 22 nt, Homo sapiens
aacaaaguuucagaguauauug

SEQ ID NO: 1684761 - RNA, 12 nt, Homo sapiens
aacaacauuuau

SEQ ID NO: 1684762 - RNA, 21 nt, Homo sapiens
aacacacaggugcaacagacu

SEQ ID NO: 1684763 - RNA, 10 nt, Homo sapiens
aacaccagaa

SEQ ID NO: 1684764 - RNA, 17 nt, Homo sapiens
aacacucaacaaacuua

SEQ ID NO: 1684765 - RNA, 22 nt, Homo sapiens
aacagaaagccugggugacauu

SEQ ID NO: 1684766 - RNA, 16 nt, Homo sapiens
aacagaauuuuccauu

SEQ ID NO: 1684767 - RNA, 22 nt, Homo sapiens
aacaggugucagagcugaaauu

SEQ ID NO: 1684768 - RNA, 22 nt, Homo sapiens
aacauaaguguugguagcacuu

SEQ ID NO: 1684769 - RNA, 13 nt, Homo sapiens
aacaucuccaugg

SEQ ID NO: 1684770 - RNA, 20 nt, Homo sapiens
aacaugccagccacugugau

SEQ ID NO: 1684771 - RNA, 21 nt, Homo sapiens
aacccugacuccucuuugugc

SEQ ID NO: 1684772 - RNA, 23 nt, Homo sapiens
aacccugacuccucuuugugcag

SEQ ID NO: 1684773 - RNA, 13 nt, Homo sapiens
aaccuacaguuuu

SEQ ID NO: 1684774 - RNA, 18 nt, Homo sapiens
aaccuugaccgacaugaa

SEQ ID NO: 1684775 - RNA, 14 nt, Homo sapiens
aacuccucaugucu

SEQ ID NO: 1684776 - RNA, 21 nt, Homo sapiens
aacuccugucuucuuucucca

SEQ ID NO: 1684777 - RNA, 19 nt, Homo sapiens
aacugagguucuugggaua

SEQ ID NO: 1684778 - RNA, 21 nt, Homo sapiens
aacugcuucccuuacuuugcu

SEQ ID NO: 1684779 - RNA, 20 nt, Homo sapiens
aacugugaauacuugaacuc

SEQ ID NO: 1684780 - RNA, 16 nt, Homo sapiens
aacuucaccuacauua

SEQ ID NO: 1684781 - RNA, 21 nt, Homo sapiens
aagaaaugggugaaugagcuu

SEQ ID NO: 1684782 - RNA, 22 nt, Homo sapiens
aagaagagcgagagaucaaaga

SEQ ID NO: 1684783 - RNA, 16 nt, Homo sapiens
aagaagugagcagugu

SEQ ID NO: 1684784 - RNA, 17 nt, Homo sapiens
aagaccagccuggccaa

SEQ ID NO: 1684785 - RNA, 13 nt, Homo sapiens
aagacccucccau

SEQ ID NO: 1684786 - RNA, 20 nt, Homo sapiens
aagagggaggggcccuguca

SEQ ID NO: 1684787 - RNA, 17 nt, Homo sapiens
aagaguaagcaguguua

SEQ ID NO: 1684788 - RNA, 22 nt, Homo sapiens
aagaguacagaagcuuuagcaa

SEQ ID NO: 1684789 - RNA, 15 nt, Homo sapiens
aagaugcaucaucuc

SEQ ID NO: 1684790 - RNA, 16 nt, Homo sapiens
aagaugcaucaucucu

SEQ ID NO: 1684791 - RNA, 15 nt, Homo sapiens
aagauugcaccacug

SEQ ID NO: 1684792 - RNA, 14 nt, Homo sapiens
aagcaaauggccaa

SEQ ID NO: 1684793 - RNA, 20 nt, Homo sapiens
aagcaauucuccugccuuag

SEQ ID NO: 1684794 - RNA, 13 nt, Homo sapiens
aagcacuagccuu

SEQ ID NO: 1684795 - RNA, 16 nt, Homo sapiens
aagccggccugagaaa

SEQ ID NO: 1684796 - RNA, 18 nt, Homo sapiens
aagcugccucaaggaauu

SEQ ID NO: 1684797 - RNA, 14 nt, Homo sapiens
aagcuuccuucaac

SEQ ID NO: 1684798 - RNA, 20 nt, Homo sapiens
aaggacuucacugcaaguuu

SEQ ID NO: 1684799 - RNA, 16 nt, Homo sapiens
aaggauuacucuccau

SEQ ID NO: 1684800 - RNA, 15 nt, Homo sapiens
aaggauucuauauca

SEQ ID NO: 1684801 - RNA, 12 nt, Homo sapiens
aaggcucagacu

SEQ ID NO: 1684802 - RNA, 16 nt, Homo sapiens
aagggggcugcugcuc

SEQ ID NO: 1684803 - RNA, 14 nt, Homo sapiens
aaggggugggccac

SEQ ID NO: 1684804 - RNA, 12 nt, Homo sapiens
aaggugaacuuu

SEQ ID NO: 1684805 - RNA, 18 nt, Homo sapiens
aaguacagggcagaacca

SEQ ID NO: 1684806 - RNA, 22 nt, Homo sapiens
aaguacagggcagaaccaagaa

SEQ ID NO: 1684807 - RNA, 19 nt, Homo sapiens
aaguagaaaugggauguuu

SEQ ID NO: 1684808 - RNA, 17 nt, Homo sapiens
aagucccuuugugacuu

SEQ ID NO: 1684809 - RNA, 22 nt, Homo sapiens
aagucugguaauaaaugugacu

SEQ ID NO: 1684810 - RNA, 23 nt, Homo sapiens
aagugauagaaaaguguggcuug

SEQ ID NO: 1684811 - RNA, 21 nt, Homo sapiens
aagugucaccccucacuguga

SEQ ID NO: 1684812 - RNA, 20 nt, Homo sapiens
aaguuggaagggaccccaga

SEQ ID NO: 1684813 - RNA, 14 nt, Homo sapiens
aaguuuuacugucu

SEQ ID NO: 1684814 - RNA, 13 nt, Homo sapiens
aauaaaagcacuu

SEQ ID NO: 1684815 - RNA, 18 nt, Homo sapiens
aauaaaaggaaucuuccu

SEQ ID NO: 1684816 - RNA, 12 nt, Homo sapiens
aauaaacugugc

SEQ ID NO: 1684817 - RNA, 22 nt, Homo sapiens
aauaaauguugcaaugcaugau

SEQ ID NO: 1684818 - RNA, 16 nt, Homo sapiens
aauaacaaacuaguca

SEQ ID NO: 1684819 - RNA, 19 nt, Homo sapiens
aauaacagccauagugugu

SEQ ID NO: 1684820 - RNA, 16 nt, Homo sapiens
aauaacaucaccacug

SEQ ID NO: 1684821 - RNA, 19 nt, Homo sapiens
aauaauggaaaaugccaug

SEQ ID NO: 1684822 - RNA, 22 nt, Homo sapiens
aauaauuuccuucaggcagcug

SEQ ID NO: 1684823 - RNA, 22 nt, Homo sapiens
aauagacuuaaaucucauugcu

SEQ ID NO: 1684824 - RNA, 19 nt, Homo sapiens
aauaggcuauuaaaaaagu

SEQ ID NO: 1684825 - RNA, 13 nt, Homo sapiens
aauauagugcaau

SEQ ID NO: 1684826 - RNA, 17 nt, Homo sapiens
aauaucccuacauguau

SEQ ID NO: 1684827 - RNA, 18 nt, Homo sapiens
aauauuaaaaaacuucau

SEQ ID NO: 1684828 - RNA, 20 nt, Homo sapiens
aauauuuaagacacugaaaa

SEQ ID NO: 1684829 - RNA, 16 nt, Homo sapiens
aauauuuucauuguga

SEQ ID NO: 1684830 - RNA, 20 nt, Homo sapiens
aaucagauucuucucucuca

SEQ ID NO: 1684831 - RNA, 18 nt, Homo sapiens
aaucagcuuuguaacugu

SEQ ID NO: 1684832 - RNA, 22 nt, Homo sapiens
aauccaugguguuauuuucuga

SEQ ID NO: 1684833 - RNA, 21 nt, Homo sapiens
aauccccacaggcacauuaac

SEQ ID NO: 1684834 - RNA, 15 nt, Homo sapiens
aaucccucucacaag

SEQ ID NO: 1684835 - RNA, 22 nt, Homo sapiens
aauccuacuuuucgaacaccaa

SEQ ID NO: 1684836 - RNA, 17 nt, Homo sapiens
aaucuuccuggcacaau

SEQ ID NO: 1684837 - RNA, 14 nt, Homo sapiens
aaugacucaaaguc

SEQ ID NO: 1684838 - RNA, 23 nt, Homo sapiens
aaugauuucacagugugugguca

SEQ ID NO: 1684839 - RNA, 14 nt, Homo sapiens
aaugccaugaauua

SEQ ID NO: 1684840 - RNA, 19 nt, Homo sapiens
aaugccccuguucauguuu

SEQ ID NO: 1684841 - RNA, 14 nt, Homo sapiens
aaugccugacucag

SEQ ID NO: 1684842 - RNA, 21 nt, Homo sapiens
aaugcuaaagaauccauaaaa

SEQ ID NO: 1684843 - RNA, 17 nt, Homo sapiens
aaugcucccaccugaau

SEQ ID NO: 1684844 - RNA, 20 nt, Homo sapiens
aaugcugcccucacugccuc

SEQ ID NO: 1684845 - RNA, 19 nt, Homo sapiens
aauggcagcuagugccuuu

SEQ ID NO: 1684846 - RNA, 18 nt, Homo sapiens
aauggcauggcaggaguc

SEQ ID NO: 1684847 - RNA, 20 nt, Homo sapiens
aauggcgcgaucuuggcuca

SEQ ID NO: 1684848 - RNA, 17 nt, Homo sapiens
aaugguugaugauacuu

SEQ ID NO: 1684849 - RNA, 12 nt, Homo sapiens
aauguccagcca

SEQ ID NO: 1684850 - RNA, 22 nt, Homo sapiens
aaugugcuggugaacacuguga

SEQ ID NO: 1684851 - RNA, 17 nt, Homo sapiens
aauguucuccagucauu

SEQ ID NO: 1684852 - RNA, 11 nt, Homo sapiens
aauuaccaugc

SEQ ID NO: 1684853 - RNA, 14 nt, Homo sapiens
aauuaccuguggau

SEQ ID NO: 1684854 - RNA, 15 nt, Homo sapiens
aauuauuucucucac

SEQ ID NO: 1684855 - RNA, 13 nt, Homo sapiens
aauucaacuuugu

SEQ ID NO: 1684856 - RNA, 16 nt, Homo sapiens
aauucaauccuacuuu

SEQ ID NO: 1684857 - RNA, 13 nt, Homo sapiens
aauucagcacuua

SEQ ID NO: 1684858 - RNA, 14 nt, Homo sapiens
aauucagcacuuaa

SEQ ID NO: 1684859 - RNA, 16 nt, Homo sapiens
aauucuaacaagucau

SEQ ID NO: 1684860 - RNA, 15 nt, Homo sapiens
aauucucuagauuua

SEQ ID NO: 1684861 - RNA, 11 nt, Homo sapiens
aauucugugac

SEQ ID NO: 1684862 - RNA, 16 nt, Homo sapiens
aauucugugacauaca

SEQ ID NO: 1684863 - RNA, 19 nt, Homo sapiens
aauucuuccuaaugucaga

SEQ ID NO: 1684864 - RNA, 23 nt, Homo sapiens
aauugaguugcacuuauugacca

SEQ ID NO: 1684865 - RNA, 21 nt, Homo sapiens
aauuuggagcacaaaauucaa

SEQ ID NO: 1684866 - RNA, 15 nt, Homo sapiens
aauuuggcuaauaac

SEQ ID NO: 1684867 - RNA, 12 nt, Homo sapiens
acaaaaauauua

SEQ ID NO: 1684868 - RNA, 15 nt, Homo sapiens
acaaacaucauuguu

SEQ ID NO: 1684869 - RNA, 15 nt, Homo sapiens
acaaagaaacaaaga

SEQ ID NO: 1684870 - RNA, 11 nt, Homo sapiens
acaaagcaauu

SEQ ID NO: 1684871 - RNA, 19 nt, Homo sapiens
acaaaggauacuuuuacag

SEQ ID NO: 1684872 - RNA, 14 nt, Homo sapiens
acaaaguacauucu

SEQ ID NO: 1684873 - RNA, 10 nt, Homo sapiens
acaacccagg

SEQ ID NO: 1684874 - RNA, 14 nt, Homo sapiens
acaaccuuccagcu

SEQ ID NO: 1684875 - RNA, 12 nt, Homo sapiens
acaaccuugucc

SEQ ID NO: 1684876 - RNA, 13 nt, Homo sapiens
acaacugauugca

SEQ ID NO: 1684877 - RNA, 20 nt, Homo sapiens
acaagaacuuuaaauugugu

SEQ ID NO: 1684878 - RNA, 15 nt, Homo sapiens
acaagccagccaacu

SEQ ID NO: 1684879 - RNA, 22 nt, Homo sapiens
acaaggccugcuugacuuucca

SEQ ID NO: 1684880 - RNA, 19 nt, Homo sapiens
acaagugcuguugggauau

SEQ ID NO: 1684881 - RNA, 20 nt, Homo sapiens
acaagugguguuuauugcaa

SEQ ID NO: 1684882 - RNA, 21 nt, Homo sapiens
acaagugguguuuauugcaau

SEQ ID NO: 1684883 - RNA, 15 nt, Homo sapiens
acaauaaagaucgcc

SEQ ID NO: 1684884 - RNA, 21 nt, Homo sapiens
acaauauuccagaucuuucag

SEQ ID NO: 1684885 - RNA, 23 nt, Homo sapiens
acaauucugugacauacauauua

SEQ ID NO: 1684886 - RNA, 12 nt, Homo sapiens
acacaaagggaa

SEQ ID NO: 1684887 - RNA, 15 nt, Homo sapiens
acacauauccacaaa

SEQ ID NO: 1684888 - RNA, 12 nt, Homo sapiens
acacuuuugcuu

SEQ ID NO: 1684889 - RNA, 12 nt, Homo sapiens
acagaauauucu

SEQ ID NO: 1684890 - RNA, 18 nt, Homo sapiens
acagaauuaagaaauacu

SEQ ID NO: 1684891 - RNA, 20 nt, Homo sapiens
acagacagcuuacaggagcc

SEQ ID NO: 1684892 - RNA, 13 nt, Homo sapiens
acagagugcaacc

SEQ ID NO: 1684893 - RNA, 17 nt, Homo sapiens
acagagugcaacccagu

SEQ ID NO: 1684894 - RNA, 19 nt, Homo sapiens
acagccaggcggcuggaau

SEQ ID NO: 1684895 - RNA, 23 nt, Homo sapiens
acagcucuccuccagcccugggc

SEQ ID NO: 1684896 - RNA, 14 nt, Homo sapiens
acagcugugcucca

SEQ ID NO: 1684897 - RNA, 20 nt, Homo sapiens
acaggcacauuaacuguugc

SEQ ID NO: 1684898 - RNA, 21 nt, Homo sapiens
acaggcagauguuugccucau

SEQ ID NO: 1684899 - RNA, 18 nt, Homo sapiens
acagguuauaacaguguu

SEQ ID NO: 1684900 - RNA, 15 nt, Homo sapiens
acaguuuuaagcaga

SEQ ID NO: 1684901 - RNA, 18 nt, Homo sapiens
acaguuuuugacauuuau

SEQ ID NO: 1684902 - RNA, 17 nt, Homo sapiens
acauacauauuaucuca

SEQ ID NO: 1684903 - RNA, 15 nt, Homo sapiens
acauaguuguauaua

SEQ ID NO: 1684904 - RNA, 15 nt, Homo sapiens
acauaugugcuggaa

SEQ ID NO: 1684905 - RNA, 16 nt, Homo sapiens
acauauguugcaagac

SEQ ID NO: 1684906 - RNA, 14 nt, Homo sapiens
acauauuaucucau

SEQ ID NO: 1684907 - RNA, 20 nt, Homo sapiens
acauccuccagauaguguag

SEQ ID NO: 1684908 - RNA, 23 nt, Homo sapiens
acauccuuucuuuuaaugaugcc

SEQ ID NO: 1684909 - RNA, 21 nt, Homo sapiens
acaucuccuguggucucugac

SEQ ID NO: 1684910 - RNA, 20 nt, Homo sapiens
acaugccucugccaaaggau

SEQ ID NO: 1684911 - RNA, 13 nt, Homo sapiens
acauuaaugccug

SEQ ID NO: 1684912 - RNA, 16 nt, Homo sapiens
acauuucuucuaguga

SEQ ID NO: 1684913 - RNA, 14 nt, Homo sapiens
acauuucuuugcau

SEQ ID NO: 1684914 - RNA, 18 nt, Homo sapiens
acauuuuauuaagcuuuu

SEQ ID NO: 1684915 - RNA, 13 nt, Homo sapiens
accagcccacccc

SEQ ID NO: 1684916 - RNA, 18 nt, Homo sapiens
accaggggccaaccucag

SEQ ID NO: 1684917 - RNA, 16 nt, Homo sapiens
accagguuugcaggag

SEQ ID NO: 1684918 - RNA, 13 nt, Homo sapiens
accauuaccaaaa

SEQ ID NO: 1684919 - RNA, 21 nt, Homo sapiens
accauuuuuuaauuuacuugu

SEQ ID NO: 1684920 - RNA, 23 nt, Homo sapiens
acccagggugugaacauguucuc

SEQ ID NO: 1684921 - RNA, 14 nt, Homo sapiens
accccaaacccauc

SEQ ID NO: 1684922 - RNA, 23 nt, Homo sapiens
accccaagggggcugcugcuccu

SEQ ID NO: 1684923 - RNA, 15 nt, Homo sapiens
accccguagauuccc

SEQ ID NO: 1684924 - RNA, 17 nt, Homo sapiens
accccgucacagccuca

SEQ ID NO: 1684925 - RNA, 14 nt, Homo sapiens
accccucacuguga

SEQ ID NO: 1684926 - RNA, 23 nt, Homo sapiens
acccugacuccucuuugugcaga

SEQ ID NO: 1684927 - RNA, 20 nt, Homo sapiens
acccuggagguaaacaaaga

SEQ ID NO: 1684928 - RNA, 21 nt, Homo sapiens
accgucuucucccuauucccu

SEQ ID NO: 1684929 - RNA, 19 nt, Homo sapiens
accuauggcaauuuagcuc

SEQ ID NO: 1684930 - RNA, 22 nt, Homo sapiens
accucaacauugcauggugcua

SEQ ID NO: 1684931 - RNA, 21 nt, Homo sapiens
accuccccacccgcucccaca

SEQ ID NO: 1684932 - RNA, 13 nt, Homo sapiens
accuccucauggc

SEQ ID NO: 1684933 - RNA, 15 nt, Homo sapiens
accuccuuagcccug

SEQ ID NO: 1684934 - RNA, 16 nt, Homo sapiens
accugccaaggagcau

SEQ ID NO: 1684935 - RNA, 20 nt, Homo sapiens
accuggagcuucagccaggu

SEQ ID NO: 1684936 - RNA, 17 nt, Homo sapiens
accuugaccgacaugaa

SEQ ID NO: 1684937 - RNA, 19 nt, Homo sapiens
acgaagaguucccuugaaa

SEQ ID NO: 1684938 - RNA, 20 nt, Homo sapiens
acgaguguagucccggaggc

SEQ ID NO: 1684939 - RNA, 22 nt, Homo sapiens
acguggugcuucucacacugga

SEQ ID NO: 1684940 - RNA, 17 nt, Homo sapiens
acuaaacuucaccuaca

SEQ ID NO: 1684941 - RNA, 18 nt, Homo sapiens
acuaaagacgguauuaaa

SEQ ID NO: 1684942 - RNA, 16 nt, Homo sapiens
acuaacaggccaaaga

SEQ ID NO: 1684943 - RNA, 20 nt, Homo sapiens
acuaacgaaauaucaaaguc

SEQ ID NO: 1684944 - RNA, 22 nt, Homo sapiens
acuaacgcaaccaagugugcua

SEQ ID NO: 1684945 - RNA, 21 nt, Homo sapiens
acuacuuggaacuaggcucuu

SEQ ID NO: 1684946 - RNA, 23 nt, Homo sapiens
acuaggcucuuaugugugccuuu

SEQ ID NO: 1684947 - RNA, 15 nt, Homo sapiens
acuauggagugcuca

SEQ ID NO: 1684948 - RNA, 14 nt, Homo sapiens
acuauguacugccu

SEQ ID NO: 1684949 - RNA, 15 nt, Homo sapiens
acuauguacugccuu

SEQ ID NO: 1684950 - RNA, 15 nt, Homo sapiens
acucaccugcacuaa

SEQ ID NO: 1684951 - RNA, 23 nt, Homo sapiens
acucauagcgggggccuaaaaaa

SEQ ID NO: 1684952 - RNA, 14 nt, Homo sapiens
acuccugcuuaauc

SEQ ID NO: 1684953 - RNA, 17 nt, Homo sapiens
acucuaggcagugacag

SEQ ID NO: 1684954 - RNA, 14 nt, Homo sapiens
acucugcugucuaa

SEQ ID NO: 1684955 - RNA, 23 nt, Homo sapiens
acucuuugguuuuaucauuccau

SEQ ID NO: 1684956 - RNA, 20 nt, Homo sapiens
acugacccugauacaggcau

SEQ ID NO: 1684957 - RNA, 21 nt, Homo sapiens
acugaugaguuucacuguacu

SEQ ID NO: 1684958 - RNA, 15 nt, Homo sapiens
acuggaaagcacaag

SEQ ID NO: 1684959 - RNA, 13 nt, Homo sapiens
acuggacccuguu

SEQ ID NO: 1684960 - RNA, 15 nt, Homo sapiens
acuggcaugggagac

SEQ ID NO: 1684961 - RNA, 14 nt, Homo sapiens
acuggcccucuagc

SEQ ID NO: 1684962 - RNA, 21 nt, Homo sapiens
acuggcuuaccuccucauggc

SEQ ID NO: 1684963 - RNA, 13 nt, Homo sapiens
acugugugccagg

SEQ ID NO: 1684964 - RNA, 13 nt, Homo sapiens
acuuaacuaugag

SEQ ID NO: 1684965 - RNA, 15 nt, Homo sapiens
acuucaaagugccug

SEQ ID NO: 1684966 - RNA, 19 nt, Homo sapiens
acuucaaggcucaaugcua

SEQ ID NO: 1684967 - RNA, 16 nt, Homo sapiens
acuucugggggucacu

SEQ ID NO: 1684968 - RNA, 13 nt, Homo sapiens
acuucuugaauau

SEQ ID NO: 1684969 - RNA, 21 nt, Homo sapiens
acuugaaagaaauggugaaug

SEQ ID NO: 1684970 - RNA, 21 nt, Homo sapiens
acuugaaauuuggcuaauaac

SEQ ID NO: 1684971 - RNA, 19 nt, Homo sapiens
acuugaaugcuaguuauac

SEQ ID NO: 1684972 - RNA, 22 nt, Homo sapiens
acuugcaguuagacucaaagaa

SEQ ID NO: 1684973 - RNA, 18 nt, Homo sapiens
acuuucaagaaucagaca

SEQ ID NO: 1684974 - RNA, 14 nt, Homo sapiens
acuuugacaguguu

SEQ ID NO: 1684975 - RNA, 13 nt, Homo sapiens
acuuugaccuaaa

SEQ ID NO: 1684976 - RNA, 15 nt, Homo sapiens
acuuuguauuuugau

SEQ ID NO: 1684977 - RNA, 13 nt, Homo sapiens
acuuuugcuugaa

SEQ ID NO: 1684978 - RNA, 17 nt, Homo sapiens
agaaacaaagauguuau

SEQ ID NO: 1684979 - RNA, 15 nt, Homo sapiens
agaaaccacuagaaa

SEQ ID NO: 1684980 - RNA, 18 nt, Homo sapiens
agaaaccugccaaggagc

SEQ ID NO: 1684981 - RNA, 16 nt, Homo sapiens
agaaaucuaagcugug

SEQ ID NO: 1684982 - RNA, 16 nt, Homo sapiens
agaaaugccccagugu

SEQ ID NO: 1684983 - RNA, 15 nt, Homo sapiens
agaaccaagaacaua

SEQ ID NO: 1684984 - RNA, 16 nt, Homo sapiens
agaacguggcucugcu

SEQ ID NO: 1684985 - RNA, 21 nt, Homo sapiens
agaacuuagccuuuaccugug

SEQ ID NO: 1684986 - RNA, 19 nt, Homo sapiens
agaacuucagcauuguaau

SEQ ID NO: 1684987 - RNA, 14 nt, Homo sapiens
agaagcauuuugca

SEQ ID NO: 1684988 - RNA, 18 nt, Homo sapiens
agaagccaguggacaguu

SEQ ID NO: 1684989 - RNA, 13 nt, Homo sapiens
agaaggauuaccu

SEQ ID NO: 1684990 - RNA, 23 nt, Homo sapiens
agaagugaaacuauauguauuca

SEQ ID NO: 1684991 - RNA, 18 nt, Homo sapiens
agaauacugccaaaacau

SEQ ID NO: 1684992 - RNA, 12 nt, Homo sapiens
agaauauucucc

SEQ ID NO: 1684993 - RNA, 19 nt, Homo sapiens
agaaucuuguuuugaaaau

SEQ ID NO: 1684994 - RNA, 21 nt, Homo sapiens
agaauguuuucaaauguucuc

SEQ ID NO: 1684995 - RNA, 16 nt, Homo sapiens
agacaaccuuguccca

SEQ ID NO: 1684996 - RNA, 21 nt, Homo sapiens
agacaaccuugucccaaggaa

SEQ ID NO: 1684997 - RNA, 12 nt, Homo sapiens
agacaagcauuu

SEQ ID NO: 1684998 - RNA, 21 nt, Homo sapiens
agacagcccuggcaaaugccu

SEQ ID NO: 1684999 - RNA, 21 nt, Homo sapiens
agacagcuggcggaggcugcu

SEQ ID NO: 1685000 - RNA, 21 nt, Homo sapiens
agacauauaacgcagucuaau

SEQ ID NO: 1685001 - RNA, 14 nt, Homo sapiens
agacaucacaagaa

SEQ ID NO: 1685002 - RNA, 14 nt, Homo sapiens
agacaugugacauu

SEQ ID NO: 1685003 - RNA, 17 nt, Homo sapiens
agacaugugacauuuau

SEQ ID NO: 1685004 - RNA, 20 nt, Homo sapiens
agacccuccuauucuauaaa

SEQ ID NO: 1685005 - RNA, 18 nt, Homo sapiens
agaccuguguuacuaaaa

SEQ ID NO: 1685006 - RNA, 20 nt, Homo sapiens
agaccuguguuacuaaaaaa

SEQ ID NO: 1685007 - RNA, 21 nt, Homo sapiens
agacuauggugcugccuugcu

SEQ ID NO: 1685008 - RNA, 17 nt, Homo sapiens
agagaaagaguuugaaa

SEQ ID NO: 1685009 - RNA, 17 nt, Homo sapiens
agagaaagcacaauuua

SEQ ID NO: 1685010 - RNA, 14 nt, Homo sapiens
agagacagaauuca

SEQ ID NO: 1685011 - RNA, 18 nt, Homo sapiens
agagaggaaccaauaccu

SEQ ID NO: 1685012 - RNA, 17 nt, Homo sapiens
agagauaagucuuucau

SEQ ID NO: 1685013 - RNA, 17 nt, Homo sapiens
agagcccagaucaccca

SEQ ID NO: 1685014 - RNA, 16 nt, Homo sapiens
agagccuaacaucucc

SEQ ID NO: 1685015 - RNA, 20 nt, Homo sapiens
agaggaccaaugcuugcaug

SEQ ID NO: 1685016 - RNA, 14 nt, Homo sapiens
agagguggggugcu

SEQ ID NO: 1685017 - RNA, 21 nt, Homo sapiens
agaguccuggagcuggcucua

SEQ ID NO: 1685018 - RNA, 21 nt, Homo sapiens
agagucucuuuuuacacuuca

SEQ ID NO: 1685019 - RNA, 21 nt, Homo sapiens
agagucuggccuggacccuga

SEQ ID NO: 1685020 - RNA, 19 nt, Homo sapiens
agagugcaacccagucaca

SEQ ID NO: 1685021 - RNA, 17 nt, Homo sapiens
agaguggaaauggggaa

SEQ ID NO: 1685022 - RNA, 21 nt, Homo sapiens
agauauguauucuuuucucag

SEQ ID NO: 1685023 - RNA, 14 nt, Homo sapiens
agauauugauuacu

SEQ ID NO: 1685024 - RNA, 20 nt, Homo sapiens
agaugcaucaucucuuccuc

SEQ ID NO: 1685025 - RNA, 15 nt, Homo sapiens
agaugccugugaaau

SEQ ID NO: 1685026 - RNA, 19 nt, Homo sapiens
agaugccugugaaauagua

SEQ ID NO: 1685027 - RNA, 21 nt, Homo sapiens
agaugcuacuucccacuguau

SEQ ID NO: 1685028 - RNA, 17 nt, Homo sapiens
agaugggggaacuguga

SEQ ID NO: 1685029 - RNA, 12 nt, Homo sapiens
agauguacugca

SEQ ID NO: 1685030 - RNA, 15 nt, Homo sapiens
agaugucucugcaaa

SEQ ID NO: 1685031 - RNA, 17 nt, Homo sapiens
agauguguuauuacuuc

SEQ ID NO: 1685032 - RNA, 14 nt, Homo sapiens
agauguuuauuuca

SEQ ID NO: 1685033 - RNA, 17 nt, Homo sapiens
agauucccaccuuccau

SEQ ID NO: 1685034 - RNA, 12 nt, Homo sapiens
agauugaacuuu

SEQ ID NO: 1685035 - RNA, 15 nt, Homo sapiens
agauugaacuuuccc

SEQ ID NO: 1685036 - RNA, 12 nt, Homo sapiens
agauuuauuagu

SEQ ID NO: 1685037 - RNA, 17 nt, Homo sapiens
agcaaaggugcacucca

SEQ ID NO: 1685038 - RNA, 20 nt, Homo sapiens
agcaacccuuccugcugcug

SEQ ID NO: 1685039 - RNA, 20 nt, Homo sapiens
agcaaugucucuuugugcuc

SEQ ID NO: 1685040 - RNA, 19 nt, Homo sapiens
agcaauucuccugccuuag

SEQ ID NO: 1685041 - RNA, 20 nt, Homo sapiens
agcaauucuccugccuuagc

SEQ ID NO: 1685042 - RNA, 15 nt, Homo sapiens
agcacacauccaaga

SEQ ID NO: 1685043 - RNA, 13 nt, Homo sapiens
agcaccaaccucc

SEQ ID NO: 1685044 - RNA, 12 nt, Homo sapiens
agcacuucccac

SEQ ID NO: 1685045 - RNA, 17 nt, Homo sapiens
agcagagauguacugca

SEQ ID NO: 1685046 - RNA, 12 nt, Homo sapiens
agcagcauccac

SEQ ID NO: 1685047 - RNA, 18 nt, Homo sapiens
agcagccaguucaaaaac

SEQ ID NO: 1685048 - RNA, 18 nt, Homo sapiens
agcagcggauugcucugg

SEQ ID NO: 1685049 - RNA, 19 nt, Homo sapiens
agcaggcccaaugcugcuu

SEQ ID NO: 1685050 - RNA, 19 nt, Homo sapiens
agcauccuuggcaguggga

SEQ ID NO: 1685051 - RNA, 21 nt, Homo sapiens
agcaugugaugggcuguuuaa

SEQ ID NO: 1685052 - RNA, 12 nt, Homo sapiens
agcaugugaugu

SEQ ID NO: 1685053 - RNA, 23 nt, Homo sapiens
agccacuggcugcuaacaaguca

SEQ ID NO: 1685054 - RNA, 22 nt, Homo sapiens
agccagcacucacaccacuaac

SEQ ID NO: 1685055 - RNA, 15 nt, Homo sapiens
agccagcugugcacu

SEQ ID NO: 1685056 - RNA, 13 nt, Homo sapiens
agccaucucuaau

SEQ ID NO: 1685057 - RNA, 23 nt, Homo sapiens
agcccuggcaaaugccugacuca

SEQ ID NO: 1685058 - RNA, 15 nt, Homo sapiens
agccggccugagaaa

SEQ ID NO: 1685059 - RNA, 16 nt, Homo sapiens
agccuauuuuuuuaga

SEQ ID NO: 1685060 - RNA, 18 nt, Homo sapiens
agccucaagucacuccca

SEQ ID NO: 1685061 - RNA, 22 nt, Homo sapiens
agccuccccagcucaccccugg

SEQ ID NO: 1685062 - RNA, 15 nt, Homo sapiens
agccucugggucuga

SEQ ID NO: 1685063 - RNA, 15 nt, Homo sapiens
agccuguauguggug

SEQ ID NO: 1685064 - RNA, 19 nt, Homo sapiens
agccuuagagcucuugugu

SEQ ID NO: 1685065 - RNA, 14 nt, Homo sapiens
agccuugcaaccca

SEQ ID NO: 1685066 - RNA, 13 nt, Homo sapiens
agccuugcaugac

SEQ ID NO: 1685067 - RNA, 19 nt, Homo sapiens
agccuuuacuguuugauau

SEQ ID NO: 1685068 - RNA, 22 nt, Homo sapiens
agcgcuccccuuaccccaguca

SEQ ID NO: 1685069 - RNA, 15 nt, Homo sapiens
agcggauugcucugg

SEQ ID NO: 1685070 - RNA, 16 nt, Homo sapiens
agcguguggagcagag

SEQ ID NO: 1685071 - RNA, 13 nt, Homo sapiens
agcuaauauacag

SEQ ID NO: 1685072 - RNA, 20 nt, Homo sapiens
agcuacuauguacugccuua

SEQ ID NO: 1685073 - RNA, 15 nt, Homo sapiens
agcuaggaacccugg

SEQ ID NO: 1685074 - RNA, 13 nt, Homo sapiens
agcuagugccuuu

SEQ ID NO: 1685075 - RNA, 15 nt, Homo sapiens
agcuauaacuuacuu

SEQ ID NO: 1685076 - RNA, 19 nt, Homo sapiens
agcuauaacuuacuucugu

SEQ ID NO: 1685077 - RNA, 15 nt, Homo sapiens
agcuauggugcuugc

SEQ ID NO: 1685078 - RNA, 17 nt, Homo sapiens
agcucuccccuccugcu

SEQ ID NO: 1685079 - RNA, 12 nt, Homo sapiens
agcucucuggga

SEQ ID NO: 1685080 - RNA, 16 nt, Homo sapiens
agcugaagaauugaaa

SEQ ID NO: 1685081 - RNA, 22 nt, Homo sapiens
agcuggagcagcggauugcucu

SEQ ID NO: 1685082 - RNA, 17 nt, Homo sapiens
agcugggauuacaggcg

SEQ ID NO: 1685083 - RNA, 11 nt, Homo sapiens
agcuuaccugg

SEQ ID NO: 1685084 - RNA, 23 nt, Homo sapiens
agcuugauuaaaucaaccaccua

SEQ ID NO: 1685085 - RNA, 17 nt, Homo sapiens
agcuugugguggggcag

SEQ ID NO: 1685086 - RNA, 18 nt, Homo sapiens
aggaaccaauaccuucaa

SEQ ID NO: 1685087 - RNA, 21 nt, Homo sapiens
aggaauucaagguuuguucaa

SEQ ID NO: 1685088 - RNA, 23 nt, Homo sapiens
aggaauuuuuuuaacuuaaggga

SEQ ID NO: 1685089 - RNA, 10 nt, Homo sapiens
aggacugugg

SEQ ID NO: 1685090 - RNA, 20 nt, Homo sapiens
aggaggguuggagugcucuu

SEQ ID NO: 1685091 - RNA, 17 nt, Homo sapiens
aggauccuggccugaga

SEQ ID NO: 1685092 - RNA, 19 nt, Homo sapiens
aggcaaaaauguccagcca

SEQ ID NO: 1685093 - RNA, 21 nt, Homo sapiens
aggcaagaaagcuuccuucaa

SEQ ID NO: 1685094 - RNA, 20 nt, Homo sapiens
aggcaagcugaaauuuuaga

SEQ ID NO: 1685095 - RNA, 16 nt, Homo sapiens
aggcaggacuucucac

SEQ ID NO: 1685096 - RNA, 16 nt, Homo sapiens
aggcaggggaauguau

SEQ ID NO: 1685097 - RNA, 20 nt, Homo sapiens
aggcaggugcuuuuggcaga

SEQ ID NO: 1685098 - RNA, 17 nt, Homo sapiens
aggcagguugagacuac

SEQ ID NO: 1685099 - RNA, 23 nt, Homo sapiens
aggcauguacaaaaauuaugcaa

SEQ ID NO: 1685100 - RNA, 16 nt, Homo sapiens
aggcccaaugcugcuu

SEQ ID NO: 1685101 - RNA, 22 nt, Homo sapiens
aggccugcuugacuuuccagaa

SEQ ID NO: 1685102 - RNA, 19 nt, Homo sapiens
aggcuacuguaaugcugcc

SEQ ID NO: 1685103 - RNA, 13 nt, Homo sapiens
aggcucaggagaa

SEQ ID NO: 1685104 - RNA, 23 nt, Homo sapiens
aggcuccgggcaccaggggccaa

SEQ ID NO: 1685105 - RNA, 17 nt, Homo sapiens
aggcuggagugcaaugg

SEQ ID NO: 1685106 - RNA, 19 nt, Homo sapiens
aggcuuguuuaccuuucuc

SEQ ID NO: 1685107 - RNA, 20 nt, Homo sapiens
aggcuuuggguggcucacua

SEQ ID NO: 1685108 - RNA, 18 nt, Homo sapiens
agggaaaaggaguaggga

SEQ ID NO: 1685109 - RNA, 19 nt, Homo sapiens
agggcaccguauuccucuc

SEQ ID NO: 1685110 - RNA, 14 nt, Homo sapiens
agggccucagucug

SEQ ID NO: 1685111 - RNA, 23 nt, Homo sapiens
aggggagguggccagcccgcaga

SEQ ID NO: 1685112 - RNA, 17 nt, Homo sapiens
aggggccauguccucuc

SEQ ID NO: 1685113 - RNA, 19 nt, Homo sapiens
aggggccugggcugugagg

SEQ ID NO: 1685114 - RNA, 18 nt, Homo sapiens
agggggaagacagauaug

SEQ ID NO: 1685115 - RNA, 21 nt, Homo sapiens
aggguaaauaggaaucauuca

SEQ ID NO: 1685116 - RNA, 22 nt, Homo sapiens
aggguggggggccauguuccca

SEQ ID NO: 1685117 - RNA, 22 nt, Homo sapiens
agguaauguuaguaaauccaug

SEQ ID NO: 1685118 - RNA, 18 nt, Homo sapiens
agguagaagugagcaaaa

SEQ ID NO: 1685119 - RNA, 17 nt, Homo sapiens
agguauacuuuaguaga

SEQ ID NO: 1685120 - RNA, 15 nt, Homo sapiens
aggugcuuggaguuu

SEQ ID NO: 1685121 - RNA, 20 nt, Homo sapiens
agguuaaaaaaaaaagucac

SEQ ID NO: 1685122 - RNA, 17 nt, Homo sapiens
agguuagugacauuuaa

SEQ ID NO: 1685123 - RNA, 18 nt, Homo sapiens
agguuauugcaauaaagu

SEQ ID NO: 1685124 - RNA, 14 nt, Homo sapiens
agguucugagauaa

SEQ ID NO: 1685125 - RNA, 22 nt, Homo sapiens
agguucuucagaagucacacau

SEQ ID NO: 1685126 - RNA, 17 nt, Homo sapiens
agguugagacuacuuaa

SEQ ID NO: 1685127 - RNA, 15 nt, Homo sapiens
agguuugaaggagaa

SEQ ID NO: 1685128 - RNA, 16 nt, Homo sapiens
aguaaaagcuacuaug

SEQ ID NO: 1685129 - RNA, 21 nt, Homo sapiens
aguaaaauacuauugccucau

SEQ ID NO: 1685130 - RNA, 15 nt, Homo sapiens
aguaccuacugugug

SEQ ID NO: 1685131 - RNA, 20 nt, Homo sapiens
aguacuauggagugcucaca

SEQ ID NO: 1685132 - RNA, 20 nt, Homo sapiens
aguacuugacuaccuacugg

SEQ ID NO: 1685133 - RNA, 15 nt, Homo sapiens
aguagaaugguggcu

SEQ ID NO: 1685134 - RNA, 13 nt, Homo sapiens
aguagacauuuau

SEQ ID NO: 1685135 - RNA, 18 nt, Homo sapiens
aguagauaugaggcauuu

SEQ ID NO: 1685136 - RNA, 18 nt, Homo sapiens
aguagauauugauuacua

SEQ ID NO: 1685137 - RNA, 13 nt, Homo sapiens
agucacacugugg

SEQ ID NO: 1685138 - RNA, 20 nt, Homo sapiens
agucacuggucuguuugcau

SEQ ID NO: 1685139 - RNA, 14 nt, Homo sapiens
agucaguccaggau

SEQ ID NO: 1685140 - RNA, 13 nt, Homo sapiens
agucaguguuaaa

SEQ ID NO: 1685141 - RNA, 19 nt, Homo sapiens
agucaguucucauuauuca

SEQ ID NO: 1685142 - RNA, 15 nt, Homo sapiens
agucaguugcucaaa

SEQ ID NO: 1685143 - RNA, 21 nt, Homo sapiens
aguccuggagcuggcucuaua

SEQ ID NO: 1685144 - RNA, 19 nt, Homo sapiens
aguccuuaggcuacuguaa

SEQ ID NO: 1685145 - RNA, 23 nt, Homo sapiens
aguccuugauuucaaaguuuugu

SEQ ID NO: 1685146 - RNA, 17 nt, Homo sapiens
aguccuuugucuaagua

SEQ ID NO: 1685147 - RNA, 17 nt, Homo sapiens
agucgccagucacugcu

SEQ ID NO: 1685148 - RNA, 23 nt, Homo sapiens
agucuggagugggauaggagcag

SEQ ID NO: 1685149 - RNA, 22 nt, Homo sapiens
agugaaguuuuacugucuauua

SEQ ID NO: 1685150 - RNA, 21 nt, Homo sapiens
agugagcagagauguacugca

SEQ ID NO: 1685151 - RNA, 17 nt, Homo sapiens
agugccuauugauacuu

SEQ ID NO: 1685152 - RNA, 14 nt, Homo sapiens
agugccuucucuau

SEQ ID NO: 1685153 - RNA, 13 nt, Homo sapiens
agugcgguuuacu

SEQ ID NO: 1685154 - RNA, 11 nt, Homo sapiens
aguggugagca

SEQ ID NO: 1685155 - RNA, 16 nt, Homo sapiens
agugucccaccuugac

SEQ ID NO: 1685156 - RNA, 19 nt, Homo sapiens
agugugacuccuuaucucu

SEQ ID NO: 1685157 - RNA, 13 nt, Homo sapiens
aguguuaaacuag

SEQ ID NO: 1685158 - RNA, 13 nt, Homo sapiens
aguuaacaggaca

SEQ ID NO: 1685159 - RNA, 14 nt, Homo sapiens
aguucuggaccugg

SEQ ID NO: 1685160 - RNA, 17 nt, Homo sapiens
aguuggacucucaggga

SEQ ID NO: 1685161 - RNA, 19 nt, Homo sapiens
aguugguaaauucacaaau

SEQ ID NO: 1685162 - RNA, 15 nt, Homo sapiens
aguuucaaguuuuaa

SEQ ID NO: 1685163 - RNA, 14 nt, Homo sapiens
aguuugaucuguca

SEQ ID NO: 1685164 - RNA, 14 nt, Homo sapiens
aguuuuaacugugg

SEQ ID NO: 1685165 - RNA, 20 nt, Homo sapiens
aguuuuauuuugggccuguu

SEQ ID NO: 1685166 - RNA, 21 nt, Homo sapiens
aguuuuggcaaggcugacaga

SEQ ID NO: 1685167 - RNA, 14 nt, Homo sapiens
auaaaauguauaaa

SEQ ID NO: 1685168 - RNA, 16 nt, Homo sapiens
auaaaccaaaggaaaa

SEQ ID NO: 1685169 - RNA, 12 nt, Homo sapiens
auaaagaacaau

SEQ ID NO: 1685170 - RNA, 17 nt, Homo sapiens
auaaagugccucggaca

SEQ ID NO: 1685171 - RNA, 14 nt, Homo sapiens
auaaauauacagua

SEQ ID NO: 1685172 - RNA, 20 nt, Homo sapiens
auaaaucauucuuacuaaaa

SEQ ID NO: 1685173 - RNA, 15 nt, Homo sapiens
auaaaucuguuauag

SEQ ID NO: 1685174 - RNA, 14 nt, Homo sapiens
auaaaugagugauu

SEQ ID NO: 1685175 - RNA, 16 nt, Homo sapiens
auaaauguaccagaga

SEQ ID NO: 1685176 - RNA, 14 nt, Homo sapiens
auaaaugugacuca

SEQ ID NO: 1685177 - RNA, 21 nt, Homo sapiens
auaagaagaaguucaugucca

SEQ ID NO: 1685178 - RNA, 17 nt, Homo sapiens
auaagaagcauuuugca

SEQ ID NO: 1685179 - RNA, 18 nt, Homo sapiens
auaagcaacuucacagaa

SEQ ID NO: 1685180 - RNA, 15 nt, Homo sapiens
auaagccaauauucc

SEQ ID NO: 1685181 - RNA, 15 nt, Homo sapiens
auaaugaucagcaaa

SEQ ID NO: 1685182 - RNA, 18 nt, Homo sapiens
auacacccaaacacuuac

SEQ ID NO: 1685183 - RNA, 16 nt, Homo sapiens
auacaucaauauguau

SEQ ID NO: 1685184 - RNA, 15 nt, Homo sapiens
auacuauugccucau

SEQ ID NO: 1685185 - RNA, 19 nt, Homo sapiens
auacuguaacauucaggaa

SEQ ID NO: 1685186 - RNA, 15 nt, Homo sapiens
auagaacacaguuug

SEQ ID NO: 1685187 - RNA, 17 nt, Homo sapiens
auagacacuugcuccca

SEQ ID NO: 1685188 - RNA, 12 nt, Homo sapiens
auagagugaaau

SEQ ID NO: 1685189 - RNA, 17 nt, Homo sapiens
auagaugauacauguca

SEQ ID NO: 1685190 - RNA, 18 nt, Homo sapiens
auaguaugaaaauggaaa

SEQ ID NO: 1685191 - RNA, 15 nt, Homo sapiens
auauaaaaaaucaug

SEQ ID NO: 1685192 - RNA, 12 nt, Homo sapiens
auauaccaaauu

SEQ ID NO: 1685193 - RNA, 19 nt, Homo sapiens
auauacugcugaucuugca

SEQ ID NO: 1685194 - RNA, 19 nt, Homo sapiens
auauauacagauacauauc

SEQ ID NO: 1685195 - RNA, 12 nt, Homo sapiens
auauauuuugca

SEQ ID NO: 1685196 - RNA, 21 nt, Homo sapiens
auaucccuacauguauugcac

SEQ ID NO: 1685197 - RNA, 21 nt, Homo sapiens
auaucuuagguaagacauaua

SEQ ID NO: 1685198 - RNA, 18 nt, Homo sapiens
auauuguaaagauccuau

SEQ ID NO: 1685199 - RNA, 19 nt, Homo sapiens
auauuuuuuuaacugugau

SEQ ID NO: 1685200 - RNA, 23 nt, Homo sapiens
aucaagaacaugucagcaauguc

SEQ ID NO: 1685201 - RNA, 15 nt, Homo sapiens
aucaauaaauguugc

SEQ ID NO: 1685202 - RNA, 20 nt, Homo sapiens
aucaauaaauguugcaaugc

SEQ ID NO: 1685203 - RNA, 19 nt, Homo sapiens
aucagaguuccuccuacuu

SEQ ID NO: 1685204 - RNA, 20 nt, Homo sapiens
aucagaguuccuccuacuua

SEQ ID NO: 1685205 - RNA, 12 nt, Homo sapiens
aucagcuuugua

SEQ ID NO: 1685206 - RNA, 16 nt, Homo sapiens
aucauuccauuuugcu

SEQ ID NO: 1685207 - RNA, 16 nt, Homo sapiens
auccaccccaccccau

SEQ ID NO: 1685208 - RNA, 13 nt, Homo sapiens
auccagcccaaac

SEQ ID NO: 1685209 - RNA, 18 nt, Homo sapiens
auccagugugagauacug

SEQ ID NO: 1685210 - RNA, 17 nt, Homo sapiens
auccauccugagccaaa

SEQ ID NO: 1685211 - RNA, 14 nt, Homo sapiens
auccauccuuccaa

SEQ ID NO: 1685212 - RNA, 21 nt, Homo sapiens
aucccauggccaggugguugu

SEQ ID NO: 1685213 - RNA, 17 nt, Homo sapiens
aucccccucuuugcaca

SEQ ID NO: 1685214 - RNA, 12 nt, Homo sapiens
aucccugagauc

SEQ ID NO: 1685215 - RNA, 17 nt, Homo sapiens
auccuagacugcuccug

SEQ ID NO: 1685216 - RNA, 14 nt, Homo sapiens
auccucaguucuca

SEQ ID NO: 1685217 - RNA, 17 nt, Homo sapiens
auccuuaaaacaauucu

SEQ ID NO: 1685218 - RNA, 13 nt, Homo sapiens
auccuuccaacau

SEQ ID NO: 1685219 - RNA, 14 nt, Homo sapiens
aucgggaagcagaa

SEQ ID NO: 1685220 - RNA, 15 nt, Homo sapiens
aucguuucuuccagu

SEQ ID NO: 1685221 - RNA, 14 nt, Homo sapiens
aucuaagugauaua

SEQ ID NO: 1685222 - RNA, 22 nt, Homo sapiens
aucucaaugaaccauaaauuca

SEQ ID NO: 1685223 - RNA, 16 nt, Homo sapiens
aucucacaagcacuuu

SEQ ID NO: 1685224 - RNA, 19 nt, Homo sapiens
aucucacuuaguccuuuau

SEQ ID NO: 1685225 - RNA, 13 nt, Homo sapiens
aucucuuccuguc

SEQ ID NO: 1685226 - RNA, 15 nt, Homo sapiens
aucuuauuuucucaa

SEQ ID NO: 1685227 - RNA, 18 nt, Homo sapiens
aucuuggagggaccaagg

SEQ ID NO: 1685228 - RNA, 15 nt, Homo sapiens
aucuuuguaccaaaa

SEQ ID NO: 1685229 - RNA, 18 nt, Homo sapiens
augaaaccacaugagaag

SEQ ID NO: 1685230 - RNA, 14 nt, Homo sapiens
augaaaugcauauu

SEQ ID NO: 1685231 - RNA, 21 nt, Homo sapiens
augaagaucuuuauauuucaa

SEQ ID NO: 1685232 - RNA, 24 nt, Homo sapiens
augaaugcuuuuagugugugcaua

SEQ ID NO: 1685233 - RNA, 14 nt, Homo sapiens
augacugcaaaagu

SEQ ID NO: 1685234 - RNA, 12 nt, Homo sapiens
augaguuugaca

SEQ ID NO: 1685235 - RNA, 11 nt, Homo sapiens
augaugccaug

SEQ ID NO: 1685236 - RNA, 23 nt, Homo sapiens
augauuuggggugauuucucacc

SEQ ID NO: 1685237 - RNA, 15 nt, Homo sapiens
augcauuuaauaaag

SEQ ID NO: 1685238 - RNA, 19 nt, Homo sapiens
augccagccacugugauag

SEQ ID NO: 1685239 - RNA, 14 nt, Homo sapiens
auggcagccuacuc

SEQ ID NO: 1685240 - RNA, 18 nt, Homo sapiens
auggccacaaaccugccc

SEQ ID NO: 1685241 - RNA, 16 nt, Homo sapiens
auggcgauguguuaua

SEQ ID NO: 1685242 - RNA, 16 nt, Homo sapiens
augggauauuuugaaa

SEQ ID NO: 1685243 - RNA, 18 nt, Homo sapiens
auggggaacucccccaga

SEQ ID NO: 1685244 - RNA, 22 nt, Homo sapiens
augguguaggaaaaaugcaagc

SEQ ID NO: 1685245 - RNA, 22 nt, Homo sapiens
augguguuauuuucugagagac

SEQ ID NO: 1685246 - RNA, 22 nt, Homo sapiens
augguuauuuaugcacuguggg

SEQ ID NO: 1685247 - RNA, 18 nt, Homo sapiens
auguaacuuccuguggau

SEQ ID NO: 1685248 - RNA, 23 nt, Homo sapiens
auguacagacuuuuuucuuguca

SEQ ID NO: 1685249 - RNA, 20 nt, Homo sapiens
auguagaggcuuguuuaccu

SEQ ID NO: 1685250 - RNA, 22 nt, Homo sapiens
auguagccuuuacuguuugaua

SEQ ID NO: 1685251 - RNA, 14 nt, Homo sapiens
augucaguacuauu

SEQ ID NO: 1685252 - RNA, 22 nt, Homo sapiens
auguccauuuuugaagugauuu

SEQ ID NO: 1685253 - RNA, 15 nt, Homo sapiens
auguccucucuuaau

SEQ ID NO: 1685254 - RNA, 13 nt, Homo sapiens
augugaagucucu

SEQ ID NO: 1685255 - RNA, 12 nt, Homo sapiens
augugacucagc

SEQ ID NO: 1685256 - RNA, 19 nt, Homo sapiens
augugagcucuuccuaucc

SEQ ID NO: 1685257 - RNA, 21 nt, Homo sapiens
augugcuggugaacacuguga

SEQ ID NO: 1685258 - RNA, 15 nt, Homo sapiens
auguguguaaauucu

SEQ ID NO: 1685259 - RNA, 17 nt, Homo sapiens
auguguuauuacuuccu

SEQ ID NO: 1685260 - RNA, 18 nt, Homo sapiens
auguguuauuacuuccuc

SEQ ID NO: 1685261 - RNA, 22 nt, Homo sapiens
auguuccccaggauucagcuau

SEQ ID NO: 1685262 - RNA, 19 nt, Homo sapiens
auguucugugacugaagaa

SEQ ID NO: 1685263 - RNA, 12 nt, Homo sapiens
auguugcaaugc

SEQ ID NO: 1685264 - RNA, 14 nt, Homo sapiens
auuaaaaaacuuca

SEQ ID NO: 1685265 - RNA, 13 nt, Homo sapiens
auuaaaauuccaa

SEQ ID NO: 1685266 - RNA, 13 nt, Homo sapiens
auuacuaucauaa

SEQ ID NO: 1685267 - RNA, 23 nt, Homo sapiens
auuacuaucauaauucagcacuu

SEQ ID NO: 1685268 - RNA, 16 nt, Homo sapiens
auuagaaucugaguau

SEQ ID NO: 1685269 - RNA, 18 nt, Homo sapiens
auucaagguuuguucaac

SEQ ID NO: 1685270 - RNA, 14 nt, Homo sapiens
auucaauccuacuu

SEQ ID NO: 1685271 - RNA, 12 nt, Homo sapiens
auucacauuuag

SEQ ID NO: 1685272 - RNA, 18 nt, Homo sapiens
auucagagcuauggugcu

SEQ ID NO: 1685273 - RNA, 13 nt, Homo sapiens
auucagcacuuaa

SEQ ID NO: 1685274 - RNA, 14 nt, Homo sapiens
auucauccuuccau

SEQ ID NO: 1685275 - RNA, 14 nt, Homo sapiens
auucauuacuagau

SEQ ID NO: 1685276 - RNA, 22 nt, Homo sapiens
auuccagccacuggcugcuaac

SEQ ID NO: 1685277 - RNA, 15 nt, Homo sapiens
auuccagcugucacu

SEQ ID NO: 1685278 - RNA, 20 nt, Homo sapiens
auucccuuaaugguguuguu

SEQ ID NO: 1685279 - RNA, 15 nt, Homo sapiens
auuccuuugcauauu

SEQ ID NO: 1685280 - RNA, 18 nt, Homo sapiens
auucuauuauacuacaau

SEQ ID NO: 1685281 - RNA, 17 nt, Homo sapiens
auucuuccuaaugucag

SEQ ID NO: 1685282 - RNA, 19 nt, Homo sapiens
auucuuuuugaaaugucaa

SEQ ID NO: 1685283 - RNA, 16 nt, Homo sapiens
auugaaaugauuucac

SEQ ID NO: 1685284 - RNA, 12 nt, Homo sapiens
auugaacuuucc

SEQ ID NO: 1685285 - RNA, 13 nt, Homo sapiens
auugaacuuuccc

SEQ ID NO: 1685286 - RNA, 20 nt, Homo sapiens
auugacuaacaggccaaaga

SEQ ID NO: 1685287 - RNA, 15 nt, Homo sapiens
auugauuacuaucau

SEQ ID NO: 1685288 - RNA, 20 nt, Homo sapiens
auugcaauaaccgcuugguu

SEQ ID NO: 1685289 - RNA, 14 nt, Homo sapiens
auugcauacuuugu

SEQ ID NO: 1685290 - RNA, 18 nt, Homo sapiens
auuggcaaagugacaaag

SEQ ID NO: 1685291 - RNA, 23 nt, Homo sapiens
auuggcaaagugacaaagcaauu

SEQ ID NO: 1685292 - RNA, 23 nt, Homo sapiens
auuguaaagauccuauagcucuu

SEQ ID NO: 1685293 - RNA, 17 nt, Homo sapiens
auugucuuauuacagca

SEQ ID NO: 1685294 - RNA, 21 nt, Homo sapiens
auuguuugguaaauguuucuu

SEQ ID NO: 1685295 - RNA, 18 nt, Homo sapiens
auuuacacauauccacaa

SEQ ID NO: 1685296 - RNA, 19 nt, Homo sapiens
auuuauuaagcaguacaaa

SEQ ID NO: 1685297 - RNA, 19 nt, Homo sapiens
auuuauuaguccuaauuca

SEQ ID NO: 1685298 - RNA, 22 nt, Homo sapiens
auuuauuccccagugacuccag

SEQ ID NO: 1685299 - RNA, 13 nt, Homo sapiens
auuucacagugug

SEQ ID NO: 1685300 - RNA, 23 nt, Homo sapiens
auuucacuggccuaaugagauaa

SEQ ID NO: 1685301 - RNA, 13 nt, Homo sapiens
auuucauacugua

SEQ ID NO: 1685302 - RNA, 17 nt, Homo sapiens
auuucuaguaccuguga

SEQ ID NO: 1685303 - RNA, 17 nt, Homo sapiens
auuucucuuuacuugaa

SEQ ID NO: 1685304 - RNA, 22 nt, Homo sapiens
auuugauugggaugaaugccau

SEQ ID NO: 1685305 - RNA, 17 nt, Homo sapiens
auuuggacaagugcugu

SEQ ID NO: 1685306 - RNA, 20 nt, Homo sapiens
auuugugguccacugagcua

SEQ ID NO: 1685307 - RNA, 16 nt, Homo sapiens
auuuuacaagggcaua

SEQ ID NO: 1685308 - RNA, 16 nt, Homo sapiens
auuuuggcgaaucuca

SEQ ID NO: 1685309 - RNA, 15 nt, Homo sapiens
auuuuguauguuaaa

SEQ ID NO: 1685310 - RNA, 23 nt, Homo sapiens
auuuuuaaaggcauuagagucaa

SEQ ID NO: 1685311 - RNA, 16 nt, Homo sapiens
auuuuuugaaaguuaa

SEQ ID NO: 1685312 - RNA, 17 nt, Homo sapiens
caaaaauguccagccac

SEQ ID NO: 1685313 - RNA, 14 nt, Homo sapiens
caaaacaaaaagau

SEQ ID NO: 1685314 - RNA, 14 nt, Homo sapiens
caaaacuccaggca

SEQ ID NO: 1685315 - RNA, 23 nt, Homo sapiens
caaaccagcccagagcagggucu

SEQ ID NO: 1685316 - RNA, 14 nt, Homo sapiens
caaacccugcaauu

SEQ ID NO: 1685317 - RNA, 21 nt, Homo sapiens
caaacugcuuuuuccaacuca

SEQ ID NO: 1685318 - RNA, 23 nt, Homo sapiens
caaacugcuuuuuccaacucaga

SEQ ID NO: 1685319 - RNA, 20 nt, Homo sapiens
caaagaaaaaaaaaaaagcc

SEQ ID NO: 1685320 - RNA, 22 nt, Homo sapiens
caaagaaaaugaaaugcauauu

SEQ ID NO: 1685321 - RNA, 20 nt, Homo sapiens
caaagcacuggccuugccuc

SEQ ID NO: 1685322 - RNA, 14 nt, Homo sapiens
caaaggaugugaua

SEQ ID NO: 1685323 - RNA, 17 nt, Homo sapiens
caaaguccuccuuucau

SEQ ID NO: 1685324 - RNA, 17 nt, Homo sapiens
caaagugcuggaauuac

SEQ ID NO: 1685325 - RNA, 21 nt, Homo sapiens
caaauaauuugaacuuuggaa

SEQ ID NO: 1685326 - RNA, 20 nt, Homo sapiens
caaauauuuagcaucuuccu

SEQ ID NO: 1685327 - RNA, 20 nt, Homo sapiens
caaauccuagacugcuccug

SEQ ID NO: 1685328 - RNA, 20 nt, Homo sapiens
caaaugcauacaaguuucau

SEQ ID NO: 1685329 - RNA, 13 nt, Homo sapiens
caaauucauggca

SEQ ID NO: 1685330 - RNA, 14 nt, Homo sapiens
caaccaacugcaaa

SEQ ID NO: 1685331 - RNA, 18 nt, Homo sapiens
caacccagggugugaaca

SEQ ID NO: 1685332 - RNA, 13 nt, Homo sapiens
caaccuuccagcu

SEQ ID NO: 1685333 - RNA, 20 nt, Homo sapiens
caacucuaccccugcuccca

SEQ ID NO: 1685334 - RNA, 14 nt, Homo sapiens
caacugauugcaac

SEQ ID NO: 1685335 - RNA, 15 nt, Homo sapiens
caacugauugcaaca

SEQ ID NO: 1685336 - RNA, 16 nt, Homo sapiens
caagagcccagaucac

SEQ ID NO: 1685337 - RNA, 16 nt, Homo sapiens
caagauugcaccacug

SEQ ID NO: 1685338 - RNA, 17 nt, Homo sapiens
caagauugcaccacugc

SEQ ID NO: 1685339 - RNA, 14 nt, Homo sapiens
caagcaaauggcca

SEQ ID NO: 1685340 - RNA, 16 nt, Homo sapiens
caagcaauucuccugc

SEQ ID NO: 1685341 - RNA, 16 nt, Homo sapiens
caagcaccaaccucca

SEQ ID NO: 1685342 - RNA, 15 nt, Homo sapiens
caagcauucuguuua

SEQ ID NO: 1685343 - RNA, 18 nt, Homo sapiens
caagcuguaucacugccu

SEQ ID NO: 1685344 - RNA, 13 nt, Homo sapiens
caaggugugaugg

SEQ ID NO: 1685345 - RNA, 14 nt, Homo sapiens
caaguaacauuuug

SEQ ID NO: 1685346 - RNA, 16 nt, Homo sapiens
caaguauuuucuacua

SEQ ID NO: 1685347 - RNA, 20 nt, Homo sapiens
caaguccuuaggcuacugua

SEQ ID NO: 1685348 - RNA, 23 nt, Homo sapiens
caagugagcagagauguacugca

SEQ ID NO: 1685349 - RNA, 20 nt, Homo sapiens
caagugguguuuauugcaau

SEQ ID NO: 1685350 - RNA, 17 nt, Homo sapiens
caagugugcacuccagc

SEQ ID NO: 1685351 - RNA, 19 nt, Homo sapiens
caaguugguaaauucacaa

SEQ ID NO: 1685352 - RNA, 20 nt, Homo sapiens
caauaaccgcuugguuugca

SEQ ID NO: 1685353 - RNA, 16 nt, Homo sapiens
caauagugcaacaucu

SEQ ID NO: 1685354 - RNA, 21 nt, Homo sapiens
caaucacagggaauggccaca

SEQ ID NO: 1685355 - RNA, 14 nt, Homo sapiens
caaucacugugcua

SEQ ID NO: 1685356 - RNA, 16 nt, Homo sapiens
caaugacugagcagca

SEQ ID NO: 1685357 - RNA, 18 nt, Homo sapiens
caaugcugucugguugcg

SEQ ID NO: 1685358 - RNA, 15 nt, Homo sapiens
caaugguugaugaua

SEQ ID NO: 1685359 - RNA, 20 nt, Homo sapiens
caauguauugagcaugugau

SEQ ID NO: 1685360 - RNA, 14 nt, Homo sapiens
cacaaaauucuuau

SEQ ID NO: 1685361 - RNA, 15 nt, Homo sapiens
cacaaagcacuggcc

SEQ ID NO: 1685362 - RNA, 14 nt, Homo sapiens
cacaacccaaaagg

SEQ ID NO: 1685363 - RNA, 15 nt, Homo sapiens
cacaagaaugugcag

SEQ ID NO: 1685364 - RNA, 13 nt, Homo sapiens
cacacacacacga

SEQ ID NO: 1685365 - RNA, 14 nt, Homo sapiens
cacacacgaugcau

SEQ ID NO: 1685366 - RNA, 17 nt, Homo sapiens
cacacgaugcauuuaau

SEQ ID NO: 1685367 - RNA, 16 nt, Homo sapiens
cacacuguccuauuau

SEQ ID NO: 1685368 - RNA, 15 nt, Homo sapiens
cacagaggacucacu

SEQ ID NO: 1685369 - RNA, 13 nt, Homo sapiens
cacagcauuguau

SEQ ID NO: 1685370 - RNA, 18 nt, Homo sapiens
cacaggcagauguuugcc

SEQ ID NO: 1685371 - RNA, 22 nt, Homo sapiens
cacaucuccuguggucucugac

SEQ ID NO: 1685372 - RNA, 23 nt, Homo sapiens
cacauguguaugauacuaaagac

SEQ ID NO: 1685373 - RNA, 21 nt, Homo sapiens
caccaugacccucuuccucau

SEQ ID NO: 1685374 - RNA, 17 nt, Homo sapiens
caccuacauuaucucac

SEQ ID NO: 1685375 - RNA, 14 nt, Homo sapiens
caccuugaccaaaa

SEQ ID NO: 1685376 - RNA, 11 nt, Homo sapiens
cacgaugcauu

SEQ ID NO: 1685377 - RNA, 13 nt, Homo sapiens
cacgccuguaauu

SEQ ID NO: 1685378 - RNA, 16 nt, Homo sapiens
cacuaugccugacuaa

SEQ ID NO: 1685379 - RNA, 16 nt, Homo sapiens
cacucagggagcauuu

SEQ ID NO: 1685380 - RNA, 15 nt, Homo sapiens
cacucccagugcuug

SEQ ID NO: 1685381 - RNA, 21 nt, Homo sapiens
cacuccugcuuaaucuucaaa

SEQ ID NO: 1685382 - RNA, 20 nt, Homo sapiens
cacugaugaguuucacugua

SEQ ID NO: 1685383 - RNA, 22 nt, Homo sapiens
cacugcuuggcccuucaagggu

SEQ ID NO: 1685384 - RNA, 15 nt, Homo sapiens
cacuggccggaguca

SEQ ID NO: 1685385 - RNA, 15 nt, Homo sapiens
cacuggccuugccuc

SEQ ID NO: 1685386 - RNA, 17 nt, Homo sapiens
cacuggccuugccucca

SEQ ID NO: 1685387 - RNA, 14 nt, Homo sapiens
cacuguuucuaaaa

SEQ ID NO: 1685388 - RNA, 19 nt, Homo sapiens
cacuuaguccuuuaucauc

SEQ ID NO: 1685389 - RNA, 18 nt, Homo sapiens
cacuucugggggucacug

SEQ ID NO: 1685390 - RNA, 15 nt, Homo sapiens
cacuuuauugcaaug

SEQ ID NO: 1685391 - RNA, 18 nt, Homo sapiens
cacuuuugcuugaauuua

SEQ ID NO: 1685392 - RNA, 20 nt, Homo sapiens
cagaaagccugggugacauu

SEQ ID NO: 1685393 - RNA, 19 nt, Homo sapiens
cagaaagcuucauccacag

SEQ ID NO: 1685394 - RNA, 13 nt, Homo sapiens
cagaaagguguga

SEQ ID NO: 1685395 - RNA, 18 nt, Homo sapiens
cagaacacgagacagcuu

SEQ ID NO: 1685396 - RNA, 15 nt, Homo sapiens
cagaagccuccaagc

SEQ ID NO: 1685397 - RNA, 13 nt, Homo sapiens
cagaagcuuaaaa

SEQ ID NO: 1685398 - RNA, 13 nt, Homo sapiens
cagaauuuuccau

SEQ ID NO: 1685399 - RNA, 18 nt, Homo sapiens
cagacagcuuacaggagc

SEQ ID NO: 1685400 - RNA, 19 nt, Homo sapiens
cagacucuggggguggaca

SEQ ID NO: 1685401 - RNA, 20 nt, Homo sapiens
cagagaaaauaaaagcacuu

SEQ ID NO: 1685402 - RNA, 23 nt, Homo sapiens
cagagaccagcccaccccugugc

SEQ ID NO: 1685403 - RNA, 16 nt, Homo sapiens
cagagacugaauagau

SEQ ID NO: 1685404 - RNA, 14 nt, Homo sapiens
cagagcaagacugu

SEQ ID NO: 1685405 - RNA, 15 nt, Homo sapiens
cagagcaagacuguc

SEQ ID NO: 1685406 - RNA, 24 nt, Homo sapiens
cagagcaagagauaagucuuucau

SEQ ID NO: 1685407 - RNA, 15 nt, Homo sapiens
cagagcuauggugcu

SEQ ID NO: 1685408 - RNA, 20 nt, Homo sapiens
cagagcucuggguugugcac

SEQ ID NO: 1685409 - RNA, 21 nt, Homo sapiens
cagagcucuggguugugcaca

SEQ ID NO: 1685410 - RNA, 22 nt, Homo sapiens
cagaggaauaacaucaccacug

SEQ ID NO: 1685411 - RNA, 12 nt, Homo sapiens
cagaggacucac

SEQ ID NO: 1685412 - RNA, 16 nt, Homo sapiens
cagagugcaacccagu

SEQ ID NO: 1685413 - RNA, 12 nt, Homo sapiens
cagaguuuucau

SEQ ID NO: 1685414 - RNA, 18 nt, Homo sapiens
cagauacauaucugugua

SEQ ID NO: 1685415 - RNA, 14 nt, Homo sapiens
cagauaccugugag

SEQ ID NO: 1685416 - RNA, 23 nt, Homo sapiens
cagaucuauuguuuguugcacua

SEQ ID NO: 1685417 - RNA, 13 nt, Homo sapiens
cagauucuuucag

SEQ ID NO: 1685418 - RNA, 16 nt, Homo sapiens
cagauuggccaauuaa

SEQ ID NO: 1685419 - RNA, 14 nt, Homo sapiens
cagcaggacugugg

SEQ ID NO: 1685420 - RNA, 24 nt, Homo sapiens
cagcaggccucugggacccacaga

SEQ ID NO: 1685421 - RNA, 15 nt, Homo sapiens
cagcauuugauaaaa

SEQ ID NO: 1685422 - RNA, 17 nt, Homo sapiens
cagccaaaugcagggag

SEQ ID NO: 1685423 - RNA, 22 nt, Homo sapiens
cagccucugggucugagucaug

SEQ ID NO: 1685424 - RNA, 16 nt, Homo sapiens
cagccuguauguggug

SEQ ID NO: 1685425 - RNA, 18 nt, Homo sapiens
cagccuugcaacccaagg

SEQ ID NO: 1685426 - RNA, 13 nt, Homo sapiens
cagcgaacagccu

SEQ ID NO: 1685427 - RNA, 20 nt, Homo sapiens
cagcggguacuuauuucuca

SEQ ID NO: 1685428 - RNA, 22 nt, Homo sapiens
cagcucaaugcaguuagcugaa

SEQ ID NO: 1685429 - RNA, 15 nt, Homo sapiens
cagcugacagccaca

SEQ ID NO: 1685430 - RNA, 14 nt, Homo sapiens
cagcugcccugugu

SEQ ID NO: 1685431 - RNA, 13 nt, Homo sapiens
cagcugugcucca

SEQ ID NO: 1685432 - RNA, 16 nt, Homo sapiens
caggaaagacuggccc

SEQ ID NO: 1685433 - RNA, 17 nt, Homo sapiens
caggagacaaaagagca

SEQ ID NO: 1685434 - RNA, 14 nt, Homo sapiens
caggcacuccugga

SEQ ID NO: 1685435 - RNA, 18 nt, Homo sapiens
caggcaugugucuggccc

SEQ ID NO: 1685436 - RNA, 12 nt, Homo sapiens
caggcccauuca

SEQ ID NO: 1685437 - RNA, 22 nt, Homo sapiens
caggcugaaauuucuuguucau

SEQ ID NO: 1685438 - RNA, 16 nt, Homo sapiens
caggcuggagugcaau

SEQ ID NO: 1685439 - RNA, 20 nt, Homo sapiens
caggcuggucucaaacuccu

SEQ ID NO: 1685440 - RNA, 13 nt, Homo sapiens
cagggaucugccc

SEQ ID NO: 1685441 - RNA, 22 nt, Homo sapiens
cagggcaccguauuccucuccc

SEQ ID NO: 1685442 - RNA, 21 nt, Homo sapiens
cagggcucgggagccauguca

SEQ ID NO: 1685443 - RNA, 15 nt, Homo sapiens
caggggcucuguggc

SEQ ID NO: 1685444 - RNA, 18 nt, Homo sapiens
caggggggagaaguucuu

SEQ ID NO: 1685445 - RNA, 21 nt, Homo sapiens
cagggugaagccuucaaagcu

SEQ ID NO: 1685446 - RNA, 18 nt, Homo sapiens
caggguuuacaugaagca

SEQ ID NO: 1685447 - RNA, 13 nt, Homo sapiens
caggugaucugcc

SEQ ID NO: 1685448 - RNA, 20 nt, Homo sapiens
caggugcuguuuuuguucua

SEQ ID NO: 1685449 - RNA, 16 nt, Homo sapiens
caguaaaauacuauug

SEQ ID NO: 1685450 - RNA, 12 nt, Homo sapiens
caguacauuuaa

SEQ ID NO: 1685451 - RNA, 23 nt, Homo sapiens
caguacuauggagugcucacaaa

SEQ ID NO: 1685452 - RNA, 21 nt, Homo sapiens
caguauuuuuuccacuacaca

SEQ ID NO: 1685453 - RNA, 22 nt, Homo sapiens
caguccaggaugcuaacaucua

SEQ ID NO: 1685454 - RNA, 20 nt, Homo sapiens
cagucugacccuuacagccu

SEQ ID NO: 1685455 - RNA, 16 nt, Homo sapiens
cagucuuucuucacuc

SEQ ID NO: 1685456 - RNA, 11 nt, Homo sapiens
cagugacucca

SEQ ID NO: 1685457 - RNA, 17 nt, Homo sapiens
caguggauugauuauaa

SEQ ID NO: 1685458 - RNA, 22 nt, Homo sapiens
cagugucccaccuugaccaaaa

SEQ ID NO: 1685459 - RNA, 19 nt, Homo sapiens
caguguuauuuauucccca

SEQ ID NO: 1685460 - RNA, 22 nt, Homo sapiens
caguugauacauaguuguauau

SEQ ID NO: 1685461 - RNA, 18 nt, Homo sapiens
cauaagagaaaccugcca

SEQ ID NO: 1685462 - RNA, 14 nt, Homo sapiens
cauaauucagcacu

SEQ ID NO: 1685463 - RNA, 11 nt, Homo sapiens
cauacauaaaa

SEQ ID NO: 1685464 - RNA, 16 nt, Homo sapiens
cauacauauuaucuca

SEQ ID NO: 1685465 - RNA, 23 nt, Homo sapiens
cauauauuuauugaguaccuacu

SEQ ID NO: 1685466 - RNA, 16 nt, Homo sapiens
cauaucccuuccucuc

SEQ ID NO: 1685467 - RNA, 20 nt, Homo sapiens
cauauuuaauaaagcacaaa

SEQ ID NO: 1685468 - RNA, 21 nt, Homo sapiens
caucaauaaauguugcaaugc

SEQ ID NO: 1685469 - RNA, 12 nt, Homo sapiens
caucacuuugac

SEQ ID NO: 1685470 - RNA, 19 nt, Homo sapiens
caucagacugucaagaaga

SEQ ID NO: 1685471 - RNA, 17 nt, Homo sapiens
caucaucucuuccucac

SEQ ID NO: 1685472 - RNA, 16 nt, Homo sapiens
cauccaccucaucacu

SEQ ID NO: 1685473 - RNA, 16 nt, Homo sapiens
caucccacugcucccc

SEQ ID NO: 1685474 - RNA, 18 nt, Homo sapiens
cauccuccagauagugua

SEQ ID NO: 1685475 - RNA, 11 nt, Homo sapiens
cauccuuccaa

SEQ ID NO: 1685476 - RNA, 15 nt, Homo sapiens
cauccuuccauccau

SEQ ID NO: 1685477 - RNA, 22 nt, Homo sapiens
cauccuuucuuuuaaugaugcc

SEQ ID NO: 1685478 - RNA, 15 nt, Homo sapiens
caucuaauguauuau

SEQ ID NO: 1685479 - RNA, 15 nt, Homo sapiens
caucucuuccucaca

SEQ ID NO: 1685480 - RNA, 23 nt, Homo sapiens
caucuucuuucuuccacccacaa

SEQ ID NO: 1685481 - RNA, 11 nt, Homo sapiens
caucuugccuc

SEQ ID NO: 1685482 - RNA, 21 nt, Homo sapiens
caugaaauaaaauauaucuua

SEQ ID NO: 1685483 - RNA, 20 nt, Homo sapiens
caugaagaauguuucuggaa

SEQ ID NO: 1685484 - RNA, 13 nt, Homo sapiens
caugaaugugcug

SEQ ID NO: 1685485 - RNA, 22 nt, Homo sapiens
caugaaugugcuggugaacacu

SEQ ID NO: 1685486 - RNA, 18 nt, Homo sapiens
caugaguuaucaugaauu

SEQ ID NO: 1685487 - RNA, 14 nt, Homo sapiens
caugcaaaugagcu

SEQ ID NO: 1685488 - RNA, 22 nt, Homo sapiens
caugccuguaaucucagcacuu

SEQ ID NO: 1685489 - RNA, 13 nt, Homo sapiens
caugcuccucacc

SEQ ID NO: 1685490 - RNA, 12 nt, Homo sapiens
caugggagaccc

SEQ ID NO: 1685491 - RNA, 17 nt, Homo sapiens
caugucuacaaucugcu

SEQ ID NO: 1685492 - RNA, 21 nt, Homo sapiens
cauguuaaugacaauauucca

SEQ ID NO: 1685493 - RNA, 17 nt, Homo sapiens
cauguucccaaaacaau

SEQ ID NO: 1685494 - RNA, 18 nt, Homo sapiens
cauuaacaaaaauauuag

SEQ ID NO: 1685495 - RNA, 22 nt, Homo sapiens
cauuaacaaaaauauuagcaaa

SEQ ID NO: 1685496 - RNA, 17 nt, Homo sapiens
cauuaccuccauccauc

SEQ ID NO: 1685497 - RNA, 17 nt, Homo sapiens
cauuauuuaauuacaga

SEQ ID NO: 1685498 - RNA, 19 nt, Homo sapiens
cauucagagcuauggugcu

SEQ ID NO: 1685499 - RNA, 15 nt, Homo sapiens
cauucauccuuccau

SEQ ID NO: 1685500 - RNA, 21 nt, Homo sapiens
cauuccuaaucaaauucuguc

SEQ ID NO: 1685501 - RNA, 22 nt, Homo sapiens
cauuccucagcuucuucacagg

SEQ ID NO: 1685502 - RNA, 13 nt, Homo sapiens
cauucuauucucc

SEQ ID NO: 1685503 - RNA, 15 nt, Homo sapiens
cauucuauucuccag

SEQ ID NO: 1685504 - RNA, 18 nt, Homo sapiens
cauuggugagaguccaac

SEQ ID NO: 1685505 - RNA, 14 nt, Homo sapiens
cauuguacuugaag

SEQ ID NO: 1685506 - RNA, 17 nt, Homo sapiens
cauugugaaaaggcaaa

SEQ ID NO: 1685507 - RNA, 14 nt, Homo sapiens
cauuuacacauauc

SEQ ID NO: 1685508 - RNA, 19 nt, Homo sapiens
cauuuacacauauccacaa

SEQ ID NO: 1685509 - RNA, 17 nt, Homo sapiens
cauuucuuugcauucca

SEQ ID NO: 1685510 - RNA, 19 nt, Homo sapiens
cauuugggagacaugugac

SEQ ID NO: 1685511 - RNA, 17 nt, Homo sapiens
cauuuuauuaagcuuuu

SEQ ID NO: 1685512 - RNA, 20 nt, Homo sapiens
cauuuuuauuaaagcauuuc

SEQ ID NO: 1685513 - RNA, 18 nt, Homo sapiens
cauuuuuuugcaugcaug

SEQ ID NO: 1685514 - RNA, 18 nt, Homo sapiens
ccaaaaguguugacugug

SEQ ID NO: 1685515 - RNA, 15 nt, Homo sapiens
ccaaacauguuccca

SEQ ID NO: 1685516 - RNA, 16 nt, Homo sapiens
ccaaacauguucccaa

SEQ ID NO: 1685517 - RNA, 16 nt, Homo sapiens
ccaaagaacaggugua

SEQ ID NO: 1685518 - RNA, 21 nt, Homo sapiens
ccaaauauuuagcaucuuccu

SEQ ID NO: 1685519 - RNA, 22 nt, Homo sapiens
ccaaauuucuuuugcugaacag

SEQ ID NO: 1685520 - RNA, 16 nt, Homo sapiens
ccaacucuuucucucu

SEQ ID NO: 1685521 - RNA, 22 nt, Homo sapiens
ccaagaacauaaacccuccaag

SEQ ID NO: 1685522 - RNA, 14 nt, Homo sapiens
ccaagagcuacucc

SEQ ID NO: 1685523 - RNA, 15 nt, Homo sapiens
ccaagcccccuccuu

SEQ ID NO: 1685524 - RNA, 21 nt, Homo sapiens
ccaaggaaaggcauguacaaa

SEQ ID NO: 1685525 - RNA, 12 nt, Homo sapiens
ccaagucagcag

SEQ ID NO: 1685526 - RNA, 18 nt, Homo sapiens
ccaagucagcaguccuag

SEQ ID NO: 1685527 - RNA, 21 nt, Homo sapiens
ccaaucaccuuuccuguucca

SEQ ID NO: 1685528 - RNA, 22 nt, Homo sapiens
ccacaacuacuagugugacucc

SEQ ID NO: 1685529 - RNA, 16 nt, Homo sapiens
ccacagaggacucacu

SEQ ID NO: 1685530 - RNA, 19 nt, Homo sapiens
ccacagcggauguuguaga

SEQ ID NO: 1685531 - RNA, 12 nt, Homo sapiens
ccacaucuccug

SEQ ID NO: 1685532 - RNA, 16 nt, Homo sapiens
ccacuuuauugcaaug

SEQ ID NO: 1685533 - RNA, 17 nt, Homo sapiens
ccacuuuauugcaaugc

SEQ ID NO: 1685534 - RNA, 16 nt, Homo sapiens
ccagaaccacacuuga

SEQ ID NO: 1685535 - RNA, 18 nt, Homo sapiens
ccagaaccgcagaagccu

SEQ ID NO: 1685536 - RNA, 15 nt, Homo sapiens
ccagacaauuccauu

SEQ ID NO: 1685537 - RNA, 13 nt, Homo sapiens
ccagaucuuucag

SEQ ID NO: 1685538 - RNA, 22 nt, Homo sapiens
ccagcugugcacuuucuucucu

SEQ ID NO: 1685539 - RNA, 20 nt, Homo sapiens
ccaggaaagguuuuccuuau

SEQ ID NO: 1685540 - RNA, 23 nt, Homo sapiens
ccaggcaugaaauucuuccuaau

SEQ ID NO: 1685541 - RNA, 12 nt, Homo sapiens
ccaggcccagau

SEQ ID NO: 1685542 - RNA, 23 nt, Homo sapiens
ccaggccuuaucugaaaggccag

SEQ ID NO: 1685543 - RNA, 18 nt, Homo sapiens
ccaggcuggagugcaaug

SEQ ID NO: 1685544 - RNA, 20 nt, Homo sapiens
ccaggcuggagugcaauggc

SEQ ID NO: 1685545 - RNA, 14 nt, Homo sapiens
ccagggugugaaca

SEQ ID NO: 1685546 - RNA, 15 nt, Homo sapiens
ccaggucugacucca

SEQ ID NO: 1685547 - RNA, 16 nt, Homo sapiens
ccagucacugcugcaa

SEQ ID NO: 1685548 - RNA, 17 nt, Homo sapiens
ccaucauacacuuccuu

SEQ ID NO: 1685549 - RNA, 23 nt, Homo sapiens
ccaucguauuaaaaaacaauuaa

SEQ ID NO: 1685550 - RNA, 14 nt, Homo sapiens
ccaucuuuccaucc

SEQ ID NO: 1685551 - RNA, 15 nt, Homo sapiens
ccaucuuugcugcca

SEQ ID NO: 1685552 - RNA, 15 nt, Homo sapiens
ccauucacuacaggu

SEQ ID NO: 1685553 - RNA, 18 nt, Homo sapiens
ccauuccucagcuucuuc

SEQ ID NO: 1685554 - RNA, 23 nt, Homo sapiens
ccauuuuaauuuuaaagugcaaa

SEQ ID NO: 1685555 - RNA, 17 nt, Homo sapiens
cccaaaaauuacuuugg

SEQ ID NO: 1685556 - RNA, 14 nt, Homo sapiens
cccaaauauuuagc

SEQ ID NO: 1685557 - RNA, 13 nt, Homo sapiens
cccaacccauuca

SEQ ID NO: 1685558 - RNA, 17 nt, Homo sapiens
cccaacuccucaugucu

SEQ ID NO: 1685559 - RNA, 20 nt, Homo sapiens
cccagacguggugcuucuca

SEQ ID NO: 1685560 - RNA, 17 nt, Homo sapiens
cccagauaccugugagg

SEQ ID NO: 1685561 - RNA, 18 nt, Homo sapiens
cccagcacaaagcacugg

SEQ ID NO: 1685562 - RNA, 19 nt, Homo sapiens
cccaggaauucaagguugg

SEQ ID NO: 1685563 - RNA, 20 nt, Homo sapiens
cccaggcuggagugcaaugg

SEQ ID NO: 1685564 - RNA, 19 nt, Homo sapiens
cccagucccagacaauucc

SEQ ID NO: 1685565 - RNA, 22 nt, Homo sapiens
cccagucuuucuucacucuggc

SEQ ID NO: 1685566 - RNA, 11 nt, Homo sapiens
cccaucuccac

SEQ ID NO: 1685567 - RNA, 19 nt, Homo sapiens
cccaucugaagaguggaaa

SEQ ID NO: 1685568 - RNA, 17 nt, Homo sapiens
ccccaaguuaguucaau

SEQ ID NO: 1685569 - RNA, 12 nt, Homo sapiens
ccccaauccauc

SEQ ID NO: 1685570 - RNA, 22 nt, Homo sapiens
ccccaccccaucuuugcugcca

SEQ ID NO: 1685571 - RNA, 11 nt, Homo sapiens
ccccaggguuu

SEQ ID NO: 1685572 - RNA, 11 nt, Homo sapiens
cccccuagugg

SEQ ID NO: 1685573 - RNA, 13 nt, Homo sapiens
cccccuucaggag

SEQ ID NO: 1685574 - RNA, 15 nt, Homo sapiens
ccccgucacagccuc

SEQ ID NO: 1685575 - RNA, 13 nt, Homo sapiens
ccccuaaagccag

SEQ ID NO: 1685576 - RNA, 23 nt, Homo sapiens
cccgccaaggaaaggcauguaca

SEQ ID NO: 1685577 - RNA, 12 nt, Homo sapiens
cccuaaagccag

SEQ ID NO: 1685578 - RNA, 19 nt, Homo sapiens
cccuagggcucuccaagca

SEQ ID NO: 1685579 - RNA, 21 nt, Homo sapiens
cccucaccuguagcagccagu

SEQ ID NO: 1685580 - RNA, 11 nt, Homo sapiens
cccugcuccac

SEQ ID NO: 1685581 - RNA, 14 nt, Homo sapiens
cccuguggcacuca

SEQ ID NO: 1685582 - RNA, 18 nt, Homo sapiens
cccuuacagccucugacu

SEQ ID NO: 1685583 - RNA, 20 nt, Homo sapiens
cccuuuuaagcaugugaugu

SEQ ID NO: 1685584 - RNA, 17 nt, Homo sapiens
ccggaugaaacuucuca

SEQ ID NO: 1685585 - RNA, 21 nt, Homo sapiens
ccgggugggcggcacagccuu

SEQ ID NO: 1685586 - RNA, 23 nt, Homo sapiens
ccguuucauuuagucaugugacc

SEQ ID NO: 1685587 - RNA, 15 nt, Homo sapiens
ccuaaaagcacuccu

SEQ ID NO: 1685588 - RNA, 23 nt, Homo sapiens
ccuaaagagcauccugauaccau

SEQ ID NO: 1685589 - RNA, 21 nt, Homo sapiens
ccuaagaagaaggccagagag

SEQ ID NO: 1685590 - RNA, 18 nt, Homo sapiens
ccuaagagaugggacuag

SEQ ID NO: 1685591 - RNA, 16 nt, Homo sapiens
ccuaauguguuuagau

SEQ ID NO: 1685592 - RNA, 15 nt, Homo sapiens
ccuacauuaucucac

SEQ ID NO: 1685593 - RNA, 20 nt, Homo sapiens
ccuacauuaucucacuuagu

SEQ ID NO: 1685594 - RNA, 18 nt, Homo sapiens
ccuacugguguaaucuca

SEQ ID NO: 1685595 - RNA, 19 nt, Homo sapiens
ccuaggaucccgucuucca

SEQ ID NO: 1685596 - RNA, 13 nt, Homo sapiens
ccuaucagaauuu

SEQ ID NO: 1685597 - RNA, 18 nt, Homo sapiens
ccucacugccucuuugca

SEQ ID NO: 1685598 - RNA, 18 nt, Homo sapiens
ccucagcucucugggacc

SEQ ID NO: 1685599 - RNA, 18 nt, Homo sapiens
ccucagcuucuucacagg

SEQ ID NO: 1685600 - RNA, 23 nt, Homo sapiens
ccucauggcucuggcacagugua

SEQ ID NO: 1685601 - RNA, 18 nt, Homo sapiens
ccucaugucuucucacaa

SEQ ID NO: 1685602 - RNA, 19 nt, Homo sapiens
ccucccaagguccucucag

SEQ ID NO: 1685603 - RNA, 13 nt, Homo sapiens
ccuccucauggca

SEQ ID NO: 1685604 - RNA, 16 nt, Homo sapiens
ccucuaagugcugcug

SEQ ID NO: 1685605 - RNA, 22 nt, Homo sapiens
ccucuaggcccugugagcacaa

SEQ ID NO: 1685606 - RNA, 18 nt, Homo sapiens
ccucucaggcucuugacu

SEQ ID NO: 1685607 - RNA, 21 nt, Homo sapiens
ccucucucucccaggucccag

SEQ ID NO: 1685608 - RNA, 21 nt, Homo sapiens
ccucugacuuaagcugccuca

SEQ ID NO: 1685609 - RNA, 23 nt, Homo sapiens
ccucugucugagacaggugccua

SEQ ID NO: 1685610 - RNA, 21 nt, Homo sapiens
ccucugugcuucgacuacugc

SEQ ID NO: 1685611 - RNA, 17 nt, Homo sapiens
ccucuugcaaugccuca

SEQ ID NO: 1685612 - RNA, 18 nt, Homo sapiens
ccucuugcagggucuugc

SEQ ID NO: 1685613 - RNA, 18 nt, Homo sapiens
ccugaccccauuccugau

SEQ ID NO: 1685614 - RNA, 15 nt, Homo sapiens
ccugagaagccagug

SEQ ID NO: 1685615 - RNA, 15 nt, Homo sapiens
ccugagcagaaagag

SEQ ID NO: 1685616 - RNA, 16 nt, Homo sapiens
ccugauggagugugca

SEQ ID NO: 1685617 - RNA, 18 nt, Homo sapiens
ccugauggagugugcaga

SEQ ID NO: 1685618 - RNA, 17 nt, Homo sapiens
ccugcccucugcucugc

SEQ ID NO: 1685619 - RNA, 22 nt, Homo sapiens
ccugccucccaagguccucuca

SEQ ID NO: 1685620 - RNA, 18 nt, Homo sapiens
ccugccugucugaagcca

SEQ ID NO: 1685621 - RNA, 20 nt, Homo sapiens
ccugcuuuccugcagcaguc

SEQ ID NO: 1685622 - RNA, 15 nt, Homo sapiens
ccuggaggaaugauu

SEQ ID NO: 1685623 - RNA, 23 nt, Homo sapiens
ccugguggugggggcuucucugc

SEQ ID NO: 1685624 - RNA, 12 nt, Homo sapiens
aaaaaacagugg

SEQ ID NO: 1685625 - RNA, 16 nt, Homo sapiens
aaaaacacucaacaaa

SEQ ID NO: 1685626 - RNA, 17 nt, Homo sapiens
aaaaauaaagcacuuau

SEQ ID NO: 1685627 - RNA, 19 nt, Homo sapiens
aaaaauagacuuaaaucuc

SEQ ID NO: 1685628 - RNA, 17 nt, Homo sapiens
aaaaaugaugcgcauca

SEQ ID NO: 1685629 - RNA, 20 nt, Homo sapiens
aaaaaugcaagccaucucua

SEQ ID NO: 1685630 - RNA, 15 nt, Homo sapiens
aaaaaugucaucuca

SEQ ID NO: 1685631 - RNA, 21 nt, Homo sapiens
aaaacaaagccaugccaauaa

SEQ ID NO: 1685632 - RNA, 13 nt, Homo sapiens
aaaacauuugcug

SEQ ID NO: 1685633 - RNA, 15 nt, Homo sapiens
aaaacucugcaugua

SEQ ID NO: 1685634 - RNA, 11 nt, Homo sapiens
aaaagcacuua

SEQ ID NO: 1685635 - RNA, 21 nt, Homo sapiens
aaaagcccacaccuaacauua

SEQ ID NO: 1685636 - RNA, 20 nt, Homo sapiens
aaaaggaguagggaguucau

SEQ ID NO: 1685637 - RNA, 23 nt, Homo sapiens
aaaaggauucuauaucaugacca

SEQ ID NO: 1685638 - RNA, 23 nt, Homo sapiens
aaaaguaaagaugcuacuuccca

SEQ ID NO: 1685639 - RNA, 19 nt, Homo sapiens
aaaagucuacaacauagca

SEQ ID NO: 1685640 - RNA, 17 nt, Homo sapiens
aaaaguguugacugugu

SEQ ID NO: 1685641 - RNA, 13 nt, Homo sapiens
aaaaucauuaaca

SEQ ID NO: 1685642 - RNA, 12 nt, Homo sapiens
aaaaugcaauug

SEQ ID NO: 1685643 - RNA, 22 nt, Homo sapiens
aaaauuagaaucugaguauaaa

SEQ ID NO: 1685644 - RNA, 17 nt, Homo sapiens
aaaauuucauagcugua

SEQ ID NO: 1685645 - RNA, 18 nt, Homo sapiens
aaaauuuuguauguuaaa

SEQ ID NO: 1685646 - RNA, 16 nt, Homo sapiens
aaacaaagacuuugau

SEQ ID NO: 1685647 - RNA, 13 nt, Homo sapiens
aaacaacauuuau

SEQ ID NO: 1685648 - RNA, 15 nt, Homo sapiens
aaacaauucugugac

SEQ ID NO: 1685649 - RNA, 17 nt, Homo sapiens
aaacagcugcccugugu

SEQ ID NO: 1685650 - RNA, 13 nt, Homo sapiens
aaacauuuugaca

SEQ ID NO: 1685651 - RNA, 12 nt, Homo sapiens
aaacccagagau

SEQ ID NO: 1685652 - RNA, 12 nt, Homo sapiens
aaacuucaccua

SEQ ID NO: 1685653 - RNA, 19 nt, Homo sapiens
aaagaaauaaaccaaagga

SEQ ID NO: 1685654 - RNA, 14 nt, Homo sapiens
aaagaauaguagua

SEQ ID NO: 1685655 - RNA, 15 nt, Homo sapiens
aaagagaaguuccca

SEQ ID NO: 1685656 - RNA, 16 nt, Homo sapiens
aaagaugaaaaguaua

SEQ ID NO: 1685657 - RNA, 23 nt, Homo sapiens
aaagaugcaucaucucuuccuca

SEQ ID NO: 1685658 - RNA, 13 nt, Homo sapiens
aaagcaaaggugc

SEQ ID NO: 1685659 - RNA, 22 nt, Homo sapiens
aaagcacuccugcuuaaucuuc

SEQ ID NO: 1685660 - RNA, 14 nt, Homo sapiens
aaagcacuggccuu

SEQ ID NO: 1685661 - RNA, 20 nt, Homo sapiens
aaagcacuggccuugccucc

SEQ ID NO: 1685662 - RNA, 19 nt, Homo sapiens
aaagcuacuauguacugcc

SEQ ID NO: 1685663 - RNA, 21 nt, Homo sapiens
aauuaauaucccuacauguau

SEQ ID NO: 1685664 - RNA, 19 nt, Homo sapiens
aauuacauuucacuucaag

SEQ ID NO: 1685665 - RNA, 22 nt, Homo sapiens
aauuauguucuacagaauauuc

SEQ ID NO: 1685666 - RNA, 11 nt, Homo sapiens
aauuccagcua

SEQ ID NO: 1685667 - RNA, 16 nt, Homo sapiens
aauuccuguacugugu

SEQ ID NO: 1685668 - RNA, 16 nt, Homo sapiens
aauucuccugccuuag

SEQ ID NO: 1685669 - RNA, 17 nt, Homo sapiens
aauucuccugccuuagc

SEQ ID NO: 1685670 - RNA, 17 nt, Homo sapiens
aauucuuagucacaaaa

SEQ ID NO: 1685671 - RNA, 18 nt, Homo sapiens
aauugaaaaguacaacua

SEQ ID NO: 1685672 - RNA, 19 nt, Homo sapiens
aauuguacaaaauuaagca

SEQ ID NO: 1685673 - RNA, 13 nt, Homo sapiens
aauuuaauaccag

SEQ ID NO: 1685674 - RNA, 12 nt, Homo sapiens
aauuuagcucuc

SEQ ID NO: 1685675 - RNA, 14 nt, Homo sapiens
aauuuccugugagg

SEQ ID NO: 1685676 - RNA, 19 nt, Homo sapiens
aauuucucuuuacuugaaa

SEQ ID NO: 1685677 - RNA, 17 nt, Homo sapiens
aauuugggagagccaua

SEQ ID NO: 1685678 - RNA, 20 nt, Homo sapiens
aauuugggagagccauacau

SEQ ID NO: 1685679 - RNA, 22 nt, Homo sapiens
aauuuguguguuuuuagcugug

SEQ ID NO: 1685680 - RNA, 23 nt, Homo sapiens
aauuuuagaugccugugaaauag

SEQ ID NO: 1685681 - RNA, 20 nt, Homo sapiens
aauuuugguuuaugacucuu

SEQ ID NO: 1685682 - RNA, 13 nt, Homo sapiens
acaaaaauuagcu

SEQ ID NO: 1685683 - RNA, 17 nt, Homo sapiens
acaaacagaauuuucca

SEQ ID NO: 1685684 - RNA, 15 nt, Homo sapiens
acaagaaccacuccu

SEQ ID NO: 1685685 - RNA, 11 nt, Homo sapiens
acaagcauuuu

SEQ ID NO: 1685686 - RNA, 19 nt, Homo sapiens
acaagcuguaucacugccu

SEQ ID NO: 1685687 - RNA, 23 nt, Homo sapiens
acaauaaagaucgcccccaccuc

SEQ ID NO: 1685688 - RNA, 15 nt, Homo sapiens
acaauuaacugcccu

SEQ ID NO: 1685689 - RNA, 20 nt, Homo sapiens
cucugcugucuaaccuguga

SEQ ID NO: 1685690 - RNA, 21 nt, Homo sapiens
cucuggcauuccuuuucccaa

SEQ ID NO: 1685691 - RNA, 23 nt, Homo sapiens
cucuguccuucccccagcacaaa

SEQ ID NO: 1685692 - RNA, 20 nt, Homo sapiens
cucugugcuucgacuacugc

SEQ ID NO: 1685693 - RNA, 19 nt, Homo sapiens
cucuguuucccuuucacug

SEQ ID NO: 1685694 - RNA, 15 nt, Homo sapiens
cucuucccacuccag

SEQ ID NO: 1685695 - RNA, 15 nt, Homo sapiens
cucuuucccaacccc

SEQ ID NO: 1685696 - RNA, 12 nt, Homo sapiens
cugaaaggccag

SEQ ID NO: 1685697 - RNA, 18 nt, Homo sapiens
cugaacaccuauugcacu

SEQ ID NO: 1685698 - RNA, 17 nt, Homo sapiens
cugaacccuccaaagga

SEQ ID NO: 1685699 - RNA, 13 nt, Homo sapiens
cugaauuaguaau

SEQ ID NO: 1685700 - RNA, 23 nt, Homo sapiens
cugacaggccuuccuccucucaa

SEQ ID NO: 1685701 - RNA, 16 nt, Homo sapiens
cugagcagcauccacc

SEQ ID NO: 1685702 - RNA, 21 nt, Homo sapiens
cugagcaggaaagacuggccc

SEQ ID NO: 1685703 - RNA, 18 nt, Homo sapiens
cugaggcagaaggauuac

SEQ ID NO: 1685704 - RNA, 15 nt, Homo sapiens
cugaggcccagagag

SEQ ID NO: 1685705 - RNA, 18 nt, Homo sapiens
cugaguagcugggauuac

SEQ ID NO: 1685706 - RNA, 19 nt, Homo sapiens
cugauacuuugacaguguu

SEQ ID NO: 1685707 - RNA, 23 nt, Homo sapiens
cugaugccuguguacugccuuaa

SEQ ID NO: 1685708 - RNA, 15 nt, Homo sapiens
cugauugcauccacu

SEQ ID NO: 1685709 - RNA, 17 nt, Homo sapiens
cugcaaaacuccaggca

SEQ ID NO: 1685710 - RNA, 16 nt, Homo sapiens
cugcaaguaaguauga

SEQ ID NO: 1685711 - RNA, 11 nt, Homo sapiens
cugcagccuuc

SEQ ID NO: 1685712 - RNA, 21 nt, Homo sapiens
cugccauaaauauuucucaac

SEQ ID NO: 1685713 - RNA, 14 nt, Homo sapiens
cugcccgccuaaga

SEQ ID NO: 1685714 - RNA, 14 nt, Homo sapiens
cugcuaccaaaaca

SEQ ID NO: 1685715 - RNA, 13 nt, Homo sapiens
cugcucccauucc

SEQ ID NO: 1685716 - RNA, 19 nt, Homo sapiens
cugcuccccuaaagccagg

SEQ ID NO: 1685717 - RNA, 17 nt, Homo sapiens
cugcucuauacuguggc

SEQ ID NO: 1685718 - RNA, 14 nt, Homo sapiens
cugcugcaaggugg

SEQ ID NO: 1685719 - RNA, 17 nt, Homo sapiens
cugcugcugcuacugcu

SEQ ID NO: 1685720 - RNA, 15 nt, Homo sapiens
cugcuguugaacuuu

SEQ ID NO: 1685721 - RNA, 15 nt, Homo sapiens
cugcuucacugcccc

SEQ ID NO: 1685722 - RNA, 14 nt, Homo sapiens
cuggaagaagugag

SEQ ID NO: 1685723 - RNA, 15 nt, Homo sapiens
cuggaauucuaacaa

SEQ ID NO: 1685724 - RNA, 21 nt, Homo sapiens
cuggaauuuggacaagugcug

SEQ ID NO: 1685725 - RNA, 21 nt, Homo sapiens
cuggaccugcccugggccaca

SEQ ID NO: 1685726 - RNA, 13 nt, Homo sapiens
cuggagauaugaa

SEQ ID NO: 1685727 - RNA, 18 nt, Homo sapiens
cuggauccucaguucuca

SEQ ID NO: 1685728 - RNA, 19 nt, Homo sapiens
cuggaucucacaagcacuu

SEQ ID NO: 1685729 - RNA, 14 nt, Homo sapiens
cuggaugguggugc

SEQ ID NO: 1685730 - RNA, 18 nt, Homo sapiens
cuggauuucauacuguaa

SEQ ID NO: 1685731 - RNA, 15 nt, Homo sapiens
agaacagagugcaac

SEQ ID NO: 1685732 - RNA, 20 nt, Homo sapiens
agaacagagugcaacccagu

SEQ ID NO: 1685733 - RNA, 20 nt, Homo sapiens
agaaccacacuugaaaccuu

SEQ ID NO: 1685734 - RNA, 19 nt, Homo sapiens
agaaccucuaagugcugcu

SEQ ID NO: 1685735 - RNA, 20 nt, Homo sapiens
agaaccucuaagugcugcug

SEQ ID NO: 1685736 - RNA, 16 nt, Homo sapiens
agaagaaaauuugcca

SEQ ID NO: 1685737 - RNA, 19 nt, Homo sapiens
agaagccuaaaaaaagcua

SEQ ID NO: 1685738 - RNA, 21 nt, Homo sapiens
agaagccuccaagccugccuc

SEQ ID NO: 1685739 - RNA, 20 nt, Homo sapiens
agaagcuuaaaaucugugaa

SEQ ID NO: 1685740 - RNA, 19 nt, Homo sapiens
agaauaccacaucaaauaa

SEQ ID NO: 1685741 - RNA, 19 nt, Homo sapiens
agaaucgcuugaacccagg

SEQ ID NO: 1685742 - RNA, 22 nt, Homo sapiens
agaauguuucuggaauucuuca

SEQ ID NO: 1685743 - RNA, 15 nt, Homo sapiens
agaauuauaacugua

SEQ ID NO: 1685744 - RNA, 21 nt, Homo sapiens
agaauucaaguggguauucug

SEQ ID NO: 1685745 - RNA, 23 nt, Homo sapiens
agaccagcccaccccugugccca

SEQ ID NO: 1685746 - RNA, 15 nt, Homo sapiens
agacucuaguauuua

SEQ ID NO: 1685747 - RNA, 16 nt, Homo sapiens
agacuggcccucuagc

SEQ ID NO: 1685748 - RNA, 12 nt, Homo sapiens
agagaaggcagg

SEQ ID NO: 1685749 - RNA, 15 nt, Homo sapiens
agagaggaaccaaua

SEQ ID NO: 1685750 - RNA, 12 nt, Homo sapiens
agagcagggucu

SEQ ID NO: 1685751 - RNA, 18 nt, Homo sapiens
agagcagggucucucuaa

SEQ ID NO: 1685752 - RNA, 17 nt, Homo sapiens
agagccccuacuguggg

SEQ ID NO: 1685753 - RNA, 20 nt, Homo sapiens
agagccccuacugugggcaa

SEQ ID NO: 1685754 - RNA, 18 nt, Homo sapiens
agagccuaacaucuccau

SEQ ID NO: 1685755 - RNA, 16 nt, Homo sapiens
agaggaaccaauaccu

SEQ ID NO: 1685756 - RNA, 22 nt, Homo sapiens
agaggaauaacaucaccacugu

SEQ ID NO: 1685757 - RNA, 16 nt, Homo sapiens
agaggacucacuugcc

SEQ ID NO: 1685758 - RNA, 18 nt, Homo sapiens
agaggacucacuugccca

SEQ ID NO: 1685759 - RNA, 23 nt, Homo sapiens
uaaauugggaaaacuccaucaau

SEQ ID NO: 1685760 - RNA, 14 nt, Homo sapiens
uaaauuuuagcaag

SEQ ID NO: 1685761 - RNA, 21 nt, Homo sapiens
uaacacauuuuuuugcaugca

SEQ ID NO: 1685762 - RNA, 22 nt, Homo sapiens
uaacaucuaaaaauagacuuaa

SEQ ID NO: 1685763 - RNA, 14 nt, Homo sapiens
uaacaucugaccug

SEQ ID NO: 1685764 - RNA, 20 nt, Homo sapiens
uaacaugcccuguucagcua

SEQ ID NO: 1685765 - RNA, 18 nt, Homo sapiens
uaacuaugagccaggcau

SEQ ID NO: 1685766 - RNA, 18 nt, Homo sapiens
uaacugcccucugaaaua

SEQ ID NO: 1685767 - RNA, 19 nt, Homo sapiens
uaacuguuucauagcaaac

SEQ ID NO: 1685768 - RNA, 16 nt, Homo sapiens
uaagagguuuguauau

SEQ ID NO: 1685769 - RNA, 17 nt, Homo sapiens
uaagauuuugugaauug

SEQ ID NO: 1685770 - RNA, 23 nt, Homo sapiens
uaaguaaaagcuacuauguacug

SEQ ID NO: 1685771 - RNA, 12 nt, Homo sapiens
uaagucuuucau

SEQ ID NO: 1685772 - RNA, 11 nt, Homo sapiens
uaagugauaua

SEQ ID NO: 1685773 - RNA, 18 nt, Homo sapiens
uaaguguugguagcacuu

SEQ ID NO: 1685774 - RNA, 16 nt, Homo sapiens
uaaguuaucuuugaau

SEQ ID NO: 1685775 - RNA, 22 nt, Homo sapiens
uaauaagagaauguuccuacuc

SEQ ID NO: 1685776 - RNA, 18 nt, Homo sapiens
uaauaucccuacauguau

SEQ ID NO: 1685777 - RNA, 22 nt, Homo sapiens
uaaucuagagaaggcauuucau

SEQ ID NO: 1685778 - RNA, 15 nt, Homo sapiens
uaaucucagcacuuu

SEQ ID NO: 1685779 - RNA, 20 nt, Homo sapiens
uaauggcagcuagugccuuu

SEQ ID NO: 1685780 - RNA, 17 nt, Homo sapiens
uaauguauuaugagcca

SEQ ID NO: 1685781 - RNA, 12 nt, Homo sapiens
uaauuaccaugc

SEQ ID NO: 1685782 - RNA, 23 nt, Homo sapiens
uacaaaccauuuuguuauugacu

SEQ ID NO: 1685783 - RNA, 18 nt, Homo sapiens
uacaaacuuuguuuguca

SEQ ID NO: 1685784 - RNA, 15 nt, Homo sapiens
uacaacugauugcaa

SEQ ID NO: 1685785 - RNA, 13 nt, Homo sapiens
uacagacaucuaa

SEQ ID NO: 1685786 - RNA, 21 nt, Homo sapiens
uacagacaucuaauguucucc

SEQ ID NO: 1685787 - RNA, 14 nt, Homo sapiens
uacaggucaucugc

SEQ ID NO: 1685788 - RNA, 20 nt, Homo sapiens
uacagguuaagacaaagggu

SEQ ID NO: 1685789 - RNA, 14 nt, Homo sapiens
uacaugcauauaau

SEQ ID NO: 1685790 - RNA, 16 nt, Homo sapiens
uacauguauugcacau

SEQ ID NO: 1685791 - RNA, 18 nt, Homo sapiens
uacauuuacuggacccug

SEQ ID NO: 1685792 - RNA, 20 nt, Homo sapiens
uaccuccauccauccuucca

SEQ ID NO: 1685793 - RNA, 21 nt, Homo sapiens
uaccuccauccauccuuccaa

SEQ ID NO: 1685794 - RNA, 19 nt, Homo sapiens
uaccuggaggaaugauuag

SEQ ID NO: 1685795 - RNA, 20 nt, Homo sapiens
uaccuggauguucuuuuuac

SEQ ID NO: 1685796 - RNA, 20 nt, Homo sapiens
uacuagacuagacaucacaa

SEQ ID NO: 1685797 - RNA, 16 nt, Homo sapiens
uacuauguacugccuu

SEQ ID NO: 1685798 - RNA, 20 nt, Homo sapiens
uacugaaucugcuaccaaaa

SEQ ID NO: 1685799 - RNA, 18 nt, Homo sapiens
uacugccaaaacauuuau

SEQ ID NO: 1685800 - RNA, 22 nt, Homo sapiens
uacugggacaccauuaccaaaa

SEQ ID NO: 1685801 - RNA, 21 nt, Homo sapiens
uacuuacauguucccaaaaca

SEQ ID NO: 1685802 - RNA, 16 nt, Homo sapiens
uacuucuugaauauaa

SEQ ID NO: 1685803 - RNA, 17 nt, Homo sapiens
uacuuugguagcuggga

SEQ ID NO: 1685804 - RNA, 22 nt, Homo sapiens
uagaaaaguguggcuugggcau

SEQ ID NO: 1685805 - RNA, 20 nt, Homo sapiens
uagaaacucaggauggucau

SEQ ID NO: 1685806 - RNA, 21 nt, Homo sapiens
uagaaacugaggcccagagag

SEQ ID NO: 1685807 - RNA, 15 nt, Homo sapiens
ggugaacacugugac

SEQ ID NO: 1685808 - RNA, 16 nt, Homo sapiens
ggugacagcuccggga

SEQ ID NO: 1685809 - RNA, 21 nt, Homo sapiens
ggugacagugccuucucuauu

SEQ ID NO: 1685810 - RNA, 14 nt, Homo sapiens
ggugccaaccucuu

SEQ ID NO: 1685811 - RNA, 18 nt, Homo sapiens
ggugcccuuugggguccc

SEQ ID NO: 1685812 - RNA, 19 nt, Homo sapiens
ggugcccuuuggggucccg

SEQ ID NO: 1685813 - RNA, 13 nt, Homo sapiens
ggugcuucucaca

SEQ ID NO: 1685814 - RNA, 12 nt, Homo sapiens
gguggggggcca

SEQ ID NO: 1685815 - RNA, 18 nt, Homo sapiens
gguguuauuuucugagag

SEQ ID NO: 1685816 - RNA, 21 nt, Homo sapiens
gguucccaaaucccucucaca

SEQ ID NO: 1685817 - RNA, 15 nt, Homo sapiens
gguuccccaauccau

SEQ ID NO: 1685818 - RNA, 21 nt, Homo sapiens
gguucggcucuagggccucag

SEQ ID NO: 1685819 - RNA, 24 nt, Homo sapiens
gguucuguagagccaauuagacuu

SEQ ID NO: 1685820 - RNA, 21 nt, Homo sapiens
gguugcggaccuaggaccauu

SEQ ID NO: 1685821 - RNA, 15 nt, Homo sapiens
gguuggagugcucuu

SEQ ID NO: 1685822 - RNA, 19 nt, Homo sapiens
gguugucuuauugcaccau

SEQ ID NO: 1685823 - RNA, 15 nt, Homo sapiens
gguuucaaagugaua

SEQ ID NO: 1685824 - RNA, 19 nt, Homo sapiens
guaaaauagaugaguguua

SEQ ID NO: 1685825 - RNA, 12 nt, Homo sapiens
guaaaaugaagg

SEQ ID NO: 1685826 - RNA, 16 nt, Homo sapiens
guaaauacaugcauau

SEQ ID NO: 1685827 - RNA, 12 nt, Homo sapiens
guaaauguuucu

SEQ ID NO: 1685828 - RNA, 23 nt, Homo sapiens
guaacuguuuagaugaaugucag

SEQ ID NO: 1685829 - RNA, 14 nt, Homo sapiens
guaacuuccugugg

SEQ ID NO: 1685830 - RNA, 20 nt, Homo sapiens
guaaggcaggcccauucaga

SEQ ID NO: 1685831 - RNA, 18 nt, Homo sapiens
guaauaaaugugacucag

SEQ ID NO: 1685832 - RNA, 15 nt, Homo sapiens
guacagauucuuuca

SEQ ID NO: 1685833 - RNA, 17 nt, Homo sapiens
guaccugcuggguguuu

SEQ ID NO: 1685834 - RNA, 13 nt, Homo sapiens
guacugccuuaaa

SEQ ID NO: 1685835 - RNA, 18 nt, Homo sapiens
guacugccuuagugcuga

SEQ ID NO: 1685836 - RNA, 20 nt, Homo sapiens
guacuguacuuucccagguu

SEQ ID NO: 1685837 - RNA, 22 nt, Homo sapiens
guagaaacugaggcccagagag

SEQ ID NO: 1685838 - RNA, 15 nt, Homo sapiens
guagugccacuguug

SEQ ID NO: 1685839 - RNA, 18 nt, Homo sapiens
guaucauguauggugaua

SEQ ID NO: 1685840 - RNA, 18 nt, Homo sapiens
guauucauuacuagauaa

SEQ ID NO: 1685841 - RNA, 22 nt, Homo sapiens
guauucccaaaaauuacuuugg

SEQ ID NO: 1685842 - RNA, 18 nt, Homo sapiens
guauuccgauacaaagug

SEQ ID NO: 1685843 - RNA, 12 nt, Homo sapiens
gucaacauuucu

SEQ ID NO: 1685844 - RNA, 18 nt, Homo sapiens
gucaacuuauucuuugag

SEQ ID NO: 1685845 - RNA, 20 nt, Homo sapiens
gucaagaagaggaaagggag

SEQ ID NO: 1685846 - RNA, 19 nt, Homo sapiens
gucagcugcuguugaacuu

SEQ ID NO: 1685847 - RNA, 21 nt, Homo sapiens
guccuaaaaguucucaaugua

SEQ ID NO: 1685848 - RNA, 16 nt, Homo sapiens
guccuauuauauucau

SEQ ID NO: 1685849 - RNA, 14 nt, Homo sapiens
gucggauccuguga

SEQ ID NO: 1685850 - RNA, 16 nt, Homo sapiens
gucuauuaauauucag

SEQ ID NO: 1685851 - RNA, 18 nt, Homo sapiens
gucuggcuccagcccuug

SEQ ID NO: 1685852 - RNA, 16 nt, Homo sapiens
gucugguugcuaauga

SEQ ID NO: 1685853 - RNA, 15 nt, Homo sapiens
gucuguggcuuucag

SEQ ID NO: 1685854 - RNA, 12 nt, Homo sapiens
gagccaugucau

SEQ ID NO: 1685855 - RNA, 15 nt, Homo sapiens
gagcccauucccacc

SEQ ID NO: 1685856 - RNA, 21 nt, Homo sapiens
gagccuuacuucaaagugccu

SEQ ID NO: 1685857 - RNA, 22 nt, Homo sapiens
gagcuacagaacacuuugcuag

SEQ ID NO: 1685858 - RNA, 17 nt, Homo sapiens
gagcuagaaacucagga

SEQ ID NO: 1685859 - RNA, 21 nt, Homo sapiens
gagcugauacuuugacagugu

SEQ ID NO: 1685860 - RNA, 17 nt, Homo sapiens
gagcugcucucucauga

SEQ ID NO: 1685861 - RNA, 12 nt, Homo sapiens
gaggaaagggag

SEQ ID NO: 1685862 - RNA, 23 nt, Homo sapiens
gaggacagggcccccacagggga

SEQ ID NO: 1685863 - RNA, 16 nt, Homo sapiens
gaggagccugcaacau

SEQ ID NO: 1685864 - RNA, 17 nt, Homo sapiens
gaggcaaacagcaagag

SEQ ID NO: 1685865 - RNA, 12 nt, Homo sapiens
gaggcacuucca

SEQ ID NO: 1685866 - RNA, 17 nt, Homo sapiens
gaggcagauagcacugg

SEQ ID NO: 1685867 - RNA, 13 nt, Homo sapiens
gaggcucagagag

SEQ ID NO: 1685868 - RNA, 17 nt, Homo sapiens
gagguuuauacugcaaa

SEQ ID NO: 1685869 - RNA, 15 nt, Homo sapiens
gaguaaaauucaguu

SEQ ID NO: 1685870 - RNA, 15 nt, Homo sapiens
gaguaagcaguguua

SEQ ID NO: 1685871 - RNA, 20 nt, Homo sapiens
gaguaccuacugugugccag

SEQ ID NO: 1685872 - RNA, 22 nt, Homo sapiens
gagucagugccagguccuugcc

SEQ ID NO: 1685873 - RNA, 13 nt, Homo sapiens
gaguccacuccca

SEQ ID NO: 1685874 - RNA, 22 nt, Homo sapiens
gagugauaauaguccuuuacaa

SEQ ID NO: 1685875 - RNA, 13 nt, Homo sapiens
gagugauucuguc

SEQ ID NO: 1685876 - RNA, 22 nt, Homo sapiens
gaguguuguuuugugguaucau

SEQ ID NO: 1685877 - RNA, 21 nt, Homo sapiens
gauaaaugagugauucugucc

SEQ ID NO: 1685878 - RNA, 13 nt, Homo sapiens
gauaagucuuuca

SEQ ID NO: 1685879 - RNA, 14 nt, Homo sapiens
gauaccauaugaau

SEQ ID NO: 1685880 - RNA, 16 nt, Homo sapiens
gauacuuugacagugu

SEQ ID NO: 1685881 - RNA, 16 nt, Homo sapiens
gauacuuuuacagguu

SEQ ID NO: 1685882 - RNA, 20 nt, Homo sapiens
gauauaauggauaauuuuca

SEQ ID NO: 1685883 - RNA, 12 nt, Homo sapiens
gauauaccaaau

SEQ ID NO: 1685884 - RNA, 16 nt, Homo sapiens
gauauugaauguuaaa

SEQ ID NO: 1685885 - RNA, 18 nt, Homo sapiens
gaugagagaauguggaaa

SEQ ID NO: 1685886 - RNA, 16 nt, Homo sapiens
gaugagggaagcaaua

SEQ ID NO: 1685887 - RNA, 12 nt, Homo sapiens
gaugcauuuaau

SEQ ID NO: 1685888 - RNA, 22 nt, Homo sapiens
gauggagugugcagacagccau

SEQ ID NO: 1685889 - RNA, 20 nt, Homo sapiens
gaugucucugcaaaccaaca

SEQ ID NO: 1685890 - RNA, 23 nt, Homo sapiens
gauuacucuccauaucccuuccu

SEQ ID NO: 1685891 - RNA, 23 nt, Homo sapiens
gauuucucacccucuguccuucc

SEQ ID NO: 1685892 - RNA, 20 nt, Homo sapiens
gcaaagcaaauguugggaaa

SEQ ID NO: 1685893 - RNA, 13 nt, Homo sapiens
gcaaauacuguau

SEQ ID NO: 1685894 - RNA, 16 nt, Homo sapiens
gcaaauggccaaugag

SEQ ID NO: 1685895 - RNA, 17 nt, Homo sapiens
gcaaauggccaaugaga

SEQ ID NO: 1685896 - RNA, 13 nt, Homo sapiens
gcaaauguuaaaa

SEQ ID NO: 1685897 - RNA, 14 nt, Homo sapiens
gcaacagacuugaa

SEQ ID NO: 1685898 - RNA, 17 nt, Homo sapiens
gcaauaauaaaguacuu

SEQ ID NO: 1685899 - RNA, 23 nt, Homo sapiens
gcaauacugcuuaauugcugaua

SEQ ID NO: 1685900 - RNA, 22 nt, Homo sapiens
gcaaugaggcagauagcacugg

SEQ ID NO: 1685901 - RNA, 16 nt, Homo sapiens
gcaaugcaugauacua

SEQ ID NO: 1685902 - RNA, 21 nt, Homo sapiens
gcaaugucucuuugugcucua

SEQ ID NO: 1685903 - RNA, 18 nt, Homo sapiens
gcaauucuccugccuuag

SEQ ID NO: 1685904 - RNA, 20 nt, Homo sapiens
gcacaagacuggcccagugc

SEQ ID NO: 1685905 - RNA, 12 nt, Homo sapiens
gcacauuaacug

SEQ ID NO: 1685906 - RNA, 14 nt, Homo sapiens
gcacauuucuuugc

SEQ ID NO: 1685907 - RNA, 15 nt, Homo sapiens
gcacauuucuuugca

SEQ ID NO: 1685908 - RNA, 14 nt, Homo sapiens
gcaccaggggccaa

SEQ ID NO: 1685909 - RNA, 19 nt, Homo sapiens
gcaccuacacucaccugca

SEQ ID NO: 1685910 - RNA, 16 nt, Homo sapiens
gcacugagcagggauc

SEQ ID NO: 1685911 - RNA, 16 nt, Homo sapiens
gcacuggccuugccuc

SEQ ID NO: 1685912 - RNA, 14 nt, Homo sapiens
gcacuuucuucucu

SEQ ID NO: 1685913 - RNA, 18 nt, Homo sapiens
gcagaaauauagugcaau

SEQ ID NO: 1685914 - RNA, 16 nt, Homo sapiens
gcagagauguacugca

SEQ ID NO: 1685915 - RNA, 16 nt, Homo sapiens
gcagcaggccagagaa

SEQ ID NO: 1685916 - RNA, 17 nt, Homo sapiens
gcaggagaaucgcuuga

SEQ ID NO: 1685917 - RNA, 15 nt, Homo sapiens
gcagucuaauuacau

SEQ ID NO: 1685918 - RNA, 19 nt, Homo sapiens
gcauacugccuuguuuaau

SEQ ID NO: 1685919 - RNA, 20 nt, Homo sapiens
gcauagcaguauauguuaau

SEQ ID NO: 1685920 - RNA, 20 nt, Homo sapiens
gcauaggcuggggacacagg

SEQ ID NO: 1685921 - RNA, 18 nt, Homo sapiens
gcaucaucucuuccucac

SEQ ID NO: 1685922 - RNA, 22 nt, Homo sapiens
gcaugcagcuuugcaaacccau

SEQ ID NO: 1685923 - RNA, 23 nt, Homo sapiens
gcauuaacaaggaaaaauacuga

SEQ ID NO: 1685924 - RNA, 21 nt, Homo sapiens
gcauuagcaaggcagagccuu

SEQ ID NO: 1685925 - RNA, 14 nt, Homo sapiens
gcauuguguggaau

SEQ ID NO: 1685926 - RNA, 18 nt, Homo sapiens
gccaaaggaugugauaua

SEQ ID NO: 1685927 - RNA, 17 nt, Homo sapiens
gccaagcuggcacaaaa

SEQ ID NO: 1685928 - RNA, 22 nt, Homo sapiens
gccacagaggacucacuugccc

SEQ ID NO: 1685929 - RNA, 17 nt, Homo sapiens
gccacuaugccugacua

SEQ ID NO: 1685930 - RNA, 15 nt, Homo sapiens
gccagagaaagcaaa

SEQ ID NO: 1685931 - RNA, 22 nt, Homo sapiens
gccagagaaagcaaaggugcac

SEQ ID NO: 1685932 - RNA, 22 nt, Homo sapiens
gccagagguaauguuaguaaau

SEQ ID NO: 1685933 - RNA, 17 nt, Homo sapiens
gccagcugugcacuuuc

SEQ ID NO: 1685934 - RNA, 14 nt, Homo sapiens
gccaggcucaggag

SEQ ID NO: 1685935 - RNA, 17 nt, Homo sapiens
gcccccccuaucucuuc

SEQ ID NO: 1685936 - RNA, 19 nt, Homo sapiens
gcccccuccuugucugugc

SEQ ID NO: 1685937 - RNA, 19 nt, Homo sapiens
gccgggugugguggcucac

SEQ ID NO: 1685938 - RNA, 17 nt, Homo sapiens
gccgucuccucccucag

SEQ ID NO: 1685939 - RNA, 13 nt, Homo sapiens
gccuaaccuggga

SEQ ID NO: 1685940 - RNA, 17 nt, Homo sapiens
gccuaugucuggcagau

SEQ ID NO: 1685941 - RNA, 17 nt, Homo sapiens
gccucaagucacuccca

SEQ ID NO: 1685942 - RNA, 18 nt, Homo sapiens
gccucaagucacucccaa

SEQ ID NO: 1685943 - RNA, 14 nt, Homo sapiens
gccuccugcaaagu

SEQ ID NO: 1685944 - RNA, 14 nt, Homo sapiens
gccucuugcaaugc

SEQ ID NO: 1685945 - RNA, 21 nt, Homo sapiens
gccugcagagcaggaccuggg

SEQ ID NO: 1685946 - RNA, 20 nt, Homo sapiens
gccugcuugacuuuccagaa

SEQ ID NO: 1685947 - RNA, 21 nt, Homo sapiens
gccuggaucucacaagcacuu

SEQ ID NO: 1685948 - RNA, 16 nt, Homo sapiens
gccugggugacauuug

SEQ ID NO: 1685949 - RNA, 21 nt, Homo sapiens
gccuguaaucucagcacuuug

SEQ ID NO: 1685950 - RNA, 14 nt, Homo sapiens
gccuugcaacccaa

SEQ ID NO: 1685951 - RNA, 18 nt, Homo sapiens
gcgaccccgucacagccu

SEQ ID NO: 1685952 - RNA, 19 nt, Homo sapiens
gcgccuguaauuccagcua

SEQ ID NO: 1685953 - RNA, 17 nt, Homo sapiens
gcggauccaagcaaaug

SEQ ID NO: 1685954 - RNA, 17 nt, Homo sapiens
gcuaaagaauccauaaa

SEQ ID NO: 1685955 - RNA, 15 nt, Homo sapiens
gcuaccaacuuguau

SEQ ID NO: 1685956 - RNA, 17 nt, Homo sapiens
gcuacuauguacugccu

SEQ ID NO: 1685957 - RNA, 13 nt, Homo sapiens
gcuagcaguacua

SEQ ID NO: 1685958 - RNA, 15 nt, Homo sapiens
gcuagcaguacuaau

SEQ ID NO: 1685959 - RNA, 23 nt, Homo sapiens
gcuaggagauacucuucugccuc

SEQ ID NO: 1685960 - RNA, 20 nt, Homo sapiens
gcuauuuuuaauuuccugug

SEQ ID NO: 1685961 - RNA, 16 nt, Homo sapiens
gcucaggucaacugac

SEQ ID NO: 1685962 - RNA, 17 nt, Homo sapiens
gcuccagcccuugucag

SEQ ID NO: 1685963 - RNA, 22 nt, Homo sapiens
gcuccagcccuugucagauuca

SEQ ID NO: 1685964 - RNA, 20 nt, Homo sapiens
gcuccuccuugcccagacua

SEQ ID NO: 1685965 - RNA, 13 nt, Homo sapiens
gcuccuguggcag

SEQ ID NO: 1685966 - RNA, 17 nt, Homo sapiens
gcugaaauucaccaaga

SEQ ID NO: 1685967 - RNA, 18 nt, Homo sapiens
gcugaacauaacuucuca

SEQ ID NO: 1685968 - RNA, 18 nt, Homo sapiens
gcugacagagcucugggu

SEQ ID NO: 1685969 - RNA, 14 nt, Homo sapiens
gcugaggcugagaa

SEQ ID NO: 1685970 - RNA, 22 nt, Homo sapiens
gcugaugccuguguacugccuu

SEQ ID NO: 1685971 - RNA, 17 nt, Homo sapiens
gcugcacacacucaccu

SEQ ID NO: 1685972 - RNA, 19 nt, Homo sapiens
gcugcacacacucaccucu

SEQ ID NO: 1685973 - RNA, 16 nt, Homo sapiens
gcugcccucacugccu

SEQ ID NO: 1685974 - RNA, 12 nt, Homo sapiens
gcugcuacugcu

SEQ ID NO: 1685975 - RNA, 23 nt, Homo sapiens
ccaaugcugucugguugcgccau

SEQ ID NO: 1685976 - RNA, 22 nt, Homo sapiens
ccaauggaaaauauaaugauca

SEQ ID NO: 1685977 - RNA, 13 nt, Homo sapiens
ccaauuagacuug

SEQ ID NO: 1685978 - RNA, 19 nt, Homo sapiens
ccaauuucucuuuacuuga

SEQ ID NO: 1685979 - RNA, 21 nt, Homo sapiens
ccacagaaggugaacuuugug

SEQ ID NO: 1685980 - RNA, 12 nt, Homo sapiens
ccagacucuggg

SEQ ID NO: 1685981 - RNA, 22 nt, Homo sapiens
ccagauaacuuucggcagguuc

SEQ ID NO: 1685982 - RNA, 16 nt, Homo sapiens
ccagccccugguggug

SEQ ID NO: 1685983 - RNA, 20 nt, Homo sapiens
ccagcccugggcacauagca

SEQ ID NO: 1685984 - RNA, 17 nt, Homo sapiens
ccagcuacucaggaguc

SEQ ID NO: 1685985 - RNA, 18 nt, Homo sapiens
ccagcuacucaggagucu

SEQ ID NO: 1685986 - RNA, 15 nt, Homo sapiens
ccagcugugcacuuu

SEQ ID NO: 1685987 - RNA, 19 nt, Homo sapiens
ccagcugugcacuuucuuc

SEQ ID NO: 1685988 - RNA, 17 nt, Homo sapiens
ccaggaccuugcuuccu

SEQ ID NO: 1685989 - RNA, 14 nt, Homo sapiens
ccaggauucagcua

SEQ ID NO: 1685990 - RNA, 15 nt, Homo sapiens
ccaggccugggaaug

SEQ ID NO: 1685991 - RNA, 17 nt, Homo sapiens
ccagggacagggcccug

SEQ ID NO: 1685992 - RNA, 17 nt, Homo sapiens
ccagggaggcagccuag

SEQ ID NO: 1685993 - RNA, 23 nt, Homo sapiens
ccagggaggggucccugcaaaac

SEQ ID NO: 1685994 - RNA, 20 nt, Homo sapiens
ccagggcaccguauuccucu

SEQ ID NO: 1685995 - RNA, 15 nt, Homo sapiens
ccagggguguagaug

SEQ ID NO: 1685996 - RNA, 22 nt, Homo sapiens
ccaguaaaauacuauugccuca

SEQ ID NO: 1685997 - RNA, 13 nt, Homo sapiens
ccaguacauuuaa

SEQ ID NO: 1685998 - RNA, 16 nt, Homo sapiens
ccagucacuucugggg

SEQ ID NO: 1685999 - RNA, 20 nt, Homo sapiens
ccagucugugaagucaagaa

SEQ ID NO: 1686000 - RNA, 22 nt, Homo sapiens
ccaguuccucuuuugugcugcu

SEQ ID NO: 1686001 - RNA, 19 nt, Homo sapiens
ccauaucccuuccucucag

SEQ ID NO: 1686002 - RNA, 19 nt, Homo sapiens
ccauauuuaauaaagcaca

SEQ ID NO: 1686003 - RNA, 21 nt, Homo sapiens
ccaucaauaaauguugcaaug

SEQ ID NO: 1686004 - RNA, 15 nt, Homo sapiens
ccaucagacugucaa

SEQ ID NO: 1686005 - RNA, 16 nt, Homo sapiens
ccaucauacacuuccu

SEQ ID NO: 1686006 - RNA, 14 nt, Homo sapiens
ccauccaucuuucc

SEQ ID NO: 1686007 - RNA, 20 nt, Homo sapiens
ccaucguauuaaaaaacaau

SEQ ID NO: 1686008 - RNA, 22 nt, Homo sapiens
ccaucuuugcugccagcucuca

SEQ ID NO: 1686009 - RNA, 19 nt, Homo sapiens
ccaugaguuaucaugaauu

SEQ ID NO: 1686010 - RNA, 18 nt, Homo sapiens
ccaugcuuuguagguguc

SEQ ID NO: 1686011 - RNA, 16 nt, Homo sapiens
ccauuacagagguauu

SEQ ID NO: 1686012 - RNA, 13 nt, Homo sapiens
ccauuaccuccau

SEQ ID NO: 1686013 - RNA, 16 nt, Homo sapiens
ccauuaccuccaucca

SEQ ID NO: 1686014 - RNA, 16 nt, Homo sapiens
ccauucagagcuaugg

SEQ ID NO: 1686015 - RNA, 17 nt, Homo sapiens
ccauuccggguucacuc

SEQ ID NO: 1686016 - RNA, 16 nt, Homo sapiens
ccauuccugaucccau

SEQ ID NO: 1686017 - RNA, 19 nt, Homo sapiens
ccauuucaguucaguuuca

SEQ ID NO: 1686018 - RNA, 15 nt, Homo sapiens
cccaaccuacauucc

SEQ ID NO: 1686019 - RNA, 18 nt, Homo sapiens
cccaaucaccuuuccugu

SEQ ID NO: 1686020 - RNA, 17 nt, Homo sapiens
cccacagguguguuucc

SEQ ID NO: 1686021 - RNA, 14 nt, Homo sapiens
cccaccacuggcca

SEQ ID NO: 1686022 - RNA, 18 nt, Homo sapiens
cccagacaauuccauuca

SEQ ID NO: 1686023 - RNA, 20 nt, Homo sapiens
cccagacaauuccauucaau

SEQ ID NO: 1686024 - RNA, 24 nt, Homo sapiens
cccagcaaaggggagucucagcuu

SEQ ID NO: 1686025 - RNA, 11 nt, Homo sapiens
cccagucccau

SEQ ID NO: 1686026 - RNA, 15 nt, Homo sapiens
cccagucccauuccu

SEQ ID NO: 1686027 - RNA, 21 nt, Homo sapiens
cccagugcuugcaagauucca

SEQ ID NO: 1686028 - RNA, 22 nt, Homo sapiens
cccaugauuuggggugauuucu

SEQ ID NO: 1686029 - RNA, 18 nt, Homo sapiens
cccauuccucccuccggc

SEQ ID NO: 1686030 - RNA, 20 nt, Homo sapiens
ccccaagggggcugcugcuc

SEQ ID NO: 1686031 - RNA, 22 nt, Homo sapiens
ccccaggcaucuguuagcagag

SEQ ID NO: 1686032 - RNA, 12 nt, Homo sapiens
ccccuacugugg

SEQ ID NO: 1686033 - RNA, 13 nt, Homo sapiens
cccuacaccaaca

SEQ ID NO: 1686034 - RNA, 22 nt, Homo sapiens
cccuagggcucuccaagcacua

SEQ ID NO: 1686035 - RNA, 19 nt, Homo sapiens
cccuccauucauccuucca

SEQ ID NO: 1686036 - RNA, 22 nt, Homo sapiens
cccucugugcuucgacuacugc

SEQ ID NO: 1686037 - RNA, 17 nt, Homo sapiens
cccugucucuacuaaaa

SEQ ID NO: 1686038 - RNA, 15 nt, Homo sapiens
cccuuggacauuuua

SEQ ID NO: 1686039 - RNA, 13 nt, Homo sapiens
cccuuugugacuu

SEQ ID NO: 1686040 - RNA, 19 nt, Homo sapiens
cccuuugugacuucaagaa

SEQ ID NO: 1686041 - RNA, 12 nt, Homo sapiens
ccgauaccaugc

SEQ ID NO: 1686042 - RNA, 13 nt, Homo sapiens
ccgcagaccugga

SEQ ID NO: 1686043 - RNA, 20 nt, Homo sapiens
ccggggagaaacccagagau

SEQ ID NO: 1686044 - RNA, 21 nt, Homo sapiens
ccgucuuccagagaaccugug

SEQ ID NO: 1686045 - RNA, 21 nt, Homo sapiens
ccgucuucucccuauucccuc

SEQ ID NO: 1686046 - RNA, 15 nt, Homo sapiens
ccuaacaaaugcucc

SEQ ID NO: 1686047 - RNA, 21 nt, Homo sapiens
ccuaagagaugggacuaggac

SEQ ID NO: 1686048 - RNA, 20 nt, Homo sapiens
ccuaauucaauccuacuuuu

SEQ ID NO: 1686049 - RNA, 21 nt, Homo sapiens
ccuacauguauugcacauugu

SEQ ID NO: 1686050 - RNA, 14 nt, Homo sapiens
ccuacauuaucuca

SEQ ID NO: 1686051 - RNA, 14 nt, Homo sapiens
ccuagaaagacaga

SEQ ID NO: 1686052 - RNA, 12 nt, Homo sapiens
ccuauagcucuu

SEQ ID NO: 1686053 - RNA, 21 nt, Homo sapiens
ccuauucccucucucucccag

SEQ ID NO: 1686054 - RNA, 21 nt, Homo sapiens
ccucaacauugcauggugcua

SEQ ID NO: 1686055 - RNA, 22 nt, Homo sapiens
ccucaacauugcauggugcuag

SEQ ID NO: 1686056 - RNA, 21 nt, Homo sapiens
ccucaggguggggggugacag

SEQ ID NO: 1686057 - RNA, 16 nt, Homo sapiens
ccuccagacucagcag

SEQ ID NO: 1686058 - RNA, 20 nt, Homo sapiens
ccuccugauggagugugcag

SEQ ID NO: 1686059 - RNA, 21 nt, Homo sapiens
ccucugaaagaugcaucaucu

SEQ ID NO: 1686060 - RNA, 22 nt, Homo sapiens
ccucuuggccacagaggacuca

SEQ ID NO: 1686061 - RNA, 13 nt, Homo sapiens
ccugcauguucug

SEQ ID NO: 1686062 - RNA, 20 nt, Homo sapiens
ccugcucuaaggcaguagaa

SEQ ID NO: 1686063 - RNA, 21 nt, Homo sapiens
ccuggagugucggauccugug

SEQ ID NO: 1686064 - RNA, 11 nt, Homo sapiens
ccuggcacaau

SEQ ID NO: 1686065 - RNA, 12 nt, Homo sapiens
ccugggcacaaa

SEQ ID NO: 1686066 - RNA, 18 nt, Homo sapiens
ccugggcacauagcauag

SEQ ID NO: 1686067 - RNA, 14 nt, Homo sapiens
ccugggcugugagg

SEQ ID NO: 1686068 - RNA, 22 nt, Homo sapiens
ccugggugacauuugggagaca

SEQ ID NO: 1686069 - RNA, 16 nt, Homo sapiens
ccuguaauaaauaugu

SEQ ID NO: 1686070 - RNA, 21 nt, Homo sapiens
ccugucugcuaggcgcugggg

SEQ ID NO: 1686071 - RNA, 22 nt, Homo sapiens
ccugugaggacugguugucucu

SEQ ID NO: 1686072 - RNA, 22 nt, Homo sapiens
ccugugugggacugaguggcaa

SEQ ID NO: 1686073 - RNA, 16 nt, Homo sapiens
ccuguucagcuacucc

SEQ ID NO: 1686074 - RNA, 22 nt, Homo sapiens
ccuuaaaauguggucugccaau

SEQ ID NO: 1686075 - RNA, 23 nt, Homo sapiens
ccuuauuuugugugcuuucccag

SEQ ID NO: 1686076 - RNA, 16 nt, Homo sapiens
ccuuccucucaggcuc

SEQ ID NO: 1686077 - RNA, 15 nt, Homo sapiens
ccuugagucucugaa

SEQ ID NO: 1686078 - RNA, 13 nt, Homo sapiens
ccuugcagauauc

SEQ ID NO: 1686079 - RNA, 17 nt, Homo sapiens
ccuuuaucauccuuaaa

SEQ ID NO: 1686080 - RNA, 15 nt, Homo sapiens
ccuuuggaauggugu

SEQ ID NO: 1686081 - RNA, 14 nt, Homo sapiens
cgacucugaccucu

SEQ ID NO: 1686082 - RNA, 13 nt, Homo sapiens
cgauacaaagugu

SEQ ID NO: 1686083 - RNA, 17 nt, Homo sapiens
cgccagcguguggagca

SEQ ID NO: 1686084 - RNA, 16 nt, Homo sapiens
cgcccccccuaucucu

SEQ ID NO: 1686085 - RNA, 18 nt, Homo sapiens
cgccuguaauuccagcua

SEQ ID NO: 1686086 - RNA, 14 nt, Homo sapiens
cgcuagcaguacua

SEQ ID NO: 1686087 - RNA, 22 nt, Homo sapiens
cggacccuucuggguccaggga

SEQ ID NO: 1686088 - RNA, 18 nt, Homo sapiens
cggagagagaauguauuu

SEQ ID NO: 1686089 - RNA, 22 nt, Homo sapiens
cggagggccccugcgugggggc

SEQ ID NO: 1686090 - RNA, 13 nt, Homo sapiens
cggcacagccuuc

SEQ ID NO: 1686091 - RNA, 17 nt, Homo sapiens
cggguucucccaugauu

SEQ ID NO: 1686092 - RNA, 15 nt, Homo sapiens
cgucuccucccucag

SEQ ID NO: 1686093 - RNA, 23 nt, Homo sapiens
cuaaaaaucaaauaagcuaauaa

SEQ ID NO: 1686094 - RNA, 13 nt, Homo sapiens
cuaaaaguacaaa

SEQ ID NO: 1686095 - RNA, 18 nt, Homo sapiens
aaaaacucaggcaaagaa

SEQ ID NO: 1686096 - RNA, 21 nt, Homo sapiens
aaaaagucaccaaauagugug

SEQ ID NO: 1686097 - RNA, 14 nt, Homo sapiens
aaaagacacugcag

SEQ ID NO: 1686098 - RNA, 16 nt, Homo sapiens
aaaaggauaguaagca

SEQ ID NO: 1686099 - RNA, 14 nt, Homo sapiens
aaaagucucacaaa

SEQ ID NO: 1686100 - RNA, 16 nt, Homo sapiens
aaaauccaaaacucuu

SEQ ID NO: 1686101 - RNA, 19 nt, Homo sapiens
aaaaugcaagccaucucua

SEQ ID NO: 1686102 - RNA, 19 nt, Homo sapiens
aaacacucaacaaacuuag

SEQ ID NO: 1686103 - RNA, 20 nt, Homo sapiens
aaacagaauuuuccauuuau

SEQ ID NO: 1686104 - RNA, 18 nt, Homo sapiens
aaacaggugcuaauuugu

SEQ ID NO: 1686105 - RNA, 21 nt, Homo sapiens
aaacagguuauaacaguguuu

SEQ ID NO: 1686106 - RNA, 15 nt, Homo sapiens
aaacauacaguccau

SEQ ID NO: 1686107 - RNA, 11 nt, Homo sapiens
aaacauuugcu

SEQ ID NO: 1686108 - RNA, 20 nt, Homo sapiens
aaacccaucuuuuguucucc

SEQ ID NO: 1686109 - RNA, 14 nt, Homo sapiens
aaacccccacucca

SEQ ID NO: 1686110 - RNA, 18 nt, Homo sapiens
aaacccccacuccagcuc

SEQ ID NO: 1686111 - RNA, 13 nt, Homo sapiens
aaacuaacuugau

SEQ ID NO: 1686112 - RNA, 17 nt, Homo sapiens
aaacucuuaaguccuaa

SEQ ID NO: 1686113 - RNA, 17 nt, Homo sapiens
aaacuuacaaacuuugu

SEQ ID NO: 1686114 - RNA, 15 nt, Homo sapiens
aaagaagugaaacua

SEQ ID NO: 1686115 - RNA, 18 nt, Homo sapiens
aaagaagugaaacuauau

SEQ ID NO: 1686116 - RNA, 20 nt, Homo sapiens
aaagaauaguaguaacuguu

SEQ ID NO: 1686117 - RNA, 12 nt, Homo sapiens
aaagacuggccc

SEQ ID NO: 1686118 - RNA, 21 nt, Homo sapiens
aaagacuuugauccauguaug

SEQ ID NO: 1686119 - RNA, 16 nt, Homo sapiens
aaagauccuauagcuc

SEQ ID NO: 1686120 - RNA, 17 nt, Homo sapiens
aaagaugcaucaucucu

SEQ ID NO: 1686121 - RNA, 18 nt, Homo sapiens
aaagcacuggccuugccu

SEQ ID NO: 1686122 - RNA, 13 nt, Homo sapiens
aaagcuacuaugu

SEQ ID NO: 1686123 - RNA, 23 nt, Homo sapiens
aaagcuacuauguacugccuuag

SEQ ID NO: 1686124 - RNA, 17 nt, Homo sapiens
aaaggaaauaggaucuc

SEQ ID NO: 1686125 - RNA, 12 nt, Homo sapiens
aaaggugguggu

SEQ ID NO: 1686126 - RNA, 23 nt, Homo sapiens
aaaguaaggugcuuggaguuuac

SEQ ID NO: 1686127 - RNA, 21 nt, Homo sapiens
aaagugcuggaauuacaggcg

SEQ ID NO: 1686128 - RNA, 18 nt, Homo sapiens
aaaguguauuuguguaua

SEQ ID NO: 1686129 - RNA, 15 nt, Homo sapiens
aaauaaaagcacuua

SEQ ID NO: 1686130 - RNA, 15 nt, Homo sapiens
aaauacacauuugcu

SEQ ID NO: 1686131 - RNA, 15 nt, Homo sapiens
aaauagacaaaaagu

SEQ ID NO: 1686132 - RNA, 22 nt, Homo sapiens
aaauagaugugucuuaacauaa

SEQ ID NO: 1686133 - RNA, 13 nt, Homo sapiens
aaauauuucucaa

SEQ ID NO: 1686134 - RNA, 11 nt, Homo sapiens
aaaucuauucc

SEQ ID NO: 1686135 - RNA, 19 nt, Homo sapiens
aaaucuucccaugcauucu

SEQ ID NO: 1686136 - RNA, 22 nt, Homo sapiens
aaaugacaaccugaauuaucua

SEQ ID NO: 1686137 - RNA, 18 nt, Homo sapiens
aaaugauuucacagugug

SEQ ID NO: 1686138 - RNA, 22 nt, Homo sapiens
aaaugcauauuugcaaagugua

SEQ ID NO: 1686139 - RNA, 16 nt, Homo sapiens
aaaugccaguggugga

SEQ ID NO: 1686140 - RNA, 20 nt, Homo sapiens
aaauggaggaucucuaaaga

SEQ ID NO: 1686141 - RNA, 15 nt, Homo sapiens
aaauggguuuauuca

SEQ ID NO: 1686142 - RNA, 13 nt, Homo sapiens
aaaugguccuauu

SEQ ID NO: 1686143 - RNA, 13 nt, Homo sapiens
aaaugucaucuca

SEQ ID NO: 1686144 - RNA, 18 nt, Homo sapiens
aaauuaaugguuuauucu

SEQ ID NO: 1686145 - RNA, 14 nt, Homo sapiens
aaauuaccugugga

SEQ ID NO: 1686146 - RNA, 17 nt, Homo sapiens
aaauuagaaucugagua

SEQ ID NO: 1686147 - RNA, 17 nt, Homo sapiens
aaauuauuucucucaca

SEQ ID NO: 1686148 - RNA, 19 nt, Homo sapiens
aaauuccaaauucauggca

SEQ ID NO: 1686149 - RNA, 21 nt, Homo sapiens
aaauuucuguaaaacagguua

SEQ ID NO: 1686150 - RNA, 16 nt, Homo sapiens
aaauuugagagacaaa

SEQ ID NO: 1686151 - RNA, 22 nt, Homo sapiens
aaauuugugguccacugagcua

SEQ ID NO: 1686152 - RNA, 14 nt, Homo sapiens
aacaagaacuuuaa

SEQ ID NO: 1686153 - RNA, 22 nt, Homo sapiens
aacaccaaaaaugaugcgcauc

SEQ ID NO: 1686154 - RNA, 23 nt, Homo sapiens
aacagcaagaguaagcaguguua

SEQ ID NO: 1686155 - RNA, 15 nt, Homo sapiens
aacaggcuaccaacu

SEQ ID NO: 1686156 - RNA, 18 nt, Homo sapiens
aacagguuauaacagugu

SEQ ID NO: 1686157 - RNA, 14 nt, Homo sapiens
aacauaacuucuca

SEQ ID NO: 1686158 - RNA, 19 nt, Homo sapiens
acuguaggcacacuuugca

SEQ ID NO: 1686159 - RNA, 22 nt, Homo sapiens
acuguauauucaggacuugaaa

SEQ ID NO: 1686160 - RNA, 20 nt, Homo sapiens
acuguccuauuauauucauu

SEQ ID NO: 1686161 - RNA, 14 nt, Homo sapiens
acugugacugauau

SEQ ID NO: 1686162 - RNA, 21 nt, Homo sapiens
acugugggcaaaguccuccuu

SEQ ID NO: 1686163 - RNA, 20 nt, Homo sapiens
acuguuuagaugaaugucag

SEQ ID NO: 1686164 - RNA, 19 nt, Homo sapiens
acuuaaaugguaauaagca

SEQ ID NO: 1686165 - RNA, 23 nt, Homo sapiens
acuuaguccuuuaucauccuuaa

SEQ ID NO: 1686166 - RNA, 23 nt, Homo sapiens
acuucaagaacccugacuccucu

SEQ ID NO: 1686167 - RNA, 14 nt, Homo sapiens
acuucaccuacauu

SEQ ID NO: 1686168 - RNA, 15 nt, Homo sapiens
acuuccgagcuaugu

SEQ ID NO: 1686169 - RNA, 22 nt, Homo sapiens
acuucugaagagaccacucaau

SEQ ID NO: 1686170 - RNA, 23 nt, Homo sapiens
acuucugcaacaagcaugcagcu

SEQ ID NO: 1686171 - RNA, 15 nt, Homo sapiens
acuugcagguacuuu

SEQ ID NO: 1686172 - RNA, 14 nt, Homo sapiens
acuugccuucugau

SEQ ID NO: 1686173 - RNA, 18 nt, Homo sapiens
acuuucuucucuuuccca

SEQ ID NO: 1686174 - RNA, 18 nt, Homo sapiens
acuuugacuuugcccagg

SEQ ID NO: 1686175 - RNA, 14 nt, Homo sapiens
acuuugcacugaua

SEQ ID NO: 1686176 - RNA, 23 nt, Homo sapiens
acuuuguuugucacaaguggugu

SEQ ID NO: 1686177 - RNA, 15 nt, Homo sapiens
agaaaaaaagggauc

SEQ ID NO: 1686178 - RNA, 20 nt, Homo sapiens
agaaauacucaugugcaaua

SEQ ID NO: 1686179 - RNA, 14 nt, Homo sapiens
agaaauagaauuau

SEQ ID NO: 1686180 - RNA, 19 nt, Homo sapiens
agaaaucaauaguugaauu

SEQ ID NO: 1686181 - RNA, 21 nt, Homo sapiens
agaaccaagaacauaaacccu

SEQ ID NO: 1686182 - RNA, 21 nt, Homo sapiens
agaacuauugugcucagagac

SEQ ID NO: 1686183 - RNA, 14 nt, Homo sapiens
agaagaaggccaga

SEQ ID NO: 1686184 - RNA, 21 nt, Homo sapiens
agaagaugagccuugcagaua

SEQ ID NO: 1686185 - RNA, 20 nt, Homo sapiens
agaagccuaaaaaaagcuaa

SEQ ID NO: 1686186 - RNA, 23 nt, Homo sapiens
agaaguacagggcagaaccaaga

SEQ ID NO: 1686187 - RNA, 15 nt, Homo sapiens
agaauguuccuacuc

SEQ ID NO: 1686188 - RNA, 22 nt, Homo sapiens
agacacugaaaaaucuaaguga

SEQ ID NO: 1686189 - RNA, 13 nt, Homo sapiens
agacagaagcuua

SEQ ID NO: 1686190 - RNA, 17 nt, Homo sapiens
agaccuguucuuuccau

SEQ ID NO: 1686191 - RNA, 21 nt, Homo sapiens
agacgugaugggcuaggccuc

SEQ ID NO: 1686192 - RNA, 19 nt, Homo sapiens
agacuguugaguuaugaua

SEQ ID NO: 1686193 - RNA, 20 nt, Homo sapiens
agagaaaccugccaaggagc

SEQ ID NO: 1686194 - RNA, 16 nt, Homo sapiens
agagaaccugugggcu

SEQ ID NO: 1686195 - RNA, 14 nt, Homo sapiens
agagaauguauuug

SEQ ID NO: 1686196 - RNA, 16 nt, Homo sapiens
agagaugggacuagga

SEQ ID NO: 1686197 - RNA, 14 nt, Homo sapiens
agagcagagaagua

SEQ ID NO: 1686198 - RNA, 17 nt, Homo sapiens
agagcccgggagcugcu

SEQ ID NO: 1686199 - RNA, 23 nt, Homo sapiens
agaggacugguucugaggccaga

SEQ ID NO: 1686200 - RNA, 12 nt, Homo sapiens
agaugaggcaaa

SEQ ID NO: 1686201 - RNA, 14 nt, Homo sapiens
agaugcaucaucuc

SEQ ID NO: 1686202 - RNA, 17 nt, Homo sapiens
agauggcgauguguuau

SEQ ID NO: 1686203 - RNA, 14 nt, Homo sapiens
agaugucucugcaa

SEQ ID NO: 1686204 - RNA, 12 nt, Homo sapiens
agauguuuauuu

SEQ ID NO: 1686205 - RNA, 22 nt, Homo sapiens
agauucccaucauacacuuccu

SEQ ID NO: 1686206 - RNA, 15 nt, Homo sapiens
agauugcaccacugc

SEQ ID NO: 1686207 - RNA, 17 nt, Homo sapiens
agcaaacucugcugucu

SEQ ID NO: 1686208 - RNA, 23 nt, Homo sapiens
agcaaaggggagucucagcuuuc

SEQ ID NO: 1686209 - RNA, 19 nt, Homo sapiens
agcaaaggugcacuccaga

SEQ ID NO: 1686210 - RNA, 14 nt, Homo sapiens
agcaccagggcuca

SEQ ID NO: 1686211 - RNA, 20 nt, Homo sapiens
agcacuuugggagacugaag

SEQ ID NO: 1686212 - RNA, 16 nt, Homo sapiens
agcagcugaugcugua

SEQ ID NO: 1686213 - RNA, 14 nt, Homo sapiens
agcauccaguguga

SEQ ID NO: 1686214 - RNA, 14 nt, Homo sapiens
agcaucucaguggu

SEQ ID NO: 1686215 - RNA, 22 nt, Homo sapiens
agcaucugcuccaucggggcag

SEQ ID NO: 1686216 - RNA, 15 nt, Homo sapiens
agcauggacauuuag

SEQ ID NO: 1686217 - RNA, 21 nt, Homo sapiens
agcauuguaaaauuauuucau

SEQ ID NO: 1686218 - RNA, 19 nt, Homo sapiens
agcauuuacauuuauuagg

SEQ ID NO: 1686219 - RNA, 20 nt, Homo sapiens
agccaaauuuaaaacuguug

SEQ ID NO: 1686220 - RNA, 20 nt, Homo sapiens
agccaagauugcaccacugc

SEQ ID NO: 1686221 - RNA, 13 nt, Homo sapiens
agccaauauuccu

SEQ ID NO: 1686222 - RNA, 16 nt, Homo sapiens
agccacuggcugcuaa

SEQ ID NO: 1686223 - RNA, 14 nt, Homo sapiens
agccagcugcuuga

SEQ ID NO: 1686224 - RNA, 15 nt, Homo sapiens
agccaucucuaauaa

SEQ ID NO: 1686225 - RNA, 15 nt, Homo sapiens
agcccaccccugugc

SEQ ID NO: 1686226 - RNA, 14 nt, Homo sapiens
agccccuacugugg

SEQ ID NO: 1686227 - RNA, 15 nt, Homo sapiens
agccuaccucugucu

SEQ ID NO: 1686228 - RNA, 14 nt, Homo sapiens
agccucagggacga

SEQ ID NO: 1686229 - RNA, 21 nt, Homo sapiens
agccucugacuuaagcugccu

SEQ ID NO: 1686230 - RNA, 22 nt, Homo sapiens
agccugacuagaacuccugucu

SEQ ID NO: 1686231 - RNA, 23 nt, Homo sapiens
agccugccucccaagguccucuc

SEQ ID NO: 1686232 - RNA, 23 nt, Homo sapiens
agcuaauauacagucaguucuca

SEQ ID NO: 1686233 - RNA, 17 nt, Homo sapiens
agcuacuauguacugcc

SEQ ID NO: 1686234 - RNA, 21 nt, Homo sapiens
agcuacuauguacugccuuag

SEQ ID NO: 1686235 - RNA, 21 nt, Homo sapiens
agcucaccccuggaggacggc

SEQ ID NO: 1686236 - RNA, 18 nt, Homo sapiens
agcucuggguugugcaca

SEQ ID NO: 1686237 - RNA, 14 nt, Homo sapiens
agcucuuccuaucc

SEQ ID NO: 1686238 - RNA, 22 nt, Homo sapiens
agcugcugcacacacucaccuc

SEQ ID NO: 1686239 - RNA, 14 nt, Homo sapiens
agcuggcaccagaa

SEQ ID NO: 1686240 - RNA, 19 nt, Homo sapiens
agcuuaccugggcacaaac

SEQ ID NO: 1686241 - RNA, 12 nt, Homo sapiens
agcuucuacccu

SEQ ID NO: 1686242 - RNA, 16 nt, Homo sapiens
agcuucuucacaggca

SEQ ID NO: 1686243 - RNA, 20 nt, Homo sapiens
agcuugaagaggggguuaga

SEQ ID NO: 1686244 - RNA, 20 nt, Homo sapiens
aggaauaacaucaccacugu

SEQ ID NO: 1686245 - RNA, 22 nt, Homo sapiens
aggacauuugugggcaagcaga

SEQ ID NO: 1686246 - RNA, 23 nt, Homo sapiens
aggagcugauacuuugacagugu

SEQ ID NO: 1686247 - RNA, 15 nt, Homo sapiens
aggaggguuggagug

SEQ ID NO: 1686248 - RNA, 17 nt, Homo sapiens
aggauaggacagaggga

SEQ ID NO: 1686249 - RNA, 17 nt, Homo sapiens
aggaucccgucuuccag

SEQ ID NO: 1686250 - RNA, 14 nt, Homo sapiens
aggauucagcuauu

SEQ ID NO: 1686251 - RNA, 16 nt, Homo sapiens
aggcaaauuuguauau

SEQ ID NO: 1686252 - RNA, 23 nt, Homo sapiens
aggcaaggaguuugagaccagcu

SEQ ID NO: 1686253 - RNA, 15 nt, Homo sapiens
aggcacacuuugcac

SEQ ID NO: 1686254 - RNA, 18 nt, Homo sapiens
aggcagaaaagucaucau

SEQ ID NO: 1686255 - RNA, 16 nt, Homo sapiens
aggcagggcccugaaa

SEQ ID NO: 1686256 - RNA, 14 nt, Homo sapiens
aggcauguacaaaa

SEQ ID NO: 1686257 - RNA, 14 nt, Homo sapiens
aggccagagaggga

SEQ ID NO: 1686258 - RNA, 18 nt, Homo sapiens
aggcccugugagcacaaa

SEQ ID NO: 1686259 - RNA, 20 nt, Homo sapiens
aggccuuaucugaaaggcca

SEQ ID NO: 1686260 - RNA, 18 nt, Homo sapiens
aggcucagagagguagca

SEQ ID NO: 1686261 - RNA, 20 nt, Homo sapiens
aggcucuuaugugugccuuu

SEQ ID NO: 1686262 - RNA, 15 nt, Homo sapiens
aggcugaucccugag

SEQ ID NO: 1686263 - RNA, 18 nt, Homo sapiens
aggcugaucccugagauc

SEQ ID NO: 1686264 - RNA, 16 nt, Homo sapiens
aggcuggagugcaaug

SEQ ID NO: 1686265 - RNA, 22 nt, Homo sapiens
agggaaaaggaguagggaguuc

SEQ ID NO: 1686266 - RNA, 23 nt, Homo sapiens
agggaagaacuauugugcucaga

SEQ ID NO: 1686267 - RNA, 15 nt, Homo sapiens
agggaauggccacaa

SEQ ID NO: 1686268 - RNA, 23 nt, Homo sapiens
agggaccccagauaccugugagg

SEQ ID NO: 1686269 - RNA, 13 nt, Homo sapiens
agggccucagucu

SEQ ID NO: 1686270 - RNA, 22 nt, Homo sapiens
aggggcuuugugaccagaaagc

SEQ ID NO: 1686271 - RNA, 14 nt, Homo sapiens
agggggaagacaga

SEQ ID NO: 1686272 - RNA, 17 nt, Homo sapiens
aggguaccgucuucucc

SEQ ID NO: 1686273 - RNA, 16 nt, Homo sapiens
aggguucuaaguggga

SEQ ID NO: 1686274 - RNA, 17 nt, Homo sapiens
agguacgaugacagugu

SEQ ID NO: 1686275 - RNA, 16 nt, Homo sapiens
aggucaggaguugaag

SEQ ID NO: 1686276 - RNA, 18 nt, Homo sapiens
aggucccuguugucagau

SEQ ID NO: 1686277 - RNA, 15 nt, Homo sapiens
cacacgaugcauuua

SEQ ID NO: 1686278 - RNA, 16 nt, Homo sapiens
cacacgaugcauuuaa

SEQ ID NO: 1686279 - RNA, 22 nt, Homo sapiens
cacagaauuguuccaguacuau

SEQ ID NO: 1686280 - RNA, 17 nt, Homo sapiens
cacagaggacucacuug

SEQ ID NO: 1686281 - RNA, 24 nt, Homo sapiens
cacagguguguuucccaucccacu

SEQ ID NO: 1686282 - RNA, 17 nt, Homo sapiens
cacauccaucccuccau

SEQ ID NO: 1686283 - RNA, 19 nt, Homo sapiens
cacaugagaagugauaaaa

SEQ ID NO: 1686284 - RNA, 23 nt, Homo sapiens
caccaaggcugagacagugaauu

SEQ ID NO: 1686285 - RNA, 19 nt, Homo sapiens
caccacugcucuccagccu

SEQ ID NO: 1686286 - RNA, 12 nt, Homo sapiens
caccacuguaua

SEQ ID NO: 1686287 - RNA, 20 nt, Homo sapiens
cacccuccaugcuccucacc

SEQ ID NO: 1686288 - RNA, 16 nt, Homo sapiens
caccuacauuaucuca

SEQ ID NO: 1686289 - RNA, 18 nt, Homo sapiens
caccugagacaugcugaa

SEQ ID NO: 1686290 - RNA, 20 nt, Homo sapiens
caccugagacaugcugaaau

SEQ ID NO: 1686291 - RNA, 17 nt, Homo sapiens
cacuccgucugcuccaa

SEQ ID NO: 1686292 - RNA, 21 nt, Homo sapiens
cacucucccuuguacagccuu

SEQ ID NO: 1686293 - RNA, 20 nt, Homo sapiens
cacugagcuauaacuuacuu

SEQ ID NO: 1686294 - RNA, 18 nt, Homo sapiens
cacugcaaguuuuaguua

SEQ ID NO: 1686295 - RNA, 20 nt, Homo sapiens
cacuugcucccaacccauuc

SEQ ID NO: 1686296 - RNA, 12 nt, Homo sapiens
cagaacacuuug

SEQ ID NO: 1686297 - RNA, 16 nt, Homo sapiens
cagaacauauguugca

SEQ ID NO: 1686298 - RNA, 21 nt, Homo sapiens
cagaaccucuaagugcugcug

SEQ ID NO: 1686299 - RNA, 13 nt, Homo sapiens
cagaacucuuccu

SEQ ID NO: 1686300 - RNA, 15 nt, Homo sapiens
cagaagaaucuuccu

SEQ ID NO: 1686301 - RNA, 18 nt, Homo sapiens
cagaagccuccccagcuc

SEQ ID NO: 1686302 - RNA, 20 nt, Homo sapiens
cagaaggauuaccugaggca

SEQ ID NO: 1686303 - RNA, 13 nt, Homo sapiens
cagacaauuccau

SEQ ID NO: 1686304 - RNA, 18 nt, Homo sapiens
cagacguggugcuucuca

SEQ ID NO: 1686305 - RNA, 20 nt, Homo sapiens
cagacguggugcuucucaca

SEQ ID NO: 1686306 - RNA, 16 nt, Homo sapiens
cagacugucaagaaga

SEQ ID NO: 1686307 - RNA, 22 nt, Homo sapiens
cagagaaagcaaaggugcacuc

SEQ ID NO: 1686308 - RNA, 21 nt, Homo sapiens
cagagcugcugcacacacuca

SEQ ID NO: 1686309 - RNA, 17 nt, Homo sapiens
cagagcugucugaacuc

SEQ ID NO: 1686310 - RNA, 20 nt, Homo sapiens
cagagguaauguuaguaaau

SEQ ID NO: 1686311 - RNA, 12 nt, Homo sapiens
cagagugcaacc

SEQ ID NO: 1686312 - RNA, 16 nt, Homo sapiens
cagauaucugcaugug

SEQ ID NO: 1686313 - RNA, 20 nt, Homo sapiens
cagauugucuuauuacagca

SEQ ID NO: 1686314 - RNA, 15 nt, Homo sapiens
cagcaaccuauaaaa

SEQ ID NO: 1686315 - RNA, 23 nt, Homo sapiens
cagcagccccaggagaaggggcu

SEQ ID NO: 1686316 - RNA, 20 nt, Homo sapiens
cagcauuugauaaaauccaa

SEQ ID NO: 1686317 - RNA, 18 nt, Homo sapiens
cagccaggcggcuggaau

SEQ ID NO: 1686318 - RNA, 16 nt, Homo sapiens
cagcccaccccugugc

SEQ ID NO: 1686319 - RNA, 20 nt, Homo sapiens
cagccucaagucacucccaa

SEQ ID NO: 1686320 - RNA, 14 nt, Homo sapiens
cagcggauguugua

SEQ ID NO: 1686321 - RNA, 20 nt, Homo sapiens
cagcggauugcucuggagca

SEQ ID NO: 1686322 - RNA, 19 nt, Homo sapiens
caggacaguugauggagcc

SEQ ID NO: 1686323 - RNA, 21 nt, Homo sapiens
caggaccuugcuuccuucuca

SEQ ID NO: 1686324 - RNA, 23 nt, Homo sapiens
caggaccuugcuuccuucucauc

SEQ ID NO: 1686325 - RNA, 11 nt, Homo sapiens
caggacugugg

SEQ ID NO: 1686326 - RNA, 21 nt, Homo sapiens
caggacuucucaccagcaguc

SEQ ID NO: 1686327 - RNA, 15 nt, Homo sapiens
caggagauggggaau

SEQ ID NO: 1686328 - RNA, 19 nt, Homo sapiens
caggcuggagugcaauggc

SEQ ID NO: 1686329 - RNA, 20 nt, Homo sapiens
caggcuggagugcaauggcg

SEQ ID NO: 1686330 - RNA, 21 nt, Homo sapiens
cagggaggggucccugcaaaa

SEQ ID NO: 1686331 - RNA, 20 nt, Homo sapiens
cagggcaccguauuccucuc

SEQ ID NO: 1686332 - RNA, 21 nt, Homo sapiens
caggggagacgaggccaagcu

SEQ ID NO: 1686333 - RNA, 17 nt, Homo sapiens
caggguggggggccaug

SEQ ID NO: 1686334 - RNA, 22 nt, Homo sapiens
caggguggggggugacagugcc

SEQ ID NO: 1686335 - RNA, 14 nt, Homo sapiens
caggucugacucca

SEQ ID NO: 1686336 - RNA, 19 nt, Homo sapiens
caggugcaacagacuugaa

SEQ ID NO: 1686337 - RNA, 18 nt, Homo sapiens
cagguuaagacaaagggu

SEQ ID NO: 1686338 - RNA, 14 nt, Homo sapiens
cagguucugagaua

SEQ ID NO: 1686339 - RNA, 19 nt, Homo sapiens
caguacuaaucaugugagg

SEQ ID NO: 1686340 - RNA, 19 nt, Homo sapiens
cagugaccagugccuguga

SEQ ID NO: 1686341 - RNA, 20 nt, Homo sapiens
cagugacuccagggugacaa

SEQ ID NO: 1686342 - RNA, 19 nt, Homo sapiens
cagugccagcaaguccuua

SEQ ID NO: 1686343 - RNA, 15 nt, Homo sapiens
cagugccuauugaua

SEQ ID NO: 1686344 - RNA, 15 nt, Homo sapiens
cagugccugugagca

SEQ ID NO: 1686345 - RNA, 16 nt, Homo sapiens
caguggugacauaguc

SEQ ID NO: 1686346 - RNA, 18 nt, Homo sapiens
cagugucccaccuugacc

SEQ ID NO: 1686347 - RNA, 22 nt, Homo sapiens
caguugcucaaaaagaaaucaa

SEQ ID NO: 1686348 - RNA, 19 nt, Homo sapiens
caguuggacucucagggau

SEQ ID NO: 1686349 - RNA, 22 nt, Homo sapiens
caguuguagcagaaaccaacaa

SEQ ID NO: 1686350 - RNA, 17 nt, Homo sapiens
cauaaaaucgcuuucaa

SEQ ID NO: 1686351 - RNA, 21 nt, Homo sapiens
cauaaagugagacauugugaa

SEQ ID NO: 1686352 - RNA, 15 nt, Homo sapiens
cauaauucagcacuu

SEQ ID NO: 1686353 - RNA, 17 nt, Homo sapiens
cauaauucagcacuuaa

SEQ ID NO: 1686354 - RNA, 18 nt, Homo sapiens
cauagaaaccacuagaaa

SEQ ID NO: 1686355 - RNA, 22 nt, Homo sapiens
cauagagaauauaaaaauaaag

SEQ ID NO: 1686356 - RNA, 20 nt, Homo sapiens
cauagguuaaaaaaaaaagu

SEQ ID NO: 1686357 - RNA, 13 nt, Homo sapiens
cauauauaugaaa

SEQ ID NO: 1686358 - RNA, 21 nt, Homo sapiens
cauaucccuuccucucaggcu

SEQ ID NO: 1686359 - RNA, 16 nt, Homo sapiens
cauauguuuaucucac

SEQ ID NO: 1686360 - RNA, 12 nt, Homo sapiens
cauauuaucuca

SEQ ID NO: 1686361 - RNA, 19 nt, Homo sapiens
cauauuuaauaaagcacaa

SEQ ID NO: 1686362 - RNA, 11 nt, Homo sapiens
caucaccacug

SEQ ID NO: 1686363 - RNA, 14 nt, Homo sapiens
caucaccacuguau

SEQ ID NO: 1686364 - RNA, 15 nt, Homo sapiens
caucaucuuguucag

SEQ ID NO: 1686365 - RNA, 12 nt, Homo sapiens
cauccacuagcu

SEQ ID NO: 1686366 - RNA, 24 nt, Homo sapiens
cauccuuaaaacaauucugugaca

SEQ ID NO: 1686367 - RNA, 13 nt, Homo sapiens
caucuccacagga

SEQ ID NO: 1686368 - RNA, 22 nt, Homo sapiens
caucugaagaguggaaaugggg

SEQ ID NO: 1686369 - RNA, 18 nt, Homo sapiens
caugaaauucuuccuaau

SEQ ID NO: 1686370 - RNA, 18 nt, Homo sapiens
caugauacuaucugugcc

SEQ ID NO: 1686371 - RNA, 19 nt, Homo sapiens
caugauacuaucugugcca

SEQ ID NO: 1686372 - RNA, 13 nt, Homo sapiens
caugccugaugaa

SEQ ID NO: 1686373 - RNA, 20 nt, Homo sapiens
cauggauucaaccaacugca

SEQ ID NO: 1686374 - RNA, 24 nt, Homo sapiens
cauggauucaaccaacugcaaaug

SEQ ID NO: 1686375 - RNA, 23 nt, Homo sapiens
cauggcucuggcacaguguaauc

SEQ ID NO: 1686376 - RNA, 15 nt, Homo sapiens
caugggggcacuuga

SEQ ID NO: 1686377 - RNA, 12 nt, Homo sapiens
caugucagcaau

SEQ ID NO: 1686378 - RNA, 15 nt, Homo sapiens
caugucaugugagug

SEQ ID NO: 1686379 - RNA, 16 nt, Homo sapiens
cauuaccuccauccau

SEQ ID NO: 1686380 - RNA, 15 nt, Homo sapiens
cauuaucucacuuag

SEQ ID NO: 1686381 - RNA, 17 nt, Homo sapiens
cauucacuacaggugaa

SEQ ID NO: 1686382 - RNA, 18 nt, Homo sapiens
cauucagagcuauggugc

SEQ ID NO: 1686383 - RNA, 22 nt, Homo sapiens
cauuccagccacuggcugcuaa

SEQ ID NO: 1686384 - RNA, 20 nt, Homo sapiens
cauucuuuuugaaaugucaa

SEQ ID NO: 1686385 - RNA, 20 nt, Homo sapiens
cauugucaccgcaggugcuc

SEQ ID NO: 1686386 - RNA, 18 nt, Homo sapiens
cauugucuuuccugaaug

SEQ ID NO: 1686387 - RNA, 15 nt, Homo sapiens
cauuuagucauguga

SEQ ID NO: 1686388 - RNA, 16 nt, Homo sapiens
cauuuagucaugugac

SEQ ID NO: 1686389 - RNA, 19 nt, Homo sapiens
cauuucaggacucucucca

SEQ ID NO: 1686390 - RNA, 19 nt, Homo sapiens
cauuugauaaaauccaaaa

SEQ ID NO: 1686391 - RNA, 14 nt, Homo sapiens
cauuugcugccauu

SEQ ID NO: 1686392 - RNA, 21 nt, Homo sapiens
cauuuguaugucaaagcuuug

SEQ ID NO: 1686393 - RNA, 17 nt, Homo sapiens
cauuuuugugcuuuuau

SEQ ID NO: 1686394 - RNA, 15 nt, Homo sapiens
ccaaaaauuacuuug

SEQ ID NO: 1686395 - RNA, 16 nt, Homo sapiens
ccaaaaauuacuuugg

SEQ ID NO: 1686396 - RNA, 15 nt, Homo sapiens
gaaauauagugcaau

SEQ ID NO: 1686397 - RNA, 14 nt, Homo sapiens
gaaauauauuacuu

SEQ ID NO: 1686398 - RNA, 22 nt, Homo sapiens
gaaaucauaaaggaucagagau

SEQ ID NO: 1686399 - RNA, 14 nt, Homo sapiens
gaaaugccaguggu

SEQ ID NO: 1686400 - RNA, 19 nt, Homo sapiens
gaacaccuauugcacuugg

SEQ ID NO: 1686401 - RNA, 18 nt, Homo sapiens
gaacacgagacagcuugg

SEQ ID NO: 1686402 - RNA, 16 nt, Homo sapiens
gaacacugugaccagg

SEQ ID NO: 1686403 - RNA, 12 nt, Homo sapiens
gaacagagcaag

SEQ ID NO: 1686404 - RNA, 15 nt, Homo sapiens
gaacagagugcaacc

SEQ ID NO: 1686405 - RNA, 13 nt, Homo sapiens
gaagaaggccaga

SEQ ID NO: 1686406 - RNA, 15 nt, Homo sapiens
gaagaaggccagaga

SEQ ID NO: 1686407 - RNA, 15 nt, Homo sapiens
gaagacuauggugcu

SEQ ID NO: 1686408 - RNA, 15 nt, Homo sapiens
gaagaggaaagggag

SEQ ID NO: 1686409 - RNA, 23 nt, Homo sapiens
gaagaugagccuugcagauaucu

SEQ ID NO: 1686410 - RNA, 13 nt, Homo sapiens
gaagaugugaagg

SEQ ID NO: 1686411 - RNA, 17 nt, Homo sapiens
gaagauucuauguuaau

SEQ ID NO: 1686412 - RNA, 14 nt, Homo sapiens
gaagccaaugcugu

SEQ ID NO: 1686413 - RNA, 19 nt, Homo sapiens
gaagccaccgggagauuuc

SEQ ID NO: 1686414 - RNA, 19 nt, Homo sapiens
gaagcuuaaaaucugugaa

SEQ ID NO: 1686415 - RNA, 15 nt, Homo sapiens
gaaggauuacucucc

SEQ ID NO: 1686416 - RNA, 16 nt, Homo sapiens
gaagggaccccagaua

SEQ ID NO: 1686417 - RNA, 15 nt, Homo sapiens
gaagucuaaaugaag

SEQ ID NO: 1686418 - RNA, 17 nt, Homo sapiens
gaaguugccaugggaaa

SEQ ID NO: 1686419 - RNA, 15 nt, Homo sapiens
gaauaaaugucuugc

SEQ ID NO: 1686420 - RNA, 15 nt, Homo sapiens
gaauacuugaacucu

SEQ ID NO: 1686421 - RNA, 20 nt, Homo sapiens
gaauaguaguaacuguuuca

SEQ ID NO: 1686422 - RNA, 15 nt, Homo sapiens
gaaucuaaaugaagc

SEQ ID NO: 1686423 - RNA, 12 nt, Homo sapiens
gaaucuuuacaa

SEQ ID NO: 1686424 - RNA, 17 nt, Homo sapiens
gaaucuuuguaccaaaa

SEQ ID NO: 1686425 - RNA, 23 nt, Homo sapiens
gaaugcgcugaucguuucuucca

SEQ ID NO: 1686426 - RNA, 15 nt, Homo sapiens
gaauugcacugaaca

SEQ ID NO: 1686427 - RNA, 18 nt, Homo sapiens
gacaaguucacucgccuc

SEQ ID NO: 1686428 - RNA, 21 nt, Homo sapiens
gacaauauuccagaucuuuca

SEQ ID NO: 1686429 - RNA, 20 nt, Homo sapiens
gacaccugagacaugcugaa

SEQ ID NO: 1686430 - RNA, 16 nt, Homo sapiens
gacacugaaaaaucua

SEQ ID NO: 1686431 - RNA, 22 nt, Homo sapiens
gacagaagccuaaaaaaagcua

SEQ ID NO: 1686432 - RNA, 13 nt, Homo sapiens
gacagccuugcaa

SEQ ID NO: 1686433 - RNA, 20 nt, Homo sapiens
gacagcuggcggaggcugcu

SEQ ID NO: 1686434 - RNA, 17 nt, Homo sapiens
gacaguuuuugacauuu

SEQ ID NO: 1686435 - RNA, 19 nt, Homo sapiens
gacaguuuuugacauuuau

SEQ ID NO: 1686436 - RNA, 19 nt, Homo sapiens
gacauacauauuaucucau

SEQ ID NO: 1686437 - RNA, 14 nt, Homo sapiens
gacaugugacauuu

SEQ ID NO: 1686438 - RNA, 15 nt, Homo sapiens
gacaugugacauuua

SEQ ID NO: 1686439 - RNA, 22 nt, Homo sapiens
gacauuugggagacaugugaca

SEQ ID NO: 1686440 - RNA, 22 nt, Homo sapiens
gaccacucugucuuguguuucc

SEQ ID NO: 1686441 - RNA, 20 nt, Homo sapiens
gaccauaagagaaaccugcc

SEQ ID NO: 1686442 - RNA, 18 nt, Homo sapiens
gaccuugcuuccuucuca

SEQ ID NO: 1686443 - RNA, 17 nt, Homo sapiens
gacguggugcuucucac

SEQ ID NO: 1686444 - RNA, 18 nt, Homo sapiens
gacuaagaaaugccagug

SEQ ID NO: 1686445 - RNA, 20 nt, Homo sapiens
gacuacccauagacaugaaa

SEQ ID NO: 1686446 - RNA, 14 nt, Homo sapiens
gacuacugcuccug

SEQ ID NO: 1686447 - RNA, 12 nt, Homo sapiens
gacugauuucag

SEQ ID NO: 1686448 - RNA, 19 nt, Homo sapiens
gacuuccgagcuaugucag

SEQ ID NO: 1686449 - RNA, 17 nt, Homo sapiens
gacuuggagaauacugc

SEQ ID NO: 1686450 - RNA, 14 nt, Homo sapiens
gagaaacacuauuu

SEQ ID NO: 1686451 - RNA, 15 nt, Homo sapiens
gagaaacccagagau

SEQ ID NO: 1686452 - RNA, 19 nt, Homo sapiens
gagaaaugccccaguguua

SEQ ID NO: 1686453 - RNA, 18 nt, Homo sapiens
gagaauggcauggcagga

SEQ ID NO: 1686454 - RNA, 15 nt, Homo sapiens
gagacaugugacauu

SEQ ID NO: 1686455 - RNA, 14 nt, Homo sapiens
gagacugggagcca

SEQ ID NO: 1686456 - RNA, 13 nt, Homo sapiens
gagaggggggcca

SEQ ID NO: 1686457 - RNA, 13 nt, Homo sapiens
gagauguacugca

SEQ ID NO: 1686458 - RNA, 23 nt, Homo sapiens
gagauguugaaauuacauuauuu

SEQ ID NO: 1686459 - RNA, 23 nt, Homo sapiens
gagcagagcucuccccuccugcu

SEQ ID NO: 1686460 - RNA, 18 nt, Homo sapiens
gagcaggaccuacuagga

SEQ ID NO: 1686461 - RNA, 15 nt, Homo sapiens
gagcauccuuggcag

SEQ ID NO: 1686462 - RNA, 20 nt, Homo sapiens
gagccaccacgccuggcugg

SEQ ID NO: 1686463 - RNA, 16 nt, Homo sapiens
gagcugauacuuugac

SEQ ID NO: 1686464 - RNA, 16 nt, Homo sapiens
gaggaaagaacacuuc

SEQ ID NO: 1686465 - RNA, 15 nt, Homo sapiens
gaggacucacuugcc

SEQ ID NO: 1686466 - RNA, 22 nt, Homo sapiens
gaggacugguucugaggccaga

SEQ ID NO: 1686467 - RNA, 12 nt, Homo sapiens
gaggcucagaga

SEQ ID NO: 1686468 - RNA, 12 nt, Homo sapiens
gaggcugagaaa

SEQ ID NO: 1686469 - RNA, 18 nt, Homo sapiens
gaggucaggaguugaaga

SEQ ID NO: 1686470 - RNA, 15 nt, Homo sapiens
gaggugggauccucc

SEQ ID NO: 1686471 - RNA, 19 nt, Homo sapiens
gaguaccuacugugugcca

SEQ ID NO: 1686472 - RNA, 23 nt, Homo sapiens
gagucaggcuuacuaaugcugcc

SEQ ID NO: 1686473 - RNA, 15 nt, Homo sapiens
gagucucugccaguu

SEQ ID NO: 1686474 - RNA, 20 nt, Homo sapiens
gagucuguacuaaacaguaa

SEQ ID NO: 1686475 - RNA, 15 nt, Homo sapiens
gaguggaaaugggga

SEQ ID NO: 1686476 - RNA, 15 nt, Homo sapiens
gaguuaaaucucaaa

SEQ ID NO: 1686477 - RNA, 19 nt, Homo sapiens
gaguuaacaggacaguuga

SEQ ID NO: 1686478 - RNA, 13 nt, Homo sapiens
gauaaacaaacaa

SEQ ID NO: 1686479 - RNA, 20 nt, Homo sapiens
gauaacuuggggaggcaaga

SEQ ID NO: 1686480 - RNA, 17 nt, Homo sapiens
gauaauuuucauagcug

SEQ ID NO: 1686481 - RNA, 22 nt, Homo sapiens
gauaccauucuauucuccagac

SEQ ID NO: 1686482 - RNA, 17 nt, Homo sapiens
gauauuuuuuacuuuag

SEQ ID NO: 1686483 - RNA, 15 nt, Homo sapiens
gaucaagaacauguc

SEQ ID NO: 1686484 - RNA, 16 nt, Homo sapiens
gauccucccucauggc

SEQ ID NO: 1686485 - RNA, 16 nt, Homo sapiens
gaucucacaagcacuu

SEQ ID NO: 1686486 - RNA, 20 nt, Homo sapiens
gaugcaaauagauucagaga

SEQ ID NO: 1686487 - RNA, 21 nt, Homo sapiens
gaugccauggcaacuuagaga

SEQ ID NO: 1686488 - RNA, 18 nt, Homo sapiens
gaugccucuugcaggguc

SEQ ID NO: 1686489 - RNA, 19 nt, Homo sapiens
gaugccuguguacugccuu

SEQ ID NO: 1686490 - RNA, 17 nt, Homo sapiens
gaugugcaguuuggaau

SEQ ID NO: 1686491 - RNA, 14 nt, Homo sapiens
gauuguauuaacua

SEQ ID NO: 1686492 - RNA, 16 nt, Homo sapiens
gcaaaugccugacuca

SEQ ID NO: 1686493 - RNA, 16 nt, Homo sapiens
gcaacagacuguugag

SEQ ID NO: 1686494 - RNA, 22 nt, Homo sapiens
gcaaccucuuugcucaacagaa

SEQ ID NO: 1686495 - RNA, 15 nt, Homo sapiens
gcaagaaagcuuccu

SEQ ID NO: 1686496 - RNA, 12 nt, Homo sapiens
gcaagagacugg

SEQ ID NO: 1686497 - RNA, 14 nt, Homo sapiens
gcaaggugugaugg

SEQ ID NO: 1686498 - RNA, 16 nt, Homo sapiens
gcaagucccuuuguga

SEQ ID NO: 1686499 - RNA, 22 nt, Homo sapiens
gcaaugcaugauacuaucugug

SEQ ID NO: 1686500 - RNA, 21 nt, Homo sapiens
gcaauugcgaccuuaauuuaa

SEQ ID NO: 1686501 - RNA, 14 nt, Homo sapiens
gcaauuuagcucuc

SEQ ID NO: 1686502 - RNA, 20 nt, Homo sapiens
gcacaauuuaaaacaauccu

SEQ ID NO: 1686503 - RNA, 14 nt, Homo sapiens
gcacaggcagaugu

SEQ ID NO: 1686504 - RNA, 16 nt, Homo sapiens
gcaccaaccuccagac

SEQ ID NO: 1686505 - RNA, 20 nt, Homo sapiens
gcaccacugcucuccagccu

SEQ ID NO: 1686506 - RNA, 23 nt, Homo sapiens
gcacucacaccacuaacaugccc

SEQ ID NO: 1686507 - RNA, 20 nt, Homo sapiens
gcacugagcagggaucugcc

SEQ ID NO: 1686508 - RNA, 22 nt, Homo sapiens
gcacugcggcugucuccuugaa

SEQ ID NO: 1686509 - RNA, 16 nt, Homo sapiens
gcagaaccuucuuugg

SEQ ID NO: 1686510 - RNA, 13 nt, Homo sapiens
gcagaggcaccuc

SEQ ID NO: 1686511 - RNA, 16 nt, Homo sapiens
gcagauagcacugggu

SEQ ID NO: 1686512 - RNA, 15 nt, Homo sapiens
gcagcaucugcucca

SEQ ID NO: 1686513 - RNA, 15 nt, Homo sapiens
gcagcuagugccuuu

SEQ ID NO: 1686514 - RNA, 17 nt, Homo sapiens
gcaggaaagacuggccc

SEQ ID NO: 1686515 - RNA, 12 nt, Homo sapiens
gcaggacugugg

SEQ ID NO: 1686516 - RNA, 23 nt, Homo sapiens
gcaggguggggggccauguuccc

SEQ ID NO: 1686517 - RNA, 15 nt, Homo sapiens
agugggaagggagca

SEQ ID NO: 1686518 - RNA, 19 nt, Homo sapiens
agugugauauacaaagugu

SEQ ID NO: 1686519 - RNA, 19 nt, Homo sapiens
aguguuccaagucucugug

SEQ ID NO: 1686520 - RNA, 16 nt, Homo sapiens
aguuaucuuugaauau

SEQ ID NO: 1686521 - RNA, 22 nt, Homo sapiens
aguuguuuuaauaacuuaucua

SEQ ID NO: 1686522 - RNA, 19 nt, Homo sapiens
aguuuaagccgcagaccug

SEQ ID NO: 1686523 - RNA, 13 nt, Homo sapiens
aguuucaguuugu

SEQ ID NO: 1686524 - RNA, 17 nt, Homo sapiens
aguuucccguccaucuc

SEQ ID NO: 1686525 - RNA, 16 nt, Homo sapiens
aguuugcugcaaccca

SEQ ID NO: 1686526 - RNA, 22 nt, Homo sapiens
auaaaagaaauaaaccaaagga

SEQ ID NO: 1686527 - RNA, 13 nt, Homo sapiens
auaaaagcacuua

SEQ ID NO: 1686528 - RNA, 18 nt, Homo sapiens
auaaaaguguucauuguu

SEQ ID NO: 1686529 - RNA, 15 nt, Homo sapiens
auaaagcucucugua

SEQ ID NO: 1686530 - RNA, 14 nt, Homo sapiens
auaaaggauaaaga

SEQ ID NO: 1686531 - RNA, 19 nt, Homo sapiens
auaaaggaucagagauucu

SEQ ID NO: 1686532 - RNA, 13 nt, Homo sapiens
auaaauauuucuc

SEQ ID NO: 1686533 - RNA, 11 nt, Homo sapiens
auaacaguguu

SEQ ID NO: 1686534 - RNA, 14 nt, Homo sapiens
auaacaucuaugaa

SEQ ID NO: 1686535 - RNA, 13 nt, Homo sapiens
auaagucuuucau

SEQ ID NO: 1686536 - RNA, 15 nt, Homo sapiens
auaauucagcacuua

SEQ ID NO: 1686537 - RNA, 15 nt, Homo sapiens
auacauauuaucuca

SEQ ID NO: 1686538 - RNA, 14 nt, Homo sapiens
auacuauugccuca

SEQ ID NO: 1686539 - RNA, 20 nt, Homo sapiens
auacuugccuucugauagua

SEQ ID NO: 1686540 - RNA, 19 nt, Homo sapiens
auagacuggauggaaagac

SEQ ID NO: 1686541 - RNA, 22 nt, Homo sapiens
auagacuguaacuuccaaauaa

SEQ ID NO: 1686542 - RNA, 15 nt, Homo sapiens
auagccuccaaacau

SEQ ID NO: 1686543 - RNA, 15 nt, Homo sapiens
auaguacugcacuua

SEQ ID NO: 1686544 - RNA, 16 nt, Homo sapiens
auaguaguuacuguca

SEQ ID NO: 1686545 - RNA, 18 nt, Homo sapiens
auagugcaacaucucuga

SEQ ID NO: 1686546 - RNA, 20 nt, Homo sapiens
auagugcaauagugcaacau

SEQ ID NO: 1686547 - RNA, 21 nt, Homo sapiens
auagugggguuccaugaguua

SEQ ID NO: 1686548 - RNA, 17 nt, Homo sapiens
auaguguagcugaggag

SEQ ID NO: 1686549 - RNA, 14 nt, Homo sapiens
auauaauggauaau

SEQ ID NO: 1686550 - RNA, 19 nt, Homo sapiens
auauagugcaauagugcaa

SEQ ID NO: 1686551 - RNA, 16 nt, Homo sapiens
auauauaaguguacau

SEQ ID NO: 1686552 - RNA, 13 nt, Homo sapiens
auauauuuauuga

SEQ ID NO: 1686553 - RNA, 16 nt, Homo sapiens
auaucccuacauguau

SEQ ID NO: 1686554 - RNA, 15 nt, Homo sapiens
auaugaaggauuacu

SEQ ID NO: 1686555 - RNA, 16 nt, Homo sapiens
auaugaucggccauca

SEQ ID NO: 1686556 - RNA, 15 nt, Homo sapiens
auauuagaucaaaua

SEQ ID NO: 1686557 - RNA, 12 nt, Homo sapiens
auauuaucucau

SEQ ID NO: 1686558 - RNA, 15 nt, Homo sapiens
auauugaauguuaaa

SEQ ID NO: 1686559 - RNA, 19 nt, Homo sapiens
auauuuugaaaugaacuuu

SEQ ID NO: 1686560 - RNA, 23 nt, Homo sapiens
aucaaagugugauauacaaagug

SEQ ID NO: 1686561 - RNA, 14 nt, Homo sapiens
aucaaauaagcuaa

SEQ ID NO: 1686562 - RNA, 15 nt, Homo sapiens
aucaagaacauguca

SEQ ID NO: 1686563 - RNA, 17 nt, Homo sapiens
aucaauaaauguugcaa

SEQ ID NO: 1686564 - RNA, 22 nt, Homo sapiens
aucaauaaauguugcaaugcau

SEQ ID NO: 1686565 - RNA, 23 nt, Homo sapiens
aucaauaguugaauuagugagua

SEQ ID NO: 1686566 - RNA, 22 nt, Homo sapiens
aucagaaguguuaagugacaug

SEQ ID NO: 1686567 - RNA, 18 nt, Homo sapiens
aucauaauucagcacuua

SEQ ID NO: 1686568 - RNA, 22 nt, Homo sapiens
aucauaauucagcacuuaacua

SEQ ID NO: 1686569 - RNA, 20 nt, Homo sapiens
aucauacuaaacuucaccua

SEQ ID NO: 1686570 - RNA, 16 nt, Homo sapiens
auccaggccugggaau

SEQ ID NO: 1686571 - RNA, 20 nt, Homo sapiens
auccagggcagcaggccaga

SEQ ID NO: 1686572 - RNA, 13 nt, Homo sapiens
auccaucccucca

SEQ ID NO: 1686573 - RNA, 18 nt, Homo sapiens
auccaucuuuccauccau

SEQ ID NO: 1686574 - RNA, 15 nt, Homo sapiens
auccauuaccuccau

SEQ ID NO: 1686575 - RNA, 14 nt, Homo sapiens
aucccuacauguau

SEQ ID NO: 1686576 - RNA, 12 nt, Homo sapiens
auccuuggcagu

SEQ ID NO: 1686577 - RNA, 20 nt, Homo sapiens
aucuagagaaggcauuucau

SEQ ID NO: 1686578 - RNA, 15 nt, Homo sapiens
aucuagagcuuaaug

SEQ ID NO: 1686579 - RNA, 12 nt, Homo sapiens
aucucagcacuu

SEQ ID NO: 1686580 - RNA, 22 nt, Homo sapiens
aucucuuguuuacgauuucacu

SEQ ID NO: 1686581 - RNA, 13 nt, Homo sapiens
aucugaacauucu

SEQ ID NO: 1686582 - RNA, 19 nt, Homo sapiens
aucuuagguaagacauaua

SEQ ID NO: 1686583 - RNA, 20 nt, Homo sapiens
aucuuagguaagacauauaa

SEQ ID NO: 1686584 - RNA, 19 nt, Homo sapiens
aucuucuuuggacuucuga

SEQ ID NO: 1686585 - RNA, 18 nt, Homo sapiens
augaaagaaaauugaguu

SEQ ID NO: 1686586 - RNA, 13 nt, Homo sapiens
augaaguuauuaa

SEQ ID NO: 1686587 - RNA, 13 nt, Homo sapiens
augaauuauuaua

SEQ ID NO: 1686588 - RNA, 19 nt, Homo sapiens
augacuuuuauaacauuuu

SEQ ID NO: 1686589 - RNA, 17 nt, Homo sapiens
augaggaucaacuguac

SEQ ID NO: 1686590 - RNA, 15 nt, Homo sapiens
augagggaagcaaua

SEQ ID NO: 1686591 - RNA, 16 nt, Homo sapiens
augaguuucacuguac

SEQ ID NO: 1686592 - RNA, 20 nt, Homo sapiens
augaguuucacuguacugca

SEQ ID NO: 1686593 - RNA, 20 nt, Homo sapiens
augauaaauauaacaucuau

SEQ ID NO: 1686594 - RNA, 12 nt, Homo sapiens
augaucagcaaa

SEQ ID NO: 1686595 - RNA, 18 nt, Homo sapiens
augcaaauagauucagag

SEQ ID NO: 1686596 - RNA, 19 nt, Homo sapiens
augcaagccccaacuuucu

SEQ ID NO: 1686597 - RNA, 13 nt, Homo sapiens
augcagcuuugca

SEQ ID NO: 1686598 - RNA, 17 nt, Homo sapiens
augcaugauacuaucug

SEQ ID NO: 1686599 - RNA, 18 nt, Homo sapiens
augccuguguacugccuu

SEQ ID NO: 1686600 - RNA, 22 nt, Homo sapiens
augcgcugaucguuucuuccag

SEQ ID NO: 1686601 - RNA, 22 nt, Homo sapiens
augcugcuccccuaaagccagg

SEQ ID NO: 1686602 - RNA, 18 nt, Homo sapiens
auggcaauuuagcucucu

SEQ ID NO: 1686603 - RNA, 17 nt, Homo sapiens
auggcucuggcacagug

SEQ ID NO: 1686604 - RNA, 15 nt, Homo sapiens
auggggaggccucac

SEQ ID NO: 1686605 - RNA, 19 nt, Homo sapiens
augguaguuuuacaguguu

SEQ ID NO: 1686606 - RNA, 16 nt, Homo sapiens
auggugaaacccuguc

SEQ ID NO: 1686607 - RNA, 16 nt, Homo sapiens
auggugauagacugaa

SEQ ID NO: 1686608 - RNA, 21 nt, Homo sapiens
auguagccagcugugcacuuu

SEQ ID NO: 1686609 - RNA, 14 nt, Homo sapiens
augucaaagcuuug

SEQ ID NO: 1686610 - RNA, 11 nt, Homo sapiens
auguccauuuu

SEQ ID NO: 1686611 - RNA, 12 nt, Homo sapiens
augucucugcaa

SEQ ID NO: 1686612 - RNA, 13 nt, Homo sapiens
augucuggcucaa

SEQ ID NO: 1686613 - RNA, 17 nt, Homo sapiens
augugacaccccggggg

SEQ ID NO: 1686614 - RNA, 17 nt, Homo sapiens
augugaggaaaugauga

SEQ ID NO: 1686615 - RNA, 14 nt, Homo sapiens
augugagucuggga

SEQ ID NO: 1686616 - RNA, 19 nt, Homo sapiens
augugcuauacacacacac

SEQ ID NO: 1686617 - RNA, 15 nt, Homo sapiens
auguguaugauacua

SEQ ID NO: 1686618 - RNA, 21 nt, Homo sapiens
auguucuacagaauauucucc

SEQ ID NO: 1686619 - RNA, 16 nt, Homo sapiens
auguugggaaaguauu

SEQ ID NO: 1686620 - RNA, 20 nt, Homo sapiens
auuaaaagaugucucugcaa

SEQ ID NO: 1686621 - RNA, 16 nt, Homo sapiens
auuaaagcauuuccua

SEQ ID NO: 1686622 - RNA, 11 nt, Homo sapiens
auuaaagucag

SEQ ID NO: 1686623 - RNA, 17 nt, Homo sapiens
auuaagcaaauguuaaa

SEQ ID NO: 1686624 - RNA, 23 nt, Homo sapiens
auuaauuuggagcacaaaauuca

SEQ ID NO: 1686625 - RNA, 23 nt, Homo sapiens
auuaccuccauccauccuuccaa

SEQ ID NO: 1686626 - RNA, 19 nt, Homo sapiens
auuacuuuuuuaaaggcac

SEQ ID NO: 1686627 - RNA, 19 nt, Homo sapiens
auuauaaaugacaaccuga

SEQ ID NO: 1686628 - RNA, 14 nt, Homo sapiens
auuauaacuguaaa

SEQ ID NO: 1686629 - RNA, 15 nt, Homo sapiens
auuauacuacaauaa

SEQ ID NO: 1686630 - RNA, 13 nt, Homo sapiens
auuaucucacuua

SEQ ID NO: 1686631 - RNA, 15 nt, Homo sapiens
auucaauccuacuuu

SEQ ID NO: 1686632 - RNA, 13 nt, Homo sapiens
auucacuacaggu

SEQ ID NO: 1686633 - RNA, 18 nt, Homo sapiens
auucauccuuccauccau

SEQ ID NO: 1686634 - RNA, 19 nt, Homo sapiens
auucauucugaacccucca

SEQ ID NO: 1686635 - RNA, 16 nt, Homo sapiens
auuccacccuguuacu

SEQ ID NO: 1686636 - RNA, 13 nt, Homo sapiens
auuccauuuugcu

SEQ ID NO: 1686637 - RNA, 20 nt, Homo sapiens
auucccaccauucuaccuga

SEQ ID NO: 1686638 - RNA, 15 nt, Homo sapiens
auucccaccuuccau

SEQ ID NO: 1686639 - RNA, 23 nt, Homo sapiens
caacugaccugaccccauuccug

SEQ ID NO: 1686640 - RNA, 16 nt, Homo sapiens
caacugugugauuaaa

SEQ ID NO: 1686641 - RNA, 16 nt, Homo sapiens
caacuuagagauugca

SEQ ID NO: 1686642 - RNA, 17 nt, Homo sapiens
caagaaccacuccuuca

SEQ ID NO: 1686643 - RNA, 17 nt, Homo sapiens
caagacuggcccagugc

SEQ ID NO: 1686644 - RNA, 18 nt, Homo sapiens
caagauauaauggauaau

SEQ ID NO: 1686645 - RNA, 16 nt, Homo sapiens
caaggggugggccaca

SEQ ID NO: 1686646 - RNA, 19 nt, Homo sapiens
caaggugaggugaacucca

SEQ ID NO: 1686647 - RNA, 22 nt, Homo sapiens
caagugagcagagauguacugc

SEQ ID NO: 1686648 - RNA, 15 nt, Homo sapiens
caaguuaguucaauc

SEQ ID NO: 1686649 - RNA, 15 nt, Homo sapiens
caauaauauauugua

SEQ ID NO: 1686650 - RNA, 22 nt, Homo sapiens
caaucccugaggacugauuuca

SEQ ID NO: 1686651 - RNA, 19 nt, Homo sapiens
caaugacugagcagcaucc

SEQ ID NO: 1686652 - RNA, 16 nt, Homo sapiens
caaugagaucauugug

SEQ ID NO: 1686653 - RNA, 19 nt, Homo sapiens
caaugguugaugauacuuc

SEQ ID NO: 1686654 - RNA, 14 nt, Homo sapiens
caauuaacugcccu

SEQ ID NO: 1686655 - RNA, 20 nt, Homo sapiens
caauuaacugcccucugaaa

SEQ ID NO: 1686656 - RNA, 16 nt, Homo sapiens
caauucuccugccuua

SEQ ID NO: 1686657 - RNA, 14 nt, Homo sapiens
caauuuaaaacaau

SEQ ID NO: 1686658 - RNA, 17 nt, Homo sapiens
cacaaaggauacuuuua

SEQ ID NO: 1686659 - RNA, 17 nt, Homo sapiens
cacaaaugacugcaaaa

SEQ ID NO: 1686660 - RNA, 23 nt, Homo sapiens
cacaagugguguuuauugcaaua

SEQ ID NO: 1686661 - RNA, 13 nt, Homo sapiens
cacacuuugcacu

SEQ ID NO: 1686662 - RNA, 15 nt, Homo sapiens
cacagacacuaacga

SEQ ID NO: 1686663 - RNA, 19 nt, Homo sapiens
cacagaggacucacuugcc

SEQ ID NO: 1686664 - RNA, 20 nt, Homo sapiens
cacagccuucuaaauuccca

SEQ ID NO: 1686665 - RNA, 20 nt, Homo sapiens
cacauuucuuugcauuccag

SEQ ID NO: 1686666 - RNA, 15 nt, Homo sapiens
caccaaccuccagac

SEQ ID NO: 1686667 - RNA, 17 nt, Homo sapiens
caccacuaacaugcccu

SEQ ID NO: 1686668 - RNA, 23 nt, Homo sapiens
caccacuaacaugcccuguucag

SEQ ID NO: 1686669 - RNA, 18 nt, Homo sapiens
caccacuggccaugcuca

SEQ ID NO: 1686670 - RNA, 20 nt, Homo sapiens
caccccagggacagggcccu

SEQ ID NO: 1686671 - RNA, 19 nt, Homo sapiens
caccccaucuuugcugcca

SEQ ID NO: 1686672 - RNA, 22 nt, Homo sapiens
caccugagacaugcugaaauua

SEQ ID NO: 1686673 - RNA, 17 nt, Homo sapiens
caccuuccauagccucc

SEQ ID NO: 1686674 - RNA, 12 nt, Homo sapiens
cacgaugcauuu

SEQ ID NO: 1686675 - RNA, 18 nt, Homo sapiens
cacggauaucaauuugag

SEQ ID NO: 1686676 - RNA, 23 nt, Homo sapiens
cacuagaggggcacccaccaguu

SEQ ID NO: 1686677 - RNA, 18 nt, Homo sapiens
cacuagggcagccgagug

SEQ ID NO: 1686678 - RNA, 12 nt, Homo sapiens
cacuaugccuga

SEQ ID NO: 1686679 - RNA, 17 nt, Homo sapiens
cacucagggagcauuua

SEQ ID NO: 1686680 - RNA, 14 nt, Homo sapiens
cacuccagcuccuu

SEQ ID NO: 1686681 - RNA, 16 nt, Homo sapiens
cacuccgucugcucca

SEQ ID NO: 1686682 - RNA, 23 nt, Homo sapiens
cacugaaaaaucuaagugauaua

SEQ ID NO: 1686683 - RNA, 17 nt, Homo sapiens
cacugcagaaacccuga

SEQ ID NO: 1686684 - RNA, 13 nt, Homo sapiens
cacuguacugcau

SEQ ID NO: 1686685 - RNA, 23 nt, Homo sapiens
cacuucagcugggucacauccau

SEQ ID NO: 1686686 - RNA, 22 nt, Homo sapiens
cacuuugcacugauauaucaug

SEQ ID NO: 1686687 - RNA, 14 nt, Homo sapiens
cagaaaaccacuuu

SEQ ID NO: 1686688 - RNA, 22 nt, Homo sapiens
cagaaagcuucauccacagccu

SEQ ID NO: 1686689 - RNA, 17 nt, Homo sapiens
cagaaccgcagaagccu

SEQ ID NO: 1686690 - RNA, 18 nt, Homo sapiens
cagaacucccauuacaac

SEQ ID NO: 1686691 - RNA, 20 nt, Homo sapiens
cagaagaaaauuugccaauc

SEQ ID NO: 1686692 - RNA, 19 nt, Homo sapiens
cagaagaaucuuccuggca

SEQ ID NO: 1686693 - RNA, 15 nt, Homo sapiens
cagaagaaugggaau

SEQ ID NO: 1686694 - RNA, 23 nt, Homo sapiens
cagaauugccccugccauuucca

SEQ ID NO: 1686695 - RNA, 19 nt, Homo sapiens
cagaauuuuuaacuguacu

SEQ ID NO: 1686696 - RNA, 22 nt, Homo sapiens
cagacagcccuggcaaaugccu

SEQ ID NO: 1686697 - RNA, 12 nt, Homo sapiens
cagacugaaaua

SEQ ID NO: 1686698 - RNA, 21 nt, Homo sapiens
cagacuugaaugcuaguuaua

SEQ ID NO: 1686699 - RNA, 18 nt, Homo sapiens
cagagcaagacugucuca

SEQ ID NO: 1686700 - RNA, 23 nt, Homo sapiens
cagaggaauaacaucaccacugu

SEQ ID NO: 1686701 - RNA, 18 nt, Homo sapiens
ccuaaaaguucucaaugu

SEQ ID NO: 1686702 - RNA, 11 nt, Homo sapiens
ccuaaagccag

SEQ ID NO: 1686703 - RNA, 17 nt, Homo sapiens
ccuaagaagaaggccag

SEQ ID NO: 1686704 - RNA, 12 nt, Homo sapiens
ccuacauguauu

SEQ ID NO: 1686705 - RNA, 15 nt, Homo sapiens
ccuacucacacuuca

SEQ ID NO: 1686706 - RNA, 15 nt, Homo sapiens
ccuagaaagggcaag

SEQ ID NO: 1686707 - RNA, 20 nt, Homo sapiens
ccuagcagaggaaaguguaa

SEQ ID NO: 1686708 - RNA, 19 nt, Homo sapiens
ccuaggaccauuucucugc

SEQ ID NO: 1686709 - RNA, 19 nt, Homo sapiens
ccuauuuaucugaucaaga

SEQ ID NO: 1686710 - RNA, 19 nt, Homo sapiens
ccucaauaaaaaguuuuau

SEQ ID NO: 1686711 - RNA, 15 nt, Homo sapiens
ccucaccacagccuu

SEQ ID NO: 1686712 - RNA, 18 nt, Homo sapiens
ccucaccacagccuucua

SEQ ID NO: 1686713 - RNA, 17 nt, Homo sapiens
ccucagcucaaugcagu

SEQ ID NO: 1686714 - RNA, 11 nt, Homo sapiens
ccucagggugg

SEQ ID NO: 1686715 - RNA, 12 nt, Homo sapiens
ccucaguucuca

SEQ ID NO: 1686716 - RNA, 16 nt, Homo sapiens
ccucauuuugcuuccc

SEQ ID NO: 1686717 - RNA, 22 nt, Homo sapiens
ccuccaagggaucugcuugaua

SEQ ID NO: 1686718 - RNA, 16 nt, Homo sapiens
ccuccagaagcugcuc

SEQ ID NO: 1686719 - RNA, 18 nt, Homo sapiens
ccuccagaagcugcuccu

SEQ ID NO: 1686720 - RNA, 21 nt, Homo sapiens
ccuccccaagucagcaguccu

SEQ ID NO: 1686721 - RNA, 23 nt, Homo sapiens
ccucuggacuggaaagcacaaga

SEQ ID NO: 1686722 - RNA, 18 nt, Homo sapiens
ccugaggacugauuucag

SEQ ID NO: 1686723 - RNA, 19 nt, Homo sapiens
ccugauacaggcauggcag

SEQ ID NO: 1686724 - RNA, 15 nt, Homo sapiens
ccugcaagucagucc

SEQ ID NO: 1686725 - RNA, 13 nt, Homo sapiens
ccugccaccuuca

SEQ ID NO: 1686726 - RNA, 18 nt, Homo sapiens
ccugcgugggggccaguc

SEQ ID NO: 1686727 - RNA, 19 nt, Homo sapiens
ccuggcagucucaguccaa

SEQ ID NO: 1686728 - RNA, 11 nt, Homo sapiens
ccugguggugg

SEQ ID NO: 1686729 - RNA, 21 nt, Homo sapiens
ccuguaaggcaggcccauuca

SEQ ID NO: 1686730 - RNA, 18 nt, Homo sapiens
ccuguaaucucagcacuu

SEQ ID NO: 1686731 - RNA, 20 nt, Homo sapiens
ccuguaaucucagcacuuug

SEQ ID NO: 1686732 - RNA, 22 nt, Homo sapiens
ccugucuaggucuccucagggu

SEQ ID NO: 1686733 - RNA, 14 nt, Homo sapiens
ccuguguacugccu

SEQ ID NO: 1686734 - RNA, 15 nt, Homo sapiens
ccuguguacugccuu

SEQ ID NO: 1686735 - RNA, 17 nt, Homo sapiens
ccuguguacugccuuaa

SEQ ID NO: 1686736 - RNA, 14 nt, Homo sapiens
ccuguugguucuga

SEQ ID NO: 1686737 - RNA, 15 nt, Homo sapiens
ccuuaaaacaauucu

SEQ ID NO: 1686738 - RNA, 19 nt, Homo sapiens
ccuuaagggguaucaugua

SEQ ID NO: 1686739 - RNA, 18 nt, Homo sapiens
ccuuagcccugucugcua

SEQ ID NO: 1686740 - RNA, 18 nt, Homo sapiens
ccuuaucugaaaggccag

SEQ ID NO: 1686741 - RNA, 19 nt, Homo sapiens
ccuuauuaauacaaacaca

SEQ ID NO: 1686742 - RNA, 14 nt, Homo sapiens
ccuucaaggcucuu

SEQ ID NO: 1686743 - RNA, 22 nt, Homo sapiens
ccuucgcuuaagccagcacuca

SEQ ID NO: 1686744 - RNA, 15 nt, Homo sapiens
ccuugcagauaucug

SEQ ID NO: 1686745 - RNA, 19 nt, Homo sapiens
ccuugugagagcccauucc

SEQ ID NO: 1686746 - RNA, 14 nt, Homo sapiens
ccuuuccuggcagu

SEQ ID NO: 1686747 - RNA, 17 nt, Homo sapiens
ccuuugaagaaggcaag

SEQ ID NO: 1686748 - RNA, 21 nt, Homo sapiens
ccuuugucuaaguagggccag

SEQ ID NO: 1686749 - RNA, 19 nt, Homo sapiens
ccuuuuaagcaugugaugu

SEQ ID NO: 1686750 - RNA, 20 nt, Homo sapiens
cgaacaccaaaaaugaugcg

SEQ ID NO: 1686751 - RNA, 20 nt, Homo sapiens
cgaccccgucacagccucaa

SEQ ID NO: 1686752 - RNA, 14 nt, Homo sapiens
cgaugacaguguuc

SEQ ID NO: 1686753 - RNA, 15 nt, Homo sapiens
cgccuccccaaguca

SEQ ID NO: 1686754 - RNA, 23 nt, Homo sapiens
cggccgaagcccaccacuggcca

SEQ ID NO: 1686755 - RNA, 19 nt, Homo sapiens
cggcuacugguuaccugga

SEQ ID NO: 1686756 - RNA, 20 nt, Homo sapiens
cggcugucuccuugaagguu

SEQ ID NO: 1686757 - RNA, 14 nt, Homo sapiens
cgggagccauguca

SEQ ID NO: 1686758 - RNA, 17 nt, Homo sapiens
cgggaugaccuccagaa

SEQ ID NO: 1686759 - RNA, 17 nt, Homo sapiens
cgggcaccaggggccaa

SEQ ID NO: 1686760 - RNA, 19 nt, Homo sapiens
cgggugggcggcacagccu

SEQ ID NO: 1686761 - RNA, 13 nt, Homo sapiens
cgguggaggcaga

SEQ ID NO: 1686762 - RNA, 12 nt, Homo sapiens
cuaaaaaucaaa

SEQ ID NO: 1686763 - RNA, 19 nt, Homo sapiens
cuaaaaaucaaauaagcua

SEQ ID NO: 1686764 - RNA, 19 nt, Homo sapiens
cuguacuaacccagucuuu

SEQ ID NO: 1686765 - RNA, 18 nt, Homo sapiens
cuguauuccgauacaaag

SEQ ID NO: 1686766 - RNA, 22 nt, Homo sapiens
cugucuagaacuuaaguuugau

SEQ ID NO: 1686767 - RNA, 15 nt, Homo sapiens
cugugaauacuugaa

SEQ ID NO: 1686768 - RNA, 22 nt, Homo sapiens
cugugacauacauauuaucuca

SEQ ID NO: 1686769 - RNA, 23 nt, Homo sapiens
cugugacugaagaagaugagccu

SEQ ID NO: 1686770 - RNA, 18 nt, Homo sapiens
cugugagcauggggccag

SEQ ID NO: 1686771 - RNA, 20 nt, Homo sapiens
cugugcuucgacuacugcuc

SEQ ID NO: 1686772 - RNA, 17 nt, Homo sapiens
cuguggaugcaaauaga

SEQ ID NO: 1686773 - RNA, 15 nt, Homo sapiens
cuguucccuugcagg

SEQ ID NO: 1686774 - RNA, 18 nt, Homo sapiens
cuguucccuugcaggggu

SEQ ID NO: 1686775 - RNA, 16 nt, Homo sapiens
cuguuuaaagugucac

SEQ ID NO: 1686776 - RNA, 16 nt, Homo sapiens
cuguuuccuagcugug

SEQ ID NO: 1686777 - RNA, 12 nt, Homo sapiens
cuuaacuaugag

SEQ ID NO: 1686778 - RNA, 21 nt, Homo sapiens
cuuaagccagcacucacacca

SEQ ID NO: 1686779 - RNA, 20 nt, Homo sapiens
cuuaagggguaucauguaug

SEQ ID NO: 1686780 - RNA, 18 nt, Homo sapiens
cuuaaugcuacaugugag

SEQ ID NO: 1686781 - RNA, 16 nt, Homo sapiens
cuuaaugguguuguuu

SEQ ID NO: 1686782 - RNA, 16 nt, Homo sapiens
cuuacaggagccagcc

SEQ ID NO: 1686783 - RNA, 14 nt, Homo sapiens
cuuagagauugcau

SEQ ID NO: 1686784 - RNA, 21 nt, Homo sapiens
cuuagagggaaucuagcccaa

SEQ ID NO: 1686785 - RNA, 19 nt, Homo sapiens
cuuagguaagacauauaac

SEQ ID NO: 1686786 - RNA, 21 nt, Homo sapiens
cuuauuacagcauuugauaaa

SEQ ID NO: 1686787 - RNA, 14 nt, Homo sapiens
cuucaaaaagccac

SEQ ID NO: 1686788 - RNA, 21 nt, Homo sapiens
cuucaagaacccugacuccuc

SEQ ID NO: 1686789 - RNA, 23 nt, Homo sapiens
cuucaaggcucuucuuccucacc

SEQ ID NO: 1686790 - RNA, 18 nt, Homo sapiens
cuucacugcaaguuuuag

SEQ ID NO: 1686791 - RNA, 23 nt, Homo sapiens
cuucagaagucacacauuacaaa

SEQ ID NO: 1686792 - RNA, 22 nt, Homo sapiens
cuuccuaaugucagaacagagu

SEQ ID NO: 1686793 - RNA, 14 nt, Homo sapiens
cuucucaucuugcc

SEQ ID NO: 1686794 - RNA, 22 nt, Homo sapiens
cuucucuauugggcacagccua

SEQ ID NO: 1686795 - RNA, 22 nt, Homo sapiens
cuucugauuaaaguaaguagaa

SEQ ID NO: 1686796 - RNA, 16 nt, Homo sapiens
cuucuugcugaucaga

SEQ ID NO: 1686797 - RNA, 17 nt, Homo sapiens
cuugaacucuguucccc

SEQ ID NO: 1686798 - RNA, 13 nt, Homo sapiens
cuugaugggguga

SEQ ID NO: 1686799 - RNA, 14 nt, Homo sapiens
cuugauucauucug

SEQ ID NO: 1686800 - RNA, 14 nt, Homo sapiens
cuugcaagauucca

SEQ ID NO: 1686801 - RNA, 20 nt, Homo sapiens
cuugcaagauuccaaguucu

SEQ ID NO: 1686802 - RNA, 20 nt, Homo sapiens
cuugcagauaucugcaugug

SEQ ID NO: 1686803 - RNA, 22 nt, Homo sapiens
cuugcagcggcuccugcaaaag

SEQ ID NO: 1686804 - RNA, 13 nt, Homo sapiens
cuugcagggucuu

SEQ ID NO: 1686805 - RNA, 17 nt, Homo sapiens
cuugcccagacuacagg

SEQ ID NO: 1686806 - RNA, 21 nt, Homo sapiens
cuuggauuuuccugaaagugu

SEQ ID NO: 1686807 - RNA, 15 nt, Homo sapiens
cuuggcagugggaau

SEQ ID NO: 1686808 - RNA, 17 nt, Homo sapiens
cuuggggaaggggccug

SEQ ID NO: 1686809 - RNA, 15 nt, Homo sapiens
cuugggggucagggg

SEQ ID NO: 1686810 - RNA, 19 nt, Homo sapiens
cuuguaaggcauacugccu

SEQ ID NO: 1686811 - RNA, 16 nt, Homo sapiens
cuuguacuacacagaa

SEQ ID NO: 1686812 - RNA, 18 nt, Homo sapiens
cuuguauagcaugaaaua

SEQ ID NO: 1686813 - RNA, 23 nt, Homo sapiens
cuuguauagcaugaaauaaaaua

SEQ ID NO: 1686814 - RNA, 14 nt, Homo sapiens
cuugucugugcauc

SEQ ID NO: 1686815 - RNA, 14 nt, Homo sapiens
cuugucuucuggua

SEQ ID NO: 1686816 - RNA, 15 nt, Homo sapiens
cuuuaagaacuaaaa

SEQ ID NO: 1686817 - RNA, 22 nt, Homo sapiens
cuuuaagccuucaaaacuauag

SEQ ID NO: 1686818 - RNA, 20 nt, Homo sapiens
cuuuaaguuaagugcauuga

SEQ ID NO: 1686819 - RNA, 18 nt, Homo sapiens
cuuuagcaagugugcacu

SEQ ID NO: 1686820 - RNA, 21 nt, Homo sapiens
cuuuauaaauguaccagagag

SEQ ID NO: 1686821 - RNA, 20 nt, Homo sapiens
cuuuccauccauuaccucca

SEQ ID NO: 1686822 - RNA, 16 nt, Homo sapiens
gaccagaaauucccuu

SEQ ID NO: 1686823 - RNA, 15 nt, Homo sapiens
gaccagucugacccu

SEQ ID NO: 1686824 - RNA, 21 nt, Homo sapiens
gacccacagaacuuguggccu

SEQ ID NO: 1686825 - RNA, 15 nt, Homo sapiens
gacgacucugaccuc

SEQ ID NO: 1686826 - RNA, 20 nt, Homo sapiens
gacgacucugaccucuuggc

SEQ ID NO: 1686827 - RNA, 18 nt, Homo sapiens
gacguuaggccaggccuu

SEQ ID NO: 1686828 - RNA, 21 nt, Homo sapiens
gacuacuuggaacuaggcucu

SEQ ID NO: 1686829 - RNA, 18 nt, Homo sapiens
gacuccucuuugugcaga

SEQ ID NO: 1686830 - RNA, 15 nt, Homo sapiens
gacugggcacugggg

SEQ ID NO: 1686831 - RNA, 21 nt, Homo sapiens
gacuuauggcaugacucuuca

SEQ ID NO: 1686832 - RNA, 19 nt, Homo sapiens
gagaaaauaaaagcacuua

SEQ ID NO: 1686833 - RNA, 14 nt, Homo sapiens
gagaaaccugccaa

SEQ ID NO: 1686834 - RNA, 19 nt, Homo sapiens
gagacagagacaaguaauu

SEQ ID NO: 1686835 - RNA, 11 nt, Homo sapiens
gagacauguga

SEQ ID NO: 1686836 - RNA, 21 nt, Homo sapiens
gagauucccaccuuccauagc

SEQ ID NO: 1686837 - RNA, 20 nt, Homo sapiens
gagcaaacucugcugucuaa

SEQ ID NO: 1686838 - RNA, 15 nt, Homo sapiens
gagcaagacugucuc

SEQ ID NO: 1686839 - RNA, 16 nt, Homo sapiens
gagcaagacugucuca

SEQ ID NO: 1686840 - RNA, 13 nt, Homo sapiens
gagcaagcaccaa

SEQ ID NO: 1686841 - RNA, 20 nt, Homo sapiens
gagcauccuuggcaguggga

SEQ ID NO: 1686842 - RNA, 16 nt, Homo sapiens
gagccaagauugcacc

SEQ ID NO: 1686843 - RNA, 21 nt, Homo sapiens
gagccaagauugcaccacugc

SEQ ID NO: 1686844 - RNA, 18 nt, Homo sapiens
gagcuaggaacccuggag

SEQ ID NO: 1686845 - RNA, 12 nt, Homo sapiens
gagcuauaacuu

SEQ ID NO: 1686846 - RNA, 15 nt, Homo sapiens
gagcuggcaccagaa

SEQ ID NO: 1686847 - RNA, 15 nt, Homo sapiens
gaggaguaaaauuca

SEQ ID NO: 1686848 - RNA, 20 nt, Homo sapiens
gaggcaggagaaucgcuuga

SEQ ID NO: 1686849 - RNA, 21 nt, Homo sapiens
gaggcauuugcagcugugcca

SEQ ID NO: 1686850 - RNA, 12 nt, Homo sapiens
gaggcuggccaa

SEQ ID NO: 1686851 - RNA, 17 nt, Homo sapiens
gaggguuggagugcucu

SEQ ID NO: 1686852 - RNA, 23 nt, Homo sapiens
gaggucaggaguugaagaccagc

SEQ ID NO: 1686853 - RNA, 20 nt, Homo sapiens
gaggugggauccucccucau

SEQ ID NO: 1686854 - RNA, 14 nt, Homo sapiens
gagguuaggaguag

SEQ ID NO: 1686855 - RNA, 16 nt, Homo sapiens
gaguagggaguucauc

SEQ ID NO: 1686856 - RNA, 14 nt, Homo sapiens
gaguccacucccag

SEQ ID NO: 1686857 - RNA, 20 nt, Homo sapiens
gaguccacucccagugcuug

SEQ ID NO: 1686858 - RNA, 23 nt, Homo sapiens
gaguccacucccagugcuugcaa

SEQ ID NO: 1686859 - RNA, 14 nt, Homo sapiens
gagugcaacccagu

SEQ ID NO: 1686860 - RNA, 18 nt, Homo sapiens
gaguuucacuguacugca

SEQ ID NO: 1686861 - RNA, 14 nt, Homo sapiens
gauaaaauccaaaa

SEQ ID NO: 1686862 - RNA, 14 nt, Homo sapiens
gauacagaucucag

SEQ ID NO: 1686863 - RNA, 13 nt, Homo sapiens
gauaccugugagg

SEQ ID NO: 1686864 - RNA, 22 nt, Homo sapiens
gauauauaaguguacauaugug

SEQ ID NO: 1686865 - RNA, 16 nt, Homo sapiens
gauauauaggcuauuu

SEQ ID NO: 1686866 - RNA, 17 nt, Homo sapiens
gauauugauuacuauca

SEQ ID NO: 1686867 - RNA, 14 nt, Homo sapiens
gauccagcccaaac

SEQ ID NO: 1686868 - RNA, 21 nt, Homo sapiens
gauccagggcagcaggccaga

SEQ ID NO: 1686869 - RNA, 15 nt, Homo sapiens
gaucccgucuuccag

SEQ ID NO: 1686870 - RNA, 18 nt, Homo sapiens
gaucgaguguagcuguga

SEQ ID NO: 1686871 - RNA, 15 nt, Homo sapiens
gaucguuucuuccag

SEQ ID NO: 1686872 - RNA, 21 nt, Homo sapiens
gaucuauuguuuguugcacua

SEQ ID NO: 1686873 - RNA, 17 nt, Homo sapiens
gaucucacaagcacuuu

SEQ ID NO: 1686874 - RNA, 23 nt, Homo sapiens
gaugaaagaauuggagugauaau

SEQ ID NO: 1686875 - RNA, 18 nt, Homo sapiens
gaugaauugucacaucua

SEQ ID NO: 1686876 - RNA, 22 nt, Homo sapiens
gaugaauugucacaucuaucca

SEQ ID NO: 1686877 - RNA, 22 nt, Homo sapiens
gaugaguuucacuguacugcau

SEQ ID NO: 1686878 - RNA, 22 nt, Homo sapiens
gaugcaucaucucuuccucaca

SEQ ID NO: 1686879 - RNA, 20 nt, Homo sapiens
gaugccccugacaucaucau

SEQ ID NO: 1686880 - RNA, 18 nt, Homo sapiens
cugccaaaacauuuauga

SEQ ID NO: 1686881 - RNA, 17 nt, Homo sapiens
cugcccacaacucccuu

SEQ ID NO: 1686882 - RNA, 17 nt, Homo sapiens
cugcuaggcgcugggga

SEQ ID NO: 1686883 - RNA, 19 nt, Homo sapiens
cugcucccacaggggccau

SEQ ID NO: 1686884 - RNA, 18 nt, Homo sapiens
cugcuccccuaaagccag

SEQ ID NO: 1686885 - RNA, 14 nt, Homo sapiens
cugcucugccugga

SEQ ID NO: 1686886 - RNA, 16 nt, Homo sapiens
cugcuguugaacuuuu

SEQ ID NO: 1686887 - RNA, 23 nt, Homo sapiens
cugcuucccacaacuacuagugu

SEQ ID NO: 1686888 - RNA, 20 nt, Homo sapiens
cuggaagaagugagcagugu

SEQ ID NO: 1686889 - RNA, 15 nt, Homo sapiens
cuggaauuacaggcg

SEQ ID NO: 1686890 - RNA, 20 nt, Homo sapiens
cuggacuggaaagcacaaga

SEQ ID NO: 1686891 - RNA, 19 nt, Homo sapiens
cuggaggcuccucuaggcc

SEQ ID NO: 1686892 - RNA, 17 nt, Homo sapiens
cuggaucccguucagaa

SEQ ID NO: 1686893 - RNA, 20 nt, Homo sapiens
cuggauggccaaacccaaga

SEQ ID NO: 1686894 - RNA, 23 nt, Homo sapiens
cuggcaaaugccugacucaguga

SEQ ID NO: 1686895 - RNA, 22 nt, Homo sapiens
cuggcacaguguaauccagggg

SEQ ID NO: 1686896 - RNA, 15 nt, Homo sapiens
cuggcagucucaguc

SEQ ID NO: 1686897 - RNA, 20 nt, Homo sapiens
cuggccggagucagugccag

SEQ ID NO: 1686898 - RNA, 22 nt, Homo sapiens
cuggccuaaugagauaauacuc

SEQ ID NO: 1686899 - RNA, 19 nt, Homo sapiens
cuggcuucaaaaagccaca

SEQ ID NO: 1686900 - RNA, 13 nt, Homo sapiens
cugggaaggccag

SEQ ID NO: 1686901 - RNA, 20 nt, Homo sapiens
cugggcuucgggcuaugcaa

SEQ ID NO: 1686902 - RNA, 21 nt, Homo sapiens
cuggguggaagugugugccaa

SEQ ID NO: 1686903 - RNA, 20 nt, Homo sapiens
cugguaauaaaugugacuca

SEQ ID NO: 1686904 - RNA, 22 nt, Homo sapiens
cugguaauauugacuuguauau

SEQ ID NO: 1686905 - RNA, 20 nt, Homo sapiens
cuggucucaaacuccugacc

SEQ ID NO: 1686906 - RNA, 18 nt, Homo sapiens
cuggugaacacugugacc

SEQ ID NO: 1686907 - RNA, 21 nt, Homo sapiens
cuguaaagauguuuauuucag

SEQ ID NO: 1686908 - RNA, 22 nt, Homo sapiens
cuguaaggcaggcccauucaga

SEQ ID NO: 1686909 - RNA, 19 nt, Homo sapiens
cuguaaucucagcacuuug

SEQ ID NO: 1686910 - RNA, 19 nt, Homo sapiens
cuguaauuccagcuacuca

SEQ ID NO: 1686911 - RNA, 14 nt, Homo sapiens
cuguacacagaauu

SEQ ID NO: 1686912 - RNA, 19 nt, Homo sapiens
cuguaggcacacuuugcac

SEQ ID NO: 1686913 - RNA, 15 nt, Homo sapiens
cuguaucacugccuu

SEQ ID NO: 1686914 - RNA, 12 nt, Homo sapiens
cugucaagaaga

SEQ ID NO: 1686915 - RNA, 22 nt, Homo sapiens
cugucaagaagaggaaagggag

SEQ ID NO: 1686916 - RNA, 16 nt, Homo sapiens
cugucacucugugccu

SEQ ID NO: 1686917 - RNA, 14 nt, Homo sapiens
cugucauugcacau

SEQ ID NO: 1686918 - RNA, 22 nt, Homo sapiens
cugucuauuaauauucagggua

SEQ ID NO: 1686919 - RNA, 23 nt, Homo sapiens
cugucuucuuucuccauggagcc

SEQ ID NO: 1686920 - RNA, 15 nt, Homo sapiens
cugugacugauauga

SEQ ID NO: 1686921 - RNA, 16 nt, Homo sapiens
cugugagcauggggcc

SEQ ID NO: 1686922 - RNA, 17 nt, Homo sapiens
cugugagccuugcauga

SEQ ID NO: 1686923 - RNA, 16 nt, Homo sapiens
cugugauuacugcaau

SEQ ID NO: 1686924 - RNA, 18 nt, Homo sapiens
cugugcuucgacuacugc

SEQ ID NO: 1686925 - RNA, 23 nt, Homo sapiens
cugugcuucgacuacugcuccug

SEQ ID NO: 1686926 - RNA, 14 nt, Homo sapiens
cuguggaaugugca

SEQ ID NO: 1686927 - RNA, 13 nt, Homo sapiens
cuguggcuuucag

SEQ ID NO: 1686928 - RNA, 15 nt, Homo sapiens
cuguuucauagcaaa

SEQ ID NO: 1686929 - RNA, 20 nt, Homo sapiens
cuguuucccuuucacuggca

SEQ ID NO: 1686930 - RNA, 17 nt, Homo sapiens
cuuaaaacaaagccaug

SEQ ID NO: 1686931 - RNA, 20 nt, Homo sapiens
cuuaaaccuuaagauacuaa

SEQ ID NO: 1686932 - RNA, 20 nt, Homo sapiens
cuuaaagggcccaaugaauu

SEQ ID NO: 1686933 - RNA, 22 nt, Homo sapiens
cuuaauuuaacuuuccagucuu

SEQ ID NO: 1686934 - RNA, 13 nt, Homo sapiens
cuuacaacccagg

SEQ ID NO: 1686935 - RNA, 20 nt, Homo sapiens
cuuacucuaggucaguauua

SEQ ID NO: 1686936 - RNA, 20 nt, Homo sapiens
cuuauagacacuugcuccca

SEQ ID NO: 1686937 - RNA, 14 nt, Homo sapiens
cuuauuaauacaaa

SEQ ID NO: 1686938 - RNA, 18 nt, Homo sapiens
cuuauucuuugaguaaug

SEQ ID NO: 1686939 - RNA, 19 nt, Homo sapiens
cuuauuuucucaaucuccu

SEQ ID NO: 1686940 - RNA, 21 nt, Homo sapiens
cuuauuuugugugcuuuccca

SEQ ID NO: 1686941 - RNA, 16 nt, Homo sapiens
cuucaacagccaagcu

SEQ ID NO: 1686942 - RNA, 13 nt, Homo sapiens
cuucacagaacac

SEQ ID NO: 1686943 - RNA, 12 nt, Homo sapiens
cuucacaguacc

SEQ ID NO: 1686944 - RNA, 18 nt, Homo sapiens
cuucaccuccuucugcag

SEQ ID NO: 1686945 - RNA, 21 nt, Homo sapiens
cuucagcugggucacauccau

SEQ ID NO: 1686946 - RNA, 18 nt, Homo sapiens
cuucaggcagcugaaauu

SEQ ID NO: 1686947 - RNA, 13 nt, Homo sapiens
cuucccaugcauu

SEQ ID NO: 1686948 - RNA, 23 nt, Homo sapiens
cuucccccagcacaaagcacugg

SEQ ID NO: 1686949 - RNA, 18 nt, Homo sapiens
cuuccuagauaugauaaa

SEQ ID NO: 1686950 - RNA, 22 nt, Homo sapiens
cuuccugacagguucugagaua

SEQ ID NO: 1686951 - RNA, 17 nt, Homo sapiens
cuuccuucucaucuugc

SEQ ID NO: 1686952 - RNA, 14 nt, Homo sapiens
cuuccuugauaaua

SEQ ID NO: 1686953 - RNA, 22 nt, Homo sapiens
cuucuaguugcccccauuccca

SEQ ID NO: 1686954 - RNA, 13 nt, Homo sapiens
cuucucacacugg

SEQ ID NO: 1686955 - RNA, 14 nt, Homo sapiens
cuucuccuguucca

SEQ ID NO: 1686956 - RNA, 18 nt, Homo sapiens
cuucugcagucagacuga

SEQ ID NO: 1686957 - RNA, 23 nt, Homo sapiens
cuugaaauuuggcuaauaacaaa

SEQ ID NO: 1686958 - RNA, 15 nt, Homo sapiens
cuugcagaacuguag

SEQ ID NO: 1686959 - RNA, 21 nt, Homo sapiens
cuugcagcggcuccugcaaaa

SEQ ID NO: 1686960 - RNA, 19 nt, Homo sapiens
cuugcccagacuacagggc

SEQ ID NO: 1686961 - RNA, 16 nt, Homo sapiens
cuugccucauuuugcu

SEQ ID NO: 1686962 - RNA, 22 nt, Homo sapiens
cuuggagaaaauggguuuauuc

SEQ ID NO: 1686963 - RNA, 14 nt, Homo sapiens
cuuguaaaugugac

SEQ ID NO: 1686964 - RNA, 14 nt, Homo sapiens
cuugucaaugugau

SEQ ID NO: 1686965 - RNA, 16 nt, Homo sapiens
cuugugggagacagca

SEQ ID NO: 1686966 - RNA, 16 nt, Homo sapiens
cuuuagcuuaccuggg

SEQ ID NO: 1686967 - RNA, 17 nt, Homo sapiens
cuuuaguagacauuuau

SEQ ID NO: 1686968 - RNA, 23 nt, Homo sapiens
cuuuauaaaauauuuaaugugac

SEQ ID NO: 1686969 - RNA, 19 nt, Homo sapiens
cuuuauacacaguggauug

SEQ ID NO: 1686970 - RNA, 14 nt, Homo sapiens
cuuuauugcaaugc

SEQ ID NO: 1686971 - RNA, 17 nt, Homo sapiens
cuuucauaaaaacacuc

SEQ ID NO: 1686972 - RNA, 14 nt, Homo sapiens
cuuucccaguccca

SEQ ID NO: 1686973 - RNA, 21 nt, Homo sapiens
cuuucccagucccauuccuca

SEQ ID NO: 1686974 - RNA, 20 nt, Homo sapiens
cuuuccuccacccauaauaa

SEQ ID NO: 1686975 - RNA, 17 nt, Homo sapiens
cuuugaguagauccauu

SEQ ID NO: 1686976 - RNA, 22 nt, Homo sapiens
cuuuguaacuguuuucaaggag

SEQ ID NO: 1686977 - RNA, 14 nt, Homo sapiens
cuuuguaggugucu

SEQ ID NO: 1686978 - RNA, 13 nt, Homo sapiens
cuuuuaaugaugc

SEQ ID NO: 1686979 - RNA, 16 nt, Homo sapiens
cuuuuauaaagcaugu

SEQ ID NO: 1686980 - RNA, 16 nt, Homo sapiens
cuuuuccccaguccca

SEQ ID NO: 1686981 - RNA, 21 nt, Homo sapiens
cuuuuuaaagaagugcaugaa

SEQ ID NO: 1686982 - RNA, 22 nt, Homo sapiens
cuuuuuaaagaagugcaugaaa

SEQ ID NO: 1686983 - RNA, 15 nt, Homo sapiens
cuuuuuuaaaggcac

SEQ ID NO: 1686984 - RNA, 19 nt, Homo sapiens
gaaaaaucuaagugauaua

SEQ ID NO: 1686985 - RNA, 14 nt, Homo sapiens
gaaaaccacuuuau

SEQ ID NO: 1686986 - RNA, 15 nt, Homo sapiens
gaaaaguguggcuug

SEQ ID NO: 1686987 - RNA, 22 nt, Homo sapiens
gaaaaugcuaaagaauccauaa

SEQ ID NO: 1686988 - RNA, 17 nt, Homo sapiens
gaaacagcugcccugug

SEQ ID NO: 1686989 - RNA, 18 nt, Homo sapiens
gaaacuauauguauucac

SEQ ID NO: 1686990 - RNA, 16 nt, Homo sapiens
gaaagaaucuuuacaa

SEQ ID NO: 1686991 - RNA, 20 nt, Homo sapiens
gaaagagccuaacaucucca

SEQ ID NO: 1686992 - RNA, 19 nt, Homo sapiens
gaaagccugggugacauuu

SEQ ID NO: 1686993 - RNA, 21 nt, Homo sapiens
gaaauaauugaagagagaaau

SEQ ID NO: 1686994 - RNA, 14 nt, Homo sapiens
gaaaugauuucaca

SEQ ID NO: 1686995 - RNA, 18 nt, Homo sapiens
gaaauugcauacuuugua

SEQ ID NO: 1686996 - RNA, 13 nt, Homo sapiens
gaacagagugcaa

SEQ ID NO: 1686997 - RNA, 18 nt, Homo sapiens
gaacagccuuagagcucu

SEQ ID NO: 1686998 - RNA, 18 nt, Homo sapiens
gaaccucuaagugcugcu

SEQ ID NO: 1686999 - RNA, 15 nt, Homo sapiens
ggugcucaugcugcu

SEQ ID NO: 1687000 - RNA, 18 nt, Homo sapiens
ggugcuucucacacugga

SEQ ID NO: 1687001 - RNA, 23 nt, Homo sapiens
ggugggcggcacagccuucucca

SEQ ID NO: 1687002 - RNA, 18 nt, Homo sapiens
gguggggggcauugagua

SEQ ID NO: 1687003 - RNA, 24 nt, Homo sapiens
gguguagaugggggaacugugaau

SEQ ID NO: 1687004 - RNA, 14 nt, Homo sapiens
ggugugaacauguu

SEQ ID NO: 1687005 - RNA, 19 nt, Homo sapiens
gguuaaaaaaaaaagucac

SEQ ID NO: 1687006 - RNA, 17 nt, Homo sapiens
gguuauaacaguguuua

SEQ ID NO: 1687007 - RNA, 16 nt, Homo sapiens
gguugugcacauuucu

SEQ ID NO: 1687008 - RNA, 14 nt, Homo sapiens
gguuugggagccag

SEQ ID NO: 1687009 - RNA, 18 nt, Homo sapiens
guaaaaggauaguaagca

SEQ ID NO: 1687010 - RNA, 12 nt, Homo sapiens
guaaacaaagac

SEQ ID NO: 1687011 - RNA, 12 nt, Homo sapiens
guaaauucugua

SEQ ID NO: 1687012 - RNA, 15 nt, Homo sapiens
guaaucucagcacuu

SEQ ID NO: 1687013 - RNA, 14 nt, Homo sapiens
guaaugaaauggag

SEQ ID NO: 1687014 - RNA, 18 nt, Homo sapiens
guaauuccagcuacucag

SEQ ID NO: 1687015 - RNA, 14 nt, Homo sapiens
guaccgucuucucc

SEQ ID NO: 1687016 - RNA, 13 nt, Homo sapiens
guacugcauguga

SEQ ID NO: 1687017 - RNA, 23 nt, Homo sapiens
guacugccuuaaauguaccuaug

SEQ ID NO: 1687018 - RNA, 16 nt, Homo sapiens
guauaaauauacagua

SEQ ID NO: 1687019 - RNA, 20 nt, Homo sapiens
guauacauaaguuuaggaua

SEQ ID NO: 1687020 - RNA, 17 nt, Homo sapiens
guauacccucuguuucc

SEQ ID NO: 1687021 - RNA, 19 nt, Homo sapiens
guauauuacccaauggaaa

SEQ ID NO: 1687022 - RNA, 11 nt, Homo sapiens
guauguuaaag

SEQ ID NO: 1687023 - RNA, 19 nt, Homo sapiens
guauuccgauacaaagugu

SEQ ID NO: 1687024 - RNA, 23 nt, Homo sapiens
guauuuuuuccacuacacaacug

SEQ ID NO: 1687025 - RNA, 22 nt, Homo sapiens
gucaaccccaaguuaguucaau

SEQ ID NO: 1687026 - RNA, 17 nt, Homo sapiens
gucaacuuauucuuuga

SEQ ID NO: 1687027 - RNA, 16 nt, Homo sapiens
gucaccccucacugug

SEQ ID NO: 1687028 - RNA, 21 nt, Homo sapiens
gucaccccucacugugacuga

SEQ ID NO: 1687029 - RNA, 15 nt, Homo sapiens
gucaggcugcagagg

SEQ ID NO: 1687030 - RNA, 20 nt, Homo sapiens
gucaguccaggaugcuaaca

SEQ ID NO: 1687031 - RNA, 14 nt, Homo sapiens
gucauuauucucug

SEQ ID NO: 1687032 - RNA, 20 nt, Homo sapiens
guccaacagacacaauuuau

SEQ ID NO: 1687033 - RNA, 12 nt, Homo sapiens
gucccugcaaaa

SEQ ID NO: 1687034 - RNA, 18 nt, Homo sapiens
gucuguggcuuucagccu

SEQ ID NO: 1687035 - RNA, 16 nt, Homo sapiens
gugaaaucccugccuc

SEQ ID NO: 1687036 - RNA, 15 nt, Homo sapiens
gugaagucucugggu

SEQ ID NO: 1687037 - RNA, 18 nt, Homo sapiens
gugacauuuauauauuga

SEQ ID NO: 1687038 - RNA, 23 nt, Homo sapiens
gugacauuugggagacaugugac

SEQ ID NO: 1687039 - RNA, 22 nt, Homo sapiens
gugaccagaaagcuucauccac

SEQ ID NO: 1687040 - RNA, 11 nt, Homo sapiens
gugagcacaaa

SEQ ID NO: 1687041 - RNA, 14 nt, Homo sapiens
gugagcacaaagaa

SEQ ID NO: 1687042 - RNA, 16 nt, Homo sapiens
gugagcauggggccag

SEQ ID NO: 1687043 - RNA, 13 nt, Homo sapiens
gugauuucucacc

SEQ ID NO: 1687044 - RNA, 17 nt, Homo sapiens
gugcacauuucuuugca

SEQ ID NO: 1687045 - RNA, 22 nt, Homo sapiens
gugcacauuucuuugcauucca

SEQ ID NO: 1687046 - RNA, 19 nt, Homo sapiens
guggaaugugcauucucug

SEQ ID NO: 1687047 - RNA, 24 nt, Homo sapiens
guggcucacuacugaacacaugug

SEQ ID NO: 1687048 - RNA, 17 nt, Homo sapiens
gugggauccucccucau

SEQ ID NO: 1687049 - RNA, 17 nt, Homo sapiens
gugguguuuauugcaau

SEQ ID NO: 1687050 - RNA, 11 nt, Homo sapiens
gugugguggcu

SEQ ID NO: 1687051 - RNA, 14 nt, Homo sapiens
guuccaguacuaug

SEQ ID NO: 1687052 - RNA, 20 nt, Homo sapiens
guuccuuaccucccuggucc

SEQ ID NO: 1687053 - RNA, 13 nt, Homo sapiens
guucuugggauac

SEQ ID NO: 1687054 - RNA, 11 nt, Homo sapiens
guugacugugu

SEQ ID NO: 1687055 - RNA, 16 nt, Homo sapiens
guugcagccgcagaga

SEQ ID NO: 1687056 - RNA, 16 nt, Homo sapiens
guuggaaaguaacugu

SEQ ID NO: 1687057 - RNA, 14 nt, Homo sapiens
guuguagcagaaac

SEQ ID NO: 1687058 - RNA, 15 nt, Homo sapiens
guuguggggccucag

SEQ ID NO: 1687059 - RNA, 13 nt, Homo sapiens
guuuaaagucuca

SEQ ID NO: 1687060 - RNA, 22 nt, Homo sapiens
guuuaaagucucaguuucuugc

SEQ ID NO: 1687061 - RNA, 22 nt, Homo sapiens
guuuacaauaggaguggugauu

SEQ ID NO: 1687062 - RNA, 17 nt, Homo sapiens
guuuagaugaaugucag

SEQ ID NO: 1687063 - RNA, 16 nt, Homo sapiens
guuucacuguacugca

SEQ ID NO: 1687064 - RNA, 16 nt, Homo sapiens
guuuccacagccugca

SEQ ID NO: 1687065 - RNA, 16 nt, Homo sapiens
guuucuccauguuggu

SEQ ID NO: 1687066 - RNA, 17 nt, Homo sapiens
guuuuaacuguggauau

SEQ ID NO: 1687067 - RNA, 23 nt, Homo sapiens
uaaaaaacaauuaacugcccucu

SEQ ID NO: 1687068 - RNA, 23 nt, Homo sapiens
uaaaaauggcaggggguggaauu

SEQ ID NO: 1687069 - RNA, 15 nt, Homo sapiens
uaaaagcuacuaugu

SEQ ID NO: 1687070 - RNA, 15 nt, Homo sapiens
uaaaagguacuggua

SEQ ID NO: 1687071 - RNA, 24 nt, Homo sapiens
uaaaagguauacuuuaguagacau

SEQ ID NO: 1687072 - RNA, 16 nt, Homo sapiens
uaaaauacuauugccu

SEQ ID NO: 1687073 - RNA, 19 nt, Homo sapiens
uaaaauacuauugccucau

SEQ ID NO: 1687074 - RNA, 15 nt, Homo sapiens
uaaaauaguaugaaa

SEQ ID NO: 1687075 - RNA, 12 nt, Homo sapiens
uaaaaugauguu

SEQ ID NO: 1687076 - RNA, 21 nt, Homo sapiens
uaaaauguggucugccaaucu

SEQ ID NO: 1687077 - RNA, 23 nt, Homo sapiens
uaaaauguggucugccaaucugu

SEQ ID NO: 1687078 - RNA, 22 nt, Homo sapiens
uaaaauguuuguuaaagcuaga

SEQ ID NO: 1687079 - RNA, 15 nt, Homo sapiens
uaaaauucuauuaua

SEQ ID NO: 1687080 - RNA, 20 nt, Homo sapiens
uaaaauucuauuauacuaca

SEQ ID NO: 1687081 - RNA, 21 nt, Homo sapiens
uaaacaaagacuuugauccau

SEQ ID NO: 1687082 - RNA, 16 nt, Homo sapiens
uaaacuauaaccucuc

SEQ ID NO: 1687083 - RNA, 22 nt, Homo sapiens
uaaacuucaccuacauuaucuc

SEQ ID NO: 1687084 - RNA, 13 nt, Homo sapiens
uaaagaauccaua

SEQ ID NO: 1687085 - RNA, 17 nt, Homo sapiens
uaaagacccuccuauuc

SEQ ID NO: 1687086 - RNA, 20 nt, Homo sapiens
uaaaguaaauacaugcauau

SEQ ID NO: 1687087 - RNA, 17 nt, Homo sapiens
uaaaguggaaguaugua

SEQ ID NO: 1687088 - RNA, 19 nt, Homo sapiens
uaaauauuucucaacugag

SEQ ID NO: 1687089 - RNA, 19 nt, Homo sapiens
uaaaucauucuuacuaaaa

SEQ ID NO: 1687090 - RNA, 17 nt, Homo sapiens
uaaauccaugguguuau

SEQ ID NO: 1687091 - RNA, 14 nt, Homo sapiens
uaaaugugacucag

SEQ ID NO: 1687092 - RNA, 16 nt, Homo sapiens
uaaauugcaucacugu

SEQ ID NO: 1687093 - RNA, 22 nt, Homo sapiens
uaacagaaagccugggugacau

SEQ ID NO: 1687094 - RNA, 23 nt, Homo sapiens
uaacagaaagccugggugacauu

SEQ ID NO: 1687095 - RNA, 19 nt, Homo sapiens
uaacaugcccuguucagcu

SEQ ID NO: 1687096 - RNA, 20 nt, Homo sapiens
uaaccgcuugguuugcaacc

SEQ ID NO: 1687097 - RNA, 21 nt, Homo sapiens
uaaccugggaccuguggucau

SEQ ID NO: 1687098 - RNA, 22 nt, Homo sapiens
uaaccuugaaaaaaaacagugg

SEQ ID NO: 1687099 - RNA, 15 nt, Homo sapiens
uaacuguacugaaua

SEQ ID NO: 1687100 - RNA, 14 nt, Homo sapiens
uaagaaauacucau

SEQ ID NO: 1687101 - RNA, 19 nt, Homo sapiens
uaagaacuaaaauguucua

SEQ ID NO: 1687102 - RNA, 22 nt, Homo sapiens
uaagaaucuuuagagaaguaua

SEQ ID NO: 1687103 - RNA, 18 nt, Homo sapiens
uaagacuaaaaguugcau

SEQ ID NO: 1687104 - RNA, 12 nt, Homo sapiens
uaagcuuuuugg

SEQ ID NO: 1687105 - RNA, 18 nt, Homo sapiens
uaagggguaucauguaug

SEQ ID NO: 1687106 - RNA, 20 nt, Homo sapiens
uaaguaaaagcuacuaugua

SEQ ID NO: 1687107 - RNA, 21 nt, Homo sapiens
uaagugcuugguugggguggu

SEQ ID NO: 1687108 - RNA, 22 nt, Homo sapiens
uaauaaagaugaguugguucuc

SEQ ID NO: 1687109 - RNA, 16 nt, Homo sapiens
uaauaaaugugacuca

SEQ ID NO: 1687110 - RNA, 12 nt, Homo sapiens
uaauaacuuauc

SEQ ID NO: 1687111 - RNA, 19 nt, Homo sapiens
uaauaauaagucaguguua

SEQ ID NO: 1687112 - RNA, 13 nt, Homo sapiens
uaauaauuauuca

SEQ ID NO: 1687113 - RNA, 16 nt, Homo sapiens
uaauacuacuacuguu

SEQ ID NO: 1687114 - RNA, 21 nt, Homo sapiens
uaauauacagucaguucucau

SEQ ID NO: 1687115 - RNA, 17 nt, Homo sapiens
uaauauuuuccuaguag

SEQ ID NO: 1687116 - RNA, 19 nt, Homo sapiens
uaauauuuuccuaguagau

SEQ ID NO: 1687117 - RNA, 19 nt, Homo sapiens
uaauggguaugcucagguc

SEQ ID NO: 1687118 - RNA, 21 nt, Homo sapiens
uaaugguaguuuuacaguguu

SEQ ID NO: 1687119 - RNA, 20 nt, Homo sapiens
ugugguccacugagcuauaa

SEQ ID NO: 1687120 - RNA, 14 nt, Homo sapiens
uguguacugccuua

SEQ ID NO: 1687121 - RNA, 19 nt, Homo sapiens
ugugucccugaaguauuua

SEQ ID NO: 1687122 - RNA, 14 nt, Homo sapiens
ugugugcuuuccca

SEQ ID NO: 1687123 - RNA, 20 nt, Homo sapiens
uguguuucuagaaucacagc

SEQ ID NO: 1687124 - RNA, 15 nt, Homo sapiens
uguuauaucagggaa

SEQ ID NO: 1687125 - RNA, 17 nt, Homo sapiens
uguuggugugaauuugc

SEQ ID NO: 1687126 - RNA, 14 nt, Homo sapiens
uguuuaauggguau

SEQ ID NO: 1687127 - RNA, 14 nt, Homo sapiens
uguuuauugcaaua

SEQ ID NO: 1687128 - RNA, 12 nt, Homo sapiens
uguuugccucau

SEQ ID NO: 1687129 - RNA, 23 nt, Homo sapiens
uguuuggaaauaaacugugcaau

SEQ ID NO: 1687130 - RNA, 16 nt, Homo sapiens
uguuuugugguaucau

SEQ ID NO: 1687131 - RNA, 14 nt, Homo sapiens
uuaaaaaacuucau

SEQ ID NO: 1687132 - RNA, 23 nt, Homo sapiens
uuaaaaaaguuggguuuucucca

SEQ ID NO: 1687133 - RNA, 18 nt, Homo sapiens
uuaaaacaauucugugac

SEQ ID NO: 1687134 - RNA, 18 nt, Homo sapiens
uuaaaagaugucucugca

SEQ ID NO: 1687135 - RNA, 14 nt, Homo sapiens
uuaaaagucucaca

SEQ ID NO: 1687136 - RNA, 15 nt, Homo sapiens
uuaaaguucauugca

SEQ ID NO: 1687137 - RNA, 20 nt, Homo sapiens
uuaacaaaaauauuagcaaa

SEQ ID NO: 1687138 - RNA, 16 nt, Homo sapiens
uuaacaggacaguuga

SEQ ID NO: 1687139 - RNA, 21 nt, Homo sapiens
uuaagaaauacucaugugcaa

SEQ ID NO: 1687140 - RNA, 15 nt, Homo sapiens
uuaagccagcacuca

SEQ ID NO: 1687141 - RNA, 15 nt, Homo sapiens
uuaaggggaagaaug

SEQ ID NO: 1687142 - RNA, 19 nt, Homo sapiens
uuaauaucccuacauguau

SEQ ID NO: 1687143 - RNA, 20 nt, Homo sapiens
uuacaacccagggugugaac

SEQ ID NO: 1687144 - RNA, 12 nt, Homo sapiens
uuacaagccuaa

SEQ ID NO: 1687145 - RNA, 14 nt, Homo sapiens
uuacauaaagugag

SEQ ID NO: 1687146 - RNA, 17 nt, Homo sapiens
uuagacaagacugucua

SEQ ID NO: 1687147 - RNA, 19 nt, Homo sapiens
uuagagcuggcaccagaac

SEQ ID NO: 1687148 - RNA, 17 nt, Homo sapiens
uuagaguaaugaaaugg

SEQ ID NO: 1687149 - RNA, 23 nt, Homo sapiens
uuagcucucuuggguucccaaau

SEQ ID NO: 1687150 - RNA, 21 nt, Homo sapiens
uuagguuucagcagagcugaa

SEQ ID NO: 1687151 - RNA, 13 nt, Homo sapiens
uuagucaugugac

SEQ ID NO: 1687152 - RNA, 14 nt, Homo sapiens
uuauacaugugaua

SEQ ID NO: 1687153 - RNA, 22 nt, Homo sapiens
uuauggaauggggcaaaguaaa

SEQ ID NO: 1687154 - RNA, 17 nt, Homo sapiens
uuauguagguaagacug

SEQ ID NO: 1687155 - RNA, 15 nt, Homo sapiens
uuauuacucuauaca

SEQ ID NO: 1687156 - RNA, 13 nt, Homo sapiens
uuauugacuaaca

SEQ ID NO: 1687157 - RNA, 16 nt, Homo sapiens
uuauugauguuuucau

SEQ ID NO: 1687158 - RNA, 21 nt, Homo sapiens
uuauuuacagcugugcuccac

SEQ ID NO: 1687159 - RNA, 21 nt, Homo sapiens
uuauuuaugcacugugggaug

SEQ ID NO: 1687160 - RNA, 20 nt, Homo sapiens
uucaaaguuuuguuguacuu

SEQ ID NO: 1687161 - RNA, 19 nt, Homo sapiens
uucaaguuuuaaaguucau

SEQ ID NO: 1687162 - RNA, 16 nt, Homo sapiens
uucaaucuggauucau

SEQ ID NO: 1687163 - RNA, 13 nt, Homo sapiens
uucaauguauuga

SEQ ID NO: 1687164 - RNA, 18 nt, Homo sapiens
uucaccuacauuaucuca

SEQ ID NO: 1687165 - RNA, 17 nt, Homo sapiens
uucaccuccuucugcag

SEQ ID NO: 1687166 - RNA, 12 nt, Homo sapiens
uucacuacaggu

SEQ ID NO: 1687167 - RNA, 17 nt, Homo sapiens
uucagaaaaggaugccu

SEQ ID NO: 1687168 - RNA, 16 nt, Homo sapiens
uucauaaaaacacuca

SEQ ID NO: 1687169 - RNA, 20 nt, Homo sapiens
uucauaguaguuacugucag

SEQ ID NO: 1687170 - RNA, 22 nt, Homo sapiens
uucaucagaacucuuccuccuc

SEQ ID NO: 1687171 - RNA, 20 nt, Homo sapiens
uucaugaaugugcuggugaa

SEQ ID NO: 1687172 - RNA, 19 nt, Homo sapiens
uucauucuuuuugaaaugu

SEQ ID NO: 1687173 - RNA, 22 nt, Homo sapiens
uuccaguacuauggagugcuca

SEQ ID NO: 1687174 - RNA, 22 nt, Homo sapiens
uuccaguuccucuuuugugcug

SEQ ID NO: 1687175 - RNA, 18 nt, Homo sapiens
uuccauagccuccaaaca

SEQ ID NO: 1687176 - RNA, 19 nt, Homo sapiens
uuccauccauuaccuccau

SEQ ID NO: 1687177 - RNA, 16 nt, Homo sapiens
uuccaugaguuaucau

SEQ ID NO: 1687178 - RNA, 15 nt, Homo sapiens
uucccacagugccua

SEQ ID NO: 1687179 - RNA, 17 nt, Homo sapiens
uucccuuucacuggcau

SEQ ID NO: 1687180 - RNA, 21 nt, Homo sapiens
uuccuagauaugauaaauaua

SEQ ID NO: 1687181 - RNA, 15 nt, Homo sapiens
uuccuccuacuuaca

SEQ ID NO: 1687182 - RNA, 16 nt, Homo sapiens
uucuaaauaugaauga

SEQ ID NO: 1687183 - RNA, 23 nt, Homo sapiens
uucuaaauaugaaugaaugggau

SEQ ID NO: 1687184 - RNA, 23 nt, Homo sapiens
uucucacacuggaggagcacaca

SEQ ID NO: 1687185 - RNA, 15 nt, Homo sapiens
uucucaucuugccuc

SEQ ID NO: 1687186 - RNA, 13 nt, Homo sapiens
uucuccuguucca

SEQ ID NO: 1687187 - RNA, 21 nt, Homo sapiens
uucucuguauuccgauacaaa

SEQ ID NO: 1687188 - RNA, 14 nt, Homo sapiens
uucucuuuacuuga

SEQ ID NO: 1687189 - RNA, 16 nt, Homo sapiens
uucugaaguguuucac

SEQ ID NO: 1687190 - RNA, 11 nt, Homo sapiens
uucugccaaac

SEQ ID NO: 1687191 - RNA, 16 nt, Homo sapiens
uucuggaccugggcau

SEQ ID NO: 1687192 - RNA, 22 nt, Homo sapiens
uucuuaaaacaaagccaugcca

SEQ ID NO: 1687193 - RNA, 16 nt, Homo sapiens
uugaaaauaaccuaau

SEQ ID NO: 1687194 - RNA, 15 nt, Homo sapiens
uugaaagaaauggug

SEQ ID NO: 1687195 - RNA, 16 nt, Homo sapiens
uugaaaguuagcauaa

SEQ ID NO: 1687196 - RNA, 13 nt, Homo sapiens
uugaaucuaugaa

SEQ ID NO: 1687197 - RNA, 19 nt, Homo sapiens
uugacuuuuauaaagcaug

SEQ ID NO: 1687198 - RNA, 20 nt, Homo sapiens
uugagauucugaaguaugaa

SEQ ID NO: 1687199 - RNA, 16 nt, Homo sapiens
uugaguaaugugacua

SEQ ID NO: 1687200 - RNA, 15 nt, Homo sapiens
uugaguaccuacugu

SEQ ID NO: 1687201 - RNA, 14 nt, Homo sapiens
uugcaaggugugau

SEQ ID NO: 1687202 - RNA, 19 nt, Homo sapiens
uugcaaugcaugauacuau

SEQ ID NO: 1687203 - RNA, 20 nt, Homo sapiens
uugcccaggcuggagugcaa

SEQ ID NO: 1687204 - RNA, 21 nt, Homo sapiens
uugcccaggcuggagugcaau

SEQ ID NO: 1687205 - RNA, 23 nt, Homo sapiens
uugcccaggcuggagugcaaugg

SEQ ID NO: 1687206 - RNA, 14 nt, Homo sapiens
uugccucauauugu

SEQ ID NO: 1687207 - RNA, 18 nt, Homo sapiens
uugccuucucuguucccu

SEQ ID NO: 1687208 - RNA, 21 nt, Homo sapiens
uugcugauaccauaugaauga

SEQ ID NO: 1687209 - RNA, 12 nt, Homo sapiens
uugcuugaauuu

SEQ ID NO: 1687210 - RNA, 15 nt, Homo sapiens
uuggagaaaaugggu

SEQ ID NO: 1687211 - RNA, 14 nt, Homo sapiens
uuggcucaccauaa

SEQ ID NO: 1687212 - RNA, 17 nt, Homo sapiens
uugggaaaacauuugcu

SEQ ID NO: 1687213 - RNA, 16 nt, Homo sapiens
uugggagacaugugac

SEQ ID NO: 1687214 - RNA, 17 nt, Homo sapiens
uugggagacaugugaca

SEQ ID NO: 1687215 - RNA, 23 nt, Homo sapiens
uugggagggugguucaacaaaga

SEQ ID NO: 1687216 - RNA, 14 nt, Homo sapiens
uuggguuuucucca

SEQ ID NO: 1687217 - RNA, 15 nt, Homo sapiens
uuguaaaugugacac

SEQ ID NO: 1687218 - RNA, 17 nt, Homo sapiens
uuguagacaaaguacau

SEQ ID NO: 1687219 - RNA, 16 nt, Homo sapiens
uuguaucaaaguguga

SEQ ID NO: 1687220 - RNA, 15 nt, Homo sapiens
uugucggguucuccc

SEQ ID NO: 1687221 - RNA, 16 nt, Homo sapiens
uugucggguucuccca

SEQ ID NO: 1687222 - RNA, 17 nt, Homo sapiens
uugucuuauuacagcau

SEQ ID NO: 1687223 - RNA, 17 nt, Homo sapiens
uugugaguuuaccuugu

SEQ ID NO: 1687224 - RNA, 17 nt, Homo sapiens
uuguuccaguacuaugg

SEQ ID NO: 1687225 - RNA, 13 nt, Homo sapiens
uuuaaaauuucau

SEQ ID NO: 1687226 - RNA, 14 nt, Homo sapiens
uuuaaaguaugcau

SEQ ID NO: 1687227 - RNA, 21 nt, Homo sapiens
uuuaagaagucuaaaugaagu

SEQ ID NO: 1687228 - RNA, 21 nt, Homo sapiens
uuuaaugaugccauggcaacu

SEQ ID NO: 1687229 - RNA, 15 nt, Homo sapiens
uuuaucucacacaca

SEQ ID NO: 1687230 - RNA, 13 nt, Homo sapiens
uuuaugacucuua

SEQ ID NO: 1687231 - RNA, 20 nt, Homo sapiens
uuuauuccccagugacucca

SEQ ID NO: 1687232 - RNA, 22 nt, Homo sapiens
uuuauuccccagugacuccagg

SEQ ID NO: 1687233 - RNA, 20 nt, Homo sapiens
uuuauugaguaccuacugug

SEQ ID NO: 1687234 - RNA, 23 nt, Homo sapiens
uuucagagugacuacacacagua

SEQ ID NO: 1687235 - RNA, 16 nt, Homo sapiens
uuucaguaagucucau

SEQ ID NO: 1687236 - RNA, 12 nt, Homo sapiens
uuucauagcaaa

SEQ ID NO: 1687237 - RNA, 19 nt, Homo sapiens
uuuccauccauuaccucca

SEQ ID NO: 1687238 - RNA, 16 nt, Homo sapiens
uuucuaaagacuugua

SEQ ID NO: 1687239 - RNA, 15 nt, Homo sapiens
aacacccgacgucau

SEQ ID NO: 1687240 - RNA, 20 nt, Homo sapiens
aacacuuugcuaggagauac

SEQ ID NO: 1687241 - RNA, 22 nt, Homo sapiens
aacagagugcaacccagucaca

SEQ ID NO: 1687242 - RNA, 24 nt, Homo sapiens
aacagccaagcuggcacaaaagac

SEQ ID NO: 1687243 - RNA, 19 nt, Homo sapiens
aacaugccagccacuguga

SEQ ID NO: 1687244 - RNA, 14 nt, Homo sapiens
aacauguucccaag

SEQ ID NO: 1687245 - RNA, 14 nt, Homo sapiens
aaccacacuugaaa

SEQ ID NO: 1687246 - RNA, 18 nt, Homo sapiens
aacccagagaugccugau

SEQ ID NO: 1687247 - RNA, 17 nt, Homo sapiens
aacccagggugugaaca

SEQ ID NO: 1687248 - RNA, 15 nt, Homo sapiens
aaccucuuugcucaa

SEQ ID NO: 1687249 - RNA, 21 nt, Homo sapiens
aaccugaauuaucuauuucau

SEQ ID NO: 1687250 - RNA, 13 nt, Homo sapiens
aaccugugcugaa

SEQ ID NO: 1687251 - RNA, 13 nt, Homo sapiens
aacuaaaauguuc

SEQ ID NO: 1687252 - RNA, 15 nt, Homo sapiens
aacuaaaauguucua

SEQ ID NO: 1687253 - RNA, 14 nt, Homo sapiens
aacuacuaguguga

SEQ ID NO: 1687254 - RNA, 14 nt, Homo sapiens
aacuauugugcuca

SEQ ID NO: 1687255 - RNA, 19 nt, Homo sapiens
aacuccuauaaagugccuc

SEQ ID NO: 1687256 - RNA, 13 nt, Homo sapiens
aacugauugcaac

SEQ ID NO: 1687257 - RNA, 13 nt, Homo sapiens
aacuguacugaau

SEQ ID NO: 1687258 - RNA, 17 nt, Homo sapiens
aacuuugacuuugccca

SEQ ID NO: 1687259 - RNA, 18 nt, Homo sapiens
aagaaaauuugccaaucu

SEQ ID NO: 1687260 - RNA, 17 nt, Homo sapiens
aagaaagcuuccuucaa

SEQ ID NO: 1687261 - RNA, 20 nt, Homo sapiens
aagaaauacucaugugcaau

SEQ ID NO: 1687262 - RNA, 15 nt, Homo sapiens
aagaagaaggccaga

SEQ ID NO: 1687263 - RNA, 14 nt, Homo sapiens
aagaagaugagccu

SEQ ID NO: 1687264 - RNA, 21 nt, Homo sapiens
aagaaggacaaggauguucac

SEQ ID NO: 1687265 - RNA, 14 nt, Homo sapiens
aagaaucuuuacaa

SEQ ID NO: 1687266 - RNA, 21 nt, Homo sapiens
aagacauauaacgcagucuaa

SEQ ID NO: 1687267 - RNA, 16 nt, Homo sapiens
aagaccagccuggcca

SEQ ID NO: 1687268 - RNA, 13 nt, Homo sapiens
aagacuacugaau

SEQ ID NO: 1687269 - RNA, 13 nt, Homo sapiens
aagacugucucaa

SEQ ID NO: 1687270 - RNA, 15 nt, Homo sapiens
aagagcuacucccac

SEQ ID NO: 1687271 - RNA, 16 nt, Homo sapiens
aagagguuuguauaua

SEQ ID NO: 1687272 - RNA, 18 nt, Homo sapiens
aagauaaaaugauguuau

SEQ ID NO: 1687273 - RNA, 15 nt, Homo sapiens
aagcaaauguuggga

SEQ ID NO: 1687274 - RNA, 17 nt, Homo sapiens
aagcaaugguugaugau

SEQ ID NO: 1687275 - RNA, 19 nt, Homo sapiens
aagcaauucuccugccuua

SEQ ID NO: 1687276 - RNA, 20 nt, Homo sapiens
aagccagcacucacaccacu

SEQ ID NO: 1687277 - RNA, 17 nt, Homo sapiens
aagcccacucacccuuu

SEQ ID NO: 1687278 - RNA, 16 nt, Homo sapiens
aagccugggugacauu

SEQ ID NO: 1687279 - RNA, 16 nt, Homo sapiens
aagcuacuauguacug

SEQ ID NO: 1687280 - RNA, 21 nt, Homo sapiens
aagcuacuauguacugccuua

SEQ ID NO: 1687281 - RNA, 22 nt, Homo sapiens
aagcuacuauguacugccuuag

SEQ ID NO: 1687282 - RNA, 12 nt, Homo sapiens
aagcugccucaa

SEQ ID NO: 1687283 - RNA, 23 nt, Homo sapiens
aaggaaaaaacuuugacuuugcc

SEQ ID NO: 1687284 - RNA, 20 nt, Homo sapiens
aaggaccugcucccacaggg

SEQ ID NO: 1687285 - RNA, 21 nt, Homo sapiens
aaggagaaaugacuuuuauaa

SEQ ID NO: 1687286 - RNA, 15 nt, Homo sapiens
aaggagcugauacuu

SEQ ID NO: 1687287 - RNA, 20 nt, Homo sapiens
aaggcugagacagugaauuu

SEQ ID NO: 1687288 - RNA, 22 nt, Homo sapiens
aagggacagcaagugagcagag

SEQ ID NO: 1687289 - RNA, 22 nt, Homo sapiens
aagggaucugcuugauauccca

SEQ ID NO: 1687290 - RNA, 20 nt, Homo sapiens
aaggggccugggcugugagg

SEQ ID NO: 1687291 - RNA, 18 nt, Homo sapiens
aagggggcugcugcuccu

SEQ ID NO: 1687292 - RNA, 17 nt, Homo sapiens
aagguacugguacuaua

SEQ ID NO: 1687293 - RNA, 19 nt, Homo sapiens
aaggucugugggccaaaga

SEQ ID NO: 1687294 - RNA, 13 nt, Homo sapiens
aagucacucccaa

SEQ ID NO: 1687295 - RNA, 14 nt, Homo sapiens
aagucccuuuguga

SEQ ID NO: 1687296 - RNA, 20 nt, Homo sapiens
aagucccuuugugacuucaa

SEQ ID NO: 1687297 - RNA, 14 nt, Homo sapiens
aagucgccagucac

SEQ ID NO: 1687298 - RNA, 14 nt, Homo sapiens
aaguguacauaugu

SEQ ID NO: 1687299 - RNA, 20 nt, Homo sapiens
aagugugauauacaaagugu

SEQ ID NO: 1687300 - RNA, 13 nt, Homo sapiens
aauaaagugaucu

SEQ ID NO: 1687301 - RNA, 16 nt, Homo sapiens
aauaaaugucuugccu

SEQ ID NO: 1687302 - RNA, 12 nt, Homo sapiens
aauaacauguuu

SEQ ID NO: 1687303 - RNA, 11 nt, Homo sapiens
aauaauuuccu

SEQ ID NO: 1687304 - RNA, 14 nt, Homo sapiens
aauacacauuugcu

SEQ ID NO: 1687305 - RNA, 17 nt, Homo sapiens
aauaccauuuaguaaga

SEQ ID NO: 1687306 - RNA, 13 nt, Homo sapiens
aauagaacacagu

SEQ ID NO: 1687307 - RNA, 22 nt, Homo sapiens
aauagauucagagaaauuuaga

SEQ ID NO: 1687308 - RNA, 20 nt, Homo sapiens
aauagauuugggucauuuag

SEQ ID NO: 1687309 - RNA, 21 nt, Homo sapiens
aauagucuaaggccauggcau

SEQ ID NO: 1687310 - RNA, 22 nt, Homo sapiens
aauaucccuacauguauugcac

SEQ ID NO: 1687311 - RNA, 11 nt, Homo sapiens
aauaugaauga

SEQ ID NO: 1687312 - RNA, 15 nt, Homo sapiens
aauauuccuuugcau

SEQ ID NO: 1687313 - RNA, 15 nt, Homo sapiens
aaucaaauucugucu

SEQ ID NO: 1687314 - RNA, 14 nt, Homo sapiens
aaucagcaggaugu

SEQ ID NO: 1687315 - RNA, 13 nt, Homo sapiens
aaucauaaaggau

SEQ ID NO: 1687316 - RNA, 15 nt, Homo sapiens
aaucaugugaggaaa

SEQ ID NO: 1687317 - RNA, 20 nt, Homo sapiens
aaucaugugaggaaaugaug

SEQ ID NO: 1687318 - RNA, 22 nt, Homo sapiens
aaucauuuuucuuuuguagcua

SEQ ID NO: 1687319 - RNA, 13 nt, Homo sapiens
aauccaugguguu

SEQ ID NO: 1687320 - RNA, 13 nt, Homo sapiens
aaucucagcacuu

SEQ ID NO: 1687321 - RNA, 22 nt, Homo sapiens
aaucuccucucucuuuccucca

SEQ ID NO: 1687322 - RNA, 13 nt, Homo sapiens
aaucuggauucau

SEQ ID NO: 1687323 - RNA, 18 nt, Homo sapiens
aaucuucaaagccuucuc

SEQ ID NO: 1687324 - RNA, 20 nt, Homo sapiens
aaugaggcagauagcacugg

SEQ ID NO: 1687325 - RNA, 22 nt, Homo sapiens
aaugcauauuugcaaaguguau

SEQ ID NO: 1687326 - RNA, 22 nt, Homo sapiens
aaugcgcugaucguuucuucca

SEQ ID NO: 1687327 - RNA, 21 nt, Homo sapiens
aauguaugcauucacauuuag

SEQ ID NO: 1687328 - RNA, 14 nt, Homo sapiens
aauguaugugcaca

SEQ ID NO: 1687329 - RNA, 15 nt, Homo sapiens
aauguaugugcacau

SEQ ID NO: 1687330 - RNA, 18 nt, Homo sapiens
aaugucucuuugugcucu

SEQ ID NO: 1687331 - RNA, 12 nt, Homo sapiens
aaugugacucag

SEQ ID NO: 1687332 - RNA, 22 nt, Homo sapiens
aauguuuguuaaagcuagauag

SEQ ID NO: 1687333 - RNA, 19 nt, Homo sapiens
aauguuuucaaaagguauu

SEQ ID NO: 1687334 - RNA, 20 nt, Homo sapiens
gucuguguucgacucagccu

SEQ ID NO: 1687335 - RNA, 13 nt, Homo sapiens
gucuguuugcauu

SEQ ID NO: 1687336 - RNA, 12 nt, Homo sapiens
gugaaguguuac

SEQ ID NO: 1687337 - RNA, 20 nt, Homo sapiens
gugaauacuugaacucuguu

SEQ ID NO: 1687338 - RNA, 16 nt, Homo sapiens
gugacauuugggagac

SEQ ID NO: 1687339 - RNA, 22 nt, Homo sapiens
gugaguuuaccuuguauacugu

SEQ ID NO: 1687340 - RNA, 14 nt, Homo sapiens
gugauuacugcaau

SEQ ID NO: 1687341 - RNA, 21 nt, Homo sapiens
gugauuacugcaaucacugug

SEQ ID NO: 1687342 - RNA, 13 nt, Homo sapiens
gugcacuccagac

SEQ ID NO: 1687343 - RNA, 18 nt, Homo sapiens
gugccagguccuugcccu

SEQ ID NO: 1687344 - RNA, 21 nt, Homo sapiens
gugcccagggcucuaaugugu

SEQ ID NO: 1687345 - RNA, 19 nt, Homo sapiens
gugcgaagacugagccaga

SEQ ID NO: 1687346 - RNA, 15 nt, Homo sapiens
gugcuauacacacac

SEQ ID NO: 1687347 - RNA, 14 nt, Homo sapiens
gugcucacaaagga

SEQ ID NO: 1687348 - RNA, 19 nt, Homo sapiens
gugcugccuugcuucugua

SEQ ID NO: 1687349 - RNA, 16 nt, Homo sapiens
gugcuugcuggugccu

SEQ ID NO: 1687350 - RNA, 15 nt, Homo sapiens
gugcuuuuggcagag

SEQ ID NO: 1687351 - RNA, 14 nt, Homo sapiens
guggauacuggggg

SEQ ID NO: 1687352 - RNA, 23 nt, Homo sapiens
guggaugcaaauagauucagaga

SEQ ID NO: 1687353 - RNA, 22 nt, Homo sapiens
guggcauaaauugcaucacugu

SEQ ID NO: 1687354 - RNA, 20 nt, Homo sapiens
gugggauggggacauuugaa

SEQ ID NO: 1687355 - RNA, 11 nt, Homo sapiens
gugggccacag

SEQ ID NO: 1687356 - RNA, 13 nt, Homo sapiens
gugguauggggcu

SEQ ID NO: 1687357 - RNA, 14 nt, Homo sapiens
gugguccacugagc

SEQ ID NO: 1687358 - RNA, 21 nt, Homo sapiens
gugguugucuuauugcaccau

SEQ ID NO: 1687359 - RNA, 23 nt, Homo sapiens
gugugacuccuuaucucuuucca

SEQ ID NO: 1687360 - RNA, 19 nt, Homo sapiens
guguugccucuugcaaugc

SEQ ID NO: 1687361 - RNA, 14 nt, Homo sapiens
guguuuauugcaau

SEQ ID NO: 1687362 - RNA, 21 nt, Homo sapiens
guguuuggaaauaaacugugc

SEQ ID NO: 1687363 - RNA, 15 nt, Homo sapiens
guuauuuaugcacug

SEQ ID NO: 1687364 - RNA, 23 nt, Homo sapiens
guucaaguuugcugcaacccaag

SEQ ID NO: 1687365 - RNA, 14 nt, Homo sapiens
guucagcugcccca

SEQ ID NO: 1687366 - RNA, 14 nt, Homo sapiens
guucccaaaacaau

SEQ ID NO: 1687367 - RNA, 14 nt, Homo sapiens
guucucccaugauu

SEQ ID NO: 1687368 - RNA, 18 nt, Homo sapiens
guucuggaccugggcaug

SEQ ID NO: 1687369 - RNA, 22 nt, Homo sapiens
guucuucuuucucuguauuccg

SEQ ID NO: 1687370 - RNA, 17 nt, Homo sapiens
guugccucuugcaaugc

SEQ ID NO: 1687371 - RNA, 19 nt, Homo sapiens
guuguaucaaagugugaua

SEQ ID NO: 1687372 - RNA, 16 nt, Homo sapiens
guuguuaaaaauguca

SEQ ID NO: 1687373 - RNA, 19 nt, Homo sapiens
guuuaccuuguauacugua

SEQ ID NO: 1687374 - RNA, 20 nt, Homo sapiens
guuuagaugaggcucagaga

SEQ ID NO: 1687375 - RNA, 18 nt, Homo sapiens
guuucagcagagcugaaa

SEQ ID NO: 1687376 - RNA, 20 nt, Homo sapiens
guuucauuuagucaugugac

SEQ ID NO: 1687377 - RNA, 21 nt, Homo sapiens
guuucauuuagucaugugacc

SEQ ID NO: 1687378 - RNA, 21 nt, Homo sapiens
guuucguaacacagcauugua

SEQ ID NO: 1687379 - RNA, 17 nt, Homo sapiens
guuuguuauaucaggga

SEQ ID NO: 1687380 - RNA, 22 nt, Homo sapiens
guuuguuggaaaguaacuguga

SEQ ID NO: 1687381 - RNA, 21 nt, Homo sapiens
guuuuacaguguuucuggcuu

SEQ ID NO: 1687382 - RNA, 15 nt, Homo sapiens
uaaaaaaucaugcca

SEQ ID NO: 1687383 - RNA, 18 nt, Homo sapiens
uaaaaaguaauaaaugag

SEQ ID NO: 1687384 - RNA, 16 nt, Homo sapiens
uaaaaauaugcuucua

SEQ ID NO: 1687385 - RNA, 19 nt, Homo sapiens
uaaaaaucaaauaagcuaa

SEQ ID NO: 1687386 - RNA, 18 nt, Homo sapiens
uaaaacaaagccaugcca

SEQ ID NO: 1687387 - RNA, 12 nt, Homo sapiens
uaaaacaauucu

SEQ ID NO: 1687388 - RNA, 22 nt, Homo sapiens
uaaaacagguuauaacaguguu

SEQ ID NO: 1687389 - RNA, 23 nt, Homo sapiens
uaaaagcuacuauguacugccuu

SEQ ID NO: 1687390 - RNA, 12 nt, Homo sapiens
uaaaaguucuca

SEQ ID NO: 1687391 - RNA, 11 nt, Homo sapiens
uaaaaugaagg

SEQ ID NO: 1687392 - RNA, 18 nt, Homo sapiens
uaaagacuuguauagcau

SEQ ID NO: 1687393 - RNA, 16 nt, Homo sapiens
uaaagagaaguuccca

SEQ ID NO: 1687394 - RNA, 20 nt, Homo sapiens
uaaagaucgcccccaccucc

SEQ ID NO: 1687395 - RNA, 18 nt, Homo sapiens
uaaaguauaauguuuauu

SEQ ID NO: 1687396 - RNA, 16 nt, Homo sapiens
uaaaguaugcauuauu

SEQ ID NO: 1687397 - RNA, 21 nt, Homo sapiens
uaaauauguguugaaugaaga

SEQ ID NO: 1687398 - RNA, 15 nt, Homo sapiens
uaaauccaugguguu

SEQ ID NO: 1687399 - RNA, 22 nt, Homo sapiens
uaaaugcuucauuuguauguca

SEQ ID NO: 1687400 - RNA, 19 nt, Homo sapiens
uaaaugugacucagcauca

SEQ ID NO: 1687401 - RNA, 13 nt, Homo sapiens
uaaaugugcuuug

SEQ ID NO: 1687402 - RNA, 15 nt, Homo sapiens
uaaauguugcaaugc

SEQ ID NO: 1687403 - RNA, 16 nt, Homo sapiens
uaaauuauuuacugca

SEQ ID NO: 1687404 - RNA, 16 nt, Homo sapiens
uaaauucaacuuugua

SEQ ID NO: 1687405 - RNA, 18 nt, Homo sapiens
uaaauugggaaaacucca

SEQ ID NO: 1687406 - RNA, 19 nt, Homo sapiens
cuaaaaguucucaauguag

SEQ ID NO: 1687407 - RNA, 14 nt, Homo sapiens
cuaaagaauccaua

SEQ ID NO: 1687408 - RNA, 20 nt, Homo sapiens
cuaaaggaaaaaacuuugac

SEQ ID NO: 1687409 - RNA, 19 nt, Homo sapiens
cuaacaagucaccaaaaga

SEQ ID NO: 1687410 - RNA, 20 nt, Homo sapiens
cuaacaagucaccaaaagac

SEQ ID NO: 1687411 - RNA, 15 nt, Homo sapiens
cuaacaggccaaaga

SEQ ID NO: 1687412 - RNA, 17 nt, Homo sapiens
cuaacauuauacuucau

SEQ ID NO: 1687413 - RNA, 13 nt, Homo sapiens
cuaaccugugacc

SEQ ID NO: 1687414 - RNA, 17 nt, Homo sapiens
cuaacuagcauuguaaa

SEQ ID NO: 1687415 - RNA, 20 nt, Homo sapiens
cuaagaagaaggccagagag

SEQ ID NO: 1687416 - RNA, 19 nt, Homo sapiens
cuaagcaaccacacugcuu

SEQ ID NO: 1687417 - RNA, 14 nt, Homo sapiens
cuaagcaugugucc

SEQ ID NO: 1687418 - RNA, 21 nt, Homo sapiens
cuaaggagcugauacuuugac

SEQ ID NO: 1687419 - RNA, 13 nt, Homo sapiens
cuaauauuuacua

SEQ ID NO: 1687420 - RNA, 11 nt, Homo sapiens
cuaauguauua

SEQ ID NO: 1687421 - RNA, 15 nt, Homo sapiens
cuaauuacauuucac

SEQ ID NO: 1687422 - RNA, 19 nt, Homo sapiens
cuacacucaccugcacuaa

SEQ ID NO: 1687423 - RNA, 19 nt, Homo sapiens
cuacaggugaaggcucuca

SEQ ID NO: 1687424 - RNA, 14 nt, Homo sapiens
cuacauuaucucac

SEQ ID NO: 1687425 - RNA, 14 nt, Homo sapiens
cuaccaaaacaguu

SEQ ID NO: 1687426 - RNA, 22 nt, Homo sapiens
cuacccuuugucccuguagccu

SEQ ID NO: 1687427 - RNA, 13 nt, Homo sapiens
cuacugugugcca

SEQ ID NO: 1687428 - RNA, 21 nt, Homo sapiens
cuacuguuaucaguaaugcua

SEQ ID NO: 1687429 - RNA, 16 nt, Homo sapiens
cuacuuacaacccagg

SEQ ID NO: 1687430 - RNA, 21 nt, Homo sapiens
cuagcacuuugggagacugaa

SEQ ID NO: 1687431 - RNA, 19 nt, Homo sapiens
cuagcagaggaaaguguaa

SEQ ID NO: 1687432 - RNA, 12 nt, Homo sapiens
cuagcauuguaa

SEQ ID NO: 1687433 - RNA, 23 nt, Homo sapiens
cuagcauuguaaaauuauuucau

SEQ ID NO: 1687434 - RNA, 23 nt, Homo sapiens
cuagcuucuacccuuugucccug

SEQ ID NO: 1687435 - RNA, 14 nt, Homo sapiens
cuaggaaccagcca

SEQ ID NO: 1687436 - RNA, 16 nt, Homo sapiens
cuaggcagugacagug

SEQ ID NO: 1687437 - RNA, 16 nt, Homo sapiens
cuagggccucagucug

SEQ ID NO: 1687438 - RNA, 21 nt, Homo sapiens
cuagggcucuccaagcacuag

SEQ ID NO: 1687439 - RNA, 13 nt, Homo sapiens
cuaguaccuguga

SEQ ID NO: 1687440 - RNA, 14 nt, Homo sapiens
cuauauguauucac

SEQ ID NO: 1687441 - RNA, 15 nt, Homo sapiens
cuaugaaccugaaaa

SEQ ID NO: 1687442 - RNA, 22 nt, Homo sapiens
cuauguacugccuuagugcuga

SEQ ID NO: 1687443 - RNA, 22 nt, Homo sapiens
cuaugucaguacuauucaggua

SEQ ID NO: 1687444 - RNA, 20 nt, Homo sapiens
cuauucccucucucucccag

SEQ ID NO: 1687445 - RNA, 23 nt, Homo sapiens
cuauucuauaaaacucugcaugu

SEQ ID NO: 1687446 - RNA, 21 nt, Homo sapiens
cuauuuauuuauuuauucauu

SEQ ID NO: 1687447 - RNA, 18 nt, Homo sapiens
cucaaagaaguacuguac

SEQ ID NO: 1687448 - RNA, 20 nt, Homo sapiens
cucaacauugcauggugcua

SEQ ID NO: 1687449 - RNA, 14 nt, Homo sapiens
cucaagaguacaga

SEQ ID NO: 1687450 - RNA, 20 nt, Homo sapiens
cucaauccauccauguacuu

SEQ ID NO: 1687451 - RNA, 22 nt, Homo sapiens
cucaaucuccucucucuuuccu

SEQ ID NO: 1687452 - RNA, 15 nt, Homo sapiens
cucacucccaaggga

SEQ ID NO: 1687453 - RNA, 22 nt, Homo sapiens
cucacugcugcaaauacuguau

SEQ ID NO: 1687454 - RNA, 16 nt, Homo sapiens
cucacuuaguccuuua

SEQ ID NO: 1687455 - RNA, 15 nt, Homo sapiens
cucagcuucuucaca

SEQ ID NO: 1687456 - RNA, 17 nt, Homo sapiens
cucaggagucugaggca

SEQ ID NO: 1687457 - RNA, 23 nt, Homo sapiens
cucaggcaaagaaaaugaaaugc

SEQ ID NO: 1687458 - RNA, 16 nt, Homo sapiens
cucauuuuacacaaag

SEQ ID NO: 1687459 - RNA, 18 nt, Homo sapiens
cuccaagccugccuccca

SEQ ID NO: 1687460 - RNA, 20 nt, Homo sapiens
cuccaccccacaacccaaaa

SEQ ID NO: 1687461 - RNA, 18 nt, Homo sapiens
cuccagaagcugcuccuu

SEQ ID NO: 1687462 - RNA, 18 nt, Homo sapiens
cuccauucauccuuccau

SEQ ID NO: 1687463 - RNA, 16 nt, Homo sapiens
cucccaacccauucac

SEQ ID NO: 1687464 - RNA, 14 nt, Homo sapiens
cucccaagguccuc

SEQ ID NO: 1687465 - RNA, 20 nt, Homo sapiens
cucccacaggggccaugucc

SEQ ID NO: 1687466 - RNA, 22 nt, Homo sapiens
cucccccagagguggauacugg

SEQ ID NO: 1687467 - RNA, 15 nt, Homo sapiens
cuccccuaaagccag

SEQ ID NO: 1687468 - RNA, 15 nt, Homo sapiens
cuccgucugcuccaa

SEQ ID NO: 1687469 - RNA, 19 nt, Homo sapiens
cuccuacuuacaacccagg

SEQ ID NO: 1687470 - RNA, 16 nt, Homo sapiens
cuccugaccucaggug

SEQ ID NO: 1687471 - RNA, 12 nt, Homo sapiens
cuccuguuccau

SEQ ID NO: 1687472 - RNA, 16 nt, Homo sapiens
cuccuguuuugcacag

SEQ ID NO: 1687473 - RNA, 18 nt, Homo sapiens
cuccuuugaagaaggcaa

SEQ ID NO: 1687474 - RNA, 13 nt, Homo sapiens
cucuaaagagcau

SEQ ID NO: 1687475 - RNA, 17 nt, Homo sapiens
cucuaaggcaguagaau

SEQ ID NO: 1687476 - RNA, 13 nt, Homo sapiens
cucuagcuucuac

SEQ ID NO: 1687477 - RNA, 16 nt, Homo sapiens
cucuagcuucuacccu

SEQ ID NO: 1687478 - RNA, 17 nt, Homo sapiens
cucuagggccucagucu

SEQ ID NO: 1687479 - RNA, 17 nt, Homo sapiens
cucuauaaaguauggua

SEQ ID NO: 1687480 - RNA, 19 nt, Homo sapiens
cucucacacuuuugcuuga

SEQ ID NO: 1687481 - RNA, 22 nt, Homo sapiens
cucucacggcuuguaaauguga

SEQ ID NO: 1687482 - RNA, 19 nt, Homo sapiens
cucucuuuccuccacccau

SEQ ID NO: 1687483 - RNA, 20 nt, Homo sapiens
cucugaaagaugcaucaucu

SEQ ID NO: 1687484 - RNA, 21 nt, Homo sapiens
cucugccaaaggaugugauau

SEQ ID NO: 1687485 - RNA, 14 nt, Homo sapiens
gcuggagcagcgga

SEQ ID NO: 1687486 - RNA, 15 nt, Homo sapiens
gcuggagugcaaugg

SEQ ID NO: 1687487 - RNA, 14 nt, Homo sapiens
gcuuagaacaaagg

SEQ ID NO: 1687488 - RNA, 12 nt, Homo sapiens
gcuucgacuacu

SEQ ID NO: 1687489 - RNA, 15 nt, Homo sapiens
gcuucgacuacugcu

SEQ ID NO: 1687490 - RNA, 17 nt, Homo sapiens
gcuucuucacaggcacu

SEQ ID NO: 1687491 - RNA, 11 nt, Homo sapiens
gcuugggcauu

SEQ ID NO: 1687492 - RNA, 14 nt, Homo sapiens
gcuugggcauugaa

SEQ ID NO: 1687493 - RNA, 14 nt, Homo sapiens
ggaaaauucuuaaa

SEQ ID NO: 1687494 - RNA, 12 nt, Homo sapiens
ggaaagucacag

SEQ ID NO: 1687495 - RNA, 14 nt, Homo sapiens
ggaagcauacaauu

SEQ ID NO: 1687496 - RNA, 14 nt, Homo sapiens
ggaaguuugcugug

SEQ ID NO: 1687497 - RNA, 14 nt, Homo sapiens
ggaaucuagcccaa

SEQ ID NO: 1687498 - RNA, 20 nt, Homo sapiens
ggaauggggcaaaguaaauu

SEQ ID NO: 1687499 - RNA, 17 nt, Homo sapiens
ggaauguaugugcacau

SEQ ID NO: 1687500 - RNA, 14 nt, Homo sapiens
ggacaguggugaca

SEQ ID NO: 1687501 - RNA, 18 nt, Homo sapiens
ggacccugagaagccagu

SEQ ID NO: 1687502 - RNA, 17 nt, Homo sapiens
ggaccuaggaccauuuc

SEQ ID NO: 1687503 - RNA, 20 nt, Homo sapiens
ggacuccauccaccucauca

SEQ ID NO: 1687504 - RNA, 19 nt, Homo sapiens
ggagaauacugccaaaaca

SEQ ID NO: 1687505 - RNA, 22 nt, Homo sapiens
ggagaaucgcuugaacccagga

SEQ ID NO: 1687506 - RNA, 16 nt, Homo sapiens
ggagacaugugacauu

SEQ ID NO: 1687507 - RNA, 14 nt, Homo sapiens
ggagaggggggcca

SEQ ID NO: 1687508 - RNA, 18 nt, Homo sapiens
ggagcaggaccuacuagg

SEQ ID NO: 1687509 - RNA, 22 nt, Homo sapiens
ggagcauccuuggcagugggaa

SEQ ID NO: 1687510 - RNA, 16 nt, Homo sapiens
ggagcccuauugcugc

SEQ ID NO: 1687511 - RNA, 13 nt, Homo sapiens
ggaggacaugggg

SEQ ID NO: 1687512 - RNA, 19 nt, Homo sapiens
ggaggggucccugcaaaac

SEQ ID NO: 1687513 - RNA, 20 nt, Homo sapiens
ggagggugguucaacaaaga

SEQ ID NO: 1687514 - RNA, 19 nt, Homo sapiens
ggagguuguggggccucag

SEQ ID NO: 1687515 - RNA, 19 nt, Homo sapiens
ggauaaaucauaaagucag

SEQ ID NO: 1687516 - RNA, 23 nt, Homo sapiens
ggaucagcaacccuuccugcugc

SEQ ID NO: 1687517 - RNA, 20 nt, Homo sapiens
ggaugaugagggaagcaaua

SEQ ID NO: 1687518 - RNA, 22 nt, Homo sapiens
ggaugcaaauagauucagagaa

SEQ ID NO: 1687519 - RNA, 21 nt, Homo sapiens
ggauggaaagacaaacugcac

SEQ ID NO: 1687520 - RNA, 18 nt, Homo sapiens
ggauggccaaacccaaga

SEQ ID NO: 1687521 - RNA, 12 nt, Homo sapiens
ggaugguggugc

SEQ ID NO: 1687522 - RNA, 18 nt, Homo sapiens
ggcaaaugccugacucag

SEQ ID NO: 1687523 - RNA, 17 nt, Homo sapiens
ggcacuacuucuauuca

SEQ ID NO: 1687524 - RNA, 23 nt, Homo sapiens
ggcaggaggcuuuggguggcuca

SEQ ID NO: 1687525 - RNA, 21 nt, Homo sapiens
ggcagggagagaguagcugca

SEQ ID NO: 1687526 - RNA, 14 nt, Homo sapiens
ggccaagguccugc

SEQ ID NO: 1687527 - RNA, 16 nt, Homo sapiens
ggccacgggucugugu

SEQ ID NO: 1687528 - RNA, 15 nt, Homo sapiens
ggccccaucuccaca

SEQ ID NO: 1687529 - RNA, 18 nt, Homo sapiens
ggccggagucagugccag

SEQ ID NO: 1687530 - RNA, 23 nt, Homo sapiens
ggccuggaccugcccugggccac

SEQ ID NO: 1687531 - RNA, 20 nt, Homo sapiens
ggccuuaucugaaaggccag

SEQ ID NO: 1687532 - RNA, 13 nt, Homo sapiens
ggcgccuguaauu

SEQ ID NO: 1687533 - RNA, 14 nt, Homo sapiens
ggcucuccaagcac

SEQ ID NO: 1687534 - RNA, 15 nt, Homo sapiens
ggcuggagugcaaug

SEQ ID NO: 1687535 - RNA, 20 nt, Homo sapiens
ggcuggagugcaauggcgcg

SEQ ID NO: 1687536 - RNA, 13 nt, Homo sapiens
ggcuggauccuau

SEQ ID NO: 1687537 - RNA, 17 nt, Homo sapiens
ggcuggggacacaggau

SEQ ID NO: 1687538 - RNA, 16 nt, Homo sapiens
ggcuucaaaaagccac

SEQ ID NO: 1687539 - RNA, 18 nt, Homo sapiens
ggcuuguaaaugugacac

SEQ ID NO: 1687540 - RNA, 13 nt, Homo sapiens
gggaacugaaauc

SEQ ID NO: 1687541 - RNA, 19 nt, Homo sapiens
gggagaaaaaaagggaucu

SEQ ID NO: 1687542 - RNA, 15 nt, Homo sapiens
gggagacaugugaca

SEQ ID NO: 1687543 - RNA, 21 nt, Homo sapiens
gggagauuuuuuugagucaaa

SEQ ID NO: 1687544 - RNA, 20 nt, Homo sapiens
gggcaccaggggccaaccuc

SEQ ID NO: 1687545 - RNA, 14 nt, Homo sapiens
gggccccaucucca

SEQ ID NO: 1687546 - RNA, 19 nt, Homo sapiens
gggcggcacagccuucucc

SEQ ID NO: 1687547 - RNA, 21 nt, Homo sapiens
gggcuaagguuuccagucaga

SEQ ID NO: 1687548 - RNA, 20 nt, Homo sapiens
gggcuggaaggaccugcucc

SEQ ID NO: 1687549 - RNA, 19 nt, Homo sapiens
ggggacauagcugugcuau

SEQ ID NO: 1687550 - RNA, 13 nt, Homo sapiens
ggggcagugugag

SEQ ID NO: 1687551 - RNA, 17 nt, Homo sapiens
ggggccauguccucucu

SEQ ID NO: 1687552 - RNA, 18 nt, Homo sapiens
ggggccuugggugagugg

SEQ ID NO: 1687553 - RNA, 13 nt, Homo sapiens
gguaaacaaagac

SEQ ID NO: 1687554 - RNA, 16 nt, Homo sapiens
gguacgaugacagugu

SEQ ID NO: 1687555 - RNA, 14 nt, Homo sapiens
ggucaucacuuuga

SEQ ID NO: 1687556 - RNA, 21 nt, Homo sapiens
gguccccccgagucuccggga

SEQ ID NO: 1687557 - RNA, 19 nt, Homo sapiens
gguccuggccgucccuaag

SEQ ID NO: 1687558 - RNA, 12 nt, Homo sapiens
gguccuugcccu

SEQ ID NO: 1687559 - RNA, 19 nt, Homo sapiens
cuggcaaaugccugacuca

SEQ ID NO: 1687560 - RNA, 21 nt, Homo sapiens
cuggccuauuuaucugaucaa

SEQ ID NO: 1687561 - RNA, 12 nt, Homo sapiens
cuggcugcuaac

SEQ ID NO: 1687562 - RNA, 18 nt, Homo sapiens
cuggcuucaaaaagccac

SEQ ID NO: 1687563 - RNA, 15 nt, Homo sapiens
cugggaccuccuuag

SEQ ID NO: 1687564 - RNA, 14 nt, Homo sapiens
cugggaugucuccg

SEQ ID NO: 1687565 - RNA, 21 nt, Homo sapiens
cugggaugugaagucucuggg

SEQ ID NO: 1687566 - RNA, 15 nt, Homo sapiens
cugggauuacaggcg

SEQ ID NO: 1687567 - RNA, 13 nt, Homo sapiens
cugggcugugagg

SEQ ID NO: 1687568 - RNA, 17 nt, Homo sapiens
cugggcuucgggcuaug

SEQ ID NO: 1687569 - RNA, 19 nt, Homo sapiens
cuggggaaacaacauuuau

SEQ ID NO: 1687570 - RNA, 22 nt, Homo sapiens
cuggggucaucgggaaaggcaa

SEQ ID NO: 1687571 - RNA, 21 nt, Homo sapiens
cugguaauaaaugugacucag

SEQ ID NO: 1687572 - RNA, 14 nt, Homo sapiens
cugguaauauugac

SEQ ID NO: 1687573 - RNA, 13 nt, Homo sapiens
cuggugggacagu

SEQ ID NO: 1687574 - RNA, 21 nt, Homo sapiens
cugguugcuaaugacagccuu

SEQ ID NO: 1687575 - RNA, 18 nt, Homo sapiens
cuguaaucucagcacuuu

SEQ ID NO: 1687576 - RNA, 14 nt, Homo sapiens
cuguaauuccagcu

SEQ ID NO: 1687577 - RNA, 15 nt, Homo sapiens
cuguacacagaauug

SEQ ID NO: 1687578 - RNA, 13 nt, Homo sapiens
cugucucuacuaa

SEQ ID NO: 1687579 - RNA, 16 nt, Homo sapiens
cugucuucuuucucca

SEQ ID NO: 1687580 - RNA, 21 nt, Homo sapiens
cugugaagucaagaaucacuu

SEQ ID NO: 1687581 - RNA, 20 nt, Homo sapiens
cugugcccaccaugacccuc

SEQ ID NO: 1687582 - RNA, 22 nt, Homo sapiens
cugugcugaacauaacuucuca

SEQ ID NO: 1687583 - RNA, 17 nt, Homo sapiens
cuguggagugaggugua

SEQ ID NO: 1687584 - RNA, 14 nt, Homo sapiens
cuguguacugccuu

SEQ ID NO: 1687585 - RNA, 21 nt, Homo sapiens
cuguucccccacccuccaugc

SEQ ID NO: 1687586 - RNA, 19 nt, Homo sapiens
cuuaaaacaauucugugac

SEQ ID NO: 1687587 - RNA, 15 nt, Homo sapiens
cuuaaaaucugugaa

SEQ ID NO: 1687588 - RNA, 22 nt, Homo sapiens
cuuaacccccuagaaagacaga

SEQ ID NO: 1687589 - RNA, 21 nt, Homo sapiens
cuuaauuauugauguuuucau

SEQ ID NO: 1687590 - RNA, 16 nt, Homo sapiens
cuuaccugggcacaaa

SEQ ID NO: 1687591 - RNA, 21 nt, Homo sapiens
cuuacuaaaaaguauaaaaua

SEQ ID NO: 1687592 - RNA, 18 nt, Homo sapiens
cuuaucuuacaauauuga

SEQ ID NO: 1687593 - RNA, 20 nt, Homo sapiens
cuuauuaauacaaacacaaa

SEQ ID NO: 1687594 - RNA, 21 nt, Homo sapiens
cuuauucuuugaguaauguga

SEQ ID NO: 1687595 - RNA, 20 nt, Homo sapiens
cuucaaagccuucucccuag

SEQ ID NO: 1687596 - RNA, 22 nt, Homo sapiens
cuucaaggcucuucuuccucac

SEQ ID NO: 1687597 - RNA, 22 nt, Homo sapiens
cuucagcugggucacauccauc

SEQ ID NO: 1687598 - RNA, 16 nt, Homo sapiens
cuuccuagauaugaua

SEQ ID NO: 1687599 - RNA, 13 nt, Homo sapiens
cuuccuggcacaa

SEQ ID NO: 1687600 - RNA, 20 nt, Homo sapiens
cuucuauucagcauuguacu

SEQ ID NO: 1687601 - RNA, 16 nt, Homo sapiens
cuucucacacuggagg

SEQ ID NO: 1687602 - RNA, 19 nt, Homo sapiens
cuucuccuguuccauuuca

SEQ ID NO: 1687603 - RNA, 18 nt, Homo sapiens
cuugaaaaaaaacagugg

SEQ ID NO: 1687604 - RNA, 18 nt, Homo sapiens
cuuggagaauacugccaa

SEQ ID NO: 1687605 - RNA, 19 nt, Homo sapiens
cuuggagaauacugccaaa

SEQ ID NO: 1687606 - RNA, 19 nt, Homo sapiens
cuuguacuacacagaauug

SEQ ID NO: 1687607 - RNA, 19 nt, Homo sapiens
cuuguauuaucuccuuuga

SEQ ID NO: 1687608 - RNA, 12 nt, Homo sapiens
cuuuaagugugc

SEQ ID NO: 1687609 - RNA, 19 nt, Homo sapiens
cuuuacaaacccugcaauu

SEQ ID NO: 1687610 - RNA, 23 nt, Homo sapiens
cuuucauuacccuacagacagcu

SEQ ID NO: 1687611 - RNA, 21 nt, Homo sapiens
cuuuccauccauuaccuccau

SEQ ID NO: 1687612 - RNA, 13 nt, Homo sapiens
cuuuccuguucca

SEQ ID NO: 1687613 - RNA, 22 nt, Homo sapiens
cuuucuuuuuuaaaaauggaaa

SEQ ID NO: 1687614 - RNA, 14 nt, Homo sapiens
cuuugacaguguuu

SEQ ID NO: 1687615 - RNA, 18 nt, Homo sapiens
cuuugaccucuucucucc

SEQ ID NO: 1687616 - RNA, 12 nt, Homo sapiens
cuuugcugccag

SEQ ID NO: 1687617 - RNA, 14 nt, Homo sapiens
cuuuguuugucaca

SEQ ID NO: 1687618 - RNA, 17 nt, Homo sapiens
cuuuuccccagucccag

SEQ ID NO: 1687619 - RNA, 14 nt, Homo sapiens
gaaaacauguuaau

SEQ ID NO: 1687620 - RNA, 23 nt, Homo sapiens
gaaaaguguguauauauuuugug

SEQ ID NO: 1687621 - RNA, 20 nt, Homo sapiens
gaaacaaauaauuugaacuu

SEQ ID NO: 1687622 - RNA, 22 nt, Homo sapiens
gaaacaaauaauuugaacuuug

SEQ ID NO: 1687623 - RNA, 13 nt, Homo sapiens
gaaagcacaagac

SEQ ID NO: 1687624 - RNA, 18 nt, Homo sapiens
gaaagcauaaagcucaaa

SEQ ID NO: 1687625 - RNA, 11 nt, Homo sapiens
gaaaugaacuu

SEQ ID NO: 1687626 - RNA, 15 nt, Homo sapiens
gaaaugaacuuuguc

SEQ ID NO: 1687627 - RNA, 14 nt, Homo sapiens
gaaaugaugagaaa

SEQ ID NO: 1687628 - RNA, 16 nt, Homo sapiens
gaaauuccuguacugu

SEQ ID NO: 1687629 - RNA, 16 nt, Homo sapiens
gaacaccuauugcacu

SEQ ID NO: 1687630 - RNA, 18 nt, Homo sapiens
gaacagagugcaacccag

SEQ ID NO: 1687631 - RNA, 15 nt, Homo sapiens
gaacauauguugcaa

SEQ ID NO: 1687632 - RNA, 21 nt, Homo sapiens
gaacggaggaggacaugggga

SEQ ID NO: 1687633 - RNA, 14 nt, Homo sapiens
gaacuccaggcaug

SEQ ID NO: 1687634 - RNA, 22 nt, Homo sapiens
gaacucuagagggcgagggaug

SEQ ID NO: 1687635 - RNA, 12 nt, Homo sapiens
gaacucuuuaug

SEQ ID NO: 1687636 - RNA, 18 nt, Homo sapiens
gaacugagaccuccagaa

SEQ ID NO: 1687637 - RNA, 21 nt, Homo sapiens
gaagacuauggugcugccuug

SEQ ID NO: 1687638 - RNA, 20 nt, Homo sapiens
gaagcagaaauauagugcaa

SEQ ID NO: 1687639 - RNA, 13 nt, Homo sapiens
gaagccagugucu

SEQ ID NO: 1687640 - RNA, 18 nt, Homo sapiens
gaagcccaccacuggcca

SEQ ID NO: 1687641 - RNA, 12 nt, Homo sapiens
gaagcugcuccu

SEQ ID NO: 1687642 - RNA, 21 nt, Homo sapiens
gaaggaccugcucccacaggg

SEQ ID NO: 1687643 - RNA, 13 nt, Homo sapiens
gaaggauuaccug

SEQ ID NO: 1687644 - RNA, 22 nt, Homo sapiens
gaagucgggcaugguggcucau

SEQ ID NO: 1687645 - RNA, 14 nt, Homo sapiens
gaagugagcagugu

SEQ ID NO: 1687646 - RNA, 19 nt, Homo sapiens
gaaguucuagccacagcag

SEQ ID NO: 1687647 - RNA, 15 nt, Homo sapiens
gaaguuugcugugcu

SEQ ID NO: 1687648 - RNA, 14 nt, Homo sapiens
gaaucuaaaugaag

SEQ ID NO: 1687649 - RNA, 17 nt, Homo sapiens
gaaucuagcccaaccua

SEQ ID NO: 1687650 - RNA, 14 nt, Homo sapiens
gaaugguguaggaa

SEQ ID NO: 1687651 - RNA, 22 nt, Homo sapiens
gacaaauauuccuuugcauauu

SEQ ID NO: 1687652 - RNA, 17 nt, Homo sapiens
gacacugaugaguuuca

SEQ ID NO: 1687653 - RNA, 10 nt, Homo sapiens
gacagaauuc

SEQ ID NO: 1687654 - RNA, 19 nt, Homo sapiens
gacagcaggaagccauaga

SEQ ID NO: 1687655 - RNA, 22 nt, Homo sapiens
gacagcccuggcaaaugccuga

SEQ ID NO: 1687656 - RNA, 21 nt, Homo sapiens
gacaggccuuccuccucucaa

SEQ ID NO: 1687657 - RNA, 17 nt, Homo sapiens
gacauacauauuaucuc

SEQ ID NO: 1687658 - RNA, 18 nt, Homo sapiens
gacauacauauuaucuca

SEQ ID NO: 1687659 - RNA, 19 nt, Homo sapiens
gaccaaaaucagcuuugua

SEQ ID NO: 1687660 - RNA, 15 nt, Homo sapiens
gaccacucaauccau

SEQ ID NO: 1687661 - RNA, 17 nt, Homo sapiens
gaccagcccaccccugu

SEQ ID NO: 1687662 - RNA, 15 nt, Homo sapiens
gaccauuucucugca

SEQ ID NO: 1687663 - RNA, 21 nt, Homo sapiens
gaccccauuccugaucccaug

SEQ ID NO: 1687664 - RNA, 17 nt, Homo sapiens
gacccugauacaggcau

SEQ ID NO: 1687665 - RNA, 22 nt, Homo sapiens
gaccuaaauuauuuacugcaaa

SEQ ID NO: 1687666 - RNA, 22 nt, Homo sapiens
gacggugcucacucccaaggga

SEQ ID NO: 1687667 - RNA, 14 nt, Homo sapiens
gacguuaggccagg

SEQ ID NO: 1687668 - RNA, 17 nt, Homo sapiens
gacuauggugcugccuu

SEQ ID NO: 1687669 - RNA, 13 nt, Homo sapiens
gacucagccucag

SEQ ID NO: 1687670 - RNA, 18 nt, Homo sapiens
gacuuugauccauguaug

SEQ ID NO: 1687671 - RNA, 12 nt, Homo sapiens
gagaaaacaugc

SEQ ID NO: 1687672 - RNA, 12 nt, Homo sapiens
gagaaacccaga

SEQ ID NO: 1687673 - RNA, 20 nt, Homo sapiens
gagaaagcaaaggugcacuc

SEQ ID NO: 1687674 - RNA, 16 nt, Homo sapiens
gagacaugugacauuu

SEQ ID NO: 1687675 - RNA, 13 nt, Homo sapiens
gagacuugcaguu

SEQ ID NO: 1687676 - RNA, 14 nt, Homo sapiens
gagagcccauuccc

SEQ ID NO: 1687677 - RNA, 16 nt, Homo sapiens
gagauaagucuuucau

SEQ ID NO: 1687678 - RNA, 12 nt, Homo sapiens
gagauucccacc

SEQ ID NO: 1687679 - RNA, 23 nt, Homo sapiens
gagcaaugggaauggcauuauug

SEQ ID NO: 1687680 - RNA, 16 nt, Homo sapiens
acacacgaugcauuua

SEQ ID NO: 1687681 - RNA, 16 nt, Homo sapiens
acaccaaaaaugaugc

SEQ ID NO: 1687682 - RNA, 14 nt, Homo sapiens
acaccuauugcacu

SEQ ID NO: 1687683 - RNA, 13 nt, Homo sapiens
acacgaugcauuu

SEQ ID NO: 1687684 - RNA, 16 nt, Homo sapiens
acacgaugcauuuaau

SEQ ID NO: 1687685 - RNA, 22 nt, Homo sapiens
acagcuugggaauccugcuaaa

SEQ ID NO: 1687686 - RNA, 20 nt, Homo sapiens
acaggcagauguuugccuca

SEQ ID NO: 1687687 - RNA, 16 nt, Homo sapiens
acaggucacacgaggg

SEQ ID NO: 1687688 - RNA, 18 nt, Homo sapiens
acagguguauauaagcaa

SEQ ID NO: 1687689 - RNA, 21 nt, Homo sapiens
acagucaguucucauuauuca

SEQ ID NO: 1687690 - RNA, 16 nt, Homo sapiens
acagugccuauugaua

SEQ ID NO: 1687691 - RNA, 18 nt, Homo sapiens
acauaaguguugguagca

SEQ ID NO: 1687692 - RNA, 21 nt, Homo sapiens
acauaaguguugguagcacuu

SEQ ID NO: 1687693 - RNA, 12 nt, Homo sapiens
acauagcugugc

SEQ ID NO: 1687694 - RNA, 14 nt, Homo sapiens
acauagcugugcua

SEQ ID NO: 1687695 - RNA, 14 nt, Homo sapiens
acauauauuuugca

SEQ ID NO: 1687696 - RNA, 13 nt, Homo sapiens
acauauccacaaa

SEQ ID NO: 1687697 - RNA, 12 nt, Homo sapiens
acauaugugcug

SEQ ID NO: 1687698 - RNA, 22 nt, Homo sapiens
acauccaucccuccauucaucc

SEQ ID NO: 1687699 - RNA, 16 nt, Homo sapiens
acaugagaagugauaa

SEQ ID NO: 1687700 - RNA, 17 nt, Homo sapiens
acaugagaagugauaaa

SEQ ID NO: 1687701 - RNA, 18 nt, Homo sapiens
acaugccagccacuguga

SEQ ID NO: 1687702 - RNA, 19 nt, Homo sapiens
acaugccucugccaaagga

SEQ ID NO: 1687703 - RNA, 19 nt, Homo sapiens
acauguauugcacauugua

SEQ ID NO: 1687704 - RNA, 23 nt, Homo sapiens
acauguuaaugacaauauuccag

SEQ ID NO: 1687705 - RNA, 12 nt, Homo sapiens
acauuaucucac

SEQ ID NO: 1687706 - RNA, 19 nt, Homo sapiens
acauuucuuugcauuccag

SEQ ID NO: 1687707 - RNA, 15 nt, Homo sapiens
acauuugcuacuguu

SEQ ID NO: 1687708 - RNA, 20 nt, Homo sapiens
acauuugggagacaugugac

SEQ ID NO: 1687709 - RNA, 18 nt, Homo sapiens
acauuuuguggugacaga

SEQ ID NO: 1687710 - RNA, 17 nt, Homo sapiens
acauuuuuuugcaugca

SEQ ID NO: 1687711 - RNA, 23 nt, Homo sapiens
accaacaggcuaccaacuuguau

SEQ ID NO: 1687712 - RNA, 13 nt, Homo sapiens
accagagcugucu

SEQ ID NO: 1687713 - RNA, 11 nt, Homo sapiens
accagcccaga

SEQ ID NO: 1687714 - RNA, 14 nt, Homo sapiens
accaugcuucacaa

SEQ ID NO: 1687715 - RNA, 21 nt, Homo sapiens
accauucuaccugaggccagg

SEQ ID NO: 1687716 - RNA, 18 nt, Homo sapiens
acccaccccguagauucc

SEQ ID NO: 1687717 - RNA, 16 nt, Homo sapiens
acccagggugugaaca

SEQ ID NO: 1687718 - RNA, 21 nt, Homo sapiens
accccaagggggcugcugcuc

SEQ ID NO: 1687719 - RNA, 15 nt, Homo sapiens
acccccaggcaucug

SEQ ID NO: 1687720 - RNA, 16 nt, Homo sapiens
accccucacugugacu

SEQ ID NO: 1687721 - RNA, 22 nt, Homo sapiens
acccuguuuuaccguugcuaag

SEQ ID NO: 1687722 - RNA, 20 nt, Homo sapiens
accgcaggugcucaugcugc

SEQ ID NO: 1687723 - RNA, 16 nt, Homo sapiens
accgcuugguuugcaa

SEQ ID NO: 1687724 - RNA, 19 nt, Homo sapiens
accuaacauuauacuucau

SEQ ID NO: 1687725 - RNA, 15 nt, Homo sapiens
accuacauuaucuca

SEQ ID NO: 1687726 - RNA, 16 nt, Homo sapiens
accuacauuaucucac

SEQ ID NO: 1687727 - RNA, 23 nt, Homo sapiens
accucuuggccacagaggacuca

SEQ ID NO: 1687728 - RNA, 22 nt, Homo sapiens
accugcccacaacucccuugca

SEQ ID NO: 1687729 - RNA, 23 nt, Homo sapiens
accugcccugggccacacugacc

SEQ ID NO: 1687730 - RNA, 16 nt, Homo sapiens
accuuauuuuacagaa

SEQ ID NO: 1687731 - RNA, 22 nt, Homo sapiens
accuuauuuuacagaagugaaa

SEQ ID NO: 1687732 - RNA, 15 nt, Homo sapiens
accuugaccaaaauc

SEQ ID NO: 1687733 - RNA, 11 nt, Homo sapiens
acgaugcauuu

SEQ ID NO: 1687734 - RNA, 13 nt, Homo sapiens
acgaugcauuuaa

SEQ ID NO: 1687735 - RNA, 19 nt, Homo sapiens
acgcggcuuuaagugugcu

SEQ ID NO: 1687736 - RNA, 18 nt, Homo sapiens
acggcuuguaaaugugac

SEQ ID NO: 1687737 - RNA, 20 nt, Homo sapiens
acgggucuguguucgacuca

SEQ ID NO: 1687738 - RNA, 19 nt, Homo sapiens
acggugcucacucccaagg

SEQ ID NO: 1687739 - RNA, 23 nt, Homo sapiens
acguuguuuugguuguacuuugg

SEQ ID NO: 1687740 - RNA, 22 nt, Homo sapiens
acguuuauaaacagaaauggaa

SEQ ID NO: 1687741 - RNA, 23 nt, Homo sapiens
acuaacucaaauacacauuugcu

SEQ ID NO: 1687742 - RNA, 11 nt, Homo sapiens
acuauggugcu

SEQ ID NO: 1687743 - RNA, 18 nt, Homo sapiens
acucaaauacacauuugc

SEQ ID NO: 1687744 - RNA, 18 nt, Homo sapiens
acucacccuuugagcuac

SEQ ID NO: 1687745 - RNA, 16 nt, Homo sapiens
acucaccugcacuaac

SEQ ID NO: 1687746 - RNA, 15 nt, Homo sapiens
acucagaaaauuccc

SEQ ID NO: 1687747 - RNA, 12 nt, Homo sapiens
acucagcaucac

SEQ ID NO: 1687748 - RNA, 19 nt, Homo sapiens
acucccggccugucauuca

SEQ ID NO: 1687749 - RNA, 18 nt, Homo sapiens
acucuaggcagugacagu

SEQ ID NO: 1687750 - RNA, 17 nt, Homo sapiens
acucuaggucaguauua

SEQ ID NO: 1687751 - RNA, 17 nt, Homo sapiens
acucuggcuucaaaaag

SEQ ID NO: 1687752 - RNA, 21 nt, Homo sapiens
acucuggcuucaaaaagccac

SEQ ID NO: 1687753 - RNA, 20 nt, Homo sapiens
acugauccaguauaagacua

SEQ ID NO: 1687754 - RNA, 13 nt, Homo sapiens
acugcugcugcug

SEQ ID NO: 1687755 - RNA, 18 nt, Homo sapiens
acuggccuauuuaucuga

SEQ ID NO: 1687756 - RNA, 22 nt, Homo sapiens
acugggauguaaguuuguguaa

SEQ ID NO: 1687757 - RNA, 22 nt, Homo sapiens
acugugggauguguucuucuuu

SEQ ID NO: 1687758 - RNA, 19 nt, Homo sapiens
acugugggcaaaguccucc

SEQ ID NO: 1687759 - RNA, 14 nt, Homo sapiens
acuuacaacccagg

SEQ ID NO: 1687760 - RNA, 15 nt, Homo sapiens
acuuacaucaugugu

SEQ ID NO: 1687761 - RNA, 13 nt, Homo sapiens
acuuccuguggau

SEQ ID NO: 1687762 - RNA, 19 nt, Homo sapiens
acuuggagaauacugccaa

SEQ ID NO: 1687763 - RNA, 20 nt, Homo sapiens
acuuggggguaaaggucugu

SEQ ID NO: 1687764 - RNA, 22 nt, Homo sapiens
acuuucccagguugacuaagaa

SEQ ID NO: 1687765 - RNA, 23 nt, Homo sapiens
acuuugagauguugaaauuacau

SEQ ID NO: 1687766 - RNA, 19 nt, Homo sapiens
agaaaaugaaaugcauauu

SEQ ID NO: 1687767 - RNA, 18 nt, Homo sapiens
agaaaauggguuuauuca

SEQ ID NO: 1687768 - RNA, 19 nt, Homo sapiens
agaaacacuauuugugacu

SEQ ID NO: 1687769 - RNA, 16 nt, Homo sapiens
agaaagcuuccuucaa

SEQ ID NO: 1687770 - RNA, 14 nt, Homo sapiens
agaaaucuauucca

SEQ ID NO: 1687771 - RNA, 14 nt, Homo sapiens
agaacagagugcaa

SEQ ID NO: 1687772 - RNA, 21 nt, Homo sapiens
aaagcuacuauguacugccuu

SEQ ID NO: 1687773 - RNA, 18 nt, Homo sapiens
aaaguaauaaaugaguuc

SEQ ID NO: 1687774 - RNA, 17 nt, Homo sapiens
aaagugcuggaauuaca

SEQ ID NO: 1687775 - RNA, 16 nt, Homo sapiens
aaaguggaaguaugua

SEQ ID NO: 1687776 - RNA, 16 nt, Homo sapiens
aaaguguucauuguuu

SEQ ID NO: 1687777 - RNA, 23 nt, Homo sapiens
aaauaacagaaagccugggugac

SEQ ID NO: 1687778 - RNA, 13 nt, Homo sapiens
aaauaauuucucu

SEQ ID NO: 1687779 - RNA, 17 nt, Homo sapiens
aaauacucaugugcaau

SEQ ID NO: 1687780 - RNA, 15 nt, Homo sapiens
aaauacuuaaauucc

SEQ ID NO: 1687781 - RNA, 18 nt, Homo sapiens
aaauaucaaagucauuaa

SEQ ID NO: 1687782 - RNA, 21 nt, Homo sapiens
aaauaucaaagucauuaaaga

SEQ ID NO: 1687783 - RNA, 19 nt, Homo sapiens
aaauauuucucaacugagg

SEQ ID NO: 1687784 - RNA, 16 nt, Homo sapiens
aaaucuaagugauaua

SEQ ID NO: 1687785 - RNA, 19 nt, Homo sapiens
aaaugaugcgcaucaaugu

SEQ ID NO: 1687786 - RNA, 14 nt, Homo sapiens
aaaugccugacuca

SEQ ID NO: 1687787 - RNA, 22 nt, Homo sapiens
aaauggaaaaauaaacacuaca

SEQ ID NO: 1687788 - RNA, 16 nt, Homo sapiens
aaauggccaaugagau

SEQ ID NO: 1687789 - RNA, 22 nt, Homo sapiens
aaauuaaugguuuauucuuugc

SEQ ID NO: 1687790 - RNA, 15 nt, Homo sapiens
aaauuauuucucuca

SEQ ID NO: 1687791 - RNA, 13 nt, Homo sapiens
aaauucuaccuua

SEQ ID NO: 1687792 - RNA, 18 nt, Homo sapiens
aaauugggaaaacuccau

SEQ ID NO: 1687793 - RNA, 18 nt, Homo sapiens
aaauuuaauaccagauac

SEQ ID NO: 1687794 - RNA, 12 nt, Homo sapiens
aaauuuacuuuu

SEQ ID NO: 1687795 - RNA, 15 nt, Homo sapiens
aacaauucugugaca

SEQ ID NO: 1687796 - RNA, 22 nt, Homo sapiens
uagaaaguauguuuguguuggu

SEQ ID NO: 1687797 - RNA, 15 nt, Homo sapiens
uagacaaaaaguaua

SEQ ID NO: 1687798 - RNA, 16 nt, Homo sapiens
uagaccuguucuuucc

SEQ ID NO: 1687799 - RNA, 19 nt, Homo sapiens
uagacuuggagaauacugc

SEQ ID NO: 1687800 - RNA, 12 nt, Homo sapiens
uagagauugcau

SEQ ID NO: 1687801 - RNA, 16 nt, Homo sapiens
uagagccccuacugug

SEQ ID NO: 1687802 - RNA, 14 nt, Homo sapiens
uagaugccugugaa

SEQ ID NO: 1687803 - RNA, 17 nt, Homo sapiens
uagauggauaagggaau

SEQ ID NO: 1687804 - RNA, 14 nt, Homo sapiens
uagcaagugugcac

SEQ ID NO: 1687805 - RNA, 20 nt, Homo sapiens
uagcagaguuaaaucucaaa

SEQ ID NO: 1687806 - RNA, 17 nt, Homo sapiens
uagcauuuugcuaucuu

SEQ ID NO: 1687807 - RNA, 14 nt, Homo sapiens
uagcccugucugcu

SEQ ID NO: 1687808 - RNA, 14 nt, Homo sapiens
uagccuccaaacau

SEQ ID NO: 1687809 - RNA, 18 nt, Homo sapiens
uagccucuggacuggaaa

SEQ ID NO: 1687810 - RNA, 19 nt, Homo sapiens
uagcugccuaucagaauuu

SEQ ID NO: 1687811 - RNA, 18 nt, Homo sapiens
uagcugggauuacaggcg

SEQ ID NO: 1687812 - RNA, 13 nt, Homo sapiens
uaggaaucccaga

SEQ ID NO: 1687813 - RNA, 20 nt, Homo sapiens
uaggcuacuguaaugcugcc

SEQ ID NO: 1687814 - RNA, 17 nt, Homo sapiens
uaggcuauuaaaaaagu

SEQ ID NO: 1687815 - RNA, 16 nt, Homo sapiens
uaggucuccucagggu

SEQ ID NO: 1687816 - RNA, 17 nt, Homo sapiens
uaggucuccucagggug

SEQ ID NO: 1687817 - RNA, 14 nt, Homo sapiens
uaggugucucauag

SEQ ID NO: 1687818 - RNA, 13 nt, Homo sapiens
uaguaaauccaug

SEQ ID NO: 1687819 - RNA, 18 nt, Homo sapiens
uaguaaauccaugguguu

SEQ ID NO: 1687820 - RNA, 13 nt, Homo sapiens
uagucaugugacc

SEQ ID NO: 1687821 - RNA, 21 nt, Homo sapiens
uagugauguccuuaaaaugug

SEQ ID NO: 1687822 - RNA, 22 nt, Homo sapiens
uagugcugaugccuguguacug

SEQ ID NO: 1687823 - RNA, 16 nt, Homo sapiens
uaguuaaagaaaggaa

SEQ ID NO: 1687824 - RNA, 13 nt, Homo sapiens
uaguuacugucag

SEQ ID NO: 1687825 - RNA, 16 nt, Homo sapiens
uaguuguagacaaagu

SEQ ID NO: 1687826 - RNA, 15 nt, Homo sapiens
uauaaaucuguuaua

SEQ ID NO: 1687827 - RNA, 17 nt, Homo sapiens
uauaauacuacuacugu

SEQ ID NO: 1687828 - RNA, 13 nt, Homo sapiens
uauacugcaaaag

SEQ ID NO: 1687829 - RNA, 18 nt, Homo sapiens
uauagcauuuugcuaucu

SEQ ID NO: 1687830 - RNA, 17 nt, Homo sapiens
uauaguauaagcagugu

SEQ ID NO: 1687831 - RNA, 18 nt, Homo sapiens
uauagugcaauagugcaa

SEQ ID NO: 1687832 - RNA, 11 nt, Homo sapiens
uauauaaacug

SEQ ID NO: 1687833 - RNA, 15 nt, Homo sapiens
uauauaaguguacau

SEQ ID NO: 1687834 - RNA, 19 nt, Homo sapiens
uauauagaaaaugcuaaag

SEQ ID NO: 1687835 - RNA, 19 nt, Homo sapiens
uauauguguguauacauau

SEQ ID NO: 1687836 - RNA, 20 nt, Homo sapiens
uauauugcaaggugugaugg

SEQ ID NO: 1687837 - RNA, 14 nt, Homo sapiens
uaucagaaguguua

SEQ ID NO: 1687838 - RNA, 18 nt, Homo sapiens
uaucauaauucagcacuu

SEQ ID NO: 1687839 - RNA, 23 nt, Homo sapiens
uaucucauuuuacacaaagggaa

SEQ ID NO: 1687840 - RNA, 19 nt, Homo sapiens
uaucugcaugugucaugaa

SEQ ID NO: 1687841 - RNA, 18 nt, Homo sapiens
uaugagccaggcaucaua

SEQ ID NO: 1687842 - RNA, 22 nt, Homo sapiens
uaugagccaggcaucauacuaa

SEQ ID NO: 1687843 - RNA, 17 nt, Homo sapiens
uaugcaauucaguguuc

SEQ ID NO: 1687844 - RNA, 13 nt, Homo sapiens
uauguacugccuu

SEQ ID NO: 1687845 - RNA, 15 nt, Homo sapiens
uauguacugccuuag

SEQ ID NO: 1687846 - RNA, 12 nt, Homo sapiens
uaugugcacauc

SEQ ID NO: 1687847 - RNA, 16 nt, Homo sapiens
uaugugcuauacacac

SEQ ID NO: 1687848 - RNA, 13 nt, Homo sapiens
uauuaaacaaagu

SEQ ID NO: 1687849 - RNA, 23 nt, Homo sapiens
uauuaaauugggaaaacuccauc

SEQ ID NO: 1687850 - RNA, 11 nt, Homo sapiens
uauucucugaa

SEQ ID NO: 1687851 - RNA, 14 nt, Homo sapiens
uauugaaauucuau

SEQ ID NO: 1687852 - RNA, 14 nt, Homo sapiens
uauugagcauguga

SEQ ID NO: 1687853 - RNA, 23 nt, Homo sapiens
uauugguucagggaacucuggca

SEQ ID NO: 1687854 - RNA, 12 nt, Homo sapiens
uauuuacagcug

SEQ ID NO: 1687855 - RNA, 19 nt, Homo sapiens
uauuuauugaguaccuacu

SEQ ID NO: 1687856 - RNA, 12 nt, Homo sapiens
uauuuucauaga

SEQ ID NO: 1687857 - RNA, 12 nt, Homo sapiens
ucaaaaagccac

SEQ ID NO: 1687858 - RNA, 15 nt, Homo sapiens
ucaaagaaguacugu

SEQ ID NO: 1687859 - RNA, 22 nt, Homo sapiens
ucaaauacacauuugcuacugu

SEQ ID NO: 1687860 - RNA, 21 nt, Homo sapiens
ucaaauuuuggcgaaucucaa

SEQ ID NO: 1687861 - RNA, 14 nt, Homo sapiens
ucaaccaacugcaa

SEQ ID NO: 1687862 - RNA, 21 nt, Homo sapiens
ucaagcuggaagaagugagca

SEQ ID NO: 1687863 - RNA, 17 nt, Homo sapiens
ucaagguuuguucaaca

SEQ ID NO: 1687864 - RNA, 20 nt, Homo sapiens
ucaauuucuaguaccuguga

SEQ ID NO: 1687865 - RNA, 16 nt, Homo sapiens
ucacaagaaugugcag

SEQ ID NO: 1687866 - RNA, 13 nt, Homo sapiens
aacaucaccacug

SEQ ID NO: 1687867 - RNA, 20 nt, Homo sapiens
aacauuaaaauuagcacuaa

SEQ ID NO: 1687868 - RNA, 16 nt, Homo sapiens
aacauuugcugccauu

SEQ ID NO: 1687869 - RNA, 18 nt, Homo sapiens
aacauuugcugccauuac

SEQ ID NO: 1687870 - RNA, 14 nt, Homo sapiens
aacccagucuuucu

SEQ ID NO: 1687871 - RNA, 20 nt, Homo sapiens
aaccuaauuuuauccaugga

SEQ ID NO: 1687872 - RNA, 20 nt, Homo sapiens
aaccuccgccucccagguuc

SEQ ID NO: 1687873 - RNA, 13 nt, Homo sapiens
aaccuuccagcuc

SEQ ID NO: 1687874 - RNA, 22 nt, Homo sapiens
aaccuugaaaaaaaacagugga

SEQ ID NO: 1687875 - RNA, 12 nt, Homo sapiens
aacuaacuugau

SEQ ID NO: 1687876 - RNA, 17 nt, Homo sapiens
aacuauauguauucaca

SEQ ID NO: 1687877 - RNA, 20 nt, Homo sapiens
aacucaaauacacauuugcu

SEQ ID NO: 1687878 - RNA, 18 nt, Homo sapiens
aacucaaggauaccuucu

SEQ ID NO: 1687879 - RNA, 16 nt, Homo sapiens
aacucuaccugcacac

SEQ ID NO: 1687880 - RNA, 13 nt, Homo sapiens
aacugaaggcaga

SEQ ID NO: 1687881 - RNA, 18 nt, Homo sapiens
aacugagaccuccagaaa

SEQ ID NO: 1687882 - RNA, 14 nt, Homo sapiens
aacugcaaauggaa

SEQ ID NO: 1687883 - RNA, 17 nt, Homo sapiens
aacugcauuccuucccc

SEQ ID NO: 1687884 - RNA, 16 nt, Homo sapiens
aacuguagcugccaug

SEQ ID NO: 1687885 - RNA, 15 nt, Homo sapiens
aacuguuuucaagga

SEQ ID NO: 1687886 - RNA, 16 nt, Homo sapiens
aacuuagagauugcau

SEQ ID NO: 1687887 - RNA, 21 nt, Homo sapiens
aacuuauucuuugaguaaugu

SEQ ID NO: 1687888 - RNA, 20 nt, Homo sapiens
aacuucaccuacauuaucuc

SEQ ID NO: 1687889 - RNA, 21 nt, Homo sapiens
aacuucaccuacauuaucuca

SEQ ID NO: 1687890 - RNA, 16 nt, Homo sapiens
aacuuuggaacagggu

SEQ ID NO: 1687891 - RNA, 22 nt, Homo sapiens
aagaacuauugugcucagagac

SEQ ID NO: 1687892 - RNA, 21 nt, Homo sapiens
aagaagaugagccuugcagau

SEQ ID NO: 1687893 - RNA, 15 nt, Homo sapiens
aagacaaacugcaca

SEQ ID NO: 1687894 - RNA, 13 nt, Homo sapiens
aagacaagcauuu

SEQ ID NO: 1687895 - RNA, 18 nt, Homo sapiens
aagacuggauuugcagaa

SEQ ID NO: 1687896 - RNA, 19 nt, Homo sapiens
aagacuuugauccauguau

SEQ ID NO: 1687897 - RNA, 22 nt, Homo sapiens
aagagcagugguaagaauagua

SEQ ID NO: 1687898 - RNA, 14 nt, Homo sapiens
aagagcuacuccca

SEQ ID NO: 1687899 - RNA, 14 nt, Homo sapiens
aagaggaaagggag

SEQ ID NO: 1687900 - RNA, 19 nt, Homo sapiens
aagagucuggccuggaccc

SEQ ID NO: 1687901 - RNA, 20 nt, Homo sapiens
aagaugagccuugcagauau

SEQ ID NO: 1687902 - RNA, 16 nt, Homo sapiens
aagaugggucacugaa

SEQ ID NO: 1687903 - RNA, 16 nt, Homo sapiens
aagauucuauguuaau

SEQ ID NO: 1687904 - RNA, 18 nt, Homo sapiens
aagauuuucccagucugu

SEQ ID NO: 1687905 - RNA, 17 nt, Homo sapiens
aagcaauuuacugauga

SEQ ID NO: 1687906 - RNA, 16 nt, Homo sapiens
aagcacuagccuuccc

SEQ ID NO: 1687907 - RNA, 20 nt, Homo sapiens
aagcacuggccuugccucca

SEQ ID NO: 1687908 - RNA, 20 nt, Homo sapiens
aagcaguuccugucccacau

SEQ ID NO: 1687909 - RNA, 19 nt, Homo sapiens
aagccagccaacucuuucu

SEQ ID NO: 1687910 - RNA, 17 nt, Homo sapiens
aagcccaccacuggcca

SEQ ID NO: 1687911 - RNA, 15 nt, Homo sapiens
aagccuaagaaucuu

SEQ ID NO: 1687912 - RNA, 21 nt, Homo sapiens
aagcgcggacccuucuggguc

SEQ ID NO: 1687913 - RNA, 16 nt, Homo sapiens
aagcugauuuuugucu

SEQ ID NO: 1687914 - RNA, 12 nt, Homo sapiens
aagcuggaagaa

SEQ ID NO: 1687915 - RNA, 16 nt, Homo sapiens
aaggaaauguuaguaa

SEQ ID NO: 1687916 - RNA, 20 nt, Homo sapiens
aaggaggcugaucccugaga

SEQ ID NO: 1687917 - RNA, 16 nt, Homo sapiens
aaggauucuauaucau

SEQ ID NO: 1687918 - RNA, 23 nt, Homo sapiens
aaggcucagacugggcacugggg

SEQ ID NO: 1687919 - RNA, 16 nt, Homo sapiens
aaggcuccuccuugcc

SEQ ID NO: 1687920 - RNA, 17 nt, Homo sapiens
aaggcucuucuuccuca

SEQ ID NO: 1687921 - RNA, 13 nt, Homo sapiens
aagggaccccaga

SEQ ID NO: 1687922 - RNA, 15 nt, Homo sapiens
aagggaccccagaua

SEQ ID NO: 1687923 - RNA, 21 nt, Homo sapiens
aagggaccccagauaccugug

SEQ ID NO: 1687924 - RNA, 17 nt, Homo sapiens
aagggcccaaugaauua

SEQ ID NO: 1687925 - RNA, 21 nt, Homo sapiens
aagggugcccuuugggguccc

SEQ ID NO: 1687926 - RNA, 19 nt, Homo sapiens
aaguacagaauuugaauua

SEQ ID NO: 1687927 - RNA, 21 nt, Homo sapiens
aaguacagggcagaaccaaga

SEQ ID NO: 1687928 - RNA, 18 nt, Homo sapiens
aaguacaggucaucugcu

SEQ ID NO: 1687929 - RNA, 23 nt, Homo sapiens
aagucaccaaauagugugaaaua

SEQ ID NO: 1687930 - RNA, 18 nt, Homo sapiens
aaguccuaaaaguucuca

SEQ ID NO: 1687931 - RNA, 14 nt, Homo sapiens
aagucuacaacaua

SEQ ID NO: 1687932 - RNA, 11 nt, Homo sapiens
aagucuuucau

SEQ ID NO: 1687933 - RNA, 12 nt, Homo sapiens
aagugagcagag

SEQ ID NO: 1687934 - RNA, 21 nt, Homo sapiens
aagugccucggacaguccgca

SEQ ID NO: 1687935 - RNA, 22 nt, Homo sapiens
aagugucaccccucacugugac

SEQ ID NO: 1687936 - RNA, 15 nt, Homo sapiens
aaguguugacugugu

SEQ ID NO: 1687937 - RNA, 14 nt, Homo sapiens
aauaaaaaucacuu

SEQ ID NO: 1687938 - RNA, 14 nt, Homo sapiens
aauaaacugugcaa

SEQ ID NO: 1687939 - RNA, 15 nt, Homo sapiens
aauaaaugucuugcc

SEQ ID NO: 1687940 - RNA, 16 nt, Homo sapiens
aauaaaugugacucag

SEQ ID NO: 1687941 - RNA, 20 nt, Homo sapiens
aauaacauguuucucuauaa

SEQ ID NO: 1687942 - RNA, 14 nt, Homo sapiens
aauaagucauugua

SEQ ID NO: 1687943 - RNA, 15 nt, Homo sapiens
aauaauaaagcauuu

SEQ ID NO: 1687944 - RNA, 17 nt, Homo sapiens
aauaauaaagcauuuau

SEQ ID NO: 1687945 - RNA, 15 nt, Homo sapiens
aauacagacaucuaa

SEQ ID NO: 1687946 - RNA, 20 nt, Homo sapiens
aauaccuucaaggcucuucu

SEQ ID NO: 1687947 - RNA, 17 nt, Homo sapiens
aauacuacuacuguuau

SEQ ID NO: 1687948 - RNA, 21 nt, Homo sapiens
aauacuugaacucuguucccc

SEQ ID NO: 1687949 - RNA, 17 nt, Homo sapiens
aauauacaggaggaugu

SEQ ID NO: 1687950 - RNA, 16 nt, Homo sapiens
aauaucccuacaugua

SEQ ID NO: 1687951 - RNA, 23 nt, Homo sapiens
aauaucccuuggacauuuuaugu

SEQ ID NO: 1687952 - RNA, 17 nt, Homo sapiens
aauaugcuuauaaccua

SEQ ID NO: 1687953 - RNA, 12 nt, Homo sapiens
aaucagcuuugu

SEQ ID NO: 1687954 - RNA, 19 nt, Homo sapiens
aaucaugugaggaaaugau

SEQ ID NO: 1687955 - RNA, 17 nt, Homo sapiens
aauccauuucaggacuc

SEQ ID NO: 1687956 - RNA, 16 nt, Homo sapiens
aaucccccagcacuuc

SEQ ID NO: 1687957 - RNA, 12 nt, Homo sapiens
aaucuguacaaa

SEQ ID NO: 1687958 - RNA, 16 nt, Homo sapiens
aaucuuuguaccaaaa

SEQ ID NO: 1687959 - RNA, 19 nt, Homo sapiens
aaugacuuuuauaacauuu

SEQ ID NO: 1687960 - RNA, 16 nt, Homo sapiens
aaugagaucauuguga

SEQ ID NO: 1687961 - RNA, 15 nt, Homo sapiens
aaugauuucacagug

SEQ ID NO: 1687962 - RNA, 20 nt, Homo sapiens
aaugguaguuuuacaguguu

SEQ ID NO: 1687963 - RNA, 13 nt, Homo sapiens
aaugugacucagc

SEQ ID NO: 1687964 - RNA, 21 nt, Homo sapiens
aaugugcuggugaacacugug

SEQ ID NO: 1687965 - RNA, 16 nt, Homo sapiens
aauguuggagcagcag

SEQ ID NO: 1687966 - RNA, 21 nt, Homo sapiens
aauguuuauuaaaugcuucau

SEQ ID NO: 1687967 - RNA, 19 nt, Homo sapiens
aauguuucuggaauucuuc

SEQ ID NO: 1687968 - RNA, 16 nt, Homo sapiens
aauuaaacuuccaaag

SEQ ID NO: 1687969 - RNA, 23 nt, Homo sapiens
aauuaaaggagaagauuccugaa

SEQ ID NO: 1687970 - RNA, 22 nt, Homo sapiens
aauuaaggguaugauuaacucu

SEQ ID NO: 1687971 - RNA, 22 nt, Homo sapiens
aauuauuauauacauacugcau

SEQ ID NO: 1687972 - RNA, 18 nt, Homo sapiens
aauucacaaauacauaac

SEQ ID NO: 1687973 - RNA, 18 nt, Homo sapiens
aauucugauugauuugau

SEQ ID NO: 1687974 - RNA, 15 nt, Homo sapiens
aauucugucugggga

SEQ ID NO: 1687975 - RNA, 15 nt, Homo sapiens
aauugcauacuuugu

SEQ ID NO: 1687976 - RNA, 20 nt, Homo sapiens
aauuuaauacagacaucuaa

SEQ ID NO: 1687977 - RNA, 20 nt, Homo sapiens
aauuucauagcuguacuucu

SEQ ID NO: 1687978 - RNA, 23 nt, Homo sapiens
aauuucuaguaccugugacucuu

SEQ ID NO: 1687979 - RNA, 17 nt, Homo sapiens
aauuucucuuuacuuga

SEQ ID NO: 1687980 - RNA, 12 nt, Homo sapiens
aauuugaacuuu

SEQ ID NO: 1687981 - RNA, 20 nt, Homo sapiens
aauuuguauaugacugcauu

SEQ ID NO: 1687982 - RNA, 24 nt, Homo sapiens
aauuugugguccacugagcuauaa

SEQ ID NO: 1687983 - RNA, 17 nt, Homo sapiens
aauuuuaaaaaagggag

SEQ ID NO: 1687984 - RNA, 18 nt, Homo sapiens
aauuuucuaaaagcuuuc

SEQ ID NO: 1687985 - RNA, 23 nt, Homo sapiens
acaaaaauauuagcaaacugaau

SEQ ID NO: 1687986 - RNA, 17 nt, Homo sapiens
augagagaauguggaaa

SEQ ID NO: 1687987 - RNA, 13 nt, Homo sapiens
augagagcauaau

SEQ ID NO: 1687988 - RNA, 20 nt, Homo sapiens
augaggcaaacagcaagagu

SEQ ID NO: 1687989 - RNA, 17 nt, Homo sapiens
augaggcagauagcacu

SEQ ID NO: 1687990 - RNA, 21 nt, Homo sapiens
augagguuucuuugacuucaa

SEQ ID NO: 1687991 - RNA, 13 nt, Homo sapiens
augaguugguucu

SEQ ID NO: 1687992 - RNA, 15 nt, Homo sapiens
augaguuucacugua

SEQ ID NO: 1687993 - RNA, 19 nt, Homo sapiens
augcaauuggcauuaacaa

SEQ ID NO: 1687994 - RNA, 17 nt, Homo sapiens
augcauacaaguuucau

SEQ ID NO: 1687995 - RNA, 12 nt, Homo sapiens
augcauuauuaa

SEQ ID NO: 1687996 - RNA, 18 nt, Homo sapiens
augccccugacaucauca

SEQ ID NO: 1687997 - RNA, 14 nt, Homo sapiens
augccuguaaucuc

SEQ ID NO: 1687998 - RNA, 23 nt, Homo sapiens
augccuguaaucucagcacuuug

SEQ ID NO: 1687999 - RNA, 15 nt, Homo sapiens
augcugggcaaugag

SEQ ID NO: 1688000 - RNA, 22 nt, Homo sapiens
augcugucugguugcgccauuu

SEQ ID NO: 1688001 - RNA, 18 nt, Homo sapiens
auggaaaaauaaacacua

SEQ ID NO: 1688002 - RNA, 20 nt, Homo sapiens
auggagugcucacaaaggau

SEQ ID NO: 1688003 - RNA, 20 nt, Homo sapiens
auggauuuuucuuuaacugc

SEQ ID NO: 1688004 - RNA, 17 nt, Homo sapiens
auggcaauuuagcucuc

SEQ ID NO: 1688005 - RNA, 19 nt, Homo sapiens
auggguaugcucaggucaa

SEQ ID NO: 1688006 - RNA, 16 nt, Homo sapiens
auguauuaugagccaa

SEQ ID NO: 1688007 - RNA, 16 nt, Homo sapiens
augucagaacagagug

SEQ ID NO: 1688008 - RNA, 21 nt, Homo sapiens
augucaguacuauucagguaa

SEQ ID NO: 1688009 - RNA, 18 nt, Homo sapiens
augugaagucucugggug

SEQ ID NO: 1688010 - RNA, 21 nt, Homo sapiens
augugagcucuuccuaucccu

SEQ ID NO: 1688011 - RNA, 18 nt, Homo sapiens
augugcuauacacacaca

SEQ ID NO: 1688012 - RNA, 19 nt, Homo sapiens
auguucccaaaacaauggu

SEQ ID NO: 1688013 - RNA, 13 nt, Homo sapiens
auguucuccauuu

SEQ ID NO: 1688014 - RNA, 18 nt, Homo sapiens
auuaaaauuccaaauuca

SEQ ID NO: 1688015 - RNA, 19 nt, Homo sapiens
auuaaagcauuuccuacca

SEQ ID NO: 1688016 - RNA, 16 nt, Homo sapiens
auuaagaaauacucau

SEQ ID NO: 1688017 - RNA, 18 nt, Homo sapiens
auuaagagucuacucuca

SEQ ID NO: 1688018 - RNA, 15 nt, Homo sapiens
auuacccugauacua

SEQ ID NO: 1688019 - RNA, 15 nt, Homo sapiens
auuaccuccauccau

SEQ ID NO: 1688020 - RNA, 14 nt, Homo sapiens
auuagcaaggcaga

SEQ ID NO: 1688021 - RNA, 20 nt, Homo sapiens
auuauguaaauaacucuaac

SEQ ID NO: 1688022 - RNA, 20 nt, Homo sapiens
auucaacagagacugaauag

SEQ ID NO: 1688023 - RNA, 23 nt, Homo sapiens
auucaaucuuuggaggcuuuuaa

SEQ ID NO: 1688024 - RNA, 16 nt, Homo sapiens
auucacaguugauaca

SEQ ID NO: 1688025 - RNA, 23 nt, Homo sapiens
auucagagcuauggugcuugcug

SEQ ID NO: 1688026 - RNA, 13 nt, Homo sapiens
auucaucuaaugu

SEQ ID NO: 1688027 - RNA, 14 nt, Homo sapiens
auuccaaguucuca

SEQ ID NO: 1688028 - RNA, 21 nt, Homo sapiens
auucccaucauacacuuccuu

SEQ ID NO: 1688029 - RNA, 12 nt, Homo sapiens
auuccccaguga

SEQ ID NO: 1688030 - RNA, 19 nt, Homo sapiens
auucuauucuccagacaug

SEQ ID NO: 1688031 - RNA, 15 nt, Homo sapiens
auucuccugccuuag

SEQ ID NO: 1688032 - RNA, 14 nt, Homo sapiens
auucuucucucuca

SEQ ID NO: 1688033 - RNA, 16 nt, Homo sapiens
auugcauccacuagcu

SEQ ID NO: 1688034 - RNA, 19 nt, Homo sapiens
auuggaccugcccacaacu

SEQ ID NO: 1688035 - RNA, 17 nt, Homo sapiens
auugggaaaacauuugc

SEQ ID NO: 1688036 - RNA, 16 nt, Homo sapiens
auugguagaaggauuu

SEQ ID NO: 1688037 - RNA, 21 nt, Homo sapiens
auuguauuuuuaacaccagaa

SEQ ID NO: 1688038 - RNA, 14 nt, Homo sapiens
auugucacaucuau

SEQ ID NO: 1688039 - RNA, 17 nt, Homo sapiens
auugugaccacucugaa

SEQ ID NO: 1688040 - RNA, 18 nt, Homo sapiens
auuuaauaaagcacaaaa

SEQ ID NO: 1688041 - RNA, 15 nt, Homo sapiens
auuuacagcugugcu

SEQ ID NO: 1688042 - RNA, 15 nt, Homo sapiens
auuuagucaugugac

SEQ ID NO: 1688043 - RNA, 17 nt, Homo sapiens
auuuauugaaaugauuu

SEQ ID NO: 1688044 - RNA, 14 nt, Homo sapiens
auuuauuuauucau

SEQ ID NO: 1688045 - RNA, 22 nt, Homo sapiens
auuuccagaaccacacuugaaa

SEQ ID NO: 1688046 - RNA, 20 nt, Homo sapiens
auuuccauugcuuauuaugu

SEQ ID NO: 1688047 - RNA, 17 nt, Homo sapiens
auuucccccuucaucca

SEQ ID NO: 1688048 - RNA, 22 nt, Homo sapiens
auuucugaggagccugcaacau

SEQ ID NO: 1688049 - RNA, 17 nt, Homo sapiens
auuugggagacauguga

SEQ ID NO: 1688050 - RNA, 21 nt, Homo sapiens
auuuguauugguucagggaac

SEQ ID NO: 1688051 - RNA, 14 nt, Homo sapiens
auuuuagaugccug

SEQ ID NO: 1688052 - RNA, 14 nt, Homo sapiens
auuuuauacugaca

SEQ ID NO: 1688053 - RNA, 23 nt, Homo sapiens
auuuuauccauggaagaaacaca

SEQ ID NO: 1688054 - RNA, 16 nt, Homo sapiens
auuuuccugaaagugu

SEQ ID NO: 1688055 - RNA, 19 nt, Homo sapiens
auuuuguuauugacuaaca

SEQ ID NO: 1688056 - RNA, 19 nt, Homo sapiens
auuuuuggugggaauccaa

SEQ ID NO: 1688057 - RNA, 16 nt, Homo sapiens
caaaaagagucagaca

SEQ ID NO: 1688058 - RNA, 21 nt, Homo sapiens
caaaauuaagcaaauguuaaa

SEQ ID NO: 1688059 - RNA, 15 nt, Homo sapiens
caaacugcuucccuu

SEQ ID NO: 1688060 - RNA, 13 nt, Homo sapiens
caaacuuuaguuu

SEQ ID NO: 1688061 - RNA, 18 nt, Homo sapiens
caaacuuuguuugucaca

SEQ ID NO: 1688062 - RNA, 19 nt, Homo sapiens
caaagcagcaggacugugg

SEQ ID NO: 1688063 - RNA, 21 nt, Homo sapiens
caaaggaugugauauauaagu

SEQ ID NO: 1688064 - RNA, 18 nt, Homo sapiens
caaaggugcacuccagac

SEQ ID NO: 1688065 - RNA, 18 nt, Homo sapiens
caaagugacaaagcaauu

SEQ ID NO: 1688066 - RNA, 17 nt, Homo sapiens
caaagugugauauacaa

SEQ ID NO: 1688067 - RNA, 17 nt, Homo sapiens
caaaucccucucacaag

SEQ ID NO: 1688068 - RNA, 21 nt, Homo sapiens
caaaugccugacucagugacc

SEQ ID NO: 1688069 - RNA, 11 nt, Homo sapiens
caaauguucuc

SEQ ID NO: 1688070 - RNA, 22 nt, Homo sapiens
caaauucuaccuuauuuuacag

SEQ ID NO: 1688071 - RNA, 20 nt, Homo sapiens
caacagaacauauguugcaa

SEQ ID NO: 1688072 - RNA, 15 nt, Homo sapiens
caacagacuguugag

SEQ ID NO: 1688073 - RNA, 21 nt, Homo sapiens
caacagccaagcuggcacaaa

SEQ ID NO: 1688074 - RNA, 20 nt, Homo sapiens
caacauauauuuauugagua

SEQ ID NO: 1688075 - RNA, 16 nt, Homo sapiens
caacucauuuucauau

SEQ ID NO: 1688076 - RNA, 16 nt, Homo sapiens
caacuccucaugucuu

SEQ ID NO: 1688077 - RNA, 13 nt, Homo sapiens
caagaaugugcag

SEQ ID NO: 1688078 - RNA, 18 nt, Homo sapiens
caagagauaagucuuuca

SEQ ID NO: 1688079 - RNA, 19 nt, Homo sapiens
caagagauaagucuuucau

SEQ ID NO: 1688080 - RNA, 17 nt, Homo sapiens
caagagcguugucuacc

SEQ ID NO: 1688081 - RNA, 12 nt, Homo sapiens
caagauugcacc

SEQ ID NO: 1688082 - RNA, 20 nt, Homo sapiens
caagauugcaccacugcucu

SEQ ID NO: 1688083 - RNA, 15 nt, Homo sapiens
caagcagaugacaga

SEQ ID NO: 1688084 - RNA, 14 nt, Homo sapiens
caagcuggcacaaa

SEQ ID NO: 1688085 - RNA, 15 nt, Homo sapiens
caagcuggcacaaaa

SEQ ID NO: 1688086 - RNA, 18 nt, Homo sapiens
caaggcucuucuuccuca

SEQ ID NO: 1688087 - RNA, 19 nt, Homo sapiens
caaggcucuucuuccucac

SEQ ID NO: 1688088 - RNA, 16 nt, Homo sapiens
caagggucagggugag

SEQ ID NO: 1688089 - RNA, 22 nt, Homo sapiens
caagguccucucaguucucucc

SEQ ID NO: 1688090 - RNA, 16 nt, Homo sapiens
caagucccuuugugac

SEQ ID NO: 1688091 - RNA, 21 nt, Homo sapiens
caagugagcagagauguacug

SEQ ID NO: 1688092 - RNA, 20 nt, Homo sapiens
caauaauaaaguacuugacu

SEQ ID NO: 1688093 - RNA, 18 nt, Homo sapiens
caauagugcaacaucucu

SEQ ID NO: 1688094 - RNA, 11 nt, Homo sapiens
caauuaacugc

SEQ ID NO: 1688095 - RNA, 12 nt, Homo sapiens
caauucugugac

SEQ ID NO: 1688096 - RNA, 23 nt, Homo sapiens
caauucugugacauacauauuau

SEQ ID NO: 1688097 - RNA, 15 nt, Homo sapiens
caauuggcauuaaca

SEQ ID NO: 1688098 - RNA, 12 nt, Homo sapiens
cacaagcacuuu

SEQ ID NO: 1688099 - RNA, 18 nt, Homo sapiens
cacaauguuaaguuauau

SEQ ID NO: 1688100 - RNA, 13 nt, Homo sapiens
cacacacgaugca

SEQ ID NO: 1688101 - RNA, 17 nt, Homo sapiens
cacacacgaugcauuua

SEQ ID NO: 1688102 - RNA, 18 nt, Homo sapiens
cacacacgaugcauuuaa

SEQ ID NO: 1688103 - RNA, 19 nt, Homo sapiens
cacacacgaugcauuuaau

SEQ ID NO: 1688104 - RNA, 16 nt, Homo sapiens
cacaccacaaauggga

SEQ ID NO: 1688105 - RNA, 13 nt, Homo sapiens
cacacgaugcauu

SEQ ID NO: 1688106 - RNA, 12 nt, Homo sapiens
cugcacacuguc

SEQ ID NO: 1688107 - RNA, 22 nt, Homo sapiens
cugcagcagucgcccaagcaga

SEQ ID NO: 1688108 - RNA, 23 nt, Homo sapiens
cugcagucagacugaaauauaaa

SEQ ID NO: 1688109 - RNA, 15 nt, Homo sapiens
cugcauuguugaauu

SEQ ID NO: 1688110 - RNA, 19 nt, Homo sapiens
cugcauuguugaauucugc

SEQ ID NO: 1688111 - RNA, 18 nt, Homo sapiens
cugccaaaggaugugaua

SEQ ID NO: 1688112 - RNA, 16 nt, Homo sapiens
cugccagcucucagga

SEQ ID NO: 1688113 - RNA, 13 nt, Homo sapiens
cugccucaggacc

SEQ ID NO: 1688114 - RNA, 18 nt, Homo sapiens
cugccucaggccaaggga

SEQ ID NO: 1688115 - RNA, 22 nt, Homo sapiens
cugccuuaaauguaccuauggc

SEQ ID NO: 1688116 - RNA, 22 nt, Homo sapiens
cugccuuagugcugaugccugu

SEQ ID NO: 1688117 - RNA, 18 nt, Homo sapiens
cugcggccccgucugugg

SEQ ID NO: 1688118 - RNA, 19 nt, Homo sapiens
cugcuaacaagucaccaaa

SEQ ID NO: 1688119 - RNA, 22 nt, Homo sapiens
cugcuaacaagucaccaaaaga

SEQ ID NO: 1688120 - RNA, 20 nt, Homo sapiens
cugcugggccccaucuccac

SEQ ID NO: 1688121 - RNA, 13 nt, Homo sapiens
cuggaaagcacaa

SEQ ID NO: 1688122 - RNA, 12 nt, Homo sapiens
cuggaauucuuc

SEQ ID NO: 1688123 - RNA, 20 nt, Homo sapiens
cuggagauaugaaggauuac

SEQ ID NO: 1688124 - RNA, 22 nt, Homo sapiens
cuggagcaggcccaaugcugcu

SEQ ID NO: 1688125 - RNA, 22 nt, Homo sapiens
cuggaggacggccggcucucua

SEQ ID NO: 1688126 - RNA, 14 nt, Homo sapiens
cuggagugcaaugg

SEQ ID NO: 1688127 - RNA, 20 nt, Homo sapiens
cuggaucucacaagcacuuu

SEQ ID NO: 1688128 - RNA, 15 nt, Homo sapiens
cuggaugguggugca

SEQ ID NO: 1688129 - RNA, 17 nt, Homo sapiens
cuggauuucauacugua

SEQ ID NO: 1688130 - RNA, 14 nt, Homo sapiens
cuggauuugcagaa

SEQ ID NO: 1688131 - RNA, 16 nt, Homo sapiens
cuggcaccagaacuga

SEQ ID NO: 1688132 - RNA, 16 nt, Homo sapiens
cuggccuaaugagaua

SEQ ID NO: 1688133 - RNA, 18 nt, Homo sapiens
cugggaaggccagccuug

SEQ ID NO: 1688134 - RNA, 15 nt, Homo sapiens
cugggcacaaacaga

SEQ ID NO: 1688135 - RNA, 14 nt, Homo sapiens
cugggucugaguca

SEQ ID NO: 1688136 - RNA, 18 nt, Homo sapiens
cugguaauaaaugugacu

SEQ ID NO: 1688137 - RNA, 15 nt, Homo sapiens
cuggugggacagugg

SEQ ID NO: 1688138 - RNA, 20 nt, Homo sapiens
cugguguaaucucaaugcaa

SEQ ID NO: 1688139 - RNA, 16 nt, Homo sapiens
cugguuggcagcaucu

SEQ ID NO: 1688140 - RNA, 20 nt, Homo sapiens
cuguaacuuccaaauaaaua

SEQ ID NO: 1688141 - RNA, 17 nt, Homo sapiens
cuguaaucucagcacuu

SEQ ID NO: 1688142 - RNA, 20 nt, Homo sapiens
cuguacacagaauuguucca

SEQ ID NO: 1688143 - RNA, 23 nt, Homo sapiens
cuguaugggggagauugaacuuu

SEQ ID NO: 1688144 - RNA, 21 nt, Homo sapiens
cuguauuccgauacaaagugu

SEQ ID NO: 1688145 - RNA, 17 nt, Homo sapiens
cuguccuauuauauuca

SEQ ID NO: 1688146 - RNA, 21 nt, Homo sapiens
cugugacauacauauuaucuc

SEQ ID NO: 1688147 - RNA, 13 nt, Homo sapiens
cugugagcacaaa

SEQ ID NO: 1688148 - RNA, 21 nt, Homo sapiens
cugugagccuugcaugacauc

SEQ ID NO: 1688149 - RNA, 18 nt, Homo sapiens
cugugcuccacacucaga

SEQ ID NO: 1688150 - RNA, 17 nt, Homo sapiens
cugugcuucgacuacug

SEQ ID NO: 1688151 - RNA, 14 nt, Homo sapiens
cugugucucaugga

SEQ ID NO: 1688152 - RNA, 21 nt, Homo sapiens
cuguguucgacucagccucag

SEQ ID NO: 1688153 - RNA, 16 nt, Homo sapiens
cuguguuucugcaaua

SEQ ID NO: 1688154 - RNA, 23 nt, Homo sapiens
cuguugcacuuuugaauguccaa

SEQ ID NO: 1688155 - RNA, 18 nt, Homo sapiens
cuguugcuuaaaccacuu

SEQ ID NO: 1688156 - RNA, 15 nt, Homo sapiens
cuguuuaaaguguca

SEQ ID NO: 1688157 - RNA, 19 nt, Homo sapiens
cuguuuagaugaaugucag

SEQ ID NO: 1688158 - RNA, 17 nt, Homo sapiens
cuuaaaagguacuggua

SEQ ID NO: 1688159 - RNA, 22 nt, Homo sapiens
cuuaaacgaagaguucccuuga

SEQ ID NO: 1688160 - RNA, 16 nt, Homo sapiens
cuuacaucauguguug

SEQ ID NO: 1688161 - RNA, 13 nt, Homo sapiens
cuuaccccaguca

SEQ ID NO: 1688162 - RNA, 22 nt, Homo sapiens
cuuaccccagucacuucugggg

SEQ ID NO: 1688163 - RNA, 17 nt, Homo sapiens
cuuaccuuuccugaugc

SEQ ID NO: 1688164 - RNA, 12 nt, Homo sapiens
cuuagaacaaag

SEQ ID NO: 1688165 - RNA, 22 nt, Homo sapiens
cuucaauguauugagcauguga

SEQ ID NO: 1688166 - RNA, 17 nt, Homo sapiens
cuucacaguacccaaac

SEQ ID NO: 1688167 - RNA, 19 nt, Homo sapiens
cuucaccuacauuaucuca

SEQ ID NO: 1688168 - RNA, 15 nt, Homo sapiens
cuucagauguuggua

SEQ ID NO: 1688169 - RNA, 19 nt, Homo sapiens
cuuccauagccuccaaaca

SEQ ID NO: 1688170 - RNA, 19 nt, Homo sapiens
cuuccauccaucuuuccau

SEQ ID NO: 1688171 - RNA, 23 nt, Homo sapiens
cuucccuaggaucccgucuucca

SEQ ID NO: 1688172 - RNA, 15 nt, Homo sapiens
cuuccuaauugugcc

SEQ ID NO: 1688173 - RNA, 14 nt, Homo sapiens
cuuccuccugaugg

SEQ ID NO: 1688174 - RNA, 21 nt, Homo sapiens
cuuccucucaggcucuugacu

SEQ ID NO: 1688175 - RNA, 21 nt, Homo sapiens
cuuccuucucaucuugccuca

SEQ ID NO: 1688176 - RNA, 13 nt, Homo sapiens
cuucgacuacugc

SEQ ID NO: 1688177 - RNA, 17 nt, Homo sapiens
cuucgacuacugcuccu

SEQ ID NO: 1688178 - RNA, 13 nt, Homo sapiens
cuucuaaauuccc

SEQ ID NO: 1688179 - RNA, 21 nt, Homo sapiens
cuucugccucccacuccauac

SEQ ID NO: 1688180 - RNA, 16 nt, Homo sapiens
cuucuuguacuacaca

SEQ ID NO: 1688181 - RNA, 14 nt, Homo sapiens
cuugaauuuaauac

SEQ ID NO: 1688182 - RNA, 18 nt, Homo sapiens
cuugacuaccuacuggug

SEQ ID NO: 1688183 - RNA, 18 nt, Homo sapiens
cuugcccaguacauuuaa

SEQ ID NO: 1688184 - RNA, 20 nt, Homo sapiens
cuugccuccaggaccuugcu

SEQ ID NO: 1688185 - RNA, 17 nt, Homo sapiens
cuugcuuccuucucauc

SEQ ID NO: 1688186 - RNA, 16 nt, Homo sapiens
cuuggcuucagguuag

SEQ ID NO: 1688187 - RNA, 16 nt, Homo sapiens
cuugggggucaggggg

SEQ ID NO: 1688188 - RNA, 22 nt, Homo sapiens
cuugugagagcccauucccacc

SEQ ID NO: 1688189 - RNA, 21 nt, Homo sapiens
cuuguucauaagauuaugaaa

SEQ ID NO: 1688190 - RNA, 15 nt, Homo sapiens
cuuguuccugaaaug

SEQ ID NO: 1688191 - RNA, 13 nt, Homo sapiens
cuuuaagugugcu

SEQ ID NO: 1688192 - RNA, 19 nt, Homo sapiens
cuuuagagaaguauacaua

SEQ ID NO: 1688193 - RNA, 15 nt, Homo sapiens
cuuucacccauccua

SEQ ID NO: 1688194 - RNA, 16 nt, Homo sapiens
cuuucauaaaaacacu

SEQ ID NO: 1688195 - RNA, 15 nt, Homo sapiens
cuuucccagucccau

SEQ ID NO: 1688196 - RNA, 18 nt, Homo sapiens
cuuucuaagcaaccacac

SEQ ID NO: 1688197 - RNA, 22 nt, Homo sapiens
cuuucuacaacugauugcaaca

SEQ ID NO: 1688198 - RNA, 14 nt, Homo sapiens
cuuucucucucuaa

SEQ ID NO: 1688199 - RNA, 14 nt, Homo sapiens
cuuucuuauccaac

SEQ ID NO: 1688200 - RNA, 18 nt, Homo sapiens
cuuucuuuguauuuuccu

SEQ ID NO: 1688201 - RNA, 22 nt, Homo sapiens
cuuugaauauguaguaucuaua

SEQ ID NO: 1688202 - RNA, 15 nt, Homo sapiens
cuuugacaguguuuu

SEQ ID NO: 1688203 - RNA, 20 nt, Homo sapiens
cuuugaccuaaauuauuuac

SEQ ID NO: 1688204 - RNA, 15 nt, Homo sapiens
cuuugacuuugccca

SEQ ID NO: 1688205 - RNA, 11 nt, Homo sapiens
cuuugcacuga

SEQ ID NO: 1688206 - RNA, 16 nt, Homo sapiens
cuuugcauauuauaaa

SEQ ID NO: 1688207 - RNA, 20 nt, Homo sapiens
cuuugccuucucuguucccu

SEQ ID NO: 1688208 - RNA, 15 nt, Homo sapiens
cuuuggaauggugua

SEQ ID NO: 1688209 - RNA, 21 nt, Homo sapiens
cuuuggguggcucacuacuga

SEQ ID NO: 1688210 - RNA, 12 nt, Homo sapiens
cuuuuguugccc

SEQ ID NO: 1688211 - RNA, 14 nt, Homo sapiens
gaaaaaacuuugac

SEQ ID NO: 1688212 - RNA, 15 nt, Homo sapiens
gaaaaauaaacacua

SEQ ID NO: 1688213 - RNA, 21 nt, Homo sapiens
gaaaaccacuuuauugcaaug

SEQ ID NO: 1688214 - RNA, 23 nt, Homo sapiens
gaaaacccaccccguagauuccc

SEQ ID NO: 1688215 - RNA, 22 nt, Homo sapiens
gaaaacuauaagccaauauucc

SEQ ID NO: 1688216 - RNA, 13 nt, Homo sapiens
gaaaagucuuccu

SEQ ID NO: 1688217 - RNA, 17 nt, Homo sapiens
gaaaaugaaaugcauau

SEQ ID NO: 1688218 - RNA, 10 nt, Homo sapiens
gaaaauggaa

SEQ ID NO: 1688219 - RNA, 14 nt, Homo sapiens
gaaacaacauuuau

SEQ ID NO: 1688220 - RNA, 18 nt, Homo sapiens
gaaaccaacaagaaccac

SEQ ID NO: 1688221 - RNA, 20 nt, Homo sapiens
gaaagaauagaacacaguuu

SEQ ID NO: 1688222 - RNA, 20 nt, Homo sapiens
gaaagcacaagacuggccca

SEQ ID NO: 1688223 - RNA, 18 nt, Homo sapiens
gaaagccugggugacauu

SEQ ID NO: 1688224 - RNA, 20 nt, Homo sapiens
gaaagccugggugacauuug

SEQ ID NO: 1688225 - RNA, 11 nt, Homo sapiens
gaaaggccagc

SEQ ID NO: 1688226 - RNA, 20 nt, Homo sapiens
gccaauaaagugaucugugu

SEQ ID NO: 1688227 - RNA, 21 nt, Homo sapiens
gccacagaggacucacuugcc

SEQ ID NO: 1688228 - RNA, 11 nt, Homo sapiens
gccacagccau

SEQ ID NO: 1688229 - RNA, 15 nt, Homo sapiens
gccacuggcugcuaa

SEQ ID NO: 1688230 - RNA, 20 nt, Homo sapiens
gccaggaucccccucuuugc

SEQ ID NO: 1688231 - RNA, 17 nt, Homo sapiens
gccaggggcugguggga

SEQ ID NO: 1688232 - RNA, 13 nt, Homo sapiens
gccagguccuugc

SEQ ID NO: 1688233 - RNA, 15 nt, Homo sapiens
gccagguccuugccc

SEQ ID NO: 1688234 - RNA, 15 nt, Homo sapiens
gccagucacugcugc

SEQ ID NO: 1688235 - RNA, 13 nt, Homo sapiens
gccauacugccuu

SEQ ID NO: 1688236 - RNA, 18 nt, Homo sapiens
gccauacugccuuugcag

SEQ ID NO: 1688237 - RNA, 17 nt, Homo sapiens
gccauggcaacuuagag

SEQ ID NO: 1688238 - RNA, 13 nt, Homo sapiens
gcccaaugcugcu

SEQ ID NO: 1688239 - RNA, 18 nt, Homo sapiens
gcccacaacucccuugca

SEQ ID NO: 1688240 - RNA, 12 nt, Homo sapiens
gcccagacuaca

SEQ ID NO: 1688241 - RNA, 23 nt, Homo sapiens
gcccagagagggaagaugaccug

SEQ ID NO: 1688242 - RNA, 22 nt, Homo sapiens
gcccagagcagggucucucuaa

SEQ ID NO: 1688243 - RNA, 21 nt, Homo sapiens
gcccaggcuggagugcaaugg

SEQ ID NO: 1688244 - RNA, 15 nt, Homo sapiens
gcccaguacauuuaa

SEQ ID NO: 1688245 - RNA, 22 nt, Homo sapiens
gcccuaacuccuauaaagugcc

SEQ ID NO: 1688246 - RNA, 17 nt, Homo sapiens
gcccuugucagauucac

SEQ ID NO: 1688247 - RNA, 23 nt, Homo sapiens
gccgcagagaaaugccccagugu

SEQ ID NO: 1688248 - RNA, 17 nt, Homo sapiens
gccucaguagcaucuca

SEQ ID NO: 1688249 - RNA, 13 nt, Homo sapiens
gccugacaacuca

SEQ ID NO: 1688250 - RNA, 20 nt, Homo sapiens
gccuggccaacauggugaaa

SEQ ID NO: 1688251 - RNA, 21 nt, Homo sapiens
gccugggcugugaggacaggg

SEQ ID NO: 1688252 - RNA, 19 nt, Homo sapiens
gccuguaaucucagcacuu

SEQ ID NO: 1688253 - RNA, 20 nt, Homo sapiens
gccuguaaucucagcacuuu

SEQ ID NO: 1688254 - RNA, 18 nt, Homo sapiens
gccuguguacugccuuaa

SEQ ID NO: 1688255 - RNA, 16 nt, Homo sapiens
gccuucuccacuggcc

SEQ ID NO: 1688256 - RNA, 15 nt, Homo sapiens
gccuuuguuucccau

SEQ ID NO: 1688257 - RNA, 16 nt, Homo sapiens
gcgccuguaauuccag

SEQ ID NO: 1688258 - RNA, 20 nt, Homo sapiens
gcgugcgccacuaugccuga

SEQ ID NO: 1688259 - RNA, 15 nt, Homo sapiens
gcuaacaagucacca

SEQ ID NO: 1688260 - RNA, 11 nt, Homo sapiens
gcuauggugcu

SEQ ID NO: 1688261 - RNA, 19 nt, Homo sapiens
gcuauucuaacuaaugaca

SEQ ID NO: 1688262 - RNA, 18 nt, Homo sapiens
gcucaccgcccugcuuca

SEQ ID NO: 1688263 - RNA, 20 nt, Homo sapiens
gcucagacugggcacugggg

SEQ ID NO: 1688264 - RNA, 17 nt, Homo sapiens
gcucaggagaagccagu

SEQ ID NO: 1688265 - RNA, 17 nt, Homo sapiens
gcucccacaggggccau

SEQ ID NO: 1688266 - RNA, 12 nt, Homo sapiens
gcuccugcaaaa

SEQ ID NO: 1688267 - RNA, 21 nt, Homo sapiens
gcucuauacuguggccugcag

SEQ ID NO: 1688268 - RNA, 22 nt, Homo sapiens
gcucuccaagcacuagccuucc

SEQ ID NO: 1688269 - RNA, 18 nt, Homo sapiens
gcucucuauagcaccagg

SEQ ID NO: 1688270 - RNA, 17 nt, Homo sapiens
gcucuggguugugcaca

SEQ ID NO: 1688271 - RNA, 12 nt, Homo sapiens
gcucuguggcaa

SEQ ID NO: 1688272 - RNA, 16 nt, Homo sapiens
gcucuucuuccucacc

SEQ ID NO: 1688273 - RNA, 12 nt, Homo sapiens
gcugcaacccaa

SEQ ID NO: 1688274 - RNA, 19 nt, Homo sapiens
gcuggaauucuaacaaguc

SEQ ID NO: 1688275 - RNA, 19 nt, Homo sapiens
gcugggaagacuauggugc

SEQ ID NO: 1688276 - RNA, 23 nt, Homo sapiens
gcugugaaauccauauauaugaa

SEQ ID NO: 1688277 - RNA, 21 nt, Homo sapiens
gcuguuccauuacaccacagc

SEQ ID NO: 1688278 - RNA, 17 nt, Homo sapiens
gcuuaaugcuacaugug

SEQ ID NO: 1688279 - RNA, 16 nt, Homo sapiens
gcuuacuaaugcugcc

SEQ ID NO: 1688280 - RNA, 22 nt, Homo sapiens
gcuucagccaggucugacucca

SEQ ID NO: 1688281 - RNA, 21 nt, Homo sapiens
gcuuccuucucaucuugccuc

SEQ ID NO: 1688282 - RNA, 14 nt, Homo sapiens
gcuucgacuacugc

SEQ ID NO: 1688283 - RNA, 16 nt, Homo sapiens
gcuucgggcuaugcaa

SEQ ID NO: 1688284 - RNA, 23 nt, Homo sapiens
gcuugacuuuccagaaugaccuu

SEQ ID NO: 1688285 - RNA, 16 nt, Homo sapiens
gcuugucaaugugauu

SEQ ID NO: 1688286 - RNA, 17 nt, Homo sapiens
gcuuucuuugaccucuu

SEQ ID NO: 1688287 - RNA, 17 nt, Homo sapiens
gcuuuggguggcucacu

SEQ ID NO: 1688288 - RNA, 21 nt, Homo sapiens
ggaaagcacaagacuggccca

SEQ ID NO: 1688289 - RNA, 16 nt, Homo sapiens
ggaagacaagcauuuu

SEQ ID NO: 1688290 - RNA, 20 nt, Homo sapiens
ggaauguucuuucugcucua

SEQ ID NO: 1688291 - RNA, 21 nt, Homo sapiens
ggaauugcuggaggaaccaga

SEQ ID NO: 1688292 - RNA, 20 nt, Homo sapiens
ggacaagugcuguugggaua

SEQ ID NO: 1688293 - RNA, 18 nt, Homo sapiens
ggaccaaggggugggcca

SEQ ID NO: 1688294 - RNA, 13 nt, Homo sapiens
ggacccucgagag

SEQ ID NO: 1688295 - RNA, 16 nt, Homo sapiens
ggacucucagggauuc

SEQ ID NO: 1688296 - RNA, 22 nt, Homo sapiens
ggacuugguuuguuauaucagg

SEQ ID NO: 1688297 - RNA, 15 nt, Homo sapiens
ggagaaacccagaga

SEQ ID NO: 1688298 - RNA, 16 nt, Homo sapiens
ggaggaaagcuugaag

SEQ ID NO: 1688299 - RNA, 20 nt, Homo sapiens
ggaggagcacacauccaaga

SEQ ID NO: 1688300 - RNA, 14 nt, Homo sapiens
ggaguccacuccca

SEQ ID NO: 1688301 - RNA, 21 nt, Homo sapiens
ggaugcaaauagauucagaga

SEQ ID NO: 1688302 - RNA, 22 nt, Homo sapiens
ggaugucuccgucucugucuca

SEQ ID NO: 1688303 - RNA, 16 nt, Homo sapiens
ggauuucauacuguaa

SEQ ID NO: 1688304 - RNA, 24 nt, Homo sapiens
ggcaaagaaaaugaaaugcauauu

SEQ ID NO: 1688305 - RNA, 19 nt, Homo sapiens
ggcaaaugccugacucagu

SEQ ID NO: 1688306 - RNA, 18 nt, Homo sapiens
ggcaacuuagagauugca

SEQ ID NO: 1688307 - RNA, 18 nt, Homo sapiens
ggcacucagggagcauuu

SEQ ID NO: 1688308 - RNA, 21 nt, Homo sapiens
ggcagaaccaagaacauaaac

SEQ ID NO: 1688309 - RNA, 20 nt, Homo sapiens
ggcagccucuccgacucugc

SEQ ID NO: 1688310 - RNA, 20 nt, Homo sapiens
ggcaggagaaucgcuugaac

SEQ ID NO: 1688311 - RNA, 22 nt, Homo sapiens
ggccaacauggugaaacccugu

SEQ ID NO: 1688312 - RNA, 23 nt, Homo sapiens
ggccaacauggugaaacccuguc

SEQ ID NO: 1688313 - RNA, 19 nt, Homo sapiens
ggccacgggggcaguguga

SEQ ID NO: 1688314 - RNA, 14 nt, Homo sapiens
ggccaucuucuuuc

SEQ ID NO: 1688315 - RNA, 14 nt, Homo sapiens
ggccccgucugugg

SEQ ID NO: 1688316 - RNA, 23 nt, Homo sapiens
ggcccgaggacgcucccugcucc

SEQ ID NO: 1688317 - RNA, 11 nt, Homo sapiens
ggcccugucac

SEQ ID NO: 1688318 - RNA, 20 nt, Homo sapiens
ggcccuuaccuuuccugaug

SEQ ID NO: 1688319 - RNA, 14 nt, Homo sapiens
ggccgccagcgugu

SEQ ID NO: 1688320 - RNA, 19 nt, Homo sapiens
ggccgggugggcggcacag

SEQ ID NO: 1688321 - RNA, 20 nt, Homo sapiens
ggccgguucuaaggcucaga

SEQ ID NO: 1688322 - RNA, 22 nt, Homo sapiens
ggcgaccccgucacagccucaa

SEQ ID NO: 1688323 - RNA, 19 nt, Homo sapiens
ggcuacugguuaccuggag

SEQ ID NO: 1688324 - RNA, 23 nt, Homo sapiens
ggcucuguggcaaaaagagucag

SEQ ID NO: 1688325 - RNA, 19 nt, Homo sapiens
ggcuggagugcaauggcgc

SEQ ID NO: 1688326 - RNA, 21 nt, Homo sapiens
ggcugggaagacuauggugcu

SEQ ID NO: 1688327 - RNA, 21 nt, Homo sapiens
ggcuucagguuagugacauuu

SEQ ID NO: 1688328 - RNA, 13 nt, Homo sapiens
gggaaaaggagua

SEQ ID NO: 1688329 - RNA, 22 nt, Homo sapiens
gggaaagagccuaacaucucca

SEQ ID NO: 1688330 - RNA, 23 nt, Homo sapiens
gggaaaggcagggcccugaaaug

SEQ ID NO: 1688331 - RNA, 17 nt, Homo sapiens
gggaagacuauggugcu

SEQ ID NO: 1688332 - RNA, 19 nt, Homo sapiens
gggacagcaagugagcaga

SEQ ID NO: 1688333 - RNA, 16 nt, Homo sapiens
gggacuccaagcccug

SEQ ID NO: 1688334 - RNA, 14 nt, Homo sapiens
gggcagaaccaaga

SEQ ID NO: 1688335 - RNA, 17 nt, Homo sapiens
gggcaguuccuuaccuc

SEQ ID NO: 1688336 - RNA, 17 nt, Homo sapiens
gggcgaccccgucacag

SEQ ID NO: 1688337 - RNA, 15 nt, Homo sapiens
gggcucuguggcaaa

SEQ ID NO: 1688338 - RNA, 17 nt, Homo sapiens
ggggagauugaacuuuc

SEQ ID NO: 1688339 - RNA, 22 nt, Homo sapiens
gggucccugcaaaacuccaggc

SEQ ID NO: 1688340 - RNA, 18 nt, Homo sapiens
ggguggggggugacagug

SEQ ID NO: 1688341 - RNA, 21 nt, Homo sapiens
gguaucauugucuuuccugaa

SEQ ID NO: 1688342 - RNA, 18 nt, Homo sapiens
gguccagggagggguccc

SEQ ID NO: 1688343 - RNA, 22 nt, Homo sapiens
ggucccugcaaaacuccaggca

SEQ ID NO: 1688344 - RNA, 15 nt, Homo sapiens
ggucucucagggaug

SEQ ID NO: 1688345 - RNA, 11 nt, Homo sapiens
ucaugcugcuc

SEQ ID NO: 1688346 - RNA, 20 nt, Homo sapiens
ucaugugagugggugggaug

SEQ ID NO: 1688347 - RNA, 14 nt, Homo sapiens
ucauuauguuaaua

SEQ ID NO: 1688348 - RNA, 18 nt, Homo sapiens
ucauucugaacccuccaa

SEQ ID NO: 1688349 - RNA, 19 nt, Homo sapiens
uccaagggaucugcuugau

SEQ ID NO: 1688350 - RNA, 13 nt, Homo sapiens
uccagaagcugcu

SEQ ID NO: 1688351 - RNA, 15 nt, Homo sapiens
uccagcaaccuauaa

SEQ ID NO: 1688352 - RNA, 21 nt, Homo sapiens
uccagguuauugcaauaaagu

SEQ ID NO: 1688353 - RNA, 22 nt, Homo sapiens
uccaguacuauggagugcucac

SEQ ID NO: 1688354 - RNA, 22 nt, Homo sapiens
uccaguuagagucuucaucugu

SEQ ID NO: 1688355 - RNA, 18 nt, Homo sapiens
uccaucacguuagcuguc

SEQ ID NO: 1688356 - RNA, 13 nt, Homo sapiens
uccauccauguac

SEQ ID NO: 1688357 - RNA, 16 nt, Homo sapiens
uccaucccuccauuca

SEQ ID NO: 1688358 - RNA, 17 nt, Homo sapiens
uccaucccuccauucau

SEQ ID NO: 1688359 - RNA, 13 nt, Homo sapiens
uccauccuuccaa

SEQ ID NO: 1688360 - RNA, 22 nt, Homo sapiens
uccaugcuccucaccugucuag

SEQ ID NO: 1688361 - RNA, 12 nt, Homo sapiens
uccauguugacu

SEQ ID NO: 1688362 - RNA, 16 nt, Homo sapiens
uccauuacaccacagc

SEQ ID NO: 1688363 - RNA, 13 nt, Homo sapiens
uccauuuucaagc

SEQ ID NO: 1688364 - RNA, 19 nt, Homo sapiens
ucccaaaucccucucacaa

SEQ ID NO: 1688365 - RNA, 14 nt, Homo sapiens
ucccaacccauuca

SEQ ID NO: 1688366 - RNA, 15 nt, Homo sapiens
ucccaaccccaggaa

SEQ ID NO: 1688367 - RNA, 16 nt, Homo sapiens
ucccaagguccucuca

SEQ ID NO: 1688368 - RNA, 15 nt, Homo sapiens
ucccaccuugaccaa

SEQ ID NO: 1688369 - RNA, 21 nt, Homo sapiens
ucccaggggagccagcugcuu

SEQ ID NO: 1688370 - RNA, 20 nt, Homo sapiens
ucccaucugaagaguggaaa

SEQ ID NO: 1688371 - RNA, 17 nt, Homo sapiens
uccccagucccagacaa

SEQ ID NO: 1688372 - RNA, 23 nt, Homo sapiens
uccccagugacuccagggugaca

SEQ ID NO: 1688373 - RNA, 13 nt, Homo sapiens
ucccccagcacuu

SEQ ID NO: 1688374 - RNA, 15 nt, Homo sapiens
uccccuaaaauaaca

SEQ ID NO: 1688375 - RNA, 14 nt, Homo sapiens
uccccuaaagccag

SEQ ID NO: 1688376 - RNA, 16 nt, Homo sapiens
uccccuacaccaacaa

SEQ ID NO: 1688377 - RNA, 16 nt, Homo sapiens
uccccucacacacaaa

SEQ ID NO: 1688378 - RNA, 21 nt, Homo sapiens
ucccgccccgccccucccacg

SEQ ID NO: 1688379 - RNA, 14 nt, Homo sapiens
ucccucagcucucu

SEQ ID NO: 1688380 - RNA, 17 nt, Homo sapiens
ucccucagcucucuggg

SEQ ID NO: 1688381 - RNA, 16 nt, Homo sapiens
ucccugaaguauuuaa

SEQ ID NO: 1688382 - RNA, 11 nt, Homo sapiens
ucccugcaaaa

SEQ ID NO: 1688383 - RNA, 15 nt, Homo sapiens
ucccugccucaggcc

SEQ ID NO: 1688384 - RNA, 15 nt, Homo sapiens
ucccuugcagggguc

SEQ ID NO: 1688385 - RNA, 13 nt, Homo sapiens
uccuaaagagaca

SEQ ID NO: 1688386 - RNA, 18 nt, Homo sapiens
uccuagcugugugaauac

SEQ ID NO: 1688387 - RNA, 21 nt, Homo sapiens
uccuauaaagugccucggaca

SEQ ID NO: 1688388 - RNA, 21 nt, Homo sapiens
uccucaggguggggggugaca

SEQ ID NO: 1688389 - RNA, 14 nt, Homo sapiens
uccuccuacuuaca

SEQ ID NO: 1688390 - RNA, 14 nt, Homo sapiens
uccucuagacuuga

SEQ ID NO: 1688391 - RNA, 11 nt, Homo sapiens
uccugcauguu

SEQ ID NO: 1688392 - RNA, 18 nt, Homo sapiens
uccugggacacuccgucu

SEQ ID NO: 1688393 - RNA, 23 nt, Homo sapiens
uccuguggaugcaaauagauuca

SEQ ID NO: 1688394 - RNA, 21 nt, Homo sapiens
uccuuaaaacaauucugugac

SEQ ID NO: 1688395 - RNA, 13 nt, Homo sapiens
uccuuccauccau

SEQ ID NO: 1688396 - RNA, 20 nt, Homo sapiens
uccuucccccagcacaaagc

SEQ ID NO: 1688397 - RNA, 20 nt, Homo sapiens
uccuugcccagacuacaggg

SEQ ID NO: 1688398 - RNA, 22 nt, Homo sapiens
uccuuuacaaacauacagucca

SEQ ID NO: 1688399 - RNA, 23 nt, Homo sapiens
uccuuuucccaacuccucauguc

SEQ ID NO: 1688400 - RNA, 15 nt, Homo sapiens
ucgacucagccucag

SEQ ID NO: 1688401 - RNA, 19 nt, Homo sapiens
ucgacucagccucagggac

SEQ ID NO: 1688402 - RNA, 16 nt, Homo sapiens
ucgggagccaugucau

SEQ ID NO: 1688403 - RNA, 21 nt, Homo sapiens
ucuaaaaaucaaauaagcuaa

SEQ ID NO: 1688404 - RNA, 14 nt, Homo sapiens
ucuaacaagucaua

SEQ ID NO: 1688405 - RNA, 14 nt, Homo sapiens
ucuaagugggagaa

SEQ ID NO: 1688406 - RNA, 14 nt, Homo sapiens
ucuacaacauagca

SEQ ID NO: 1688407 - RNA, 21 nt, Homo sapiens
ucuagcccaaccuacauucca

SEQ ID NO: 1688408 - RNA, 20 nt, Homo sapiens
ucuaggcccugugagcacaa

SEQ ID NO: 1688409 - RNA, 21 nt, Homo sapiens
ucuaggcccugugagcacaaa

SEQ ID NO: 1688410 - RNA, 12 nt, Homo sapiens
ucuauaucauga

SEQ ID NO: 1688411 - RNA, 14 nt, Homo sapiens
ucuauucagcauug

SEQ ID NO: 1688412 - RNA, 15 nt, Homo sapiens
ucuauuccaguauuu

SEQ ID NO: 1688413 - RNA, 17 nt, Homo sapiens
ucucaaauuuguggucc

SEQ ID NO: 1688414 - RNA, 15 nt, Homo sapiens
ucucacaagcacuuu

SEQ ID NO: 1688415 - RNA, 19 nt, Homo sapiens
ucucagaguguuuugacca

SEQ ID NO: 1688416 - RNA, 12 nt, Homo sapiens
ucucagcacuuu

SEQ ID NO: 1688417 - RNA, 13 nt, Homo sapiens
ucucagcacuuug

SEQ ID NO: 1688418 - RNA, 16 nt, Homo sapiens
ucucauccauggauuc

SEQ ID NO: 1688419 - RNA, 17 nt, Homo sapiens
ucucauuacuuauacug

SEQ ID NO: 1688420 - RNA, 21 nt, Homo sapiens
ucuccaagcacuagccuuccc

SEQ ID NO: 1688421 - RNA, 23 nt, Homo sapiens
ucuccacuggacccuugauucau

SEQ ID NO: 1688422 - RNA, 20 nt, Homo sapiens
ucuccagucauuauguuaau

SEQ ID NO: 1688423 - RNA, 16 nt, Homo sapiens
ucuccauguuggucag

SEQ ID NO: 1688424 - RNA, 13 nt, Homo sapiens
ucuccuguggucu

SEQ ID NO: 1688425 - RNA, 17 nt, Homo sapiens
ucuccuguuccauuuca

SEQ ID NO: 1688426 - RNA, 10 nt, Homo sapiens
ucuccuugaa

SEQ ID NO: 1688427 - RNA, 19 nt, Homo sapiens
ucucuccuuauagacacuu

SEQ ID NO: 1688428 - RNA, 15 nt, Homo sapiens
ucugaacauucuccu

SEQ ID NO: 1688429 - RNA, 15 nt, Homo sapiens
ucugaauuaauuaau

SEQ ID NO: 1688430 - RNA, 11 nt, Homo sapiens
ucugaguauaa

SEQ ID NO: 1688431 - RNA, 14 nt, Homo sapiens
ucugccaaacauua

SEQ ID NO: 1688432 - RNA, 14 nt, Homo sapiens
ucuggacuggaaag

SEQ ID NO: 1688433 - RNA, 19 nt, Homo sapiens
ucuggcauuccuuuuccca

SEQ ID NO: 1688434 - RNA, 22 nt, Homo sapiens
ucuggcccuaacuccuauaaag

SEQ ID NO: 1688435 - RNA, 18 nt, Homo sapiens
ucuggcuucaaaaagcca

SEQ ID NO: 1688436 - RNA, 15 nt, Homo sapiens
ucugggacccacaga

SEQ ID NO: 1688437 - RNA, 14 nt, Homo sapiens
ucugggucugaguc

SEQ ID NO: 1688438 - RNA, 21 nt, Homo sapiens
ucugguaauaaaugugacuca

SEQ ID NO: 1688439 - RNA, 22 nt, Homo sapiens
ucugguaauauugacuuguaua

SEQ ID NO: 1688440 - RNA, 14 nt, Homo sapiens
ucugugaagaaaga

SEQ ID NO: 1688441 - RNA, 19 nt, Homo sapiens
ucuuaacccccuagaaaga

SEQ ID NO: 1688442 - RNA, 14 nt, Homo sapiens
ucuuacuaaaaagu

SEQ ID NO: 1688443 - RNA, 19 nt, Homo sapiens
ucuuagcccucaccacagc

SEQ ID NO: 1688444 - RNA, 12 nt, Homo sapiens
ucuucacaggca

SEQ ID NO: 1688445 - RNA, 20 nt, Homo sapiens
ucuuccacccacaaacucca

SEQ ID NO: 1688446 - RNA, 22 nt, Homo sapiens
ucuucgguggccuugagucucu

SEQ ID NO: 1688447 - RNA, 12 nt, Homo sapiens
ucuuggugccuc

SEQ ID NO: 1688448 - RNA, 20 nt, Homo sapiens
ucuuguucauaagauuauga

SEQ ID NO: 1688449 - RNA, 17 nt, Homo sapiens
ucuuuagcuuaccuggg

SEQ ID NO: 1688450 - RNA, 13 nt, Homo sapiens
ucuuugcugccag

SEQ ID NO: 1688451 - RNA, 20 nt, Homo sapiens
ucuuugguuuuaucauucca

SEQ ID NO: 1688452 - RNA, 13 nt, Homo sapiens
ugaaaagugugua

SEQ ID NO: 1688453 - RNA, 23 nt, Homo sapiens
ugaaauauaaaaaaggugguggu

SEQ ID NO: 1688454 - RNA, 14 nt, Homo sapiens
ugaaauguguuucc

SEQ ID NO: 1688455 - RNA, 18 nt, Homo sapiens
ugaaauuugagagacaaa

SEQ ID NO: 1688456 - RNA, 20 nt, Homo sapiens
ugaaauuuuagaaauauuca

SEQ ID NO: 1688457 - RNA, 17 nt, Homo sapiens
ugaacauguucuccauu

SEQ ID NO: 1688458 - RNA, 10 nt, Homo sapiens
ugaacuuugg

SEQ ID NO: 1688459 - RNA, 14 nt, Homo sapiens
ugaaguuuuacugu

SEQ ID NO: 1688460 - RNA, 22 nt, Homo sapiens
ugaauauuuuucuguaguguga

SEQ ID NO: 1688461 - RNA, 19 nt, Homo sapiens
ugaaugccuaugguggauc

SEQ ID NO: 1688462 - RNA, 16 nt, Homo sapiens
ugaaugugcuggugaa

SEQ ID NO: 1688463 - RNA, 15 nt, Homo sapiens
ugacaccugcugaga

SEQ ID NO: 1688464 - RNA, 14 nt, Homo sapiens
ugacaggccuuccu

SEQ ID NO: 1688465 - RNA, 22 nt, Homo sapiens
ugacaggccuuccuccucucaa

SEQ ID NO: 1688466 - RNA, 12 nt, Homo sapiens
uuucugauugca

SEQ ID NO: 1688467 - RNA, 23 nt, Homo sapiens
uuucuuguaaggcauacugccuu

SEQ ID NO: 1688468 - RNA, 12 nt, Homo sapiens
uuugaagugauu

SEQ ID NO: 1688469 - RNA, 23 nt, Homo sapiens
uuugauacuaccagggucucuca

SEQ ID NO: 1688470 - RNA, 17 nt, Homo sapiens
uuugcagcugugccaua

SEQ ID NO: 1688471 - RNA, 15 nt, Homo sapiens
uuugccucauaauag

SEQ ID NO: 1688472 - RNA, 15 nt, Homo sapiens
uuugcuccagaacac

SEQ ID NO: 1688473 - RNA, 23 nt, Homo sapiens
uuugcuggggaacuggcgccauc

SEQ ID NO: 1688474 - RNA, 23 nt, Homo sapiens
uuuggaaaacagcgaacagccuu

SEQ ID NO: 1688475 - RNA, 20 nt, Homo sapiens
uuuggagcacaaaauucaaa

SEQ ID NO: 1688476 - RNA, 22 nt, Homo sapiens
uuuggauucuaaauacaugcca

SEQ ID NO: 1688477 - RNA, 20 nt, Homo sapiens
uuugggggucagcauccagu

SEQ ID NO: 1688478 - RNA, 18 nt, Homo sapiens
uuugggguaauacuucca

SEQ ID NO: 1688479 - RNA, 19 nt, Homo sapiens
uuugguuuugacagguuuu

SEQ ID NO: 1688480 - RNA, 17 nt, Homo sapiens
uuuguauaaaaguguga

SEQ ID NO: 1688481 - RNA, 19 nt, Homo sapiens
uuuguucaaguuugcugca

SEQ ID NO: 1688482 - RNA, 22 nt, Homo sapiens
uuuuauuuacagcugugcucca

SEQ ID NO: 1688483 - RNA, 15 nt, Homo sapiens
uuuucucugcauuua

SEQ ID NO: 1688484 - RNA, 23 nt, Homo sapiens
uuuuggcaaugacucaaagucug

SEQ ID NO: 1688485 - RNA, 20 nt, Homo sapiens
uuuugggggucagcauccag

SEQ ID NO: 1688486 - RNA, 23 nt, Homo sapiens
uuuuucacccauuuacacauauc

SEQ ID NO: 1688487 - RNA, 23 nt, Homo sapiens
uuuuuccugcauguucugugacu

SEQ ID NO: 1688488 - RNA, 15 nt, Homo sapiens
uuuuugaaucuauga

SEQ ID NO: 1688489 - RNA, 13 nt, Homo sapiens
uuuuugacauuua

SEQ ID NO: 1688490 - RNA, 12 nt, Homo sapiens
aaaaacaauuaa

SEQ ID NO: 1688491 - RNA, 21 nt, Homo sapiens
aaaaaugcaagccaucucuaa

SEQ ID NO: 1688492 - RNA, 15 nt, Homo sapiens
aaaaauguccagcca

SEQ ID NO: 1688493 - RNA, 21 nt, Homo sapiens
aaaaauuguaucucauuacuu

SEQ ID NO: 1688494 - RNA, 14 nt, Homo sapiens
aaaacguguaaaug

SEQ ID NO: 1688495 - RNA, 10 nt, Homo sapiens
aaaagcuuuc

SEQ ID NO: 1688496 - RNA, 11 nt, Homo sapiens
aaaaguucuca

SEQ ID NO: 1688497 - RNA, 16 nt, Homo sapiens
aaaauaaacacuacag

SEQ ID NO: 1688498 - RNA, 12 nt, Homo sapiens
aaaauaaucaug

SEQ ID NO: 1688499 - RNA, 21 nt, Homo sapiens
aaaaugcaauuggcauuaaca

SEQ ID NO: 1688500 - RNA, 13 nt, Homo sapiens
aaaauucaaagca

SEQ ID NO: 1688501 - RNA, 16 nt, Homo sapiens
aaaccaacaggcuacc

SEQ ID NO: 1688502 - RNA, 22 nt, Homo sapiens
aaaccauuuuguuauugacuaa

SEQ ID NO: 1688503 - RNA, 19 nt, Homo sapiens
aaaccugccaaggagcauc

SEQ ID NO: 1688504 - RNA, 18 nt, Homo sapiens
aaaccugggaaggccagc

SEQ ID NO: 1688505 - RNA, 21 nt, Homo sapiens
aaacgauuagugauguccuua

SEQ ID NO: 1688506 - RNA, 22 nt, Homo sapiens
aaacuucaccuacauuaucuca

SEQ ID NO: 1688507 - RNA, 10 nt, Homo sapiens
aaacuucuca

SEQ ID NO: 1688508 - RNA, 17 nt, Homo sapiens
aaacuuuguuugucaca

SEQ ID NO: 1688509 - RNA, 14 nt, Homo sapiens
aaagaauccauaaa

SEQ ID NO: 1688510 - RNA, 22 nt, Homo sapiens
aaagaauccauaaaaaguaaua

SEQ ID NO: 1688511 - RNA, 16 nt, Homo sapiens
aaagacagaagcuuaa

SEQ ID NO: 1688512 - RNA, 17 nt, Homo sapiens
aaagagaggaaccaaua

SEQ ID NO: 1688513 - RNA, 13 nt, Homo sapiens
aaagcauaaagcu

SEQ ID NO: 1688514 - RNA, 10 nt, Homo sapiens
aaagcauuuc

SEQ ID NO: 1688515 - RNA, 24 nt, Homo sapiens
aaagcuguuccuugguccuaguaa

SEQ ID NO: 1688516 - RNA, 12 nt, Homo sapiens
aaagcuucacag

SEQ ID NO: 1688517 - RNA, 12 nt, Homo sapiens
aaagcuuccuuc

SEQ ID NO: 1688518 - RNA, 14 nt, Homo sapiens
aaaggaacucuaga

SEQ ID NO: 1688519 - RNA, 16 nt, Homo sapiens
aaaggaucagagauuc

SEQ ID NO: 1688520 - RNA, 18 nt, Homo sapiens
aaagguauuauacaugug

SEQ ID NO: 1688521 - RNA, 17 nt, Homo sapiens
aaaguaaauacaugcau

SEQ ID NO: 1688522 - RNA, 16 nt, Homo sapiens
aaaguauaaaauagua

SEQ ID NO: 1688523 - RNA, 22 nt, Homo sapiens
aaagucacaggucacacgaggg

SEQ ID NO: 1688524 - RNA, 17 nt, Homo sapiens
aaagugacaaagcaauu

SEQ ID NO: 1688525 - RNA, 14 nt, Homo sapiens
aaauaaaagcacuu

SEQ ID NO: 1688526 - RNA, 16 nt, Homo sapiens
aaauacuauugccuca

SEQ ID NO: 1688527 - RNA, 16 nt, Homo sapiens
aaauacugaauuagua

SEQ ID NO: 1688528 - RNA, 16 nt, Homo sapiens
aaauaguugcauagca

SEQ ID NO: 1688529 - RNA, 18 nt, Homo sapiens
aaauauaacaucuaugaa

SEQ ID NO: 1688530 - RNA, 17 nt, Homo sapiens
aaaucuaauaauuauuc

SEQ ID NO: 1688531 - RNA, 12 nt, Homo sapiens
aaaucuauucca

SEQ ID NO: 1688532 - RNA, 17 nt, Homo sapiens
aaaugcaagccaucucu

SEQ ID NO: 1688533 - RNA, 15 nt, Homo sapiens
aaaugccugacucag

SEQ ID NO: 1688534 - RNA, 18 nt, Homo sapiens
aaauguauaaauauacag

SEQ ID NO: 1688535 - RNA, 18 nt, Homo sapiens
aaauuuaaaacuguugga

SEQ ID NO: 1688536 - RNA, 13 nt, Homo sapiens
aaauuucauagcu

SEQ ID NO: 1688537 - RNA, 14 nt, Homo sapiens
aacaauucugugac

SEQ ID NO: 1688538 - RNA, 15 nt, Homo sapiens
aacaccuauugcacu

SEQ ID NO: 1688539 - RNA, 12 nt, Homo sapiens
aacagacuugaa

SEQ ID NO: 1688540 - RNA, 13 nt, Homo sapiens
aacagacuugaau

SEQ ID NO: 1688541 - RNA, 14 nt, Homo sapiens
aacagagacugaau

SEQ ID NO: 1688542 - RNA, 14 nt, Homo sapiens
aacagagugcaacc

SEQ ID NO: 1688543 - RNA, 14 nt, Homo sapiens
aacaggcugaaauu

SEQ ID NO: 1688544 - RNA, 15 nt, Homo sapiens
aacaugggcugugau

SEQ ID NO: 1688545 - RNA, 12 nt, Homo sapiens
aacauucaggaa

SEQ ID NO: 1688546 - RNA, 23 nt, Homo sapiens
aacauuccagccacuggcugcua

SEQ ID NO: 1688547 - RNA, 14 nt, Homo sapiens
aaccaagaacauaa

SEQ ID NO: 1688548 - RNA, 16 nt, Homo sapiens
aaccacauugaagaau

SEQ ID NO: 1688549 - RNA, 23 nt, Homo sapiens
aaccuacaguuuuaacuguggau

SEQ ID NO: 1688550 - RNA, 18 nt, Homo sapiens
aaccuauaaaaaggauuc

SEQ ID NO: 1688551 - RNA, 17 nt, Homo sapiens
aaccugggaaggccagc

SEQ ID NO: 1688552 - RNA, 20 nt, Homo sapiens
aacgaagaguucccuugaaa

SEQ ID NO: 1688553 - RNA, 18 nt, Homo sapiens
aacuccuauaaagugccu

SEQ ID NO: 1688554 - RNA, 12 nt, Homo sapiens
aacugaggccca

SEQ ID NO: 1688555 - RNA, 22 nt, Homo sapiens
aacuucaccuacauuaucucac

SEQ ID NO: 1688556 - RNA, 23 nt, Homo sapiens
aacuuuuuaaagaagugcaugaa

SEQ ID NO: 1688557 - RNA, 21 nt, Homo sapiens
aagaaccacuccuucauguuu

SEQ ID NO: 1688558 - RNA, 15 nt, Homo sapiens
aagaagcauuuugca

SEQ ID NO: 1688559 - RNA, 15 nt, Homo sapiens
aagaauaauaauuaa

SEQ ID NO: 1688560 - RNA, 22 nt, Homo sapiens
aagaauguuucuggaauucuuc

SEQ ID NO: 1688561 - RNA, 14 nt, Homo sapiens
aagacuauggugcu

SEQ ID NO: 1688562 - RNA, 17 nt, Homo sapiens
aagagccuaacaucucc

SEQ ID NO: 1688563 - RNA, 22 nt, Homo sapiens
aagaguucccuugaaacuuugg

SEQ ID NO: 1688564 - RNA, 20 nt, Homo sapiens
aagaugcaucaucucuuccu

SEQ ID NO: 1688565 - RNA, 16 nt, Homo sapiens
aagaugucucugcaaa

SEQ ID NO: 1688566 - RNA, 12 nt, Homo sapiens
aagcaaccacac

SEQ ID NO: 1688567 - RNA, 18 nt, Homo sapiens
aagcaaugguugaugaua

SEQ ID NO: 1688568 - RNA, 14 nt, Homo sapiens
aagcaauuuacuga

SEQ ID NO: 1688569 - RNA, 21 nt, Homo sapiens
aagcaggcuugcccaguacau

SEQ ID NO: 1688570 - RNA, 13 nt, Homo sapiens
aagcaugugaugu

SEQ ID NO: 1688571 - RNA, 13 nt, Homo sapiens
aagccagcacuca

SEQ ID NO: 1688572 - RNA, 12 nt, Homo sapiens
aagcugcuccuu

SEQ ID NO: 1688573 - RNA, 23 nt, Homo sapiens
aagcuggaagaagugagcagugu

SEQ ID NO: 1688574 - RNA, 18 nt, Homo sapiens
aagcuguaucacugccuu

SEQ ID NO: 1688575 - RNA, 19 nt, Homo sapiens
aaggagggagcuacucuca

SEQ ID NO: 1688576 - RNA, 22 nt, Homo sapiens
aaggcagagccuuuuuaccugg

SEQ ID NO: 1688577 - RNA, 14 nt, Homo sapiens
aaggcauguacaaa

SEQ ID NO: 1688578 - RNA, 13 nt, Homo sapiens
aaggcauuucaua

SEQ ID NO: 1688579 - RNA, 18 nt, Homo sapiens
aaggcucuucuuccucac

SEQ ID NO: 1688580 - RNA, 18 nt, Homo sapiens
aagggaccccagauaccu

SEQ ID NO: 1688581 - RNA, 13 nt, Homo sapiens
aagguggccucug

SEQ ID NO: 1688582 - RNA, 21 nt, Homo sapiens
aaguaacugugagaacccagu

SEQ ID NO: 1688583 - RNA, 17 nt, Homo sapiens
aaguacuguacuuuccc

SEQ ID NO: 1688584 - RNA, 18 nt, Homo sapiens
aagucccuucaauuucua

SEQ ID NO: 1688585 - RNA, 20 nt, Homo sapiens
aagucgccagucacugcugc

SEQ ID NO: 1688586 - RNA, 20 nt, Homo sapiens
aagucuaaaugaaguuauua

SEQ ID NO: 1688587 - RNA, 23 nt, Homo sapiens
aagugagcagagauguacugcaa

SEQ ID NO: 1688588 - RNA, 16 nt, Homo sapiens
aagugcuguugggaua

SEQ ID NO: 1688589 - RNA, 21 nt, Homo sapiens
aaguuggguuuucuccauuca

SEQ ID NO: 1688590 - RNA, 18 nt, Homo sapiens
aaguuugcugcaacccaa

SEQ ID NO: 1688591 - RNA, 20 nt, Homo sapiens
aaguuugcugugcuuuggaa

SEQ ID NO: 1688592 - RNA, 14 nt, Homo sapiens
aauaaaagcacuua

SEQ ID NO: 1688593 - RNA, 15 nt, Homo sapiens
aauaaagcacaaaac

SEQ ID NO: 1688594 - RNA, 18 nt, Homo sapiens
aauaaaugugacucagca

SEQ ID NO: 1688595 - RNA, 15 nt, Homo sapiens
aauacaaacacaaaa

SEQ ID NO: 1688596 - RNA, 20 nt, Homo sapiens
aauacugccaaaacauuuau

SEQ ID NO: 1688597 - RNA, 14 nt, Homo sapiens
aauagacaaaaagu

SEQ ID NO: 1688598 - RNA, 12 nt, Homo sapiens
aauagauaugaa

SEQ ID NO: 1688599 - RNA, 14 nt, Homo sapiens
aauaguucuauaca

SEQ ID NO: 1688600 - RNA, 14 nt, Homo sapiens
aauaucaaagucau

SEQ ID NO: 1688601 - RNA, 20 nt, Homo sapiens
aauauuuuucuguaguguga

SEQ ID NO: 1688602 - RNA, 21 nt, Homo sapiens
aauauuuuucuguagugugaa

SEQ ID NO: 1688603 - RNA, 12 nt, Homo sapiens
aaucaggaaaga

SEQ ID NO: 1688604 - RNA, 20 nt, Homo sapiens
aaucauaaaggaucagagau

SEQ ID NO: 1688605 - RNA, 13 nt, Homo sapiens
aauccaguuauua

SEQ ID NO: 1688606 - RNA, 20 nt, Homo sapiens
aauccaguuauuagagaugu

SEQ ID NO: 1688607 - RNA, 23 nt, Homo sapiens
aauccaucguauuaaaaaacaau

SEQ ID NO: 1688608 - RNA, 15 nt, Homo sapiens
aauccugaagagcau

SEQ ID NO: 1688609 - RNA, 12 nt, Homo sapiens
aaucuaagugau

SEQ ID NO: 1688610 - RNA, 21 nt, Homo sapiens
aaucuagagaaggcauuucau

SEQ ID NO: 1688611 - RNA, 14 nt, Homo sapiens
aaucucagcacuuu

SEQ ID NO: 1688612 - RNA, 12 nt, Homo sapiens
aaucugaguaua

SEQ ID NO: 1688613 - RNA, 13 nt, Homo sapiens
aaugaacuuuguc

SEQ ID NO: 1688614 - RNA, 14 nt, Homo sapiens
aaugacaaguauuu

SEQ ID NO: 1688615 - RNA, 19 nt, Homo sapiens
aaugagcucugaaaucuuc

SEQ ID NO: 1688616 - RNA, 17 nt, Homo sapiens
aaugauuucacagugug

SEQ ID NO: 1688617 - RNA, 18 nt, Homo sapiens
aaugcaagccaucucuaa

SEQ ID NO: 1688618 - RNA, 21 nt, Homo sapiens
aaugcaagccaucucuaauaa

SEQ ID NO: 1688619 - RNA, 16 nt, Homo sapiens
aaugccccaguguuau

SEQ ID NO: 1688620 - RNA, 13 nt, Homo sapiens
aaugcuacaugug

SEQ ID NO: 1688621 - RNA, 10 nt, Homo sapiens
aaugcugcuu

SEQ ID NO: 1688622 - RNA, 24 nt, Homo sapiens
aaugggaauauuuuauacugacag

SEQ ID NO: 1688623 - RNA, 15 nt, Homo sapiens
aauguauuaugagcc

SEQ ID NO: 1688624 - RNA, 18 nt, Homo sapiens
aauguauugagcauguga

SEQ ID NO: 1688625 - RNA, 17 nt, Homo sapiens
aaugucagaacagagug

SEQ ID NO: 1688626 - RNA, 16 nt, Homo sapiens
aauguuaaagggauau

SEQ ID NO: 1688627 - RNA, 21 nt, Homo sapiens
aauguucuccagucauuaugu

SEQ ID NO: 1688628 - RNA, 21 nt, Homo sapiens
aauguuggagcagcaggccuc

SEQ ID NO: 1688629 - RNA, 18 nt, Homo sapiens
aauuaccaugcuucacaa

SEQ ID NO: 1688630 - RNA, 16 nt, Homo sapiens
aauuauugauguuuuc

SEQ ID NO: 1688631 - RNA, 20 nt, Homo sapiens
aauucugugacauacauauu

SEQ ID NO: 1688632 - RNA, 22 nt, Homo sapiens
aauucugugacauacauauuau

SEQ ID NO: 1688633 - RNA, 15 nt, Homo sapiens
aauugguagaaggau

SEQ ID NO: 1688634 - RNA, 20 nt, Homo sapiens
aauuguaucucauuacuuau

SEQ ID NO: 1688635 - RNA, 12 nt, Homo sapiens
aauuuaacaaga

SEQ ID NO: 1688636 - RNA, 17 nt, Homo sapiens
aauuuuuccugcauguu

SEQ ID NO: 1688637 - RNA, 13 nt, Homo sapiens
acaaaauuaagca

SEQ ID NO: 1688638 - RNA, 17 nt, Homo sapiens
acaaaauucaaagcaug

SEQ ID NO: 1688639 - RNA, 20 nt, Homo sapiens
acaaacccccacuccagcuc

SEQ ID NO: 1688640 - RNA, 21 nt, Homo sapiens
acaaagcacuggccuugccuc

SEQ ID NO: 1688641 - RNA, 16 nt, Homo sapiens
acaaauacauaaccuu

SEQ ID NO: 1688642 - RNA, 15 nt, Homo sapiens
acaaccuuccagcuc

SEQ ID NO: 1688643 - RNA, 14 nt, Homo sapiens
acaacugauugcaa

SEQ ID NO: 1688644 - RNA, 14 nt, Homo sapiens
acaacugugugauu

SEQ ID NO: 1688645 - RNA, 19 nt, Homo sapiens
acaauuccuccucuggcca

SEQ ID NO: 1688646 - RNA, 15 nt, Homo sapiens
acacaaaaaucauua

SEQ ID NO: 1688647 - RNA, 17 nt, Homo sapiens
acacacauuaugagcuu

SEQ ID NO: 1688648 - RNA, 15 nt, Homo sapiens
acacacgaugcauuu

SEQ ID NO: 1688649 - RNA, 17 nt, Homo sapiens
acacacgaugcauuuaa

SEQ ID NO: 1688650 - RNA, 23 nt, Homo sapiens
acacagaauuguuccaguacuau

SEQ ID NO: 1688651 - RNA, 14 nt, Homo sapiens
acacagcauuguau

SEQ ID NO: 1688652 - RNA, 13 nt, Homo sapiens
acaccugagacau

SEQ ID NO: 1688653 - RNA, 14 nt, Homo sapiens
acacgaugcauuua

SEQ ID NO: 1688654 - RNA, 18 nt, Homo sapiens
gcaggugcucaugcugcu

SEQ ID NO: 1688655 - RNA, 11 nt, Homo sapiens
gcagguugaga

SEQ ID NO: 1688656 - RNA, 19 nt, Homo sapiens
gcaguuggacucucaggga

SEQ ID NO: 1688657 - RNA, 16 nt, Homo sapiens
gcauccagugugagau

SEQ ID NO: 1688658 - RNA, 14 nt, Homo sapiens
gcaugugucaugaa

SEQ ID NO: 1688659 - RNA, 14 nt, Homo sapiens
gcauucacauuuag

SEQ ID NO: 1688660 - RNA, 22 nt, Homo sapiens
gcauugucaccgcaggugcuca

SEQ ID NO: 1688661 - RNA, 14 nt, Homo sapiens
gccacaaaccugcc

SEQ ID NO: 1688662 - RNA, 18 nt, Homo sapiens
gccacaccguggcagcuu

SEQ ID NO: 1688663 - RNA, 18 nt, Homo sapiens
gccacagaaggugaacuu

SEQ ID NO: 1688664 - RNA, 21 nt, Homo sapiens
gccacaucuccuguggucucu

SEQ ID NO: 1688665 - RNA, 21 nt, Homo sapiens
gccacccccaggcaucuguua

SEQ ID NO: 1688666 - RNA, 21 nt, Homo sapiens
gccagcccucgguaucugcag

SEQ ID NO: 1688667 - RNA, 14 nt, Homo sapiens
gccagcucucagga

SEQ ID NO: 1688668 - RNA, 20 nt, Homo sapiens
gccaucgccgggacuccaga

SEQ ID NO: 1688669 - RNA, 15 nt, Homo sapiens
gccauuuuugugcuu

SEQ ID NO: 1688670 - RNA, 14 nt, Homo sapiens
gcccaaaccuggga

SEQ ID NO: 1688671 - RNA, 15 nt, Homo sapiens
gcccagagcaggguc

SEQ ID NO: 1688672 - RNA, 18 nt, Homo sapiens
gcccaggcuggagugcaa

SEQ ID NO: 1688673 - RNA, 19 nt, Homo sapiens
gcccaggcuggagugcaau

SEQ ID NO: 1688674 - RNA, 20 nt, Homo sapiens
gcccaggcuggagugcaaug

SEQ ID NO: 1688675 - RNA, 20 nt, Homo sapiens
gccccgucuguggcuuucag

SEQ ID NO: 1688676 - RNA, 12 nt, Homo sapiens
gcccucugcucu

SEQ ID NO: 1688677 - RNA, 16 nt, Homo sapiens
gcccugugagcacaaa

SEQ ID NO: 1688678 - RNA, 16 nt, Homo sapiens
gccgaagcccaccacu

SEQ ID NO: 1688679 - RNA, 15 nt, Homo sapiens
gccgcagaccuggag

SEQ ID NO: 1688680 - RNA, 16 nt, Homo sapiens
gccgcagagaaaugcc

SEQ ID NO: 1688681 - RNA, 22 nt, Homo sapiens
gccuaagaagaaggccagagag

SEQ ID NO: 1688682 - RNA, 21 nt, Homo sapiens
gccucauauuguccucugcaa

SEQ ID NO: 1688683 - RNA, 17 nt, Homo sapiens
gccucccaaagugcugg

SEQ ID NO: 1688684 - RNA, 23 nt, Homo sapiens
gccuccuagaccuguucuuucca

SEQ ID NO: 1688685 - RNA, 17 nt, Homo sapiens
gccugacucagugacca

SEQ ID NO: 1688686 - RNA, 22 nt, Homo sapiens
gccuggaucucacaagcacuuu

SEQ ID NO: 1688687 - RNA, 17 nt, Homo sapiens
gccugggaauggauuag

SEQ ID NO: 1688688 - RNA, 15 nt, Homo sapiens
gccugguuggcagca

SEQ ID NO: 1688689 - RNA, 22 nt, Homo sapiens
gccuguaaucucagcacuuugg

SEQ ID NO: 1688690 - RNA, 14 nt, Homo sapiens
gccuguguacugcc

SEQ ID NO: 1688691 - RNA, 18 nt, Homo sapiens
gccuuacuucaaagugcc

SEQ ID NO: 1688692 - RNA, 19 nt, Homo sapiens
gccuucugauaguauuccu

SEQ ID NO: 1688693 - RNA, 20 nt, Homo sapiens
gccuuguacagucugcuccu

SEQ ID NO: 1688694 - RNA, 18 nt, Homo sapiens
gcuacuauguacugccuu

SEQ ID NO: 1688695 - RNA, 17 nt, Homo sapiens
gcuacuguaaugcugcc

SEQ ID NO: 1688696 - RNA, 22 nt, Homo sapiens
gcuaggcgcuggggagacugau

SEQ ID NO: 1688697 - RNA, 12 nt, Homo sapiens
gcuagugccuuu

SEQ ID NO: 1688698 - RNA, 23 nt, Homo sapiens
gcuauuuuuaauuuccugugagg

SEQ ID NO: 1688699 - RNA, 12 nt, Homo sapiens
gcucccauuccu

SEQ ID NO: 1688700 - RNA, 16 nt, Homo sapiens
gcuccccuaaagccag

SEQ ID NO: 1688701 - RNA, 12 nt, Homo sapiens
gcucuagggccu

SEQ ID NO: 1688702 - RNA, 20 nt, Homo sapiens
gcucuuaugugugccuuugu

SEQ ID NO: 1688703 - RNA, 19 nt, Homo sapiens
gcugauaccauaugaauga

SEQ ID NO: 1688704 - RNA, 17 nt, Homo sapiens
gcugaucguuucuucca

SEQ ID NO: 1688705 - RNA, 21 nt, Homo sapiens
gcugaugccuguguacugccu

SEQ ID NO: 1688706 - RNA, 16 nt, Homo sapiens
gcugccucaggaccca

SEQ ID NO: 1688707 - RNA, 19 nt, Homo sapiens
gcugcuccccuaaagccag

SEQ ID NO: 1688708 - RNA, 15 nt, Homo sapiens
gcuggcuggguucca

SEQ ID NO: 1688709 - RNA, 22 nt, Homo sapiens
gcuggucucaaacuccugaccu

SEQ ID NO: 1688710 - RNA, 17 nt, Homo sapiens
gcuggugaacacuguga

SEQ ID NO: 1688711 - RNA, 16 nt, Homo sapiens
gcuguacuaacccagu

SEQ ID NO: 1688712 - RNA, 19 nt, Homo sapiens
gcugucacucugugccuuu

SEQ ID NO: 1688713 - RNA, 23 nt, Homo sapiens
gcuguggccgucuccucccucag

SEQ ID NO: 1688714 - RNA, 16 nt, Homo sapiens
gcuuaaaaucugugaa

SEQ ID NO: 1688715 - RNA, 13 nt, Homo sapiens
gcuucacaguacc

SEQ ID NO: 1688716 - RNA, 22 nt, Homo sapiens
gcuucagguuagugacauuuaa

SEQ ID NO: 1688717 - RNA, 15 nt, Homo sapiens
gcuugcaagauucca

SEQ ID NO: 1688718 - RNA, 16 nt, Homo sapiens
gcuugcaagauuccaa

SEQ ID NO: 1688719 - RNA, 15 nt, Homo sapiens
gcuuuguugugagaa

SEQ ID NO: 1688720 - RNA, 16 nt, Homo sapiens
gcuuuguugugagaau

SEQ ID NO: 1688721 - RNA, 22 nt, Homo sapiens
ggaaagagccuaacaucuccau

SEQ ID NO: 1688722 - RNA, 19 nt, Homo sapiens
ggaaugugcauucucugag

SEQ ID NO: 1688723 - RNA, 13 nt, Homo sapiens
ggaauguucuuuc

SEQ ID NO: 1688724 - RNA, 18 nt, Homo sapiens
ggaccccagauaccugug

SEQ ID NO: 1688725 - RNA, 21 nt, Homo sapiens
ggacccuucuggguccaggga

SEQ ID NO: 1688726 - RNA, 15 nt, Homo sapiens
ggacgggaugaccuc

SEQ ID NO: 1688727 - RNA, 17 nt, Homo sapiens
ggacuaaaugaucucug

SEQ ID NO: 1688728 - RNA, 20 nt, Homo sapiens
ggacugcauggggaggcagc

SEQ ID NO: 1688729 - RNA, 18 nt, Homo sapiens
ggagaagccagugucuag

SEQ ID NO: 1688730 - RNA, 15 nt, Homo sapiens
ggagauugaacuuuc

SEQ ID NO: 1688731 - RNA, 13 nt, Homo sapiens
ggagcaggaccua

SEQ ID NO: 1688732 - RNA, 18 nt, Homo sapiens
ggagcccuauugcugcua

SEQ ID NO: 1688733 - RNA, 14 nt, Homo sapiens
ggagccugcaacau

SEQ ID NO: 1688734 - RNA, 18 nt, Homo sapiens
ggagcugcucucucauga

SEQ ID NO: 1688735 - RNA, 22 nt, Homo sapiens
ggaggcuuuggguggcucacua

SEQ ID NO: 1688736 - RNA, 21 nt, Homo sapiens
ggagguuacagugagccaaga

SEQ ID NO: 1688737 - RNA, 12 nt, Homo sapiens
ggaguccacucc

SEQ ID NO: 1688738 - RNA, 18 nt, Homo sapiens
ggagugucggauccugug

SEQ ID NO: 1688739 - RNA, 20 nt, Homo sapiens
ggagugucggauccugugag

SEQ ID NO: 1688740 - RNA, 20 nt, Homo sapiens
ggauauuuugaaaugaacuu

SEQ ID NO: 1688741 - RNA, 22 nt, Homo sapiens
ggauauuuugaaaugaacuuug

SEQ ID NO: 1688742 - RNA, 11 nt, Homo sapiens
ggaucagagau

SEQ ID NO: 1688743 - RNA, 16 nt, Homo sapiens
ggauccucaguucuca

SEQ ID NO: 1688744 - RNA, 17 nt, Homo sapiens
ggaucucacaagcacuu

SEQ ID NO: 1688745 - RNA, 14 nt, Homo sapiens
ggauuuuucuuuaa

SEQ ID NO: 1688746 - RNA, 17 nt, Homo sapiens
ggcaaaugccugacuca

SEQ ID NO: 1688747 - RNA, 18 nt, Homo sapiens
ggcaccguauuccucucc

SEQ ID NO: 1688748 - RNA, 14 nt, Homo sapiens
ggcagcaggccaga

SEQ ID NO: 1688749 - RNA, 16 nt, Homo sapiens
ggcagcuagugccuuu

SEQ ID NO: 1688750 - RNA, 15 nt, Homo sapiens
ggcaggaacggugga

SEQ ID NO: 1688751 - RNA, 19 nt, Homo sapiens
ggcaggguucuccaagggc

SEQ ID NO: 1688752 - RNA, 20 nt, Homo sapiens
ggcauucuuugcaauacugc

SEQ ID NO: 1688753 - RNA, 21 nt, Homo sapiens
ggccacagaaggugaacuuug

SEQ ID NO: 1688754 - RNA, 22 nt, Homo sapiens
ggccacccccuauccucugagu

SEQ ID NO: 1688755 - RNA, 17 nt, Homo sapiens
ggccacgggggcagugu

SEQ ID NO: 1688756 - RNA, 18 nt, Homo sapiens
ggccagucaggcugcaga

SEQ ID NO: 1688757 - RNA, 23 nt, Homo sapiens
ggccagucaggcugcagaggcac

SEQ ID NO: 1688758 - RNA, 14 nt, Homo sapiens
ggccauacugccuu

SEQ ID NO: 1688759 - RNA, 23 nt, Homo sapiens
ggcccauucagagcuauggugcu

SEQ ID NO: 1688760 - RNA, 14 nt, Homo sapiens
ggccccaucuccac

SEQ ID NO: 1688761 - RNA, 15 nt, Homo sapiens
ggcccccuucaggag

SEQ ID NO: 1688762 - RNA, 19 nt, Homo sapiens
ggccccugcgugggggcca

SEQ ID NO: 1688763 - RNA, 22 nt, Homo sapiens
ggccgccagcguguggagcaga

SEQ ID NO: 1688764 - RNA, 16 nt, Homo sapiens
ggccuagaaagggcaa

SEQ ID NO: 1688765 - RNA, 21 nt, Homo sapiens
ggccuccagaagcugcuccuu

SEQ ID NO: 1688766 - RNA, 20 nt, Homo sapiens
ggcgaccccgucacagccuc

SEQ ID NO: 1688767 - RNA, 14 nt, Homo sapiens
ggcgugugugacac

SEQ ID NO: 1688768 - RNA, 23 nt, Homo sapiens
ggcuaauuuaacaagaacuuuaa

SEQ ID NO: 1688769 - RNA, 18 nt, Homo sapiens
ggcuacuguaaugcugcc

SEQ ID NO: 1688770 - RNA, 17 nt, Homo sapiens
ggcucacgccuguaauu

SEQ ID NO: 1688771 - RNA, 22 nt, Homo sapiens
ggcuccucuaggcccugugagc

SEQ ID NO: 1688772 - RNA, 16 nt, Homo sapiens
ggcucuugacuacuug

SEQ ID NO: 1688773 - RNA, 20 nt, Homo sapiens
ucaaagcagcaggacugugg

SEQ ID NO: 1688774 - RNA, 20 nt, Homo sapiens
ucaaauaagcuaauauacag

SEQ ID NO: 1688775 - RNA, 17 nt, Homo sapiens
ucaaauacacauuugcu

SEQ ID NO: 1688776 - RNA, 18 nt, Homo sapiens
ucaaauacacauuugcua

SEQ ID NO: 1688777 - RNA, 23 nt, Homo sapiens
ucaaauuauuuccaagagagauu

SEQ ID NO: 1688778 - RNA, 22 nt, Homo sapiens
ucaacugagguucuugggauac

SEQ ID NO: 1688779 - RNA, 13 nt, Homo sapiens
ucaagaagaggaa

SEQ ID NO: 1688780 - RNA, 19 nt, Homo sapiens
ucaagaagaggaaagggag

SEQ ID NO: 1688781 - RNA, 22 nt, Homo sapiens
ucaagcaauucuccugccuuag

SEQ ID NO: 1688782 - RNA, 23 nt, Homo sapiens
ucaagggucagggugagacguga

SEQ ID NO: 1688783 - RNA, 17 nt, Homo sapiens
ucaagguugguucaaca

SEQ ID NO: 1688784 - RNA, 22 nt, Homo sapiens
ucaaguucuggaccugggcaug

SEQ ID NO: 1688785 - RNA, 22 nt, Homo sapiens
ucaauuuuaucccucaccugua

SEQ ID NO: 1688786 - RNA, 14 nt, Homo sapiens
ucacaaauacauaa

SEQ ID NO: 1688787 - RNA, 22 nt, Homo sapiens
ucacaagaaaacuauaagccaa

SEQ ID NO: 1688788 - RNA, 13 nt, Homo sapiens
ucacaagcacuuu

SEQ ID NO: 1688789 - RNA, 18 nt, Homo sapiens
ucacagccucaagucacu

SEQ ID NO: 1688790 - RNA, 21 nt, Homo sapiens
ucacaucuauccacacuguca

SEQ ID NO: 1688791 - RNA, 10 nt, Homo sapiens
ucaccacugu

SEQ ID NO: 1688792 - RNA, 16 nt, Homo sapiens
ucaccuacauuaucuc

SEQ ID NO: 1688793 - RNA, 13 nt, Homo sapiens
ucaccuucuaguu

SEQ ID NO: 1688794 - RNA, 19 nt, Homo sapiens
ucacugcccccuccguccc

SEQ ID NO: 1688795 - RNA, 22 nt, Homo sapiens
ucacugcugcaaauacuguaua

SEQ ID NO: 1688796 - RNA, 14 nt, Homo sapiens
ucacuguacugcau

SEQ ID NO: 1688797 - RNA, 19 nt, Homo sapiens
ucagacagcaggaagccau

SEQ ID NO: 1688798 - RNA, 16 nt, Homo sapiens
ucagcauccaguguga

SEQ ID NO: 1688799 - RNA, 20 nt, Homo sapiens
ucagcugggucacauccauc

SEQ ID NO: 1688800 - RNA, 16 nt, Homo sapiens
ucagcugugccuuccc

SEQ ID NO: 1688801 - RNA, 12 nt, Homo sapiens
ucaggacucucu

SEQ ID NO: 1688802 - RNA, 17 nt, Homo sapiens
ucaggaguugaagacca

SEQ ID NO: 1688803 - RNA, 17 nt, Homo sapiens
ucagggaaaaggaguag

SEQ ID NO: 1688804 - RNA, 15 nt, Homo sapiens
ucagggagcauuuaa

SEQ ID NO: 1688805 - RNA, 21 nt, Homo sapiens
ucagguuuguuuugugaauuu

SEQ ID NO: 1688806 - RNA, 20 nt, Homo sapiens
ucagugaccagugccuguga

SEQ ID NO: 1688807 - RNA, 16 nt, Homo sapiens
ucaguuccaaacagac

SEQ ID NO: 1688808 - RNA, 23 nt, Homo sapiens
ucaguuccaaacagacaaaacag

SEQ ID NO: 1688809 - RNA, 23 nt, Homo sapiens
ucaguuuuuguauggaagccacc

SEQ ID NO: 1688810 - RNA, 16 nt, Homo sapiens
ucauaauucagcacuu

SEQ ID NO: 1688811 - RNA, 17 nt, Homo sapiens
ucauaauucagcacuua

SEQ ID NO: 1688812 - RNA, 18 nt, Homo sapiens
ucauacuaaacuucaccu

SEQ ID NO: 1688813 - RNA, 17 nt, Homo sapiens
ucaucauauguauaugu

SEQ ID NO: 1688814 - RNA, 19 nt, Homo sapiens
ucauccauccugagccaaa

SEQ ID NO: 1688815 - RNA, 23 nt, Homo sapiens
ucauccuuaaaacaauucuguga

SEQ ID NO: 1688816 - RNA, 17 nt, Homo sapiens
ucauccuuccauccauc

SEQ ID NO: 1688817 - RNA, 18 nt, Homo sapiens
ucaugaggccggaugaaa

SEQ ID NO: 1688818 - RNA, 21 nt, Homo sapiens
ucaugaguagugggcuaugca

SEQ ID NO: 1688819 - RNA, 14 nt, Homo sapiens
ucaugccugaugaa

SEQ ID NO: 1688820 - RNA, 23 nt, Homo sapiens
ucaugcugcuccccuaaagccag

SEQ ID NO: 1688821 - RNA, 19 nt, Homo sapiens
ucauggugauagacugaag

SEQ ID NO: 1688822 - RNA, 17 nt, Homo sapiens
ucaugucccagaacuua

SEQ ID NO: 1688823 - RNA, 22 nt, Homo sapiens
ucauuaguccuuugucuaagua

SEQ ID NO: 1688824 - RNA, 21 nt, Homo sapiens
ucauucuuuuugaaaugucaa

SEQ ID NO: 1688825 - RNA, 14 nt, Homo sapiens
ucauuuugcacuga

SEQ ID NO: 1688826 - RNA, 18 nt, Homo sapiens
uccaaaacucuuucauaa

SEQ ID NO: 1688827 - RNA, 14 nt, Homo sapiens
uccacccuguuacu

SEQ ID NO: 1688828 - RNA, 22 nt, Homo sapiens
uccagggcagcaggccagagaa

SEQ ID NO: 1688829 - RNA, 18 nt, Homo sapiens
uccagggugacaaggccu

SEQ ID NO: 1688830 - RNA, 14 nt, Homo sapiens
uccaguacuaugga

SEQ ID NO: 1688831 - RNA, 20 nt, Homo sapiens
uccauccaucuuuccaucca

SEQ ID NO: 1688832 - RNA, 14 nt, Homo sapiens
uccaucucccuuag

SEQ ID NO: 1688833 - RNA, 17 nt, Homo sapiens
uccauggaagaaacaca

SEQ ID NO: 1688834 - RNA, 21 nt, Homo sapiens
ucccaacccauucacuacagg

SEQ ID NO: 1688835 - RNA, 20 nt, Homo sapiens
ucccacaacuacuaguguga

SEQ ID NO: 1688836 - RNA, 22 nt, Homo sapiens
ucccacaacuacuagugugacu

SEQ ID NO: 1688837 - RNA, 20 nt, Homo sapiens
ucccacucccggccugucau

SEQ ID NO: 1688838 - RNA, 16 nt, Homo sapiens
ucccagucugugaagu

SEQ ID NO: 1688839 - RNA, 18 nt, Homo sapiens
ucccauaaacacugaauu

SEQ ID NO: 1688840 - RNA, 23 nt, Homo sapiens
ucccaugcuuuguaggugucuca

SEQ ID NO: 1688841 - RNA, 13 nt, Homo sapiens
uccccagucccag

SEQ ID NO: 1688842 - RNA, 16 nt, Homo sapiens
uccccagucccagaca

SEQ ID NO: 1688843 - RNA, 20 nt, Homo sapiens
ucccuccauucauccuucca

SEQ ID NO: 1688844 - RNA, 13 nt, Homo sapiens
ucccugccuggag

SEQ ID NO: 1688845 - RNA, 14 nt, Homo sapiens
ucccuggggucacc

SEQ ID NO: 1688846 - RNA, 17 nt, Homo sapiens
uccgcuagcaguacuaa

SEQ ID NO: 1688847 - RNA, 23 nt, Homo sapiens
uccggcgggugacagcuccggga

SEQ ID NO: 1688848 - RNA, 21 nt, Homo sapiens
uccggggagaaacccagagau

SEQ ID NO: 1688849 - RNA, 18 nt, Homo sapiens
uccuaaucaaauucuguc

SEQ ID NO: 1688850 - RNA, 13 nt, Homo sapiens
uccuaauucaauc

SEQ ID NO: 1688851 - RNA, 16 nt, Homo sapiens
uccuacucacacuuca

SEQ ID NO: 1688852 - RNA, 17 nt, Homo sapiens
uccuagcugugugaaua

SEQ ID NO: 1688853 - RNA, 14 nt, Homo sapiens
uccuccuugcccag

SEQ ID NO: 1688854 - RNA, 19 nt, Homo sapiens
uccugauggagugugcaga

SEQ ID NO: 1688855 - RNA, 22 nt, Homo sapiens
uccugcaaagucuccagaagaa

SEQ ID NO: 1688856 - RNA, 18 nt, Homo sapiens
uccugcuuaaucuucaaa

SEQ ID NO: 1688857 - RNA, 20 nt, Homo sapiens
uccuguggucucugaccagg

SEQ ID NO: 1688858 - RNA, 19 nt, Homo sapiens
uccuuaggcuacuguaaug

SEQ ID NO: 1688859 - RNA, 15 nt, Homo sapiens
uccuuauuaauacaa

SEQ ID NO: 1688860 - RNA, 15 nt, Homo sapiens
uccuuccauccaucu

SEQ ID NO: 1688861 - RNA, 18 nt, Homo sapiens
uccuucugaaguguuuca

SEQ ID NO: 1688862 - RNA, 20 nt, Homo sapiens
uccuuuauacacaguggauu

SEQ ID NO: 1688863 - RNA, 20 nt, Homo sapiens
uccuuucuuuuaaugaugcc

SEQ ID NO: 1688864 - RNA, 23 nt, Homo sapiens
ucggggagcguucuaaauaugaa

SEQ ID NO: 1688865 - RNA, 17 nt, Homo sapiens
ucuaaauacaugccaca

SEQ ID NO: 1688866 - RNA, 14 nt, Homo sapiens
ucuaacuuggggaa

SEQ ID NO: 1688867 - RNA, 12 nt, Homo sapiens
ucuaagugauau

SEQ ID NO: 1688868 - RNA, 14 nt, Homo sapiens
ucuaagugcugcug

SEQ ID NO: 1688869 - RNA, 15 nt, Homo sapiens
ucuaauaauuauuca

SEQ ID NO: 1688870 - RNA, 14 nt, Homo sapiens
ucuaaugugucucu

SEQ ID NO: 1688871 - RNA, 15 nt, Homo sapiens
ucuaauuacauuuca

SEQ ID NO: 1688872 - RNA, 20 nt, Homo sapiens
ucuagagcuuaaugcuacau

SEQ ID NO: 1688873 - RNA, 12 nt, Homo sapiens
ucuauacugugg

SEQ ID NO: 1688874 - RNA, 15 nt, Homo sapiens
ucuauccacacuguc

SEQ ID NO: 1688875 - RNA, 11 nt, Homo sapiens
ucuauguuaau

SEQ ID NO: 1688876 - RNA, 12 nt, Homo sapiens
ucuauguucccc

SEQ ID NO: 1688877 - RNA, 18 nt, Homo sapiens
ucuauuguuuguugcacu

SEQ ID NO: 1688878 - RNA, 14 nt, Homo sapiens
ucucaaaccuggca

SEQ ID NO: 1688879 - RNA, 14 nt, Homo sapiens
ucucauuauucaca

SEQ ID NO: 1688880 - RNA, 15 nt, Homo sapiens
ucucauuauucacag

SEQ ID NO: 1688881 - RNA, 13 nt, Homo sapiens
ucuccauucagga

SEQ ID NO: 1688882 - RNA, 16 nt, Homo sapiens
ucucccauaaacacug

SEQ ID NO: 1688883 - RNA, 22 nt, Homo sapiens
ucucccuuggguaaaaugaagg

SEQ ID NO: 1688884 - RNA, 12 nt, Homo sapiens
ucuccucagggu

SEQ ID NO: 1688885 - RNA, 18 nt, Homo sapiens
ucucuaaaggggacuuga

SEQ ID NO: 1688886 - RNA, 17 nt, Homo sapiens
ucucuacuaaaaguaca

SEQ ID NO: 1688887 - RNA, 13 nt, Homo sapiens
ucucugaaagugu

SEQ ID NO: 1688888 - RNA, 13 nt, Homo sapiens
ucucugguaauau

SEQ ID NO: 1688889 - RNA, 18 nt, Homo sapiens
ucucuuuacuugaaauuu

SEQ ID NO: 1688890 - RNA, 19 nt, Homo sapiens
ucugaauccuuuuaaucua

SEQ ID NO: 1688891 - RNA, 13 nt, Homo sapiens
ucugcaggccacu

SEQ ID NO: 1688892 - RNA, 18 nt, Homo sapiens
ucugccaaucuguacaaa

SEQ ID NO: 1688893 - RNA, 21 nt, Homo sapiens
uuguuucccaucagacuguca

SEQ ID NO: 1688894 - RNA, 16 nt, Homo sapiens
uuguuucccccucuuu

SEQ ID NO: 1688895 - RNA, 18 nt, Homo sapiens
uuuaaaagucucacaaag

SEQ ID NO: 1688896 - RNA, 17 nt, Homo sapiens
uuuaaagaagugcauga

SEQ ID NO: 1688897 - RNA, 17 nt, Homo sapiens
uuuaaagccauucugau

SEQ ID NO: 1688898 - RNA, 17 nt, Homo sapiens
uuuaauaaagcacaaaa

SEQ ID NO: 1688899 - RNA, 15 nt, Homo sapiens
uuuacacaaagggaa

SEQ ID NO: 1688900 - RNA, 11 nt, Homo sapiens
uuuacaguguu

SEQ ID NO: 1688901 - RNA, 14 nt, Homo sapiens
uuuagagaaguaua

SEQ ID NO: 1688902 - RNA, 15 nt, Homo sapiens
uuuagaugaauguca

SEQ ID NO: 1688903 - RNA, 15 nt, Homo sapiens
uuuagucaugugacc

SEQ ID NO: 1688904 - RNA, 16 nt, Homo sapiens
uuuauaaaaguguuca

SEQ ID NO: 1688905 - RNA, 14 nt, Homo sapiens
uuuauaauacccuu

SEQ ID NO: 1688906 - RNA, 21 nt, Homo sapiens
uuuauaauacuacuacuguua

SEQ ID NO: 1688907 - RNA, 16 nt, Homo sapiens
uuucacccauuuacac

SEQ ID NO: 1688908 - RNA, 18 nt, Homo sapiens
uuucacccauuuacacau

SEQ ID NO: 1688909 - RNA, 19 nt, Homo sapiens
uuucccaucagacugucaa

SEQ ID NO: 1688910 - RNA, 19 nt, Homo sapiens
uuucuagcucugacagccu

SEQ ID NO: 1688911 - RNA, 18 nt, Homo sapiens
uuucucucacacuuuugc

SEQ ID NO: 1688912 - RNA, 23 nt, Homo sapiens
uuucuuccacccacaaacuccag

SEQ ID NO: 1688913 - RNA, 18 nt, Homo sapiens
uuugaagguagaauguuu

SEQ ID NO: 1688914 - RNA, 19 nt, Homo sapiens
uuugacuuugcccaggcau

SEQ ID NO: 1688915 - RNA, 15 nt, Homo sapiens
uuugaggucuagaga

SEQ ID NO: 1688916 - RNA, 15 nt, Homo sapiens
uuugcaugcaugcaa

SEQ ID NO: 1688917 - RNA, 21 nt, Homo sapiens
uuuggcacuugccauuccaaa

SEQ ID NO: 1688918 - RNA, 22 nt, Homo sapiens
uuugggagcccaugggggagcu

SEQ ID NO: 1688919 - RNA, 21 nt, Homo sapiens
uuuguuugccaggacaugcaa

SEQ ID NO: 1688920 - RNA, 23 nt, Homo sapiens
uuuuacagaagugaaagugaggu

SEQ ID NO: 1688921 - RNA, 23 nt, Homo sapiens
uuuucgaacaccaaaaaugaugc

SEQ ID NO: 1688922 - RNA, 16 nt, Homo sapiens
uuuucuucuugggaua

SEQ ID NO: 1688923 - RNA, 14 nt, Homo sapiens
uuuugcaugcaugc

SEQ ID NO: 1688924 - RNA, 15 nt, Homo sapiens
uugguuguacuuugg

SEQ ID NO: 1688925 - RNA, 16 nt, Homo sapiens
uuguauggaagccacc

SEQ ID NO: 1688926 - RNA, 15 nt, Homo sapiens
uugucuaccuucuuu

SEQ ID NO: 1688927 - RNA, 15 nt, Homo sapiens
uugucuuauugcacc

SEQ ID NO: 1688928 - RNA, 20 nt, Homo sapiens
uugugaguuuaccuuguaua

SEQ ID NO: 1688929 - RNA, 18 nt, Homo sapiens
uuguucaaguuugcugca

SEQ ID NO: 1688930 - RNA, 12 nt, Homo sapiens
uuguugugagaa

SEQ ID NO: 1688931 - RNA, 17 nt, Homo sapiens
uuguuugccaggacaug

SEQ ID NO: 1688932 - RNA, 12 nt, Homo sapiens
uuguuuugugaa

SEQ ID NO: 1688933 - RNA, 19 nt, Homo sapiens
uuuaaaaaauugacuaccu

SEQ ID NO: 1688934 - RNA, 14 nt, Homo sapiens
uuuaacaccagaaa

SEQ ID NO: 1688935 - RNA, 19 nt, Homo sapiens
uuuaacuuaagggagaaaa

SEQ ID NO: 1688936 - RNA, 20 nt, Homo sapiens
uuuaagccgcagaccuggag

SEQ ID NO: 1688937 - RNA, 14 nt, Homo sapiens
uuuaauaccagaua

SEQ ID NO: 1688938 - RNA, 19 nt, Homo sapiens
uuuacaagggcauaaagua

SEQ ID NO: 1688939 - RNA, 17 nt, Homo sapiens
uuuagacaagacugucu

SEQ ID NO: 1688940 - RNA, 16 nt, Homo sapiens
uuuagaugccugugaa

SEQ ID NO: 1688941 - RNA, 19 nt, Homo sapiens
uuuagcaucuuccuugaua

SEQ ID NO: 1688942 - RNA, 14 nt, Homo sapiens
uuuauaaacagaaa

SEQ ID NO: 1688943 - RNA, 19 nt, Homo sapiens
uuuauaacauuuugagaaa

SEQ ID NO: 1688944 - RNA, 19 nt, Homo sapiens
uuuauauguauauaacaaa

SEQ ID NO: 1688945 - RNA, 21 nt, Homo sapiens
uuuauauuuuuuuaacuguga

SEQ ID NO: 1688946 - RNA, 21 nt, Homo sapiens
uuuauuccccagugacuccag

SEQ ID NO: 1688947 - RNA, 13 nt, Homo sapiens
uuuauuucaucuc

SEQ ID NO: 1688948 - RNA, 22 nt, Homo sapiens
uuucaaaagguauuauacaugu

SEQ ID NO: 1688949 - RNA, 20 nt, Homo sapiens
uuucauacuguaacauucag

SEQ ID NO: 1688950 - RNA, 11 nt, Homo sapiens
uuuccagucag

SEQ ID NO: 1688951 - RNA, 21 nt, Homo sapiens
uuucccagucccauuccucag

SEQ ID NO: 1688952 - RNA, 15 nt, Homo sapiens
uuuccccagucccag

SEQ ID NO: 1688953 - RNA, 18 nt, Homo sapiens
uuucuauauuccuccagc

SEQ ID NO: 1688954 - RNA, 18 nt, Homo sapiens
uuucuauuuuuaugauga

SEQ ID NO: 1688955 - RNA, 20 nt, Homo sapiens
uuucuauuuuuaugaugaca

SEQ ID NO: 1688956 - RNA, 21 nt, Homo sapiens
uuucucugcaggccacuuacc

SEQ ID NO: 1688957 - RNA, 14 nt, Homo sapiens
uuucuguaguguga

SEQ ID NO: 1688958 - RNA, 20 nt, Homo sapiens
uuucuuccaguuagagucuu

SEQ ID NO: 1688959 - RNA, 20 nt, Homo sapiens
uuugauauaccaaauuaaaa

SEQ ID NO: 1688960 - RNA, 17 nt, Homo sapiens
uuugcucaacagaacau

SEQ ID NO: 1688961 - RNA, 15 nt, Homo sapiens
uuuggaauauuaaaa

SEQ ID NO: 1688962 - RNA, 18 nt, Homo sapiens
uuuggagauagauggaua

SEQ ID NO: 1688963 - RNA, 15 nt, Homo sapiens
uuuggcgaaucucaa

SEQ ID NO: 1688964 - RNA, 11 nt, Homo sapiens
uuugggagaca

SEQ ID NO: 1688965 - RNA, 19 nt, Homo sapiens
uuugucuaaguagggccag

SEQ ID NO: 1688966 - RNA, 14 nt, Homo sapiens
uuugugucccugaa

SEQ ID NO: 1688967 - RNA, 21 nt, Homo sapiens
uuuuaauaacuuaucuauaaa

SEQ ID NO: 1688968 - RNA, 15 nt, Homo sapiens
uuuuaauuuacuugu

SEQ ID NO: 1688969 - RNA, 12 nt, Homo sapiens
uuuuagcuguga

SEQ ID NO: 1688970 - RNA, 19 nt, Homo sapiens
uuuucucaguguugguaua

SEQ ID NO: 1688971 - RNA, 15 nt, Homo sapiens
uuuucuguaguguga

SEQ ID NO: 1688972 - RNA, 14 nt, Homo sapiens
uuuugaaaugucaa

SEQ ID NO: 1688973 - RNA, 20 nt, Homo sapiens
uuuugaagauucuauguuaa

SEQ ID NO: 1688974 - RNA, 21 nt, Homo sapiens
uuuugggggucagcauccagu

SEQ ID NO: 1688975 - RNA, 23 nt, Homo sapiens
cauguguagagccccuacugugg

SEQ ID NO: 1688976 - RNA, 15 nt, Homo sapiens
cauguucccaaaaca

SEQ ID NO: 1688977 - RNA, 19 nt, Homo sapiens
cauuaaggggaagaaugaa

SEQ ID NO: 1688978 - RNA, 23 nt, Homo sapiens
cauuaaggggaagaaugaaagcu

SEQ ID NO: 1688979 - RNA, 20 nt, Homo sapiens
cauucaggauucuguuccuu

SEQ ID NO: 1688980 - RNA, 14 nt, Homo sapiens
cauucauccuucca

SEQ ID NO: 1688981 - RNA, 13 nt, Homo sapiens
cauuccuuuuccc

SEQ ID NO: 1688982 - RNA, 14 nt, Homo sapiens
cauucuauucucca

SEQ ID NO: 1688983 - RNA, 20 nt, Homo sapiens
cauucuuugcaauacugcuu

SEQ ID NO: 1688984 - RNA, 22 nt, Homo sapiens
cauugaagaauguuagaguaau

SEQ ID NO: 1688985 - RNA, 15 nt, Homo sapiens
cauugcacauaagcu

SEQ ID NO: 1688986 - RNA, 17 nt, Homo sapiens
cauuggcaaagugacaa

SEQ ID NO: 1688987 - RNA, 21 nt, Homo sapiens
cauugucaccgcaggugcuca

SEQ ID NO: 1688988 - RNA, 19 nt, Homo sapiens
cauuguuucguaacacagc

SEQ ID NO: 1688989 - RNA, 17 nt, Homo sapiens
cauuuagucaugugacc

SEQ ID NO: 1688990 - RNA, 15 nt, Homo sapiens
cauuuauauauugaa

SEQ ID NO: 1688991 - RNA, 16 nt, Homo sapiens
cauuucucauguugaa

SEQ ID NO: 1688992 - RNA, 13 nt, Homo sapiens
cauuugaacaugu

SEQ ID NO: 1688993 - RNA, 18 nt, Homo sapiens
cauuugauaaaauccaaa

SEQ ID NO: 1688994 - RNA, 14 nt, Homo sapiens
cauuuuacacaaag

SEQ ID NO: 1688995 - RNA, 15 nt, Homo sapiens
cauuuugacacaaaa

SEQ ID NO: 1688996 - RNA, 17 nt, Homo sapiens
cauuuugcuucccaucu

SEQ ID NO: 1688997 - RNA, 22 nt, Homo sapiens
ccaaacccaucuuuuguucucc

SEQ ID NO: 1688998 - RNA, 19 nt, Homo sapiens
ccaaacugauccaguauaa

SEQ ID NO: 1688999 - RNA, 22 nt, Homo sapiens
ccaaagcccacucacccuuuga

SEQ ID NO: 1689000 - RNA, 14 nt, Homo sapiens
ccaaaugcagggag

SEQ ID NO: 1689001 - RNA, 15 nt, Homo sapiens
ccaaaugcagggagg

SEQ ID NO: 1689002 - RNA, 13 nt, Homo sapiens
ccaagaacauaaa

SEQ ID NO: 1689003 - RNA, 17 nt, Homo sapiens
ccaagagggacuccaag

SEQ ID NO: 1689004 - RNA, 14 nt, Homo sapiens
ccaagcuggcacaa

SEQ ID NO: 1689005 - RNA, 22 nt, Homo sapiens
ccaaggaaucagcaggaugugu

SEQ ID NO: 1689006 - RNA, 22 nt, Homo sapiens
ccaaggcugagacagugaauuu

SEQ ID NO: 1689007 - RNA, 20 nt, Homo sapiens
ccaagggggcugcugcuccu

SEQ ID NO: 1689008 - RNA, 21 nt, Homo sapiens
ccaaguaacauuuugugguga

SEQ ID NO: 1689009 - RNA, 17 nt, Homo sapiens
ccaaucacccuguaaua

SEQ ID NO: 1689010 - RNA, 15 nt, Homo sapiens
ccaaucuguacaaaa

SEQ ID NO: 1689011 - RNA, 14 nt, Homo sapiens
ccaaucuuuccuac

SEQ ID NO: 1689012 - RNA, 18 nt, Homo sapiens
ugggagacaugugacauu

SEQ ID NO: 1689013 - RNA, 16 nt, Homo sapiens
ugggcggcacagccuu

SEQ ID NO: 1689014 - RNA, 13 nt, Homo sapiens
uggggccucaggc

SEQ ID NO: 1689015 - RNA, 15 nt, Homo sapiens
ugggggaacugugaa

SEQ ID NO: 1689016 - RNA, 16 nt, Homo sapiens
ugggggcuucucugcu

SEQ ID NO: 1689017 - RNA, 15 nt, Homo sapiens
ugggguaauacuucc

SEQ ID NO: 1689018 - RNA, 18 nt, Homo sapiens
ugggguaguuguguuuca

SEQ ID NO: 1689019 - RNA, 13 nt, Homo sapiens
ugggugacauuug

SEQ ID NO: 1689020 - RNA, 18 nt, Homo sapiens
ugguaaauucacaaauac

SEQ ID NO: 1689021 - RNA, 20 nt, Homo sapiens
ugguaauaaaugugacucag

SEQ ID NO: 1689022 - RNA, 23 nt, Homo sapiens
uggucaagggcugucauugcaca

SEQ ID NO: 1689023 - RNA, 18 nt, Homo sapiens
uggucaggcuggucucaa

SEQ ID NO: 1689024 - RNA, 14 nt, Homo sapiens
uggucaugugaguc

SEQ ID NO: 1689025 - RNA, 18 nt, Homo sapiens
uggucuguuugcauuuga

SEQ ID NO: 1689026 - RNA, 17 nt, Homo sapiens
uggugaaugugugagaa

SEQ ID NO: 1689027 - RNA, 12 nt, Homo sapiens
ugguggugguga

SEQ ID NO: 1689028 - RNA, 12 nt, Homo sapiens
ugguuuugacag

SEQ ID NO: 1689029 - RNA, 17 nt, Homo sapiens
uguaaucucagcacuuu

SEQ ID NO: 1689030 - RNA, 13 nt, Homo sapiens
uguaauuccagcu

SEQ ID NO: 1689031 - RNA, 19 nt, Homo sapiens
uguacacagaauuguucca

SEQ ID NO: 1689032 - RNA, 13 nt, Homo sapiens
uguacugccuuaa

SEQ ID NO: 1689033 - RNA, 22 nt, Homo sapiens
uguagagccaauuagacuugaa

SEQ ID NO: 1689034 - RNA, 21 nt, Homo sapiens
uguagucccggaggccuuccc

SEQ ID NO: 1689035 - RNA, 14 nt, Homo sapiens
uguauuaugagcca

SEQ ID NO: 1689036 - RNA, 18 nt, Homo sapiens
ugucaccccucacuguga

SEQ ID NO: 1689037 - RNA, 14 nt, Homo sapiens
uguccagagucucu

SEQ ID NO: 1689038 - RNA, 18 nt, Homo sapiens
ugucuuauuacagcauuu

SEQ ID NO: 1689039 - RNA, 13 nt, Homo sapiens
ugucuucuuuaug

SEQ ID NO: 1689040 - RNA, 15 nt, Homo sapiens
ugugacucagcauca

SEQ ID NO: 1689041 - RNA, 23 nt, Homo sapiens
ugugacuccuuaucucuuuccac

SEQ ID NO: 1689042 - RNA, 20 nt, Homo sapiens
ugugauauauaaguguacau

SEQ ID NO: 1689043 - RNA, 23 nt, Homo sapiens
ugugauugaaggugauaagggaa

SEQ ID NO: 1689044 - RNA, 22 nt, Homo sapiens
ugugcuucaaggacauugguga

SEQ ID NO: 1689045 - RNA, 13 nt, Homo sapiens
uguguacugccuu

SEQ ID NO: 1689046 - RNA, 21 nt, Homo sapiens
uguguuuauauggaagaaagu

SEQ ID NO: 1689047 - RNA, 14 nt, Homo sapiens
uguuauaucaggga

SEQ ID NO: 1689048 - RNA, 13 nt, Homo sapiens
uguucaacaucua

SEQ ID NO: 1689049 - RNA, 17 nt, Homo sapiens
uguucaaguuugcugca

SEQ ID NO: 1689050 - RNA, 21 nt, Homo sapiens
uguuccaguacuauggagugc

SEQ ID NO: 1689051 - RNA, 21 nt, Homo sapiens
uguucgacucagccucaggga

SEQ ID NO: 1689052 - RNA, 22 nt, Homo sapiens
uguucuccuuuggaauggugua

SEQ ID NO: 1689053 - RNA, 12 nt, Homo sapiens
uguugacugugu

SEQ ID NO: 1689054 - RNA, 20 nt, Homo sapiens
uguugcccaggcuggagugc

SEQ ID NO: 1689055 - RNA, 20 nt, Homo sapiens
uguuguaucaaagugugaua

SEQ ID NO: 1689056 - RNA, 19 nt, Homo sapiens
uuaaaacaauucugugaca

SEQ ID NO: 1689057 - RNA, 15 nt, Homo sapiens
uuaaaauuuuguaug

SEQ ID NO: 1689058 - RNA, 17 nt, Homo sapiens
uuaaauuuaauaccaga

SEQ ID NO: 1689059 - RNA, 19 nt, Homo sapiens
uuaacccuauuuuaccuag

SEQ ID NO: 1689060 - RNA, 18 nt, Homo sapiens
uuaagaaucaagauauaa

SEQ ID NO: 1689061 - RNA, 15 nt, Homo sapiens
uuaagcaugugaugu

SEQ ID NO: 1689062 - RNA, 22 nt, Homo sapiens
uuaaucuagagaaggcauuuca

SEQ ID NO: 1689063 - RNA, 20 nt, Homo sapiens
uuacaauaggaguggugauu

SEQ ID NO: 1689064 - RNA, 16 nt, Homo sapiens
uuaccccagucacuuc

SEQ ID NO: 1689065 - RNA, 15 nt, Homo sapiens
uuaccuccauccauc

SEQ ID NO: 1689066 - RNA, 14 nt, Homo sapiens
uuaccuuguauacu

SEQ ID NO: 1689067 - RNA, 16 nt, Homo sapiens
uuacuaucauaauuca

SEQ ID NO: 1689068 - RNA, 21 nt, Homo sapiens
uuacuugggcuucaacagcca

SEQ ID NO: 1689069 - RNA, 13 nt, Homo sapiens
uuagcaaacugaa

SEQ ID NO: 1689070 - RNA, 15 nt, Homo sapiens
auuccuuuucccaac

SEQ ID NO: 1689071 - RNA, 17 nt, Homo sapiens
auucuauuauacuacaa

SEQ ID NO: 1689072 - RNA, 16 nt, Homo sapiens
auucuccugccuuagc

SEQ ID NO: 1689073 - RNA, 21 nt, Homo sapiens
auucuguccccaaauguccau

SEQ ID NO: 1689074 - RNA, 22 nt, Homo sapiens
auucuuccuaaugucagaacag

SEQ ID NO: 1689075 - RNA, 23 nt, Homo sapiens
auugaccauuuuuuaauuuacuu

SEQ ID NO: 1689076 - RNA, 21 nt, Homo sapiens
auugaguuccaguugaaguua

SEQ ID NO: 1689077 - RNA, 17 nt, Homo sapiens
auugauggguuaauuaa

SEQ ID NO: 1689078 - RNA, 15 nt, Homo sapiens
auugcaacagacugu

SEQ ID NO: 1689079 - RNA, 15 nt, Homo sapiens
auugcauacuuugua

SEQ ID NO: 1689080 - RNA, 23 nt, Homo sapiens
auugcauuuuuauuaaagcauuu

SEQ ID NO: 1689081 - RNA, 20 nt, Homo sapiens
auugcuuacaagccuaagaa

SEQ ID NO: 1689082 - RNA, 22 nt, Homo sapiens
auugggcacagccuagggucuu

SEQ ID NO: 1689083 - RNA, 18 nt, Homo sapiens
auuguuccaguacuaugg

SEQ ID NO: 1689084 - RNA, 20 nt, Homo sapiens
auuguuccaguacuauggag

SEQ ID NO: 1689085 - RNA, 21 nt, Homo sapiens
auuguuuagaugaggcucaga

SEQ ID NO: 1689086 - RNA, 15 nt, Homo sapiens
auuuaauaaagauga

SEQ ID NO: 1689087 - RNA, 19 nt, Homo sapiens
auuuaauacagacaucuaa

SEQ ID NO: 1689088 - RNA, 23 nt, Homo sapiens
auuuagcaucuuccuugauaaua

SEQ ID NO: 1689089 - RNA, 21 nt, Homo sapiens
auuuauuccccagugacucca

SEQ ID NO: 1689090 - RNA, 21 nt, Homo sapiens
auuuauugaaaugauuucaca

SEQ ID NO: 1689091 - RNA, 20 nt, Homo sapiens
auuucacuaggacucagaaa

SEQ ID NO: 1689092 - RNA, 14 nt, Homo sapiens
auuucauacuguaa

SEQ ID NO: 1689093 - RNA, 15 nt, Homo sapiens
auuucauacuguaac

SEQ ID NO: 1689094 - RNA, 19 nt, Homo sapiens
auuucuaguaccugugacu

SEQ ID NO: 1689095 - RNA, 18 nt, Homo sapiens
auuucuauauuccuccag

SEQ ID NO: 1689096 - RNA, 11 nt, Homo sapiens
auuucuuugca

SEQ ID NO: 1689097 - RNA, 21 nt, Homo sapiens
auuugauacauuuuuguacua

SEQ ID NO: 1689098 - RNA, 17 nt, Homo sapiens
auuugugggcaagcaga

SEQ ID NO: 1689099 - RNA, 21 nt, Homo sapiens
auuugugguccacugagcuau

SEQ ID NO: 1689100 - RNA, 23 nt, Homo sapiens
auuuucccagucugugaagucaa

SEQ ID NO: 1689101 - RNA, 17 nt, Homo sapiens
auuuugcacugaggaua

SEQ ID NO: 1689102 - RNA, 17 nt, Homo sapiens
auuuugggccuguuccu

SEQ ID NO: 1689103 - RNA, 17 nt, Homo sapiens
auuuuuccugcauguuc

SEQ ID NO: 1689104 - RNA, 18 nt, Homo sapiens
auuuuuuugcaugcaugc

SEQ ID NO: 1689105 - RNA, 14 nt, Homo sapiens
caaaacucuuucau

SEQ ID NO: 1689106 - RNA, 18 nt, Homo sapiens
caaaaguguugacugugu

SEQ ID NO: 1689107 - RNA, 21 nt, Homo sapiens
caaaauauauuuuguuuacaa

SEQ ID NO: 1689108 - RNA, 18 nt, Homo sapiens
caaacacaaaaaucauua

SEQ ID NO: 1689109 - RNA, 15 nt, Homo sapiens
caaacuccugaccuc

SEQ ID NO: 1689110 - RNA, 16 nt, Homo sapiens
caaagacuuugaucca

SEQ ID NO: 1689111 - RNA, 18 nt, Homo sapiens
caaagcauggacauuuag

SEQ ID NO: 1689112 - RNA, 20 nt, Homo sapiens
caaagcccacucacccuuug

SEQ ID NO: 1689113 - RNA, 21 nt, Homo sapiens
caaagucgccagucacugcug

SEQ ID NO: 1689114 - RNA, 15 nt, Homo sapiens
caaauacacauuugc

SEQ ID NO: 1689115 - RNA, 16 nt, Homo sapiens
caaauacacauuugcu

SEQ ID NO: 1689116 - RNA, 16 nt, Homo sapiens
caaaugccugacucag

SEQ ID NO: 1689117 - RNA, 16 nt, Homo sapiens
caaauucaccuucccc

SEQ ID NO: 1689118 - RNA, 19 nt, Homo sapiens
caaauuugugguccacuga

SEQ ID NO: 1689119 - RNA, 15 nt, Homo sapiens
caacaccacuaggaa

SEQ ID NO: 1689120 - RNA, 18 nt, Homo sapiens
caacauggugaaacccug

SEQ ID NO: 1689121 - RNA, 16 nt, Homo sapiens
caaccucaggcuccua

SEQ ID NO: 1689122 - RNA, 13 nt, Homo sapiens
caaccucuuugcu

SEQ ID NO: 1689123 - RNA, 22 nt, Homo sapiens
caacugaccugaccccauuccu

SEQ ID NO: 1689124 - RNA, 12 nt, Homo sapiens
caacugauugca

SEQ ID NO: 1689125 - RNA, 18 nt, Homo sapiens
caagaagaggaaagggag

SEQ ID NO: 1689126 - RNA, 19 nt, Homo sapiens
caagaguaagcaguguuac

SEQ ID NO: 1689127 - RNA, 22 nt, Homo sapiens
caagaguacagaagcuuuagca

SEQ ID NO: 1689128 - RNA, 22 nt, Homo sapiens
caagauuggucucccauaugca

SEQ ID NO: 1689129 - RNA, 17 nt, Homo sapiens
caagcacuagccuuccc

SEQ ID NO: 1689130 - RNA, 18 nt, Homo sapiens
caaggagcauccuuggca

SEQ ID NO: 1689131 - RNA, 14 nt, Homo sapiens
caaggugugauggu

SEQ ID NO: 1689132 - RNA, 14 nt, Homo sapiens
caaguaaguaugaa

SEQ ID NO: 1689133 - RNA, 22 nt, Homo sapiens
caagucccuuugugacuucaag

SEQ ID NO: 1689134 - RNA, 21 nt, Homo sapiens
caaguggugagcaagcaccaa

SEQ ID NO: 1689135 - RNA, 15 nt, Homo sapiens
caaguucucaccucu

SEQ ID NO: 1689136 - RNA, 16 nt, Homo sapiens
caauaaagugaucugu

SEQ ID NO: 1689137 - RNA, 18 nt, Homo sapiens
caauaaauguugcaaugc

SEQ ID NO: 1689138 - RNA, 22 nt, Homo sapiens
caauaggugagagaauguauuu

SEQ ID NO: 1689139 - RNA, 21 nt, Homo sapiens
caauauuccuuauuaauacaa

SEQ ID NO: 1689140 - RNA, 19 nt, Homo sapiens
caaucuuuccuacuuucua

SEQ ID NO: 1689141 - RNA, 17 nt, Homo sapiens
caaugagaucauuguga

SEQ ID NO: 1689142 - RNA, 18 nt, Homo sapiens
caauggcgcgaucuuggc

SEQ ID NO: 1689143 - RNA, 19 nt, Homo sapiens
caauguauugagcauguga

SEQ ID NO: 1689144 - RNA, 18 nt, Homo sapiens
caaugucucuuugugcuc

SEQ ID NO: 1689145 - RNA, 15 nt, Homo sapiens
caauuagacuugaaa

SEQ ID NO: 1689146 - RNA, 20 nt, Homo sapiens
caauucugugacauacauau

SEQ ID NO: 1689147 - RNA, 17 nt, Homo sapiens
cacaaacccccacucca

SEQ ID NO: 1689148 - RNA, 11 nt, Homo sapiens
cacaaagggaa

SEQ ID NO: 1689149 - RNA, 16 nt, Homo sapiens
cacaaccuuccagcuc

SEQ ID NO: 1689150 - RNA, 19 nt, Homo sapiens
cacaaccuuccagcuccau

SEQ ID NO: 1689151 - RNA, 21 nt, Homo sapiens
cacaagacuggcccagugcca

SEQ ID NO: 1689152 - RNA, 14 nt, Homo sapiens
cacaagguuuuaua

SEQ ID NO: 1689153 - RNA, 22 nt, Homo sapiens
cacaagugguguuuauugcaau

SEQ ID NO: 1689154 - RNA, 14 nt, Homo sapiens
cacacgaugcauuu

SEQ ID NO: 1689155 - RNA, 19 nt, Homo sapiens
cacacuggaggagcacaca

SEQ ID NO: 1689156 - RNA, 15 nt, Homo sapiens
cacacuuugcacuga

SEQ ID NO: 1689157 - RNA, 17 nt, Homo sapiens
cacagaaggugaacuuu

SEQ ID NO: 1689158 - RNA, 18 nt, Homo sapiens
cacaggcacauuaacugu

SEQ ID NO: 1689159 - RNA, 18 nt, Homo sapiens
cacaggggaugguuucac

SEQ ID NO: 1689160 - RNA, 18 nt, Homo sapiens
cacaguaauuauguucua

SEQ ID NO: 1689161 - RNA, 12 nt, Homo sapiens
cacaugacucuc

SEQ ID NO: 1689162 - RNA, 17 nt, Homo sapiens
cacauguguaugauacu

SEQ ID NO: 1689163 - RNA, 20 nt, Homo sapiens
cacauuuagaaaagugaauu

SEQ ID NO: 1689164 - RNA, 23 nt, Homo sapiens
caccauacuccuugcuuccugau

SEQ ID NO: 1689165 - RNA, 17 nt, Homo sapiens
cacccuccaugcuccuc

SEQ ID NO: 1689166 - RNA, 14 nt, Homo sapiens
cacgaugcauuuaa

SEQ ID NO: 1689167 - RNA, 20 nt, Homo sapiens
cacgaugcauuuaauaaaga

SEQ ID NO: 1689168 - RNA, 18 nt, Homo sapiens
cacggcuuguaaauguga

SEQ ID NO: 1689169 - RNA, 13 nt, Homo sapiens
cacucaauccauc

SEQ ID NO: 1689170 - RNA, 22 nt, Homo sapiens
cacugaaaaaucuaagugauau

SEQ ID NO: 1689171 - RNA, 20 nt, Homo sapiens
cacugggaugccucuugcag

SEQ ID NO: 1689172 - RNA, 21 nt, Homo sapiens
cacuucaaggcucaaugcuau

SEQ ID NO: 1689173 - RNA, 23 nt, Homo sapiens
cacuuggggguaaaggucugugg

SEQ ID NO: 1689174 - RNA, 20 nt, Homo sapiens
cacuuucaagaaucagacag

SEQ ID NO: 1689175 - RNA, 22 nt, Homo sapiens
cagaaaaaaauaaauguucuaa

SEQ ID NO: 1689176 - RNA, 21 nt, Homo sapiens
cagaacagagugcaacccagu

SEQ ID NO: 1689177 - RNA, 19 nt, Homo sapiens
cagaacuucagcauuguaa

SEQ ID NO: 1689178 - RNA, 14 nt, Homo sapiens
cagaagaaaucaua

SEQ ID NO: 1689179 - RNA, 20 nt, Homo sapiens
cagaagccuccccagcucac

SEQ ID NO: 1689180 - RNA, 15 nt, Homo sapiens
cagaagcugcuccuu

SEQ ID NO: 1689181 - RNA, 14 nt, Homo sapiens
cagaagucccuuca

SEQ ID NO: 1689182 - RNA, 16 nt, Homo sapiens
cagaauauucucccau

SEQ ID NO: 1689183 - RNA, 19 nt, Homo sapiens
cagaauuguuccaguacua

SEQ ID NO: 1689184 - RNA, 16 nt, Homo sapiens
cagaauuuuccauuua

SEQ ID NO: 1689185 - RNA, 16 nt, Homo sapiens
cagaauuuuuaacugu

SEQ ID NO: 1689186 - RNA, 20 nt, Homo sapiens
cagacacuaacgaaauauca

SEQ ID NO: 1689187 - RNA, 21 nt, Homo sapiens
cagagaaaauaaaagcacuua

SEQ ID NO: 1689188 - RNA, 17 nt, Homo sapiens
cagagacacuguugaua

SEQ ID NO: 1689189 - RNA, 13 nt, Homo sapiens
aaaaaaaagggaa

SEQ ID NO: 1689190 - RNA, 13 nt, Homo sapiens
aaaaaaacuucca

SEQ ID NO: 1689191 - RNA, 11 nt, Homo sapiens
aaaaaaagaga

SEQ ID NO: 1689192 - RNA, 14 nt, Homo sapiens
aaaaaauuaugaca

SEQ ID NO: 1689193 - RNA, 15 nt, Homo sapiens
aaaaacaggucuuca

SEQ ID NO: 1689194 - RNA, 21 nt, Homo sapiens
aaaaacauagaaaaauucagc

SEQ ID NO: 1689195 - RNA, 17 nt, Homo sapiens
aaaaacguaucuccuaa

SEQ ID NO: 1689196 - RNA, 18 nt, Homo sapiens
aaaaacugcuuacuuaug

SEQ ID NO: 1689197 - RNA, 12 nt, Homo sapiens
aaaaagcuucca

SEQ ID NO: 1689198 - RNA, 13 nt, Homo sapiens
caccaaaguucua

SEQ ID NO: 1689199 - RNA, 18 nt, Homo sapiens
caccaacaacgcuuguga

SEQ ID NO: 1689200 - RNA, 14 nt, Homo sapiens
caccacagacacac

SEQ ID NO: 1689201 - RNA, 20 nt, Homo sapiens
caccacugcuuaagugccua

SEQ ID NO: 1689202 - RNA, 14 nt, Homo sapiens
caccacugggcaaa

SEQ ID NO: 1689203 - RNA, 16 nt, Homo sapiens
caccagaauugugcaa

SEQ ID NO: 1689204 - RNA, 17 nt, Homo sapiens
caccagagcaaccucuc

SEQ ID NO: 1689205 - RNA, 14 nt, Homo sapiens
caccaguaccugaa

SEQ ID NO: 1689206 - RNA, 22 nt, Homo sapiens
caccaguaccugaaagcacugu

SEQ ID NO: 1689207 - RNA, 16 nt, Homo sapiens
caccagugcgugcucc

SEQ ID NO: 1689208 - RNA, 16 nt, Homo sapiens
cacccacauaccuggc

SEQ ID NO: 1689209 - RNA, 20 nt, Homo sapiens
cacccaggcuggagugcagu

SEQ ID NO: 1689210 - RNA, 20 nt, Homo sapiens
cacccaguuugauaccugca

SEQ ID NO: 1689211 - RNA, 15 nt, Homo sapiens
caccccuaaagagau

SEQ ID NO: 1689212 - RNA, 21 nt, Homo sapiens
cacccgugagcgccugugcac

SEQ ID NO: 1689213 - RNA, 22 nt, Homo sapiens
cacccgugagcgccugugcaca

SEQ ID NO: 1689214 - RNA, 18 nt, Homo sapiens
cacccuccaccucuucac

SEQ ID NO: 1689215 - RNA, 17 nt, Homo sapiens
cacccuccuugcaggau

SEQ ID NO: 1689216 - RNA, 20 nt, Homo sapiens
cacccuguagguucuugaua

SEQ ID NO: 1689217 - RNA, 15 nt, Homo sapiens
cacccuuucuugaca

SEQ ID NO: 1689218 - RNA, 22 nt, Homo sapiens
caccuaccaucagggacaggau

SEQ ID NO: 1689219 - RNA, 16 nt, Homo sapiens
caccuaccgaguucaa

SEQ ID NO: 1689220 - RNA, 16 nt, Homo sapiens
caccuagacuguaaac

SEQ ID NO: 1689221 - RNA, 12 nt, Homo sapiens
caccuaugugcc

SEQ ID NO: 1689222 - RNA, 13 nt, Homo sapiens
caccucaccagaa

SEQ ID NO: 1689223 - RNA, 20 nt, Homo sapiens
caccuccucauguacauacc

SEQ ID NO: 1689224 - RNA, 21 nt, Homo sapiens
caccugccuccucguuccuuu

SEQ ID NO: 1689225 - RNA, 22 nt, Homo sapiens
caccugccugcaucugugaaaa

SEQ ID NO: 1689226 - RNA, 17 nt, Homo sapiens
caccuuaagauuuugca

SEQ ID NO: 1689227 - RNA, 18 nt, Homo sapiens
caccuuaagauuuugcac

SEQ ID NO: 1689228 - RNA, 14 nt, Homo sapiens
caccuugacagggc

SEQ ID NO: 1689229 - RNA, 15 nt, Homo sapiens
caccuugugaucaug

SEQ ID NO: 1689230 - RNA, 21 nt, Homo sapiens
cacgaaacuuguuauugugaa

SEQ ID NO: 1689231 - RNA, 20 nt, Homo sapiens
cacgaaagaaauguaccuuc

SEQ ID NO: 1689232 - RNA, 16 nt, Homo sapiens
cacgcuggagugcagu

SEQ ID NO: 1689233 - RNA, 19 nt, Homo sapiens
cacgcuguuuguuucauau

SEQ ID NO: 1689234 - RNA, 20 nt, Homo sapiens
cacggccacauuugguucua

SEQ ID NO: 1689235 - RNA, 16 nt, Homo sapiens
cacgguagugccugaa

SEQ ID NO: 1689236 - RNA, 19 nt, Homo sapiens
cacgguuuggaaauauuca

SEQ ID NO: 1689237 - RNA, 19 nt, Homo sapiens
cacgugucuuccacuuugc

SEQ ID NO: 1689238 - RNA, 17 nt, Homo sapiens
cacuaaagccagccuga

SEQ ID NO: 1689239 - RNA, 11 nt, Homo sapiens
cacuaauuccu

SEQ ID NO: 1689240 - RNA, 22 nt, Homo sapiens
cacuaauuugauguuuacaggu

SEQ ID NO: 1689241 - RNA, 15 nt, Homo sapiens
cacuacauucauuua

SEQ ID NO: 1689242 - RNA, 16 nt, Homo sapiens
cacuaccguaaauguc

SEQ ID NO: 1689243 - RNA, 21 nt, Homo sapiens
cacuacugggugucauuucau

SEQ ID NO: 1689244 - RNA, 19 nt, Homo sapiens
aggcaugagccacugcacu

SEQ ID NO: 1689245 - RNA, 16 nt, Homo sapiens
aggcaugguggcucau

SEQ ID NO: 1689246 - RNA, 18 nt, Homo sapiens
aggccacagcugccaucg

SEQ ID NO: 1689247 - RNA, 20 nt, Homo sapiens
aggccagagggagugacaga

SEQ ID NO: 1689248 - RNA, 14 nt, Homo sapiens
aggccagugugucu

SEQ ID NO: 1689249 - RNA, 17 nt, Homo sapiens
aggccagugugucucug

SEQ ID NO: 1689250 - RNA, 21 nt, Homo sapiens
aggccauggcagaauaaucuu

SEQ ID NO: 1689251 - RNA, 17 nt, Homo sapiens
aggcccacaggaggcaa

SEQ ID NO: 1689252 - RNA, 21 nt, Homo sapiens
aggcccugagcuuuguccuga

SEQ ID NO: 1689253 - RNA, 19 nt, Homo sapiens
aggcccugcuccugcagca

SEQ ID NO: 1689254 - RNA, 23 nt, Homo sapiens
aggcccuuccucuccacugccuu

SEQ ID NO: 1689255 - RNA, 21 nt, Homo sapiens
aggccgauuugggaaccaagc

SEQ ID NO: 1689256 - RNA, 16 nt, Homo sapiens
aggccuaggauucuaa

SEQ ID NO: 1689257 - RNA, 14 nt, Homo sapiens
aggccugugccuug

SEQ ID NO: 1689258 - RNA, 21 nt, Homo sapiens
aggcgccccuucccccuccaa

SEQ ID NO: 1689259 - RNA, 17 nt, Homo sapiens
aggcgccgcacuuccuu

SEQ ID NO: 1689260 - RNA, 20 nt, Homo sapiens
aggcgggagcaucucuugag

SEQ ID NO: 1689261 - RNA, 17 nt, Homo sapiens
aggcuaguccggaccca

SEQ ID NO: 1689262 - RNA, 23 nt, Homo sapiens
aggcuaguccggacccaccucac

SEQ ID NO: 1689263 - RNA, 17 nt, Homo sapiens
aggcucagagaugugca

SEQ ID NO: 1689264 - RNA, 16 nt, Homo sapiens
aggcucauggacgaga

SEQ ID NO: 1689265 - RNA, 14 nt, Homo sapiens
aggcugguggcaag

SEQ ID NO: 1689266 - RNA, 20 nt, Homo sapiens
aggcuguguauuuacaugaa

SEQ ID NO: 1689267 - RNA, 15 nt, Homo sapiens
aggcuucaucaaggu

SEQ ID NO: 1689268 - RNA, 15 nt, Homo sapiens
aggcuuuacagugua

SEQ ID NO: 1689269 - RNA, 21 nt, Homo sapiens
aggcuuuguacagagugcuuu

SEQ ID NO: 1689270 - RNA, 14 nt, Homo sapiens
agggaacaguauuu

SEQ ID NO: 1689271 - RNA, 20 nt, Homo sapiens
agggaaguaguccuuggcau

SEQ ID NO: 1689272 - RNA, 21 nt, Homo sapiens
agggacucagggccaugccug

SEQ ID NO: 1689273 - RNA, 12 nt, Homo sapiens
agggacucccac

SEQ ID NO: 1689274 - RNA, 12 nt, Homo sapiens
agggacugccuc

SEQ ID NO: 1689275 - RNA, 14 nt, Homo sapiens
agggagaacgggaa

SEQ ID NO: 1689276 - RNA, 17 nt, Homo sapiens
agggagugcuggcucac

SEQ ID NO: 1689277 - RNA, 15 nt, Homo sapiens
agggcaagaucucag

SEQ ID NO: 1689278 - RNA, 22 nt, Homo sapiens
agggcacccuaguucuaccuca

SEQ ID NO: 1689279 - RNA, 13 nt, Homo sapiens
agggccagccacu

SEQ ID NO: 1689280 - RNA, 17 nt, Homo sapiens
agggcccuccgaccacu

SEQ ID NO: 1689281 - RNA, 13 nt, Homo sapiens
aggggaauggagg

SEQ ID NO: 1689282 - RNA, 19 nt, Homo sapiens
aggggccgcccuuggcucc

SEQ ID NO: 1689283 - RNA, 12 nt, Homo sapiens
aggggcucucag

SEQ ID NO: 1689284 - RNA, 14 nt, Homo sapiens
aggggcucuggaga

SEQ ID NO: 1689285 - RNA, 18 nt, Homo sapiens
agggggaagaagcagaga

SEQ ID NO: 1689286 - RNA, 18 nt, Homo sapiens
agggggugugucugcuca

SEQ ID NO: 1689287 - RNA, 14 nt, Homo sapiens
aggguagugcuaag

SEQ ID NO: 1689288 - RNA, 20 nt, Homo sapiens
aggguaucaggugcugccau

SEQ ID NO: 1689289 - RNA, 14 nt, Homo sapiens
aggguccaguggau

SEQ ID NO: 1689290 - RNA, 20 nt, Homo sapiens
aggguccuuuaguaccugaa

SEQ ID NO: 1689291 - RNA, 17 nt, Homo sapiens
agggucugugugaaugu

SEQ ID NO: 1689292 - RNA, 18 nt, Homo sapiens
agggugacugaugauaca

SEQ ID NO: 1689293 - RNA, 18 nt, Homo sapiens
agggugcuuuguguaaua

SEQ ID NO: 1689294 - RNA, 14 nt, Homo sapiens
caucccauguauuu

SEQ ID NO: 1689295 - RNA, 19 nt, Homo sapiens
caucccccaaaguucacaa

SEQ ID NO: 1689296 - RNA, 17 nt, Homo sapiens
cauccccuggacuggga

SEQ ID NO: 1689297 - RNA, 19 nt, Homo sapiens
cauccccuuuguguagaaa

SEQ ID NO: 1689298 - RNA, 21 nt, Homo sapiens
cauccuaagaaauaugugaga

SEQ ID NO: 1689299 - RNA, 15 nt, Homo sapiens
cauccucaugcugcu

SEQ ID NO: 1689300 - RNA, 16 nt, Homo sapiens
caucggccuccaugac

SEQ ID NO: 1689301 - RNA, 17 nt, Homo sapiens
caucuaagcugcagcuu

SEQ ID NO: 1689302 - RNA, 21 nt, Homo sapiens
caucuacccugcugaccuccc

SEQ ID NO: 1689303 - RNA, 17 nt, Homo sapiens
caucuauucaagcacuu

SEQ ID NO: 1689304 - RNA, 15 nt, Homo sapiens
caucucaauaacaaa

SEQ ID NO: 1689305 - RNA, 14 nt, Homo sapiens
caucucaggggcca

SEQ ID NO: 1689306 - RNA, 16 nt, Homo sapiens
caucucauuccaacuu

SEQ ID NO: 1689307 - RNA, 15 nt, Homo sapiens
caucuccagcuauuu

SEQ ID NO: 1689308 - RNA, 20 nt, Homo sapiens
caucuccuauaaucugucaa

SEQ ID NO: 1689309 - RNA, 14 nt, Homo sapiens
caucucuuguauau

SEQ ID NO: 1689310 - RNA, 21 nt, Homo sapiens
caucugaaaguagagguugua

SEQ ID NO: 1689311 - RNA, 15 nt, Homo sapiens
caucuggaaaccucu

SEQ ID NO: 1689312 - RNA, 15 nt, Homo sapiens
caucuggaaucugga

SEQ ID NO: 1689313 - RNA, 17 nt, Homo sapiens
caucuggaccugguaca

SEQ ID NO: 1689314 - RNA, 20 nt, Homo sapiens
caucuggaccugguacaaau

SEQ ID NO: 1689315 - RNA, 21 nt, Homo sapiens
caucuggcugccuuugcuuaa

SEQ ID NO: 1689316 - RNA, 19 nt, Homo sapiens
caucuggguuuguuuacag

SEQ ID NO: 1689317 - RNA, 16 nt, Homo sapiens
caucuguagugaccca

SEQ ID NO: 1689318 - RNA, 18 nt, Homo sapiens
caucuuauagcacuuuga

SEQ ID NO: 1689319 - RNA, 22 nt, Homo sapiens
caucuugugaaauggccaggau

SEQ ID NO: 1689320 - RNA, 17 nt, Homo sapiens
caucuuguugccaugga

SEQ ID NO: 1689321 - RNA, 22 nt, Homo sapiens
caucuuuagugcuuucuuguca

SEQ ID NO: 1689322 - RNA, 23 nt, Homo sapiens
caucuuuguggcgggagugcuca

SEQ ID NO: 1689323 - RNA, 19 nt, Homo sapiens
caugaaaauuuuaaaaaua

SEQ ID NO: 1689324 - RNA, 22 nt, Homo sapiens
caugaaucccacccacauguga

SEQ ID NO: 1689325 - RNA, 17 nt, Homo sapiens
caugaaucucucaauua

SEQ ID NO: 1689326 - RNA, 17 nt, Homo sapiens
caugaccauccugccau

SEQ ID NO: 1689327 - RNA, 22 nt, Homo sapiens
caugaccugaucacuagccugu

SEQ ID NO: 1689328 - RNA, 20 nt, Homo sapiens
caugacucguauaugucuca

SEQ ID NO: 1689329 - RNA, 14 nt, Homo sapiens
caugagaauaagag

SEQ ID NO: 1689330 - RNA, 15 nt, Homo sapiens
caugaguccuugaaa

SEQ ID NO: 1689331 - RNA, 19 nt, Homo sapiens
cagacuaagaaauauucca

SEQ ID NO: 1689332 - RNA, 20 nt, Homo sapiens
cagacuacacaggaugaggu

SEQ ID NO: 1689333 - RNA, 20 nt, Homo sapiens
cagacuucaucauugugcua

SEQ ID NO: 1689334 - RNA, 15 nt, Homo sapiens
cagacuuccuugaga

SEQ ID NO: 1689335 - RNA, 13 nt, Homo sapiens
cagagaaaagagu

SEQ ID NO: 1689336 - RNA, 15 nt, Homo sapiens
cagagaaccaaaggg

SEQ ID NO: 1689337 - RNA, 18 nt, Homo sapiens
cagagaagcggauuucca

SEQ ID NO: 1689338 - RNA, 21 nt, Homo sapiens
cagagacccucugccaccaga

SEQ ID NO: 1689339 - RNA, 19 nt, Homo sapiens
cagagaccugaagugugca

SEQ ID NO: 1689340 - RNA, 16 nt, Homo sapiens
cagagacugucccuga

SEQ ID NO: 1689341 - RNA, 15 nt, Homo sapiens
cagagagcggucuca

SEQ ID NO: 1689342 - RNA, 17 nt, Homo sapiens
cagagauugaacuccaa

SEQ ID NO: 1689343 - RNA, 15 nt, Homo sapiens
cagagcagaugcaga

SEQ ID NO: 1689344 - RNA, 23 nt, Homo sapiens
cagagcaggaagcauucagagag

SEQ ID NO: 1689345 - RNA, 19 nt, Homo sapiens
cagagcaggcaauuucacc

SEQ ID NO: 1689346 - RNA, 23 nt, Homo sapiens
cagagcauuuccaacaccacaga

SEQ ID NO: 1689347 - RNA, 21 nt, Homo sapiens
cagagccaccugacucuugca

SEQ ID NO: 1689348 - RNA, 20 nt, Homo sapiens
cagaggauaaggaggcacug

SEQ ID NO: 1689349 - RNA, 19 nt, Homo sapiens
cagaggcaguaaccaugcc

SEQ ID NO: 1689350 - RNA, 16 nt, Homo sapiens
cagagggcuugugaac

SEQ ID NO: 1689351 - RNA, 18 nt, Homo sapiens
cagagguugcagugagcc

SEQ ID NO: 1689352 - RNA, 18 nt, Homo sapiens
cagagucucacuguugcc

SEQ ID NO: 1689353 - RNA, 19 nt, Homo sapiens
cagagucucacuguugccc

SEQ ID NO: 1689354 - RNA, 19 nt, Homo sapiens
cagagucuucagagacuuc

SEQ ID NO: 1689355 - RNA, 14 nt, Homo sapiens
cagaguuguugcuu

SEQ ID NO: 1689356 - RNA, 14 nt, Homo sapiens
cagaguuugccuuc

SEQ ID NO: 1689357 - RNA, 18 nt, Homo sapiens
cagauaaaacauggacaa

SEQ ID NO: 1689358 - RNA, 15 nt, Homo sapiens
cagauaaguuugcag

SEQ ID NO: 1689359 - RNA, 13 nt, Homo sapiens
cagauaccucacc

SEQ ID NO: 1689360 - RNA, 16 nt, Homo sapiens
cagaucacgaggucag

SEQ ID NO: 1689361 - RNA, 14 nt, Homo sapiens
cagaucacugccac

SEQ ID NO: 1689362 - RNA, 16 nt, Homo sapiens
cagaugauuguucaaa

SEQ ID NO: 1689363 - RNA, 12 nt, Homo sapiens
cagaugcaauug

SEQ ID NO: 1689364 - RNA, 19 nt, Homo sapiens
cagaugccccagagcuguu

SEQ ID NO: 1689365 - RNA, 19 nt, Homo sapiens
cagauggacagacagccac

SEQ ID NO: 1689366 - RNA, 12 nt, Homo sapiens
cagaugucccuu

SEQ ID NO: 1689367 - RNA, 14 nt, Homo sapiens
cagauucagucuug

SEQ ID NO: 1689368 - RNA, 15 nt, Homo sapiens
cagauucccagagca

SEQ ID NO: 1689369 - RNA, 17 nt, Homo sapiens
cagauuguuaucuauca

SEQ ID NO: 1689370 - RNA, 13 nt, Homo sapiens
cagauuuugauaa

SEQ ID NO: 1689371 - RNA, 14 nt, Homo sapiens
cagcaacacagccu

SEQ ID NO: 1689372 - RNA, 19 nt, Homo sapiens
cagcaacuucuucuccauc

SEQ ID NO: 1689373 - RNA, 16 nt, Homo sapiens
cagcaaugacaucuca

SEQ ID NO: 1689374 - RNA, 22 nt, Homo sapiens
cagcaauuccuggacucggggg

SEQ ID NO: 1689375 - RNA, 13 nt, Homo sapiens
aaaaaaaucaucu

SEQ ID NO: 1689376 - RNA, 12 nt, Homo sapiens
aaaaaacagagg

SEQ ID NO: 1689377 - RNA, 18 nt, Homo sapiens
aaaaaaccuucagugaaa

SEQ ID NO: 1689378 - RNA, 13 nt, Homo sapiens
aaaaaagcuuuau

SEQ ID NO: 1689379 - RNA, 14 nt, Homo sapiens
aaaaacacaugggg

SEQ ID NO: 1689380 - RNA, 15 nt, Homo sapiens
aaaaacuagagcaca

SEQ ID NO: 1689381 - RNA, 18 nt, Homo sapiens
aaaaagacauucuuccaa

SEQ ID NO: 1689382 - RNA, 19 nt, Homo sapiens
aaaaauauauuuaaugaua

SEQ ID NO: 1689383 - RNA, 23 nt, Homo sapiens
aaaaauauauuuaaugauaagua

SEQ ID NO: 1689384 - RNA, 18 nt, Homo sapiens
aaaaaugcccauuugccu

SEQ ID NO: 1689385 - RNA, 23 nt, Homo sapiens
aaaaauggaacuguacacuuguu

SEQ ID NO: 1689386 - RNA, 15 nt, Homo sapiens
aaaaauggaacugug

SEQ ID NO: 1689387 - RNA, 15 nt, Homo sapiens
aaaaauguccugccu

SEQ ID NO: 1689388 - RNA, 16 nt, Homo sapiens
aaaaauguuugucuca

SEQ ID NO: 1689389 - RNA, 14 nt, Homo sapiens
aaaaauuaucuaua

SEQ ID NO: 1689390 - RNA, 20 nt, Homo sapiens
aaaacaaaugugaaggggag

SEQ ID NO: 1689391 - RNA, 17 nt, Homo sapiens
aaaacacaaaaguuucu

SEQ ID NO: 1689392 - RNA, 16 nt, Homo sapiens
aaaacaccuagcuuua

SEQ ID NO: 1689393 - RNA, 13 nt, Homo sapiens
aaaacagaaagca

SEQ ID NO: 1689394 - RNA, 23 nt, Homo sapiens
aaaacagaacaucauuagaacaa

SEQ ID NO: 1689395 - RNA, 17 nt, Homo sapiens
aaaaccacuagaacucu

SEQ ID NO: 1689396 - RNA, 23 nt, Homo sapiens
aaaaccugaagacugaggacaaa

SEQ ID NO: 1689397 - RNA, 16 nt, Homo sapiens
aaaacuaaacuuucau

SEQ ID NO: 1689398 - RNA, 20 nt, Homo sapiens
aaaacuauauucauuuccac

SEQ ID NO: 1689399 - RNA, 19 nt, Homo sapiens
aaaacucagccugggacag

SEQ ID NO: 1689400 - RNA, 20 nt, Homo sapiens
aaaacucauuacuuuuccau

SEQ ID NO: 1689401 - RNA, 15 nt, Homo sapiens
aaaacuguuaccuaa

SEQ ID NO: 1689402 - RNA, 16 nt, Homo sapiens
aaaacuuagugacaaa

SEQ ID NO: 1689403 - RNA, 14 nt, Homo sapiens
aaaacuucuuguca

SEQ ID NO: 1689404 - RNA, 17 nt, Homo sapiens
aaaagaaaacaccacua

SEQ ID NO: 1689405 - RNA, 17 nt, Homo sapiens
aaaagacaagaaaauca

SEQ ID NO: 1689406 - RNA, 15 nt, Homo sapiens
aaaagaccaguccau

SEQ ID NO: 1689407 - RNA, 20 nt, Homo sapiens
aaaagacguucauuauguau

SEQ ID NO: 1689408 - RNA, 12 nt, Homo sapiens
aaaagaugaagu

SEQ ID NO: 1689409 - RNA, 16 nt, Homo sapiens
aaaagcgacccauuca

SEQ ID NO: 1689410 - RNA, 19 nt, Homo sapiens
aaaagguuaaauauuguca

SEQ ID NO: 1689411 - RNA, 15 nt, Homo sapiens
aaaagguuauauacc

SEQ ID NO: 1689412 - RNA, 18 nt, Homo sapiens
aaaaguaaauucauguaa

SEQ ID NO: 1689413 - RNA, 14 nt, Homo sapiens
aaaaguacauguau

SEQ ID NO: 1689414 - RNA, 19 nt, Homo sapiens
aaaaguagguuuacauuca

SEQ ID NO: 1689415 - RNA, 18 nt, Homo sapiens
aaaagucguuuuccaaac

SEQ ID NO: 1689416 - RNA, 16 nt, Homo sapiens
aaaaguuauugugaua

SEQ ID NO: 1689417 - RNA, 13 nt, Homo sapiens
aaaaguugugauu

SEQ ID NO: 1689418 - RNA, 14 nt, Homo sapiens
aaaauagacauauu

SEQ ID NO: 1689419 - RNA, 18 nt, Homo sapiens
aaaauaguuaagacauga

SEQ ID NO: 1689420 - RNA, 22 nt, Homo sapiens
aaaauccuaagacacaaaugca

SEQ ID NO: 1689421 - RNA, 17 nt, Homo sapiens
aaaaucuugugcuagaa

SEQ ID NO: 1689422 - RNA, 23 nt, Homo sapiens
aaaaugagugacuagacguucau

SEQ ID NO: 1689423 - RNA, 11 nt, Homo sapiens
aaaauggaacu

SEQ ID NO: 1689424 - RNA, 15 nt, Homo sapiens
aaaauguccugccuu

SEQ ID NO: 1689425 - RNA, 17 nt, Homo sapiens
aaaauguccugccuuuu

SEQ ID NO: 1689426 - RNA, 14 nt, Homo sapiens
aaaauuaugaccau

SEQ ID NO: 1689427 - RNA, 14 nt, Homo sapiens
aaaauucagaugcu

SEQ ID NO: 1689428 - RNA, 20 nt, Homo sapiens
aaaauucuauguuaauuaca

SEQ ID NO: 1689429 - RNA, 18 nt, Homo sapiens
aaacaaaaaucuguguaa

SEQ ID NO: 1689430 - RNA, 14 nt, Homo sapiens
aaacaaauaugcaa

SEQ ID NO: 1689431 - RNA, 18 nt, Homo sapiens
aaacaaggggcuguuaca

SEQ ID NO: 1689432 - RNA, 21 nt, Homo sapiens
aaacacagcaacaaugacuua

SEQ ID NO: 1689433 - RNA, 16 nt, Homo sapiens
aaacagaacaggguca

SEQ ID NO: 1689434 - RNA, 19 nt, Homo sapiens
aaacagauggcacuuugaa

SEQ ID NO: 1689435 - RNA, 14 nt, Homo sapiens
aaacauaucuugag

SEQ ID NO: 1689436 - RNA, 16 nt, Homo sapiens
aaacaugauuguuuac

SEQ ID NO: 1689437 - RNA, 19 nt, Homo sapiens
aaacauuguguugacauua

SEQ ID NO: 1689438 - RNA, 16 nt, Homo sapiens
aaaccaauagcuuuaa

SEQ ID NO: 1689439 - RNA, 21 nt, Homo sapiens
aaaccacaacugacacaggaa

SEQ ID NO: 1689440 - RNA, 15 nt, Homo sapiens
aaaccacuagaacuc

SEQ ID NO: 1689441 - RNA, 14 nt, Homo sapiens
aaaccaucuggccu

SEQ ID NO: 1689442 - RNA, 22 nt, Homo sapiens
aaacccaguuuucccucuggga

SEQ ID NO: 1689443 - RNA, 23 nt, Homo sapiens
aaacccaguuuucccucugggag

SEQ ID NO: 1689444 - RNA, 19 nt, Homo sapiens
aaacccauucccucuccag

SEQ ID NO: 1689445 - RNA, 16 nt, Homo sapiens
aaaccuacauauucca

SEQ ID NO: 1689446 - RNA, 19 nt, Homo sapiens
aaaccugucuccacugugc

SEQ ID NO: 1689447 - RNA, 14 nt, Homo sapiens
aaaccuuagcuccc

SEQ ID NO: 1689448 - RNA, 13 nt, Homo sapiens
aaacgguucaguu

SEQ ID NO: 1689449 - RNA, 20 nt, Homo sapiens
aaacgucuucuaaacuuccc

SEQ ID NO: 1689450 - RNA, 21 nt, Homo sapiens
aaacuaaaggugcacugcuuu

SEQ ID NO: 1689451 - RNA, 18 nt, Homo sapiens
aaacuacacaucccuaau

SEQ ID NO: 1689452 - RNA, 21 nt, Homo sapiens
aaacuagcagaagaacuagua

SEQ ID NO: 1689453 - RNA, 13 nt, Homo sapiens
aaacucaaaauau

SEQ ID NO: 1689454 - RNA, 11 nt, Homo sapiens
aaacucaggga

SEQ ID NO: 1689455 - RNA, 16 nt, Homo sapiens
aaacucauuuuugcca

SEQ ID NO: 1689456 - RNA, 14 nt, Homo sapiens
aaacuccaaugaaa

SEQ ID NO: 1689457 - RNA, 14 nt, Homo sapiens
augcgaugugucca

SEQ ID NO: 1689458 - RNA, 19 nt, Homo sapiens
augcguacguuuccugaga

SEQ ID NO: 1689459 - RNA, 15 nt, Homo sapiens
augcuaucucugugu

SEQ ID NO: 1689460 - RNA, 13 nt, Homo sapiens
augcucagaaagg

SEQ ID NO: 1689461 - RNA, 21 nt, Homo sapiens
augcuccagcaacacagccug

SEQ ID NO: 1689462 - RNA, 19 nt, Homo sapiens
augcugaaaaaucauccaa

SEQ ID NO: 1689463 - RNA, 22 nt, Homo sapiens
augcugaaaaaucauccaagac

SEQ ID NO: 1689464 - RNA, 13 nt, Homo sapiens
augcugccagccu

SEQ ID NO: 1689465 - RNA, 15 nt, Homo sapiens
augcugcuauggaag

SEQ ID NO: 1689466 - RNA, 15 nt, Homo sapiens
augcuggacuugccu

SEQ ID NO: 1689467 - RNA, 16 nt, Homo sapiens
augcuggcagccaugg

SEQ ID NO: 1689468 - RNA, 19 nt, Homo sapiens
augcugguuuucuacccaa

SEQ ID NO: 1689469 - RNA, 18 nt, Homo sapiens
augcuguuugacaaaguu

SEQ ID NO: 1689470 - RNA, 20 nt, Homo sapiens
augcuguuugacaaaguuac

SEQ ID NO: 1689471 - RNA, 19 nt, Homo sapiens
augcuguuuguagugaaau

SEQ ID NO: 1689472 - RNA, 20 nt, Homo sapiens
augcuucacaucucuucacu

SEQ ID NO: 1689473 - RNA, 15 nt, Homo sapiens
augcuucaugugcug

SEQ ID NO: 1689474 - RNA, 17 nt, Homo sapiens
augcuuggcuaacuaua

SEQ ID NO: 1689475 - RNA, 20 nt, Homo sapiens
auggaaaaucagcugcucag

SEQ ID NO: 1689476 - RNA, 20 nt, Homo sapiens
auggaaagaaucuaauagag

SEQ ID NO: 1689477 - RNA, 18 nt, Homo sapiens
auggaaguaaagccucaa

SEQ ID NO: 1689478 - RNA, 14 nt, Homo sapiens
auggaaucaauuca

SEQ ID NO: 1689479 - RNA, 17 nt, Homo sapiens
auggaaugcuguguuaa

SEQ ID NO: 1689480 - RNA, 12 nt, Homo sapiens
auggacacucca

SEQ ID NO: 1689481 - RNA, 18 nt, Homo sapiens
auggacacuccagugcca

SEQ ID NO: 1689482 - RNA, 17 nt, Homo sapiens
auggagcaugaauggua

SEQ ID NO: 1689483 - RNA, 14 nt, Homo sapiens
auggaggcccuccu

SEQ ID NO: 1689484 - RNA, 15 nt, Homo sapiens
auggaggcccuccug

SEQ ID NO: 1689485 - RNA, 19 nt, Homo sapiens
auggauaaaauaaugcugc

SEQ ID NO: 1689486 - RNA, 17 nt, Homo sapiens
auggaugauucagaaau

SEQ ID NO: 1689487 - RNA, 15 nt, Homo sapiens
auggcuauauggcaa

SEQ ID NO: 1689488 - RNA, 22 nt, Homo sapiens
auggcuggaagggguccagccu

SEQ ID NO: 1689489 - RNA, 14 nt, Homo sapiens
augggccuggccac

SEQ ID NO: 1689490 - RNA, 16 nt, Homo sapiens
auggggaaaaaacugu

SEQ ID NO: 1689491 - RNA, 16 nt, Homo sapiens
auggggccaucugggc

SEQ ID NO: 1689492 - RNA, 16 nt, Homo sapiens
augguaauuguugcua

SEQ ID NO: 1689493 - RNA, 18 nt, Homo sapiens
auggucaaucccaaaagu

SEQ ID NO: 1689494 - RNA, 18 nt, Homo sapiens
augguguaauaagacaua

SEQ ID NO: 1689495 - RNA, 21 nt, Homo sapiens
auguaaaagaacuuacugauu

SEQ ID NO: 1689496 - RNA, 13 nt, Homo sapiens
auguaaacauaag

SEQ ID NO: 1689497 - RNA, 20 nt, Homo sapiens
auguaaagauuugcuuccau

SEQ ID NO: 1689498 - RNA, 22 nt, Homo sapiens
auguaaucucucugcagcugcc

SEQ ID NO: 1689499 - RNA, 15 nt, Homo sapiens
auguacagacauaca

SEQ ID NO: 1689500 - RNA, 11 nt, Homo sapiens
auguacaugag

SEQ ID NO: 1689501 - RNA, 22 nt, Homo sapiens
auguagcaauggcacuguugca

SEQ ID NO: 1689502 - RNA, 13 nt, Homo sapiens
auguaucugugaa

SEQ ID NO: 1689503 - RNA, 18 nt, Homo sapiens
auguauuguaaacaugug

SEQ ID NO: 1689504 - RNA, 19 nt, Homo sapiens
augucagacagaacuugaa

SEQ ID NO: 1689505 - RNA, 17 nt, Homo sapiens
auguccauuuauaucau

SEQ ID NO: 1689506 - RNA, 19 nt, Homo sapiens
augucuaucaacuuuaauc

SEQ ID NO: 1689507 - RNA, 15 nt, Homo sapiens
augucucgcuaguga

SEQ ID NO: 1689508 - RNA, 18 nt, Homo sapiens
augucuucauucccaagg

SEQ ID NO: 1689509 - RNA, 20 nt, Homo sapiens
augucuuggacacuguacaa

SEQ ID NO: 1689510 - RNA, 19 nt, Homo sapiens
augucuuuuauuuacuuuu

SEQ ID NO: 1689511 - RNA, 21 nt, Homo sapiens
augucuuuucuuggcaaaagc

SEQ ID NO: 1689512 - RNA, 17 nt, Homo sapiens
augugaaaacaucucaa

SEQ ID NO: 1689513 - RNA, 14 nt, Homo sapiens
augugaaacacuuu

SEQ ID NO: 1689514 - RNA, 21 nt, Homo sapiens
augugccccagcaggcaugga

SEQ ID NO: 1689515 - RNA, 13 nt, Homo sapiens
augugcccuccug

SEQ ID NO: 1689516 - RNA, 18 nt, Homo sapiens
auguggccaagcacaucu

SEQ ID NO: 1689517 - RNA, 14 nt, Homo sapiens
augugugaggagcu

SEQ ID NO: 1689518 - RNA, 21 nt, Homo sapiens
auguguucauuaaagcaugaa

SEQ ID NO: 1689519 - RNA, 22 nt, Homo sapiens
auguguuuuaucacuucauuca

SEQ ID NO: 1689520 - RNA, 22 nt, Homo sapiens
auguuaaaauucucauuacucu

SEQ ID NO: 1689521 - RNA, 21 nt, Homo sapiens
auguuaaagguucacaggggu

SEQ ID NO: 1689522 - RNA, 16 nt, Homo sapiens
auguuagaaugagauc

SEQ ID NO: 1689523 - RNA, 16 nt, Homo sapiens
auguucugggacacag

SEQ ID NO: 1689524 - RNA, 18 nt, Homo sapiens
auguuguaauucaugcca

SEQ ID NO: 1689525 - RNA, 23 nt, Homo sapiens
auguuuaugauaauaaaggcacc

SEQ ID NO: 1689526 - RNA, 21 nt, Homo sapiens
auguuucaagaaaauggauuu

SEQ ID NO: 1689527 - RNA, 12 nt, Homo sapiens
auguuuuccacc

SEQ ID NO: 1689528 - RNA, 14 nt, Homo sapiens
auguuuucuaguca

SEQ ID NO: 1689529 - RNA, 13 nt, Homo sapiens
auguuuuguauac

SEQ ID NO: 1689530 - RNA, 22 nt, Homo sapiens
auuaaaccugucuccacugugc

SEQ ID NO: 1689531 - RNA, 15 nt, Homo sapiens
auuaaauaaaucauu

SEQ ID NO: 1689532 - RNA, 15 nt, Homo sapiens
auuaaauauauacug

SEQ ID NO: 1689533 - RNA, 20 nt, Homo sapiens
auuaaauguuugacacaauu

SEQ ID NO: 1689534 - RNA, 19 nt, Homo sapiens
auuaacaacaauaacacug

SEQ ID NO: 1689535 - RNA, 15 nt, Homo sapiens
auuaagacaugcacu

SEQ ID NO: 1689536 - RNA, 23 nt, Homo sapiens
auuaagcagaaauccugcaauga

SEQ ID NO: 1689537 - RNA, 18 nt, Homo sapiens
auuaaugccauuaucccu

SEQ ID NO: 1689538 - RNA, 15 nt, Homo sapiens
auuaauggcacugau

SEQ ID NO: 1689539 - RNA, 23 nt, Homo sapiens
auuacaagcgugagccacugcac

SEQ ID NO: 1689540 - RNA, 21 nt, Homo sapiens
auuacaaggcuuuaucucagg

SEQ ID NO: 1689541 - RNA, 14 nt, Homo sapiens
auuacaauugugag

SEQ ID NO: 1689542 - RNA, 20 nt, Homo sapiens
auuacacauuuguacagaau

SEQ ID NO: 1689543 - RNA, 19 nt, Homo sapiens
auuacccccuccuucagac

SEQ ID NO: 1689544 - RNA, 17 nt, Homo sapiens
auuagcaaggucauuuc

SEQ ID NO: 1689545 - RNA, 23 nt, Homo sapiens
auuagcauggccccaguccaugc

SEQ ID NO: 1689546 - RNA, 16 nt, Homo sapiens
auuaucacgcagauca

SEQ ID NO: 1689547 - RNA, 17 nt, Homo sapiens
auuaucacgcagaucac

SEQ ID NO: 1689548 - RNA, 17 nt, Homo sapiens
auuaugaugaaaaccua

SEQ ID NO: 1689549 - RNA, 21 nt, Homo sapiens
auuaugaugaaaaccuacaua

SEQ ID NO: 1689550 - RNA, 18 nt, Homo sapiens
auuauguccacuguguau

SEQ ID NO: 1689551 - RNA, 15 nt, Homo sapiens
auuauugcuguugcu

SEQ ID NO: 1689552 - RNA, 19 nt, Homo sapiens
auuauuuauucagcuucau

SEQ ID NO: 1689553 - RNA, 16 nt, Homo sapiens
auuauuucucuaauua

SEQ ID NO: 1689554 - RNA, 14 nt, Homo sapiens
auuauuuucuguca

SEQ ID NO: 1689555 - RNA, 15 nt, Homo sapiens
auuauuuucugucag

SEQ ID NO: 1689556 - RNA, 17 nt, Homo sapiens
auuauuuucuucaucca

SEQ ID NO: 1689557 - RNA, 22 nt, Homo sapiens
auucaacaagagcacuacauuc

SEQ ID NO: 1689558 - RNA, 18 nt, Homo sapiens
auucacaaaauuuccaca

SEQ ID NO: 1689559 - RNA, 13 nt, Homo sapiens
auucaccaaaaua

SEQ ID NO: 1689560 - RNA, 19 nt, Homo sapiens
auucacccuucaacauaaa

SEQ ID NO: 1689561 - RNA, 16 nt, Homo sapiens
auucagagaauaucaa

SEQ ID NO: 1689562 - RNA, 17 nt, Homo sapiens
auucaguuuucauuugg

SEQ ID NO: 1689563 - RNA, 22 nt, Homo sapiens
auucaugugggcauuucuugcg

SEQ ID NO: 1689564 - RNA, 12 nt, Homo sapiens
auucauucucau

SEQ ID NO: 1689565 - RNA, 19 nt, Homo sapiens
auuccagaaugcuguacau

SEQ ID NO: 1689566 - RNA, 17 nt, Homo sapiens
auuccagcguacuauaa

SEQ ID NO: 1689567 - RNA, 14 nt, Homo sapiens
caaaacuacaugag

SEQ ID NO: 1689568 - RNA, 22 nt, Homo sapiens
caaaacuauacuugaacaaaag

SEQ ID NO: 1689569 - RNA, 22 nt, Homo sapiens
caaaacuucuugucagacauaa

SEQ ID NO: 1689570 - RNA, 19 nt, Homo sapiens
caaaagagaaaaacaaaac

SEQ ID NO: 1689571 - RNA, 20 nt, Homo sapiens
caaaagaggagcacuuccaa

SEQ ID NO: 1689572 - RNA, 14 nt, Homo sapiens
caaaaggaccccaa

SEQ ID NO: 1689573 - RNA, 23 nt, Homo sapiens
caaaaggagagacucccaugaag

SEQ ID NO: 1689574 - RNA, 18 nt, Homo sapiens
caaaaguuucuuacucaa

SEQ ID NO: 1689575 - RNA, 21 nt, Homo sapiens
caaaaguuucuuacucaagga

SEQ ID NO: 1689576 - RNA, 22 nt, Homo sapiens
caaaaguuucuuacucaaggaa

SEQ ID NO: 1689577 - RNA, 20 nt, Homo sapiens
caaaauaaaaagugacacag

SEQ ID NO: 1689578 - RNA, 13 nt, Homo sapiens
caaaauccaaaaa

SEQ ID NO: 1689579 - RNA, 21 nt, Homo sapiens
caaaauguuuucuucaucugu

SEQ ID NO: 1689580 - RNA, 13 nt, Homo sapiens
caaaauugaugug

SEQ ID NO: 1689581 - RNA, 13 nt, Homo sapiens
caaacaccuucca

SEQ ID NO: 1689582 - RNA, 16 nt, Homo sapiens
caaacacuuacagaau

SEQ ID NO: 1689583 - RNA, 18 nt, Homo sapiens
caaacauuguguugacau

SEQ ID NO: 1689584 - RNA, 15 nt, Homo sapiens
caaaccacaacugac

SEQ ID NO: 1689585 - RNA, 21 nt, Homo sapiens
caaacccacgauuuucuccag

SEQ ID NO: 1689586 - RNA, 12 nt, Homo sapiens
caaacucagugc

SEQ ID NO: 1689587 - RNA, 14 nt, Homo sapiens
caaacuguguacau

SEQ ID NO: 1689588 - RNA, 17 nt, Homo sapiens
caaagaaaugaacauuc

SEQ ID NO: 1689589 - RNA, 20 nt, Homo sapiens
caaagaauuuuuuuuaacau

SEQ ID NO: 1689590 - RNA, 17 nt, Homo sapiens
caaagaggcugccccuc

SEQ ID NO: 1689591 - RNA, 15 nt, Homo sapiens
caaagagguguacag

SEQ ID NO: 1689592 - RNA, 20 nt, Homo sapiens
caaagccacauuauuucuag

SEQ ID NO: 1689593 - RNA, 23 nt, Homo sapiens
caaaggcccccuacgccaaucaa

SEQ ID NO: 1689594 - RNA, 14 nt, Homo sapiens
caaaggugcuaaau

SEQ ID NO: 1689595 - RNA, 19 nt, Homo sapiens
caaagguuccaacuguaua

SEQ ID NO: 1689596 - RNA, 18 nt, Homo sapiens
caaagucugugugaugaa

SEQ ID NO: 1689597 - RNA, 17 nt, Homo sapiens
caaagugcggcugccau

SEQ ID NO: 1689598 - RNA, 13 nt, Homo sapiens
caaaguggaggag

SEQ ID NO: 1689599 - RNA, 22 nt, Homo sapiens
caaauaaaacuagugacagcuu

SEQ ID NO: 1689600 - RNA, 17 nt, Homo sapiens
caaauaaacucuaaaca

SEQ ID NO: 1689601 - RNA, 15 nt, Homo sapiens
caaauaaauaucauc

SEQ ID NO: 1689602 - RNA, 21 nt, Homo sapiens
caaauauggggaaaaaacugu

SEQ ID NO: 1689603 - RNA, 15 nt, Homo sapiens
caaauccuuccaaaa

SEQ ID NO: 1689604 - RNA, 22 nt, Homo sapiens
caaaucuccaguauucuuguca

SEQ ID NO: 1689605 - RNA, 14 nt, Homo sapiens
caaaucucuuccac

SEQ ID NO: 1689606 - RNA, 14 nt, Homo sapiens
caaaugaaacuuua

SEQ ID NO: 1689607 - RNA, 17 nt, Homo sapiens
caaaugacaugcacuga

SEQ ID NO: 1689608 - RNA, 16 nt, Homo sapiens
caaaugcucucucaaa

SEQ ID NO: 1689609 - RNA, 23 nt, Homo sapiens
caaauggcagaaccaaagcucaa

SEQ ID NO: 1689610 - RNA, 16 nt, Homo sapiens
caaaugugcugucaaa

SEQ ID NO: 1689611 - RNA, 20 nt, Homo sapiens
caaauuauauuugugugaaa

SEQ ID NO: 1689612 - RNA, 11 nt, Homo sapiens
caaauuucaca

SEQ ID NO: 1689613 - RNA, 17 nt, Homo sapiens
caaauuuuuacugagaa

SEQ ID NO: 1689614 - RNA, 16 nt, Homo sapiens
caaauuuuucuaucaa

SEQ ID NO: 1689615 - RNA, 13 nt, Homo sapiens
caacaaaccaagc

SEQ ID NO: 1689616 - RNA, 14 nt, Homo sapiens
caacaaugacuuaa

SEQ ID NO: 1689617 - RNA, 22 nt, Homo sapiens
caacaaugacuuaaccauauaa

SEQ ID NO: 1689618 - RNA, 13 nt, Homo sapiens
caacacagaggaa

SEQ ID NO: 1689619 - RNA, 21 nt, Homo sapiens
caacagaaguauuucugugga

SEQ ID NO: 1689620 - RNA, 13 nt, Homo sapiens
caacagagcaaga

SEQ ID NO: 1689621 - RNA, 12 nt, Homo sapiens
caacagccaugc

SEQ ID NO: 1689622 - RNA, 12 nt, Homo sapiens
caacauaacuga

SEQ ID NO: 1689623 - RNA, 16 nt, Homo sapiens
caacaugcugccccag

SEQ ID NO: 1689624 - RNA, 18 nt, Homo sapiens
caaccaauuuacacugcc

SEQ ID NO: 1689625 - RNA, 20 nt, Homo sapiens
caaccacacaccucaccaga

SEQ ID NO: 1689626 - RNA, 22 nt, Homo sapiens
caaccagccaggcagguccaca

SEQ ID NO: 1689627 - RNA, 20 nt, Homo sapiens
caaccccuucgcuccugugu

SEQ ID NO: 1689628 - RNA, 18 nt, Homo sapiens
caacccuaucuccugaca

SEQ ID NO: 1689629 - RNA, 14 nt, Homo sapiens
caaccgccucaaaa

SEQ ID NO: 1689630 - RNA, 22 nt, Homo sapiens
caaccgcuucccuauuuauuua

SEQ ID NO: 1689631 - RNA, 13 nt, Homo sapiens
caaccucauccag

SEQ ID NO: 1689632 - RNA, 17 nt, Homo sapiens
caaccucccaacccaga

SEQ ID NO: 1689633 - RNA, 16 nt, Homo sapiens
caaccuccuguggaac

SEQ ID NO: 1689634 - RNA, 21 nt, Homo sapiens
caacgcacaggaaaagguagc

SEQ ID NO: 1689635 - RNA, 22 nt, Homo sapiens
caacguagcuucuaccaugaac

SEQ ID NO: 1689636 - RNA, 18 nt, Homo sapiens
caacuaccauuaucuuca

SEQ ID NO: 1689637 - RNA, 13 nt, Homo sapiens
caacuaggccuca

SEQ ID NO: 1689638 - RNA, 18 nt, Homo sapiens
caacuauuuauugaauga

SEQ ID NO: 1689639 - RNA, 21 nt, Homo sapiens
caacucuucgaagccuugccu

SEQ ID NO: 1689640 - RNA, 12 nt, Homo sapiens
caacucuugauu

SEQ ID NO: 1689641 - RNA, 20 nt, Homo sapiens
caacugaggauguggcuuau

SEQ ID NO: 1689642 - RNA, 21 nt, Homo sapiens
caacugaguguuauuugcaca

SEQ ID NO: 1689643 - RNA, 12 nt, Homo sapiens
caacuuucugua

SEQ ID NO: 1689644 - RNA, 13 nt, Homo sapiens
caacuuucuguaa

SEQ ID NO: 1689645 - RNA, 22 nt, Homo sapiens
caagaaaagggcugacauuuuc

SEQ ID NO: 1689646 - RNA, 20 nt, Homo sapiens
caagaaaaucagguauuaau

SEQ ID NO: 1689647 - RNA, 15 nt, Homo sapiens
caagaagugguccau

SEQ ID NO: 1689648 - RNA, 13 nt, Homo sapiens
caagaauaauuca

SEQ ID NO: 1689649 - RNA, 15 nt, Homo sapiens
caagacccaucucaa

SEQ ID NO: 1689650 - RNA, 21 nt, Homo sapiens
caagacuccaucucaaaaaag

SEQ ID NO: 1689651 - RNA, 14 nt, Homo sapiens
caagacuuccucau

SEQ ID NO: 1689652 - RNA, 20 nt, Homo sapiens
caagacuuggcaacagaagc

SEQ ID NO: 1689653 - RNA, 22 nt, Homo sapiens
caagagagggccaugcaauuca

SEQ ID NO: 1689654 - RNA, 23 nt, Homo sapiens
caagagcugcccuccuuguccac

SEQ ID NO: 1689655 - RNA, 21 nt, Homo sapiens
caagaguuuucuuccuuguaa

SEQ ID NO: 1689656 - RNA, 12 nt, Homo sapiens
caagaugagauu

SEQ ID NO: 1689657 - RNA, 20 nt, Homo sapiens
caagauucuagaugauuaaa

SEQ ID NO: 1689658 - RNA, 15 nt, Homo sapiens
caagcaagcucucuu

SEQ ID NO: 1689659 - RNA, 15 nt, Homo sapiens
caagcagagugcaca

SEQ ID NO: 1689660 - RNA, 23 nt, Homo sapiens
caagcauuuugugaacuagggaa

SEQ ID NO: 1689661 - RNA, 23 nt, Homo sapiens
caagccaaaaaccuuagcucccu

SEQ ID NO: 1689662 - RNA, 16 nt, Homo sapiens
caagccccacuuauuc

SEQ ID NO: 1689663 - RNA, 20 nt, Homo sapiens
caagcgacgacagaugcuaa

SEQ ID NO: 1689664 - RNA, 12 nt, Homo sapiens
caagcugcauuu

SEQ ID NO: 1689665 - RNA, 21 nt, Homo sapiens
caagcugccgaaccaaaagaa

SEQ ID NO: 1689666 - RNA, 21 nt, Homo sapiens
caagcuguccagagaaaagag

SEQ ID NO: 1689667 - RNA, 21 nt, Homo sapiens
caagcuuguuaucagcuuuca

SEQ ID NO: 1689668 - RNA, 20 nt, Homo sapiens
caaggaaaaacaggucuuca

SEQ ID NO: 1689669 - RNA, 12 nt, Homo sapiens
caaggaaaaaga

SEQ ID NO: 1689670 - RNA, 20 nt, Homo sapiens
caaggaaagccccagcacua

SEQ ID NO: 1689671 - RNA, 23 nt, Homo sapiens
caaggaagagccaauguuuucca

SEQ ID NO: 1689672 - RNA, 14 nt, Homo sapiens
caaggaguacaaug

SEQ ID NO: 1689673 - RNA, 18 nt, Homo sapiens
caaggaugcugucaagca

SEQ ID NO: 1689674 - RNA, 19 nt, Homo sapiens
caaggcccauaucugugaa

SEQ ID NO: 1689675 - RNA, 22 nt, Homo sapiens
caaggcccauaucugugaaaug

SEQ ID NO: 1689676 - RNA, 23 nt, Homo sapiens
caccacacccagccucaguccuc

SEQ ID NO: 1689677 - RNA, 15 nt, Homo sapiens
caccacaugugcaca

SEQ ID NO: 1689678 - RNA, 19 nt, Homo sapiens
caccacggcguuguaccug

SEQ ID NO: 1689679 - RNA, 15 nt, Homo sapiens
caccagcaccaacac

SEQ ID NO: 1689680 - RNA, 15 nt, Homo sapiens
caccagccacuuuag

SEQ ID NO: 1689681 - RNA, 18 nt, Homo sapiens
caccagccccacugccag

SEQ ID NO: 1689682 - RNA, 22 nt, Homo sapiens
caccaguaaucccagcuacuca

SEQ ID NO: 1689683 - RNA, 22 nt, Homo sapiens
caccaguguccccuccacuguc

SEQ ID NO: 1689684 - RNA, 15 nt, Homo sapiens
cacccacauaccugg

SEQ ID NO: 1689685 - RNA, 12 nt, Homo sapiens
cacccacaugug

SEQ ID NO: 1689686 - RNA, 13 nt, Homo sapiens
cacccacauguga

SEQ ID NO: 1689687 - RNA, 17 nt, Homo sapiens
cacccaccuaugugcca

SEQ ID NO: 1689688 - RNA, 18 nt, Homo sapiens
cacccaccuaugugccaa

SEQ ID NO: 1689689 - RNA, 14 nt, Homo sapiens
cacccagaccccag

SEQ ID NO: 1689690 - RNA, 16 nt, Homo sapiens
cacccauaauccuuuc

SEQ ID NO: 1689691 - RNA, 20 nt, Homo sapiens
caccccaaguagucugcuca

SEQ ID NO: 1689692 - RNA, 16 nt, Homo sapiens
caccccucacucuggc

SEQ ID NO: 1689693 - RNA, 22 nt, Homo sapiens
cacccugcuacacauacaggau

SEQ ID NO: 1689694 - RNA, 21 nt, Homo sapiens
cacccuggaggauuucaucuc

SEQ ID NO: 1689695 - RNA, 15 nt, Homo sapiens
cacccugggagacag

SEQ ID NO: 1689696 - RNA, 23 nt, Homo sapiens
cacccuggggccuggaccugccu

SEQ ID NO: 1689697 - RNA, 19 nt, Homo sapiens
cacccuuccuucuguaaau

SEQ ID NO: 1689698 - RNA, 19 nt, Homo sapiens
cacccuuggacaagacaaa

SEQ ID NO: 1689699 - RNA, 21 nt, Homo sapiens
caccuaccacucacaugacac

SEQ ID NO: 1689700 - RNA, 19 nt, Homo sapiens
caccuacgcgagucuuacu

SEQ ID NO: 1689701 - RNA, 13 nt, Homo sapiens
caccuagacugua

SEQ ID NO: 1689702 - RNA, 17 nt, Homo sapiens
caccuagcugugcaaga

SEQ ID NO: 1689703 - RNA, 16 nt, Homo sapiens
caccuccucauguaca

SEQ ID NO: 1689704 - RNA, 22 nt, Homo sapiens
caccucucuccuuugcugaggc

SEQ ID NO: 1689705 - RNA, 15 nt, Homo sapiens
caccugcaugugcug

SEQ ID NO: 1689706 - RNA, 21 nt, Homo sapiens
caccuguauaauguuuuguaa

SEQ ID NO: 1689707 - RNA, 20 nt, Homo sapiens
caccuucaccuggaugugca

SEQ ID NO: 1689708 - RNA, 21 nt, Homo sapiens
caccuuccagcuccuguaaca

SEQ ID NO: 1689709 - RNA, 13 nt, Homo sapiens
caccuuuuacucu

SEQ ID NO: 1689710 - RNA, 20 nt, Homo sapiens
cacgcacacacacaaacaca

SEQ ID NO: 1689711 - RNA, 17 nt, Homo sapiens
cacgcuggagugcagug

SEQ ID NO: 1689712 - RNA, 18 nt, Homo sapiens
cacggcguuguaccugua

SEQ ID NO: 1689713 - RNA, 15 nt, Homo sapiens
cacgggucacuugaa

SEQ ID NO: 1689714 - RNA, 16 nt, Homo sapiens
cacgguggcucaggcc

SEQ ID NO: 1689715 - RNA, 18 nt, Homo sapiens
cacguacacacacauaca

SEQ ID NO: 1689716 - RNA, 17 nt, Homo sapiens
cacguggcagaccguga

SEQ ID NO: 1689717 - RNA, 16 nt, Homo sapiens
cacgugucucagacug

SEQ ID NO: 1689718 - RNA, 22 nt, Homo sapiens
cacgugucuuccacuuugcaua

SEQ ID NO: 1689719 - RNA, 17 nt, Homo sapiens
cacuaaggugugcucug

SEQ ID NO: 1689720 - RNA, 14 nt, Homo sapiens
cacuaauacuacug

SEQ ID NO: 1689721 - RNA, 13 nt, Homo sapiens
cacuaccacauua

SEQ ID NO: 1689722 - RNA, 19 nt, Homo sapiens
cacuagguucaauucccug

SEQ ID NO: 1689723 - RNA, 23 nt, Homo sapiens
cacuauagccuaggugacagagu

SEQ ID NO: 1689724 - RNA, 21 nt, Homo sapiens
cacucacauuuauucugcuca

SEQ ID NO: 1689725 - RNA, 17 nt, Homo sapiens
cacucaguuuaugcugu

SEQ ID NO: 1689726 - RNA, 13 nt, Homo sapiens
cacuccugaaccc

SEQ ID NO: 1689727 - RNA, 16 nt, Homo sapiens
cacucggcauuucaaa

SEQ ID NO: 1689728 - RNA, 19 nt, Homo sapiens
cacucuacccuauacaacu

SEQ ID NO: 1689729 - RNA, 16 nt, Homo sapiens
cacucucuucccuuuc

SEQ ID NO: 1689730 - RNA, 20 nt, Homo sapiens
cacucugcagacugcuagug

SEQ ID NO: 1689731 - RNA, 15 nt, Homo sapiens
cacucuuuauagugc

SEQ ID NO: 1689732 - RNA, 22 nt, Homo sapiens
cacucuuuauagugcacaaaau

SEQ ID NO: 1689733 - RNA, 16 nt, Homo sapiens
cacucuuuugcuuuau

SEQ ID NO: 1689734 - RNA, 20 nt, Homo sapiens
cacucuuuugcuuuauucca

SEQ ID NO: 1689735 - RNA, 17 nt, Homo sapiens
cacugaaagacaccauu

SEQ ID NO: 1689736 - RNA, 18 nt, Homo sapiens
cacugaauuaaucaucua

SEQ ID NO: 1689737 - RNA, 13 nt, Homo sapiens
cacugacuugaga

SEQ ID NO: 1689738 - RNA, 19 nt, Homo sapiens
cacugauauggguuuauaa

SEQ ID NO: 1689739 - RNA, 18 nt, Homo sapiens
cacugaugggcaaccccc

SEQ ID NO: 1689740 - RNA, 16 nt, Homo sapiens
cacugauguacaauua

SEQ ID NO: 1689741 - RNA, 14 nt, Homo sapiens
cacugcagggccag

SEQ ID NO: 1689742 - RNA, 14 nt, Homo sapiens
cacugccacuuugc

SEQ ID NO: 1689743 - RNA, 13 nt, Homo sapiens
cacugccuguaua

SEQ ID NO: 1689744 - RNA, 18 nt, Homo sapiens
cacugccuguauacuuua

SEQ ID NO: 1689745 - RNA, 18 nt, Homo sapiens
cacuguaagacucauucc

SEQ ID NO: 1689746 - RNA, 15 nt, Homo sapiens
cacuguauguuuacu

SEQ ID NO: 1689747 - RNA, 16 nt, Homo sapiens
cacugucacccuccac

SEQ ID NO: 1689748 - RNA, 15 nt, Homo sapiens
cacuguccugaccau

SEQ ID NO: 1689749 - RNA, 19 nt, Homo sapiens
cacugucuccuuucucuua

SEQ ID NO: 1689750 - RNA, 15 nt, Homo sapiens
cacuuaaccauucca

SEQ ID NO: 1689751 - RNA, 20 nt, Homo sapiens
cacuuacagcucuggccaca

SEQ ID NO: 1689752 - RNA, 12 nt, Homo sapiens
cacuuacuauug

SEQ ID NO: 1689753 - RNA, 18 nt, Homo sapiens
cacuucagaauuccauau

SEQ ID NO: 1689754 - RNA, 13 nt, Homo sapiens
cacuucaucugau

SEQ ID NO: 1689755 - RNA, 13 nt, Homo sapiens
cacuucauucaca

SEQ ID NO: 1689756 - RNA, 17 nt, Homo sapiens
cacuucauucacauuca

SEQ ID NO: 1689757 - RNA, 22 nt, Homo sapiens
cacuucgcgugcccucgcugcu

SEQ ID NO: 1689758 - RNA, 21 nt, Homo sapiens
cacuugcagacucuacagagg

SEQ ID NO: 1689759 - RNA, 13 nt, Homo sapiens
cacuuggaugcag

SEQ ID NO: 1689760 - RNA, 16 nt, Homo sapiens
cacuuggaugcagggu

SEQ ID NO: 1689761 - RNA, 17 nt, Homo sapiens
cacuuugaaauaccuca

SEQ ID NO: 1689762 - RNA, 18 nt, Homo sapiens
cacuuuuuaaaaucucaa

SEQ ID NO: 1689763 - RNA, 14 nt, Homo sapiens
cagaaaaaugucau

SEQ ID NO: 1689764 - RNA, 16 nt, Homo sapiens
cagaaaacaagaugag

SEQ ID NO: 1689765 - RNA, 20 nt, Homo sapiens
cagaaaauauuauguguuuc

SEQ ID NO: 1689766 - RNA, 22 nt, Homo sapiens
cagaaaauauuauguguuucca

SEQ ID NO: 1689767 - RNA, 23 nt, Homo sapiens
cagaaaauguugagaaucccaaa

SEQ ID NO: 1689768 - RNA, 18 nt, Homo sapiens
cagaaacaaaaacacuaa

SEQ ID NO: 1689769 - RNA, 18 nt, Homo sapiens
cagaaagcagauaccuca

SEQ ID NO: 1689770 - RNA, 22 nt, Homo sapiens
cagaaauuuaucuuucaaagag

SEQ ID NO: 1689771 - RNA, 15 nt, Homo sapiens
cagaacaacacuucc

SEQ ID NO: 1689772 - RNA, 20 nt, Homo sapiens
cagaaccucuuccccagaaa

SEQ ID NO: 1689773 - RNA, 14 nt, Homo sapiens
cagaacuugaaugu

SEQ ID NO: 1689774 - RNA, 15 nt, Homo sapiens
cagaagaaugggaau

SEQ ID NO: 1689775 - RNA, 21 nt, Homo sapiens
cagaagauccaagaggcccug

SEQ ID NO: 1689776 - RNA, 23 nt, Homo sapiens
cagaagcaguugagucgucauca

SEQ ID NO: 1689777 - RNA, 12 nt, Homo sapiens
cagaagcccuga

SEQ ID NO: 1689778 - RNA, 19 nt, Homo sapiens
cagaaguauuucuguggau

SEQ ID NO: 1689779 - RNA, 23 nt, Homo sapiens
cagaauagcuuugaauguggccc

SEQ ID NO: 1689780 - RNA, 15 nt, Homo sapiens
cagaauguacggaaa

SEQ ID NO: 1689781 - RNA, 13 nt, Homo sapiens
cagaauguaucug

SEQ ID NO: 1689782 - RNA, 14 nt, Homo sapiens
cagaauguaucugu

SEQ ID NO: 1689783 - RNA, 18 nt, Homo sapiens
cagaauguaucugugaag

SEQ ID NO: 1689784 - RNA, 22 nt, Homo sapiens
cagaauguuuuuaaaauaugag

SEQ ID NO: 1689785 - RNA, 16 nt, Homo sapiens
cagaauugugcaaaug

SEQ ID NO: 1689786 - RNA, 15 nt, Homo sapiens
caggaacagaaggau

SEQ ID NO: 1689787 - RNA, 20 nt, Homo sapiens
caggacaacuuuacaaaaca

SEQ ID NO: 1689788 - RNA, 15 nt, Homo sapiens
caggaccaagccaca

SEQ ID NO: 1689789 - RNA, 22 nt, Homo sapiens
caggacuguuuuauaaacugcu

SEQ ID NO: 1689790 - RNA, 21 nt, Homo sapiens
caggaggugugauuccugaag

SEQ ID NO: 1689791 - RNA, 13 nt, Homo sapiens
caggauauugaca

SEQ ID NO: 1689792 - RNA, 13 nt, Homo sapiens
caggaugaguuac

SEQ ID NO: 1689793 - RNA, 18 nt, Homo sapiens
caggaugaguuacuugaa

SEQ ID NO: 1689794 - RNA, 19 nt, Homo sapiens
caggaugaguuacuugaaa

SEQ ID NO: 1689795 - RNA, 15 nt, Homo sapiens
caggcacugcugccc

SEQ ID NO: 1689796 - RNA, 21 nt, Homo sapiens
caggcacugggcaagugaaga

SEQ ID NO: 1689797 - RNA, 22 nt, Homo sapiens
caggcagacuacacaggaugag

SEQ ID NO: 1689798 - RNA, 18 nt, Homo sapiens
caggcagagaaucauacu

SEQ ID NO: 1689799 - RNA, 13 nt, Homo sapiens
caggcagcucaag

SEQ ID NO: 1689800 - RNA, 12 nt, Homo sapiens
caggcagucucu

SEQ ID NO: 1689801 - RNA, 15 nt, Homo sapiens
caggcauguucucug

SEQ ID NO: 1689802 - RNA, 15 nt, Homo sapiens
caggcauuugacuga

SEQ ID NO: 1689803 - RNA, 22 nt, Homo sapiens
caggccaccccuaggaacucag

SEQ ID NO: 1689804 - RNA, 20 nt, Homo sapiens
caggcccugcuccugcagca

SEQ ID NO: 1689805 - RNA, 22 nt, Homo sapiens
caggccgauuugggaaccaagc

SEQ ID NO: 1689806 - RNA, 21 nt, Homo sapiens
caggccgcauccugaacugcu

SEQ ID NO: 1689807 - RNA, 18 nt, Homo sapiens
caggccggccagccucac

SEQ ID NO: 1689808 - RNA, 13 nt, Homo sapiens
caggccuggacuu

SEQ ID NO: 1689809 - RNA, 13 nt, Homo sapiens
caggcucuucucc

SEQ ID NO: 1689810 - RNA, 17 nt, Homo sapiens
caggcugggccaugucc

SEQ ID NO: 1689811 - RNA, 18 nt, Homo sapiens
caggcugggccaugucca

SEQ ID NO: 1689812 - RNA, 22 nt, Homo sapiens
caggcugggccauguccaaaga

SEQ ID NO: 1689813 - RNA, 13 nt, Homo sapiens
caggcuuuguaca

SEQ ID NO: 1689814 - RNA, 13 nt, Homo sapiens
cagggaagccaaa

SEQ ID NO: 1689815 - RNA, 16 nt, Homo sapiens
cagggacuccaugcug

SEQ ID NO: 1689816 - RNA, 23 nt, Homo sapiens
cagggcaaaugacaugcacugac

SEQ ID NO: 1689817 - RNA, 15 nt, Homo sapiens
cagggcuuaccugua

SEQ ID NO: 1689818 - RNA, 14 nt, Homo sapiens
cagggggaaggugg

SEQ ID NO: 1689819 - RNA, 11 nt, Homo sapiens
caggggugacg

SEQ ID NO: 1689820 - RNA, 20 nt, Homo sapiens
caggguccagugggaacuga

SEQ ID NO: 1689821 - RNA, 23 nt, Homo sapiens
caggguccagugggaacugaaga

SEQ ID NO: 1689822 - RNA, 20 nt, Homo sapiens
cagggucucacuauguugcc

SEQ ID NO: 1689823 - RNA, 21 nt, Homo sapiens
cagggucucacucugucgccc

SEQ ID NO: 1689824 - RNA, 16 nt, Homo sapiens
cagggucucucccuca

SEQ ID NO: 1689825 - RNA, 18 nt, Homo sapiens
cagggugguguaccugcu

SEQ ID NO: 1689826 - RNA, 21 nt, Homo sapiens
caggguuucaccauguugccc

SEQ ID NO: 1689827 - RNA, 20 nt, Homo sapiens
caggguuuugccauguuggc

SEQ ID NO: 1689828 - RNA, 20 nt, Homo sapiens
cagguaccaucuuguauaca

SEQ ID NO: 1689829 - RNA, 17 nt, Homo sapiens
caggugauccaccugcc

SEQ ID NO: 1689830 - RNA, 22 nt, Homo sapiens
cagguggccccaguucaaucuc

SEQ ID NO: 1689831 - RNA, 17 nt, Homo sapiens
cagguuuaacauuugcc

SEQ ID NO: 1689832 - RNA, 17 nt, Homo sapiens
caguaaaagaugaaguu

SEQ ID NO: 1689833 - RNA, 14 nt, Homo sapiens
caguaaauguacaa

SEQ ID NO: 1689834 - RNA, 14 nt, Homo sapiens
caguaacuuuaugu

SEQ ID NO: 1689835 - RNA, 18 nt, Homo sapiens
caguaacuuuauguguaa

SEQ ID NO: 1689836 - RNA, 20 nt, Homo sapiens
caguacagcaugugccuuaa

SEQ ID NO: 1689837 - RNA, 16 nt, Homo sapiens
caguacuugugaaaca

SEQ ID NO: 1689838 - RNA, 18 nt, Homo sapiens
caguagaaauaauaugca

SEQ ID NO: 1689839 - RNA, 20 nt, Homo sapiens
caguaucuauauauguguau

SEQ ID NO: 1689840 - RNA, 21 nt, Homo sapiens
caguaucuauauauguguaug

SEQ ID NO: 1689841 - RNA, 19 nt, Homo sapiens
caguaucuuugcacuccaa

SEQ ID NO: 1689842 - RNA, 21 nt, Homo sapiens
cagucacaugaccugaucacu

SEQ ID NO: 1689843 - RNA, 17 nt, Homo sapiens
cagucaccuaugugguc

SEQ ID NO: 1689844 - RNA, 16 nt, Homo sapiens
caguccaauaggugua

SEQ ID NO: 1689845 - RNA, 23 nt, Homo sapiens
caguccccguggccaucccugug

SEQ ID NO: 1689846 - RNA, 18 nt, Homo sapiens
caguccuccgguugcaua

SEQ ID NO: 1689847 - RNA, 20 nt, Homo sapiens
cagucgaugcguucacucca

SEQ ID NO: 1689848 - RNA, 19 nt, Homo sapiens
cagugaccccugaccucac

SEQ ID NO: 1689849 - RNA, 23 nt, Homo sapiens
cagugagauauuugguaccaugg

SEQ ID NO: 1689850 - RNA, 15 nt, Homo sapiens
cagugagccauguuc

SEQ ID NO: 1689851 - RNA, 16 nt, Homo sapiens
cagugccaacuccuca

SEQ ID NO: 1689852 - RNA, 22 nt, Homo sapiens
cagugccagcaaugacaucuca

SEQ ID NO: 1689853 - RNA, 22 nt, Homo sapiens
cagugcccacaggaucagucug

SEQ ID NO: 1689854 - RNA, 16 nt, Homo sapiens
cagugcccucauuuua

SEQ ID NO: 1689855 - RNA, 17 nt, Homo sapiens
caguggauugcauuucu

SEQ ID NO: 1689856 - RNA, 16 nt, Homo sapiens
caguggauuguuuaua

SEQ ID NO: 1689857 - RNA, 19 nt, Homo sapiens
caguggggccuguggaaug

SEQ ID NO: 1689858 - RNA, 17 nt, Homo sapiens
cagugggggcagagcca

SEQ ID NO: 1689859 - RNA, 15 nt, Homo sapiens
caguguucuaugaac

SEQ ID NO: 1689860 - RNA, 20 nt, Homo sapiens
caguguucuaugaacaacuc

SEQ ID NO: 1689861 - RNA, 11 nt, Homo sapiens
caguguugccc

SEQ ID NO: 1689862 - RNA, 11 nt, Homo sapiens
caguguuuaca

SEQ ID NO: 1689863 - RNA, 23 nt, Homo sapiens
caguguuuuagagagagaacuuu

SEQ ID NO: 1689864 - RNA, 16 nt, Homo sapiens
caguuaacuauugcau

SEQ ID NO: 1689865 - RNA, 15 nt, Homo sapiens
caguuagacuagucc

SEQ ID NO: 1689866 - RNA, 23 nt, Homo sapiens
caguuauuaaucuggacauucga

SEQ ID NO: 1689867 - RNA, 18 nt, Homo sapiens
caguugugucagcuacug

SEQ ID NO: 1689868 - RNA, 19 nt, Homo sapiens
caguuucuuagcuuuuuaa

SEQ ID NO: 1689869 - RNA, 20 nt, Homo sapiens
caguuugcuuuguaugcacu

SEQ ID NO: 1689870 - RNA, 17 nt, Homo sapiens
cauaaaaaaacuuccau

SEQ ID NO: 1689871 - RNA, 21 nt, Homo sapiens
cauaaaaagccugcaauuuca

SEQ ID NO: 1689872 - RNA, 22 nt, Homo sapiens
cauaaaaagccugcaauuucau

SEQ ID NO: 1689873 - RNA, 19 nt, Homo sapiens
cauaaaaauuuuuccugag

SEQ ID NO: 1689874 - RNA, 14 nt, Homo sapiens
cauaaacaaugaug

SEQ ID NO: 1689875 - RNA, 13 nt, Homo sapiens
cauaaagccaugu

SEQ ID NO: 1689876 - RNA, 14 nt, Homo sapiens
cauaaaugaaucau

SEQ ID NO: 1689877 - RNA, 22 nt, Homo sapiens
cauaacugccuugaaccuguga

SEQ ID NO: 1689878 - RNA, 21 nt, Homo sapiens
cauaagaauuuuuuauaagua

SEQ ID NO: 1689879 - RNA, 18 nt, Homo sapiens
cauaagggguuugccauu

SEQ ID NO: 1689880 - RNA, 22 nt, Homo sapiens
cauaauaaauaauuaaccacca

SEQ ID NO: 1689881 - RNA, 15 nt, Homo sapiens
cauaaucuaguuuac

SEQ ID NO: 1689882 - RNA, 20 nt, Homo sapiens
cauacacaguggcaccuuca

SEQ ID NO: 1689883 - RNA, 12 nt, Homo sapiens
cauacaggccau

SEQ ID NO: 1689884 - RNA, 21 nt, Homo sapiens
cauacauuuaugcacauucac

SEQ ID NO: 1689885 - RNA, 17 nt, Homo sapiens
cauacccacacacccag

SEQ ID NO: 1689886 - RNA, 17 nt, Homo sapiens
cauaccuaaguacugua

SEQ ID NO: 1689887 - RNA, 18 nt, Homo sapiens
cauaccuaaguacuguaa

SEQ ID NO: 1689888 - RNA, 15 nt, Homo sapiens
cauaccucugaccaa

SEQ ID NO: 1689889 - RNA, 18 nt, Homo sapiens
cauacuggccuggacugu

SEQ ID NO: 1689890 - RNA, 17 nt, Homo sapiens
cauacuucuguuuccau

SEQ ID NO: 1689891 - RNA, 20 nt, Homo sapiens
cauacuucuguuuccaucug

SEQ ID NO: 1689892 - RNA, 18 nt, Homo sapiens
cauagaaaauuaaacaca

SEQ ID NO: 1689893 - RNA, 23 nt, Homo sapiens
cauagaaaauuaaacacaaagug

SEQ ID NO: 1689894 - RNA, 19 nt, Homo sapiens
cauagaaacaugacacuga

SEQ ID NO: 1689895 - RNA, 22 nt, Homo sapiens
gcgccagccugucccauggaca

SEQ ID NO: 1689896 - RNA, 15 nt, Homo sapiens
gcgcccuuaccuucc

SEQ ID NO: 1689897 - RNA, 21 nt, Homo sapiens
gcgcccuuggcuucugugaug

SEQ ID NO: 1689898 - RNA, 19 nt, Homo sapiens
gcgugcucccgaugcugcu

SEQ ID NO: 1689899 - RNA, 15 nt, Homo sapiens
gcguggcggagcugc

SEQ ID NO: 1689900 - RNA, 15 nt, Homo sapiens
gcguuguuacaggaa

SEQ ID NO: 1689901 - RNA, 13 nt, Homo sapiens
gcuaaguacacaa

SEQ ID NO: 1689902 - RNA, 17 nt, Homo sapiens
gcuacugucucacugaa

SEQ ID NO: 1689903 - RNA, 11 nt, Homo sapiens
gcuagaacuuu

SEQ ID NO: 1689904 - RNA, 20 nt, Homo sapiens
gcuagaaggcaaagugcaca

SEQ ID NO: 1689905 - RNA, 20 nt, Homo sapiens
gcuaggguggcccuugcagu

SEQ ID NO: 1689906 - RNA, 14 nt, Homo sapiens
gcuauagcuacagg

SEQ ID NO: 1689907 - RNA, 14 nt, Homo sapiens
gcuaugugcacuga

SEQ ID NO: 1689908 - RNA, 22 nt, Homo sapiens
gcucaacugaggauguggcuua

SEQ ID NO: 1689909 - RNA, 13 nt, Homo sapiens
gcucacaccaaau

SEQ ID NO: 1689910 - RNA, 22 nt, Homo sapiens
gcucacgccuguaaucccaaca

SEQ ID NO: 1689911 - RNA, 14 nt, Homo sapiens
gcucagccaagcuu

SEQ ID NO: 1689912 - RNA, 20 nt, Homo sapiens
gcucauaagcaauaccagca

SEQ ID NO: 1689913 - RNA, 13 nt, Homo sapiens
gcuccacugaaca

SEQ ID NO: 1689914 - RNA, 14 nt, Homo sapiens
gcuccagaaauguc

SEQ ID NO: 1689915 - RNA, 17 nt, Homo sapiens
gcuccagguacauauca

SEQ ID NO: 1689916 - RNA, 21 nt, Homo sapiens
gcucccucuauuuauguuugc

SEQ ID NO: 1689917 - RNA, 18 nt, Homo sapiens
gcuccuaguuugaccuca

SEQ ID NO: 1689918 - RNA, 15 nt, Homo sapiens
gcuccugaggggcau

SEQ ID NO: 1689919 - RNA, 19 nt, Homo sapiens
gcuccugagugcccucaga

SEQ ID NO: 1689920 - RNA, 23 nt, Homo sapiens
gcuccugcagcauggucccugcc

SEQ ID NO: 1689921 - RNA, 15 nt, Homo sapiens
gcuccuggggcaaug

SEQ ID NO: 1689922 - RNA, 15 nt, Homo sapiens
gcuccuucuguccua

SEQ ID NO: 1689923 - RNA, 18 nt, Homo sapiens
gcuccuuggcuuaccuga

SEQ ID NO: 1689924 - RNA, 15 nt, Homo sapiens
gcucgagcaguccug

SEQ ID NO: 1689925 - RNA, 20 nt, Homo sapiens
gcucgugggauguccuacua

SEQ ID NO: 1689926 - RNA, 12 nt, Homo sapiens
gcucucagcuca

SEQ ID NO: 1689927 - RNA, 14 nt, Homo sapiens
gcucuggacaggca

SEQ ID NO: 1689928 - RNA, 14 nt, Homo sapiens
gcucuggccacaac

SEQ ID NO: 1689929 - RNA, 19 nt, Homo sapiens
gcucuucuaccauuugaau

SEQ ID NO: 1689930 - RNA, 14 nt, Homo sapiens
gcucuucugcccaa

SEQ ID NO: 1689931 - RNA, 21 nt, Homo sapiens
gcucuuucaucucugcuugga

SEQ ID NO: 1689932 - RNA, 16 nt, Homo sapiens
gcucuuuuuuacucau

SEQ ID NO: 1689933 - RNA, 17 nt, Homo sapiens
gcugaaaaaucauccaa

SEQ ID NO: 1689934 - RNA, 19 nt, Homo sapiens
gcugaaaaccaucuggccu

SEQ ID NO: 1689935 - RNA, 16 nt, Homo sapiens
gcugaagcuggugcgc

SEQ ID NO: 1689936 - RNA, 18 nt, Homo sapiens
gcugacuagaagggccag

SEQ ID NO: 1689937 - RNA, 16 nt, Homo sapiens
gcugagaauguggaau

SEQ ID NO: 1689938 - RNA, 22 nt, Homo sapiens
gcugagauugagcagaagauca

SEQ ID NO: 1689939 - RNA, 14 nt, Homo sapiens
gcugauuaccugaa

SEQ ID NO: 1689940 - RNA, 14 nt, Homo sapiens
gcugauugaagaca

SEQ ID NO: 1689941 - RNA, 16 nt, Homo sapiens
gcugcaccuggucaua

SEQ ID NO: 1689942 - RNA, 17 nt, Homo sapiens
gcugcagagcaccuuug

SEQ ID NO: 1689943 - RNA, 16 nt, Homo sapiens
gcugcauuugugucau

SEQ ID NO: 1689944 - RNA, 16 nt, Homo sapiens
gcugccagccuucucc

SEQ ID NO: 1689945 - RNA, 22 nt, Homo sapiens
gcugccccaaccugcugaaggg

SEQ ID NO: 1689946 - RNA, 17 nt, Homo sapiens
gcugccuuggcucagac

SEQ ID NO: 1689947 - RNA, 19 nt, Homo sapiens
gcugcuuccugucugagua

SEQ ID NO: 1689948 - RNA, 21 nt, Homo sapiens
gcuggacgugcgcgaugccug

SEQ ID NO: 1689949 - RNA, 22 nt, Homo sapiens
gcuggacgugcgcgaugccugg

SEQ ID NO: 1689950 - RNA, 16 nt, Homo sapiens
gcuggagguggggcga

SEQ ID NO: 1689951 - RNA, 19 nt, Homo sapiens
gcuggagugcaguggugca

SEQ ID NO: 1689952 - RNA, 22 nt, Homo sapiens
gcuggagugcaguggugcaauc

SEQ ID NO: 1689953 - RNA, 20 nt, Homo sapiens
gcuggcaagucuuccaugac

SEQ ID NO: 1689954 - RNA, 16 nt, Homo sapiens
gcuggcagaaagggaa

SEQ ID NO: 1689955 - RNA, 15 nt, Homo sapiens
gcuggcaucaagagg

SEQ ID NO: 1689956 - RNA, 17 nt, Homo sapiens
gcuggccucucuagcac

SEQ ID NO: 1689957 - RNA, 13 nt, Homo sapiens
gcuggcuugcagu

SEQ ID NO: 1689958 - RNA, 21 nt, Homo sapiens
gcugggccaccagccacuuua

SEQ ID NO: 1689959 - RNA, 13 nt, Homo sapiens
gcugggccauguc

SEQ ID NO: 1689960 - RNA, 16 nt, Homo sapiens
gcugggccauguccaa

SEQ ID NO: 1689961 - RNA, 18 nt, Homo sapiens
gcugggccucuucugccu

SEQ ID NO: 1689962 - RNA, 14 nt, Homo sapiens
gcuguagaugacaa

SEQ ID NO: 1689963 - RNA, 16 nt, Homo sapiens
gcuguauguaaacugu

SEQ ID NO: 1689964 - RNA, 18 nt, Homo sapiens
gcuguccugaucugugau

SEQ ID NO: 1689965 - RNA, 12 nt, Homo sapiens
gcugucugcuca

SEQ ID NO: 1689966 - RNA, 18 nt, Homo sapiens
gcugugacuucuccaggu

SEQ ID NO: 1689967 - RNA, 22 nt, Homo sapiens
gcugugagccccugguccugag

SEQ ID NO: 1689968 - RNA, 14 nt, Homo sapiens
gcuguggaugcuuc

SEQ ID NO: 1689969 - RNA, 18 nt, Homo sapiens
gcuguguauuuacaugaa

SEQ ID NO: 1689970 - RNA, 21 nt, Homo sapiens
gcuguucuucuguucugcaga

SEQ ID NO: 1689971 - RNA, 18 nt, Homo sapiens
gcuguugaagucaccuug

SEQ ID NO: 1689972 - RNA, 12 nt, Homo sapiens
gcuguugcuuga

SEQ ID NO: 1689973 - RNA, 16 nt, Homo sapiens
gcuguuggucaugugg

SEQ ID NO: 1689974 - RNA, 21 nt, Homo sapiens
gcuuaccagaagcuuccauag

SEQ ID NO: 1689975 - RNA, 13 nt, Homo sapiens
gcuuaccugacac

SEQ ID NO: 1689976 - RNA, 18 nt, Homo sapiens
gcuucaccagagcauuuc

SEQ ID NO: 1689977 - RNA, 14 nt, Homo sapiens
gcuucacuguauaa

SEQ ID NO: 1689978 - RNA, 15 nt, Homo sapiens
gcuucaguggcagcu

SEQ ID NO: 1689979 - RNA, 20 nt, Homo sapiens
gcuucauaaaugaagcagcu

SEQ ID NO: 1689980 - RNA, 21 nt, Homo sapiens
gcuucauaaaugaagcagcuu

SEQ ID NO: 1689981 - RNA, 23 nt, Homo sapiens
gcuuccaucccaaccagugccaa

SEQ ID NO: 1689982 - RNA, 23 nt, Homo sapiens
gcuuccgagaauagcuccacugg

SEQ ID NO: 1689983 - RNA, 12 nt, Homo sapiens
gcuucugugaug

SEQ ID NO: 1689984 - RNA, 14 nt, Homo sapiens
gcuucuuucucuca

SEQ ID NO: 1689985 - RNA, 14 nt, Homo sapiens
gcuugaaccuggga

SEQ ID NO: 1689986 - RNA, 19 nt, Homo sapiens
gcuuggggccaccaaagcu

SEQ ID NO: 1689987 - RNA, 20 nt, Homo sapiens
gcuuguaaauagcucaggug

SEQ ID NO: 1689988 - RNA, 13 nt, Homo sapiens
gcuugucaggggg

SEQ ID NO: 1689989 - RNA, 13 nt, Homo sapiens
gcuuuagggcaau

SEQ ID NO: 1689990 - RNA, 16 nt, Homo sapiens
gcuuucuacccagcga

SEQ ID NO: 1689991 - RNA, 23 nt, Homo sapiens
gcuuucuaugcuguuuguaguga

SEQ ID NO: 1689992 - RNA, 20 nt, Homo sapiens
gcuuugaaaagucacuuacu

SEQ ID NO: 1689993 - RNA, 17 nt, Homo sapiens
gcuuuguccugaaggaa

SEQ ID NO: 1689994 - RNA, 23 nt, Homo sapiens
gcuuuguugaaugaagcagagaa

SEQ ID NO: 1689995 - RNA, 16 nt, Homo sapiens
gcuuuguuggcaagga

SEQ ID NO: 1689996 - RNA, 21 nt, Homo sapiens
gcuuuuaugauauauauaugc

SEQ ID NO: 1689997 - RNA, 24 nt, Homo sapiens
gcuuuucaugcguguguguugucu

SEQ ID NO: 1689998 - RNA, 19 nt, Homo sapiens
gcuuuuggucucccuggga

SEQ ID NO: 1689999 - RNA, 21 nt, Homo sapiens
ggaaaaaaauaguaaagccaa

SEQ ID NO: 1690000 - RNA, 14 nt, Homo sapiens
ggaaaaauguuugu

SEQ ID NO: 1690001 - RNA, 20 nt, Homo sapiens
ggaaacagcuaaugggacac

SEQ ID NO: 1690002 - RNA, 12 nt, Homo sapiens
ggaaagugcaua

SEQ ID NO: 1690003 - RNA, 14 nt, Homo sapiens
ggaaauagcuaaua

SEQ ID NO: 1690004 - RNA, 18 nt, Homo sapiens
ggaacagacaacagaagu

SEQ ID NO: 1690005 - RNA, 23 nt, Homo sapiens
ggccaguauuuuuauuucuuuaa

SEQ ID NO: 1690006 - RNA, 22 nt, Homo sapiens
ggccaguggggccuguggaaug

SEQ ID NO: 1690007 - RNA, 22 nt, Homo sapiens
ggccauacuucuguuuccaucu

SEQ ID NO: 1690008 - RNA, 16 nt, Homo sapiens
ggccauguccaaagag

SEQ ID NO: 1690009 - RNA, 14 nt, Homo sapiens
ggccauucagagac

SEQ ID NO: 1690010 - RNA, 13 nt, Homo sapiens
ggcccagugacaa

SEQ ID NO: 1690011 - RNA, 16 nt, Homo sapiens
ggcccauaucugugaa

SEQ ID NO: 1690012 - RNA, 20 nt, Homo sapiens
ggccggcugugcucagagac

SEQ ID NO: 1690013 - RNA, 14 nt, Homo sapiens
ggccuacagcuuug

SEQ ID NO: 1690014 - RNA, 13 nt, Homo sapiens
ggccuaugcacau

SEQ ID NO: 1690015 - RNA, 15 nt, Homo sapiens
ggccuccaugaccug

SEQ ID NO: 1690016 - RNA, 18 nt, Homo sapiens
ggccuuuccugguuuuca

SEQ ID NO: 1690017 - RNA, 14 nt, Homo sapiens
ggcgucccuaccuc

SEQ ID NO: 1690018 - RNA, 16 nt, Homo sapiens
ggcgucccuaccuccu

SEQ ID NO: 1690019 - RNA, 19 nt, Homo sapiens
ggcuauggacacaggguga

SEQ ID NO: 1690020 - RNA, 17 nt, Homo sapiens
ggcucagacauguuuuc

SEQ ID NO: 1690021 - RNA, 18 nt, Homo sapiens
ggcucaggccauggcucc

SEQ ID NO: 1690022 - RNA, 23 nt, Homo sapiens
ggcuccaacacugcaacaugggg

SEQ ID NO: 1690023 - RNA, 22 nt, Homo sapiens
ggcuccaccccauccaguucau

SEQ ID NO: 1690024 - RNA, 13 nt, Homo sapiens
ggcucccaugacc

SEQ ID NO: 1690025 - RNA, 17 nt, Homo sapiens
ggcuccuucccaucgcu

SEQ ID NO: 1690026 - RNA, 21 nt, Homo sapiens
ggcucugcaaugggcacuggg

SEQ ID NO: 1690027 - RNA, 11 nt, Homo sapiens
ggcucuuccaa

SEQ ID NO: 1690028 - RNA, 21 nt, Homo sapiens
ggcugauuauuaaaguccuuu

SEQ ID NO: 1690029 - RNA, 16 nt, Homo sapiens
ggcugcuuuguucaau

SEQ ID NO: 1690030 - RNA, 21 nt, Homo sapiens
ggcugggccucuucugccucu

SEQ ID NO: 1690031 - RNA, 16 nt, Homo sapiens
ggcuggguaccaaugc

SEQ ID NO: 1690032 - RNA, 20 nt, Homo sapiens
ggcugugcucucaccagcug

SEQ ID NO: 1690033 - RNA, 16 nt, Homo sapiens
ggcuguggagaggguc

SEQ ID NO: 1690034 - RNA, 22 nt, Homo sapiens
ggcuguggagagggucaaggag

SEQ ID NO: 1690035 - RNA, 13 nt, Homo sapiens
ggcuguucugcac

SEQ ID NO: 1690036 - RNA, 21 nt, Homo sapiens
ggcuuaccuguacacugacuu

SEQ ID NO: 1690037 - RNA, 15 nt, Homo sapiens
ggcuucacuguauaa

SEQ ID NO: 1690038 - RNA, 14 nt, Homo sapiens
ggcuucccaugucu

SEQ ID NO: 1690039 - RNA, 16 nt, Homo sapiens
ggcuuuucuagccuau

SEQ ID NO: 1690040 - RNA, 18 nt, Homo sapiens
gggaaaaucuauuccugc

SEQ ID NO: 1690041 - RNA, 19 nt, Homo sapiens
gggaaaaucuauuccugcc

SEQ ID NO: 1690042 - RNA, 14 nt, Homo sapiens
gggaaaucaguguu

SEQ ID NO: 1690043 - RNA, 12 nt, Homo sapiens
gggaaauugcuu

SEQ ID NO: 1690044 - RNA, 21 nt, Homo sapiens
gggaagaguggucuugagggg

SEQ ID NO: 1690045 - RNA, 12 nt, Homo sapiens
gggaagccaaaa

SEQ ID NO: 1690046 - RNA, 15 nt, Homo sapiens
gggaaggucaccagc

SEQ ID NO: 1690047 - RNA, 16 nt, Homo sapiens
gggaaugagcccagag

SEQ ID NO: 1690048 - RNA, 21 nt, Homo sapiens
gggacagagccaugcugggaa

SEQ ID NO: 1690049 - RNA, 16 nt, Homo sapiens
gggacucaaugcacug

SEQ ID NO: 1690050 - RNA, 16 nt, Homo sapiens
gggacucagggccaug

SEQ ID NO: 1690051 - RNA, 13 nt, Homo sapiens
gggagaacgggaa

SEQ ID NO: 1690052 - RNA, 17 nt, Homo sapiens
gggagaaggcagugauu

SEQ ID NO: 1690053 - RNA, 12 nt, Homo sapiens
gggagugucuaa

SEQ ID NO: 1690054 - RNA, 17 nt, Homo sapiens
gggauccguacauucaa

SEQ ID NO: 1690055 - RNA, 13 nt, Homo sapiens
gggaucuugcaaa

SEQ ID NO: 1690056 - RNA, 10 nt, Homo sapiens
gggauguuuu

SEQ ID NO: 1690057 - RNA, 21 nt, Homo sapiens
gggauuuauuuucaauuaaua

SEQ ID NO: 1690058 - RNA, 15 nt, Homo sapiens
gggcaaacagaagaa

SEQ ID NO: 1690059 - RNA, 22 nt, Homo sapiens
gggcaaaugacaugcacugacc

SEQ ID NO: 1690060 - RNA, 15 nt, Homo sapiens
gggcacuggcccagg

SEQ ID NO: 1690061 - RNA, 16 nt, Homo sapiens
gggcaggcugggccau

SEQ ID NO: 1690062 - RNA, 17 nt, Homo sapiens
gggcagggaucuugcaa

SEQ ID NO: 1690063 - RNA, 22 nt, Homo sapiens
gggcauagaucagaagacuaca

SEQ ID NO: 1690064 - RNA, 17 nt, Homo sapiens
gggcauccauaccagcu

SEQ ID NO: 1690065 - RNA, 20 nt, Homo sapiens
gggcaugccccggccaccuc

SEQ ID NO: 1690066 - RNA, 18 nt, Homo sapiens
gggccagggucuguguga

SEQ ID NO: 1690067 - RNA, 17 nt, Homo sapiens
gggccauguccaaagag

SEQ ID NO: 1690068 - RNA, 17 nt, Homo sapiens
gggccgugagggguccc

SEQ ID NO: 1690069 - RNA, 20 nt, Homo sapiens
gggccugagagaauuggcuc

SEQ ID NO: 1690070 - RNA, 18 nt, Homo sapiens
gggccuggggccugagag

SEQ ID NO: 1690071 - RNA, 15 nt, Homo sapiens
gggcugcccuggugc

SEQ ID NO: 1690072 - RNA, 16 nt, Homo sapiens
gggcuuugugucauca

SEQ ID NO: 1690073 - RNA, 18 nt, Homo sapiens
ggggaagaaacacuuucu

SEQ ID NO: 1690074 - RNA, 15 nt, Homo sapiens
ggggagccuuagccg

SEQ ID NO: 1690075 - RNA, 23 nt, Homo sapiens
ggggcaccuuaagauuuugcacc

SEQ ID NO: 1690076 - RNA, 10 nt, Homo sapiens
ggggcuucca

SEQ ID NO: 1690077 - RNA, 15 nt, Homo sapiens
gggggcuccacccca

SEQ ID NO: 1690078 - RNA, 19 nt, Homo sapiens
gggguagccuccuauccac

SEQ ID NO: 1690079 - RNA, 13 nt, Homo sapiens
gggguagccugag

SEQ ID NO: 1690080 - RNA, 13 nt, Homo sapiens
gggguggagcaug

SEQ ID NO: 1690081 - RNA, 14 nt, Homo sapiens
gggguuagaccacu

SEQ ID NO: 1690082 - RNA, 22 nt, Homo sapiens
ggguaauccaggcacagcugag

SEQ ID NO: 1690083 - RNA, 23 nt, Homo sapiens
gggucaaggaguacuccaagaca

SEQ ID NO: 1690084 - RNA, 23 nt, Homo sapiens
gggucccccugcuugucuucacc

SEQ ID NO: 1690085 - RNA, 19 nt, Homo sapiens
gggucucacaguguugccc

SEQ ID NO: 1690086 - RNA, 18 nt, Homo sapiens
gggucugugugaaugugg

SEQ ID NO: 1690087 - RNA, 15 nt, Homo sapiens
gggugauaacucagg

SEQ ID NO: 1690088 - RNA, 21 nt, Homo sapiens
ggguggcccuugcaguucagc

SEQ ID NO: 1690089 - RNA, 17 nt, Homo sapiens
ggguuagauguugccau

SEQ ID NO: 1690090 - RNA, 12 nt, Homo sapiens
ggguuuugcucu

SEQ ID NO: 1690091 - RNA, 20 nt, Homo sapiens
gguacuauuuagauauaaca

SEQ ID NO: 1690092 - RNA, 15 nt, Homo sapiens
gguacucaauggagu

SEQ ID NO: 1690093 - RNA, 16 nt, Homo sapiens
gguacugaaagccuua

SEQ ID NO: 1690094 - RNA, 16 nt, Homo sapiens
gguagcuuaccugaca

SEQ ID NO: 1690095 - RNA, 20 nt, Homo sapiens
gguagggaauaaaauccuaa

SEQ ID NO: 1690096 - RNA, 13 nt, Homo sapiens
gguaucaggugcu

SEQ ID NO: 1690097 - RNA, 18 nt, Homo sapiens
gguaugaucacggcucac

SEQ ID NO: 1690098 - RNA, 21 nt, Homo sapiens
gguauuaaauugauguugcug

SEQ ID NO: 1690099 - RNA, 16 nt, Homo sapiens
gguauuacacuguauu

SEQ ID NO: 1690100 - RNA, 12 nt, Homo sapiens
ggucacaugaug

SEQ ID NO: 1690101 - RNA, 16 nt, Homo sapiens
gguccaugcagggggc

SEQ ID NO: 1690102 - RNA, 15 nt, Homo sapiens
gguccauucucugag

SEQ ID NO: 1690103 - RNA, 18 nt, Homo sapiens
gguccuggacaaaggagu

SEQ ID NO: 1690104 - RNA, 22 nt, Homo sapiens
gguccuugcaccccucacucug

SEQ ID NO: 1690105 - RNA, 16 nt, Homo sapiens
ggucuaacacuggcau

SEQ ID NO: 1690106 - RNA, 20 nt, Homo sapiens
ggucucacaguguugcccag

SEQ ID NO: 1690107 - RNA, 17 nt, Homo sapiens
ggucucccgauucccaa

SEQ ID NO: 1690108 - RNA, 20 nt, Homo sapiens
ggucucgcuuuguugcccag

SEQ ID NO: 1690109 - RNA, 22 nt, Homo sapiens
ggucugcuggcuucuacacugg

SEQ ID NO: 1690110 - RNA, 15 nt, Homo sapiens
ggucuguuggggucu

SEQ ID NO: 1690111 - RNA, 15 nt, Homo sapiens
ggucuucccuaccuc

SEQ ID NO: 1690112 - RNA, 21 nt, Homo sapiens
ggugaaccacuucauucugca

SEQ ID NO: 1690113 - RNA, 19 nt, Homo sapiens
ggugagcagaaguggagcu

SEQ ID NO: 1690114 - RNA, 15 nt, Homo sapiens
ggugagcuccagcug

SEQ ID NO: 1690115 - RNA, 21 nt, Homo sapiens
guucuaccucaggcagcucaa

SEQ ID NO: 1690116 - RNA, 13 nt, Homo sapiens
guucuauccaaac

SEQ ID NO: 1690117 - RNA, 19 nt, Homo sapiens
guucucuucuucauucuau

SEQ ID NO: 1690118 - RNA, 17 nt, Homo sapiens
guucugaugccaauacu

SEQ ID NO: 1690119 - RNA, 14 nt, Homo sapiens
guucugcacugaaa

SEQ ID NO: 1690120 - RNA, 15 nt, Homo sapiens
guucugcacugaaaa

SEQ ID NO: 1690121 - RNA, 24 nt, Homo sapiens
guucugcuucaauaaaucuuugga

SEQ ID NO: 1690122 - RNA, 20 nt, Homo sapiens
guucugggcucuuuccucug

SEQ ID NO: 1690123 - RNA, 21 nt, Homo sapiens
guucuuacacaggcuucauca

SEQ ID NO: 1690124 - RNA, 11 nt, Homo sapiens
guucuuaccug

SEQ ID NO: 1690125 - RNA, 15 nt, Homo sapiens
guucuuggugaugcu

SEQ ID NO: 1690126 - RNA, 19 nt, Homo sapiens
guugcaccaggcacugcug

SEQ ID NO: 1690127 - RNA, 12 nt, Homo sapiens
guugcuucaggc

SEQ ID NO: 1690128 - RNA, 14 nt, Homo sapiens
guuggaaauauuca

SEQ ID NO: 1690129 - RNA, 13 nt, Homo sapiens
guuggaagcuugu

SEQ ID NO: 1690130 - RNA, 16 nt, Homo sapiens
guuggaugaugagcag

SEQ ID NO: 1690131 - RNA, 15 nt, Homo sapiens
guuggcucacagggc

SEQ ID NO: 1690132 - RNA, 19 nt, Homo sapiens
guuguaacuaggcucagag

SEQ ID NO: 1690133 - RNA, 19 nt, Homo sapiens
guugucuacaccaaugccc

SEQ ID NO: 1690134 - RNA, 11 nt, Homo sapiens
guuguuugcaa

SEQ ID NO: 1690135 - RNA, 18 nt, Homo sapiens
guuuaagaaaaguauuuu

SEQ ID NO: 1690136 - RNA, 19 nt, Homo sapiens
guuuauuaaaaaaauggaa

SEQ ID NO: 1690137 - RNA, 17 nt, Homo sapiens
guuuauugaaugugauu

SEQ ID NO: 1690138 - RNA, 20 nt, Homo sapiens
guuuauuuuuauacuuucag

SEQ ID NO: 1690139 - RNA, 19 nt, Homo sapiens
guuucacccuuaacccaag

SEQ ID NO: 1690140 - RNA, 20 nt, Homo sapiens
guuucauggguuauguguau

SEQ ID NO: 1690141 - RNA, 19 nt, Homo sapiens
guuuccaauaaacgcaagc

SEQ ID NO: 1690142 - RNA, 15 nt, Homo sapiens
guuucccuuccucca

SEQ ID NO: 1690143 - RNA, 22 nt, Homo sapiens
guuucuccuguuggcucacagg

SEQ ID NO: 1690144 - RNA, 16 nt, Homo sapiens
guuucuuaacuauaaa

SEQ ID NO: 1690145 - RNA, 15 nt, Homo sapiens
guuucuuccacaaca

SEQ ID NO: 1690146 - RNA, 13 nt, Homo sapiens
guuugagaccagc

SEQ ID NO: 1690147 - RNA, 19 nt, Homo sapiens
guuugauaccugcacuguc

SEQ ID NO: 1690148 - RNA, 22 nt, Homo sapiens
guuugauaccugcacuguccug

SEQ ID NO: 1690149 - RNA, 22 nt, Homo sapiens
guuugaugucauuaauguguug

SEQ ID NO: 1690150 - RNA, 20 nt, Homo sapiens
guuugcaguuggcuaagaga

SEQ ID NO: 1690151 - RNA, 19 nt, Homo sapiens
guuugccuuuguaccauau

SEQ ID NO: 1690152 - RNA, 14 nt, Homo sapiens
guuugcugugaaca

SEQ ID NO: 1690153 - RNA, 22 nt, Homo sapiens
guuugggaauauccauguacuu

SEQ ID NO: 1690154 - RNA, 14 nt, Homo sapiens
guuuguagugaaau

SEQ ID NO: 1690155 - RNA, 21 nt, Homo sapiens
guuuguauagaguucauccca

SEQ ID NO: 1690156 - RNA, 17 nt, Homo sapiens
guuuuaaaaaaucucaa

SEQ ID NO: 1690157 - RNA, 17 nt, Homo sapiens
guuuuaaguacuacaca

SEQ ID NO: 1690158 - RNA, 19 nt, Homo sapiens
guuuuacugugaaacuggc

SEQ ID NO: 1690159 - RNA, 18 nt, Homo sapiens
guuuucauugacacucuu

SEQ ID NO: 1690160 - RNA, 13 nt, Homo sapiens
guuuuuacuguga

SEQ ID NO: 1690161 - RNA, 14 nt, Homo sapiens
guuuuuagcuggug

SEQ ID NO: 1690162 - RNA, 17 nt, Homo sapiens
uaaaaaaaaaaguuaca

SEQ ID NO: 1690163 - RNA, 19 nt, Homo sapiens
uaaaaaaauacaugcaucu

SEQ ID NO: 1690164 - RNA, 24 nt, Homo sapiens
uaaaaaagggcuugggagauucau

SEQ ID NO: 1690165 - RNA, 19 nt, Homo sapiens
uaaaaaauuaugacaaugu

SEQ ID NO: 1690166 - RNA, 16 nt, Homo sapiens
uaaaaagaaaaaccac

SEQ ID NO: 1690167 - RNA, 18 nt, Homo sapiens
uaaaaaguuaaucuucau

SEQ ID NO: 1690168 - RNA, 13 nt, Homo sapiens
uaaaaauagacac

SEQ ID NO: 1690169 - RNA, 20 nt, Homo sapiens
uaaaacaacacucacauuua

SEQ ID NO: 1690170 - RNA, 17 nt, Homo sapiens
uaaaaccugugugccau

SEQ ID NO: 1690171 - RNA, 16 nt, Homo sapiens
uaaaacuacaugguca

SEQ ID NO: 1690172 - RNA, 21 nt, Homo sapiens
uaaaacugauuuuuagcuuua

SEQ ID NO: 1690173 - RNA, 20 nt, Homo sapiens
uaaaacuuaccuaagugaca

SEQ ID NO: 1690174 - RNA, 19 nt, Homo sapiens
uaaaagaaccgagcaauuu

SEQ ID NO: 1690175 - RNA, 20 nt, Homo sapiens
uaaaagaacuuacugauuau

SEQ ID NO: 1690176 - RNA, 14 nt, Homo sapiens
uaaaagaauauuca

SEQ ID NO: 1690177 - RNA, 15 nt, Homo sapiens
uaaaagccacauaga

SEQ ID NO: 1690178 - RNA, 20 nt, Homo sapiens
uaaaagguauuuugaauacc

SEQ ID NO: 1690179 - RNA, 14 nt, Homo sapiens
uaaaaguaaauuca

SEQ ID NO: 1690180 - RNA, 19 nt, Homo sapiens
uaaaaguaaauucauguaa

SEQ ID NO: 1690181 - RNA, 17 nt, Homo sapiens
uaaaagugggcuugauu

SEQ ID NO: 1690182 - RNA, 21 nt, Homo sapiens
uaaaauagaaauaagugguua

SEQ ID NO: 1690183 - RNA, 21 nt, Homo sapiens
uaaaauagaguguaguuuaca

SEQ ID NO: 1690184 - RNA, 22 nt, Homo sapiens
uaaaauaggaaccuaugaaacu

SEQ ID NO: 1690185 - RNA, 21 nt, Homo sapiens
uaaaauauaauuuucaaaaag

SEQ ID NO: 1690186 - RNA, 21 nt, Homo sapiens
uaaaaugugauguucuaaggc

SEQ ID NO: 1690187 - RNA, 23 nt, Homo sapiens
uaaaauuaaucacaaauuucacu

SEQ ID NO: 1690188 - RNA, 18 nt, Homo sapiens
uaaaauuagaaagcaacu

SEQ ID NO: 1690189 - RNA, 17 nt, Homo sapiens
uaaaauucagaugcugu

SEQ ID NO: 1690190 - RNA, 16 nt, Homo sapiens
uaaaauugcugugcuu

SEQ ID NO: 1690191 - RNA, 14 nt, Homo sapiens
uaaacaaauaacaa

SEQ ID NO: 1690192 - RNA, 22 nt, Homo sapiens
uaaacaaaugugauacauuuaa

SEQ ID NO: 1690193 - RNA, 20 nt, Homo sapiens
uaaacaagaguuuucuuccu

SEQ ID NO: 1690194 - RNA, 19 nt, Homo sapiens
uaaacacaaaguguauaca

SEQ ID NO: 1690195 - RNA, 15 nt, Homo sapiens
uaaacaccuccucau

SEQ ID NO: 1690196 - RNA, 15 nt, Homo sapiens
uaaacagguggugag

SEQ ID NO: 1690197 - RNA, 16 nt, Homo sapiens
uaaacauugugaucau

SEQ ID NO: 1690198 - RNA, 16 nt, Homo sapiens
uaaaccucaaaauguc

SEQ ID NO: 1690199 - RNA, 13 nt, Homo sapiens
uaaaccuccgcca

SEQ ID NO: 1690200 - RNA, 15 nt, Homo sapiens
uaaaccuccgccaau

SEQ ID NO: 1690201 - RNA, 16 nt, Homo sapiens
uaaaccuccuucggga

SEQ ID NO: 1690202 - RNA, 15 nt, Homo sapiens
uaaacgcaagcugag

SEQ ID NO: 1690203 - RNA, 19 nt, Homo sapiens
uaaacuaauauuuguuuca

SEQ ID NO: 1690204 - RNA, 13 nt, Homo sapiens
uaaacucagggac

SEQ ID NO: 1690205 - RNA, 18 nt, Homo sapiens
uaaacuguuagcacuguu

SEQ ID NO: 1690206 - RNA, 15 nt, Homo sapiens
uaaacuuaacuuuaa

SEQ ID NO: 1690207 - RNA, 13 nt, Homo sapiens
uaaacuucacuga

SEQ ID NO: 1690208 - RNA, 14 nt, Homo sapiens
uaaacuuguuuaca

SEQ ID NO: 1690209 - RNA, 21 nt, Homo sapiens
uaaagaaaaguagguuuacau

SEQ ID NO: 1690210 - RNA, 23 nt, Homo sapiens
uaaagaauguuucuuaacuauaa

SEQ ID NO: 1690211 - RNA, 19 nt, Homo sapiens
uaaagaauuaacagagauu

SEQ ID NO: 1690212 - RNA, 13 nt, Homo sapiens
uaaagacaaccau

SEQ ID NO: 1690213 - RNA, 21 nt, Homo sapiens
uaaagauauggagaauugcug

SEQ ID NO: 1690214 - RNA, 17 nt, Homo sapiens
uaaagaucaugacauau

SEQ ID NO: 1690215 - RNA, 15 nt, Homo sapiens
uaaagauggcacuuu

SEQ ID NO: 1690216 - RNA, 16 nt, Homo sapiens
uaaagauuugcuucca

SEQ ID NO: 1690217 - RNA, 15 nt, Homo sapiens
uaaagcauauuggug

SEQ ID NO: 1690218 - RNA, 18 nt, Homo sapiens
uaaagcauauuggugcua

SEQ ID NO: 1690219 - RNA, 19 nt, Homo sapiens
uaaagcauauuggugcuag

SEQ ID NO: 1690220 - RNA, 16 nt, Homo sapiens
uaaaguaaugaucuca

SEQ ID NO: 1690221 - RNA, 15 nt, Homo sapiens
uaaagucacagaauu

SEQ ID NO: 1690222 - RNA, 14 nt, Homo sapiens
uaaagucugaauca

SEQ ID NO: 1690223 - RNA, 16 nt, Homo sapiens
uaaaguguucugccag

SEQ ID NO: 1690224 - RNA, 15 nt, Homo sapiens
uaaaguguuugccuc

SEQ ID NO: 1690225 - RNA, 20 nt, Homo sapiens
acagcagcauuuuuauuuca

SEQ ID NO: 1690226 - RNA, 17 nt, Homo sapiens
acagcagccccugcaca

SEQ ID NO: 1690227 - RNA, 21 nt, Homo sapiens
acagccccuggcccacccacu

SEQ ID NO: 1690228 - RNA, 21 nt, Homo sapiens
acagccuccucugucugcccu

SEQ ID NO: 1690229 - RNA, 18 nt, Homo sapiens
acagccuggcacagggca

SEQ ID NO: 1690230 - RNA, 20 nt, Homo sapiens
acagcuaucgaacuucacaa

SEQ ID NO: 1690231 - RNA, 21 nt, Homo sapiens
acagcucccugccaaacugaa

SEQ ID NO: 1690232 - RNA, 16 nt, Homo sapiens
acagcuccuucugucc

SEQ ID NO: 1690233 - RNA, 13 nt, Homo sapiens
acagcucucaccu

SEQ ID NO: 1690234 - RNA, 14 nt, Homo sapiens
acagcucuucucca

SEQ ID NO: 1690235 - RNA, 20 nt, Homo sapiens
acagcuuuggggugucuuuu

SEQ ID NO: 1690236 - RNA, 23 nt, Homo sapiens
acaggaaaaaaaaaaaucuaucc

SEQ ID NO: 1690237 - RNA, 15 nt, Homo sapiens
acaggaaaccacuua

SEQ ID NO: 1690238 - RNA, 20 nt, Homo sapiens
acaggaagcaccccaugcca

SEQ ID NO: 1690239 - RNA, 15 nt, Homo sapiens
acaggauaacccuug

SEQ ID NO: 1690240 - RNA, 14 nt, Homo sapiens
acaggcaccugcca

SEQ ID NO: 1690241 - RNA, 18 nt, Homo sapiens
acaggcagucucucucuu

SEQ ID NO: 1690242 - RNA, 15 nt, Homo sapiens
acaggccauacuuua

SEQ ID NO: 1690243 - RNA, 21 nt, Homo sapiens
acaggcccuuccucuccacug

SEQ ID NO: 1690244 - RNA, 21 nt, Homo sapiens
acaggcuguucugcacugaaa

SEQ ID NO: 1690245 - RNA, 20 nt, Homo sapiens
acagggaaaacugcaaagcu

SEQ ID NO: 1690246 - RNA, 13 nt, Homo sapiens
acagggcauucaa

SEQ ID NO: 1690247 - RNA, 20 nt, Homo sapiens
acaggguuuuuaccugucac

SEQ ID NO: 1690248 - RNA, 14 nt, Homo sapiens
acagguccccagau

SEQ ID NO: 1690249 - RNA, 20 nt, Homo sapiens
acaggucuagaaaaccagcu

SEQ ID NO: 1690250 - RNA, 15 nt, Homo sapiens
acaggugugagucac

SEQ ID NO: 1690251 - RNA, 17 nt, Homo sapiens
acaguaaguccaguaaa

SEQ ID NO: 1690252 - RNA, 14 nt, Homo sapiens
acaguacagcaugu

SEQ ID NO: 1690253 - RNA, 18 nt, Homo sapiens
acaguacagcaugugccu

SEQ ID NO: 1690254 - RNA, 22 nt, Homo sapiens
acaguagagcaaaucuaugaga

SEQ ID NO: 1690255 - RNA, 21 nt, Homo sapiens
acaguaucccacauccaacuc

SEQ ID NO: 1690256 - RNA, 15 nt, Homo sapiens
acaguauuacuucug

SEQ ID NO: 1690257 - RNA, 18 nt, Homo sapiens
acagucaaaauguuugau

SEQ ID NO: 1690258 - RNA, 20 nt, Homo sapiens
acagucaaaauguuugauau

SEQ ID NO: 1690259 - RNA, 12 nt, Homo sapiens
acagucagcucu

SEQ ID NO: 1690260 - RNA, 14 nt, Homo sapiens
acagucccacugug

SEQ ID NO: 1690261 - RNA, 17 nt, Homo sapiens
acagugccgacagcucu

SEQ ID NO: 1690262 - RNA, 18 nt, Homo sapiens
acagugccgacagcucuc

SEQ ID NO: 1690263 - RNA, 18 nt, Homo sapiens
acaguguacaaugccuuu

SEQ ID NO: 1690264 - RNA, 14 nt, Homo sapiens
acaguguugcccag

SEQ ID NO: 1690265 - RNA, 18 nt, Homo sapiens
acaguuuaucaugaagcc

SEQ ID NO: 1690266 - RNA, 22 nt, Homo sapiens
acaguuuauuuuuauacuuuca

SEQ ID NO: 1690267 - RNA, 22 nt, Homo sapiens
gcgcuggguauuggaaauggau

SEQ ID NO: 1690268 - RNA, 21 nt, Homo sapiens
gcggaaagccuguaagccugc

SEQ ID NO: 1690269 - RNA, 13 nt, Homo sapiens
gcggaggcugugu

SEQ ID NO: 1690270 - RNA, 17 nt, Homo sapiens
gcggagguugcaaugag

SEQ ID NO: 1690271 - RNA, 16 nt, Homo sapiens
gcgggacccgaccccc

SEQ ID NO: 1690272 - RNA, 15 nt, Homo sapiens
gcgggaggcagaguu

SEQ ID NO: 1690273 - RNA, 15 nt, Homo sapiens
gcggucaauuugccu

SEQ ID NO: 1690274 - RNA, 18 nt, Homo sapiens
gcgucccagucucuggca

SEQ ID NO: 1690275 - RNA, 15 nt, Homo sapiens
gcgucuggguucuca

SEQ ID NO: 1690276 - RNA, 15 nt, Homo sapiens
gcgugaaucuguauc

SEQ ID NO: 1690277 - RNA, 16 nt, Homo sapiens
gcgugagccacugcac

SEQ ID NO: 1690278 - RNA, 18 nt, Homo sapiens
gcguggacucugcacaug

SEQ ID NO: 1690279 - RNA, 20 nt, Homo sapiens
gcguggugcucuuugcugca

SEQ ID NO: 1690280 - RNA, 24 nt, Homo sapiens
gcguucugcaagcaucaguucuac

SEQ ID NO: 1690281 - RNA, 16 nt, Homo sapiens
gcuaaaggaagugaau

SEQ ID NO: 1690282 - RNA, 12 nt, Homo sapiens
gcuaaauuccac

SEQ ID NO: 1690283 - RNA, 17 nt, Homo sapiens
gcuaagauaccaaaacc

SEQ ID NO: 1690284 - RNA, 21 nt, Homo sapiens
gcuaauguaauaacugugaag

SEQ ID NO: 1690285 - RNA, 20 nt, Homo sapiens
gcuacagagccgagcaauau

SEQ ID NO: 1690286 - RNA, 17 nt, Homo sapiens
gcuacagcuuucuugcu

SEQ ID NO: 1690287 - RNA, 17 nt, Homo sapiens
gcuacaguuauuaaucu

SEQ ID NO: 1690288 - RNA, 23 nt, Homo sapiens
gcuacaguuauuaaucuggacau

SEQ ID NO: 1690289 - RNA, 19 nt, Homo sapiens
gcuacccugaguucaucca

SEQ ID NO: 1690290 - RNA, 21 nt, Homo sapiens
gcuaccuguugguuagauuca

SEQ ID NO: 1690291 - RNA, 21 nt, Homo sapiens
gcuacuccccagaccucaggg

SEQ ID NO: 1690292 - RNA, 15 nt, Homo sapiens
gcuagaaaacauuuu

SEQ ID NO: 1690293 - RNA, 15 nt, Homo sapiens
gcuagaaggcaaagu

SEQ ID NO: 1690294 - RNA, 23 nt, Homo sapiens
gcuagaaggcaaagugcacauga

SEQ ID NO: 1690295 - RNA, 14 nt, Homo sapiens
gcuagaguccucac

SEQ ID NO: 1690296 - RNA, 16 nt, Homo sapiens
gcuaggggacaucaga

SEQ ID NO: 1690297 - RNA, 19 nt, Homo sapiens
gcuaggguggcccuugcag

SEQ ID NO: 1690298 - RNA, 16 nt, Homo sapiens
gcuaguccggacccac

SEQ ID NO: 1690299 - RNA, 11 nt, Homo sapiens
gcuaucucugu

SEQ ID NO: 1690300 - RNA, 11 nt, Homo sapiens
gcuaugaauga

SEQ ID NO: 1690301 - RNA, 14 nt, Homo sapiens
gcuauuacugucug

SEQ ID NO: 1690302 - RNA, 22 nt, Homo sapiens
gcuauuuccagagccagcucaa

SEQ ID NO: 1690303 - RNA, 19 nt, Homo sapiens
gcucaaaguacuacagcaa

SEQ ID NO: 1690304 - RNA, 18 nt, Homo sapiens
gcucaccagccccagugc

SEQ ID NO: 1690305 - RNA, 14 nt, Homo sapiens
gcucacugcagccu

SEQ ID NO: 1690306 - RNA, 16 nt, Homo sapiens
gcucagagaugugcac

SEQ ID NO: 1690307 - RNA, 16 nt, Homo sapiens
gcucagauuauuuaaa

SEQ ID NO: 1690308 - RNA, 19 nt, Homo sapiens
gcucagcggggacagcucc

SEQ ID NO: 1690309 - RNA, 14 nt, Homo sapiens
gcucauaagcaaua

SEQ ID NO: 1690310 - RNA, 21 nt, Homo sapiens
gcucauaagcaauaccagcaa

SEQ ID NO: 1690311 - RNA, 21 nt, Homo sapiens
gcucauaugcauguagucacu

SEQ ID NO: 1690312 - RNA, 17 nt, Homo sapiens
gcuccaggccugcagca

SEQ ID NO: 1690313 - RNA, 16 nt, Homo sapiens
gcucccugaagccagc

SEQ ID NO: 1690314 - RNA, 19 nt, Homo sapiens
gcuccuuggcuuaccugac

SEQ ID NO: 1690315 - RNA, 15 nt, Homo sapiens
gcucgcccuccuuuc

SEQ ID NO: 1690316 - RNA, 22 nt, Homo sapiens
gcucgggucccuucaccuccuc

SEQ ID NO: 1690317 - RNA, 14 nt, Homo sapiens
gcucuacaucuucu

SEQ ID NO: 1690318 - RNA, 20 nt, Homo sapiens
gcucucaguuaaaaugugag

SEQ ID NO: 1690319 - RNA, 14 nt, Homo sapiens
gcucucauugacuu

SEQ ID NO: 1690320 - RNA, 23 nt, Homo sapiens
gcucuccccaaacuugcuuuaug

SEQ ID NO: 1690321 - RNA, 21 nt, Homo sapiens
gcucugagagucuagauucuc

SEQ ID NO: 1690322 - RNA, 18 nt, Homo sapiens
gcucugaucauccacugu

SEQ ID NO: 1690323 - RNA, 16 nt, Homo sapiens
gcucugcugacagaca

SEQ ID NO: 1690324 - RNA, 22 nt, Homo sapiens
gcucuggacucuaaagaccaaa

SEQ ID NO: 1690325 - RNA, 13 nt, Homo sapiens
gcucuguauauau

SEQ ID NO: 1690326 - RNA, 16 nt, Homo sapiens
gcucuguggaugccag

SEQ ID NO: 1690327 - RNA, 14 nt, Homo sapiens
gcucuuaaauguag

SEQ ID NO: 1690328 - RNA, 13 nt, Homo sapiens
gcucuucacugaa

SEQ ID NO: 1690329 - RNA, 18 nt, Homo sapiens
gcucuucuaccauuugaa

SEQ ID NO: 1690330 - RNA, 21 nt, Homo sapiens
gcucuucuguggaccacugca

SEQ ID NO: 1690331 - RNA, 15 nt, Homo sapiens
gcucuuuaccaagga

SEQ ID NO: 1690332 - RNA, 15 nt, Homo sapiens
gcucuuugcugcacu

SEQ ID NO: 1690333 - RNA, 22 nt, Homo sapiens
gcugaaaaaacaccuagcuuua

SEQ ID NO: 1690334 - RNA, 22 nt, Homo sapiens
gcugaaugccuccuguggggaa

SEQ ID NO: 1690335 - RNA, 22 nt, Homo sapiens
gcugaauguggacucaaucccu

SEQ ID NO: 1690336 - RNA, 16 nt, Homo sapiens
gcugaccucccaguga

SEQ ID NO: 1690337 - RNA, 17 nt, Homo sapiens
gcugaccuggagaugcu

SEQ ID NO: 1690338 - RNA, 15 nt, Homo sapiens
gcugagaacuccuga

SEQ ID NO: 1690339 - RNA, 21 nt, Homo sapiens
gcugagaaggguugauccugc

SEQ ID NO: 1690340 - RNA, 21 nt, Homo sapiens
gcugagaauguggaauaccua

SEQ ID NO: 1690341 - RNA, 14 nt, Homo sapiens
gcugagagaccuga

SEQ ID NO: 1690342 - RNA, 20 nt, Homo sapiens
gcugaggcccccagcugccu

SEQ ID NO: 1690343 - RNA, 19 nt, Homo sapiens
gcugaguagggacucaggg

SEQ ID NO: 1690344 - RNA, 14 nt, Homo sapiens
gcugauccaugaga

SEQ ID NO: 1690345 - RNA, 22 nt, Homo sapiens
gcugauugaagacacacucagc

SEQ ID NO: 1690346 - RNA, 17 nt, Homo sapiens
gcugcaggacuugagaa

SEQ ID NO: 1690347 - RNA, 19 nt, Homo sapiens
gcugcaggucaacagcuau

SEQ ID NO: 1690348 - RNA, 22 nt, Homo sapiens
gcugcaucuuauagcacuuuga

SEQ ID NO: 1690349 - RNA, 15 nt, Homo sapiens
gcugccucacuuccu

SEQ ID NO: 1690350 - RNA, 20 nt, Homo sapiens
gcugcggggggcaccagagg

SEQ ID NO: 1690351 - RNA, 15 nt, Homo sapiens
gcugcugcugcucca

SEQ ID NO: 1690352 - RNA, 19 nt, Homo sapiens
gcugcuuagacauaacaaa

SEQ ID NO: 1690353 - RNA, 19 nt, Homo sapiens
gcugcuuuaggaauucugc

SEQ ID NO: 1690354 - RNA, 15 nt, Homo sapiens
gcuggaagcaaagua

SEQ ID NO: 1690355 - RNA, 18 nt, Homo sapiens
gcuggacggggacugggg

SEQ ID NO: 1690356 - RNA, 14 nt, Homo sapiens
gcuggagugcagug

SEQ ID NO: 1690357 - RNA, 20 nt, Homo sapiens
gcuggagugcaguggugcaa

SEQ ID NO: 1690358 - RNA, 22 nt, Homo sapiens
gcuggcaagucuuccaugaccc

SEQ ID NO: 1690359 - RNA, 16 nt, Homo sapiens
gcuggccucucuagca

SEQ ID NO: 1690360 - RNA, 19 nt, Homo sapiens
gcuggccucucuagcacaa

SEQ ID NO: 1690361 - RNA, 18 nt, Homo sapiens
gcuggccucuggcucuca

SEQ ID NO: 1690362 - RNA, 16 nt, Homo sapiens
gcugggccaccagcca

SEQ ID NO: 1690363 - RNA, 15 nt, Homo sapiens
gcugggcuucagugg

SEQ ID NO: 1690364 - RNA, 18 nt, Homo sapiens
gcugggcuucaguggcag

SEQ ID NO: 1690365 - RNA, 19 nt, Homo sapiens
gcuggggaggagcuuuguu

SEQ ID NO: 1690366 - RNA, 22 nt, Homo sapiens
gcuggucuuggugaacacacau

SEQ ID NO: 1690367 - RNA, 13 nt, Homo sapiens
gcuguagaugaca

SEQ ID NO: 1690368 - RNA, 22 nt, Homo sapiens
gcuguggagagggucaaggagu

SEQ ID NO: 1690369 - RNA, 13 nt, Homo sapiens
gcuguuaaacugu

SEQ ID NO: 1690370 - RNA, 15 nt, Homo sapiens
gcuguuaccauucac

SEQ ID NO: 1690371 - RNA, 15 nt, Homo sapiens
gcuguucugcacuga

SEQ ID NO: 1690372 - RNA, 22 nt, Homo sapiens
gcuguuuguuucauauauacag

SEQ ID NO: 1690373 - RNA, 19 nt, Homo sapiens
gcuuaacacuugaccuaaa

SEQ ID NO: 1690374 - RNA, 14 nt, Homo sapiens
gcuuaagccaucuu

SEQ ID NO: 1690375 - RNA, 17 nt, Homo sapiens
gcuuaagccaucuuugu

SEQ ID NO: 1690376 - RNA, 19 nt, Homo sapiens
cuaauuuuaguauucauuc

SEQ ID NO: 1690377 - RNA, 20 nt, Homo sapiens
cuaauuuucuagauuuucua

SEQ ID NO: 1690378 - RNA, 22 nt, Homo sapiens
cuaauuuuuucccagacuacua

SEQ ID NO: 1690379 - RNA, 18 nt, Homo sapiens
cuacaaccaauuuacacu

SEQ ID NO: 1690380 - RNA, 14 nt, Homo sapiens
cuacaagauuuaga

SEQ ID NO: 1690381 - RNA, 17 nt, Homo sapiens
cuacacccagaccccag

SEQ ID NO: 1690382 - RNA, 14 nt, Homo sapiens
cuacacucuugacu

SEQ ID NO: 1690383 - RNA, 17 nt, Homo sapiens
cuacagcacuacugggu

SEQ ID NO: 1690384 - RNA, 11 nt, Homo sapiens
cuacagcuuuc

SEQ ID NO: 1690385 - RNA, 20 nt, Homo sapiens
cuacagugccaacuccucac

SEQ ID NO: 1690386 - RNA, 20 nt, Homo sapiens
caaagaggcugccccucuca

SEQ ID NO: 1690387 - RNA, 16 nt, Homo sapiens
caaagaucacugccca

SEQ ID NO: 1690388 - RNA, 17 nt, Homo sapiens
caaagauguggguggca

SEQ ID NO: 1690389 - RNA, 21 nt, Homo sapiens
caaagcacuagagaaugcaca

SEQ ID NO: 1690390 - RNA, 15 nt, Homo sapiens
caaaguagcaauuuc

SEQ ID NO: 1690391 - RNA, 24 nt, Homo sapiens
caaaguauaaccauaugauacuau

SEQ ID NO: 1690392 - RNA, 14 nt, Homo sapiens
caaaguauuugcug

SEQ ID NO: 1690393 - RNA, 20 nt, Homo sapiens
caaaguccuuuuuuuccauc

SEQ ID NO: 1690394 - RNA, 14 nt, Homo sapiens
caaagugcacauga

SEQ ID NO: 1690395 - RNA, 17 nt, Homo sapiens
caaagugcugagauuac

SEQ ID NO: 1690396 - RNA, 21 nt, Homo sapiens
caaaguguuuuuuauugaaug

SEQ ID NO: 1690397 - RNA, 22 nt, Homo sapiens
caaaguuacugauucacugcau

SEQ ID NO: 1690398 - RNA, 22 nt, Homo sapiens
caaauaaguauuuauaauagca

SEQ ID NO: 1690399 - RNA, 14 nt, Homo sapiens
caaauacuuagcaa

SEQ ID NO: 1690400 - RNA, 18 nt, Homo sapiens
caaauacuuagcaaaaag

SEQ ID NO: 1690401 - RNA, 18 nt, Homo sapiens
caaauagugcaacuauga

SEQ ID NO: 1690402 - RNA, 17 nt, Homo sapiens
caaaucaaaacucacaa

SEQ ID NO: 1690403 - RNA, 15 nt, Homo sapiens
caaauccgcucucuu

SEQ ID NO: 1690404 - RNA, 18 nt, Homo sapiens
caaaucguuuauuucaca

SEQ ID NO: 1690405 - RNA, 20 nt, Homo sapiens
caaaucuggcuccuuuacaa

SEQ ID NO: 1690406 - RNA, 15 nt, Homo sapiens
caaaugcaugaacaa

SEQ ID NO: 1690407 - RNA, 19 nt, Homo sapiens
caaaugucuaucaacuuua

SEQ ID NO: 1690408 - RNA, 17 nt, Homo sapiens
caaaugugauacauuua

SEQ ID NO: 1690409 - RNA, 15 nt, Homo sapiens
auuguauuacagaug

SEQ ID NO: 1690410 - RNA, 22 nt, Homo sapiens
auugucauaggauuaagcaguu

SEQ ID NO: 1690411 - RNA, 23 nt, Homo sapiens
auugugccgagaaaagcauuuua

SEQ ID NO: 1690412 - RNA, 22 nt, Homo sapiens
auugugguuuauugaaugugau

SEQ ID NO: 1690413 - RNA, 15 nt, Homo sapiens
auuguguugacauua

SEQ ID NO: 1690414 - RNA, 18 nt, Homo sapiens
auuguuaaucucuguuau

SEQ ID NO: 1690415 - RNA, 17 nt, Homo sapiens
auuguugaaauuuugca

SEQ ID NO: 1690416 - RNA, 16 nt, Homo sapiens
auuguuuggcuuccuc

SEQ ID NO: 1690417 - RNA, 21 nt, Homo sapiens
auuguuuugaaacucaguaug

SEQ ID NO: 1690418 - RNA, 16 nt, Homo sapiens
auuuaaacaccuccuc

SEQ ID NO: 1690419 - RNA, 13 nt, Homo sapiens
auuuaaaugggaa

SEQ ID NO: 1690420 - RNA, 13 nt, Homo sapiens
auuuaaugcauua

SEQ ID NO: 1690421 - RNA, 22 nt, Homo sapiens
auuuaauuuagugaucuuagca

SEQ ID NO: 1690422 - RNA, 19 nt, Homo sapiens
auuuagaaaaaaguuuaca

SEQ ID NO: 1690423 - RNA, 12 nt, Homo sapiens
auuuagacucau

SEQ ID NO: 1690424 - RNA, 21 nt, Homo sapiens
auuuagacuuacuauuacaua

SEQ ID NO: 1690425 - RNA, 17 nt, Homo sapiens
auuuagcuggccauuca

SEQ ID NO: 1690426 - RNA, 16 nt, Homo sapiens
auuuauaaaugagcaa

SEQ ID NO: 1690427 - RNA, 17 nt, Homo sapiens
auuuauuuacagaugaa

SEQ ID NO: 1690428 - RNA, 16 nt, Homo sapiens
auuuauuuacauguga

SEQ ID NO: 1690429 - RNA, 15 nt, Homo sapiens
auuuauuuucaauua

SEQ ID NO: 1690430 - RNA, 14 nt, Homo sapiens
auuucacuugauga

SEQ ID NO: 1690431 - RNA, 15 nt, Homo sapiens
auuucagauauucca

SEQ ID NO: 1690432 - RNA, 14 nt, Homo sapiens
auuucauaccucag

SEQ ID NO: 1690433 - RNA, 17 nt, Homo sapiens
accacagguucaugcca

SEQ ID NO: 1690434 - RNA, 17 nt, Homo sapiens
accacauccuccgucca

SEQ ID NO: 1690435 - RNA, 21 nt, Homo sapiens
accaccccaacaaaccaucca

SEQ ID NO: 1690436 - RNA, 16 nt, Homo sapiens
accacccuagucccuu

SEQ ID NO: 1690437 - RNA, 19 nt, Homo sapiens
accaccucccucaccaaca

SEQ ID NO: 1690438 - RNA, 15 nt, Homo sapiens
accacuaacuccuga

SEQ ID NO: 1690439 - RNA, 21 nt, Homo sapiens
accacuacaugcagcccaugc

SEQ ID NO: 1690440 - RNA, 17 nt, Homo sapiens
accacuccauucccaac

SEQ ID NO: 1690441 - RNA, 13 nt, Homo sapiens
accacuucacuga

SEQ ID NO: 1690442 - RNA, 16 nt, Homo sapiens
accagaauugugcaaa

SEQ ID NO: 1690443 - RNA, 16 nt, Homo sapiens
accagacacguacaaa

SEQ ID NO: 1690444 - RNA, 13 nt, Homo sapiens
accagagcauuuc

SEQ ID NO: 1690445 - RNA, 13 nt, Homo sapiens
accagauuugcua

SEQ ID NO: 1690446 - RNA, 17 nt, Homo sapiens
accagccccacugccag

SEQ ID NO: 1690447 - RNA, 13 nt, Homo sapiens
accagcucugggg

SEQ ID NO: 1690448 - RNA, 18 nt, Homo sapiens
accagggugguugggacg

SEQ ID NO: 1690449 - RNA, 19 nt, Homo sapiens
accagugguuuccagucau

SEQ ID NO: 1690450 - RNA, 19 nt, Homo sapiens
accauauugugcuucacag

SEQ ID NO: 1690451 - RNA, 18 nt, Homo sapiens
accaucaguucuuuuguc

SEQ ID NO: 1690452 - RNA, 15 nt, Homo sapiens
accauccugccaucc

SEQ ID NO: 1690453 - RNA, 21 nt, Homo sapiens
accaucuccagcuauuuacac

SEQ ID NO: 1690454 - RNA, 22 nt, Homo sapiens
acccacagacugguuuugcaac

SEQ ID NO: 1690455 - RNA, 23 nt, Homo sapiens
acccacaugugacacauaugcac

SEQ ID NO: 1690456 - RNA, 21 nt, Homo sapiens
acccacugcuuuuggucugug

SEQ ID NO: 1690457 - RNA, 15 nt, Homo sapiens
acccagaaaucauuu

SEQ ID NO: 1690458 - RNA, 21 nt, Homo sapiens
acccagagaguccugugcuga

SEQ ID NO: 1690459 - RNA, 20 nt, Homo sapiens
acccagcuugugccuguggu

SEQ ID NO: 1690460 - RNA, 18 nt, Homo sapiens
acccaggaccaagccaca

SEQ ID NO: 1690461 - RNA, 20 nt, Homo sapiens
acccaggacuuccauuugcu

SEQ ID NO: 1690462 - RNA, 20 nt, Homo sapiens
acccaggcuggagugcagug

SEQ ID NO: 1690463 - RNA, 23 nt, Homo sapiens
acccaguuugauaccugcacugu

SEQ ID NO: 1690464 - RNA, 19 nt, Homo sapiens
acccaucuaguacuugaaa

SEQ ID NO: 1690465 - RNA, 15 nt, Homo sapiens
acccaugacuuuaua

SEQ ID NO: 1690466 - RNA, 18 nt, Homo sapiens
acccaugagauucauuca

SEQ ID NO: 1690467 - RNA, 17 nt, Homo sapiens
acccaugggcucugaca

SEQ ID NO: 1690468 - RNA, 22 nt, Homo sapiens
acccaugggcucugacagaaag

SEQ ID NO: 1690469 - RNA, 17 nt, Homo sapiens
accccagcucccuagga

SEQ ID NO: 1690470 - RNA, 17 nt, Homo sapiens
accccaucuuuacuaaa

SEQ ID NO: 1690471 - RNA, 14 nt, Homo sapiens
accccaugccaaag

SEQ ID NO: 1690472 - RNA, 14 nt, Homo sapiens
accccauguccuca

SEQ ID NO: 1690473 - RNA, 20 nt, Homo sapiens
acccccacccccagcucaau

SEQ ID NO: 1690474 - RNA, 21 nt, Homo sapiens
gguauucuuaagggaacuucc

SEQ ID NO: 1690475 - RNA, 23 nt, Homo sapiens
gguauuucaaaacacaucuuucc

SEQ ID NO: 1690476 - RNA, 19 nt, Homo sapiens
gguauuuuggucacagggu

SEQ ID NO: 1690477 - RNA, 17 nt, Homo sapiens
ggucacauugugccuuu

SEQ ID NO: 1690478 - RNA, 13 nt, Homo sapiens
ggucauacaugca

SEQ ID NO: 1690479 - RNA, 15 nt, Homo sapiens
ggucauacaugcaua

SEQ ID NO: 1690480 - RNA, 18 nt, Homo sapiens
ggucaugugggucuucca

SEQ ID NO: 1690481 - RNA, 19 nt, Homo sapiens
ggucauuuuuauguuauua

SEQ ID NO: 1690482 - RNA, 11 nt, Homo sapiens
gguccacagag

SEQ ID NO: 1690483 - RNA, 19 nt, Homo sapiens
ggucccaggcagagaauca

SEQ ID NO: 1690484 - RNA, 16 nt, Homo sapiens
gguccuaaaagcaaaa

SEQ ID NO: 1690485 - RNA, 15 nt, Homo sapiens
gguccuggcuccuga

SEQ ID NO: 1690486 - RNA, 23 nt, Homo sapiens
ggucuagacuauuaggugcaauu

SEQ ID NO: 1690487 - RNA, 20 nt, Homo sapiens
ggugaaccuuaguaccuaaa

SEQ ID NO: 1690488 - RNA, 20 nt, Homo sapiens
ggugacaguccaaaccacuc

SEQ ID NO: 1690489 - RNA, 16 nt, Homo sapiens
ggugacgguugggagc

SEQ ID NO: 1690490 - RNA, 19 nt, Homo sapiens
ggugagcuccagcugcugc

SEQ ID NO: 1690491 - RNA, 19 nt, Homo sapiens
ggugcgcccugucucugug

SEQ ID NO: 1690492 - RNA, 16 nt, Homo sapiens
ggugcucuuugcugca

SEQ ID NO: 1690493 - RNA, 13 nt, Homo sapiens
gguggaugccugg

SEQ ID NO: 1690494 - RNA, 17 nt, Homo sapiens
gguggcccuugcaguuc

SEQ ID NO: 1690495 - RNA, 20 nt, Homo sapiens
gguguagccagguauggcuc

SEQ ID NO: 1690496 - RNA, 14 nt, Homo sapiens
gguguauguaugag

SEQ ID NO: 1690497 - RNA, 21 nt, Homo sapiens
ggugucaguauccaggcuuug

SEQ ID NO: 1690498 - RNA, 20 nt, Homo sapiens
ggugugaaccaccacaccca

SEQ ID NO: 1690499 - RNA, 15 nt, Homo sapiens
ggugugagcuucaga

SEQ ID NO: 1690500 - RNA, 17 nt, Homo sapiens
ggugugguggcacacac

SEQ ID NO: 1690501 - RNA, 19 nt, Homo sapiens
gguucagcuaagcuaggaa

SEQ ID NO: 1690502 - RNA, 17 nt, Homo sapiens
gguuggagcgagcaucc

SEQ ID NO: 1690503 - RNA, 20 nt, Homo sapiens
gguuggggugacagucauca

SEQ ID NO: 1690504 - RNA, 18 nt, Homo sapiens
gguuuauugaaugugauu

SEQ ID NO: 1690505 - RNA, 23 nt, Homo sapiens
gguuuccgaaggguuuugcuaca

SEQ ID NO: 1690506 - RNA, 16 nt, Homo sapiens
gguuugagaugcugua

SEQ ID NO: 1690507 - RNA, 20 nt, Homo sapiens
gguuuuaaccgcacaugcac

SEQ ID NO: 1690508 - RNA, 20 nt, Homo sapiens
guaaacagauggcacuuuga

SEQ ID NO: 1690509 - RNA, 14 nt, Homo sapiens
guaaauaacaggca

SEQ ID NO: 1690510 - RNA, 13 nt, Homo sapiens
guaaauacaggua

SEQ ID NO: 1690511 - RNA, 17 nt, Homo sapiens
guaaauagcucaggugu

SEQ ID NO: 1690512 - RNA, 23 nt, Homo sapiens
guaacauacuggccuggacuguu

SEQ ID NO: 1690513 - RNA, 16 nt, Homo sapiens
guaacauauucuguau

SEQ ID NO: 1690514 - RNA, 19 nt, Homo sapiens
guaacaucacuauccaugc

SEQ ID NO: 1690515 - RNA, 14 nt, Homo sapiens
guaacccaaaccuc

SEQ ID NO: 1690516 - RNA, 20 nt, Homo sapiens
guaaccuguugcuguguuua

SEQ ID NO: 1690517 - RNA, 14 nt, Homo sapiens
guaaggcucuagau

SEQ ID NO: 1690518 - RNA, 14 nt, Homo sapiens
guaaguuucaggug

SEQ ID NO: 1690519 - RNA, 20 nt, Homo sapiens
guaauaaaccuccuucggga

SEQ ID NO: 1690520 - RNA, 14 nt, Homo sapiens
guaauaauaccuca

SEQ ID NO: 1690521 - RNA, 19 nt, Homo sapiens
guaauccaggcacagcuga

SEQ ID NO: 1690522 - RNA, 19 nt, Homo sapiens
guaaucccagcuacucagg

SEQ ID NO: 1690523 - RNA, 18 nt, Homo sapiens
guaaucucucugcagcug

SEQ ID NO: 1690524 - RNA, 20 nt, Homo sapiens
guaauuuuaguagagacagg

SEQ ID NO: 1690525 - RNA, 15 nt, Homo sapiens
guaauuuugcaaaac

SEQ ID NO: 1690526 - RNA, 20 nt, Homo sapiens
guacaaacacaggauuugua

SEQ ID NO: 1690527 - RNA, 17 nt, Homo sapiens
guacaauugugggcaua

SEQ ID NO: 1690528 - RNA, 14 nt, Homo sapiens
guaccaagcauuua

SEQ ID NO: 1690529 - RNA, 20 nt, Homo sapiens
guacccacuuagucauguaa

SEQ ID NO: 1690530 - RNA, 20 nt, Homo sapiens
guacccagugccuacagggc

SEQ ID NO: 1690531 - RNA, 13 nt, Homo sapiens
guaccgacuuuga

SEQ ID NO: 1690532 - RNA, 14 nt, Homo sapiens
guaccucaucccau

SEQ ID NO: 1690533 - RNA, 19 nt, Homo sapiens
guaccugaaagcacuguag

SEQ ID NO: 1690534 - RNA, 20 nt, Homo sapiens
guaccugcuggcacuaucca

SEQ ID NO: 1690535 - RNA, 20 nt, Homo sapiens
guacuguaauaauaccucaa

SEQ ID NO: 1690536 - RNA, 14 nt, Homo sapiens
guacuuguuugcaa

SEQ ID NO: 1690537 - RNA, 13 nt, Homo sapiens
guagaacugagaa

SEQ ID NO: 1690538 - RNA, 21 nt, Homo sapiens
guagagaaaagcacacuugua

SEQ ID NO: 1690539 - RNA, 20 nt, Homo sapiens
guagagacaggguuuugcca

SEQ ID NO: 1690540 - RNA, 22 nt, Homo sapiens
guagagacaggguuuugccaug

SEQ ID NO: 1690541 - RNA, 19 nt, Homo sapiens
guagaggcugggggcucca

SEQ ID NO: 1690542 - RNA, 17 nt, Homo sapiens
guagcagugucuguaaa

SEQ ID NO: 1690543 - RNA, 15 nt, Homo sapiens
guagccuccuaucca

SEQ ID NO: 1690544 - RNA, 17 nt, Homo sapiens
guagccugugcauguau

SEQ ID NO: 1690545 - RNA, 18 nt, Homo sapiens
guagcuaaccaucacccc

SEQ ID NO: 1690546 - RNA, 14 nt, Homo sapiens
guagcuacaggaca

SEQ ID NO: 1690547 - RNA, 16 nt, Homo sapiens
guagcucucccuaggc

SEQ ID NO: 1690548 - RNA, 21 nt, Homo sapiens
guagcuuaccagaagcuucca

SEQ ID NO: 1690549 - RNA, 15 nt, Homo sapiens
guaggagacuugcca

SEQ ID NO: 1690550 - RNA, 22 nt, Homo sapiens
guaguuaggaaauaaaaccuuu

SEQ ID NO: 1690551 - RNA, 13 nt, Homo sapiens
guauaaacacucu

SEQ ID NO: 1690552 - RNA, 18 nt, Homo sapiens
guauaaaugugauaugau

SEQ ID NO: 1690553 - RNA, 17 nt, Homo sapiens
guauacuaagugauaca

SEQ ID NO: 1690554 - RNA, 16 nt, Homo sapiens
guauacuauaguacca

SEQ ID NO: 1690555 - RNA, 23 nt, Homo sapiens
guauagaaguuuguccauuugua

SEQ ID NO: 1690556 - RNA, 17 nt, Homo sapiens
guauagacaguuuguaa

SEQ ID NO: 1690557 - RNA, 18 nt, Homo sapiens
guauauauuuagugcugc

SEQ ID NO: 1690558 - RNA, 10 nt, Homo sapiens
guauaugcac

SEQ ID NO: 1690559 - RNA, 17 nt, Homo sapiens
guauaugucuuuuaccc

SEQ ID NO: 1690560 - RNA, 13 nt, Homo sapiens
guaucaacacugu

SEQ ID NO: 1690561 - RNA, 14 nt, Homo sapiens
guaucaacacuguu

SEQ ID NO: 1690562 - RNA, 19 nt, Homo sapiens
guaucacgggucacuugaa

SEQ ID NO: 1690563 - RNA, 19 nt, Homo sapiens
guaucuuuugaacuggcaa

SEQ ID NO: 1690564 - RNA, 21 nt, Homo sapiens
guauggggaggcaaguguggg

SEQ ID NO: 1690565 - RNA, 14 nt, Homo sapiens
guauguugccuuua

SEQ ID NO: 1690566 - RNA, 14 nt, Homo sapiens
guauuacacuguau

SEQ ID NO: 1690567 - RNA, 18 nt, Homo sapiens
guauugaaauguuugcau

SEQ ID NO: 1690568 - RNA, 12 nt, Homo sapiens
guauugguggcu

SEQ ID NO: 1690569 - RNA, 14 nt, Homo sapiens
guauuuuggucaca

SEQ ID NO: 1690570 - RNA, 17 nt, Homo sapiens
gucaaagugaugaauau

SEQ ID NO: 1690571 - RNA, 21 nt, Homo sapiens
gucaacaucuuuuacauucug

SEQ ID NO: 1690572 - RNA, 21 nt, Homo sapiens
gucaagcaccugcaugugcug

SEQ ID NO: 1690573 - RNA, 15 nt, Homo sapiens
ggccauuuacuguaa

SEQ ID NO: 1690574 - RNA, 13 nt, Homo sapiens
ggcccaguccucu

SEQ ID NO: 1690575 - RNA, 15 nt, Homo sapiens
ggccccugcaucccc

SEQ ID NO: 1690576 - RNA, 16 nt, Homo sapiens
ggccccugcccggcug

SEQ ID NO: 1690577 - RNA, 20 nt, Homo sapiens
ggccccuucucucccugcca

SEQ ID NO: 1690578 - RNA, 19 nt, Homo sapiens
ggcccugcugcccaaucuc

SEQ ID NO: 1690579 - RNA, 15 nt, Homo sapiens
ggcccuuugaagccu

SEQ ID NO: 1690580 - RNA, 17 nt, Homo sapiens
ggcccuuugaagccuca

SEQ ID NO: 1690581 - RNA, 13 nt, Homo sapiens
ggccgcacugggg

SEQ ID NO: 1690582 - RNA, 17 nt, Homo sapiens
ggccggcugugcucaga

SEQ ID NO: 1690583 - RNA, 16 nt, Homo sapiens
ggccgugagggguccc

SEQ ID NO: 1690584 - RNA, 16 nt, Homo sapiens
ggccuagaccuggugc

SEQ ID NO: 1690585 - RNA, 17 nt, Homo sapiens
ggccuaugcacauaugg

SEQ ID NO: 1690586 - RNA, 19 nt, Homo sapiens
ggccucagcugaaugccuc

SEQ ID NO: 1690587 - RNA, 12 nt, Homo sapiens
ggccuccaugac

SEQ ID NO: 1690588 - RNA, 20 nt, Homo sapiens
ggccucuggcucucaugggg

SEQ ID NO: 1690589 - RNA, 15 nt, Homo sapiens
ggccuggacaguauc

SEQ ID NO: 1690590 - RNA, 23 nt, Homo sapiens
ggccuggaccugcccugggccac

SEQ ID NO: 1690591 - RNA, 17 nt, Homo sapiens
ggccuggacuuccagug

SEQ ID NO: 1690592 - RNA, 16 nt, Homo sapiens
ggccuggccaccucuc

SEQ ID NO: 1690593 - RNA, 16 nt, Homo sapiens
ggccuggccagaugca

SEQ ID NO: 1690594 - RNA, 16 nt, Homo sapiens
ggccuggggccugaga

SEQ ID NO: 1690595 - RNA, 17 nt, Homo sapiens
ggccuuagugggccagg

SEQ ID NO: 1690596 - RNA, 12 nt, Homo sapiens
ggccuuuccugg

SEQ ID NO: 1690597 - RNA, 15 nt, Homo sapiens
ggccuuucugugucc

SEQ ID NO: 1690598 - RNA, 20 nt, Homo sapiens
ggcggagguugcaaugagcc

SEQ ID NO: 1690599 - RNA, 21 nt, Homo sapiens
ggcuaacuauauuugcuuuuu

SEQ ID NO: 1690600 - RNA, 18 nt, Homo sapiens
ggcuaagaggcugcugaa

SEQ ID NO: 1690601 - RNA, 21 nt, Homo sapiens
ggcuagacacccauuuucaca

SEQ ID NO: 1690602 - RNA, 21 nt, Homo sapiens
ggcucagagggggacugcugc

SEQ ID NO: 1690603 - RNA, 19 nt, Homo sapiens
ggcucagcggggacagcuc

SEQ ID NO: 1690604 - RNA, 14 nt, Homo sapiens
ggcucccaugacca

SEQ ID NO: 1690605 - RNA, 16 nt, Homo sapiens
ggcuccuggggcaaug

SEQ ID NO: 1690606 - RNA, 17 nt, Homo sapiens
ggcuccuuuacaaaaga

SEQ ID NO: 1690607 - RNA, 18 nt, Homo sapiens
ggcucuccucgcaggugu

SEQ ID NO: 1690608 - RNA, 19 nt, Homo sapiens
ggcucugacagaaagcaga

SEQ ID NO: 1690609 - RNA, 22 nt, Homo sapiens
ggcucuguaccacgcuggccau

SEQ ID NO: 1690610 - RNA, 15 nt, Homo sapiens
ggcugaaagaugacg

SEQ ID NO: 1690611 - RNA, 16 nt, Homo sapiens
ggcuggaaggggucca

SEQ ID NO: 1690612 - RNA, 15 nt, Homo sapiens
ggcuggacaugcuga

SEQ ID NO: 1690613 - RNA, 15 nt, Homo sapiens
ggcuggagugcagug

SEQ ID NO: 1690614 - RNA, 19 nt, Homo sapiens
ggcuggagugcaguggcgu

SEQ ID NO: 1690615 - RNA, 20 nt, Homo sapiens
ggcuggagugcaguggugca

SEQ ID NO: 1690616 - RNA, 23 nt, Homo sapiens
ggcuggagugcaguggugcaauc

SEQ ID NO: 1690617 - RNA, 19 nt, Homo sapiens
ggcuggaugugguggcaua

SEQ ID NO: 1690618 - RNA, 13 nt, Homo sapiens
ggcugggccaugu

SEQ ID NO: 1690619 - RNA, 22 nt, Homo sapiens
ggcugggggccucagugccacu

SEQ ID NO: 1690620 - RNA, 20 nt, Homo sapiens
ggcuggguaccaaugcugca

SEQ ID NO: 1690621 - RNA, 17 nt, Homo sapiens
ggcugguaacaguucau

SEQ ID NO: 1690622 - RNA, 18 nt, Homo sapiens
ggcuggucuuggugaaca

SEQ ID NO: 1690623 - RNA, 15 nt, Homo sapiens
ggcuucaucugucaa

SEQ ID NO: 1690624 - RNA, 16 nt, Homo sapiens
ggcuucuacacugggu

SEQ ID NO: 1690625 - RNA, 15 nt, Homo sapiens
ggcuugacucaggau

SEQ ID NO: 1690626 - RNA, 21 nt, Homo sapiens
gggaaaccccccagagcucuu

SEQ ID NO: 1690627 - RNA, 22 nt, Homo sapiens
gggaaacuuagaucaucaguca

SEQ ID NO: 1690628 - RNA, 17 nt, Homo sapiens
gggaaauacaaggaaua

SEQ ID NO: 1690629 - RNA, 13 nt, Homo sapiens
gggaacauuucug

SEQ ID NO: 1690630 - RNA, 21 nt, Homo sapiens
gggaaccaugaagacaggaug

SEQ ID NO: 1690631 - RNA, 20 nt, Homo sapiens
gggaacgaugugucuguauu

SEQ ID NO: 1690632 - RNA, 18 nt, Homo sapiens
gggaaggaggguacagcu

SEQ ID NO: 1690633 - RNA, 16 nt, Homo sapiens
gggaaggucaccagca

SEQ ID NO: 1690634 - RNA, 22 nt, Homo sapiens
gggaaggucagcccagccccuc

SEQ ID NO: 1690635 - RNA, 20 nt, Homo sapiens
gggaaguccucccugguguc

SEQ ID NO: 1690636 - RNA, 15 nt, Homo sapiens
gggacagagccaugc

SEQ ID NO: 1690637 - RNA, 11 nt, Homo sapiens
gggacaggaug

SEQ ID NO: 1690638 - RNA, 19 nt, Homo sapiens
gggacauugcaauuugcag

SEQ ID NO: 1690639 - RNA, 20 nt, Homo sapiens
gggacgcuccgcugccgugc

SEQ ID NO: 1690640 - RNA, 13 nt, Homo sapiens
gggacugagccug

SEQ ID NO: 1690641 - RNA, 15 nt, Homo sapiens
gggacuugggucuca

SEQ ID NO: 1690642 - RNA, 22 nt, Homo sapiens
gggagaacgcggggaccccaga

SEQ ID NO: 1690643 - RNA, 12 nt, Homo sapiens
gggaggacaaaa

SEQ ID NO: 1690644 - RNA, 20 nt, Homo sapiens
gggaggcggagguugcaaug

SEQ ID NO: 1690645 - RNA, 22 nt, Homo sapiens
gggauguccuacuaucacugaa

SEQ ID NO: 1690646 - RNA, 22 nt, Homo sapiens
gggcaaacagaagaauuuuucu

SEQ ID NO: 1690647 - RNA, 17 nt, Homo sapiens
gggcaacagagcaagau

SEQ ID NO: 1690648 - RNA, 15 nt, Homo sapiens
gggcacaguccagga

SEQ ID NO: 1690649 - RNA, 18 nt, Homo sapiens
gggcacugaggaccagcc

SEQ ID NO: 1690650 - RNA, 15 nt, Homo sapiens
gggcagcauagcaag

SEQ ID NO: 1690651 - RNA, 15 nt, Homo sapiens
gggcagcucauagag

SEQ ID NO: 1690652 - RNA, 20 nt, Homo sapiens
gggcaggagggcccuaccug

SEQ ID NO: 1690653 - RNA, 16 nt, Homo sapiens
gggccauguccaaaga

SEQ ID NO: 1690654 - RNA, 22 nt, Homo sapiens
gggccgaauccccucccuguca

SEQ ID NO: 1690655 - RNA, 18 nt, Homo sapiens
gggccuuucuguguccua

SEQ ID NO: 1690656 - RNA, 21 nt, Homo sapiens
gggcgccaccgccacccgcag

SEQ ID NO: 1690657 - RNA, 18 nt, Homo sapiens
gggcguggagagcccggc

SEQ ID NO: 1690658 - RNA, 18 nt, Homo sapiens
gggcuaggggacaucaga

SEQ ID NO: 1690659 - RNA, 23 nt, Homo sapiens
gggcuauuuuuucccccacaaac

SEQ ID NO: 1690660 - RNA, 21 nt, Homo sapiens
gggcugaccugccucucacac

SEQ ID NO: 1690661 - RNA, 14 nt, Homo sapiens
gggcugcccucucc

SEQ ID NO: 1690662 - RNA, 17 nt, Homo sapiens
gggcugggcaaggaaaa

SEQ ID NO: 1690663 - RNA, 17 nt, Homo sapiens
gggcuggguaccaaugc

SEQ ID NO: 1690664 - RNA, 23 nt, Homo sapiens
ggggaacauuucuguaaauacca

SEQ ID NO: 1690665 - RNA, 18 nt, Homo sapiens
ggggaagaguggucuuga

SEQ ID NO: 1690666 - RNA, 16 nt, Homo sapiens
ggggccuagacucugu

SEQ ID NO: 1690667 - RNA, 12 nt, Homo sapiens
gggggaaggugg

SEQ ID NO: 1690668 - RNA, 14 nt, Homo sapiens
ggggucguuugcuu

SEQ ID NO: 1690669 - RNA, 11 nt, Homo sapiens
gggguggagca

SEQ ID NO: 1690670 - RNA, 18 nt, Homo sapiens
gggguggugggaaccaug

SEQ ID NO: 1690671 - RNA, 22 nt, Homo sapiens
ggguacucaauggaguaugucu

SEQ ID NO: 1690672 - RNA, 22 nt, Homo sapiens
gcuugaagcuguggagggccac

SEQ ID NO: 1690673 - RNA, 15 nt, Homo sapiens
gcuugagcccaggag

SEQ ID NO: 1690674 - RNA, 14 nt, Homo sapiens
gcuugcucauuaau

SEQ ID NO: 1690675 - RNA, 16 nt, Homo sapiens
gcuuguaucaacacug

SEQ ID NO: 1690676 - RNA, 20 nt, Homo sapiens
gcuugucuuaaaauaaugaa

SEQ ID NO: 1690677 - RNA, 16 nt, Homo sapiens
gcuuguuguuugcgca

SEQ ID NO: 1690678 - RNA, 22 nt, Homo sapiens
gcuuuagaugaggaaaugaucc

SEQ ID NO: 1690679 - RNA, 14 nt, Homo sapiens
gcuuuagcacagga

SEQ ID NO: 1690680 - RNA, 23 nt, Homo sapiens
gcuuucguguaaauuauguaaug

SEQ ID NO: 1690681 - RNA, 18 nt, Homo sapiens
gcuuugucuucagccucu

SEQ ID NO: 1690682 - RNA, 15 nt, Homo sapiens
gcuuuguguaauaua

SEQ ID NO: 1690683 - RNA, 20 nt, Homo sapiens
gcuuuguguuugguuuacau

SEQ ID NO: 1690684 - RNA, 15 nt, Homo sapiens
gcuuuucggcaaagc

SEQ ID NO: 1690685 - RNA, 19 nt, Homo sapiens
ggaaaagcaaaacuguagg

SEQ ID NO: 1690686 - RNA, 20 nt, Homo sapiens
ggaaaagcugcugacagugu

SEQ ID NO: 1690687 - RNA, 22 nt, Homo sapiens
ggaaaagguagcuuaccugaca

SEQ ID NO: 1690688 - RNA, 24 nt, Homo sapiens
ggaaaauaaacugacacuuauuaa

SEQ ID NO: 1690689 - RNA, 14 nt, Homo sapiens
ggaaaaugacucug

SEQ ID NO: 1690690 - RNA, 15 nt, Homo sapiens
ggaaagccucacuga

SEQ ID NO: 1690691 - RNA, 16 nt, Homo sapiens
ggaaagugcauaugaa

SEQ ID NO: 1690692 - RNA, 13 nt, Homo sapiens
ggaacacacuugg

SEQ ID NO: 1690693 - RNA, 13 nt, Homo sapiens
ggaaccaugaaga

SEQ ID NO: 1690694 - RNA, 17 nt, Homo sapiens
ggaaccuguccuaagga

SEQ ID NO: 1690695 - RNA, 19 nt, Homo sapiens
ggaaccuugcuguccugau

SEQ ID NO: 1690696 - RNA, 23 nt, Homo sapiens
ggaacugggccaacucaccugag

SEQ ID NO: 1690697 - RNA, 17 nt, Homo sapiens
ggaagaaaaugguuuau

SEQ ID NO: 1690698 - RNA, 15 nt, Homo sapiens
ggaagcuccacuguc

SEQ ID NO: 1690699 - RNA, 17 nt, Homo sapiens
ggaagcucugaagucac

SEQ ID NO: 1690700 - RNA, 16 nt, Homo sapiens
ggaaguaaagccucaa

SEQ ID NO: 1690701 - RNA, 13 nt, Homo sapiens
ggaaguccuugcc

SEQ ID NO: 1690702 - RNA, 14 nt, Homo sapiens
ggaaguugacuuau

SEQ ID NO: 1690703 - RNA, 21 nt, Homo sapiens
ggaauaaccuuccauacauuu

SEQ ID NO: 1690704 - RNA, 23 nt, Homo sapiens
ggaauaagcucuaguucuuaaca

SEQ ID NO: 1690705 - RNA, 16 nt, Homo sapiens
ggaauaauuauuuauu

SEQ ID NO: 1690706 - RNA, 21 nt, Homo sapiens
ggaauauuuuuuaaagaggau

SEQ ID NO: 1690707 - RNA, 17 nt, Homo sapiens
ggaauccagacccggcu

SEQ ID NO: 1690708 - RNA, 18 nt, Homo sapiens
ggacaaaacuucuuguca

SEQ ID NO: 1690709 - RNA, 19 nt, Homo sapiens
ggacaaaacuucuugucag

SEQ ID NO: 1690710 - RNA, 23 nt, Homo sapiens
ggacacuuaauacuaccuugaaa

SEQ ID NO: 1690711 - RNA, 20 nt, Homo sapiens
ggacagucagcucucuccuu

SEQ ID NO: 1690712 - RNA, 17 nt, Homo sapiens
ggacauuuaaaauucaa

SEQ ID NO: 1690713 - RNA, 19 nt, Homo sapiens
ggacauuuaaaauucaauu

SEQ ID NO: 1690714 - RNA, 12 nt, Homo sapiens
ggaccacugcau

SEQ ID NO: 1690715 - RNA, 15 nt, Homo sapiens
ggaccaguggugccu

SEQ ID NO: 1690716 - RNA, 17 nt, Homo sapiens
ggaccauucauacccac

SEQ ID NO: 1690717 - RNA, 17 nt, Homo sapiens
ggaccugcccugggcca

SEQ ID NO: 1690718 - RNA, 12 nt, Homo sapiens
ggacuccaugcu

SEQ ID NO: 1690719 - RNA, 17 nt, Homo sapiens
ggacuccaugcugccag

SEQ ID NO: 1690720 - RNA, 13 nt, Homo sapiens
ggacucugcacau

SEQ ID NO: 1690721 - RNA, 21 nt, Homo sapiens
ggacucugcaucccagcaccu

SEQ ID NO: 1690722 - RNA, 16 nt, Homo sapiens
ggacugauacugcagu

SEQ ID NO: 1690723 - RNA, 15 nt, Homo sapiens
ggacuuggaagcucc

SEQ ID NO: 1690724 - RNA, 22 nt, Homo sapiens
ggagaaagcagccauuggcacu

SEQ ID NO: 1690725 - RNA, 24 nt, Homo sapiens
ggagaacaucuuugacacucugca

SEQ ID NO: 1690726 - RNA, 12 nt, Homo sapiens
ggagaaucucag

SEQ ID NO: 1690727 - RNA, 19 nt, Homo sapiens
ggagcagauuuuugcaaua

SEQ ID NO: 1690728 - RNA, 19 nt, Homo sapiens
ggagccuaggaccacucag

SEQ ID NO: 1690729 - RNA, 21 nt, Homo sapiens
ggagccuuuuuaaaacacaug

SEQ ID NO: 1690730 - RNA, 18 nt, Homo sapiens
ggagcugcucucucauga

SEQ ID NO: 1690731 - RNA, 19 nt, Homo sapiens
ggaggacggugcaacccaa

SEQ ID NO: 1690732 - RNA, 15 nt, Homo sapiens
ggaggaucaguuuuu

SEQ ID NO: 1690733 - RNA, 20 nt, Homo sapiens
ggaggcagagguugcaguga

SEQ ID NO: 1690734 - RNA, 14 nt, Homo sapiens
ggagggcaguuuuc

SEQ ID NO: 1690735 - RNA, 16 nt, Homo sapiens
ggaguaggacauacca

SEQ ID NO: 1690736 - RNA, 20 nt, Homo sapiens
ggagucaccuucccuugcca

SEQ ID NO: 1690737 - RNA, 22 nt, Homo sapiens
ggagucaccuucccuugccacu

SEQ ID NO: 1690738 - RNA, 22 nt, Homo sapiens
ggagugcaguggcgugaucucg

SEQ ID NO: 1690739 - RNA, 22 nt, Homo sapiens
ggaguuccggaauuauucugug

SEQ ID NO: 1690740 - RNA, 18 nt, Homo sapiens
ggauaacccuacacccag

SEQ ID NO: 1690741 - RNA, 16 nt, Homo sapiens
ggaucuggccacagac

SEQ ID NO: 1690742 - RNA, 17 nt, Homo sapiens
ggaucuggccacagacu

SEQ ID NO: 1690743 - RNA, 15 nt, Homo sapiens
ggaugacccacuguc

SEQ ID NO: 1690744 - RNA, 16 nt, Homo sapiens
ggaugacccacugucc

SEQ ID NO: 1690745 - RNA, 15 nt, Homo sapiens
ggaugcuggccuuug

SEQ ID NO: 1690746 - RNA, 19 nt, Homo sapiens
ggaugcuggccuuugcucu

SEQ ID NO: 1690747 - RNA, 17 nt, Homo sapiens
ggaugucacagggccaa

SEQ ID NO: 1690748 - RNA, 17 nt, Homo sapiens
ggauucaucagcauuug

SEQ ID NO: 1690749 - RNA, 19 nt, Homo sapiens
ggauugcuaaucaccaaag

SEQ ID NO: 1690750 - RNA, 14 nt, Homo sapiens
ggauuuaauuucca

SEQ ID NO: 1690751 - RNA, 21 nt, Homo sapiens
ggcaagcugugacuucuccag

SEQ ID NO: 1690752 - RNA, 13 nt, Homo sapiens
ggcaagucuucca

SEQ ID NO: 1690753 - RNA, 16 nt, Homo sapiens
ggcaagucuuccauga

SEQ ID NO: 1690754 - RNA, 16 nt, Homo sapiens
ggcaaucucagaugca

SEQ ID NO: 1690755 - RNA, 19 nt, Homo sapiens
ggcaaucucagaugcaguu

SEQ ID NO: 1690756 - RNA, 18 nt, Homo sapiens
ggcaauuucaccaccaaa

SEQ ID NO: 1690757 - RNA, 21 nt, Homo sapiens
ggcacaauaugggcacuuuaa

SEQ ID NO: 1690758 - RNA, 21 nt, Homo sapiens
ggcacacaucaggaguucaau

SEQ ID NO: 1690759 - RNA, 15 nt, Homo sapiens
ggcacaccgggcacu

SEQ ID NO: 1690760 - RNA, 11 nt, Homo sapiens
ggcacauuccc

SEQ ID NO: 1690761 - RNA, 23 nt, Homo sapiens
ggcaccuuaagauuuugcaccug

SEQ ID NO: 1690762 - RNA, 19 nt, Homo sapiens
ggcacucagaagacacuga

SEQ ID NO: 1690763 - RNA, 20 nt, Homo sapiens
ggcacucagaagacacugau

SEQ ID NO: 1690764 - RNA, 21 nt, Homo sapiens
ggcacuguaguucuaagacuc

SEQ ID NO: 1690765 - RNA, 13 nt, Homo sapiens
ggcacuucauuga

SEQ ID NO: 1690766 - RNA, 11 nt, Homo sapiens
ggcacuuugaa

SEQ ID NO: 1690767 - RNA, 15 nt, Homo sapiens
ggcagauggggcacu

SEQ ID NO: 1690768 - RNA, 18 nt, Homo sapiens
ggcagcauagcaagacac

SEQ ID NO: 1690769 - RNA, 22 nt, Homo sapiens
ggcagcccugccaugucacaau

SEQ ID NO: 1690770 - RNA, 15 nt, Homo sapiens
ggcagcggguggcau

SEQ ID NO: 1690771 - RNA, 22 nt, Homo sapiens
ggcaucaugcaugucaaacaug

SEQ ID NO: 1690772 - RNA, 15 nt, Homo sapiens
cugaccugagccaga

SEQ ID NO: 1690773 - RNA, 18 nt, Homo sapiens
cugacucuccuccuugag

SEQ ID NO: 1690774 - RNA, 13 nt, Homo sapiens
cugacucuugcag

SEQ ID NO: 1690775 - RNA, 17 nt, Homo sapiens
cugagaaaagccucucc

SEQ ID NO: 1690776 - RNA, 17 nt, Homo sapiens
cugagaaauguucagaa

SEQ ID NO: 1690777 - RNA, 22 nt, Homo sapiens
cugagaaccccucugggaaaau

SEQ ID NO: 1690778 - RNA, 20 nt, Homo sapiens
cugagaacuccugacuguaa

SEQ ID NO: 1690779 - RNA, 11 nt, Homo sapiens
aaaaaaaagcu

SEQ ID NO: 1690780 - RNA, 15 nt, Homo sapiens
aaaaaacaaucugga

SEQ ID NO: 1690781 - RNA, 15 nt, Homo sapiens
aaaaaccugauggaa

SEQ ID NO: 1690782 - RNA, 18 nt, Homo sapiens
aaaaacuccccuuccuca

SEQ ID NO: 1690783 - RNA, 22 nt, Homo sapiens
aaaaagaagaacuauaugugaa

SEQ ID NO: 1690784 - RNA, 17 nt, Homo sapiens
aaaaagcccuuugcuaa

SEQ ID NO: 1690785 - RNA, 16 nt, Homo sapiens
aaaaagcucauuucau

SEQ ID NO: 1690786 - RNA, 23 nt, Homo sapiens
aaaaaguccuugauuuagcacua

SEQ ID NO: 1690787 - RNA, 16 nt, Homo sapiens
aaaaaugugucuguaa

SEQ ID NO: 1690788 - RNA, 15 nt, Homo sapiens
aaaacaagaugagau

SEQ ID NO: 1690789 - RNA, 13 nt, Homo sapiens
aaaacaguauuua

SEQ ID NO: 1690790 - RNA, 15 nt, Homo sapiens
aaaacagucaaccaa

SEQ ID NO: 1690791 - RNA, 23 nt, Homo sapiens
aaaacaguuuugucagucuuucu

SEQ ID NO: 1690792 - RNA, 19 nt, Homo sapiens
aaaacauugauuauaagca

SEQ ID NO: 1690793 - RNA, 14 nt, Homo sapiens
aaaaccacuuuccu

SEQ ID NO: 1690794 - RNA, 14 nt, Homo sapiens
aaaaccccaucucu

SEQ ID NO: 1690795 - RNA, 21 nt, Homo sapiens
aaaaccccaucuuuacuaaaa

SEQ ID NO: 1690796 - RNA, 18 nt, Homo sapiens
aaaaccugugugccauuu

SEQ ID NO: 1690797 - RNA, 21 nt, Homo sapiens
aaaacucugguaaaugaucac

SEQ ID NO: 1690798 - RNA, 19 nt, Homo sapiens
aaaacugaaaaucuaauau

SEQ ID NO: 1690799 - RNA, 21 nt, Homo sapiens
aaaacuuuggaguccccucac

SEQ ID NO: 1690800 - RNA, 22 nt, Homo sapiens
aaaagcagugggcuccuggcag

SEQ ID NO: 1690801 - RNA, 23 nt, Homo sapiens
aaaagcauaauugaaaguucuga

SEQ ID NO: 1690802 - RNA, 20 nt, Homo sapiens
aaaagcgacccauucagaga

SEQ ID NO: 1690803 - RNA, 15 nt, Homo sapiens
aaaagcugaucauaa

SEQ ID NO: 1690804 - RNA, 20 nt, Homo sapiens
aaaagcuuauucaucuguuu

SEQ ID NO: 1690805 - RNA, 21 nt, Homo sapiens
aaaagggauccguacauucaa

SEQ ID NO: 1690806 - RNA, 22 nt, Homo sapiens
aaaagguuaaacccacagccaa

SEQ ID NO: 1690807 - RNA, 15 nt, Homo sapiens
aaaaguauaugugag

SEQ ID NO: 1690808 - RNA, 19 nt, Homo sapiens
aaaaguuccaagagucuaa

SEQ ID NO: 1690809 - RNA, 12 nt, Homo sapiens
aaaaguuuacaa

SEQ ID NO: 1690810 - RNA, 16 nt, Homo sapiens
aaaauaguaaagccaa

SEQ ID NO: 1690811 - RNA, 20 nt, Homo sapiens
aaaauauacuggggcuuccu

SEQ ID NO: 1690812 - RNA, 15 nt, Homo sapiens
aaaauccauccaauc

SEQ ID NO: 1690813 - RNA, 21 nt, Homo sapiens
aaaaucuuggaaguacaugaa

SEQ ID NO: 1690814 - RNA, 22 nt, Homo sapiens
aaaaugaaaauuaggauuucau

SEQ ID NO: 1690815 - RNA, 23 nt, Homo sapiens
aaaaugaaugaggucugggcuag

SEQ ID NO: 1690816 - RNA, 12 nt, Homo sapiens
aaaaugagacaa

SEQ ID NO: 1690817 - RNA, 21 nt, Homo sapiens
aaaaugugaauugcaugacuu

SEQ ID NO: 1690818 - RNA, 17 nt, Homo sapiens
aaaaugugauguucuaa

SEQ ID NO: 1690819 - RNA, 13 nt, Homo sapiens
aaaauguugaaua

SEQ ID NO: 1690820 - RNA, 17 nt, Homo sapiens
aaaauuauacuaacuua

SEQ ID NO: 1690821 - RNA, 17 nt, Homo sapiens
aaaauucagagaguuag

SEQ ID NO: 1690822 - RNA, 14 nt, Homo sapiens
aaaauugacaauga

SEQ ID NO: 1690823 - RNA, 15 nt, Homo sapiens
aaaauugacaaugau

SEQ ID NO: 1690824 - RNA, 16 nt, Homo sapiens
aaaauuuuaguccaaa

SEQ ID NO: 1690825 - RNA, 21 nt, Homo sapiens
aaaauuuuuuuuguaacugga

SEQ ID NO: 1690826 - RNA, 21 nt, Homo sapiens
aaacaaauaaucacauugacu

SEQ ID NO: 1690827 - RNA, 13 nt, Homo sapiens
aaacaaauaugca

SEQ ID NO: 1690828 - RNA, 16 nt, Homo sapiens
aaacaauaucauauca

SEQ ID NO: 1690829 - RNA, 15 nt, Homo sapiens
aaacaaucacacuca

SEQ ID NO: 1690830 - RNA, 17 nt, Homo sapiens
aaacaccgcuucugccu

SEQ ID NO: 1690831 - RNA, 22 nt, Homo sapiens
aaacaccuagcuuuauucuuca

SEQ ID NO: 1690832 - RNA, 14 nt, Homo sapiens
aaacaccuccucau

SEQ ID NO: 1690833 - RNA, 18 nt, Homo sapiens
aaacacgaaacuuguuau

SEQ ID NO: 1690834 - RNA, 23 nt, Homo sapiens
aaacacucuugaauagacuucca

SEQ ID NO: 1690835 - RNA, 17 nt, Homo sapiens
aaacacuuacagaauua

SEQ ID NO: 1690836 - RNA, 11 nt, Homo sapiens
aaacagucaaa

SEQ ID NO: 1690837 - RNA, 14 nt, Homo sapiens
aaacauagcaucuc

SEQ ID NO: 1690838 - RNA, 20 nt, Homo sapiens
aaacauuauaaaaauugaca

SEQ ID NO: 1690839 - RNA, 14 nt, Homo sapiens
aaacauugugauca

SEQ ID NO: 1690840 - RNA, 16 nt, Homo sapiens
aaaccacuagaacucu

SEQ ID NO: 1690841 - RNA, 23 nt, Homo sapiens
aaacccacgauuuucuccagcuc

SEQ ID NO: 1690842 - RNA, 13 nt, Homo sapiens
aaaccccaucucu

SEQ ID NO: 1690843 - RNA, 19 nt, Homo sapiens
aaaccccaucuuuacuaaa

SEQ ID NO: 1690844 - RNA, 11 nt, Homo sapiens
aaaccuaccaa

SEQ ID NO: 1690845 - RNA, 13 nt, Homo sapiens
aaaccuaccaaaa

SEQ ID NO: 1690846 - RNA, 15 nt, Homo sapiens
aaaccuaguacugcc

SEQ ID NO: 1690847 - RNA, 14 nt, Homo sapiens
aaaccucaaaaugu

SEQ ID NO: 1690848 - RNA, 18 nt, Homo sapiens
aaaccuccgccaaugcac

SEQ ID NO: 1690849 - RNA, 14 nt, Homo sapiens
aaaccugugugcca

SEQ ID NO: 1690850 - RNA, 19 nt, Homo sapiens
aaaccuuucaaauuucaca

SEQ ID NO: 1690851 - RNA, 19 nt, Homo sapiens
aaacgucuucuaaacuucc

SEQ ID NO: 1690852 - RNA, 17 nt, Homo sapiens
aaacucaagacaaugca

SEQ ID NO: 1690853 - RNA, 12 nt, Homo sapiens
aaacucagggac

SEQ ID NO: 1690854 - RNA, 20 nt, Homo sapiens
aaacucagggacagagccau

SEQ ID NO: 1690855 - RNA, 11 nt, Homo sapiens
aaacucagugc

SEQ ID NO: 1690856 - RNA, 18 nt, Homo sapiens
aaacuccugggcucaggc

SEQ ID NO: 1690857 - RNA, 20 nt, Homo sapiens
aaacugcaaagcucggugcu

SEQ ID NO: 1690858 - RNA, 10 nt, Homo sapiens
aaacugccau

SEQ ID NO: 1690859 - RNA, 21 nt, Homo sapiens
aaacugcuuacuuaugccaua

SEQ ID NO: 1690860 - RNA, 14 nt, Homo sapiens
aaacugucuugccc

SEQ ID NO: 1690861 - RNA, 21 nt, Homo sapiens
aaacugugaagcauuuacaga

SEQ ID NO: 1690862 - RNA, 13 nt, Homo sapiens
aaacuuaaaucuc

SEQ ID NO: 1690863 - RNA, 13 nt, Homo sapiens
aaacuuagaucau

SEQ ID NO: 1690864 - RNA, 20 nt, Homo sapiens
aaacuucuugucagacauaa

SEQ ID NO: 1690865 - RNA, 23 nt, Homo sapiens
aaacuuugacgagucaccuucca

SEQ ID NO: 1690866 - RNA, 15 nt, Homo sapiens
aaagaaagaaggaag

SEQ ID NO: 1690867 - RNA, 13 nt, Homo sapiens
aaggaagagccaa

SEQ ID NO: 1690868 - RNA, 20 nt, Homo sapiens
aaggaauagaagcaaauuaa

SEQ ID NO: 1690869 - RNA, 13 nt, Homo sapiens
aaggacagcugaa

SEQ ID NO: 1690870 - RNA, 22 nt, Homo sapiens
aaggacagcugaaccccugggg

SEQ ID NO: 1690871 - RNA, 21 nt, Homo sapiens
aaggaccugaaauuccaaagu

SEQ ID NO: 1690872 - RNA, 17 nt, Homo sapiens
aaggacgguucuuacac

SEQ ID NO: 1690873 - RNA, 22 nt, Homo sapiens
aaggaguacaaugcccagauca

SEQ ID NO: 1690874 - RNA, 11 nt, Homo sapiens
aaggagucaaa

SEQ ID NO: 1690875 - RNA, 19 nt, Homo sapiens
aaggauagcaccgcuuuug

SEQ ID NO: 1690876 - RNA, 12 nt, Homo sapiens
aaggaugaauga

SEQ ID NO: 1690877 - RNA, 23 nt, Homo sapiens
aaggaugcugucaagcaccugca

SEQ ID NO: 1690878 - RNA, 23 nt, Homo sapiens
aaggcagggugguguaccugcug

SEQ ID NO: 1690879 - RNA, 20 nt, Homo sapiens
aaggcagugauuagcacuug

SEQ ID NO: 1690880 - RNA, 22 nt, Homo sapiens
aaggcauaugcuggcccauaaa

SEQ ID NO: 1690881 - RNA, 15 nt, Homo sapiens
aaggcuuuaucucag

SEQ ID NO: 1690882 - RNA, 13 nt, Homo sapiens
aagggaacuucca

SEQ ID NO: 1690883 - RNA, 12 nt, Homo sapiens
aagggacuccca

SEQ ID NO: 1690884 - RNA, 16 nt, Homo sapiens
aagggagguggcaaga

SEQ ID NO: 1690885 - RNA, 21 nt, Homo sapiens
aagggaucaucaugcagcuca

SEQ ID NO: 1690886 - RNA, 21 nt, Homo sapiens
aagggcacgugaagucauuga

SEQ ID NO: 1690887 - RNA, 16 nt, Homo sapiens
aaggggcacugguggc

SEQ ID NO: 1690888 - RNA, 23 nt, Homo sapiens
aaggggccucaccgagugggggc

SEQ ID NO: 1690889 - RNA, 19 nt, Homo sapiens
aaggggcuguuacauaaca

SEQ ID NO: 1690890 - RNA, 14 nt, Homo sapiens
aaggggugggccac

SEQ ID NO: 1690891 - RNA, 21 nt, Homo sapiens
aaggguugggagcugaugaaa

SEQ ID NO: 1690892 - RNA, 15 nt, Homo sapiens
aaggucucauucuuc

SEQ ID NO: 1690893 - RNA, 18 nt, Homo sapiens
aaggucucauucuuccaa

SEQ ID NO: 1690894 - RNA, 14 nt, Homo sapiens
aaggucugaugucu

SEQ ID NO: 1690895 - RNA, 16 nt, Homo sapiens
aaggugaugugauuca

SEQ ID NO: 1690896 - RNA, 14 nt, Homo sapiens
aagguggaugccaa

SEQ ID NO: 1690897 - RNA, 13 nt, Homo sapiens
aagguuaaaccca

SEQ ID NO: 1690898 - RNA, 12 nt, Homo sapiens
aagguucacagg

SEQ ID NO: 1690899 - RNA, 15 nt, Homo sapiens
aagguucacucucaa

SEQ ID NO: 1690900 - RNA, 14 nt, Homo sapiens
aagguucagcugaa

SEQ ID NO: 1690901 - RNA, 11 nt, Homo sapiens
aagguucucug

SEQ ID NO: 1690902 - RNA, 14 nt, Homo sapiens
aagguucucugugc

SEQ ID NO: 1690903 - RNA, 21 nt, Homo sapiens
aagguuuuaaccgcacaugca

SEQ ID NO: 1690904 - RNA, 18 nt, Homo sapiens
aaguaacuucacauuaaa

SEQ ID NO: 1690905 - RNA, 22 nt, Homo sapiens
aaguaauuccucucacuaaacu

SEQ ID NO: 1690906 - RNA, 15 nt, Homo sapiens
aaguacaauaauuca

SEQ ID NO: 1690907 - RNA, 11 nt, Homo sapiens
aaguacauauu

SEQ ID NO: 1690908 - RNA, 11 nt, Homo sapiens
aaguacaucuc

SEQ ID NO: 1690909 - RNA, 19 nt, Homo sapiens
aaguacuguaauaauaccu

SEQ ID NO: 1690910 - RNA, 18 nt, Homo sapiens
aaguacuucuccacccug

SEQ ID NO: 1690911 - RNA, 14 nt, Homo sapiens
aaguagaauccuaa

SEQ ID NO: 1690912 - RNA, 12 nt, Homo sapiens
aaguagcaauuu

SEQ ID NO: 1690913 - RNA, 19 nt, Homo sapiens
aaguauaaucagcacuuug

SEQ ID NO: 1690914 - RNA, 19 nt, Homo sapiens
aaguauaucuuuaauucug

SEQ ID NO: 1690915 - RNA, 17 nt, Homo sapiens
aaguaugagggaaaaug

SEQ ID NO: 1690916 - RNA, 15 nt, Homo sapiens
aaguauuucugugga

SEQ ID NO: 1690917 - RNA, 17 nt, Homo sapiens
aagucaaucauuucuca

SEQ ID NO: 1690918 - RNA, 13 nt, Homo sapiens
aagucacugcaca

SEQ ID NO: 1690919 - RNA, 17 nt, Homo sapiens
aagucaugugcauuucc

SEQ ID NO: 1690920 - RNA, 13 nt, Homo sapiens
aagucauuccuuc

SEQ ID NO: 1690921 - RNA, 17 nt, Homo sapiens
aaguccuuucuaaguau

SEQ ID NO: 1690922 - RNA, 13 nt, Homo sapiens
aagucuccaguca

SEQ ID NO: 1690923 - RNA, 16 nt, Homo sapiens
aagucugcuacccuca

SEQ ID NO: 1690924 - RNA, 23 nt, Homo sapiens
aagugaaggacauagagguauau

SEQ ID NO: 1690925 - RNA, 17 nt, Homo sapiens
aagugccacucauuccu

SEQ ID NO: 1690926 - RNA, 16 nt, Homo sapiens
aagugccuuacagggu

SEQ ID NO: 1690927 - RNA, 23 nt, Homo sapiens
aagugcugggauuacagguguga

SEQ ID NO: 1690928 - RNA, 16 nt, Homo sapiens
aaguguaccuguguac

SEQ ID NO: 1690929 - RNA, 18 nt, Homo sapiens
aaguguguaugauaauga

SEQ ID NO: 1690930 - RNA, 13 nt, Homo sapiens
aaguuacuuuaug

SEQ ID NO: 1690931 - RNA, 18 nt, Homo sapiens
aaguuauacuguggcuau

SEQ ID NO: 1690932 - RNA, 22 nt, Homo sapiens
aaguuauccagaggguugugau

SEQ ID NO: 1690933 - RNA, 14 nt, Homo sapiens
aaguuauugauguu

SEQ ID NO: 1690934 - RNA, 16 nt, Homo sapiens
aaguuauugauguuuu

SEQ ID NO: 1690935 - RNA, 15 nt, Homo sapiens
aaguuauugugauaa

SEQ ID NO: 1690936 - RNA, 14 nt, Homo sapiens
aaguucaacuucca

SEQ ID NO: 1690937 - RNA, 17 nt, Homo sapiens
aaguucaacuuccagaa

SEQ ID NO: 1690938 - RNA, 13 nt, Homo sapiens
aaguucagcacuu

SEQ ID NO: 1690939 - RNA, 22 nt, Homo sapiens
aaguucauaccuaaguacugua

SEQ ID NO: 1690940 - RNA, 21 nt, Homo sapiens
aaguuccaagagucuaaagau

SEQ ID NO: 1690941 - RNA, 20 nt, Homo sapiens
aaguuccccuuauguggguu

SEQ ID NO: 1690942 - RNA, 22 nt, Homo sapiens
aaguucuucuccaauccuauca

SEQ ID NO: 1690943 - RNA, 20 nt, Homo sapiens
aaguucuuggugguggauga

SEQ ID NO: 1690944 - RNA, 15 nt, Homo sapiens
aaguuucaaugugau

SEQ ID NO: 1690945 - RNA, 17 nt, Homo sapiens
aaguuugcacucuuuga

SEQ ID NO: 1690946 - RNA, 23 nt, Homo sapiens
aaguuuugaguagauauuacuuu

SEQ ID NO: 1690947 - RNA, 16 nt, Homo sapiens
aauaaaauccuaagac

SEQ ID NO: 1690948 - RNA, 12 nt, Homo sapiens
aauaaacauaau

SEQ ID NO: 1690949 - RNA, 15 nt, Homo sapiens
aauaaacccuuccug

SEQ ID NO: 1690950 - RNA, 14 nt, Homo sapiens
aauaaagcuucauu

SEQ ID NO: 1690951 - RNA, 20 nt, Homo sapiens
aauaaaggaugugauugugg

SEQ ID NO: 1690952 - RNA, 18 nt, Homo sapiens
aauaacucuccaguaaca

SEQ ID NO: 1690953 - RNA, 12 nt, Homo sapiens
aauaauaugcau

SEQ ID NO: 1690954 - RNA, 16 nt, Homo sapiens
aauaaugaacacuaca

SEQ ID NO: 1690955 - RNA, 17 nt, Homo sapiens
aauaauucauauucuuc

SEQ ID NO: 1690956 - RNA, 22 nt, Homo sapiens
aauaauucauauucuucauauc

SEQ ID NO: 1690957 - RNA, 18 nt, Homo sapiens
aauaauucaugauucaac

SEQ ID NO: 1690958 - RNA, 22 nt, Homo sapiens
aauaauuuuaagaaaucaaaga

SEQ ID NO: 1690959 - RNA, 17 nt, Homo sapiens
aauacaaacaaucucuu

SEQ ID NO: 1690960 - RNA, 16 nt, Homo sapiens
aauacacuaauuccuu

SEQ ID NO: 1690961 - RNA, 15 nt, Homo sapiens
aauacaugcaucuca

SEQ ID NO: 1690962 - RNA, 18 nt, Homo sapiens
aauacgguaaggauacuu

SEQ ID NO: 1690963 - RNA, 20 nt, Homo sapiens
aauacuacugcacagaguca

SEQ ID NO: 1690964 - RNA, 23 nt, Homo sapiens
aauacuacugcacagagucagga

SEQ ID NO: 1690965 - RNA, 15 nt, Homo sapiens
aauagauuucucaag

SEQ ID NO: 1690966 - RNA, 14 nt, Homo sapiens
aauaggaauaagcu

SEQ ID NO: 1690967 - RNA, 24 nt, Homo sapiens
aauaggagaggaugagagcccaga

SEQ ID NO: 1690968 - RNA, 15 nt, Homo sapiens
aauagugcaacuaug

SEQ ID NO: 1690969 - RNA, 19 nt, Homo sapiens
aauaguuuugauccuaaau

SEQ ID NO: 1690970 - RNA, 17 nt, Homo sapiens
aauauaauuuucaaaaa

SEQ ID NO: 1690971 - RNA, 13 nt, Homo sapiens
aauauagugacua

SEQ ID NO: 1690972 - RNA, 19 nt, Homo sapiens
aauauagugacuaugaacu

SEQ ID NO: 1690973 - RNA, 23 nt, Homo sapiens
aauauauauauauaucaguuuga

SEQ ID NO: 1690974 - RNA, 21 nt, Homo sapiens
aauauauuguacacuacagca

SEQ ID NO: 1690975 - RNA, 19 nt, Homo sapiens
aauauauuuuuagacucau

SEQ ID NO: 1690976 - RNA, 17 nt, Homo sapiens
aauauccaaaccaaaua

SEQ ID NO: 1690977 - RNA, 20 nt, Homo sapiens
auaaacuuuuuuucaaugug

SEQ ID NO: 1690978 - RNA, 17 nt, Homo sapiens
auaaagauuucaagauc

SEQ ID NO: 1690979 - RNA, 12 nt, Homo sapiens
auaaagccaugu

SEQ ID NO: 1690980 - RNA, 14 nt, Homo sapiens
auaaaguccugaca

SEQ ID NO: 1690981 - RNA, 23 nt, Homo sapiens
auaaauuuuauaacagaauuaaa

SEQ ID NO: 1690982 - RNA, 15 nt, Homo sapiens
auaacaaugacacua

SEQ ID NO: 1690983 - RNA, 14 nt, Homo sapiens
auaacaauguuaag

SEQ ID NO: 1690984 - RNA, 12 nt, Homo sapiens
auaacacugucu

SEQ ID NO: 1690985 - RNA, 19 nt, Homo sapiens
auaacacuugcccaugcua

SEQ ID NO: 1690986 - RNA, 19 nt, Homo sapiens
auaaccuuuuuguauauca

SEQ ID NO: 1690987 - RNA, 21 nt, Homo sapiens
auaacgauuuuaugaaaugac

SEQ ID NO: 1690988 - RNA, 14 nt, Homo sapiens
auaacucuccagua

SEQ ID NO: 1690989 - RNA, 18 nt, Homo sapiens
auaacucuguaaaaacac

SEQ ID NO: 1690990 - RNA, 23 nt, Homo sapiens
auaacucuguaaaaacacugaaa

SEQ ID NO: 1690991 - RNA, 12 nt, Homo sapiens
auaacugugaag

SEQ ID NO: 1690992 - RNA, 17 nt, Homo sapiens
auaacuuagguggcaag

SEQ ID NO: 1690993 - RNA, 14 nt, Homo sapiens
auaacuucugaccu

SEQ ID NO: 1690994 - RNA, 13 nt, Homo sapiens
auaagaagcaaau

SEQ ID NO: 1690995 - RNA, 14 nt, Homo sapiens
auaagacacucaaa

SEQ ID NO: 1690996 - RNA, 16 nt, Homo sapiens
auaagcaauaccagca

SEQ ID NO: 1690997 - RNA, 19 nt, Homo sapiens
auaagcacugaaaaacaac

SEQ ID NO: 1690998 - RNA, 21 nt, Homo sapiens
auaagcucuaguucuuaacaa

SEQ ID NO: 1690999 - RNA, 16 nt, Homo sapiens
auaaguuugcaguugg

SEQ ID NO: 1691000 - RNA, 13 nt, Homo sapiens
auaauaccucaau

SEQ ID NO: 1691001 - RNA, 10 nt, Homo sapiens
auaauacucu

SEQ ID NO: 1691002 - RNA, 15 nt, Homo sapiens
auaauccuuucugcc

SEQ ID NO: 1691003 - RNA, 16 nt, Homo sapiens
auaaugaaaacauccu

SEQ ID NO: 1691004 - RNA, 15 nt, Homo sapiens
auaaugacucagaau

SEQ ID NO: 1691005 - RNA, 15 nt, Homo sapiens
auaaugagcuauuaa

SEQ ID NO: 1691006 - RNA, 21 nt, Homo sapiens
auaauuaaauuuugaguucua

SEQ ID NO: 1691007 - RNA, 15 nt, Homo sapiens
auaauuuucugaaag

SEQ ID NO: 1691008 - RNA, 23 nt, Homo sapiens
auacacguuacugaucuuacuca

SEQ ID NO: 1691009 - RNA, 14 nt, Homo sapiens
auacacuaaccaaa

SEQ ID NO: 1691010 - RNA, 22 nt, Homo sapiens
auacagcccucccccagcaguu

SEQ ID NO: 1691011 - RNA, 22 nt, Homo sapiens
auacauccacaggguuuugaca

SEQ ID NO: 1691012 - RNA, 18 nt, Homo sapiens
auacauuuaugcacauuc

SEQ ID NO: 1691013 - RNA, 19 nt, Homo sapiens
auaccaagaugccaucugu

SEQ ID NO: 1691014 - RNA, 13 nt, Homo sapiens
auaccaagcuugu

SEQ ID NO: 1691015 - RNA, 20 nt, Homo sapiens
auaccucaaacuaucuggcc

SEQ ID NO: 1691016 - RNA, 22 nt, Homo sapiens
auaccugcucuuguucuacuga

SEQ ID NO: 1691017 - RNA, 18 nt, Homo sapiens
auaccuggcccaaccaga

SEQ ID NO: 1691018 - RNA, 14 nt, Homo sapiens
auacucaacaaaac

SEQ ID NO: 1691019 - RNA, 15 nt, Homo sapiens
auacucuagaugaag

SEQ ID NO: 1691020 - RNA, 23 nt, Homo sapiens
auacucuagaugaaguuuuacau

SEQ ID NO: 1691021 - RNA, 14 nt, Homo sapiens
auacugaguaugug

SEQ ID NO: 1691022 - RNA, 14 nt, Homo sapiens
auacuguacaugaa

SEQ ID NO: 1691023 - RNA, 13 nt, Homo sapiens
auacuguuuauuu

SEQ ID NO: 1691024 - RNA, 21 nt, Homo sapiens
auacuuauauuucccuaaaau

SEQ ID NO: 1691025 - RNA, 16 nt, Homo sapiens
auagaaacaugacacu

SEQ ID NO: 1691026 - RNA, 15 nt, Homo sapiens
auagaaguagcaaaa

SEQ ID NO: 1691027 - RNA, 21 nt, Homo sapiens
auagaaugagcacccauucca

SEQ ID NO: 1691028 - RNA, 21 nt, Homo sapiens
auagagauagcuacaguguaa

SEQ ID NO: 1691029 - RNA, 18 nt, Homo sapiens
auagagauuugucuaauu

SEQ ID NO: 1691030 - RNA, 21 nt, Homo sapiens
auagagugacuccaagaacaa

SEQ ID NO: 1691031 - RNA, 14 nt, Homo sapiens
auagagugucucag

SEQ ID NO: 1691032 - RNA, 19 nt, Homo sapiens
auagaucaaagucaaaaau

SEQ ID NO: 1691033 - RNA, 22 nt, Homo sapiens
auagaugccgcggaaggucccu

SEQ ID NO: 1691034 - RNA, 17 nt, Homo sapiens
auagauuucuacacuga

SEQ ID NO: 1691035 - RNA, 14 nt, Homo sapiens
auagcaauuucgcc

SEQ ID NO: 1691036 - RNA, 21 nt, Homo sapiens
auagcacuuugaaauaccuca

SEQ ID NO: 1691037 - RNA, 14 nt, Homo sapiens
auagcaucucagga

SEQ ID NO: 1691038 - RNA, 16 nt, Homo sapiens
auagccauugaucaua

SEQ ID NO: 1691039 - RNA, 13 nt, Homo sapiens
auagcccacagcu

SEQ ID NO: 1691040 - RNA, 17 nt, Homo sapiens
auaggacauugugucag

SEQ ID NO: 1691041 - RNA, 15 nt, Homo sapiens
auaggagugaauaca

SEQ ID NO: 1691042 - RNA, 16 nt, Homo sapiens
auaggaugguaccaag

SEQ ID NO: 1691043 - RNA, 17 nt, Homo sapiens
auaggcaaaaucugaca

SEQ ID NO: 1691044 - RNA, 15 nt, Homo sapiens
auaguaaguucagca

SEQ ID NO: 1691045 - RNA, 13 nt, Homo sapiens
auaguccaaaaag

SEQ ID NO: 1691046 - RNA, 11 nt, Homo sapiens
auagucuuuca

SEQ ID NO: 1691047 - RNA, 18 nt, Homo sapiens
auaguuggucaucuagca

SEQ ID NO: 1691048 - RNA, 20 nt, Homo sapiens
auauaaaaauaaugucauag

SEQ ID NO: 1691049 - RNA, 18 nt, Homo sapiens
auauaaaguacaucucua

SEQ ID NO: 1691050 - RNA, 20 nt, Homo sapiens
auauaacuaagacauaugca

SEQ ID NO: 1691051 - RNA, 23 nt, Homo sapiens
auauaauggaagagaaaucucau

SEQ ID NO: 1691052 - RNA, 19 nt, Homo sapiens
auauaauucccaagcuuuu

SEQ ID NO: 1691053 - RNA, 19 nt, Homo sapiens
auauacaguaacuuuaugu

SEQ ID NO: 1691054 - RNA, 12 nt, Homo sapiens
auauaccaagcu

SEQ ID NO: 1691055 - RNA, 16 nt, Homo sapiens
auauagguugugcaaa

SEQ ID NO: 1691056 - RNA, 17 nt, Homo sapiens
auauauacccacaugua

SEQ ID NO: 1691057 - RNA, 15 nt, Homo sapiens
auauauauauacuua

SEQ ID NO: 1691058 - RNA, 19 nt, Homo sapiens
auauauguguauauauaca

SEQ ID NO: 1691059 - RNA, 19 nt, Homo sapiens
auauauguuaagcagauau

SEQ ID NO: 1691060 - RNA, 13 nt, Homo sapiens
auauauuuuuaga

SEQ ID NO: 1691061 - RNA, 14 nt, Homo sapiens
auaucagcacauau

SEQ ID NO: 1691062 - RNA, 14 nt, Homo sapiens
auaucauacuucca

SEQ ID NO: 1691063 - RNA, 12 nt, Homo sapiens
auaucaucauag

SEQ ID NO: 1691064 - RNA, 22 nt, Homo sapiens
auaucauuuauuuuuuacauua

SEQ ID NO: 1691065 - RNA, 18 nt, Homo sapiens
auaucccaagugcacuuu

SEQ ID NO: 1691066 - RNA, 15 nt, Homo sapiens
auauccugugacugu

SEQ ID NO: 1691067 - RNA, 14 nt, Homo sapiens
auaucgaucucuua

SEQ ID NO: 1691068 - RNA, 18 nt, Homo sapiens
auaucuauaguagacaca

SEQ ID NO: 1691069 - RNA, 12 nt, Homo sapiens
auaucugggcug

SEQ ID NO: 1691070 - RNA, 22 nt, Homo sapiens
auaucuugcgaauccaagcucc

SEQ ID NO: 1691071 - RNA, 15 nt, Homo sapiens
auaucuuugugauaa

SEQ ID NO: 1691072 - RNA, 23 nt, Homo sapiens
auaugaucuguuuuguaucuuaa

SEQ ID NO: 1691073 - RNA, 18 nt, Homo sapiens
auaugcaccuugugucug

SEQ ID NO: 1691074 - RNA, 14 nt, Homo sapiens
auaugcagugauau

SEQ ID NO: 1691075 - RNA, 18 nt, Homo sapiens
auaugggacugagccugg

SEQ ID NO: 1691076 - RNA, 15 nt, Homo sapiens
auaugggcacuuuaa

SEQ ID NO: 1691077 - RNA, 19 nt, Homo sapiens
auauuaacaacaauaacac

SEQ ID NO: 1691078 - RNA, 12 nt, Homo sapiens
auauuacuuguu

SEQ ID NO: 1691079 - RNA, 22 nt, Homo sapiens
auauuaucacgcagaucacuaa

SEQ ID NO: 1691080 - RNA, 13 nt, Homo sapiens
auauuccugcauu

SEQ ID NO: 1691081 - RNA, 21 nt, Homo sapiens
auauucugaagcaacauuuua

SEQ ID NO: 1691082 - RNA, 18 nt, Homo sapiens
auauucugguuacugugg

SEQ ID NO: 1691083 - RNA, 15 nt, Homo sapiens
auauuuaaugcauua

SEQ ID NO: 1691084 - RNA, 13 nt, Homo sapiens
auauuuacuaccu

SEQ ID NO: 1691085 - RNA, 13 nt, Homo sapiens
aucaaacccacga

SEQ ID NO: 1691086 - RNA, 20 nt, Homo sapiens
aucaaacccacgauuuucuc

SEQ ID NO: 1691087 - RNA, 12 nt, Homo sapiens
aucaacaaagaa

SEQ ID NO: 1691088 - RNA, 21 nt, Homo sapiens
aucuuuacaaaacuacaugag

SEQ ID NO: 1691089 - RNA, 22 nt, Homo sapiens
augaaaacauagcaucucagga

SEQ ID NO: 1691090 - RNA, 18 nt, Homo sapiens
augaaaauaaauagcuua

SEQ ID NO: 1691091 - RNA, 17 nt, Homo sapiens
augaaaaugucaauacu

SEQ ID NO: 1691092 - RNA, 16 nt, Homo sapiens
augaaaauuaggauuu

SEQ ID NO: 1691093 - RNA, 12 nt, Homo sapiens
augaaacuaaga

SEQ ID NO: 1691094 - RNA, 22 nt, Homo sapiens
augaaauccugcuucaguguau

SEQ ID NO: 1691095 - RNA, 17 nt, Homo sapiens
augaaauuuaaacauua

SEQ ID NO: 1691096 - RNA, 16 nt, Homo sapiens
augaacacuacagaua

SEQ ID NO: 1691097 - RNA, 20 nt, Homo sapiens
augaacacuuauaagugaag

SEQ ID NO: 1691098 - RNA, 22 nt, Homo sapiens
augaacccauccgguuugccau

SEQ ID NO: 1691099 - RNA, 12 nt, Homo sapiens
augaacuuucuc

SEQ ID NO: 1691100 - RNA, 23 nt, Homo sapiens
augaagcagcuuuaaacaaauuc

SEQ ID NO: 1691101 - RNA, 12 nt, Homo sapiens
augaagccagcu

SEQ ID NO: 1691102 - RNA, 15 nt, Homo sapiens
augaagggcuccgug

SEQ ID NO: 1691103 - RNA, 18 nt, Homo sapiens
augaauauuuuguaacua

SEQ ID NO: 1691104 - RNA, 15 nt, Homo sapiens
augaaucaucaaagc

SEQ ID NO: 1691105 - RNA, 11 nt, Homo sapiens
augaauucuua

SEQ ID NO: 1691106 - RNA, 17 nt, Homo sapiens
augacagaaaaguaaug

SEQ ID NO: 1691107 - RNA, 17 nt, Homo sapiens
augacagccucuauccu

SEQ ID NO: 1691108 - RNA, 18 nt, Homo sapiens
augacauaugacuugauc

SEQ ID NO: 1691109 - RNA, 14 nt, Homo sapiens
augacaugcacuga

SEQ ID NO: 1691110 - RNA, 21 nt, Homo sapiens
augacccccgcaaguuugcac

SEQ ID NO: 1691111 - RNA, 21 nt, Homo sapiens
augacgucaucaucacauuca

SEQ ID NO: 1691112 - RNA, 14 nt, Homo sapiens
augacuacuuuuuc

SEQ ID NO: 1691113 - RNA, 13 nt, Homo sapiens
augacuugcuacu

SEQ ID NO: 1691114 - RNA, 17 nt, Homo sapiens
augagaugacauucacc

SEQ ID NO: 1691115 - RNA, 13 nt, Homo sapiens
augagauuggcau

SEQ ID NO: 1691116 - RNA, 18 nt, Homo sapiens
augagcacccauuccaaa

SEQ ID NO: 1691117 - RNA, 16 nt, Homo sapiens
augagccgcugugagc

SEQ ID NO: 1691118 - RNA, 11 nt, Homo sapiens
augagcucaaa

SEQ ID NO: 1691119 - RNA, 16 nt, Homo sapiens
augagcugacaucuca

SEQ ID NO: 1691120 - RNA, 15 nt, Homo sapiens
augaggaaaugaucc

SEQ ID NO: 1691121 - RNA, 22 nt, Homo sapiens
augagguucuggccccugucau

SEQ ID NO: 1691122 - RNA, 14 nt, Homo sapiens
augauagcuacugu

SEQ ID NO: 1691123 - RNA, 16 nt, Homo sapiens
augauauaacccuaac

SEQ ID NO: 1691124 - RNA, 21 nt, Homo sapiens
augaucaauccuuuauuauua

SEQ ID NO: 1691125 - RNA, 18 nt, Homo sapiens
augaucagcaucugugau

SEQ ID NO: 1691126 - RNA, 20 nt, Homo sapiens
augaucuuugcagacaggca

SEQ ID NO: 1691127 - RNA, 19 nt, Homo sapiens
augaugaaaaccuacauau

SEQ ID NO: 1691128 - RNA, 14 nt, Homo sapiens
augaugcagucucc

SEQ ID NO: 1691129 - RNA, 13 nt, Homo sapiens
augauuguucaaa

SEQ ID NO: 1691130 - RNA, 20 nt, Homo sapiens
augauuguucaaagcacaga

SEQ ID NO: 1691131 - RNA, 17 nt, Homo sapiens
augauuucagcagggau

SEQ ID NO: 1691132 - RNA, 12 nt, Homo sapiens
augcacauuucu

SEQ ID NO: 1691133 - RNA, 18 nt, Homo sapiens
augcaccuugugucugua

SEQ ID NO: 1691134 - RNA, 18 nt, Homo sapiens
augcagugauauggcaga

SEQ ID NO: 1691135 - RNA, 18 nt, Homo sapiens
augcagugguaugaucac

SEQ ID NO: 1691136 - RNA, 15 nt, Homo sapiens
augcauugcuaaaau

SEQ ID NO: 1691137 - RNA, 20 nt, Homo sapiens
augccaaggccguggggcuc

SEQ ID NO: 1691138 - RNA, 14 nt, Homo sapiens
augccacccuagcc

SEQ ID NO: 1691139 - RNA, 16 nt, Homo sapiens
augccccggccaccuc

SEQ ID NO: 1691140 - RNA, 22 nt, Homo sapiens
augccgauauacucuagaugaa

SEQ ID NO: 1691141 - RNA, 18 nt, Homo sapiens
augccuugugcuguuaau

SEQ ID NO: 1691142 - RNA, 13 nt, Homo sapiens
augcgaaaguuug

SEQ ID NO: 1691143 - RNA, 20 nt, Homo sapiens
augcgucccaagauguugau

SEQ ID NO: 1691144 - RNA, 14 nt, Homo sapiens
augcucagggucaa

SEQ ID NO: 1691145 - RNA, 16 nt, Homo sapiens
augcugacuucacuua

SEQ ID NO: 1691146 - RNA, 14 nt, Homo sapiens
augcugauaugauc

SEQ ID NO: 1691147 - RNA, 15 nt, Homo sapiens
augcugcacagaaau

SEQ ID NO: 1691148 - RNA, 13 nt, Homo sapiens
augcugccuggug

SEQ ID NO: 1691149 - RNA, 16 nt, Homo sapiens
augcugccuggugggg

SEQ ID NO: 1691150 - RNA, 10 nt, Homo sapiens
augcugcuau

SEQ ID NO: 1691151 - RNA, 15 nt, Homo sapiens
augcuggcauuugca

SEQ ID NO: 1691152 - RNA, 16 nt, Homo sapiens
augcuggcuguuggcu

SEQ ID NO: 1691153 - RNA, 18 nt, Homo sapiens
augcugggaaugagacau

SEQ ID NO: 1691154 - RNA, 20 nt, Homo sapiens
augcugucaagcaccugcau

SEQ ID NO: 1691155 - RNA, 23 nt, Homo sapiens
augcuguucucuucuucauucua

SEQ ID NO: 1691156 - RNA, 15 nt, Homo sapiens
augcuucagauauua

SEQ ID NO: 1691157 - RNA, 20 nt, Homo sapiens
augcuuccagcuaacagguc

SEQ ID NO: 1691158 - RNA, 22 nt, Homo sapiens
auggaaaaucagcugcucagca

SEQ ID NO: 1691159 - RNA, 20 nt, Homo sapiens
auggaacacacuuggaugca

SEQ ID NO: 1691160 - RNA, 16 nt, Homo sapiens
auggaacucucuccac

SEQ ID NO: 1691161 - RNA, 15 nt, Homo sapiens
auggaaucaauucaa

SEQ ID NO: 1691162 - RNA, 16 nt, Homo sapiens
auggacagacagccac

SEQ ID NO: 1691163 - RNA, 17 nt, Homo sapiens
auggagcagccuggaga

SEQ ID NO: 1691164 - RNA, 18 nt, Homo sapiens
auggagggaaugcucaga

SEQ ID NO: 1691165 - RNA, 19 nt, Homo sapiens
auggaggucauacaugcau

SEQ ID NO: 1691166 - RNA, 15 nt, Homo sapiens
auggauauuauuaga

SEQ ID NO: 1691167 - RNA, 20 nt, Homo sapiens
auggauugggggggccaaaa

SEQ ID NO: 1691168 - RNA, 23 nt, Homo sapiens
auggcaaaaccccaucuuuacua

SEQ ID NO: 1691169 - RNA, 15 nt, Homo sapiens
auggcagaaccaaag

SEQ ID NO: 1691170 - RNA, 14 nt, Homo sapiens
auggcauugaacug

SEQ ID NO: 1691171 - RNA, 13 nt, Homo sapiens
auggccacuguga

SEQ ID NO: 1691172 - RNA, 14 nt, Homo sapiens
augggagcagucca

SEQ ID NO: 1691173 - RNA, 14 nt, Homo sapiens
augggagcuccucu

SEQ ID NO: 1691174 - RNA, 14 nt, Homo sapiens
augggcucuuccaa

SEQ ID NO: 1691175 - RNA, 20 nt, Homo sapiens
augggcucuuccaacaagga

SEQ ID NO: 1691176 - RNA, 16 nt, Homo sapiens
auggggacacagauca

SEQ ID NO: 1691177 - RNA, 15 nt, Homo sapiens
auggggggugggggg

SEQ ID NO: 1691178 - RNA, 18 nt, Homo sapiens
auggggugggguagggcu

SEQ ID NO: 1691179 - RNA, 18 nt, Homo sapiens
augggucccccucagcaa

SEQ ID NO: 1691180 - RNA, 23 nt, Homo sapiens
augguacucuuguugaguucugu

SEQ ID NO: 1691181 - RNA, 20 nt, Homo sapiens
augguauggaacucucucca

SEQ ID NO: 1691182 - RNA, 16 nt, Homo sapiens
augguuacucuuguca

SEQ ID NO: 1691183 - RNA, 20 nt, Homo sapiens
augguuauuuagcuggccau

SEQ ID NO: 1691184 - RNA, 16 nt, Homo sapiens
auguaaaauguugaau

SEQ ID NO: 1691185 - RNA, 13 nt, Homo sapiens
auguaaacuacuu

SEQ ID NO: 1691186 - RNA, 14 nt, Homo sapiens
auguaaacugccau

SEQ ID NO: 1691187 - RNA, 22 nt, Homo sapiens
auguaagauuauagauucuaaa

SEQ ID NO: 1691188 - RNA, 14 nt, Homo sapiens
auguacaacugcac

SEQ ID NO: 1691189 - RNA, 18 nt, Homo sapiens
auguacccacuuagucau

SEQ ID NO: 1691190 - RNA, 22 nt, Homo sapiens
auguaccuccccugccuugcug

SEQ ID NO: 1691191 - RNA, 21 nt, Homo sapiens
auguacuguacuaauucuuac

SEQ ID NO: 1691192 - RNA, 15 nt, Homo sapiens
auguagcacauaaac

SEQ ID NO: 1691193 - RNA, 16 nt, Homo sapiens
auguauaaaugugaua

SEQ ID NO: 1691194 - RNA, 20 nt, Homo sapiens
auguaucacgggucacuuga

SEQ ID NO: 1691195 - RNA, 13 nt, Homo sapiens
auguauccaacaa

SEQ ID NO: 1691196 - RNA, 23 nt, Homo sapiens
auguaucugaguugccaagacaa

SEQ ID NO: 1691197 - RNA, 20 nt, Homo sapiens
auguauuuguuugcaauuuu

SEQ ID NO: 1691198 - RNA, 23 nt, Homo sapiens
caagagauuguuguuugccauac

SEQ ID NO: 1691199 - RNA, 15 nt, Homo sapiens
caagagugauugcag

SEQ ID NO: 1691200 - RNA, 18 nt, Homo sapiens
caagagugauugcagcuu

SEQ ID NO: 1691201 - RNA, 21 nt, Homo sapiens
caagaguuuauuuccaaauaa

SEQ ID NO: 1691202 - RNA, 15 nt, Homo sapiens
caagaguuuucuucc

SEQ ID NO: 1691203 - RNA, 17 nt, Homo sapiens
caagauacgcucgccac

SEQ ID NO: 1691204 - RNA, 23 nt, Homo sapiens
caagauguugauuuuuacugugu

SEQ ID NO: 1691205 - RNA, 21 nt, Homo sapiens
caagauugcgccguuguacuc

SEQ ID NO: 1691206 - RNA, 13 nt, Homo sapiens
caagcaacacaga

SEQ ID NO: 1691207 - RNA, 12 nt, Homo sapiens
caagcaccugca

SEQ ID NO: 1691208 - RNA, 19 nt, Homo sapiens
caagcaccugcaugugcug

SEQ ID NO: 1691209 - RNA, 17 nt, Homo sapiens
caagcagagcaaucagu

SEQ ID NO: 1691210 - RNA, 18 nt, Homo sapiens
caagcaggugaacuggga

SEQ ID NO: 1691211 - RNA, 18 nt, Homo sapiens
caagccacaagucuucca

SEQ ID NO: 1691212 - RNA, 15 nt, Homo sapiens
caagccugugcaaug

SEQ ID NO: 1691213 - RNA, 14 nt, Homo sapiens
caagcgacgacaga

SEQ ID NO: 1691214 - RNA, 12 nt, Homo sapiens
caagcuauucaa

SEQ ID NO: 1691215 - RNA, 18 nt, Homo sapiens
caagcucucuugccgagg

SEQ ID NO: 1691216 - RNA, 11 nt, Homo sapiens
caagcucugcu

SEQ ID NO: 1691217 - RNA, 20 nt, Homo sapiens
caagcugugacuucuccagg

SEQ ID NO: 1691218 - RNA, 22 nt, Homo sapiens
caagcuuguuaucagcuuucag

SEQ ID NO: 1691219 - RNA, 20 nt, Homo sapiens
caagcuuuguauauaaauga

SEQ ID NO: 1691220 - RNA, 18 nt, Homo sapiens
caaggaguacuccaagac

SEQ ID NO: 1691221 - RNA, 21 nt, Homo sapiens
caaggaugcugucaagcaccu

SEQ ID NO: 1691222 - RNA, 24 nt, Homo sapiens
caaggcccugagcuuuguccugaa

SEQ ID NO: 1691223 - RNA, 19 nt, Homo sapiens
caaggcugcagugagccau

SEQ ID NO: 1691224 - RNA, 18 nt, Homo sapiens
caaguauccaaccaacuu

SEQ ID NO: 1691225 - RNA, 21 nt, Homo sapiens
caagucaggcccuuauuuuca

SEQ ID NO: 1691226 - RNA, 17 nt, Homo sapiens
caagugcgugccgugug

SEQ ID NO: 1691227 - RNA, 12 nt, Homo sapiens
caagugugaaca

SEQ ID NO: 1691228 - RNA, 21 nt, Homo sapiens
caagugugggccacuguggug

SEQ ID NO: 1691229 - RNA, 22 nt, Homo sapiens
caaguuccaugggauacaaccu

SEQ ID NO: 1691230 - RNA, 21 nt, Homo sapiens
caaguuuuucugucaagaaga

SEQ ID NO: 1691231 - RNA, 17 nt, Homo sapiens
caauaaaccuccgccaa

SEQ ID NO: 1691232 - RNA, 16 nt, Homo sapiens
caauaaaguuugccca

SEQ ID NO: 1691233 - RNA, 15 nt, Homo sapiens
caauaacacugucuc

SEQ ID NO: 1691234 - RNA, 14 nt, Homo sapiens
caauaguuugcaua

SEQ ID NO: 1691235 - RNA, 23 nt, Homo sapiens
caauaucuaauauauaugaauaa

SEQ ID NO: 1691236 - RNA, 18 nt, Homo sapiens
caauaugaugacucccuu

SEQ ID NO: 1691237 - RNA, 19 nt, Homo sapiens
caaucaguauguauucuuu

SEQ ID NO: 1691238 - RNA, 17 nt, Homo sapiens
caaucauaauaccugcu

SEQ ID NO: 1691239 - RNA, 12 nt, Homo sapiens
caaucccaaaag

SEQ ID NO: 1691240 - RNA, 18 nt, Homo sapiens
caauccgaaguaugaggg

SEQ ID NO: 1691241 - RNA, 16 nt, Homo sapiens
caauccuggcucugug

SEQ ID NO: 1691242 - RNA, 18 nt, Homo sapiens
caaucuccccuugcacua

SEQ ID NO: 1691243 - RNA, 18 nt, Homo sapiens
caaugaagugacacuuug

SEQ ID NO: 1691244 - RNA, 22 nt, Homo sapiens
caaugacugugcuacugucuuu

SEQ ID NO: 1691245 - RNA, 16 nt, Homo sapiens
caaugauggcaauuuu

SEQ ID NO: 1691246 - RNA, 21 nt, Homo sapiens
caaugauuauuuucauuacaa

SEQ ID NO: 1691247 - RNA, 19 nt, Homo sapiens
caaugcacauccauuccca

SEQ ID NO: 1691248 - RNA, 20 nt, Homo sapiens
caaugcaccuagcugugcaa

SEQ ID NO: 1691249 - RNA, 22 nt, Homo sapiens
caaugcaccuagcugugcaaga

SEQ ID NO: 1691250 - RNA, 16 nt, Homo sapiens
caauggaaacaaucuu

SEQ ID NO: 1691251 - RNA, 22 nt, Homo sapiens
caauggcacuguugcaaacuca

SEQ ID NO: 1691252 - RNA, 21 nt, Homo sapiens
caauguuuaugcaaggaagga

SEQ ID NO: 1691253 - RNA, 21 nt, Homo sapiens
caauuagcaauugacugucac

SEQ ID NO: 1691254 - RNA, 23 nt, Homo sapiens
caauuaggauuuugaugugacaa

SEQ ID NO: 1691255 - RNA, 15 nt, Homo sapiens
caauuaucuguguca

SEQ ID NO: 1691256 - RNA, 16 nt, Homo sapiens
caauuauugauauaua

SEQ ID NO: 1691257 - RNA, 15 nt, Homo sapiens
caauucccauugcau

SEQ ID NO: 1691258 - RNA, 14 nt, Homo sapiens
caauuccuucuuca

SEQ ID NO: 1691259 - RNA, 20 nt, Homo sapiens
caauucucaaaagaaaaggc

SEQ ID NO: 1691260 - RNA, 20 nt, Homo sapiens
caauugacugucacuguucc

SEQ ID NO: 1691261 - RNA, 15 nt, Homo sapiens
caauugugcugccau

SEQ ID NO: 1691262 - RNA, 22 nt, Homo sapiens
caauuugagauucuacaguaag

SEQ ID NO: 1691263 - RNA, 19 nt, Homo sapiens
cacaaaccacaacugacac

SEQ ID NO: 1691264 - RNA, 20 nt, Homo sapiens
cacaaaccacaacugacaca

SEQ ID NO: 1691265 - RNA, 13 nt, Homo sapiens
cacaaacccaagg

SEQ ID NO: 1691266 - RNA, 18 nt, Homo sapiens
cacaaagcccuuccaugu

SEQ ID NO: 1691267 - RNA, 13 nt, Homo sapiens
cacaaaugcauga

SEQ ID NO: 1691268 - RNA, 15 nt, Homo sapiens
cacaacacacacacu

SEQ ID NO: 1691269 - RNA, 15 nt, Homo sapiens
cacaaccugcaucuu

SEQ ID NO: 1691270 - RNA, 21 nt, Homo sapiens
cacaacuccuacaugauguua

SEQ ID NO: 1691271 - RNA, 13 nt, Homo sapiens
cacaacugacaca

SEQ ID NO: 1691272 - RNA, 22 nt, Homo sapiens
cacaagccacaagucuuccaga

SEQ ID NO: 1691273 - RNA, 14 nt, Homo sapiens
cacaaguuacacug

SEQ ID NO: 1691274 - RNA, 18 nt, Homo sapiens
cacaaguuacacugccau

SEQ ID NO: 1691275 - RNA, 20 nt, Homo sapiens
cacaauaugggcacuuuaaa

SEQ ID NO: 1691276 - RNA, 15 nt, Homo sapiens
cacaaugaugaugau

SEQ ID NO: 1691277 - RNA, 10 nt, Homo sapiens
cacacacaaa

SEQ ID NO: 1691278 - RNA, 14 nt, Homo sapiens
cacacacacaugcu

SEQ ID NO: 1691279 - RNA, 13 nt, Homo sapiens
cacacacauacac

SEQ ID NO: 1691280 - RNA, 13 nt, Homo sapiens
cacacacauccac

SEQ ID NO: 1691281 - RNA, 11 nt, Homo sapiens
cacacaccagu

SEQ ID NO: 1691282 - RNA, 21 nt, Homo sapiens
cacacacgcuuucuuaugcaa

SEQ ID NO: 1691283 - RNA, 20 nt, Homo sapiens
cacacaguauuacuucugcu

SEQ ID NO: 1691284 - RNA, 22 nt, Homo sapiens
cacacauccccuuuguguagaa

SEQ ID NO: 1691285 - RNA, 12 nt, Homo sapiens
cacacaucucau

SEQ ID NO: 1691286 - RNA, 12 nt, Homo sapiens
cacacaugcuag

SEQ ID NO: 1691287 - RNA, 18 nt, Homo sapiens
cacacauuauuaccccac

SEQ ID NO: 1691288 - RNA, 13 nt, Homo sapiens
cacaccagucaca

SEQ ID NO: 1691289 - RNA, 20 nt, Homo sapiens
cacacccuggaggauuucau

SEQ ID NO: 1691290 - RNA, 22 nt, Homo sapiens
cacacgcuuucuuaugcaaucu

SEQ ID NO: 1691291 - RNA, 13 nt, Homo sapiens
cacacggaucuga

SEQ ID NO: 1691292 - RNA, 16 nt, Homo sapiens
cacacguuugugagcu

SEQ ID NO: 1691293 - RNA, 13 nt, Homo sapiens
cacacucaaggga

SEQ ID NO: 1691294 - RNA, 22 nt, Homo sapiens
cacagacacacacacgcacgca

SEQ ID NO: 1691295 - RNA, 20 nt, Homo sapiens
cacagagaagcggauuucca

SEQ ID NO: 1691296 - RNA, 16 nt, Homo sapiens
cacagaguagaaacuc

SEQ ID NO: 1691297 - RNA, 13 nt, Homo sapiens
cacagcagcauuu

SEQ ID NO: 1691298 - RNA, 14 nt, Homo sapiens
cacagcagcauuuu

SEQ ID NO: 1691299 - RNA, 21 nt, Homo sapiens
cacagcagccccugcacaaag

SEQ ID NO: 1691300 - RNA, 20 nt, Homo sapiens
cacagccuccucugucugcc

SEQ ID NO: 1691301 - RNA, 17 nt, Homo sapiens
cacagcggagucugucc

SEQ ID NO: 1691302 - RNA, 16 nt, Homo sapiens
cacagcucaggaacua

SEQ ID NO: 1691303 - RNA, 17 nt, Homo sapiens
cacagcucccugccaaa

SEQ ID NO: 1691304 - RNA, 17 nt, Homo sapiens
cacagcucuguguugcc

SEQ ID NO: 1691305 - RNA, 23 nt, Homo sapiens
cacagcugagagacuuuuaauca

SEQ ID NO: 1691306 - RNA, 18 nt, Homo sapiens
cacaggcagguccagggu

SEQ ID NO: 1691307 - RNA, 21 nt, Homo sapiens
cacagggguucccuucucuca

SEQ ID NO: 1691308 - RNA, 15 nt, Homo sapiens
caguugacaaaaagc

SEQ ID NO: 1691309 - RNA, 19 nt, Homo sapiens
caguuguuuguuuuugcuu

SEQ ID NO: 1691310 - RNA, 21 nt, Homo sapiens
caguuguuuguuuuugcuugu

SEQ ID NO: 1691311 - RNA, 19 nt, Homo sapiens
caguuuuauaaaaagugga

SEQ ID NO: 1691312 - RNA, 19 nt, Homo sapiens
cauaaagaagcaagaaugg

SEQ ID NO: 1691313 - RNA, 17 nt, Homo sapiens
cauaaagccauguuucc

SEQ ID NO: 1691314 - RNA, 17 nt, Homo sapiens
cauaaaugaagcagcuu

SEQ ID NO: 1691315 - RNA, 17 nt, Homo sapiens
cauaaaugaaucaucaa

SEQ ID NO: 1691316 - RNA, 12 nt, Homo sapiens
cauaacugccuu

SEQ ID NO: 1691317 - RNA, 19 nt, Homo sapiens
cauaacuuauugcugauuu

SEQ ID NO: 1691318 - RNA, 18 nt, Homo sapiens
cauaagcaauaccagcaa

SEQ ID NO: 1691319 - RNA, 22 nt, Homo sapiens
cauaaguauacaguucaauaaa

SEQ ID NO: 1691320 - RNA, 16 nt, Homo sapiens
cauaauccuuucugcc

SEQ ID NO: 1691321 - RNA, 18 nt, Homo sapiens
cauacaaagagguguaca

SEQ ID NO: 1691322 - RNA, 22 nt, Homo sapiens
cauacacacacacgcgugcaca

SEQ ID NO: 1691323 - RNA, 15 nt, Homo sapiens
cauacauuaauuaau

SEQ ID NO: 1691324 - RNA, 15 nt, Homo sapiens
cauacauuuaugcac

SEQ ID NO: 1691325 - RNA, 14 nt, Homo sapiens
cauaccucugacca

SEQ ID NO: 1691326 - RNA, 18 nt, Homo sapiens
cauaccucugaccaacag

SEQ ID NO: 1691327 - RNA, 14 nt, Homo sapiens
cauacuuccaucug

SEQ ID NO: 1691328 - RNA, 16 nt, Homo sapiens
cauagaaacaugacac

SEQ ID NO: 1691329 - RNA, 20 nt, Homo sapiens
cauagagauagcuacagugu

SEQ ID NO: 1691330 - RNA, 11 nt, Homo sapiens
cauagcauuau

SEQ ID NO: 1691331 - RNA, 19 nt, Homo sapiens
cauagccugcagccucauc

SEQ ID NO: 1691332 - RNA, 14 nt, Homo sapiens
cauaggccaugaaa

SEQ ID NO: 1691333 - RNA, 17 nt, Homo sapiens
cauaguaguaugaugau

SEQ ID NO: 1691334 - RNA, 13 nt, Homo sapiens
cauaguccaaaaa

SEQ ID NO: 1691335 - RNA, 14 nt, Homo sapiens
cauaguccaaaaag

SEQ ID NO: 1691336 - RNA, 21 nt, Homo sapiens
cauauaacuaagacauaugca

SEQ ID NO: 1691337 - RNA, 16 nt, Homo sapiens
cauauaccaucuccag

SEQ ID NO: 1691338 - RNA, 15 nt, Homo sapiens
cauauaccuauaaug

SEQ ID NO: 1691339 - RNA, 23 nt, Homo sapiens
cauauacugccauguacuaguuu

SEQ ID NO: 1691340 - RNA, 15 nt, Homo sapiens
cauauauacccacau

SEQ ID NO: 1691341 - RNA, 13 nt, Homo sapiens
cauaucaaaaagu

SEQ ID NO: 1691342 - RNA, 16 nt, Homo sapiens
cauaucggcucacaaa

SEQ ID NO: 1691343 - RNA, 20 nt, Homo sapiens
cauaucuuaaagaaacagcu

SEQ ID NO: 1691344 - RNA, 11 nt, Homo sapiens
cauaugcauuu

SEQ ID NO: 1691345 - RNA, 15 nt, Homo sapiens
cauauggacucugca

SEQ ID NO: 1691346 - RNA, 16 nt, Homo sapiens
cauauggacucugcac

SEQ ID NO: 1691347 - RNA, 20 nt, Homo sapiens
cauauggacucugcacauga

SEQ ID NO: 1691348 - RNA, 19 nt, Homo sapiens
cauauguagacuauauaca

SEQ ID NO: 1691349 - RNA, 18 nt, Homo sapiens
cauaugugaucugucuug

SEQ ID NO: 1691350 - RNA, 20 nt, Homo sapiens
cauaugugaucugucuugua

SEQ ID NO: 1691351 - RNA, 20 nt, Homo sapiens
cauauuccucucaguccuuc

SEQ ID NO: 1691352 - RNA, 16 nt, Homo sapiens
cauauucuuuucugca

SEQ ID NO: 1691353 - RNA, 21 nt, Homo sapiens
caucaaagcucacaccaaauu

SEQ ID NO: 1691354 - RNA, 12 nt, Homo sapiens
caucaacuacua

SEQ ID NO: 1691355 - RNA, 14 nt, Homo sapiens
caucaauaucacaa

SEQ ID NO: 1691356 - RNA, 20 nt, Homo sapiens
caucacccucuuccugugau

SEQ ID NO: 1691357 - RNA, 12 nt, Homo sapiens
caucagcaaaca

SEQ ID NO: 1691358 - RNA, 13 nt, Homo sapiens
caucaggacucug

SEQ ID NO: 1691359 - RNA, 23 nt, Homo sapiens
caucaucccuuaauuaaauauca

SEQ ID NO: 1691360 - RNA, 13 nt, Homo sapiens
caucaucuauggc

SEQ ID NO: 1691361 - RNA, 12 nt, Homo sapiens
caucaugcaugu

SEQ ID NO: 1691362 - RNA, 20 nt, Homo sapiens
caucauuacccuucccugca

SEQ ID NO: 1691363 - RNA, 19 nt, Homo sapiens
caucauugugcuagcugau

SEQ ID NO: 1691364 - RNA, 19 nt, Homo sapiens
cauccaaucuauuauuucu

SEQ ID NO: 1691365 - RNA, 22 nt, Homo sapiens
cauccacaggguuuugacacuu

SEQ ID NO: 1691366 - RNA, 14 nt, Homo sapiens
cauccacugugcca

SEQ ID NO: 1691367 - RNA, 14 nt, Homo sapiens
cauccagugacaaa

SEQ ID NO: 1691368 - RNA, 17 nt, Homo sapiens
cauccagugacaaacca

SEQ ID NO: 1691369 - RNA, 18 nt, Homo sapiens
caucccacgcuugcuuua

SEQ ID NO: 1691370 - RNA, 22 nt, Homo sapiens
cauccccaacugcgacugugac

SEQ ID NO: 1691371 - RNA, 19 nt, Homo sapiens
cauccgguuugccauguug

SEQ ID NO: 1691372 - RNA, 20 nt, Homo sapiens
cauccuaccccuuugcacuu

SEQ ID NO: 1691373 - RNA, 16 nt, Homo sapiens
cauccucaugcugcuc

SEQ ID NO: 1691374 - RNA, 12 nt, Homo sapiens
cauccuggguaa

SEQ ID NO: 1691375 - RNA, 15 nt, Homo sapiens
caucgcgaugucgca

SEQ ID NO: 1691376 - RNA, 22 nt, Homo sapiens
caucuauaaagaagaacuugca

SEQ ID NO: 1691377 - RNA, 21 nt, Homo sapiens
caucuauuuuggauuguauau

SEQ ID NO: 1691378 - RNA, 22 nt, Homo sapiens
caucucccacccuguaccucau

SEQ ID NO: 1691379 - RNA, 15 nt, Homo sapiens
caucucggagcaucc

SEQ ID NO: 1691380 - RNA, 22 nt, Homo sapiens
caucuggguuuguuuacagcaa

SEQ ID NO: 1691381 - RNA, 23 nt, Homo sapiens
caucuugcucugcugacagacac

SEQ ID NO: 1691382 - RNA, 18 nt, Homo sapiens
caugaaaaaaaugauccc

SEQ ID NO: 1691383 - RNA, 21 nt, Homo sapiens
caugaagcccaagugaaauca

SEQ ID NO: 1691384 - RNA, 16 nt, Homo sapiens
caugaagcgaaacaca

SEQ ID NO: 1691385 - RNA, 20 nt, Homo sapiens
caugaaggagcagcauugac

SEQ ID NO: 1691386 - RNA, 23 nt, Homo sapiens
caugaaucccacccacaugugac

SEQ ID NO: 1691387 - RNA, 18 nt, Homo sapiens
caugaauucuuaugcuua

SEQ ID NO: 1691388 - RNA, 13 nt, Homo sapiens
caugacauaugac

SEQ ID NO: 1691389 - RNA, 16 nt, Homo sapiens
caugauaaaugauaga

SEQ ID NO: 1691390 - RNA, 13 nt, Homo sapiens
caugaugcugccc

SEQ ID NO: 1691391 - RNA, 16 nt, Homo sapiens
caugauuuccuugaau

SEQ ID NO: 1691392 - RNA, 16 nt, Homo sapiens
caugcaaggcacugua

SEQ ID NO: 1691393 - RNA, 11 nt, Homo sapiens
caugcacacac

SEQ ID NO: 1691394 - RNA, 13 nt, Homo sapiens
caugcacugaccc

SEQ ID NO: 1691395 - RNA, 22 nt, Homo sapiens
caugccugccccccucaucuca

SEQ ID NO: 1691396 - RNA, 20 nt, Homo sapiens
caugccuugugcuguuaaua

SEQ ID NO: 1691397 - RNA, 21 nt, Homo sapiens
caugcgauguguccaaucgga

SEQ ID NO: 1691398 - RNA, 18 nt, Homo sapiens
cauggacuacaccagggu

SEQ ID NO: 1691399 - RNA, 14 nt, Homo sapiens
cauggacuuuauaa

SEQ ID NO: 1691400 - RNA, 18 nt, Homo sapiens
cauggauguuaaauuaua

SEQ ID NO: 1691401 - RNA, 21 nt, Homo sapiens
caugggcaccaaccugcauuu

SEQ ID NO: 1691402 - RNA, 21 nt, Homo sapiens
cauggggaaaaaaaucaucua

SEQ ID NO: 1691403 - RNA, 16 nt, Homo sapiens
caugguacuaguguuu

SEQ ID NO: 1691404 - RNA, 13 nt, Homo sapiens
cauggugccccua

SEQ ID NO: 1691405 - RNA, 19 nt, Homo sapiens
cauggugccccuagcuuua

SEQ ID NO: 1691406 - RNA, 20 nt, Homo sapiens
caugguuacaaacuacagac

SEQ ID NO: 1691407 - RNA, 21 nt, Homo sapiens
cauguagcccccuggccucug

SEQ ID NO: 1691408 - RNA, 18 nt, Homo sapiens
caugucuuguacaugugu

SEQ ID NO: 1691409 - RNA, 15 nt, Homo sapiens
caugugcugccugca

SEQ ID NO: 1691410 - RNA, 19 nt, Homo sapiens
cauguggcuaaaugccuaa

SEQ ID NO: 1691411 - RNA, 16 nt, Homo sapiens
cauguggcuuuuuuaa

SEQ ID NO: 1691412 - RNA, 16 nt, Homo sapiens
cauguguguauauaug

SEQ ID NO: 1691413 - RNA, 16 nt, Homo sapiens
cauguguuugcauaaa

SEQ ID NO: 1691414 - RNA, 19 nt, Homo sapiens
cauguguuuuaauuccaau

SEQ ID NO: 1691415 - RNA, 20 nt, Homo sapiens
cauguuauauuuaaugcauu

SEQ ID NO: 1691416 - RNA, 22 nt, Homo sapiens
cauguuucaagaaaauggauuu
